United States Patent 7,709,616 (MICRORNAS AND USES THEREOF) - sequence listing, part 15

SEQ ID NO: 438579 - RNA, 64 nt, hsa; identical to SEQ ID NO: 438482

SEQ ID NO: 438580 - RNA, 64 nt, hsa; identical to SEQ ID NO: 438483

SEQ ID NO: 438581 - RNA, 64 nt, hsa; identical to SEQ ID NO: 438484

SEQ ID NO: 438582 - RNA, 64 nt, hsa; identical to SEQ ID NO: 438485

SEQ ID NO: 438583 - RNA, 64 nt, hsa; identical to SEQ ID NO: 438486

SEQ ID NO: 438584 - RNA, 64 nt, hsa; identical to SEQ ID NO: 438487

SEQ ID NO: 438585 - RNA, 64 nt, hsa; identical to SEQ ID NO: 438488

SEQ ID NO: 438586 - RNA, 64 nt, hsa; identical to SEQ ID NO: 438489

SEQ ID NO: 438587 - RNA, 64 nt, hsa; identical to SEQ ID NO: 438490

SEQ ID NO: 438588 - RNA, 64 nt, hsa; identical to SEQ ID NO: 438491

SEQ ID NO: 438589 - RNA, 64 nt, hsa; identical to SEQ ID NO: 438492

SEQ ID NO: 438590 - RNA, 64 nt, hsa; identical to SEQ ID NO: 438493

SEQ ID NO: 438591 - RNA, 64 nt, hsa; identical to SEQ ID NO: 438494

SEQ ID NO: 438592 - RNA, 64 nt, hsa; identical to SEQ ID NO: 438495

SEQ ID NO: 438593 - RNA, 64 nt, hsa; identical to SEQ ID NO: 438496

SEQ ID NO: 438594 - RNA, 64 nt, hsa; identical to SEQ ID NO: 438497

SEQ ID NO: 438595 - RNA, 64 nt, hsa; identical to SEQ ID NO: 438498

SEQ ID NO: 438596 - RNA, 64 nt, hsa; identical to SEQ ID NO: 438499

SEQ ID NO: 438597 - RNA, 64 nt, hsa; identical to SEQ ID NO: 438500

SEQ ID NO: 438598 - RNA, 64 nt, hsa; identical to SEQ ID NO: 438501

SEQ ID NO: 438599 - RNA, 64 nt, hsa; identical to SEQ ID NO: 438502

SEQ ID NO: 438600 - RNA, 64 nt, hsa; identical to SEQ ID NO: 438503

SEQ ID NO: 438601 - RNA, 64 nt, hsa; identical to SEQ ID NO: 438504

SEQ ID NO: 438602 - RNA, 64 nt, hsa; identical to SEQ ID NO: 438505

SEQ ID NO: 438603 - RNA, 64 nt, hsa; identical to SEQ ID NO: 438506

SEQ ID NO: 438604 - RNA, 64 nt, hsa; identical to SEQ ID NO: 438507

SEQ ID NO: 438605 - RNA, 64 nt, hsa; identical to SEQ ID NO: 438508

SEQ ID NO: 438606 - RNA, 64 nt, hsa; identical to SEQ ID NO: 438509

SEQ ID NO: 438607 - RNA, 64 nt, hsa; identical to SEQ ID NO: 438510

SEQ ID NO: 438608 - RNA, 64 nt, hsa; identical to SEQ ID NO: 438511

SEQ ID NO: 438609 - RNA, 64 nt, hsa; identical to SEQ ID NO: 438512

SEQ ID NO: 438610 - RNA, 64 nt, hsa; identical to SEQ ID NO: 438513

SEQ ID NO: 438611 - RNA, 64 nt, hsa; identical to SEQ ID NO: 438514

SEQ ID NO: 438612 - RNA, 64 nt, hsa; identical to SEQ ID NO: 438515

SEQ ID NO: 438613 - RNA, 64 nt, hsa; identical to SEQ ID NO: 438516

SEQ ID NO: 438614 - RNA, 64 nt, hsa; identical to SEQ ID NO: 438517

SEQ ID NO: 438615 - RNA, 64 nt, hsa; identical to SEQ ID NO: 438518

SEQ ID NO: 438616 - RNA, 63 nt, hsa; identical to SEQ ID NO: 438519

SEQ ID NO: 438617 - RNA, 64 nt, hsa; identical to SEQ ID NO: 438520

SEQ ID NO: 438618 - RNA, 64 nt, hsa; identical to SEQ ID NO: 438521

SEQ ID NO: 438619 - RNA, 64 nt, hsa; identical to SEQ ID NO: 438522

SEQ ID NO: 438620 - RNA, 64 nt, hsa; identical to SEQ ID NO: 438523

SEQ ID NO: 438621 - RNA, 64 nt, hsa; identical to SEQ ID NO: 438524

SEQ ID NO: 438622 - RNA, 64 nt, hsa; identical to SEQ ID NO: 438525

SEQ ID NO: 438623 - RNA, 64 nt, hsa; identical to SEQ ID NO: 438526

SEQ ID NO: 438624 - RNA, 64 nt, hsa; identical to SEQ ID NO: 438527

SEQ ID NO: 438625 - RNA, 64 nt, hsa; identical to SEQ ID NO: 438528

SEQ ID NO: 438626 - RNA, 64 nt, hsa; identical to SEQ ID NO: 438529

SEQ ID NO: 438627 - RNA, 64 nt, hsa; identical to SEQ ID NO: 438530

SEQ ID NO: 438628 - RNA, 64 nt, hsa; identical to SEQ ID NO: 438531

SEQ ID NO: 438629 - RNA, 64 nt, hsa; identical to SEQ ID NO: 438532

SEQ ID NO: 438630 - RNA, 64 nt, hsa; identical to SEQ ID NO: 438533

SEQ ID NO: 438631 - RNA, 64 nt, hsa; identical to SEQ ID NO: 438534

SEQ ID NO: 438632 - RNA, 64 nt, hsa; identical to SEQ ID NO: 438535

SEQ ID NO: 438633 - RNA, 64 nt, hsa; identical to SEQ ID NO: 438536

SEQ ID NO: 438634 - RNA, 64 nt, hsa; identical to SEQ ID NO: 438537

SEQ ID NO: 438635 - RNA, 64 nt, hsa; identical to SEQ ID NO: 438538

SEQ ID NO: 438636 - RNA, 64 nt, hsa; identical to SEQ ID NO: 438539

SEQ ID NO: 438637 - RNA, 64 nt, hsa; identical to SEQ ID NO: 438540

SEQ ID NO: 438638 - RNA, 64 nt, hsa; identical to SEQ ID NO: 438541

SEQ ID NO: 438639 - RNA, 64 nt, hsa; identical to SEQ ID NO: 438542

SEQ ID NO: 438640 - RNA, 64 nt, hsa; identical to SEQ ID NO: 438543

SEQ ID NO: 438641 - RNA, 64 nt, hsa; identical to SEQ ID NO: 438544

SEQ ID NO: 438642 - RNA, 64 nt, hsa; identical to SEQ ID NO: 438545

SEQ ID NO: 438643 - RNA, 64 nt, hsa; identical to SEQ ID NO: 438546

SEQ ID NO: 438644 - RNA, 64 nt, hsa; identical to SEQ ID NO: 438547

SEQ ID NO: 438645 - RNA, 64 nt, hsa; identical to SEQ ID NO: 438548

SEQ ID NO: 438646 - RNA, 64 nt, hsa; identical to SEQ ID NO: 438549

SEQ ID NO: 438647 - RNA, 64 nt, hsa; identical to SEQ ID NO: 438550

SEQ ID NO: 438648 - RNA, 64 nt, hsa; identical to SEQ ID NO: 438551

SEQ ID NO: 438649 - RNA, 64 nt, hsa; identical to SEQ ID NO: 438552

SEQ ID NO: 438650 - RNA, 64 nt, hsa; identical to SEQ ID NO: 438553

SEQ ID NO: 438651 - RNA, 64 nt, hsa; identical to SEQ ID NO: 438554

SEQ ID NO: 438652 - RNA, 64 nt, hsa; identical to SEQ ID NO: 438555

SEQ ID NO: 438653 - RNA, 64 nt, hsa; identical to SEQ ID NO: 438556

SEQ ID NO: 438654 - RNA, 64 nt, hsa; identical to SEQ ID NO: 438557

SEQ ID NO: 438655 - RNA, 64 nt, hsa; identical to SEQ ID NO: 438558

SEQ ID NO: 438656 - RNA, 64 nt, hsa; identical to SEQ ID NO: 438559

SEQ ID NO: 438657 - RNA, 64 nt, hsa; identical to SEQ ID NO: 438560

SEQ ID NO: 438658 - RNA, 64 nt, hsa; identical to SEQ ID NO: 438561

SEQ ID NO: 438659 - RNA, 64 nt, hsa; identical to SEQ ID NO: 438562

SEQ ID NO: 438660 - RNA, 64 nt, hsa; identical to SEQ ID NO: 438563

SEQ ID NO: 438661 - RNA, 64 nt, hsa; identical to SEQ ID NO: 438564

SEQ ID NO: 438662 - RNA, 64 nt, hsa; identical to SEQ ID NO: 438565

SEQ ID NO: 438663 - RNA, 64 nt, hsa; identical to SEQ ID NO: 438566

SEQ ID NO: 438664 - RNA, 64 nt, hsa; identical to SEQ ID NO: 438567

SEQ ID NO: 438665 - RNA, 64 nt, hsa; identical to SEQ ID NO: 392709

SEQ ID NO: 438666 - RNA, 64 nt, hsa; identical to SEQ ID NO: 392710

SEQ ID NO: 438667 - RNA, 64 nt, hsa; identical to SEQ ID NO: 392711

SEQ ID NO: 438668 - RNA, 64 nt, hsa; identical to SEQ ID NO: 392712

SEQ ID NO: 438669 - RNA, 64 nt, hsa; identical to SEQ ID NO: 392713

SEQ ID NO: 438670 - RNA, 64 nt, hsa; identical to SEQ ID NO: 392714

SEQ ID NO: 438671 - RNA, 64 nt, hsa; identical to SEQ ID NO: 392715

SEQ ID NO: 438672 - RNA, 64 nt, hsa; identical to SEQ ID NO: 392716

SEQ ID NO: 438673 - RNA, 64 nt, hsa
uuauuuaaaaaaaaacauaacuuuguaaauauuacccuguaauauuauauauacuuaauaaaac

SEQ ID NO: 438674 - RNA, 64 nt, hsa
guaauuugccacgcuuuuugacugcucaccaauacccuguaaaaauacguaauucuuccuguuu

SEQ ID NO: 438675 - RNA, 64 nt, hsa
guuuuacuuuuuuaaagcugaguaguuaagaauucccuguaaaaacaaaacccuguaaauugag

SEQ ID NO: 438676 - RNA, 64 nt, hsa
gcugaguaguuaagaauucccuguaaaaacaaaacccuguaaauugagccucaugucugguaua

SEQ ID NO: 438677 - RNA, 64 nt, hsa
ccauuuuacuguguuugaguuaaaaaccaaacaucccuguaauuuaauuugaagauucuuuaac

SEQ ID NO: 438678 - RNA, 64 nt, hsa
uuuguagcucugcauauuuugcccaccuugucuucccuguaaguuuaagacguuuccaaggaaa

SEQ ID NO: 438679 - RNA, 64 nt, hsa
ucuaggcugccagcucacagcccccaccccagggcccuguaagcugugcagugugagggccugg

SEQ ID NO: 438680 - RNA, 64 nt, hsa
acaucaccacccauugucaggugcucucccucaccccuguaagccagacaguuuguucaaaacc

SEQ ID NO: 438681 - RNA, 64 nt, hsa
cuuuaugauuguugagcauuaauccucaaaaugacccuguaaaauaguuaauauuauccccauu

SEQ ID NO: 438682 - RNA, 64 nt, hsa
augccuacacgaucucauuucuuccuuaccacaucccuguaaguaaggugaaaugccagagacc

SEQ ID NO: 438683 - RNA, 62 nt, hsa
uuuguauaggaagugcuauuucucauaggcuguuucuugaaauuuuaaguuuauugcuuuaa

SEQ ID NO: 438684 - RNA, 62 nt, hsa
uguugaacagaauuggaguauuuucuuuauaauuucuugaacaggcaaaugaaagcuuauua

SEQ ID NO: 438685 - RNA, 62 nt, hsa
aauuaaaauauuaaauaacauauuuauggcauuuucuugaagagugugguugaagaaauauu

SEQ ID NO: 438686 - RNA, 62 nt, hsa
uuaggagcaaaucuccccagggguguacgguauuucuugacucugggaacagcugcuacccc

SEQ ID NO: 438687 - RNA, 62 nt, hsa
uagaauauucucuuauuauuuauauuuuuauauuucuugaaagaugguaaguuucuugaagu

SEQ ID NO: 438688 - RNA, 62 nt, hsa
uuauauuuuuauauuucuugaaagaugguaaguuucuugaaguuuuuggggcguuucucuuu

SEQ ID NO: 438689 - RNA, 62 nt, hsa
aucaacaaggugcauauaaaccauccuaugccuuucuugaaaugugcauuuuaagaaguuau

SEQ ID NO: 438690 - RNA, 62 nt, hsa
agauuuagaaagccuuaugcacucuuuguguuuuucuugaaacuugcuguaguaacuuuuug

SEQ ID NO: 438691 - RNA, 62 nt, hsa
gaccauuguuaaauuuaauuauaguguauuucuuucuugaauuucagucugcugcuuuguaa

SEQ ID NO: 438692 - RNA, 62 nt, hsa
uauuuauaaaaugacaaacuuggaccacaggcuuucuugaccuuguacaguauaguaaaaau

SEQ ID NO: 438693 - RNA, 62 nt, hsa
guaucaauauuuacuuuaaucacaaaggaugguuucuugaaauaauuuguauugauugaggc

SEQ ID NO: 438694 - RNA, 62 nt, hsa
uauaauuuuguaggaaaaauaugcaucuauuuuuucuugacuucuuuuauauaguaauaaaa

SEQ ID NO: 438695 - RNA, 62 nt, hsa
uagccugaguuugcuguuaauguuuaacacauuuucuugaguaacaguucuguuaauauugu

SEQ ID NO: 438696 - RNA, 62 nt, hsa
ucuagcuuuucaagugaugacuauauacugcuuuucuugacuguauauauuguuacugaauu

SEQ ID NO: 438697 - RNA, 62 nt, hsa
gugguaagagaauguuauagugaauuaucccuuuucuugacuauuggaggaccaaaaaaaua

SEQ ID NO: 438698 - RNA, 62 nt, hsa
agaaaucauguuaugauaaaaaauuuuguaauuuucuugaugacuggaauuuuuauuaugca

SEQ ID NO: 438699 - RNA, 62 nt, hsa
aaugcuguauucuucuuugguggagauaaagauuucuugaguuuuguuuuaaaauuaaagcu

SEQ ID NO: 438700 - RNA, 62 nt, hsa
cauuggcuauuuaaagacaaagacaaauucuguuucuugagaagagaauauuagcuuuacug

SEQ ID NO: 438701 - RNA, 62 nt, hsa
cucccugcacugcauucgcacaaacugcuuccuuucuugauucguagauuuaauaacuuacc

SEQ ID NO: 438702 - RNA, 62 nt, hsa
auucguagauuuaauaacuuaccugaagggguuuucuugauaauuuuccuuuaauaugaaau

SEQ ID NO: 438703 - RNA, 62 nt, hsa
guugaugucaauaacaguauaaaacagcccuauuucuugauaaaaaaugacaaaugacuguc

SEQ ID NO: 438704 - RNA, 62 nt, hsa
aaaguaauuuuaauucaccacauacuuaucaauuucuugaugcuuccaaaugacaucuacag

SEQ ID NO: 438705 - RNA, 62 nt, hsa
uagcaauacaaguacacauuucuguggcuugauuucuugaauaugcugagacccaauuugga

SEQ ID NO: 438706 - RNA, 62 nt, hsa
aaaaccugaauagccaugacaagaguuugcauuuucuugaugauucaucuccaugagugcac

SEQ ID NO: 438707 - RNA, 62 nt, hsa
gcaccucaaaugaacagacuugguuuccuugcuuucuugacauuuccaugacuguuucacau

SEQ ID NO: 438708 - RNA, 62 nt, hsa
aauuuauuuuaauauggauuucuuguuuuuguuuucuugagacggagucuuggucuugucac

SEQ ID NO: 438709 - RNA, 62 nt, hsa
auacaagagucuuuaagucauucuaaauauuuuuucuugaaaguuuuaacuaagugagaaau

SEQ ID NO: 438710 - RNA, 62 nt, hsa
gucuucagggaacugagcuaauacuuuuuuuuuuucuugauguuuucuugaaaagccuuucu

SEQ ID NO: 438711 - RNA, 62 nt, hsa
acugagcuaauacuuuuuuuuuuucuugauguuuucuugaaaagccuuucuguugcaacuau

SEQ ID NO: 438712 - RNA, 62 nt, hsa
uuaaaaugaaaauaauuacugcuauuuuaaaauuucuugaucauugaaugugagacccuucu

SEQ ID NO: 438713 - RNA, 62 nt, hsa
cuuuggaauuuugcauucgagguauacugucauuucuugaaaucuuuuucucguuuaguugc

SEQ ID NO: 438714 - RNA, 62 nt, hsa
uugcuaaauuaccaagcaaagcagacaaucuuuuucuugaaauuaccuccauucuuacuuug

SEQ ID NO: 438715 - RNA, 62 nt, hsa
cuuaguguccagauaugucacuauuacucauuuuucuugacaguucaaauggauuuuugugc

SEQ ID NO: 438716 - RNA, 62 nt, hsa
aaaacaugguuuuguuuuuuuuuuuuccuuuuuuucuugauuaggucuggaacagcucuaga

SEQ ID NO: 438717 - RNA, 62 nt, hsa
cugggcugccaggucagccucucuggcaaggcuuucuugagccccgccccuuucuuuccccg

SEQ ID NO: 438718 - RNA, 62 nt, hsa
uguuuauaguuuuuaaauaaaagacugaacauuuucuugaguccuucauuucugaguaugcu

SEQ ID NO: 438719 - RNA, 62 nt, hsa
uuggcuaaaagcuuuuauuguuugauguuguguuucuugacuguuuauucagaaucacagug

SEQ ID NO: 438720 - RNA, 62 nt, hsa
gugacuuagugcauugauucagauuuuuaaaauuucuugaugugguuuguaauaaucaaaua

SEQ ID NO: 438721 - RNA, 62 nt, hsa
ucagauuuuuauuuuuaaaauauuuucauuuuuuucuugaauuuuauauccguuuguucacu

SEQ ID NO: 438722 - RNA, 62 nt, hsa
aauagauacaagccuaggagccccagcccccuuuucuugaccauaucacaagugauugaagc

SEQ ID NO: 438723 - RNA, 62 nt, hsa
uuuguguaggaacauaacaaggguguacggcuuuucuugagcccauuuuaaacaacccuugu

SEQ ID NO: 438724 - RNA, 62 nt, hsa
gcuaauuauauacaucuguaguuauucuacauuuucuugaaauuugggagguuaauaccaag

SEQ ID NO: 438725 - RNA, 62 nt, hsa
cuaauuaauauacaucuguaguuauucuacauuuucuugaaauuugggagguuaauaccaag

SEQ ID NO: 438726 - RNA, 62 nt, hsa
uauucaggccuaaagacauugaaaaagcaucuuuucuugagaucauggucauaugagguccu

SEQ ID NO: 438727 - RNA, 62 nt, hsa
cggcaguacgguauuaugaaaccaagaaaggguuucuugaaaagcuugucgguucaaagagg

SEQ ID NO: 438728 - RNA, 62 nt, hsa
uuuuaacauuccacuuaugccuugaaacaucauuucuugauaacuuuuugauacuucuuucu

SEQ ID NO: 438729 - RNA, 62 nt, hsa
aacaucauuucuugauaacuuuuugauacuucuuucuugauaaggcacuuuuaccaggugug

SEQ ID NO: 438730 - RNA, 62 nt, hsa
cccacagcuuucugcccauuguuucuuacuaguuucuugaauuguucuuguggacuuuuccu

SEQ ID NO: 438731 - RNA, 62 nt, hsa
aguucaaaugagccaucuuuuuccuuugcguuuuucuugacugaaggugagauguuauuugu

SEQ ID NO: 438732 - RNA, 62 nt, hsa
aaacaugauaggauuaacauaauguugguggauuucuugaauagaauuugucuuaacauucc

SEQ ID NO: 438733 - RNA, 62 nt, hsa
aucuuaucuauuacuccaaaccucccuuuuuauuucuugagccuggcuuggaccuuggcauu

SEQ ID NO: 438734 - RNA, 62 nt, hsa
cccaggaagugaguuaaaaacaauaaaagcccuuucuugaguuaaaaagaaaaaaaaaaggu

SEQ ID NO: 438735 - RNA, 62 nt, hsa
caaguuaagagccaaucacugauccccaaguguuucuugagcaucuggucuggggggaccac

SEQ ID NO: 438736 - RNA, 62 nt, hsa
aauuggcaagaaagggagauuucaaaauuauauuucuugaugguaucuuuucaauuaaugua

SEQ ID NO: 438737 - RNA, 62 nt, hsa
gauauagucccuuauguauauagcuuuuuuucuuucuugagaauucaucuugaguuaucuuu

SEQ ID NO: 438738 - RNA, 62 nt, hsa
acugauaucugauguuuaugauauggugucuuuuucuugaaacaagcuuccaagggcuagaa

SEQ ID NO: 438739 - RNA, 62 nt, hsa
uuuuauaauugaaaaggccccucuauuuuauuuuucuugaaaacauucccuuuuuuaggaac

SEQ ID NO: 438740 - RNA, 62 nt, hsa
aggaauguuauauaggcuugucaguucccauuuuucuugacaacaauaaauaccacuuuuaa

SEQ ID NO: 438741 - RNA, 62 nt, hsa
ucuccugaccauguauuuuaaaauauagucuauuucuugacuuugaacuuaaagcuuuaauc

SEQ ID NO: 438742 - RNA, 64 nt, hsa
gguuuuaaaaauagacaguauuuuuuaaaaaucaaaaaaugacuugcaaauuguuuuuuaaaag

SEQ ID NO: 438743 - RNA, 64 nt, hsa
aguguucuauuuauuucuuguauuguuuggaagaaaaaaugaugauagagucccaaaaagaaga

SEQ ID NO: 438744 - RNA, 64 nt, hsa
gaaaucagaaaauauaauaaaauugcacaaaaaaaaaaaugaaaaagaugcagacuggucuuuu

SEQ ID NO: 438745 - RNA, 64 nt, hsa
uucugaaugcuuuauauucuuucugcuguaaauuaaaaaugaagaaaauuuccccauacuacgu

SEQ ID NO: 438746 - RNA, 64 nt, hsa
aaauguguauuaccaauguggguguaaauuuuuaaaaaaugauuauugauagaaguuuggcagg

SEQ ID NO: 438747 - RNA, 64 nt, hsa
ugauauuuggaaauaccuggauauuugcuagaggaaaaaugaaagcaaaacuucguacacagug

SEQ ID NO: 438748 - RNA, 64 nt, hsa
cuuaaucagaaaaggacuagauuuguuuaagaagaaaaaugaaaccagacccagaucaauauuu

SEQ ID NO: 438749 - RNA, 64 nt, hsa
gggaauuuugcugcucccuauugcuucuguuuacaaaaaugaauuuuuccugguuucccacuag

SEQ ID NO: 438750 - RNA, 64 nt, hsa
ccugaggaauugcgagauauugcugaggggaaaaaaaaaugaccuuuucuugaaauguaacuug

SEQ ID NO: 438751 - RNA, 64 nt, hsa
gcugccaugguggucaaauggcauguguuugcacaaaaaugaccgauguguuuaaccaaagcuu

SEQ ID NO: 438752 - RNA, 64 nt, hsa
ucaagaaccauacuucgacauuuccucugccacaaaaaaugaacgcauuuuaaguuaggaguca

SEQ ID NO: 438753 - RNA, 64 nt, hsa
aggcagaucugaaaaagaaccaaauagagcuccuaaaaaugagaaauauuuauugaaauaagaa

SEQ ID NO: 438754 - RNA, 64 nt, hsa
uaaggaauaucucuugauauagaauuuuuauauuaaaaaugauuuuucuuugcuuaaccuucug

SEQ ID NO: 438755 - RNA, 64 nt, hsa
auuuggaauucuucugguuuguucuuucauguuuaaaaaugauguuuuucaaugcauuuuuuuc

SEQ ID NO: 438756 - RNA, 64 nt, hsa
ccuucuuacacauaauggugucuuaaaauugacaaaaaaugagcacuuacaauuguaugucucc

SEQ ID NO: 438757 - RNA, 64 nt, hsa
gagcagcuuagauuucccuacuggcaagguuuuuaaaaaugagguaaaugccguauaugaucaa

SEQ ID NO: 438758 - RNA, 64 nt, hsa
aacuuaaaacuccaaacuagaguacguaacauugaaaaaugaggcauaaaaaugcaauaaacug

SEQ ID NO: 438759 - RNA, 64 nt, hsa
agagagggaggaagaaagggagagagaagaaaagaaaaaugaagaaaaguaauuagaauauuuu

SEQ ID NO: 438760 - RNA, 64 nt, hsa
aaaucaccuggcuucuauaacaaauaaaugggaaaaaaaugaaauaaaaagaagagagggagga

SEQ ID NO: 438761 - RNA, 64 nt, hsa
gaggaaaaaaaugacuaaaaauauuauaacuuaaaaaaaugacagauguugaaugcccacaggc

SEQ ID NO: 438762 - RNA, 64 nt, hsa
agaaugaauaauaauuauccagaguuuagaggaaaaaaaugacuaaaaauauuauaacuuaaaa

SEQ ID NO: 438763 - RNA, 64 nt, hsa
uaccugcuuuuuguuucauuuuguuuuguuuuguaaaaaugauaaaacuucagaaaauaaaaug

SEQ ID NO: 438764 - RNA, 64 nt, hsa
guuuacuuuguuggacaaaccaaaucaguucucaaaaaaugaccggugcuuauaaaaaguuaua

SEQ ID NO: 438765 - RNA, 64 nt, hsa
auuacauuauucauuauaauuuucuuuguguaauaaaaaugaaaucucaugagaaaauaaauuu

SEQ ID NO: 438766 - RNA, 64 nt, hsa
acacagaguaugggcacggcuaugcuaacuugacaaaaaugacugaugcaacaaucgaguuauu

SEQ ID NO: 438767 - RNA, 64 nt, hsa
caacauggcaaaaccccaucucuacuaaaaauacaaaaaugagcuaggcaugguggcacacgcc

SEQ ID NO: 438768 - RNA, 64 nt, hsa
aggcaaacauuucuuaaaauguuucauuuucauuaaaaaugaaagccaaauuuauaugccaccg

SEQ ID NO: 438769 - RNA, 64 nt, hsa
aguauauuucuuuuuaaagaaucuuuuuaagauuaaaaaugaauaccuuaaaucucccaaaaga

SEQ ID NO: 438770 - RNA, 64 nt, hsa
ccuuuauuguuucuagguguugauauacuuuaauaaaaaugauauguuuaauauuuucccauua

SEQ ID NO: 438771 - RNA, 64 nt, hsa
uucccuuaaauaauugacuauuuugcuguguuuuaaaaaugauugaaauuuaucuugccauauc

SEQ ID NO: 438772 - RNA, 64 nt, hsa
uauaguuuuguauaauagcauagauuuuccuucaaaaaaugaacauuuauauaucuacaaaaau

SEQ ID NO: 438773 - RNA, 64 nt, hsa
gaugaauaauuuaaagaaaaacaccuaaaauuugaaaaaugauuguaggaucaaaaaaggcaga

SEQ ID NO: 438774 - RNA, 64 nt, hsa
cuuuuguuaaaaauaaaguuaaaaguuaaaguuaaaaaaugaaguuaaaaguuucaucagaaac

SEQ ID NO: 438775 - RNA, 64 nt, hsa
cuguuuuggaaaugcacaguugacauguugaaauaaaaaugaauaccauuuuuaaauguuucuu

SEQ ID NO: 438776 - RNA, 64 nt, hsa
cagugucuucuuuauauauuuauuuuuuauuagaaaaaaugaaguuugguuggugaugcaugaa

SEQ ID NO: 438777 - RNA, 64 nt, hsa
accuuauccuuucucccauaaccuuuguacacuaaaaaaugaaagaauuuagaauguauuugau

SEQ ID NO: 438778 - RNA, 64 nt, hsa
uuaaaauuauuuuuaacaugugcuuuuccaaauuaaaaaugaaguagaguauaccaaaugcaua

SEQ ID NO: 438779 - RNA, 64 nt, hsa
gugcugcuuagaaugaccaaauauaguuauuguaaaaaaugauauuuaugaacuuuuuauuuua

SEQ ID NO: 438780 - RNA, 64 nt, hsa
aaauguuugacaaaaaugaauaugcuuuuccuuaaaaaaugaaaacuuuaauuuuuaccaucca

SEQ ID NO: 438781 - RNA, 64 nt, hsa
agcuuuuuaacccggauuacuguaaauguuugacaaaaaugaauaugcuuuuccuuaaaaaaug

SEQ ID NO: 438782 - RNA, 64 nt, hsa
agcaaaaucucaucucuacaaaaaguaaaaauuaaaaaaugaaauuaaaaauaaaauuaccuag

SEQ ID NO: 438783 - RNA, 64 nt, hsa
guuuguaaaaccaucagauauuucuuauggcacaaaaaaugaggaauagcaaaauuccuguguu

SEQ ID NO: 438784 - RNA, 64 nt, hsa
gaauuagaccauuuggccuuugaacuuucauaggaaaaaugacccaacauuucuuagcaugagc

SEQ ID NO: 438785 - RNA, 64 nt, hsa
ccuuuugugaccucucauuccaagauugucaauuaaaaaugaguuuaaaauguuuaacuuguga

SEQ ID NO: 438786 - RNA, 64 nt, hsa
uacaaccuuuugaucuuuguuggaauuuuaagggaaaaaugaacuaaacuucauauuuguugau

SEQ ID NO: 438787 - RNA, 64 nt, hsa
agauaucauuaggaucacacagaguuaaauauagaaaaaugaaaccaucauuauauucuuucgu

SEQ ID NO: 438788 - RNA, 64 nt, hsa
cucaugauagaaaauuuggaaagugcaaauaagcaaaaaugaaaacaauuuuaaaaauguaaaa

SEQ ID NO: 438789 - RNA, 64 nt, hsa
caguccaccuuucuaggccuugguuccuugccugaaaaaugaaagaggcgcuggcuuuccacag

SEQ ID NO: 438790 - RNA, 64 nt, hsa
augggucccucucacuaauguuucaacaauagggaaaaaugagaacuauguggacacuuguuuc

SEQ ID NO: 438791 - RNA, 64 nt, hsa
ucaguguuccuuucaaacaugugaguucuuuaacaaaaaugaaauaaaccaggugucugugauu

SEQ ID NO: 438792 - RNA, 64 nt, hsa
aaaugcaguucuuugccuucucuguuccugcaccaaaaaugaucaggagaaagcauauuaccag

SEQ ID NO: 438793 - RNA, 64 nt, hsa
gcuaagcugggaugccacauaggcagaagccaggaaaaaugaccaaccacagaaccaagugguu

SEQ ID NO: 438794 - RNA, 64 nt, hsa
gaagauuugagaacuuuuuaacuauucauugacuaaaaaugaacauuaauguuaaagacuuaag

SEQ ID NO: 438795 - RNA, 64 nt, hsa
gccuauacauucauuugcuuuguacuauaaaaauaaaaaugauuucuuaaguuaaugacauccc

SEQ ID NO: 438796 - RNA, 64 nt, hsa
uauuuugcuuuuacgucucaacuguguauguaaaaaaaaugaauauuuaaauuacaacccuaga

SEQ ID NO: 438797 - RNA, 64 nt, hsa
uuaacuuuugaugcuuucuguuccccuaaaaccaaaaaaugaaccccuugugucguuguuaacc

SEQ ID NO: 438798 - RNA, 64 nt, hsa
uugcgcuuugcaucagcaaggcauugacuucugaaaaaaugaucugaaaaaaguuucaccguuu

SEQ ID NO: 438799 - RNA, 64 nt, hsa
aaaauauuuuacaguuguaaaaaauauccaucagaaaaaugacacacaaaacaaaauaucugga

SEQ ID NO: 438800 - RNA, 64 nt, hsa
uugcaccagaaucagcauuuuuuuuuuaacugcaaaaaaugauggucucaucucugaauuuaua

SEQ ID NO: 438801 - RNA, 55 nt, hsa
cagagcuuaguaauuucuaaaaagaaaaaaugaucuuuuuccgacuucuaaacaa

SEQ ID NO: 438802 - RNA, 64 nt, hsa
uuuuauaauaaaaugccucagagcuacaauuuuaaaaaaugauuuagcacaagcuaaaucucaa

SEQ ID NO: 438803 - RNA, 64 nt, hsa
aaugaagcuaaagauuuacuagaaggucaagcuaaaaaaugaaguaaauguaugaugaauuuua

SEQ ID NO: 438804 - RNA, 64 nt, hsa
guugugaguuauuugcuuauccuguuuuauucugaaaaaugaaagugcucaauagaauuuuuaa

SEQ ID NO: 438805 - RNA, 64 nt, hsa
uaauauucuuguuuuuauuuucuucaaguuagcuaaaaaugagaugcguaugaagugaggaggc

SEQ ID NO: 438806 - RNA, 50 nt, hsa
agagucagaaagcuaaauaaaaaaaugaaacuuuuuugaguaauaaaaau

SEQ ID NO: 438807 - RNA, 64 nt, hsa
agcuaaauaaaaaaaugaaacuuuuuugaguaauaaaaaugaaaagacgcuguauguaugacuu

SEQ ID NO: 438808 - RNA, 64 nt, hsa
uuccaagguuauuucugaauguaacaauuuccuuaaaaaugacuuauccaauuucuguauuuca

SEQ ID NO: 438809 - RNA, 64 nt, hsa
uaauaauuuaaaaacaagacaucuccagguaggaaaaaaugaaagcuauuucaugcaaacauua

SEQ ID NO: 438810 - RNA, 64 nt, hsa
aacauggugaaacccugccucuacuaaaaauacaaaaaaugagccgggugcaauggcaggcacc

SEQ ID NO: 438811 - RNA, 64 nt, hsa
cagaucuguuuaacccacuugaaaaaaaaacacuaaaaaugaagaaaugcuauaaguauaaacu

SEQ ID NO: 438812 - RNA, 64 nt, hsa
auguaucauucuuuucuaauguauaugaucuaacaaaaaugaaacaugaaaugcaguagcaacc

SEQ ID NO: 438813 - RNA, 64 nt, hsa
gugugacauguugggcagaucaagagacagcuacaaaaaugaagguuuucauaaugcaauguaa

SEQ ID NO: 438814 - RNA, 64 nt, hsa
uguaaacauaucccagaugaaaacugcuguauggaaaaaugacagaaaguaacugauugacacu

SEQ ID NO: 438815 - RNA, 64 nt, hsa
ggaccaaaggcuagguuguaaucuugauagucuaaaaaaugaucaaaacaaaugauuuucaagg

SEQ ID NO: 438816 - RNA, 64 nt, hsa
augacaugagaaugaagaaauuauuuuggaaaaaaaaaaugaccuaauuuaccuaucagugaaa

SEQ ID NO: 438817 - RNA, 64 nt, hsa
ugguaguauuuuguuggaagagaauguuuauacaaaaaaugaaauucuuccaacagcagagaaa

SEQ ID NO: 438818 - RNA, 64 nt, hsa
aaaauuuucucucugauuuuuacuuucauucaugaaaaaugaaaauucagaaauucuuuuuuuc

SEQ ID NO: 438819 - RNA, 64 nt, hsa
ucuaucaucaaugaguauauuuuauuuuuauuauaaaaaugauauugugguggacugcuaaaaa

SEQ ID NO: 438820 - RNA, 64 nt, hsa
ccuaggugacagaaugagacccugucucaaaaaaaaaaaugauugaaauuaaaauucagcuuua

SEQ ID NO: 438821 - RNA, 64 nt, hsa
aucuuuggaugccugaauuuuaaaagggcuagaaaaaaaugauugaccagccugggaaacauaa

SEQ ID NO: 438822 - RNA, 64 nt, hsa
auaauaaaacaaauaauuuccucaaauaacaaagaaaaaugauaccuauaaauauauuuauaaa

SEQ ID NO: 438823 - RNA, 64 nt, hsa
uuggaugaauaaauaaaugcaauugaauucccagaaaaaugauuguuucaaggaagugacaguu

SEQ ID NO: 438824 - RNA, 64 nt, hsa
aaaaaaaaaaaaaaaaaaaaaaaaguuaauguccaaaaaugacagauuuacaaguguaagcuau

SEQ ID NO: 438825 - RNA, 64 nt, hsa
caacauggcaaaacuccgucucugcaaaaaauacaaaaaugagcccgguauguuggcauaugcc

SEQ ID NO: 438826 - RNA, 64 nt, hsa
cauuaauuuuauaucaggauucauguaagagacuaaaaaugauccauagugguuaguacuguaa

SEQ ID NO: 438827 - RNA, 64 nt, hsa
uuacuauacauugaaaugccugcaaacuauaugcaaaaaugaguaugaggaaaucaaauguaaa

SEQ ID NO: 438828 - RNA, 64 nt, hsa
aguuaagcuacuccucuuucuccuaaaaaaaaaaaaaaaugagagaauuagggaaacaccaaaa

SEQ ID NO: 438829 - RNA, 64 nt, hsa
gcugugacagcuuuuuggcugcuuuaaccauaagaaaaaugauugguggaugauuuuauuagcc

SEQ ID NO: 438830 - RNA, 64 nt, hsa
aucuuaauaaagcugcucuuuacuguuucuagucaaaaaugagacuucgaucaaaccauaagau

SEQ ID NO: 438831 - RNA, 64 nt, hsa
acaaaagauugguccuuggugaaauaaacuuuucaaaaaugaauguucuuuucaaaaaauaaag

SEQ ID NO: 438832 - RNA, 64 nt, hsa
aaaguagaaaaaugcacuuacuaagaacaugaaaaaaaaugaaguaggaaaauaagaugaagac

SEQ ID NO: 438833 - RNA, 64 nt, hsa
guauuauccugaauacacuauuuugaaaauuuuuaaaaaugacuucuuuauuuugcuuuaccgu

SEQ ID NO: 438834 - RNA, 64 nt, hsa
uuuuacaauauaugcugagauuaaaaaccaagguaaaaaugaucaaacauauaugaaauugagu

SEQ ID NO: 438835 - RNA, 64 nt, hsa
aauaaucaauuuaguuaccucccaacuaaaaaguaaaaaugaaaaagacgacauggcagaaguu

SEQ ID NO: 438836 - RNA, 64 nt, hsa
ggaagccaaucugaaaacaggcauguggaaacacaaaaaugauguguaugaaaagcaccugaug

SEQ ID NO: 438837 - RNA, 64 nt, hsa
uuauguaaacauguaaagaaaauaagucagcgaaaaaaaugaaacccaaaacucucugcaugua

SEQ ID NO: 438838 - RNA, 64 nt, hsa
uaaugaaugacuauacaaauuauaguaucuuaauaaaaaugagaacacugucccuuuauguaaa

SEQ ID NO: 438839 - RNA, 64 nt, hsa
ccuuggauuaaaacgggaaucacaucuuaaagcuaaaaaugaaccugcaagccuucuaaaugag

SEQ ID NO: 438840 - RNA, 64 nt, hsa
agacaaaaucaaauuguccuauugugacucuucuaaaaaugaagaugaagagcuauuuaaugac

SEQ ID NO: 438841 - RNA, 64 nt, hsa
guuaagcaugaaacaaacagcagcuguuguccuuaaaaaugaauugaccuggccgggcgcggug

SEQ ID NO: 438842 - RNA, 64 nt, hsa
aaguauuguuuauagauaauuuaucucacaagucaaaaaugaagauuuugcagcacugaaaauc

SEQ ID NO: 438843 - RNA, 64 nt, hsa
aagugcuauuggcauuccaaaauucagcuaaaggaaaaaugaucaaaaacaaaguaaggugcac

SEQ ID NO: 438844 - RNA, 64 nt, hsa
aucacauaacucugguguguuaacauugcaaugaaaaaaugaaaaaaagaaggaaaaaagaaua

SEQ ID NO: 438845 - RNA, 64 nt, hsa
agccaccaugccuggccuucauuaucucuuuuuuaaaaaugaaaaaguuuauaauuuacauuca

SEQ ID NO: 438846 - RNA, 64 nt, hsa
auaauguaaauacuugcuagcuuaugugccauuaaaaaaugacuugauuuggcuuacagaccag

SEQ ID NO: 438847 - RNA, 64 nt, hsa
aauauuaacugguauucaaaaaugaauaacagccaaaaaugaauaacagccauuugauuuaugu

SEQ ID NO: 438848 - RNA, 64 nt, hsa
acaacuuugaaagcaguaauauuaacugguauucaaaaaugaauaacagccaaaaaugaauaac

SEQ ID NO: 438849 - RNA, 64 nt, hsa
ucccaugauccccucucuuccuccccacccugaaaaaaaugaguuccuauuuuuucugggagag

SEQ ID NO: 438850 - RNA, 64 nt, hsa
aaccuaagaacaaauguaaaaguaaagaugcaggaaaaaugaauugcuugguauucauuacuuc

SEQ ID NO: 438851 - RNA, 64 nt, hsa
cuccagaccuauaaggaaauguuuaguuuuuaugaaaaaugacaagucgaugguuaaacuucuc

SEQ ID NO: 438852 - RNA, 64 nt, hsa
ugaucaccaaacagaucuugccacuuugauuguuaaaaaugaaccacauucuagcccuggucug

SEQ ID NO: 438853 - RNA, 64 nt, hsa
uauucacauuuaguuuauguuucugauaugacagaaaaaugaaaaguguuugaguucagccucu

SEQ ID NO: 438854 - RNA, 64 nt, hsa
gccaguaaaauuauaccauuggcaugaagcugugaaaaaugagaaauucuaccuuuaccaggga

SEQ ID NO: 438855 - RNA, 64 nt, hsa
cuuuuugagaccucuuaagaaaaaauaaaaaguaaaaaaugaaaggaaucuuuuuuagaaauag

SEQ ID NO: 438856 - RNA, 64 nt, hsa
ucugcuguauuaaugacaauuauucaugaaaauaaaaaaugaaauauuuuguauacuacuaccu

SEQ ID NO: 438857 - RNA, 64 nt, hsa
uguuuauuaaguagcuagaaauaauuauguggaaaaaaaugaauaauggaaaauagugagucuc

SEQ ID NO: 438858 - RNA, 64 nt, hsa
auuucaaaaaaaaauuacaaaaguaugugaauuuaaaaaugagagcaguccucucacccuacca

SEQ ID NO: 438859 - RNA, 64 nt, hsa
gguggcuggaacaucuauuuuucuacaaaacuggaaaaaugaaccugguucuagaagaauguac

SEQ ID NO: 438860 - RNA, 64 nt, hsa
gcuuagcugacuacagaauaggugaggguuucuuaaaaaugagauuuaagggcugggcacggug

SEQ ID NO: 438861 - RNA, 64 nt, hsa
caacaagagugaaacucuugucucaaaaaaaaaaaaaaaugagguuuaagacaguuuugucauu

SEQ ID NO: 438862 - RNA, 64 nt, hsa
ggauuauucauuuugucccauaagaagauaauuaaaaaaugacaaaaaugaacugaacaaaaaa

SEQ ID NO: 438863 - RNA, 64 nt, hsa
auuuugucccauaagaagauaauuaaaaaaugacaaaaaugaacugaacaaaaaaguucuaaca

SEQ ID NO: 438864 - RNA, 64 nt, hsa
aaggcaacagacuuaaaguuguccucagccaaggaaaaaugauacugcaacuuuaaaauuuaaa

SEQ ID NO: 438865 - RNA, 64 nt, hsa
uccaaaagcaugagauuuuucuauccaaauaugcaaaaaugacccaagagaacuuucuuauuuu

SEQ ID NO: 438866 - RNA, 64 nt, hsa
gugaagaggauggaaaaacugaauacaagauaccaaaaaugaaaaaaagugucccauuuuuaau

SEQ ID NO: 438867 - RNA, 64 nt, hsa
uucuuuaauuauggucaaauauaauuuggucaccaaaaaugaaauaauaguuuaaaacaaguag

SEQ ID NO: 438868 - RNA, 64 nt, hsa
gggacuucccgaacuaauuuuuuuaaggauacugaaaaaugagagagaguggucgaaugccuga

SEQ ID NO: 438869 - RNA, 64 nt, hsa
ugaucacuuaaaguaguuuccuucuuuauucugaaaaaaugaggaaaaaauaacaacaguggca

SEQ ID NO: 438870 - RNA, 64 nt, hsa
gaagaaggccuggcaggaccuggccuguuuguuuaaaaaugaaguauggguugggggauuacgc

SEQ ID NO: 438871 - RNA, 64 nt, hsa
ucucuaucuccucacuuuuucucccaaaguagaaaaaaaugauaucugaacugcgucugccuac

SEQ ID NO: 438872 - RNA, 64 nt, hsa
accagccuggcaacagagcaagacuccgucucacaaaaaugaauaaauaaaauaaaaauaaaaa

SEQ ID NO: 438873 - RNA, 64 nt, hsa
uuuugucaauuucauguaauuuacccuuugcaauaaaaaugauucauuaaauauauaacuaaau

SEQ ID NO: 438874 - RNA, 64 nt, hsa
uuuuuuuuuaaauauggcuggaaagcuuguuuugaaaaaugaagcuuauauuaauuguugcuuc

SEQ ID NO: 438875 - RNA, 64 nt, hsa
uaaguaauuuaacaacagauuugcuaauuuaaaaaaaaaugaaaaaaaaaaucuuaccagcagu

SEQ ID NO: 438876 - RNA, 64 nt, hsa
cuuaaggaccuuugggucuacaaguauaugugaaaaaaaugagacuuacugggugaggaaaucc

SEQ ID NO: 438877 - RNA, 64 nt, hsa
auaaaaaccaugcugguauauggcuucaaguuguaaaaaugaaagugacuuuaaaagaaaauag

SEQ ID NO: 438878 - RNA, 64 nt, hsa
aaauuauucuuagugaauuauuuucuaaauuaaaaaaaaugacuuggcuuuugguauugauaau

SEQ ID NO: 438879 - RNA, 64 nt, hsa
uacuguuuagaugggagaaaccucuagagagaguaaaaaugaauuacacuguaucuuauaugaa

SEQ ID NO: 438880 - RNA, 64 nt, hsa
gaguaucuggagaauaaaacccaaauucaaaaaaaaaaaugauaauuuauuuuuaagguaaaaa

SEQ ID NO: 438881 - RNA, 64 nt, hsa
uuacaauguugguuuuaaagauaagcacauggguaaaaaugagggugauccuuauucaaaaaua

SEQ ID NO: 438882 - RNA, 64 nt, hsa
cacacuguuguauaaagcagcagaacugaaggggaaaaaugauuguuguauacacugaauugcu

SEQ ID NO: 438883 - RNA, 64 nt, hsa
uuuuuuauauuuggaaacaucaaauaaaaauggaaaaaaugaucauggcuuuaaaaaaaaaaca

SEQ ID NO: 438884 - RNA, 64 nt, hsa
accaucaaugaauucagauaugggaaaagucaguaaaaaugauacugaagaggaaaguaauaaa

SEQ ID NO: 438885 - RNA, 64 nt, hsa
uggugaggaggaagaacaaauaauagaagaaaauaaaaaugagauagaagaaaaguaagaacca

SEQ ID NO: 438886 - RNA, 64 nt, hsa
uacuuacagauucuuccuguaaacuaaauaaaaaaaaaaugauagugcauuuuggugguaauuu

SEQ ID NO: 438887 - RNA, 64 nt, hsa
aacaauauuccauauaaauaaguuuagccuuuauaaaaaugaaguugcaggcugacauuacauu

SEQ ID NO: 438888 - RNA, 64 nt, hsa
aaucaaauugaaucuuuuacuuaccucuugcaaaaaaaaugaaaaaugaaaaaacaaauucaaa

SEQ ID NO: 438889 - RNA, 64 nt, hsa
uugaaucuuuuacuuaccucuugcaaaaaaaaugaaaaaugaaaaaacaaauucaaaaccuauu

SEQ ID NO: 438890 - RNA, 64 nt, hsa
guaacuuuacacuuuuuugguuauuuuauuuuaaaaaaaugaaaaauuaauuuaaaaaaaugca

SEQ ID NO: 438891 - RNA, 64 nt, hsa
ugugacaucuuuuuaaaaaaaauaacaacaaaaaaaaaaugagagaaaagcuaaaaaaaaaaaa

SEQ ID NO: 438892 - RNA, 64 nt, hsa
cauauugugagaaaaacguuaggagcugguaguaaaaaaugagauucuaugccaaaauaacuuc

SEQ ID NO: 438893 - RNA, 64 nt, hsa
gaacauuuugaaauauuuuuguuuuagauuugcaaaaaaugacauauaggucaguacucacaug

SEQ ID NO: 438894 - RNA, 64 nt, hsa
acuguuuaccucuugcuauguauuuucucccgguaaaaaugaauugaaccauuucaacuauuuu

SEQ ID NO: 438895 - RNA, 64 nt, hsa
auuuuucuaugcauaguuaugcauuuauauucucaaaaaugaaaucauaauguacauugcuuug

SEQ ID NO: 438896 - RNA, 64 nt, hsa
uagaaaaugacuuauuuccagaagauaccgcucuaaaaaugaaauuguuaggugaaaguguuuu

SEQ ID NO: 438897 - RNA, 64 nt, hsa
guaucuucacaccuugaauaagcauaauaccauaaaaaaugacacuugacaugucaauguauuu

SEQ ID NO: 438898 - RNA, 64 nt, hsa
uuuuaaacucguauuugugguuuuuuucccagauaaaaaugaaauuaaaccauuucuuuuuaag

SEQ ID NO: 438899 - RNA, 64 nt, hsa
acaaccaaagaaggccugcucuuugcugcuuuuaaaaaaugacaauuaaaugugcagauucccc

SEQ ID NO: 438900 - RNA, 64 nt, hsa
cagcccgcaguuuaugugugugcuuuuuucuaugaaaaaugauguauuuugcuacuuccugugu

SEQ ID NO: 438901 - RNA, 64 nt, hsa
uugaacguaugugcucuuauaaaguggacuucugaaaaaugaauguaaaagacacugguguauc

SEQ ID NO: 438902 - RNA, 64 nt, hsa
aauuguuagauggcaauagucauuaaaaacauagaaaaaugaugucuuuaaguggagaauugug

SEQ ID NO: 438903 - RNA, 64 nt, hsa
ccagcugcaauaccugucuguaauaugagaaaaaaaaaaugaaucuauuuaaucauuucuacuu

SEQ ID NO: 438904 - RNA, 64 nt, hsa
aaauccuaugacaguaagcaaaaacagaaccaugaaaaaugauuggacauacaccuuuucaauu

SEQ ID NO: 438905 - RNA, 64 nt, hsa
agcacuuuucuaacuaaugagcucugugguaagaaaaaaugaacucuuucaauugagauuaagu

SEQ ID NO: 438906 - RNA, 64 nt, hsa
uguaucugagagggucuccagaccagguuacugcaaaaaugagguuuugcuuucaggauuuggc

SEQ ID NO: 438907 - RNA, 64 nt, hsa
uaauacugagcaagccuguggaauuuucuuuaugaaaaaugauuuuagccuuugcaaauguuaa

SEQ ID NO: 438908 - RNA, 64 nt, hsa
uuauguucugagugugugguauguucccuuaaaaaaaaaugacacuuggaagaaaaauguauga

SEQ ID NO: 438909 - RNA, 64 nt, hsa
cuccaauucuuuccuaaagaacauuuuuagcagcaaaaaugaaguaugacacuugcuguuuuuc

SEQ ID NO: 438910 - RNA, 64 nt, hsa
uauaaaaacagguuccaaauauucacugcuuuguaaaaaugaacaaacaugagacuguaagaaa

SEQ ID NO: 438911 - RNA, 64 nt, hsa
gaacauggaaauacaguggugaaaccaccuaugcaaaaaugauaacagugaggaaauuaugaca

SEQ ID NO: 438912 - RNA, 64 nt, hsa
uaucaguguugucuauaaauauuugaagguauauaaaaaugagaugauguaauguauuuauaaa

SEQ ID NO: 438913 - RNA, 64 nt, hsa
caaaaauauguuuaaacuuuuuuuuauucuuuugaaaaaugauuuguaaauugagggucauagu

SEQ ID NO: 438914 - RNA, 64 nt, hsa
gggaauucccucccaaauuugauuuuguuauuagaaaaaugauuccgugaacacagauguguuu

SEQ ID NO: 438915 - RNA, 64 nt, hsa
cugucucugauaaaaagaaaaaaaaugaaaaaauaaaaaugaacagguauaaaaagagaauaug

SEQ ID NO: 438916 - RNA, 64 nt, hsa
caacaaagaggccccugucucugauaaaaagaaaaaaaaugaaaaaauaaaaaugaacagguau

SEQ ID NO: 438917 - RNA, 64 nt, hsa
ugguagacauuucaaacugucacauuagggauacaaaaaugaacaggcugggagugguggcuca

SEQ ID NO: 438918 - RNA, 64 nt, hsa
caaaauauguuaaauuucugacaauuccuaauacaaaaaugacccgauuaaaagauucuguggc

SEQ ID NO: 438919 - RNA, 64 nt, hsa
cuguuuccuaagcaucagauaaucuaugcuaaaaaaaaaugaauauagaaaagcugcuucuugc

SEQ ID NO: 438920 - RNA, 64 nt, hsa
gacaaaaauauauauguaugugacccuacccauaaaaaaugaaauauucacagaaucagaucug

SEQ ID NO: 438921 - RNA, 64 nt, hsa
cacggccagcccacaaugauauuacaaaccuauuaaaaaugauacuuagacagaauugucagua

SEQ ID NO: 438922 - RNA, 64 nt, hsa
aauaugugagcaaaaugaaacaaauacuuguuguaaaaaugaugguuuguagaggggucaaaca

SEQ ID NO: 438923 - RNA, 64 nt, hsa
aaagugaucccagauuagauuuuugagauccaaaaaaaaugaaaaccuaggaaaguagcaaaua

SEQ ID NO: 438924 - RNA, 64 nt, hsa
gcagcccucacuuuucauggcagugcaagauugcaaaaaugacugugcaaccugaaacccagga

SEQ ID NO: 438925 - RNA, 64 nt, hsa
gaauacacaugaaccccuauaccaauuuuaagaaaaaaaugauucucuuuccucuuuguccaag

SEQ ID NO: 438926 - RNA, 64 nt, hsa
ugucaaauauauuucucuuucagggucaugaucaaaaaaugaaaagucugcuuaacuccaauuu

SEQ ID NO: 438927 - RNA, 64 nt, hsa
gaaaccaguuuaaugggauacaaccagcauuuuaaaaaaugaaauagaauacagcauggaaaau

SEQ ID NO: 438928 - RNA, 64 nt, hsa
gaagacaaaauugguguuuagauucuggaggagaaaaaaugaguuacaaugucagguguuuuua

SEQ ID NO: 438929 - RNA, 64 nt, hsa
ucuaaacauagguucugcauaucuguuagauuuuaaaaaugacugguguuuugucuucacauuu

SEQ ID NO: 438930 - RNA, 64 nt, hsa
ggccccuccuagggagccucuucgacuuuuuuagaaaaaugaucuccauuucuuuccagccaug

SEQ ID NO: 438931 - RNA, 64 nt, hsa
auuuugcuuaaauuucuacaguauguaaaagugaaaaaaugaugaagacgggugcaccugucug

SEQ ID NO: 438932 - RNA, 64 nt, hsa
cgugauaauauaaucucuauuuuuuuaggaaaacaaaaaugaaaaacuacuccauuugaggauu

SEQ ID NO: 438933 - RNA, 64 nt, hsa
guaggcuguaauauguguacauuguguuuaagagaaaaaugaaacccacaugccgccauuuucc

SEQ ID NO: 438934 - RNA, 64 nt, hsa
caacguggugaaacacugucucuacuaaaaauacaaaaaugagcugggugugaugauacaugcc

SEQ ID NO: 438935 - RNA, 64 nt, hsa
augaugacuucaaaaauuaauaaaaagaaaagaaaaaaaugauuucuggccgggcgugguggcu

SEQ ID NO: 438936 - RNA, 64 nt, hsa
uacguugaguuugcaaccagaugggaaaaaucacaaaaaugagaaggggagcagauaucuuguu

SEQ ID NO: 438937 - RNA, 64 nt, hsa
uggacuaaugugaaaaaaacauugcugaaaaccuaaaaaugaaaguuugugaguguuuauuggu

SEQ ID NO: 438938 - RNA, 64 nt, hsa
uuucuccuagaaucucaaguggaauuggaaucauaaaaaugaaugagauuugaaaacuuucaca

SEQ ID NO: 438939 - RNA, 64 nt, hsa
auaaauguaguuaguuugauacuccuuagaauaaaaaaaugaaacaguaacaacuuuuauguaa

SEQ ID NO: 438940 - RNA, 64 nt, hsa
aucuuuagcuuuauaaucuaaggaaccaaauuuaaaaaaugauggauuaugcucugugaaauga

SEQ ID NO: 438941 - RNA, 64 nt, hsa
gcauggcuuugauauucucuacuuccuggccuuuaaaaaugaccuauaauuuuucaguuugcuu

SEQ ID NO: 438942 - RNA, 64 nt, hsa
gaaaucuauaacauuucuuuugcccaagugacacaaaaaugauuacugcauagaaaucaaaugu

SEQ ID NO: 438943 - RNA, 64 nt, hsa
uuguuuuagauguuuuaaauaguugcaauggauuaaaaaugaugauuuaaaauguugcuuguaa

SEQ ID NO: 438944 - RNA, 64 nt, hsa
uaauuggguggggcagguguguauuuacuuuagaaaaaaugaaaaagacaagauuuaugagaaa

SEQ ID NO: 438945 - RNA, 64 nt, hsa
uauuacauuuuauuuuuucuuaauccaguucugcaaaaaugaccuauaaauuuauucauguaca

SEQ ID NO: 438946 - RNA, 64 nt, hsa
cugauaauucaagggagcucaaagucacaagaagaaaaaugaaaggaaaaaacagcagcccuau

SEQ ID NO: 438947 - RNA, 64 nt, hsa
gaacauuuugacaaauauuuauuuuuguaagccuaaaaaugauucuuugaaaguuuaaagaaac

SEQ ID NO: 438948 - RNA, 62 nt, hsa
auuguagcaagugcuggaaugucccuuuuuuccuaugcaacuuuuuuuaacccuuuaaugaa

SEQ ID NO: 438949 - RNA, 62 nt, hsa
agaaugaaccagauuugguggugguuuuguuucuaugcaaacuggacacaaauuacaacagu

SEQ ID NO: 438950 - RNA, 62 nt, hsa
uucgaauuuugucuuuaaaauucaugugguuucuaugcaaaguucuucauaucaucacaaca

SEQ ID NO: 438951 - RNA, 62 nt, hsa
agauguauuauaccagugaaaagguguuauaucuaugcaaaccuacuaacaaauuauacugu

SEQ ID NO: 438952 - RNA, 62 nt, hsa
uagggauccuccucacugugggcgcugcguaccuaugcaagugccuagcuaugaagucccag

SEQ ID NO: 438953 - RNA, 62 nt, hsa
agaccagccuggacaacauagugagaccccgucuaugcaaaaaauacacaaauuagccuggu

SEQ ID NO: 438954 - RNA, 62 nt, hsa
ccuaaacucaggagucaacguguuuaccucuucuaugcaagccuugcuagacagccagguua

SEQ ID NO: 438955 - RNA, 62 nt, hsa
ucuuuauguccgcccaccuagugcuuccacuucuaugcaaaugccuccaagccauucacuuc

SEQ ID NO: 438956 - RNA, 64 nt, hsa
cauaacacccaucacauugucugagaauaggauuaaugagcaaaaguuaugauaauagaguuau

SEQ ID NO: 438957 - RNA, 64 nt, hsa
cuaaugccgugaaugaaacacagucuguguagggaaugagcaaaaaaguugaauuccaauugcu

SEQ ID NO: 438958 - RNA, 64 nt, hsa
gguauauguaauauauaugugggaaauacaggggaaugagcaaaucucaaagagcuggcgucuu

SEQ ID NO: 438959 - RNA, 64 nt, hsa
acccaauacauuauuagacugaacugugaccugaaaugagcaauaaacucuguauuaauucacu

SEQ ID NO: 438960 - RNA, 64 nt, hsa
cacacacuuaccuuacuaagucuuugcuuuaauaaaugagcaacccuggguauagucuuaaaau

SEQ ID NO: 438961 - RNA, 64 nt, hsa
aaauuauuccuaaacucucuaaguguggacggagaaugagcaagccccagaaguauuuuacaac

SEQ ID NO: 438962 - RNA, 64 nt, hsa
gcugcgucuccccugacacacacuuucuuuuuugaaugagcaagucuccauuuugauuucagca

SEQ ID NO: 438963 - RNA, 64 nt, hsa
uaaauugucucuugcaucacuaaaauuuuuuuaaaaugagcauaacaacgaaaggcauccagcu

SEQ ID NO: 438964 - RNA, 64 nt, hsa
uauacugaaaucuguuauuuuagugaggcuccaaaaugagcaaagcuaggccugauuagaguag

SEQ ID NO: 438965 - RNA, 64 nt, hsa
acccucuugagauucguuuuaaguguaauuccauaaugagcagagguguacgcgaaauuguguu

SEQ ID NO: 438966 - RNA, 64 nt, hsa
ucuauauuuuucuuauuuaauuacaaauacuauaaaugagcaaggaaaaggaauagacuuucuu

SEQ ID NO: 438967 - RNA, 64 nt, hsa
ugccaaaggaacuugauuacauggugucuaaccaaaugagcaggcuuaggaauuuagaugagau

SEQ ID NO: 438968 - RNA, 64 nt, hsa
cucuacccccuagccugggcguuggaucuacuggaaugagcagcagccgcuuccucggcagccu

SEQ ID NO: 438969 - RNA, 64 nt, hsa
gugggauaaaaguuaucuuccccuuggaaagacuaaugagcacaaugauauuaaucacuuuuau

SEQ ID NO: 438970 - RNA, 64 nt, hsa
uguauuguguagcuaggccuaaugaagcauucaaaaugagcaaugcuaauggguuguuuagcuu

SEQ ID NO: 438971 - RNA, 64 nt, hsa
aucuucucaccuugauuuugagcuggaauguuucaaugagcaaaauaaauuagacaaaaguuua

SEQ ID NO: 438972 - RNA, 64 nt, hsa
gaucugccagacauucuaauuugaaccagauaucucuggguagcuacaaaguuccucagggguu

SEQ ID NO: 438973 - RNA, 64 nt, hsa
acuuuauuccuccacaggaacccagcauuccugaucuggguaccaauauuucugcaaucaguuu

SEQ ID NO: 438974 - RNA, 64 nt, hsa
aguaauagcuuuggcuguuuauuugauagcuguuucuggguauuuaauaggaauccuuucucaa

SEQ ID NO: 438975 - RNA, 64 nt, hsa
cuggacacuucuuuauacucucuucccuuuuuuuucuggguagaagccacccuucccugccucc

SEQ ID NO: 438976 - RNA, 64 nt, hsa
aagggguuaauaaaugggccauccuuuccugagcucuggguauacuaccagucacagaacguca

SEQ ID NO: 438977 - RNA, 64 nt, hsa
cccguggagaaucagguuaaugagguaaaggcuuucuggguauuugcugccaaggccacaucac

SEQ ID NO: 438978 - RNA, 64 nt, hsa
guguguacgugaccacguucuaucuguucauuugucuggguauagucacuccuggugaugauau

SEQ ID NO: 438979 - RNA, 64 nt, hsa
ugcauuuuccaaugagauaucuugcaguuucuguucuggguagauuuuuuucucucauaugcac

SEQ ID NO: 438980 - RNA, 64 nt, hsa
auccuuaugagggagauucugaucauauuaaaaaucuggguaaacuaaaaccugcucauaaccu

SEQ ID NO: 438981 - RNA, 64 nt, hsa
uccucagguauaaguucuauaaacaggcuuggaaucuggguaauuaaaaacagaaaauuauagu

SEQ ID NO: 438982 - RNA, 64 nt, hsa
uuuaucuucccccuugucguuugagguuuugaucucuggguaaagaggccguuuaucuuuguaa

SEQ ID NO: 438983 - RNA, 64 nt, hsa
gaucagucggacauuuuaauuugaaccacguaucucuggguagcuacaaaauuccucagggauu

SEQ ID NO: 438984 - RNA, 64 nt, hsa
auccaguggagcuaaucaguccugccuccugcucucuggguauagacaggggugggaagggucc

SEQ ID NO: 438985 - RNA, 64 nt, hsa
ucccaucuaaagaaaccugucaggaauacgagcuucuggguauguuucguuucccauugcugua

SEQ ID NO: 438986 - RNA, 64 nt, hsa
aacagcauuuuuuuccuuagccucuguuugccacucuggguaucucuccuaugggcaaagccau

SEQ ID NO: 438987 - RNA, 64 nt, hsa
aaauguucuguuuaaaucaguaggcuuaauguguucuggguauuuaucuccuuguauuuuaaau

SEQ ID NO: 438988 - RNA, 64 nt, hsa
cccucacucuugcugcacaguuguguuuacuuuuucuggguagaggaugcugaacugacucagc

SEQ ID NO: 438989 - RNA, 64 nt, hsa
ggacagauaucauugcaucacauuuauuuaucuuucuggguauuuuuauagcccuuaauaaaaa

SEQ ID NO: 438990 - RNA, 64 nt, hsa
aaaucauacaaaugguggcuguucugagaaucagucuggguauugauuuccuuuuccagugacu

SEQ ID NO: 438991 - RNA, 64 nt, hsa
ugucaccugccuggcuccugcucucugauguaccucuggguagugagauggaaauggugccugc

SEQ ID NO: 438992 - RNA, 64 nt, hsa
gacaauuagauaccuauccuguaguuacugaaaaucuggguaguaaaucuacccaauuaaaaug

SEQ ID NO: 438993 - RNA, 64 nt, hsa
gaggaggcugugcugaguuuguguggcuggaaucucuggguaaggaacuuaaagaacaaaaauc

SEQ ID NO: 438994 - RNA, 64 nt, hsa
acccuccuguuuuguugaaggaucaaccccaaauucuggguauuugaguacaugugaaucaugg

SEQ ID NO: 438995 - RNA, 64 nt, hsa
caucaucuccacagccugguaaauuccaugugccucuggguacaaaagugccucaacgacaugc

SEQ ID NO: 438996 - RNA, 64 nt, hsa
guuuuuacacuucucuuuaauucccaccuaagccucuggguaauauuguaaauauuguuuuaaa

SEQ ID NO: 438997 - RNA, 64 nt, hsa
uguaguuuauaugcuuaguuguugccuauagugaucuggguaagauucaaacauuuaucuuuug

SEQ ID NO: 438998 - RNA, 64 nt, hsa
ugcgcuggauggacaccgccuugcacuguuggauucuggguaugacauacucgcagcaguguua

SEQ ID NO: 438999 - RNA, 64 nt, hsa
uguuaucaaaaugauuuuaaagacuauuucuuuuucuggguaacuauugaaguuuguaauuaaa

SEQ ID NO: 439000 - RNA, 64 nt, hsa
ccaggucaccagauccaaggagcgcuugaggagcucuggguacagggcagcaacccagagccca

SEQ ID NO: 439001 - RNA, 64 nt, hsa
agcccauaccagcuggcaucucccccccgugccuucuggguacaauaagcacccaauucucaac

SEQ ID NO: 439002 - RNA, 64 nt, hsa
ugagacaagggcucggccuuaaggagcugaagagucuggguagcuuguuuaggguacaagaagc

SEQ ID NO: 439003 - RNA, 64 nt, hsa
agggacuuugaaaauuccaucuuacccuuguagcucuggguaagaugaccugagucccuuauga

SEQ ID NO: 439004 - RNA, 64 nt, hsa
gaugguacuugcugucuucugcaaaccugccccuucuggguacuucccuugaccccgagaucac

SEQ ID NO: 439005 - RNA, 64 nt, hsa
aaauauuuauaaauaaaaggagagagguuugaguucuggguauccucccuuucuguaacagccu

SEQ ID NO: 439006 - RNA, 64 nt, hsa
ucccugagugaguuucuucuggguguccuuuuauucuggguagggagcgggaguccguguucuc

SEQ ID NO: 439007 - RNA, 64 nt, hsa
aaagaaaaaaaaaaagaaaagaaaacuucaauuuucuggguaugcacaaagaccaugaagacuu

SEQ ID NO: 439008 - RNA, 64 nt, hsa
ucccuaaugaacacgcaugggcugaaaugaaggcucuggguaggggacuguuuuggauccaagg

SEQ ID NO: 439009 - RNA, 64 nt, hsa
gaauuaugauggaagacaggaaaguucagaguuuucuggguaggacuuuggugguuuaaaaaug

SEQ ID NO: 439010 - RNA, 64 nt, hsa
cccccccagcacccagcaugcccggcugugccccucuggguaugcucacaugcacauauaugga

SEQ ID NO: 439011 - RNA, 64 nt, hsa
cguguuuuauguuaagucacaaacccacuugacuucuggguacuggaauuaauaccagugggug

SEQ ID NO: 439012 - RNA, 64 nt, hsa
cccucccccaccccggguaguggagaugcuggugucuggguagucauggauuucugcuggacau

SEQ ID NO: 439013 - RNA, 64 nt, hsa
auauacauuuaaagaccguguuuacauaaucucuucuggguagaaaauggaaauacuuaaccuu

SEQ ID NO: 439014 - RNA, 64 nt, hsa
gaucauuuagaugagaguucuuuggggcuuauuuucuggguaaggcucaucuuuaaaaacuggc

SEQ ID NO: 439015 - RNA, 64 nt, hsa
aagauugaacuacaggugcauagcaagcacucuuucuggguaacuaggcugcugguuuuaauua

SEQ ID NO: 439016 - RNA, 64 nt, hsa
uauuguauuagaagucugcccuagcuguuaaauuucuggguauuuauccuaaggaauuaauuaa

SEQ ID NO: 439017 - RNA, 64 nt, hsa
cuguaggagcaacuucucugaucaaaauuacuuuucuggguaugugcugauuaaggggguggac

SEQ ID NO: 439018 - RNA, 64 nt, hsa
aguuucagugaccuugagggcuaaagauuguucuucuggguaagagcucuugggcugguuuuuc

SEQ ID NO: 439019 - RNA, 64 nt, hsa
gcugggacuggaaaggacagcccuugaccuggguucuggguauaauuugcacuuuugagacugg

SEQ ID NO: 439020 - RNA, 64 nt, hsa
gaaauaugcacuuagcacuuugguuccacaucugucuggguaaaccaugaagaaaaugaagcug

SEQ ID NO: 439021 - RNA, 64 nt, hsa
ggugaagacaggcuugagggcugccccagcaggcucuggguaugaccugccucuggcccugguc

SEQ ID NO: 439022 - RNA, 64 nt, hsa
acagcgauucaaaggguggcauuggguuggacguucuggguacaagccaaccuagucccacguu

SEQ ID NO: 439023 - RNA, 64 nt, hsa
gagggccgggaagccaggaaagcuugguguuuucucuggguacaccccaagcagcgucuccuuu

SEQ ID NO: 439024 - RNA, 64 nt, hsa
aagagcggauuagucacagauauuggcuuugcuaucuggguagaaauuaauacaauucccugug

SEQ ID NO: 439025 - RNA, 64 nt, hsa
uucuuaauuccacaugacugaggcauauaugaucucuggguaggugaguuguugugacaaccac

SEQ ID NO: 439026 - RNA, 64 nt, hsa
ucaggcgggcaccaaggcaacggcaccauuggucucuggguagugcuuuaagaaugaacacaau

SEQ ID NO: 439027 - RNA, 64 nt, hsa
caccgauuucauuacggugccacgcagucauggaucuggguaguccggaaaacaaaaggaggga

SEQ ID NO: 439028 - RNA, 64 nt, hsa
auauccuacuguguaacaggucagaauuucaagcucuggguaauaacugcugauauuuuuucua

SEQ ID NO: 439029 - RNA, 64 nt, hsa
gaguggucugaaaaaacaucaagcauaguaauugucuggguagacagauuucagaauuuuuaaa

SEQ ID NO: 439030 - RNA, 64 nt, hsa
uccagugagccgagauggcgcuauugcacuccagucuggguaacagggagacugcaucucaaaa

SEQ ID NO: 439031 - RNA, 64 nt, hsa
cuaacucaaaaaauuugaaguguuuuaaguuguuucuggguaagggagauguuaggagaaagga

SEQ ID NO: 439032 - RNA, 64 nt, hsa
auguaccccuccgauuugugaagccuacaggaaaucuggguauauggauuuguaacugcagaag

SEQ ID NO: 439033 - RNA, 64 nt, hsa
auuucauuuucuuauaaaccaguaaucuugcuuuucuggguaaauuuucagcuauuauuacuaa

SEQ ID NO: 439034 - RNA, 64 nt, hsa
gagguccagguagccugcaacacuggaaaugaguucuggguaagugaguuauaagaguacaugc

SEQ ID NO: 439035 - RNA, 64 nt, hsa
cagcuauggacaugcgggauaucucccccugcucucuggguauuugaaaugucaauuuuagcac

SEQ ID NO: 439036 - RNA, 64 nt, hsa
cuuggcccaggauguugaaagggugcaaauuccuucuggguagauaagaaaugacucugggaga

SEQ ID NO: 439037 - RNA, 64 nt, hsa; identical to SEQ ID NO: 235043

SEQ ID NO: 439038 - RNA, 64 nt, hsa; identical to SEQ ID NO: 235044

SEQ ID NO: 439039 - RNA, 64 nt, hsa
uacauuuccuaaaaugccauaagaaaaugcaauaucuggguacuguauggggaaaaaaaugucc

SEQ ID NO: 439040 - RNA, 64 nt, hsa
gcaguguccacguuuuuggaaaauguauuuugccucuggguaggaaaagauguauguugcuauc

SEQ ID NO: 439041 - RNA, 64 nt, hsa
uugaaaaaaaucaaaauuuuuugccuuccauuuuucuggguaauguccuuuaagaaaagugaau

SEQ ID NO: 439042 - RNA, 64 nt, hsa
ccuucaagugccaaacagaguauguccgaugguaucuggguaagaagaaagcaaaagcaaggga

SEQ ID NO: 439043 - RNA, 64 nt, hsa
uagccugaggggccuggagucguggcccugcauuucuggguagggcuggcaaugguugccuuaa

SEQ ID NO: 439044 - RNA, 64 nt, hsa
ucuacuugcaggguaucuccacagcaugcaccauucuggguacagggggacauccucuguuacu

SEQ ID NO: 439045 - RNA, 64 nt, hsa
cagccucagccccuugucuacuuguucuccagcuucuggguagcugggcuucuggaaggguggc

SEQ ID NO: 439046 - RNA, 64 nt, hsa
cuguaggauuuucuuuucuuuaaaaaauguauauucuggguaguuuuaauugguaaaaaaaugu

SEQ ID NO: 439047 - RNA, 64 nt, hsa
acugugcucaaccagacagauagugaaacagcuuucuggguaauucaccaauuuccuuuaaaac

SEQ ID NO: 439048 - RNA, 64 nt, hsa
uagaacauauccuccagagacuuggcuuaauuggucuggguaaauauggcugagcguuguuauc

SEQ ID NO: 439049 - RNA, 64 nt, hsa
guucaaaaacauucauccucuuacugcaaguuuaucuggguacuuuuaccuguguguucaaagg

SEQ ID NO: 439050 - RNA, 64 nt, hsa
acauugaagugacuugggaaauaacauucaagcuucuggguaaacacauacaaacaguggcaaa

SEQ ID NO: 439051 - RNA, 64 nt, hsa
uaggaaaaugaucagaauauuccagcucaacaagucuggguauauucacuauugugagucaaua

SEQ ID NO: 439052 - RNA, 64 nt, hsa
acugcaugaaaccaugacugacugagagucacucucuggguagaugauaggcgccuuucuggcc

SEQ ID NO: 439053 - RNA, 64 nt, hsa
aggaggauuguugagcccaggaguuugagugcaaucuggguaacauuuuuuagaggugccaguu

SEQ ID NO: 439054 - RNA, 64 nt, hsa
uuauuuucaaacaagcacacuuguacaauuauuuucuggguacuucccauaugcacauagcacu

SEQ ID NO: 439055 - RNA, 64 nt, hsa
aagaaugaacuagaacauucaagacucuuuuacuucuggguauugauuugcuguacauuuuuaa

SEQ ID NO: 439056 - RNA, 64 nt, hsa
aacugccccauuuugaaggugaggaaauugagguucuggguauaacuuucuuuggucacauaau

SEQ ID NO: 439057 - RNA, 64 nt, hsa
cuccuggcugguuuaccugcugcugcccauuuucucuggguacugcuggccagaggacuuuagc

SEQ ID NO: 439058 - RNA, 64 nt, hsa
agggaggaaggcagcuagaaaugggagggaagcuucuggguaggcaccauaguaggggaauguc

SEQ ID NO: 439059 - RNA, 64 nt, hsa
gcagugaacgaaaugaauuuuaaugccuauuauuucuggguacuuuaacaauauuucaaauauc

SEQ ID NO: 439060 - RNA, 64 nt, hsa
uuagaaauucucuacauucauugagcucucauugucuggguagaguauuacacguugcauacua

SEQ ID NO: 439061 - RNA, 64 nt, hsa
gcaagauauuuaacuuaauaucuuagacaagaguucuggguacaauuuugggaucuaguucccc

SEQ ID NO: 439062 - RNA, 64 nt, hsa
caaaggcaacauaugacaacaaguaauuuaugaaucuggguaguagcguugguaaucugaguuc

SEQ ID NO: 439063 - RNA, 64 nt, hsa
gggugauaugugagagagaaaucuggaaccuucuucuggguagauacaggauaagauagauaca

SEQ ID NO: 439064 - RNA, 64 nt, hsa
uucuaugucuagcacauguugauuuccuauguauucuggguauucuauuaaaggaaacuuugaa

SEQ ID NO: 439065 - RNA, 64 nt, hsa; identical to SEQ ID NO: 235045

SEQ ID NO: 439066 - RNA, 64 nt, hsa; identical to SEQ ID NO: 235046

SEQ ID NO: 439067 - RNA, 64 nt, hsa
cuacguaggaaaagauguauuugugcaucuucuuucuggguaguuaaaaauuacucccucuuuu

SEQ ID NO: 439068 - RNA, 64 nt, hsa
acugccuuuuccacacaaaggcugggaauaaaauucuggguauucucguauucucauuuaaagg

SEQ ID NO: 439069 - RNA, 64 nt, hsa
uuuuuugucucaagauuauauuauaauaauguucucuggguagguguugaaaaugagccuguaa

SEQ ID NO: 439070 - RNA, 64 nt, hsa
uguguauauaaugauaucuauauuuuugcccaggucuggguauugcuccugcccagacccugac

SEQ ID NO: 439071 - RNA, 64 nt, hsa
uauuucuuacuguaauugccagaggcagaaauggucuggguauaagcuauuucauaaaagcagc

SEQ ID NO: 439072 - RNA, 64 nt, hsa
uucuucaauauguguugacaaccagcccugugguucuggguagcaaaggaaauacaguauaacu

SEQ ID NO: 439073 - RNA, 64 nt, hsa
ggaaucugaccacuauacuguccuuuuuuuguauucuggguaaauguuuuuuggaaaagauuug

SEQ ID NO: 439074 - RNA, 64 nt, hsa
cuguuuuacccaggaauucuuggauauuuaguuuucuggguacugaaguggaugggagggggaa

SEQ ID NO: 439075 - RNA, 64 nt, hsa
gcggagcaagugccaagcagaacagaccuuaucaucuggguaacagacuucucaguguuggugc

SEQ ID NO: 439076 - RNA, 64 nt, hsa
acucaggagggggauggagcucaggcccuugucuucuggguaguuuuguuacuacuguugcuuu

SEQ ID NO: 439077 - RNA, 64 nt, hsa
gaggagggggcaccgacagcgcugcgagccaggcucuggguaguggcugaggccagaggcccau

SEQ ID NO: 439078 - RNA, 64 nt, hsa
auuguaagaaauacuguacaaugacuuuauugcaucuggguagcuguaaggcaugaaggaugcc

SEQ ID NO: 439079 - RNA, 64 nt, hsa
ucaggaggaccugugaagcauguaguuaucuagaucuggguaauuucauguuuauuaaacucga

SEQ ID NO: 439080 - RNA, 64 nt, hsa
guguuauugauuagugaggagccaguaagaaacaucuggguauuuggaaacaaguggucauugu

SEQ ID NO: 439081 - RNA, 64 nt, hsa
agacuucaauccugauuagugucuccagucaagcucuggguacugaauugccuguucauaaaac

SEQ ID NO: 439082 - RNA, 64 nt, hsa
guagguggcuugagcuagagauaaaacagaaucuucuggguaguccccuguugauuaucuucag

SEQ ID NO: 439083 - RNA, 64 nt, hsa
ugugugcaagcaugaaguagaaacacuuuuuuuuucuggguacaguacauggguaucggugcuc

SEQ ID NO: 439084 - RNA, 64 nt, hsa
cccugccccucccugcucccuuuugaugguggccucuggguacucgggcagaguccuugggaca

SEQ ID NO: 439085 - RNA, 64 nt, hsa
cacuggguugcugugcuguagggugaucggcuguucuggguagccuggggcugaggaggugccc

SEQ ID NO: 439086 - RNA, 64 nt, hsa
gggaaaagguuauggaacuggagggggugagcuuucuggguagaaggagacuuccugaauuucc

SEQ ID NO: 439087 - RNA, 64 nt, hsa
auagucaaaauaccccuaacauacugcauuucacucuggguaccaaauuuaagcaagauauuga

SEQ ID NO: 439088 - RNA, 64 nt, hsa
cugguauaaguguuucauauuugaaaaaguuaucucuggguauugcauaaaaggcuucaucuua

SEQ ID NO: 439089 - RNA, 64 nt, hsa
aaagucccuguuuuguccugaaauuuuagucuauucuggguaaauaggauuuucugacacagau

SEQ ID NO: 439090 - RNA, 64 nt, hsa
aaccauguccaugcugagaaggcagcuuucccgcucuggguaccuuacguccugcccagcucug

SEQ ID NO: 439091 - RNA, 64 nt, hsa
gcguggagcaugaguugugaauggcagggaucauucuggguaaaaaaaaccuagaaucauuucu

SEQ ID NO: 439092 - RNA, 64 nt, hsa; identical to SEQ ID NO: 235047

SEQ ID NO: 439093 - RNA, 64 nt, hsa; identical to SEQ ID NO: 235048

SEQ ID NO: 439094 - RNA, 64 nt, hsa
uuguaguuuacuauuuacccuaaaacuuucugugucuggguacccucugaguaggccuauaauu

SEQ ID NO: 439095 - RNA, 64 nt, hsa
guguccuggaugcccauuauauuguuuucuccuuucuggguaacaagcccuaacuucuguaauu

SEQ ID NO: 439096 - RNA, 64 nt, hsa
acuucauuucaaaugaaguuaauuaauuuacauuucuggguaaaaacugguucuauaaauuaag

SEQ ID NO: 439097 - RNA, 64 nt, hsa
gggcacagucaccccaggccuugcugagcccaggucuggguacugaguguccagagcugccucc

SEQ ID NO: 439098 - RNA, 64 nt, hsa
auucuuugaguucuuaaaaguccuucauacaccuucuggguagggaaacaaccaacuaauugac

SEQ ID NO: 439099 - RNA, 64 nt, hsa
gcuggggggguggggggcaguggauggugcccuaucuggguagagguagugugaguguggugug

SEQ ID NO: 439100 - RNA, 64 nt, hsa
caacucaggugcaugauacaaggagagguugucaucuggguagggcagagaggagggcuugcuc

SEQ ID NO: 439101 - RNA, 64 nt, hsa
uagguaguaguaaguaugugccacaggcugauuaucuggguaaucuuuuacgggugggagguga

SEQ ID NO: 439102 - RNA, 64 nt, hsa
cugucggaguggucucugguagaacccaaggacuucuggguacugagaagcagcagcagaauga

SEQ ID NO: 439103 - RNA, 64 nt, hsa
guaauuaaaauauacuuaaaaauuaauaguuuuaucuggguacaaauaaacaggugccugaacu

SEQ ID NO: 439104 - RNA, 64 nt, hsa
auaaaaacccauggaaaugguuuaagaaaaugguucuggguacaccagaaauuuguuugccuga

SEQ ID NO: 439105 - RNA, 64 nt, hsa
ccuucugacaccagcucccuguggaggccugguuucuggguaaugccucccuugggcaucuuca

SEQ ID NO: 439106 - RNA, 64 nt, hsa
guccccccacccucauucuacugaaaaggaggggucuggguacuucuugaaggugcugacggcc

SEQ ID NO: 439107 - RNA, 64 nt, hsa
cucagaauuuuauuccaggcuagcuugcugcaggucuggguaguuggaucauggcuccacuggg

SEQ ID NO: 439108 - RNA, 64 nt, hsa
augcucgugguagaacccaucaaucaucugguccucuggguacuggugagcaucccuggucuuc

SEQ ID NO: 439109 - RNA, 64 nt, hsa
cucaggcuucaggcccacuuguugaacagaacaaucuggguagcaacagcaucuuccacaguuu

SEQ ID NO: 439110 - RNA, 64 nt, hsa
uucgcuucucccuggacugggcccugauucucccucuggguaaccagucccaggugaaccacac

SEQ ID NO: 439111 - RNA, 64 nt, hsa
aguagcucuuaggaaaauauaucuuccuccugagucuggguaauuauaccucucccaagccccc

SEQ ID NO: 439112 - RNA, 64 nt, hsa
augaagaauaugagucauucaauaacaaugagcaucuggguacagacaguaaagcccuuugauu

SEQ ID NO: 439113 - RNA, 64 nt, hsa
cuuuggaggugccuauuuuuucugcuguaauuguucuggguagauggaguauaaacauuugaau

SEQ ID NO: 439114 - RNA, 64 nt, hsa
aaaaacgaaaaccaaacgagcgagaaguugaaguucuggguaucaaagcuaguuguucugucug

SEQ ID NO: 439115 - RNA, 64 nt, hsa
ucaaucauagccaagaucccaucccuccauguacucuggguaucagcaacuguccucaucaguc

SEQ ID NO: 439116 - RNA, 64 nt, hsa
cuucuauaaauucuuagguuuagagaugauaccaucuggguaccuuugcuugaaccgugcaacc

SEQ ID NO: 439117 - RNA, 64 nt, hsa
cauuaacugaggguaauuacaguaguagacauggucuggguacuauacuaccauguuuauuugc

SEQ ID NO: 439118 - RNA, 64 nt, hsa
uagacauuaggaguggaucggaauacuucugcuuucuggguaaaacuuaaaaguuuacuauuuc

SEQ ID NO: 439119 - RNA, 64 nt, hsa
ggacagcuaagacugagcauagcaguucacauggucuggguaaacaagucacuggcacagggga

SEQ ID NO: 439120 - RNA, 64 nt, hsa
gcccagguuucuggucucuaggcuggggaaguccucuggguaggaaucagcaagaagauccuaa

SEQ ID NO: 439121 - RNA, 64 nt, hsa
ugcagugagccgaggucgcaccacugcacuccagucuggguaacagagcgagacuuucuagaaa

SEQ ID NO: 439122 - RNA, 64 nt, hsa
gccauuucucacuagcacuauauaugauuugggcucuggguaauuuggaaguguuagguuugug

SEQ ID NO: 439123 - RNA, 64 nt, hsa
gauugguggaauggagaacacacguguuggugcuucuggguagcacugguuugcauuaguuuau

SEQ ID NO: 439124 - RNA, 64 nt, hsa
cacgauuggguaucacucacaguuugccuuuuuuucuggguaauguuuuuuggauuuuagccaa

SEQ ID NO: 439125 - RNA, 64 nt, hsa
ccuuguucccuuccaccccuccaguuagucccuaucuggguaagggucuucccuugagcuccag

SEQ ID NO: 439126 - RNA, 64 nt, hsa
cgacuugaaacuuccuacauguucucuaacuguaucuggguaaaaaggugcgcgccagcugugg

SEQ ID NO: 439127 - RNA, 64 nt, hsa
cuuagccuggauuuccuucuaacauguuaucaaaucuggguaucuuuccaggcuucccugacuu

SEQ ID NO: 439128 - RNA, 64 nt, hsa
guaacuuugauagaugguuugucaaauguaucuuucuggguauccacaccucuuggcaaugaaa

SEQ ID NO: 439129 - RNA, 64 nt, hsa
gccugagccuuccuggagccaggaccuggauuccucuggguagagggcaacgccugcagccccu

SEQ ID NO: 439130 - RNA, 64 nt, hsa
gacaggaaguauuguuucagucacagaaagcuuuucuggguaccucugguuagcacuuucuacu

SEQ ID NO: 439131 - RNA, 64 nt, hsa
aggaggcggaggcgcuccucccugccucaguggcucuggguaccugcaagcagaacuuccaaag

SEQ ID NO: 439132 - RNA, 64 nt, hsa
ugugcuccacagcucaccugcuugccaagguacgucuggguaguaguuucuggaaaugacugca

SEQ ID NO: 439133 - RNA, 64 nt, hsa
gagccacagccuagggguuggaggaagacuccacucuggguacacccuuaggggcuggcuuuau

SEQ ID NO: 439134 - RNA, 64 nt, hsa
agucuccucaccuugaggggucuuuaguaaugcaucuggguagcaucucaacugcugguagcau

SEQ ID NO: 439135 - RNA, 64 nt, hsa
acuucagagucuuucaugccagcguuugagcuccucuggguaaaaucuucccuuuguugacugg

SEQ ID NO: 439136 - RNA, 64 nt, hsa
auggcccuggccagagcucagcaugggcagggguucuggguaggacggucacuguccucucucc

SEQ ID NO: 439137 - RNA, 64 nt, hsa
ucaccaauggccaaaacuccucucaacggugaccucuggguaguccuggcaugccaacaucagc

SEQ ID NO: 439138 - RNA, 64 nt, hsa
guauggaagcaagugugggaugggucuuugccuuucuggguagggagcugucuaauccaagucc

SEQ ID NO: 439139 - RNA, 64 nt, hsa
cucuggggcuucugcuguccuuuggagggugucuucuggguagagggaugggaaggaagggacc

SEQ ID NO: 439140 - RNA, 64 nt, hsa
accacuguguacuggagccugcauuaugcacgugucuggguaucuuuguauauauguguauaua

SEQ ID NO: 439141 - RNA, 64 nt, hsa
ccaaggaugucagauuagaaaauagcaucccaccucuggguaucugaguggcucugaaguugca

SEQ ID NO: 439142 - RNA, 64 nt, hsa
auuaugccaugguugcuuuugagauagauuguagucuggguagcaucuuuaaaauguauguggg

SEQ ID NO: 439143 - RNA, 64 nt, hsa
aggaaauuauuuugauuaaauauauuuuauuugaucuggguauuuuuggaccacauuauuaaau

SEQ ID NO: 439144 - RNA, 64 nt, hsa
ccuccagccaagcagcccuucaaguucuuuuauuucuggguaacagaaguagacagacagguua

SEQ ID NO: 439145 - RNA, 64 nt, hsa
cuucaaugguuuguuaguugccauuacaacuuugucuggguagaguuuuugaguuuuugcaguu

SEQ ID NO: 439146 - RNA, 64 nt, hsa
cuaagcaacguggcuuaguccaucagcaucuuauucuggguaauaaaaaauaaaaauaaacgga

SEQ ID NO: 439147 - RNA, 64 nt, hsa
uguuuuuguguuuauguuaggaucugaaucauguucuggguaaggggacgaggagcgaacacug

SEQ ID NO: 439148 - RNA, 64 nt, hsa
auucucccccucucccugagaguccccugcaguuucuggguaacagggcacaccccucuaguuu

SEQ ID NO: 439149 - RNA, 64 nt, hsa
cugagaagaccaggaacaaaguucucuuggcagaucuggguaaugugugugucucacauuuuua

SEQ ID NO: 439150 - RNA, 64 nt, hsa
agagcagggaggcuuggggaggggaaaauuuagcucuggguagcucuuaaaucuuagccucagu

SEQ ID NO: 439151 - RNA, 64 nt, hsa
uuuuguuucuuuaacaaaaaguuauagaaauuucucuggguauuguguugaaucuacaucacau

SEQ ID NO: 439152 - RNA, 64 nt, hsa
guccagacaagagucacuggccccugcuccagcuucuggguauccagagagcacugcacuuccc

SEQ ID NO: 439153 - RNA, 64 nt, hsa
uuuuggcuugcaaaauauuuuuguaauaaagauuucuggguaauaaugaguccuuccgguguuc

SEQ ID NO: 439154 - RNA, 64 nt, hsa
cacaucaugacccuuucuggcagccucuuggugcucuggguagugagggaugaccagucuuguc

SEQ ID NO: 439155 - RNA, 64 nt, hsa
gugugcuguuugaauugacuauuugcacucaaagucuggguauucauugguuauuggccugaaa

SEQ ID NO: 439156 - RNA, 64 nt, hsa
cuugucaccugcuugcaaaggguauagacaucauucuggguaguucuagaggauaucgcaacaa

SEQ ID NO: 439157 - RNA, 64 nt, hsa
agggcauuccuccccacucugucuccaggcugccucuggguagccucuagucugcuguucuuca

SEQ ID NO: 439158 - RNA, 64 nt, hsa
aauuauuugaaugccugccaggagccagauuuguucuggguauuaggaauacacugguuaacag

SEQ ID NO: 439159 - RNA, 52 nt, hsa
ugcacggggcacugcccugagcucuggguaaggacgagaagagccaaggucc

SEQ ID NO: 439160 - RNA, 64 nt, hsa
agguuggagggggcacuuagcagugaaccuuaagucuggguacauguaacccugcugaggggcu

SEQ ID NO: 439161 - RNA, 64 nt, hsa
aggugcagagguucugagggacccaggcucuuccucuggguaaaggucuguaagaaggggcugg

SEQ ID NO: 439162 - RNA, 64 nt, hsa
caaggcccaaaugcuggaccacaucuccugcuguucuggguaaccuugagcuauguaugacaca

SEQ ID NO: 439163 - RNA, 64 nt, hsa
cauuuagaucaucuaaaucagguaugagugaaacucuggguauggucuuuccugaggccaaauu

SEQ ID NO: 439164 - RNA, 64 nt, hsa
guuaguuacuuauauuuuuauuagaacucauuauucuggguacccuccaaugagaauuagagag

SEQ ID NO: 439165 - RNA, 64 nt, hsa
auaaagaaaaaaacaauauuggauuuggauuuaaucuggguaaaaucagccuucugagaagggc

SEQ ID NO: 439166 - RNA, 64 nt, hsa
ugcaaagccacagucaugaagagaccauggugugucuggguaacugugagcaguuuauguaacu

SEQ ID NO: 439167 - RNA, 64 nt, hsa
acaguacuuauguucccaaguagcaucaucaucuucuggguaguaauuacauugugguauuaau

SEQ ID NO: 439168 - RNA, 64 nt, hsa
uuuaauuuuauaaaauuuaaucaugcuucuuuugucuggguaauagacauuggacagauauuuu

SEQ ID NO: 439169 - RNA, 64 nt, hsa
cagguggaauagaagaaaucgugaugaaauaauuucuggguagauccuguguccuagugacugu

SEQ ID NO: 439170 - RNA, 58 nt, hsa
caaggcaaaguguugucugauucuauuuucuggguauuuuaggaagaguugggaguug

SEQ ID NO: 439171 - RNA, 64 nt, hsa
ugaagagauuucaaagaauugucagcuugugguuucuggguauaaguggcuuguuucguucuua

SEQ ID NO: 439172 - RNA, 64 nt, hsa
gaagaaaauagcagacguuuccccucucucuaacucuggguaucccacagaugcaaaagggaga

SEQ ID NO: 439173 - RNA, 64 nt, hsa; identical to SEQ ID NO: 391125

SEQ ID NO: 439174 - RNA, 64 nt, hsa; identical to SEQ ID NO: 391126

SEQ ID NO: 439175 - RNA, 64 nt, hsa; identical to SEQ ID NO: 391127

SEQ ID NO: 439176 - RNA, 64 nt, hsa; identical to SEQ ID NO: 391128

SEQ ID NO: 439177 - RNA, 64 nt, hsa; identical to SEQ ID NO: 391129

SEQ ID NO: 439178 - RNA, 64 nt, hsa; identical to SEQ ID NO: 391130

SEQ ID NO: 439179 - RNA, 64 nt, hsa; identical to SEQ ID NO: 391131

SEQ ID NO: 439180 - RNA, 64 nt, hsa; identical to SEQ ID NO: 391132

SEQ ID NO: 439181 - RNA, 64 nt, hsa; identical to SEQ ID NO: 391133

SEQ ID NO: 439182 - RNA, 64 nt, hsa; identical to SEQ ID NO: 391134

SEQ ID NO: 439183 - RNA, 64 nt, hsa; identical to SEQ ID NO: 391135

SEQ ID NO: 439184 - RNA, 64 nt, hsa; identical to SEQ ID NO: 391136

SEQ ID NO: 439185 - RNA, 64 nt, hsa; identical to SEQ ID NO: 391137

SEQ ID NO: 439186 - RNA, 64 nt, hsa; identical to SEQ ID NO: 391138

SEQ ID NO: 439187 - RNA, 64 nt, hsa; identical to SEQ ID NO: 391139

SEQ ID NO: 439188 - RNA, 64 nt, hsa; identical to SEQ ID NO: 391140

SEQ ID NO: 439189 - RNA, 64 nt, hsa
aucccugagagucucuguuucaucaggacauucugaaauuuacccacagugaggcuguggaugg

SEQ ID NO: 439190 - RNA, 64 nt, hsa
gcuuagauuuaaaagcaucaaaacaacaacaauggaaauuuauguuggcgauagccaagaccac

SEQ ID NO: 439191 - RNA, 64 nt, hsa
gaaaaaaccugagaagaaagggagaaaagaccaugaaauuuaccagauaacacuuuuuaagacu

SEQ ID NO: 439192 - RNA, 64 nt, hsa
uaggagccacgugagugaaaguuuuaagaaaaaugaaauuuaugucauacuuauuuuuuuagua

SEQ ID NO: 439193 - RNA, 64 nt, hsa
gcuuuauguuaccaaaacauacaguaaaaaaguagaaauuuaugaaauacuuuugauaaaaagu

SEQ ID NO: 439194 - RNA, 64 nt, hsa
auacuuuuuaaccaaucucuguggcuucacucaugaaauuuacuucaguuaauaugagacuggg

SEQ ID NO: 439195 - RNA, 64 nt, hsa
aggauaagcauuuugcucuuuuuaagaacagcaugaaauuuagaauaccaaugauagcuaucuu

SEQ ID NO: 439196 - RNA, 64 nt, hsa
ugauagcuaucuuuaagaaucagaauuaguacuagaaauuuaaaaaacccuauaguuuggaguu

SEQ ID NO: 439197 - RNA, 64 nt, hsa
gggcuggaaaaauguagaacguuuuuauauucuagaaauuuauuuuggaaguacauuuuuauaa

SEQ ID NO: 439198 - RNA, 64 nt, hsa
acaugaucaucaaguuaauugguaaauuuuuauugaaauuuaaaacuugcauuuuuauauaugu

SEQ ID NO: 439199 - RNA, 64 nt, hsa
gcauacaucaugauuauggcaaagaggagagaaagaaauuuauuuuacauugacauugcauugc

SEQ ID NO: 439200 - RNA, 64 nt, hsa
ucauauauuuuagcauauucgaacuaauuucuaagaaauuuaguuauaacucuauguaguuaua

SEQ ID NO: 439201 - RNA, 64 nt, hsa
agaauacgacagacuggguaauuuaaaaagaaaagaaauuuauuuucuuccuaguucuggaggc

SEQ ID NO: 439202 - RNA, 64 nt, hsa
uuuucuauuuugcauauuuucaggcaugguaacagaaauuuaccuuuuaauaaauuaaaaaauc

SEQ ID NO: 439203 - RNA, 64 nt, hsa
gacuuuuaagaaaugcuaacagauuuuucuggaggaaauuuagacaaaacaaugucauuuagua

SEQ ID NO: 439204 - RNA, 64 nt, hsa
uaugcauacacagaugcauauguguauauauaaugaaauuuauguugcugguauuuugcauuuu

SEQ ID NO: 439205 - RNA, 64 nt, hsa
cuugcuacuauagcgucuuauguaugguuuaaaggaaauuuaucaggugagagagaugagcaac

SEQ ID NO: 439206 - RNA, 64 nt, hsa
uugauacuuagucaugggaggauauuacaaaaaagaaauuuaaauuguguucauagucuuucag

SEQ ID NO: 439207 - RNA, 64 nt, hsa
aggccagaacuauagucauacucacacaaagggagaaauuuaaacucgaaccaagcaaaaggcu

SEQ ID NO: 439208 - RNA, 64 nt, hsa
ucucuaagggacaggauuuuccagauccuaauuggaaauuuagcaauaaggagaggaguccaag

SEQ ID NO: 439209 - RNA, 64 nt, hsa
ucuauucccaugccagaaucuuaucaauacauaagaaauuuaggaagauuaggugccaaaauac

SEQ ID NO: 439210 - RNA, 64 nt, hsa
gucccucaacuuggcuaaagaaucucaaucucuugaaauuuauuuuuuuaaugucauauucauc

SEQ ID NO: 439211 - RNA, 64 nt, hsa
cugaagcuaauaauguuuuauguuuugauuuuuugaaauuuaauuguagaagucacugccuucu

SEQ ID NO: 439212 - RNA, 64 nt, hsa
aaauguuaacaaaauauaucuuaacagauuacaugaaauuuaggaauuauuuaaaaguuaccau

SEQ ID NO: 439213 - RNA, 64 nt, hsa
aguuucuguaaaagaagagacauuaagaguuccugaaauuuauaucuggcauacggauaggcuu

SEQ ID NO: 439214 - RNA, 64 nt, hsa
guuaaccucagcugugaucuuauguauguaaagugaaauuuaaauagauaauuauagguugauu

SEQ ID NO: 439215 - RNA, 64 nt, hsa
aauauauuuucaucucuucuuguuaaauugggaggaaauuuaugauagcaauuaugaagauugu

SEQ ID NO: 439216 - RNA, 64 nt, hsa
uaguucaacaugaacuaaaauggcaugcuauuuggaaauuuaguuugagauaaacuaaagugug

SEQ ID NO: 439217 - RNA, 64 nt, hsa
aaaccagcacuuggccaaaaacaaaauuguaaaggaaauuuaaauucuggagaauucuacaggg

SEQ ID NO: 439218 - RNA, 64 nt, hsa
gaacugucuucucagcaguugauccagcuguacggaaauuuaggguauuuaaacuuuuaaagga

SEQ ID NO: 439219 - RNA, 64 nt, hsa
aagguggaugguaccuuauggcaaaaaucucucagaaauuuaugugugguuuuaaagucauucc

SEQ ID NO: 439220 - RNA, 64 nt, hsa
aucucugggacacauuuaaagcaguguguagagggaaauuuauagcacuaaaugcccacaaggg

SEQ ID NO: 439221 - RNA, 64 nt, hsa
ucuuuuagacuuuuaaggacaauuuacagcaaaugaaauuuaugaugcugugacaagaaauuua

SEQ ID NO: 439222 - RNA, 64 nt, hsa
uuuacagcaaaugaaauuuaugaugcugugacaagaaauuuaaagaaucaaaacgaugguuuga

SEQ ID NO: 439223 - RNA, 64 nt, hsa
aguaugauucuuuauuuuuacuuuuucauuucaagaaauuuagaguuuccaaauuuagagcuuc

SEQ ID NO: 439224 - RNA, 64 nt, hsa
caaagucauuuagggguaauaaauacuuggcuuggaaauuuaacacaguccuuuugucuccaaa

SEQ ID NO: 439225 - RNA, 64 nt, hsa
aaaaucaaaauaauauucugugacaaugacaggugaaauuuauaugugacaagugaaaauuaua

SEQ ID NO: 439226 - RNA, 64 nt, hsa
ggugaaauuuauaugugacaagugaaaauuauaugaaauuuaagaguccauaaauaaaauuugu

SEQ ID NO: 439227 - RNA, 64 nt, hsa
auguaauacuugaguagauuuuuuuuucuaguuugaaauuuagucugucuuuuugaccuuacua

SEQ ID NO: 439228 - RNA, 64 nt, hsa
auuuuugcuuuuacuucaaauguuauuuaaaguagaaauuuaauuuguagauauaaccuuuaaa

SEQ ID NO: 439229 - RNA, 64 nt, hsa
agugaugaucugacauuuacaauuaccccacauggaaauuuagggguuucugaaucaagcuuaa

SEQ ID NO: 439230 - RNA, 64 nt, hsa
uaauacucaagguuguaaaaccccucaaagccuagaaauuuaauuguuauggcugaaauuccuc

SEQ ID NO: 439231 - RNA, 64 nt, hsa
uuagguacagucuggaucauggcauguagaaauagaaauuuagaauuuuacugcagcuuugaug

SEQ ID NO: 439232 - RNA, 64 nt, hsa
uauguuuuuauguaaucagucauuacacuagggagaaauuuaucagcuuuaguucuaaauaugc

SEQ ID NO: 439233 - RNA, 64 nt, hsa
aaauacagauuauuuauuaacucuguucugccuggaaauuuaggcuucauacggaaaguguuug

SEQ ID NO: 439234 - RNA, 64 nt, hsa
uucuuauguacaaggaacaacaauaaaucauauggaaauuuauauuuauacuuacuguauccau

SEQ ID NO: 439235 - RNA, 64 nt, hsa
auauacauccuucccuauuauguguaugcaaauagaaauuuauaagcauuuuacuacaaguuaa

SEQ ID NO: 439236 - RNA, 64 nt, hsa
uuucugucacuauagauuaauuugcauuuuuaaagaaauuuacauacauggaaccauacaucau

SEQ ID NO: 439237 - RNA, 64 nt, hsa
gaucucaaauagcaugaguguaugucuauauccugaaauuuauugucuaaaaugcaugaauaua

SEQ ID NO: 439238 - RNA, 64 nt, hsa
cagcuguaauuuuucuauaauucucuguaugacagaaauuuaaccaagugcaguugucuugauu

SEQ ID NO: 439239 - RNA, 64 nt, hsa
aagaagauaaauaauuguguaauuaaacuuuccagaaauuuaucuuccucaugugcaguuuaac

SEQ ID NO: 439240 - RNA, 64 nt, hsa
acuacauauauauuuagaggaagaaagugaaggggaaauuuaaaauguuuacggcgcuuaauug

SEQ ID NO: 439241 - RNA, 64 nt, hsa
aucugcucaguaauauaauuugccauuuuuauuagaaauuuaauuucuucaugugaugucauga

SEQ ID NO: 439242 - RNA, 64 nt, hsa
uggguagggggaaaugaccuuuuuacaagagagugaaauuuaggucagggaaaagaccaagggc

SEQ ID NO: 439243 - RNA, 64 nt, hsa
caacagagcgagacucagucucaaaaagaaaaaagaaauuuauugcugaucacaaggacagaca

SEQ ID NO: 439244 - RNA, 64 nt, hsa
gugugaauuaauaagaaaugggguaaauagaaaagaaauuuauugcugauuggccaggugcggu

SEQ ID NO: 439245 - RNA, 64 nt, hsa
cuuaguaaauguaauaaauuauuuuuuagaucuugaaauuuauaauaaaaauacuuuaccuacc

SEQ ID NO: 439246 - RNA, 64 nt, hsa
ccaaaaccugauguuuuaaaugugcuuucuuuuugaaauuuauguuuucaaauaaaaucucccu

SEQ ID NO: 439247 - RNA, 64 nt, hsa
gucaguggccuuucaccaguggagcugccuucccagggagaaggagccgugcgccagggcaggg

SEQ ID NO: 439248 - RNA, 64 nt, hsa
ucucuccugagccuccucuugaugcaagcucuaaagggagaagucaggcccugccucuccaggg

SEQ ID NO: 439249 - RNA, 64 nt, hsa
uucaggggugguaaggacucugguaccagggaagagggagaauuaauuuauugugcaaaugcug

SEQ ID NO: 439250 - RNA, 64 nt, hsa
aagugagggaaaucaggucuuuauugauaaaguuagggagaagauugaugcaauaggacaauuu

SEQ ID NO: 439251 - RNA, 64 nt, hsa
aaucuuauguaaauaaccuuaggcaugaguccuuagggagaaguuaaugaccauuguuaaagug

SEQ ID NO: 439252 - RNA, 64 nt, hsa
ugaaaguauaaaugaaugggccaugaguguucagagggagaaaagaaagguuuaauauacuccu

SEQ ID NO: 439253 - RNA, 64 nt, hsa
aggcucucccaggggcugauggggggguucugugagggagaaucagggcucgggaagccacgcc

SEQ ID NO: 439254 - RNA, 64 nt, hsa
cggcauggaggguggugugaguuccucuggugggagggagaacgcacaucucuucugggcggcc

SEQ ID NO: 439255 - RNA, 64 nt, hsa
cuguuuucugugucuagugccaauuagcuaaaucagggagaaagaaaugaucacaugacuuuua

SEQ ID NO: 439256 - RNA, 64 nt, hsa
cacugucuaaguuuauguugcauuuuuagucaaaagggagaaaucuuauuccuucuugaaaauu

SEQ ID NO: 439257 - RNA, 64 nt, hsa
agggcaccaccuucaaggcacagcccuuguugggagggagaacccucuccagaaacccugccac

SEQ ID NO: 439258 - RNA, 64 nt, hsa
uugguuuccucucugcucugccccugcucagcacagggagaauguugacuuagaagcaauaggg

SEQ ID NO: 439259 - RNA, 64 nt, hsa
auggacaauaaaguaguauaugauccucagauacagggagaaggacaaggcauacagcuuauug

SEQ ID NO: 439260 - RNA, 64 nt, hsa
acuuugaagauaggaauaucuaaauuauaucucuagggagaaaauguuguaaaaaauuaaaagu

SEQ ID NO: 439261 - RNA, 64 nt, hsa
caaucggccuauuggcucaaugggaagagaggagagggagaaaaauaaaaugaaaggaaaaaaa

SEQ ID NO: 439262 - RNA, 64 nt, hsa
cacaucacuggaaucugcaauucaagaagugacaagggagaauucuugcuuuaccuauggacug

SEQ ID NO: 439263 - RNA, 64 nt, hsa
aaaggcccggcccaggaccacugugagcuggaaaagggagaaaggcagugggaaaagaggugag

SEQ ID NO: 439264 - RNA, 64 nt, hsa
ccccauucccucuuuaucuaucaacucuaggacaagggagaacaaaagcaagccagaagcagag

SEQ ID NO: 439265 - RNA, 64 nt, hsa
cucaagacuguuagccuggcagagccaggggugaagggagaagcucuuggagcaggcaggaugc

SEQ ID NO: 439266 - RNA, 64 nt, hsa
ucccaugguguucugacuucaagggcuggcagccagggagaaugggcccaggggaagcaaagac

SEQ ID NO: 439267 - RNA, 64 nt, hsa
uugacaccugacucugagcuggaacaguaggggcagggagaagacaggucucaagaaaagguuu

SEQ ID NO: 439268 - RNA, 64 nt, hsa
aaaagaaagucuucugggauuuauagaucaauuuagggagaaaugacauuuuaacaauucugag

SEQ ID NO: 439269 - RNA, 64 nt, hsa
uggucuugugucuuaagacagcugcugugaccaaagggagaauggagauaacagggguggcagg

SEQ ID NO: 439270 - RNA, 64 nt, hsa
gacucaaaccaggaauuuccaaagauuucaagccagggagaaggguucuuggugaugcagggca

SEQ ID NO: 439271 - RNA, 64 nt, hsa
cuuugagccuccugccccugcuuucugcccagggagggagaaggaagagggggagcugguuuuu

SEQ ID NO: 439272 - RNA, 64 nt, hsa
gcaagugcucuggggaugaggcauggguauaggaagggagaaaggaguuggagacaagauccuc

SEQ ID NO: 439273 - RNA, 64 nt, hsa
caaccgccaaauuguuucagagcagaaaagaaaaagggagaaaaccucuuagcaaagcccugug

SEQ ID NO: 439274 - RNA, 64 nt, hsa
gcugguggcugggacccuccaggggugagaaggaagggagaagguggcauaacuuuuuggaaca

SEQ ID NO: 439275 - RNA, 64 nt, hsa
cugagcugcugugaaagccccugcacaaucagccagggagaacugggcggguuuaguggcccca

SEQ ID NO: 439276 - RNA, 64 nt, hsa
gucuuaggccuacgaugccacacaaagguuguucagggagaagggggugcaggaggcagagggu

SEQ ID NO: 439277 - RNA, 64 nt, hsa
cuuuuaucauugcaggccaguggacagagggagaagggagaacaggggucgccaacacuugugu

SEQ ID NO: 439278 - RNA, 64 nt, hsa
ugcaugucuuuuaucauugcaggccaguggacagagggagaagggagaacaggggucgccaaca

SEQ ID NO: 439279 - RNA, 64 nt, hsa
cauuuaacaaaacuaaucuaaaaaagaacuaaaaagggagaacggggcaagggaccucaggcug

SEQ ID NO: 439280 - RNA, 64 nt, hsa
cccauuaaagaccgggcugguuagcguccagcucagggagaagggcgcuagugccuaaccucac

SEQ ID NO: 439281 - RNA, 64 nt, hsa
cgggcuccugggcccuguucuuaggaucaguggcagggagaaacggguaucucuuuucucucuu

SEQ ID NO: 439282 - RNA, 64 nt, hsa
cacucugagguuuccccaagagaaccagauuggcagggagaagcauuguggggcaauuguuccu

SEQ ID NO: 439283 - RNA, 64 nt, hsa
gguggggagggaggaaaggguaggaagggugggaagggagaagcagacauagucauuuaugauu

SEQ ID NO: 439284 - RNA, 64 nt, hsa
uccacugguugacauggcagcaguuacuggcaagagggagaaaggacgcugccgccuaagagug

SEQ ID NO: 439285 - RNA, 64 nt, hsa
aguguccucagccgacacucacgagggcagugcaagggagaaccugccagcccagccccaccac

SEQ ID NO: 439286 - RNA, 64 nt, hsa
auggucaugaaagcgugguucuguaagaaaucagagggagaaagggagagaagggggagggaga

SEQ ID NO: 439287 - RNA, 64 nt, hsa
guccucuacaucaauuaacaucgugggucacuacagggagaaaauccaggucaugcaguuccug

SEQ ID NO: 439288 - RNA, 64 nt, hsa
auguuguguggcaaugggauuugggcuacccuaaagggagaaggaagggcagagaauggcuggg

SEQ ID NO: 439289 - RNA, 64 nt, hsa
uauuguguaacaaguacugcucccagcagcaauuagggagaaaacuagucuaaauuauuucaac

SEQ ID NO: 439290 - RNA, 64 nt, hsa
gguuacaccacuccuucguccuuacaggagauguagggagaagaaucugcaggcugcuuguagg

SEQ ID NO: 439291 - RNA, 64 nt, hsa
uaaaccagguaauugaaugaagaaaggucacuaaagggagaaaugacauguuuucuauuuucuu

SEQ ID NO: 439292 - RNA, 64 nt, hsa
ugccaucuuaaucacagaccucaggggcuccaacagggagaaaaaacaaucacuggucuugucu

SEQ ID NO: 439293 - RNA, 64 nt, hsa
aagccugauacuuuagccaucauaacucacuaacagggagaaguagcuaguagcaaugugccuu

SEQ ID NO: 439294 - RNA, 64 nt, hsa
cagagugacagucauaaauacugucaaacaauaaagggagaauggugcuguuuaaagucacauc

SEQ ID NO: 439295 - RNA, 64 nt, hsa
uaaaccucaucuuguacuaaaggaggacacacucagggagaagaccucugugggcagggcuugu

SEQ ID NO: 439296 - RNA, 64 nt, hsa
auguaugggcaaagcuuuugugaucacacaccacagggagaaucugcauguggggacacugugg

SEQ ID NO: 439297 - RNA, 64 nt, hsa
ucugccuggccgugcugaaccucugcuggucccaagggagaagggagugagcgugggucaccug

SEQ ID NO: 439298 - RNA, 64 nt, hsa
auaugcacugaugaggaaagacauacugugugauagggagaaaaagcagcuuauaaaauaaugu

SEQ ID NO: 439299 - RNA, 64 nt, hsa; identical to SEQ ID NO: 295046

SEQ ID NO: 439300 - RNA, 64 nt, hsa; identical to SEQ ID NO: 295047

SEQ ID NO: 439301 - RNA, 64 nt, hsa; identical to SEQ ID NO: 295048

SEQ ID NO: 439302 - RNA, 64 nt, hsa; identical to SEQ ID NO: 295049

SEQ ID NO: 439303 - RNA, 64 nt, hsa; identical to SEQ ID NO: 295050

SEQ ID NO: 439304 - RNA, 64 nt, hsa; identical to SEQ ID NO: 295051

SEQ ID NO: 439305 - RNA, 64 nt, hsa; identical to SEQ ID NO: 295052

SEQ ID NO: 439306 - RNA, 64 nt, hsa; identical to SEQ ID NO: 295053

SEQ ID NO: 439307 - RNA, 64 nt, hsa; identical to SEQ ID NO: 295054

SEQ ID NO: 439308 - RNA, 64 nt, hsa; identical to SEQ ID NO: 295055

SEQ ID NO: 439309 - RNA, 64 nt, hsa; identical to SEQ ID NO: 295056

SEQ ID NO: 439310 - RNA, 64 nt, hsa; identical to SEQ ID NO: 295057

SEQ ID NO: 439311 - RNA, 64 nt, hsa; identical to SEQ ID NO: 295058

SEQ ID NO: 439312 - RNA, 64 nt, hsa; identical to SEQ ID NO: 295059

SEQ ID NO: 439313 - RNA, 64 nt, hsa; identical to SEQ ID NO: 295060

SEQ ID NO: 439314 - RNA, 64 nt, hsa; identical to SEQ ID NO: 295061

SEQ ID NO: 439315 - RNA, 64 nt, hsa; identical to SEQ ID NO: 295062

SEQ ID NO: 439316 - RNA, 64 nt, hsa; identical to SEQ ID NO: 295063

SEQ ID NO: 439317 - RNA, 64 nt, hsa; identical to SEQ ID NO: 295064

SEQ ID NO: 439318 - RNA, 64 nt, hsa; identical to SEQ ID NO: 295065

SEQ ID NO: 439319 - RNA, 64 nt, hsa; identical to SEQ ID NO: 295066

SEQ ID NO: 439320 - RNA, 64 nt, hsa; identical to SEQ ID NO: 295067

SEQ ID NO: 439321 - RNA, 64 nt, hsa; identical to SEQ ID NO: 295068

SEQ ID NO: 439322 - RNA, 64 nt, hsa; identical to SEQ ID NO: 295069

SEQ ID NO: 439323 - RNA, 64 nt, hsa; identical to SEQ ID NO: 295070

SEQ ID NO: 439324 - RNA, 64 nt, hsa; identical to SEQ ID NO: 295071

SEQ ID NO: 439325 - RNA, 64 nt, hsa; identical to SEQ ID NO: 295072

SEQ ID NO: 439326 - RNA, 64 nt, hsa; identical to SEQ ID NO: 295073

SEQ ID NO: 439327 - RNA, 64 nt, hsa; identical to SEQ ID NO: 295074

SEQ ID NO: 439328 - RNA, 64 nt, hsa; identical to SEQ ID NO: 295075

SEQ ID NO: 439329 - RNA, 64 nt, hsa; identical to SEQ ID NO: 295076

SEQ ID NO: 439330 - RNA, 64 nt, hsa; identical to SEQ ID NO: 295077

SEQ ID NO: 439331 - RNA, 64 nt, hsa; identical to SEQ ID NO: 295078

SEQ ID NO: 439332 - RNA, 64 nt, hsa; identical to SEQ ID NO: 295079

SEQ ID NO: 439333 - RNA, 64 nt, hsa; identical to SEQ ID NO: 295080

SEQ ID NO: 439334 - RNA, 64 nt, hsa; identical to SEQ ID NO: 295081

SEQ ID NO: 439335 - RNA, 64 nt, hsa; identical to SEQ ID NO: 295082

SEQ ID NO: 439336 - RNA, 64 nt, hsa; identical to SEQ ID NO: 295083

SEQ ID NO: 439337 - RNA, 64 nt, hsa; identical to SEQ ID NO: 295084

SEQ ID NO: 439338 - RNA, 64 nt, hsa; identical to SEQ ID NO: 295085

SEQ ID NO: 439339 - RNA, 64 nt, hsa; identical to SEQ ID NO: 84084

SEQ ID NO: 439340 - RNA, 64 nt, hsa; identical to SEQ ID NO: 84085

SEQ ID NO: 439341 - RNA, 64 nt, hsa
gcacuacauguaaccuucaucuaguuaaccaaucgcaaagcaagggggaaguaaguacaaaugg

SEQ ID NO: 439342 - RNA, 64 nt, hsa
agauuuauuuuuaauauguugacuuuauuucugagcaaagcaucggucauguguguauuuuuuc

SEQ ID NO: 439343 - RNA, 64 nt, hsa
aucaacaaauauauuuauuggagaccgacuuugugcaaagcaaugcuaaucaggguucuccaug

SEQ ID NO: 439344 - RNA, 64 nt, hsa
uauuccgaggaguagagaggcagaagagaugucagcaaagcaagugaugaagcagaguggaugu

SEQ ID NO: 439345 - RNA, 64 nt, hsa
ucuagauuggagugcugcacaaacaaacauaagagcaaagcaaaacuguaucacauaggguuuu

SEQ ID NO: 439346 - RNA, 64 nt, hsa
aacuuuuauguuuacagggcacgucuguuguaaugcaaagcauauuuggcaagcaguucaucac

SEQ ID NO: 439347 - RNA, 64 nt, hsa
ugccuggagcacugcagagaugacuuuggagaaagcaaagcagugacccagugaccaggcacau

SEQ ID NO: 439348 - RNA, 64 nt, hsa
auccaagccuuacccagcugugcuacugucauuugcaaagcaaggaaauacuacuacugguaau

SEQ ID NO: 439349 - RNA, 64 nt, hsa
gaagaagccucaacuuacccaggaggagcuagaagcaaagcaagguuuguugauagcuuuuaaa

SEQ ID NO: 439350 - RNA, 64 nt, hsa
ucaacuuacccaggaggagcuagaagcaaagcaagcaaagcaaaagcuggaagaucgccucgca

SEQ ID NO: 439351 - RNA, 64 nt, hsa
gucauccaaguccaggucuagaucacacucaaaagcaaagcauucucuucccagugccuaucgg

SEQ ID NO: 439352 - RNA, 64 nt, hsa
aagaagaaucagaauguaccauaagaaaucagaugcaaagcacguuaaugucauugguaaguuu

SEQ ID NO: 439353 - RNA, 64 nt, hsa
acuauuuugucuuuuaguuuuaaacuuuuuuaaggcaaagcaagcuccccaaucccuguucucc

SEQ ID NO: 439354 - RNA, 64 nt, hsa
ggaucagaacucuccuaucugaaccuacugaggagcaaagcagcaauuacaugggauccugugg

SEQ ID NO: 439355 - RNA, 64 nt, hsa
ugauugcaccaacagguccagaguaugagugcaagcaaagcagaacucucaugcgugaccugag

SEQ ID NO: 439356 - RNA, 64 nt, hsa
cccucaggauggcgccuucagccucuccggcaaagcaaagcagaagcugcugaagcacggggug

SEQ ID NO: 439357 - RNA, 64 nt, hsa
ccaaacccucaggauggcgccuucagccucuccggcaaagcaaagcagaagcugcugaagcacg

SEQ ID NO: 439358 - RNA, 64 nt, hsa
aauuuggugcccauuaugaauuugaaguuaagugauagcucacuuguaaagugacuaccuuaau

SEQ ID NO: 439359 - RNA, 64 nt, hsa
gccauugggagguuuugaaaaaccaguuaauuuaauagcucaaaauugucccugauuuuauuuu

SEQ ID NO: 439360 - RNA, 64 nt, hsa
gcaugacaauuuuuagagcugcagguuagcuauuauagcucaagcuuuuuuguuuguuuuuuuc

SEQ ID NO: 439361 - RNA, 64 nt, hsa
uaugaauguaaugaguaugagggcaguuucagucauagcucagaucuuauccugcaacaagaag

SEQ ID NO: 439362 - RNA, 64 nt, hsa
cauguauguacugcaugugguaaagccuucagucauagcucagccauugcucagcaucagauaa

SEQ ID NO: 439363 - RNA, 64 nt, hsa
uucaauucucuaaaaucccagaacacaaucagaaauagcucaggcagacacuaauaauuaagaa

SEQ ID NO: 439364 - RNA, 64 nt, hsa
gcaagaggcuuaagagagaaacaccgaaauucagauagcucagggacugcuaacagagaacuac

SEQ ID NO: 439365 - RNA, 64 nt, hsa
gcacuguuacccaguguguauauaaugacuuguuauagcucagugugcccuugaauccauacag

SEQ ID NO: 439366 - RNA, 64 nt, hsa
cugcauuucaacucuucacuuccucagccuacaaauagcucauuagaugacauucacgcaugcu

SEQ ID NO: 439367 - RNA, 64 nt, hsa
ugauaauaaggcuaagugggagaguaccuguucaauagcucauauaucgaguacccugucauac

SEQ ID NO: 439368 - RNA, 64 nt, hsa
ugagguaguguuccacuggcaggaugacuuuucaauagcucaaaucaauuucagugccuuuauc

SEQ ID NO: 439369 - RNA, 64 nt, hsa
agaauaguaguuagguucccuaacacuaccgcugauagcucaccugggaacugaauccaccuaa

SEQ ID NO: 439370 - RNA, 64 nt, hsa
ucauauaacuuuaaaaauaauacuuuuagcucuaauagcucaagaacacaauauucguuaaugu

SEQ ID NO: 439371 - RNA, 64 nt, hsa
auucucuauuuuuauauugaaacauaauuacuugauagcucagggucuacauuucauucaacuu

SEQ ID NO: 439372 - RNA, 64 nt, hsa
cuugggaaucccuuccuuguguccuuaccaaaugauagcucauaaaacucugauaauguaacaa

SEQ ID NO: 439373 - RNA, 64 nt, hsa; identical to SEQ ID NO: 99128

SEQ ID NO: 439374 - RNA, 64 nt, hsa; identical to SEQ ID NO: 99129

SEQ ID NO: 439375 - RNA, 64 nt, hsa; identical to SEQ ID NO: 99130

SEQ ID NO: 439376 - RNA, 64 nt, hsa; identical to SEQ ID NO: 99131

SEQ ID NO: 439377 - RNA, 64 nt, hsa; identical to SEQ ID NO: 99132

SEQ ID NO: 439378 - RNA, 64 nt, hsa; identical to SEQ ID NO: 99133

SEQ ID NO: 439379 - RNA, 64 nt, hsa; identical to SEQ ID NO: 99134

SEQ ID NO: 439380 - RNA, 64 nt, hsa; identical to SEQ ID NO: 99135

SEQ ID NO: 439381 - RNA, 64 nt, hsa; identical to SEQ ID NO: 99136

SEQ ID NO: 439382 - RNA, 64 nt, hsa; identical to SEQ ID NO: 99137

SEQ ID NO: 439383 - RNA, 64 nt, hsa; identical to SEQ ID NO: 99138

SEQ ID NO: 439384 - RNA, 64 nt, hsa; identical to SEQ ID NO: 99139

SEQ ID NO: 439385 - RNA, 64 nt, hsa; identical to SEQ ID NO: 99140

SEQ ID NO: 439386 - RNA, 64 nt, hsa; identical to SEQ ID NO: 99141

SEQ ID NO: 439387 - RNA, 64 nt, hsa; identical to SEQ ID NO: 99142

SEQ ID NO: 439388 - RNA, 64 nt, hsa; identical to SEQ ID NO: 99143

SEQ ID NO: 439389 - RNA, 64 nt, hsa; identical to SEQ ID NO: 99144

SEQ ID NO: 439390 - RNA, 64 nt, hsa; identical to SEQ ID NO: 99145

SEQ ID NO: 439391 - RNA, 64 nt, hsa; identical to SEQ ID NO: 99146

SEQ ID NO: 439392 - RNA, 64 nt, hsa; identical to SEQ ID NO: 99147

SEQ ID NO: 439393 - RNA, 64 nt, hsa; identical to SEQ ID NO: 99148

SEQ ID NO: 439394 - RNA, 64 nt, hsa; identical to SEQ ID NO: 99149

SEQ ID NO: 439395 - RNA, 64 nt, hsa
cuauaacaaaagacagauugacaagagaaaaacaaacauaaauuuauuagcggguauauguaau

SEQ ID NO: 439396 - RNA, 64 nt, hsa
cuuguuauaguagucgguccaucaugaccaguaaaacauaaaucaaaaguuaauguaauuguua

SEQ ID NO: 439397 - RNA, 64 nt, hsa
gucugggaaacaaagcgagacccugucuccacuaaacauaaaaacaaaauuacuggggccccau

SEQ ID NO: 439398 - RNA, 64 nt, hsa
uuggaaaacaguuuggcaguuucucaaaggauuaaacauaaaauuaccauaggauucagcaguu

SEQ ID NO: 439399 - RNA, 64 nt, hsa
aagaaaaaugaagaaaaguaauuagaauauuuucaacauaaagaaaagacgaauauuuaaggug

SEQ ID NO: 439400 - RNA, 64 nt, hsa
uguuuaaauaacauuaugggauugcaaccagcaaaacauaaacugagaaaaaguucuauagggc

SEQ ID NO: 439401 - RNA, 64 nt, hsa
gauuacagugcuccuuucauucuuucaaacagauaacauaaaaguucuguuacccucauucuau

SEQ ID NO: 439402 - RNA, 64 nt, hsa
guuaguccucuuagaugacugcuuauuuauguguaacauaaaucccacauauucuaaugacaac

SEQ ID NO: 439403 - RNA, 64 nt, hsa
aagacaacaugcuuuggaaacauauguccuagaaaacauaaaauuaaaaaaaaacacuauagug

SEQ ID NO: 439404 - RNA, 64 nt, hsa
ugucagucaagcagcacuuuuucagaauauacagaacauaaauaauaugaugugguugaguguu

SEQ ID NO: 439405 - RNA, 64 nt, hsa
aaaauaauaguuuuagugaggauggugcugaguaaacauaaaaacugauuugcucucagcugau

SEQ ID NO: 439406 - RNA, 64 nt, hsa
uuuugguaaacgguuuuuauuaaagaugcuauggaacauaaaguuguauugcaugcaauuugaa

SEQ ID NO: 439407 - RNA, 64 nt, hsa
cauaggaggcacuucuuuucauaaagagaagcuaaacauaaaaaggaauuuuaaauuuaacucu

SEQ ID NO: 439408 - RNA, 64 nt, hsa
cauacauauauacacauaugcauguguguguguaaacauaaaaguccuuuauuauuaaaaaaug

SEQ ID NO: 439409 - RNA, 64 nt, hsa
ucagaauucacuguaauggaauuuugccucuaauaacauaaagggggaagaaacauaaaguggu

SEQ ID NO: 439410 - RNA, 64 nt, hsa
ggaauuuugccucuaauaacauaaagggggaagaaacauaaagugguucucuuaauaaaacuag

SEQ ID NO: 439411 - RNA, 64 nt, hsa
ggucacuuuaaauguucuaguagcaacuuuuaaaaacauaaaaagaagcaggugaaaauguuaa

SEQ ID NO: 439412 - RNA, 64 nt, hsa
uuucaugaagguaaagcuuucuucacuauucuggaacauaaaacuuuauucaguguaauuuaag

SEQ ID NO: 439413 - RNA, 64 nt, hsa
auuucuuaaaauucugaauucgucuuuucugagaaacauaaauuuacauauuuuucaacagaag

SEQ ID NO: 439414 - RNA, 64 nt, hsa
cuaucuuucaaaaguaaauguaauaaaaaugcacaacauaaaauguuuaugaucccagcaauac

SEQ ID NO: 439415 - RNA, 64 nt, hsa
uaaaccacuugaagggacucaugaagcauccugcaacauaaauuugcauuuuuacaucagauuu

SEQ ID NO: 439416 - RNA, 64 nt, hsa
ugcuacauguaaaaagaaccaaacucacaauauuaacauaaacaucuuucauauuuuguuagua

SEQ ID NO: 439417 - RNA, 64 nt, hsa
uagauuauaacaaacugcuagcaaaaucugaggaaacauaaauucuucugaagaaucauaggaa

SEQ ID NO: 439418 - RNA, 64 nt, hsa
uguauuuaaaacauuucauguauuucuuuagaacaacauaaaauuaaaauuuaacaucugcagu

SEQ ID NO: 439419 - RNA, 64 nt, hsa
uagucuuaugaauagacauaaauuguaauuugggaacauaaaaacuacugaauaaaucaugugg

SEQ ID NO: 439420 - RNA, 64 nt, hsa
guuuaauaauauuuaaugucuuuuuaggaucauaaacauaaauagguuuguugauauucaggcc

SEQ ID NO: 439421 - RNA, 64 nt, hsa
acuuagcuugaguuaaaggcaaagaaaaucuaaaaacauaaauguuauauuucacaagaaauca

SEQ ID NO: 439422 - RNA, 64 nt, hsa
cucuuuauucucauguuccacauggucuaauuuuaacauaaauaauaugccuucacacuggauu

SEQ ID NO: 439423 - RNA, 64 nt, hsa
uuuuuuuuaaagcauaaaacauauuucuagauacaacauaaaccuugguuauaugucaacuauu

SEQ ID NO: 439424 - RNA, 64 nt, hsa
uuucagcaguacaaaggcauguuuuaaaaucuauaacauaaagaauaaggaauagcuuuguauu

SEQ ID NO: 439425 - RNA, 64 nt, hsa
cagacacauuuuuggauuucugugaaguugaauaaacauaaaagcuaauacaguuguauuauuu

SEQ ID NO: 439426 - RNA, 64 nt, hsa
acauaucuuuaaauuaccaaaaaacaagaaacaaaacauaaaaaccccaaaacuaucacuugga

SEQ ID NO: 439427 - RNA, 64 nt, hsa
agauucuaguacaaaguuacuguuuaacaaaagcaacauaaacucugggaaagauuucauuuug

SEQ ID NO: 439428 - RNA, 64 nt, hsa
gaauugacguuuaugauuuauguuaauucagccaaacauaaauaaccuuccuuaaguacaauuu

SEQ ID NO: 439429 - RNA, 64 nt, hsa
ggaaguaagcccaagagaacaacauaaagcaaacaacauaaagcacaauaaaaaugcaaauaaa

SEQ ID NO: 439430 - RNA, 64 nt, hsa
cccaucuccaacucggaaguaagcccaagagaacaacauaaagcaaacaacauaaagcacaaua

SEQ ID NO: 439431 - RNA, 64 nt, hsa
aaauaauuucuucagagauaacuucaaguuguugaacauaaagguguuagauguuagcacaucu

SEQ ID NO: 439432 - RNA, 64 nt, hsa
uacuuuuacuccaugggcauugaaaagguuaagaaacauaaaugguacauauuuuuaaaguuaa

SEQ ID NO: 439433 - RNA, 64 nt, hsa
uuuuucauccuuacaauccugucccaugguauuuaacauaaaaaaaaauaaaacuguuaacaga

SEQ ID NO: 439434 - RNA, 64 nt, hsa
aauugucuuaguuugagagauggcugaaauaaugaacauaaaaugcuauuuauaauaacaagua

SEQ ID NO: 439435 - RNA, 64 nt, hsa
aauuuuucauuaaaaaaauuacauuaucugaaauaacauaaagcuacuaaacugcuuuguauuc

SEQ ID NO: 439436 - RNA, 64 nt, hsa
uacaugccuuugauuccuuagaggucgguaauuuaacauaaaacagggaugucacuuugagggg

SEQ ID NO: 439437 - RNA, 64 nt, hsa
cacaguaauucugacaacaccucaaacuuuucuaaacauaaaauaaaucauacuggugaggaac

SEQ ID NO: 439438 - RNA, 64 nt, hsa
ggcaaagcauuuaacuggucccuaaaucuuacuaaacauaaaaaaacuuaaacuggagagaaac

SEQ ID NO: 439439 - RNA, 64 nt, hsa
guuaaaaaaaaaauuagauucuuaaaguguggcaaacauaaaauuugcaagaaaauguagaaau

SEQ ID NO: 439440 - RNA, 64 nt, hsa
ugacagugcuuugaaaacaccucaaacuuuucaaaacauaaaucauaguguugagaaauccuag

SEQ ID NO: 439441 - RNA, 64 nt, hsa
ggcaaagccuuuuaccaguccucaacucuuacuaaacauaaaaaaauucauacuggagggaacu

SEQ ID NO: 439442 - RNA, 64 nt, hsa
ccagauuuaacauaaguaguaaauaacauaaaauaacauaaaacaguauuuuuaggauucauga

SEQ ID NO: 439443 - RNA, 64 nt, hsa
auguguuguuccagauuuaacauaaguaguaaauaacauaaaauaacauaaaacaguauuuuua

SEQ ID NO: 439444 - RNA, 64 nt, hsa
gagaauaaguauaaacauaaagcaacuaaaaugaaacauaaaaccuuuuauuuucuucugauuu

SEQ ID NO: 439445 - RNA, 64 nt, hsa
ucaaauauuuuuuccaggggugagaauaaguauaaacauaaagcaacuaaaaugaaacauaaaa

SEQ ID NO: 439446 - RNA, 64 nt, hsa
gaaguucuuaaauuaguuauggagacaaagugaaaacauaaaaugugaccauuuaacuuauggc

SEQ ID NO: 439447 - RNA, 64 nt, hsa
uuccugcuuaaaacccugcagguuucccaaugcacucagaaagaaauccaguuuccauggcccu

SEQ ID NO: 439448 - RNA, 64 nt, hsa
cagugucuuugucaccaggcccuuuggacucuaccucagaaauauuucuuggaccuuccacuuc

SEQ ID NO: 439449 - RNA, 64 nt, hsa
gaaagagaacauggucacccaaaagcaacuguaacucagaaauuaaguuacucagaaauuaagu

SEQ ID NO: 439450 - RNA, 64 nt, hsa
acccaaaagcaacuguaacucagaaauuaaguuacucagaaauuaaguagcucagaaauuaaga

SEQ ID NO: 439451 - RNA, 64 nt, hsa
aacucagaaauuaaguuacucagaaauuaaguagcucagaaauuaagaaagaaugguauaauga

SEQ ID NO: 439452 - RNA, 64 nt, hsa
aggaaggauucaccaccuccaggaaaagugucuucucagaaacaaccagcugagaagguaauua

SEQ ID NO: 439453 - RNA, 64 nt, hsa
auaaaggagggaccaauaucugggacagugucuucucagaaacaaccagcugagaagguaauua

SEQ ID NO: 439454 - RNA, 64 nt, hsa
auaaagaagggacaacaaucugggacagugucuccucagaaacaaucggccuggaagguaguua

SEQ ID NO: 439455 - RNA, 64 nt, hsa
auaauggguggugggaaaucuggaacagugucuucucagaaacaaccagccucaaagguaauua

SEQ ID NO: 439456 - RNA, 64 nt, hsa
auaaaggauggacuacagugugggacagugucuucucagaaacaaccagccuugaagguaauua

SEQ ID NO: 439457 - RNA, 64 nt, hsa
auaaaggauggagaaaaaucugggacagugucuucucagaaacaaccagccuugaagguaauua

SEQ ID NO: 439458 - RNA, 64 nt, hsa
auaaaggauggagaaaaaucugggacagugucuucucagaaaccaccagccuugacgguaauga

SEQ ID NO: 439459 - RNA, 64 nt, hsa
aaaaaggauggagaaauaucuaggaaagugucuucucagaaaccaccaaccuugaagguaauga

SEQ ID NO: 439460 - RNA, 64 nt, hsa
aaaaaggauggagaaauaucuaggaaagugucuucucagaaaccaccagccuugaagguaauga

SEQ ID NO: 439461 - RNA, 64 nt, hsa
ucaaaaguugaaauuaaccauagauguagauaaacucagaaauuuaauucauguuucuuaaaug

SEQ ID NO: 439462 - RNA, 64 nt, hsa
gcaaccuguugauagcaagugaauuuuucucuaacucagaaacaucaguuacucugaagggcau

SEQ ID NO: 439463 - RNA, 64 nt, hsa
gauccuuugacauguuaauucaauucuagaaauccucagaaauguuuuuauauuaugcagagau

SEQ ID NO: 439464 - RNA, 64 nt, hsa
aaacaaaacacagcuuaucuaaucuaaugagaaacucagaaaaaaauguuuugaugaauacaau

SEQ ID NO: 439465 - RNA, 64 nt, hsa
uagauuuuuaaaaaagaauuaaaaugugggaguucucagaaagaaauaaacacaugagaauaag

SEQ ID NO: 439466 - RNA, 64 nt, hsa
aauaacgccugauguauagauuaguuagcaaauucucagaaaucccccacauaaaagccuuacu

SEQ ID NO: 439467 - RNA, 64 nt, hsa
gcacuccagccugggcgacagagugaaacuacaucucagaaaaaaaaaaaaaaaaaaaaaaaaa

SEQ ID NO: 439468 - RNA, 64 nt, hsa
auacacagaaugaucuacagugaucuuuaacauacucagaaauaugaaaaauguuugaauauga

SEQ ID NO: 439469 - RNA, 64 nt, hsa
uaaaaaucaaagugauuuugaaaaucucuaauggcucagaaaauaaaaacauccaguuugugga

SEQ ID NO: 439470 - RNA, 64 nt, hsa
uuuuuguuguaguuaucuucugggguuucaauuccucagaaacaacuuuuuucacaacggaaag

SEQ ID NO: 439471 - RNA, 64 nt, hsa
aguuucaucagaaacuuaaaacauagacugaucacucagaaauuaaaguccguuuuacugugaa

SEQ ID NO: 439472 - RNA, 64 nt, hsa
caauggaguggggaaguacuuucauuacccaagccucagaaaaacacacaagaacaauaacaca

SEQ ID NO: 439473 - RNA, 64 nt, hsa
gugugaggugggaguacugcaaccugacacaaugcucagaaacagaaucaguguccuagagacu

SEQ ID NO: 439474 - RNA, 64 nt, hsa
ggucaucuaugacaccacaccagcacaguaggaccucagaaaaguacccaaaugcguacgucuu

SEQ ID NO: 439475 - RNA, 64 nt, hsa
aaaacuaagguaacuucucagaaagauaucaaaucucagaaagaaugucaaaucagaugaaguu

SEQ ID NO: 439476 - RNA, 64 nt, hsa
ucacucacuguggaaauaaaaacuaagguaacuucucagaaagauaucaaaucucagaaagaau

SEQ ID NO: 439477 - RNA, 64 nt, hsa
uagcuuggauucaaucaugugacuuuuaaauuggcucagaaagcaauuuuguaauuucagagag

SEQ ID NO: 439478 - RNA, 64 nt, hsa
ugacgccgccuuccuccgguuauugaaaggacgccucagaaaugcuuuguuuucuuuuacgaug

SEQ ID NO: 439479 - RNA, 64 nt, hsa
gauacauuauuuuuucuuucuuucauagcugugucucagaaaggacccauuuguggcucuuuuu

SEQ ID NO: 439480 - RNA, 64 nt, hsa
ucuagccaucuaaauugacucuuccaauauaggucucagaaauccaauauuuggaguacaauuu

SEQ ID NO: 439481 - RNA, 64 nt, hsa
cacuccagccugggcgacaagagcaagacucugucucagaaaaaaaaaaaaaaaagagagagag

SEQ ID NO: 439482 - RNA, 64 nt, hsa
aggaaaaucuauuggcucucgugggucucuucaucucagaaaugccaaucaggucaagguuugc

SEQ ID NO: 439483 - RNA, 64 nt, hsa
uuaugaagccuuaacuaauucuuguuuuugcuuccucagaaacuuuuuauugcaucugccaucc

SEQ ID NO: 439484 - RNA, 64 nt, hsa
acuaagauaaaugugaagucugaguaagguugcucucagaaaaaaaaaaaaagcauauauauau

SEQ ID NO: 439485 - RNA, 64 nt, hsa
ugucaggucaacauuuuucagaaauguauuuauucucagaaacagaaccagagagaaguuaaac

SEQ ID NO: 439486 - RNA, 64 nt, hsa
uuuauaauauguaauuuuucaugaaaagaaagggcucagaaaaauuaggaugugauuuugguug

SEQ ID NO: 439487 - RNA, 64 nt, hsa
cucgagccauagagccugaaaucaucuuuguuggcucagaaaauaccuuagcuucacucagcug

SEQ ID NO: 439488 - RNA, 64 nt, hsa
uaggagucuuauaucccaggugaggaauuugaagcucagaaagguugaggggcuccccagaggu

SEQ ID NO: 439489 - RNA, 64 nt, hsa
augcuaaauauauggagccauuauuauuuccugucucagaaagucuggcuguuaaagaauguug

SEQ ID NO: 439490 - RNA, 64 nt, hsa
agggaaaggggugcagcuuccacccuggcaggcucucagaaauuuuuaguuccuuuuuccacca

SEQ ID NO: 439491 - RNA, 64 nt, hsa
gcacuccagccugggcaacagagcgagacuccaacucagaaaaagcaaaacaaaacaaacaaac

SEQ ID NO: 439492 - RNA, 64 nt, hsa
aaccucaggaaccaaaggucaccgacacugaguacucagaaaucaagauacacaagugaggaau

SEQ ID NO: 439493 - RNA, 64 nt, hsa; identical to SEQ ID NO: 229068

SEQ ID NO: 439494 - RNA, 64 nt, hsa; identical to SEQ ID NO: 229069

SEQ ID NO: 439495 - RNA, 64 nt, hsa
uacacauucuauacaggagagauguauuauuuccccccuucagccccuacuaaacucuuaagcc

SEQ ID NO: 439496 - RNA, 64 nt, hsa
aaaccacuaagaguuccucccgcgcagacugcugccccuucagcugcccucgauuuugcuccac

SEQ ID NO: 439497 - RNA, 64 nt, hsa
cuucuucccauuuugucuucccuucugccuguuuccccuucaggcuuggcucuaggaaccaaag

SEQ ID NO: 439498 - RNA, 64 nt, hsa
uuugguuagugccacuaccuucuucccuccuuucccccuucaauuuggaaauaaauuucuguau

SEQ ID NO: 439499 - RNA, 64 nt, hsa
ggccuaugaaaagguccugaugcccaaccucccaccccuucaauguggggacgagacccccuca

SEQ ID NO: 439500 - RNA, 64 nt, hsa
gagccacugggagacuggggagacuggcuguaacccccuucacaccuggguuuggcaucagcac

SEQ ID NO: 439501 - RNA, 64 nt, hsa
cccuugccccaggacaccgccuaccccguacagaccccuucacuccggggugcuauccccaucc

SEQ ID NO: 439502 - RNA, 64 nt, hsa
ucuucccugacugcuguccccuacccagccuugcccccuucauccuuuugcguuugguauugag

SEQ ID NO: 439503 - RNA, 64 nt, hsa
agacucuacuccucuuucuuuuguauggacaguuccccuucagucccaucccccuacacauaca

SEQ ID NO: 439504 - RNA, 64 nt, hsa
cugucuuaaaaaaaacuaaaaagaaaaaaagaagccccuucacucuacaggggacaggagacca

SEQ ID NO: 439505 - RNA, 64 nt, hsa
agacaggguccaccaacuccccaagaugaagaagccccuucaggccagucgugguggcucaugc

SEQ ID NO: 439506 - RNA, 64 nt, hsa
ggagcucccuaucuacccucaccccacgagacagccccuucaggauuuccacuggaccuugccc

SEQ ID NO: 439507 - RNA, 64 nt, hsa
uccacugacuguccaagggccacucccaagaagcccccuucacgauccacccuuucaggcuaag

SEQ ID NO: 439508 - RNA, 64 nt, hsa
uguuucuguuccucuucccaucuacuccccuacgccccuucaaccuuuuuucucugucugcuuc

SEQ ID NO: 439509 - RNA, 64 nt, hsa
ccuaaaggaaaccuuucuuaaagacaggcugaaaccccuucaaaggcagaugaggagguacaga

SEQ ID NO: 439510 - RNA, 64 nt, hsa
uaaaaugucuuuuuuaccuuuuguuuaccaagggccccuucauaaauagcaggcaaaugccuag

SEQ ID NO: 439511 - RNA, 64 nt, hsa
cuuucaaagccuuuuagcuuuuccagcaccucagccccuucacacauuuacacauaccaauuuu

SEQ ID NO: 439512 - RNA, 64 nt, hsa
cucauaugcacaagcccaccaaccccuucacaccccccuucacaggggucguaugaguaagggg

SEQ ID NO: 439513 - RNA, 64 nt, hsa
cguucacauucccucauaugcacaagcccaccaaccccuucacaccccccuucacaggggucgu

SEQ ID NO: 439514 - RNA, 64 nt, hsa
uuuugcuuaucauguuccauuucgugccgcuuucccccuucaagaugccauuuggaggguaggg

SEQ ID NO: 439515 - RNA, 64 nt, hsa
caggccaaguauaugagaaagguaaguccauuuuccccuucagguccucaguggauuacuuaac

SEQ ID NO: 439516 - RNA, 64 nt, hsa
guuggugagaugccaaguuuggucugaguugugaccccuucagaguagaugcccggcaggcugg

SEQ ID NO: 439517 - RNA, 64 nt, hsa
ccggagcucauuacugccuucccucccagggaggccccuucagagaggagaggccacaggagcu

SEQ ID NO: 439518 - RNA, 64 nt, hsa
uccccuucuaguugauccuuuucaccucccugauccccuucauuucuucaccgcgguuccucgu

SEQ ID NO: 439519 - RNA, 64 nt, hsa
ccucuucaggaaauguccugacuccccucagcucccccuucaccccuccuugcccgccuacccu

SEQ ID NO: 439520 - RNA, 64 nt, hsa
gggcugggacugaggccuccugcagguaccugccccccuucacacagcaccucucaaucuccua

SEQ ID NO: 439521 - RNA, 64 nt, hsa
gacuuugcauaucauuugcauagacaccucugauccccuucagugggaaccguagugucagugc

SEQ ID NO: 439522 - RNA, 64 nt, hsa
ugcucuggcaggacucacguuacagaccccucuaccccuucagccugcccuacagcgacuuccc

SEQ ID NO: 439523 - RNA, 64 nt, hsa
ccacgcccacccuucgaggaaggugucaccuggaccccuucauuccacggaggaagcugaggcc

SEQ ID NO: 439524 - RNA, 56 nt, hsa
uccuggaggaacgacccugacccggcccccuucaccccuucagccgagcccagacc

SEQ ID NO: 439525 - RNA, 64 nt, hsa
uccuggaggaacgacccugacccggcccccuucaccccuucagccgagcccagaccuccccucu

SEQ ID NO: 439526 - RNA, 64 nt, hsa
cccauucagucccagggagcagagacccccccaaccccuucacaaaccccaacaccccugacuu

SEQ ID NO: 439527 - RNA, 64 nt, hsa
gggagccgcguugucccaagagccugccacccucccccuucaaugcaccucuggugguggagug

SEQ ID NO: 439528 - RNA, 64 nt, hsa
cugguuaccuggagaaguaguauuugccuauuucccccuucauccauccugagccaaauuucuu

SEQ ID NO: 439529 - RNA, 64 nt, hsa
uccacccacaaacuccaggcuggaaguacuuggcccccuucaggagccuggccaggcagggaga

SEQ ID NO: 439530 - RNA, 64 nt, hsa
ucuccucuuucauuauucuguucuguauuccuuuccccuucauucucacccugucugcuuuuac

SEQ ID NO: 439531 - RNA, 64 nt, hsa
cucuuaaaaaguacagagagccugugcugugaacccccuucaaugggaaaaagcugcaguggug

SEQ ID NO: 439532 - RNA, 64 nt, hsa; identical to SEQ ID NO: 179925

SEQ ID NO: 439533 - RNA, 64 nt, hsa; identical to SEQ ID NO: 179926

SEQ ID NO: 439534 - RNA, 64 nt, hsa; identical to SEQ ID NO: 179927

SEQ ID NO: 439535 - RNA, 64 nt, hsa; identical to SEQ ID NO: 179928

SEQ ID NO: 439536 - RNA, 64 nt, hsa; identical to SEQ ID NO: 179929

SEQ ID NO: 439537 - RNA, 64 nt, hsa; identical to SEQ ID NO: 179930

SEQ ID NO: 439538 - RNA, 64 nt, hsa; identical to SEQ ID NO: 179931

SEQ ID NO: 439539 - RNA, 64 nt, hsa; identical to SEQ ID NO: 179932

SEQ ID NO: 439540 - RNA, 64 nt, hsa; identical to SEQ ID NO: 179933

SEQ ID NO: 439541 - RNA, 64 nt, hsa; identical to SEQ ID NO: 179934

SEQ ID NO: 439542 - RNA, 64 nt, hsa; identical to SEQ ID NO: 179935

SEQ ID NO: 439543 - RNA, 64 nt, hsa; identical to SEQ ID NO: 179936

SEQ ID NO: 439544 - RNA, 64 nt, hsa; identical to SEQ ID NO: 179937

SEQ ID NO: 439545 - RNA, 64 nt, hsa; identical to SEQ ID NO: 179938

SEQ ID NO: 439546 - RNA, 64 nt, hsa; identical to SEQ ID NO: 179939

SEQ ID NO: 439547 - RNA, 64 nt, hsa; identical to SEQ ID NO: 179940

SEQ ID NO: 439548 - RNA, 64 nt, hsa; identical to SEQ ID NO: 179941

SEQ ID NO: 439549 - RNA, 64 nt, hsa; identical to SEQ ID NO: 179942

SEQ ID NO: 439550 - RNA, 64 nt, hsa; identical to SEQ ID NO: 179943

SEQ ID NO: 439551 - RNA, 64 nt, hsa
augaauuuggguaugaacagauugccugcuuucccuuaaauaacacuuagauuuauuggaccag

SEQ ID NO: 439552 - RNA, 64 nt, hsa
cugaauucugguuacauguguuuuucucucccuccuuaaauaaagagagggguuaaacaugccc

SEQ ID NO: 439553 - RNA, 64 nt, hsa
auauguauaaauauguauuuugucaaauuuguuacuuaaauauauagagaccaguuuucucugg

SEQ ID NO: 439554 - RNA, 64 nt, hsa
uuucuuucacagauacugauuauucuuuccaguucuuaaauaaaacugcacuugauuucacuca

SEQ ID NO: 439555 - RNA, 64 nt, hsa
uacaaauccaagcagauugacucucaaaaauaaucuuaaauacugcaaauagucccaacuaaga

SEQ ID NO: 439556 - RNA, 64 nt, hsa
ugaacugaacugcagcuauagaauguuucaaaugcuuaaauauauaauacauuuuuuuccaugg

SEQ ID NO: 439557 - RNA, 64 nt, hsa
agaacuucuagcuaaugcucaggugagaucauagcuuaaauacauugaaaaaacuaaaguacca

SEQ ID NO: 439558 - RNA, 64 nt, hsa
auguagguuuuauuuuuaaaagucuugagcucuucuuaaauauacauuauaaagagcaagcaua

SEQ ID NO: 439559 - RNA, 64 nt, hsa
gcucuuugaagccaaccaaggcaggcagaacccucuuaaauaugagacugauguauagguucuc

SEQ ID NO: 439560 - RNA, 64 nt, hsa
ucuaaauacaaaugcaaaugaagcauuaguaauacuuaaauaauuuuacugugcuacauaaagu

SEQ ID NO: 439561 - RNA, 64 nt, hsa
cauuuugaauaauauggcuuaguguuaacggggacuuaaauaugauuuuuuuuucuuacucauu

SEQ ID NO: 439562 - RNA, 64 nt, hsa
aaaggaagaaaaaagaucccuauuagauacacuucuuaaauacaaucacauuaacauuuugagc

SEQ ID NO: 439563 - RNA, 64 nt, hsa
acaguuuuauacccuuuuucauuuaacuuuauaacuuaaauauugcucuauguuaguauaagcu

SEQ ID NO: 439564 - RNA, 64 nt, hsa
uuuacuacauauauugauuuuuaaauaaaguugccuuaaauaaguguauguaagcaguaguagu

SEQ ID NO: 439565 - RNA, 64 nt, hsa
gauuuuauuuuaaaauauuuauuuugauaugaugcuuaaauauuauauaaacauuuggaaaagu

SEQ ID NO: 439566 - RNA, 64 nt, hsa
uaaaauauuaacuucaaaaaagucuuuuucaguucuuaaauaaaaauuuauuuauuuaagauac

SEQ ID NO: 439567 - RNA, 64 nt, hsa
agagauaaauguaugugaauguuuaugauaaacgcuuaaauauuucuaaaauauuaacuucaaa

SEQ ID NO: 439568 - RNA, 64 nt, hsa
cuguagaguuucaaccucuuugagauauaaguaucuuaaauaucauagagcacugugauucauu

SEQ ID NO: 439569 - RNA, 64 nt, hsa
aaaacuaaggguaaaagacauuuaaagaauuaaacuuaaauaagugugugcagcauuucuacuu

SEQ ID NO: 439570 - RNA, 64 nt, hsa
gcaaaccauagcacaggcuaauuuuuuguuguuucuuaaauaagaaacuuuuuuauuuaaaaaa

SEQ ID NO: 439571 - RNA, 64 nt, hsa
uuaaaaaagcuuaaaacuuugaaguuagcuuuaacuuaaauaguauuucccauuuaucgcagac

SEQ ID NO: 439572 - RNA, 64 nt, hsa
guucagggcaacuacaaauaaucacuuacuaagccuuaaauaaagccauuauuuuuauaucaau

SEQ ID NO: 439573 - RNA, 64 nt, hsa
uuaaauuguuuucuuucuuccaagaaagaagccacuuaaauaagcuuauacuuugccaaagcug

SEQ ID NO: 439574 - RNA, 64 nt, hsa
augaccagaggaaagauggauaagaugauaauuucuuaaauagacauuuuccuuuuuucuuugu

SEQ ID NO: 439575 - RNA, 64 nt, hsa
uggugcuugaagauaaaugugcuguuucuaguuucuuaaauagcccacaccccuggaugcaaaa

SEQ ID NO: 439576 - RNA, 64 nt, hsa
uccagaauguacuauccaucuugaugagaaaacucuuaaauaguaccaaacauuuugaacuuua

SEQ ID NO: 439577 - RNA, 64 nt, hsa
aaugaaagcuuuagaaggcaugagauguuccuaucuuaaauaaagcauguuucuuuucuauaga

SEQ ID NO: 439578 - RNA, 64 nt, hsa
gggaacuuuuuucgaaaggauacaugaccaccuucuuaaauaguaugacuuuacauagacucuu

SEQ ID NO: 439579 - RNA, 64 nt, hsa
uauucaucugucauauacuauugauccuuuggcacuuaaauaaaugugaaauccuccaggaauu

SEQ ID NO: 439580 - RNA, 64 nt, hsa
acacucaccccauuucccucauuucuuuccuacacuuaaauaccucguguauggugcaaucaga

SEQ ID NO: 439581 - RNA, 64 nt, hsa
cccuagaaaaauuaaacaguuacugaaauuaugacuuaaauacccaaugacuccuuaaauaugu

SEQ ID NO: 439582 - RNA, 64 nt, hsa
uuacugaaauuaugacuuaaauacccaaugacuccuuaaauauguaaauuauaguuauaccuug

SEQ ID NO: 439583 - RNA, 64 nt, hsa
aauguuuucaguuuucuuuuuuauuuugguuaugcuuaaauaugaauguaauuaccaaaagauu

SEQ ID NO: 439584 - RNA, 64 nt, hsa
cuaaugaaguuaugacaucuguccuaauuaguuucuuaaauacauuuacuacuuaaugguuuug

SEQ ID NO: 439585 - RNA, 64 nt, hsa
cacaaagaauaggaugggauaaagaaaguggacacuuaaauaagcuauaaauuauaugguccuu

SEQ ID NO: 439586 - RNA, 64 nt, hsa
ccaaaaaugucaguauugacaacacagucuaacucuuaaauaaaauuaugcuaauuaguuacau

SEQ ID NO: 439587 - RNA, 64 nt, hsa
ugauacacaaauuguuuaagguuauacacucgagcuuaaauagauauuuuuaaccagguguuug

SEQ ID NO: 439588 - RNA, 64 nt, hsa
guuauaugugaucuuucuauaaccaugccauucacuuaaauaauucaugaagggaaugguuuaa

SEQ ID NO: 439589 - RNA, 64 nt, hsa
uauaaugccugcaaugugucauauacucgcacaacuuaaauaggucauuuuugucuguggcauu

SEQ ID NO: 439590 - RNA, 64 nt, hsa
aaguuucuuuaauuagacuuguaggcacucuucacuuaaauaccucaguucuucuuuucuuuug

SEQ ID NO: 439591 - RNA, 64 nt, hsa
ugaaacauaauuucacaauuauuccuuuuuccaccuuaaauaauaagaguagaauacuuucugu

SEQ ID NO: 439592 - RNA, 64 nt, hsa
gaauuuuguaauuuuuuucugagaaaaaaaaguucuuaaauacaauaaaauugaaauguugaaa

SEQ ID NO: 439593 - RNA, 64 nt, hsa
uuaggaauaauuguaaauauauguuacgaaucuucuuaaauauauauauauacacacccuguga

SEQ ID NO: 439594 - RNA, 64 nt, hsa
agaguucacacaauaggauauaaguccuguaugacuuaaauagugaauuuuguccuuaacauuu

SEQ ID NO: 439595 - RNA, 64 nt, hsa
uaaacugucuucuucuguuccucauuuugcuuuacuuaaauaaucuuucauauuuuuuaagugu

SEQ ID NO: 439596 - RNA, 64 nt, hsa
ugaaugugggaaguccuucagcagcaauucaaaacuuaaauacuaugauguuuaauaaguauua

SEQ ID NO: 439597 - RNA, 64 nt, hsa
guaauagaaauauuauucaaugccaaaauauuuucuuaaauagucauagaacuaacaagaaaaa

SEQ ID NO: 439598 - RNA, 64 nt, hsa
cauauuucaaaaauguugucauucauuaaggccucuuaaauagaccacuauuuuuugugucugg

SEQ ID NO: 439599 - RNA, 64 nt, hsa
ggucccagcaugaaauaaagccuuggccugggggccgcuucauucucccucacugugcugcgcu

SEQ ID NO: 439600 - RNA, 64 nt, hsa
cugacucucaggcguuaggcagcuggaugacuucccgcuucacgcagcaaaggccaggggcuug

SEQ ID NO: 439601 - RNA, 64 nt, hsa
uguggcccuucuguccaccagacccaccuggagcccgcuucaagcucucuguugcgcucccgca

SEQ ID NO: 439602 - RNA, 64 nt, hsa
gacuuuacaccuaccccucaccggaaagcuagacccgcuucagggccaggaguggcguuuccgc

SEQ ID NO: 439603 - RNA, 64 nt, hsa
ccccgcacccggcacacucccccuuccuccagccccgcuucagccacaugcuccagcugcugcc

SEQ ID NO: 439604 - RNA, 64 nt, hsa
aggagcugauuuccaggccccugaggacuggagaccgcuucaccccugcacuucagacaccguu

SEQ ID NO: 439605 - RNA, 64 nt, hsa
ugcucaggguggauaacacgggucguucugcagcccgcuucagcacaaauaggcagcuuaaggc

SEQ ID NO: 439606 - RNA, 64 nt, hsa
cccugagaagggcgggccuuccauguucucucacccgcuucaacuccacauuguccaagucaca

SEQ ID NO: 439607 - RNA, 64 nt, hsa
gaccuuuccuuccccaguggggaacccaccaaguccgcuucagauaccaaaggggaagacagaa

SEQ ID NO: 439608 - RNA, 64 nt, hsa
gacacuggcagcaguugccagguuuuagcugccaccgcuucaguaugagauauagcugucccau

SEQ ID NO: 439609 - RNA, 64 nt, hsa
uguuaaauaggcuugagggguuguugcgcaauggccgcuucagaugacagauguuguaagagaa

SEQ ID NO: 439610 - RNA, 64 nt, hsa
cuuuauuuuugugccaauuauucaccuuaucgugccgcuucauggaagcuugaguauguucucc

SEQ ID NO: 439611 - RNA, 64 nt, hsa
uuaggcucgccauggaaauacgcgcggggagcggccgcuucaaaggcggcacacuucacuacag

SEQ ID NO: 439612 - RNA, 64 nt, hsa
gugccgccgccgccgccaggcacuccggagcuguccgcuucagcaccacggcggccgcgguagc

SEQ ID NO: 439613 - RNA, 64 nt, hsa
aauuuccccucuguccuccauccagcggcuucuuccgcuucauucucuaccauaccacuugugc

SEQ ID NO: 439614 - RNA, 64 nt, hsa
aguuacuaccucauuguuacuuucuaaaccaggcccgcuucacgaguuagaguugagcuccccu

SEQ ID NO: 439615 - RNA, 64 nt, hsa
cacugaaguuucgaccugggcucaagcaauccucccgcuucagccuccugaguagcuggugcgc

SEQ ID NO: 439616 - RNA, 64 nt, hsa
auagauaaaccucaagcaacgauucauguuguaaccgcuucauaugguuuaguuuucaaaaaac

SEQ ID NO: 439617 - RNA, 64 nt, hsa
gcugcucucgaacuccugaccucaggugauccacccgcuucagcuucccaaagugcuggcauua

SEQ ID NO: 439618 - RNA, 64 nt, hsa
cccagcucuguggccucaggacucucugccucacccgcuucagcccagggccccuggagacuga

SEQ ID NO: 439619 - RNA, 64 nt, hsa
uugcccauuccuuacaccccuuccccauccugcuccgcuucauguccccuccugaguagucaug

SEQ ID NO: 439620 - RNA, 64 nt, hsa
ggcaugucaggagaguuagaggugcaucacacauccgcuucauauguuggguaagaaacauaac

SEQ ID NO: 439621 - RNA, 64 nt, hsa
ugcacccccgggcgaguuacgcggccucucugugccgcuucauuuguagagggcuguaacagug

SEQ ID NO: 439622 - RNA, 64 nt, hsa
cucaggaacuaguuaaagagcaaacccauuucucccgcuucacucuguuucagauauuuuuauu

SEQ ID NO: 439623 - RNA, 64 nt, hsa
gucucuuacagagggggcccaaggaaucaccaccccgcuucaguguaaacaacgugccuugucc

SEQ ID NO: 439624 - RNA, 64 nt, hsa
gagcgcucaauccagcuccuugaaccccuccagcccgcuucagccugggcaucacugcaggccc

SEQ ID NO: 439625 - RNA, 64 nt, hsa
uuuauaauuuuuuauugguaaacauaugcuaaauccgcuucaguauuuuauuauguuuuuuaaa

SEQ ID NO: 439626 - RNA, 64 nt, hsa
acugcaaccucaauccugggcucaagugauccucccgcuucagccucucaagcagcgggaacua

SEQ ID NO: 439627 - RNA, 64 nt, hsa
ggccuccugccaggugacugcuaucccguccacaccgcuucauugaugaggacaggagacucca

SEQ ID NO: 439628 - RNA, 64 nt, hsa
uaaacaagagcccuuaagcccacgcauagcauugccgcuucagcuugcugaggacugucuccaa

SEQ ID NO: 439629 - RNA, 64 nt, hsa
gacugagcaucuaaaaugggcagccuccauccacccgcuucagggaggaacuggacucucuggg

SEQ ID NO: 439630 - RNA, 64 nt, hsa
accugggccgggggcagcacggccuggcuuucccccgcuucagugggccuugcccuuuguacag

SEQ ID NO: 439631 - RNA, 64 nt, hsa
agcagucagaggaggacgugagccaguuugauacccgcuucacacggcagacgccgguggacag

SEQ ID NO: 439632 - RNA, 64 nt, hsa
acauagcccuuucuuugccaugaggccaugaggcccgcuucauccuuuucuauuucccuagaac

SEQ ID NO: 439633 - RNA, 58 nt, hsa
acgacaccucgcucaccugagcgccgcaccgcuucagggacggagacaggaccgggcg

SEQ ID NO: 439634 - RNA, 64 nt, hsa
aagggccaccaccgcccucauggaaagagcugagccgcuucagacugcggggcaagcgggccgc

SEQ ID NO: 439635 - RNA, 64 nt, hsa
agacucaauuuuggagggcaagacagggaggaggccgcuucaucccagacucucuucuagggcu

SEQ ID NO: 439636 - RNA, 64 nt, hsa
aggaggcaggcuuuuagaaucauguuuuguuaauccgcuucacuaaauuggaccuucacauauc

SEQ ID NO: 439637 - RNA, 64 nt, hsa
cugugugcugaucgcauccucaguuucuuguccaccgcuucacuggcaagagucccaggcucca

SEQ ID NO: 439638 - RNA, 64 nt, hsa
uccuuuuccucauaccaacuugacuauguuucacccgcuucaugacuaaaucacagguggcaga

SEQ ID NO: 439639 - RNA, 64 nt, hsa
ggcuagagcgcaggggcacaaucaccacacacugccgcuucaaucuccugggcucaaaugaucc

SEQ ID NO: 439640 - RNA, 64 nt, hsa
aguacuuuggugucuccaccacugucccuucuccccgcuucaaaauaaguguaauccacgguag

SEQ ID NO: 439641 - RNA, 64 nt, hsa
gccagcuuugacaugcccgugaggacaggagccgccgcuucaguugucacugcagagccaucgu

SEQ ID NO: 439642 - RNA, 64 nt, hsa
auuuaaaauacuagugucacuuucugaguacccgccgcuucacaggcugaguccaggccugugu

SEQ ID NO: 439643 - RNA, 64 nt, hsa
ggucugggugcggguguucccugugagcccgaguccgcuucaggaggggagccugcaggugccg

SEQ ID NO: 439644 - RNA, 50 nt, hsa
cuguaccacggaaauugugaccgcuucagaggcaaggcuugccacuuggg

SEQ ID NO: 439645 - RNA, 64 nt, hsa
gcuggucuugaacuccggggcucaagcgauccucccgcuucagccucccuaagugcugggauug

SEQ ID NO: 439646 - RNA, 64 nt, hsa
aacgacaaacgcucauggcgcugcuuugcuccacccgcuucagauagaucauuguuagauauuu

SEQ ID NO: 439647 - RNA, 64 nt, hsa
aaagguuaguguuugggggccgggggaggacugaccgcuucauaagccaguacgucugagcuga

SEQ ID NO: 439648 - RNA, 64 nt, hsa
caucacccucagucagugcccaagaguggccaaaccgcuucacaucugcagugcuuccccaggg

SEQ ID NO: 439649 - RNA, 64 nt, hsa
uccaaugcacaauagccccuccgaaaggaaggaaccgcuucacuucuugccccacuuggggcag

SEQ ID NO: 439650 - RNA, 64 nt, hsa
ccuugccccagacaaccagcauguaagacccuucccgcuucaccauuccgauuccuguccccuu

SEQ ID NO: 439651 - RNA, 64 nt, hsa
cucuuggaagaucccgcauggguucgaggugaggccgcuucagaaccucaaaugaaagacuguc

SEQ ID NO: 439652 - RNA, 64 nt, hsa
gcaccccuccuccuugcugauuugcacacauuggccgcuucagacacgcacuucuggggccagc

SEQ ID NO: 439653 - RNA, 64 nt, hsa
gcuuugugccuggacccagagagugugggacuccccgcuucauccccaccgucccacuccacag

SEQ ID NO: 439654 - RNA, 64 nt, hsa
agcucuuccaaccuugacauucccaggaggagccccgcuucaccccuucugacucuggaaaccg

SEQ ID NO: 439655 - RNA, 64 nt, hsa
auguuagacagaugcugagugugcguuuucucaaccgcuucaacauuguaagcgauguaugcuu

SEQ ID NO: 439656 - RNA, 64 nt, hsa
ugaucaguuggguggccugaggcaacuccuuuccccgcuucagcccucaacugccucgaguccu

SEQ ID NO: 439657 - RNA, 64 nt, hsa
agccugcucggcuguauguuucucgcacgcucacccgcuucagugcggcucugucccugcugcc

SEQ ID NO: 439658 - RNA, 64 nt, hsa
aauagauuuaagugucacuuucccucccugccccccgcuucagucucuaccauaucugguccca

SEQ ID NO: 439659 - RNA, 64 nt, hsa
auggcagguggucccugcugaaacccccacgccuccgcuucagcaucuccacgcucugaagcug

SEQ ID NO: 439660 - RNA, 64 nt, hsa
ucgcucucccuccaugccaaggacaggacuuggaccgcuucagccugggcugggagcagcccua

SEQ ID NO: 439661 - RNA, 57 nt, hsa
gaacaaaaggcucucccuaaaagaccaccgcuucaaaaaaaccugaggaauggagug

SEQ ID NO: 439662 - RNA, 57 nt, hsa
gaacaaaaggcucucccuaaaagaccgccgcuucaaaaaaaccugaggaauggagug

SEQ ID NO: 439663 - RNA, 64 nt, hsa
gaugaugucuugucaguauuacuguuuugcuaagccgcuucauucaugccuacacaauuuuuuu

SEQ ID NO: 439664 - RNA, 64 nt, hsa; identical to SEQ ID NO: 332833

SEQ ID NO: 439665 - RNA, 64 nt, hsa; identical to SEQ ID NO: 332834

SEQ ID NO: 439666 - RNA, 64 nt, hsa; identical to SEQ ID NO: 332835

SEQ ID NO: 439667 - RNA, 64 nt, hsa; identical to SEQ ID NO: 332836

SEQ ID NO: 439668 - RNA, 64 nt, hsa; identical to SEQ ID NO: 332837

SEQ ID NO: 439669 - RNA, 64 nt, hsa; identical to SEQ ID NO: 332838

SEQ ID NO: 439670 - RNA, 64 nt, hsa; identical to SEQ ID NO: 332839

SEQ ID NO: 439671 - RNA, 64 nt, hsa; identical to SEQ ID NO: 332840

SEQ ID NO: 439672 - RNA, 64 nt, hsa; identical to SEQ ID NO: 332841

SEQ ID NO: 439673 - RNA, 64 nt, hsa; identical to SEQ ID NO: 332842

SEQ ID NO: 439674 - RNA, 64 nt, hsa; identical to SEQ ID NO: 332843

SEQ ID NO: 439675 - RNA, 64 nt, hsa; identical to SEQ ID NO: 332844

SEQ ID NO: 439676 - RNA, 64 nt, hsa; identical to SEQ ID NO: 332845

SEQ ID NO: 439677 - RNA, 64 nt, hsa; identical to SEQ ID NO: 332846

SEQ ID NO: 439678 - RNA, 64 nt, hsa; identical to SEQ ID NO: 332847

SEQ ID NO: 439679 - RNA, 64 nt, hsa; identical to SEQ ID NO: 332848

SEQ ID NO: 439680 - RNA, 64 nt, hsa; identical to SEQ ID NO: 332849

SEQ ID NO: 439681 - RNA, 64 nt, hsa; identical to SEQ ID NO: 332850

SEQ ID NO: 439682 - RNA, 64 nt, hsa; identical to SEQ ID NO: 332851

SEQ ID NO: 439683 - RNA, 64 nt, hsa; identical to SEQ ID NO: 332852

SEQ ID NO: 439684 - RNA, 64 nt, hsa; identical to SEQ ID NO: 332853

SEQ ID NO: 439685 - RNA, 64 nt, hsa; identical to SEQ ID NO: 332854

SEQ ID NO: 439686 - RNA, 64 nt, hsa; identical to SEQ ID NO: 332855

SEQ ID NO: 439687 - RNA, 64 nt, hsa; identical to SEQ ID NO: 332856

SEQ ID NO: 439688 - RNA, 64 nt, hsa; identical to SEQ ID NO: 332857

SEQ ID NO: 439689 - RNA, 64 nt, hsa; identical to SEQ ID NO: 332858

SEQ ID NO: 439690 - RNA, 64 nt, hsa; identical to SEQ ID NO: 332859

SEQ ID NO: 439691 - RNA, 64 nt, hsa; identical to SEQ ID NO: 332860

SEQ ID NO: 439692 - RNA, 64 nt, hsa; identical to SEQ ID NO: 332861

SEQ ID NO: 439693 - RNA, 64 nt, hsa; identical to SEQ ID NO: 332862

SEQ ID NO: 439694 - RNA, 64 nt, hsa; identical to SEQ ID NO: 332863

SEQ ID NO: 439695 - RNA, 64 nt, hsa; identical to SEQ ID NO: 332864

SEQ ID NO: 439696 - RNA, 64 nt, hsa; identical to SEQ ID NO: 332865

SEQ ID NO: 439697 - RNA, 64 nt, hsa; identical to SEQ ID NO: 332866

SEQ ID NO: 439698 - RNA, 64 nt, hsa; identical to SEQ ID NO: 332867

SEQ ID NO: 439699 - RNA, 64 nt, hsa; identical to SEQ ID NO: 332868

SEQ ID NO: 439700 - RNA, 64 nt, hsa; identical to SEQ ID NO: 145127

SEQ ID NO: 439701 - RNA, 64 nt, hsa; identical to SEQ ID NO: 145128

SEQ ID NO: 439702 - RNA, 63 nt, hsa; identical to SEQ ID NO: 233068

SEQ ID NO: 439703 - RNA, 63 nt, hsa; identical to SEQ ID NO: 233069

SEQ ID NO: 439704 - RNA, 63 nt, hsa; identical to SEQ ID NO: 233070

SEQ ID NO: 439705 - RNA, 63 nt, hsa; identical to SEQ ID NO: 233071

SEQ ID NO: 439706 - RNA, 63 nt, hsa; identical to SEQ ID NO: 233072

SEQ ID NO: 439707 - RNA, 63 nt, hsa; identical to SEQ ID NO: 233073

SEQ ID NO: 439708 - RNA, 63 nt, hsa; identical to SEQ ID NO: 233074

SEQ ID NO: 439709 - RNA, 63 nt, hsa; identical to SEQ ID NO: 233075

SEQ ID NO: 439710 - RNA, 63 nt, hsa; identical to SEQ ID NO: 233076

SEQ ID NO: 439711 - RNA, 63 nt, hsa; identical to SEQ ID NO: 233077

SEQ ID NO: 439712 - RNA, 63 nt, hsa; identical to SEQ ID NO: 233078

SEQ ID NO: 439713 - RNA, 63 nt, hsa; identical to SEQ ID NO: 233079

SEQ ID NO: 439714 - RNA, 64 nt, hsa; identical to SEQ ID NO: 368571

SEQ ID NO: 439715 - RNA, 64 nt, hsa; identical to SEQ ID NO: 368572

SEQ ID NO: 439716 - RNA, 64 nt, hsa; identical to SEQ ID NO: 368573

SEQ ID NO: 439717 - RNA, 64 nt, hsa; identical to SEQ ID NO: 368574

SEQ ID NO: 439718 - RNA, 64 nt, hsa; identical to SEQ ID NO: 368575

SEQ ID NO: 439719 - RNA, 64 nt, hsa; identical to SEQ ID NO: 368576

SEQ ID NO: 439720 - RNA, 64 nt, hsa; identical to SEQ ID NO: 368577

SEQ ID NO: 439721 - RNA, 64 nt, hsa; identical to SEQ ID NO: 368578

SEQ ID NO: 439722 - RNA, 64 nt, hsa; identical to SEQ ID NO: 368579

SEQ ID NO: 439723 - RNA, 64 nt, hsa; identical to SEQ ID NO: 368580

SEQ ID NO: 439724 - RNA, 64 nt, hsa; identical to SEQ ID NO: 368581

SEQ ID NO: 439725 - RNA, 64 nt, hsa; identical to SEQ ID NO: 368582

SEQ ID NO: 439726 - RNA, 64 nt, hsa; identical to SEQ ID NO: 368583

SEQ ID NO: 439727 - RNA, 64 nt, hsa; identical to SEQ ID NO: 368584

SEQ ID NO: 439728 - RNA, 64 nt, hsa; identical to SEQ ID NO: 368585

SEQ ID NO: 439729 - RNA, 64 nt, hsa; identical to SEQ ID NO: 368586

SEQ ID NO: 439730 - RNA, 64 nt, hsa; identical to SEQ ID NO: 368587

SEQ ID NO: 439731 - RNA, 64 nt, hsa; identical to SEQ ID NO: 368588

SEQ ID NO: 439732 - RNA, 64 nt, hsa; identical to SEQ ID NO: 368589

SEQ ID NO: 439733 - RNA, 64 nt, hsa; identical to SEQ ID NO: 368590

SEQ ID NO: 439734 - RNA, 64 nt, hsa; identical to SEQ ID NO: 368591

SEQ ID NO: 439735 - RNA, 64 nt, hsa; identical to SEQ ID NO: 368592

SEQ ID NO: 439736 - RNA, 64 nt, hsa; identical to SEQ ID NO: 368593

SEQ ID NO: 439737 - RNA, 64 nt, hsa; identical to SEQ ID NO: 368594

SEQ ID NO: 439738 - RNA, 64 nt, hsa; identical to SEQ ID NO: 368595

SEQ ID NO: 439739 - RNA, 64 nt, hsa; identical to SEQ ID NO: 368596

SEQ ID NO: 439740 - RNA, 64 nt, hsa; identical to SEQ ID NO: 368597

SEQ ID NO: 439741 - RNA, 64 nt, hsa; identical to SEQ ID NO: 368598

SEQ ID NO: 439742 - RNA, 64 nt, hsa; identical to SEQ ID NO: 368599

SEQ ID NO: 439743 - RNA, 64 nt, hsa; identical to SEQ ID NO: 368600

SEQ ID NO: 439744 - RNA, 64 nt, hsa; identical to SEQ ID NO: 368601

SEQ ID NO: 439745 - RNA, 64 nt, hsa; identical to SEQ ID NO: 368602

SEQ ID NO: 439746 - RNA, 64 nt, hsa; identical to SEQ ID NO: 368603

SEQ ID NO: 439747 - RNA, 64 nt, hsa; identical to SEQ ID NO: 368604

SEQ ID NO: 439748 - RNA, 64 nt, hsa; identical to SEQ ID NO: 368605

SEQ ID NO: 439749 - RNA, 64 nt, hsa; identical to SEQ ID NO: 368606

SEQ ID NO: 439750 - RNA, 64 nt, hsa; identical to SEQ ID NO: 368607

SEQ ID NO: 439751 - RNA, 64 nt, hsa; identical to SEQ ID NO: 368608

SEQ ID NO: 439752 - RNA, 64 nt, hsa; identical to SEQ ID NO: 368609

SEQ ID NO: 439753 - RNA, 64 nt, hsa; identical to SEQ ID NO: 368610

SEQ ID NO: 439754 - RNA, 64 nt, hsa; identical to SEQ ID NO: 368611

SEQ ID NO: 439755 - RNA, 64 nt, hsa; identical to SEQ ID NO: 368612

SEQ ID NO: 439756 - RNA, 64 nt, hsa; identical to SEQ ID NO: 368613

SEQ ID NO: 439757 - RNA, 64 nt, hsa
uucagcaccagugaaaggcuuugagaaggacgugggcagcaaaacgacacugcgcaucaccuac

SEQ ID NO: 439758 - RNA, 64 nt, hsa
agacccagagaaggacggugccaagggccccaggggcagcaaggccuugguggagcagccagag

SEQ ID NO: 439759 - RNA, 64 nt, hsa
ccagcaggcccagcaugcagguggugggacacugggcagcaaggcugcugccggaaucacuucu

SEQ ID NO: 439760 - RNA, 64 nt, hsa
aacaaucuuuucugccuccaacuacuaugaaguuggcagcaacagaggggccuaugucaaacug

SEQ ID NO: 439761 - RNA, 64 nt, hsa
cggagcuccguggaacuggagcuagagcggugccggcagcaagcaggccuccuggugaccggag

SEQ ID NO: 439762 - RNA, 64 nt, hsa
cuaaguagccuguguuuuuaaauccagggcugcaggcagcaacgcaagucaggcugaacauuca

SEQ ID NO: 439763 - RNA, 64 nt, hsa
ucuucccuaggugaaucugugaaugguccuuucuggcagcaaucccugccuucuuuuugggccc

SEQ ID NO: 439764 - RNA, 64 nt, hsa
ggccccaucaucuuggaugcugcccugcguauuuggcagcaauggugggccacccagggccucu

SEQ ID NO: 439765 - RNA, 64 nt, hsa
aagcgucuaaccuaaagucccaggauuggcuccaggcagcaauuauaucauaacuuauugaacu

SEQ ID NO: 439766 - RNA, 64 nt, hsa
gagagagaggcugagaucauucaggaguuuguugggcagcaagcauggagcuucuugcacaaau

SEQ ID NO: 439767 - RNA, 64 nt, hsa
uagaaaaggauucuggugcuuccccuguuugcguggcagcaaggguuccacgugcauuugcaau

SEQ ID NO: 439768 - RNA, 64 nt, hsa
gcagaggagugacagccgcagacacacgacagccggcagcaacuggaauggcagcaauuaaggg

SEQ ID NO: 439769 - RNA, 64 nt, hsa
ccgcagacacacgacagccggcagcaacuggaauggcagcaauuaaggguggggggcggggguu

SEQ ID NO: 439770 - RNA, 64 nt, hsa; identical to SEQ ID NO: 215703

SEQ ID NO: 439771 - RNA, 64 nt, hsa; identical to SEQ ID NO: 215704

SEQ ID NO: 439772 - RNA, 64 nt, hsa; identical to SEQ ID NO: 215705

SEQ ID NO: 439773 - RNA, 64 nt, hsa; identical to SEQ ID NO: 215706

SEQ ID NO: 439774 - RNA, 64 nt, hsa; identical to SEQ ID NO: 215707

SEQ ID NO: 439775 - RNA, 64 nt, hsa; identical to SEQ ID NO: 215708

SEQ ID NO: 439776 - RNA, 64 nt, hsa; identical to SEQ ID NO: 215709

SEQ ID NO: 439777 - RNA, 64 nt, hsa; identical to SEQ ID NO: 215710

SEQ ID NO: 439778 - RNA, 62 nt, hsa; identical to SEQ ID NO: 215711

SEQ ID NO: 439779 - RNA, 64 nt, hsa; identical to SEQ ID NO: 215712

SEQ ID NO: 439780 - RNA, 64 nt, hsa; identical to SEQ ID NO: 215713

SEQ ID NO: 439781 - RNA, 64 nt, hsa; identical to SEQ ID NO: 215714

SEQ ID NO: 439782 - RNA, 64 nt, hsa; identical to SEQ ID NO: 215715

SEQ ID NO: 439783 - RNA, 64 nt, hsa; identical to SEQ ID NO: 215716

SEQ ID NO: 439784 - RNA, 64 nt, hsa; identical to SEQ ID NO: 215717

SEQ ID NO: 439785 - RNA, 64 nt, hsa; identical to SEQ ID NO: 215718

SEQ ID NO: 439786 - RNA, 64 nt, hsa; identical to SEQ ID NO: 215719

SEQ ID NO: 439787 - RNA, 64 nt, hsa; identical to SEQ ID NO: 215720

SEQ ID NO: 439788 - RNA, 64 nt, hsa; identical to SEQ ID NO: 215721

SEQ ID NO: 439789 - RNA, 64 nt, hsa; identical to SEQ ID NO: 215722

SEQ ID NO: 439790 - RNA, 64 nt, hsa; identical to SEQ ID NO: 215723

SEQ ID NO: 439791 - RNA, 64 nt, hsa; identical to SEQ ID NO: 215724

SEQ ID NO: 439792 - RNA, 64 nt, hsa; identical to SEQ ID NO: 215725

SEQ ID NO: 439793 - RNA, 64 nt, hsa; identical to SEQ ID NO: 215726

SEQ ID NO: 439794 - RNA, 64 nt, hsa; identical to SEQ ID NO: 215727

SEQ ID NO: 439795 - RNA, 64 nt, hsa; identical to SEQ ID NO: 215728

SEQ ID NO: 439796 - RNA, 64 nt, hsa; identical to SEQ ID NO: 215729

SEQ ID NO: 439797 - RNA, 64 nt, hsa; identical to SEQ ID NO: 215730

SEQ ID NO: 439798 - RNA, 64 nt, hsa; identical to SEQ ID NO: 215731

SEQ ID NO: 439799 - RNA, 64 nt, hsa; identical to SEQ ID NO: 215732

SEQ ID NO: 439800 - RNA, 64 nt, hsa; identical to SEQ ID NO: 215733

SEQ ID NO: 439801 - RNA, 64 nt, hsa
ugauuaaauucagccuaaacuuuuugacgggaacacugcagagacaaugcugugaguuuccaac

SEQ ID NO: 439802 - RNA, 64 nt, hsa
uagccugaguuucauaggagguaaucaccagacaacugcagaauguagaacacugagcaggaca

SEQ ID NO: 439803 - RNA, 64 nt, hsa
ccgauuuuuacugagaagagauaugccuguuguuacugcagaaccugaaccguaaguaggauga

SEQ ID NO: 439804 - RNA, 64 nt, hsa
guuaagcauaaaaagaaagggaaaaagcagaaacacugcagaagacacaaacaaacaaagaaga

SEQ ID NO: 439805 - RNA, 64 nt, hsa
ccagccugguuucauaccgaaaagacauugaaggacugcagaaauguaugggugcaccgggccg

SEQ ID NO: 439806 - RNA, 64 nt, hsa
uuucucuucugucccgucaccaggcucuugcuucacugcagauacaguucacucugaaagcugg

SEQ ID NO: 439807 - RNA, 64 nt, hsa
uuucuuacccacauuccccaaucaauacacacacacugcagaacccagaacagaaggccacagg

SEQ ID NO: 439808 - RNA, 64 nt, hsa
ccacuccucucugguaccccauccccgcaucagcacugcagagagaacacauuucggcgagggu

SEQ ID NO: 439809 - RNA, 64 nt, hsa
uucuauuaugagcuaucaaaguuuacauuuuuguacugcagacgcuucauguaaauaaaaacua

SEQ ID NO: 439810 - RNA, 64 nt, hsa
ugggcuucaugcauuauggaucccgacccccaccacugcagacucgcucuaggaagaacuggag

SEQ ID NO: 439811 - RNA, 64 nt, hsa
cuucuacuguaaugagacaagccuuucuucugucacugcagaauuuagaaggggccgugagcag

SEQ ID NO: 439812 - RNA, 64 nt, hsa
acaggcaucaagaagccagggccgugccuggagcacugcagagaugacuuuggagaaagcaaag

SEQ ID NO: 439813 - RNA, 64 nt, hsa
ggaucugaaagaucuaaacauggugugcuuagaaacugcagauuuuagaucuaauguauacugc

SEQ ID NO: 439814 - RNA, 64 nt, hsa
ucacuuaaagguaccucuguagaaauaaccuaaaacugcagaaggaucugaaagaucuaaacau

SEQ ID NO: 439815 - RNA, 64 nt, hsa
ggccucucgugguccucagccccucacccccaguacugcagaucucacaguuugccuuccagaa

SEQ ID NO: 439816 - RNA, 64 nt, hsa
guggcucugcuggcucagugugggcugcaggaggacugcagacucagcugcaauucugaggggg

SEQ ID NO: 439817 - RNA, 64 nt, hsa
caacgcugcuagucuuaaccccagaccagagagaacugcagaucugacugggccuaaauuaagu

SEQ ID NO: 439818 - RNA, 64 nt, hsa
uaucuguauuaacagcaauguuacucucaaugaaacugcagaagccaccaugaacauggaagac

SEQ ID NO: 439819 - RNA, 64 nt, hsa
aagcuacauagaagggacagggucuguguuacagacugcagaggaugugcagguacuaugcaug

SEQ ID NO: 439820 - RNA, 64 nt, hsa
uucuggaaaagaugccauucuuuuuaagcuugaaacugcagaagaaauucacaggaaaaaucaa

SEQ ID NO: 439821 - RNA, 64 nt, hsa
caaugucguaggugauagaaaacucgccuacuccacugcagaacuugcagaaugcgugguguua

SEQ ID NO: 439822 - RNA, 64 nt, hsa
aagucagagauaauugccuauacuaagaaucuauacugcagaauauaguguaucaaaaacuuuu

SEQ ID NO: 439823 - RNA, 64 nt, hsa
ggaccgugugaagcuaggggguguuucucagcacacugcagaagggcagcucagaagaaugcag

SEQ ID NO: 439824 - RNA, 64 nt, hsa
ccuuuggauguauacacacauguuucuugauuuuacugcagaucaagggguguuguuagaugcu

SEQ ID NO: 439825 - RNA, 64 nt, hsa
accacauauccacccuugagaaguaugucaaaagacugcagacuauagauuuuuuuuuaauaua

SEQ ID NO: 439826 - RNA, 64 nt, hsa
aucccucucugcugcuuuuguuggugcugcccacacugcagauauauuaaggauguuaggagag

SEQ ID NO: 439827 - RNA, 64 nt, hsa
uuuucuuaaaaccaaucaauaauagcuagcuauuacugcagacuauaaaaucuggauauagaaa

SEQ ID NO: 439828 - RNA, 64 nt, hsa
uuauaaacauuuaaagacaaagacauuucaaauaacugcagaaaaaauauuguaguuugaauau

SEQ ID NO: 439829 - RNA, 64 nt, hsa
ggcuucuucagucgcucccuggaggcaggugggcacugcagaggaucacuggaauccagaucga

SEQ ID NO: 439830 - RNA, 64 nt, hsa
guaaaggacuggggaggcgugucuugaaaaagcaacugcagaaauuccuuaugaugauugugug

SEQ ID NO: 439831 - RNA, 64 nt, hsa
cuuuacuuuuuuccccccaaauagguauauauagacugcagaagcuucagucccauauauaaac

SEQ ID NO: 439832 - RNA, 64 nt, hsa
aaaguguuuuugagaauuuuuauauauauuacucacugcagagaucauguucauuuacauuccc

SEQ ID NO: 439833 - RNA, 64 nt, hsa
ucccauuuuguuuuuccagaguucguggagguggacugcagagcccagagcccuucaucucucu

SEQ ID NO: 439834 - RNA, 64 nt, hsa
gcuuggagaguggaucagagagacuaggacaguuacugcagagcuccuaagucaccacucaacc

SEQ ID NO: 439835 - RNA, 64 nt, hsa
ugucaucugaugcauuuggaccauaugcugccagacugcagaacgggggagccggggcucaggg

SEQ ID NO: 439836 - RNA, 64 nt, hsa
gaggguuguguggacaccccucgcucugaugccaacugcagauaauacacaccuccugcagcgu

SEQ ID NO: 439837 - RNA, 64 nt, hsa
ccucaggacuguccuggcuccgaccuuuguguacacugcagacgcugguucugaggaacuguug

SEQ ID NO: 439838 - RNA, 64 nt, hsa
ucccuuucaugcugcauauuaacugguuaauuauacugcagaaaccuuuucaccuccacuaguc

SEQ ID NO: 439839 - RNA, 64 nt, hsa
acagucacaccuugcaagucaucauagucuucauacugcagagaaaucuuacaaaugugaagac

SEQ ID NO: 439840 - RNA, 64 nt, hsa
aaaaacaacccuugcacgucaucauagaauucauacugcagagaaacuuuacaaauaggaagaa

SEQ ID NO: 439841 - RNA, 64 nt, hsa
aaaaauauucauguagcaaaucugagaauugaaaacugcagauaaccggccggguauggugacu

SEQ ID NO: 439842 - RNA, 64 nt, hsa
aaaaaaaaaaaaaacagaaagaaagaaaaagaaaacugcagauaacccuauacauuaauacugg

SEQ ID NO: 439843 - RNA, 64 nt, hsa
ggggaagggucuccaggcuuuauuccucccaggcacugcagaggcaccggugaggaagggucuc

SEQ ID NO: 439844 - RNA, 64 nt, hsa
agguucagggagaacagcugcguugcucccaggcacugcagaggcccgguggggaagggucucc

SEQ ID NO: 439845 - RNA, 64 nt, hsa; identical to SEQ ID NO: 88665

SEQ ID NO: 439846 - RNA, 64 nt, hsa; identical to SEQ ID NO: 88666

SEQ ID NO: 439847 - RNA, 64 nt, hsa; identical to SEQ ID NO: 88667

SEQ ID NO: 439848 - RNA, 64 nt, hsa; identical to SEQ ID NO: 88668

SEQ ID NO: 439849 - RNA, 64 nt, hsa; identical to SEQ ID NO: 88669

SEQ ID NO: 439850 - RNA, 64 nt, hsa; identical to SEQ ID NO: 88670

SEQ ID NO: 439851 - RNA, 64 nt, hsa; identical to SEQ ID NO: 88671

SEQ ID NO: 439852 - RNA, 64 nt, hsa; identical to SEQ ID NO: 88672

SEQ ID NO: 439853 - RNA, 64 nt, hsa; identical to SEQ ID NO: 88673

SEQ ID NO: 439854 - RNA, 64 nt, hsa; identical to SEQ ID NO: 88674

SEQ ID NO: 439855 - RNA, 64 nt, hsa; identical to SEQ ID NO: 88675

SEQ ID NO: 439856 - RNA, 64 nt, hsa; identical to SEQ ID NO: 88676

SEQ ID NO: 439857 - RNA, 64 nt, hsa; identical to SEQ ID NO: 88677

SEQ ID NO: 439858 - RNA, 64 nt, hsa; identical to SEQ ID NO: 88678

SEQ ID NO: 439859 - RNA, 64 nt, hsa; identical to SEQ ID NO: 88679

SEQ ID NO: 439860 - RNA, 64 nt, hsa; identical to SEQ ID NO: 88680

SEQ ID NO: 439861 - RNA, 64 nt, hsa; identical to SEQ ID NO: 88681

SEQ ID NO: 439862 - RNA, 64 nt, hsa; identical to SEQ ID NO: 88682

SEQ ID NO: 439863 - RNA, 64 nt, hsa; identical to SEQ ID NO: 88683

SEQ ID NO: 439864 - RNA, 64 nt, hsa; identical to SEQ ID NO: 88684

SEQ ID NO: 439865 - RNA, 64 nt, hsa; identical to SEQ ID NO: 88685

SEQ ID NO: 439866 - RNA, 64 nt, hsa; identical to SEQ ID NO: 88686

SEQ ID NO: 439867 - RNA, 64 nt, hsa; identical to SEQ ID NO: 88687

SEQ ID NO: 439868 - RNA, 64 nt, hsa; identical to SEQ ID NO: 88688

SEQ ID NO: 439869 - RNA, 64 nt, hsa; identical to SEQ ID NO: 88689

SEQ ID NO: 439870 - RNA, 64 nt, hsa; identical to SEQ ID NO: 88690

SEQ ID NO: 439871 - RNA, 64 nt, hsa; identical to SEQ ID NO: 88691

SEQ ID NO: 439872 - RNA, 50 nt, hsa; identical to SEQ ID NO: 88692

SEQ ID NO: 439873 - RNA, 64 nt, hsa; identical to SEQ ID NO: 88693

SEQ ID NO: 439874 - RNA, 64 nt, hsa; identical to SEQ ID NO: 88694

SEQ ID NO: 439875 - RNA, 64 nt, hsa; identical to SEQ ID NO: 88695

SEQ ID NO: 439876 - RNA, 64 nt, hsa; identical to SEQ ID NO: 88696

SEQ ID NO: 439877 - RNA, 64 nt, hsa; identical to SEQ ID NO: 88697

SEQ ID NO: 439878 - RNA, 64 nt, hsa; identical to SEQ ID NO: 88698

SEQ ID NO: 439879 - RNA, 64 nt, hsa; identical to SEQ ID NO: 88699

SEQ ID NO: 439880 - RNA, 64 nt, hsa; identical to SEQ ID NO: 88700

SEQ ID NO: 439881 - RNA, 64 nt, hsa; identical to SEQ ID NO: 88701

SEQ ID NO: 439882 - RNA, 64 nt, hsa; identical to SEQ ID NO: 88702

SEQ ID NO: 439883 - RNA, 64 nt, hsa; identical to SEQ ID NO: 88703

SEQ ID NO: 439884 - RNA, 64 nt, hsa; identical to SEQ ID NO: 88704

SEQ ID NO: 439885 - RNA, 64 nt, hsa; identical to SEQ ID NO: 88705

SEQ ID NO: 439886 - RNA, 64 nt, hsa; identical to SEQ ID NO: 88706

SEQ ID NO: 439887 - RNA, 64 nt, hsa; identical to SEQ ID NO: 88707

SEQ ID NO: 439888 - RNA, 64 nt, hsa; identical to SEQ ID NO: 88708

SEQ ID NO: 439889 - RNA, 64 nt, hsa; identical to SEQ ID NO: 88709

SEQ ID NO: 439890 - RNA, 64 nt, hsa; identical to SEQ ID NO: 88710

SEQ ID NO: 439891 - RNA, 64 nt, hsa; identical to SEQ ID NO: 88711

SEQ ID NO: 439892 - RNA, 64 nt, hsa; identical to SEQ ID NO: 88712

SEQ ID NO: 439893 - RNA, 64 nt, hsa; identical to SEQ ID NO: 88713

SEQ ID NO: 439894 - RNA, 64 nt, hsa; identical to SEQ ID NO: 88714

SEQ ID NO: 439895 - RNA, 64 nt, hsa; identical to SEQ ID NO: 88715

SEQ ID NO: 439896 - RNA, 64 nt, hsa; identical to SEQ ID NO: 88716

SEQ ID NO: 439897 - RNA, 64 nt, hsa; identical to SEQ ID NO: 88717

SEQ ID NO: 439898 - RNA, 64 nt, hsa; identical to SEQ ID NO: 88718

SEQ ID NO: 439899 - RNA, 64 nt, hsa; identical to SEQ ID NO: 88719

SEQ ID NO: 439900 - RNA, 64 nt, hsa; identical to SEQ ID NO: 88720

SEQ ID NO: 439901 - RNA, 64 nt, hsa; identical to SEQ ID NO: 88721

SEQ ID NO: 439902 - RNA, 64 nt, hsa; identical to SEQ ID NO: 88722

SEQ ID NO: 439903 - RNA, 64 nt, hsa; identical to SEQ ID NO: 88723

SEQ ID NO: 439904 - RNA, 64 nt, hsa; identical to SEQ ID NO: 88724

SEQ ID NO: 439905 - RNA, 64 nt, hsa; identical to SEQ ID NO: 88725

SEQ ID NO: 439906 - RNA, 64 nt, hsa; identical to SEQ ID NO: 88726

SEQ ID NO: 439907 - RNA, 64 nt, hsa; identical to SEQ ID NO: 88727

SEQ ID NO: 439908 - RNA, 64 nt, hsa; identical to SEQ ID NO: 88728

SEQ ID NO: 439909 - RNA, 64 nt, hsa; identical to SEQ ID NO: 88729

SEQ ID NO: 439910 - RNA, 64 nt, hsa; identical to SEQ ID NO: 88730

SEQ ID NO: 439911 - RNA, 64 nt, hsa; identical to SEQ ID NO: 88731

SEQ ID NO: 439912 - RNA, 64 nt, hsa; identical to SEQ ID NO: 88732

SEQ ID NO: 439913 - RNA, 64 nt, hsa; identical to SEQ ID NO: 88733

SEQ ID NO: 439914 - RNA, 64 nt, hsa; identical to SEQ ID NO: 88734

SEQ ID NO: 439915 - RNA, 64 nt, hsa; identical to SEQ ID NO: 88735

SEQ ID NO: 439916 - RNA, 64 nt, hsa; identical to SEQ ID NO: 88736

SEQ ID NO: 439917 - RNA, 64 nt, hsa; identical to SEQ ID NO: 88737

SEQ ID NO: 439918 - RNA, 64 nt, hsa; identical to SEQ ID NO: 88738

SEQ ID NO: 439919 - RNA, 64 nt, hsa; identical to SEQ ID NO: 88739

SEQ ID NO: 439920 - RNA, 64 nt, hsa; identical to SEQ ID NO: 88740

SEQ ID NO: 439921 - RNA, 64 nt, hsa; identical to SEQ ID NO: 88741

SEQ ID NO: 439922 - RNA, 64 nt, hsa; identical to SEQ ID NO: 88742

SEQ ID NO: 439923 - RNA, 64 nt, hsa; identical to SEQ ID NO: 88743

SEQ ID NO: 439924 - RNA, 64 nt, hsa; identical to SEQ ID NO: 88744

SEQ ID NO: 439925 - RNA, 64 nt, hsa; identical to SEQ ID NO: 88745

SEQ ID NO: 439926 - RNA, 64 nt, hsa; identical to SEQ ID NO: 88746

SEQ ID NO: 439927 - RNA, 64 nt, hsa; identical to SEQ ID NO: 88747

SEQ ID NO: 439928 - RNA, 64 nt, hsa; identical to SEQ ID NO: 88748

SEQ ID NO: 439929 - RNA, 64 nt, hsa; identical to SEQ ID NO: 88749

SEQ ID NO: 439930 - RNA, 64 nt, hsa; identical to SEQ ID NO: 88750

SEQ ID NO: 439931 - RNA, 64 nt, hsa; identical to SEQ ID NO: 88751

SEQ ID NO: 439932 - RNA, 64 nt, hsa; identical to SEQ ID NO: 88752

SEQ ID NO: 439933 - RNA, 64 nt, hsa; identical to SEQ ID NO: 88753

SEQ ID NO: 439934 - RNA, 64 nt, hsa; identical to SEQ ID NO: 88754

SEQ ID NO: 439935 - RNA, 64 nt, hsa; identical to SEQ ID NO: 88755

SEQ ID NO: 439936 - RNA, 64 nt, hsa; identical to SEQ ID NO: 88756

SEQ ID NO: 439937 - RNA, 64 nt, hsa; identical to SEQ ID NO: 88757

SEQ ID NO: 439938 - RNA, 64 nt, hsa; identical to SEQ ID NO: 88758

SEQ ID NO: 439939 - RNA, 64 nt, hsa; identical to SEQ ID NO: 88759

SEQ ID NO: 439940 - RNA, 64 nt, hsa; identical to SEQ ID NO: 88760

SEQ ID NO: 439941 - RNA, 64 nt, hsa; identical to SEQ ID NO: 88761

SEQ ID NO: 439942 - RNA, 64 nt, hsa; identical to SEQ ID NO: 88762

SEQ ID NO: 439943 - RNA, 64 nt, hsa; identical to SEQ ID NO: 88763

SEQ ID NO: 439944 - RNA, 64 nt, hsa; identical to SEQ ID NO: 88764

SEQ ID NO: 439945 - RNA, 64 nt, hsa; identical to SEQ ID NO: 88765

SEQ ID NO: 439946 - RNA, 64 nt, hsa; identical to SEQ ID NO: 212912

SEQ ID NO: 439947 - RNA, 64 nt, hsa; identical to SEQ ID NO: 212913

SEQ ID NO: 439948 - RNA, 64 nt, hsa; identical to SEQ ID NO: 212914

SEQ ID NO: 439949 - RNA, 64 nt, hsa; identical to SEQ ID NO: 212915

SEQ ID NO: 439950 - RNA, 64 nt, hsa; identical to SEQ ID NO: 212916

SEQ ID NO: 439951 - RNA, 64 nt, hsa; identical to SEQ ID NO: 212917

SEQ ID NO: 439952 - RNA, 64 nt, hsa; identical to SEQ ID NO: 212918

SEQ ID NO: 439953 - RNA, 64 nt, hsa
uccagaaggguaaacuaaacuaaagcuacaauuaauaugggaauuuggaagaagugguaggauu

SEQ ID NO: 439954 - RNA, 64 nt, hsa
auugaguugaggcuguggagaaauaaggacacauauaugggaauggaaugcaaaaguuaaacuu

SEQ ID NO: 439955 - RNA, 64 nt, hsa
cagugcuaggaauacuguguaucuaucauuagcuauaugggacuauauuguagauugugguuuc

SEQ ID NO: 439956 - RNA, 64 nt, hsa
uguaccagcuuuaccacuuuucagccauuuauuaauaugggaauuuaacuuacucaagcaauag

SEQ ID NO: 439957 - RNA, 64 nt, hsa
gccaauguuuuuauaaaucacuuguacauaguacauaugggaauaguugcauaugggaauuuaa

SEQ ID NO: 439958 - RNA, 64 nt, hsa
aucacuuguacauaguacauaugggaauaguugcauaugggaauuuaaaccaacauguggcuga

SEQ ID NO: 439959 - RNA, 64 nt, hsa
aaaacaaaacaguaagauugucuguaaucacaucauaugggaauaaaaaacaaaaauaauuucc

SEQ ID NO: 439960 - RNA, 64 nt, hsa
aaauacauugagaaaguuuccaucuuauucuuuuauaugggacugaugauguguguugggguag

SEQ ID NO: 439961 - RNA, 64 nt, hsa; identical to SEQ ID NO: 183983

SEQ ID NO: 439962 - RNA, 64 nt, hsa; identical to SEQ ID NO: 183984

SEQ ID NO: 439963 - RNA, 64 nt, hsa; identical to SEQ ID NO: 183985

SEQ ID NO: 439964 - RNA, 64 nt, hsa; identical to SEQ ID NO: 183986

SEQ ID NO: 439965 - RNA, 64 nt, hsa; identical to SEQ ID NO: 183987

SEQ ID NO: 439966 - RNA, 64 nt, hsa; identical to SEQ ID NO: 183988

SEQ ID NO: 439967 - RNA, 64 nt, hsa; identical to SEQ ID NO: 183989

SEQ ID NO: 439968 - RNA, 64 nt, hsa; identical to SEQ ID NO: 183990

SEQ ID NO: 439969 - RNA, 64 nt, hsa; identical to SEQ ID NO: 183991

SEQ ID NO: 439970 - RNA, 64 nt, hsa; identical to SEQ ID NO: 183992

SEQ ID NO: 439971 - RNA, 64 nt, hsa; identical to SEQ ID NO: 183993

SEQ ID NO: 439972 - RNA, 64 nt, hsa; identical to SEQ ID NO: 183994

SEQ ID NO: 439973 - RNA, 64 nt, hsa; identical to SEQ ID NO: 183995

SEQ ID NO: 439974 - RNA, 64 nt, hsa; identical to SEQ ID NO: 183996

SEQ ID NO: 439975 - RNA, 64 nt, hsa; identical to SEQ ID NO: 183997

SEQ ID NO: 439976 - RNA, 64 nt, hsa; identical to SEQ ID NO: 183998

SEQ ID NO: 439977 - RNA, 64 nt, hsa; identical to SEQ ID NO: 183999

SEQ ID NO: 439978 - RNA, 64 nt, hsa; identical to SEQ ID NO: 184000

SEQ ID NO: 439979 - RNA, 64 nt, hsa; identical to SEQ ID NO: 184001

SEQ ID NO: 439980 - RNA, 64 nt, hsa; identical to SEQ ID NO: 184002

SEQ ID NO: 439981 - RNA, 64 nt, hsa; identical to SEQ ID NO: 184003

SEQ ID NO: 439982 - RNA, 64 nt, hsa; identical to SEQ ID NO: 184004

SEQ ID NO: 439983 - RNA, 64 nt, hsa; identical to SEQ ID NO: 184005

SEQ ID NO: 439984 - RNA, 64 nt, hsa; identical to SEQ ID NO: 184006

SEQ ID NO: 439985 - RNA, 64 nt, hsa; identical to SEQ ID NO: 184007

SEQ ID NO: 439986 - RNA, 64 nt, hsa; identical to SEQ ID NO: 184008

SEQ ID NO: 439987 - RNA, 64 nt, hsa; identical to SEQ ID NO: 184009

SEQ ID NO: 439988 - RNA, 64 nt, hsa; identical to SEQ ID NO: 184010

SEQ ID NO: 439989 - RNA, 64 nt, hsa; identical to SEQ ID NO: 184011

SEQ ID NO: 439990 - RNA, 64 nt, hsa; identical to SEQ ID NO: 184012

SEQ ID NO: 439991 - RNA, 64 nt, hsa; identical to SEQ ID NO: 184013

SEQ ID NO: 439992 - RNA, 64 nt, hsa; identical to SEQ ID NO: 184014

SEQ ID NO: 439993 - RNA, 64 nt, hsa; identical to SEQ ID NO: 184015

SEQ ID NO: 439994 - RNA, 64 nt, hsa; identical to SEQ ID NO: 184016

SEQ ID NO: 439995 - RNA, 64 nt, hsa; identical to SEQ ID NO: 184017

SEQ ID NO: 439996 - RNA, 64 nt, hsa; identical to SEQ ID NO: 184018

SEQ ID NO: 439997 - RNA, 64 nt, hsa; identical to SEQ ID NO: 184019

SEQ ID NO: 439998 - RNA, 64 nt, hsa; identical to SEQ ID NO: 184020

SEQ ID NO: 439999 - RNA, 64 nt, hsa; identical to SEQ ID NO: 184021

SEQ ID NO: 440000 - RNA, 64 nt, hsa; identical to SEQ ID NO: 184022

SEQ ID NO: 440001 - RNA, 64 nt, hsa; identical to SEQ ID NO: 184023

SEQ ID NO: 440002 - RNA, 64 nt, hsa; identical to SEQ ID NO: 184024

SEQ ID NO: 440003 - RNA, 64 nt, hsa; identical to SEQ ID NO: 184025

SEQ ID NO: 440004 - RNA, 64 nt, hsa; identical to SEQ ID NO: 184026

SEQ ID NO: 440005 - RNA, 64 nt, hsa; identical to SEQ ID NO: 184027

SEQ ID NO: 440006 - RNA, 64 nt, hsa; identical to SEQ ID NO: 184028

SEQ ID NO: 440007 - RNA, 64 nt, hsa; identical to SEQ ID NO: 184029

SEQ ID NO: 440008 - RNA, 64 nt, hsa; identical to SEQ ID NO: 184030

SEQ ID NO: 440009 - RNA, 64 nt, hsa; identical to SEQ ID NO: 184031

SEQ ID NO: 440010 - RNA, 64 nt, hsa; identical to SEQ ID NO: 184032

SEQ ID NO: 440011 - RNA, 64 nt, hsa; identical to SEQ ID NO: 184033

SEQ ID NO: 440012 - RNA, 64 nt, hsa
cacagcaccaggcccacggaaaguggcuaauguuagcuacuaugaauggugccagugaagacac

SEQ ID NO: 440013 - RNA, 64 nt, hsa
uuggcuggguguggugucacaugccaguaaccccagcuacuagggaggcugaggcaggagaauc

SEQ ID NO: 440014 - RNA, 64 nt, hsa
cugguauucccagcugccauguggcagcagcaggagcuacuagaauauucucagcacaggaaug

SEQ ID NO: 440015 - RNA, 64 nt, hsa
uuagcugggcgugguggugcaugccuguaaucccagcuacuagggaggcugaggcaagagaguu

SEQ ID NO: 440016 - RNA, 64 nt, hsa
agauuugaugagcaagugguuaggaugcagggagagcuacuaugggugauauuuuccuuguuua

SEQ ID NO: 440017 - RNA, 64 nt, hsa
auagauuuaccuuauauugucuuuauuuuccaugagcuacuaagucauuagagauacucugaag

SEQ ID NO: 440018 - RNA, 64 nt, hsa; identical to SEQ ID NO: 110071

SEQ ID NO: 440019 - RNA, 64 nt, hsa; identical to SEQ ID NO: 110072

SEQ ID NO: 440020 - RNA, 64 nt, hsa; identical to SEQ ID NO: 110073

SEQ ID NO: 440021 - RNA, 64 nt, hsa; identical to SEQ ID NO: 110074

SEQ ID NO: 440022 - RNA, 64 nt, hsa; identical to SEQ ID NO: 110075

SEQ ID NO: 440023 - RNA, 64 nt, hsa; identical to SEQ ID NO: 110076

SEQ ID NO: 440024 - RNA, 64 nt, hsa; identical to SEQ ID NO: 110077

SEQ ID NO: 440025 - RNA, 64 nt, hsa; identical to SEQ ID NO: 110078

SEQ ID NO: 440026 - RNA, 64 nt, hsa; identical to SEQ ID NO: 110079

SEQ ID NO: 440027 - RNA, 64 nt, hsa; identical to SEQ ID NO: 110080

SEQ ID NO: 440028 - RNA, 64 nt, hsa; identical to SEQ ID NO: 110081

SEQ ID NO: 440029 - RNA, 64 nt, hsa; identical to SEQ ID NO: 110082

SEQ ID NO: 440030 - RNA, 64 nt, hsa; identical to SEQ ID NO: 110083

SEQ ID NO: 440031 - RNA, 64 nt, hsa; identical to SEQ ID NO: 110084

SEQ ID NO: 440032 - RNA, 64 nt, hsa; identical to SEQ ID NO: 110085

SEQ ID NO: 440033 - RNA, 64 nt, hsa; identical to SEQ ID NO: 110086

SEQ ID NO: 440034 - RNA, 64 nt, hsa; identical to SEQ ID NO: 110087

SEQ ID NO: 440035 - RNA, 64 nt, hsa; identical to SEQ ID NO: 110088

SEQ ID NO: 440036 - RNA, 64 nt, hsa; identical to SEQ ID NO: 110089

SEQ ID NO: 440037 - RNA, 64 nt, hsa; identical to SEQ ID NO: 110090

SEQ ID NO: 440038 - RNA, 64 nt, hsa; identical to SEQ ID NO: 110091

SEQ ID NO: 440039 - RNA, 64 nt, hsa; identical to SEQ ID NO: 110092

SEQ ID NO: 440040 - RNA, 64 nt, hsa; identical to SEQ ID NO: 110093

SEQ ID NO: 440041 - RNA, 64 nt, hsa; identical to SEQ ID NO: 110094

SEQ ID NO: 440042 - RNA, 64 nt, hsa; identical to SEQ ID NO: 110095

SEQ ID NO: 440043 - RNA, 64 nt, hsa; identical to SEQ ID NO: 110096

SEQ ID NO: 440044 - RNA, 64 nt, hsa; identical to SEQ ID NO: 110097

SEQ ID NO: 440045 - RNA, 64 nt, hsa; identical to SEQ ID NO: 110098

SEQ ID NO: 440046 - RNA, 64 nt, hsa; identical to SEQ ID NO: 110099

SEQ ID NO: 440047 - RNA, 64 nt, hsa; identical to SEQ ID NO: 110100

SEQ ID NO: 440048 - RNA, 64 nt, hsa; identical to SEQ ID NO: 110101

SEQ ID NO: 440049 - RNA, 64 nt, hsa; identical to SEQ ID NO: 110102

SEQ ID NO: 440050 - RNA, 64 nt, hsa; identical to SEQ ID NO: 110103

SEQ ID NO: 440051 - RNA, 64 nt, hsa; identical to SEQ ID NO: 110104

SEQ ID NO: 440052 - RNA, 64 nt, hsa; identical to SEQ ID NO: 110105

SEQ ID NO: 440053 - RNA, 64 nt, hsa; identical to SEQ ID NO: 110106

SEQ ID NO: 440054 - RNA, 64 nt, hsa
ucuucuuuccuucugacagaccaggucaucuggcuuccgagaucaucagagaagauaagucugu

SEQ ID NO: 440055 - RNA, 64 nt, hsa
gagacuuuucaugaaacugaauaaaagaaauccuuuccgagauagaggagauuuguaggugaau

SEQ ID NO: 440056 - RNA, 64 nt, hsa
cucaggagaauagcuuuuacucugguaggaaugcuuccgagacaccacaaggcagccugaacac

SEQ ID NO: 440057 - RNA, 64 nt, hsa
agagaucgaagccguggagguggagaucggccgcuuccgagaccagcaguacgagaugcucaag

SEQ ID NO: 440058 - RNA, 64 nt, hsa
ggcauucuuuuaaaaccaggcugaaacauuuuauuuccgagacuuaacguuguguuuccuguuu

SEQ ID NO: 440059 - RNA, 64 nt, hsa
aggaccccuggggcccccaucggagcccugcaaauuccgagaaaugugaaacuuggugggguca

SEQ ID NO: 440060 - RNA, 64 nt, hsa
cacagagaaguuggguuuaggacagcaggugcuguuccgagacucaguccuaaaggguuuuuuu

SEQ ID NO: 440061 - RNA, 64 nt, hsa
ugucacauuacuaagauacgauauuucuuuuuuuuuccgagacggagucuugcucugccacugu

SEQ ID NO: 440062 - RNA, 64 nt, hsa
aguaagaagcgugucugggucuggagaagggugcuuccgagagugugcagguggcccuuccccu

SEQ ID NO: 440063 - RNA, 64 nt, hsa
uggaguuaugcugcguaugaaaggaugagucuucuuccgagaaauaaagcuuguuuguucuccc

SEQ ID NO: 440064 - RNA, 64 nt, hsa
aggaguauuaguacauaaauuuucuacucaacaauuccgagauaggauuaugccuaguuuguca

SEQ ID NO: 440065 - RNA, 64 nt, hsa
caucaugauggaaggugcagacuuuuuuggaaguuuccgagaggagggucuauagaccauuugu

SEQ ID NO: 440066 - RNA, 64 nt, hsa
cuaguguuaauccagagaaccccccgcaaugugcuuccgagauucagacugcuucauugggaag

SEQ ID NO: 440067 - RNA, 64 nt, hsa
acucccuccuuuagugaaggagccguguuagagcuuccgagaauagcuccacuggagagaagug

SEQ ID NO: 440068 - RNA, 64 nt, hsa
auccauuucuuuguaucuauaucaacguauacuuuuccgagacuguauacguccauauagauag

SEQ ID NO: 440069 - RNA, 64 nt, hsa
cccccaggaauacuuuaaguuaugcccagaaaacuuccgagaugaggauguuuuugucugugaa

SEQ ID NO: 440070 - RNA, 64 nt, hsa
gccaggagugggcucauccuagaggagcggaguuuuccgagaggaccaucuccugguuuccuga

SEQ ID NO: 440071 - RNA, 64 nt, hsa
ucaugccucaggcaaaggcguggguccaucguucuuccgagaggguuuguguggcgacuacacc

SEQ ID NO: 440072 - RNA, 64 nt, hsa
gaacugcuuucuguaauugcacuguggauaaauguuccgagagucuccauuguuguacaggauc

SEQ ID NO: 440073 - RNA, 64 nt, hsa
agagcugauaauuuguuagcuggaaccuauucacuuccgagauucagacauagccaugcuggug

SEQ ID NO: 440074 - RNA, 64 nt, hsa
agccuugccuucccuccucuuaaaucaggguguguuccgagauuacagaacaucacaccuuggc

SEQ ID NO: 440075 - RNA, 64 nt, hsa
agaggcucacaccuacaaaugcuucacucuguccuuccgagaccugacaagcuuugaggaccuc

SEQ ID NO: 440076 - RNA, 64 nt, hsa
gcuggcucugacaagaugguccauuuguuccugcuuccgagauccccagggcagccuggauccc

SEQ ID NO: 440077 - RNA, 64 nt, hsa
gggaggcgccuggcuguaucccccgcaggcccucuuccgagagccuuccuccucgggcagugcg

SEQ ID NO: 440078 - RNA, 64 nt, hsa
gucucaugggucucugcgcccugcacuucguacuuuccgagaguuuaacuggugcuuagagaga

SEQ ID NO: 440079 - RNA, 64 nt, hsa
aagcaaguuugagguuucauccuucaaaaggggguuccgagagagcaccguagggcuuuucuca

SEQ ID NO: 440080 - RNA, 64 nt, hsa
guaucaaauaauugaaagaaaaguuuaaacacauuuccgagaggcagggcaacuaauaacuggu

SEQ ID NO: 440081 - RNA, 64 nt, hsa
cuuuugguacaguguuuucaucucuuggucauaauuccgagauccccagagaccacuguuucug

SEQ ID NO: 440082 - RNA, 64 nt, hsa
gggugagaggugauagaggcagcacugugcaugauuccgagagggugugguggcacugccagcc

SEQ ID NO: 440083 - RNA, 64 nt, hsa
auccaaguacuaaccaggcccgacccugcuuagcuuccgagaucagaugagaucaggcgcguuc

SEQ ID NO: 440084 - RNA, 64 nt, hsa
ucucuucuugcacuguccccaaacuugcugucaauuccgagaucuaaucucccccuacgcucug

SEQ ID NO: 440085 - RNA, 64 nt, hsa
caccuguaggggaccugucugacugggaagggaguuccgagagggagggggcaaucccuucccc

SEQ ID NO: 440086 - RNA, 64 nt, hsa
uccacagugucccauuuuccgacuaggagacaucuuccgagaaacaggcgauaauuuuucagau

SEQ ID NO: 440087 - RNA, 64 nt, hsa
uguauuuuaaaaaauagggcaauugauugggccauuccgagagaauuguuugcaaguuuugggu

SEQ ID NO: 440088 - RNA, 64 nt, hsa
cugggggaggagaggaagaagcgcggcuaacuuauuccgagaaugccgaggaguugucguuuuu

SEQ ID NO: 440089 - RNA, 64 nt, hsa
gcaugauuaagacaauaaaguauuuuuucuagucuuccgagaaacuuuucugaucaguuugcga

SEQ ID NO: 440090 - RNA, 64 nt, hsa
agaugggaugaugcucagacucaucugaucaaaguuccgagaggcauagaaggaaaaacgaagg

SEQ ID NO: 440091 - RNA, 64 nt, hsa
uuuuucacaccaggauaccaaggguuugguggacuuccgagauguggcccuugcacuagcagcu

SEQ ID NO: 440092 - RNA, 64 nt, hsa
auguguuguugcuguguccuggaggagacaugaguuccgagaugacccaaucugccuuugaauc

SEQ ID NO: 440093 - RNA, 64 nt, hsa
ugguggcaguagcgaugcaagaaugaugggagcuuuccgagagcguucaguguuucacugaaga

SEQ ID NO: 440094 - RNA, 64 nt, hsa
agcugcuggcgcacaggccucuucuccccggcacuuccgagauccaccagaucgacuugaucgu

SEQ ID NO: 440095 - RNA, 64 nt, hsa
cugccuuucugacuuggccgccguguccaacaaauuccgagaccucuugcagguaagccccagg

SEQ ID NO: 440096 - RNA, 64 nt, hsa
cagcuucaccaggggcuuuucaggugugcucggcuuccgagaguucuucaagugggccaacacc

SEQ ID NO: 440097 - RNA, 64 nt, hsa
gggacaaagugugggugauccuggagacgccaguuuccgagauuguucugcauauucauuugca

SEQ ID NO: 440098 - RNA, 64 nt, hsa
acggcggcaccggggcucuguggaaucccgaucguuccgagaggucuggagggccccgugguuc

SEQ ID NO: 440099 - RNA, 64 nt, hsa
cugaaguuacacugccagcaguuccccaggccucuuccgagaggcacaugguucuagccuggac

SEQ ID NO: 440100 - RNA, 64 nt, hsa
cgcccugccgaggcccgauggcuccaucaucuucuuccgagaugaccgcuacuggcgccucgac

SEQ ID NO: 440101 - RNA, 64 nt, hsa
aacuaaaggagccaucucucuccccucuccuccguuccgagaggaggggugggucucagacguu

SEQ ID NO: 440102 - RNA, 64 nt, hsa
ggcagaauacauugaucagcaguuugagcaguauuuccgagacgagaguggccugaaccgaaag

SEQ ID NO: 440103 - RNA, 64 nt, hsa
aggccagaugcacaucccuggaaggacauccauguuccgagaagaacagauaaucccuguauuu

SEQ ID NO: 440104 - RNA, 64 nt, hsa
uaaaagcugaagagagcguauuauuauucgcccauuccgagagaaaguugaagaugacugaaga

SEQ ID NO: 440105 - RNA, 64 nt, hsa
ggggucagggcaggaaggaacuucacucugcugcuuccgagaaccucggccgugacauucgggg

SEQ ID NO: 440106 - RNA, 64 nt, hsa
cccccaggaugaagucgucuucuucggugaccacuuccgagacccaacccugcacgcccagcuc

SEQ ID NO: 440107 - RNA, 64 nt, hsa
agccccagacccgaaaaaaguguucugcccaagauuccgagagcccugcgcucuagggcagggg

SEQ ID NO: 440108 - RNA, 64 nt, hsa
agucacagcagcaagacacgcacagucaaccauuuuccgagaaaaaaagaaaauuccccacuug

SEQ ID NO: 440109 - RNA, 64 nt, hsa
cgcccuuggcuucccacccuccucuccaguccuuuuccgagaugaggugagacaaggguccaac

SEQ ID NO: 440110 - RNA, 64 nt, hsa
uucuugcccuuucuuuuuuuuuuuuuuuuuuuuuuuccgagauggagucucucucugucaccca

SEQ ID NO: 440111 - RNA, 64 nt, hsa
caguauccucuccggaucugucgauuuggagaccuuccgagagagaaccaagggugcagucagc

SEQ ID NO: 440112 - RNA, 64 nt, hsa
aguuuguggagaguacagacugcguuggcugggcuuccgagagcuucggccugccuaagucuga

SEQ ID NO: 440113 - RNA, 64 nt, hsa; identical to SEQ ID NO: 97841

SEQ ID NO: 440114 - RNA, 64 nt, hsa; identical to SEQ ID NO: 97842

SEQ ID NO: 440115 - RNA, 64 nt, hsa; identical to SEQ ID NO: 97843

SEQ ID NO: 440116 - RNA, 64 nt, hsa; identical to SEQ ID NO: 97844

SEQ ID NO: 440117 - RNA, 64 nt, hsa; identical to SEQ ID NO: 97845

SEQ ID NO: 440118 - RNA, 64 nt, hsa; identical to SEQ ID NO: 97846

SEQ ID NO: 440119 - RNA, 64 nt, hsa; identical to SEQ ID NO: 97847

SEQ ID NO: 440120 - RNA, 64 nt, hsa; identical to SEQ ID NO: 97848

SEQ ID NO: 440121 - RNA, 64 nt, hsa
gaaauaugaucagagcuugaacacaggcuuauuuuuaaaauaaaaauauuuuuaacauggguuu

SEQ ID NO: 440122 - RNA, 64 nt, hsa
aaauaaugcuuugagaagaauguuuaauagaaaauuaaaauaacuuuuucuggccucucuuguu

SEQ ID NO: 440123 - RNA, 64 nt, hsa
uuuuucagccaucaguucaagagccaaugccuuuuuaaaauaaagcuucuguggucuuguuuuu

SEQ ID NO: 440124 - RNA, 64 nt, hsa
ucccauuccuugucugccauucugaauaugcuuauuaaaauauuuuuuuaaacauauuugccua

SEQ ID NO: 440125 - RNA, 64 nt, hsa
guggcucauuuauaccuaauaaaauaaugguauuuuaaaauaaugcuacuuucaaaguagcauu

SEQ ID NO: 440126 - RNA, 64 nt, hsa
gaaggcauguuaaacauuauuuccucuaugguaguuaaaauacagaauuagauuuuuaacaggu

SEQ ID NO: 440127 - RNA, 64 nt, hsa
caccagagacuugaagaacuugcaaacuggcguuuuaaaauaaccgguuaauuuauuuccacac

SEQ ID NO: 440128 - RNA, 64 nt, hsa
agaagaauaaguccuucuguuuucucuuuaacauuuaaaauaucucaaugcacaugauauaauu

SEQ ID NO: 440129 - RNA, 64 nt, hsa
uauguaaaauaaaauuaugccauagcaagauugcuuaaaauagcaacacucuauauuuagauug

SEQ ID NO: 440130 - RNA, 64 nt, hsa
uugcuuaaaauagcaacacucuauauuuagauuguuaaaauaacuaguguugcuuggacuauua

SEQ ID NO: 440131 - RNA, 64 nt, hsa
caaccugaaggaauaaaaugauuuguggaaaugcuuaaaauagaccuaacugaauacagucuca

SEQ ID NO: 440132 - RNA, 64 nt, hsa
aaucuaguggguugaccuuuaaaugcaacaguuuuuaaaauauauugcugcauuuuauagaaua

SEQ ID NO: 440133 - RNA, 64 nt, hsa
uuaucuuuaguuacuugaagaguuucuaguuuuuuuaaaauacaguuuauguuaaaauaauuuu

SEQ ID NO: 440134 - RNA, 64 nt, hsa
aagaguuucuaguuuuuuuaaaauacaguuuauguuaaaauaauuuuuauuaauuuagagaaga

SEQ ID NO: 440135 - RNA, 64 nt, hsa
ugguuuccagagggucuggacugguuugggugcuuuaaaauagauauuuaguucaguggugcuu

SEQ ID NO: 440136 - RNA, 64 nt, hsa
uuuccaaaguccuuuuuuuucccuuaauguugaauuaaaauacuugcucauaguugauuuacca

SEQ ID NO: 440137 - RNA, 64 nt, hsa
uacaucaaaucaaauagaaucuuauaucuguauguuaaaauagagcacuuaccugaagucagug

SEQ ID NO: 440138 - RNA, 64 nt, hsa
ucugaagucucuauuuuccaaguuguccuuucucuuaaaauacccuuuacugauuuaauacaga

SEQ ID NO: 440139 - RNA, 64 nt, hsa
uuuuuuaaucaagggagauacaccuaucagauguuuaaaauaacaacacuacccacugaaauca

SEQ ID NO: 440140 - RNA, 64 nt, hsa
cacuuuugaucuauuuauauauauguauguguuuuuaaaauauguguauauuuuaucagauuug

SEQ ID NO: 440141 - RNA, 64 nt, hsa
ucuuugcuucguauguaaauaaaguuaaaaacaguuaaaauaaggaguauuuugguagaguaua

SEQ ID NO: 440142 - RNA, 64 nt, hsa
aaauuugaucaguuagcaaaacuuaauacaccaauuaaaauauuucuacauaugagaauguuua

SEQ ID NO: 440143 - RNA, 64 nt, hsa
gaugggaugcaugacauacagguagcucucuuuuuuaaaauauagguaucucuuugcauauaua

SEQ ID NO: 440144 - RNA, 64 nt, hsa
uuugcuagugaugaaucaaauaaauuugauauacuuaaaauaauuuggacaguuuuuaugugac

SEQ ID NO: 440145 - RNA, 64 nt, hsa
uaauuugaagauggaacaggaaacuagagugcauuuaaaauacucugucuucauuuuaacaugu

SEQ ID NO: 440146 - RNA, 64 nt, hsa
ugcuucacacacaguucaaccauuuaaccagaaauuaaaauaucacccuuuucagcccucccau

SEQ ID NO: 440147 - RNA, 64 nt, hsa
cauguaaaaucuauaucagcaaaagggucuaccuuuaaaauaagcaauaacaaagaagaaaacc

SEQ ID NO: 440148 - RNA, 64 nt, hsa
uuuauuaaggugguggagccacugcaguguuaucuuaaaauaagaauauuuuguugagauauuc

SEQ ID NO: 440149 - RNA, 64 nt, hsa
guaaaaucaguagaaauuuuacuacaauugcuuguuaaaauauuuuauaagugauguuccuuuu

SEQ ID NO: 440150 - RNA, 64 nt, hsa
uguaccauuuugcuaccaguuacauugaacugcuuuaaaauaaauaauaaaauuauuucuaaug

SEQ ID NO: 440151 - RNA, 64 nt, hsa
gcuuauaaaagacuuuuaaugaaauguugccuuuuuaaaauaauuauacuugcacaugaaaaua

SEQ ID NO: 440152 - RNA, 64 nt, hsa
uuccuauauaacuaaaaauuuuguuucauaaauuuuaaaauaauuauuuuugacuaugaacauu

SEQ ID NO: 440153 - RNA, 64 nt, hsa
aaggaccucaauggaauaaauuugaaaagcuaaauuaaaauacaaaaauuuaaaucugacauuu

SEQ ID NO: 440154 - RNA, 64 nt, hsa
agaaucaaaaaauuccuguuuugauacuucuaaguuaaaauauauguuacaguuuaucugguac

SEQ ID NO: 440155 - RNA, 64 nt, hsa
gggaaggggagaagaaagaaaaacacauuuggccuuaaaauagcaugcauucucccagaagccc

SEQ ID NO: 440156 - RNA, 64 nt, hsa
uggaaaagcacuuuuaauuuugagaauuucacauuuaaaauaagccaaaagccugauguucaca

SEQ ID NO: 440157 - RNA, 64 nt, hsa
gaauuauuguggggauuaaguuagauaauguguuuuaaaauauaaagcuacauccaaagaaaug

SEQ ID NO: 440158 - RNA, 64 nt, hsa
uucagaaaauuucugcagagcccugcccuggcacuuaaaauagcuuccaauaaguaacuuagac

SEQ ID NO: 440159 - RNA, 64 nt, hsa
uuauuguauuaacagcugagguagcuaaaguuauuuaaaauaaaauuaaauuuaugauccaagu

SEQ ID NO: 440160 - RNA, 64 nt, hsa
agaugcuaacauccucccccaucccaacugcaccuuaaaauaugcaugucaccuucaagguuuu

SEQ ID NO: 440161 - RNA, 64 nt, hsa
gaacauuuguuuguuugucuucugauguuuuuucuuaaaauaguaauuucuccuacuuuucuuu

SEQ ID NO: 440162 - RNA, 64 nt, hsa
uuaggaaagauuucuuagguuuugaaagaauacauuaaaauaaaaaacuugccccuacuaggua

SEQ ID NO: 440163 - RNA, 64 nt, hsa
uaaaucauauuugauuaacauuucauuuaagcuuuuaaaauaucaauuuuuuaaauagcuccca

SEQ ID NO: 440164 - RNA, 64 nt, hsa
cccaugggcauuaaggcaaaguaguuccagugauuuaaaauacgguuccaaauacgcuaaaacc

SEQ ID NO: 440165 - RNA, 64 nt, hsa
augaaguaaauaugcugcaguuaauuaugcuaaguuaaaauacaguuuaguuauuugcuuuaaa

SEQ ID NO: 440166 - RNA, 64 nt, hsa
uaugcuaaguuaaaauacaguuuaguuauuugcuuuaaaauaaacucuucuuuuuuucuuuaaa

SEQ ID NO: 440167 - RNA, 64 nt, hsa
gaauuaucauaacuuauggcaucaggaggaaacuuuaaaauaucaaggaaucacucagucaccc

SEQ ID NO: 440168 - RNA, 64 nt, hsa
ggaaucgugucuuccaugcuccacuggguucaauuuaaaauaggagaggcuuucucuucugaaa

SEQ ID NO: 440169 - RNA, 64 nt, hsa
aucccuuugggccuguacaaagaaauucuggauguuaaaauaauauauacucaucacagaaaaa

SEQ ID NO: 440170 - RNA, 64 nt, hsa
cccugauaggggaagugggaguugacaggaugguuuaaaauaagacgugaagguuucaguuacc

SEQ ID NO: 440171 - RNA, 64 nt, hsa
uuggugguagcuucuagucccagaaucuguguuuuuaaaauacuacaugacauucugucuauuc

SEQ ID NO: 440172 - RNA, 64 nt, hsa
uauuuuaacacacuauuuugcuuuuguauuuuaguuaaaauaaucgauggggauguguagcccc

SEQ ID NO: 440173 - RNA, 64 nt, hsa
aauuuguuuuaacguuaaauuguaguuugcuguauuaaaauagaucaaugaauauaauucaguc

SEQ ID NO: 440174 - RNA, 64 nt, hsa
uaauaauuuuuaaauuuuuuucuaauuuuaugccuuaaaauagguuucugauuacauaaaauuu

SEQ ID NO: 440175 - RNA, 64 nt, hsa
uagauuccaauaaauaucuauuuauuauuaaauauuaaaauaucuauuuauuauuaaaaccauu

SEQ ID NO: 440176 - RNA, 64 nt, hsa
gagcauaagauaugagauacaugaaccugaacuauuaaaauaaaauauuauauuuaacccuuag

SEQ ID NO: 440177 - RNA, 64 nt, hsa
cuugcuucugucaagugugacucuaucucaguaauuaaaauaagugcugaucuacugauuuuuu

SEQ ID NO: 440178 - RNA, 64 nt, hsa
aaauguuuaaguaaacucugucucaguuuuaggauuaaaauacccaccgguggugugaugaugc

SEQ ID NO: 440179 - RNA, 64 nt, hsa
ugugcuaaguuaaaauacaguuuaguuauuugcuuuaaaauaaacucuucuuuuuuucuuuaaa

SEQ ID NO: 440180 - RNA, 64 nt, hsa
augaaguaaauaugcugcaguuaauugugcuaaguuaaaauacaguuuaguuauuugcuuuaaa

SEQ ID NO: 440181 - RNA, 64 nt, hsa
uuuuguaccuacguaagaguacuugaaguuuuauuuaaaauaaaauguuguggaaaagguagca

SEQ ID NO: 440182 - RNA, 64 nt, hsa
aauugcuuuaaaucuugaaaauacaaggaauguuuuaaaauauaaaacaaagccaaguuaaacu

SEQ ID NO: 440183 - RNA, 64 nt, hsa
uuucaaaggaaaggguguuauagugcaauagcaauuaaaauauaucaaaucgcacugaauacuc

SEQ ID NO: 440184 - RNA, 64 nt, hsa
gugaucuacugaaaagagguuauauuaaagcaaauuaaaauauuuuccuucucuguccucugaa

SEQ ID NO: 440185 - RNA, 64 nt, hsa
ugggcauuuaaccauuuacugucuggcuuugcccuuaaaauaggguugcaauuaaaaugugauu

SEQ ID NO: 440186 - RNA, 64 nt, hsa
gacagaggcauuuucaccuuaauggugaaguaauuuaaaauauaaauccauucaggugacaacc

SEQ ID NO: 440187 - RNA, 64 nt, hsa
acacagggggccuggaaagaaagggaaaguggauuuaaaauauauauauacguaacccaagccc

SEQ ID NO: 440188 - RNA, 64 nt, hsa
gaucagcccucaaagaauggggucugugggcuaguuaaaauagaaauaaacuuuuaaaauaucc

SEQ ID NO: 440189 - RNA, 64 nt, hsa
gggucugugggcuaguuaaaauagaaauaaacuuuuaaaauauccacagaauugauauugugau

SEQ ID NO: 440190 - RNA, 64 nt, hsa
uuugcauaaucaaggcacuguaaaucuuauaauuuuaaaauaaauuacuuaagaacaguuguca

SEQ ID NO: 440191 - RNA, 64 nt, hsa
guaauaauucuugcauuuuuuccccauaaccugguuaaaauaaauacgccauuggcaauacuuc

SEQ ID NO: 440192 - RNA, 64 nt, hsa
cuccuuuacccagcauaaacucuaugguuaauucuuaaaauaaugccuuacagucuccauuaac

SEQ ID NO: 440193 - RNA, 64 nt, hsa
gcucauuucauuuuucugugucuuacacagaaacuuaaaauauuucaaacuuuucauuauaugu

SEQ ID NO: 440194 - RNA, 64 nt, hsa
gguaaaugagaucaucuguuaccuguacgcuguauuaaaauagaaccaggaaaggcucaggauu

SEQ ID NO: 440195 - RNA, 64 nt, hsa
ccaauuaugaggacugacauccuggccacucuccuuaaaauaaacacugacauuuuucuugcuu

SEQ ID NO: 440196 - RNA, 64 nt, hsa
uguccuaacugaaagaugaucauuuguaguugccuuaaaauaaugaauacauuuccaaaauggu

SEQ ID NO: 440197 - RNA, 64 nt, hsa
gaauacaguuuugaguagaguugaucaaaaucaauuaaaauagucucuuuaaaaggaaagaaaa

SEQ ID NO: 440198 - RNA, 64 nt, hsa
caagugaucaaacuacauauuguaaagcccauuuuuaaaauacauuguauauauguguaugcac

SEQ ID NO: 440199 - RNA, 64 nt, hsa
guguuaguuuuauuuuuguacugcaauuuuuaguuuaaaauauguuggaugcacucgucaaaua

SEQ ID NO: 440200 - RNA, 64 nt, hsa
gauaacaggaaaauaaguuuugauugcauuguuuuuaaaauaagcuaguuuucugagguguuuu

SEQ ID NO: 440201 - RNA, 64 nt, hsa
gagccaccgcgccuggccagggacuauacucuuuuuaaaauagacauuuguggggcucacacaa

SEQ ID NO: 440202 - RNA, 64 nt, hsa
aaaaaaucauuuuauccgucuuuuaaguauauguuuaaaauaauaauuuaugugucugcauauu

SEQ ID NO: 440203 - RNA, 64 nt, hsa
ugugaaugaaaugauacgaugucucagauuugcuuuaaaauaauagggagguuggggaaguggg

SEQ ID NO: 440204 - RNA, 64 nt, hsa
ugauaugaacugugauaaugcagaagguuuccuuuuaaaauaaaguucagucaaaaaagugaga

SEQ ID NO: 440205 - RNA, 64 nt, hsa
gauuuguguuuuacaguauaucuuaagauaauauuuaaaauaguuccagauaaaaacaauauau

SEQ ID NO: 440206 - RNA, 64 nt, hsa
guccuguuaugucauuguguuugugugcuguuguuuaaaauaaaaguaccuauugaacauguga

SEQ ID NO: 440207 - RNA, 64 nt, hsa
gcagcagcauuugaguccaugaaugcuauggucauuaaaauaauugauuauacuuuccuaaaga

SEQ ID NO: 440208 - RNA, 64 nt, hsa
ucccuauuuuguuuaguagugaugaaagauggguuuaaaauauacagaaaugggagaaaauuaa

SEQ ID NO: 440209 - RNA, 64 nt, hsa
uuucucuuaaaauaaaauccauuuccuauuucucuuaaaauaaaauccauuauucuuaauaugg

SEQ ID NO: 440210 - RNA, 64 nt, hsa
ugugauuaugcuuaacagcuguuuccuguuucucuuaaaauaaaauccauuuccuauuucucuu

SEQ ID NO: 440211 - RNA, 64 nt, hsa
aaguaaguuuaaagacuuuaaggacauucaaaguuuaaaauaguguucaaauugcaaaauuugg

SEQ ID NO: 440212 - RNA, 64 nt, hsa
uuacauuuaauagcuuguuaccugugauuuuauuuuaaaauauuuauuuugauaugaugcuuaa

SEQ ID NO: 440213 - RNA, 64 nt, hsa
guuguuacugguccuguuguagcagugaauauaguuaaaauacguacauuaaaaaaaaaauuau

SEQ ID NO: 440214 - RNA, 64 nt, hsa
acuaagaauuuagguggaauugaugucugggcaauuaaaauaaauggcauaagagcuuaaaaac

SEQ ID NO: 440215 - RNA, 64 nt, hsa
cuaaaauacuacauugucacuguaagcuauacuuuuaaaauauuuauuuuuuuuaaaguauuuu

SEQ ID NO: 440216 - RNA, 64 nt, hsa
ccacaaaaaaacagcagaccaacauauagaguguuuaaaauagcauuucugggcaaauucaaac

SEQ ID NO: 440217 - RNA, 64 nt, hsa
auuggaacagucuucuagaauugaggaauauuuauuaaaauaccuguaaagaaaauagugaauc

SEQ ID NO: 440218 - RNA, 64 nt, hsa
guagucugauuuagagacuaguuacuucuauuuuuuaaaauaauggaguaacaaauuacagaau

SEQ ID NO: 440219 - RNA, 64 nt, hsa
uacauaccuuuguguauagacaagcccaugcccauuaaaauaaaguuauccuguaacauaaauu

SEQ ID NO: 440220 - RNA, 64 nt, hsa
agagcuucuuuggcucuagaaaaauuucaaacaauuaaaauaagaaaaaauuuuaaacugguuu

SEQ ID NO: 440221 - RNA, 63 nt, hsa
augguuugguucacuuuaugaaaaauaaaauguauuaaaauauaguuuaaaugcuguucuuga

SEQ ID NO: 440222 - RNA, 64 nt, hsa
ucaacauauauacuuuuugcaaaauuuccuugauuuaaaauauuuguuauuuuaaauauacaaa

SEQ ID NO: 440223 - RNA, 64 nt, hsa
aauaaaaagcauuuauuguuuuugcaauaaauguuuaaaauauuucaauaaagauagcauguua

SEQ ID NO: 440224 - RNA, 64 nt, hsa
acucagaaaaaaauguuuugaugaauacaauguauuaaaauauaaaacauguagauccuuugac

SEQ ID NO: 440225 - RNA, 64 nt, hsa
aguuuaaaaguuuagcuuauugaguaguugucauuuaaaauauaauugcgaauaucagaaaacu

SEQ ID NO: 440226 - RNA, 64 nt, hsa
aauacguuucauagaaaauaaguaagaacuauuuuuaaaauauucaaacaaaacuaaaacaaaa

SEQ ID NO: 440227 - RNA, 64 nt, hsa
aaaucuguaauaaaaaacuaaauuaaaccuugcauuaaaauaauaucacaguaucaguggacua

SEQ ID NO: 440228 - RNA, 64 nt, hsa
uaucuaugucucauaaaaauuagaauguacuauuuuaaaauaauauguguaaauugaaauuuuu

SEQ ID NO: 440229 - RNA, 64 nt, hsa
aauuaaaauaagaauugaaugucaauaugagauauuaaaauaagcacagaaaaucauuggucuc

SEQ ID NO: 440230 - RNA, 64 nt, hsa
uguacaccauaguuuacaauauuauguuuccuaauuaaaauaagaauugaaugucaauaugaga

SEQ ID NO: 440231 - RNA, 64 nt, hsa
aaauacuauucucauuauguugauacuagcauacuuaaaauaucucuaaaauagguaaauguau

SEQ ID NO: 440232 - RNA, 64 nt, hsa
uacaaaacaaacaaacaaacaaaaaacccauguguuaaaauacucagugcuaaacauggcuuaa

SEQ ID NO: 440233 - RNA, 64 nt, hsa
gugauguuucuagucugaguuugcuaaguauauuuuaaaauaaucaguaaaguuagauuuuauc

SEQ ID NO: 440234 - RNA, 64 nt, hsa
aaccuuacacccauuauugauuuauuuuucuguuuuaaaauaucuuccugcacuggcuaaaacc

SEQ ID NO: 440235 - RNA, 64 nt, hsa
uuucuacaaugaacauguuuuauuuuuacuuuuguuaaaauaaauaacauuuaauuugacggaa

SEQ ID NO: 440236 - RNA, 64 nt, hsa
acaaaagaaacaagagagaaaaaaaucaaaauaauuaaaauaaauuguuagagaaaaguuacuu

SEQ ID NO: 440237 - RNA, 64 nt, hsa
aaacugauuucuucagaauuagauggcuuauuuuuuaaaauauuugaaugaaaacauuuuauuu

SEQ ID NO: 440238 - RNA, 64 nt, hsa
uuuuuuaaaauauuugaaugaaaacauuuuauuuuuaaaauauuacacaggaggcuucggaguu

SEQ ID NO: 440239 - RNA, 64 nt, hsa
gcacccagccgaguugcuuucuuacuaaauccuauuaaaauaugcaaaaauaagucagauuuua

SEQ ID NO: 440240 - RNA, 64 nt, hsa
aggacuuauuuuuuaacuguaauauuuauuaguuuuaaaauauuuguaucucauuuguaacaau

SEQ ID NO: 440241 - RNA, 64 nt, hsa
auaccaguugaaugggguuaaagcuuucaauaucuuaaaauauuuauaaaacauuucacuguug

SEQ ID NO: 440242 - RNA, 64 nt, hsa
auuuuaacuaugaccuuuaauugaaaauaaauaauuaaaauaucagacauguuuuggaaaaguc

SEQ ID NO: 440243 - RNA, 64 nt, hsa
cuuguggcuuuuauuaucuuuaaacuuguugcauuuaaaauauuuuuaaaaccuucuuaacaaa

SEQ ID NO: 440244 - RNA, 64 nt, hsa
uggcagucucaauccuacugucauucuuuuuauuuuaaaauaaauaaauaagccuaucuuuuug

SEQ ID NO: 440245 - RNA, 64 nt, hsa
gacucuuucaaguguaucugagcaugacuguauuuuaaaauacuuaaaagugcuugauauaaau

SEQ ID NO: 440246 - RNA, 64 nt, hsa
uacgugaaacugauuaguugcaaaauccaguagguuaaaauacucacauauuuuuacuuaaauu

SEQ ID NO: 440247 - RNA, 64 nt, hsa
agagaugaccuauauaaaucaaaguacacauuauuuaaaauauuuaaaaaaauuuucaguuucu

SEQ ID NO: 440248 - RNA, 64 nt, hsa
cagacauuguauguuaucauacugaaauuuacaauuaaaauauuuucuguagauuauuugaaaa

SEQ ID NO: 440249 - RNA, 64 nt, hsa
gugguagucaugaagagauaauguuuuuaggcaguuaaaauacuucuagaacuccaucuauuuu

SEQ ID NO: 440250 - RNA, 64 nt, hsa
aucacuuucucuuugcauaauaauguacuaauauuuaaaauaccuucagccuaaggcacaagga

SEQ ID NO: 440251 - RNA, 64 nt, hsa
auuuugguagaaagguaugaguuuggucgaaaaauuaaaauaguggcaaaauaagauuuaguug

SEQ ID NO: 440252 - RNA, 64 nt, hsa
gucagguacuacauagcucuguaaaaaauguaauuuaaaauaagcaauaauuaaggcacaguug

SEQ ID NO: 440253 - RNA, 64 nt, hsa
uguucggagaguguuuuuguacuauauugacuacuuaaaauagagaaugagacuaagaagggaa

SEQ ID NO: 440254 - RNA, 64 nt, hsa
aauaugaaauauuacauauauauaagugccauauuuaaaauaauuugucuaacaguagaacugu

SEQ ID NO: 440255 - RNA, 64 nt, hsa
auagguuuagccuuuaaguguauguuuuuauacuuuaaaauaagaaauauaaccuuuuaagcua

SEQ ID NO: 440256 - RNA, 64 nt, hsa
ugagauacaauucacauaccauauaaucacacauuuaaaauacacaauucagugguuuuaacau

SEQ ID NO: 440257 - RNA, 64 nt, hsa
uaauugaugucaauauuaguaguccacuuuaugcuuaaaauaaaaucauaaaaaaucaaguuuu

SEQ ID NO: 440258 - RNA, 64 nt, hsa
aaucauaaaaaaucaaguuuuaagguuauauuuuuuaaaauaaugaauuuucuaucucuaggca

SEQ ID NO: 440259 - RNA, 64 nt, hsa
cauuaguucuucuuuuccuaaaacuuuuuacuuguuaaaauagucugcugcauguaauaugugc

SEQ ID NO: 440260 - RNA, 64 nt, hsa
uuagauccugcuaaauuucaauuaagaggggaccuuaaaauaaggaucaaucucuuauuuaacc

SEQ ID NO: 440261 - RNA, 64 nt, hsa
guagucacugugacucgggcauguuucccugaaguuaaaauaguuuuuagaacuuuuuguuuaa

SEQ ID NO: 440262 - RNA, 64 nt, hsa
acaguuaucuuacugaaaaugcaugcauggugaauuaaaauaaaagggggaacaaugcacaaau

SEQ ID NO: 440263 - RNA, 64 nt, hsa
auuguuaauaauauaacauauaagaauacuuuuauuaaaauaaccaugcaacaauaacacuauc

SEQ ID NO: 440264 - RNA, 64 nt, hsa
guuauguguugaacaguaugcuucagggguaaauuuaaaauagucucuugaagcccuagucaug

SEQ ID NO: 440265 - RNA, 64 nt, hsa
aaaaaaaauuaaaugcauaagcauaagguagaaauuaaaauaacaaaauugucuacagcuucuu

SEQ ID NO: 440266 - RNA, 64 nt, hsa
ggggcauaugggagcuuaauauaucauaucuaauuuaaaauaauuucacugaaauaaacuccau

SEQ ID NO: 440267 - RNA, 64 nt, hsa
uaacagauuuuacugauauguaaaaauuuugccauuaaaauaaaugauuucucacugagaggaa

SEQ ID NO: 440268 - RNA, 64 nt, hsa
uauauauucagauacucuagcacuaauuuuagucuuaaaauauucccacgauauucuguacaca

SEQ ID NO: 440269 - RNA, 64 nt, hsa
auauucuuuggcauacuuuguagacuuugaccacuuaaaauacuaaguggccaaaugauaaaaa

SEQ ID NO: 440270 - RNA, 64 nt, hsa
uucaaguguuugauuaaaauagagaaaauaauuuuuaaaauaauagauaaaaauuuuaaaaaca

SEQ ID NO: 440271 - RNA, 64 nt, hsa
uagguaucuuuuucuaaaaacuucaaguguuugauuaaaauagagaaaauaauuuuuaaaauaa

SEQ ID NO: 440272 - RNA, 64 nt, hsa
aguauaucauuuauugagugcccaugcuguacauuuaaaauaugcauuauuuaauuuaaucuua

SEQ ID NO: 440273 - RNA, 64 nt, hsa
uuaguguauuauuuaaagauaaagguucuuggguuuaaaauacauuagaacuuaaugcagacau

SEQ ID NO: 440274 - RNA, 64 nt, hsa
uuaaagguaacaguaauuuucaacacauuuuauuuuaaaauauuauuuuaacaaaaguuacauu

SEQ ID NO: 440275 - RNA, 64 nt, hsa
aguaguccaaauuaaagaaaauguuuuucucaauuuaaaauaauuucuuuuucuuuuguuuaug

SEQ ID NO: 440276 - RNA, 64 nt, hsa
auugcucauaaugacuuacaggcuaaaauuaguuuuaaaauacuauauuaaauucugaaugcaa

SEQ ID NO: 440277 - RNA, 64 nt, hsa
agauguauguugcuauccugcaggaaauauaaacuuaaaauaaaauuauauaccccacaggcug

SEQ ID NO: 440278 - RNA, 64 nt, hsa
gugguuuuuauuuaaaguacuuauuuuuuugagguuaaaauauucagaaacuacuuuuaugcau

SEQ ID NO: 440279 - RNA, 64 nt, hsa
aaugauaacuaagaucacaaugacuguguacccuuuaaaauaucuuuuaauuugaggaauuaca

SEQ ID NO: 440280 - RNA, 64 nt, hsa
uuagucauuucuguuucuaaauauuuuuaucauuuuaaaauauuuuuuuuccauuuggcauaca

SEQ ID NO: 440281 - RNA, 64 nt, hsa
uuuaaaacaaauaugcacagaaaauaaacauuucuuaaaauauauucugggucaguugguauga

SEQ ID NO: 440282 - RNA, 64 nt, hsa
auuuauuaucgaggaguuuuaaaguacuguaacuuuaaaauaaauaacuacaaagcuucuuugu

SEQ ID NO: 440283 - RNA, 64 nt, hsa
ucaugcugagauaucaauugguuuccccuucuuuuuaaaauacguccaguucuuacccaguuaa

SEQ ID NO: 440284 - RNA, 64 nt, hsa
aaaacaaucuaaauauugaagaggaauggccuaauuaaaauaugauguagucauaggauagauu

SEQ ID NO: 440285 - RNA, 64 nt, hsa
uuuuaaaaaauaaggucuuaauguuucauuuaauuuaaaauauacugucauguuguguuuugua

SEQ ID NO: 440286 - RNA, 64 nt, hsa
cuccuuuugcugucuuucucuaaauaugauuacuuuaaaauaaaaaaguaacaaggugucuuuu

SEQ ID NO: 440287 - RNA, 64 nt, hsa
uuaugccguauaggaugucagacaauaccacugguuaaaauaaagccuauuuuucaaauuuagu

SEQ ID NO: 440288 - RNA, 64 nt, hsa
ugcuugcacuauaggagucauaaaaggaacuuaguuaaaauauguuggauuguuaaacauuugg

SEQ ID NO: 440289 - RNA, 64 nt, hsa
cagcuuauuuaaaaccaaauauaguugaacauauuuaaaauacauuuucacagaauggaugaau

SEQ ID NO: 440290 - RNA, 64 nt, hsa
uuagauauauuuugugaacccuugauuagacauauuaaaauauaccaauguuguaguaaaauuu

SEQ ID NO: 440291 - RNA, 64 nt, hsa
aacuagcugccuuuagauuuugauaaucacagucuuaaaauacuaggaaagaaguggaugggaa

SEQ ID NO: 440292 - RNA, 64 nt, hsa
uuuuaaugccaacaaaauugguuguaaucaaauuuuaaaauaauaauaauuuggcccccccuuu

SEQ ID NO: 440293 - RNA, 64 nt, hsa
aaauuuuaaaauaauaauaauuuggcccccccuuuuaaaauagucuugacucuuugugugugac

SEQ ID NO: 440294 - RNA, 64 nt, hsa
cuuaaagauaauguacaugcuucaugucaugucuuuaaaauaauuuaaucaacuuuauugucuu

SEQ ID NO: 440295 - RNA, 64 nt, hsa
uuuguaaauguuagacuuuuaucauaccuguaaguuaaaauacuuguuaucaauaacuugucau

SEQ ID NO: 440296 - RNA, 64 nt, hsa
agauguuaaacuuugaauuuaauauaccagauuauuaaaauauuguccauuaacuaguucauag

SEQ ID NO: 440297 - RNA, 64 nt, hsa
ucucauuugucuaauugcaauuaaaagaaaaauguuaaaauauuaaaaugaaaauaaaagcauu

SEQ ID NO: 440298 - RNA, 64 nt, hsa
guggggauggauuaugaugaaaucauuuucaaucuuaaaauauaauacaacaaucuugcaaaau

SEQ ID NO: 440299 - RNA, 64 nt, hsa
agaaagacacugaaauuuagaaaauuuugucgauuuaaaauauuucuccuaucuaccaaguaaa

SEQ ID NO: 440300 - RNA, 64 nt, hsa
cccuuuuuaagccuuaccugagaggaacaaugccuuaaaauaaaaaagcauuaaugagaugaaa

SEQ ID NO: 440301 - RNA, 64 nt, hsa
gacccaaagcccuuacguuugaugcaauuuauuuuuaaaauaggccuuguuuuucagcuucauc

SEQ ID NO: 440302 - RNA, 64 nt, hsa
uuaauguuuauacuuagauuuucuuuuaaaaaaauuaaaauaaaacaaaaaaaaauuucuagga

SEQ ID NO: 440303 - RNA, 64 nt, hsa
auucuuuuuuuugcauccaauugugccugaacuuuuaaaauauguaaaugcugccauguuccaa

SEQ ID NO: 440304 - RNA, 64 nt, hsa
auuauuguguguguuuuguaauauuugcgaucacuuaaaauaucagauaaauacagucaugcau

SEQ ID NO: 440305 - RNA, 64 nt, hsa
ggcuugugucuguugcacauuucuugaagcauuuuuaaaauaacauguaaccuguaaccuuguu

SEQ ID NO: 440306 - RNA, 64 nt, hsa
augcuauuuaugucacaucucacauuaaauuauuuuaaaauaagcagugcccuucaaaacagau

SEQ ID NO: 440307 - RNA, 64 nt, hsa
agagcacaguguagccauguacaguuuccauuauuuaaaauaaauaaauguguugguucauuug

SEQ ID NO: 440308 - RNA, 64 nt, hsa
ucaagcggguuuuuggaaaaauuuauggucuccauuaaaauacauauuacaacugggguagauu

SEQ ID NO: 440309 - RNA, 64 nt, hsa
cuagaucagauccuguaugacuuuaaaauacauuuuaaaauauauuuugcaucucagcagaagg

SEQ ID NO: 440310 - RNA, 64 nt, hsa
uugccauucuuacuagaucagauccuguaugacuuuaaaauacauuuuaaaauauauuuugcau

SEQ ID NO: 440311 - RNA, 64 nt, hsa
ugcaaaaccaaucuguaucauguaccaaacugacuuaaaauaaaucuacauguuuauugaauua

SEQ ID NO: 440312 - RNA, 64 nt, hsa
aaaucaauuaaaucauuguguucaacaggaauauuuaaaauauucugcaugaauccuguggcug

SEQ ID NO: 440313 - RNA, 64 nt, hsa
ugauagucuccugcuguuuuaccccuuccauuuuuuaaaauaagaaauuagcagcccucugcau

SEQ ID NO: 440314 - RNA, 64 nt, hsa
uuacucaaguagaagccugaaaauuaaucugcuuuuaaaauaaagagcaguguucuccauucgu

SEQ ID NO: 440315 - RNA, 64 nt, hsa
accugguaucuauuuguauauaugcuaaauaauuuuaaaauacaagaguuuuugaaauuuuuuu

SEQ ID NO: 440316 - RNA, 64 nt, hsa
gaauauuauagucaguucuugguacuuaaaguacuuaaaauaaguagugcuuuguuuaaaagga

SEQ ID NO: 440317 - RNA, 64 nt, hsa
uuuuuuacuguuuuguuaaugaagaaauuccuuuuuaaaauauuuuuccaaaauaaauuuuaug

SEQ ID NO: 440318 - RNA, 64 nt, hsa
aaauggaagugagauggcaagacucccguuucucuuaaaauaaguaaaauuccaaggauauaug

SEQ ID NO: 440319 - RNA, 64 nt, hsa
aaauugaccuagaaucuuugugagguuuuuucuauuaaaauauuuauauuucuaaauccgaggu

SEQ ID NO: 440320 - RNA, 64 nt, hsa
uuuucaaucucauaaaaaagggauagugcaucuuuuaaaauacauuuuauuuggggaggaacau

SEQ ID NO: 440321 - RNA, 64 nt, hsa
aaaacaauuugcaaaccagcagaauuuuaagcuuuuaaaauaauucaauggauauacauuuuuu

SEQ ID NO: 440322 - RNA, 64 nt, hsa
aaauuaaaaagacaaauuaaaccugaaauuauauuuaaaauauauuugagacaugaaauacaua

SEQ ID NO: 440323 - RNA, 64 nt, hsa
uacauuccccccaccccaauuugcuauuuccuuauuaaaauagaaaauuauaggcaagauacaa

SEQ ID NO: 440324 - RNA, 64 nt, hsa
aaauaugaaaguagauucaugaaaauguauuccuuuaaaauauuguuuuccuacaggccuauuu

SEQ ID NO: 440325 - RNA, 64 nt, hsa
uaaaauguuuuaugacauuuuucuggcugugaucuuaaaauaauucauaucuaaauaguauuuu

SEQ ID NO: 440326 - RNA, 64 nt, hsa
caguuauaaagaaauugaugagguuuuuaccuuuuuaaaauauugguuagaaguucaaaaacca

SEQ ID NO: 440327 - RNA, 64 nt, hsa
uuugaaauuuauuacagugcaauugaaaauacacuuaaaauacugcaggaugcuuagugcucag

SEQ ID NO: 440328 - RNA, 64 nt, hsa
gaaaauuuggccacccucagccucugaauguuuauuaaaauaaauuuagucuuucuuugcuuaa

SEQ ID NO: 440329 - RNA, 64 nt, hsa
uguccagcuaccugccagguggcuuucacuguguuuaaaauacauugcauuccaagcugguccc

SEQ ID NO: 440330 - RNA, 64 nt, hsa
uuaccuuuucauguauauuugaaaucagagguguuuaaaauaccuaugagauaccaauguagcc

SEQ ID NO: 440331 - RNA, 64 nt, hsa
cuuaucuuugacuguuauuuuaugcagucgcucauuaaaauauuccucugaugugaaauuaaau

SEQ ID NO: 440332 - RNA, 64 nt, hsa
cuuccucaccacugacuauuuuaucaaauuugccuuaaaauaaugaaaaagaaaaguauaguua

SEQ ID NO: 440333 - RNA, 64 nt, hsa
uuuggauacaauacucuugauuuaugauaauuaguuaaaauauauuaaaaauauuauuaguaaa

SEQ ID NO: 440334 - RNA, 64 nt, hsa
guuccagggauugugaaauaaauguugcaguuuuuuaaaauaaugaaaauaaauacucuugguu

SEQ ID NO: 440335 - RNA, 64 nt, hsa
ugcuaaaucacauucagcauguguauuuugacauuuaaaauacuucccucaauucuguaaauua

SEQ ID NO: 440336 - RNA, 64 nt, hsa
uuuccaaaguaaccugcuuuuugccuggauaggguuaaaauagaccuuucuugccuauccuugc

SEQ ID NO: 440337 - RNA, 64 nt, hsa
gaagugcagaaguuggaacagugguaaggcuguuuuaaaauaagauguuuuguuuuaauaauau

SEQ ID NO: 440338 - RNA, 64 nt, hsa
uaaaauauauaagcuuaaauuuuauaucuuacauuuaaaauauuaagauuccuuugacuugcca

SEQ ID NO: 440339 - RNA, 64 nt, hsa
uuccaaauauuuauuucaugagcaguacagcuaauuaaaauauauaagcuuaaauuuuauaucu

SEQ ID NO: 440340 - RNA, 64 nt, hsa
uaaacaguuauuguauuuuuuauuucuuucuaacuuaaaauacgacacccaguauuuucuuuaa

SEQ ID NO: 440341 - RNA, 64 nt, hsa
gccucaugucugguauauauuuuaccaaacagccuuaaaauauauuuggaagcaaaaaucagua

SEQ ID NO: 440342 - RNA, 64 nt, hsa
auggagcucacgacgugugaccauuucgucauauuuaaaauauaacuucaagaaaagaguaaac

SEQ ID NO: 440343 - RNA, 64 nt, hsa
ccagugucuucgccacauaaaauagccauuuucuuuaaaauaguuuuggacuaacgaagcugaa

SEQ ID NO: 440344 - RNA, 64 nt, hsa
gagauacguaaaguaggccccacaaauaauauuuuuaaaauacaaaggaucaccacaauccucu

SEQ ID NO: 440345 - RNA, 64 nt, hsa
cauuguuuaucuaauauuauuuaugacaguaauuuuaaaauauauuauucauaaguucaaggau

SEQ ID NO: 440346 - RNA, 64 nt, hsa
ugcaaagcaaccugucuuacauucuuacauuaucuuaaaauaaauauuucugcccuugaaucaa

SEQ ID NO: 440347 - RNA, 64 nt, hsa
aguagaccccaagcauccuuuucuaaaaagugacuuaaaauaagccaacagacucucccagacc

SEQ ID NO: 440348 - RNA, 64 nt, hsa
augcuuauaccuaauuuuuaguuuuuaaacuauuuuaaaauauacuaugauuuuauauguauau

SEQ ID NO: 440349 - RNA, 64 nt, hsa
gucauuucccaagacuagcauagggaguauccauuuaaaauacauucaucuuccucccauuucc

SEQ ID NO: 440350 - RNA, 64 nt, hsa
gugauucauauucaguacuguuuuuaaucacuuuuuaaaauauaaggaccgaaugcaaggaaac

SEQ ID NO: 440351 - RNA, 64 nt, hsa
caaagcugaaacugauuagaaaauucuuuauauuuuaaaauagcucuuucucauuuuuagagaa

SEQ ID NO: 440352 - RNA, 64 nt, hsa
cuagaacugucaaauaacaaaacggcucauguuuuuaaaauauauguaacucauuuuaaaauau

SEQ ID NO: 440353 - RNA, 64 nt, hsa
acggcucauguuuuuaaaauauauguaacucauuuuaaaauauauuaaauuguauuccaaaccu

SEQ ID NO: 440354 - RNA, 64 nt, hsa
caaaccuguucuucuguuucuguggcaccuagguuuaaaauauguauuaauguguaaaucacaa

SEQ ID NO: 440355 - RNA, 64 nt, hsa
gauuuuuuuauuuguauuaaugaaaagcuuuaguuuaaaauaaggagauccagaauaaaaagaa

SEQ ID NO: 440356 - RNA, 64 nt, hsa
aguuucuguuuuucuccauuuagacauaggucaauuaaaauauuuggguuuaaaaugacuaaau

SEQ ID NO: 440357 - RNA, 64 nt, hsa
uuguauuaugcugcucacugauccuucugcauauuuaaaauaaaauguccuaaaggguuaguag

SEQ ID NO: 440358 - RNA, 64 nt, hsa
auaaacaagacacaacguuuuuauacaacauacuuuaaaauauuaaggaguuuucuuaauuuug

SEQ ID NO: 440359 - RNA, 64 nt, hsa
uauuacuauuuuuauuuuaaaauaaaauuuaccuuuaaaauaauaauaguacuauugcuaguac

SEQ ID NO: 440360 - RNA, 64 nt, hsa
uaauaauaguacuauuacuauuacuauuuuuauuuuaaaauaaaauuuaccuuuaaaauaauaa

SEQ ID NO: 440361 - RNA, 64 nt, hsa
uagauugcaaaaucuccaauccacacauauuguuuuaaaauaagaauguuauccaacuauuaag

SEQ ID NO: 440362 - RNA, 64 nt, hsa
ugaaucaaguguaauauaauuuuuuucuucuuuuuuaaaauauucccacucagcacucagagac

SEQ ID NO: 440363 - RNA, 64 nt, hsa
cugacaaaccagagaaaaauggaccuuuuuccaguuaaaauauugcuguagauuuagaggaauu

SEQ ID NO: 440364 - RNA, 64 nt, hsa
uuuacucuauguacagaauuuaacguugaauauauuaaaauaacaaaucuggcaugguuugcgg

SEQ ID NO: 440365 - RNA, 64 nt, hsa
acauauuucucuuaggacuuuuaaagaugagccauuaaaauagaaugauccuuuauggaccaaa

SEQ ID NO: 440366 - RNA, 64 nt, hsa
aacaaaaccagaaucagguaaaacagcuaugugauuaaaauauuuuaauucuucagcaauuacc

SEQ ID NO: 440367 - RNA, 64 nt, hsa
acuuaaaaugcauagcauuauuaaaaacaaucuuuuaaaauauaauuuauaacauagauugaag

SEQ ID NO: 440368 - RNA, 64 nt, hsa
uuuucacuauuacuguuguaauuauugauugugauuaaaauauuugcucccaggagaacuccug

SEQ ID NO: 440369 - RNA, 64 nt, hsa
auaguauagguaaauuuucuuuuucaaauccaauuuaaaauaaccuuuccuuuuaaaugugcug

SEQ ID NO: 440370 - RNA, 64 nt, hsa
aacacaaaacuuuuauaaauuauuuuaacaaagauuaaaauauacugcagggcaaauaauauuc

SEQ ID NO: 440371 - RNA, 64 nt, hsa
auagcagaauuuuuuuauacaggguuaauaauccuuaaaauacuuuuauuuccaugccuuauua

SEQ ID NO: 440372 - RNA, 64 nt, hsa
agcuacugcaaauuuugucuuucuguaaauguuauuaaaauauccagugagcucuuuagaagga

SEQ ID NO: 440373 - RNA, 64 nt, hsa
auuucaagacuauuuuugagguaauucuagccuuuuaaaauauucuacagaccuacggggcuua

SEQ ID NO: 440374 - RNA, 64 nt, hsa
aaaaaaagcaauucacaaaaccauuucauauuuuuuaaaauauugugcuuaaagaugguccugg

SEQ ID NO: 440375 - RNA, 64 nt, hsa
aagcaguacagaggaaaacaggaaccugauuuuuuuaaaauaaauuuuaaauaaaauagaauua

SEQ ID NO: 440376 - RNA, 64 nt, hsa
uccuuugaaauaaacuuaugaaauguuuucucucuuaaaauauuucuccuguguaaaauaaauc

SEQ ID NO: 440377 - RNA, 64 nt, hsa
gcaggcucucuaaagaaaaacucauuguaacuuauuaaaauaauaucuggugcaaaguaucugu

SEQ ID NO: 440378 - RNA, 64 nt, hsa
uuuucccuaagugaucaacaucaaauuuuuagaauuaaaauacauuuaacucagggaauuugua

SEQ ID NO: 440379 - RNA, 64 nt, hsa
aauguuauagugugaacuaccuuuauaacauagguuaaaauacgcuugcuaggguguguuuuca

SEQ ID NO: 440380 - RNA, 64 nt, hsa
ccaauggaauuagaugagugcuaugcacuuaauuuuaaaauaaaacuaguuuucaguaaaaugg

SEQ ID NO: 440381 - RNA, 64 nt, hsa
gggggcuguagaguuugaaaaagcauauucaauauuaaaauaguuuuauauuugggaaggcaaa

SEQ ID NO: 440382 - RNA, 64 nt, hsa
aaauuguguaaauacaauugacauaggaauuacauuaaaauauuaggaagaaacaaggacaaau

SEQ ID NO: 440383 - RNA, 64 nt, hsa
uaaaccauucuccuauaugaaauuuuggauacuguuaaaauauaacucauguggacuucaaugc

SEQ ID NO: 440384 - RNA, 64 nt, hsa
uaauccauuaccuggcacuagcaacauuagaauuuuaaaauaaaauaauugggaaagaaggugg

SEQ ID NO: 440385 - RNA, 64 nt, hsa
uaacaauuuucuucagaagaauucuaugcuauuauuaaaauaaaauauuuacuguguauugccu

SEQ ID NO: 440386 - RNA, 64 nt, hsa
uugguugaagggauuacagagcccaauaaaggauuuaaaauauauucauuaagauuuuauuugg

SEQ ID NO: 440387 - RNA, 64 nt, hsa
uaaucaaaaugcacuuuuuaauaaaaacugauacuuaaaauaaauggcuguuauuucuacugug

SEQ ID NO: 440388 - RNA, 64 nt, hsa
uguauggucaguaggcaaucuuaaauguuuuuauuuaaaauaaaguauuccuugaaaauauaaa

SEQ ID NO: 440389 - RNA, 64 nt, hsa
ccaaaaguauaagauacauuuuuugguaaaccauuuaaaauacaaaauccuauuuuggaggcaa

SEQ ID NO: 440390 - RNA, 64 nt, hsa
gaggagggagugcgucuguucacuuuaaguuacuuuaaaauaacucugaacaugauuauauuau

SEQ ID NO: 440391 - RNA, 64 nt, hsa
uguuuauauuaaaauaaaauauuguauuaaaaauuuaaaauagguauuuuggauagauaugugu

SEQ ID NO: 440392 - RNA, 64 nt, hsa
uauuaucuuugucuauaacugacagauguuuauauuaaaauaaaauauuguauuaaaaauuuaa

SEQ ID NO: 440393 - RNA, 64 nt, hsa
gacagucuuugucauaggcaaacuugaauuugauuuaaaauagggcugggaaaaauauucaaua

SEQ ID NO: 440394 - RNA, 64 nt, hsa
cuuguaguauucaaguaagauaagugaccuaauuuuaaaauaauucuucuacuuuucuguauau

SEQ ID NO: 440395 - RNA, 64 nt, hsa
aguuaaugguugaauuuuuaaaguuuuuaguuacuuaaaauaugauuuuaaauuacauauuaau

SEQ ID NO: 440396 - RNA, 64 nt, hsa
uuuauaaaaaacccuuuguucauauuucuucccuuuaaaauauguaaugucaaaaaugacucac

SEQ ID NO: 440397 - RNA, 64 nt, hsa
aauggauucuugucuccucuucagaauuagccauuuaaaauauuuucugugacuucaaauugua

SEQ ID NO: 440398 - RNA, 64 nt, hsa
aguuaagacuugaaauugaaaauucuuuuaauauuuaaaauaacuuguuuauucaaugucuaaa

SEQ ID NO: 440399 - RNA, 64 nt, hsa
gcagaaaucgaauuuaaaacaaaaaggagggacuuuaaaauaccuucuugacaaaaaucaacaa

SEQ ID NO: 440400 - RNA, 64 nt, hsa
cuguguuuacuggaaaaauucagaggccuaaaguuuaaaauaaaauuuacuucugauguuuuaa

SEQ ID NO: 440401 - RNA, 64 nt, hsa
uuauacacuugucuugaauuuuuuucagauccacuuaaaauauuuagaaaaacaaguuuuauuc

SEQ ID NO: 440402 - RNA, 64 nt, hsa
gacaagauguaaaauaauauguuuuucaugcaguuuaaaauauuacuaacuuaaggguuucuau

SEQ ID NO: 440403 - RNA, 64 nt, hsa
aaauauuacuaacuuaaggguuucuaugugcuuuuuaaaauauuccuucuuugauguugacauc

SEQ ID NO: 440404 - RNA, 64 nt, hsa
aauagucuauauuuuaaccugcauaaaaaggucuuuaaaauauuguugaacacuugaagccauc

SEQ ID NO: 440405 - RNA, 64 nt, hsa
ugccgaauugucuuuggugcuuuucacuuguguuuuaaaauaaggauuuuucucuuauuucucc

SEQ ID NO: 440406 - RNA, 64 nt, hsa
gguuaagggaggugggggucacuguucaucacucuuaaaauauguguuuucucuauagaaaagu

SEQ ID NO: 440407 - RNA, 64 nt, hsa
uguacuuggacugucauagccucugcguuugaccuuaaaauagcucuucccaguaagauugugc

SEQ ID NO: 440408 - RNA, 64 nt, hsa
ugugcugucguuuuguuuguuuuucuaugauaauuuaaaauacauagguagggcuacugaggaa

SEQ ID NO: 440409 - RNA, 64 nt, hsa
guuauucacagacagaacuuuguuuccugugauuuuaaaauaccgcgucuguuccuccauggac

SEQ ID NO: 440410 - RNA, 64 nt, hsa
ugcacuuuaaaauaguaaaauggaaagugaauuuuuaaaauauaugcauuaaaaguuuacuuua

SEQ ID NO: 440411 - RNA, 64 nt, hsa
cuaccaaaaaauggaaaagaauuuuacaugcacuuuaaaauaguaaaauggaaagugaauuuuu

SEQ ID NO: 440412 - RNA, 64 nt, hsa
gaacuuugagacuaauuuguauugacucgguuuuuuaaaauaacuggcaaaugcuaugcuucua

SEQ ID NO: 440413 - RNA, 64 nt, hsa
guucuuuguguggguugacaccuauuuauaauucuuaaaauaaggguagcucaaaggagccaag

SEQ ID NO: 440414 - RNA, 64 nt, hsa
gaucugaauagagaaaucagcaguuaaaauaaaauuaaaauagcucugaacauuuaagaaugag

SEQ ID NO: 440415 - RNA, 64 nt, hsa
cugagucgagagaucugaauagagaaaucagcaguuaaaauaaaauuaaaauagcucugaacau

SEQ ID NO: 440416 - RNA, 64 nt, hsa
uagaaauggagagggaacuguuuugaauaaggauuuaaaauaccugcacaaggauagagagaaa

SEQ ID NO: 440417 - RNA, 64 nt, hsa
aguucucuagcuaaggaauggacauaccuuuguuuuaaaauauuuuauacuuacaaaaaucuag

SEQ ID NO: 440418 - RNA, 64 nt, hsa
ccucaaaggguuauuugaaaucuuuuguuguauuuuaaaauauuuuuuggaagagcugcuaauu

SEQ ID NO: 440419 - RNA, 64 nt, hsa
gcauuaacgcacaucucuuccacaacuaacagacuuaaaauaacaguguccuucguauuaauau

SEQ ID NO: 440420 - RNA, 64 nt, hsa
auuaucaaaacuuuuaaaauagaugcucauauuuuuaaaauaaaguuuuaaaaauaacugcauu

SEQ ID NO: 440421 - RNA, 64 nt, hsa
cacaagaaaauaauggcaauaauuaucaaaacuuuuaaaauagaugcucauauuuuuaaaauaa

SEQ ID NO: 440422 - RNA, 64 nt, hsa
ccauuuuuccuuaaccaacacccaaaucaaacaauuaaaauauacaguguuuuuccacucacua

SEQ ID NO: 440423 - RNA, 64 nt, hsa
uuaugauacuaaucuuuuaaguauccaaagaauauuaaaauacuucaauccuggauucacagug

SEQ ID NO: 440424 - RNA, 64 nt, hsa
uguuaauuuaaggauauauauuaauagaguauguuuaaaauaaauauuguuuucaucacugacu

SEQ ID NO: 440425 - RNA, 64 nt, hsa
guacaccauauaugaauaaacaguuuccaaaaacuuaaaauacaaaauauauuuuaccaaaaau

SEQ ID NO: 440426 - RNA, 64 nt, hsa
caugcacugagguccacagaccuacugcacugaguuaaaauagcgguacaaguucuggcaagag

SEQ ID NO: 440427 - RNA, 64 nt, hsa
aaauaaaaauauaggugaugggcagaucuuuucuuuaaaauaaaaaagcaaaaacucuuguggu

SEQ ID NO: 440428 - RNA, 64 nt, hsa
uaugguauaacaacaagugaauuugaagacucauuuaaaauauuguguuauuuauaaagucauu

SEQ ID NO: 440429 - RNA, 64 nt, hsa
uugauguauggauuacuuuuuuuuguaaacaugguuaaaauaaaacuuuugugguucuucugaa

SEQ ID NO: 440430 - RNA, 64 nt, hsa
uuuuagcaguggcuuauuauuuguuuuucauaaauuaaaauaacuuuugauaauguuuacuuua

SEQ ID NO: 440431 - RNA, 64 nt, hsa
agaguacccaaauucuaggacaaugcuuaaaguguuaaaauacccuagauacuguguuaugugc

SEQ ID NO: 440432 - RNA, 64 nt, hsa
guuuugaauuacccauaucacugccaguuuuauuuuaaaauauuuuguguuugaaguaucugug

SEQ ID NO: 440433 - RNA, 64 nt, hsa
auuccaguauuauguauauugcaaauuaaacauuuuaaaauauuuuuuuccaauuuauuucuca

SEQ ID NO: 440434 - RNA, 64 nt, hsa
ccaaacugauaacauuuaucucauuuucuagcacuuaaaauacaaagucuauauuauugcauaa

SEQ ID NO: 440435 - RNA, 64 nt, hsa
auguguaauauuccaguuuucucugcauaaguaauuaaaauauacuuaaaaauuaauaguuuua

SEQ ID NO: 440436 - RNA, 64 nt, hsa
caauccuuuugauaaauuuaaaauguuacuuauuuuaaaauaaaugaagugagauggcauggug

SEQ ID NO: 440437 - RNA, 64 nt, hsa
cacuuuucaagucugauccauauuuaauaaugcuuuaaaauaaaaauaaaaacaauccuuuuga

SEQ ID NO: 440438 - RNA, 64 nt, hsa
guagggagaaaauaugugcuaaugauauuuugaguuaaaauaucuuuuggggaggauuugcuga

SEQ ID NO: 440439 - RNA, 64 nt, hsa
aauacccuuaaggagguucaagcagagugagaaguuaaaauacccuuaaggucuuuaagggagg

SEQ ID NO: 440440 - RNA, 64 nt, hsa
ucccgaaggacggagguucaagcagagugagaaguuaaaauacccuuaaggagguucaagcaga

SEQ ID NO: 440441 - RNA, 64 nt, hsa
aaugcuauuaacaguaucagguaaaaaguacacuuuaaaauauuuuaaucaggcagaguuuuau

SEQ ID NO: 440442 - RNA, 64 nt, hsa
caggaaaggguuuuuugagaccauauguaugcuauuaaaauauauugagauuaauacaugaaaa

SEQ ID NO: 440443 - RNA, 64 nt, hsa
aagcauauuagaauaauuguggguugacagauuuuuaaaauagaauuuagaguauuugggguuu

SEQ ID NO: 440444 - RNA, 64 nt, hsa
uaaacuuacuacuuucuugugggacagaaagaccuuaaaauauucauauuacuuaaugaauaug

SEQ ID NO: 440445 - RNA, 64 nt, hsa
aauaaaaauuaaauauuagaaugugagaaauuuauuaaaauauaguucuaaaaauaaguuucuu

SEQ ID NO: 440446 - RNA, 64 nt, hsa
uauugcuauaacauauauuuuuuucugaaauguuuuaaaauagaaguacaccuaauuguuauug

SEQ ID NO: 440447 - RNA, 64 nt, hsa
uucuuagcuguauauacauuuuuuuaaaaguuuguuaaaauaugcuugacuagaguuuccaguu

SEQ ID NO: 440448 - RNA, 64 nt, hsa
gcaauauaaggaaagugauccaaaauuugaaauauuaaaauaauaucuaauaaaaagucacaaa

SEQ ID NO: 440449 - RNA, 64 nt, hsa
guugccaaccuuuucuuuuauaaaacuauuacauuuaaaauauggacgucugaaaaauaaaaua

SEQ ID NO: 440450 - RNA, 63 nt, hsa
aacucaaucaccauagcugauauaacucuacccuuaaaauauucccuguauagaaauguggaa

SEQ ID NO: 440451 - RNA, 64 nt, hsa
agagaaucugugggaaauaggcagauauagcuuuuuaaaauauaaaguacuugggauuuugcau

SEQ ID NO: 440452 - RNA, 64 nt, hsa
gagagcuuuuccuuauacaucucaaugcugagaguuaaaauauucccagguuaaaauuuuuuua

SEQ ID NO: 440453 - RNA, 64 nt, hsa
cuugugugauuaacuuauuuagagaugcuguaacuuaaaauaggggauauuuaagguagcuuca

SEQ ID NO: 440454 - RNA, 64 nt, hsa
guuacuauuuucuacaauuaauaguuugucuauuuuaaaauaaauuaguuguuaagagucuuaa

SEQ ID NO: 440455 - RNA, 64 nt, hsa
aaugaacuuuaaaaaagcaaauuucaugcacugauuaaaauaggauuauuuuaaauacaaaagg

SEQ ID NO: 440456 - RNA, 64 nt, hsa
gggucuuaauugaaaugaaaauuuaauuuuguuuuuaaaauauuguuuaucuuuauuuauuuug

SEQ ID NO: 440457 - RNA, 64 nt, hsa
guugauuugaggauauaauaauguuuuaaucuuuuuaaaauauaagugguuauucucugacuug

SEQ ID NO: 440458 - RNA, 64 nt, hsa
aagucaguugauuuuuuuucuauuaaaacuguuguuaaaauauuuuuuaaaacaaaaacauuau

SEQ ID NO: 440459 - RNA, 64 nt, hsa
ccauagguguauauauagguauauaauuuuaagguuaaaauauucagucuacaaguuugguucu

SEQ ID NO: 440460 - RNA, 64 nt, hsa
uuuuaaacuuguuaaaaagaaauuuauauaaaauuuaaaauacaaauguuaaauuauccagaaa

SEQ ID NO: 440461 - RNA, 64 nt, hsa
cccuuuaaaaauaauuccuuggacugccuggugguuaaaauacgauuccucauauccaaggcua

SEQ ID NO: 440462 - RNA, 64 nt, hsa
aauaaaagacuuauaaaauaccuaacuacaggacuuaaaauauagauuggcgcguaguauacag

SEQ ID NO: 440463 - RNA, 64 nt, hsa
uucgagauuaucguuuucuuaaagugccaguauuuuaaaauagcguucuuguaauuuuacacgc

SEQ ID NO: 440464 - RNA, 64 nt, hsa
gaagaccugagaauguauccccaaaagcgugagcuuaaaauacaagacugccauauuaaauuuu

SEQ ID NO: 440465 - RNA, 64 nt, hsa
gaaauaaauugggcccaagagcuuuaacucggucuuaaaauaugcccaaauuuuuacuuuguuu

SEQ ID NO: 440466 - RNA, 64 nt, hsa
uaaaaugguuucuagcauauguauaaugcuauaguuaaaauacuauuuuucaaaaucauacaga

SEQ ID NO: 440467 - RNA, 64 nt, hsa
gcauguaacagacuggcacaugugccagcugaauuuaaaauauaauacuuuuaaaaagaaaauu

SEQ ID NO: 440468 - RNA, 64 nt, hsa
aaaacaaaaaacuauguauuugcacagcacacuauuaaaauauuaaguguaauuauuuuaacac

SEQ ID NO: 440469 - RNA, 64 nt, hsa
uuaauugauuuuacagucuguaaugcuugauguuuuaaaauaauaacauuuuuauauuuuuuaa

SEQ ID NO: 440470 - RNA, 64 nt, hsa
uacaaguuuucuuuaaagcccucuccuuuagaauuuaaaauauuguaccauugaagaguuugga

SEQ ID NO: 440471 - RNA, 64 nt, hsa
guuaacaugaaaauggcauuuuuccauaauagcuuuaaaauaauuuuuuaguaauuauuacaaa

SEQ ID NO: 440472 - RNA, 64 nt, hsa
gcccggccaagaucuaacucacgcuuacuuuucauuaaaauauuucuugucgcuuuuagcuauu

SEQ ID NO: 440473 - RNA, 64 nt, hsa
uacucaucuugcacggccagaacuguuugguugauuaaaauacaucagcucuuaaaaacucauu

SEQ ID NO: 440474 - RNA, 64 nt, hsa
ucugugcgaccaaugagacgacuucagcaucuuuuuaaaauaaucuaagcaucauugaagcagu

SEQ ID NO: 440475 - RNA, 64 nt, hsa
aaauuaauaacuuuuaguaauuacuuuuauuaauuuaaaauagaacgcuugagaggcacuuugu

SEQ ID NO: 440476 - RNA, 64 nt, hsa
uuuuuuaaaauuaauauuaauaacuuuuauuaauuuaaaauagaaugcuuaaaauaaaauagaa

SEQ ID NO: 440477 - RNA, 64 nt, hsa
uauuaauaacuuuuauuaauuuaaaauagaaugcuuaaaauaaaauagaaugcuugagaggcac

SEQ ID NO: 440478 - RNA, 64 nt, hsa
augaaaagacagcuuaaggaagagcuaaauucuguuaaaauauuuggggcauguuugugcacug

SEQ ID NO: 440479 - RNA, 64 nt, hsa
ugaaaacagcauuggccaaagguacugaggcugcuuaaaauauucaauucugcuuuuuaauuuu

SEQ ID NO: 440480 - RNA, 64 nt, hsa
uuuuuucccuaaaugguauggccaaaagucagaguuaaaauauauauaguuagauuccaacuuc

SEQ ID NO: 440481 - RNA, 64 nt, hsa
uuaaaaaauauauauauaaaauauuuuuuucuuuuuaaaauagacacuauaguuuuacccauaa

SEQ ID NO: 440482 - RNA, 64 nt, hsa
gcuuucagaucaacacaaauagcugcagccuggguuaaaauauaacaucacuauuuggcuuuug

SEQ ID NO: 440483 - RNA, 64 nt, hsa
cccucaaauauuuuacuauuuguuuuauuuggaguuaaaauaagaguaucauccauauggucca

SEQ ID NO: 440484 - RNA, 64 nt, hsa
aucgagcgcaguucaugcacaaggccccguugauuuaaaauauuggaucuugcucuguuagggu

SEQ ID NO: 440485 - RNA, 64 nt, hsa
uuagaaugaccucuaacacuccuguaauugucuuuuaaaauacugauauuuuuauuuguuaaua

SEQ ID NO: 440486 - RNA, 64 nt, hsa
uaguuucucuaaaacuuuaucugaaagagucauuuuaaaauaacuauuaaacaauguaacugcu

SEQ ID NO: 440487 - RNA, 64 nt, hsa
gcuaucuuaauguucugaaauaaguuaaaacauuuuaaaauaugaauacuguaaaggaaauaaa

SEQ ID NO: 440488 - RNA, 64 nt, hsa
aaauagaaguacagugaggucuauagccauuuuauuaaaauagcuuaaaaguuuguaaaaaaau

SEQ ID NO: 440489 - RNA, 64 nt, hsa
cuacaaugaauagguauggugguuucacagaauuuuaaaauagaguuaaagggaagugauguac

SEQ ID NO: 440490 - RNA, 64 nt, hsa
gauauaaucuuggcuucuuaaaaacuguguaucauuaaaauauauguucugcaagaauuaaaac

SEQ ID NO: 440491 - RNA, 64 nt, hsa
uuauauuccaaggaaaauugaaaguauucagaaauuaaaauauuauuugauaucugaaaccugg

SEQ ID NO: 440492 - RNA, 64 nt, hsa
aagguuuacugcucguaaggaaacauuuuauguauuaaaauaaacuguuccuugauaaaaggcu

SEQ ID NO: 440493 - RNA, 64 nt, hsa
acacaguuuguuuuucuuguaaucacuuuucauguuaaaauaaucagcauucaaauuguaugcu

SEQ ID NO: 440494 - RNA, 64 nt, hsa; identical to SEQ ID NO: 440487

SEQ ID NO: 440495 - RNA, 64 nt, hsa; identical to SEQ ID NO: 440486

SEQ ID NO: 440496 - RNA, 64 nt, hsa
uaacugcuaucuuaauguucugaaauaaaacauuuuaaaauauaaauccuguaguuuaaaagga

SEQ ID NO: 440497 - RNA, 64 nt, hsa
ccauggguuuaaaacuguaucuuaaagagucauuuuaaaauaauauaaauauuaaaaaauguaa

SEQ ID NO: 440498 - RNA, 64 nt, hsa
uuuguauuaaauuuauuacuauuucuuaugccuuuuaaaauacuguuuacuaugaagacaaugu

SEQ ID NO: 440499 - RNA, 64 nt, hsa
aguaucacucuaguaaaaaaaccaaauaauuuguuuaaaauaaccaaagaguuguuauaaugca

SEQ ID NO: 440500 - RNA, 64 nt, hsa
uuuuuucuuuuuacacuaauaacuuuuaugccuuuuaaaauaaauuuauuuucauaaaugguuu

SEQ ID NO: 440501 - RNA, 64 nt, hsa
cauggucuuucugggccuuacugugcugguauaauuaaaauaaaauauauuuuguucuauuggu

SEQ ID NO: 440502 - RNA, 64 nt, hsa
uaguuuucuagcucucgggucccuuuauugcuuuuuaaaauaggguuugaaacaugccacagga

SEQ ID NO: 440503 - RNA, 64 nt, hsa
gccuuagagacgugguaaagcacuuuggcaggguuuaaaauauuugugagaagcccacauuuca

SEQ ID NO: 440504 - RNA, 64 nt, hsa
ggagugggaauugcuaucauguaaaauaucaaaguuaaaauacuaaggugcauuuucccugaag

SEQ ID NO: 440505 - RNA, 64 nt, hsa
aagugccaaacuguuauuuuacuauauauaaauauuaaaauauuguguugaaguauagggaugu

SEQ ID NO: 440506 - RNA, 64 nt, hsa
uuuccaaucuucuucccccuacuuggguaauugauuaaaauaccuccauuuacggccucuuucu

SEQ ID NO: 440507 - RNA, 64 nt, hsa
aaugaagaagaggggaaaauggggagaaagaugguuaaaauacauaauaauccacguuuaaaag

SEQ ID NO: 440508 - RNA, 64 nt, hsa
cagcuuuucccaccaguggugcuguugagauauuuuaaaauauugccuccguuuuaucgaggag

SEQ ID NO: 440509 - RNA, 64 nt, hsa
uaucuauauuuauuuguaaaaauccaagcauaguuuaaaauaugaugucgauauuacuagucuu

SEQ ID NO: 440510 - RNA, 64 nt, hsa
gauauuuuuuuauuuuauacaugcuguuuuuuaauuaaaauauaaucacugaaguuuacuaauu

SEQ ID NO: 440511 - RNA, 64 nt, hsa
aaucuauuagauuuuagaaaaacauuuaaacuuuuuaaaauacuuauuaaaaaauuuguauaag

SEQ ID NO: 440512 - RNA, 64 nt, hsa
guguugagccaugcuacaguuagucuugucccaauuaaaauacuaugcaguaucucuuacauca

SEQ ID NO: 440513 - RNA, 64 nt, hsa
ggucuuaaaguaguuacucccuucucguguuugcuuaaaauaugugaaguuuuccuugcuauuu

SEQ ID NO: 440514 - RNA, 64 nt, hsa
uuucauagugcuuucaaauacaccuuuuugaucauuaaaauaaaaaaauaaaucuugcucuguu

SEQ ID NO: 440515 - RNA, 64 nt, hsa
aaaaucuugagguuaaacaucucucucucuuuuuuuaaaauacaaggcccugauaaaauugaua

SEQ ID NO: 440516 - RNA, 64 nt, hsa
gauuuuguagaaauguaaagauuacuugagguguuuaaaauaaauuuuucauucagacuaccuu

SEQ ID NO: 440517 - RNA, 64 nt, hsa
uaaugaguacacaaguuuuugccuaucccuuuccuuaaaauauaagaaauaaaggagcucuuac

SEQ ID NO: 440518 - RNA, 64 nt, hsa
acgucaggccacccucauaguaagugguguaguauuaaaauauuuucacggaauuaaaaguagc

SEQ ID NO: 440519 - RNA, 64 nt, hsa
gggguuuuuuuucuaagcuucuuugucuuaaauuuuaaaauagugaauauguuugagacucccu

SEQ ID NO: 440520 - RNA, 64 nt, hsa
ucagcuuauuugaagauuaauuuucuuuguuaacuuaaaauaacuauuuuaacccuugaguggc

SEQ ID NO: 440521 - RNA, 64 nt, hsa
uuccauugcuuuguuugcuuuaaaaauuccacaauuaaaauaucugucauugaaagcuuagaca

SEQ ID NO: 440522 - RNA, 64 nt, hsa
cacaauaauuauugccuguaugucaauuauuauuuuaaaauauuguuguauuuacuuaaugucu

SEQ ID NO: 440523 - RNA, 64 nt, hsa
uuucuuagaaacuuuaaaccuuuaacuucaaacauuaaaauacaagucuuuuaaguacaugagu

SEQ ID NO: 440524 - RNA, 64 nt, hsa
gaauuuuacuguuacacauaguuuuugacuugaauuaaaauacuagacaaagcagaaauguaca

SEQ ID NO: 440525 - RNA, 64 nt, hsa
cuaaccaaacuuccucagauugugcacuguuuguuuaaaauaaucacguauuuuagucugaugc

SEQ ID NO: 440526 - RNA, 64 nt, hsa
aaauaguauauguggacacauauauaucauuauauuaaaauaaauucuaccauuuuaaauuggu

SEQ ID NO: 440527 - RNA, 64 nt, hsa
uguuuuauaaugauuauaauuuacaugcuuauuuuuaaaauaguauauguggacacauauauau

SEQ ID NO: 440528 - RNA, 64 nt, hsa
agaaguuacuuugcuuuuaaagaaacuuggcugcuuaaaauaagcaaaaauuggaugcguaaag

SEQ ID NO: 440529 - RNA, 64 nt, hsa
aauuuuuaaucaguuugcuuucuccagagaaauuuuaaaauaauagaagaaauagaaauuuuga

SEQ ID NO: 440530 - RNA, 64 nt, hsa
aaaugugaaguagugaugguuuuugaaauaagcuuuaaaauauagggaucuugaaggcucccug

SEQ ID NO: 440531 - RNA, 64 nt, hsa
ucuguuaccuacuuuugccagugaaauuuaaguuuuaaaauacuuucagaauguauuuuuacua

SEQ ID NO: 440532 - RNA, 64 nt, hsa
uucuuuuuugaaaauuagcaauuauaaagauuguuuaaaauaucuugauauuuucacaaauuuu

SEQ ID NO: 440533 - RNA, 64 nt, hsa
guaguaucuaaaagcauaauuuaauagcauugucuuaaaauacgugaugaguuauuuggugcac

SEQ ID NO: 440534 - RNA, 64 nt, hsa
uuucuuucuaaaaguauaauuuaauagaauuaucuuaaaauacaugaucaguauucagugcgcu

SEQ ID NO: 440535 - RNA, 64 nt, hsa
uucuuuuuacugucaucuauuauuuuaacaggaguuaaaauaacuccuguuaaacuuucugaca

SEQ ID NO: 440536 - RNA, 64 nt, hsa
gcuugguauuucugucuuauacauaggaaaacauuuaaaauaaauaguuuuuaauuguaggcuc

SEQ ID NO: 440537 - RNA, 64 nt, hsa
aagccuuuaaugcucuggguucaugucagauacauuaaaauacucacugaagagaagcccuaug

SEQ ID NO: 440538 - RNA, 64 nt, hsa
cuauauguauauuuuguuaauuaguggcucauauuuaaaauaguucucugacuauggauuucaa

SEQ ID NO: 440539 - RNA, 64 nt, hsa
gauuaugcaauucuaacuguagaagagauagcuauuaaaauaaucaguagccugggcauagugg

SEQ ID NO: 440540 - RNA, 64 nt, hsa
uaaagacuacaguuaauucugacacuguaucuuauuaaaauaggaugauuugcauuuuguaaaa

SEQ ID NO: 440541 - RNA, 64 nt, hsa
aaagaaggccucuuaaauucaacccauguuuuacuuaaaauaucuuggcauaagcucaaaaaag

SEQ ID NO: 440542 - RNA, 64 nt, hsa
uguuucuauuauugaaaauuguauguaaaacuauuuaaaauagaauagaaggauacacacccaa

SEQ ID NO: 440543 - RNA, 64 nt, hsa
uuaaauuuauuuuuuauuauguaacauacuuuuauuaaaauauauacuuauauaauaaaaguau

SEQ ID NO: 440544 - RNA, 64 nt, hsa
agcauuauuuauaaacuuugcuaugaaaaagacauuaaaauaugagauguaugaugaaaaucua

SEQ ID NO: 440545 - RNA, 64 nt, hsa
auaauuuuuaauugggguggcaacuuaaauucaauuaaaauaacucaugugucacaagaguaaa

SEQ ID NO: 440546 - RNA, 64 nt, hsa
auauucuguagaagauauuucuaaaaucuuaucuuuaaaauaugaaauaauuuuuaauuggggu

SEQ ID NO: 440547 - RNA, 64 nt, hsa
ugcagaaggcggaguuuuuaaauuuaaaacauuuuuaaaauagcaaauguuaauauuccaguuu

SEQ ID NO: 440548 - RNA, 64 nt, hsa
cacaaaugcuauuucacccugcagguuagcaguauuaaaauagaaacaucaaaucccccaucag

SEQ ID NO: 440549 - RNA, 64 nt, hsa
uauagcaguugcagguaaacugucaggauugguuuuaaaauauuuuuguaacuuuaaaauauuc

SEQ ID NO: 440550 - RNA, 64 nt, hsa
cugucaggauugguuuuaaaauauuuuuguaacuuuaaaauauucuauaauuaugcaugugauu

SEQ ID NO: 440551 - RNA, 64 nt, hsa
auguagaaaaagagauagaaggaaccaccuaugcuuaaaauacuguaaauaugcagugagguuu

SEQ ID NO: 440552 - RNA, 64 nt, hsa
agaauguuguaauaaguaaaugccuuaagaguauuuaaaauaugcuuccacauuucaaaauaua

SEQ ID NO: 440553 - RNA, 64 nt, hsa
aauacaguaccgugucugaauuaauuauuaauauuuaaaauacuucauuccuuaacucucccuc

SEQ ID NO: 440554 - RNA, 64 nt, hsa
uuuaaaugugaauuuuuauuucuuuuuaauuauuuuaaaauauuuaaaccuuuuucuugaucuu

SEQ ID NO: 440555 - RNA, 64 nt, hsa
aucaugaauucccuuuuaaucaacuguagguuauuuaaaauaaauuccuacaacuuaauggaaa

SEQ ID NO: 440556 - RNA, 64 nt, hsa
uuuuuaacaaucuucaauaauguaaagauuacuuuuaaaauauuuaaguuaaaacuacuugaau

SEQ ID NO: 440557 - RNA, 64 nt, hsa
acucuuguguuucuguuuuucccaguaugcauguuuaaaauagaagugacaagaaucacauccg

SEQ ID NO: 440558 - RNA, 64 nt, hsa
caaguagaaaaaaaaauguauuugcccuaaauccuuaaaauacaaaugcuauaaaaauuccugu

SEQ ID NO: 440559 - RNA, 64 nt, hsa
acagaaaaaggaagugcuggugcauauuuuugaguuaaaauauuucccuauuuuaucaugauua

SEQ ID NO: 440560 - RNA, 64 nt, hsa
acaguuguauuuaacagaaauuguauauuguaauuuaaaauaauuauauaacuguauuugaaau

SEQ ID NO: 440561 - RNA, 64 nt, hsa
auuuccuuccugugcuccacguucuucugugugauuaaaauaagaauauuauuuuuggaaauau

SEQ ID NO: 440562 - RNA, 64 nt, hsa
ucuuuugggaaccaaaguauuuuacuguaaaucuuuaaaauaacagaauucagugcucuuucau

SEQ ID NO: 440563 - RNA, 64 nt, hsa
cuuaguaauguccuuaacuuuagaaauacagcuuuuaaaauauugugguucuggaccuuacaag

SEQ ID NO: 440564 - RNA, 64 nt, hsa
gaaagugacugauuuuaauaaugagauaggucacuuaaaauaacagugccuuugaccuuaaaac

SEQ ID NO: 440565 - RNA, 64 nt, hsa
auuagucauuauagcucagaccuaagcuaauuauuuaaaauaaauacauguaaaggccacugcc

SEQ ID NO: 440566 - RNA, 64 nt, hsa
auucuauauauauauaaauauauauaaauauauauuaaaauaccaguuuuuuuucucugggugc

SEQ ID NO: 440567 - RNA, 64 nt, hsa
cuauucuguaagucugagcguaaaacuucaaguauuaaaauaauuuguacauguagagagaaaa

SEQ ID NO: 440568 - RNA, 64 nt, hsa
aaaucuugaggucauauacugaaauaugaauaaauuaaaauaaugaauucagaucuaaucauuu

SEQ ID NO: 440569 - RNA, 64 nt, hsa
auuauugacauuaaguaaugguaccauauauuuuuuaaaauacauauugacuugaauugugagg

SEQ ID NO: 440570 - RNA, 64 nt, hsa
auuuaucucuuuguuguauuuuccaugauguuucuuaaaauagaaaguuuauuuagauucagaa

SEQ ID NO: 440571 - RNA, 64 nt, hsa
aacacggcaugggaguaagguuauccuuagaaauuuaaaauaacuccacaguaaaauagguaga

SEQ ID NO: 440572 - RNA, 64 nt, hsa
ucuaaguuuaugaauggcaugaaucacucauuuauuaaaauauaucagguuggagagugagaau

SEQ ID NO: 440573 - RNA, 64 nt, hsa
acuugcugcaugacccuccaaguagaccuguggcuuaaaauaaagaaaaugcagcaaaaagaau

SEQ ID NO: 440574 - RNA, 64 nt, hsa
acugaauguuugaauagaaaccucuacuaaauuauuaaaauagacauuuaguguucucacagcu

SEQ ID NO: 440575 - RNA, 64 nt, hsa
aauuguacacauugauauuuaaugacaaauuuacuuaaaauaaauugaccccuuguucuuacuu

SEQ ID NO: 440576 - RNA, 64 nt, hsa
ugaagcugcaaacuucuuuuuacucuaaucauuuuuaaaauacuaauggaagaacuuucuagca

SEQ ID NO: 440577 - RNA, 64 nt, hsa
cucccacagaauuuucaagcccuuaagaguuuaguuaaaauaaaauuuuugaaauuauugucuu

SEQ ID NO: 440578 - RNA, 64 nt, hsa
cuuuuaguguuucagauaaccucucaaaaagacuuuaaaauaaugcuauuacacaaagcugcau

SEQ ID NO: 440579 - RNA, 64 nt, hsa
uaaaaaguauucuuuauucauauguauagaaugcuuaaaauagcacuguagacaagauguuucc

SEQ ID NO: 440580 - RNA, 64 nt, hsa
aaaaaguagaaguaucaaauaaaaagggcaacuuuuaaaauauuaagccugaagacuucuaaaa

SEQ ID NO: 440581 - RNA, 64 nt, hsa
uuuguuucaugagauucaaacuugaugcuaugcuuuaaaauaaacucaguacuuuuagaaacau

SEQ ID NO: 440582 - RNA, 64 nt, hsa
aaaaggagguggaugcauccaaagcacgagucacuuaaaauaucgacgguaaacuacuauuuug

SEQ ID NO: 440583 - RNA, 64 nt, hsa
aauuaccacaccagaucaauuuuaugcagaggccuuaaaauauucuuucacaguagcuuucuua

SEQ ID NO: 440584 - RNA, 64 nt, hsa
guaaaaguuauacuuaacuugucugucuauuauuuuaaaauaugcauugaaauaaugugguaua

SEQ ID NO: 440585 - RNA, 64 nt, hsa
uuucuucagaauauuuuuaaaagguacagaauccuuaaaauauuaacaacuaauugcauccauc

SEQ ID NO: 440586 - RNA, 64 nt, hsa
uucacacaaagugaaauuaguauuuugagccuuauuaaaauauuuucuuaauuaugguaccucu

SEQ ID NO: 440587 - RNA, 64 nt, hsa
cacugcaguuauuuaccagaaguuuaaaucuuuguuaaaauauaguguuguguuacaauaagug

SEQ ID NO: 440588 - RNA, 64 nt, hsa
ccugccuugccuguuaggucuguugaagugcauguuaaaauaauuauaugaagcagaaugagau

SEQ ID NO: 440589 - RNA, 64 nt, hsa
aacauagauauuuucuuucuccugaccauguauuuuaaaauauagucuauuucuugacuuugaa

SEQ ID NO: 440590 - RNA, 64 nt, hsa
uuaaaaaugccauaacaaucuugcgagacuaacuuuaaaauauacuuuaaaugauuauuaugau

SEQ ID NO: 440591 - RNA, 64 nt, hsa
uaccuugcacacaucaucuguaagcuguuugguuuuaaaauacuguagauaauuaaccaaggua

SEQ ID NO: 440592 - RNA, 64 nt, hsa
acucaaccaaaugguacaaaaccacaguguaccauuaaaauaugcacuaagucucuuuuuuaca

SEQ ID NO: 440593 - RNA, 64 nt, hsa
cuuuuaaaggagggcauguucaguuuucugugaauuaaaauaugcucaugugugggcacacacg

SEQ ID NO: 440594 - RNA, 64 nt, hsa
aauuugucaguucauuccuggaaaaucuuuugaguuaaaauaaggauccuaggacagcaccucg

SEQ ID NO: 440595 - RNA, 64 nt, hsa
uuagaguaaaacuauuuuguguacaauuguguuuuuaaaauaguuaguagaucacuaugguauu

SEQ ID NO: 440596 - RNA, 64 nt, hsa
gccacaaacuggacaagaagcuggguauuuggguuuaaaauagauuuucuugacucugagcuug

SEQ ID NO: 440597 - RNA, 64 nt, hsa; identical to SEQ ID NO: 440582

SEQ ID NO: 440598 - RNA, 64 nt, hsa; identical to SEQ ID NO: 440583

SEQ ID NO: 440599 - RNA, 64 nt, hsa
ucucuauauauuuuaauguauugcacauguauauuuaaaauauauacgaaagaacucuaaaucc

SEQ ID NO: 440600 - RNA, 64 nt, hsa
uuucccuaacucugguccaccugcaaccuaggaguuaaaauaaguaucuugcuauguuaagagu

SEQ ID NO: 440601 - RNA, 64 nt, hsa
auaugucauauguuauuauaacagaucucuuccuacaucuuauuuuucuucuuuguauacagua

SEQ ID NO: 440602 - RNA, 64 nt, hsa
aagaaauauuuauuauuaaaaguaagucauuuauacaucuuagaaaaaauuacauaguuuuguu

SEQ ID NO: 440603 - RNA, 64 nt, hsa
augccuuaagucaaugcacucagcaaggagaagcacaucuuauuuaucuuguuaccuauaguuu

SEQ ID NO: 440604 - RNA, 64 nt, hsa
ggugauuggaggggaaugacuuaguuaugacuggacaucuuaaaagcugauagacaagccaaau

SEQ ID NO: 440605 - RNA, 64 nt, hsa
gccucuaguuuuguaagcuccuggagggcggauaacaucuuauacuacucuuguauucucaugg

SEQ ID NO: 440606 - RNA, 64 nt, hsa
uuugugugugucacaugcugccugagucacauguacaucuuauuucugccucuaguuuuguaag

SEQ ID NO: 440607 - RNA, 64 nt, hsa
accgcgcccggcggcgaaacacgauauuguacuaacaucuuaauuuuguuauaaaaucucacaa

SEQ ID NO: 440608 - RNA, 64 nt, hsa
caccaggcccgagaaaugcuuuuuuaaaaaacacacaucuuauggcauucaccuucuuggagcu

SEQ ID NO: 440609 - RNA, 64 nt, hsa
acagauccaagguaacuggguaggaaaucuuuugacaucuuaacucauguugaguuugugcugu

SEQ ID NO: 440610 - RNA, 64 nt, hsa
uaucagguaaacugucacuuaaauggagguguccacaucuuaauuguuucuccuugacacauuu

SEQ ID NO: 440611 - RNA, 64 nt, hsa
aauguagauuuuuauuuucuacuuuugauuauuaacaucuuaugaaaaaaauauuuuaaaaaac

SEQ ID NO: 440612 - RNA, 64 nt, hsa
ggggagaguaucaugggagaugguauccaugauaacaucuuauucuaaugaaauguagauuuuu

SEQ ID NO: 440613 - RNA, 64 nt, hsa
aaucuuggcauccuaucacuaugugauauuuuguacaucuuacuguauuuacaaguuuauuuau

SEQ ID NO: 440614 - RNA, 64 nt, hsa
ggcuaucuggggcaggcacaaauugguggaaaucacaucuuaaugucaagcucauuaaguuaac

SEQ ID NO: 440615 - RNA, 64 nt, hsa
cuuccagagaacacguuggcucaguccugggucaacaucuuagacccgguccugcccuuccuga

SEQ ID NO: 440616 - RNA, 64 nt, hsa
ugaccuggcuggugacagaacaugcagcaaggggacaucuuaggcuggccagacuucagcuguu

SEQ ID NO: 440617 - RNA, 64 nt, hsa
cuagcaauaugugccacaacaugacagucuugugacaucuuaaggaaaagaagaguuccuguua

SEQ ID NO: 440618 - RNA, 62 nt, hsa
uuuuacaggggauuaugauuaaaagugauuuaguacaucuuacaugauaucucauuucuacg

SEQ ID NO: 440619 - RNA, 64 nt, hsa; identical to SEQ ID NO: 125388

SEQ ID NO: 440620 - RNA, 64 nt, hsa; identical to SEQ ID NO: 125389

SEQ ID NO: 440621 - RNA, 64 nt, hsa; identical to SEQ ID NO: 125390

SEQ ID NO: 440622 - RNA, 64 nt, hsa; identical to SEQ ID NO: 125391

SEQ ID NO: 440623 - RNA, 64 nt, hsa; identical to SEQ ID NO: 125392

SEQ ID NO: 440624 - RNA, 64 nt, hsa; identical to SEQ ID NO: 125393

SEQ ID NO: 440625 - RNA, 64 nt, hsa; identical to SEQ ID NO: 125394

SEQ ID NO: 440626 - RNA, 64 nt, hsa; identical to SEQ ID NO: 125395

SEQ ID NO: 440627 - RNA, 64 nt, hsa; identical to SEQ ID NO: 125396

SEQ ID NO: 440628 - RNA, 64 nt, hsa; identical to SEQ ID NO: 125397

SEQ ID NO: 440629 - RNA, 64 nt, hsa; identical to SEQ ID NO: 125398

SEQ ID NO: 440630 - RNA, 64 nt, hsa; identical to SEQ ID NO: 125399

SEQ ID NO: 440631 - RNA, 64 nt, hsa; identical to SEQ ID NO: 125400

SEQ ID NO: 440632 - RNA, 64 nt, hsa; identical to SEQ ID NO: 125401

SEQ ID NO: 440633 - RNA, 64 nt, hsa; identical to SEQ ID NO: 309634

SEQ ID NO: 440634 - RNA, 64 nt, hsa; identical to SEQ ID NO: 309635

SEQ ID NO: 440635 - RNA, 64 nt, hsa; identical to SEQ ID NO: 309636

SEQ ID NO: 440636 - RNA, 64 nt, hsa; identical to SEQ ID NO: 309637

SEQ ID NO: 440637 - RNA, 64 nt, hsa; identical to SEQ ID NO: 309638

SEQ ID NO: 440638 - RNA, 64 nt, hsa; identical to SEQ ID NO: 309639

SEQ ID NO: 440639 - RNA, 64 nt, hsa; identical to SEQ ID NO: 309640

SEQ ID NO: 440640 - RNA, 64 nt, hsa; identical to SEQ ID NO: 309641

SEQ ID NO: 440641 - RNA, 64 nt, hsa; identical to SEQ ID NO: 309642

SEQ ID NO: 440642 - RNA, 64 nt, hsa; identical to SEQ ID NO: 309643

SEQ ID NO: 440643 - RNA, 64 nt, hsa; identical to SEQ ID NO: 309644

SEQ ID NO: 440644 - RNA, 64 nt, hsa; identical to SEQ ID NO: 309645

SEQ ID NO: 440645 - RNA, 64 nt, hsa; identical to SEQ ID NO: 309646

SEQ ID NO: 440646 - RNA, 64 nt, hsa; identical to SEQ ID NO: 309647

SEQ ID NO: 440647 - RNA, 64 nt, hsa; identical to SEQ ID NO: 309648

SEQ ID NO: 440648 - RNA, 64 nt, hsa; identical to SEQ ID NO: 309649

SEQ ID NO: 440649 - RNA, 64 nt, hsa; identical to SEQ ID NO: 309650

SEQ ID NO: 440650 - RNA, 64 nt, hsa; identical to SEQ ID NO: 309651

SEQ ID NO: 440651 - RNA, 64 nt, hsa; identical to SEQ ID NO: 309652

SEQ ID NO: 440652 - RNA, 64 nt, hsa; identical to SEQ ID NO: 309653

SEQ ID NO: 440653 - RNA, 64 nt, hsa; identical to SEQ ID NO: 309654

SEQ ID NO: 440654 - RNA, 64 nt, hsa; identical to SEQ ID NO: 309655

SEQ ID NO: 440655 - RNA, 64 nt, hsa; identical to SEQ ID NO: 309656

SEQ ID NO: 440656 - RNA, 64 nt, hsa; identical to SEQ ID NO: 309657

SEQ ID NO: 440657 - RNA, 64 nt, hsa; identical to SEQ ID NO: 309658

SEQ ID NO: 440658 - RNA, 64 nt, hsa; identical to SEQ ID NO: 309659

SEQ ID NO: 440659 - RNA, 64 nt, hsa; identical to SEQ ID NO: 309660

SEQ ID NO: 440660 - RNA, 64 nt, hsa; identical to SEQ ID NO: 309661

SEQ ID NO: 440661 - RNA, 64 nt, hsa; identical to SEQ ID NO: 309662

SEQ ID NO: 440662 - RNA, 64 nt, hsa; identical to SEQ ID NO: 309663

SEQ ID NO: 440663 - RNA, 64 nt, hsa; identical to SEQ ID NO: 309664

SEQ ID NO: 440664 - RNA, 64 nt, hsa; identical to SEQ ID NO: 309665

SEQ ID NO: 440665 - RNA, 64 nt, hsa; identical to SEQ ID NO: 309666

SEQ ID NO: 440666 - RNA, 64 nt, hsa; identical to SEQ ID NO: 309667

SEQ ID NO: 440667 - RNA, 64 nt, hsa; identical to SEQ ID NO: 309668

SEQ ID NO: 440668 - RNA, 64 nt, hsa; identical to SEQ ID NO: 309669

SEQ ID NO: 440669 - RNA, 64 nt, hsa
aucccgauuugaacaauguacucccuggccuggauacauuaauaaccauaaauuugcaugaauu

SEQ ID NO: 440670 - RNA, 64 nt, hsa
auccugcgugcagugccaggaccuggccgcacuguacauuaagccuucagggcugucucaggcc

SEQ ID NO: 440671 - RNA, 64 nt, hsa
gugcauuuaguuccgcauaugaugguuuuuuuuuuacauuaaagaguauaugugucuuaaugca

SEQ ID NO: 440672 - RNA, 64 nt, hsa
gugcauuuugucacugaaucugaccuugagaauguacauuaauucuuauauuuuacauaaugua

SEQ ID NO: 440673 - RNA, 64 nt, hsa
acagagaaaaaaaaugcaaaauuuauaauagaguuacauuaaccuuguuguuuaccuuucacug

SEQ ID NO: 440674 - RNA, 64 nt, hsa
acauugagugcauuaaauaacaaauuaucuuugauacauuaaacuuuuauucuucaugcaucug

SEQ ID NO: 440675 - RNA, 64 nt, hsa
ggugaagaaaaauuuuacaguauauccuguucuguacauuaaauuaaaaaaacaaaaauguaca

SEQ ID NO: 440676 - RNA, 64 nt, hsa
uuuuucucauuuacuucuuaauuuguucauuaauuacauuaauucuuuccuguaggaugucuca

SEQ ID NO: 440677 - RNA, 64 nt, hsa
uuuuaugucuagaguagguccugaaguuuggcuuuacauuaaguuuagcacuguaucagaauga

SEQ ID NO: 440678 - RNA, 64 nt, hsa
guaguugcauauaaucuaugcacauccuccuguauacauuaagucaucucuagauuauuuauaa

SEQ ID NO: 440679 - RNA, 64 nt, hsa
uacugccuaugggcugugauguauauagaaguuguacauuaaacauacccucauuuuuuucuuu

SEQ ID NO: 440680 - RNA, 64 nt, hsa
aaucuuuauauguuccacauguuaagaauaaauguacauuaaaucuuguuaagcacugugaugg

SEQ ID NO: 440681 - RNA, 64 nt, hsa
gugauaucugugucuguauugacuugucuuguguuacauuaaacaguaggcagaacugaggucu

SEQ ID NO: 440682 - RNA, 64 nt, hsa
ccuguccaugucuaauaaguaaaaacugauagaauacauuaaaaagucacugguuuaucauaga

SEQ ID NO: 440683 - RNA, 64 nt, hsa
ucuucacaucugccuuaaaagugcuauguagagauacauuaacagaguuauaauaaaacagugu

SEQ ID NO: 440684 - RNA, 64 nt, hsa
accuauggagguuucucacacuggugugucauuauacauuaauuguacaauaugcauuuucagu

SEQ ID NO: 440685 - RNA, 64 nt, hsa
guaauucauauaguaagaguauucuaaacagcacuacauuaauaucauuugauagguauaaagu

SEQ ID NO: 440686 - RNA, 64 nt, hsa
cuuugcccagucaauucagugauugauagcaauuuacauuaauugcaguaaagcucuuuggauu

SEQ ID NO: 440687 - RNA, 64 nt, hsa
cucaaccucaucauacgcugauuuaauauuguuuuacauuaaaauaguccuuuucccuguugug

SEQ ID NO: 440688 - RNA, 64 nt, hsa
uccaaggcuccuuagauugggucguuacuaaaaguacauuaaaacacucuuguuuaucgaagua

SEQ ID NO: 440689 - RNA, 64 nt, hsa
aaacacacuguauuuuacaagucaaaauauaauuuacauuaaucacuauguuaaugaguaugua

SEQ ID NO: 440690 - RNA, 64 nt, hsa
aaaauauauuggcuuuuguuuucaaugugaaagauacauuaaauggacacauaucuugcaaaau

SEQ ID NO: 440691 - RNA, 64 nt, hsa
cuaaaguuaugcaaacacacaguuccccauuuacuacauuaaugcccuugacagggaguagcug

SEQ ID NO: 440692 - RNA, 64 nt, hsa
cuacaguuuaauacaaaaugaauugcgguuuuauuacauuaauaaccuuucaccucaggguuuu

SEQ ID NO: 440693 - RNA, 64 nt, hsa
ucaggaaguuaaaauaucucuacacguauauuuuuacauuaaaaauacaguguuagcauaaauc

SEQ ID NO: 440694 - RNA, 64 nt, hsa
uugauucauacuuaaaccugaaagcaggaaugccuacauuaauuccuacauuaaaaacagccau

SEQ ID NO: 440695 - RNA, 64 nt, hsa
uaaaccugaaagcaggaaugccuacauuaauuccuacauuaaaaacagccaucuacccuugauu

SEQ ID NO: 440696 - RNA, 64 nt, hsa
uuuugccuugucuggcauguuuguuuuaaaugaauacauuaaugggguuuuuauccuuuugaau

SEQ ID NO: 440697 - RNA, 64 nt, hsa
uuuuuauaaaguaccaguguuuagcugcuuuuuauacauuaaauuagcaauuugaaaaacucaa

SEQ ID NO: 440698 - RNA, 64 nt, hsa
cuauguaaugguggucauuuuuucccuuuuagaauacauuaaaugguugauuuggggaggaaaa

SEQ ID NO: 440699 - RNA, 64 nt, hsa
gaccacagaaguggaauuugaaaguauaaugcaguacauuaauauucauguucauggaacugaa

SEQ ID NO: 440700 - RNA, 64 nt, hsa
aauugcacaaucucuggcuauuagcacuguucacuacauuaacaugcaagagagagagaagccu

SEQ ID NO: 440701 - RNA, 64 nt, hsa
cauugagacuguccugguuaggcugugugucuccuacauuaacagcuggggaggagggaaaagc

SEQ ID NO: 440702 - RNA, 64 nt, hsa
gcggcgccaccgagcccggcaaaugcgcacgaccuacauuaauuuaugcagagacagcuguuug

SEQ ID NO: 440703 - RNA, 64 nt, hsa
uuuugugucugugaacauaggugugcuucccaaauacauuaacaagcucuuacuucccccuaac

SEQ ID NO: 440704 - RNA, 64 nt, hsa
guuucaguuacaaucaucuuuacccauuaagacuuacauuaacauuccuuuuauauaaagaguu

SEQ ID NO: 440705 - RNA, 64 nt, hsa
gcuuuaaggacaguuuugaucuacagggccagucuacauuaaaaauuagcaacccgaaaggaug

SEQ ID NO: 440706 - RNA, 62 nt, hsa
aguaguaaggaagucaaauuuguuuuuuuaucauugauuauaagugguauauuuguuuuuug

SEQ ID NO: 440707 - RNA, 62 nt, hsa
auugauuauaagugguauauuuguuuuuugucauugauuaaaagugauuuuagcccuaggcc

SEQ ID NO: 440708 - RNA, 62 nt, hsa
uuaccccaauucuaaauagguaccaaaagaguauugauuaugaccuggagccugagcuuugg

SEQ ID NO: 440709 - RNA, 62 nt, hsa
aggaagcuuaaguaaauuucugauuuuccuuuauugauuauguaacccacgugauuugcaua

SEQ ID NO: 440710 - RNA, 62 nt, hsa
guuaaagugucaugccuugaccaaucuaaugaauugauuaauuaacugggccuuuauacuua

SEQ ID NO: 440711 - RNA, 62 nt, hsa
uaggaaguuagucuaauaauucacugcagaaaauugauuaaguggcuguccuuuuaauuaag

SEQ ID NO: 440712 - RNA, 62 nt, hsa
uugaguccaugaaugcuauggucauuaaaauaauugauuauacuuuccuaaagaaaagccau

SEQ ID NO: 440713 - RNA, 62 nt, hsa
aacaaugcaaauucuucuucaagacugaagacauugauuagauauaaaauucaguuuaaaaa

SEQ ID NO: 440714 - RNA, 62 nt, hsa
uuaauaaucuuuugggaggguagaauaaaauaauugauuacuauugcugcauacccggggug

SEQ ID NO: 440715 - RNA, 62 nt, hsa
gaacauuguguggguuuuguuuuguuuaauuuauugauuagucuuuaaaguaggcuuuuuuu

SEQ ID NO: 440716 - RNA, 62 nt, hsa
aguauguuucauuauucuuucuaaauuugauaauugauuaggaaguauuuuauauauaacca

SEQ ID NO: 440717 - RNA, 62 nt, hsa
cccuuaaaaugucuaguaaagcuugcacauggauugauuaaaagcaaauaccugucuuaggg

SEQ ID NO: 440718 - RNA, 62 nt, hsa
ggacaaaaagucuggaaacuuucauaucaauaauugauuauguauuaacugaaacaaaagac

SEQ ID NO: 440719 - RNA, 62 nt, hsa
gaaacaaaagacuagagaaagacacagugggaauugauuauguauuaacugaggaauaaaag

SEQ ID NO: 440720 - RNA, 62 nt, hsa
ugaaugaaaauaugcuuguauuuaguaaaaugauugauuaugugacugugagauuccaagug

SEQ ID NO: 440721 - RNA, 62 nt, hsa
auguucucuacauguuaggauauguuuuccuuauugauuacaacucagcuauaauccugagg

SEQ ID NO: 440722 - RNA, 64 nt, hsa
cgaucuccugaccucacgauuugcccgccucggcuucccagagugcugggauuacaggcgugag

SEQ ID NO: 440723 - RNA, 64 nt, hsa
aacuccuggggucaaaugauccgccugcgucggcuucccagagugcugggauuacaggugucag

SEQ ID NO: 440724 - RNA, 64 nt, hsa
gaaugagcucuuccugaacgugggcaccaaggacuucccagacggagagcuucgggggcacgug

SEQ ID NO: 440725 - RNA, 64 nt, hsa
ugggccccggggcugccguuuugcugggcagugguucccagagagucagagcuggcaccccuca

SEQ ID NO: 440726 - RNA, 64 nt, hsa
uggugaugcccaaagaggagagaggaagcucucuuucccagaugccccagcaaguguaaccuug

SEQ ID NO: 440727 - RNA, 64 nt, hsa
aaacucuuaaugcuguguuugagcuuucaugaguuucccagagagacauagcuggaaaauuccu

SEQ ID NO: 440728 - RNA, 64 nt, hsa
gguugcauggcggcugggcaaaggugcuccccacuucccagauggugcggcggcuggccagagg

SEQ ID NO: 440729 - RNA, 64 nt, hsa
gauggugcggcggcuggccagaggcacucuucacuucccagacagaggggcggccgggcagagg

SEQ ID NO: 440730 - RNA, 64 nt, hsa
gacagaggggcggccgggcagaggugcuccucacuucccagagggugcaggagccagcucugac

SEQ ID NO: 440731 - RNA, 64 nt, hsa
uggacuauucucucuaaagcaagagagacuagcauucccagacaucauucuagggucuuuaagc

SEQ ID NO: 440732 - RNA, 64 nt, hsa
guguuuuucaaaauaaguuuaugucaaauccagcuucccagaaacacuaauaauuaaguacauc

SEQ ID NO: 440733 - RNA, 64 nt, hsa
cuagagauuugccucuaucuuccuuuccucagucuucccagacugcuaucaagcuguguaaaaa

SEQ ID NO: 440734 - RNA, 64 nt, hsa
uuguucuuuauuuuacaggcaguuacugaggcucuucccagaucucaguaaacagccacucagc

SEQ ID NO: 440735 - RNA, 64 nt, hsa
ccuugcacagggaaggcuugaggugagaagccgcuucccagacugucagggccaggccuggguc

SEQ ID NO: 440736 - RNA, 64 nt, hsa
cagaggcccugggccaccacauuucuggcagcguuucccagacaccccucugcuaggccauccc

SEQ ID NO: 440737 - RNA, 64 nt, hsa
aacauuucugcccaucccugaugaccaagaccucuucccagacccacagcugcaggggccaagu

SEQ ID NO: 440738 - RNA, 64 nt, hsa
cagcuuuguccuauacucucuccacccugaaaaguucccagaaagccccuucccucccaagcag

SEQ ID NO: 440739 - RNA, 64 nt, hsa
aaaaaauauaguauuuucuguuguccagaaaaucuucccagauagggaaacugaggcagagagu

SEQ ID NO: 440740 - RNA, 64 nt, hsa
ucuuuuacuuggagcucuccagccuuugucauaguucccagaccuuuuuuccuuguggucaucc

SEQ ID NO: 440741 - RNA, 64 nt, hsa
cuuuuuucaguccagguguucuccuccuauucaguucccagaaucaaagcaaugcauuuuggaa

SEQ ID NO: 440742 - RNA, 64 nt, hsa
agagagacuuucagcccuaaaucuagacucaagguucccagagaugacaaauggagaagaaagg

SEQ ID NO: 440743 - RNA, 64 nt, hsa
augaucauucccagaaacauuucccagaaaauguuucccagaaaacuagacagaaugaucauuc

SEQ ID NO: 440744 - RNA, 64 nt, hsa
gaaaacaaggcagaaugaucauucccagaaacauuucccagaaaauguuucccagaaaacuaga

SEQ ID NO: 440745 - RNA, 64 nt, hsa
gucugaauuuccagaaaacaaggcagaaugaucauucccagaaacauuucccagaaaauguuuc

SEQ ID NO: 440746 - RNA, 64 nt, hsa
acuuuuuuaaauacuacaaauuagugucaggcaguucccagaaagagacaagaaauccuagugg

SEQ ID NO: 440747 - RNA, 64 nt, hsa
ugauuaaaggggcugucucccaaugaaagaggcauucccagaauuugcugcauuuagauuuuga

SEQ ID NO: 440748 - RNA, 64 nt, hsa
uccagauuuuuuaaacuguuuuaaaugugaauucuucccagaaauuucaaugcauugcauauuu

SEQ ID NO: 440749 - RNA, 64 nt, hsa
caaaguuauugcuguuggaacugaacaauaauauuucccagauagcuggccuuagcaugugauc

SEQ ID NO: 440750 - RNA, 64 nt, hsa
caccucccagagacggccacccagcgggucuggcuucccagaaaguuaacugaugauugugggg

SEQ ID NO: 440751 - RNA, 64 nt, hsa
guaaaaugcacuuuuuguguguguugauccugguuucccagaucuguauuucaguguuuacaag

SEQ ID NO: 440752 - RNA, 64 nt, hsa
gcccacccuucccaaagauugggagguuccgccguucccagaggcuccuccugcggugcuccca

SEQ ID NO: 440753 - RNA, 64 nt, hsa
ccuucaugagacagugcucaugaagccagugcguuucccagaacgaacacuaggcggcaccguu

SEQ ID NO: 440754 - RNA, 64 nt, hsa
guggguugcagguugggugcugcuguugugguccuucccagaaacugccaguagagggcagccu

SEQ ID NO: 440755 - RNA, 64 nt, hsa
caaugcacugugaccucuggcuuccccagcagcuuucccagagaggcagaggggccuuccacag

SEQ ID NO: 440756 - RNA, 64 nt, hsa
cgcuucucaccuaacugccuccuggauugucaucuucccagaugugucccauaguguccaggug

SEQ ID NO: 440757 - RNA, 64 nt, hsa
uccucugucacuugcucuuucacucucucucucauucccagagagccacgggggagggaucacc

SEQ ID NO: 440758 - RNA, 64 nt, hsa
uguguaagccagacccuucuuaggcaguugcauauucccagacugaggcagggcagguuugcag

SEQ ID NO: 440759 - RNA, 64 nt, hsa
cugaggacauggccucugagaauagcagcugcauuucccagacucccuugcagcuagcaagguu

SEQ ID NO: 440760 - RNA, 64 nt, hsa
uuaauaaaacuuaucugagucacuugaaacuugguucccagaaaacacauuucugguuuauaau

SEQ ID NO: 440761 - RNA, 64 nt, hsa
gagauuacaggugugagccacugugcccagcaguuucccagaauauauuuaaaugcaaaguuac

SEQ ID NO: 440762 - RNA, 64 nt, hsa
ggagcggucgcuggggccccagcuguacggagucuucccagagggccggcuggaacaguacauc

SEQ ID NO: 440763 - RNA, 64 nt, hsa
guaacaccucauuacaccgaagccugggccuguauucccagagcuuugggaggcugaggcgaga

SEQ ID NO: 440764 - RNA, 64 nt, hsa
uucuauuagcuacugucaacucaccagagacuguuucccagaaaaaccaguacccuugagccuu

SEQ ID NO: 440765 - RNA, 64 nt, hsa
caagaaugugugagcaaagauuuucacaugaggcuucccagaccuaccaacgaccauaccauau

SEQ ID NO: 440766 - RNA, 64 nt, hsa
aaaccagucauuagaaauggucugugcuuuuauuuucccagacuggaguggcuuuucugaaaca

SEQ ID NO: 440767 - RNA, 64 nt, hsa
cuuugaugauucuauguccagcuucagagcugcuuucccagaaauucacgcuuaaacaaccaac

SEQ ID NO: 440768 - RNA, 64 nt, hsa; identical to SEQ ID NO: 104346

SEQ ID NO: 440769 - RNA, 64 nt, hsa; identical to SEQ ID NO: 104347

SEQ ID NO: 440770 - RNA, 64 nt, hsa; identical to SEQ ID NO: 104348

SEQ ID NO: 440771 - RNA, 64 nt, hsa; identical to SEQ ID NO: 104349

SEQ ID NO: 440772 - RNA, 64 nt, hsa; identical to SEQ ID NO: 104350

SEQ ID NO: 440773 - RNA, 64 nt, hsa; identical to SEQ ID NO: 104351

SEQ ID NO: 440774 - RNA, 64 nt, hsa; identical to SEQ ID NO: 104352

SEQ ID NO: 440775 - RNA, 64 nt, hsa; identical to SEQ ID NO: 104353

SEQ ID NO: 440776 - RNA, 64 nt, hsa; identical to SEQ ID NO: 104354

SEQ ID NO: 440777 - RNA, 64 nt, hsa; identical to SEQ ID NO: 104355

SEQ ID NO: 440778 - RNA, 64 nt, hsa; identical to SEQ ID NO: 104356

SEQ ID NO: 440779 - RNA, 64 nt, hsa; identical to SEQ ID NO: 104357

SEQ ID NO: 440780 - RNA, 64 nt, hsa; identical to SEQ ID NO: 104358

SEQ ID NO: 440781 - RNA, 64 nt, hsa; identical to SEQ ID NO: 104359

SEQ ID NO: 440782 - RNA, 64 nt, hsa; identical to SEQ ID NO: 104360

SEQ ID NO: 440783 - RNA, 64 nt, hsa; identical to SEQ ID NO: 104361

SEQ ID NO: 440784 - RNA, 64 nt, hsa; identical to SEQ ID NO: 104362

SEQ ID NO: 440785 - RNA, 64 nt, hsa; identical to SEQ ID NO: 104363

SEQ ID NO: 440786 - RNA, 64 nt, hsa; identical to SEQ ID NO: 104364

SEQ ID NO: 440787 - RNA, 64 nt, hsa; identical to SEQ ID NO: 104365

SEQ ID NO: 440788 - RNA, 64 nt, hsa; identical to SEQ ID NO: 104366

SEQ ID NO: 440789 - RNA, 64 nt, hsa; identical to SEQ ID NO: 104367

SEQ ID NO: 440790 - RNA, 64 nt, hsa; identical to SEQ ID NO: 104368

SEQ ID NO: 440791 - RNA, 64 nt, hsa; identical to SEQ ID NO: 104369

SEQ ID NO: 440792 - RNA, 64 nt, hsa; identical to SEQ ID NO: 104370

SEQ ID NO: 440793 - RNA, 64 nt, hsa; identical to SEQ ID NO: 104371

SEQ ID NO: 440794 - RNA, 64 nt, hsa; identical to SEQ ID NO: 104372

SEQ ID NO: 440795 - RNA, 64 nt, hsa; identical to SEQ ID NO: 104373

SEQ ID NO: 440796 - RNA, 64 nt, hsa; identical to SEQ ID NO: 104374

SEQ ID NO: 440797 - RNA, 64 nt, hsa; identical to SEQ ID NO: 104375

SEQ ID NO: 440798 - RNA, 64 nt, hsa; identical to SEQ ID NO: 104376

SEQ ID NO: 440799 - RNA, 64 nt, hsa; identical to SEQ ID NO: 104377

SEQ ID NO: 440800 - RNA, 64 nt, hsa; identical to SEQ ID NO: 104378

SEQ ID NO: 440801 - RNA, 64 nt, hsa; identical to SEQ ID NO: 104379

SEQ ID NO: 440802 - RNA, 64 nt, hsa; identical to SEQ ID NO: 104380

SEQ ID NO: 440803 - RNA, 64 nt, hsa; identical to SEQ ID NO: 104381

SEQ ID NO: 440804 - RNA, 64 nt, hsa; identical to SEQ ID NO: 104382

SEQ ID NO: 440805 - RNA, 64 nt, hsa; identical to SEQ ID NO: 104383

SEQ ID NO: 440806 - RNA, 64 nt, hsa; identical to SEQ ID NO: 104384

SEQ ID NO: 440807 - RNA, 64 nt, hsa; identical to SEQ ID NO: 104385

SEQ ID NO: 440808 - RNA, 64 nt, hsa; identical to SEQ ID NO: 104386

SEQ ID NO: 440809 - RNA, 64 nt, hsa; identical to SEQ ID NO: 104387

SEQ ID NO: 440810 - RNA, 64 nt, hsa; identical to SEQ ID NO: 104388

SEQ ID NO: 440811 - RNA, 64 nt, hsa; identical to SEQ ID NO: 104389

SEQ ID NO: 440812 - RNA, 64 nt, hsa; identical to SEQ ID NO: 104390

SEQ ID NO: 440813 - RNA, 64 nt, hsa; identical to SEQ ID NO: 104391

SEQ ID NO: 440814 - RNA, 64 nt, hsa; identical to SEQ ID NO: 104392

SEQ ID NO: 440815 - RNA, 64 nt, hsa; identical to SEQ ID NO: 104393

SEQ ID NO: 440816 - RNA, 64 nt, hsa; identical to SEQ ID NO: 104394

SEQ ID NO: 440817 - RNA, 64 nt, hsa; identical to SEQ ID NO: 104395

SEQ ID NO: 440818 - RNA, 64 nt, hsa; identical to SEQ ID NO: 104396

SEQ ID NO: 440819 - RNA, 64 nt, hsa; identical to SEQ ID NO: 104397

SEQ ID NO: 440820 - RNA, 64 nt, hsa; identical to SEQ ID NO: 104398

SEQ ID NO: 440821 - RNA, 64 nt, hsa; identical to SEQ ID NO: 104399

SEQ ID NO: 440822 - RNA, 64 nt, hsa; identical to SEQ ID NO: 104400

SEQ ID NO: 440823 - RNA, 64 nt, hsa; identical to SEQ ID NO: 104401

SEQ ID NO: 440824 - RNA, 64 nt, hsa; identical to SEQ ID NO: 104402

SEQ ID NO: 440825 - RNA, 64 nt, hsa; identical to SEQ ID NO: 104403

SEQ ID NO: 440826 - RNA, 64 nt, hsa; identical to SEQ ID NO: 104404

SEQ ID NO: 440827 - RNA, 64 nt, hsa; identical to SEQ ID NO: 104405

SEQ ID NO: 440828 - RNA, 64 nt, hsa; identical to SEQ ID NO: 104406

SEQ ID NO: 440829 - RNA, 64 nt, hsa; identical to SEQ ID NO: 104407

SEQ ID NO: 440830 - RNA, 64 nt, hsa; identical to SEQ ID NO: 104408

SEQ ID NO: 440831 - RNA, 64 nt, hsa; identical to SEQ ID NO: 104409

SEQ ID NO: 440832 - RNA, 64 nt, hsa; identical to SEQ ID NO: 104410

SEQ ID NO: 440833 - RNA, 64 nt, hsa; identical to SEQ ID NO: 104411

SEQ ID NO: 440834 - RNA, 64 nt, hsa; identical to SEQ ID NO: 104412

SEQ ID NO: 440835 - RNA, 64 nt, hsa; identical to SEQ ID NO: 104413

SEQ ID NO: 440836 - RNA, 64 nt, hsa; identical to SEQ ID NO: 104414

SEQ ID NO: 440837 - RNA, 64 nt, hsa; identical to SEQ ID NO: 104415

SEQ ID NO: 440838 - RNA, 64 nt, hsa; identical to SEQ ID NO: 104416

SEQ ID NO: 440839 - RNA, 64 nt, hsa; identical to SEQ ID NO: 104417

SEQ ID NO: 440840 - RNA, 64 nt, hsa; identical to SEQ ID NO: 104418

SEQ ID NO: 440841 - RNA, 64 nt, hsa; identical to SEQ ID NO: 104419

SEQ ID NO: 440842 - RNA, 64 nt, hsa; identical to SEQ ID NO: 104420

SEQ ID NO: 440843 - RNA, 64 nt, hsa; identical to SEQ ID NO: 104421

SEQ ID NO: 440844 - RNA, 64 nt, hsa; identical to SEQ ID NO: 104422

SEQ ID NO: 440845 - RNA, 64 nt, hsa; identical to SEQ ID NO: 104423

SEQ ID NO: 440846 - RNA, 64 nt, hsa; identical to SEQ ID NO: 104424

SEQ ID NO: 440847 - RNA, 64 nt, hsa; identical to SEQ ID NO: 104425

SEQ ID NO: 440848 - RNA, 64 nt, hsa
uuuccuucucauauugauuauucuaaauacuaugcaauaauauaacuuagaguuccacgguuug

SEQ ID NO: 440849 - RNA, 64 nt, hsa
gcacuuuauugcacuuucaauucuuauaaagcaacaauaauauuaagguccuugacuaugugua

SEQ ID NO: 440850 - RNA, 64 nt, hsa
auuauuuccuacucgccacucuauaaaaucauggcaauaauagaagauuaugaaggauuucuau

SEQ ID NO: 440851 - RNA, 64 nt, hsa
aauccaggauaagaacccauuauacagaaguguucaauaauaucaauuuugcaacucacucagc

SEQ ID NO: 440852 - RNA, 64 nt, hsa
aaagauagguuaaaguauuugacaaaagugaauacaauaauaacacuugugucaaaaugauaua

SEQ ID NO: 440853 - RNA, 64 nt, hsa
agcuuuccuucagaaaacucugaaguuauauuugcaauaauaaugaaaccagcauuuaguacca

SEQ ID NO: 440854 - RNA, 64 nt, hsa
cccuauuuauuuucuuguucacaguaaugcaugucaauaauaaauguuuccccuuacugauaag

SEQ ID NO: 440855 - RNA, 64 nt, hsa
guguagcaaauauagauugagcuauguuaguuugcaauaauauauguuaacuuuaguaauuaaa

SEQ ID NO: 440856 - RNA, 64 nt, hsa
cauaaaauaacuucccauagagaacaggauauagcaauaauagcuccuuagauacucaguggcu

SEQ ID NO: 440857 - RNA, 64 nt, hsa
aaaauauucccagguuaaaauuuuuuuaaaguaccaauaauagagcuaaauacaaugacauuug

SEQ ID NO: 440858 - RNA, 64 nt, hsa
uuagucaaguaauggcuuuugaaaaaguaaaguucaauaauaacuaaggcugugauuuuuuuca

SEQ ID NO: 440859 - RNA, 64 nt, hsa
uacaagggcugugcuaugcuaccauauucuuguucaauaauaauagguuuguuguuuuuuuuac

SEQ ID NO: 440860 - RNA, 64 nt, hsa
acuuuggccaggauuuccuucaaagaaaacgacuuuccuucauuucccuaagccuguggcccaa

SEQ ID NO: 440861 - RNA, 64 nt, hsa
uaauggugcccacuuucucgacuuuggccaggauuuccuucaaagaaaacgacuuuccuucauu

SEQ ID NO: 440862 - RNA, 64 nt, hsa
agugcaucugggaagauuucuaccugaccaacaguuccuucagcuuccauuucgccccucauuu

SEQ ID NO: 440863 - RNA, 64 nt, hsa
ugguggcaccuccuacgucaaacaugaaguguguuuccuucagugcaucugggaagauuucuac

SEQ ID NO: 440864 - RNA, 64 nt, hsa
auucccgaaagaagggaauuucuuuuucugggguuuccuucaaacucuuggcuccaccuagcgg

SEQ ID NO: 440865 - RNA, 64 nt, hsa
ucuucuucucuuagcuaagccccaaaaugaagauuuccuucagaagucuuguuagcagaauuau

SEQ ID NO: 440866 - RNA, 64 nt, hsa
ucacuguugccugcaaggacaccacguggccauuuuccuucaacugagggcucaaaacuccugg

SEQ ID NO: 440867 - RNA, 64 nt, hsa
acagucccaaguucaauauuucugcggcaaaaacuuccuucaaaaaauaaauguacuucauugu

SEQ ID NO: 440868 - RNA, 64 nt, hsa
ccaggaagauccaggauaaucucuccaucuaaaguuccuucaucauccuggaagagccuuuugc

SEQ ID NO: 440869 - RNA, 64 nt, hsa
cuccuuugcagagccaaaacaagauuuauuaaauuuccuucaaacuguuuaucuuuaaaacaaa

SEQ ID NO: 440870 - RNA, 64 nt, hsa
cuuacagcuuauugauuuagguaacuauugugucuuccuucacuaucugaccugaaaagcacuc

SEQ ID NO: 440871 - RNA, 64 nt, hsa
guaauuaauaagaacugauacaagacaaaaacaguuccuucagauucuacggaaugacaguaua

SEQ ID NO: 440872 - RNA, 64 nt, hsa
uuuccaagaguuuagguugugcuggaggagagguuuccuucagauugcugauugcuuauacaaa

SEQ ID NO: 440873 - RNA, 64 nt, hsa
ugccuaaaauuacuaaugcaccacgucagucugcuuccuucaggcaucauucucaauucaucag

SEQ ID NO: 440874 - RNA, 64 nt, hsa
cacccaaauagcugagugcaguccuugcucauauuuccuucaucuuaaccccgcaaacaagaau

SEQ ID NO: 440875 - RNA, 64 nt, hsa
uguuuaccuuguuucaggggugggagaaacuccuuuccuucagcuggcauuugaauguuuccaa

SEQ ID NO: 440876 - RNA, 64 nt, hsa
ccaauuuccagagccacuaucucugcuguccacuuuccuucaggcucugugaauacuucaaccu

SEQ ID NO: 440877 - RNA, 64 nt, hsa
caaugucaccaaauuuucagaguucuaaacuccuuuccuucaagccggaauuuuccuuuuuuca

SEQ ID NO: 440878 - RNA, 64 nt, hsa
gucacgaacccguuacauuucaggacgauccuuuuuccuucagcagcauuucuuacuggcugug

SEQ ID NO: 440879 - RNA, 64 nt, hsa
gggaaauuguuacggaagcuuuucacuggaacauuuccuucauauucccuuuugauauguuuac

SEQ ID NO: 440880 - RNA, 64 nt, hsa
cacucccuaucaccaacauauuuugguuaguauauuccuucauauuaaaaugacuuuuugucag

SEQ ID NO: 440881 - RNA, 64 nt, hsa
cuugcuucuggaucuguucuuuuuuuaaaaaaacuuccuucaccgcgccuauaauccuagcacu

SEQ ID NO: 440882 - RNA, 64 nt, hsa
agcaagacucugucucaaaaacaagcaaacagacuuccuucaacaaauauuuauuaaauaucca

SEQ ID NO: 440883 - RNA, 64 nt, hsa
accaguacagcuugacagcucccggcaccaucccuuccuucaucugacuuauugaacuuuuaca

SEQ ID NO: 440884 - RNA, 64 nt, hsa
aggccuuggacucuucccugaggguugccugagauuccuucaugcuuucuauucaggacuaagu

SEQ ID NO: 440885 - RNA, 64 nt, hsa
ucagaguaaaugguucccuucuuuccuuccuacuuuccuucauucucucuuccuucccuccuuc

SEQ ID NO: 440886 - RNA, 64 nt, hsa
acuguuuguuucuaaaaauccuacugugcccaguuuccuucacuacaugcccugcauuuuuuau

SEQ ID NO: 440887 - RNA, 64 nt, hsa
agaugugauaauucuaagagugucuaugacuuauuuccuucacuuaauucuauccacagucaaa

SEQ ID NO: 440888 - RNA, 64 nt, hsa
uuuaaacauagaaaguuucuucaacucaaaagaguuccuucaaaugaugaguuaaugugcaacc

SEQ ID NO: 440889 - RNA, 64 nt, hsa
acuccaucugauuuuucugagccauuuugauuuguuccuucauuaaaaaaaaucucuuaaaguu

SEQ ID NO: 440890 - RNA, 64 nt, hsa
aaccauuaggacucacugggacagaacuuucaaguuccuucaacugugaaaagugucuuuuugg

SEQ ID NO: 440891 - RNA, 64 nt, hsa
aggagccaaguucuaguaguuucaguucuaggcuuuccuucaagaacagucagaucacaaagug

SEQ ID NO: 440892 - RNA, 64 nt, hsa
cuaugacgcauaagcuagcaugccuaugauuuauuuccuucaugaauuugucacuggaucagca

SEQ ID NO: 440893 - RNA, 64 nt, hsa
auguuuauugugucuaaaagaguugguugcuauuuuccuucauuaugaauagucaguauuuuaa

SEQ ID NO: 440894 - RNA, 64 nt, hsa
guuccaggauauaauugaagucagcaacuaagucuuccuucaaaguugugauuuuugggaaaau

SEQ ID NO: 440895 - RNA, 64 nt, hsa
ucuuuuguagaacuuaacacuacaagcggaagccuuccuucaacaacaccgaugucuccaucgg

SEQ ID NO: 440896 - RNA, 64 nt, hsa
caaaaacgcuaacauugaaaaaguaugucagauuuuccuucauguuucugguuauaagaagcau

SEQ ID NO: 440897 - RNA, 64 nt, hsa
auaaugacucgagcaggaaagcaguagaagaggauuccuucaccacaguuucaccuuuacgcug

SEQ ID NO: 440898 - RNA, 64 nt, hsa
uaccuccccccccaaaaaaaaaauucaguaggaauuccuucauagaauaacauguuauuuauug

SEQ ID NO: 440899 - RNA, 64 nt, hsa
gaaccuuucuccagucuuccuucacuauuuuuuuuuccuucaccauuuaucauuucauagucau

SEQ ID NO: 440900 - RNA, 64 nt, hsa
acuguuaugaagccagaugaaccuuucuccagucuuccuucacuauuuuuuuuuccuucaccau

SEQ ID NO: 440901 - RNA, 64 nt, hsa
auacuacacuuuacaaacaauguuaacacugugauuccuucauuguuuuaagaaguuaaccuag

SEQ ID NO: 440902 - RNA, 64 nt, hsa
caaauauuacagggagucaaaugcuuuuauaaaguuccuucagugguugccucacuugcguuuu

SEQ ID NO: 440903 - RNA, 62 nt, hsa
aauguacuacugaugaguaaacuugcauucacuuccuucaaaccaucuaauuuucuccugaa

SEQ ID NO: 440904 - RNA, 64 nt, hsa
aaugacaggauuaugaguauacaguguaugccuuuuccuucaugcagaauuuugaaauguuuuc

SEQ ID NO: 440905 - RNA, 64 nt, hsa
aaaaguauucaguaugccuuuuccucaaguuacuuuccuucauuuucuuaaaaaagaaaaaaaa

SEQ ID NO: 440906 - RNA, 64 nt, hsa
agucuacucuaggauuuucaacuuuuuaguuuuguuccuucaaaguugaaggaaaaaaaguuug

SEQ ID NO: 440907 - RNA, 64 nt, hsa
cuugcuuugcuuuaucaguucauuccagcucccuguuagugaaggacacugcuguuagugaagg

SEQ ID NO: 440908 - RNA, 64 nt, hsa
ucauuccagcucccuguuagugaaggacacugcuguuagugaaggaacaaagucuaugaguccu

SEQ ID NO: 440909 - RNA, 64 nt, hsa
auuuuuguuuguuguuuucaguuuuuuuguuguuguuagugagucucccuucaaaauacgcagu

SEQ ID NO: 440910 - RNA, 64 nt, hsa
uaacuuaucaggcaucucaaugguuacuaucuauguuagugaaaaucaaauaggacucaaaguu

SEQ ID NO: 440911 - RNA, 64 nt, hsa
auuuuuguuugugguuuucaguuuuuuuguuguuguuagugagucucccuucaaaauacacagu

SEQ ID NO: 440912 - RNA, 64 nt, hsa; identical to SEQ ID NO: 440910

SEQ ID NO: 440913 - RNA, 64 nt, hsa
agcuuucugcauuuaauagguuagaauguaaauuaaaguguagcaauagcaacaaaauauuuau

SEQ ID NO: 440914 - RNA, 64 nt, hsa
ugcaguuguacaauuuuauuuuuuucugcaagaaaaaguguaauguaugaaauaaaccaaaguc

SEQ ID NO: 440915 - RNA, 64 nt, hsa
ugaaagaaaacaaaaccuguccucagaauucuauaaaguguauuaagaauguuccuuaaagguu

SEQ ID NO: 440916 - RNA, 64 nt, hsa
auuaaagcuuaaugugcuuucuuaaagaaugccaaaaguguaauaaggucauaacugcauuuau

SEQ ID NO: 440917 - RNA, 64 nt, hsa
aucauacuuuuaacagcaaccaauaacggauuguaaaguguaaaggcacagguuacucaugaug

SEQ ID NO: 440918 - RNA, 64 nt, hsa
auuccauuguaagcuguguaugugcguguuuggaaaaguguauucauacuuaguuuuuuuuucu

SEQ ID NO: 440919 - RNA, 64 nt, hsa
accucaaauuuaaaggcuaccuuauuguacguuuaaaguguauuauaacagugugguaguuaau

SEQ ID NO: 440920 - RNA, 64 nt, hsa
cagggccuuaaaagccaucauguaaauuaccaguaaaguguaacauaugcaaacauaacaaaau

SEQ ID NO: 440921 - RNA, 64 nt, hsa
uccucaaagaaaguguauugguuuuuuaaaaaagaaaguguauuuggaaauaaagucagaugga

SEQ ID NO: 440922 - RNA, 64 nt, hsa
auaauuggauuuccuaauacugucauccucaaagaaaguguauugguuuuuuaaaaaagaaagu

SEQ ID NO: 440923 - RNA, 64 nt, hsa
gguguacuugacacccaauaaacugcacguaucaaaaguguacaauguguuggcguauguauac

SEQ ID NO: 440924 - RNA, 64 nt, hsa
gacugugaagauaaaguucaaaaguauuuuuaccaaaguguagcuaauauuucaagcugaaaau

SEQ ID NO: 440925 - RNA, 64 nt, hsa
uauucucuuuuuuucuaagagucccucccuuccaaaaguguauuuuuuucaaagauuuucacuu

SEQ ID NO: 440926 - RNA, 64 nt, hsa
aagcaacaauaauuuugaagcauuugaaaaagccaaaguguacgguagaaauuucuacaaaaug

SEQ ID NO: 440927 - RNA, 64 nt, hsa
auuaauguuuuugcauacuuugcaucuuuauucaaaaguguaaacuuucuuugucaaucuaugg

SEQ ID NO: 440928 - RNA, 64 nt, hsa
gcuuuauuguuuauugcugguuuaugaccuuaauaaaguguaauuauguauuaccagcagggug

SEQ ID NO: 440929 - RNA, 64 nt, hsa
aauauuccauugaaauauugugcuguaacaugggaaaguguaaauguuuuucaugguuucuauc

SEQ ID NO: 440930 - RNA, 64 nt, hsa
uggguaauaaaggcuagucagaacccuauaccauaaaguguaguuaccauacagauuaauaugu

SEQ ID NO: 440931 - RNA, 64 nt, hsa
ggaaaggaaagaugaugcucaguuuuaaacguuaaaaguguacaaguugcuuuguuacaauaaa

SEQ ID NO: 440932 - RNA, 64 nt, hsa
aacuugauaaauggaacuauuccaucaauaggcaaaaguguaacaaccuaucuagauggauagu

SEQ ID NO: 440933 - RNA, 64 nt, hsa
aguggcaggaccaggcccaauauuaaggaguggaaaaguguaggcugcccuuggugaagcugug

SEQ ID NO: 440934 - RNA, 64 nt, hsa
auuguccacacacacacaaccagauaaucuucugaaaguguaacucagaugaugccuccaaccc

SEQ ID NO: 440935 - RNA, 64 nt, hsa
ugccuuuuccacaaaucucuugccuuuucagggcaaaguguauuugaucagaaguggccauuug

SEQ ID NO: 440936 - RNA, 64 nt, hsa
ugccagccagaagccugauugguuaguagggaauaaaguguagaccauaugaaaugaacugcaa

SEQ ID NO: 440937 - RNA, 64 nt, hsa
ugaaaauuaguaggaagaugugguuacuauuuggaaaguguaauguaacaaaacucucuuuugu

SEQ ID NO: 440938 - RNA, 64 nt, hsa
uggucccuacacugaaaacgcacauaguuugucaaaaguguacaaaagggaaagagucuuauuu

SEQ ID NO: 440939 - RNA, 64 nt, hsa
guagccucuuuuuguucugaaauugaguuuauucaaaguguaaaagcacauacugcauuuucug

SEQ ID NO: 440940 - RNA, 64 nt, hsa
gguaaacgcaaaacuuuuguacuuuauuacgaguaaaguguaaugaguacuguggaaaccaaau

SEQ ID NO: 440941 - RNA, 64 nt, hsa
ccccuaagcuuugugcaauuuuuucugguuccccaaaguguauuuuucucuaagucgagggcua

SEQ ID NO: 440942 - RNA, 64 nt, hsa
gaagauuguuuuuauuugccugauaaaguaauugaaaguguauuuuugguaugaagcugguuuu

SEQ ID NO: 440943 - RNA, 64 nt, hsa; identical to SEQ ID NO: 83734

SEQ ID NO: 440944 - RNA, 64 nt, hsa; identical to SEQ ID NO: 83735

SEQ ID NO: 440945 - RNA, 64 nt, hsa; identical to SEQ ID NO: 83736

SEQ ID NO: 440946 - RNA, 64 nt, hsa; identical to SEQ ID NO: 83737

SEQ ID NO: 440947 - RNA, 64 nt, hsa; identical to SEQ ID NO: 83738

SEQ ID NO: 440948 - RNA, 64 nt, hsa; identical to SEQ ID NO: 83739

SEQ ID NO: 440949 - RNA, 64 nt, hsa; identical to SEQ ID NO: 83740

SEQ ID NO: 440950 - RNA, 64 nt, hsa; identical to SEQ ID NO: 83741

SEQ ID NO: 440951 - RNA, 64 nt, hsa; identical to SEQ ID NO: 83742

SEQ ID NO: 440952 - RNA, 64 nt, hsa; identical to SEQ ID NO: 83743

SEQ ID NO: 440953 - RNA, 64 nt, hsa; identical to SEQ ID NO: 83744

SEQ ID NO: 440954 - RNA, 64 nt, hsa; identical to SEQ ID NO: 83745

SEQ ID NO: 440955 - RNA, 64 nt, hsa; identical to SEQ ID NO: 83746

SEQ ID NO: 440956 - RNA, 64 nt, hsa; identical to SEQ ID NO: 83747

SEQ ID NO: 440957 - RNA, 64 nt, hsa; identical to SEQ ID NO: 83741

SEQ ID NO: 440958 - RNA, 64 nt, hsa; identical to SEQ ID NO: 83749

SEQ ID NO: 440959 - RNA, 64 nt, hsa; identical to SEQ ID NO: 83750

SEQ ID NO: 440960 - RNA, 64 nt, hsa; identical to SEQ ID NO: 83751

SEQ ID NO: 440961 - RNA, 64 nt, hsa; identical to SEQ ID NO: 83752

SEQ ID NO: 440962 - RNA, 64 nt, hsa; identical to SEQ ID NO: 83753

SEQ ID NO: 440963 - RNA, 64 nt, hsa; identical to SEQ ID NO: 83754

SEQ ID NO: 440964 - RNA, 64 nt, hsa; identical to SEQ ID NO: 83755

SEQ ID NO: 440965 - RNA, 64 nt, hsa; identical to SEQ ID NO: 83756

SEQ ID NO: 440966 - RNA, 64 nt, hsa; identical to SEQ ID NO: 83757

SEQ ID NO: 440967 - RNA, 64 nt, hsa; identical to SEQ ID NO: 83742

SEQ ID NO: 440968 - RNA, 64 nt, hsa; identical to SEQ ID NO: 83743

SEQ ID NO: 440969 - RNA, 64 nt, hsa; identical to SEQ ID NO: 83760

SEQ ID NO: 440970 - RNA, 64 nt, hsa; identical to SEQ ID NO: 83761

SEQ ID NO: 440971 - RNA, 64 nt, hsa; identical to SEQ ID NO: 83762

SEQ ID NO: 440972 - RNA, 64 nt, hsa; identical to SEQ ID NO: 83763

SEQ ID NO: 440973 - RNA, 64 nt, hsa; identical to SEQ ID NO: 83764

SEQ ID NO: 440974 - RNA, 64 nt, hsa; identical to SEQ ID NO: 83765

SEQ ID NO: 440975 - RNA, 64 nt, hsa; identical to SEQ ID NO: 83766

SEQ ID NO: 440976 - RNA, 64 nt, hsa; identical to SEQ ID NO: 83767

SEQ ID NO: 440977 - RNA, 64 nt, hsa; identical to SEQ ID NO: 83768

SEQ ID NO: 440978 - RNA, 64 nt, hsa; identical to SEQ ID NO: 83769

SEQ ID NO: 440979 - RNA, 64 nt, hsa; identical to SEQ ID NO: 83770

SEQ ID NO: 440980 - RNA, 64 nt, hsa; identical to SEQ ID NO: 83771

SEQ ID NO: 440981 - RNA, 64 nt, hsa; identical to SEQ ID NO: 83772

SEQ ID NO: 440982 - RNA, 64 nt, hsa; identical to SEQ ID NO: 83773

SEQ ID NO: 440983 - RNA, 64 nt, hsa; identical to SEQ ID NO: 83774

SEQ ID NO: 440984 - RNA, 64 nt, hsa; identical to SEQ ID NO: 83775

SEQ ID NO: 440985 - RNA, 64 nt, hsa; identical to SEQ ID NO: 83776

SEQ ID NO: 440986 - RNA, 64 nt, hsa; identical to SEQ ID NO: 83777

SEQ ID NO: 440987 - RNA, 64 nt, hsa; identical to SEQ ID NO: 83778

SEQ ID NO: 440988 - RNA, 64 nt, hsa; identical to SEQ ID NO: 83779

SEQ ID NO: 440989 - RNA, 64 nt, hsa; identical to SEQ ID NO: 83780

SEQ ID NO: 440990 - RNA, 64 nt, hsa; identical to SEQ ID NO: 83781

SEQ ID NO: 440991 - RNA, 64 nt, hsa
uaccguuuuauguaagguaauuaugaaagacauuggugauaaggugacauuuggucacaguucu

SEQ ID NO: 440992 - RNA, 64 nt, hsa
uuaaugguggcuucaacuagguaguagcaauaagggugauaagaaguggucagacucugguugu

SEQ ID NO: 440993 - RNA, 64 nt, hsa; identical to SEQ ID NO: 279953

SEQ ID NO: 440994 - RNA, 64 nt, hsa; identical to SEQ ID NO: 279954

SEQ ID NO: 440995 - RNA, 64 nt, hsa; identical to SEQ ID NO: 279955

SEQ ID NO: 440996 - RNA, 64 nt, hsa; identical to SEQ ID NO: 279956

SEQ ID NO: 440997 - RNA, 64 nt, hsa; identical to SEQ ID NO: 279957

SEQ ID NO: 440998 - RNA, 64 nt, hsa; identical to SEQ ID NO: 279958

SEQ ID NO: 440999 - RNA, 64 nt, hsa; identical to SEQ ID NO: 279959

SEQ ID NO: 441000 - RNA, 64 nt, hsa; identical to SEQ ID NO: 279960

SEQ ID NO: 441001 - RNA, 64 nt, hsa; identical to SEQ ID NO: 279961

SEQ ID NO: 441002 - RNA, 64 nt, hsa; identical to SEQ ID NO: 279962

SEQ ID NO: 441003 - RNA, 64 nt, hsa; identical to SEQ ID NO: 279963

SEQ ID NO: 441004 - RNA, 64 nt, hsa; identical to SEQ ID NO: 279964

SEQ ID NO: 441005 - RNA, 64 nt, hsa; identical to SEQ ID NO: 279965

SEQ ID NO: 441006 - RNA, 64 nt, hsa; identical to SEQ ID NO: 279966

SEQ ID NO: 441007 - RNA, 64 nt, hsa; identical to SEQ ID NO: 279967

SEQ ID NO: 441008 - RNA, 64 nt, hsa; identical to SEQ ID NO: 279968

SEQ ID NO: 441009 - RNA, 64 nt, hsa
acugucaucacuucuauagauuuccuaacuccaccaugccuauuucugguuauauaauugcucu

SEQ ID NO: 441010 - RNA, 64 nt, hsa
uggaggcuggaaacuccaagauuaaggcagauuucaugccuauugagggccugcuuucugauua

SEQ ID NO: 441011 - RNA, 64 nt, hsa
ucccuuuggguuccauguuuuccuuguucccucccaugccuagcuggauugcagaguuaaguuu

SEQ ID NO: 441012 - RNA, 64 nt, hsa
cucuacaaaaaauaauuagccuggccugguggugcaugccuaguccuagcugaucuggaggcug

SEQ ID NO: 441013 - RNA, 64 nt, hsa
acuaaaaauacaaaauuggcagggugugguggcacaugccuauaaucccagcuacuugggaggc

SEQ ID NO: 441014 - RNA, 64 nt, hsa
uaaaaaguaaaauaauaggccaggcaugguggcucaugccuauaagcacccugggaggccgagg

SEQ ID NO: 441015 - RNA, 64 nt, hsa
aguaaaggagaauaacuggccgggcacgguggcucaugccuauaaaauuccagcacuuugggag

SEQ ID NO: 441016 - RNA, 64 nt, hsa
uaauaaaccuuuuuauuacauugugauuuagcaguuaugcuaaaauauguacuuaugcuuuagu

SEQ ID NO: 441017 - RNA, 64 nt, hsa
uagaggacuauuacauauuuuuuguauauuuguuuuaugcuacugaacugaaaggaucaacaac

SEQ ID NO: 441018 - RNA, 64 nt, hsa
cuuucaaucuucucagcuuauaaccgucuuucccuuaugcuaaggauagcccuuacacucaucc

SEQ ID NO: 441019 - RNA, 64 nt, hsa
uaagugcuuguucuucauguuuccuucuuguuauuuaugcuauucucuuuguggcuccauucuu

SEQ ID NO: 441020 - RNA, 64 nt, hsa
augcuggauaaauauuaguccaacaauagcuaaguuaugcuaauaucacauuauuauguauuca

SEQ ID NO: 441021 - RNA, 64 nt, hsa
guauguauaugaugauuuuuuucucaauuuugaauuaugcuacucaccaauuuauauuuuuaaa

SEQ ID NO: 441022 - RNA, 64 nt, hsa
acacuuugacuccuaaaugugauacuggugggcacauauuaauuuguaucgcuuuugcuucucu

SEQ ID NO: 441023 - RNA, 64 nt, hsa
auccgcacuuacauuagaguuaugggaauauacacauauuaauguggcucccuuuuucuugugg

SEQ ID NO: 441024 - RNA, 64 nt, hsa
aguuuaucuuauacuccugguuugauuugauuagcauauuaacgugaaaguaggauagcuacua

SEQ ID NO: 441025 - RNA, 64 nt, hsa
uccuucuaaagagacuaauuugagaguacaggugcauauuaauuuucuugguucuuucagcuga

SEQ ID NO: 441026 - RNA, 64 nt, hsa
ugggaaaauaauuaguuacagugggaaauucacucauauuaauggaggauuguacauauaaaua

SEQ ID NO: 441027 - RNA, 64 nt, hsa
augaauauaaaauauuuauuaggggauucuauuucauauuaauuccaggugauuuguuuuuuca

SEQ ID NO: 441028 - RNA, 64 nt, hsa
gaauuuucuaaacgcuuacaacuuaucugccacucauauuaauuuacuugaauuugucauaaag

SEQ ID NO: 441029 - RNA, 64 nt, hsa
uaaauauuuuauauguuuucaaagauuauuuuuucauauuaauagguuguuuaucuuuuugccu

SEQ ID NO: 441030 - RNA, 64 nt, hsa
aaauuuauuauaacacuaaacacuccuuuuuugacauauuaaagccuuuauuccaucucucaag

SEQ ID NO: 441031 - RNA, 64 nt, hsa
uguugucauuuucauuuuugcauuuuuuuguuugcauauuaaaaaaagagaaaagagaaagcaa

SEQ ID NO: 441032 - RNA, 64 nt, hsa
cuaaauuauucaugaauuaaaaugaauggauucucauauuaacacagguauuugacauaauaug

SEQ ID NO: 441033 - RNA, 64 nt, hsa
uaugugacauaacaaaauacagcuggcaggcauucauauuaaugacaacauacaugaauaucau

SEQ ID NO: 441034 - RNA, 64 nt, hsa
ucaccuaccuauuugauuauauguugauugauaacauauuaaauagagaacaaauaagagaggu

SEQ ID NO: 441035 - RNA, 64 nt, hsa
aggcagauucuuagagugaaaaagccucaguuuccauauuaaaaauguuuuaaauauuuugauu

SEQ ID NO: 441036 - RNA, 64 nt, hsa
uuuaccguagcccucaucuaacuuacacguggugcauauuaaaauaagcagagaaaaaaaaaug

SEQ ID NO: 441037 - RNA, 64 nt, hsa
ugcaucguguaaaucaucucuguagacauguguucauauuaaugaacacauuuuuucucaacau

SEQ ID NO: 441038 - RNA, 64 nt, hsa
acaccagaaagaguguugguguguagguagauuccauauuaaugaggaacacugaacuaguugg

SEQ ID NO: 441039 - RNA, 64 nt, hsa
ugcagauugggggaaaacaacaaaugucuugaagcauauuaauggaauuaguuucuaauguggc

SEQ ID NO: 441040 - RNA, 64 nt, hsa
auuucgggguagugugagcuuuuaauguuuaagucauauuaaacucuuaagucaaauuaagcag

SEQ ID NO: 441041 - RNA, 64 nt, hsa
uuaacuauagaaauguugccucucagcugagacacauauuaagcugguucuacugucuguuuuc

SEQ ID NO: 441042 - RNA, 64 nt, hsa
ggaauuacuuuacugauuaagugaccaauauguucauauuaagcaguacagaguguaggcaaga

SEQ ID NO: 441043 - RNA, 64 nt, hsa; identical to SEQ ID NO: 107827

SEQ ID NO: 441044 - RNA, 64 nt, hsa; identical to SEQ ID NO: 107828

SEQ ID NO: 441045 - RNA, 64 nt, hsa; identical to SEQ ID NO: 107829

SEQ ID NO: 441046 - RNA, 64 nt, hsa; identical to SEQ ID NO: 107830

SEQ ID NO: 441047 - RNA, 64 nt, hsa; identical to SEQ ID NO: 107831

SEQ ID NO: 441048 - RNA, 64 nt, hsa; identical to SEQ ID NO: 107832

SEQ ID NO: 441049 - RNA, 64 nt, hsa; identical to SEQ ID NO: 107833

SEQ ID NO: 441050 - RNA, 64 nt, hsa; identical to SEQ ID NO: 107834

SEQ ID NO: 441051 - RNA, 64 nt, hsa; identical to SEQ ID NO: 107835

SEQ ID NO: 441052 - RNA, 64 nt, hsa; identical to SEQ ID NO: 107836

SEQ ID NO: 441053 - RNA, 64 nt, hsa; identical to SEQ ID NO: 107837

SEQ ID NO: 441054 - RNA, 64 nt, hsa; identical to SEQ ID NO: 107838

SEQ ID NO: 441055 - RNA, 64 nt, hsa; identical to SEQ ID NO: 107839

SEQ ID NO: 441056 - RNA, 64 nt, hsa; identical to SEQ ID NO: 107840

SEQ ID NO: 441057 - RNA, 64 nt, hsa; identical to SEQ ID NO: 305621

SEQ ID NO: 441058 - RNA, 64 nt, hsa; identical to SEQ ID NO: 305622

SEQ ID NO: 441059 - RNA, 64 nt, hsa; identical to SEQ ID NO: 305623

SEQ ID NO: 441060 - RNA, 64 nt, hsa; identical to SEQ ID NO: 305624

SEQ ID NO: 441061 - RNA, 64 nt, hsa; identical to SEQ ID NO: 305625

SEQ ID NO: 441062 - RNA, 64 nt, hsa; identical to SEQ ID NO: 305626

SEQ ID NO: 441063 - RNA, 64 nt, hsa; identical to SEQ ID NO: 305627

SEQ ID NO: 441064 - RNA, 64 nt, hsa; identical to SEQ ID NO: 305628

SEQ ID NO: 441065 - RNA, 64 nt, hsa; identical to SEQ ID NO: 305629

SEQ ID NO: 441066 - RNA, 64 nt, hsa; identical to SEQ ID NO: 305630

SEQ ID NO: 441067 - RNA, 64 nt, hsa; identical to SEQ ID NO: 305631

SEQ ID NO: 441068 - RNA, 64 nt, hsa; identical to SEQ ID NO: 305632

SEQ ID NO: 441069 - RNA, 64 nt, hsa; identical to SEQ ID NO: 305633

SEQ ID NO: 441070 - RNA, 64 nt, hsa; identical to SEQ ID NO: 305634

SEQ ID NO: 441071 - RNA, 64 nt, hsa; identical to SEQ ID NO: 305635

SEQ ID NO: 441072 - RNA, 64 nt, hsa; identical to SEQ ID NO: 305636

SEQ ID NO: 441073 - RNA, 64 nt, hsa; identical to SEQ ID NO: 305637

SEQ ID NO: 441074 - RNA, 64 nt, hsa
uuaaauuguccugauucuauuuuguaaauggagaaacaaucauaucuuucuaagcgguaaugga

SEQ ID NO: 441075 - RNA, 64 nt, hsa
uagccuaacccuguaauuuuccuacauccaagaaaacaaucacaaaguagugguuuaaauacuu

SEQ ID NO: 441076 - RNA, 64 nt, hsa
acggugcagaauguccguauggaugaucaugacaaacaaucacugcgcaaaauguggaggaaaa

SEQ ID NO: 441077 - RNA, 64 nt, hsa
ucacggugcgaaauguccgcauggaugaucacgaaacaaucacggugcagaauguccguaugga

SEQ ID NO: 441078 - RNA, 64 nt, hsa
gggcauuccaaaauguccgcauggacgaucacgaaacaaucacggugcgaaauguccgcaugga

SEQ ID NO: 441079 - RNA, 64 nt, hsa; identical to SEQ ID NO: 106415

SEQ ID NO: 441080 - RNA, 64 nt, hsa; identical to SEQ ID NO: 106416

SEQ ID NO: 441081 - RNA, 64 nt, hsa; identical to SEQ ID NO: 106417

SEQ ID NO: 441082 - RNA, 64 nt, hsa; identical to SEQ ID NO: 106418

SEQ ID NO: 441083 - RNA, 64 nt, hsa; identical to SEQ ID NO: 106419

SEQ ID NO: 441084 - RNA, 64 nt, hsa; identical to SEQ ID NO: 106420

SEQ ID NO: 441085 - RNA, 64 nt, hsa; identical to SEQ ID NO: 106421

SEQ ID NO: 441086 - RNA, 64 nt, hsa; identical to SEQ ID NO: 106422

SEQ ID NO: 441087 - RNA, 64 nt, hsa; identical to SEQ ID NO: 106423

SEQ ID NO: 441088 - RNA, 64 nt, hsa; identical to SEQ ID NO: 106424

SEQ ID NO: 441089 - RNA, 64 nt, hsa; identical to SEQ ID NO: 106425

SEQ ID NO: 441090 - RNA, 64 nt, hsa; identical to SEQ ID NO: 106426

SEQ ID NO: 441091 - RNA, 64 nt, hsa; identical to SEQ ID NO: 106426

SEQ ID NO: 441092 - RNA, 64 nt, hsa; identical to SEQ ID NO: 106425

SEQ ID NO: 441093 - RNA, 64 nt, hsa; identical to SEQ ID NO: 106429

SEQ ID NO: 441094 - RNA, 64 nt, hsa; identical to SEQ ID NO: 106430

SEQ ID NO: 441095 - RNA, 64 nt, hsa; identical to SEQ ID NO: 106431

SEQ ID NO: 441096 - RNA, 64 nt, hsa; identical to SEQ ID NO: 106432

SEQ ID NO: 441097 - RNA, 64 nt, hsa; identical to SEQ ID NO: 106433

SEQ ID NO: 441098 - RNA, 64 nt, hsa; identical to SEQ ID NO: 106434

SEQ ID NO: 441099 - RNA, 64 nt, hsa; identical to SEQ ID NO: 106435

SEQ ID NO: 441100 - RNA, 64 nt, hsa; identical to SEQ ID NO: 106436

SEQ ID NO: 441101 - RNA, 64 nt, hsa; identical to SEQ ID NO: 106437

SEQ ID NO: 441102 - RNA, 64 nt, hsa; identical to SEQ ID NO: 106438

SEQ ID NO: 441103 - RNA, 64 nt, hsa; identical to SEQ ID NO: 106439

SEQ ID NO: 441104 - RNA, 64 nt, hsa; identical to SEQ ID NO: 106440

SEQ ID NO: 441105 - RNA, 64 nt, hsa; identical to SEQ ID NO: 106441

SEQ ID NO: 441106 - RNA, 64 nt, hsa; identical to SEQ ID NO: 106442

SEQ ID NO: 441107 - RNA, 64 nt, hsa; identical to SEQ ID NO: 106443

SEQ ID NO: 441108 - RNA, 64 nt, hsa; identical to SEQ ID NO: 106444

SEQ ID NO: 441109 - RNA, 64 nt, hsa; identical to SEQ ID NO: 106445

SEQ ID NO: 441110 - RNA, 64 nt, hsa; identical to SEQ ID NO: 106446

SEQ ID NO: 441111 - RNA, 64 nt, hsa; identical to SEQ ID NO: 106447

SEQ ID NO: 441112 - RNA, 64 nt, hsa; identical to SEQ ID NO: 106448

SEQ ID NO: 441113 - RNA, 64 nt, hsa; identical to SEQ ID NO: 110249

SEQ ID NO: 441114 - RNA, 64 nt, hsa; identical to SEQ ID NO: 110250

SEQ ID NO: 441115 - RNA, 64 nt, hsa; identical to SEQ ID NO: 110251

SEQ ID NO: 441116 - RNA, 64 nt, hsa; identical to SEQ ID NO: 110252

SEQ ID NO: 441117 - RNA, 64 nt, hsa; identical to SEQ ID NO: 110253

SEQ ID NO: 441118 - RNA, 64 nt, hsa; identical to SEQ ID NO: 110254

SEQ ID NO: 441119 - RNA, 64 nt, hsa; identical to SEQ ID NO: 110255

SEQ ID NO: 441120 - RNA, 64 nt, hsa; identical to SEQ ID NO: 110256

SEQ ID NO: 441121 - RNA, 64 nt, hsa; identical to SEQ ID NO: 110257

SEQ ID NO: 441122 - RNA, 64 nt, hsa; identical to SEQ ID NO: 110258

SEQ ID NO: 441123 - RNA, 64 nt, hsa; identical to SEQ ID NO: 110259

SEQ ID NO: 441124 - RNA, 64 nt, hsa; identical to SEQ ID NO: 110260

SEQ ID NO: 441125 - RNA, 64 nt, hsa; identical to SEQ ID NO: 110261

SEQ ID NO: 441126 - RNA, 64 nt, hsa; identical to SEQ ID NO: 110262

SEQ ID NO: 441127 - RNA, 64 nt, hsa; identical to SEQ ID NO: 110263

SEQ ID NO: 441128 - RNA, 64 nt, hsa; identical to SEQ ID NO: 110264

SEQ ID NO: 441129 - RNA, 64 nt, hsa; identical to SEQ ID NO: 110265

SEQ ID NO: 441130 - RNA, 64 nt, hsa; identical to SEQ ID NO: 110266

SEQ ID NO: 441131 - RNA, 64 nt, hsa; identical to SEQ ID NO: 110267

SEQ ID NO: 441132 - RNA, 64 nt, hsa; identical to SEQ ID NO: 110268

SEQ ID NO: 441133 - RNA, 64 nt, hsa; identical to SEQ ID NO: 110269

SEQ ID NO: 441134 - RNA, 64 nt, hsa; identical to SEQ ID NO: 110270

SEQ ID NO: 441135 - RNA, 64 nt, hsa; identical to SEQ ID NO: 110271

SEQ ID NO: 441136 - RNA, 64 nt, hsa; identical to SEQ ID NO: 110272

SEQ ID NO: 441137 - RNA, 64 nt, hsa; identical to SEQ ID NO: 110273

SEQ ID NO: 441138 - RNA, 64 nt, hsa; identical to SEQ ID NO: 110274

SEQ ID NO: 441139 - RNA, 64 nt, hsa; identical to SEQ ID NO: 110275

SEQ ID NO: 441140 - RNA, 64 nt, hsa; identical to SEQ ID NO: 110276

SEQ ID NO: 441141 - RNA, 64 nt, hsa; identical to SEQ ID NO: 110277

SEQ ID NO: 441142 - RNA, 64 nt, hsa; identical to SEQ ID NO: 110278

SEQ ID NO: 441143 - RNA, 64 nt, hsa; identical to SEQ ID NO: 110279

SEQ ID NO: 441144 - RNA, 64 nt, hsa; identical to SEQ ID NO: 110280

SEQ ID NO: 441145 - RNA, 64 nt, hsa; identical to SEQ ID NO: 110281

SEQ ID NO: 441146 - RNA, 64 nt, hsa; identical to SEQ ID NO: 110282

SEQ ID NO: 441147 - RNA, 64 nt, hsa; identical to SEQ ID NO: 110283

SEQ ID NO: 441148 - RNA, 64 nt, hsa; identical to SEQ ID NO: 110284

SEQ ID NO: 441149 - RNA, 64 nt, hsa; identical to SEQ ID NO: 110285

SEQ ID NO: 441150 - RNA, 64 nt, hsa; identical to SEQ ID NO: 110286

SEQ ID NO: 441151 - RNA, 64 nt, hsa; identical to SEQ ID NO: 110287

SEQ ID NO: 441152 - RNA, 64 nt, hsa; identical to SEQ ID NO: 110288

SEQ ID NO: 441153 - RNA, 64 nt, hsa; identical to SEQ ID NO: 110289

SEQ ID NO: 441154 - RNA, 64 nt, hsa; identical to SEQ ID NO: 110290

SEQ ID NO: 441155 - RNA, 64 nt, hsa; identical to SEQ ID NO: 110291

SEQ ID NO: 441156 - RNA, 64 nt, hsa; identical to SEQ ID NO: 110292

SEQ ID NO: 441157 - RNA, 64 nt, hsa; identical to SEQ ID NO: 110293

SEQ ID NO: 441158 - RNA, 64 nt, hsa; identical to SEQ ID NO: 110294

SEQ ID NO: 441159 - RNA, 64 nt, hsa; identical to SEQ ID NO: 110295

SEQ ID NO: 441160 - RNA, 64 nt, hsa; identical to SEQ ID NO: 110296

SEQ ID NO: 441161 - RNA, 64 nt, hsa; identical to SEQ ID NO: 110297

SEQ ID NO: 441162 - RNA, 64 nt, hsa; identical to SEQ ID NO: 110298

SEQ ID NO: 441163 - RNA, 64 nt, hsa; identical to SEQ ID NO: 110299

SEQ ID NO: 441164 - RNA, 64 nt, hsa; identical to SEQ ID NO: 110300

SEQ ID NO: 441165 - RNA, 64 nt, hsa; identical to SEQ ID NO: 110301

SEQ ID NO: 441166 - RNA, 64 nt, hsa; identical to SEQ ID NO: 110302

SEQ ID NO: 441167 - RNA, 64 nt, hsa; identical to SEQ ID NO: 110303

SEQ ID NO: 441168 - RNA, 64 nt, hsa; identical to SEQ ID NO: 110304

SEQ ID NO: 441169 - RNA, 64 nt, hsa; identical to SEQ ID NO: 110305

SEQ ID NO: 441170 - RNA, 64 nt, hsa; identical to SEQ ID NO: 110306

SEQ ID NO: 441171 - RNA, 64 nt, hsa; identical to SEQ ID NO: 110307

SEQ ID NO: 441172 - RNA, 64 nt, hsa; identical to SEQ ID NO: 110308

SEQ ID NO: 441173 - RNA, 64 nt, hsa; identical to SEQ ID NO: 110309

SEQ ID NO: 441174 - RNA, 64 nt, hsa; identical to SEQ ID NO: 110310

SEQ ID NO: 441175 - RNA, 64 nt, hsa; identical to SEQ ID NO: 110311

SEQ ID NO: 441176 - RNA, 64 nt, hsa; identical to SEQ ID NO: 110312

SEQ ID NO: 441177 - RNA, 64 nt, hsa; identical to SEQ ID NO: 110313

SEQ ID NO: 441178 - RNA, 64 nt, hsa; identical to SEQ ID NO: 110314

SEQ ID NO: 441179 - RNA, 64 nt, hsa; identical to SEQ ID NO: 110315

SEQ ID NO: 441180 - RNA, 64 nt, hsa; identical to SEQ ID NO: 110316

SEQ ID NO: 441181 - RNA, 64 nt, hsa; identical to SEQ ID NO: 44425

SEQ ID NO: 441182 - RNA, 64 nt, hsa; identical to SEQ ID NO: 44426

SEQ ID NO: 441183 - RNA, 64 nt, hsa; identical to SEQ ID NO: 44427

SEQ ID NO: 441184 - RNA, 64 nt, hsa; identical to SEQ ID NO: 44428

SEQ ID NO: 441185 - RNA, 64 nt, hsa; identical to SEQ ID NO: 44429

SEQ ID NO: 441186 - RNA, 64 nt, hsa; identical to SEQ ID NO: 44430

SEQ ID NO: 441187 - RNA, 64 nt, hsa; identical to SEQ ID NO: 44431

SEQ ID NO: 441188 - RNA, 64 nt, hsa; identical to SEQ ID NO: 44432

SEQ ID NO: 441189 - RNA, 64 nt, hsa; identical to SEQ ID NO: 44433

SEQ ID NO: 441190 - RNA, 64 nt, hsa; identical to SEQ ID NO: 44434

SEQ ID NO: 441191 - RNA, 64 nt, hsa; identical to SEQ ID NO: 44435

SEQ ID NO: 441192 - RNA, 64 nt, hsa; identical to SEQ ID NO: 44436

SEQ ID NO: 441193 - RNA, 64 nt, hsa; identical to SEQ ID NO: 244748

SEQ ID NO: 441194 - RNA, 64 nt, hsa; identical to SEQ ID NO: 244749

SEQ ID NO: 441195 - RNA, 64 nt, hsa; identical to SEQ ID NO: 244750

SEQ ID NO: 441196 - RNA, 64 nt, hsa; identical to SEQ ID NO: 244751

SEQ ID NO: 441197 - RNA, 64 nt, hsa; identical to SEQ ID NO: 244752

SEQ ID NO: 441198 - RNA, 64 nt, hsa; identical to SEQ ID NO: 244753

SEQ ID NO: 441199 - RNA, 64 nt, hsa; identical to SEQ ID NO: 244754

SEQ ID NO: 441200 - RNA, 64 nt, hsa; identical to SEQ ID NO: 244755

SEQ ID NO: 441201 - RNA, 64 nt, hsa; identical to SEQ ID NO: 244756

SEQ ID NO: 441202 - RNA, 64 nt, hsa; identical to SEQ ID NO: 244757

SEQ ID NO: 441203 - RNA, 64 nt, hsa; identical to SEQ ID NO: 244758

SEQ ID NO: 441204 - RNA, 64 nt, hsa; identical to SEQ ID NO: 244759

SEQ ID NO: 441205 - RNA, 64 nt, hsa; identical to SEQ ID NO: 244760

SEQ ID NO: 441206 - RNA, 64 nt, hsa; identical to SEQ ID NO: 244761

SEQ ID NO: 441207 - RNA, 64 nt, hsa; identical to SEQ ID NO: 244762

SEQ ID NO: 441208 - RNA, 64 nt, hsa; identical to SEQ ID NO: 244763

SEQ ID NO: 441209 - RNA, 64 nt, hsa; identical to SEQ ID NO: 244764

SEQ ID NO: 441210 - RNA, 64 nt, hsa
acacauauacauuauuucuguauauagaugucuguguauacauauguaugugugaguguaugua

SEQ ID NO: 441211 - RNA, 64 nt, hsa
gaugucuguguauacauauguaugugugaguguauguauacacacacacacacacacacacaca

SEQ ID NO: 441212 - RNA, 64 nt, hsa
uacuuauaacuagacgucuaugugagaaaauauauguauacauauauaugauaugcagaaguca

SEQ ID NO: 441213 - RNA, 64 nt, hsa
gagggguguuuguguguauauauauaugccuuuguguauacacuuaucaaagcuauuuucuuau

SEQ ID NO: 441214 - RNA, 64 nt, hsa
cauuucuguaaauaccauugacacauccgccuuuuguauacauccuggguaaugagagguggcu

SEQ ID NO: 441215 - RNA, 64 nt, hsa
uguaauaauaccucaauguuugaggagcauguuuuguauacaaauauauuguuaaucucuguua

SEQ ID NO: 441216 - RNA, 64 nt, hsa
ucuuuguuacuuaaaugcauuauauaaacuccuauguauacauaagguauuaaugauauaguua

SEQ ID NO: 441217 - RNA, 64 nt, hsa
uauaauuaauaaaaccugugcuugaucugacauuuguauacauaaaaguuuacaugaauuuuac

SEQ ID NO: 441218 - RNA, 64 nt, hsa
uuuugcuuuauacugaguaaugcacucuugcaaguguauacaaaaacuaaauagacuucugccc

SEQ ID NO: 441219 - RNA, 64 nt, hsa
gaauacauguuguaaauauauaucuguguauguguguauacacacacacagacacacacacaca

SEQ ID NO: 441220 - RNA, 64 nt, hsa
uguguguacauaauuauauauagagauagacuuguguauacaccuuccacaaacacauccucac

SEQ ID NO: 441221 - RNA, 64 nt, hsa
aaacuguuaaaauuuaaaaaaaauuuaaaucauguguauacaauuuuuugccagauaaaaaugu

SEQ ID NO: 441222 - RNA, 64 nt, hsa
uacaaaugcuuauuuuuauuguugcuauuuucaguguauacauaaacuaaaaauuaggguugau

SEQ ID NO: 441223 - RNA, 64 nt, hsa
uuuagaaugugaaaaaaaugcauguuuacuuaccuguauacaccauaugcaugcacuagaauua

SEQ ID NO: 441224 - RNA, 64 nt, hsa
cagauuuuuuaaauuauauauauggaaauauauauguauacauuuuaaguucuguauacauaau

SEQ ID NO: 441225 - RNA, 64 nt, hsa
uauauggaaauauauauguauacauuuuaaguucuguauacauaauuaccaaacacuaugugac

SEQ ID NO: 441226 - RNA, 64 nt, hsa
acagugaauguauuagaguauaaaauguuugccauguauacaccuguaugugcacauacacaca

SEQ ID NO: 441227 - RNA, 64 nt, hsa
acacacaaaaauguguguauacauuuggguuguguguauacaucuugccauauacaauauacaa

SEQ ID NO: 441228 - RNA, 64 nt, hsa
uaccaaauagcauacauguacacacaaaaauguguguauacauuuggguuguguguauacaucu

SEQ ID NO: 441229 - RNA, 64 nt, hsa
cacaauaccacaugagaaaauaucugagacaaaauguauacaaauauauuccuuauggcauaau

SEQ ID NO: 441230 - RNA, 64 nt, hsa
cauaguaguugcauauaaucuaugcacauccuccuguauacauuaagucaucucuagauuauuu

SEQ ID NO: 441231 - RNA, 64 nt, hsa
gauucccaacacagaauuuucaugacccuuuuauuguauacaaauaaauaccauaacaguuacu

SEQ ID NO: 441232 - RNA, 64 nt, hsa
aauuguuuauagagacuacacuaauuauuuuaacuguauacaucuguuuaauuugaacacacua

SEQ ID NO: 441233 - RNA, 64 nt, hsa
uacacauauauauguauauauacacauauauguauguauacacauauacacauguauauauaca

SEQ ID NO: 441234 - RNA, 64 nt, hsa
uacacauauacacauguauauauacauguguguauguauacauguauauauauauacauacaca

SEQ ID NO: 441235 - RNA, 64 nt, hsa
uguauacauguauauauauauacauacacauauauguauacauauauacacauauauguauaca

SEQ ID NO: 441236 - RNA, 64 nt, hsa
cauacacauauauguauacauauauacacauauauguauacauauauacacauauguauacaua

SEQ ID NO: 441237 - RNA, 64 nt, hsa
uauauacacauauauguauacauauauacacauauguauacauauauauauauucuacaguaaa

SEQ ID NO: 441238 - RNA, 64 nt, hsa
cccuuucugcuuaguuguaucucugugaaaaacuuguauacacaagcguccaugucucacacaa

SEQ ID NO: 441239 - RNA, 64 nt, hsa
aaaaaguuucuuccucaugaugcuaauaguuuuuuguauacaugggaggauagcacauuugaca

SEQ ID NO: 441240 - RNA, 64 nt, hsa
ggcgaauuuguccaaacacauaguguguguguuuuguauacacuguaugaccccaccccaaauc

SEQ ID NO: 441241 - RNA, 64 nt, hsa
acuuuaaauguuauuuuggaagacuuacgaugcauguauacaaacgaauagcagauaaugauga

SEQ ID NO: 441242 - RNA, 64 nt, hsa
guucauucuuggugugucucuaacagauacaguauguauacauuuguauaauuguuguuguuga

SEQ ID NO: 441243 - RNA, 64 nt, hsa
uuauagaagguuuagccuucauauuuuaauugcuuguauacacaacagcuguuuugcuuuuaga

SEQ ID NO: 441244 - RNA, 64 nt, hsa
gcagcuuguuaaucguguaaagucaagagaagaauguauacacauauguguguugaauaauuac

SEQ ID NO: 441245 - RNA, 64 nt, hsa
uguguguugaauaauuacuauuggcauagguauguguauacacacggugcaccaaucuacagua

SEQ ID NO: 441246 - RNA, 64 nt, hsa
gugcacagaacucaagaccucaaaauugaguuacuguauacaaagcuguucauagaaaaacaaa

SEQ ID NO: 441247 - RNA, 64 nt, hsa
uguauacauuccacguguguauauauuccacauauguauacauuccauguauguaugcauauau

SEQ ID NO: 441248 - RNA, 64 nt, hsa
uguauacauuccacguguguauauaguccccauauguauacauuccacguguguauauauucca

SEQ ID NO: 441249 - RNA, 64 nt, hsa
cguguauguauuccacauguauauauuccacauauguauacauuccacguguguauauaguccc

SEQ ID NO: 441250 - RNA, 64 nt, hsa
auauugcuguccaccccauaaauauguacaauucuguauacauuuuuaaaaucauaaaaauaag

SEQ ID NO: 441251 - RNA, 64 nt, hsa
auaugucaauuacccugauuugaucauagcacguuguauacauguacugcaauauugcugucca

SEQ ID NO: 441252 - RNA, 64 nt, hsa
cauuucuguaaacccaaauuauaugguuucuucugcgaaagaguaaggugugugcuuuuuuuuu

SEQ ID NO: 441253 - RNA, 64 nt, hsa
aaacauuuuugcuuucuccaguuuucuguuaauggcgaaagaauggaagcgaauaaaguuuuac

SEQ ID NO: 441254 - RNA, 64 nt, hsa
cacagagugcucaggaugaugcuauugcuggagagcgaaagauggaacagccuuguccaggcag

SEQ ID NO: 441255 - RNA, 64 nt, hsa
agauauaguuuuguuccacaauuuguacuuaaaagcgaaagaacauugaaaacauagacuuacu

SEQ ID NO: 441256 - RNA, 64 nt, hsa
guagagaagcauacuggagaagcauauccagagggcgaaagauaucucuccauugugcaucugc

SEQ ID NO: 441257 - RNA, 64 nt, hsa
aaguuuguuacugguuaaaaaccucaaaugaaaugcgaaagaauuugaauuuuuccugcauaug

SEQ ID NO: 441258 - RNA, 64 nt, hsa
uuucaguuacaauuuaaucuuuacaauuaaaagggcgaaagauguagaauuuuaguuuuuguug

SEQ ID NO: 441259 - RNA, 64 nt, hsa
gauaacagcuugcacccuccucagaauguuuucagcgaaagagugggguggcuguucucugcuc

SEQ ID NO: 441260 - RNA, 64 nt, hsa
uuggugugucuuuauguucauuuggagagucagggcgaaagacaggugauguagcacuucuguu

SEQ ID NO: 441261 - RNA, 64 nt, hsa
uaugcagcuuggagacaggauucugacagagcaagcgaaagagcaaagucaugucagaaggaga

SEQ ID NO: 441262 - RNA, 64 nt, hsa
ucuuuuagauuugagcauuugaagauucaaaguugcgaaagagcacaaaccauauuagguaaaa

SEQ ID NO: 441263 - RNA, 64 nt, hsa
gagagacauuguuaauuuugggggaauuggcauugcgaaagacuugaaaacuaaugaguaaagu

SEQ ID NO: 441264 - RNA, 64 nt, hsa
agcagagugagcuguugacucgaucgaaaccccggcgaaagaaaucaaacccccaacuucuucg

SEQ ID NO: 441265 - RNA, 64 nt, hsa
aaaccuacuccaaaaaugaacaaaaaaaaaaaaagcgaaagacugcaguugugcuaaaaacaaa

SEQ ID NO: 441266 - RNA, 64 nt, hsa
ccuaucagcguguaagggggccugccccucaucugcgaaagaagagcccagacaccgggaaccc

SEQ ID NO: 441267 - RNA, 64 nt, hsa
ucccgagagcucacccugcccaccucgccgcaaagcgaaagaaacuggagcagccggcggcagg

SEQ ID NO: 441268 - RNA, 64 nt, hsa
ugaguggagaucacgccacugcgcuccagccugggcgaaagagugagacuccaucucaaaaaaa

SEQ ID NO: 441269 - RNA, 64 nt, hsa
ccugccuuuucccaccuggaaacauauacuguaugcgaaagaguugauauaugcaaaguaauuc

SEQ ID NO: 441270 - RNA, 64 nt, hsa
auuuacaacaaaagcaacgaggagauuacaugaagcgaaagagggggcucacagaauugaaggg

SEQ ID NO: 441271 - RNA, 64 nt, hsa
gcgggggcucugguuguaaaacacacuuccugcugcgaaagacccacaugcuacaagacgggca

SEQ ID NO: 441272 - RNA, 64 nt, hsa
uauacuguguucuuauauaugagaaagcacaaaugcgaaagaggucaugucuucucaaaaucua

SEQ ID NO: 441273 - RNA, 64 nt, hsa
cuuucuuccccccaccagcuguaaaagauccuaugcgaaagacacuggcucuuuuuuuuaaucc

SEQ ID NO: 441274 - RNA, 64 nt, hsa
cauugaagcugaaugugccaacuggcaguuagaagcgaaagauggcauugggagaaauuuuaga

SEQ ID NO: 441275 - RNA, 64 nt, hsa
ccaaauuccauaaacagaacugacguuaaaauaugcgaaagauucagaaccuagguuuagggua

SEQ ID NO: 441276 - RNA, 64 nt, hsa
ucugccuccacagucacccauuucauugcucgcugcgaaagagacgugagacugacauaugcca

SEQ ID NO: 441277 - RNA, 64 nt, hsa
uccacaaacccuucccuauagaaguucaauggcugcgaaagaauuuguaguaaaccaggccucc

SEQ ID NO: 441278 - RNA, 64 nt, hsa
caagcugauaugugccuguuucuggacaauggaggcgaaagaguggaauuucauucaaaggcau

SEQ ID NO: 441279 - RNA, 64 nt, hsa
cucucucagcagguuagcgcaauggcugcgauuugcgaaagaaucuuggaaaugggccccacgu

SEQ ID NO: 441280 - RNA, 64 nt, hsa
gcaaguuguauaacucaggcgucuuugcauuucugcgaaagaucaaggucugcaagggaauucu

SEQ ID NO: 441281 - RNA, 64 nt, hsa
gggagugcccaugcccucugugaagugcccaaaugcgaaagaauaacaccuuuucuugcauucu

SEQ ID NO: 441282 - RNA, 64 nt, hsa
gcuagagugcauuuuuacugguggaucagugugugcgaaagagaugacccuuuauaaagagauu

SEQ ID NO: 441283 - RNA, 64 nt, hsa
uuggccucacucucuguaagcauauaaaccacaggcgaaagaggaugcugcauugcgaggaccc

SEQ ID NO: 441284 - RNA, 64 nt, hsa
uccccccgccucgacggcaccacuggccggccccgcgaaagacugcgcgugcguagagcacgcc

SEQ ID NO: 441285 - RNA, 64 nt, hsa
ucagcugagauggugccacugcacuccagccugggcgaaagagcgacucugucuccaaaaaaaa

SEQ ID NO: 441286 - RNA, 64 nt, hsa
cucuggcgucccggcaggcgagaggcgaggcugagcgaaagaaggaaggacagacggaccuguc

SEQ ID NO: 441287 - RNA, 64 nt, hsa
gaagugaccauaaaguggucacuuccaccgugaagcgaaagagccaguagugaauccccucauu

SEQ ID NO: 441288 - RNA, 64 nt, hsa
uuuuuaaugcuaaucuugugaaaauaauugacaggcgaaagaaaacucuauuuagaugcauauu

SEQ ID NO: 441289 - RNA, 64 nt, hsa
cucugcccagcuuuucauugcugugacagugauggcgaaagaggguaauaaccagacacaaacu

SEQ ID NO: 441290 - RNA, 63 nt, hsa
gcuauucauaaccuauauucuagaguagacaaucuggacuauguaauaaauagucugcugauu

SEQ ID NO: 441291 - RNA, 63 nt, hsa
aguaugaauaaagguguggcagaauauaauaaucuggacuauuuucuauaggauaauugcugg

SEQ ID NO: 441292 - RNA, 63 nt, hsa
caaugccuauugcugggcaggcuaaguguggagcuggacuacggcggcaguauggaauuccag

SEQ ID NO: 441293 - RNA, 63 nt, hsa
cuaccugaugaaccugagcgggugccgaagcuacuggacuaugcugauggguauguccuaccc

SEQ ID NO: 441294 - RNA, 63 nt, hsa
cuuacuuuuauuacagucaauuuugaggauauucuggacuaaauauuuaagugcagucauuuc

SEQ ID NO: 441295 - RNA, 63 nt, hsa
cauuucuuuuugguuugcaaaaagagcacagcccuggacuacaaguuuggagauuuaaauucu

SEQ ID NO: 441296 - RNA, 63 nt, hsa
cauuucuuuuugguuugcaaaaagagcacagcccuggacuaugaguuuggagaucuaaauucu

SEQ ID NO: 441297 - RNA, 63 nt, hsa
cuaacuuuuauuacagucaauuuugaggauauucuggacuaaauauuuaagugcagucauuuc

SEQ ID NO: 441298 - RNA, 64 nt, hsa
agcucauaaucuauuuuuuucauguaguauauaagucaagaauguuuuauugucauuaugugaa

SEQ ID NO: 441299 - RNA, 64 nt, hsa
uugcauuucagguauuaaaauugcuuucuuaacugucaagaaucacaaaauaacaaaucauauu

SEQ ID NO: 441300 - RNA, 64 nt, hsa
uaaaauuaauugaaggcagcaaaaggcacaguaggucaagaagcaggucucgaucccggaccag

SEQ ID NO: 441301 - RNA, 64 nt, hsa
gaucccguucccguagucgcaaaucuuacagccggucaagaagcaggagcaggagccggagccg

SEQ ID NO: 441302 - RNA, 64 nt, hsa
aaccagccucacagccacacgggggaagcagagagucaagaaugcaaagaggccgcuucccuaa

SEQ ID NO: 441303 - RNA, 64 nt, hsa
gacccacggggcuccuggcuugcagcuggugauggucaagaacugacuacaaaacaggaaugga

SEQ ID NO: 441304 - RNA, 64 nt, hsa
uccagaagaaagauggaaauucugaaaacugaaugucaagaaaaggagucaagaacaauucaca

SEQ ID NO: 441305 - RNA, 64 nt, hsa
uggaaauucugaaaacugaaugucaagaaaaggagucaagaacaauucacaguaugagaagaaa

SEQ ID NO: 441306 - RNA, 64 nt, hsa; identical to SEQ ID NO: 336839

SEQ ID NO: 441307 - RNA, 64 nt, hsa; identical to SEQ ID NO: 336840

SEQ ID NO: 441308 - RNA, 64 nt, hsa; identical to SEQ ID NO: 336841

SEQ ID NO: 441309 - RNA, 64 nt, hsa; identical to SEQ ID NO: 336842

SEQ ID NO: 441310 - RNA, 64 nt, hsa; identical to SEQ ID NO: 336843

SEQ ID NO: 441311 - RNA, 64 nt, hsa; identical to SEQ ID NO: 336844

SEQ ID NO: 441312 - RNA, 64 nt, hsa; identical to SEQ ID NO: 336845

SEQ ID NO: 441313 - RNA, 64 nt, hsa; identical to SEQ ID NO: 336846

SEQ ID NO: 441314 - RNA, 64 nt, hsa; identical to SEQ ID NO: 336847

SEQ ID NO: 441315 - RNA, 64 nt, hsa; identical to SEQ ID NO: 336848

SEQ ID NO: 441316 - RNA, 64 nt, hsa; identical to SEQ ID NO: 336849

SEQ ID NO: 441317 - RNA, 64 nt, hsa; identical to SEQ ID NO: 336850

SEQ ID NO: 441318 - RNA, 64 nt, hsa; identical to SEQ ID NO: 336851

SEQ ID NO: 441319 - RNA, 64 nt, hsa; identical to SEQ ID NO: 336852

SEQ ID NO: 441320 - RNA, 64 nt, hsa; identical to SEQ ID NO: 336853

SEQ ID NO: 441321 - RNA, 64 nt, hsa; identical to SEQ ID NO: 336854

SEQ ID NO: 441322 - RNA, 64 nt, hsa; identical to SEQ ID NO: 336855

SEQ ID NO: 441323 - RNA, 64 nt, hsa; identical to SEQ ID NO: 336856

SEQ ID NO: 441324 - RNA, 64 nt, hsa; identical to SEQ ID NO: 336857

SEQ ID NO: 441325 - RNA, 64 nt, hsa; identical to SEQ ID NO: 336858

SEQ ID NO: 441326 - RNA, 64 nt, hsa; identical to SEQ ID NO: 336859

SEQ ID NO: 441327 - RNA, 64 nt, hsa; identical to SEQ ID NO: 336860

SEQ ID NO: 441328 - RNA, 64 nt, hsa; identical to SEQ ID NO: 336861

SEQ ID NO: 441329 - RNA, 64 nt, hsa; identical to SEQ ID NO: 336862

SEQ ID NO: 441330 - RNA, 64 nt, hsa; identical to SEQ ID NO: 336863

SEQ ID NO: 441331 - RNA, 64 nt, hsa; identical to SEQ ID NO: 336864

SEQ ID NO: 441332 - RNA, 64 nt, hsa; identical to SEQ ID NO: 336865

SEQ ID NO: 441333 - RNA, 64 nt, hsa; identical to SEQ ID NO: 336866

SEQ ID NO: 441334 - RNA, 64 nt, hsa; identical to SEQ ID NO: 336867

SEQ ID NO: 441335 - RNA, 64 nt, hsa; identical to SEQ ID NO: 336868

SEQ ID NO: 441336 - RNA, 64 nt, hsa; identical to SEQ ID NO: 336869

SEQ ID NO: 441337 - RNA, 64 nt, hsa; identical to SEQ ID NO: 336870

SEQ ID NO: 441338 - RNA, 64 nt, hsa; identical to SEQ ID NO: 362171

SEQ ID NO: 441339 - RNA, 64 nt, hsa; identical to SEQ ID NO: 362172

SEQ ID NO: 441340 - RNA, 64 nt, hsa; identical to SEQ ID NO: 362173

SEQ ID NO: 441341 - RNA, 64 nt, hsa; identical to SEQ ID NO: 362174

SEQ ID NO: 441342 - RNA, 64 nt, hsa; identical to SEQ ID NO: 362175

SEQ ID NO: 441343 - RNA, 64 nt, hsa; identical to SEQ ID NO: 362176

SEQ ID NO: 441344 - RNA, 64 nt, hsa; identical to SEQ ID NO: 362177

SEQ ID NO: 441345 - RNA, 64 nt, hsa; identical to SEQ ID NO: 362178

SEQ ID NO: 441346 - RNA, 64 nt, hsa; identical to SEQ ID NO: 362179

SEQ ID NO: 441347 - RNA, 64 nt, hsa; identical to SEQ ID NO: 362180

SEQ ID NO: 441348 - RNA, 64 nt, hsa; identical to SEQ ID NO: 362181

SEQ ID NO: 441349 - RNA, 64 nt, hsa; identical to SEQ ID NO: 362182

SEQ ID NO: 441350 - RNA, 64 nt, hsa; identical to SEQ ID NO: 362183

SEQ ID NO: 441351 - RNA, 64 nt, hsa; identical to SEQ ID NO: 362184

SEQ ID NO: 441352 - RNA, 64 nt, hsa; identical to SEQ ID NO: 362185

SEQ ID NO: 441353 - RNA, 64 nt, hsa; identical to SEQ ID NO: 362186

SEQ ID NO: 441354 - RNA, 64 nt, hsa; identical to SEQ ID NO: 362187

SEQ ID NO: 441355 - RNA, 64 nt, hsa; identical to SEQ ID NO: 362188

SEQ ID NO: 441356 - RNA, 64 nt, hsa; identical to SEQ ID NO: 362189

SEQ ID NO: 441357 - RNA, 64 nt, hsa; identical to SEQ ID NO: 362190

SEQ ID NO: 441358 - RNA, 64 nt, hsa; identical to SEQ ID NO: 362191

SEQ ID NO: 441359 - RNA, 64 nt, hsa; identical to SEQ ID NO: 362192

SEQ ID NO: 441360 - RNA, 64 nt, hsa; identical to SEQ ID NO: 362193

SEQ ID NO: 441361 - RNA, 64 nt, hsa; identical to SEQ ID NO: 362194

SEQ ID NO: 441362 - RNA, 64 nt, hsa; identical to SEQ ID NO: 362195

SEQ ID NO: 441363 - RNA, 64 nt, hsa; identical to SEQ ID NO: 362196

SEQ ID NO: 441364 - RNA, 64 nt, hsa; identical to SEQ ID NO: 362197

SEQ ID NO: 441365 - RNA, 64 nt, hsa; identical to SEQ ID NO: 362198

SEQ ID NO: 441366 - RNA, 64 nt, hsa; identical to SEQ ID NO: 362199

SEQ ID NO: 441367 - RNA, 64 nt, hsa; identical to SEQ ID NO: 362200

SEQ ID NO: 441368 - RNA, 64 nt, hsa; identical to SEQ ID NO: 362201

SEQ ID NO: 441369 - RNA, 64 nt, hsa; identical to SEQ ID NO: 362202

SEQ ID NO: 441370 - RNA, 64 nt, hsa; identical to SEQ ID NO: 362203

SEQ ID NO: 441371 - RNA, 64 nt, hsa; identical to SEQ ID NO: 362204

SEQ ID NO: 441372 - RNA, 64 nt, hsa; identical to SEQ ID NO: 362205

SEQ ID NO: 441373 - RNA, 64 nt, hsa; identical to SEQ ID NO: 362206

SEQ ID NO: 441374 - RNA, 64 nt, hsa; identical to SEQ ID NO: 362207

SEQ ID NO: 441375 - RNA, 64 nt, hsa; identical to SEQ ID NO: 362208

SEQ ID NO: 441376 - RNA, 64 nt, hsa; identical to SEQ ID NO: 189518

SEQ ID NO: 441377 - RNA, 64 nt, hsa; identical to SEQ ID NO: 189519

SEQ ID NO: 441378 - RNA, 64 nt, hsa; identical to SEQ ID NO: 189520

SEQ ID NO: 441379 - RNA, 64 nt, hsa; identical to SEQ ID NO: 189521

SEQ ID NO: 441380 - RNA, 64 nt, hsa; identical to SEQ ID NO: 189522

SEQ ID NO: 441381 - RNA, 64 nt, hsa; identical to SEQ ID NO: 189523

SEQ ID NO: 441382 - RNA, 64 nt, hsa; identical to SEQ ID NO: 189524

SEQ ID NO: 441383 - RNA, 64 nt, hsa; identical to SEQ ID NO: 189525

SEQ ID NO: 441384 - RNA, 64 nt, hsa; identical to SEQ ID NO: 189526

SEQ ID NO: 441385 - RNA, 64 nt, hsa; identical to SEQ ID NO: 189527

SEQ ID NO: 441386 - RNA, 64 nt, hsa; identical to SEQ ID NO: 189528

SEQ ID NO: 441387 - RNA, 64 nt, hsa; identical to SEQ ID NO: 189529

SEQ ID NO: 441388 - RNA, 64 nt, hsa; identical to SEQ ID NO: 189530

SEQ ID NO: 441389 - RNA, 64 nt, hsa
gccauuuuaacauuucuguauuugaagugcuuaucgaaucuaaaagugacuacuguuaauauuu

SEQ ID NO: 441390 - RNA, 64 nt, hsa
aagagcaaguuugcucagucaagugaucagaucccgaaucuagauucccaguucuaaggccuua

SEQ ID NO: 441391 - RNA, 64 nt, hsa
ccagagaccuuggacuccggacuauccauggcuccgaaucuaagugcugcccacucccaugcuc

SEQ ID NO: 441392 - RNA, 64 nt, hsa
ucugacugcauugaaaugcaaugucuaaaauggacgaaucuauauagagugaauauagauuagc

SEQ ID NO: 441393 - RNA, 64 nt, hsa
uuuucucauuuccagguuauuauaaugaaacucacgaaucuacggacauuuugcuuucagggug

SEQ ID NO: 441394 - RNA, 64 nt, hsa
cucaauaagauacuuauaugagaacuacaaucaccgaaucuacuguauucaauauuagcagauc

SEQ ID NO: 441395 - RNA, 64 nt, hsa
uuucggaagaacaacaacaaaaaagagguaaagacgaaucuauaaaguaccgagacuuccuggg

SEQ ID NO: 441396 - RNA, 64 nt, hsa
ugaggaaaccaaggcauggagcaguucccagagucgaaucuagaucucaucugucauccggguc

SEQ ID NO: 441397 - RNA, 57 nt, hsa
uuccugugcuuuuucucagaaacugggcgaaucuacagaacaaagaacggcauguga

SEQ ID NO: 441398 - RNA, 64 nt, hsa
caaugaguuucuucaaaggagggaaaacuuucuacgaaucuaagauccauggagcuagaauugu

SEQ ID NO: 441399 - RNA, 64 nt, hsa
gggguacucuguauauguguuucuucuuuguauacgaaucuauuuauauaaauuguuuuuuuaa

SEQ ID NO: 441400 - RNA, 64 nt, hsa
acaugccaaacaauguuagguacuuuccauacaacgaaucuauuauucccaucuuacagauaaa

SEQ ID NO: 441401 - RNA, 64 nt, hsa
uacuugggucuucaggagcugguccaaggagcuucgaaucuaagucaucuagaaugacccugaa

SEQ ID NO: 441402 - RNA, 64 nt, hsa
uggacacaucucagcaggucggucuagagaguugcgaaucuaaaccugggacaggcuggggcca

SEQ ID NO: 441403 - RNA, 64 nt, hsa
cuucaaaauucucuguauucaaauuugauuguggcgaaucuacuucaaaaaggaaaaauaaucc

SEQ ID NO: 441404 - RNA, 64 nt, hsa
uuauuuuaaauuaguagaaaagaggagcuauuuccgaaucuauagaauaaaguaccaccuaaaa

SEQ ID NO: 441405 - RNA, 64 nt, hsa
aauguuuggguguugaagucacaggguuugguuucgaaucuaggcuccacuuguuagagccucg

SEQ ID NO: 441406 - RNA, 64 nt, hsa
cguuugcagcacaacaccauugcccggaggcuuccgaaucuagcaaagcagcauauuaaaugac

SEQ ID NO: 441407 - RNA, 64 nt, hsa
gaggggcuccuggagucacugcagagggagugugcgaaucuacccugaccaaugggcucaagaa

SEQ ID NO: 441408 - RNA, 55 nt, hsa
gucucuccugggacaacuagggcugcgaaucuagaggagggggcaggcugagggu

SEQ ID NO: 441409 - RNA, 64 nt, hsa
uucacucaggacacaaaccagacagguuuaauagcgaaucuaauuuugaauucugaccauggau

SEQ ID NO: 441410 - RNA, 64 nt, hsa
uguaacagacuccuggguguuuuucuuucucauucgaaucuaccacaguuggucauauccaacc

SEQ ID NO: 441411 - RNA, 64 nt, hsa
caaaaaguuauagagacuucuaugaguauuguaccgaaucuaaaucacaauugaguauauaauc

SEQ ID NO: 441412 - RNA, 64 nt, hsa
gaaacugacccucagcagcugccugauuguuacgcgaaucuagcuuuaacggaagcaaauucau

SEQ ID NO: 441413 - RNA, 64 nt, hsa
aaguccaauguggcaaggaaaaacaggucuucaucgaaucuacuaauuccacaccuuuuauuga

SEQ ID NO: 441414 - RNA, 64 nt, hsa; identical to SEQ ID NO: 223834

SEQ ID NO: 441415 - RNA, 64 nt, hsa; identical to SEQ ID NO: 223835

SEQ ID NO: 441416 - RNA, 64 nt, hsa; identical to SEQ ID NO: 223836

SEQ ID NO: 441417 - RNA, 64 nt, hsa; identical to SEQ ID NO: 223837

SEQ ID NO: 441418 - RNA, 64 nt, hsa; identical to SEQ ID NO: 235935

SEQ ID NO: 441419 - RNA, 64 nt, hsa; identical to SEQ ID NO: 235936

SEQ ID NO: 441420 - RNA, 64 nt, hsa; identical to SEQ ID NO: 235937

SEQ ID NO: 441421 - RNA, 64 nt, hsa; identical to SEQ ID NO: 235938

SEQ ID NO: 441422 - RNA, 64 nt, hsa; identical to SEQ ID NO: 235939

SEQ ID NO: 441423 - RNA, 64 nt, hsa; identical to SEQ ID NO: 235940

SEQ ID NO: 441424 - RNA, 64 nt, hsa; identical to SEQ ID NO: 235941

SEQ ID NO: 441425 - RNA, 64 nt, hsa; identical to SEQ ID NO: 235942

SEQ ID NO: 441426 - RNA, 64 nt, hsa; identical to SEQ ID NO: 235943

SEQ ID NO: 441427 - RNA, 64 nt, hsa; identical to SEQ ID NO: 235944

SEQ ID NO: 441428 - RNA, 64 nt, hsa; identical to SEQ ID NO: 235945

SEQ ID NO: 441429 - RNA, 64 nt, hsa; identical to SEQ ID NO: 235946

SEQ ID NO: 441430 - RNA, 64 nt, hsa; identical to SEQ ID NO: 235947

SEQ ID NO: 441431 - RNA, 64 nt, hsa; identical to SEQ ID NO: 235948

SEQ ID NO: 441432 - RNA, 64 nt, hsa; identical to SEQ ID NO: 235949

SEQ ID NO: 441433 - RNA, 64 nt, hsa; identical to SEQ ID NO: 235950

SEQ ID NO: 441434 - RNA, 64 nt, hsa; identical to SEQ ID NO: 235951

SEQ ID NO: 441435 - RNA, 64 nt, hsa; identical to SEQ ID NO: 235952

SEQ ID NO: 441436 - RNA, 64 nt, hsa; identical to SEQ ID NO: 235953

SEQ ID NO: 441437 - RNA, 64 nt, hsa; identical to SEQ ID NO: 235954

SEQ ID NO: 441438 - RNA, 64 nt, hsa; identical to SEQ ID NO: 235955

SEQ ID NO: 441439 - RNA, 64 nt, hsa; identical to SEQ ID NO: 235956

SEQ ID NO: 441440 - RNA, 64 nt, hsa; identical to SEQ ID NO: 235957

SEQ ID NO: 441441 - RNA, 64 nt, hsa; identical to SEQ ID NO: 235958

SEQ ID NO: 441442 - RNA, 64 nt, hsa; identical to SEQ ID NO: 235959

SEQ ID NO: 441443 - RNA, 64 nt, hsa; identical to SEQ ID NO: 235960

SEQ ID NO: 441444 - RNA, 64 nt, hsa; identical to SEQ ID NO: 235961

SEQ ID NO: 441445 - RNA, 64 nt, hsa; identical to SEQ ID NO: 235962

SEQ ID NO: 441446 - RNA, 64 nt, hsa; identical to SEQ ID NO: 235963

SEQ ID NO: 441447 - RNA, 64 nt, hsa; identical to SEQ ID NO: 235964

SEQ ID NO: 441448 - RNA, 64 nt, hsa; identical to SEQ ID NO: 235965

SEQ ID NO: 441449 - RNA, 64 nt, hsa; identical to SEQ ID NO: 235966

SEQ ID NO: 441450 - RNA, 64 nt, hsa; identical to SEQ ID NO: 235967

SEQ ID NO: 441451 - RNA, 64 nt, hsa; identical to SEQ ID NO: 235968

SEQ ID NO: 441452 - RNA, 64 nt, hsa; identical to SEQ ID NO: 235969

SEQ ID NO: 441453 - RNA, 64 nt, hsa; identical to SEQ ID NO: 235970

SEQ ID NO: 441454 - RNA, 64 nt, hsa; identical to SEQ ID NO: 235971

SEQ ID NO: 441455 - RNA, 64 nt, hsa; identical to SEQ ID NO: 235972

SEQ ID NO: 441456 - RNA, 64 nt, hsa; identical to SEQ ID NO: 235973

SEQ ID NO: 441457 - RNA, 64 nt, hsa; identical to SEQ ID NO: 235974

SEQ ID NO: 441458 - RNA, 58 nt, hsa; identical to SEQ ID NO: 235975

SEQ ID NO: 441459 - RNA, 64 nt, hsa; identical to SEQ ID NO: 235976

SEQ ID NO: 441460 - RNA, 64 nt, hsa; identical to SEQ ID NO: 235977

SEQ ID NO: 441461 - RNA, 64 nt, hsa; identical to SEQ ID NO: 235978

SEQ ID NO: 441462 - RNA, 64 nt, hsa; identical to SEQ ID NO: 235979

SEQ ID NO: 441463 - RNA, 64 nt, hsa; identical to SEQ ID NO: 235980

SEQ ID NO: 441464 - RNA, 64 nt, hsa; identical to SEQ ID NO: 235981

SEQ ID NO: 441465 - RNA, 64 nt, hsa; identical to SEQ ID NO: 235981

SEQ ID NO: 441466 - RNA, 64 nt, hsa; identical to SEQ ID NO: 235983

SEQ ID NO: 441467 - RNA, 64 nt, hsa; identical to SEQ ID NO: 235984

SEQ ID NO: 441468 - RNA, 64 nt, hsa; identical to SEQ ID NO: 235985

SEQ ID NO: 441469 - RNA, 64 nt, hsa; identical to SEQ ID NO: 235986

SEQ ID NO: 441470 - RNA, 64 nt, hsa; identical to SEQ ID NO: 235987

SEQ ID NO: 441471 - RNA, 64 nt, hsa; identical to SEQ ID NO: 235988

SEQ ID NO: 441472 - RNA, 64 nt, hsa; identical to SEQ ID NO: 235989

SEQ ID NO: 441473 - RNA, 64 nt, hsa; identical to SEQ ID NO: 235990

SEQ ID NO: 441474 - RNA, 64 nt, hsa; identical to SEQ ID NO: 235991

SEQ ID NO: 441475 - RNA, 64 nt, hsa; identical to SEQ ID NO: 235992

SEQ ID NO: 441476 - RNA, 64 nt, hsa
uauuuucaaaacgaaguucuuacuuuuaaagagaauuaccuauauucuccugauacugauuacc

SEQ ID NO: 441477 - RNA, 64 nt, hsa
cugauuugaccaauuuaucaaauaugucauuuuaauuaccuagcuggaaguuagagacaugaaa

SEQ ID NO: 441478 - RNA, 64 nt, hsa
acaguuagacaauccaugguuuaaugcacaugaaauuaccuauauuuuauacuguuucaaugua

SEQ ID NO: 441479 - RNA, 64 nt, hsa
uucuaagaccauuucauucugaaacuucuuaucaauuaccuaaaucucaacgaaaaacaauuua

SEQ ID NO: 441480 - RNA, 64 nt, hsa
agugaaguuggucagggacauguggccacuuauuauuaccuaaagaaaacauuuguucccuguu

SEQ ID NO: 441481 - RNA, 64 nt, hsa
uuagggucaaagacauucuauuugaacacuugcaauuaccuagaucuaguuggccuuugguuga

SEQ ID NO: 441482 - RNA, 64 nt, hsa
uaaaauuacauaguauuaccuagacauagacaguauuaccuagguagaugcacugcucaccugc

SEQ ID NO: 441483 - RNA, 64 nt, hsa
cuccacacgcaguaugaagauaaaauuacauaguauuaccuagacauagacaguauuaccuagg

SEQ ID NO: 441484 - RNA, 64 nt, hsa
uaaaaucucaaauaacaaguacaaacauugaacaauuaccuauaaagauuuguaaaaguaaaau

SEQ ID NO: 441485 - RNA, 64 nt, hsa
cucgacuuguauuuauuaaauacucaaacucaguauuaccuacucaaugccuuuuaaaagaaag

SEQ ID NO: 441486 - RNA, 64 nt, hsa; identical to SEQ ID NO: 274946

SEQ ID NO: 441487 - RNA, 64 nt, hsa; identical to SEQ ID NO: 274947

SEQ ID NO: 441488 - RNA, 64 nt, hsa; identical to SEQ ID NO: 274948

SEQ ID NO: 441489 - RNA, 64 nt, hsa; identical to SEQ ID NO: 274949

SEQ ID NO: 441490 - RNA, 64 nt, hsa; identical to SEQ ID NO: 274950

SEQ ID NO: 441491 - RNA, 64 nt, hsa; identical to SEQ ID NO: 274951

SEQ ID NO: 441492 - RNA, 64 nt, hsa; identical to SEQ ID NO: 274952

SEQ ID NO: 441493 - RNA, 64 nt, hsa; identical to SEQ ID NO: 274953

SEQ ID NO: 441494 - RNA, 64 nt, hsa; identical to SEQ ID NO: 274954

SEQ ID NO: 441495 - RNA, 64 nt, hsa; identical to SEQ ID NO: 274955

SEQ ID NO: 441496 - RNA, 64 nt, hsa; identical to SEQ ID NO: 274956

SEQ ID NO: 441497 - RNA, 64 nt, hsa; identical to SEQ ID NO: 274957

SEQ ID NO: 441498 - RNA, 64 nt, hsa; identical to SEQ ID NO: 274958

SEQ ID NO: 441499 - RNA, 64 nt, hsa; identical to SEQ ID NO: 274959

SEQ ID NO: 441500 - RNA, 64 nt, hsa; identical to SEQ ID NO: 274960

SEQ ID NO: 441501 - RNA, 64 nt, hsa; identical to SEQ ID NO: 274961

SEQ ID NO: 441502 - RNA, 64 nt, hsa; identical to SEQ ID NO: 274962

SEQ ID NO: 441503 - RNA, 64 nt, hsa; identical to SEQ ID NO: 274963

SEQ ID NO: 441504 - RNA, 64 nt, hsa; identical to SEQ ID NO: 274964

SEQ ID NO: 441505 - RNA, 64 nt, hsa; identical to SEQ ID NO: 274965

SEQ ID NO: 441506 - RNA, 64 nt, hsa; identical to SEQ ID NO: 274966

SEQ ID NO: 441507 - RNA, 64 nt, hsa; identical to SEQ ID NO: 274967

SEQ ID NO: 441508 - RNA, 64 nt, hsa; identical to SEQ ID NO: 274968

SEQ ID NO: 441509 - RNA, 64 nt, hsa; identical to SEQ ID NO: 274969

SEQ ID NO: 441510 - RNA, 64 nt, hsa; identical to SEQ ID NO: 274970

SEQ ID NO: 441511 - RNA, 64 nt, hsa; identical to SEQ ID NO: 274971

SEQ ID NO: 441512 - RNA, 64 nt, hsa; identical to SEQ ID NO: 274972

SEQ ID NO: 441513 - RNA, 64 nt, hsa; identical to SEQ ID NO: 274973

SEQ ID NO: 441514 - RNA, 64 nt, hsa; identical to SEQ ID NO: 274974

SEQ ID NO: 441515 - RNA, 64 nt, hsa; identical to SEQ ID NO: 274975

SEQ ID NO: 441516 - RNA, 64 nt, hsa; identical to SEQ ID NO: 274976

SEQ ID NO: 441517 - RNA, 64 nt, hsa; identical to SEQ ID NO: 274977

SEQ ID NO: 441518 - RNA, 64 nt, hsa; identical to SEQ ID NO: 274978

SEQ ID NO: 441519 - RNA, 64 nt, hsa; identical to SEQ ID NO: 274979

SEQ ID NO: 441520 - RNA, 64 nt, hsa; identical to SEQ ID NO: 274980

SEQ ID NO: 441521 - RNA, 64 nt, hsa; identical to SEQ ID NO: 274981

SEQ ID NO: 441522 - RNA, 59 nt, hsa; identical to SEQ ID NO: 274982

SEQ ID NO: 441523 - RNA, 64 nt, hsa; identical to SEQ ID NO: 394553

SEQ ID NO: 441524 - RNA, 64 nt, hsa; identical to SEQ ID NO: 394554

SEQ ID NO: 441525 - RNA, 64 nt, hsa; identical to SEQ ID NO: 394555

SEQ ID NO: 441526 - RNA, 64 nt, hsa; identical to SEQ ID NO: 394556

SEQ ID NO: 441527 - RNA, 64 nt, hsa; identical to SEQ ID NO: 394557

SEQ ID NO: 441528 - RNA, 64 nt, hsa; identical to SEQ ID NO: 394558

SEQ ID NO: 441529 - RNA, 64 nt, hsa; identical to SEQ ID NO: 394559

SEQ ID NO: 441530 - RNA, 64 nt, hsa; identical to SEQ ID NO: 394560

SEQ ID NO: 441531 - RNA, 64 nt, hsa; identical to SEQ ID NO: 394561

SEQ ID NO: 441532 - RNA, 64 nt, hsa; identical to SEQ ID NO: 394562

SEQ ID NO: 441533 - RNA, 64 nt, hsa; identical to SEQ ID NO: 394563

SEQ ID NO: 441534 - RNA, 64 nt, hsa; identical to SEQ ID NO: 394564

SEQ ID NO: 441535 - RNA, 64 nt, hsa; identical to SEQ ID NO: 394565

SEQ ID NO: 441536 - RNA, 64 nt, hsa; identical to SEQ ID NO: 394566

SEQ ID NO: 441537 - RNA, 64 nt, hsa; identical to SEQ ID NO: 394567

SEQ ID NO: 441538 - RNA, 64 nt, hsa; identical to SEQ ID NO: 394567

SEQ ID NO: 441539 - RNA, 64 nt, hsa; identical to SEQ ID NO: 394569

SEQ ID NO: 441540 - RNA, 64 nt, hsa; identical to SEQ ID NO: 394570

SEQ ID NO: 441541 - RNA, 64 nt, hsa; identical to SEQ ID NO: 394571

SEQ ID NO: 441542 - RNA, 64 nt, hsa; identical to SEQ ID NO: 394572

SEQ ID NO: 441543 - RNA, 64 nt, hsa; identical to SEQ ID NO: 394573

SEQ ID NO: 441544 - RNA, 64 nt, hsa; identical to SEQ ID NO: 394574

SEQ ID NO: 441545 - RNA, 64 nt, hsa; identical to SEQ ID NO: 394575

SEQ ID NO: 441546 - RNA, 64 nt, hsa; identical to SEQ ID NO: 394576

SEQ ID NO: 441547 - RNA, 64 nt, hsa; identical to SEQ ID NO: 394577

SEQ ID NO: 441548 - RNA, 64 nt, hsa; identical to SEQ ID NO: 394578

SEQ ID NO: 441549 - RNA, 64 nt, hsa; identical to SEQ ID NO: 394579

SEQ ID NO: 441550 - RNA, 64 nt, hsa; identical to SEQ ID NO: 394580

SEQ ID NO: 441551 - RNA, 64 nt, hsa; identical to SEQ ID NO: 394581

SEQ ID NO: 441552 - RNA, 64 nt, hsa; identical to SEQ ID NO: 394582

SEQ ID NO: 441553 - RNA, 64 nt, hsa; identical to SEQ ID NO: 394583

SEQ ID NO: 441554 - RNA, 64 nt, hsa; identical to SEQ ID NO: 394584

SEQ ID NO: 441555 - RNA, 64 nt, hsa; identical to SEQ ID NO: 394585

SEQ ID NO: 441556 - RNA, 64 nt, hsa; identical to SEQ ID NO: 394586

SEQ ID NO: 441557 - RNA, 64 nt, hsa; identical to SEQ ID NO: 394587

SEQ ID NO: 441558 - RNA, 64 nt, hsa; identical to SEQ ID NO: 394588

SEQ ID NO: 441559 - RNA, 64 nt, hsa; identical to SEQ ID NO: 394589

SEQ ID NO: 441560 - RNA, 64 nt, hsa; identical to SEQ ID NO: 394590

SEQ ID NO: 441561 - RNA, 63 nt, hsa; identical to SEQ ID NO: 66692

SEQ ID NO: 441562 - RNA, 63 nt, hsa; identical to SEQ ID NO: 66693

SEQ ID NO: 441563 - RNA, 63 nt, hsa; identical to SEQ ID NO: 66694

SEQ ID NO: 441564 - RNA, 63 nt, hsa; identical to SEQ ID NO: 66695

SEQ ID NO: 441565 - RNA, 63 nt, hsa; identical to SEQ ID NO: 66696

SEQ ID NO: 441566 - RNA, 63 nt, hsa; identical to SEQ ID NO: 66697

SEQ ID NO: 441567 - RNA, 63 nt, hsa; identical to SEQ ID NO: 66698

SEQ ID NO: 441568 - RNA, 63 nt, hsa; identical to SEQ ID NO: 66699

SEQ ID NO: 441569 - RNA, 63 nt, hsa; identical to SEQ ID NO: 66700

SEQ ID NO: 441570 - RNA, 63 nt, hsa; identical to SEQ ID NO: 66701

SEQ ID NO: 441571 - RNA, 63 nt, hsa; identical to SEQ ID NO: 66702

SEQ ID NO: 441572 - RNA, 63 nt, hsa; identical to SEQ ID NO: 66703

SEQ ID NO: 441573 - RNA, 63 nt, hsa; identical to SEQ ID NO: 66704

SEQ ID NO: 441574 - RNA, 63 nt, hsa; identical to SEQ ID NO: 66705

SEQ ID NO: 441575 - RNA, 63 nt, hsa; identical to SEQ ID NO: 66706

SEQ ID NO: 441576 - RNA, 63 nt, hsa; identical to SEQ ID NO: 66707

SEQ ID NO: 441577 - RNA, 63 nt, hsa; identical to SEQ ID NO: 66708

SEQ ID NO: 441578 - RNA, 63 nt, hsa; identical to SEQ ID NO: 66709

SEQ ID NO: 441579 - RNA, 63 nt, hsa; identical to SEQ ID NO: 66710

SEQ ID NO: 441580 - RNA, 63 nt, hsa; identical to SEQ ID NO: 66711

SEQ ID NO: 441581 - RNA, 63 nt, hsa; identical to SEQ ID NO: 66712

SEQ ID NO: 441582 - RNA, 63 nt, hsa; identical to SEQ ID NO: 66713

SEQ ID NO: 441583 - RNA, 63 nt, hsa; identical to SEQ ID NO: 66714

SEQ ID NO: 441584 - RNA, 63 nt, hsa; identical to SEQ ID NO: 66715

SEQ ID NO: 441585 - RNA, 63 nt, hsa; identical to SEQ ID NO: 66716

SEQ ID NO: 441586 - RNA, 63 nt, hsa; identical to SEQ ID NO: 66717

SEQ ID NO: 441587 - RNA, 63 nt, hsa; identical to SEQ ID NO: 66718

SEQ ID NO: 441588 - RNA, 63 nt, hsa; identical to SEQ ID NO: 66719

SEQ ID NO: 441589 - RNA, 63 nt, hsa; identical to SEQ ID NO: 66720

SEQ ID NO: 441590 - RNA, 63 nt, hsa; identical to SEQ ID NO: 66721

SEQ ID NO: 441591 - RNA, 63 nt, hsa; identical to SEQ ID NO: 66722

SEQ ID NO: 441592 - RNA, 63 nt, hsa; identical to SEQ ID NO: 66723

SEQ ID NO: 441593 - RNA, 63 nt, hsa; identical to SEQ ID NO: 66724

SEQ ID NO: 441594 - RNA, 63 nt, hsa; identical to SEQ ID NO: 66725

SEQ ID NO: 441595 - RNA, 63 nt, hsa; identical to SEQ ID NO: 66726

SEQ ID NO: 441596 - RNA, 63 nt, hsa; identical to SEQ ID NO: 66727

SEQ ID NO: 441597 - RNA, 63 nt, hsa; identical to SEQ ID NO: 66728

SEQ ID NO: 441598 - RNA, 63 nt, hsa; identical to SEQ ID NO: 66729

SEQ ID NO: 441599 - RNA, 63 nt, hsa; identical to SEQ ID NO: 66730

SEQ ID NO: 441600 - RNA, 63 nt, hsa; identical to SEQ ID NO: 66731

SEQ ID NO: 441601 - RNA, 63 nt, hsa; identical to SEQ ID NO: 66732

SEQ ID NO: 441602 - RNA, 63 nt, hsa; identical to SEQ ID NO: 66733

SEQ ID NO: 441603 - RNA, 63 nt, hsa; identical to SEQ ID NO: 66734

SEQ ID NO: 441604 - RNA, 63 nt, hsa; identical to SEQ ID NO: 66735

SEQ ID NO: 441605 - RNA, 63 nt, hsa; identical to SEQ ID NO: 66736

SEQ ID NO: 441606 - RNA, 63 nt, hsa; identical to SEQ ID NO: 66737

SEQ ID NO: 441607 - RNA, 63 nt, hsa; identical to SEQ ID NO: 66738

SEQ ID NO: 441608 - RNA, 63 nt, hsa; identical to SEQ ID NO: 66739

SEQ ID NO: 441609 - RNA, 63 nt, hsa; identical to SEQ ID NO: 66740

SEQ ID NO: 441610 - RNA, 63 nt, hsa; identical to SEQ ID NO: 66741

SEQ ID NO: 441611 - RNA, 63 nt, hsa; identical to SEQ ID NO: 66742

SEQ ID NO: 441612 - RNA, 63 nt, hsa; identical to SEQ ID NO: 66743

SEQ ID NO: 441613 - RNA, 63 nt, hsa; identical to SEQ ID NO: 66744

SEQ ID NO: 441614 - RNA, 63 nt, hsa; identical to SEQ ID NO: 66745

SEQ ID NO: 441615 - RNA, 63 nt, hsa; identical to SEQ ID NO: 66746

SEQ ID NO: 441616 - RNA, 63 nt, hsa; identical to SEQ ID NO: 66747

SEQ ID NO: 441617 - RNA, 63 nt, hsa; identical to SEQ ID NO: 66748

SEQ ID NO: 441618 - RNA, 63 nt, hsa; identical to SEQ ID NO: 66749

SEQ ID NO: 441619 - RNA, 63 nt, hsa; identical to SEQ ID NO: 66750

SEQ ID NO: 441620 - RNA, 63 nt, hsa; identical to SEQ ID NO: 66751

SEQ ID NO: 441621 - RNA, 63 nt, hsa; identical to SEQ ID NO: 66752

SEQ ID NO: 441622 - RNA, 63 nt, hsa; identical to SEQ ID NO: 66753

SEQ ID NO: 441623 - RNA, 63 nt, hsa; identical to SEQ ID NO: 66754

SEQ ID NO: 441624 - RNA, 63 nt, hsa; identical to SEQ ID NO: 66755

SEQ ID NO: 441625 - RNA, 63 nt, hsa; identical to SEQ ID NO: 66756

SEQ ID NO: 441626 - RNA, 63 nt, hsa; identical to SEQ ID NO: 66757

SEQ ID NO: 441627 - RNA, 63 nt, hsa; identical to SEQ ID NO: 66758

SEQ ID NO: 441628 - RNA, 63 nt, hsa; identical to SEQ ID NO: 66759

SEQ ID NO: 441629 - RNA, 63 nt, hsa; identical to SEQ ID NO: 66760

SEQ ID NO: 441630 - RNA, 63 nt, hsa; identical to SEQ ID NO: 66761

SEQ ID NO: 441631 - RNA, 63 nt, hsa; identical to SEQ ID NO: 66762

SEQ ID NO: 441632 - RNA, 63 nt, hsa; identical to SEQ ID NO: 66763

SEQ ID NO: 441633 - RNA, 63 nt, hsa; identical to SEQ ID NO: 66764

SEQ ID NO: 441634 - RNA, 63 nt, hsa; identical to SEQ ID NO: 66765

SEQ ID NO: 441635 - RNA, 63 nt, hsa; identical to SEQ ID NO: 66766

SEQ ID NO: 441636 - RNA, 63 nt, hsa; identical to SEQ ID NO: 66767

SEQ ID NO: 441637 - RNA, 63 nt, hsa; identical to SEQ ID NO: 66768

SEQ ID NO: 441638 - RNA, 58 nt, hsa; identical to SEQ ID NO: 66050

SEQ ID NO: 441639 - RNA, 63 nt, hsa; identical to SEQ ID NO: 66770

SEQ ID NO: 441640 - RNA, 63 nt, hsa; identical to SEQ ID NO: 66771

SEQ ID NO: 441641 - RNA, 63 nt, hsa; identical to SEQ ID NO: 66772

SEQ ID NO: 441642 - RNA, 63 nt, hsa; identical to SEQ ID NO: 66773

SEQ ID NO: 441643 - RNA, 63 nt, hsa; identical to SEQ ID NO: 66774

SEQ ID NO: 441644 - RNA, 63 nt, hsa; identical to SEQ ID NO: 66775

SEQ ID NO: 441645 - RNA, 63 nt, hsa; identical to SEQ ID NO: 66776

SEQ ID NO: 441646 - RNA, 63 nt, hsa; identical to SEQ ID NO: 66777

SEQ ID NO: 441647 - RNA, 63 nt, hsa; identical to SEQ ID NO: 66778

SEQ ID NO: 441648 - RNA, 63 nt, hsa; identical to SEQ ID NO: 66779

SEQ ID NO: 441649 - RNA, 63 nt, hsa; identical to SEQ ID NO: 66780

SEQ ID NO: 441650 - RNA, 63 nt, hsa; identical to SEQ ID NO: 66781

SEQ ID NO: 441651 - RNA, 63 nt, hsa; identical to SEQ ID NO: 66782

SEQ ID NO: 441652 - RNA, 63 nt, hsa; identical to SEQ ID NO: 66783

SEQ ID NO: 441653 - RNA, 63 nt, hsa; identical to SEQ ID NO: 66784

SEQ ID NO: 441654 - RNA, 63 nt, hsa; identical to SEQ ID NO: 66785

SEQ ID NO: 441655 - RNA, 63 nt, hsa; identical to SEQ ID NO: 66786

SEQ ID NO: 441656 - RNA, 63 nt, hsa; identical to SEQ ID NO: 66787

SEQ ID NO: 441657 - RNA, 63 nt, hsa; identical to SEQ ID NO: 66788

SEQ ID NO: 441658 - RNA, 63 nt, hsa; identical to SEQ ID NO: 66789

SEQ ID NO: 441659 - RNA, 63 nt, hsa; identical to SEQ ID NO: 66790

SEQ ID NO: 441660 - RNA, 63 nt, hsa; identical to SEQ ID NO: 66791

SEQ ID NO: 441661 - RNA, 63 nt, hsa; identical to SEQ ID NO: 66792

SEQ ID NO: 441662 - RNA, 63 nt, hsa; identical to SEQ ID NO: 66793

SEQ ID NO: 441663 - RNA, 63 nt, hsa; identical to SEQ ID NO: 66794

SEQ ID NO: 441664 - RNA, 63 nt, hsa; identical to SEQ ID NO: 66795

SEQ ID NO: 441665 - RNA, 63 nt, hsa; identical to SEQ ID NO: 66796

SEQ ID NO: 441666 - RNA, 63 nt, hsa; identical to SEQ ID NO: 66797

SEQ ID NO: 441667 - RNA, 63 nt, hsa; identical to SEQ ID NO: 66798

SEQ ID NO: 441668 - RNA, 63 nt, hsa; identical to SEQ ID NO: 66799

SEQ ID NO: 441669 - RNA, 63 nt, hsa; identical to SEQ ID NO: 66800

SEQ ID NO: 441670 - RNA, 63 nt, hsa; identical to SEQ ID NO: 66801

SEQ ID NO: 441671 - RNA, 63 nt, hsa; identical to SEQ ID NO: 66802

SEQ ID NO: 441672 - RNA, 63 nt, hsa; identical to SEQ ID NO: 66803

SEQ ID NO: 441673 - RNA, 63 nt, hsa; identical to SEQ ID NO: 66804

SEQ ID NO: 441674 - RNA, 63 nt, hsa; identical to SEQ ID NO: 66805

SEQ ID NO: 441675 - RNA, 63 nt, hsa; identical to SEQ ID NO: 66806

SEQ ID NO: 441676 - RNA, 63 nt, hsa; identical to SEQ ID NO: 66807

SEQ ID NO: 441677 - RNA, 63 nt, hsa; identical to SEQ ID NO: 66808

SEQ ID NO: 441678 - RNA, 63 nt, hsa; identical to SEQ ID NO: 66809

SEQ ID NO: 441679 - RNA, 63 nt, hsa; identical to SEQ ID NO: 66810

SEQ ID NO: 441680 - RNA, 62 nt, hsa; identical to SEQ ID NO: 66092

SEQ ID NO: 441681 - RNA, 63 nt, hsa; identical to SEQ ID NO: 66812

SEQ ID NO: 441682 - RNA, 63 nt, hsa; identical to SEQ ID NO: 66813

SEQ ID NO: 441683 - RNA, 63 nt, hsa; identical to SEQ ID NO: 66814

SEQ ID NO: 441684 - RNA, 63 nt, hsa; identical to SEQ ID NO: 66815

SEQ ID NO: 441685 - RNA, 63 nt, hsa; identical to SEQ ID NO: 66816

SEQ ID NO: 441686 - RNA, 63 nt, hsa; identical to SEQ ID NO: 66817

SEQ ID NO: 441687 - RNA, 63 nt, hsa; identical to SEQ ID NO: 66818

SEQ ID NO: 441688 - RNA, 63 nt, hsa; identical to SEQ ID NO: 66819

SEQ ID NO: 441689 - RNA, 63 nt, hsa; identical to SEQ ID NO: 66820

SEQ ID NO: 441690 - RNA, 63 nt, hsa; identical to SEQ ID NO: 66821

SEQ ID NO: 441691 - RNA, 63 nt, hsa; identical to SEQ ID NO: 66822

SEQ ID NO: 441692 - RNA, 63 nt, hsa; identical to SEQ ID NO: 66823

SEQ ID NO: 441693 - RNA, 63 nt, hsa; identical to SEQ ID NO: 66824

SEQ ID NO: 441694 - RNA, 63 nt, hsa; identical to SEQ ID NO: 66825

SEQ ID NO: 441695 - RNA, 63 nt, hsa; identical to SEQ ID NO: 66826

SEQ ID NO: 441696 - RNA, 63 nt, hsa; identical to SEQ ID NO: 66827

SEQ ID NO: 441697 - RNA, 63 nt, hsa; identical to SEQ ID NO: 66828

SEQ ID NO: 441698 - RNA, 63 nt, hsa; identical to SEQ ID NO: 66829

SEQ ID NO: 441699 - RNA, 63 nt, hsa; identical to SEQ ID NO: 66830

SEQ ID NO: 441700 - RNA, 63 nt, hsa; identical to SEQ ID NO: 66831

SEQ ID NO: 441701 - RNA, 63 nt, hsa; identical to SEQ ID NO: 66832

SEQ ID NO: 441702 - RNA, 63 nt, hsa; identical to SEQ ID NO: 66833

SEQ ID NO: 441703 - RNA, 63 nt, hsa; identical to SEQ ID NO: 66834

SEQ ID NO: 441704 - RNA, 63 nt, hsa; identical to SEQ ID NO: 66835

SEQ ID NO: 441705 - RNA, 63 nt, hsa; identical to SEQ ID NO: 66836

SEQ ID NO: 441706 - RNA, 63 nt, hsa; identical to SEQ ID NO: 66837

SEQ ID NO: 441707 - RNA, 63 nt, hsa; identical to SEQ ID NO: 66838

SEQ ID NO: 441708 - RNA, 63 nt, hsa; identical to SEQ ID NO: 66839

SEQ ID NO: 441709 - RNA, 63 nt, hsa; identical to SEQ ID NO: 66840

SEQ ID NO: 441710 - RNA, 63 nt, hsa; identical to SEQ ID NO: 66841

SEQ ID NO: 441711 - RNA, 63 nt, hsa; identical to SEQ ID NO: 66842

SEQ ID NO: 441712 - RNA, 63 nt, hsa; identical to SEQ ID NO: 66843

SEQ ID NO: 441713 - RNA, 63 nt, hsa; identical to SEQ ID NO: 66844

SEQ ID NO: 441714 - RNA, 63 nt, hsa; identical to SEQ ID NO: 66845

SEQ ID NO: 441715 - RNA, 63 nt, hsa; identical to SEQ ID NO: 66846

SEQ ID NO: 441716 - RNA, 63 nt, hsa; identical to SEQ ID NO: 66847

SEQ ID NO: 441717 - RNA, 63 nt, hsa; identical to SEQ ID NO: 66848

SEQ ID NO: 441718 - RNA, 63 nt, hsa; identical to SEQ ID NO: 66849

SEQ ID NO: 441719 - RNA, 63 nt, hsa; identical to SEQ ID NO: 66850

SEQ ID NO: 441720 - RNA, 63 nt, hsa; identical to SEQ ID NO: 66851

SEQ ID NO: 441721 - RNA, 63 nt, hsa; identical to SEQ ID NO: 66852

SEQ ID NO: 441722 - RNA, 50 nt, hsa; identical to SEQ ID NO: 66134

SEQ ID NO: 441723 - RNA, 63 nt, hsa; identical to SEQ ID NO: 66854

SEQ ID NO: 441724 - RNA, 63 nt, hsa; identical to SEQ ID NO: 66855

SEQ ID NO: 441725 - RNA, 63 nt, hsa; identical to SEQ ID NO: 66856

SEQ ID NO: 441726 - RNA, 63 nt, hsa; identical to SEQ ID NO: 66857

SEQ ID NO: 441727 - RNA, 63 nt, hsa; identical to SEQ ID NO: 66858

SEQ ID NO: 441728 - RNA, 63 nt, hsa; identical to SEQ ID NO: 66859

SEQ ID NO: 441729 - RNA, 63 nt, hsa; identical to SEQ ID NO: 66860

SEQ ID NO: 441730 - RNA, 63 nt, hsa; identical to SEQ ID NO: 66861

SEQ ID NO: 441731 - RNA, 63 nt, hsa; identical to SEQ ID NO: 66862

SEQ ID NO: 441732 - RNA, 63 nt, hsa; identical to SEQ ID NO: 66863

SEQ ID NO: 441733 - RNA, 63 nt, hsa; identical to SEQ ID NO: 66864

SEQ ID NO: 441734 - RNA, 63 nt, hsa; identical to SEQ ID NO: 66865

SEQ ID NO: 441735 - RNA, 63 nt, hsa; identical to SEQ ID NO: 66866

SEQ ID NO: 441736 - RNA, 63 nt, hsa; identical to SEQ ID NO: 66867

SEQ ID NO: 441737 - RNA, 63 nt, hsa; identical to SEQ ID NO: 66868

SEQ ID NO: 441738 - RNA, 63 nt, hsa; identical to SEQ ID NO: 66869

SEQ ID NO: 441739 - RNA, 63 nt, hsa; identical to SEQ ID NO: 66870

SEQ ID NO: 441740 - RNA, 63 nt, hsa; identical to SEQ ID NO: 66871

SEQ ID NO: 441741 - RNA, 63 nt, hsa; identical to SEQ ID NO: 66872

SEQ ID NO: 441742 - RNA, 63 nt, hsa; identical to SEQ ID NO: 66873

SEQ ID NO: 441743 - RNA, 63 nt, hsa; identical to SEQ ID NO: 66874

SEQ ID NO: 441744 - RNA, 63 nt, hsa; identical to SEQ ID NO: 66875

SEQ ID NO: 441745 - RNA, 63 nt, hsa; identical to SEQ ID NO: 66876

SEQ ID NO: 441746 - RNA, 63 nt, hsa; identical to SEQ ID NO: 66877

SEQ ID NO: 441747 - RNA, 63 nt, hsa; identical to SEQ ID NO: 66878

SEQ ID NO: 441748 - RNA, 63 nt, hsa; identical to SEQ ID NO: 66879

SEQ ID NO: 441749 - RNA, 63 nt, hsa; identical to SEQ ID NO: 66880

SEQ ID NO: 441750 - RNA, 61 nt, hsa; identical to SEQ ID NO: 66881

SEQ ID NO: 441751 - RNA, 63 nt, hsa; identical to SEQ ID NO: 66882

SEQ ID NO: 441752 - RNA, 63 nt, hsa; identical to SEQ ID NO: 66883

SEQ ID NO: 441753 - RNA, 63 nt, hsa; identical to SEQ ID NO: 66884

SEQ ID NO: 441754 - RNA, 63 nt, hsa; identical to SEQ ID NO: 66885

SEQ ID NO: 441755 - RNA, 63 nt, hsa; identical to SEQ ID NO: 66886

SEQ ID NO: 441756 - RNA, 63 nt, hsa; identical to SEQ ID NO: 66887

SEQ ID NO: 441757 - RNA, 63 nt, hsa; identical to SEQ ID NO: 66888

SEQ ID NO: 441758 - RNA, 63 nt, hsa; identical to SEQ ID NO: 66889

SEQ ID NO: 441759 - RNA, 63 nt, hsa; identical to SEQ ID NO: 66890

SEQ ID NO: 441760 - RNA, 63 nt, hsa; identical to SEQ ID NO: 66891

SEQ ID NO: 441761 - RNA, 63 nt, hsa; identical to SEQ ID NO: 66892

SEQ ID NO: 441762 - RNA, 63 nt, hsa; identical to SEQ ID NO: 66893

SEQ ID NO: 441763 - RNA, 63 nt, hsa; identical to SEQ ID NO: 66894

SEQ ID NO: 441764 - RNA, 63 nt, hsa; identical to SEQ ID NO: 66895

SEQ ID NO: 441765 - RNA, 63 nt, hsa; identical to SEQ ID NO: 66896

SEQ ID NO: 441766 - RNA, 63 nt, hsa; identical to SEQ ID NO: 66897

SEQ ID NO: 441767 - RNA, 63 nt, hsa; identical to SEQ ID NO: 66898

SEQ ID NO: 441768 - RNA, 63 nt, hsa; identical to SEQ ID NO: 66899

SEQ ID NO: 441769 - RNA, 63 nt, hsa; identical to SEQ ID NO: 66900

SEQ ID NO: 441770 - RNA, 63 nt, hsa; identical to SEQ ID NO: 66901

SEQ ID NO: 441771 - RNA, 63 nt, hsa; identical to SEQ ID NO: 66902

SEQ ID NO: 441772 - RNA, 63 nt, hsa; identical to SEQ ID NO: 66903

SEQ ID NO: 441773 - RNA, 63 nt, hsa; identical to SEQ ID NO: 66904

SEQ ID NO: 441774 - RNA, 63 nt, hsa; identical to SEQ ID NO: 66905

SEQ ID NO: 441775 - RNA, 63 nt, hsa; identical to SEQ ID NO: 66906

SEQ ID NO: 441776 - RNA, 63 nt, hsa; identical to SEQ ID NO: 66907

SEQ ID NO: 441777 - RNA, 63 nt, hsa; identical to SEQ ID NO: 66908

SEQ ID NO: 441778 - RNA, 63 nt, hsa; identical to SEQ ID NO: 66909

SEQ ID NO: 441779 - RNA, 63 nt, hsa; identical to SEQ ID NO: 66910

SEQ ID NO: 441780 - RNA, 63 nt, hsa; identical to SEQ ID NO: 66911

SEQ ID NO: 441781 - RNA, 63 nt, hsa; identical to SEQ ID NO: 66912

SEQ ID NO: 441782 - RNA, 63 nt, hsa; identical to SEQ ID NO: 66913

SEQ ID NO: 441783 - RNA, 51 nt, hsa; identical to SEQ ID NO: 66195

SEQ ID NO: 441784 - RNA, 63 nt, hsa; identical to SEQ ID NO: 66915

SEQ ID NO: 441785 - RNA, 63 nt, hsa; identical to SEQ ID NO: 66916

SEQ ID NO: 441786 - RNA, 63 nt, hsa; identical to SEQ ID NO: 66917

SEQ ID NO: 441787 - RNA, 63 nt, hsa; identical to SEQ ID NO: 66918

SEQ ID NO: 441788 - RNA, 63 nt, hsa; identical to SEQ ID NO: 66919

SEQ ID NO: 441789 - RNA, 63 nt, hsa; identical to SEQ ID NO: 66920

SEQ ID NO: 441790 - RNA, 63 nt, hsa; identical to SEQ ID NO: 66921

SEQ ID NO: 441791 - RNA, 63 nt, hsa; identical to SEQ ID NO: 66922

SEQ ID NO: 441792 - RNA, 63 nt, hsa; identical to SEQ ID NO: 66923

SEQ ID NO: 441793 - RNA, 63 nt, hsa; identical to SEQ ID NO: 66924

SEQ ID NO: 441794 - RNA, 63 nt, hsa; identical to SEQ ID NO: 66925

SEQ ID NO: 441795 - RNA, 63 nt, hsa; identical to SEQ ID NO: 66926

SEQ ID NO: 441796 - RNA, 63 nt, hsa; identical to SEQ ID NO: 66927

SEQ ID NO: 441797 - RNA, 63 nt, hsa; identical to SEQ ID NO: 66928

SEQ ID NO: 441798 - RNA, 63 nt, hsa; identical to SEQ ID NO: 66929

SEQ ID NO: 441799 - RNA, 63 nt, hsa; identical to SEQ ID NO: 66930

SEQ ID NO: 441800 - RNA, 63 nt, hsa; identical to SEQ ID NO: 66931

SEQ ID NO: 441801 - RNA, 63 nt, hsa; identical to SEQ ID NO: 66932

SEQ ID NO: 441802 - RNA, 63 nt, hsa; identical to SEQ ID NO: 66933

SEQ ID NO: 441803 - RNA, 63 nt, hsa; identical to SEQ ID NO: 66934

SEQ ID NO: 441804 - RNA, 63 nt, hsa; identical to SEQ ID NO: 66935

SEQ ID NO: 441805 - RNA, 63 nt, hsa; identical to SEQ ID NO: 66936

SEQ ID NO: 441806 - RNA, 63 nt, hsa; identical to SEQ ID NO: 66937

SEQ ID NO: 441807 - RNA, 63 nt, hsa; identical to SEQ ID NO: 66938

SEQ ID NO: 441808 - RNA, 63 nt, hsa; identical to SEQ ID NO: 66939

SEQ ID NO: 441809 - RNA, 63 nt, hsa; identical to SEQ ID NO: 66940

SEQ ID NO: 441810 - RNA, 63 nt, hsa; identical to SEQ ID NO: 66941

SEQ ID NO: 441811 - RNA, 63 nt, hsa; identical to SEQ ID NO: 66942

SEQ ID NO: 441812 - RNA, 63 nt, hsa; identical to SEQ ID NO: 66943

SEQ ID NO: 441813 - RNA, 63 nt, hsa; identical to SEQ ID NO: 66944

SEQ ID NO: 441814 - RNA, 63 nt, hsa; identical to SEQ ID NO: 66945

SEQ ID NO: 441815 - RNA, 63 nt, hsa; identical to SEQ ID NO: 66946

SEQ ID NO: 441816 - RNA, 63 nt, hsa; identical to SEQ ID NO: 66947

SEQ ID NO: 441817 - RNA, 63 nt, hsa; identical to SEQ ID NO: 66948

SEQ ID NO: 441818 - RNA, 63 nt, hsa; identical to SEQ ID NO: 66949

SEQ ID NO: 441819 - RNA, 63 nt, hsa; identical to SEQ ID NO: 66950

SEQ ID NO: 441820 - RNA, 63 nt, hsa; identical to SEQ ID NO: 66951

SEQ ID NO: 441821 - RNA, 63 nt, hsa; identical to SEQ ID NO: 66952

SEQ ID NO: 441822 - RNA, 63 nt, hsa; identical to SEQ ID NO: 66953

SEQ ID NO: 441823 - RNA, 63 nt, hsa; identical to SEQ ID NO: 66954

SEQ ID NO: 441824 - RNA, 63 nt, hsa; identical to SEQ ID NO: 66955

SEQ ID NO: 441825 - RNA, 63 nt, hsa; identical to SEQ ID NO: 66956

SEQ ID NO: 441826 - RNA, 63 nt, hsa; identical to SEQ ID NO: 66957

SEQ ID NO: 441827 - RNA, 63 nt, hsa; identical to SEQ ID NO: 66958

SEQ ID NO: 441828 - RNA, 63 nt, hsa; identical to SEQ ID NO: 66959

SEQ ID NO: 441829 - RNA, 63 nt, hsa; identical to SEQ ID NO: 66960

SEQ ID NO: 441830 - RNA, 63 nt, hsa; identical to SEQ ID NO: 66961

SEQ ID NO: 441831 - RNA, 63 nt, hsa; identical to SEQ ID NO: 66962

SEQ ID NO: 441832 - RNA, 63 nt, hsa; identical to SEQ ID NO: 66963

SEQ ID NO: 441833 - RNA, 63 nt, hsa; identical to SEQ ID NO: 66964

SEQ ID NO: 441834 - RNA, 63 nt, hsa; identical to SEQ ID NO: 66965

SEQ ID NO: 441835 - RNA, 63 nt, hsa; identical to SEQ ID NO: 66966

SEQ ID NO: 441836 - RNA, 63 nt, hsa; identical to SEQ ID NO: 66967

SEQ ID NO: 441837 - RNA, 63 nt, hsa; identical to SEQ ID NO: 66968

SEQ ID NO: 441838 - RNA, 63 nt, hsa; identical to SEQ ID NO: 66969

SEQ ID NO: 441839 - RNA, 63 nt, hsa; identical to SEQ ID NO: 66970

SEQ ID NO: 441840 - RNA, 63 nt, hsa; identical to SEQ ID NO: 66971

SEQ ID NO: 441841 - RNA, 63 nt, hsa; identical to SEQ ID NO: 66972

SEQ ID NO: 441842 - RNA, 63 nt, hsa; identical to SEQ ID NO: 66973

SEQ ID NO: 441843 - RNA, 63 nt, hsa; identical to SEQ ID NO: 66974

SEQ ID NO: 441844 - RNA, 63 nt, hsa; identical to SEQ ID NO: 66975

SEQ ID NO: 441845 - RNA, 63 nt, hsa; identical to SEQ ID NO: 66976

SEQ ID NO: 441846 - RNA, 63 nt, hsa; identical to SEQ ID NO: 66977

SEQ ID NO: 441847 - RNA, 63 nt, hsa; identical to SEQ ID NO: 66978

SEQ ID NO: 441848 - RNA, 63 nt, hsa; identical to SEQ ID NO: 66979

SEQ ID NO: 441849 - RNA, 63 nt, hsa; identical to SEQ ID NO: 66980

SEQ ID NO: 441850 - RNA, 63 nt, hsa; identical to SEQ ID NO: 66981

SEQ ID NO: 441851 - RNA, 63 nt, hsa; identical to SEQ ID NO: 66982

SEQ ID NO: 441852 - RNA, 63 nt, hsa; identical to SEQ ID NO: 66983

SEQ ID NO: 441853 - RNA, 63 nt, hsa; identical to SEQ ID NO: 66984

SEQ ID NO: 441854 - RNA, 63 nt, hsa; identical to SEQ ID NO: 66985

SEQ ID NO: 441855 - RNA, 63 nt, hsa; identical to SEQ ID NO: 66986

SEQ ID NO: 441856 - RNA, 63 nt, hsa; identical to SEQ ID NO: 66987

SEQ ID NO: 441857 - RNA, 63 nt, hsa; identical to SEQ ID NO: 66988

SEQ ID NO: 441858 - RNA, 63 nt, hsa; identical to SEQ ID NO: 66989

SEQ ID NO: 441859 - RNA, 63 nt, hsa; identical to SEQ ID NO: 66990

SEQ ID NO: 441860 - RNA, 63 nt, hsa; identical to SEQ ID NO: 66991

SEQ ID NO: 441861 - RNA, 63 nt, hsa; identical to SEQ ID NO: 66992

SEQ ID NO: 441862 - RNA, 63 nt, hsa; identical to SEQ ID NO: 66993

SEQ ID NO: 441863 - RNA, 63 nt, hsa; identical to SEQ ID NO: 66994

SEQ ID NO: 441864 - RNA, 63 nt, hsa; identical to SEQ ID NO: 66995

SEQ ID NO: 441865 - RNA, 63 nt, hsa; identical to SEQ ID NO: 66996

SEQ ID NO: 441866 - RNA, 63 nt, hsa; identical to SEQ ID NO: 66997

SEQ ID NO: 441867 - RNA, 63 nt, hsa; identical to SEQ ID NO: 66998

SEQ ID NO: 441868 - RNA, 63 nt, hsa; identical to SEQ ID NO: 66999

SEQ ID NO: 441869 - RNA, 63 nt, hsa; identical to SEQ ID NO: 67000

SEQ ID NO: 441870 - RNA, 63 nt, hsa; identical to SEQ ID NO: 67001

SEQ ID NO: 441871 - RNA, 63 nt, hsa; identical to SEQ ID NO: 67002

SEQ ID NO: 441872 - RNA, 63 nt, hsa; identical to SEQ ID NO: 67003

SEQ ID NO: 441873 - RNA, 63 nt, hsa; identical to SEQ ID NO: 67004

SEQ ID NO: 441874 - RNA, 63 nt, hsa; identical to SEQ ID NO: 67005

SEQ ID NO: 441875 - RNA, 63 nt, hsa; identical to SEQ ID NO: 67006

SEQ ID NO: 441876 - RNA, 63 nt, hsa; identical to SEQ ID NO: 67007

SEQ ID NO: 441877 - RNA, 63 nt, hsa; identical to SEQ ID NO: 67008

SEQ ID NO: 441878 - RNA, 63 nt, hsa; identical to SEQ ID NO: 67009

SEQ ID NO: 441879 - RNA, 63 nt, hsa; identical to SEQ ID NO: 67010

SEQ ID NO: 441880 - RNA, 63 nt, hsa; identical to SEQ ID NO: 67011

SEQ ID NO: 441881 - RNA, 63 nt, hsa; identical to SEQ ID NO: 67012

SEQ ID NO: 441882 - RNA, 63 nt, hsa; identical to SEQ ID NO: 67013

SEQ ID NO: 441883 - RNA, 63 nt, hsa; identical to SEQ ID NO: 67014

SEQ ID NO: 441884 - RNA, 63 nt, hsa; identical to SEQ ID NO: 67015

SEQ ID NO: 441885 - RNA, 63 nt, hsa; identical to SEQ ID NO: 67016

SEQ ID NO: 441886 - RNA, 63 nt, hsa; identical to SEQ ID NO: 67017

SEQ ID NO: 441887 - RNA, 63 nt, hsa; identical to SEQ ID NO: 67018

SEQ ID NO: 441888 - RNA, 63 nt, hsa; identical to SEQ ID NO: 67019

SEQ ID NO: 441889 - RNA, 63 nt, hsa; identical to SEQ ID NO: 67020

SEQ ID NO: 441890 - RNA, 63 nt, hsa; identical to SEQ ID NO: 67021

SEQ ID NO: 441891 - RNA, 63 nt, hsa; identical to SEQ ID NO: 67022

SEQ ID NO: 441892 - RNA, 63 nt, hsa; identical to SEQ ID NO: 67023

SEQ ID NO: 441893 - RNA, 63 nt, hsa; identical to SEQ ID NO: 67024

SEQ ID NO: 441894 - RNA, 63 nt, hsa; identical to SEQ ID NO: 67025

SEQ ID NO: 441895 - RNA, 63 nt, hsa; identical to SEQ ID NO: 67026

SEQ ID NO: 441896 - RNA, 63 nt, hsa; identical to SEQ ID NO: 67027

SEQ ID NO: 441897 - RNA, 63 nt, hsa; identical to SEQ ID NO: 67028

SEQ ID NO: 441898 - RNA, 63 nt, hsa; identical to SEQ ID NO: 67029

SEQ ID NO: 441899 - RNA, 63 nt, hsa; identical to SEQ ID NO: 67030

SEQ ID NO: 441900 - RNA, 63 nt, hsa; identical to SEQ ID NO: 67031

SEQ ID NO: 441901 - RNA, 63 nt, hsa; identical to SEQ ID NO: 67032

SEQ ID NO: 441902 - RNA, 63 nt, hsa; identical to SEQ ID NO: 67033

SEQ ID NO: 441903 - RNA, 63 nt, hsa; identical to SEQ ID NO: 67034

SEQ ID NO: 441904 - RNA, 63 nt, hsa; identical to SEQ ID NO: 67035

SEQ ID NO: 441905 - RNA, 63 nt, hsa; identical to SEQ ID NO: 67036

SEQ ID NO: 441906 - RNA, 63 nt, hsa; identical to SEQ ID NO: 67037

SEQ ID NO: 441907 - RNA, 63 nt, hsa; identical to SEQ ID NO: 67038

SEQ ID NO: 441908 - RNA, 63 nt, hsa; identical to SEQ ID NO: 67039

SEQ ID NO: 441909 - RNA, 63 nt, hsa; identical to SEQ ID NO: 67040

SEQ ID NO: 441910 - RNA, 63 nt, hsa; identical to SEQ ID NO: 67041

SEQ ID NO: 441911 - RNA, 63 nt, hsa; identical to SEQ ID NO: 67042

SEQ ID NO: 441912 - RNA, 63 nt, hsa; identical to SEQ ID NO: 67043

SEQ ID NO: 441913 - RNA, 63 nt, hsa; identical to SEQ ID NO: 67044

SEQ ID NO: 441914 - RNA, 63 nt, hsa; identical to SEQ ID NO: 67045

SEQ ID NO: 441915 - RNA, 63 nt, hsa; identical to SEQ ID NO: 67046

SEQ ID NO: 441916 - RNA, 63 nt, hsa; identical to SEQ ID NO: 67047

SEQ ID NO: 441917 - RNA, 63 nt, hsa; identical to SEQ ID NO: 67048

SEQ ID NO: 441918 - RNA, 63 nt, hsa; identical to SEQ ID NO: 67049

SEQ ID NO: 441919 - RNA, 63 nt, hsa; identical to SEQ ID NO: 67050

SEQ ID NO: 441920 - RNA, 63 nt, hsa; identical to SEQ ID NO: 67051

SEQ ID NO: 441921 - RNA, 63 nt, hsa; identical to SEQ ID NO: 67052

SEQ ID NO: 441922 - RNA, 63 nt, hsa; identical to SEQ ID NO: 67053

SEQ ID NO: 441923 - RNA, 63 nt, hsa; identical to SEQ ID NO: 67054

SEQ ID NO: 441924 - RNA, 63 nt, hsa; identical to SEQ ID NO: 67055

SEQ ID NO: 441925 - RNA, 63 nt, hsa; identical to SEQ ID NO: 67056

SEQ ID NO: 441926 - RNA, 63 nt, hsa; identical to SEQ ID NO: 67057

SEQ ID NO: 441927 - RNA, 63 nt, hsa; identical to SEQ ID NO: 67058

SEQ ID NO: 441928 - RNA, 63 nt, hsa; identical to SEQ ID NO: 67059

SEQ ID NO: 441929 - RNA, 63 nt, hsa; identical to SEQ ID NO: 67060

SEQ ID NO: 441930 - RNA, 63 nt, hsa; identical to SEQ ID NO: 67061

SEQ ID NO: 441931 - RNA, 63 nt, hsa; identical to SEQ ID NO: 67062

SEQ ID NO: 441932 - RNA, 63 nt, hsa; identical to SEQ ID NO: 67063

SEQ ID NO: 441933 - RNA, 63 nt, hsa; identical to SEQ ID NO: 67064

SEQ ID NO: 441934 - RNA, 63 nt, hsa; identical to SEQ ID NO: 67065

SEQ ID NO: 441935 - RNA, 63 nt, hsa; identical to SEQ ID NO: 67066

SEQ ID NO: 441936 - RNA, 63 nt, hsa; identical to SEQ ID NO: 67067

SEQ ID NO: 441937 - RNA, 63 nt, hsa; identical to SEQ ID NO: 67068

SEQ ID NO: 441938 - RNA, 63 nt, hsa; identical to SEQ ID NO: 67069

SEQ ID NO: 441939 - RNA, 63 nt, hsa; identical to SEQ ID NO: 67070

SEQ ID NO: 441940 - RNA, 63 nt, hsa; identical to SEQ ID NO: 67071

SEQ ID NO: 441941 - RNA, 63 nt, hsa; identical to SEQ ID NO: 67072

SEQ ID NO: 441942 - RNA, 63 nt, hsa; identical to SEQ ID NO: 67073

SEQ ID NO: 441943 - RNA, 63 nt, hsa; identical to SEQ ID NO: 67074

SEQ ID NO: 441944 - RNA, 63 nt, hsa; identical to SEQ ID NO: 67075

SEQ ID NO: 441945 - RNA, 63 nt, hsa; identical to SEQ ID NO: 67076

SEQ ID NO: 441946 - RNA, 63 nt, hsa; identical to SEQ ID NO: 67077

SEQ ID NO: 441947 - RNA, 63 nt, hsa; identical to SEQ ID NO: 67078

SEQ ID NO: 441948 - RNA, 63 nt, hsa; identical to SEQ ID NO: 67079

SEQ ID NO: 441949 - RNA, 63 nt, hsa; identical to SEQ ID NO: 67080

SEQ ID NO: 441950 - RNA, 63 nt, hsa; identical to SEQ ID NO: 67081

SEQ ID NO: 441951 - RNA, 63 nt, hsa; identical to SEQ ID NO: 67082

SEQ ID NO: 441952 - RNA, 63 nt, hsa; identical to SEQ ID NO: 67083

SEQ ID NO: 441953 - RNA, 63 nt, hsa; identical to SEQ ID NO: 67084

SEQ ID NO: 441954 - RNA, 63 nt, hsa; identical to SEQ ID NO: 67085

SEQ ID NO: 441955 - RNA, 63 nt, hsa; identical to SEQ ID NO: 67086

SEQ ID NO: 441956 - RNA, 63 nt, hsa; identical to SEQ ID NO: 67087

SEQ ID NO: 441957 - RNA, 63 nt, hsa; identical to SEQ ID NO: 67088

SEQ ID NO: 441958 - RNA, 63 nt, hsa; identical to SEQ ID NO: 67089

SEQ ID NO: 441959 - RNA, 63 nt, hsa; identical to SEQ ID NO: 67090

SEQ ID NO: 441960 - RNA, 63 nt, hsa; identical to SEQ ID NO: 67091

SEQ ID NO: 441961 - RNA, 63 nt, hsa; identical to SEQ ID NO: 67092

SEQ ID NO: 441962 - RNA, 63 nt, hsa; identical to SEQ ID NO: 67093

SEQ ID NO: 441963 - RNA, 63 nt, hsa; identical to SEQ ID NO: 67094

SEQ ID NO: 441964 - RNA, 63 nt, hsa; identical to SEQ ID NO: 67095

SEQ ID NO: 441965 - RNA, 63 nt, hsa; identical to SEQ ID NO: 67096

SEQ ID NO: 441966 - RNA, 63 nt, hsa; identical to SEQ ID NO: 67097

SEQ ID NO: 441967 - RNA, 63 nt, hsa; identical to SEQ ID NO: 67098

SEQ ID NO: 441968 - RNA, 63 nt, hsa; identical to SEQ ID NO: 67099

SEQ ID NO: 441969 - RNA, 63 nt, hsa; identical to SEQ ID NO: 67100

SEQ ID NO: 441970 - RNA, 63 nt, hsa; identical to SEQ ID NO: 67101

SEQ ID NO: 441971 - RNA, 63 nt, hsa; identical to SEQ ID NO: 67102

SEQ ID NO: 441972 - RNA, 63 nt, hsa; identical to SEQ ID NO: 67103

SEQ ID NO: 441973 - RNA, 63 nt, hsa; identical to SEQ ID NO: 67104

SEQ ID NO: 441974 - RNA, 63 nt, hsa; identical to SEQ ID NO: 67105

SEQ ID NO: 441975 - RNA, 63 nt, hsa; identical to SEQ ID NO: 67106

SEQ ID NO: 441976 - RNA, 63 nt, hsa; identical to SEQ ID NO: 67107

SEQ ID NO: 441977 - RNA, 63 nt, hsa; identical to SEQ ID NO: 67108

SEQ ID NO: 441978 - RNA, 63 nt, hsa; identical to SEQ ID NO: 67109

SEQ ID NO: 441979 - RNA, 63 nt, hsa; identical to SEQ ID NO: 67110

SEQ ID NO: 441980 - RNA, 63 nt, hsa; identical to SEQ ID NO: 67111

SEQ ID NO: 441981 - RNA, 63 nt, hsa; identical to SEQ ID NO: 67112

SEQ ID NO: 441982 - RNA, 63 nt, hsa; identical to SEQ ID NO: 67113

SEQ ID NO: 441983 - RNA, 63 nt, hsa; identical to SEQ ID NO: 67114

SEQ ID NO: 441984 - RNA, 63 nt, hsa; identical to SEQ ID NO: 67115

SEQ ID NO: 441985 - RNA, 63 nt, hsa; identical to SEQ ID NO: 67116

SEQ ID NO: 441986 - RNA, 63 nt, hsa; identical to SEQ ID NO: 67117

SEQ ID NO: 441987 - RNA, 63 nt, hsa; identical to SEQ ID NO: 67118

SEQ ID NO: 441988 - RNA, 63 nt, hsa; identical to SEQ ID NO: 67119

SEQ ID NO: 441989 - RNA, 63 nt, hsa; identical to SEQ ID NO: 67120

SEQ ID NO: 441990 - RNA, 63 nt, hsa; identical to SEQ ID NO: 67121

SEQ ID NO: 441991 - RNA, 63 nt, hsa; identical to SEQ ID NO: 67122

SEQ ID NO: 441992 - RNA, 63 nt, hsa; identical to SEQ ID NO: 67123

SEQ ID NO: 441993 - RNA, 63 nt, hsa; identical to SEQ ID NO: 67124

SEQ ID NO: 441994 - RNA, 63 nt, hsa; identical to SEQ ID NO: 67125

SEQ ID NO: 441995 - RNA, 63 nt, hsa; identical to SEQ ID NO: 67126

SEQ ID NO: 441996 - RNA, 63 nt, hsa; identical to SEQ ID NO: 67127

SEQ ID NO: 441997 - RNA, 63 nt, hsa; identical to SEQ ID NO: 67128

SEQ ID NO: 441998 - RNA, 63 nt, hsa; identical to SEQ ID NO: 67129

SEQ ID NO: 441999 - RNA, 63 nt, hsa; identical to SEQ ID NO: 67130

SEQ ID NO: 442000 - RNA, 63 nt, hsa; identical to SEQ ID NO: 67131

SEQ ID NO: 442001 - RNA, 63 nt, hsa; identical to SEQ ID NO: 67132

SEQ ID NO: 442002 - RNA, 63 nt, hsa; identical to SEQ ID NO: 67133

SEQ ID NO: 442003 - RNA, 63 nt, hsa; identical to SEQ ID NO: 67134

SEQ ID NO: 442004 - RNA, 63 nt, hsa; identical to SEQ ID NO: 67135

SEQ ID NO: 442005 - RNA, 63 nt, hsa; identical to SEQ ID NO: 67136

SEQ ID NO: 442006 - RNA, 63 nt, hsa; identical to SEQ ID NO: 67137

SEQ ID NO: 442007 - RNA, 63 nt, hsa; identical to SEQ ID NO: 67138

SEQ ID NO: 442008 - RNA, 63 nt, hsa; identical to SEQ ID NO: 67139

SEQ ID NO: 442009 - RNA, 63 nt, hsa; identical to SEQ ID NO: 67140

SEQ ID NO: 442010 - RNA, 63 nt, hsa; identical to SEQ ID NO: 67141

SEQ ID NO: 442011 - RNA, 63 nt, hsa; identical to SEQ ID NO: 67142

SEQ ID NO: 442012 - RNA, 63 nt, hsa; identical to SEQ ID NO: 67143

SEQ ID NO: 442013 - RNA, 56 nt, hsa; identical to SEQ ID NO: 66425

SEQ ID NO: 442014 - RNA, 63 nt, hsa; identical to SEQ ID NO: 67145

SEQ ID NO: 442015 - RNA, 63 nt, hsa; identical to SEQ ID NO: 67146

SEQ ID NO: 442016 - RNA, 63 nt, hsa; identical to SEQ ID NO: 67147

SEQ ID NO: 442017 - RNA, 63 nt, hsa; identical to SEQ ID NO: 67148

SEQ ID NO: 442018 - RNA, 63 nt, hsa; identical to SEQ ID NO: 67149

SEQ ID NO: 442019 - RNA, 63 nt, hsa; identical to SEQ ID NO: 67150

SEQ ID NO: 442020 - RNA, 63 nt, hsa; identical to SEQ ID NO: 67151

SEQ ID NO: 442021 - RNA, 63 nt, hsa; identical to SEQ ID NO: 67152

SEQ ID NO: 442022 - RNA, 63 nt, hsa; identical to SEQ ID NO: 67153

SEQ ID NO: 442023 - RNA, 63 nt, hsa; identical to SEQ ID NO: 67154

SEQ ID NO: 442024 - RNA, 63 nt, hsa; identical to SEQ ID NO: 67155

SEQ ID NO: 442025 - RNA, 63 nt, hsa; identical to SEQ ID NO: 67156

SEQ ID NO: 442026 - RNA, 63 nt, hsa; identical to SEQ ID NO: 67157

SEQ ID NO: 442027 - RNA, 63 nt, hsa; identical to SEQ ID NO: 67158

SEQ ID NO: 442028 - RNA, 63 nt, hsa; identical to SEQ ID NO: 67159

SEQ ID NO: 442029 - RNA, 63 nt, hsa; identical to SEQ ID NO: 67160

SEQ ID NO: 442030 - RNA, 63 nt, hsa; identical to SEQ ID NO: 67161

SEQ ID NO: 442031 - RNA, 63 nt, hsa; identical to SEQ ID NO: 67162

SEQ ID NO: 442032 - RNA, 63 nt, hsa; identical to SEQ ID NO: 67163

SEQ ID NO: 442033 - RNA, 63 nt, hsa; identical to SEQ ID NO: 67164

SEQ ID NO: 442034 - RNA, 63 nt, hsa; identical to SEQ ID NO: 67165

SEQ ID NO: 442035 - RNA, 63 nt, hsa; identical to SEQ ID NO: 67166

SEQ ID NO: 442036 - RNA, 63 nt, hsa; identical to SEQ ID NO: 67167

SEQ ID NO: 442037 - RNA, 63 nt, hsa; identical to SEQ ID NO: 67168

SEQ ID NO: 442038 - RNA, 63 nt, hsa; identical to SEQ ID NO: 67169

SEQ ID NO: 442039 - RNA, 63 nt, hsa; identical to SEQ ID NO: 67170

SEQ ID NO: 442040 - RNA, 63 nt, hsa; identical to SEQ ID NO: 67171

SEQ ID NO: 442041 - RNA, 63 nt, hsa; identical to SEQ ID NO: 67172

SEQ ID NO: 442042 - RNA, 63 nt, hsa; identical to SEQ ID NO: 67173

SEQ ID NO: 442043 - RNA, 63 nt, hsa; identical to SEQ ID NO: 67174

SEQ ID NO: 442044 - RNA, 63 nt, hsa; identical to SEQ ID NO: 67175

SEQ ID NO: 442045 - RNA, 63 nt, hsa; identical to SEQ ID NO: 67176

SEQ ID NO: 442046 - RNA, 63 nt, hsa; identical to SEQ ID NO: 67177

SEQ ID NO: 442047 - RNA, 63 nt, hsa; identical to SEQ ID NO: 67178

SEQ ID NO: 442048 - RNA, 63 nt, hsa; identical to SEQ ID NO: 67179

SEQ ID NO: 442049 - RNA, 63 nt, hsa; identical to SEQ ID NO: 67180

SEQ ID NO: 442050 - RNA, 63 nt, hsa; identical to SEQ ID NO: 67181

SEQ ID NO: 442051 - RNA, 63 nt, hsa; identical to SEQ ID NO: 67182

SEQ ID NO: 442052 - RNA, 63 nt, hsa; identical to SEQ ID NO: 67183

SEQ ID NO: 442053 - RNA, 63 nt, hsa; identical to SEQ ID NO: 67184

SEQ ID NO: 442054 - RNA, 63 nt, hsa; identical to SEQ ID NO: 67185

SEQ ID NO: 442055 - RNA, 63 nt, hsa; identical to SEQ ID NO: 67186

SEQ ID NO: 442056 - RNA, 63 nt, hsa; identical to SEQ ID NO: 67187

SEQ ID NO: 442057 - RNA, 63 nt, hsa; identical to SEQ ID NO: 67188

SEQ ID NO: 442058 - RNA, 63 nt, hsa; identical to SEQ ID NO: 67189

SEQ ID NO: 442059 - RNA, 63 nt, hsa; identical to SEQ ID NO: 67190

SEQ ID NO: 442060 - RNA, 63 nt, hsa; identical to SEQ ID NO: 67191

SEQ ID NO: 442061 - RNA, 63 nt, hsa; identical to SEQ ID NO: 67192

SEQ ID NO: 442062 - RNA, 63 nt, hsa; identical to SEQ ID NO: 67193

SEQ ID NO: 442063 - RNA, 63 nt, hsa; identical to SEQ ID NO: 67194

SEQ ID NO: 442064 - RNA, 63 nt, hsa; identical to SEQ ID NO: 67195

SEQ ID NO: 442065 - RNA, 63 nt, hsa; identical to SEQ ID NO: 67196

SEQ ID NO: 442066 - RNA, 63 nt, hsa; identical to SEQ ID NO: 67197

SEQ ID NO: 442067 - RNA, 63 nt, hsa; identical to SEQ ID NO: 67198

SEQ ID NO: 442068 - RNA, 63 nt, hsa; identical to SEQ ID NO: 67199

SEQ ID NO: 442069 - RNA, 63 nt, hsa; identical to SEQ ID NO: 67200

SEQ ID NO: 442070 - RNA, 63 nt, hsa; identical to SEQ ID NO: 67201

SEQ ID NO: 442071 - RNA, 63 nt, hsa; identical to SEQ ID NO: 67202

SEQ ID NO: 442072 - RNA, 63 nt, hsa; identical to SEQ ID NO: 67203

SEQ ID NO: 442073 - RNA, 63 nt, hsa; identical to SEQ ID NO: 67204

SEQ ID NO: 442074 - RNA, 63 nt, hsa; identical to SEQ ID NO: 67205

SEQ ID NO: 442075 - RNA, 63 nt, hsa; identical to SEQ ID NO: 67206

SEQ ID NO: 442076 - RNA, 63 nt, hsa; identical to SEQ ID NO: 67207

SEQ ID NO: 442077 - RNA, 63 nt, hsa; identical to SEQ ID NO: 67208

SEQ ID NO: 442078 - RNA, 63 nt, hsa; identical to SEQ ID NO: 67209

SEQ ID NO: 442079 - RNA, 63 nt, hsa; identical to SEQ ID NO: 67210

SEQ ID NO: 442080 - RNA, 63 nt, hsa; identical to SEQ ID NO: 67211

SEQ ID NO: 442081 - RNA, 63 nt, hsa; identical to SEQ ID NO: 67212

SEQ ID NO: 442082 - RNA, 63 nt, hsa; identical to SEQ ID NO: 67213

SEQ ID NO: 442083 - RNA, 63 nt, hsa; identical to SEQ ID NO: 67214

SEQ ID NO: 442084 - RNA, 63 nt, hsa; identical to SEQ ID NO: 67215

SEQ ID NO: 442085 - RNA, 63 nt, hsa; identical to SEQ ID NO: 67216

SEQ ID NO: 442086 - RNA, 63 nt, hsa; identical to SEQ ID NO: 67217

SEQ ID NO: 442087 - RNA, 63 nt, hsa; identical to SEQ ID NO: 67218

SEQ ID NO: 442088 - RNA, 63 nt, hsa; identical to SEQ ID NO: 67219

SEQ ID NO: 442089 - RNA, 63 nt, hsa; identical to SEQ ID NO: 67220

SEQ ID NO: 442090 - RNA, 63 nt, hsa; identical to SEQ ID NO: 67221

SEQ ID NO: 442091 - RNA, 63 nt, hsa; identical to SEQ ID NO: 67222

SEQ ID NO: 442092 - RNA, 63 nt, hsa; identical to SEQ ID NO: 67223

SEQ ID NO: 442093 - RNA, 63 nt, hsa; identical to SEQ ID NO: 67224

SEQ ID NO: 442094 - RNA, 63 nt, hsa; identical to SEQ ID NO: 67211

SEQ ID NO: 442095 - RNA, 63 nt, hsa; identical to SEQ ID NO: 67226

SEQ ID NO: 442096 - RNA, 63 nt, hsa; identical to SEQ ID NO: 67227

SEQ ID NO: 442097 - RNA, 63 nt, hsa; identical to SEQ ID NO: 67228

SEQ ID NO: 442098 - RNA, 63 nt, hsa; identical to SEQ ID NO: 67229

SEQ ID NO: 442099 - RNA, 63 nt, hsa; identical to SEQ ID NO: 67230

SEQ ID NO: 442100 - RNA, 63 nt, hsa; identical to SEQ ID NO: 67231

SEQ ID NO: 442101 - RNA, 63 nt, hsa; identical to SEQ ID NO: 67232

SEQ ID NO: 442102 - RNA, 63 nt, hsa; identical to SEQ ID NO: 67233

SEQ ID NO: 442103 - RNA, 63 nt, hsa; identical to SEQ ID NO: 67234

SEQ ID NO: 442104 - RNA, 63 nt, hsa; identical to SEQ ID NO: 67235

SEQ ID NO: 442105 - RNA, 63 nt, hsa; identical to SEQ ID NO: 67236

SEQ ID NO: 442106 - RNA, 63 nt, hsa; identical to SEQ ID NO: 67237

SEQ ID NO: 442107 - RNA, 63 nt, hsa; identical to SEQ ID NO: 67238

SEQ ID NO: 442108 - RNA, 63 nt, hsa; identical to SEQ ID NO: 67239

SEQ ID NO: 442109 - RNA, 63 nt, hsa; identical to SEQ ID NO: 67240

SEQ ID NO: 442110 - RNA, 63 nt, hsa; identical to SEQ ID NO: 67241

SEQ ID NO: 442111 - RNA, 63 nt, hsa; identical to SEQ ID NO: 67242

SEQ ID NO: 442112 - RNA, 63 nt, hsa; identical to SEQ ID NO: 67243

SEQ ID NO: 442113 - RNA, 63 nt, hsa; identical to SEQ ID NO: 67244

SEQ ID NO: 442114 - RNA, 63 nt, hsa; identical to SEQ ID NO: 67245

SEQ ID NO: 442115 - RNA, 63 nt, hsa; identical to SEQ ID NO: 67246

SEQ ID NO: 442116 - RNA, 63 nt, hsa; identical to SEQ ID NO: 67247

SEQ ID NO: 442117 - RNA, 63 nt, hsa; identical to SEQ ID NO: 67248

SEQ ID NO: 442118 - RNA, 63 nt, hsa; identical to SEQ ID NO: 67249

SEQ ID NO: 442119 - RNA, 63 nt, hsa; identical to SEQ ID NO: 67250

SEQ ID NO: 442120 - RNA, 63 nt, hsa; identical to SEQ ID NO: 67251

SEQ ID NO: 442121 - RNA, 63 nt, hsa; identical to SEQ ID NO: 67252

SEQ ID NO: 442122 - RNA, 63 nt, hsa; identical to SEQ ID NO: 67253

SEQ ID NO: 442123 - RNA, 63 nt, hsa; identical to SEQ ID NO: 67254

SEQ ID NO: 442124 - RNA, 63 nt, hsa; identical to SEQ ID NO: 67255

SEQ ID NO: 442125 - RNA, 63 nt, hsa; identical to SEQ ID NO: 67256

SEQ ID NO: 442126 - RNA, 63 nt, hsa; identical to SEQ ID NO: 67257

SEQ ID NO: 442127 - RNA, 63 nt, hsa; identical to SEQ ID NO: 67258

SEQ ID NO: 442128 - RNA, 63 nt, hsa; identical to SEQ ID NO: 67259

SEQ ID NO: 442129 - RNA, 63 nt, hsa; identical to SEQ ID NO: 67260

SEQ ID NO: 442130 - RNA, 63 nt, hsa; identical to SEQ ID NO: 67261

SEQ ID NO: 442131 - RNA, 63 nt, hsa; identical to SEQ ID NO: 67262

SEQ ID NO: 442132 - RNA, 63 nt, hsa; identical to SEQ ID NO: 67263

SEQ ID NO: 442133 - RNA, 63 nt, hsa; identical to SEQ ID NO: 67264

SEQ ID NO: 442134 - RNA, 63 nt, hsa; identical to SEQ ID NO: 67265

SEQ ID NO: 442135 - RNA, 63 nt, hsa; identical to SEQ ID NO: 67266

SEQ ID NO: 442136 - RNA, 63 nt, hsa; identical to SEQ ID NO: 67267

SEQ ID NO: 442137 - RNA, 63 nt, hsa; identical to SEQ ID NO: 67268

SEQ ID NO: 442138 - RNA, 63 nt, hsa; identical to SEQ ID NO: 67269

SEQ ID NO: 442139 - RNA, 63 nt, hsa; identical to SEQ ID NO: 67270

SEQ ID NO: 442140 - RNA, 63 nt, hsa; identical to SEQ ID NO: 67271

SEQ ID NO: 442141 - RNA, 63 nt, hsa; identical to SEQ ID NO: 67272

SEQ ID NO: 442142 - RNA, 63 nt, hsa; identical to SEQ ID NO: 67273

SEQ ID NO: 442143 - RNA, 63 nt, hsa; identical to SEQ ID NO: 67274

SEQ ID NO: 442144 - RNA, 63 nt, hsa; identical to SEQ ID NO: 67275

SEQ ID NO: 442145 - RNA, 63 nt, hsa; identical to SEQ ID NO: 67276

SEQ ID NO: 442146 - RNA, 63 nt, hsa; identical to SEQ ID NO: 67277

SEQ ID NO: 442147 - RNA, 63 nt, hsa; identical to SEQ ID NO: 67278

SEQ ID NO: 442148 - RNA, 63 nt, hsa; identical to SEQ ID NO: 67279

SEQ ID NO: 442149 - RNA, 63 nt, hsa; identical to SEQ ID NO: 67280

SEQ ID NO: 442150 - RNA, 63 nt, hsa; identical to SEQ ID NO: 67281

SEQ ID NO: 442151 - RNA, 63 nt, hsa; identical to SEQ ID NO: 67282

SEQ ID NO: 442152 - RNA, 63 nt, hsa; identical to SEQ ID NO: 67283

SEQ ID NO: 442153 - RNA, 63 nt, hsa; identical to SEQ ID NO: 67284

SEQ ID NO: 442154 - RNA, 63 nt, hsa; identical to SEQ ID NO: 67285

SEQ ID NO: 442155 - RNA, 63 nt, hsa; identical to SEQ ID NO: 67286

SEQ ID NO: 442156 - RNA, 63 nt, hsa; identical to SEQ ID NO: 67287

SEQ ID NO: 442157 - RNA, 63 nt, hsa; identical to SEQ ID NO: 67288

SEQ ID NO: 442158 - RNA, 63 nt, hsa; identical to SEQ ID NO: 67289

SEQ ID NO: 442159 - RNA, 63 nt, hsa; identical to SEQ ID NO: 67290

SEQ ID NO: 442160 - RNA, 63 nt, hsa; identical to SEQ ID NO: 67291

SEQ ID NO: 442161 - RNA, 63 nt, hsa; identical to SEQ ID NO: 67292

SEQ ID NO: 442162 - RNA, 63 nt, hsa; identical to SEQ ID NO: 67293

SEQ ID NO: 442163 - RNA, 63 nt, hsa; identical to SEQ ID NO: 67294

SEQ ID NO: 442164 - RNA, 63 nt, hsa; identical to SEQ ID NO: 67295

SEQ ID NO: 442165 - RNA, 63 nt, hsa; identical to SEQ ID NO: 67296

SEQ ID NO: 442166 - RNA, 63 nt, hsa; identical to SEQ ID NO: 67297

SEQ ID NO: 442167 - RNA, 63 nt, hsa; identical to SEQ ID NO: 67298

SEQ ID NO: 442168 - RNA, 63 nt, hsa; identical to SEQ ID NO: 67299

SEQ ID NO: 442169 - RNA, 63 nt, hsa; identical to SEQ ID NO: 67300

SEQ ID NO: 442170 - RNA, 63 nt, hsa; identical to SEQ ID NO: 67301

SEQ ID NO: 442171 - RNA, 63 nt, hsa; identical to SEQ ID NO: 67302

SEQ ID NO: 442172 - RNA, 63 nt, hsa; identical to SEQ ID NO: 67303

SEQ ID NO: 442173 - RNA, 63 nt, hsa; identical to SEQ ID NO: 67304

SEQ ID NO: 442174 - RNA, 63 nt, hsa; identical to SEQ ID NO: 67305

SEQ ID NO: 442175 - RNA, 63 nt, hsa; identical to SEQ ID NO: 67306

SEQ ID NO: 442176 - RNA, 63 nt, hsa; identical to SEQ ID NO: 67307

SEQ ID NO: 442177 - RNA, 63 nt, hsa; identical to SEQ ID NO: 67308

SEQ ID NO: 442178 - RNA, 63 nt, hsa; identical to SEQ ID NO: 67309

SEQ ID NO: 442179 - RNA, 63 nt, hsa; identical to SEQ ID NO: 67310

SEQ ID NO: 442180 - RNA, 63 nt, hsa; identical to SEQ ID NO: 67311

SEQ ID NO: 442181 - RNA, 63 nt, hsa; identical to SEQ ID NO: 67312

SEQ ID NO: 442182 - RNA, 63 nt, hsa; identical to SEQ ID NO: 67313

SEQ ID NO: 442183 - RNA, 63 nt, hsa; identical to SEQ ID NO: 67314

SEQ ID NO: 442184 - RNA, 63 nt, hsa; identical to SEQ ID NO: 67315

SEQ ID NO: 442185 - RNA, 63 nt, hsa; identical to SEQ ID NO: 67316

SEQ ID NO: 442186 - RNA, 63 nt, hsa; identical to SEQ ID NO: 67317

SEQ ID NO: 442187 - RNA, 63 nt, hsa; identical to SEQ ID NO: 67318

SEQ ID NO: 442188 - RNA, 62 nt, hsa; identical to SEQ ID NO: 67319

SEQ ID NO: 442189 - RNA, 63 nt, hsa; identical to SEQ ID NO: 67320

SEQ ID NO: 442190 - RNA, 63 nt, hsa; identical to SEQ ID NO: 67321

SEQ ID NO: 442191 - RNA, 63 nt, hsa; identical to SEQ ID NO: 67322

SEQ ID NO: 442192 - RNA, 63 nt, hsa; identical to SEQ ID NO: 67323

SEQ ID NO: 442193 - RNA, 63 nt, hsa; identical to SEQ ID NO: 67324

SEQ ID NO: 442194 - RNA, 63 nt, hsa; identical to SEQ ID NO: 67325

SEQ ID NO: 442195 - RNA, 63 nt, hsa; identical to SEQ ID NO: 67326

SEQ ID NO: 442196 - RNA, 63 nt, hsa; identical to SEQ ID NO: 67327

SEQ ID NO: 442197 - RNA, 63 nt, hsa; identical to SEQ ID NO: 67328

SEQ ID NO: 442198 - RNA, 63 nt, hsa; identical to SEQ ID NO: 67329

SEQ ID NO: 442199 - RNA, 63 nt, hsa; identical to SEQ ID NO: 67330

SEQ ID NO: 442200 - RNA, 63 nt, hsa; identical to SEQ ID NO: 67331

SEQ ID NO: 442201 - RNA, 63 nt, hsa; identical to SEQ ID NO: 67332

SEQ ID NO: 442202 - RNA, 63 nt, hsa; identical to SEQ ID NO: 67333

SEQ ID NO: 442203 - RNA, 63 nt, hsa; identical to SEQ ID NO: 67334

SEQ ID NO: 442204 - RNA, 63 nt, hsa; identical to SEQ ID NO: 67335

SEQ ID NO: 442205 - RNA, 63 nt, hsa; identical to SEQ ID NO: 67336

SEQ ID NO: 442206 - RNA, 63 nt, hsa; identical to SEQ ID NO: 67337

SEQ ID NO: 442207 - RNA, 63 nt, hsa; identical to SEQ ID NO: 67338

SEQ ID NO: 442208 - RNA, 63 nt, hsa; identical to SEQ ID NO: 67339

SEQ ID NO: 442209 - RNA, 63 nt, hsa; identical to SEQ ID NO: 67340

SEQ ID NO: 442210 - RNA, 63 nt, hsa; identical to SEQ ID NO: 67341

SEQ ID NO: 442211 - RNA, 62 nt, hsa; identical to SEQ ID NO: 67342

SEQ ID NO: 442212 - RNA, 63 nt, hsa; identical to SEQ ID NO: 67343

SEQ ID NO: 442213 - RNA, 63 nt, hsa; identical to SEQ ID NO: 67344

SEQ ID NO: 442214 - RNA, 63 nt, hsa; identical to SEQ ID NO: 67345

SEQ ID NO: 442215 - RNA, 61 nt, hsa; identical to SEQ ID NO: 67346

SEQ ID NO: 442216 - RNA, 63 nt, hsa; identical to SEQ ID NO: 67347

SEQ ID NO: 442217 - RNA, 63 nt, hsa; identical to SEQ ID NO: 67348

SEQ ID NO: 442218 - RNA, 63 nt, hsa; identical to SEQ ID NO: 67349

SEQ ID NO: 442219 - RNA, 63 nt, hsa; identical to SEQ ID NO: 67350

SEQ ID NO: 442220 - RNA, 63 nt, hsa; identical to SEQ ID NO: 67351

SEQ ID NO: 442221 - RNA, 63 nt, hsa; identical to SEQ ID NO: 67352

SEQ ID NO: 442222 - RNA, 63 nt, hsa; identical to SEQ ID NO: 67353

SEQ ID NO: 442223 - RNA, 63 nt, hsa; identical to SEQ ID NO: 67354

SEQ ID NO: 442224 - RNA, 63 nt, hsa; identical to SEQ ID NO: 67355

SEQ ID NO: 442225 - RNA, 63 nt, hsa; identical to SEQ ID NO: 67356

SEQ ID NO: 442226 - RNA, 63 nt, hsa; identical to SEQ ID NO: 67357

SEQ ID NO: 442227 - RNA, 63 nt, hsa; identical to SEQ ID NO: 67358

SEQ ID NO: 442228 - RNA, 63 nt, hsa; identical to SEQ ID NO: 67359

SEQ ID NO: 442229 - RNA, 63 nt, hsa; identical to SEQ ID NO: 67360

SEQ ID NO: 442230 - RNA, 63 nt, hsa; identical to SEQ ID NO: 67361

SEQ ID NO: 442231 - RNA, 63 nt, hsa; identical to SEQ ID NO: 67362

SEQ ID NO: 442232 - RNA, 63 nt, hsa; identical to SEQ ID NO: 67363

SEQ ID NO: 442233 - RNA, 63 nt, hsa; identical to SEQ ID NO: 67364

SEQ ID NO: 442234 - RNA, 63 nt, hsa; identical to SEQ ID NO: 67365

SEQ ID NO: 442235 - RNA, 63 nt, hsa; identical to SEQ ID NO: 67366

SEQ ID NO: 442236 - RNA, 63 nt, hsa; identical to SEQ ID NO: 67367

SEQ ID NO: 442237 - RNA, 63 nt, hsa; identical to SEQ ID NO: 67368

SEQ ID NO: 442238 - RNA, 63 nt, hsa; identical to SEQ ID NO: 67369

SEQ ID NO: 442239 - RNA, 63 nt, hsa; identical to SEQ ID NO: 67370

SEQ ID NO: 442240 - RNA, 63 nt, hsa; identical to SEQ ID NO: 67371

SEQ ID NO: 442241 - RNA, 63 nt, hsa; identical to SEQ ID NO: 67372

SEQ ID NO: 442242 - RNA, 63 nt, hsa; identical to SEQ ID NO: 67373

SEQ ID NO: 442243 - RNA, 63 nt, hsa; identical to SEQ ID NO: 67374

SEQ ID NO: 442244 - RNA, 63 nt, hsa; identical to SEQ ID NO: 67375

SEQ ID NO: 442245 - RNA, 63 nt, hsa; identical to SEQ ID NO: 67376

SEQ ID NO: 442246 - RNA, 63 nt, hsa; identical to SEQ ID NO: 67377

SEQ ID NO: 442247 - RNA, 63 nt, hsa; identical to SEQ ID NO: 66907

SEQ ID NO: 442248 - RNA, 63 nt, hsa; identical to SEQ ID NO: 67379

SEQ ID NO: 442249 - RNA, 63 nt, hsa; identical to SEQ ID NO: 67380

SEQ ID NO: 442250 - RNA, 63 nt, hsa; identical to SEQ ID NO: 67381

SEQ ID NO: 442251 - RNA, 63 nt, hsa; identical to SEQ ID NO: 67382

SEQ ID NO: 442252 - RNA, 63 nt, hsa; identical to SEQ ID NO: 67383

SEQ ID NO: 442253 - RNA, 63 nt, hsa; identical to SEQ ID NO: 67384

SEQ ID NO: 442254 - RNA, 63 nt, hsa; identical to SEQ ID NO: 67385

SEQ ID NO: 442255 - RNA, 63 nt, hsa; identical to SEQ ID NO: 67386

SEQ ID NO: 442256 - RNA, 63 nt, hsa; identical to SEQ ID NO: 67387

SEQ ID NO: 442257 - RNA, 63 nt, hsa; identical to SEQ ID NO: 67388

SEQ ID NO: 442258 - RNA, 63 nt, hsa; identical to SEQ ID NO: 67389

SEQ ID NO: 442259 - RNA, 63 nt, hsa; identical to SEQ ID NO: 67390

SEQ ID NO: 442260 - RNA, 63 nt, hsa; identical to SEQ ID NO: 67391

SEQ ID NO: 442261 - RNA, 63 nt, hsa; identical to SEQ ID NO: 67392

SEQ ID NO: 442262 - RNA, 63 nt, hsa; identical to SEQ ID NO: 67393

SEQ ID NO: 442263 - RNA, 63 nt, hsa; identical to SEQ ID NO: 67394

SEQ ID NO: 442264 - RNA, 63 nt, hsa; identical to SEQ ID NO: 67395

SEQ ID NO: 442265 - RNA, 63 nt, hsa; identical to SEQ ID NO: 67396

SEQ ID NO: 442266 - RNA, 63 nt, hsa; identical to SEQ ID NO: 67397

SEQ ID NO: 442267 - RNA, 63 nt, hsa; identical to SEQ ID NO: 67398

SEQ ID NO: 442268 - RNA, 63 nt, hsa; identical to SEQ ID NO: 67399

SEQ ID NO: 442269 - RNA, 63 nt, hsa; identical to SEQ ID NO: 67400

SEQ ID NO: 442270 - RNA, 63 nt, hsa; identical to SEQ ID NO: 67401

SEQ ID NO: 442271 - RNA, 63 nt, hsa; identical to SEQ ID NO: 67402

SEQ ID NO: 442272 - RNA, 63 nt, hsa; identical to SEQ ID NO: 67403

SEQ ID NO: 442273 - RNA, 63 nt, hsa; identical to SEQ ID NO: 67404

SEQ ID NO: 442274 - RNA, 63 nt, hsa; identical to SEQ ID NO: 67405

SEQ ID NO: 442275 - RNA, 63 nt, hsa; identical to SEQ ID NO: 67406

SEQ ID NO: 442276 - RNA, 63 nt, hsa; identical to SEQ ID NO: 67407

SEQ ID NO: 442277 - RNA, 63 nt, hsa; identical to SEQ ID NO: 67408

SEQ ID NO: 442278 - RNA, 63 nt, hsa; identical to SEQ ID NO: 67409

SEQ ID NO: 442279 - RNA, 63 nt, hsa; identical to SEQ ID NO: 67410

SEQ ID NO: 442280 - RNA, 64 nt, hsa
ucauaguuaauacagguauaucuauuuuuauuuacuuuguaagaaacaagcucaaggagcuucc

SEQ ID NO: 442281 - RNA, 64 nt, hsa
uaguuaauaauaaaugcuguaaauaagcaucucacuuuguaaaaauaaaauauugugguuuugu

SEQ ID NO: 442282 - RNA, 64 nt, hsa
aggcccugccccuggcuccuuaaaugccccgucucuuuguaaacugauauucagccagcaaugc

SEQ ID NO: 442283 - RNA, 64 nt, hsa
agccggccgccuucuccccucucccagggaugcucuuuguaaauaucggaugggugugggagug

SEQ ID NO: 442284 - RNA, 64 nt, hsa
gggggucccuuuucaucccuucucugacagauugcuuuguaaacuuucuuaggccuucccccca

SEQ ID NO: 442285 - RNA, 64 nt, hsa
aaaggucaauuauacuuuuguuguucauuagcaucuuuguaaacuauaagacguaguuuuaauu

SEQ ID NO: 442286 - RNA, 64 nt, hsa
agagguuugcaugcugguaaugcaaccuuugaaacuuuguaaaggaaacauauauguauauauu

SEQ ID NO: 442287 - RNA, 64 nt, hsa
caaauguauuauuuuggugacaaaaaugaaggagcuuuguaaauuuuuuuuaaaauuaugaauc

SEQ ID NO: 442288 - RNA, 64 nt, hsa
cuguggggaggcauaagcugauguuuguaaagcgcuuuguaaauaaacgugcucucugaaugcc

SEQ ID NO: 442289 - RNA, 64 nt, hsa
cuuuuugagauacuauuuucauuuuugugagccucuuuguaauaaaaugguacauuucuauauc

SEQ ID NO: 442290 - RNA, 64 nt, hsa
ucccacccacaaugcaugagagugccuauuaaaucuuuguaaguguuaucaaauguuuugaucu

SEQ ID NO: 442291 - RNA, 64 nt, hsa
guuccucuggcagccaauaaaaucaucauaagcccuuuguaauaaaaagcuaguuuccugagug

SEQ ID NO: 442292 - RNA, 64 nt, hsa
cuguauauucuauacaaagguacuuguccuuucccuuuguaaacuacauuugacauggauuaaa

SEQ ID NO: 442293 - RNA, 64 nt, hsa
uugcauuauagaggaauguaguaugucauaaguacuuuguaaagauuugacauucaacuguagu

SEQ ID NO: 442294 - RNA, 64 nt, hsa
uguaauuucucauauggugcuggaaaugguugggcuuuguaacauuugaaguguuuccauggua

SEQ ID NO: 442295 - RNA, 64 nt, hsa
gaguaaagugcaauuucauuggauagcuaaauaucuuuguaagauagagauuguugaaaauucu

SEQ ID NO: 442296 - RNA, 64 nt, hsa
uguggcauguugauuucuauggccaacuuucucucuuuguaaaacaaagauugauugauuuucu

SEQ ID NO: 442297 - RNA, 64 nt, hsa
auuuaauacagcagagcauggcaugaccaagcaucuuuguaaaguguuagauggaaaaugcugu

SEQ ID NO: 442298 - RNA, 64 nt, hsa
acauaaugacauaauuuaguuucauguaaugaaacuuuguaaacagaauacauacauguguaua

SEQ ID NO: 442299 - RNA, 64 nt, hsa
uguuuacuguuaugagguagaauaaaaaagaauacuuuguaauagccacaaguucuuguuuaga

SEQ ID NO: 442300 - RNA, 64 nt, hsa
uuuguguccaguuauauuauuuaaaaaaguguuacuuuguaaaaauuguauauaaagaacugua

SEQ ID NO: 442301 - RNA, 64 nt, hsa
uugaugaacacauuaauccguuaaguaaaauggacuuuguaauuguacagcauaccuaagaaac

SEQ ID NO: 442302 - RNA, 64 nt, hsa
aacaucuaaaguguauuaacagugcaugcuuuuacuuuguaaauguggugccaaaucccuguuu

SEQ ID NO: 442303 - RNA, 64 nt, hsa
acugacuucugguuuccacuguaucaguauguaccuuuguaauuguuauuuuuaugucuuuuau

SEQ ID NO: 442304 - RNA, 64 nt, hsa
agggcucugugucagggaaaaccuucuggguggacuuuguaagaauccaguuuccaagguuaga

SEQ ID NO: 442305 - RNA, 64 nt, hsa
uggauucucauagacaacuggguaacuuauauuucuuuguaaucaagacuugagauaucgaagu

SEQ ID NO: 442306 - RNA, 64 nt, hsa
aaacaagccuuggaaauaaaucucuauuaaaccgcuuuguaaccaagcucugguacccucuguc

SEQ ID NO: 442307 - RNA, 64 nt, hsa
gaacacaucgugaugaugacguccucucaacucucuuuguaaaaauuuuguuauuuuugcuugu

SEQ ID NO: 442308 - RNA, 64 nt, hsa
accaauuuugugcuaaugagcauugagacugaugcuuuguaagucacaccacaacaaauauuga

SEQ ID NO: 442309 - RNA, 64 nt, hsa
ccuauuuuauuuuucuauaaugaucauauauuaccuuuguaauaaaacauuauaaccaaaacau

SEQ ID NO: 442310 - RNA, 64 nt, hsa
uaagccucucgagggugaggccuagccuucuugucuuuguaacccacagcagcugguacugugc

SEQ ID NO: 442311 - RNA, 64 nt, hsa
aaaggguuuucaauaggguguagaccuccaguaccuuuguaacuaaagucugucuagucauugu

SEQ ID NO: 442312 - RNA, 64 nt, hsa
aaaauuuuaucucuuauucaguaaaaaacaacuucuuuguaaucguuauguguguauauguaug

SEQ ID NO: 442313 - RNA, 64 nt, hsa
gcauguguagccucuccuggucauagaccagucucuuuguaaguuauuguggcaguucacacag

SEQ ID NO: 442314 - RNA, 64 nt, hsa
uagagaaauauaguucacaaugaaauuauauuuucuuuguaaagaaaguggcuugaaaucuuuu

SEQ ID NO: 442315 - RNA, 64 nt, hsa
cagugaucuugaaccauuguuuuauauuuuucaccuuuguaaccucauggaaagaggcuuuaca

SEQ ID NO: 442316 - RNA, 64 nt, hsa
aaaaaguugaaggccuuauucuacauuucaccuacuuuguaagugagagagacaagaagcaaau

SEQ ID NO: 442317 - RNA, 64 nt, hsa
gaacucagcuacacucucugauuuugugcuacuccuuuguaaagucacugccuuaagggggcug

SEQ ID NO: 442318 - RNA, 64 nt, hsa
uuugaauuuuugcugguuaaccuuuaucauuuaucuuuguaaugugaacaugcuucagagugua

SEQ ID NO: 442319 - RNA, 64 nt, hsa
aaaaaaaaaaaaucacuuggcgcaggagggagaacuuuguaagaagcugcccucuguuuuuuuu

SEQ ID NO: 442320 - RNA, 64 nt, hsa
uuccuaaaccaggaagcugcguuagccgaucaggcuuuguaagaucucgccaacagcuagcugc

SEQ ID NO: 442321 - RNA, 64 nt, hsa
uuuuguuuccuucucccuuccccuuuucccuguacuuuguaaugucaguguuuauaugaauaug

SEQ ID NO: 442322 - RNA, 64 nt, hsa
ccaaaaaaggaaucaaauccacgaguggaaaagccuuuguaaauuuaauuuuauuacacauaac

SEQ ID NO: 442323 - RNA, 64 nt, hsa
uccgggcucaucuguaccaaggacauagaacauucuuuguaacccgaauguucccuggauguug

SEQ ID NO: 442324 - RNA, 64 nt, hsa
uccuuagccuaaagaaugaucuguuguuugaaaccuuuguaacuuguuuguaugaguaaagaaa

SEQ ID NO: 442325 - RNA, 64 nt, hsa
aacaagccugguaggaaagggcaagucuuuaggucuuuguaagaacuaaagaagaucuguaauu

SEQ ID NO: 442326 - RNA, 64 nt, hsa
aaaccacuaucuugcacugcuaacuuuuuucuaccuuuguaaauagaaacauuucugcauaaaa

SEQ ID NO: 442327 - RNA, 64 nt, hsa
gauauuuauguucacacaggaauuugguuuacugcuuuguaaauaaaaggaaaaacuccgggua

SEQ ID NO: 442328 - RNA, 64 nt, hsa
gaaagcugauuacugucaauaaacagcuucaugccuuuguaaguuauuucuuguuuguuuguuu

SEQ ID NO: 442329 - RNA, 64 nt, hsa
uuaauuuuuggaauuugggaagcagacagcuuuacuuuguaagguuggaacagcagcacuauac

SEQ ID NO: 442330 - RNA, 64 nt, hsa
ugaugcaugucuuuuaaaaugcaauguaagcauacuuuguaaauaggauuuuuagaauuaaaaa

SEQ ID NO: 442331 - RNA, 64 nt, hsa
augaauaauguaagguaaagaguugcaugucagucuuuguaauuauuuacacuuuaacuuucuc

SEQ ID NO: 442332 - RNA, 64 nt, hsa
uuauguuuaaucaauugcaagcaaauagauuuuucuuuguaacaauuuguucugcagaaggcug

SEQ ID NO: 442333 - RNA, 64 nt, hsa
uccuccugcauuuguugauaccacuaacaaaaugcuuuguaacagacuugcgguuaauuaugca

SEQ ID NO: 442334 - RNA, 64 nt, hsa
uuuaugaauuggaagugauguuggcuuuaguuaucuuuguaaauaagguaauuagaaugguaug

SEQ ID NO: 442335 - RNA, 64 nt, hsa
gagguuuugaucucuggguaaagaggccguuuaucuuuguaaacacgaaacauuuuugcuuucu

SEQ ID NO: 442336 - RNA, 64 nt, hsa
guauucucagauagauguuacagggcuucuuauucuuuguaauguacucuuuuuaaaucccuuu

SEQ ID NO: 442337 - RNA, 64 nt, hsa
ggcuuuuaaaacguauguuuguaugguagagaaacuuuguaaaagaagaauccaagagaaguuu

SEQ ID NO: 442338 - RNA, 64 nt, hsa
ccgagaugccuuugacauuuugggcugaaguguucuuuguaaggaaaaccuguuuccuauuuug

SEQ ID NO: 442339 - RNA, 64 nt, hsa
cuuuccccuuuaaaaggaauuagcuauagaacugcuuuguaaagaugcuucuugauauuuuacu

SEQ ID NO: 442340 - RNA, 64 nt, hsa
ggccaaccagcccaaaauuauuucaucuuguauucuuuguaaaauucucccucaccccacccug

SEQ ID NO: 442341 - RNA, 64 nt, hsa
uucccucccugccucccccagcucccacacuggccuuuguaaauaaauggcguggucuuuguug

SEQ ID NO: 442342 - RNA, 64 nt, hsa
uguauaggaagaagcaaagucuacagcacauagucuuuguaagggauugaugugaacacuuuuu

SEQ ID NO: 442343 - RNA, 64 nt, hsa
cuuuccaugaaucauuguggugguugagauggagcuuuguaaugggaauaaaacaguaccuuag

SEQ ID NO: 442344 - RNA, 64 nt, hsa
ccggucacuauauaaagcaaauaaacuuaaaacacuuuguaaccauguauuuacucugccaggu

SEQ ID NO: 442345 - RNA, 64 nt, hsa
cuuuagcaaccugucuuggcccuaaugagaaacccuuuguaagugggcucuggauuuuugguuu

SEQ ID NO: 442346 - RNA, 64 nt, hsa
uuauagcuagagaaacaauauuacugccuuugcucuuuguaacuaugucuguuuucuuuuuugu

SEQ ID NO: 442347 - RNA, 64 nt, hsa
guggguugugcauccccaauccagauaauaaagacuuuguaaaacaugaauaaaacacauuuua

SEQ ID NO: 442348 - RNA, 64 nt, hsa
ggcggcugagcuccagccaccccgcagucacuuucuuuguaacaacuuccguugcugccaucgu

SEQ ID NO: 442349 - RNA, 64 nt, hsa
aauggcuaauuuucaguugcuaauuaauuagcagcuuuguaauacuugauuugggagcauuuac

SEQ ID NO: 442350 - RNA, 64 nt, hsa
cuguucuguuuggcacuuguauuuaauucuucaccuuuguaagacauuuguauauuguggaugu

SEQ ID NO: 442351 - RNA, 64 nt, hsa
uugucgggagauugaaagauguuuuuguuucuuucuuuguaaaggccuuggauauugaaaaaau

SEQ ID NO: 442352 - RNA, 64 nt, hsa
uugggaaagaggucaacugagauuuggaaaucaucuuuguaauauuugcaaauuauacuuguuc

SEQ ID NO: 442353 - RNA, 64 nt, hsa
cucagaaaaccacaguguguuuucauauuuggaacuuuguaauagcgggaguagcaguagucca

SEQ ID NO: 442354 - RNA, 64 nt, hsa
auaguguauuucuuucuugaauuucagucugcugcuuuguaaaaaauaacuguaauugauauuu

SEQ ID NO: 442355 - RNA, 64 nt, hsa
gucagaccagaauuuucuuugucccaugaggugucuuuguaagucagcaugcucuugcuugaac

SEQ ID NO: 442356 - RNA, 64 nt, hsa
uauuuuccugaaauacauuugcaaaauaaggcugcuuuguaaucaaggaauauuuuuauugauu

SEQ ID NO: 442357 - RNA, 58 nt, hsa; identical to SEQ ID NO: 66050

SEQ ID NO: 442358 - RNA, 64 nt, hsa
uauccauuuguacaugguuuacauguuguggaugcuuuguaaacauuuuccuguauguuuaaau

SEQ ID NO: 442359 - RNA, 64 nt, hsa
uaucuggguuaaguguuuaucauauauauggguacuuuguaauaucuaaaaacuuagaaacgga

SEQ ID NO: 442360 - RNA, 64 nt, hsa
ugacauuguuaccaaccauuaauuggcucaggaccuuuguaauuuuuauuuaacuauaugaguu

SEQ ID NO: 442361 - RNA, 64 nt, hsa
guaaacuucagugucccaccuugaccaaaaucagcuuuguaacuguuuucaaggaggugcuuag

SEQ ID NO: 442362 - RNA, 64 nt, hsa
ccaaacaagaagaccucaugagagagguaaacaccuuuguaaagaaucuguaaccaauaccaug

SEQ ID NO: 442363 - RNA, 64 nt, hsa
cuacacagcuuuugcauacuuacaguuucuguuccuuuguaauaacuuuaacuugcaccuuuga

SEQ ID NO: 442364 - RNA, 64 nt, hsa
cccaaaccauaccacacacauuaucauuguuaaacuuuguaaaguauuuaagguacauggaaca

SEQ ID NO: 442365 - RNA, 64 nt, hsa
aaucuaaauuucuguaguagagagagccguagcccuuuguaaaggcuuucguucguccaaacaa

SEQ ID NO: 442366 - RNA, 64 nt, hsa
uugagcugugagauggauuuauuuuuaaaugcuacuuuguaaaggugaccuuuaaaaaauaaaa

SEQ ID NO: 442367 - RNA, 64 nt, hsa
gaaucuuuacaccuccugugugguuacaaguuaacuuuguaaguagcguaccuuccuuccuuaa

SEQ ID NO: 442368 - RNA, 64 nt, hsa
uuuagaacaaauaagguauauuuuuuagaaucaacuuuguaagcacuauaaaaucuuuaauaag

SEQ ID NO: 442369 - RNA, 64 nt, hsa
uacaagcucgaauuauuccucauuguauagccugcuuuguaaacuaguuuacaauuugcaggcu

SEQ ID NO: 442370 - RNA, 64 nt, hsa
uuccucuuccuccuccacuucccacuuauugucacuuuguaauauucagagagcacuuggauua

SEQ ID NO: 442371 - RNA, 64 nt, hsa
accuauaauagaaaauagcagacaacauaaacaucuuuguaaauaucaaaccuaauacauuucu

SEQ ID NO: 442372 - RNA, 64 nt, hsa
aaauaucaaaaggaagauucuuccauuaaauugccuuuguaauaugagaauguauuaguacaaa

SEQ ID NO: 442373 - RNA, 64 nt, hsa
cuaugccuaauacucacacgcaacauuucuuguacuuuguaagucguuugcgagaaugcagacc

SEQ ID NO: 442374 - RNA, 64 nt, hsa
uguuaacuuauugcuuuguaucuugggaaaaaaacuuuguaaauaaguuauaaaguuucuuuga

SEQ ID NO: 442375 - RNA, 64 nt, hsa
gucacacuagcauagagaauguguugaaauuuaacuuuguaagcuuguaugugguuguugaucu

SEQ ID NO: 442376 - RNA, 64 nt, hsa
cuggcgccuccucucuacuuucauggacuuguuccuuuguaauagugcaauuugguuuuguuuu

SEQ ID NO: 442377 - RNA, 64 nt, hsa
auucacuagauuucuacguagugaucugcuuuuacuuuguaauuuguaguucucaaaagacuuu

SEQ ID NO: 442378 - RNA, 64 nt, hsa
aaucuauguugaauccuuuuauaaaccaguaucacuuuguaauauaaacaccuauuuguacuua

SEQ ID NO: 442379 - RNA, 64 nt, hsa
ugaccagccagaccucaggucuucacucuuucuucuuuguaaacuaugucauguggaaagauuu

SEQ ID NO: 442380 - RNA, 64 nt, hsa
cagauuuauuccuuuguuacuucucuaauucuuccuuuguaaaaaaaaaaaaaagcaacacuuu

SEQ ID NO: 442381 - RNA, 64 nt, hsa
auuuaaauucaggcuacugcuucaaucucaauugcuuuguaagugaaaaacaugacccagagga

SEQ ID NO: 442382 - RNA, 64 nt, hsa
aaccauuaaaaguuggggcuccuacucuccuuugcuuuguaaauucaaaaguugggggugggua

SEQ ID NO: 442383 - RNA, 64 nt, hsa
uuuuguaccggcacgggauauggaacgaaaacugcuuuguaaugcaguuugugacauuaauagu

SEQ ID NO: 442384 - RNA, 64 nt, hsa
cuuuuggaucucauuguugauauaccugaauuuacuuuguaagagauuuuaacuucacuucaug

SEQ ID NO: 442385 - RNA, 64 nt, hsa
uuuagaggauagccuugaggcuagauuaucuuuccuuuguaagauuauuugaucagaauauuuu

SEQ ID NO: 442386 - RNA, 64 nt, hsa
ugagaagcauggcucaccagccagccucuguggucuuuguaauuagaagcuucagaacucacua

SEQ ID NO: 442387 - RNA, 64 nt, hsa
aauaaaaguacauuuuauaaaccauuuacuauggcuuuguaacaauugcauacccauauuuuaa

SEQ ID NO: 442388 - RNA, 64 nt, hsa
ccauguaacuuaauuacugcuaguuuugaaaugucuuuguaagaguagggucgccaugaugcag

SEQ ID NO: 442389 - RNA, 64 nt, hsa
cuggagcuuuguauucugugacugcuauggcuagcuuuguaaccaaagcaaaaugagaauuuca

SEQ ID NO: 442390 - RNA, 64 nt, hsa
cuguacaaaagcugcaguaaccugucuucaguuacuuuguaauuuauuguggcaugagauaaga

SEQ ID NO: 442391 - RNA, 64 nt, hsa
auagcaugcaaggguaagaaugaguuuuuaacugcuuuguaagaaaauggaaaaggucaauaaa

SEQ ID NO: 442392 - RNA, 64 nt, hsa
ccaaucuaaauauggaauuugguaaauuagaauacuuuguaauuuguaagaccaaauucauacu

SEQ ID NO: 442393 - RNA, 64 nt, hsa
uuuauaagcagcugugaaauuuaagugaaauguucuuuguaaacauuuguacuauuuuaaauga

SEQ ID NO: 442394 - RNA, 64 nt, hsa
acugcacagggcuuauagcugcuucauucugcuacuuuguaacuaggagccauugcauuuauua

SEQ ID NO: 442395 - RNA, 64 nt, hsa
auugauggcaucccuacagucuucuucacuugaacuuuguaaaacugcauauggaccuguaauc

SEQ ID NO: 442396 - RNA, 64 nt, hsa
auuuuguaauauucucuccgccauugagaaugugcuuuguaagauccacccccugcccacaaaa

SEQ ID NO: 442397 - RNA, 64 nt, hsa
gugacaauacaccuuccccacccuugagaaggugcuuuguaauauucuccccacccaccccacg

SEQ ID NO: 442398 - RNA, 64 nt, hsa
aacauguuccugggaucacugaugacuuuuuauacuuuguaaagacaauuguuggagagccccu

SEQ ID NO: 442399 - RNA, 62 nt, hsa; identical to SEQ ID NO: 66092

SEQ ID NO: 442400 - RNA, 64 nt, hsa
cugagccuuguaauucuaaaugaauguuuacacucuuuguaagaguggaaccaacacuaacaua

SEQ ID NO: 442401 - RNA, 64 nt, hsa
uaugauaccaugacaaaaaucuuuccugaauugucuuuguaaaaguauuauugaauuuucaauu

SEQ ID NO: 442402 - RNA, 64 nt, hsa
ugaaggaaaaaguaagaugagaaauaaagaaagccuuuguaaggugguuuuaaaagccuuauau

SEQ ID NO: 442403 - RNA, 64 nt, hsa
guuacaugauuuauaauuucacugauugagauuacuuuguaaguagcuguucagaagaauaaaa

SEQ ID NO: 442404 - RNA, 64 nt, hsa
agguaacauaauggugaugguuggccauuugagucuuuguaaccuaggaaagacaaaggucuga

SEQ ID NO: 442405 - RNA, 64 nt, hsa
uaauggcaagucuagaacucuccgaauccuacagcuuuguaauuuuuuuucuacaaaugucuaa

SEQ ID NO: 442406 - RNA, 64 nt, hsa
uacugauucaauuauaauuguaauggauuuuugacuuuguaauggauucuuuucaucaaaaagc

SEQ ID NO: 442407 - RNA, 64 nt, hsa
cucuaguugucuguguauaauauuuccaaagcuccuuuguaaaccccgucuccuuucauucaga

SEQ ID NO: 442408 - RNA, 64 nt, hsa
gugguaggguagagacuacccuagacaucugcaucuuuguaaguuagccagacaauaaagaaaa

SEQ ID NO: 442409 - RNA, 64 nt, hsa
aucuuuauauuugucuuauuuugaaucuuauccacuuuguaagaacaaguuuauguuugagcaa

SEQ ID NO: 442410 - RNA, 64 nt, hsa
cuuguuaguagacagugguguccucaaaauuuuacuuuguaauucuucagaauugauuauuuuu

SEQ ID NO: 442411 - RNA, 64 nt, hsa
ucuuuugguuucugcuucucucuucucucaaccccuuuguaaugguuugggggcagacucuuaa

SEQ ID NO: 442412 - RNA, 64 nt, hsa
uucacuguuccucugucauacuguaucuggaaugcuuuguaauacuugcaugcuucuuagacca

SEQ ID NO: 442413 - RNA, 64 nt, hsa
caguaugacauaaugauuugcuauguuguaaaaucuuuguaaaaaauuucuauauaaaaauauu

SEQ ID NO: 442414 - RNA, 64 nt, hsa
uucuuugcccaauaaccacauuuuauuucuucagcuuuguaaauaccagguucuaggaaauguu

SEQ ID NO: 442415 - RNA, 64 nt, hsa
gucuaauuuuuaaauuuuaaguuauuuuguacagcuuuguaaauucuuaacauuuuuauauugc

SEQ ID NO: 442416 - RNA, 64 nt, hsa
aacuguagugcagugauccuuuacagguuuauuucuuuguaaaaaaaaauaauaauaauuugaa

SEQ ID NO: 442417 - RNA, 64 nt, hsa
cuugaggcccaucucuccagccagccacugccuucuuuguaauauuaagugccuugagcuggaa

SEQ ID NO: 442418 - RNA, 64 nt, hsa
augccgucucaaggcauuuacgguuuaaaaagaccuuuguaauuacuaacgaaaaugcaaagca

SEQ ID NO: 442419 - RNA, 64 nt, hsa
uagguguguuucugagaauuuguuugaauuaguucuuuguaaauaaaacaggauuuugaaugca

SEQ ID NO: 442420 - RNA, 64 nt, hsa
aacagggaauaaaagcuuuucaacucaaccacuucuuuguaagacaaaacugaaguaucugugu

SEQ ID NO: 442421 - RNA, 64 nt, hsa
caggguuuucuguuuuuugauggaggugaaaucucuuuguaauccacuagguuuucaucguaaa

SEQ ID NO: 442422 - RNA, 64 nt, hsa
gguagacucuuuuauaccuguugucacaagaaagcuuuguaaaaccagacagugaagcaaaaug

SEQ ID NO: 442423 - RNA, 64 nt, hsa
uaagucaaucauuuaauuuuugggaccucaguuucuuuguaaguaaaauaacaccugcuuguuc

SEQ ID NO: 442424 - RNA, 64 nt, hsa
agggacugggucacuauugugguuuuuacuauaacuuuguaaauuaacuuaauuuugcugacuu

SEQ ID NO: 442425 - RNA, 64 nt, hsa
aggcuuugaaucaacuuaagggaaaaccuuuugucuuuguaaaaauaaaagccuguagcuaagg

SEQ ID NO: 442426 - RNA, 64 nt, hsa
aagaauaugcccgacuccccaugacaagacagaacuuuguaacaaacaguaccaauuuauuuug

SEQ ID NO: 442427 - RNA, 64 nt, hsa
auuuguuccugccccacccuaacugaucaauguacuuuguaaucucccccacccuuaagaaggu

SEQ ID NO: 442428 - RNA, 64 nt, hsa
guacuuuguaaucucccccacccuuaagaagguacuuuguaaucuuccccacccuuaagaaggu

SEQ ID NO: 442429 - RNA, 64 nt, hsa
guacuuuguaaucuuccccacccuuaagaagguucuuuguaauucuccccacccuugagaaugu

SEQ ID NO: 442430 - RNA, 64 nt, hsa
caaacguguucuuuuagaccaguuuucuaauaagcuuuguaaaauguacuauccaaauuagaag

SEQ ID NO: 442431 - RNA, 64 nt, hsa
auggagaacauuaggacaaaaagucaccaacuuacuuuguaacauuuuaauaaugacuuaaggg

SEQ ID NO: 442432 - RNA, 64 nt, hsa
agcccauacaaguauucauuuuuucuacccuuuccuuuguaaguuccugggcaaccuuuuugau

SEQ ID NO: 442433 - RNA, 64 nt, hsa
gaggugugugugugucuauguguguguuucagcacuuuguaaauagcaagaagcuguacagauu

SEQ ID NO: 442434 - RNA, 64 nt, hsa
ugggugaaggguacccaggaccacucuguaccaucuuuguaacuuccugugaauuuauaauaau

SEQ ID NO: 442435 - RNA, 64 nt, hsa
aaaaaauaauugcuuugacauugucuauaugguacuuuguaaagucaugcuuaaguacaaauuc

SEQ ID NO: 442436 - RNA, 64 nt, hsa
aauuguuugaaagccuccauauaguuagauugugcuuuguaauuuuguuguuguugcucuaucu

SEQ ID NO: 442437 - RNA, 64 nt, hsa
auaaaaguguguuugaaaaauauuaucuuggguucuuuguaaaauuuauuuuuuacaugcugaa

SEQ ID NO: 442438 - RNA, 64 nt, hsa
gugggaauaaaaagcugugaaauuguucaaccuacuuuguaaccaaagaagcaaagcuguguaa

SEQ ID NO: 442439 - RNA, 64 nt, hsa
uuaaugacuagcuuuuaaaaauacaguacaaagacuuuguaaaugugauucagggcccccagca

SEQ ID NO: 442440 - RNA, 64 nt, hsa
caggguccuccaggcaucagcuguuguguccucucuuuguaacaguggacaggacagaccaccc

SEQ ID NO: 442441 - RNA, 50 nt, hsa; identical to SEQ ID NO: 66134

SEQ ID NO: 442442 - RNA, 64 nt, hsa
ugcuacauuuuaaaagcaauuguauuaguaagaacuuuguaaauaaauaccuaaaacccaagug

SEQ ID NO: 442443 - RNA, 64 nt, hsa
ggauccgugcuuugucggccagcguuucugcagucuuuguaaaggccccacgagagcgggccag

SEQ ID NO: 442444 - RNA, 64 nt, hsa
aacaguaagauaucucaaugaaccauaaauucaacuuuguaaaaaucuuuugaagcauagauaa

SEQ ID NO: 442445 - RNA, 64 nt, hsa
cugcauauacuucuugggauauaguaucuaagaccuuuguaaacugccauuuuguuagguaugg

SEQ ID NO: 442446 - RNA, 64 nt, hsa
cugcagugccaccugaguuccaaauuuuaccauucuuuguaaacaguuggauggauuaugauaa

SEQ ID NO: 442447 - RNA, 64 nt, hsa
cuauaaaaucuuagaaagaaacauaggcauagaucuuuguaaccuugaauuaggcagugguuuc

SEQ ID NO: 442448 - RNA, 64 nt, hsa
agauugaucaucugccuuaacgugaucggagaugcuuuguaaucuacuguccagcugaaagcac

SEQ ID NO: 442449 - RNA, 64 nt, hsa
aagcugcugccaagcacauaucccuaugacaacacuuuguaaaagccgcggggcccccauacag

SEQ ID NO: 442450 - RNA, 64 nt, hsa
uguuacugcuuauugaucacugcuagacuguaagcuuuguaagggcagggaccauauaagccuu

SEQ ID NO: 442451 - RNA, 64 nt, hsa
cuuuuagccucuacaugcuaggaucacaggaagacuuuguaaggacaguuuaaguucuccugca

SEQ ID NO: 442452 - RNA, 64 nt, hsa
ggggacuggagggagacuuuuauacguuuuguaccuuuguaaccagagagaugcuuauguuauu

SEQ ID NO: 442453 - RNA, 64 nt, hsa
uuggaaaaacaacagcgacaaaaaagucaagaaacuuuguaaaauaucgugugugugauuccuu

SEQ ID NO: 442454 - RNA, 64 nt, hsa
ccagggaucugggguggucagggcucaggcuucacuuuguaaaccaggugggggcaucucacag

SEQ ID NO: 442455 - RNA, 64 nt, hsa
aggguauauacaaauuaaaacugagacacauuggcuuuguaaaucaguauguuuuuacauaaug

SEQ ID NO: 442456 - RNA, 64 nt, hsa
gucuuuuuuuauauaaugaaccacucuuuuuuaacuuuguaaccuucccuugaagacagaauuu

SEQ ID NO: 442457 - RNA, 64 nt, hsa
guuucauuuaccgaaugagaauucuucauuuucacuuuguaauuuuucuuaguauauagucagc

SEQ ID NO: 442458 - RNA, 64 nt, hsa
ucauccacauccaccuucggaauacauuaacuuccuuuguaauuuauuugaaaguaguguuaaa

SEQ ID NO: 442459 - RNA, 64 nt, hsa
aaagccacaaacaguucaucauuuggugcuuagucuuuguaagggcucucugugguuugacuua

SEQ ID NO: 442460 - RNA, 64 nt, hsa
uaagaccucuaugaaugaauguaucagagaaugucuuuguaacuguuuaauucaaucuguaaua

SEQ ID NO: 442461 - RNA, 64 nt, hsa
gccaagguacuuuuuuauuuaaaaaaaaacauaacuuuguaaauauuacccuguaauauuauau

SEQ ID NO: 442462 - RNA, 64 nt, hsa
cggcacacacggaguggcuuugacagauugauaacuuuguaagaugggagacaucugaaauauu

SEQ ID NO: 442463 - RNA, 64 nt, hsa
augggaaaaaaaaaauccuugcuaaugugguuuccuuuguaaaccaggauucuuauuugugcug

SEQ ID NO: 442464 - RNA, 64 nt, hsa
ggguugauuaaaucuauaaguuuuuaugugaggacuuuguaagucagcauaaaaaugaaaaguu

SEQ ID NO: 442465 - RNA, 64 nt, hsa
acauauucaaauuccguauaccaaaauccauuuccuuuguaacaagaauuuaccaguaacugug

SEQ ID NO: 442466 - RNA, 64 nt, hsa
uaaauccuccacucucuggaaggagacugaggggcuuuguaaaacauuagucaguugcucauuu

SEQ ID NO: 442467 - RNA, 64 nt, hsa
ucagaaccucacuugguaccauauagaucaaaagcuuuguaaccacaggaaaaaauaaacucuu

SEQ ID NO: 442468 - RNA, 64 nt, hsa
auggaauauuccccuaucucuagaauuuuaagugcuuuguaaugggaacugccucuuuccuguu

SEQ ID NO: 442469 - RNA, 62 nt, hsa
cagccaaaacaaccaaacuauuuucuaaauaaaccuuuguaaucuaauguugggugccgcag

SEQ ID NO: 442470 - RNA, 64 nt, hsa
uuauuuuauguugaauuauuuuuggagcugaaaucuuuguaauauuaaagcaacuaguuucuaa

SEQ ID NO: 442471 - RNA, 64 nt, hsa
ucuuauguuuugccacaguuaacccauugugcuucuuuguaaucaaacaguuugugggagaaug

SEQ ID NO: 442472 - RNA, 64 nt, hsa
uauuaggaugugggcugguuugcuuuucuaccaccuuuguaauuuuauguaucccaucuccuuu

SEQ ID NO: 442473 - RNA, 64 nt, hsa
augcaauuuuuuucaggaugcaaaggcaauuauucuuuguaagcgggacauuuagaauauauuu

SEQ ID NO: 442474 - RNA, 64 nt, hsa
ugcuuaaaaaagcuaaucccuaaaauaguuagaucuuuguaaaugcauauuaaauaauaaagua

SEQ ID NO: 442475 - RNA, 64 nt, hsa
guaaugcaguuuuuaaaaaccuguaucugacccacuuuguaauuuuugcuccaauauccauucu

SEQ ID NO: 442476 - RNA, 64 nt, hsa
guuacugcaucaucuguuuguaaucauuaucucacuuuguaaauaaaaacacaccuuaaaacau

SEQ ID NO: 442477 - RNA, 64 nt, hsa
auuaugaauugaguccacaaaggaacacaaaacucuuuguaauucuguuaaaucuuuuauguag

SEQ ID NO: 442478 - RNA, 64 nt, hsa
uaacuuauuagaaacccaaauugggacaacagugcuuuguaaauuguguugucuucagcaguca

SEQ ID NO: 442479 - RNA, 64 nt, hsa
auuucuugcucaguuguuucaggcaagcccaagacuuuguaauuuuuaaagggcccaagauuuu

SEQ ID NO: 442480 - RNA, 64 nt, hsa
agauuuaaaaagguuguauuacauauuguuuaaacuuuguaaguagaaauauaucuguuauaau

SEQ ID NO: 442481 - RNA, 64 nt, hsa
cauauuacuguuucacauguacagcuuucuacuucuuuguaagaacaccaaccaaccaagguuu

SEQ ID NO: 442482 - RNA, 64 nt, hsa
guaggcugcuuuggaaauaauucccauauccuugcuuuguaaguugguaauaucacuaugcauu

SEQ ID NO: 442483 - RNA, 64 nt, hsa
gcuggcgcucaugggcccugguguuugcaccgcacuuuguaaucagucccgugguugucuguac

SEQ ID NO: 442484 - RNA, 64 nt, hsa
cagucagauuuuuaaaguuuuguacaaaguuuuccuuuguaaucacucccauuuuuacuuaaca

SEQ ID NO: 442485 - RNA, 64 nt, hsa
agguaaccuuaaagacagaccccucuaaagaacgcuuuguaaauacaugugagguauagccacc

SEQ ID NO: 442486 - RNA, 64 nt, hsa
ucucuuuuggauuuuuuuaagguauuugcuaagucuuuguaaacggaaauugaaaaugaccugg

SEQ ID NO: 442487 - RNA, 64 nt, hsa
ccauagcagaaaaaccuagacccaccuagugaaacuuuguaagaacuccagggcaaaaacgaac

SEQ ID NO: 442488 - RNA, 64 nt, hsa
guaaaugucgcuucuucaagugaaugauucugcacuuuguaaacagcacugagauuuauuuuaa

SEQ ID NO: 442489 - RNA, 64 nt, hsa
ugugaaaaacaguuuguauaguuggaauauuugucuuuguaauuacuugugauguuuuaaaaua

SEQ ID NO: 442490 - RNA, 64 nt, hsa
cuuauaguaaaagugcaaucauauggauggcuaacuuuguaaucucuacaaauaauuuaccuua

SEQ ID NO: 442491 - RNA, 64 nt, hsa
cugcucguuagcauggaagacuucuccauucuaucuuuguaaaacagacaagauaugcacuuga

SEQ ID NO: 442492 - RNA, 64 nt, hsa
gaaaggaagacauaaguguugugauuaguagaagcuuuguaaucauaacacaaugaguaauucu

SEQ ID NO: 442493 - RNA, 64 nt, hsa
aauguguguguguaguuacuuaaagguuauuccucuuuguaauaggaaacuauaugggaugaac

SEQ ID NO: 442494 - RNA, 64 nt, hsa
gaauuuuaaguucuagccccaugauaaccuuuuucuuuguaauuuaugcuuucauauauccuug

SEQ ID NO: 442495 - RNA, 64 nt, hsa
uugccuucuuauuuuacuucuuuuagcuguuuaacuuuguaagaugcaaagagguuggaucaag

SEQ ID NO: 442496 - RNA, 64 nt, hsa
accuaaauaauaauaaaaaaaaaagcccuuuaaacuuuguaaggaaauauuuuuugauuuugcg

SEQ ID NO: 442497 - RNA, 64 nt, hsa
ugcccaaguaauucacuacagccuaaagccuugccuuuguaauuugacuucugacauguuggca

SEQ ID NO: 442498 - RNA, 64 nt, hsa
uugcaagagucugauucuuuaaguauauuaaucucuuuguaaucucuucugaaaucauuguaaa

SEQ ID NO: 442499 - RNA, 64 nt, hsa
aagcuuuguagcagaauauauuugcagcuauugacuuuguaauuuaggaaaaauguauaauaag

SEQ ID NO: 442500 - RNA, 64 nt, hsa
ugaguuaaugugcugagcauuuuuuuaaaagaagcuuuguaauaaaacauuuuuaaaaauuguc

SEQ ID NO: 442501 - RNA, 64 nt, hsa
ggggcagguuagaagucauuguauaauuuguaggcuuuguaaugauugaaugcaagcguggaaa

SEQ ID NO: 442502 - RNA, 51 nt, hsa; identical to SEQ ID NO: 66195

SEQ ID NO: 442503 - RNA, 64 nt, hsa
uaguuucucucaccuucuugaaggcauuuacagucuuuguaagcuuuucuccuagauuuucccu

SEQ ID NO: 442504 - RNA, 64 nt, hsa
auggaaaacagugccaaaccuccacagcucauuucuuuguaauauaaucagaaugaaaaauaau

SEQ ID NO: 442505 - RNA, 64 nt, hsa
agugcuacuauaauaaguuuuucacgagaacaaacuuuguaaaucuuccauaagcaaaaugaca

SEQ ID NO: 442506 - RNA, 64 nt, hsa
uaucuuggauuuauuaugaagaacuuuguaguugcuuuguaauuucccauaaauugucuuugaa

SEQ ID NO: 442507 - RNA, 64 nt, hsa
augauuuuagaaauaagauaaucaacguacaacucuuuguaaaacaaaagcaacuuugggugag

SEQ ID NO: 442508 - RNA, 64 nt, hsa
aacuugaagcuuuccaauggcgcuucucuauggacuuuguaaauaaguuauaucuuuguaauuu

SEQ ID NO: 442509 - RNA, 64 nt, hsa
gcgcuucucuauggacuuuguaaauaaguuauaucuuuguaauuuuccugcuacuuuaucauuu

SEQ ID NO: 442510 - RNA, 64 nt, hsa
gaaaaguuauaugcuguaguuuuuaguauuuugucuuuguaauuuacagaaguuauuggagaaa

SEQ ID NO: 442511 - RNA, 64 nt, hsa
ucaaguccucaucuguuauauaaaauccuuucugcuuuguaaguuuucucuuuuugggauuuuc

SEQ ID NO: 442512 - RNA, 64 nt, hsa
cuuccccucccauguugucgcacugaucacacugcuuuguaauuauuuucuuuauuguugguaa

SEQ ID NO: 442513 - RNA, 64 nt, hsa
agaauguuuuguugggcuguguugaacauuauuucuuuguaaaugaauguuguaggaaugagga

SEQ ID NO: 442514 - RNA, 64 nt, hsa
uauaacaugugauuauaauuuuucuuagcauuuucuuuguaaagaacuacaauauaaacuaguu

SEQ ID NO: 442515 - RNA, 64 nt, hsa
gguacaguauguaacugcgggaaacccacugccccuuuguaagcuguggaacccaaacuguaug

SEQ ID NO: 442516 - RNA, 64 nt, hsa
uuuuaauaauuuugauugaaacccuuuaacaacucuuuguaaauuuuaacucauuuuaguugau

SEQ ID NO: 442517 - RNA, 64 nt, hsa
uaccaauuuguacauuuuaauuauucaauuucuacuuuguaaaaauagggaaauuauuugaagu

SEQ ID NO: 442518 - RNA, 64 nt, hsa
augaauagcaaaugagaaaauguauauaaaagcacuuuguaaauuguaaaaguaguacagaugu

SEQ ID NO: 442519 - RNA, 64 nt, hsa
uuucuacguauaaacacucuugaauagacuuccacuuuguaauuagaaaauuuuauggacagua

SEQ ID NO: 442520 - RNA, 64 nt, hsa
uauuuugugaacacuuuugaaaauguacauguuccuuuguaauugacacuauauauuucuuaau

SEQ ID NO: 442521 - RNA, 64 nt, hsa
ugacuccaaugccuguacugugucuacugcaccacuuuguaaacacuucaauuuacuaucuuug

SEQ ID NO: 442522 - RNA, 64 nt, hsa
ggaucccugagcuuucccaguagccuccaguuuccuuuguaagacccagggaucacuuagccau

SEQ ID NO: 442523 - RNA, 64 nt, hsa
uccugagagccagccugacauuagacagaauacccuuuguaauacauuggaaauuuuuacucau

SEQ ID NO: 442524 - RNA, 64 nt, hsa
gugauucauucauuauucuaguccugcuuuaguccuuuguaauuugugguaauuaugcuuuucu

SEQ ID NO: 442525 - RNA, 64 nt, hsa
uaaauauuuuaauuacuauuuaaauaucucuuuacuuuguaauccuaugcauuuuacgcauuaa

SEQ ID NO: 442526 - RNA, 64 nt, hsa
ugcugguuuauguucuaggaacucuucaugagcacuuuguaaacacccucuugcuuaauccucc

SEQ ID NO: 442527 - RNA, 64 nt, hsa
caccuuuacaauuaaacuaaauauugugcaaccgcuuuguaaauuaauaugaagaagauauauc

SEQ ID NO: 442528 - RNA, 64 nt, hsa
auaacgugaauauuuauacaguagccucuucaggcuuuguaauuuucauuccaaaaaugcccgg

SEQ ID NO: 442529 - RNA, 64 nt, hsa
augauauauauuuuuuuuaaugcaggaaaguauacuuuguaaggagcagauuuuuuuguucuca

SEQ ID NO: 442530 - RNA, 64 nt, hsa
aagcacauuccaaacuuuagcaacaguuaucacacuuuguaauuugcaaagaaaaguuucaccu

SEQ ID NO: 442531 - RNA, 64 nt, hsa
aaaaagaccaguaacuuuguuuuucaaaauuagucuuuguaacauagaauucaugaguguuuac

SEQ ID NO: 442532 - RNA, 64 nt, hsa
ugaacuugcuucccuuuucacuaauuuugcuaaacuuuguaaugcacauucuuagcauauaacu

SEQ ID NO: 442533 - RNA, 64 nt, hsa
aaaaaauauccaaggaucagagucucuuucuaagcuuuguaagcuaagcaauaguuuauguccu

SEQ ID NO: 442534 - RNA, 64 nt, hsa
auuuuggaaggucugaaaacuugcacagggucaucuuuguaauuauauaaccccaaacuaagau

SEQ ID NO: 442535 - RNA, 64 nt, hsa
uguaaaagaguuuauacaggccuuaaauaucagacuuuguaacagguagaaauauuacagaaua

SEQ ID NO: 442536 - RNA, 64 nt, hsa
auggcugcaaguggaagcggauaauauguaggcacuuuguaaauucauauugaguaaaugaaug

SEQ ID NO: 442537 - RNA, 64 nt, hsa
uuugcauucugaggcugaacuaauaaaaacucuucuuuguaaucauauuuugggcauucucagc

SEQ ID NO: 442538 - RNA, 64 nt, hsa
aauuuguaaacacugccagaauacuuucuagcugcuuuguaauuuuuuaagaguguuauuuugu

SEQ ID NO: 442539 - RNA, 64 nt, hsa
uccagaauucugaguuaaagaaacaaaguauuugcuuuguaaaaggccaaaauucuauuuccua

SEQ ID NO: 442540 - RNA, 64 nt, hsa
gucauuucugcuucagcucuuugcugcuucacuucuuuguaaaguuguaaccugaugguaauua

SEQ ID NO: 442541 - RNA, 64 nt, hsa
ugagguuuugguaauuguagaccuguuucauaagcuuuguaauucagaaauccuuguauuuagu

SEQ ID NO: 442542 - RNA, 64 nt, hsa
ugcagaaucaguuacaaacaucacaguucccaugcuuuguaauaacaccuggugaaaaaguuag

SEQ ID NO: 442543 - RNA, 64 nt, hsa
aauaguggguggauagcaaguauauucuaaaaaacuuuguaaauaaaguuuuguggcuaaaaug

SEQ ID NO: 442544 - RNA, 64 nt, hsa
auauugauagucacuagaguaauguauucuuaaccuuuguaagaacugaucucagcauguauuc

SEQ ID NO: 442545 - RNA, 64 nt, hsa
cuaacaacaacaaagggcaguaaauuaaaguacucuuuguaagguacaguuaccgauuaaucua

SEQ ID NO: 442546 - RNA, 64 nt, hsa
uuugaaauuacuguaccuagucuuuuuugcauuacuuuguaaccuuuuucuaugcaagagucuu

SEQ ID NO: 442547 - RNA, 64 nt, hsa
caucuuuugguucuguucacugagcuaaauuuaucuuuguaaaucuuuuugagucuggggggug

SEQ ID NO: 442548 - RNA, 64 nt, hsa
gcaagagcuucugggacagagacugcuuggccagcuuuguaaguaaguggcugccuccaaugug

SEQ ID NO: 442549 - RNA, 64 nt, hsa
guugaugguuuugugauuuagcuggguaaacuaucuuuguaacagauaaguuauuuauaaaaau

SEQ ID NO: 442550 - RNA, 64 nt, hsa
guugggaacagccaaagggauuccaaggcuaaaucuuuguaacagcucucuuucccccuugcua

SEQ ID NO: 442551 - RNA, 64 nt, hsa
uccuugauucagauauuuaugugaacuuaaaccucuuuguaaaauagcgcuaaauaauuugaac

SEQ ID NO: 442552 - RNA, 64 nt, hsa
uuaccaacugcugagauuuuuauguauuuugugacuuuguaacaacugcuauuguaauaagugu

SEQ ID NO: 442553 - RNA, 64 nt, hsa
gaaucuccuuguuguucuuuaacccucacugggacuuuguaaacuuccaagucauucucaccua

SEQ ID NO: 442554 - RNA, 64 nt, hsa
uuuuauucuuucuacugagggcauugucuguuuucuuuguaaaugccguacaauaaacaaauua

SEQ ID NO: 442555 - RNA, 64 nt, hsa
gaagcaguaagggggaaggagggugauuauauugcuuuguaaugguuugugauacuugaaacau

SEQ ID NO: 442556 - RNA, 64 nt, hsa
auauggauuauguuuuagcauuuuauacagucaacuuuguaaugaacuuuuuaaaaauuaauug

SEQ ID NO: 442557 - RNA, 64 nt, hsa
aacccauggaaaaaugccaucaaaugaauaaugccuuuguaaccacaacuuucacuauaaugug

SEQ ID NO: 442558 - RNA, 64 nt, hsa
ucuuugucacuggaugcuacuugaagagggaguacuuuguaaccacuuugauaugcuguuauca

SEQ ID NO: 442559 - RNA, 64 nt, hsa
auaauacagucaccuagacacuuccauuuguaaucuuuguaauagacuguaaauauauuuuugg

SEQ ID NO: 442560 - RNA, 64 nt, hsa
aaacaaauaacagaaacaaaaucuguaaauguuccuuuguaaaacuuguaaauuuuauuuauac

SEQ ID NO: 442561 - RNA, 64 nt, hsa
aauuuuuaaaaguaguaagccacauuacauuuaucuuuguaaaaagauuuaugguaacugguuu

SEQ ID NO: 442562 - RNA, 64 nt, hsa
acugauacauaauuuaaaagcacacucccuuccacuuuguaauaccagaacucuaauuggacac

SEQ ID NO: 442563 - RNA, 64 nt, hsa
guaauuuguacauauuuuagaauuuguguaucugcuuuguaauaaauguaauuucuuuccuuuu

SEQ ID NO: 442564 - RNA, 64 nt, hsa
guuuuaagacauuuaaaaacgugaaauuuguuaucuuuguaaaaugacaaucauguagaaaccu

SEQ ID NO: 442565 - RNA, 64 nt, hsa
acuagcacauauaugcaagcaccuaguauaauuucuuuguaauaugugaaacuuuauuaaugua

SEQ ID NO: 442566 - RNA, 64 nt, hsa
aucacugcuauuagacaauugaaguguucauuuacuuuguaauuccaauaaucauaguuaugga

SEQ ID NO: 442567 - RNA, 64 nt, hsa
uuuuuucauuguguguauuucccaagaaaguauccuuuguaaaaacuugcuuguuuuccuuauu

SEQ ID NO: 442568 - RNA, 64 nt, hsa
aaaagaguaauguauuaccucaauuuuugacugacuuuguaaaagccaauaacugguuuaaugu

SEQ ID NO: 442569 - RNA, 64 nt, hsa
gcaguuauguuuacacaucauuuuuauguuccugcuuuguaauucauguuugagauggguggcc

SEQ ID NO: 442570 - RNA, 64 nt, hsa
gggggaagccuuugcaagaaaauugcauacaaggcuuuguaacgaucaagugcuaaucgaugga

SEQ ID NO: 442571 - RNA, 64 nt, hsa
ugaauaccagcuggggagacacuagggaagggagcuuuguaagccuugauugcgaaaguccaaa

SEQ ID NO: 442572 - RNA, 64 nt, hsa
gguaggauucucucuaaauuauuuauugaagaggcuuuguaaauagugcaccagugacaggugc

SEQ ID NO: 442573 - RNA, 64 nt, hsa
ggccguaguuuauuuuaaaauauauuuuuaaaagcuuuguaaaaauuaugucauucucagaauu

SEQ ID NO: 442574 - RNA, 64 nt, hsa
gugugcccuguaaccugacugguuaacagcaguccuuuguaaacaguguuuuaaacucuccuag

SEQ ID NO: 442575 - RNA, 64 nt, hsa
uuuauacuuguagcaaauuguuuuaauucuguagcuuuguaauauguuuuaaaaucagaaacua

SEQ ID NO: 442576 - RNA, 64 nt, hsa
cuccuaugucuguuacaaaacauaguuuauguagcuuuguaacauuccucagugccuguccaua

SEQ ID NO: 442577 - RNA, 64 nt, hsa
auauucauaucuguuucauuuggaggauuuucuucuuuguaauguaaagaaauucaaaguuauc

SEQ ID NO: 442578 - RNA, 64 nt, hsa
uauaaacauuaacuuuccuauaagaauauuuuggcuuuguaaucuauagccucaaauugguauu

SEQ ID NO: 442579 - RNA, 64 nt, hsa
caacacucuuacaccuguuauggaaaaugucaaccuuuguaagaaaaccaaaauaaaaauugaa

SEQ ID NO: 442580 - RNA, 64 nt, hsa
acaccucacagcagcuucgugcuuuuguacagaccuuuguaacaaguguacagaaaacucauuu

SEQ ID NO: 442581 - RNA, 64 nt, hsa
gcgcuacguuuauugccucgucuuauucacugaccuuuguaaugauacacagugaauucuuuuu

SEQ ID NO: 442582 - RNA, 64 nt, hsa
cuauuuuuuuaauguacccuaccuucaguauucucuuuguaaguuggugacuugcaucuguggc

SEQ ID NO: 442583 - RNA, 64 nt, hsa
uuuucuaauuaauagccaaagauuucauaucuaacuuuguaaccagaauuauacaguaaguuga

SEQ ID NO: 442584 - RNA, 64 nt, hsa
cgugcccaggggcccacagggaacccugcuugcacuuuguaacauguuuacuuuucagggcauc

SEQ ID NO: 442585 - RNA, 64 nt, hsa
auucugcugcccuccaccauuuauuuuuacagugcuuuguaauuuuuuucaucaguuccuuaaa

SEQ ID NO: 442586 - RNA, 64 nt, hsa
gaccccagacauccugcaaccuggggggacauuccuuuguaaaaccugggcuggaagucaaagc

SEQ ID NO: 442587 - RNA, 64 nt, hsa
uauuuuguuuuuaaaauguguuuaauaaaugauccuuuguaaauaacuuuggucucccuacauu

SEQ ID NO: 442588 - RNA, 64 nt, hsa
ucaauaguauggaucuuuuuaaaucaauaagaugcuuuguaaaguugaaauaaguaauacuuuc

SEQ ID NO: 442589 - RNA, 64 nt, hsa
uuuaaauaccaaaagagggaaaauaaaaaagaaccuuuguaaaauauaucugaaccuaaugguu

SEQ ID NO: 442590 - RNA, 64 nt, hsa
ucugccccucuuccuucuuccuucugugacuuaacuuuguaaaggggauauggacaaguaagua

SEQ ID NO: 442591 - RNA, 64 nt, hsa
uugaguauaaaaagaaccccaauguuauguuaugcuuuguaaauuuuuuuuuuugcuuuuaccu

SEQ ID NO: 442592 - RNA, 64 nt, hsa
uaaaacauacaguuuauuccacacagcaguuugacuuuguaaaaguuuagcaaaauaacugauu

SEQ ID NO: 442593 - RNA, 64 nt, hsa
cuuagcuuuuuaauuguuguuucuuucuaguggucuuuguaagaguguagaagcauuccuucuu

SEQ ID NO: 442594 - RNA, 64 nt, hsa
cagggggagggggagagagcaaggagaucgguaucuuuguaauaaaacugcaauuuuauaaauu

SEQ ID NO: 442595 - RNA, 64 nt, hsa
ugauaaauaggacaaaucauuuaugugugaguuucuuuguaauaaaauguaucaauauguuaua

SEQ ID NO: 442596 - RNA, 64 nt, hsa
gcagcauuuuucuuaaggcuaugcuucaguuuuucuuuguaagccaucacaagccauaguggua

SEQ ID NO: 442597 - RNA, 64 nt, hsa
cauggagacccaccacgucucuaugccggaugaccuuuguaaguuaagguccuugugcaucuua

SEQ ID NO: 442598 - RNA, 64 nt, hsa
agucuugccuuucuucccugcuguuuuagcauuucuuuguaaaauguuagcuucaauuaauuag

SEQ ID NO: 442599 - RNA, 64 nt, hsa
auuagguuaaguauuauuuagguauuauaauaugcuuuguaaauuuuauauuccaaauauugcu

SEQ ID NO: 442600 - RNA, 64 nt, hsa
acacagaaugaaagggcaucucagccucucugaacuuuguaaaaaucuguccccaguucuucca

SEQ ID NO: 442601 - RNA, 64 nt, hsa
auuauauuaugaagcuuuuaugugaaacauguuucuuuguaaugaaaaccacauuggagauguu

SEQ ID NO: 442602 - RNA, 64 nt, hsa
ugucuuaguucagacucauauauggauuucaaaucuuuguaauaaaaauuauuuguauuuuuaa

SEQ ID NO: 442603 - RNA, 64 nt, hsa
ucaugcuguuuaagugcaggcugagacccagccucuuuguaaguacaguaaaauaauccaccgu

SEQ ID NO: 442604 - RNA, 64 nt, hsa
gacguguguccuuugguacuaugguguguuguaucuuuguaagagcaaaagccucagaaaggga

SEQ ID NO: 442605 - RNA, 64 nt, hsa
uauuucugaaacuccauuauaacauauguaacuccuuuguaaccaaaauuuagguaagcaggcu

SEQ ID NO: 442606 - RNA, 64 nt, hsa
aaaacuauguguaaauauauuaaggaaaguauagcuuuguaauuuaaauuggagcuuuuagcuu

SEQ ID NO: 442607 - RNA, 64 nt, hsa
gaaaucacuaaacucuaguacauuauagcaggugcuuuguaaucuggaauggagaagagguagg

SEQ ID NO: 442608 - RNA, 64 nt, hsa
agugugccuggcugguuugcagauauuuguucugcuuuguaaaaauuggccauuagugcauuua

SEQ ID NO: 442609 - RNA, 64 nt, hsa
gagaggaaacuaauggaguuucauuguaacuguccuuuguaauuuauauaaauguauuauuuuc

SEQ ID NO: 442610 - RNA, 64 nt, hsa
uguaugaaaauguccucuucuucaaagguauaggcuuuguaaugaauuagauuuucugccaaua

SEQ ID NO: 442611 - RNA, 64 nt, hsa
uagaggaauuauacaaaauuaauauauaugaguccuuuguaauuuauuuuuuuuugagacagga

SEQ ID NO: 442612 - RNA, 64 nt, hsa
agcucuaaacuagccuugaaguuuacagacaugacuuuguaaauguauuguuuuucuuuguugu

SEQ ID NO: 442613 - RNA, 64 nt, hsa
agucaauuucaguucagcuaacauauauuaauaccuuuguaacucuuugcuauggcuuuuguua

SEQ ID NO: 442614 - RNA, 64 nt, hsa
cagaacaaacauauuuaugaucaugaauaaugugcuuuguaaaaagauuucaaguuauuaggaa

SEQ ID NO: 442615 - RNA, 64 nt, hsa
cagggguucuaauuacugucugugagaguuacuacuuuguaacuuaugguuucugcuucaguau

SEQ ID NO: 442616 - RNA, 64 nt, hsa
cuguguaauucuauuguaauaaacuggcagguaucuuuguaacuauaaauagugcaugcucagc

SEQ ID NO: 442617 - RNA, 64 nt, hsa
ucaccaggagauuacaauuuuuugcucuucuugucuuuguaaucuauuuaguugauuuuaauua

SEQ ID NO: 442618 - RNA, 64 nt, hsa
gaaaaacucucagggcccuauuaagauuuauaaccuuuguaauguucuucaccacagacaccuu

SEQ ID NO: 442619 - RNA, 64 nt, hsa
aaggcuuaccccucucuaggguugcaguugcuuucuuuguaauaaguauuuugccacaccugua

SEQ ID NO: 442620 - RNA, 64 nt, hsa
uguaaaugugguaggaaauauaaaucauaugguccuuuguaaaauauacaaauaaucuaacaca

SEQ ID NO: 442621 - RNA, 64 nt, hsa
ggugucuacgguuaagcaacagauaccuccuucccuuuguaaauaguauuuuuauacuucaucc

SEQ ID NO: 442622 - RNA, 64 nt, hsa
auagccuauacugcauuagcccaagagauuguugcuuuguaacuuuuugcacuauuguuuuggc

SEQ ID NO: 442623 - RNA, 64 nt, hsa
ugccaaaucauuucaacugaaaagaacaguauugcuuuguaauagagucuguaauaggauuucc

SEQ ID NO: 442624 - RNA, 64 nt, hsa
auccuuuuccuucugaccaacacuuagucuuuaacuuuguaagguucgguuuaagguuucaggg

SEQ ID NO: 442625 - RNA, 64 nt, hsa
uuagugguauccuauauuacuuuagugucguacgcuuuguaagacuuaaauauuuuauucuauu

SEQ ID NO: 442626 - RNA, 64 nt, hsa
gacuuucuuccauauaugugguucauuggaaguucuuuguaauuuuaauuccaugaaagucuua

SEQ ID NO: 442627 - RNA, 64 nt, hsa
cacuuugugauagguuuguacugugccuaauuuacuuuguaaaccagaaugauuccguuuuugc

SEQ ID NO: 442628 - RNA, 64 nt, hsa
uugugcuuuucagagacgccauagcuguuuuucccuuuguaauaucaaagcaguaauaucuucu

SEQ ID NO: 442629 - RNA, 64 nt, hsa
acaggggaaacuguguaagcuguacuuguuauuucuuuguaaaaugucuuagauaauaaaacua

SEQ ID NO: 442630 - RNA, 64 nt, hsa
uguuucccaccauuucccuuuaagugcucugcuccuuuguaaaaaguuaaagauuugaaagaga

SEQ ID NO: 442631 - RNA, 64 nt, hsa
cuuuuguaaagaaguauauuuuuaugaaaagaaacuuuguaaaaguaugauguaaauuuucagu

SEQ ID NO: 442632 - RNA, 64 nt, hsa
aaguauguccucauagaacuuuuaauacuuaaggcuuuguaaaaacuauccaugaagggaaagc

SEQ ID NO: 442633 - RNA, 64 nt, hsa
aucaggagacugaaaguucauacuaauuuacaaacuuuguaaagacuggugcuguucauucaua

SEQ ID NO: 442634 - RNA, 64 nt, hsa
uaauaaccacacacagauaaccacacaaaaaauccuuuguaaaauuucugauugauaggauuag

SEQ ID NO: 442635 - RNA, 64 nt, hsa
aaggugccaaauuccauuuaacuuuuuuacaagucuuuguaaaauuuuaaaugcauaaaggggg

SEQ ID NO: 442636 - RNA, 64 nt, hsa
uagugagggaaucuaauuaagauuucaugcuguucuuuguaaugauaaauguuuccggacuaaa

SEQ ID NO: 442637 - RNA, 64 nt, hsa
cauagauguuggaacuaccuuuuuacuccccauacuuuguaaguaaugcuuccagauuaaccug

SEQ ID NO: 442638 - RNA, 64 nt, hsa
uuccauaugugaauguaagcucuuaacuaugucucuuuguaauguguaauuucuuucugaaaua

SEQ ID NO: 442639 - RNA, 64 nt, hsa
uugugaaauucuagaaaaaaauauuaccaccucucuuuguaauuuacuuuacuuguaugaauuu

SEQ ID NO: 442640 - RNA, 64 nt, hsa
ucccugcacugugucaucuuuucaaggcauuugucuuuguaauauuuuccauaaauuuggacug

SEQ ID NO: 442641 - RNA, 64 nt, hsa
uuaaauuacccuauccuuuguucucuacuguuuucuuuguaauguaugacuacgagagugauac

SEQ ID NO: 442642 - RNA, 64 nt, hsa
acuuuuuuucuuuuuuugacucguugacaagugucuuuguaauauguuuuuaguucccuuuuuu

SEQ ID NO: 442643 - RNA, 64 nt, hsa
uaacagcauuuuuacuuucuguacaacaaaaaagcuuuguaaauaaaaucuuaacauuuugggu

SEQ ID NO: 442644 - RNA, 64 nt, hsa
cuauguuucuugcauuaugaaggcuacaucugugcuuuguaaguaccacuucaaaaaauaguuc

SEQ ID NO: 442645 - RNA, 64 nt, hsa
auuuagagcuuugugcuuuucucucauuccaucacuuuguaaugaugauacuuaacaugagcag

SEQ ID NO: 442646 - RNA, 64 nt, hsa
aggggcuuuaucuaugaaaaaguaguaaauaguucuuuguaaccugugugaagcagcagccagc

SEQ ID NO: 442647 - RNA, 64 nt, hsa
gucauugaggguuuguuuguguuuucaucaaugucuuuguaaagcacaaauuaucugccuuaaa

SEQ ID NO: 442648 - RNA, 64 nt, hsa
guuggagucguuuugagaugagcauuagccccagcuuuguaaccaaugaggaacacuuacuuau

SEQ ID NO: 442649 - RNA, 64 nt, hsa
caaguuaagagaaacuuuauacauuaguaaaugucuuuguaagucaguguugagauggggauaa

SEQ ID NO: 442650 - RNA, 64 nt, hsa
gaggaugucaauacaagauugucugccuguuuuucuuuguaauuuguaauuacaguuuuuguaa

SEQ ID NO: 442651 - RNA, 64 nt, hsa
acugucaauuugcucuagugucuuauuaguuaaacuuuguaaaauauauauauacuuguuuuuc

SEQ ID NO: 442652 - RNA, 64 nt, hsa
ucaacacugguuaauuucacacuccaucuccccgcuuuguaaauacccaucgggaagagacuuu

SEQ ID NO: 442653 - RNA, 64 nt, hsa
ucaguuccugaccuuccucugagcccuugagacacuuuguaaugcucuuuuguaacuaucgaca

SEQ ID NO: 442654 - RNA, 64 nt, hsa
uaauuaagugcccaauauugaaaggcugcaaguacuuuguaaucacucuuuggcauggguaaau

SEQ ID NO: 442655 - RNA, 64 nt, hsa
aauuaccaguauaucagaggaaaauuuucguagucuuuguaaaauaauauacucaucauagaaa

SEQ ID NO: 442656 - RNA, 64 nt, hsa
caaacgguuucuccuguggauaguggacagagaccuuuguaaccaauggaauuauucauuuuuc

SEQ ID NO: 442657 - RNA, 64 nt, hsa
uuuaggccguggugaaguugauaaaccaccccugcuuuguaacaaaauuauuuuaaagugacug

SEQ ID NO: 442658 - RNA, 64 nt, hsa
aaugucuguuuuguuacauaccuuucaugucgugcuuuguaaaugucuuauuuguguaauaaag

SEQ ID NO: 442659 - RNA, 64 nt, hsa
auuuaaacauuagagcuggaguggggcuggaaaucuuuguaaaggaaguucuuucaguaagaug

SEQ ID NO: 442660 - RNA, 64 nt, hsa
uuuaauacaauagagacuuuucauuuaacuuuaacuuuguaaauauugaaguguguaauaaagc

SEQ ID NO: 442661 - RNA, 64 nt, hsa
aaaaacuguuuggaaccacaccaaugauauuuuucuuuguaauacuugaaauuuauuuuuuuau

SEQ ID NO: 442662 - RNA, 64 nt, hsa
cugagaucauugguagccagggguugcuaccaaacuuuguaaccucaaggacaaaaugaggaag

SEQ ID NO: 442663 - RNA, 64 nt, hsa
aaauaaagaagacaugaauuguuuuaagucuacacuuuguaauuagcuaaguugugcaguauuu

SEQ ID NO: 442664 - RNA, 64 nt, hsa
cuaaucuagaccaaagaaugguauuuucacuuuucuuuguaacauugaaugguuugaaguacuc

SEQ ID NO: 442665 - RNA, 64 nt, hsa
auuucaauagaaauuuuuauuucauuuucaauuacuuuguaaauucguguguauuuaguacacu

SEQ ID NO: 442666 - RNA, 64 nt, hsa
uuuaccugagacuuucaguucguuuguauucuaccuuuguaaaacagccuauagaugaugaugu

SEQ ID NO: 442667 - RNA, 64 nt, hsa
auguaucuuuugguuguuugauuuuucuuucuuucuuuguaaauaguucugaguucugucaaau

SEQ ID NO: 442668 - RNA, 64 nt, hsa
agcuuuuguacuagcccaguauuuauuuacauugcuuuguaauauaaaucuguuuuagaacugc

SEQ ID NO: 442669 - RNA, 64 nt, hsa
ucccucugccccucccccagccaugccagcuggccuuuguaagugcaggaaaccgaguagaaaa

SEQ ID NO: 442670 - RNA, 64 nt, hsa
cugaguuauauaaggcuacuucaugacaagacugcuuuguaauauuucacuuuguuuuacuaca

SEQ ID NO: 442671 - RNA, 64 nt, hsa
ccauuaaaaaaagcacuggguucugcccuuucaucuuuguaagagauucuugccucuagcaaug

SEQ ID NO: 442672 - RNA, 64 nt, hsa
ucuacagcucagauacugaucucuuucuaaugggcuuuguaaaccacuugacuuugcuaauggc

SEQ ID NO: 442673 - RNA, 64 nt, hsa
aacuauguaauuuuguccuuguuauuuuuguuuccuuuguaauuuacuugaugaguuuauaucu

SEQ ID NO: 442674 - RNA, 64 nt, hsa
aaagguggcuggagagagcugaggauuuccaggacuuuguaaguucuuauucugggagaacaua

SEQ ID NO: 442675 - RNA, 64 nt, hsa
uaaaaaggcuuuuaaaauuuuguuuguuuuaaaucuuuguaaaguuauuauuccagagaguaua

SEQ ID NO: 442676 - RNA, 64 nt, hsa
aauauacauuuuucuuaauguuccaacaucuauacuuuguaaagucaaaacauuucccaugagc

SEQ ID NO: 442677 - RNA, 64 nt, hsa
cagaaaguggcuuugacaccaagugcuacugucccuuuguaauuggcuucuaacagaauucaac

SEQ ID NO: 442678 - RNA, 64 nt, hsa
ucccaggugagcccuggauuggcucccagaaggccuuuguaaaaucaguagccguccugcaggc

SEQ ID NO: 442679 - RNA, 64 nt, hsa
gcuuccucaggcuucucaccuguggccaacuucacuuuguaagacccauauuuuuaacucuucc

SEQ ID NO: 442680 - RNA, 64 nt, hsa
ggucuuuccagagcuuauaguugcuaacacuuuucuuuguaaagaaguuuaccuuuugacugga

SEQ ID NO: 442681 - RNA, 64 nt, hsa
gguuauuccuuuccuuuccuggagcuacaccuuucuuuguaaaacuguacugugggccgggcgc

SEQ ID NO: 442682 - RNA, 64 nt, hsa
uuuccucccaaggguucuggcaccuuaugauguacuuuguaaaaaaauugauugaagauuuuaa

SEQ ID NO: 442683 - RNA, 64 nt, hsa
uuuacuagcgagaaaucuuugauuucauuuuauucuuuguaauucuagacacuagauuguaguu

SEQ ID NO: 442684 - RNA, 64 nt, hsa
agucaguaaaaaaacacaaaaacuguaugaaugacuuuguaaauuuuguucuauaugaauaaaa

SEQ ID NO: 442685 - RNA, 64 nt, hsa
uuuaacucuaacacccuucagaaauuucuaacuacuuuguaacugcauggcuuaaccuggugau

SEQ ID NO: 442686 - RNA, 64 nt, hsa
uuguuaaugguuaauauaggcagggcgaauacuacuuuguaacuuuuaaagucuuaaacuuuuc

SEQ ID NO: 442687 - RNA, 64 nt, hsa
aucuauuuguuuuguacauguauauaucuaggaacuuuguaacaacacaucuuuaauaauguua

SEQ ID NO: 442688 - RNA, 64 nt, hsa
uuuuuucauuuucaguuauuuuugaagcuaaaaccuuuguaauauuguuacuaaagugucuagu

SEQ ID NO: 442689 - RNA, 64 nt, hsa
guauaaauugguuccugagaggguuuccuaacagcuuuguaauaagaaaaauauggccuugaug

SEQ ID NO: 442690 - RNA, 64 nt, hsa
agacuacuacaaaauuggaaaaagauuggcaauucuuuguaaagaauuugugaauuguguauaa

SEQ ID NO: 442691 - RNA, 64 nt, hsa
cauaauagaacaacguuuaugaaccugccguuugcuuuguaacguaacuaaauaauguaauggc

SEQ ID NO: 442692 - RNA, 64 nt, hsa
aauagaugaacuaagagaaaaagaaucggauggucuuuguaacugauucuggacauaugcauca

SEQ ID NO: 442693 - RNA, 64 nt, hsa
uaucacugcuuaacuucaucuucaugaaaugaaacuuuguaacuuauuguaguuagaaauugua

SEQ ID NO: 442694 - RNA, 64 nt, hsa
uuuugacuuaaguagaaguaauaugcucucauuucuuuguaaucuagauuuuccuauguugaau

SEQ ID NO: 442695 - RNA, 64 nt, hsa
auuaguacacaaaacuaagaaucuuuagacuuaucuuuguaacuaauuaggguggaaguuauga

SEQ ID NO: 442696 - RNA, 64 nt, hsa
ggcaauaaacauguuuucauguaauacuggcuuacuuuguaauuuacaucuguaacuuucauau

SEQ ID NO: 442697 - RNA, 64 nt, hsa
gaacauguaacuucucucacaagaguacucuuuacuuuguaaucauauacaaugucaacuuuuu

SEQ ID NO: 442698 - RNA, 64 nt, hsa
uuuguugagaugaguuugcuguacugacgcugcacuuuguaaacagauuaccaguuuuuuacuu

SEQ ID NO: 442699 - RNA, 64 nt, hsa
guuacacuguguuuuaaauuacuuuaaaaauaaacuuuguaagcagauuuuaauuuagucuuug

SEQ ID NO: 442700 - RNA, 64 nt, hsa
acaagagcugcugcuauaacuuccaguuuuacaucuuuguaaaauuguaucucaaaggcagaaa

SEQ ID NO: 442701 - RNA, 64 nt, hsa
cuaauaugcuguuuccauuaugacacagcagcuccuuuguaaguaccaggucauguccaucccu

SEQ ID NO: 442702 - RNA, 64 nt, hsa
caagagagaacagggugguauucuaaguauguuucuuuguaacaucuuuagcaguaggacagag

SEQ ID NO: 442703 - RNA, 64 nt, hsa
uauuauuauuauuauuuuuugagauggagucucacuuuguaacccaggcuggaaugcaauggca

SEQ ID NO: 442704 - RNA, 64 nt, hsa
aaaagacuuuauuguucuaauuauccagauguaccuuuguaaaauagcucuuuuaugaauuagc

SEQ ID NO: 442705 - RNA, 64 nt, hsa
aagcuuugaacaauuguguuuucgucacaggagucuuuguaaugcuuguacaguugaugucgau

SEQ ID NO: 442706 - RNA, 64 nt, hsa
guauuuuucuuuguauaugaaauaauuuuuuguacuuuguaaaauauggagcccauuguaccuu

SEQ ID NO: 442707 - RNA, 64 nt, hsa
caugaaaggugucaucaucacuaggaauaacacccuuuguaacuacauauagaacuguuacaau

SEQ ID NO: 442708 - RNA, 64 nt, hsa
gcugaagaguugaucccuuuguccuaucguggggcuuuguaauguuacacaucucgugaaaacu

SEQ ID NO: 442709 - RNA, 64 nt, hsa
uguagauuuguuuuguguuguuugaaaauauuaucuuuguaauuauuuuuaauauguaaggaau

SEQ ID NO: 442710 - RNA, 64 nt, hsa
cacagcccuuuuaucucugcuuuccugaagcagccuuuguaaguggaaggauuguacugaaggc

SEQ ID NO: 442711 - RNA, 64 nt, hsa
uccuagcugacucagcauagauuguauaaaauaccuuuguaacggcucuuagcacacucacaga

SEQ ID NO: 442712 - RNA, 64 nt, hsa
cauaagauaaccacuugauuuugugauuccaauucuuuguaauugucuucagagcagcccuacu

SEQ ID NO: 442713 - RNA, 64 nt, hsa
cuuugucaugugauuuuugagucucaauuuaaggcuuuguaaaaugaagaguagaauuccaaga

SEQ ID NO: 442714 - RNA, 64 nt, hsa
ucgucggaccuugugauuuggauugucaccuagccuuuguaaccgcuuggugccucuuaggacu

SEQ ID NO: 442715 - RNA, 64 nt, hsa
auggaggauauuauuauguggguauuuauaugaccuuuguaaccauuuaaaaauguaaaaacga

SEQ ID NO: 442716 - RNA, 64 nt, hsa
cugaggacagaagggacuagggcucuggcggggucuuuguaagaccagaguuucggacagccca

SEQ ID NO: 442717 - RNA, 64 nt, hsa
uuuaaauaaggggaggguuguuccagcuuugauccuuuguaagauuuugugacugucaccugag

SEQ ID NO: 442718 - RNA, 64 nt, hsa
cuccgguucccugagggaugagccuucagccucccuuuguaaugcugcuccucuccacugccca

SEQ ID NO: 442719 - RNA, 64 nt, hsa
uauaauggaagcaagacuuccaaccucacggagacuuuguaauuuguuuucugagagcacaggg

SEQ ID NO: 442720 - RNA, 64 nt, hsa
ucccauagaaaauuggguguguauacuuguauaacuuuguaaauaaguuuuuuuucuggguuca

SEQ ID NO: 442721 - RNA, 64 nt, hsa
acuccacccaacacguuuuugcaaagcaagaagucuuuguaagacaccuuaaacaaaguccuuc

SEQ ID NO: 442722 - RNA, 64 nt, hsa
gcccugauggucauuuuucuaaacagaggcccugcuuuguaauauguggccaaggagauaauuu

SEQ ID NO: 442723 - RNA, 64 nt, hsa
uucauguuuuucuguagcacugggcccaaauauucuuuguaaagaaaaucgcugcagcaaaaac

SEQ ID NO: 442724 - RNA, 64 nt, hsa
uauuuaagucggcagcuuucuaauuuaaucuuagcuuuguaauucauguuuugcuuuuguggac

SEQ ID NO: 442725 - RNA, 64 nt, hsa
ucaccaaauaaucuuaccucuagucuacuuacaacuuuguaaggguuucuaagcuaugcccauu

SEQ ID NO: 442726 - RNA, 64 nt, hsa
augaaaaucaaaugaugcaaaauauauacaagcacuuuguaaauuguaaaaugauacaaaauuu

SEQ ID NO: 442727 - RNA, 64 nt, hsa
guugugugaagcucuuggcuuuuuuccaacguuacuuuguaacuaaugaggguggauguucauu

SEQ ID NO: 442728 - RNA, 64 nt, hsa
auguuauuguugacucucucccaagugccuugaucuuuguaauaucuccuguuguuucuaugau

SEQ ID NO: 442729 - RNA, 64 nt, hsa
ugauacaagaaacaaccuuggaaaaguuauuucccuuuguaauaccuuuaaaaauccagaguau

SEQ ID NO: 442730 - RNA, 64 nt, hsa
acauaaccuuaaaaaggacuauauuaaucaccuucuuuguaaucccuucacagucccagguuua

SEQ ID NO: 442731 - RNA, 64 nt, hsa
gcauuuaaggaaacuagacaaguaaaauuauccucuuuguaauuuaaugaaaagguacaacaga

SEQ ID NO: 442732 - RNA, 56 nt, hsa; identical to SEQ ID NO: 66425

SEQ ID NO: 442733 - RNA, 64 nt, hsa
agccaaagaucauuuuuuuauauagacuucagcccuuuguaaauauuguaacuggggaguauag

SEQ ID NO: 442734 - RNA, 64 nt, hsa
cccaacaauuaaaucuugccuuuacacacccaaacuuuguaauuuuagucuuggugaaauauaa

SEQ ID NO: 442735 - RNA, 64 nt, hsa
ucagggugcuuuuauauauaagagcagcagccgccuuuguaaagugugaucuaugagaauugga

SEQ ID NO: 442736 - RNA, 64 nt, hsa
aaucaguagaacuuacacauccuaggaaaucuuucuuuguaaguaauucuuuuggucucaagug

SEQ ID NO: 442737 - RNA, 64 nt, hsa
uuacugucaccuugauggacaaguuucaauaaaacuuuguaaaaauaauuggacaugugccugg

SEQ ID NO: 442738 - RNA, 64 nt, hsa
ugggccauggagcuggcccagaggccccucagcccuuuguaaagucugaugaaggcaggggugg

SEQ ID NO: 442739 - RNA, 64 nt, hsa
aagauagaaaggaacaagacuaaaauuguaaauacuuuguaaacaucagcauuuguacuugaau

SEQ ID NO: 442740 - RNA, 64 nt, hsa
agaaccucucacaagcuggggcaggucaccuuaucuuuguaagaugaggauaucaucuagauca

SEQ ID NO: 442741 - RNA, 64 nt, hsa
ggaggguaggccucagaccagggggucuccaaaacuuuguaaaucaugcaucuuuucuccauaa

SEQ ID NO: 442742 - RNA, 64 nt, hsa
uuuccucagccucgaaaagugggcucuggaaucccuuuguaaauagguguguugaauuuguuuu

SEQ ID NO: 442743 - RNA, 64 nt, hsa
gcuaagguugggaggcuaacgagucuaccucccucuuuguaaaucaaagaauuguuuaaaaugg

SEQ ID NO: 442744 - RNA, 64 nt, hsa
uuuccuuuucuuuuucuuuccuuucauuuuuuuucuuuguaaugcaccugacagaaaaaaaaga

SEQ ID NO: 442745 - RNA, 64 nt, hsa
ucaaacauugugaucuauaaaugcacagaaaauacuuuguaaaaaguagcauccuuauauaaua

SEQ ID NO: 442746 - RNA, 64 nt, hsa
aauuuucugcuuuguauauuucuauauuguuuaacuuuguaagaaugcccauuacuuuuuuaac

SEQ ID NO: 442747 - RNA, 64 nt, hsa
auguugauuuuagaagauggagaacuccagccaccuuuguaaagcacuaguguuugucauuuau

SEQ ID NO: 442748 - RNA, 64 nt, hsa
uaaugcuguugccucaucuauaacaugcauuugucuuuguaaugucaccaccuucccagcucuc

SEQ ID NO: 442749 - RNA, 64 nt, hsa
cuccugucuuucucauccaggucaggcauugacacuuuguaagaaaggggguaggggacacagc

SEQ ID NO: 442750 - RNA, 64 nt, hsa
gggguuucugcaucaauuagaauaucauuaauuucuuuguaaccaagugaaaaacuauacuuuu

SEQ ID NO: 442751 - RNA, 64 nt, hsa
gcuuuauuuaaagucuucuguccagcuuuaagcacuuuguaagacauggcugaaaguagcuuuu

SEQ ID NO: 442752 - RNA, 64 nt, hsa
ucgucagucaaaccccuuuaaaauguugcuuuggcuuuguaaauuuaaauauguaagugcuaua

SEQ ID NO: 442753 - RNA, 64 nt, hsa
uuuuuucucuuuauguaguuugacuaugccuuaccuuuguaaauauuuuugcuuguguugucgc

SEQ ID NO: 442754 - RNA, 64 nt, hsa
uuuaaaugaaauggggagauauuuacauuccguacuuuguaaacuugagcuauuggacuucacu

SEQ ID NO: 442755 - RNA, 64 nt, hsa
accuuacauuguaacaaucuuacugguggaaagucuuuguaaggaaaaaacacauagcaaggag

SEQ ID NO: 442756 - RNA, 64 nt, hsa
uugguuuuugauagaacagaggccagcaaacuuucuuuguaaaaggcugguuaguaaauuauug

SEQ ID NO: 442757 - RNA, 64 nt, hsa
cuacugaagagcucaaugauugacaucugaaaugcuuuguaauuauugacuucagccccuaaga

SEQ ID NO: 442758 - RNA, 64 nt, hsa
uuaacuguaacuaaguucaacagacuauuauuaucuuuguaauaaauuaaccuagcaauaaaaa

SEQ ID NO: 442759 - RNA, 64 nt, hsa
uuucucugcucucauuuaacccgucaaacacaaucuuuguaaagcuagauuggugguguuuuau

SEQ ID NO: 442760 - RNA, 64 nt, hsa
gucuagagagggucgucuggccugcuugcugggucuuuguaacccagcacuuccucuugcccuc

SEQ ID NO: 442761 - RNA, 64 nt, hsa
augcagaugaagaggguaggaacuaaauaaaggacuuuguaagccaaagugguugggcugcuuu

SEQ ID NO: 442762 - RNA, 64 nt, hsa
cucccaccccagaucccagggacucauccugugacuuuguaaccacacucauuccuuucaaaca

SEQ ID NO: 442763 - RNA, 64 nt, hsa
uguuuuaaauguacagacauauuuaacuggugcacuuuguaaauucccuggggaaaacuugcag

SEQ ID NO: 442764 - RNA, 64 nt, hsa
ggcacuggauucuaaguaguugccaucuugaauccuuuguaauaaagccauacuuuugugugug

SEQ ID NO: 442765 - RNA, 64 nt, hsa
ucaaccugcucauuaaaucaucucucuauuaguucuuuguaaaucacuuaguacauuagagcua

SEQ ID NO: 442766 - RNA, 64 nt, hsa
auaaaugauauggcauguacuuucaauuauguagcuuuguaacuaugaauauuuacauauuuug

SEQ ID NO: 442767 - RNA, 64 nt, hsa
aguggcuuuuuguuuccccaaggggaaagacuggcuuuguaauuauaauuuuuuccuuauuuau

SEQ ID NO: 442768 - RNA, 64 nt, hsa
uguauauuacuuuuauuuuuaggaccauaaucaacuuuguaauauucuuauauaauuaauuagu

SEQ ID NO: 442769 - RNA, 64 nt, hsa
ucagaauauucuucuaaguauuuugaugaaguaacuuuguaauuauuugaacauuguuuuaauc

SEQ ID NO: 442770 - RNA, 64 nt, hsa
uaagguugaacuuugccaaaaaaaaaagaaguuacuuuguaauuuuuggggaaaaaagcacaua

SEQ ID NO: 442771 - RNA, 64 nt, hsa
auaguuaauuuguucuuaccaaaaaauaaaauuacuuuguaaauagcaguucacauuuuuccac

SEQ ID NO: 442772 - RNA, 64 nt, hsa
uacuucuacuggacaucacagaauucuuuggguucuuuguaauuuaaugaauaggucugaaaac

SEQ ID NO: 442773 - RNA, 64 nt, hsa
uauauuggguuugcuuuauuucauaggcuuaauucuuuguaaaucugaaugaccauaauagaaa

SEQ ID NO: 442774 - RNA, 64 nt, hsa
uuuuaaaagcuuugcaaccuauauauuuauauaacuuuguaauauaacaugggcaaauaucuga

SEQ ID NO: 442775 - RNA, 64 nt, hsa
aguuuugggaauaggcaucaaugggugguauuugcuuuguaacuccccccagguacgauaggga

SEQ ID NO: 442776 - RNA, 64 nt, hsa
ggaugggggaaacacagcaguucuugguaaaguccuuuguaauaauaguuugauuuuuuuauuu

SEQ ID NO: 442777 - RNA, 64 nt, hsa
uauggaauguucuuauuuagcuuaucauaaucuacuuuguaaaacaugcugaaaccucacugug

SEQ ID NO: 442778 - RNA, 64 nt, hsa
uggaauucagaaagguuacccccuuccucugugucuuuguaaggauacauuuggaagaacauac

SEQ ID NO: 442779 - RNA, 64 nt, hsa
cgucauugaagucugcuugauuaaaccauaauaucuuuguaauaauuggauuuaaaaugcuaug

SEQ ID NO: 442780 - RNA, 64 nt, hsa
uuuuauuaauuuaaaauagaacgcuugagaggcacuuuguaaagauuuguuaaacuggaaacgu

SEQ ID NO: 442781 - RNA, 64 nt, hsa
cuauuccauauuguauccacaauuuaugauaucacuuuguaacccauacauuuauacaauuaua

SEQ ID NO: 442782 - RNA, 64 nt, hsa
agcugcuuagauuuagaaaucuacucuugcuggucuuuguaaguugcaugaauauuugacuuug

SEQ ID NO: 442783 - RNA, 64 nt, hsa
ucucucucagcaaaauaaaacugugaugugucuucuuuguaaaaguuuagguauaaaaugcuau

SEQ ID NO: 442784 - RNA, 64 nt, hsa
uaaaaagaccauuaacuuaaagugguguuaaaugcuuuguaaagcugagaucuaaauggggaca

SEQ ID NO: 442785 - RNA, 64 nt, hsa
auccugggcagccaaccaggcaacaccaaggacucuuuguaaacgauagcugaucgugugcacg

SEQ ID NO: 442786 - RNA, 64 nt, hsa
uuaucagcaacauaaauuuaucaaauuugcagcacuuuguaaaugaugagauugcuuccuaccu

SEQ ID NO: 442787 - RNA, 64 nt, hsa
uauuuuaaacuugugauaggcauaucuaugaaaccuuuguaaauuuaguuuauugcuuuaccau

SEQ ID NO: 442788 - RNA, 64 nt, hsa
guguuuguauuuucaacuggaguacauguauuuucuuuguaaaguagcuuccuaugaaaaugug

SEQ ID NO: 442789 - RNA, 64 nt, hsa
aaagauucaccaggcacuggcaugaagaaagagucuuuguaaauggacauugaacaaacaaacu

SEQ ID NO: 442790 - RNA, 64 nt, hsa
agucauaauucauaaaauuuuaguuuaaugugcucuuuguaaaaugaaauuguaaagaaaauac

SEQ ID NO: 442791 - RNA, 64 nt, hsa
gaacaaagaggaaaucaucuucauaguaaugaaacuuuguaaaguguuuccuuauauugguaau

SEQ ID NO: 442792 - RNA, 64 nt, hsa
cagagggcuuacagccucagcaaggaccuuguggcuuuguaacaacaaucagccauaacaaguu

SEQ ID NO: 442793 - RNA, 64 nt, hsa
aaauaguuacauuucacaaaagauauuuuaaacucuuuguaaaacuuagauaauagagccuagc

SEQ ID NO: 442794 - RNA, 64 nt, hsa
uccuggagaaugggaguguuaagacuuuugacuucuuuguaaguuuuguacugcuuuggagagu

SEQ ID NO: 442795 - RNA, 64 nt, hsa
auaacccuaaugaugcaagucauaugggggaacacuuuguaaauggucaggauaaaaaccaaau

SEQ ID NO: 442796 - RNA, 64 nt, hsa
auaauuuuuuuacccauaagacaucacauuaucccuuuguaagcuacuuaucuccaaaaaacuu

SEQ ID NO: 442797 - RNA, 64 nt, hsa
uuucauuuucguuaagaauuuggggcaggaaauacuuuguaacuuuguauaugaaucaaaacaa

SEQ ID NO: 442798 - RNA, 64 nt, hsa
uucugguuuuuacuuuuuuaauguaagucucagucuuuguaauuaauuauugaauugugagaac

SEQ ID NO: 442799 - RNA, 64 nt, hsa
uaugugguuugccccaagugugcacuauuuaauacuuuguaauaugccaccaagaguacugaca

SEQ ID NO: 442800 - RNA, 64 nt, hsa
uuuccuaugcaguuuagccaccuucucauuaauucuuuguaacagcaaauccuaggcucagagg

SEQ ID NO: 442801 - RNA, 64 nt, hsa
acaggaggaucucuaaagcaguagccaaacaccacuuuguaaaaggacucuuccaucagagaug

SEQ ID NO: 442802 - RNA, 64 nt, hsa
uuaaaauagcuuaaaaguuuguaaaaaaaugaaucuuuguaauuacuuaauauguuaguuaaga

SEQ ID NO: 442803 - RNA, 64 nt, hsa
ugaucuaugaauguuuuucuuaaaauuuacaaagcuuuguaaauuagauuuucuuuaauaaaau

SEQ ID NO: 442804 - RNA, 64 nt, hsa
uaucuaauucacaaauuaauuucuggaaauuaaacuuuguaaauuaaguuuuugccuauaagaa

SEQ ID NO: 442805 - RNA, 64 nt, hsa
ugaagaugucaauaagcuugcauuaagccaccugcuuuguaaguggauugauuaauaaauaacu

SEQ ID NO: 442806 - RNA, 64 nt, hsa
guaaauuaaauguuauuugaaaauguuauaagagcuuuguaaauauuucagaaaauaugggaua

SEQ ID NO: 442807 - RNA, 64 nt, hsa
aaguguuuacaggaugcccuucugaaggguaguccuuuguaaagcuguacagacuuugcaguuu

SEQ ID NO: 442808 - RNA, 64 nt, hsa
augugguuugcccucaauugagcacuguuuauuacuuuguaauaugccacugugaguacugaca

SEQ ID NO: 442809 - RNA, 64 nt, hsa
gcuguaaggcugggcugcugcgacacaggcagcgcuuuguaaacugugaagccauauacgugaa

SEQ ID NO: 442810 - RNA, 64 nt, hsa
caagggcaauucccaucucauccaucacucaggucuuuguaaagggugcagccaagcucugcag

SEQ ID NO: 442811 - RNA, 64 nt, hsa
acuagugauugucagacugguauggaggugacugcuuuguaagguuuugucguuucuaauacag

SEQ ID NO: 442812 - RNA, 64 nt, hsa
cgucuuauuuuccuucuuccuagaugacucagcucuuuguaaauguugugcucaacuucuaggg

SEQ ID NO: 442813 - RNA, 64 nt, hsa; identical to SEQ ID NO: 442799

SEQ ID NO: 442814 - RNA, 64 nt, hsa
augcgguuugcccucaagugugcacuguuuauuacuuuguaauaugccacugugaguacugaca

SEQ ID NO: 442815 - RNA, 64 nt, hsa
aguuuuaguggccuguccuugaccugccgugguccuuuguaaacuauggcuccaugcuguguga

SEQ ID NO: 442816 - RNA, 64 nt, hsa
uuuugagacuggccucuuuuacucaccauaaugccuuuguaauucauccaugcuguugugugua

SEQ ID NO: 442817 - RNA, 64 nt, hsa
caauacauuguacaugaaaaaaugaaaaguagaacuuuguaauacuuuaaucaauaaaauuaau

SEQ ID NO: 442818 - RNA, 64 nt, hsa
uaaagcauccgguucuaaaauuaauuuguugcagcuuuguaaauauuucuuuaagauucagccu

SEQ ID NO: 442819 - RNA, 64 nt, hsa
cagaaguuccagacagaugagaaagcaaaaaguacuuuguaaaguguuauacaaucagaaggug

SEQ ID NO: 442820 - RNA, 64 nt, hsa
gcacugggguauuguuggcuucuuguguuggaaacuuuguaauguaaaaggaaaaacuggaaau

SEQ ID NO: 442821 - RNA, 64 nt, hsa
ugugaggaauugaugagaugauguaugugaaacacuuuguaaccuguaaagcgcugugcacacg

SEQ ID NO: 442822 - RNA, 64 nt, hsa
uucaaagacucgaauucauuuucucagucauuuccuuuguaacagaguuuuacgacuuagaguc

SEQ ID NO: 442823 - RNA, 64 nt, hsa
uacauagaggugauaaguaauaaaacuaugaacacuuuguaaaacauugacauuuuauuuucca

SEQ ID NO: 442824 - RNA, 64 nt, hsa
uagcgccuacuucacggaaacuugugccuuuaaacuuuguaaacuuaaacacagccgagaaguu

SEQ ID NO: 442825 - RNA, 64 nt, hsa
guuuaaauuauucagugcuaaucauuguuuuuuccuuuguaaauguugauucagaaaaggaaag

SEQ ID NO: 442826 - RNA, 64 nt, hsa
auauguuacugccccacccuaacugaucaauguacuuuguaauccucccacccuuaagaagguu

SEQ ID NO: 442827 - RNA, 64 nt, hsa
uuccuggauuauucaaaaugauguauguugaagccuuuguaaauugucagaugcugugcaaaug

SEQ ID NO: 442828 - RNA, 64 nt, hsa
cuuagauuuaaaaagugaaagaaacugcaggcgccuuuguaaaaugcaaaauauuuaauuaaaa

SEQ ID NO: 442829 - RNA, 64 nt, hsa
caccccugucucucaccuccaccaaccccacucacuuuguaacuucaucacugacccggccaau

SEQ ID NO: 442830 - RNA, 64 nt, hsa
ugacguugaucuccugguagcaugaccuuuuggccuuuguaagacacacagccuuucuguauca

SEQ ID NO: 442831 - RNA, 64 nt, hsa
caaacacguagcauuugcaccccuccaaagccaucuuuguaaaggaaaacguauuuguaauuga

SEQ ID NO: 442832 - RNA, 64 nt, hsa
uuacuacagauugacacguuuuuaauuagcuguccuuuguaagaagucaggaaaucugaugcug

SEQ ID NO: 442833 - RNA, 64 nt, hsa
gucuuagaaugcgaaucuguguuaagaaucuagucuuuguaauagaaguuucccaguggcauuc

SEQ ID NO: 442834 - RNA, 64 nt, hsa
auaggaacuucagaggcuuuguuuaaacgcaaagcuuuguaaaagccacaaggucugagcugaa

SEQ ID NO: 442835 - RNA, 64 nt, hsa
uaauacugcuaccuucagggcagaagacacugcucuuuguaacccagccaccaccaaaaagcaa

SEQ ID NO: 442836 - RNA, 64 nt, hsa
aaguggggagaaaaaaaccaagaggccaccgugccuuuguaaagaaacaaaauaaaguuuguac

SEQ ID NO: 442837 - RNA, 64 nt, hsa
cagagcuuuuuggaaauacucagauccuggccgccuuuguaaccuucucuaaacgucaggccug

SEQ ID NO: 442838 - RNA, 64 nt, hsa
caaacucugcuuccuuggacagauuuggcaauagcuuuguaagugauguggacauaauugccua

SEQ ID NO: 442839 - RNA, 64 nt, hsa
aucuguguuagaaguguugcaaaugcuguacugacuuuguaaaauauaaaacuaaggaaaacuc

SEQ ID NO: 442840 - RNA, 64 nt, hsa
uauaguguuuggacagcugauaaauuuaauccuucuuuguaauacuuucuaugugacauuucuc

SEQ ID NO: 442841 - RNA, 64 nt, hsa
uugaagagucaucugauucgaggccacucauguucuuuguaacuuaaacuuugaccaagaaauu

SEQ ID NO: 442842 - RNA, 64 nt, hsa
cuggcuguuuucuucuggggcuuagucgaaucagcuuuguaauguuaugggacaaaaaucaauu

SEQ ID NO: 442843 - RNA, 64 nt, hsa
augucaccuauaugggauuugccuguuuuaauaacuuuguaaggaauucuugcucuucuagggg

SEQ ID NO: 442844 - RNA, 64 nt, hsa
auagcaacucauuuauuucauuuuggucuuaaugcuuuguaaacaggucaaaaaauacugucau

SEQ ID NO: 442845 - RNA, 64 nt, hsa
ucuccaucccuauucccuccucugaaaugcaccccuuuguaauugaggacaaggugguucugug

SEQ ID NO: 442846 - RNA, 64 nt, hsa
uuguuuaugucagagcuuuguuguaagccucucacuuuguaaggaaauucuuauuggguagguu

SEQ ID NO: 442847 - RNA, 64 nt, hsa
aauuuuuuugcauuuaugaacggcuguuuuucuacuuuguaauugugagacauuuucuugggga

SEQ ID NO: 442848 - RNA, 64 nt, hsa
aacuguuaugccuuuuauuuguuugcaaggaugucuuuguaauguguuucaugaauagaauauc

SEQ ID NO: 442849 - RNA, 64 nt, hsa
ugucacauaggaauuguucagcaacagaaagauacuuuguaaugagaagguacaaauuugagua

SEQ ID NO: 442850 - RNA, 64 nt, hsa
aauuugagaaaaaucugggucuuucuaaaaacugcuuuguaaguuacuuuuucuuuaugacuuc

SEQ ID NO: 442851 - RNA, 64 nt, hsa
ugcccugcauccccccuccucugccugagugugucuuuguaaugucagcuggcaucauacaaag

SEQ ID NO: 442852 - RNA, 64 nt, hsa
agcagggacugugagagacaaccagcagcauccucuuuguaaucacagggcagggaucagaguu

SEQ ID NO: 442853 - RNA, 64 nt, hsa
uccaggccugaaccccucccgugcuguaauaaaucuuuguaaauaacugcugagacuccucuuu

SEQ ID NO: 442854 - RNA, 64 nt, hsa
cucgaacccacacugcaacaggaacugugagagucuuuguaaguaaacugcccugucuagguca

SEQ ID NO: 442855 - RNA, 64 nt, hsa
uugcagaccugggacuuuagggcuaaccaguucucuuuguaaggacuugugccucuugggagac

SEQ ID NO: 442856 - RNA, 64 nt, hsa
uagacucuacauugggcagccuuuaaauaugauucuuuguaaugcuaaauagccuuuuuuucuc

SEQ ID NO: 442857 - RNA, 64 nt, hsa
auauauauacuuuuucauauauaauuagaucuuucuuuguaauuucauauguaguucuucauag

SEQ ID NO: 442858 - RNA, 64 nt, hsa
uccuugguugauaacugucuugauacuuuucauucuuuguaagaggccaaaucgucuaaggacg

SEQ ID NO: 442859 - RNA, 64 nt, hsa
ugaucagugugcuaaaucucucugccuguuuggacuuuguaauuauuuuuuuagcaguaauuaa

SEQ ID NO: 442860 - RNA, 64 nt, hsa
gcugaaaacuaccuguggguuaaggauguaguuccuuuguaagggugggcaggccucguaagaa

SEQ ID NO: 442861 - RNA, 64 nt, hsa
ggaaggacccgcuuccuguugucggugcuaauuccuuuguaauuccagcccccugucgccuguc

SEQ ID NO: 442862 - RNA, 64 nt, hsa
aaggcugcaucuuuauauguuacauucauauaaacuuuguaacuuuuuggacauugaaagaugu

SEQ ID NO: 442863 - RNA, 64 nt, hsa
cuugagucugggauuauccgcauuguauuuagugcuuuguaauaaaauauguuuuguaguaaca

SEQ ID NO: 442864 - RNA, 64 nt, hsa
uuuggcacaaauauuuuaucauaugcagucacuucuuuguaaaugauuuuuuguaaagucauug

SEQ ID NO: 442865 - RNA, 64 nt, hsa
acaucaccaugacaucucucuccaaaguaacgaccuuuguaagugaagaugcucuuccagagac

SEQ ID NO: 442866 - RNA, 64 nt, hsa
cccuccuuugcccugggacaucuguaucucuuggcuuuguaauaaaugcugcauacuuucugga

SEQ ID NO: 442867 - RNA, 64 nt, hsa
cucgcccugcugcauuugcucuugucuggauuaacuuuguaauuuauggaguauugugcacaac

SEQ ID NO: 442868 - RNA, 64 nt, hsa
auauucagucacaagucauuuuggucauguuggucuuuguaacaaaucaaaauuaccuuauauc

SEQ ID NO: 442869 - RNA, 64 nt, hsa
uuuuagacuuuuuuuuauaaauagacuuauuuuccuuuguaauguauuggccuuuuagugagua

SEQ ID NO: 442870 - RNA, 64 nt, hsa
gauuacaucaagcuaauugugcgagcucaauucacuuuguaagaaaacucucggagaaauaaaa

SEQ ID NO: 442871 - RNA, 64 nt, hsa
acuacacaauucuccuucgggaccucaauuuccacuuuguaaaaugaggguggaggugggaaua

SEQ ID NO: 442872 - RNA, 64 nt, hsa
guuacugaggaccaaagauacauguaaaauagggcuuuguaaacuccacagggacuguucuaua

SEQ ID NO: 442873 - RNA, 64 nt, hsa
ccuugguacugcagagucuggguuguagagaacucuuuguaagcaauaaaguuuggggugauga

SEQ ID NO: 442874 - RNA, 64 nt, hsa
uuaccuccccuuuucuauguugcuauuguaaggucuuuguaaaaucuugcaguuuuguaagccc

SEQ ID NO: 442875 - RNA, 64 nt, hsa
gugcaauugucuuuuuuuuccuuugaacgugcuucuuuguaaugaccaagguaccgauuucugc

SEQ ID NO: 442876 - RNA, 64 nt, hsa
cuguacucuccacauuauuuuaaauauuaguugccuuuguaaacaguuuccccucccccacccc

SEQ ID NO: 442877 - RNA, 64 nt, hsa
uuccguuucuuaaguauugcgcagauuuguucaacuuuguaaauauggacaucacuuuuuuuuu

SEQ ID NO: 442878 - RNA, 64 nt, hsa
aguaguacaugggaaaaacaguaugggaagaguucuuuguaauguaaggaaauaacaauguagu

SEQ ID NO: 442879 - RNA, 64 nt, hsa
uaaaaaaaaauaaaauuauuuugaauuauucuaccuuuguaaacaauuggcuaaaagaaucauc

SEQ ID NO: 442880 - RNA, 64 nt, hsa
gaauacaugaucuugaacagcuccuguacuugcucuuuguaaaaaaaaauaaaauuauuuugaa

SEQ ID NO: 442881 - RNA, 64 nt, hsa
uucagaaauaugaauaaauaguuuuuguuaaacccuuuguaaaauaccaagguucccguuaaca

SEQ ID NO: 442882 - RNA, 64 nt, hsa
agaaauucauguuuacuuuucuagguguaugauacuuuguaaaguugauacuuuccuaagaauu

SEQ ID NO: 442883 - RNA, 64 nt, hsa
acauggaaaauguuaaggaagcaaaugguuguaacuuuguaaguacuuauaacaugguguaucu

SEQ ID NO: 442884 - RNA, 64 nt, hsa
guggugguuuuucguucucuuaaauaaucaggugcuuuguaaccaagcacaucggaaccagagg

SEQ ID NO: 442885 - RNA, 64 nt, hsa
guucaaagaugagggccuggcuuccgugcucuggcuuuguaacuuaucuggaagggaaagcaca

SEQ ID NO: 442886 - RNA, 64 nt, hsa
uguacuguggauuguacauuuaacuuuggaauggcuuuguaauaaucagucuuaagaaaauguu

SEQ ID NO: 442887 - RNA, 64 nt, hsa
caugcuuuacugccauugcuguaugcuuuacugucuuuguaaaaaucccccucuccccuuuucu

SEQ ID NO: 442888 - RNA, 64 nt, hsa
uuuauccaugauauucaguacaacucugucauuucuuuguaauauuuaaaaaauauuaguaaag

SEQ ID NO: 442889 - RNA, 64 nt, hsa
gaaaauguuuugaauuuauaaaauuaauguuuuucuuuguaacauuuauauauauuuuuuaaca

SEQ ID NO: 442890 - RNA, 64 nt, hsa
cauuuugauuuguauucaaguacucuucaaguaucuuuguaaugaagguuuggcuacuuguaua

SEQ ID NO: 442891 - RNA, 64 nt, hsa
uugaucaguauuccuccucuaucaccuuuuuagacuuuguaagguaaauauuuggacuaacuuu

SEQ ID NO: 442892 - RNA, 64 nt, hsa
aaauugcugggccauaugaaaaaucaauaguuagcuuuguaagaaacagucaaacuguuuucca

SEQ ID NO: 442893 - RNA, 64 nt, hsa
ccuaucuaucauacucccaaauuccuucuugcaucuuuguaauuucucacucuuccuucucccu

SEQ ID NO: 442894 - RNA, 64 nt, hsa
uuguucuguauuuuuaaauugccaagaaaaacaacuuuguaaauuuggagauauuuuccaacag

SEQ ID NO: 442895 - RNA, 64 nt, hsa
aaaccuuauaaaaacagguuccaaauauucacugcuuuguaaaaaugaacaaacaugagacugu

SEQ ID NO: 442896 - RNA, 64 nt, hsa
uuacugggauagucagguaaacaguuggucaagacuuuguaaagaaauugguuucuguaaaucc

SEQ ID NO: 442897 - RNA, 64 nt, hsa
ucaguauuugguggucccuaugacuuauacauaacuuuguaaaaagaaaaaaaaauuuuuucug

SEQ ID NO: 442898 - RNA, 64 nt, hsa
ggaagcacccaucuucacuuggugcugccaucaacuuuguaagauugcauucuauuuauuguga

SEQ ID NO: 442899 - RNA, 64 nt, hsa
aaauguaggauacuuuuuauuuggggcucauugucuuuguaauuacggagaggaacaaaccauc

SEQ ID NO: 442900 - RNA, 64 nt, hsa
auucauugcuuuacauacuagacauuuuucuucucuuuguaaguagauucaaauuagauaguca

SEQ ID NO: 442901 - RNA, 64 nt, hsa
aaaucugccuaauuuuucuugaaagcuaaauuuucuuuguaaguuuuuacaaauuguuuaauac

SEQ ID NO: 442902 - RNA, 64 nt, hsa
accaggagcaagagaccagaaggaugaucugcuccuuuguaacguuguugagggcccucuuguu

SEQ ID NO: 442903 - RNA, 64 nt, hsa
augugugaaaucuaagcaguaauguacuuucucccuuuguaaagacuuggggaguaaggacauu

SEQ ID NO: 442904 - RNA, 63 nt, hsa; identical to SEQ ID NO: 67316

SEQ ID NO: 442905 - RNA, 64 nt, hsa
cccgacuuccucugccaguuauugacacagcucucuuuguaagagaggaaagaaacuaaaccca

SEQ ID NO: 442906 - RNA, 64 nt, hsa
cgcaggugucccggucugcauaagccucgugugccuuuguaaaguccaccuacacuuuugacca

SEQ ID NO: 442907 - RNA, 63 nt, hsa
auaucagugauacugaugagaauaaacuaaacgccuuuguaacagccuugccgcaugcucguu

SEQ ID NO: 442908 - RNA, 64 nt, hsa
accgcugggcucgcuggugaccgccacagccccgcuuuguaaccagggaauacacagucauuuc

SEQ ID NO: 442909 - RNA, 64 nt, hsa
uucuugaaccccgaccacuaccccagguuucuaacuuuguaacuugcuucugaugugggucccu

SEQ ID NO: 442910 - RNA, 64 nt, hsa
gagagaggacagguccucaacaaauggcaugugacuuuguaaguguagaauugcugugagguau

SEQ ID NO: 442911 - RNA, 64 nt, hsa
gccccgccccagggcaauguuggacccccuuuuacuuuguaaaguuuguauuuauuccccuuua

SEQ ID NO: 442912 - RNA, 64 nt, hsa
gggcccguccuaggaauggauguggggauggucgcuuuguaaugugcugguucucuuuuuuuuu

SEQ ID NO: 442913 - RNA, 64 nt, hsa
uuggaaaauucaccaccucuagcuccucacuguucuuuguaauuaacacgcuguugguaaucuu

SEQ ID NO: 442914 - RNA, 64 nt, hsa
aucccgccccaaacguccgcuuuccuuuucucuacuuuguaauuuauugaucaguuucuguugg

SEQ ID NO: 442915 - RNA, 64 nt, hsa
uuccugcccucuaauuugggggcagcaguuugugcuuuguaagcuucagucuuauuuauagugu

SEQ ID NO: 442916 - RNA, 64 nt, hsa
acauaugugggaggcuuucaugagguguguugcacuuuguaacugucuagagcucuugauggaa

SEQ ID NO: 442917 - RNA, 64 nt, hsa
aaaaaggcaaccaaccacauuagaagucuuggcacuuuguaacggaacggguacuacacuuuau

SEQ ID NO: 442918 - RNA, 64 nt, hsa
cuguugucuuaaugccauuucauuucacaugguacuuuguaaauuuugacgagaaaguugguug

SEQ ID NO: 442919 - RNA, 64 nt, hsa
uuuuccaggucaguacguaaagauguaacccauucuuuguaagguucagaauauuucuagaaug

SEQ ID NO: 442920 - RNA, 64 nt, hsa
acauauuugcacaaguacaguaacaaucugcuuucuuuguaacaugacacauuugaaaucauug

SEQ ID NO: 442921 - RNA, 64 nt, hsa
ggaagaaguguaacucaccagccucugcucuuaucuuuguaauaaauguuaaagccagaaguug

SEQ ID NO: 442922 - RNA, 64 nt, hsa
guauaauacauauguuguacuuuuauguauuucacuuuguaacaaaguaucuuucaguuuuaua

SEQ ID NO: 442923 - RNA, 64 nt, hsa
aaaccuaaaaaguacaguguguuuaucacgagagcuuuguaagguacuucacuuccacuuuaaa

SEQ ID NO: 442924 - RNA, 64 nt, hsa
aauucuacaaaaaaauguuguuaauaaaugucugcuuuguaaaagcaguuuugcaauuuuuuaa

SEQ ID NO: 442925 - RNA, 64 nt, hsa
gcugugguugcugugacaguuucguuuucugaaucuuuguaaugcucuuccacccugcucgugc

SEQ ID NO: 442926 - RNA, 64 nt, hsa
aaaucugaacuaacuugcuuuuagaagucuuuuucuuuguaagcauuguaaaugcuaauaaauc

SEQ ID NO: 442927 - RNA, 64 nt, hsa
guguguccccuguccugccccaccgguuugcuggcuuuguaauaacauaagaccauugugguug

SEQ ID NO: 442928 - RNA, 64 nt, hsa
gccucuugaagcuuuuucugccuccugauucucucuuuguaaacuauuuucaaauuguuuuuca

SEQ ID NO: 442929 - RNA, 64 nt, hsa
aauacaguauuuuccaugguucugccugcacuuacuuuguaaugccacgguugagauugagaga

SEQ ID NO: 442930 - RNA, 63 nt, hsa
uggaugugaaucuuacauuccuuuucaucauuuccuuuguaaaaaugacgagugcuggguuuu

SEQ ID NO: 442931 - RNA, 64 nt, hsa
uuuuucguuuuaaauuuuagauuuuauuuuagugcuuuguaauuaauugggguuuauauugaua

SEQ ID NO: 442932 - RNA, 64 nt, hsa
ggaauggcuucaaaauaagucacgaacacaaauucuuuguaaauuauguaaauuccuguuuaua

SEQ ID NO: 442933 - RNA, 64 nt, hsa
gucuuccccacccagcucuccccugcgccccugucuuuguaaauugacccuucuggaguggggg

SEQ ID NO: 442934 - RNA, 62 nt, hsa
acccuaauaaacaccugcucacuggcuggguauucuuuguaaccaguguuucuggcuccugc

SEQ ID NO: 442935 - RNA, 64 nt, hsa
agcauuagaaacauugagaguucaagugcuguuucuuuguaaaaauguauccagaguaguugga

SEQ ID NO: 442936 - RNA, 64 nt, hsa
cuaagcacguuugggaaggaacagccuaaagaugcuuuguaaagcuguauuuuacccuugagcu

SEQ ID NO: 442937 - RNA, 64 nt, hsa
ccugcuucacagaauaaugggaagugacucuagucuuuguaagcaauuuucauucucauuagga

SEQ ID NO: 442938 - RNA, 64 nt, hsa
uuaauugugugaacuuggaagcacaccaaucuuacuuuguaaauucugauuucuuuucaccauu

SEQ ID NO: 442939 - RNA, 64 nt, hsa
aaagagaaaaguacaagacagaaaucuucuagcacuuuguaaacacagugaauaaccucuugga

SEQ ID NO: 442940 - RNA, 64 nt, hsa
aagucauaggacuggcaaagcaacuguuuaaacccuuuguaaccggggccuugcccccaccucc

SEQ ID NO: 442941 - RNA, 64 nt, hsa
ucuaucaaacaaaugacuuucauauugcaacaaucuuuguaagaaccacucaaauaaaagucuc

SEQ ID NO: 442942 - RNA, 64 nt, hsa
gguaucuuuucaauuaauguaucuguaaaaguuucuuuguaaauacuauguguucugguguguc

SEQ ID NO: 442943 - RNA, 64 nt, hsa
uggaacugcagggaacuucucugcuccuccuugucuuuguaaaaagggaccaccucccuggggc

SEQ ID NO: 442944 - RNA, 64 nt, hsa
uugagacuggcagcaguggguauaugguaaaagccuuuguaaaacagugcauuuuucagauuug

SEQ ID NO: 442945 - RNA, 64 nt, hsa
guuccaacaguggccuucuccgggcuucauaguucuuuguaauauguugaaguuaauuugaauu

SEQ ID NO: 442946 - RNA, 64 nt, hsa
acacugcccaaccccaggucuaaguccagucugucuuuguaagcauggaaauaugguguccacg

SEQ ID NO: 442947 - RNA, 64 nt, hsa
cuugugucuggacuaaguuaaaagaauuaaaauacuuuguaauguccugggcuuugggaaaugu

SEQ ID NO: 442948 - RNA, 64 nt, hsa
cauuaguuuaauuuucuucaaaaugaaaauacugcuuuguaauuacaaaaugagacacaccuau

SEQ ID NO: 442949 - RNA, 64 nt, hsa
uuuauaucccggaauauuucccuccggcuuucgccuuuguaacucccaucuguggacccaucgu

SEQ ID NO: 442950 - RNA, 64 nt, hsa
aauccuaaaaucagguuuacuuaacuuuagauugcuuuguaaauguuuggaaacuuucuuuuac

SEQ ID NO: 442951 - RNA, 64 nt, hsa
caaagaacugaagaugagaauacuggucaucuaacuuuguaauuugauuugauuauacuguaaa

SEQ ID NO: 442952 - RNA, 64 nt, hsa
cucgaggcuaacgauguagguuucauuucucagacuuuguaauauaaggcaagcccucucucag

SEQ ID NO: 442953 - RNA, 64 nt, hsa
agagccacaggccuaagucauuaaaaaauucucccuuuguaaccucagugcuggggacugaggc

SEQ ID NO: 442954 - RNA, 64 nt, hsa
ucccucucucauuggccuauacaucucuuaggaccuuuguaaugguguccaugcaccuuuagag

SEQ ID NO: 442955 - RNA, 64 nt, hsa
acgccaggcggcauccuuuucuaugaaguguugacuuuguaaaucugcccacacccagcuggcc

SEQ ID NO: 442956 - RNA, 64 nt, hsa
guguggggaagguuggagaagaguuagguuugugcuuuguaaucuuggcauccauguuuugugc

SEQ ID NO: 442957 - RNA, 64 nt, hsa
acaaguguuacuugugccgggaaaauuuugcugucuuuguaauuuuaaaacuuuaaaauaaauu

SEQ ID NO: 442958 - RNA, 64 nt, hsa
gcuguuuaucaucagcuccucugaaaugugaucccuuuguaacugugcucaucacuucgccagu

SEQ ID NO: 442959 - RNA, 64 nt, hsa
ugcuacugaaagcuaucccaggugauacagagcucuuuguaaaccgcagucacacauuaggguu

SEQ ID NO: 442960 - RNA, 64 nt, hsa
uuuuuuuuuaauuaaagagcaaagcuuuuuauuacuuuguaauuuaaaaaacugaaaaaaaaaa

SEQ ID NO: 442961 - RNA, 64 nt, hsa
gugacugccaaauaauauuugaagucaucugucucuuuguaaauuauuuuauaugaccuauaaa

SEQ ID NO: 442962 - RNA, 64 nt, hsa
guuagacuccugggaugcccuccucccccucgcccuuuguaauaaccuaaucugagaccgugcu

SEQ ID NO: 442963 - RNA, 64 nt, hsa
ugcuuagaauucugagaggcaggaacugcucugucuuuguaacuacucaaggccaacugucaca

SEQ ID NO: 442964 - RNA, 64 nt, hsa
ggcaguguucuuggggguggggcugcauccaaggcuuuguaaaccggcuggaccacgucucccu

SEQ ID NO: 442965 - RNA, 64 nt, hsa
uucaaagaccaguuuguaccgaugaaacgcgcaacuuuguaaucccaacacuuucuauuuucua

SEQ ID NO: 442966 - RNA, 64 nt, hsa; identical to SEQ ID NO: 442495

SEQ ID NO: 442967 - RNA, 64 nt, hsa
gggucuuucauagccaaacuuguauauuuaaauucuuuguaauaauaauauccaaaucaucauc

SEQ ID NO: 442968 - RNA, 64 nt, hsa
uuacauaccgugagaaguuacguaacauuuacuccuuuguaaauguuucccuaucaucagacaa

SEQ ID NO: 442969 - RNA, 64 nt, hsa
acauacuuauauagaggaauuuauguaaccaugacuuuguaauuuugagaauuccucccaguga

SEQ ID NO: 442970 - RNA, 64 nt, hsa
ggaauuaauaaaacaaagucauacaacacauuuucuuuguaauugagaacuagauaacauggua

SEQ ID NO: 442971 - RNA, 64 nt, hsa
cucacccccaaugaggucuuaggcagauucuuuacuuuguaauucaaaaggccuguuaaccuuu

SEQ ID NO: 442972 - RNA, 64 nt, hsa
cuuggaaaaaaaauacuagccuagcuggucauuucuuuguaagguaguuagcaauuuuaagucu

SEQ ID NO: 442973 - RNA, 64 nt, hsa
caaaugagauuuuguacauggaguugacauaauacuuuguaaauugaauuuuuuaaagaaauag

SEQ ID NO: 442974 - RNA, 64 nt, hsa
aagaaucguucaacugucaaucagccucuugauucuuuguaaauugccaggguggguggguaca

SEQ ID NO: 442975 - RNA, 64 nt, hsa
accacucugcuuccuuggacaauaucaguaauagcuuuguaagugauguggacguaauugccua

SEQ ID NO: 442976 - RNA, 64 nt, hsa
auuugcccucccaucccguuuagaguuauuuaggcuuuguaacgauugggggauaaaaagaugu

SEQ ID NO: 442977 - RNA, 64 nt, hsa
cuuaaaacacuaacggaaacccauggaguuuguccuuuguaaaaauuuuaaacacagugucuug

SEQ ID NO: 442978 - RNA, 64 nt, hsa
guacuccaaugguguacaaugucuuuugcacaaacuuuguaacuuuuguuacugugaauucaaa

SEQ ID NO: 442979 - RNA, 64 nt, hsa
ggguuuuuaauauaaagguguuaagcuuauuuugcuuuguaaguaaagaauguguauauuguga

SEQ ID NO: 442980 - RNA, 64 nt, hsa
agcuguuuuguuuuguguuguugaauuugaaagccuuuguaaauaucaauauaauguaccaaug

SEQ ID NO: 442981 - RNA, 64 nt, hsa
ugaaagcuauauacuugugcuaucuaaagcacuacuuuguaaagaugacuacccaagauuguaa

SEQ ID NO: 442982 - RNA, 64 nt, hsa
uuguuuucaaugaauuaagaaagauuaaauauaucuuuguaaauuauuuuaugucauaguuuaa

SEQ ID NO: 442983 - RNA, 64 nt, hsa
agguguuuugccagccugaacuauauuuaagagacuuuguaaaaaagaaaaauguauauagcug

SEQ ID NO: 442984 - RNA, 64 nt, hsa
auauaagauuuugguucuacuugcuauaugccuccuuuguaaaaauaaacaccgaggcuuacug

SEQ ID NO: 442985 - RNA, 64 nt, hsa
cguaguauuccugagcaaaacguggcuuucaucgcuuuguaaaaauuugcaucuguuuagaaac

SEQ ID NO: 442986 - RNA, 64 nt, hsa
guccucucagaagcacaagugcauacuaggaaggcuuuguaaacugguuuuguaggcaggcugu

SEQ ID NO: 442987 - RNA, 64 nt, hsa
uuugcuuuuagcagauaugaagauuuccuuauuucuuuguaauugugcagauauuuugaaaggc

SEQ ID NO: 442988 - RNA, 64 nt, hsa
ucucucaaaaagcuuauuaagccugaaaagccaacuuuguaacauauuuaaaacugcuauuuuc

SEQ ID NO: 442989 - RNA, 64 nt, hsa
aagcaaagccaauggagaguauuucacaaaaauacuuuguaaaugagaugccaguaguguucaa

SEQ ID NO: 442990 - RNA, 64 nt, hsa
gaaugaaaagcacauaaauguaaucuacuuugaacuuuguaaaaaugauguguggaggcuauuc

SEQ ID NO: 442991 - RNA, 64 nt, hsa
aauacuuuuggacuugaaaauuauuucuucucuacuuuguaaccaaaugcaaucggugugccuu

SEQ ID NO: 442992 - RNA, 64 nt, hsa
cuauaauuugaauaauuuugagcuaucaaaaugucuuuguaauuuucacaaccgcuguccauug

SEQ ID NO: 442993 - RNA, 64 nt, hsa
uuguaccccaaugcaaaaccuucgucucuuugugcuuuguaaagcaaacucaagaaaacuggua

SEQ ID NO: 442994 - RNA, 64 nt, hsa
uagccguuuggaaguguucuuugauauuacaguucuuuguaaaaugaccugcgaauuacccuaa

SEQ ID NO: 442995 - RNA, 64 nt, hsa
aaaauccaugguuaucugagauaggagauacaaacuuuguaauucuaauaaugcacucaguuua

SEQ ID NO: 442996 - RNA, 64 nt, hsa
auccugccccucacuucuuaacauauuccugugucuuuguaauggccaaauuucuccuuccacu

SEQ ID NO: 442997 - RNA, 64 nt, hsa
agauaacgagagggggaaaaaaagcuacuacugccuuuguaacuuccacuuagccuacuacagg

SEQ ID NO: 442998 - RNA, 64 nt, hsa
agguauucugccagccugaacuauauuuaagaaacuuuguaaaaaauaaaaauguauauagcug

SEQ ID NO: 442999 - RNA, 62 nt, hsa; identical to SEQ ID NO: 70699

SEQ ID NO: 443000 - RNA, 63 nt, hsa; identical to SEQ ID NO: 70700

SEQ ID NO: 443001 - RNA, 63 nt, hsa; identical to SEQ ID NO: 70701

SEQ ID NO: 443002 - RNA, 63 nt, hsa; identical to SEQ ID NO: 70702

SEQ ID NO: 443003 - RNA, 63 nt, hsa; identical to SEQ ID NO: 70703

SEQ ID NO: 443004 - RNA, 63 nt, hsa; identical to SEQ ID NO: 70704

SEQ ID NO: 443005 - RNA, 63 nt, hsa; identical to SEQ ID NO: 70705

SEQ ID NO: 443006 - RNA, 63 nt, hsa; identical to SEQ ID NO: 70706

SEQ ID NO: 443007 - RNA, 63 nt, hsa; identical to SEQ ID NO: 70707

SEQ ID NO: 443008 - RNA, 63 nt, hsa; identical to SEQ ID NO: 70708

SEQ ID NO: 443009 - RNA, 63 nt, hsa; identical to SEQ ID NO: 70709

SEQ ID NO: 443010 - RNA, 63 nt, hsa; identical to SEQ ID NO: 70710

SEQ ID NO: 443011 - RNA, 63 nt, hsa; identical to SEQ ID NO: 70711

SEQ ID NO: 443012 - RNA, 63 nt, hsa; identical to SEQ ID NO: 70712

SEQ ID NO: 443013 - RNA, 63 nt, hsa; identical to SEQ ID NO: 70713

SEQ ID NO: 443014 - RNA, 63 nt, hsa; identical to SEQ ID NO: 70714

SEQ ID NO: 443015 - RNA, 63 nt, hsa; identical to SEQ ID NO: 70715

SEQ ID NO: 443016 - RNA, 63 nt, hsa; identical to SEQ ID NO: 70716

SEQ ID NO: 443017 - RNA, 63 nt, hsa; identical to SEQ ID NO: 70717

SEQ ID NO: 443018 - RNA, 63 nt, hsa; identical to SEQ ID NO: 70718

SEQ ID NO: 443019 - RNA, 63 nt, hsa; identical to SEQ ID NO: 70719

SEQ ID NO: 443020 - RNA, 63 nt, hsa; identical to SEQ ID NO: 70720

SEQ ID NO: 443021 - RNA, 63 nt, hsa; identical to SEQ ID NO: 70721

SEQ ID NO: 443022 - RNA, 64 nt, hsa; identical to SEQ ID NO: 239676

SEQ ID NO: 443023 - RNA, 64 nt, hsa; identical to SEQ ID NO: 239677

SEQ ID NO: 443024 - RNA, 64 nt, hsa; identical to SEQ ID NO: 239678

SEQ ID NO: 443025 - RNA, 64 nt, hsa; identical to SEQ ID NO: 239679

SEQ ID NO: 443026 - RNA, 64 nt, hsa; identical to SEQ ID NO: 239680

SEQ ID NO: 443027 - RNA, 64 nt, hsa; identical to SEQ ID NO: 239681

SEQ ID NO: 443028 - RNA, 64 nt, hsa; identical to SEQ ID NO: 239682

SEQ ID NO: 443029 - RNA, 64 nt, hsa; identical to SEQ ID NO: 239683

SEQ ID NO: 443030 - RNA, 64 nt, hsa; identical to SEQ ID NO: 239684

SEQ ID NO: 443031 - RNA, 64 nt, hsa; identical to SEQ ID NO: 239685

SEQ ID NO: 443032 - RNA, 64 nt, hsa; identical to SEQ ID NO: 239686

SEQ ID NO: 443033 - RNA, 64 nt, hsa; identical to SEQ ID NO: 239687

SEQ ID NO: 443034 - RNA, 64 nt, hsa; identical to SEQ ID NO: 239688

SEQ ID NO: 443035 - RNA, 64 nt, hsa; identical to SEQ ID NO: 239689

SEQ ID NO: 443036 - RNA, 64 nt, hsa; identical to SEQ ID NO: 239690

SEQ ID NO: 443037 - RNA, 64 nt, hsa; identical to SEQ ID NO: 239691

SEQ ID NO: 443038 - RNA, 64 nt, hsa; identical to SEQ ID NO: 239692

SEQ ID NO: 443039 - RNA, 64 nt, hsa; identical to SEQ ID NO: 239693

SEQ ID NO: 443040 - RNA, 64 nt, hsa; identical to SEQ ID NO: 239694

SEQ ID NO: 443041 - RNA, 64 nt, hsa; identical to SEQ ID NO: 239695

SEQ ID NO: 443042 - RNA, 64 nt, hsa; identical to SEQ ID NO: 239696

SEQ ID NO: 443043 - RNA, 64 nt, hsa; identical to SEQ ID NO: 239697

SEQ ID NO: 443044 - RNA, 64 nt, hsa; identical to SEQ ID NO: 239698

SEQ ID NO: 443045 - RNA, 64 nt, hsa; identical to SEQ ID NO: 239699

SEQ ID NO: 443046 - RNA, 64 nt, hsa; identical to SEQ ID NO: 239700

SEQ ID NO: 443047 - RNA, 64 nt, hsa; identical to SEQ ID NO: 239701

SEQ ID NO: 443048 - RNA, 64 nt, hsa; identical to SEQ ID NO: 239702

SEQ ID NO: 443049 - RNA, 64 nt, hsa; identical to SEQ ID NO: 239703

SEQ ID NO: 443050 - RNA, 64 nt, hsa; identical to SEQ ID NO: 239704

SEQ ID NO: 443051 - RNA, 64 nt, hsa; identical to SEQ ID NO: 239705

SEQ ID NO: 443052 - RNA, 64 nt, hsa; identical to SEQ ID NO: 239706

SEQ ID NO: 443053 - RNA, 64 nt, hsa; identical to SEQ ID NO: 239707

SEQ ID NO: 443054 - RNA, 64 nt, hsa; identical to SEQ ID NO: 239708

SEQ ID NO: 443055 - RNA, 64 nt, hsa; identical to SEQ ID NO: 239709

SEQ ID NO: 443056 - RNA, 64 nt, hsa; identical to SEQ ID NO: 239710

SEQ ID NO: 443057 - RNA, 64 nt, hsa; identical to SEQ ID NO: 239711

SEQ ID NO: 443058 - RNA, 64 nt, hsa; identical to SEQ ID NO: 239712

SEQ ID NO: 443059 - RNA, 64 nt, hsa; identical to SEQ ID NO: 239713

SEQ ID NO: 443060 - RNA, 64 nt, hsa; identical to SEQ ID NO: 239714

SEQ ID NO: 443061 - RNA, 64 nt, hsa; identical to SEQ ID NO: 239715

SEQ ID NO: 443062 - RNA, 64 nt, hsa; identical to SEQ ID NO: 239716

SEQ ID NO: 443063 - RNA, 64 nt, hsa; identical to SEQ ID NO: 239717

SEQ ID NO: 443064 - RNA, 64 nt, hsa; identical to SEQ ID NO: 239718

SEQ ID NO: 443065 - RNA, 64 nt, hsa; identical to SEQ ID NO: 239719

SEQ ID NO: 443066 - RNA, 64 nt, hsa; identical to SEQ ID NO: 239720

SEQ ID NO: 443067 - RNA, 64 nt, hsa; identical to SEQ ID NO: 239721

SEQ ID NO: 443068 - RNA, 64 nt, hsa; identical to SEQ ID NO: 239722

SEQ ID NO: 443069 - RNA, 64 nt, hsa; identical to SEQ ID NO: 239723

SEQ ID NO: 443070 - RNA, 64 nt, hsa; identical to SEQ ID NO: 239724

SEQ ID NO: 443071 - RNA, 64 nt, hsa; identical to SEQ ID NO: 239725

SEQ ID NO: 443072 - RNA, 64 nt, hsa; identical to SEQ ID NO: 239726

SEQ ID NO: 443073 - RNA, 64 nt, hsa; identical to SEQ ID NO: 239727

SEQ ID NO: 443074 - RNA, 64 nt, hsa; identical to SEQ ID NO: 239728

SEQ ID NO: 443075 - RNA, 64 nt, hsa; identical to SEQ ID NO: 239729

SEQ ID NO: 443076 - RNA, 64 nt, hsa; identical to SEQ ID NO: 239730

SEQ ID NO: 443077 - RNA, 64 nt, hsa; identical to SEQ ID NO: 239731

SEQ ID NO: 443078 - RNA, 64 nt, hsa; identical to SEQ ID NO: 239732

SEQ ID NO: 443079 - RNA, 64 nt, hsa; identical to SEQ ID NO: 239733

SEQ ID NO: 443080 - RNA, 64 nt, hsa; identical to SEQ ID NO: 239734

SEQ ID NO: 443081 - RNA, 64 nt, hsa; identical to SEQ ID NO: 239735

SEQ ID NO: 443082 - RNA, 64 nt, hsa; identical to SEQ ID NO: 239736

SEQ ID NO: 443083 - RNA, 64 nt, hsa; identical to SEQ ID NO: 239737

SEQ ID NO: 443084 - RNA, 64 nt, hsa; identical to SEQ ID NO: 239738

SEQ ID NO: 443085 - RNA, 64 nt, hsa; identical to SEQ ID NO: 239739

SEQ ID NO: 443086 - RNA, 64 nt, hsa; identical to SEQ ID NO: 239740

SEQ ID NO: 443087 - RNA, 64 nt, hsa; identical to SEQ ID NO: 239741

SEQ ID NO: 443088 - RNA, 64 nt, hsa; identical to SEQ ID NO: 239742

SEQ ID NO: 443089 - RNA, 64 nt, hsa; identical to SEQ ID NO: 239743

SEQ ID NO: 443090 - RNA, 64 nt, hsa; identical to SEQ ID NO: 239744

SEQ ID NO: 443091 - RNA, 64 nt, hsa; identical to SEQ ID NO: 239745

SEQ ID NO: 443092 - RNA, 64 nt, hsa; identical to SEQ ID NO: 239746

SEQ ID NO: 443093 - RNA, 64 nt, hsa
uuacucgucugaauauugcuuuuagccguguuuuauaacauagacgagcaguagggucuguuua

SEQ ID NO: 443094 - RNA, 64 nt, hsa
ugccauaacaugugguaacaauaguucauuucucauaacauauaugagguauacaaaauuuucu

SEQ ID NO: 443095 - RNA, 64 nt, hsa
cuucuccuuauaaauaaguucagacauacauuuaauaacauagggugacuuguguuuuuaggua

SEQ ID NO: 443096 - RNA, 64 nt, hsa
agcuguguaguauaucaaauuaauuugcuaccuaauaacauagaaaguaaauaucuuugugguc

SEQ ID NO: 443097 - RNA, 64 nt, hsa
aaaaaacugagaacucugcuguuucagauaugccauaacauacaucugaaacacauguguaaca

SEQ ID NO: 443098 - RNA, 64 nt, hsa
auguuucuucucugccuuaaagagcuauucacuaauaacauagaaauccgcaagcugggugugc

SEQ ID NO: 443099 - RNA, 64 nt, hsa
uguuauuaaugauuaugaacuuuugcuuaacaaaauaacauacgacgagagcuugaguugucaa

SEQ ID NO: 443100 - RNA, 64 nt, hsa
cuacaaacuuucuuugguagguuagggagguuguauaacauaaaaaacacaucacuauauguag

SEQ ID NO: 443101 - RNA, 64 nt, hsa
caacauuauuguauuuuccacuuauuauuacuguauaacauaugcuaguguuuaguuggauuaa

SEQ ID NO: 443102 - RNA, 64 nt, hsa
ugacuguuuauucucuugaccaaauagacucauaauaacauauaauuuuaaaagaaauuuaaau

SEQ ID NO: 443103 - RNA, 64 nt, hsa
gauauagugguaauggcuuucacauuuuuauaacauaacauaacucacuucacaaccuucuugg

SEQ ID NO: 443104 - RNA, 64 nt, hsa
cuuaggauauagugguaauggcuuucacauuuuuauaacauaacauaacucacuucacaaccuu

SEQ ID NO: 443105 - RNA, 64 nt, hsa
ucauauuuagccauaguauaugauagauugccccauaacauaguuuuucaucaagaguuuauua

SEQ ID NO: 443106 - RNA, 64 nt, hsa
uguuucagcaguacaaaggcauguuuuaaaaucuauaacauaaagaauaaggaauagcuuugua

SEQ ID NO: 443107 - RNA, 64 nt, hsa
accagucuuuuucuguuuuugcuccaucuugaccauaacauauucaucaaaccauuuucuucaa

SEQ ID NO: 443108 - RNA, 64 nt, hsa
uuccagauuuaacauaaguaguaaauaacauaaaauaacauaaaacaguauuuuuaggauucau

SEQ ID NO: 443109 - RNA, 64 nt, hsa
gaauguguuguuccagauuuaacauaaguaguaaauaacauaaaauaacauaaaacaguauuuu

SEQ ID NO: 443110 - RNA, 64 nt, hsa; identical to SEQ ID NO: 361536

SEQ ID NO: 443111 - RNA, 64 nt, hsa; identical to SEQ ID NO: 361537

SEQ ID NO: 443112 - RNA, 64 nt, hsa; identical to SEQ ID NO: 361538

SEQ ID NO: 443113 - RNA, 64 nt, hsa; identical to SEQ ID NO: 361539

SEQ ID NO: 443114 - RNA, 64 nt, hsa; identical to SEQ ID NO: 361540

SEQ ID NO: 443115 - RNA, 64 nt, hsa; identical to SEQ ID NO: 361541

SEQ ID NO: 443116 - RNA, 64 nt, hsa; identical to SEQ ID NO: 361542

SEQ ID NO: 443117 - RNA, 64 nt, hsa; identical to SEQ ID NO: 361543

SEQ ID NO: 443118 - RNA, 64 nt, hsa; identical to SEQ ID NO: 361544

SEQ ID NO: 443119 - RNA, 64 nt, hsa; identical to SEQ ID NO: 361545

SEQ ID NO: 443120 - RNA, 64 nt, hsa; identical to SEQ ID NO: 361546

SEQ ID NO: 443121 - RNA, 64 nt, hsa; identical to SEQ ID NO: 361547

SEQ ID NO: 443122 - RNA, 64 nt, hsa; identical to SEQ ID NO: 361548

SEQ ID NO: 443123 - RNA, 64 nt, hsa; identical to SEQ ID NO: 361549

SEQ ID NO: 443124 - RNA, 64 nt, hsa; identical to SEQ ID NO: 361550

SEQ ID NO: 443125 - RNA, 64 nt, hsa; identical to SEQ ID NO: 361551

SEQ ID NO: 443126 - RNA, 64 nt, hsa; identical to SEQ ID NO: 361552

SEQ ID NO: 443127 - RNA, 64 nt, hsa; identical to SEQ ID NO: 361553

SEQ ID NO: 443128 - RNA, 64 nt, hsa; identical to SEQ ID NO: 361554

SEQ ID NO: 443129 - RNA, 64 nt, hsa; identical to SEQ ID NO: 361555

SEQ ID NO: 443130 - RNA, 64 nt, hsa; identical to SEQ ID NO: 361556

SEQ ID NO: 443131 - RNA, 64 nt, hsa
cuguggggauagugaggcaucgcaauguaagacucgggauuaguacacacuuguugauuaaugg

SEQ ID NO: 443132 - RNA, 64 nt, hsa
agugaggggugacccuuuagugagcuuagcacagcgggauuaaacaguccuuuaaccagcacag

SEQ ID NO: 443133 - RNA, 64 nt, hsa
agcugauacuuguuugggcacaccuccaaguucucgggauuagaaggacaagagcacucccagg

SEQ ID NO: 443134 - RNA, 64 nt, hsa
uggaugacaaacggaagauccacuaaaacguccacgggauuaacagaacguccuugcagacuga

SEQ ID NO: 443135 - RNA, 64 nt, hsa
ugaugucgugguccaguugcagccuaauggugaacgggauuacaacauagcaaauacuguuuga

SEQ ID NO: 443136 - RNA, 64 nt, hsa
cucgugauccacccgccucggccucccaaagugccgggauuacaggcgugagccacugcgccug

SEQ ID NO: 443137 - RNA, 64 nt, hsa
uauuugcaaaaugugcuaaagucaaugauuuuuacgggauuauugacuucugcuuauggaaaac

SEQ ID NO: 443138 - RNA, 64 nt, hsa
gggcccaggagccaaugugaacuuuuuuuuuuaccgggauuauaaaagaacaacaagaugaccu

SEQ ID NO: 443139 - RNA, 64 nt, hsa
uuaaaggcaaaucauucccaccaucacuuaacgccgggauuauacacauucuagaaaugauucu

SEQ ID NO: 443140 - RNA, 64 nt, hsa
ucaagugauccucuuaccuuggccucccaaacaccgggauuauaggcgugagcccccgugccug

SEQ ID NO: 443141 - RNA, 64 nt, hsa
caggugaucaacccaccuuggccucccuaaaugccgggauuacaggcaugagccaccgcuccca

SEQ ID NO: 443142 - RNA, 64 nt, hsa
cugauccaccugccucagccucccaaagugccgccgggauuacaggcgugagccaccaugccug

SEQ ID NO: 443143 - RNA, 64 nt, hsa
caaugcuuugccuuauaguuuuuuaacuuuagaacgggauuaucuuguuauuaccuguauuuuc

SEQ ID NO: 443144 - RNA, 64 nt, hsa
ccucgugauccacccgccuuggccucccaaagugcgggauuacaagcgugaaccacccugccca

SEQ ID NO: 443145 - RNA, 64 nt, hsa
ccauguucagcagaguauuuuaauuauauuuucucgggauuauugcucuucugucuauaaauuu

SEQ ID NO: 443146 - RNA, 64 nt, hsa
cuauauuuaaaauuagauggaauccaaagauacacgggauuaauaguauauuuuuuuauucuug

SEQ ID NO: 443147 - RNA, 64 nt, hsa
ucaagcgauucuccugccucagccucucaaguagcgggauuacaggcgcccaccaccaaaaauu

SEQ ID NO: 443148 - RNA, 64 nt, hsa
cugccguaugcuucaguggcacacaccaaaaaaccgggauuauuuacagcagccacuauucacc

SEQ ID NO: 443149 - RNA, 64 nt, hsa
agaugauccuuuaagcaagcagucauagacuggucgggauuaaguaaaagacggcuaguuggcc

SEQ ID NO: 443150 - RNA, 64 nt, hsa
caagugguccuccugccucagccucccacaggaucgggauuacaggcaagagccuccacgcccg

SEQ ID NO: 443151 - RNA, 64 nt, hsa
caaaugagccuccugcuucagucucccaaauugccgggauuacaggcaugagccacugugucug

SEQ ID NO: 443152 - RNA, 64 nt, hsa
cucagccacugagcugccucaaccggccaaggaacgggauuaugaugacuaugcggacuucuau

SEQ ID NO: 443153 - RNA, 64 nt, hsa
caaugaggcuuuacaaccuuccuuuguuuuggcucgggauuacuuccuggcugucuaauaauug

SEQ ID NO: 443154 - RNA, 64 nt, hsa
aagaaggaaggacuuaaauagcuuuucuuccuaccgggauuaccuauguuuuuccuugcuugca

SEQ ID NO: 443155 - RNA, 64 nt, hsa
ccuauuuaagacuuuaaggguuuguggggcggggcgggauuaacacaacauuuggcuuuguuuu

SEQ ID NO: 443156 - RNA, 64 nt, hsa
cucgugaucugcccgccuugaccucccaaagugccgggauuacaggcaugagccuccacaccug

SEQ ID NO: 443157 - RNA, 64 nt, hsa
aaaaaaguaauuaaaaagacacuuuuaccgaacucgggauuacagaaacacggaguuuccauuu

SEQ ID NO: 443158 - RNA, 64 nt, hsa; identical to SEQ ID NO: 42317

SEQ ID NO: 443159 - RNA, 64 nt, hsa; identical to SEQ ID NO: 42318

SEQ ID NO: 443160 - RNA, 64 nt, hsa; identical to SEQ ID NO: 42319

SEQ ID NO: 443161 - RNA, 64 nt, hsa; identical to SEQ ID NO: 42320

SEQ ID NO: 443162 - RNA, 64 nt, hsa; identical to SEQ ID NO: 42321

SEQ ID NO: 443163 - RNA, 64 nt, hsa; identical to SEQ ID NO: 42322

SEQ ID NO: 443164 - RNA, 64 nt, hsa; identical to SEQ ID NO: 42323

SEQ ID NO: 443165 - RNA, 64 nt, hsa; identical to SEQ ID NO: 42324

SEQ ID NO: 443166 - RNA, 64 nt, hsa; identical to SEQ ID NO: 42325

SEQ ID NO: 443167 - RNA, 64 nt, hsa; identical to SEQ ID NO: 42326

SEQ ID NO: 443168 - RNA, 64 nt, hsa; identical to SEQ ID NO: 42327

SEQ ID NO: 443169 - RNA, 64 nt, hsa; identical to SEQ ID NO: 42328

SEQ ID NO: 443170 - RNA, 64 nt, hsa; identical to SEQ ID NO: 42329

SEQ ID NO: 443171 - RNA, 64 nt, hsa; identical to SEQ ID NO: 42330

SEQ ID NO: 443172 - RNA, 64 nt, hsa; identical to SEQ ID NO: 42331

SEQ ID NO: 443173 - RNA, 64 nt, hsa; identical to SEQ ID NO: 42332

SEQ ID NO: 443174 - RNA, 64 nt, hsa
cccucucuccccaccuucccucucccggcaacaucucugggaaucaacagcauauugacacguu

SEQ ID NO: 443175 - RNA, 64 nt, hsa
caaaccuggcaagucaccugcagcccauggugagcucugggaagugugguugaggccuuggggu

SEQ ID NO: 443176 - RNA, 64 nt, hsa
caaucggagacaaaagcaguuucucuccaacucccucugggaaggugaccuggccagagccaag

SEQ ID NO: 443177 - RNA, 64 nt, hsa
gggacagauggacagacagccacccugagaaccccucugggaaaaucuauuccugccaccacug

SEQ ID NO: 443178 - RNA, 64 nt, hsa
ugagugcccucagauggucaaaacccaguuuucccucugggagccuaaaccaggcugcaucgga

SEQ ID NO: 443179 - RNA, 64 nt, hsa
uugacuccaccccuguccugagcuggaauagguccucugggaugccagcucuccccuuugugcu

SEQ ID NO: 443180 - RNA, 64 nt, hsa
cucuuugagcuucugcgaugccggccuuccguuccucugggaggcuugaaguucugcaaagaug

SEQ ID NO: 443181 - RNA, 64 nt, hsa
ucagggcucuagacccgagcccuccaaaccuggacucugggacuuaggcccccuuaaaucuaga

SEQ ID NO: 443182 - RNA, 64 nt, hsa
cgggcccaggacuguggcuccuuuucuaaaccaccucugggacucagcuccccccgccaaaaaa

SEQ ID NO: 443183 - RNA, 64 nt, hsa
ggcuguuggucuccagggcacaggaucuuagcuacucugggauacccaguucuguuuucaguau

SEQ ID NO: 443184 - RNA, 64 nt, hsa
ccccacccucaagcauuccucaggaagcgucucacucugggagccuuggcccugcucacagaga

SEQ ID NO: 443185 - RNA, 64 nt, hsa
uuuauauguauaaaaauaggagcaaaagaaaauacucugggaauagucauacugacaaaccaau

SEQ ID NO: 443186 - RNA, 64 nt, hsa
cuacuuuugauuucauuuacuuggcugauagaaacucugggaaacagaaccuagauauuuugug

SEQ ID NO: 443187 - RNA, 64 nt, hsa
uagaacucaguuuuaacuagaauuuauucaauuccucugggaauguuacauuguuugucugucu

SEQ ID NO: 443188 - RNA, 64 nt, hsa
cauaaauuagaggucuccaaaaucggaucuggggcucugggauagcugacccagccccuugaga

SEQ ID NO: 443189 - RNA, 64 nt, hsa
cauucugaagagggagguuuuggugucccugguccucugggaauagaagauccauuugucuuug

SEQ ID NO: 443190 - RNA, 64 nt, hsa
aggaucaugccagaaauagggauggaagugcauccucugggaaaaagauaauggcuucugauuc

SEQ ID NO: 443191 - RNA, 64 nt, hsa
gccuuuaucagucauuuauuggcugugagaaguucucugggaguguggguacauuugaaggcaa

SEQ ID NO: 443192 - RNA, 64 nt, hsa
aacagaaaagagccauggauggagcccuugggcucucugggaaaugggaaaucagccaaaggac

SEQ ID NO: 443193 - RNA, 64 nt, hsa
uccccaggaccacuggcugccaacuccugccgcccucugggacugccccucagucccaggagag

SEQ ID NO: 443194 - RNA, 64 nt, hsa
gcauguuucuugguaagggugcccagucaagugucucugggagcccccucuucucugucaucgu

SEQ ID NO: 443195 - RNA, 64 nt, hsa
caccucuuucucauucauucuccuuuucccugugcucugggaaagccccuggcucaggcuguca

SEQ ID NO: 443196 - RNA, 64 nt, hsa
auugguggagggagcaggugccaguccccucacucucugggagcugugaaagggaucccugucc

SEQ ID NO: 443197 - RNA, 64 nt, hsa
guggggcagacauggagccccucccuuggucagacucugggacuccugagaugggagaggcagg

SEQ ID NO: 443198 - RNA, 64 nt, hsa
acucucucucgaccuccaaacagcaggacucuuucucugggaaaccauccuuccaaaacggaau

SEQ ID NO: 443199 - RNA, 64 nt, hsa
cugcgagccuucagagcuaggagggcacccuaggcucugggaucccgugucuuuccagacaaug

SEQ ID NO: 443200 - RNA, 64 nt, hsa
gcuccaggguccagcccacaagcugcaucaggcucucugggagaggaggggccuggagggccag

SEQ ID NO: 443201 - RNA, 64 nt, hsa
cgggcucgagggcagggacucgcgcccacggcaccucugggagcugggaugauaaagaugaggc

SEQ ID NO: 443202 - RNA, 64 nt, hsa
cacccaccaccacccaccacagaaaagcacaaaccucugggaaagacaacgucucucgggggcc

SEQ ID NO: 443203 - RNA, 64 nt, hsa
agccugcagucuggagacaagcucuuccggagugcucugggagccaggccagggugugagggag

SEQ ID NO: 443204 - RNA, 64 nt, hsa
gaaugguucuuagaaaucugaugaggccucugcucucugggauguggcccucucuaugcagguu

SEQ ID NO: 443205 - RNA, 64 nt, hsa
auucuucucugccuugcccugcucucuccuguugcucugggauugcacuucugaaugaaguagc

SEQ ID NO: 443206 - RNA, 64 nt, hsa
cugcauauucuggaucauagauguucuuaguuaacucugggaaagauguuaccuuuggguuuuu

SEQ ID NO: 443207 - RNA, 64 nt, hsa
auaaugucuuagacaauuaccuuuacauuucaagcucugggauauaaauuacguagucagcauu

SEQ ID NO: 443208 - RNA, 64 nt, hsa
cccagcgccccaccaccaccacgugcagguggagcucugggaugcuauguuggggcggcaagcg

SEQ ID NO: 443209 - RNA, 64 nt, hsa
ccccaucccccacaguccagcuccggggaaggggcucugggaggcauuuuccugcuuugccccu

SEQ ID NO: 443210 - RNA, 64 nt, hsa
aacaggccuugggaggccucaggugugcgagugccucugggaggcgcagaugcccacacagcca

SEQ ID NO: 443211 - RNA, 64 nt, hsa
ugggccacagagguagugagccaguguccugggccucugggaugcccgccccauugcugccaau

SEQ ID NO: 443212 - RNA, 64 nt, hsa
gaugugacagggagugaagacacuugauaccagacucugggagauacucugcaaguugaccugg

SEQ ID NO: 443213 - RNA, 64 nt, hsa
ucacacugacaacauaacaggaugugauugccuucucugggauucagacaggcucugucaaugu

SEQ ID NO: 443214 - RNA, 64 nt, hsa
uucuguuccuccaugcccaaacuggcagaugcuucucugggagcaaggccacaugggcugaugc

SEQ ID NO: 443215 - RNA, 64 nt, hsa
agcccgaagaauucugcugcucaccaggacccagcucugggagugcagcuggaauggaacccag

SEQ ID NO: 443216 - RNA, 64 nt, hsa
ccuucguucuucagcccgacuggaggaacagcagcucugggaggcacagagugcaggucucagg

SEQ ID NO: 443217 - RNA, 64 nt, hsa
cguggcugcugcagggcacauggagggaccuacccucugggaaagcccuugugucccucccaga

SEQ ID NO: 443218 - RNA, 64 nt, hsa
ccaggguagcugcccuggggucugggcacucugccucugggagagaggaagaagaaaggggccc

SEQ ID NO: 443219 - RNA, 64 nt, hsa
cucucucugugcagguggccagugccccucccugcucugggagcauugcuagccuucuacccca

SEQ ID NO: 443220 - RNA, 64 nt, hsa
cagagaaggagccggggaccagcuugaagacuggcucugggacacacugaccauugugaaauuc

SEQ ID NO: 443221 - RNA, 64 nt, hsa
uaccaguugucgaagaugauccguuagugauguucucugggaaguggacugugguuuuuccaga

SEQ ID NO: 443222 - RNA, 64 nt, hsa
acauaccaagcuuugggacauggugccucaugcucucugggauugcagaccauccaggucuguc

SEQ ID NO: 443223 - RNA, 64 nt, hsa
aauagauuuagacaaauguuaaggaaccauacuucucugggacagcauggcauauagugauaua

SEQ ID NO: 443224 - RNA, 64 nt, hsa
ugucuaggccucggugcuggccuggguucuagaucucugggaaccagugccugagucacagcug

SEQ ID NO: 443225 - RNA, 64 nt, hsa
aaucaguggugagugacuggccuggguucuagaccucugggaaccagcaccugagucacagcug

SEQ ID NO: 443226 - RNA, 64 nt, hsa
auaugcuagugauguacgagcugcgcguccugcccucugggagguuacugucugguaggaagga

SEQ ID NO: 443227 - RNA, 64 nt, hsa
cugugcccucccauagcacugccucuuccagggccucugggagccugacagugcccagcaugaa

SEQ ID NO: 443228 - RNA, 64 nt, hsa
ugagugccuacuguguguugggugccauuccaggcucugggauuuuuuuuuuuuuuuuuuuaag

SEQ ID NO: 443229 - RNA, 64 nt, hsa
gguuacaggcaugagccacugugcccagcccaggcucugggaauauugagauaaauaagaugcu

SEQ ID NO: 443230 - RNA, 64 nt, hsa
gccugucugggauuccccacuugugccugggguccucugggauuucuuugucauguacagacuc

SEQ ID NO: 443231 - RNA, 64 nt, hsa
caggguagcaguucuuccagaaucccaagagcuucucugggauuuucuugugauaucugauucc

SEQ ID NO: 443232 - RNA, 64 nt, hsa
ucagaucugagauuuccuaguuaugucuggggcccucugggagcuguuaucaucucagaucucu

SEQ ID NO: 443233 - RNA, 64 nt, hsa
ccgggcgaaguggcccaugccuguaaucucagcacucugggagaccgaggaagggggauugauu

SEQ ID NO: 443234 - RNA, 64 nt, hsa
gcaucauguaucugggagcaugcaguggcgagggcucugggaggugugccgagcuggcucccca

SEQ ID NO: 443235 - RNA, 64 nt, hsa
ucccucccaccgaaggccugauggcuacucaccccucugggauggcuaugggagaggaggagug

SEQ ID NO: 443236 - RNA, 64 nt, hsa
agcucuuggucaaagcacuguugcuauaagcuaucucugggaugccucuaggcccccuucccuc

SEQ ID NO: 443237 - RNA, 64 nt, hsa
ugggaugccucuaggcccccuucccucuacacaccucugggaaaagauuacacuguauuaacuc

SEQ ID NO: 443238 - RNA, 64 nt, hsa
cuagaaguuugaugaguggaagauagagaggggccucugggauggaaggcugucuucuuuugag

SEQ ID NO: 443239 - RNA, 64 nt, hsa
ccauagggagggagcuagaagaaggugccccuuccucugggagauuguggacuggggagcgugg

SEQ ID NO: 443240 - RNA, 64 nt, hsa
uucuggagacaagaaaaucaucacucuggugccuugguggcagcaccacugccugcucccugga

SEQ ID NO: 443241 - RNA, 64 nt, hsa
aucucuacuaaaaauacaaaaaauuagccaggcgugguggcaggcgccuguagucccagcuacu

SEQ ID NO: 443242 - RNA, 64 nt, hsa
aggucaacuguuggcacuguggcaugaaucaaggugguggcagcaaacuucuaguaguuuugau

SEQ ID NO: 443243 - RNA, 64 nt, hsa
cgucucuacuaaaauuacaaaaauuagccgggcgugguggcagaucccuuguagucccagcuac

SEQ ID NO: 443244 - RNA, 64 nt, hsa
uuauuaaaauuagaauuauacaaugacuuauuuuugguggcaaauacuuuaggagcaauaaugc

SEQ ID NO: 443245 - RNA, 64 nt, hsa
aacaacaaaaacaaaaacacaaauuagucgggugugguggcacacaccuguagucccagguacu

SEQ ID NO: 443246 - RNA, 64 nt, hsa
uuuaaccccaaauuuccuuuggcuauuaaaaaagugguggcaaaagacauccucaaaagaaaga

SEQ ID NO: 443247 - RNA, 64 nt, hsa
gugcacagauacacauacacgguauucccaagagugguggcagcucaaaaugauauguuugagu

SEQ ID NO: 443248 - RNA, 64 nt, hsa
aaauacaaaaaaaaaaaaaaaaaaaagccaggcaugguggcacacaccuguaaucccagcuacu

SEQ ID NO: 443249 - RNA, 64 nt, hsa
aaaaauacaaaaaaaaaaaaaaauuagcugggcaugguggcacacaccuguagucccagcuacu

SEQ ID NO: 443250 - RNA, 64 nt, hsa
ucuccacaaaaaaauucaaaaaauuagccaggugugguggcaugugccuguggucccagcuacu

SEQ ID NO: 443251 - RNA, 64 nt, hsa
aucucuacuaaaaauacaaaaaauuagcugggcaugguggcaguugccuguaauccuagcuacu

SEQ ID NO: 443252 - RNA, 64 nt, hsa
ccuacgccucccugcugccucccccagaugcaugugguggcaucaccauuccccaaauugaaua

SEQ ID NO: 443253 - RNA, 64 nt, hsa
cugggagugucagugcuagcagcacagcuaccucugguggcaggagaagagaggcccagcacag

SEQ ID NO: 443254 - RNA, 64 nt, hsa
uguuuuacagagcagggucacuugauuugcuagcugguggcagaauuggcaccauuacccaggu

SEQ ID NO: 443255 - RNA, 64 nt, hsa
gagguuagacaaaagugauucuuuugccaaugggugguggcauugauuuuuuuccuccaugcau

SEQ ID NO: 443256 - RNA, 64 nt, hsa
ucuccuuguugcccccaaagcccaugcccugccgugguggcagcuggggcuguggaugggaggg

SEQ ID NO: 443257 - RNA, 64 nt, hsa
uuccuccauuccugcucucccacugcacacagggugguggcacauuaucccucugggggguggg

SEQ ID NO: 443258 - RNA, 64 nt, hsa
cagugagcugagaucaugccacugugcuccagccugguggcacagugagacuccaccucaaaaa

SEQ ID NO: 443259 - RNA, 64 nt, hsa
caacucuacuaaaaauacaaaaauuagcugggugugguggcaugugccuguagucuuagcuacu

SEQ ID NO: 443260 - RNA, 64 nt, hsa
ccccuccucuagcugugggggugagggucccaugugguggcacaggcccccuugagugggguua

SEQ ID NO: 443261 - RNA, 64 nt, hsa
uuagcagcggaacaaggagucagacauuuuaagaugguggcaguagaggcuauggacagggcau

SEQ ID NO: 443262 - RNA, 64 nt, hsa
aacucagaggcuuagcucgccucuuuaggguccaugguggcagcagagaggcagaagugggagu

SEQ ID NO: 443263 - RNA, 64 nt, hsa
ugaaggaugguuccuggccccucugagugacagcugguggcagcacuccuugcuggggggcacu

SEQ ID NO: 443264 - RNA, 64 nt, hsa
ggcagccugaggaggaggaggccgggugccuguuugguggcagcuucagccuagggauaccuga

SEQ ID NO: 443265 - RNA, 64 nt, hsa
agcuguagagugcugcccgaaaucucuaggaaguugguggcaagggacagcacucacacucuuc

SEQ ID NO: 443266 - RNA, 64 nt, hsa
auaaaugugcuguuaaacacuugaaugaagagaaugguggcagaaugagugagcaagcagauug

SEQ ID NO: 443267 - RNA, 64 nt, hsa
uugauuauauguuuuuaaaaaccugaagcuuuuuugguggcaggaccuuucaauaaauauuuau

SEQ ID NO: 443268 - RNA, 64 nt, hsa
ccgucucuacuaaaaauacaaaauuggcagggugugguggcacaugccuauaaucccagcuacu

SEQ ID NO: 443269 - RNA, 64 nt, hsa
uaucucuacaaaaaauacaaaaauuagccagacaugguggcacaugccuuuagucccagcuacu

SEQ ID NO: 443270 - RNA, 64 nt, hsa
auuuuuuguuucccagguauagcaggcuuauguuugguggcauuaaauugguuucuuuaaaaug

SEQ ID NO: 443271 - RNA, 64 nt, hsa
uugguggcauuaaauugguuucuuuaaaaugcuuugguggcacuuuuguaaacagauugcuucu

SEQ ID NO: 443272 - RNA, 64 nt, hsa
cugggccauggaagcugugacuccucuguggacaugguggcagcagggaaccccuagagagagg

SEQ ID NO: 443273 - RNA, 64 nt, hsa
gcugcagucagaagggugugcugguaaaguauuuugguggcagcugccaucauggucauugccu

SEQ ID NO: 443274 - RNA, 64 nt, hsa
ccgucucuacuaaaaaauacaaaaaagcugggugugguggcacacacccguaguuccagcuacu

SEQ ID NO: 443275 - RNA, 64 nt, hsa
ccaaguaacguagucauaucaucgcgcucugaucugguggcaucuggcugugcaaggaagaccc

SEQ ID NO: 443276 - RNA, 64 nt, hsa
cagaaggcucugcuauaggacccgguguuccucuugguggcagauaccugcuaaaugccacuga

SEQ ID NO: 443277 - RNA, 64 nt, hsa
guaauuagguuucuaagcuguauacuguguuuauugguggcagugacaccaaagauagaggcaa

SEQ ID NO: 443278 - RNA, 64 nt, hsa
uguagcaaauaaauccuuugaaagagcuccaaauugguggcauuauccuuucaaaaucucaggg

SEQ ID NO: 443279 - RNA, 64 nt, hsa
agucucuauugaaaauacaaaaauuagcucagugugguggcacacacuuguaaucccagcuacu

SEQ ID NO: 443280 - RNA, 64 nt, hsa
gcaagcaggacuuugaggcaagugugggccacugugguggcaguggaggugggguguuugggag

SEQ ID NO: 443281 - RNA, 64 nt, hsa
uccuggauguuguguguaucgagaggccaaaggcugguggcaagugcacggggcacagcggagu

SEQ ID NO: 443282 - RNA, 64 nt, hsa
uucuuaaaguuaccacaucccacaaaauggcccuugguggcagcaauagagcaaagguuaccuu

SEQ ID NO: 443283 - RNA, 64 nt, hsa
ugucucuacaaaaaauacaaaaauuaaccaggcaugguggcaugcaccuguagucccagcuacu

SEQ ID NO: 443284 - RNA, 64 nt, hsa
cugucucuacuaaaaauacaaaaauagcugggcaugguggcacgcaccucuacucccagcuacu

SEQ ID NO: 443285 - RNA, 64 nt, hsa
ggaggccuccugacuuauucauaguauugucgccugguggcauuggugugggguagcuuguccu

SEQ ID NO: 443286 - RNA, 64 nt, hsa
uacauagaaauuuuauuauaaaaguagcuggggaugguggcacacaccuguagucccagcuacu

SEQ ID NO: 443287 - RNA, 64 nt, hsa
cccccuccccaucaccuuuggugggggcagggccugguggcaccugugcaauaaugucuguguu

SEQ ID NO: 443288 - RNA, 64 nt, hsa
acuugccauccccuacagcacagaggaagagugaugguggcaugcuggugguggcgggugcugg

SEQ ID NO: 443289 - RNA, 64 nt, hsa
ccaggcuccuuuagcgcccaguuggguggaugccugguggcagcugcgguccacccaggagccc

SEQ ID NO: 443290 - RNA, 64 nt, hsa
gacuuggaagcuccgcuuucuacccagcgagcccugguggcagugggagcugccuguucagcuc

SEQ ID NO: 443291 - RNA, 64 nt, hsa
cauuugcuacucgccgggcagacuuuaaucggggugguggcaauggucguggaggccgagggcg

SEQ ID NO: 443292 - RNA, 64 nt, hsa
cauuaggacccaugggccguggaggcuauggaggugguggcagugguggugguggccgaggagg

SEQ ID NO: 443293 - RNA, 64 nt, hsa
uuguccuaggggguaacuacggggaugaucgucgugguggcagaggaggcuaugaucgaggcgg

SEQ ID NO: 443294 - RNA, 64 nt, hsa
cuucuucccuucccaccccucacucagcuucucgugguggcaggagguaugucugacaggacag

SEQ ID NO: 443295 - RNA, 64 nt, hsa
auuugaaaguuagccuccucccuugccaccgucuugguggcaguagcgaugcaagaaugauggg

SEQ ID NO: 443296 - RNA, 64 nt, hsa
ccugccacuucuaugucucuggaccacaggauggugguggcauugcagguuggcaagugggcug

SEQ ID NO: 443297 - RNA, 64 nt, hsa
aucucuacuaaaaaauacaaaaauuagccaggcaugguggcacacaccuguaaucguagcugag

SEQ ID NO: 443298 - RNA, 64 nt, hsa
ccgucucuacuaaaauacauaaauuagccgggugugguggcaggcgccugaaaucccagcuacu

SEQ ID NO: 443299 - RNA, 64 nt, hsa
ccgucucuacuaaaaacagaaaauuauccgggcgugguggcacaugacuguaaucccagcuacu

SEQ ID NO: 443300 - RNA, 64 nt, hsa
aaaaaauaguaauaauacaaaaauuagcugggcgugguggcacaugccaguaauuccaucuacu

SEQ ID NO: 443301 - RNA, 64 nt, hsa
gcucacccuccucggggaggggaagcaccaggguugguggcaucggaggccuuaccacuccuau

SEQ ID NO: 443302 - RNA, 64 nt, hsa
ugugugcccuguuccuugcccaccucaggccuggugguggcaguggaggaggcugaggaggcug

SEQ ID NO: 443303 - RNA, 64 nt, hsa
aauauggaccugggguaccuuuaguuagggacucugguggcacuacacggggugcuggauucaa

SEQ ID NO: 443304 - RNA, 64 nt, hsa
ccagcagugaggagcugggacaugugacaggcugugguggcaccacugagccuagaccauggag

SEQ ID NO: 443305 - RNA, 64 nt, hsa
cuaauuacaacugauuuaauccacucaaguuuagaccaguuaaacccauaggauccuguauggu

SEQ ID NO: 443306 - RNA, 64 nt, hsa
ucuguaauguucugucccaguaugucuuugggucaccaguuaccuucuuaaaauaugugcuuua

SEQ ID NO: 443307 - RNA, 64 nt, hsa
cgccccgagaccccaccccgagaccccaccccggaccaguuacauucguuccuggcaaaagcaa

SEQ ID NO: 443308 - RNA, 64 nt, hsa
auaauuucaccaggcuaaauaaaggaaaauggaaaccaguuaagaggcacaguguacagaggag

SEQ ID NO: 443309 - RNA, 64 nt, hsa; identical to SEQ ID NO: 150207

SEQ ID NO: 443310 - RNA, 64 nt, hsa; identical to SEQ ID NO: 150208

SEQ ID NO: 443311 - RNA, 64 nt, hsa; identical to SEQ ID NO: 150209

SEQ ID NO: 443312 - RNA, 64 nt, hsa; identical to SEQ ID NO: 150210

SEQ ID NO: 443313 - RNA, 64 nt, hsa; identical to SEQ ID NO: 150211

SEQ ID NO: 443314 - RNA, 64 nt, hsa; identical to SEQ ID NO: 150212

SEQ ID NO: 443315 - RNA, 64 nt, hsa; identical to SEQ ID NO: 150213

SEQ ID NO: 443316 - RNA, 64 nt, hsa; identical to SEQ ID NO: 150214

SEQ ID NO: 443317 - RNA, 64 nt, hsa
aagguggccagccugguucucuucccugcucaggcugccagagaggugguaaauggcagaaagg

SEQ ID NO: 443318 - RNA, 64 nt, hsa
agccuguggcuuguggccugugaccugugaccuucugccagaauugucaugccucugaggcccc

SEQ ID NO: 443319 - RNA, 64 nt, hsa
gagucaggacaccuggcuucuugaaaaguucgcucugccagaaaccaccuagggaccacguuag

SEQ ID NO: 443320 - RNA, 64 nt, hsa
cgucuguccugucaccugccgcccagccccucuccugccagacagcccacgaccgggucgaccc

SEQ ID NO: 443321 - RNA, 64 nt, hsa
cugaaagcaccaagggucccugccccuaccuccacugccagacccucagccugaggucugguga

SEQ ID NO: 443322 - RNA, 64 nt, hsa
guccuguuuguggagugcaaucagccuccuccagcugccagagcgccucagcacaggugucagg

SEQ ID NO: 443323 - RNA, 64 nt, hsa
ccugugggcagccgcgccagcugccgggacacugcugccagaccugcccccaggguaagucuug

SEQ ID NO: 443324 - RNA, 64 nt, hsa
cgcccaacuacgacccgcucugcucacucugcaccugccagagacgaacggugaucugugaccc

SEQ ID NO: 443325 - RNA, 64 nt, hsa
acacuccuuagcacuuuaagaaagugagauggaacugccagauuucuggaaggagaaaaagugu

SEQ ID NO: 443326 - RNA, 64 nt, hsa
agcuguggcuuaugcagauguucacugggaggaccugccagaaucucggcacuuggggggagac

SEQ ID NO: 443327 - RNA, 64 nt, hsa
gaucgcccugcuggcugccggcaccgcccuccugcugccagagacgaggcaggcacagcugcca

SEQ ID NO: 443328 - RNA, 64 nt, hsa
cgcccuccugcugccagagacgaggcaggcacagcugccagagaccauccaggacguggagaga

SEQ ID NO: 443329 - RNA, 64 nt, hsa
cccucucugcaacuccuguuugcaagcgcugggccugccagacagaggccccucuuguggugca

SEQ ID NO: 443330 - RNA, 64 nt, hsa
cagcuccccaagagacaguccugaugggcacaggcugccagagcucccaagccggaguucacag

SEQ ID NO: 443331 - RNA, 64 nt, hsa
ggccagcccuggcuucuccucuguuccagcuugucugccagaagccuuccccugcaaggugccc

SEQ ID NO: 443332 - RNA, 64 nt, hsa
uuccggucugcuagcacccucagccugggagcuacugccagaggcuggcguaguggggcagcug

SEQ ID NO: 443333 - RNA, 64 nt, hsa
uugaacuggccucaagugauucucuuaccacagccugccagagugcugagauuguaggcaugaa

SEQ ID NO: 443334 - RNA, 64 nt, hsa
ucuuaacugucccuuccaaccacccuccacacugcugccagagcaaucuuaaaaauguaaacug

SEQ ID NO: 443335 - RNA, 64 nt, hsa
gucugucauguccagauuuacuuugcuucuguuacugccagaguuacuagagauaucauaauag

SEQ ID NO: 443336 - RNA, 64 nt, hsa
uugccugcuugguguccaguuaaaacucaguguacugccagauucgucuaaaugucugucaugu

SEQ ID NO: 443337 - RNA, 64 nt, hsa
gaggaccucgccccaagcaagccagugagcagcccugccagacuacugccagacugagaaaccc

SEQ ID NO: 443338 - RNA, 64 nt, hsa
cccaagcaagccagugagcagcccugccagacuacugccagacugagaaacccagaagcuggua

SEQ ID NO: 443339 - RNA, 64 nt, hsa
aguccuggccccugaaucaccagagccaccaagccugccagaggggucucauucauggcuuggg

SEQ ID NO: 443340 - RNA, 64 nt, hsa
ggggugagaagaaucaucucugcaccucgggucucugccagaggaagacuuaagcaucccugcg

SEQ ID NO: 443341 - RNA, 64 nt, hsa
gagcaaucugugacuccuaaaauggguuggggcccugccagaguuaaagcagugacuggagggu

SEQ ID NO: 443342 - RNA, 64 nt, hsa
caaggcuguccugucccccaggcacccaaggauccugccagacagcacacuuuggaggaagguc

SEQ ID NO: 443343 - RNA, 64 nt, hsa
aagagaagcacgcuguccccgucucuccuggcuucugccagaaaaucgaacaagugcaauuaac

SEQ ID NO: 443344 - RNA, 64 nt, hsa
ggacgccucuccccuggucuggaaucuuccaguucugccagaauuggccuuucccagaugcugc

SEQ ID NO: 443345 - RNA, 64 nt, hsa; identical to SEQ ID NO: 159009

SEQ ID NO: 443346 - RNA, 64 nt, hsa; identical to SEQ ID NO: 159010

SEQ ID NO: 443347 - RNA, 64 nt, hsa; identical to SEQ ID NO: 159011

SEQ ID NO: 443348 - RNA, 64 nt, hsa; identical to SEQ ID NO: 159012

SEQ ID NO: 443349 - RNA, 64 nt, hsa; identical to SEQ ID NO: 159013

SEQ ID NO: 443350 - RNA, 64 nt, hsa; identical to SEQ ID NO: 159014

SEQ ID NO: 443351 - RNA, 64 nt, hsa
ggauaaacugccaagaaccagauuuuuaaaaggccgcaaaaaaucuuuuccugggagucuacaa

SEQ ID NO: 443352 - RNA, 64 nt, hsa
uuuaauucuuuaaaaaguaaaaacucuacauggucgcaaaaauguguuuauuucuaauguccuu

SEQ ID NO: 443353 - RNA, 64 nt, hsa
auagaucgucagggaauagcccaaauguuuuaaacgcaaaaaaaaagacaaaaaaaaaccaaaa

SEQ ID NO: 443354 - RNA, 64 nt, hsa
uguaagaaaaaaaaauuuauuuaaaaauauuuuucgcaaaaaaaaaaaaaaucuugguguguuu

SEQ ID NO: 443355 - RNA, 64 nt, hsa
agucccccaaagucuuaacucuuuucagcauuaacgcaaaaauccacaguccaaagucucaucu

SEQ ID NO: 443356 - RNA, 64 nt, hsa
ccuggagcugcucuccuggccuccuuggauuuaucgcaaaaacugaagguuugcgcaagagacg

SEQ ID NO: 443357 - RNA, 64 nt, hsa
gcacucggucgggccuccacaggcauggaguccccgcaaaaaccuggccccugcaggagucagg

SEQ ID NO: 443358 - RNA, 64 nt, hsa
cugcaaaagagaacaccaaucccauccacacucacgcaaaaaccgcgaugccgacaagaaaacu

SEQ ID NO: 443359 - RNA, 64 nt, hsa
ucugcccacuuuaccuacggagacaugauaaacacgcaaaaaaaaccuagaaauuaagcaaaaa

SEQ ID NO: 443360 - RNA, 64 nt, hsa
ugauuaaagaaguuucuuauuuaaacaucucagacgcaaaaauuacauuaaauuuuuguauauu

SEQ ID NO: 443361 - RNA, 64 nt, hsa
cauguuuagcaaaaaccaauucaguuccauuccccgcaaaaaaccccuaacuuuacucugaacu

SEQ ID NO: 443362 - RNA, 64 nt, hsa
aacaggcgcccuauuuucuuucuaguuguggcugcgcaaaaacauuuaucucccaaauaagaug

SEQ ID NO: 443363 - RNA, 64 nt, hsa
acagcagaguugauuaagaaaaaugaagaaaaaacgcaaaaagagaacacauguagaagguggu

SEQ ID NO: 443364 - RNA, 64 nt, hsa
uggccucuuguagucuuggcuaaggaaauucuaacgcaaaaauagcucuugcuuugacuuaggu

SEQ ID NO: 443365 - RNA, 64 nt, hsa
cugccuaccaagacacuacuugcacuggaucuuacgcaaaaaagaaccagaacacacagugugg

SEQ ID NO: 443366 - RNA, 64 nt, hsa
guggaauaccuaaggauagcaccgcuuuuguucucgcaaaaacguaucuccuaauuugaggcuc

SEQ ID NO: 443367 - RNA, 64 nt, hsa
uucuacuguaaaaugcaauuugaaaaaaauaaaacgcaaaaaaagaaacuguaaaggaaaccaa

SEQ ID NO: 443368 - RNA, 64 nt, hsa
ugugguauaugaucuuaaaugaugaacaugagaccgcaaaaauucacuccuggagaucuccgua

SEQ ID NO: 443369 - RNA, 64 nt, hsa
uccggugcacaaaugcuuucucuucaaggcauggcgcaaaaaagccacuacuuccagaagcauc

SEQ ID NO: 443370 - RNA, 64 nt, hsa
ucuagucaauucugaaccaccaccccccgccccccgcaaaaaaguaaaagucaaaccaaacuuc

SEQ ID NO: 443371 - RNA, 64 nt, hsa
auccuaggcaacagagcgagacucugucuccccccgcaaaaaaaaaaaagaaagaaagaaagag

SEQ ID NO: 443372 - RNA, 64 nt, hsa
uucaucaggccuuggagcagucacugcuuuauuccgcaaaaauuauuugguaggaaauuuuugg

SEQ ID NO: 443373 - RNA, 64 nt, hsa
uaaacaaaucaucuuugucaguuaaguauaguugcgcaaaaauuguuaaauccuuugucuuuau

SEQ ID NO: 443374 - RNA, 64 nt, hsa
cuggcugccucaggcuucucuuacgaagaggaaacgcaaaaaaagaaaaggaaaaaccccgugc

SEQ ID NO: 443375 - RNA, 64 nt, hsa
gcacuccagccugggcgcaagaccaagacuuaaacgcaaaaaaaaaaaaaaaaaaaaaaaaaaa

SEQ ID NO: 443376 - RNA, 64 nt, hsa
caguucagccuggaugaugagagugagacuccaucgcaaaaaaaaaaaaaaaaaaagaaaagaa

SEQ ID NO: 443377 - RNA, 64 nt, hsa
caaagcucacaucugggagauuaacuuuuuuuaacgcaaaaauauucugcacauuacccauaua

SEQ ID NO: 443378 - RNA, 64 nt, hsa
guguauagcauguguauuaaugucuaacuacauacgcaaaaacuuccuuuacagagguucggac

SEQ ID NO: 443379 - RNA, 64 nt, hsa
uaguauaagggaacucaagggaaaaggaaacacacgcaaaaacuauuuuaagacuuucugaacu

SEQ ID NO: 443380 - RNA, 64 nt, hsa
uuuuguuuucuucauucauuuggaaccuuauuuucgcaaaaaaccuagcuggaauaauaaugcc

SEQ ID NO: 443381 - RNA, 64 nt, hsa
uaggcuaggauaacuuuagagcacugacauaaaacgcaaaaacaggaaucaugccguuugcaaa

SEQ ID NO: 443382 - RNA, 64 nt, hsa
cacaugucgguagguuccgugaugccccacaagccgcaaaaaccagcaaguuuuuauuagggau

SEQ ID NO: 443383 - RNA, 64 nt, hsa
cugucugacuguagcuuugugaaauaucuuaaaacgcaaaaaccaauuguguccugaaaauugu

SEQ ID NO: 443384 - RNA, 64 nt, hsa
cucagaacuugaccaugaagauacacaacagacucgcaaaaauaaagugggaaaugaaguucag

SEQ ID NO: 443385 - RNA, 64 nt, hsa
cuauaaaaagcaccggaucuuuuccaucuaauuccgcaaaaauugaucauuugcaaagucaaaa

SEQ ID NO: 443386 - RNA, 64 nt, hsa
gcugugacccucaauucauauuuaugaaucucuacgcaaaaaauaacuacagaaaaauuacuug

SEQ ID NO: 443387 - RNA, 62 nt, hsa
uugagugauguccauuccaucauuagggcuacucgcaaaagaccauauguugauucuaccug

SEQ ID NO: 443388 - RNA, 62 nt, hsa
uuaauucuuuaaaaaguaaaaacucuacauggucgcaaaaauguguuuauuucuaauguccu

SEQ ID NO: 443389 - RNA, 62 nt, hsa
guaagaaaaaaaaauuuauuuaaaaauauuuuucgcaaaaaaaaaaaaaaucuugguguguu

SEQ ID NO: 443390 - RNA, 62 nt, hsa
cuggagcugcucuccuggccuccuuggauuuaucgcaaaaacugaagguuugcgcaagagac

SEQ ID NO: 443391 - RNA, 62 nt, hsa
ccaccuagauuuuaagcaguaaauaaaacauuucgcaaaagauuaaaguugaauuuuacagu

SEQ ID NO: 443392 - RNA, 62 nt, hsa
gugauuguggaucaggaggggaaugucaggauucgcaaaauggacuuuucauuugucaagua

SEQ ID NO: 443393 - RNA, 62 nt, hsa
uggaauaccuaaggauagcaccgcuuuuguucucgcaaaaacguaucuccuaauuugaggcu

SEQ ID NO: 443394 - RNA, 62 nt, hsa
gaccucacuggccuguggugacugcacacagcucgcaaaacugucuuuggauguucaaauga

SEQ ID NO: 443395 - RNA, 62 nt, hsa
cuguaauggccacugaagcacgugagagacccucgcaaaaugaugugaaaggaccaguuucu

SEQ ID NO: 443396 - RNA, 62 nt, hsa
gaggaacaacaucaaagggaacucucucuacuucgcaaaagacuagaagaacuggaaacaac

SEQ ID NO: 443397 - RNA, 62 nt, hsa
gauucaaaccaguaacuuaguaaaauugaccuucgcaaaaccucacugggggagugccuugu

SEQ ID NO: 443398 - RNA, 62 nt, hsa
aguucagccuggaugaugagagugagacuccaucgcaaaaaaaaaaaaaaaaaaagaaaaga

SEQ ID NO: 443399 - RNA, 62 nt, hsa
auuagaauuucauaugacauucaugccuggcuucgcaaaauguuucaaguacuguaacugug

SEQ ID NO: 443400 - RNA, 62 nt, hsa
gguugaguuucucuaaggaccccucaaacaugucgcaaaaugaaccaaacuucuggcuaggc

SEQ ID NO: 443401 - RNA, 62 nt, hsa
uuuguuuucuucauucauuuggaaccuuauuuucgcaaaaaaccuagcuggaauaauaaugc

SEQ ID NO: 443402 - RNA, 62 nt, hsa
gucuucuucauauauaugauaucauuuauuuuucgcaaaaggagaaaaaacaguggccuuug

SEQ ID NO: 443403 - RNA, 62 nt, hsa
aagggacggcuaaccuuuauugacaaucuauaucgcaaaagucaggaaagagguugugagcu

SEQ ID NO: 443404 - RNA, 62 nt, hsa
auaauggggaaaaaaagucuugugauugacuuucgcaaaauaaacaggauuuacugaguaga

SEQ ID NO: 443405 - RNA, 62 nt, hsa
cugcuuuagacaacugugacagacuauauggcucgcaaaacugcaaauauuuccuauccuuu

SEQ ID NO: 443406 - RNA, 62 nt, hsa
aaaaauguguuucccucaaaucaugggaaccaucgcaaaauuauucugaagcuucugcaguc

SEQ ID NO: 443407 - RNA, 62 nt, hsa
gaucaucugaucugauccucuuguacggaugaucgcaaaacugagguguagagaggggaaug

SEQ ID NO: 443408 - RNA, 62 nt, hsa
ucagaacuugaccaugaagauacacaacagacucgcaaaaauaaagugggaaaugaaguuca

SEQ ID NO: 443409 - RNA, 64 nt, hsa
gauugagugauguccauuccaucauuagggcuacucgcaaaagaccauauguugauucuaccug

SEQ ID NO: 443410 - RNA, 64 nt, hsa
auuuaauucuuuaaaaaguaaaaacucuacauggucgcaaaaauguguuuauuucuaauguccu

SEQ ID NO: 443411 - RNA, 64 nt, hsa
auguaagaaaaaaaaauuuauuuaaaaauauuuuucgcaaaaaaaaaaaaaaucuugguguguu

SEQ ID NO: 443412 - RNA, 64 nt, hsa
gccuggagcugcucuccuggccuccuuggauuuaucgcaaaaacugaagguuugcgcaagagac

SEQ ID NO: 443413 - RNA, 64 nt, hsa
acccaccuagauuuuaagcaguaaauaaaacauuucgcaaaagauuaaaguugaauuuuacagu

SEQ ID NO: 443414 - RNA, 64 nt, hsa
cugugauuguggaucaggaggggaaugucaggauucgcaaaauggacuuuucauuugucaagua

SEQ ID NO: 443415 - RNA, 64 nt, hsa
uguggaauaccuaaggauagcaccgcuuuuguucucgcaaaaacguaucuccuaauuugaggcu

SEQ ID NO: 443416 - RNA, 64 nt, hsa
gugaccucacuggccuguggugacugcacacagcucgcaaaacugucuuuggauguucaaauga

SEQ ID NO: 443417 - RNA, 64 nt, hsa
aacuguaauggccacugaagcacgugagagacccucgcaaaaugaugugaaaggaccaguuucu

SEQ ID NO: 443418 - RNA, 64 nt, hsa
aggaggaacaacaucaaagggaacucucucuacuucgcaaaagacuagaagaacuggaaacaac

SEQ ID NO: 443419 - RNA, 64 nt, hsa
augauucaaaccaguaacuuaguaaaauugaccuucgcaaaaccucacugggggagugccuugu

SEQ ID NO: 443420 - RNA, 64 nt, hsa
gcaguucagccuggaugaugagagugagacuccaucgcaaaaaaaaaaaaaaaaaaagaaaaga

SEQ ID NO: 443421 - RNA, 64 nt, hsa
uuauuagaauuucauaugacauucaugccuggcuucgcaaaauguuucaaguacuguaacugug

SEQ ID NO: 443422 - RNA, 64 nt, hsa
aggguugaguuucucuaaggaccccucaaacaugucgcaaaaugaaccaaacuucuggcuaggc

SEQ ID NO: 443423 - RNA, 64 nt, hsa
auuuuguuuucuucauucauuuggaaccuuauuuucgcaaaaaaccuagcuggaauaauaaugc

SEQ ID NO: 443424 - RNA, 64 nt, hsa
uugucuucuucauauauaugauaucauuuauuuuucgcaaaaggagaaaaaacaguggccuuug

SEQ ID NO: 443425 - RNA, 64 nt, hsa
ucaagggacggcuaaccuuuauugacaaucuauaucgcaaaagucaggaaagagguugugagcu

SEQ ID NO: 443426 - RNA, 64 nt, hsa
agauaauggggaaaaaaagucuugugauugacuuucgcaaaauaaacaggauuuacugaguaga

SEQ ID NO: 443427 - RNA, 64 nt, hsa
ggcugcuuuagacaacugugacagacuauauggcucgcaaaacugcaaauauuuccuauccuuu

SEQ ID NO: 443428 - RNA, 64 nt, hsa
guaaaaauguguuucccucaaaucaugggaaccaucgcaaaauuauucugaagcuucugcaguc

SEQ ID NO: 443429 - RNA, 64 nt, hsa
gagaucaucugaucugauccucuuguacggaugaucgcaaaacugagguguagagaggggaaug

SEQ ID NO: 443430 - RNA, 64 nt, hsa
ucucagaacuugaccaugaagauacacaacagacucgcaaaaauaaagugggaaaugaaguuca

SEQ ID NO: 443431 - RNA, 64 nt, hsa; identical to SEQ ID NO: 238652

SEQ ID NO: 443432 - RNA, 64 nt, hsa; identical to SEQ ID NO: 238653

SEQ ID NO: 443433 - RNA, 64 nt, hsa; identical to SEQ ID NO: 238654

SEQ ID NO: 443434 - RNA, 64 nt, hsa; identical to SEQ ID NO: 238655

SEQ ID NO: 443435 - RNA, 64 nt, hsa; identical to SEQ ID NO: 238656

SEQ ID NO: 443436 - RNA, 64 nt, hsa; identical to SEQ ID NO: 238657

SEQ ID NO: 443437 - RNA, 64 nt, hsa; identical to SEQ ID NO: 238658

SEQ ID NO: 443438 - RNA, 64 nt, hsa; identical to SEQ ID NO: 238659

SEQ ID NO: 443439 - RNA, 64 nt, hsa; identical to SEQ ID NO: 238660

SEQ ID NO: 443440 - RNA, 64 nt, hsa; identical to SEQ ID NO: 238661

SEQ ID NO: 443441 - RNA, 64 nt, hsa; identical to SEQ ID NO: 238662

SEQ ID NO: 443442 - RNA, 64 nt, hsa; identical to SEQ ID NO: 238663

SEQ ID NO: 443443 - RNA, 64 nt, hsa; identical to SEQ ID NO: 238664

SEQ ID NO: 443444 - RNA, 64 nt, hsa; identical to SEQ ID NO: 238665

SEQ ID NO: 443445 - RNA, 64 nt, hsa; identical to SEQ ID NO: 238666

SEQ ID NO: 443446 - RNA, 64 nt, hsa; identical to SEQ ID NO: 238667

SEQ ID NO: 443447 - RNA, 64 nt, hsa; identical to SEQ ID NO: 238668

SEQ ID NO: 443448 - RNA, 64 nt, hsa; identical to SEQ ID NO: 238669

SEQ ID NO: 443449 - RNA, 64 nt, hsa; identical to SEQ ID NO: 238670

SEQ ID NO: 443450 - RNA, 64 nt, hsa; identical to SEQ ID NO: 238671

SEQ ID NO: 443451 - RNA, 64 nt, hsa; identical to SEQ ID NO: 238672

SEQ ID NO: 443452 - RNA, 64 nt, hsa; identical to SEQ ID NO: 238673

SEQ ID NO: 443453 - RNA, 64 nt, hsa; identical to SEQ ID NO: 238674

SEQ ID NO: 443454 - RNA, 64 nt, hsa; identical to SEQ ID NO: 238675

SEQ ID NO: 443455 - RNA, 64 nt, hsa; identical to SEQ ID NO: 238676

SEQ ID NO: 443456 - RNA, 64 nt, hsa; identical to SEQ ID NO: 238677

SEQ ID NO: 443457 - RNA, 64 nt, hsa; identical to SEQ ID NO: 238678

SEQ ID NO: 443458 - RNA, 64 nt, hsa; identical to SEQ ID NO: 238679

SEQ ID NO: 443459 - RNA, 64 nt, hsa; identical to SEQ ID NO: 238680

SEQ ID NO: 443460 - RNA, 64 nt, hsa; identical to SEQ ID NO: 238681

SEQ ID NO: 443461 - RNA, 64 nt, hsa; identical to SEQ ID NO: 238682

SEQ ID NO: 443462 - RNA, 64 nt, hsa; identical to SEQ ID NO: 238683

SEQ ID NO: 443463 - RNA, 64 nt, hsa; identical to SEQ ID NO: 238684

SEQ ID NO: 443464 - RNA, 64 nt, hsa; identical to SEQ ID NO: 238685

SEQ ID NO: 443465 - RNA, 64 nt, hsa; identical to SEQ ID NO: 238686

SEQ ID NO: 443466 - RNA, 64 nt, hsa; identical to SEQ ID NO: 238687

SEQ ID NO: 443467 - RNA, 64 nt, hsa; identical to SEQ ID NO: 238688

SEQ ID NO: 443468 - RNA, 64 nt, hsa; identical to SEQ ID NO: 238689

SEQ ID NO: 443469 - RNA, 64 nt, hsa; identical to SEQ ID NO: 238690

SEQ ID NO: 443470 - RNA, 64 nt, hsa; identical to SEQ ID NO: 238691

SEQ ID NO: 443471 - RNA, 64 nt, hsa; identical to SEQ ID NO: 238692

SEQ ID NO: 443472 - RNA, 64 nt, hsa; identical to SEQ ID NO: 238693

SEQ ID NO: 443473 - RNA, 64 nt, hsa; identical to SEQ ID NO: 238694

SEQ ID NO: 443474 - RNA, 64 nt, hsa; identical to SEQ ID NO: 238695

SEQ ID NO: 443475 - RNA, 64 nt, hsa; identical to SEQ ID NO: 238696

SEQ ID NO: 443476 - RNA, 64 nt, hsa; identical to SEQ ID NO: 238697

SEQ ID NO: 443477 - RNA, 64 nt, hsa; identical to SEQ ID NO: 238698

SEQ ID NO: 443478 - RNA, 64 nt, hsa; identical to SEQ ID NO: 238699

SEQ ID NO: 443479 - RNA, 64 nt, hsa; identical to SEQ ID NO: 238700

SEQ ID NO: 443480 - RNA, 64 nt, hsa; identical to SEQ ID NO: 238701

SEQ ID NO: 443481 - RNA, 64 nt, hsa; identical to SEQ ID NO: 238702

SEQ ID NO: 443482 - RNA, 64 nt, hsa; identical to SEQ ID NO: 238703

SEQ ID NO: 443483 - RNA, 64 nt, hsa; identical to SEQ ID NO: 238704

SEQ ID NO: 443484 - RNA, 64 nt, hsa; identical to SEQ ID NO: 238705

SEQ ID NO: 443485 - RNA, 64 nt, hsa; identical to SEQ ID NO: 238706

SEQ ID NO: 443486 - RNA, 64 nt, hsa; identical to SEQ ID NO: 238707

SEQ ID NO: 443487 - RNA, 64 nt, hsa; identical to SEQ ID NO: 238708

SEQ ID NO: 443488 - RNA, 64 nt, hsa; identical to SEQ ID NO: 238709

SEQ ID NO: 443489 - RNA, 64 nt, hsa; identical to SEQ ID NO: 238710

SEQ ID NO: 443490 - RNA, 64 nt, hsa; identical to SEQ ID NO: 238711

SEQ ID NO: 443491 - RNA, 64 nt, hsa; identical to SEQ ID NO: 238712

SEQ ID NO: 443492 - RNA, 64 nt, hsa; identical to SEQ ID NO: 238713

SEQ ID NO: 443493 - RNA, 64 nt, hsa; identical to SEQ ID NO: 238714

SEQ ID NO: 443494 - RNA, 64 nt, hsa; identical to SEQ ID NO: 238715

SEQ ID NO: 443495 - RNA, 64 nt, hsa; identical to SEQ ID NO: 238716

SEQ ID NO: 443496 - RNA, 64 nt, hsa; identical to SEQ ID NO: 238717

SEQ ID NO: 443497 - RNA, 64 nt, hsa; identical to SEQ ID NO: 238718

SEQ ID NO: 443498 - RNA, 64 nt, hsa; identical to SEQ ID NO: 238719

SEQ ID NO: 443499 - RNA, 64 nt, hsa; identical to SEQ ID NO: 168996

SEQ ID NO: 443500 - RNA, 64 nt, hsa; identical to SEQ ID NO: 168997

SEQ ID NO: 443501 - RNA, 64 nt, hsa; identical to SEQ ID NO: 168998

SEQ ID NO: 443502 - RNA, 64 nt, hsa; identical to SEQ ID NO: 168999

SEQ ID NO: 443503 - RNA, 64 nt, hsa; identical to SEQ ID NO: 169000

SEQ ID NO: 443504 - RNA, 64 nt, hsa; identical to SEQ ID NO: 169001

SEQ ID NO: 443505 - RNA, 64 nt, hsa; identical to SEQ ID NO: 169002

SEQ ID NO: 443506 - RNA, 64 nt, hsa; identical to SEQ ID NO: 169003

SEQ ID NO: 443507 - RNA, 64 nt, hsa; identical to SEQ ID NO: 107011

SEQ ID NO: 443508 - RNA, 64 nt, hsa; identical to SEQ ID NO: 107012

SEQ ID NO: 443509 - RNA, 64 nt, hsa; identical to SEQ ID NO: 107013

SEQ ID NO: 443510 - RNA, 64 nt, hsa; identical to SEQ ID NO: 107014

SEQ ID NO: 443511 - RNA, 64 nt, hsa; identical to SEQ ID NO: 107015

SEQ ID NO: 443512 - RNA, 64 nt, hsa; identical to SEQ ID NO: 107016

SEQ ID NO: 443513 - RNA, 64 nt, hsa; identical to SEQ ID NO: 107017

SEQ ID NO: 443514 - RNA, 64 nt, hsa; identical to SEQ ID NO: 107018

SEQ ID NO: 443515 - RNA, 64 nt, hsa; identical to SEQ ID NO: 107019

SEQ ID NO: 443516 - RNA, 64 nt, hsa; identical to SEQ ID NO: 107020

SEQ ID NO: 443517 - RNA, 64 nt, hsa; identical to SEQ ID NO: 107021

SEQ ID NO: 443518 - RNA, 64 nt, hsa; identical to SEQ ID NO: 107022

SEQ ID NO: 443519 - RNA, 64 nt, hsa; identical to SEQ ID NO: 107023

SEQ ID NO: 443520 - RNA, 64 nt, hsa; identical to SEQ ID NO: 107024

SEQ ID NO: 443521 - RNA, 64 nt, hsa; identical to SEQ ID NO: 107025

SEQ ID NO: 443522 - RNA, 64 nt, hsa; identical to SEQ ID NO: 107026

SEQ ID NO: 443523 - RNA, 64 nt, hsa; identical to SEQ ID NO: 107027

SEQ ID NO: 443524 - RNA, 64 nt, hsa; identical to SEQ ID NO: 107028

SEQ ID NO: 443525 - RNA, 64 nt, hsa; identical to SEQ ID NO: 107029

SEQ ID NO: 443526 - RNA, 64 nt, hsa; identical to SEQ ID NO: 107030

SEQ ID NO: 443527 - RNA, 64 nt, hsa; identical to SEQ ID NO: 107031

SEQ ID NO: 443528 - RNA, 64 nt, hsa; identical to SEQ ID NO: 107032

SEQ ID NO: 443529 - RNA, 63 nt, hsa
guuagcaaaccacuccuuuuguugcaaaggagcugaggucaaggguggcaaaggcacuugucc

SEQ ID NO: 443530 - RNA, 63 nt, hsa
gggaaaaauuauccccggacaacaugaaacaggugaggucaggucacugcggacaucaagggc

SEQ ID NO: 443531 - RNA, 63 nt, hsa
cugagcuauaagagggguggacacagggugggcugaggucagagguugguggggugucaucac

SEQ ID NO: 443532 - RNA, 63 nt, hsa
uugagcacugauguaaauuacuuagaucuucuuugaggucagaauucagcgaucacgguaggc

SEQ ID NO: 443533 - RNA, 63 nt, hsa
cagcagaauagcaaaaacuuugcucaggacauuugaggucaaauugaagacggaagacggaag

SEQ ID NO: 443534 - RNA, 63 nt, hsa
uguccccucugcaugcccuuaaacauuggacagugaggucacaguccacccacccucucucug

SEQ ID NO: 443535 - RNA, 63 nt, hsa
aguacucugggaagccaaggcaggcagaucacuugaggucaggaguucgagaccagccuggcc

SEQ ID NO: 443536 - RNA, 63 nt, hsa
agcacuuugggaggcugaggcgggcagaucgcuugaggucaggaguucaagaccagcccgggc

SEQ ID NO: 443537 - RNA, 63 nt, hsa
aguacuuugggaggccgagucagguggaucaccugaggucaggaguucaagaccagccuggcc

SEQ ID NO: 443538 - RNA, 63 nt, hsa
augggggcucuuucgcugcagccuccaccgugcugaggucaggaggccgacguggcaguugug

SEQ ID NO: 443539 - RNA, 63 nt, hsa
cuucacugaauuucuucaaaaccauugcagaagugaggucauccuugaaaaguggcagaaaaa

SEQ ID NO: 443540 - RNA, 63 nt, hsa
ccagcacuuugggaggccgaggugggcaaaucaugaggucaggagauugagaccuuccuggcu

SEQ ID NO: 443541 - RNA, 63 nt, hsa
acauaguauuccucaguaucuauuccaagauacugaggucauaaucagaagcuaagcugggug

SEQ ID NO: 443542 - RNA, 63 nt, hsa
agcacuuugggaggccaagguggguggaccacaugaggucaggaguuugagaucagccuggcc

SEQ ID NO: 443543 - RNA, 63 nt, hsa
ccagcacuuugggaggccaagacgggcggaucaugaggucaagagaucaagaucauccuggcc

SEQ ID NO: 443544 - RNA, 63 nt, hsa
aacacuuuaggagaccaaggcgggcagaucacuugaggucagaaguuugagaccagccaggcc

SEQ ID NO: 443545 - RNA, 63 nt, hsa
agcacucugggaggcugagacagguagaucauuugaggucaggaguucaaaaccaaccugguc

SEQ ID NO: 443546 - RNA, 63 nt, hsa
auuuggccagagccuucaggagguggaggccggugaggucaggagcccagcucuccagggggc

SEQ ID NO: 443547 - RNA, 63 nt, hsa
aggggcuuuggacuccugaggguguucccuuccugaggucacauguggauuuggccagagccu

SEQ ID NO: 443548 - RNA, 63 nt, hsa
agcacuuugggaggcugaggcaggugaaucaccugaggucaggaguucaagaccagccuggcc

SEQ ID NO: 443549 - RNA, 63 nt, hsa
ugauaaccuaagagcauuaagcucugaguccagugaggucauagcaguguaugcuccuugccc

SEQ ID NO: 443550 - RNA, 63 nt, hsa
agcacuuugggaguccaaggcaggcauaucauuugaggucaggaguuuaagaccagccuggcu

SEQ ID NO: 443551 - RNA, 63 nt, hsa
gcaugugaguaaacacaccugcgcagcccuggcugaggucacuaggcuggccagaggcaggac

SEQ ID NO: 443552 - RNA, 63 nt, hsa
uccagauuguaaauguaccaucuuaaacaacucugaggucaccaaacaguaguuauuugacug

SEQ ID NO: 443553 - RNA, 63 nt, hsa
cccagcacuuugggagguugcggguggaucacuugaggucaggaguucgagaccagccuggcc

SEQ ID NO: 443554 - RNA, 63 nt, hsa
aaaauguguaucugagugagaaaacaaguauggugaggucacuuuaauguuucacagcgaucu

SEQ ID NO: 443555 - RNA, 63 nt, hsa
gcaugcccgaguccugcaaggguggcggguggcugaggucacaccaccacuggaguggauggg

SEQ ID NO: 443556 - RNA, 63 nt, hsa
agcacuuugggaggcaggggcggguggaucaccugaggucaggaguucaagacuagccuggcc

SEQ ID NO: 443557 - RNA, 63 nt, hsa
agcacuuugagaggcugaggugguaggaucaccugaggucaggaguucaagaccagccugucc

SEQ ID NO: 443558 - RNA, 63 nt, hsa
ggacagccagagcuuucuauguacuguuaaaauugaggucacauauuuucuuuuguauccugg

SEQ ID NO: 443559 - RNA, 63 nt, hsa
ugauguacuuaaaggaauaauaaaugcauaauaugaggucaguggacgccauuuucuguuaua

SEQ ID NO: 443560 - RNA, 63 nt, hsa
cuuugggaggcugaggcgggugaaucacuugauugaggucaggaguucgagaccagccuggcc

SEQ ID NO: 443561 - RNA, 63 nt, hsa
agcacuuugcaaggccgaggaggguggaucacuugaggucaggaguucgagaccagccugacc

SEQ ID NO: 443562 - RNA, 63 nt, hsa
gaaacacagucguugcagauuaauuagucaccaugaggucacugggguggccccuaacccacc

SEQ ID NO: 443563 - RNA, 63 nt, hsa
guccuacucuguaacccuagagggcaccucugcugaggucagacaucuccuugaugucuguga

SEQ ID NO: 443564 - RNA, 63 nt, hsa
cugugggcuggguggccccauccuaccaggcccugaggucaggauggggagcugcugccuuug

SEQ ID NO: 443565 - RNA, 63 nt, hsa
uccuagcagaucguggggaacgucaggucucucugaggucaggucugaggccaguauccucca

SEQ ID NO: 443566 - RNA, 63 nt, hsa
agcacuuugggaggccaaggcugguggaucaccugaggucaggaguucgagaccagccuggcc

SEQ ID NO: 443567 - RNA, 63 nt, hsa
agcacuuugggaggcuuaggcggcuggaucaccugaggucaggaguucaagaccagccugguc

SEQ ID NO: 443568 - RNA, 63 nt, hsa
cagcagaauaacaaaaacuuugcucaggacauuugaggucaaauugaagacggaaaccggaaa

SEQ ID NO: 443569 - RNA, 63 nt, hsa
uucuugagcacugauauaaauuacggucuucuuugaggucaaaauucagccaucaugguaggc

SEQ ID NO: 443570 - RNA, 63 nt, hsa
agcacuuugggaggcugaggcaggcggaucacuugaggucaggagcucgagaccagccuggcc

SEQ ID NO: 443571 - RNA, 63 nt, hsa
agcauuuugggaggccaaggcgggcggaucacuugaggucaggagcucaagaccagccuggcc

SEQ ID NO: 443572 - RNA, 63 nt, hsa
gugugugagugggaggagagggcagagguccccugaggucaugcauuguaaucaucauagaag

SEQ ID NO: 443573 - RNA, 63 nt, hsa
ccugaggguguuaguaccuaguggugaaacggaugaggucauuucuaagguguguugcccgug

SEQ ID NO: 443574 - RNA, 63 nt, hsa
uaagaauaaggggcccugaaugucaugaaggcuugaggucagccuacagauaacaggauuauu

SEQ ID NO: 443575 - RNA, 63 nt, hsa
ucaccugauucaaggacuuugcuagcuagguuuugaggucaggcuucaguaacuguagucuug

SEQ ID NO: 443576 - RNA, 63 nt, hsa
uuggccacagugcucucagccagcacuaagggcugaggucaauaccgcagaccuuggggagga

SEQ ID NO: 443577 - RNA, 63 nt, hsa
ccugacacagucccucagagauggcccuggcucugaggucacaucagcuagguuugggaggcc

SEQ ID NO: 443578 - RNA, 63 nt, hsa
guuaggaccauccuccaggacaggugaccucuaugaggucaccuacggcuguggccgugcagg

SEQ ID NO: 443579 - RNA, 63 nt, hsa
uauuccuguggagggaccucugccgugccucucugaggucaggcugugcugugugaugggcag

SEQ ID NO: 443580 - RNA, 63 nt, hsa
cucaaauauggcauugcucaaaucugcuguguaugaggucacagggcccagcuguggcagggg

SEQ ID NO: 443581 - RNA, 63 nt, hsa
agcacuuugggaggccaaggcaggcagaucaccugaggucaggaguuugagaccagccuggcc

SEQ ID NO: 443582 - RNA, 63 nt, hsa
aacugggcgguggccgggcgugguggcucacgcugaggucaggaguucgagaccagccuggcc

SEQ ID NO: 443583 - RNA, 63 nt, hsa
agcacuuugggaggccgaggugggcagaucagcugaggucaggagaucgagaccagccuggcc

SEQ ID NO: 443584 - RNA, 64 nt, hsa; identical to SEQ ID NO: 172267

SEQ ID NO: 443585 - RNA, 64 nt, hsa; identical to SEQ ID NO: 172268

SEQ ID NO: 443586 - RNA, 64 nt, hsa; identical to SEQ ID NO: 172269

SEQ ID NO: 443587 - RNA, 64 nt, hsa; identical to SEQ ID NO: 172270

SEQ ID NO: 443588 - RNA, 64 nt, hsa; identical to SEQ ID NO: 172271

SEQ ID NO: 443589 - RNA, 64 nt, hsa; identical to SEQ ID NO: 172272

SEQ ID NO: 443590 - RNA, 64 nt, hsa; identical to SEQ ID NO: 172273

SEQ ID NO: 443591 - RNA, 64 nt, hsa; identical to SEQ ID NO: 172274

SEQ ID NO: 443592 - RNA, 64 nt, hsa; identical to SEQ ID NO: 172275

SEQ ID NO: 443593 - RNA, 64 nt, hsa; identical to SEQ ID NO: 172276

SEQ ID NO: 443594 - RNA, 64 nt, hsa; identical to SEQ ID NO: 172277

SEQ ID NO: 443595 - RNA, 64 nt, hsa; identical to SEQ ID NO: 172278

SEQ ID NO: 443596 - RNA, 64 nt, hsa; identical to SEQ ID NO: 172279

SEQ ID NO: 443597 - RNA, 64 nt, hsa; identical to SEQ ID NO: 172280

SEQ ID NO: 443598 - RNA, 64 nt, hsa; identical to SEQ ID NO: 172281

SEQ ID NO: 443599 - RNA, 64 nt, hsa; identical to SEQ ID NO: 172282

SEQ ID NO: 443600 - RNA, 64 nt, hsa; identical to SEQ ID NO: 172283

SEQ ID NO: 443601 - RNA, 64 nt, hsa; identical to SEQ ID NO: 172284

SEQ ID NO: 443602 - RNA, 64 nt, hsa; identical to SEQ ID NO: 172285

SEQ ID NO: 443603 - RNA, 64 nt, hsa; identical to SEQ ID NO: 172286

SEQ ID NO: 443604 - RNA, 64 nt, hsa; identical to SEQ ID NO: 172287

SEQ ID NO: 443605 - RNA, 64 nt, hsa; identical to SEQ ID NO: 172288

SEQ ID NO: 443606 - RNA, 64 nt, hsa; identical to SEQ ID NO: 172289

SEQ ID NO: 443607 - RNA, 64 nt, hsa; identical to SEQ ID NO: 172290

SEQ ID NO: 443608 - RNA, 64 nt, hsa; identical to SEQ ID NO: 172291

SEQ ID NO: 443609 - RNA, 64 nt, hsa; identical to SEQ ID NO: 172292

SEQ ID NO: 443610 - RNA, 64 nt, hsa; identical to SEQ ID NO: 172293

SEQ ID NO: 443611 - RNA, 64 nt, hsa; identical to SEQ ID NO: 172294

SEQ ID NO: 443612 - RNA, 64 nt, hsa; identical to SEQ ID NO: 172295

SEQ ID NO: 443613 - RNA, 64 nt, hsa; identical to SEQ ID NO: 172296

SEQ ID NO: 443614 - RNA, 64 nt, hsa; identical to SEQ ID NO: 172297

SEQ ID NO: 443615 - RNA, 64 nt, hsa; identical to SEQ ID NO: 172298

SEQ ID NO: 443616 - RNA, 64 nt, hsa; identical to SEQ ID NO: 172299

SEQ ID NO: 443617 - RNA, 64 nt, hsa; identical to SEQ ID NO: 172300

SEQ ID NO: 443618 - RNA, 64 nt, hsa; identical to SEQ ID NO: 172301

SEQ ID NO: 443619 - RNA, 64 nt, hsa; identical to SEQ ID NO: 172302

SEQ ID NO: 443620 - RNA, 64 nt, hsa; identical to SEQ ID NO: 172303

SEQ ID NO: 443621 - RNA, 64 nt, hsa; identical to SEQ ID NO: 172304

SEQ ID NO: 443622 - RNA, 64 nt, hsa; identical to SEQ ID NO: 172305

SEQ ID NO: 443623 - RNA, 64 nt, hsa; identical to SEQ ID NO: 172306

SEQ ID NO: 443624 - RNA, 64 nt, hsa; identical to SEQ ID NO: 172307

SEQ ID NO: 443625 - RNA, 64 nt, hsa; identical to SEQ ID NO: 172308

SEQ ID NO: 443626 - RNA, 64 nt, hsa; identical to SEQ ID NO: 172309

SEQ ID NO: 443627 - RNA, 64 nt, hsa; identical to SEQ ID NO: 172310

SEQ ID NO: 443628 - RNA, 65 nt, hsa
ugaagaaggcaaaaaacuuuuuuuuuuuuuuuuuugagacggagucucgcucugucgcccaggcu

SEQ ID NO: 443629 - RNA, 65 nt, hsa
auauaagggauaauuuuucuuuuuuuuuuuuuuuugagacggagucucacucuuccgcccaggcu

SEQ ID NO: 443630 - RNA, 65 nt, hsa
acagugguauauuggggaauuuuuuuuuuuuuuuugagacggagucuggcucugucacccaggcu

SEQ ID NO: 443631 - RNA, 65 nt, hsa
acacccagcuaauuuuuuuuuuuuuuuuuuuauuugagacggaguuucgcucugucgcccaggcu

SEQ ID NO: 443632 - RNA, 65 nt, hsa
ccaccaugccuggcuaauuuuuuuuauuuuuaguagagacggaauuuuaccauguuggcuaggcu

SEQ ID NO: 443633 - RNA, 65 nt, hsa
ucuuuuucuuuuuuuuuuuuuuauuuuaauuuuuugagacggaguuucccucuugucacccaggc

SEQ ID NO: 443634 - RNA, 65 nt, hsa
gccaccaugcccggcuaauuuuuguauuuuuaguagagacggaguuucaccauguuggccaggcu

SEQ ID NO: 443635 - RNA, 65 nt, hsa
cccauccucuucuuuuuuuuuuuuuuuuuuuuuuugagacggaguuucgcucuugucaccccagc

SEQ ID NO: 443636 - RNA, 65 nt, hsa
uguguauuuuguuuuguuuugcuuugcuuuguuuugagacggagucucgcucugucauccaggcu

SEQ ID NO: 443637 - RNA, 65 nt, hsa
cucuaauaccugagccaagaauggaagcuugugaggagacggacucuauguugcccaggcuguua

SEQ ID NO: 443638 - RNA, 65 nt, hsa
cgccaccaugcccggcuaauuuuguauuuuuaguagagacggaguugcaccauguuggccaggcu

SEQ ID NO: 443639 - RNA, 65 nt, hsa
acagagaacgcuacuaaugauuuuuuuuuuuuuuugagacggaguuuuguucuuguugcccaggc

SEQ ID NO: 443640 - RNA, 64 nt, hsa
acacucagggccagacccaccauccuggacuggcgaggaagaucagugccuccugcucugccca

SEQ ID NO: 443641 - RNA, 64 nt, hsa
uuagagcagggcuggucauacccucuggaguucagaggaagagguaggaccagugcuuuuuugu

SEQ ID NO: 443642 - RNA, 64 nt, hsa
auauauuagguaggucaaucuuaauuggucucaagaggaagaacugucugucauuucgguaagu

SEQ ID NO: 443643 - RNA, 64 nt, hsa
gaacugucugucauuucgguaaguaggauacugugaggaagaccaaaaagagauauggaugcuu

SEQ ID NO: 443644 - RNA, 64 nt, hsa
caacaaguauaccccaccagggccugagugacuagaggaagaggacgaggccuuguuggcacua

SEQ ID NO: 443645 - RNA, 64 nt, hsa
agaaaacuuuuuuuuagcuucaccgaugacaacagaggaagaagggaacugggauuuggguaag

SEQ ID NO: 443646 - RNA, 64 nt, hsa
ccgcacugggcuuccugaccuaagcaguaugacugaggaagagcagauugcuuaugccaugcag

SEQ ID NO: 443647 - RNA, 64 nt, hsa
ccaggccaccaaggacggcaagaaggacaagaaggaggaagacaagaagugagacuggagggaa

SEQ ID NO: 443648 - RNA, 56 nt, hsa
uuaacuacuuccugucaugaaggcuagaggaagacuuccuggaacugccuuucuuc

SEQ ID NO: 443649 - RNA, 64 nt, hsa
gccaagagccugaggcugaagggaaaaguacacagaggaagauauuuuacaaaccaggucagug

SEQ ID NO: 443650 - RNA, 64 nt, hsa
agaggaggaguugccacgaacaccacuccuggaugaggaagaggaggaaaauccugacaaggcu

SEQ ID NO: 443651 - RNA, 64 nt, hsa
gaggggauguaugaacggccaaauucccaugugagaggaagaugaccugauccaccuagccuuu

SEQ ID NO: 443652 - RNA, 64 nt, hsa
acugaacucugucugagugggaugguaugaguuagaggaagaauucucuugcaaauuaauaauc

SEQ ID NO: 443653 - RNA, 64 nt, hsa
uucugcugauggaacagccagccaugaacaaggugaggaagaagaaagaggaagcgcugaauua

SEQ ID NO: 443654 - RNA, 64 nt, hsa
gcagugaggcuuguccagaugauugagcccaggagaggaagaacaaacaaacuacggagcuggg

SEQ ID NO: 443655 - RNA, 64 nt, hsa
gacacugaccuucugcugggaaagcagcccugaggaggaagaggaggcgagggaaucagaaauu

SEQ ID NO: 443656 - RNA, 64 nt, hsa
auucaacaacauccauacagcacugcuggaggaagaggaagauuugugcagaccaagagcacca

SEQ ID NO: 443657 - RNA, 64 nt, hsa
cucaacauucaacaacauccauacagcacugcuggaggaagaggaagauuugugcagaccaaga

SEQ ID NO: 443658 - RNA, 64 nt, hsa
gaggaagcuggggaaagugguuagggagggagaggaggaagacugagaaaucucugcaucccca

SEQ ID NO: 443659 - RNA, 64 nt, hsa
augcagucugaugccagguauauuguuagggaaagaggaagaaggguaaacugagcuagccccu

SEQ ID NO: 443660 - RNA, 64 nt, hsa
gcagagcacacacuggcucaagcagcagagguaagaggaagaggcagcagcaucccaagaagga

SEQ ID NO: 443661 - RNA, 64 nt, hsa
caaaaaaaagaaaaagaaaaggaggcagaaagaggaggaagaagcuacagcaucugaaaggaau

SEQ ID NO: 443662 - RNA, 64 nt, hsa
gccuugaaggauggaugaaauuuggauagagaaugaggaagacagagggccuccaagugagaga

SEQ ID NO: 443663 - RNA, 64 nt, hsa
cagccagcuuacacaggcauuaacucuccucaaugaggaagaaucauucacaacugagcaagac

SEQ ID NO: 443664 - RNA, 64 nt, hsa
ucagaaacaaccagccuugaaggcuacaacugacgaggaagacucuguuucgaauauagccaca

SEQ ID NO: 443665 - RNA, 64 nt, hsa
ucagaaaccaccagccuugaaggguacaagugacgaggaagauucuguuuuggguauagccaga

SEQ ID NO: 443666 - RNA, 64 nt, hsa
aggagggacaagaaucaauggauaagcguggguggaggaagauccaaacagaaaagugcaaagu

SEQ ID NO: 443667 - RNA, 64 nt, hsa
aaguuauuccccaucuuccaaggguugaauucuggaggaagaagacacauuccuaguuccccgu

SEQ ID NO: 443668 - RNA, 64 nt, hsa
aaaagacacuucuuacauuguggcaagaaaaaaugaggaagaagcaaaagcagaaaccccugau

SEQ ID NO: 443669 - RNA, 64 nt, hsa
gaaaggcacuucuuacauggcagcaagagaaaaugaggaagaagcaaaaguggaaaccccugau

SEQ ID NO: 443670 - RNA, 64 nt, hsa
gcccugacccaccuggcaaagcagggcacauggggaggaagagacuggaaccuuucuuugacag

SEQ ID NO: 443671 - RNA, 64 nt, hsa
cauccccuuuagauucgugccucacuccaccagugaggaagaugccucugucuuucccacgacu

SEQ ID NO: 443672 - RNA, 64 nt, hsa
ccaggguggggagauccugggaagggaggcacuggaggaagacggcaccucuucccccauggca

SEQ ID NO: 443673 - RNA, 64 nt, hsa
uggaugaacagagaagggaagagaggaagaacgagaggaagagaagggaaggaaguguuugugu

SEQ ID NO: 443674 - RNA, 64 nt, hsa
uuugaggcaaguuggaugaacagagaagggaagagaggaagaacgagaggaagagaagggaagg

SEQ ID NO: 443675 - RNA, 64 nt, hsa
aaguccgggagaaccauaugaaggagcaggaggagaggaagaaacuuuuuuuccuucuuuucca

SEQ ID NO: 443676 - RNA, 64 nt, hsa
uuugcccaagaggcaucucaguacuccagcaauggaggaagaauagagaauuuugccuggcaau

SEQ ID NO: 443677 - RNA, 64 nt, hsa
ugguccaggcucuggugaagcccucugagcccaggaggaagagaaagcauuguccagagguagg

SEQ ID NO: 443678 - RNA, 64 nt, hsa
cuuuuguuaccugacaugccguagggugagcuuagaggaagaaagaaaacaauuuuuauuuggc

SEQ ID NO: 443679 - RNA, 64 nt, hsa
agucuuugcacuauauuaccaguauaugguuuccgaggaagauuaucuacugcaaaacaccacu

SEQ ID NO: 443680 - RNA, 64 nt, hsa
aaguuguacuucugacuaaacuggaauuaugagugaggaagaguguuuacuaaauaaaugacug

SEQ ID NO: 443681 - RNA, 64 nt, hsa
uguauucccccaucuagccauuucggaagacaccgaggaagaggaggaagaugaagaccaggac

SEQ ID NO: 443682 - RNA, 64 nt, hsa
ccaucuagccauuucggaagacaccgaggaagaggaggaagaugaagaccaggacuacagcuuu

SEQ ID NO: 443683 - RNA, 64 nt, hsa
agucaaucagcagaggagagcauuugauaacuaagaggaagacuugcaaagccguuuucucaug

SEQ ID NO: 443684 - RNA, 64 nt, hsa
ccuuucaccuccaauucccgugaucccaaaagaagaggaagacuccaggagggguauagauugu

SEQ ID NO: 443685 - RNA, 64 nt, hsa
ugcuacagccccccaacccccgaccugggguagggaggaagagggugccggggaagggaguccg

SEQ ID NO: 443686 - RNA, 64 nt, hsa
uuccaauuguuaauaacgcuauguuagcgcgcucgaggaagaagguaggaaucccggcuccuuu

SEQ ID NO: 443687 - RNA, 64 nt, hsa
ggccuuuggcgagagcuccacggaaagugaugaggaggaagaagagggcuguggucauacacac

SEQ ID NO: 443688 - RNA, 64 nt, hsa
cccuccuucccucucuucugccugauagagggaagaggaagaggaggacgaacagagauccuga

SEQ ID NO: 443689 - RNA, 64 nt, hsa
agucacagagagcaagccaagacauccagggaaagaggaagaaaggccuuagugugccccagca

SEQ ID NO: 443690 - RNA, 64 nt, hsa
ccccaggaccaacaacacccugguuuggagcugggaggaagaagggggccugagagagccccag

SEQ ID NO: 443691 - RNA, 64 nt, hsa
gggaagaggggcugggguuuaaauagcaugcuuggaggaagauuuuccuucaauuuuuccuaag

SEQ ID NO: 443692 - RNA, 64 nt, hsa
ugaacaugacaaaaguugccagaguuggggcauugaggaagagauauuucuggaaugugagacu

SEQ ID NO: 443693 - RNA, 64 nt, hsa
cugucuucaaaaucucauuagaauuuuuucacuggaggaagauuuucccuugcuucugcauaaa

SEQ ID NO: 443694 - RNA, 64 nt, hsa
acugucccaaauccugauaaauauuaacaucacagaggaagaccagacauuaugggccuggaag

SEQ ID NO: 443695 - RNA, 64 nt, hsa
gcucaucuugagaagcaggcggguugggugggaggaggaagaaagggaagaauuagguuugaau

SEQ ID NO: 443696 - RNA, 64 nt, hsa
guugccacugagaagcaggcggguugggugggaggaggaagaaagggaagaauuagguuugaau

SEQ ID NO: 443697 - RNA, 64 nt, hsa
uugcuaccaaacuuuguaaccucaaggacaaaaugaggaagauguguucauuguggacucuaaa

SEQ ID NO: 443698 - RNA, 64 nt, hsa
uguuuugcguugugcacuacaucauuucucuccugaggaagaauuuuaaacauguacagcucau

SEQ ID NO: 443699 - RNA, 64 nt, hsa
gcucagagaagccuaggugggcuaccaugaccccgaggaagagcaggcuuuguuuuccaucagc

SEQ ID NO: 443700 - RNA, 64 nt, hsa
gaccaggugaggugguggaacaaaaggccagguagaggaagaauauucccuuggguuuggaccc

SEQ ID NO: 443701 - RNA, 64 nt, hsa
caauuuucuuuggaaucuaacaggaaucuagccugaggaagaagggaggucuccauuucuaugu

SEQ ID NO: 443702 - RNA, 64 nt, hsa
uucuaccaaaaguaaaaaggguuguauuaagucagaggaagaugccucuccauuuucccucucu

SEQ ID NO: 443703 - RNA, 64 nt, hsa
cagggaacaggaggaggaagagggucaggguggagaggaagaucagucagugggcacaagacag

SEQ ID NO: 443704 - RNA, 64 nt, hsa
uggaagagcugcuggcugcaucagggaacaggaggaggaagagggucaggguggagaggaagau

SEQ ID NO: 443705 - RNA, 64 nt, hsa
auauagagaugcauucacagggguuggcugggaggaggaagaccauucugugaccaaaauaccu

SEQ ID NO: 443706 - RNA, 64 nt, hsa
aaagaaaggucgcagcaguagcuuuggggaaagggaggaagauauggcacuucuccaaccccgg

SEQ ID NO: 443707 - RNA, 64 nt, hsa
uguggaggugcuggcauucagucugcuagaggcagaggaagaagggugaggacagcaccagacu

SEQ ID NO: 443708 - RNA, 64 nt, hsa
aagggcagcacccccacuuucaacugaaucaagugaggaagagggcucagagccugacucugag

SEQ ID NO: 443709 - RNA, 64 nt, hsa
aaaaacaaaacacacguacauuagguccuggguggaggaagaagugguggagccucagggccag

SEQ ID NO: 443710 - RNA, 64 nt, hsa
caguucaggaauuaagauacuuggaauagcuguggaggaagaaccuaaauugcaaagaucugcu

SEQ ID NO: 443711 - RNA, 64 nt, hsa
augguuaagauugaugguggccuggauuagcaaagaggaagacagcuuuuaacacaguucccug

SEQ ID NO: 443712 - RNA, 64 nt, hsa
agaagugaccaugggcugggaggagguggaggaggaggaagaggagaaggaaaagugacgaaga

SEQ ID NO: 443713 - RNA, 64 nt, hsa
gagcuuuuuugugaaacucagaucagccacccaggaggaagagcgggcugaggaaacccagagg

SEQ ID NO: 443714 - RNA, 64 nt, hsa
gccaugucuucaaagucugauuugugaugaggcagaggaagauauuucuaaucggucuugccca

SEQ ID NO: 443715 - RNA, 64 nt, hsa
accacccacucuccucugccucaguaaguaucuggaggaagaaaacaggugaaagaagaaguaa

SEQ ID NO: 443716 - RNA, 64 nt, hsa
aggaaggaaacauagaaagacaugggcuaucagggaggaagauguucaauagaacaugcaagaa

SEQ ID NO: 443717 - RNA, 64 nt, hsa
uaaaaagcccuaugugaaaagaucccaagauggagaggaagaaacgcuaauucagcauguguuc

SEQ ID NO: 443718 - RNA, 64 nt, hsa
uuuucuuguguuuuaagaauuaggagacauggaagaggaagaacaaaguccccucuguaguugg

SEQ ID NO: 443719 - RNA, 64 nt, hsa
aguuguggggcauaagacaccgggaaugagggaggaggaagacaguuguguuuucucuuuaaac

SEQ ID NO: 443720 - RNA, 64 nt, hsa
accccacccgugccugugagugaggugggugggagaggaagaaaguugggguucuccaggcuca

SEQ ID NO: 443721 - RNA, 64 nt, hsa
gagauagugccauugcacuccggccugggcaacagaggaagacugccucaaacaaacaaaaaac

SEQ ID NO: 443722 - RNA, 64 nt, hsa
uccuggcucacuuugcaguuggcacuggguuggggaggaagagagcugaugaguguggcuuccc

SEQ ID NO: 443723 - RNA, 64 nt, hsa
accagaaggaaggaaugggcuacagcagguaguggaggaagaggggggugagcagguguauuaa

SEQ ID NO: 443724 - RNA, 64 nt, hsa
accaaguuggaauuccacgcccgggagugggguagaggaagacgagacaggacgaggcagaaaa

SEQ ID NO: 443725 - RNA, 64 nt, hsa
gaugggaaagggcgaacgaggauuaggggauggggaggaagagagagacuguggagcucugggg

SEQ ID NO: 443726 - RNA, 64 nt, hsa
gagaaagggcagaggaagagacaugagaaagggagaggaagagaagcccagcucugggaacuga

SEQ ID NO: 443727 - RNA, 64 nt, hsa
aggaagaggaagagugagggauggagaaagggcagaggaagagacaugagaaagggagaggaag

SEQ ID NO: 443728 - RNA, 64 nt, hsa
gcagcccagccagcagcacagucucuauggugcugaggaagagcagcagcagcaggauggugaa

SEQ ID NO: 443729 - RNA, 64 nt, hsa
cgaauugggugcacagcaccccaaccacauacacgaggaagaagaugcggucagcagucucagg

SEQ ID NO: 443730 - RNA, 64 nt, hsa
aaagaguagccggcuucagugccugccuuggggugaggaagacaccucugccccaguggauuag

SEQ ID NO: 443731 - RNA, 64 nt, hsa
agaaggccuaaagaacagagcuaaggguuucccugaggaagaaauucugccugaggacagcagc

SEQ ID NO: 443732 - RNA, 64 nt, hsa
gggccugccccugccagcaggugccagggcuggugaggaagagcuggggggcagagguaaagcc

SEQ ID NO: 443733 - RNA, 64 nt, hsa
cacccugugaccacgauggugaccgugacugugggaggaagaacuggacccaggacggagcggg

SEQ ID NO: 443734 - RNA, 64 nt, hsa
gggugcagccugccacaggcuccucauccggacugaggaagacgaggacagggaggaggaaaag

SEQ ID NO: 443735 - RNA, 64 nt, hsa
gacugaggaagacgaggacagggaggaggaaaaggaggaagaggaggacaaaaagggggaggag

SEQ ID NO: 443736 - RNA, 64 nt, hsa
cccagacucaucugaaggaucgucagaggagggugaggaagacuaauuaaacauggagaaacca

SEQ ID NO: 443737 - RNA, 64 nt, hsa
ugaagaccuagacucaucugaaggaucuuugauggaggaagaagacccagacucaucugaagga

SEQ ID NO: 443738 - RNA, 64 nt, hsa
ccccacugaaugcuugccuugcccaaauggaauggaggaagauugauuuucuccaucaguucac

SEQ ID NO: 443739 - RNA, 64 nt, hsa
uugaggaaguggaggcugguaaagagcaggaccagaggaagaauccagauuuccuuaugcuugg

SEQ ID NO: 443740 - RNA, 64 nt, hsa
uggauguguuauucuugcccucucuuuugaggcucucucauaaccccucuauuucuagagacaa

SEQ ID NO: 443741 - RNA, 64 nt, hsa
uuuucugguuacuaauuagcuucaggauacgcugcucucauacuugggcuguaguuuggagaca

SEQ ID NO: 443742 - RNA, 64 nt, hsa
aggaaggaugcucucauaaggcccaggaaggaugcucucauaagcaccuuggucauggauuagc

SEQ ID NO: 443743 - RNA, 64 nt, hsa
ccuuuucuggcaagagaagggcccaggaaggaugcucucauaaggcccaggaaggaugcucuca

SEQ ID NO: 443744 - RNA, 64 nt, hsa; identical to SEQ ID NO: 315595

SEQ ID NO: 443745 - RNA, 64 nt, hsa; identical to SEQ ID NO: 315596

SEQ ID NO: 443746 - RNA, 64 nt, hsa; identical to SEQ ID NO: 315597

SEQ ID NO: 443747 - RNA, 64 nt, hsa; identical to SEQ ID NO: 315598

SEQ ID NO: 443748 - RNA, 64 nt, hsa; identical to SEQ ID NO: 315599

SEQ ID NO: 443749 - RNA, 64 nt, hsa; identical to SEQ ID NO: 315600

SEQ ID NO: 443750 - RNA, 64 nt, hsa; identical to SEQ ID NO: 315601

SEQ ID NO: 443751 - RNA, 64 nt, hsa; identical to SEQ ID NO: 315602

SEQ ID NO: 443752 - RNA, 64 nt, hsa; identical to SEQ ID NO: 315603

SEQ ID NO: 443753 - RNA, 64 nt, hsa; identical to SEQ ID NO: 315604

SEQ ID NO: 443754 - RNA, 64 nt, hsa; identical to SEQ ID NO: 315605

SEQ ID NO: 443755 - RNA, 64 nt, hsa; identical to SEQ ID NO: 315606

SEQ ID NO: 443756 - RNA, 64 nt, hsa
uuuggcagcaauggugggccacccagggccucugaguagccacccaaagccuagccgcuguucu

SEQ ID NO: 443757 - RNA, 64 nt, hsa
uggugcaagccacauauguaauuuuaaauauucuaguagccacauuaauaaaguaaaaagaaac

SEQ ID NO: 443758 - RNA, 64 nt, hsa
gggugggggccugugggccagaggacuccaugacaguagccauggagucccaccugugccaggu

SEQ ID NO: 443759 - RNA, 64 nt, hsa
aaguagcugccccucauucuggccaguucuuuccaguagccauggggcuggcuacaagaagcaa

SEQ ID NO: 443760 - RNA, 64 nt, hsa
cacacacgcguguguuauuguagcaauaacaaaaaguagccaucuccuuguuccagcugaaaac

SEQ ID NO: 443761 - RNA, 64 nt, hsa
ccaaacacauacauggauuuugccaagugcugccaguagccaaaacaaagucuuuuuagggcaa

SEQ ID NO: 443762 - RNA, 64 nt, hsa
ccacauucgcugaagcgauggagagucgggggccaguagccagccaaccccguggggaccgggg

SEQ ID NO: 443763 - RNA, 63 nt, hsa
agaucuucuugaguuggugagaaugcagggccgaguagccagcugcauugcuuagauuugauu

SEQ ID NO: 443764 - RNA, 64 nt, hsa
uacugugaaaaagggauguuagcauucauuagaguaugaggaugagucccaagaagguucuuug

SEQ ID NO: 443765 - RNA, 64 nt, hsa
uuuaaacccacuacgcagggaugaggugcuauaauaugaggaccuuuuaacuuccaucauuuuc

SEQ ID NO: 443766 - RNA, 64 nt, hsa
uggcucacaguacagcaugugccuuaaugcuucauaugaggaggaugucccugggccagggucu

SEQ ID NO: 443767 - RNA, 64 nt, hsa
cagggucauguuugcaggggugacggcccucaucuaugaggaaagguuuuggaucuugaaugug

SEQ ID NO: 443768 - RNA, 64 nt, hsa
aguuaccucuucauagccaugaaccaaaacguucuaugaggagcaugcaaguaagucaagccuc

SEQ ID NO: 443769 - RNA, 64 nt, hsa
uugaauugauggaucucuaaaggcuuuuguccucuaugaggaugugaaaaacuagggaccacaa

SEQ ID NO: 443770 - RNA, 64 nt, hsa
uaaaaagcucaaggacuuuaugaagaucucauuauaugaggaaaaucauagguuaccauuuuau

SEQ ID NO: 443771 - RNA, 64 nt, hsa
uucagugaaaauaauuuuauuucagucaaacauuuaugaggaaaugagaucacaucuuugucac

SEQ ID NO: 443772 - RNA, 64 nt, hsa
uucacuauuuaaacuaugauaaauuaugauaauauaugaggaggccucgcuauagcaaaaauag

SEQ ID NO: 443773 - RNA, 64 nt, hsa
aggugcuuguuaugucuagaaaguaagaaaacaauaugaggagacauucugucuuucaaaaggu

SEQ ID NO: 443774 - RNA, 64 nt, hsa
uuaguguuuucucagaaucagcaacucaagguacuaugaggauuuuucucacugacauaauuug

SEQ ID NO: 443775 - RNA, 64 nt, hsa
auuugauuacauacuaaauaagaggauauguuaauaugaggaaauguaaauuaaauuaguuaua

SEQ ID NO: 443776 - RNA, 64 nt, hsa
uaagauaauucauacuggaaggaaacccuacaaauaugaggaaugucucaaagcuuuuuacuga

SEQ ID NO: 443777 - RNA, 64 nt, hsa
gucuauguaaauaccagaauuuauaguagaaauauaugaggaagcgacacuucgaauauucuac

SEQ ID NO: 443778 - RNA, 64 nt, hsa
gugaacuacccagggcagccccuuuguggcccaggauaaucaacacuguucucucuguaccaug

SEQ ID NO: 443779 - RNA, 64 nt, hsa
ggggggagaggcugcuucgaagggcaggacuggggauaaucagaaccugccugucaccucaggg

SEQ ID NO: 443780 - RNA, 64 nt, hsa
gucucaaccaaaauauuccuguuggaaucaugaugauaaucauagcagcacuuuucacagcauc

SEQ ID NO: 443781 - RNA, 64 nt, hsa
agcaagaaaauauaaauacaguuaacugcauuaagauaaucacguuaaaauuguuacuaugcag

SEQ ID NO: 443782 - RNA, 64 nt, hsa
uuauuuagguuaaauaucuguggacaagaaacaagauaaucaguuacugagugaagaaagacgg

SEQ ID NO: 443783 - RNA, 64 nt, hsa
caucuguuaaaugaugagcauuuaauaaaauugugauaaucaguuaucaguacaagugccgcau

SEQ ID NO: 443784 - RNA, 64 nt, hsa
uagagacagacguauaauuuuuauggaauuacaugauaaucauauucggauuuauagaagcauu

SEQ ID NO: 443785 - RNA, 64 nt, hsa
aagcauuuuacaaguauugcaaucauugaguagagauaaucaugguauuuucaucagcuuggua

SEQ ID NO: 443786 - RNA, 64 nt, hsa
cacacaugcacgcacacacacauacacacaugcacgcacgcacgcaugcacaccaauuuauguu

SEQ ID NO: 443787 - RNA, 64 nt, hsa
caugcacgcacacacacauacacacaugcacgcacgcacgcaugcacaccaauuuauguuuuua

SEQ ID NO: 443788 - RNA, 64 nt, hsa
acgcaugcacagauaugcuguccggacacacacacgcacgcagauaugcugccuggacacacac

SEQ ID NO: 443789 - RNA, 64 nt, hsa
gcacacacgugcagauaugcuguccggauacacacgcacgcacacaugcagauaugcugccugg

SEQ ID NO: 443790 - RNA, 64 nt, hsa
cccaaagcuuaagucucugcaggcguggcacgcacgcacgcacccacccacgcgcacuuacacg

SEQ ID NO: 443791 - RNA, 64 nt, hsa
guaucccaaagcuuaagucucugcaggcguggcacgcacgcacgcacccacccacgcgcacuua

SEQ ID NO: 443792 - RNA, 64 nt, hsa
gggagcuagaggguugugacccuucauacacacacgcacgcacgcacacaaacaugcacacacg

SEQ ID NO: 443793 - RNA, 64 nt, hsa
gcuagaggguugugacccuucauacacacacgcacgcacgcacacaaacaugcacacacgcaug

SEQ ID NO: 443794 - RNA, 64 nt, hsa
ggcaggggggcggcgggugggcccgccccacgcacgcacgcacacucggggacuuugugcaugc

SEQ ID NO: 443795 - RNA, 64 nt, hsa
cccgggcaggggggcggcgggugggcccgccccacgcacgcacgcacacucggggacuuugugc

SEQ ID NO: 443796 - RNA, 64 nt, hsa
cacgcagacaggucgauuugcccaggcccgcgcccgcacgcacgcacgcacacggccccgcaca

SEQ ID NO: 443797 - RNA, 64 nt, hsa
cagacaggucgauuugcccaggcccgcgcccgcacgcacgcacgcacacggccccgcacacagc

SEQ ID NO: 443798 - RNA, 64 nt, hsa
caggucgauuugcccaggcccgcgcccgcacgcacgcacgcacacggccccgcacacagccccg

SEQ ID NO: 443799 - RNA, 64 nt, hsa; identical to SEQ ID NO: 98228

SEQ ID NO: 443800 - RNA, 64 nt, hsa; identical to SEQ ID NO: 98229

SEQ ID NO: 443801 - RNA, 64 nt, hsa; identical to SEQ ID NO: 98230

SEQ ID NO: 443802 - RNA, 64 nt, hsa; identical to SEQ ID NO: 98231

SEQ ID NO: 443803 - RNA, 64 nt, hsa; identical to SEQ ID NO: 98232

SEQ ID NO: 443804 - RNA, 64 nt, hsa; identical to SEQ ID NO: 98233

SEQ ID NO: 443805 - RNA, 64 nt, hsa; identical to SEQ ID NO: 98234

SEQ ID NO: 443806 - RNA, 64 nt, hsa; identical to SEQ ID NO: 98235

SEQ ID NO: 443807 - RNA, 64 nt, hsa; identical to SEQ ID NO: 98236

SEQ ID NO: 443808 - RNA, 64 nt, hsa; identical to SEQ ID NO: 98237

SEQ ID NO: 443809 - RNA, 64 nt, hsa; identical to SEQ ID NO: 98238

SEQ ID NO: 443810 - RNA, 64 nt, hsa; identical to SEQ ID NO: 98239

SEQ ID NO: 443811 - RNA, 64 nt, hsa; identical to SEQ ID NO: 98240

SEQ ID NO: 443812 - RNA, 64 nt, hsa; identical to SEQ ID NO: 98241

SEQ ID NO: 443813 - RNA, 64 nt, hsa; identical to SEQ ID NO: 98242

SEQ ID NO: 443814 - RNA, 64 nt, hsa; identical to SEQ ID NO: 98243

SEQ ID NO: 443815 - RNA, 64 nt, hsa; identical to SEQ ID NO: 98244

SEQ ID NO: 443816 - RNA, 64 nt, hsa; identical to SEQ ID NO: 98245

SEQ ID NO: 443817 - RNA, 64 nt, hsa; identical to SEQ ID NO: 98246

SEQ ID NO: 443818 - RNA, 64 nt, hsa; identical to SEQ ID NO: 98247

SEQ ID NO: 443819 - RNA, 64 nt, hsa; identical to SEQ ID NO: 98248

SEQ ID NO: 443820 - RNA, 64 nt, hsa; identical to SEQ ID NO: 98249

SEQ ID NO: 443821 - RNA, 64 nt, hsa; identical to SEQ ID NO: 98250

SEQ ID NO: 443822 - RNA, 64 nt, hsa; identical to SEQ ID NO: 98251

SEQ ID NO: 443823 - RNA, 64 nt, hsa; identical to SEQ ID NO: 98252

SEQ ID NO: 443824 - RNA, 64 nt, hsa; identical to SEQ ID NO: 98253

SEQ ID NO: 443825 - RNA, 64 nt, hsa; identical to SEQ ID NO: 98254

SEQ ID NO: 443826 - RNA, 64 nt, hsa; identical to SEQ ID NO: 98255

SEQ ID NO: 443827 - RNA, 64 nt, hsa; identical to SEQ ID NO: 98256

SEQ ID NO: 443828 - RNA, 64 nt, hsa; identical to SEQ ID NO: 98257

SEQ ID NO: 443829 - RNA, 64 nt, hsa; identical to SEQ ID NO: 98258

SEQ ID NO: 443830 - RNA, 64 nt, hsa; identical to SEQ ID NO: 98259

SEQ ID NO: 443831 - RNA, 64 nt, hsa; identical to SEQ ID NO: 98260

SEQ ID NO: 443832 - RNA, 64 nt, hsa; identical to SEQ ID NO: 98261

SEQ ID NO: 443833 - RNA, 64 nt, hsa; identical to SEQ ID NO: 98262

SEQ ID NO: 443834 - RNA, 64 nt, hsa; identical to SEQ ID NO: 98263

SEQ ID NO: 443835 - RNA, 64 nt, hsa; identical to SEQ ID NO: 98264

SEQ ID NO: 443836 - RNA, 64 nt, hsa; identical to SEQ ID NO: 189531

SEQ ID NO: 443837 - RNA, 64 nt, hsa; identical to SEQ ID NO: 189532

SEQ ID NO: 443838 - RNA, 64 nt, hsa; identical to SEQ ID NO: 189533

SEQ ID NO: 443839 - RNA, 64 nt, hsa; identical to SEQ ID NO: 189534

SEQ ID NO: 443840 - RNA, 64 nt, hsa; identical to SEQ ID NO: 189535

SEQ ID NO: 443841 - RNA, 64 nt, hsa; identical to SEQ ID NO: 189536

SEQ ID NO: 443842 - RNA, 64 nt, hsa; identical to SEQ ID NO: 189537

SEQ ID NO: 443843 - RNA, 64 nt, hsa; identical to SEQ ID NO: 189538

SEQ ID NO: 443844 - RNA, 64 nt, hsa; identical to SEQ ID NO: 189539

SEQ ID NO: 443845 - RNA, 64 nt, hsa; identical to SEQ ID NO: 189540

SEQ ID NO: 443846 - RNA, 64 nt, hsa; identical to SEQ ID NO: 189541

SEQ ID NO: 443847 - RNA, 64 nt, hsa; identical to SEQ ID NO: 189542

SEQ ID NO: 443848 - RNA, 64 nt, hsa; identical to SEQ ID NO: 189543

SEQ ID NO: 443849 - RNA, 64 nt, hsa; identical to SEQ ID NO: 189544

SEQ ID NO: 443850 - RNA, 64 nt, hsa; identical to SEQ ID NO: 189545

SEQ ID NO: 443851 - RNA, 64 nt, hsa; identical to SEQ ID NO: 189546

SEQ ID NO: 443852 - RNA, 64 nt, hsa; identical to SEQ ID NO: 189547

SEQ ID NO: 443853 - RNA, 64 nt, hsa; identical to SEQ ID NO: 189548

SEQ ID NO: 443854 - RNA, 64 nt, hsa; identical to SEQ ID NO: 189549

SEQ ID NO: 443855 - RNA, 64 nt, hsa; identical to SEQ ID NO: 189550

SEQ ID NO: 443856 - RNA, 64 nt, hsa; identical to SEQ ID NO: 189551

SEQ ID NO: 443857 - RNA, 64 nt, hsa; identical to SEQ ID NO: 189552

SEQ ID NO: 443858 - RNA, 64 nt, hsa; identical to SEQ ID NO: 189553

SEQ ID NO: 443859 - RNA, 64 nt, hsa; identical to SEQ ID NO: 189554

SEQ ID NO: 443860 - RNA, 64 nt, hsa; identical to SEQ ID NO: 189555

SEQ ID NO: 443861 - RNA, 64 nt, hsa; identical to SEQ ID NO: 189556

SEQ ID NO: 443862 - RNA, 64 nt, hsa; identical to SEQ ID NO: 189557

SEQ ID NO: 443863 - RNA, 64 nt, hsa; identical to SEQ ID NO: 189558

SEQ ID NO: 443864 - RNA, 64 nt, hsa; identical to SEQ ID NO: 189559

SEQ ID NO: 443865 - RNA, 53 nt, hsa; identical to SEQ ID NO: 189560

SEQ ID NO: 443866 - RNA, 64 nt, hsa; identical to SEQ ID NO: 189561

SEQ ID NO: 443867 - RNA, 64 nt, hsa; identical to SEQ ID NO: 189562

SEQ ID NO: 443868 - RNA, 63 nt, hsa; identical to SEQ ID NO: 189563

SEQ ID NO: 443869 - RNA, 64 nt, hsa; identical to SEQ ID NO: 189564

SEQ ID NO: 443870 - RNA, 64 nt, hsa; identical to SEQ ID NO: 189565

SEQ ID NO: 443871 - RNA, 64 nt, hsa; identical to SEQ ID NO: 189566

SEQ ID NO: 443872 - RNA, 64 nt, hsa; identical to SEQ ID NO: 189567

SEQ ID NO: 443873 - RNA, 64 nt, hsa; identical to SEQ ID NO: 189568

SEQ ID NO: 443874 - RNA, 64 nt, hsa; identical to SEQ ID NO: 189569

SEQ ID NO: 443875 - RNA, 64 nt, hsa; identical to SEQ ID NO: 189570

SEQ ID NO: 443876 - RNA, 64 nt, hsa; identical to SEQ ID NO: 189571

SEQ ID NO: 443877 - RNA, 64 nt, hsa; identical to SEQ ID NO: 189572

SEQ ID NO: 443878 - RNA, 64 nt, hsa; identical to SEQ ID NO: 189573

SEQ ID NO: 443879 - RNA, 64 nt, hsa; identical to SEQ ID NO: 189574

SEQ ID NO: 443880 - RNA, 64 nt, hsa; identical to SEQ ID NO: 189575

SEQ ID NO: 443881 - RNA, 64 nt, hsa; identical to SEQ ID NO: 189576

SEQ ID NO: 443882 - RNA, 64 nt, hsa; identical to SEQ ID NO: 189577

SEQ ID NO: 443883 - RNA, 64 nt, hsa; identical to SEQ ID NO: 189578

SEQ ID NO: 443884 - RNA, 64 nt, hsa; identical to SEQ ID NO: 189579

SEQ ID NO: 443885 - RNA, 64 nt, hsa; identical to SEQ ID NO: 189580

SEQ ID NO: 443886 - RNA, 64 nt, hsa; identical to SEQ ID NO: 189581

SEQ ID NO: 443887 - RNA, 64 nt, hsa; identical to SEQ ID NO: 189582

SEQ ID NO: 443888 - RNA, 64 nt, hsa; identical to SEQ ID NO: 189583

SEQ ID NO: 443889 - RNA, 64 nt, hsa; identical to SEQ ID NO: 189584

SEQ ID NO: 443890 - RNA, 64 nt, hsa; identical to SEQ ID NO: 189585

SEQ ID NO: 443891 - RNA, 64 nt, hsa; identical to SEQ ID NO: 189586

SEQ ID NO: 443892 - RNA, 64 nt, hsa; identical to SEQ ID NO: 189587

SEQ ID NO: 443893 - RNA, 64 nt, hsa; identical to SEQ ID NO: 189588

SEQ ID NO: 443894 - RNA, 64 nt, hsa; identical to SEQ ID NO: 189589

SEQ ID NO: 443895 - RNA, 64 nt, hsa; identical to SEQ ID NO: 189590

SEQ ID NO: 443896 - RNA, 64 nt, hsa; identical to SEQ ID NO: 189591

SEQ ID NO: 443897 - RNA, 64 nt, hsa; identical to SEQ ID NO: 189592

SEQ ID NO: 443898 - RNA, 64 nt, hsa; identical to SEQ ID NO: 189593

SEQ ID NO: 443899 - RNA, 64 nt, hsa; identical to SEQ ID NO: 189594

SEQ ID NO: 443900 - RNA, 64 nt, hsa; identical to SEQ ID NO: 189595

SEQ ID NO: 443901 - RNA, 64 nt, hsa; identical to SEQ ID NO: 189596

SEQ ID NO: 443902 - RNA, 64 nt, hsa; identical to SEQ ID NO: 189597

SEQ ID NO: 443903 - RNA, 64 nt, hsa; identical to SEQ ID NO: 189598

SEQ ID NO: 443904 - RNA, 62 nt, hsa
uuucuuuccacacaggauuccguuggugaaccuguaaaaacaaaacaaacaaaacaaaacaa

SEQ ID NO: 443905 - RNA, 62 nt, hsa
cagagcaggacgcucuaggccaaaucuauuuuuguaaaaaugcucaugccuaugggugacug

SEQ ID NO: 443906 - RNA, 62 nt, hsa
uuuauugagauugaauuaugccaccacguuuauguaaaaaugaagguggcaccguggugaga

SEQ ID NO: 443907 - RNA, 62 nt, hsa
uggugagaccuaaugagaaauaguuacucaguuguaaaaauuuugauuuauucucuuucuuc

SEQ ID NO: 443908 - RNA, 62 nt, hsa
uuugucaucuguuagacucuguaugugugauuuguaaaaagcaggcugaaacuauggacaug

SEQ ID NO: 443909 - RNA, 62 nt, hsa
ugaaccccuaggcuucaggaaaacugcucuuuuguaaaaagaauagcgaugacauuuucuaa

SEQ ID NO: 443910 - RNA, 62 nt, hsa
auuugcacuguucagacauauauauguauguauguaaaaauuauauauacacaaauuagcug

SEQ ID NO: 443911 - RNA, 62 nt, hsa
cuaaagagacuuggcaccagcuuuguucaaacuguaaaaauagcaauuugccccuacucgcu

SEQ ID NO: 443912 - RNA, 62 nt, hsa
ccuuuuaaguuacugacaucagcuuccaccaguguaaaaauugaguaaaaccugaaguuuug

SEQ ID NO: 443913 - RNA, 62 nt, hsa
uagauauauuccaagccgccugacgaucuaauuguaaaaaguaaagcauacaaauacuagaa

SEQ ID NO: 443914 - RNA, 62 nt, hsa
gcaagacagaaauaagagaaucaagacuugauuguaaaaauugacaacuuuagauucugagg

SEQ ID NO: 443915 - RNA, 62 nt, hsa
agcguccuauaauccuagaccuuuucaugacguguaaaaaaugauguuucauccucugauug

SEQ ID NO: 443916 - RNA, 62 nt, hsa
uuguaaaaaggggagauuucgguaggcacagguguaaaaaggggagauuucagaagacgggc

SEQ ID NO: 443917 - RNA, 62 nt, hsa
acuuggaauaucagcagaguaguaggcacaguuguaaaaaggggagauuucgguaggcacag

SEQ ID NO: 443918 - RNA, 62 nt, hsa
cacuguaaaaauguauuaucuuguaaaacuuauguaaaaaaaaaaaaaaaaaaaaggcaaag

SEQ ID NO: 443919 - RNA, 62 nt, hsa
caaguugcaaaguuguauccacaucaggucacuguaaaaauguauuaucuuguaaaacuuau

SEQ ID NO: 443920 - RNA, 62 nt, hsa
gaaaaaaugaagaaaaauguauuuucccuuuauguaaaaauuagugaauaucuuaugaauua

SEQ ID NO: 443921 - RNA, 62 nt, hsa
ggaacuugagagcuuuuacugugauucuucaauguaaaaaauaaacaacaaugucaaacugu

SEQ ID NO: 443922 - RNA, 62 nt, hsa
ugauuuuuuuauaauaagccuuuuuaccucuguguaaaaaauauauauacaaguguaugaug

SEQ ID NO: 443923 - RNA, 62 nt, hsa
ucauuuauacuuggggaaaaaacaaggccauauguaaaaacccuuccaaugccuaagugucu

SEQ ID NO: 443924 - RNA, 62 nt, hsa
auagcuggcgagugcuuucuguauuuaaauauuguaaaaagaaaauaaguuauaacuguuau

SEQ ID NO: 443925 - RNA, 62 nt, hsa
ucauuaucuuuaaugaagacaaaggaaucuaguguaaaaaacaacagcaaacaaaaagguga

SEQ ID NO: 443926 - RNA, 62 nt, hsa
ccaacaacaauguguuguaaaaaugucuuucauguaaaaagugcaguaaauauuuacuauuu

SEQ ID NO: 443927 - RNA, 62 nt, hsa
uuguguugcagccucaaccaacaacaauguguuguaaaaaugucuuucauguaaaaagugca

SEQ ID NO: 443928 - RNA, 62 nt, hsa
guuuaaguuuacgucauugucucaaguguggcuguaaaaaucagaucuagaguuuagagaca

SEQ ID NO: 443929 - RNA, 62 nt, hsa
gcucagauugucgaguuaguaaacaugagcgauguaaaaacuuuauuugaaaucuccuaagu

SEQ ID NO: 443930 - RNA, 62 nt, hsa
uaaaagaccauaagcaaacugguuauuuaaaauguaaaaaggaauaugaaagucuuauuaaa

SEQ ID NO: 443931 - RNA, 62 nt, hsa
aaaggcauugauauuuuagaugcacccguguuuguaaaaauguagagcacaauggaauuaug

SEQ ID NO: 443932 - RNA, 62 nt, hsa
auuucuuccauuaacugcuuccagagaugucauguaaaaaaguuaguguauuagagaaguuu

SEQ ID NO: 443933 - RNA, 62 nt, hsa
gcuauuuuugagggauguauuuuuuuuaaaauuguaaaaauuguugaguucuguuuaaagaa

SEQ ID NO: 443934 - RNA, 62 nt, hsa
ugaguccuugugauuaggcccaccugaucaaauguaaaaacaugcaugggauauuugauuac

SEQ ID NO: 443935 - RNA, 62 nt, hsa
cagcaagacuuuauaauuccuucugccuaacuuguaaaaagggggcugcauucuuguuggua

SEQ ID NO: 443936 - RNA, 62 nt, hsa
aggggaaauacuuuaauuuuuuuucuuaauaguguaaaaauucccugagcuaagcuaaaacc

SEQ ID NO: 443937 - RNA, 62 nt, hsa
ucuucaaacacucuuaaauuuuucuuaaguaauguaaaaauggaacugccaauuuuauuucu

SEQ ID NO: 443938 - RNA, 62 nt, hsa
ucuuauucauuaaaugaauucaacauuuucucuguaaaaacaauagaguuucaguacaugaa

SEQ ID NO: 443939 - RNA, 62 nt, hsa
aauguacauaaauguuacauuuguaaagaaaauguaaaaauguaacuauagcauaugaauug

SEQ ID NO: 443940 - RNA, 62 nt, hsa
ccaguaccuauuuuuacucuuacaaaauuuccuguaaaaaaauacuacauuugaaauuauuu

SEQ ID NO: 443941 - RNA, 62 nt, hsa
aggauaccuggagcacaaggaauaagaucauuuguaaaaauguuuguuuauauagaccuauc

SEQ ID NO: 443942 - RNA, 62 nt, hsa
caugugaagaugugaucauuugugauguuacuuguaaaaaaaaguauauauacauaucuuuu

SEQ ID NO: 443943 - RNA, 62 nt, hsa
auuaacacaguauucauucaucuguguuauuuuguaaaaauaacuguagcuuauauucuuua

SEQ ID NO: 443944 - RNA, 62 nt, hsa
ucuucuucugagaaugugacuuuuucugguguuguaaaaaagaaaaaaaaaagaaugcucau

SEQ ID NO: 443945 - RNA, 62 nt, hsa
guuguaaaaaagaaaaaaaaaagaaugcucauuguaaaaauaaaaaaauaauaauaagcaag

SEQ ID NO: 443946 - RNA, 62 nt, hsa
gggaauuucuuuuccuacgggguacgugauuuuguaaaaaggaaguauuucucccaaaauug

SEQ ID NO: 443947 - RNA, 62 nt, hsa
ugcuaguuuaaaaaagaaaauauguaauauaauguaaaaaaaaacaaaaaaaagcuuuuaug

SEQ ID NO: 443948 - RNA, 62 nt, hsa
gaaaacguuugauuauuuucucaguguauuuuuguaaaaaauauauaaaggggguguuaauc

SEQ ID NO: 443949 - RNA, 62 nt, hsa
ugccaccaguguccacccuccggcccccgucuuguaaaaaggggaggagaauuagccaaaca

SEQ ID NO: 443950 - RNA, 62 nt, hsa
acgucucacuugaaauugcuuuguauacauuuuguaaaaauauuuauaaaauguuuuguaaa

SEQ ID NO: 443951 - RNA, 62 nt, hsa
auacauuuuguaaaaauauuuauaaaauguuuuguaaaaaaaaaaaaacuauaacaaauugc

SEQ ID NO: 443952 - RNA, 62 nt, hsa
cugauaaaacucagaauuucuuuuuaagcaguuguaaaaauugucauguuguaauucauuac

SEQ ID NO: 443953 - RNA, 62 nt, hsa
ugaaccucaugcaugaaagcagcacauuaaauuguaaaaauacaaacagaucgugugaucau

SEQ ID NO: 443954 - RNA, 62 nt, hsa
cccaugaagcaagaauagaugugagaaaucuauguaaaaaaauaauuaaagaaaugcaugug

SEQ ID NO: 443955 - RNA, 62 nt, hsa
gagugaauagauccuaagucccaaauggccaguguaaaaauguccuuaugucugaugcuguc

SEQ ID NO: 443956 - RNA, 62 nt, hsa
gacuuuuugagcaccuuucaguauuauguauuuguaaaaaccauuguuuuuggauauaaagc

SEQ ID NO: 443957 - RNA, 62 nt, hsa
uuaaaaguaguaagccacauuacauuuaucuuuguaaaaagauuuaugguaacugguuucuu

SEQ ID NO: 443958 - RNA, 62 nt, hsa
aggacguugaguggauuccuggguacagcuuuuguaaaaaugucaccauggcuuucauccaa

SEQ ID NO: 443959 - RNA, 62 nt, hsa
cugcaaaucccaaaucuuucuuuauuauuuauuguaaaaaaaguuuccuuagaagucauaaa

SEQ ID NO: 443960 - RNA, 62 nt, hsa
agaguauuuauacuggaaagaaacccuacaaauguaaaaaacguggcaaugccuuuaacugg

SEQ ID NO: 443961 - RNA, 62 nt, hsa
uaagaauccauacugaagaaaacuccuggaaguguaaaaaauguggcaacacuuuuaauaaa

SEQ ID NO: 443962 - RNA, 62 nt, hsa
agcccuauggaauuugcaaucugugauugccuuguaaaaaggagagugcauauggcacugca

SEQ ID NO: 443963 - RNA, 62 nt, hsa
uagaaaauauaugaaccaaagugauuugaguuuguaaaaauguaaaauaguaugaacaaaau

SEQ ID NO: 443964 - RNA, 62 nt, hsa
aaaaguuugcuuguuuaaaaugacaguugugauguaaaaaguuuaagaaauaugaaugugag

SEQ ID NO: 443965 - RNA, 62 nt, hsa
acuuuuuuaaagcugaguaguuaagaauucccuguaaaaacaaaacccuguaaauugagccu

SEQ ID NO: 443966 - RNA, 62 nt, hsa
auuagagaacugugauuuaaaaguacuguuaauguaaaaaauaaagcaaguguaauuaauuc

SEQ ID NO: 443967 - RNA, 62 nt, hsa
acuuccaaaaacaagggaacaaggugguuuauuguaaaaacaggaaauggugcaugucauug

SEQ ID NO: 443968 - RNA, 62 nt, hsa
augugccuguaaaccaaggaguuuuccccguuuguaaaaagacauuguagauaauugaaugu

SEQ ID NO: 443969 - RNA, 62 nt, hsa
ccuggucaacuuagcuuuuaagcagacgaugcuguaaaaacuaacggcuucucugauauuua

SEQ ID NO: 443970 - RNA, 62 nt, hsa
aaaaguugugcaugggcuuauacaauuucaaauguaaaaacagccuauuuauauauguugaa

SEQ ID NO: 443971 - RNA, 62 nt, hsa
aauguaaauagaacacuaauuaaaaaacaacuuguaaaaaugcaauuuaaauuuuaauacag

SEQ ID NO: 443972 - RNA, 62 nt, hsa
aaauauuuuuuaauuuaauggucaguauauuuuguaaaaaucauguuaauuuauuucauagu

SEQ ID NO: 443973 - RNA, 62 nt, hsa
ucugagcagcauuuugguauuuaaacauuucuuguaaaaagcugagacaguuuguaagaaaa

SEQ ID NO: 443974 - RNA, 62 nt, hsa
auauauccaaagauauaguguguacauuuuuuuguaaaaaguuuagaggcuuaccccuguaa

SEQ ID NO: 443975 - RNA, 62 nt, hsa
agaggauguauuuauauaauuauuuguuaaauuguaaaaaaaaaaguguaaaauauguauau

SEQ ID NO: 443976 - RNA, 62 nt, hsa
aagacucccucucaaaagaaaaagaaaaaagauguaaaaaccauucuuaguuugugggccuu

SEQ ID NO: 443977 - RNA, 62 nt, hsa
guauuuauaugaccuuuguaaccauuuaaaaauguaaaaacgaccugacuuaguaaugcgaa

SEQ ID NO: 443978 - RNA, 62 nt, hsa
ccuuaaaucucuuguauggcaaccaaaauuacuguaaaaaaauaaauauacuauugcacuaa

SEQ ID NO: 443979 - RNA, 62 nt, hsa
ggccugcugaggcugccccauauuuuagaaaauguaaaaauggugguuuggccauuaauuug

SEQ ID NO: 443980 - RNA, 62 nt, hsa
ccugugaaugccaaaguaaacuuuauguacaguguaaaaaaaaaaaaucucaguuauguuuu

SEQ ID NO: 443981 - RNA, 62 nt, hsa
aaauuaaguucugaaaauugaaaaaauuaaaauguaaaaaaauuaaagaauaaaaauacuuc

SEQ ID NO: 443982 - RNA, 62 nt, hsa
guaaaaaaaagucuuaacaacagcuucuugcuuguaaaaauauguauuauacaucuguauuu

SEQ ID NO: 443983 - RNA, 62 nt, hsa
uuccuuccugccccaaaauuauaaacucuaaguguaaaaaaaagucuuaacaacagcuucuu

SEQ ID NO: 443984 - RNA, 62 nt, hsa
uuucuaagaauguuuuucuauaaauuacuaauuguaaaaagucuugcuuuuuaaaacaaguu

SEQ ID NO: 443985 - RNA, 62 nt, hsa
cuccuugaggauagggauagguaagguaaacuuguaaaaaggaugucacagaagucacuuuu

SEQ ID NO: 443986 - RNA, 62 nt, hsa
guaaagaggaugcugccuuaagaauugcauguuguaaaaaaucuuuuuggaaaauacagacu

SEQ ID NO: 443987 - RNA, 62 nt, hsa
uauuuaucaaaauuaugugagguuccaaaauauguaaaaaugauaauaauaaaaaaagauua

SEQ ID NO: 443988 - RNA, 62 nt, hsa
gacuuauugagguaaauuaaaagaacaaaaacuguaaaaaggaaguaguucagcaucuaucg

SEQ ID NO: 443989 - RNA, 62 nt, hsa
uugucucagggaaaaucuucccccaccgagcuuguaaaaaacuuuaauaauuggguggagaa

SEQ ID NO: 443990 - RNA, 62 nt, hsa
auacacaaaaaucagauuuaguaacuaaagguuguaaaaaauuguaaaacugguuguacaau

SEQ ID NO: 443991 - RNA, 62 nt, hsa
caauagaugucucacacagaacaauacaaauauguaaaaaaucuuucaccacauauucuugc

SEQ ID NO: 443992 - RNA, 62 nt, hsa
uugcugguuuauaccuauguucauuuauaugcuguaaaaaaguaguagcuucuucuacaaug

SEQ ID NO: 443993 - RNA, 62 nt, hsa
augcuguaaaaaaguaguagcuucuucuacaauguaaaaauaaauguacauacaaaaaaaug

SEQ ID NO: 443994 - RNA, 62 nt, hsa
aagcucuaauuauugcagacauauuuuugagauguaaaaaaaaaaauuuaaaguuaaaugau

SEQ ID NO: 443995 - RNA, 62 nt, hsa
auuuucauuaugccccaucacaucuucuuuacuguaaaaauauuaaaaagcuguuuccaagu

SEQ ID NO: 443996 - RNA, 62 nt, hsa
gggaggaggcaaggucugcuaucaggaguuacuguaaaaacaagaacuggaagcucguguuu

SEQ ID NO: 443997 - RNA, 62 nt, hsa
uuguugcuuggcuuuuaaagaugguguauguuuguaaaaauauucuucugggcucaaaagcu

SEQ ID NO: 443998 - RNA, 62 nt, hsa
ucgggcuuuaauuugcuaaagcugugcacauauguaaaaaaaaaaaaaaaaagauuauuuua

SEQ ID NO: 443999 - RNA, 62 nt, hsa
aagaugauaaagcauuugaaugguacaguagauguaaaaaaaauucaguuuaaaagaacauu

SEQ ID NO: 444000 - RNA, 62 nt, hsa
uuuucuccuauacuugggcuacauuuuuugauuguaaaaauauuugauggccuuuugaugaa

SEQ ID NO: 444001 - RNA, 62 nt, hsa
caccuaugcaauauggcuuaucuauauuuauuuguaaaaauccaagcauaguuuaaaauaug

SEQ ID NO: 444002 - RNA, 62 nt, hsa
aaaaaugaaaguuaugacauuagcuuuaaagguguaaaaaagauguuucacuaauguaacgg

SEQ ID NO: 444003 - RNA, 62 nt, hsa
uaauaaaaauguuaauuuuggaagugcaguuuuguaaaaaccuuuuucagucaaacaguaaa

SEQ ID NO: 444004 - RNA, 62 nt, hsa
cgacagaguccauguuggaggugauaaaaaacuguaaaaaaaaaaaaaaaaaaaaagacaaa

SEQ ID NO: 444005 - RNA, 62 nt, hsa
ggggggugggaggggaagaaaaacucuauuuuuguaaaaagggaaaaagaccucguggagaa

SEQ ID NO: 444006 - RNA, 62 nt, hsa
aaaggaugcacacugcaaagaaacaguaugaauguaaaaaaugugggaaaacauacauuacu

SEQ ID NO: 444007 - RNA, 62 nt, hsa
aaaguacucacacuggagauaaacccuuugaguguaaaaaauguggaaaagcauuuagauac

SEQ ID NO: 444008 - RNA, 62 nt, hsa
aaagaacucacacuggagaaaaacccuaugaauguaaaaaaugugggaaaguguucguauau

SEQ ID NO: 444009 - RNA, 62 nt, hsa
agagaauucacacuagugagaaaccguaucaguguaaaaaauguagaaaauccuuuauugau

SEQ ID NO: 444010 - RNA, 62 nt, hsa
acacuggugacaaacccuaugaauguaaagauuguaaaaaagcuuuucuuuguuauucaaca

SEQ ID NO: 444011 - RNA, 62 nt, hsa
auguuguaaauauuuggcaauuuaagacauuguguaaaaagcaaucuguaaaaacaucucca

SEQ ID NO: 444012 - RNA, 62 nt, hsa
uggcaauuuaagacauuguguaaaaagcaaucuguaaaaacaucuccaggcuuugauuuuug

SEQ ID NO: 444013 - RNA, 62 nt, hsa
uuuacucuaccaauguuaugucgaaacugcauuguaaaaagagaagaaaguggcagguuuuc

SEQ ID NO: 444014 - RNA, 62 nt, hsa
guuuuuaaaaauuauauuccaguuuuaaucauuguaaaaaaagcaccuggaguuucaaaaca

SEQ ID NO: 444015 - RNA, 62 nt, hsa
guaggucuucagcauaagcugaaauauaugcauguaaaaacuuugacaucuuuuuuuuuaau

SEQ ID NO: 444016 - RNA, 62 nt, hsa
auuuacuaaccaguuuuuauauugaccugcaguguaaaaagcacauuuaauuauaaacaaua

SEQ ID NO: 444017 - RNA, 62 nt, hsa
ccaccaaaaugauccagucuggaauaacauuuuguaaaaaaaaaaaaaauauauauauauau

SEQ ID NO: 444018 - RNA, 62 nt, hsa
agaauugucaaccaauuucuuuaauugaacauuguaaaaaacaggaauaaguacuuuugugu

SEQ ID NO: 444019 - RNA, 62 nt, hsa
aaugcacaguaaauaugugaauuuuuccuagauguaaaaaaaaaaaucuuucauauaaagac

SEQ ID NO: 444020 - RNA, 62 nt, hsa
aucacuaguguggcuaaauaaccaaacauuuguguaaaaaaaaaaaaaagccaagauuucau

SEQ ID NO: 444021 - RNA, 62 nt, hsa
auauauauauaaauuuuaauuucauagcaacuuguaaaaaauaaaauacuuguugaaaagcc

SEQ ID NO: 444022 - RNA, 62 nt, hsa
auaaaaacauugcuuuuguugaauuguauagguguaaaaagggaauaacuguaugcagguuu

SEQ ID NO: 444023 - RNA, 62 nt, hsa
cuguaaagcuacuuguguucucuucauuugucuguaaaaauuucccuaauugauuauauagu

SEQ ID NO: 444024 - RNA, 64 nt, hsa; identical to SEQ ID NO: 55166

SEQ ID NO: 444025 - RNA, 64 nt, hsa; identical to SEQ ID NO: 55167

SEQ ID NO: 444026 - RNA, 64 nt, hsa; identical to SEQ ID NO: 55168

SEQ ID NO: 444027 - RNA, 64 nt, hsa; identical to SEQ ID NO: 55169

SEQ ID NO: 444028 - RNA, 64 nt, hsa; identical to SEQ ID NO: 55170

SEQ ID NO: 444029 - RNA, 64 nt, hsa; identical to SEQ ID NO: 55171

SEQ ID NO: 444030 - RNA, 64 nt, hsa; identical to SEQ ID NO: 55172

SEQ ID NO: 444031 - RNA, 64 nt, hsa; identical to SEQ ID NO: 55173

SEQ ID NO: 444032 - RNA, 64 nt, hsa; identical to SEQ ID NO: 55174

SEQ ID NO: 444033 - RNA, 64 nt, hsa; identical to SEQ ID NO: 55175

SEQ ID NO: 444034 - RNA, 64 nt, hsa; identical to SEQ ID NO: 55176

SEQ ID NO: 444035 - RNA, 64 nt, hsa; identical to SEQ ID NO: 55177

SEQ ID NO: 444036 - RNA, 64 nt, hsa; identical to SEQ ID NO: 345901

SEQ ID NO: 444037 - RNA, 64 nt, hsa; identical to SEQ ID NO: 345902

SEQ ID NO: 444038 - RNA, 64 nt, hsa; identical to SEQ ID NO: 345903

SEQ ID NO: 444039 - RNA, 64 nt, hsa; identical to SEQ ID NO: 345904

SEQ ID NO: 444040 - RNA, 64 nt, hsa; identical to SEQ ID NO: 345905

SEQ ID NO: 444041 - RNA, 64 nt, hsa; identical to SEQ ID NO: 345906

SEQ ID NO: 444042 - RNA, 64 nt, hsa; identical to SEQ ID NO: 345907

SEQ ID NO: 444043 - RNA, 64 nt, hsa; identical to SEQ ID NO: 345908

SEQ ID NO: 444044 - RNA, 64 nt, hsa; identical to SEQ ID NO: 345909

SEQ ID NO: 444045 - RNA, 64 nt, hsa; identical to SEQ ID NO: 345910

SEQ ID NO: 444046 - RNA, 64 nt, hsa; identical to SEQ ID NO: 345911

SEQ ID NO: 444047 - RNA, 64 nt, hsa; identical to SEQ ID NO: 345912

SEQ ID NO: 444048 - RNA, 64 nt, hsa; identical to SEQ ID NO: 345913

SEQ ID NO: 444049 - RNA, 64 nt, hsa; identical to SEQ ID NO: 345914

SEQ ID NO: 444050 - RNA, 64 nt, hsa; identical to SEQ ID NO: 345915

SEQ ID NO: 444051 - RNA, 64 nt, hsa; identical to SEQ ID NO: 345916

SEQ ID NO: 444052 - RNA, 64 nt, hsa; identical to SEQ ID NO: 345917

SEQ ID NO: 444053 - RNA, 64 nt, hsa; identical to SEQ ID NO: 345918

SEQ ID NO: 444054 - RNA, 64 nt, hsa; identical to SEQ ID NO: 345919

SEQ ID NO: 444055 - RNA, 64 nt, hsa; identical to SEQ ID NO: 345920

SEQ ID NO: 444056 - RNA, 64 nt, hsa; identical to SEQ ID NO: 345921

SEQ ID NO: 444057 - RNA, 64 nt, hsa; identical to SEQ ID NO: 345922

SEQ ID NO: 444058 - RNA, 64 nt, hsa; identical to SEQ ID NO: 345923

SEQ ID NO: 444059 - RNA, 64 nt, hsa; identical to SEQ ID NO: 345924

SEQ ID NO: 444060 - RNA, 64 nt, hsa; identical to SEQ ID NO: 345925

SEQ ID NO: 444061 - RNA, 64 nt, hsa; identical to SEQ ID NO: 345926

SEQ ID NO: 444062 - RNA, 64 nt, hsa; identical to SEQ ID NO: 345927

SEQ ID NO: 444063 - RNA, 64 nt, hsa; identical to SEQ ID NO: 345928

SEQ ID NO: 444064 - RNA, 64 nt, hsa; identical to SEQ ID NO: 345929

SEQ ID NO: 444065 - RNA, 64 nt, hsa; identical to SEQ ID NO: 345930

SEQ ID NO: 444066 - RNA, 64 nt, hsa; identical to SEQ ID NO: 345931

SEQ ID NO: 444067 - RNA, 64 nt, hsa; identical to SEQ ID NO: 345932

SEQ ID NO: 444068 - RNA, 64 nt, hsa; identical to SEQ ID NO: 345933

SEQ ID NO: 444069 - RNA, 64 nt, hsa; identical to SEQ ID NO: 345934

SEQ ID NO: 444070 - RNA, 64 nt, hsa; identical to SEQ ID NO: 345935

SEQ ID NO: 444071 - RNA, 64 nt, hsa; identical to SEQ ID NO: 345936

SEQ ID NO: 444072 - RNA, 64 nt, hsa; identical to SEQ ID NO: 345937

SEQ ID NO: 444073 - RNA, 64 nt, hsa; identical to SEQ ID NO: 345938

SEQ ID NO: 444074 - RNA, 64 nt, hsa; identical to SEQ ID NO: 345939

SEQ ID NO: 444075 - RNA, 64 nt, hsa; identical to SEQ ID NO: 345940

SEQ ID NO: 444076 - RNA, 64 nt, hsa; identical to SEQ ID NO: 345941

SEQ ID NO: 444077 - RNA, 64 nt, hsa; identical to SEQ ID NO: 345942

SEQ ID NO: 444078 - RNA, 64 nt, hsa; identical to SEQ ID NO: 345943

SEQ ID NO: 444079 - RNA, 64 nt, hsa; identical to SEQ ID NO: 345944

SEQ ID NO: 444080 - RNA, 64 nt, hsa; identical to SEQ ID NO: 345945

SEQ ID NO: 444081 - RNA, 64 nt, hsa; identical to SEQ ID NO: 345946

SEQ ID NO: 444082 - RNA, 64 nt, hsa; identical to SEQ ID NO: 345947

SEQ ID NO: 444083 - RNA, 64 nt, hsa; identical to SEQ ID NO: 345948

SEQ ID NO: 444084 - RNA, 64 nt, hsa; identical to SEQ ID NO: 345949

SEQ ID NO: 444085 - RNA, 64 nt, hsa; identical to SEQ ID NO: 345950

SEQ ID NO: 444086 - RNA, 64 nt, hsa; identical to SEQ ID NO: 345951

SEQ ID NO: 444087 - RNA, 64 nt, hsa; identical to SEQ ID NO: 345952

SEQ ID NO: 444088 - RNA, 64 nt, hsa; identical to SEQ ID NO: 345953

SEQ ID NO: 444089 - RNA, 64 nt, hsa; identical to SEQ ID NO: 345954

SEQ ID NO: 444090 - RNA, 64 nt, hsa; identical to SEQ ID NO: 345955

SEQ ID NO: 444091 - RNA, 64 nt, hsa; identical to SEQ ID NO: 345956

SEQ ID NO: 444092 - RNA, 64 nt, hsa; identical to SEQ ID NO: 345957

SEQ ID NO: 444093 - RNA, 64 nt, hsa; identical to SEQ ID NO: 345958

SEQ ID NO: 444094 - RNA, 64 nt, hsa; identical to SEQ ID NO: 345959

SEQ ID NO: 444095 - RNA, 64 nt, hsa; identical to SEQ ID NO: 345960

SEQ ID NO: 444096 - RNA, 64 nt, hsa; identical to SEQ ID NO: 345961

SEQ ID NO: 444097 - RNA, 64 nt, hsa; identical to SEQ ID NO: 345962

SEQ ID NO: 444098 - RNA, 64 nt, hsa; identical to SEQ ID NO: 345963

SEQ ID NO: 444099 - RNA, 64 nt, hsa; identical to SEQ ID NO: 345964

SEQ ID NO: 444100 - RNA, 64 nt, hsa; identical to SEQ ID NO: 345965

SEQ ID NO: 444101 - RNA, 64 nt, hsa; identical to SEQ ID NO: 345966

SEQ ID NO: 444102 - RNA, 64 nt, hsa; identical to SEQ ID NO: 345967

SEQ ID NO: 444103 - RNA, 50 nt, hsa; identical to SEQ ID NO: 345968

SEQ ID NO: 444104 - RNA, 64 nt, hsa; identical to SEQ ID NO: 345969

SEQ ID NO: 444105 - RNA, 64 nt, hsa; identical to SEQ ID NO: 345970

SEQ ID NO: 444106 - RNA, 64 nt, hsa; identical to SEQ ID NO: 345971

SEQ ID NO: 444107 - RNA, 64 nt, hsa; identical to SEQ ID NO: 345972

SEQ ID NO: 444108 - RNA, 64 nt, hsa; identical to SEQ ID NO: 345973

SEQ ID NO: 444109 - RNA, 64 nt, hsa; identical to SEQ ID NO: 345974

SEQ ID NO: 444110 - RNA, 64 nt, hsa; identical to SEQ ID NO: 345975

SEQ ID NO: 444111 - RNA, 64 nt, hsa; identical to SEQ ID NO: 345976

SEQ ID NO: 444112 - RNA, 64 nt, hsa; identical to SEQ ID NO: 345977

SEQ ID NO: 444113 - RNA, 64 nt, hsa; identical to SEQ ID NO: 345978

SEQ ID NO: 444114 - RNA, 64 nt, hsa; identical to SEQ ID NO: 345979

SEQ ID NO: 444115 - RNA, 64 nt, hsa; identical to SEQ ID NO: 345980

SEQ ID NO: 444116 - RNA, 64 nt, hsa; identical to SEQ ID NO: 345981

SEQ ID NO: 444117 - RNA, 64 nt, hsa; identical to SEQ ID NO: 345982

SEQ ID NO: 444118 - RNA, 64 nt, hsa; identical to SEQ ID NO: 345983

SEQ ID NO: 444119 - RNA, 64 nt, hsa; identical to SEQ ID NO: 345984

SEQ ID NO: 444120 - RNA, 64 nt, hsa; identical to SEQ ID NO: 345985

SEQ ID NO: 444121 - RNA, 64 nt, hsa; identical to SEQ ID NO: 345986

SEQ ID NO: 444122 - RNA, 64 nt, hsa; identical to SEQ ID NO: 345987

SEQ ID NO: 444123 - RNA, 64 nt, hsa; identical to SEQ ID NO: 345988

SEQ ID NO: 444124 - RNA, 64 nt, hsa; identical to SEQ ID NO: 345989

SEQ ID NO: 444125 - RNA, 64 nt, hsa; identical to SEQ ID NO: 345990

SEQ ID NO: 444126 - RNA, 64 nt, hsa; identical to SEQ ID NO: 345991

SEQ ID NO: 444127 - RNA, 64 nt, hsa; identical to SEQ ID NO: 345992

SEQ ID NO: 444128 - RNA, 51 nt, hsa; identical to SEQ ID NO: 345993

SEQ ID NO: 444129 - RNA, 64 nt, hsa; identical to SEQ ID NO: 345994

SEQ ID NO: 444130 - RNA, 64 nt, hsa; identical to SEQ ID NO: 345995

SEQ ID NO: 444131 - RNA, 64 nt, hsa; identical to SEQ ID NO: 345996

SEQ ID NO: 444132 - RNA, 64 nt, hsa; identical to SEQ ID NO: 345997

SEQ ID NO: 444133 - RNA, 64 nt, hsa; identical to SEQ ID NO: 345998

SEQ ID NO: 444134 - RNA, 64 nt, hsa; identical to SEQ ID NO: 345999

SEQ ID NO: 444135 - RNA, 64 nt, hsa; identical to SEQ ID NO: 346000

SEQ ID NO: 444136 - RNA, 64 nt, hsa; identical to SEQ ID NO: 346001

SEQ ID NO: 444137 - RNA, 64 nt, hsa; identical to SEQ ID NO: 346002

SEQ ID NO: 444138 - RNA, 64 nt, hsa; identical to SEQ ID NO: 346003

SEQ ID NO: 444139 - RNA, 64 nt, hsa; identical to SEQ ID NO: 346004

SEQ ID NO: 444140 - RNA, 64 nt, hsa; identical to SEQ ID NO: 346005

SEQ ID NO: 444141 - RNA, 64 nt, hsa; identical to SEQ ID NO: 346006

SEQ ID NO: 444142 - RNA, 64 nt, hsa; identical to SEQ ID NO: 346007

SEQ ID NO: 444143 - RNA, 64 nt, hsa; identical to SEQ ID NO: 346008

SEQ ID NO: 444144 - RNA, 64 nt, hsa; identical to SEQ ID NO: 346009

SEQ ID NO: 444145 - RNA, 64 nt, hsa; identical to SEQ ID NO: 346010

SEQ ID NO: 444146 - RNA, 64 nt, hsa; identical to SEQ ID NO: 346011

SEQ ID NO: 444147 - RNA, 64 nt, hsa; identical to SEQ ID NO: 346012

SEQ ID NO: 444148 - RNA, 64 nt, hsa; identical to SEQ ID NO: 346013

SEQ ID NO: 444149 - RNA, 64 nt, hsa; identical to SEQ ID NO: 346014

SEQ ID NO: 444150 - RNA, 64 nt, hsa; identical to SEQ ID NO: 346015

SEQ ID NO: 444151 - RNA, 64 nt, hsa; identical to SEQ ID NO: 346016

SEQ ID NO: 444152 - RNA, 64 nt, hsa; identical to SEQ ID NO: 346017

SEQ ID NO: 444153 - RNA, 64 nt, hsa; identical to SEQ ID NO: 346018

SEQ ID NO: 444154 - RNA, 64 nt, hsa; identical to SEQ ID NO: 346019

SEQ ID NO: 444155 - RNA, 64 nt, hsa; identical to SEQ ID NO: 346020

SEQ ID NO: 444156 - RNA, 64 nt, hsa; identical to SEQ ID NO: 346021

SEQ ID NO: 444157 - RNA, 64 nt, hsa; identical to SEQ ID NO: 346022

SEQ ID NO: 444158 - RNA, 64 nt, hsa; identical to SEQ ID NO: 346023

SEQ ID NO: 444159 - RNA, 64 nt, hsa; identical to SEQ ID NO: 346024

SEQ ID NO: 444160 - RNA, 64 nt, hsa; identical to SEQ ID NO: 346025

SEQ ID NO: 444161 - RNA, 64 nt, hsa; identical to SEQ ID NO: 346026

SEQ ID NO: 444162 - RNA, 64 nt, hsa; identical to SEQ ID NO: 346027

SEQ ID NO: 444163 - RNA, 64 nt, hsa; identical to SEQ ID NO: 346028

SEQ ID NO: 444164 - RNA, 64 nt, hsa; identical to SEQ ID NO: 346029

SEQ ID NO: 444165 - RNA, 64 nt, hsa; identical to SEQ ID NO: 346030

SEQ ID NO: 444166 - RNA, 64 nt, hsa; identical to SEQ ID NO: 346031

SEQ ID NO: 444167 - RNA, 64 nt, hsa; identical to SEQ ID NO: 346032

SEQ ID NO: 444168 - RNA, 64 nt, hsa; identical to SEQ ID NO: 346033

SEQ ID NO: 444169 - RNA, 64 nt, hsa; identical to SEQ ID NO: 346034

SEQ ID NO: 444170 - RNA, 64 nt, hsa; identical to SEQ ID NO: 346035

SEQ ID NO: 444171 - RNA, 64 nt, hsa; identical to SEQ ID NO: 346036

SEQ ID NO: 444172 - RNA, 64 nt, hsa; identical to SEQ ID NO: 346037

SEQ ID NO: 444173 - RNA, 64 nt, hsa; identical to SEQ ID NO: 346038

SEQ ID NO: 444174 - RNA, 64 nt, hsa; identical to SEQ ID NO: 346039

SEQ ID NO: 444175 - RNA, 64 nt, hsa; identical to SEQ ID NO: 346040

SEQ ID NO: 444176 - RNA, 64 nt, hsa; identical to SEQ ID NO: 346041

SEQ ID NO: 444177 - RNA, 64 nt, hsa; identical to SEQ ID NO: 346042

SEQ ID NO: 444178 - RNA, 64 nt, hsa; identical to SEQ ID NO: 346043

SEQ ID NO: 444179 - RNA, 64 nt, hsa; identical to SEQ ID NO: 346044

SEQ ID NO: 444180 - RNA, 64 nt, hsa; identical to SEQ ID NO: 346045

SEQ ID NO: 444181 - RNA, 64 nt, hsa; identical to SEQ ID NO: 346046

SEQ ID NO: 444182 - RNA, 64 nt, hsa; identical to SEQ ID NO: 346047

SEQ ID NO: 444183 - RNA, 64 nt, hsa; identical to SEQ ID NO: 346048

SEQ ID NO: 444184 - RNA, 64 nt, hsa; identical to SEQ ID NO: 346049

SEQ ID NO: 444185 - RNA, 64 nt, hsa; identical to SEQ ID NO: 346050

SEQ ID NO: 444186 - RNA, 64 nt, hsa; identical to SEQ ID NO: 346051

SEQ ID NO: 444187 - RNA, 64 nt, hsa; identical to SEQ ID NO: 346052

SEQ ID NO: 444188 - RNA, 64 nt, hsa; identical to SEQ ID NO: 346053

SEQ ID NO: 444189 - RNA, 64 nt, hsa; identical to SEQ ID NO: 346054

SEQ ID NO: 444190 - RNA, 64 nt, hsa; identical to SEQ ID NO: 346055

SEQ ID NO: 444191 - RNA, 64 nt, hsa; identical to SEQ ID NO: 346056

SEQ ID NO: 444192 - RNA, 64 nt, hsa; identical to SEQ ID NO: 346057

SEQ ID NO: 444193 - RNA, 64 nt, hsa; identical to SEQ ID NO: 346058

SEQ ID NO: 444194 - RNA, 64 nt, hsa; identical to SEQ ID NO: 346059

SEQ ID NO: 444195 - RNA, 64 nt, hsa; identical to SEQ ID NO: 346060

SEQ ID NO: 444196 - RNA, 64 nt, hsa; identical to SEQ ID NO: 346061

SEQ ID NO: 444197 - RNA, 64 nt, hsa; identical to SEQ ID NO: 346062

SEQ ID NO: 444198 - RNA, 64 nt, hsa; identical to SEQ ID NO: 346063

SEQ ID NO: 444199 - RNA, 64 nt, hsa; identical to SEQ ID NO: 346064

SEQ ID NO: 444200 - RNA, 64 nt, hsa; identical to SEQ ID NO: 346065

SEQ ID NO: 444201 - RNA, 64 nt, hsa; identical to SEQ ID NO: 346066

SEQ ID NO: 444202 - RNA, 64 nt, hsa; identical to SEQ ID NO: 346067

SEQ ID NO: 444203 - RNA, 64 nt, hsa; identical to SEQ ID NO: 346068

SEQ ID NO: 444204 - RNA, 64 nt, hsa; identical to SEQ ID NO: 346069

SEQ ID NO: 444205 - RNA, 64 nt, hsa; identical to SEQ ID NO: 346070

SEQ ID NO: 444206 - RNA, 64 nt, hsa; identical to SEQ ID NO: 346071

SEQ ID NO: 444207 - RNA, 64 nt, hsa; identical to SEQ ID NO: 346072

SEQ ID NO: 444208 - RNA, 64 nt, hsa; identical to SEQ ID NO: 346073

SEQ ID NO: 444209 - RNA, 64 nt, hsa; identical to SEQ ID NO: 346074

SEQ ID NO: 444210 - RNA, 64 nt, hsa; identical to SEQ ID NO: 346075

SEQ ID NO: 444211 - RNA, 64 nt, hsa; identical to SEQ ID NO: 346076

SEQ ID NO: 444212 - RNA, 64 nt, hsa; identical to SEQ ID NO: 346077

SEQ ID NO: 444213 - RNA, 64 nt, hsa; identical to SEQ ID NO: 346078

SEQ ID NO: 444214 - RNA, 64 nt, hsa; identical to SEQ ID NO: 346079

SEQ ID NO: 444215 - RNA, 64 nt, hsa; identical to SEQ ID NO: 346080

SEQ ID NO: 444216 - RNA, 64 nt, hsa; identical to SEQ ID NO: 346081

SEQ ID NO: 444217 - RNA, 64 nt, hsa; identical to SEQ ID NO: 346082

SEQ ID NO: 444218 - RNA, 64 nt, hsa; identical to SEQ ID NO: 346083

SEQ ID NO: 444219 - RNA, 64 nt, hsa; identical to SEQ ID NO: 346084

SEQ ID NO: 444220 - RNA, 64 nt, hsa; identical to SEQ ID NO: 346085

SEQ ID NO: 444221 - RNA, 64 nt, hsa; identical to SEQ ID NO: 346086

SEQ ID NO: 444222 - RNA, 64 nt, hsa; identical to SEQ ID NO: 346087

SEQ ID NO: 444223 - RNA, 64 nt, hsa; identical to SEQ ID NO: 346088

SEQ ID NO: 444224 - RNA, 64 nt, hsa; identical to SEQ ID NO: 346089

SEQ ID NO: 444225 - RNA, 64 nt, hsa; identical to SEQ ID NO: 346090

SEQ ID NO: 444226 - RNA, 64 nt, hsa; identical to SEQ ID NO: 346091

SEQ ID NO: 444227 - RNA, 64 nt, hsa; identical to SEQ ID NO: 346092

SEQ ID NO: 444228 - RNA, 64 nt, hsa; identical to SEQ ID NO: 346093

SEQ ID NO: 444229 - RNA, 64 nt, hsa; identical to SEQ ID NO: 346094

SEQ ID NO: 444230 - RNA, 64 nt, hsa; identical to SEQ ID NO: 346095

SEQ ID NO: 444231 - RNA, 59 nt, hsa; identical to SEQ ID NO: 346096

SEQ ID NO: 444232 - RNA, 64 nt, hsa; identical to SEQ ID NO: 346097

SEQ ID NO: 444233 - RNA, 64 nt, hsa; identical to SEQ ID NO: 346098

SEQ ID NO: 444234 - RNA, 64 nt, hsa; identical to SEQ ID NO: 346099

SEQ ID NO: 444235 - RNA, 64 nt, hsa; identical to SEQ ID NO: 346100

SEQ ID NO: 444236 - RNA, 64 nt, hsa; identical to SEQ ID NO: 346101

SEQ ID NO: 444237 - RNA, 64 nt, hsa; identical to SEQ ID NO: 346102

SEQ ID NO: 444238 - RNA, 64 nt, hsa; identical to SEQ ID NO: 346103

SEQ ID NO: 444239 - RNA, 64 nt, hsa; identical to SEQ ID NO: 346104

SEQ ID NO: 444240 - RNA, 64 nt, hsa; identical to SEQ ID NO: 346105

SEQ ID NO: 444241 - RNA, 64 nt, hsa; identical to SEQ ID NO: 346106

SEQ ID NO: 444242 - RNA, 64 nt, hsa; identical to SEQ ID NO: 346107

SEQ ID NO: 444243 - RNA, 64 nt, hsa; identical to SEQ ID NO: 346108

SEQ ID NO: 444244 - RNA, 64 nt, hsa; identical to SEQ ID NO: 346109

SEQ ID NO: 444245 - RNA, 64 nt, hsa; identical to SEQ ID NO: 346110

SEQ ID NO: 444246 - RNA, 64 nt, hsa; identical to SEQ ID NO: 346111

SEQ ID NO: 444247 - RNA, 64 nt, hsa; identical to SEQ ID NO: 346112

SEQ ID NO: 444248 - RNA, 64 nt, hsa; identical to SEQ ID NO: 346113

SEQ ID NO: 444249 - RNA, 64 nt, hsa; identical to SEQ ID NO: 346114

SEQ ID NO: 444250 - RNA, 64 nt, hsa; identical to SEQ ID NO: 346115

SEQ ID NO: 444251 - RNA, 64 nt, hsa; identical to SEQ ID NO: 346116

SEQ ID NO: 444252 - RNA, 64 nt, hsa; identical to SEQ ID NO: 218520

SEQ ID NO: 444253 - RNA, 64 nt, hsa; identical to SEQ ID NO: 218521

SEQ ID NO: 444254 - RNA, 64 nt, hsa; identical to SEQ ID NO: 218522

SEQ ID NO: 444255 - RNA, 64 nt, hsa; identical to SEQ ID NO: 218523

SEQ ID NO: 444256 - RNA, 64 nt, hsa; identical to SEQ ID NO: 218524

SEQ ID NO: 444257 - RNA, 64 nt, hsa; identical to SEQ ID NO: 218525

SEQ ID NO: 444258 - RNA, 64 nt, hsa; identical to SEQ ID NO: 218526

SEQ ID NO: 444259 - RNA, 64 nt, hsa; identical to SEQ ID NO: 218527

SEQ ID NO: 444260 - RNA, 64 nt, hsa; identical to SEQ ID NO: 218528

SEQ ID NO: 444261 - RNA, 64 nt, hsa; identical to SEQ ID NO: 218529

SEQ ID NO: 444262 - RNA, 64 nt, hsa; identical to SEQ ID NO: 218530

SEQ ID NO: 444263 - RNA, 64 nt, hsa; identical to SEQ ID NO: 218531

SEQ ID NO: 444264 - RNA, 64 nt, hsa; identical to SEQ ID NO: 218532

SEQ ID NO: 444265 - RNA, 64 nt, hsa; identical to SEQ ID NO: 218533

SEQ ID NO: 444266 - RNA, 64 nt, hsa; identical to SEQ ID NO: 218534

SEQ ID NO: 444267 - RNA, 64 nt, hsa; identical to SEQ ID NO: 218535

SEQ ID NO: 444268 - RNA, 64 nt, hsa; identical to SEQ ID NO: 218536

SEQ ID NO: 444269 - RNA, 64 nt, hsa; identical to SEQ ID NO: 218537

SEQ ID NO: 444270 - RNA, 64 nt, hsa; identical to SEQ ID NO: 218538

SEQ ID NO: 444271 - RNA, 61 nt, hsa; identical to SEQ ID NO: 218539

SEQ ID NO: 444272 - RNA, 64 nt, hsa; identical to SEQ ID NO: 218540

SEQ ID NO: 444273 - RNA, 64 nt, hsa; identical to SEQ ID NO: 218541

SEQ ID NO: 444274 - RNA, 64 nt, hsa; identical to SEQ ID NO: 218542

SEQ ID NO: 444275 - RNA, 64 nt, hsa; identical to SEQ ID NO: 218543

SEQ ID NO: 444276 - RNA, 64 nt, hsa; identical to SEQ ID NO: 218544

SEQ ID NO: 444277 - RNA, 64 nt, hsa; identical to SEQ ID NO: 218545

SEQ ID NO: 444278 - RNA, 64 nt, hsa; identical to SEQ ID NO: 218546

SEQ ID NO: 444279 - RNA, 64 nt, hsa; identical to SEQ ID NO: 218547

SEQ ID NO: 444280 - RNA, 64 nt, hsa; identical to SEQ ID NO: 218548

SEQ ID NO: 444281 - RNA, 64 nt, hsa; identical to SEQ ID NO: 218549

SEQ ID NO: 444282 - RNA, 64 nt, hsa; identical to SEQ ID NO: 218550

SEQ ID NO: 444283 - RNA, 64 nt, hsa; identical to SEQ ID NO: 218551

SEQ ID NO: 444284 - RNA, 64 nt, hsa; identical to SEQ ID NO: 218552

SEQ ID NO: 444285 - RNA, 64 nt, hsa; identical to SEQ ID NO: 218553

SEQ ID NO: 444286 - RNA, 63 nt, hsa; identical to SEQ ID NO: 218554

SEQ ID NO: 444287 - RNA, 64 nt, hsa; identical to SEQ ID NO: 218555

SEQ ID NO: 444288 - RNA, 64 nt, hsa; identical to SEQ ID NO: 218556

SEQ ID NO: 444289 - RNA, 64 nt, hsa; identical to SEQ ID NO: 218557

SEQ ID NO: 444290 - RNA, 64 nt, hsa; identical to SEQ ID NO: 218558

SEQ ID NO: 444291 - RNA, 64 nt, hsa; identical to SEQ ID NO: 218559

SEQ ID NO: 444292 - RNA, 64 nt, hsa; identical to SEQ ID NO: 218560

SEQ ID NO: 444293 - RNA, 64 nt, hsa; identical to SEQ ID NO: 218561

SEQ ID NO: 444294 - RNA, 64 nt, hsa; identical to SEQ ID NO: 218562

SEQ ID NO: 444295 - RNA, 64 nt, hsa; identical to SEQ ID NO: 218563

SEQ ID NO: 444296 - RNA, 64 nt, hsa; identical to SEQ ID NO: 218564

SEQ ID NO: 444297 - RNA, 64 nt, hsa; identical to SEQ ID NO: 218565

SEQ ID NO: 444298 - RNA, 64 nt, hsa; identical to SEQ ID NO: 218566

SEQ ID NO: 444299 - RNA, 64 nt, hsa; identical to SEQ ID NO: 218567

SEQ ID NO: 444300 - RNA, 64 nt, hsa; identical to SEQ ID NO: 218568

SEQ ID NO: 444301 - RNA, 64 nt, hsa; identical to SEQ ID NO: 218569

SEQ ID NO: 444302 - RNA, 64 nt, hsa; identical to SEQ ID NO: 218570

SEQ ID NO: 444303 - RNA, 64 nt, hsa; identical to SEQ ID NO: 218571

SEQ ID NO: 444304 - RNA, 64 nt, hsa; identical to SEQ ID NO: 218572

SEQ ID NO: 444305 - RNA, 64 nt, hsa; identical to SEQ ID NO: 218573

SEQ ID NO: 444306 - RNA, 64 nt, hsa; identical to SEQ ID NO: 218574

SEQ ID NO: 444307 - RNA, 64 nt, hsa; identical to SEQ ID NO: 218575

SEQ ID NO: 444308 - RNA, 64 nt, hsa; identical to SEQ ID NO: 218576

SEQ ID NO: 444309 - RNA, 64 nt, hsa; identical to SEQ ID NO: 218577

SEQ ID NO: 444310 - RNA, 64 nt, hsa; identical to SEQ ID NO: 218578

SEQ ID NO: 444311 - RNA, 64 nt, hsa; identical to SEQ ID NO: 218579

SEQ ID NO: 444312 - RNA, 64 nt, hsa; identical to SEQ ID NO: 218580

SEQ ID NO: 444313 - RNA, 64 nt, hsa; identical to SEQ ID NO: 218581

SEQ ID NO: 444314 - RNA, 64 nt, hsa; identical to SEQ ID NO: 218582

SEQ ID NO: 444315 - RNA, 64 nt, hsa; identical to SEQ ID NO: 218583

SEQ ID NO: 444316 - RNA, 64 nt, hsa; identical to SEQ ID NO: 218584

SEQ ID NO: 444317 - RNA, 64 nt, hsa; identical to SEQ ID NO: 218585

SEQ ID NO: 444318 - RNA, 64 nt, hsa; identical to SEQ ID NO: 218586

SEQ ID NO: 444319 - RNA, 64 nt, hsa; identical to SEQ ID NO: 218587

SEQ ID NO: 444320 - RNA, 64 nt, hsa; identical to SEQ ID NO: 218588

SEQ ID NO: 444321 - RNA, 64 nt, hsa; identical to SEQ ID NO: 218589

SEQ ID NO: 444322 - RNA, 64 nt, hsa; identical to SEQ ID NO: 218590

SEQ ID NO: 444323 - RNA, 64 nt, hsa; identical to SEQ ID NO: 218591

SEQ ID NO: 444324 - RNA, 64 nt, hsa; identical to SEQ ID NO: 218592

SEQ ID NO: 444325 - RNA, 64 nt, hsa; identical to SEQ ID NO: 218593

SEQ ID NO: 444326 - RNA, 64 nt, hsa; identical to SEQ ID NO: 218594

SEQ ID NO: 444327 - RNA, 64 nt, hsa; identical to SEQ ID NO: 218595

SEQ ID NO: 444328 - RNA, 64 nt, hsa; identical to SEQ ID NO: 218596

SEQ ID NO: 444329 - RNA, 64 nt, hsa; identical to SEQ ID NO: 218597

SEQ ID NO: 444330 - RNA, 64 nt, hsa; identical to SEQ ID NO: 218598

SEQ ID NO: 444331 - RNA, 64 nt, hsa; identical to SEQ ID NO: 218599

SEQ ID NO: 444332 - RNA, 64 nt, hsa; identical to SEQ ID NO: 218600

SEQ ID NO: 444333 - RNA, 64 nt, hsa; identical to SEQ ID NO: 218601

SEQ ID NO: 444334 - RNA, 64 nt, hsa; identical to SEQ ID NO: 218602

SEQ ID NO: 444335 - RNA, 64 nt, hsa; identical to SEQ ID NO: 218603

SEQ ID NO: 444336 - RNA, 64 nt, hsa; identical to SEQ ID NO: 218604

SEQ ID NO: 444337 - RNA, 64 nt, hsa; identical to SEQ ID NO: 218605

SEQ ID NO: 444338 - RNA, 64 nt, hsa; identical to SEQ ID NO: 218606

SEQ ID NO: 444339 - RNA, 64 nt, hsa; identical to SEQ ID NO: 218607

SEQ ID NO: 444340 - RNA, 64 nt, hsa; identical to SEQ ID NO: 218608

SEQ ID NO: 444341 - RNA, 64 nt, hsa; identical to SEQ ID NO: 218609

SEQ ID NO: 444342 - RNA, 64 nt, hsa; identical to SEQ ID NO: 218610

SEQ ID NO: 444343 - RNA, 64 nt, hsa; identical to SEQ ID NO: 218611

SEQ ID NO: 444344 - RNA, 64 nt, hsa; identical to SEQ ID NO: 218612

SEQ ID NO: 444345 - RNA, 62 nt, hsa; identical to SEQ ID NO: 218613

SEQ ID NO: 444346 - RNA, 64 nt, hsa; identical to SEQ ID NO: 218614

SEQ ID NO: 444347 - RNA, 64 nt, hsa; identical to SEQ ID NO: 218615

SEQ ID NO: 444348 - RNA, 64 nt, hsa; identical to SEQ ID NO: 218616

SEQ ID NO: 444349 - RNA, 64 nt, hsa; identical to SEQ ID NO: 218617

SEQ ID NO: 444350 - RNA, 64 nt, hsa; identical to SEQ ID NO: 218618

SEQ ID NO: 444351 - RNA, 64 nt, hsa; identical to SEQ ID NO: 218619

SEQ ID NO: 444352 - RNA, 64 nt, hsa; identical to SEQ ID NO: 218620

SEQ ID NO: 444353 - RNA, 64 nt, hsa; identical to SEQ ID NO: 218621

SEQ ID NO: 444354 - RNA, 64 nt, hsa; identical to SEQ ID NO: 218622

SEQ ID NO: 444355 - RNA, 64 nt, hsa; identical to SEQ ID NO: 218623

SEQ ID NO: 444356 - RNA, 64 nt, hsa; identical to SEQ ID NO: 218624

SEQ ID NO: 444357 - RNA, 64 nt, hsa; identical to SEQ ID NO: 218625

SEQ ID NO: 444358 - RNA, 64 nt, hsa; identical to SEQ ID NO: 218626

SEQ ID NO: 444359 - RNA, 64 nt, hsa; identical to SEQ ID NO: 218627

SEQ ID NO: 444360 - RNA, 64 nt, hsa; identical to SEQ ID NO: 218628

SEQ ID NO: 444361 - RNA, 64 nt, hsa; identical to SEQ ID NO: 218629

SEQ ID NO: 444362 - RNA, 64 nt, hsa; identical to SEQ ID NO: 218630

SEQ ID NO: 444363 - RNA, 64 nt, hsa; identical to SEQ ID NO: 218631

SEQ ID NO: 444364 - RNA, 64 nt, hsa; identical to SEQ ID NO: 218632

SEQ ID NO: 444365 - RNA, 64 nt, hsa; identical to SEQ ID NO: 218633

SEQ ID NO: 444366 - RNA, 64 nt, hsa; identical to SEQ ID NO: 218634

SEQ ID NO: 444367 - RNA, 64 nt, hsa; identical to SEQ ID NO: 218635

SEQ ID NO: 444368 - RNA, 64 nt, hsa; identical to SEQ ID NO: 218636

SEQ ID NO: 444369 - RNA, 64 nt, hsa; identical to SEQ ID NO: 218637

SEQ ID NO: 444370 - RNA, 64 nt, hsa; identical to SEQ ID NO: 218638

SEQ ID NO: 444371 - RNA, 64 nt, hsa; identical to SEQ ID NO: 218639

SEQ ID NO: 444372 - RNA, 64 nt, hsa; identical to SEQ ID NO: 218640

SEQ ID NO: 444373 - RNA, 64 nt, hsa; identical to SEQ ID NO: 218641

SEQ ID NO: 444374 - RNA, 64 nt, hsa; identical to SEQ ID NO: 218642

SEQ ID NO: 444375 - RNA, 64 nt, hsa; identical to SEQ ID NO: 218643

SEQ ID NO: 444376 - RNA, 64 nt, hsa; identical to SEQ ID NO: 218644

SEQ ID NO: 444377 - RNA, 64 nt, hsa; identical to SEQ ID NO: 218645

SEQ ID NO: 444378 - RNA, 64 nt, hsa; identical to SEQ ID NO: 218646

SEQ ID NO: 444379 - RNA, 64 nt, hsa; identical to SEQ ID NO: 218647

SEQ ID NO: 444380 - RNA, 64 nt, hsa; identical to SEQ ID NO: 218648

SEQ ID NO: 444381 - RNA, 64 nt, hsa; identical to SEQ ID NO: 218649

SEQ ID NO: 444382 - RNA, 64 nt, hsa; identical to SEQ ID NO: 218650

SEQ ID NO: 444383 - RNA, 64 nt, hsa; identical to SEQ ID NO: 218651

SEQ ID NO: 444384 - RNA, 64 nt, hsa; identical to SEQ ID NO: 218652

SEQ ID NO: 444385 - RNA, 64 nt, hsa; identical to SEQ ID NO: 218653

SEQ ID NO: 444386 - RNA, 64 nt, hsa; identical to SEQ ID NO: 218654

SEQ ID NO: 444387 - RNA, 64 nt, hsa; identical to SEQ ID NO: 218655

SEQ ID NO: 444388 - RNA, 64 nt, hsa; identical to SEQ ID NO: 218656

SEQ ID NO: 444389 - RNA, 64 nt, hsa; identical to SEQ ID NO: 218657

SEQ ID NO: 444390 - RNA, 64 nt, hsa; identical to SEQ ID NO: 218658

SEQ ID NO: 444391 - RNA, 64 nt, hsa; identical to SEQ ID NO: 218659

SEQ ID NO: 444392 - RNA, 64 nt, hsa; identical to SEQ ID NO: 218660

SEQ ID NO: 444393 - RNA, 64 nt, hsa; identical to SEQ ID NO: 218661

SEQ ID NO: 444394 - RNA, 61 nt, hsa; identical to SEQ ID NO: 218662

SEQ ID NO: 444395 - RNA, 64 nt, hsa; identical to SEQ ID NO: 218663

SEQ ID NO: 444396 - RNA, 64 nt, hsa; identical to SEQ ID NO: 218664

SEQ ID NO: 444397 - RNA, 64 nt, hsa; identical to SEQ ID NO: 218665

SEQ ID NO: 444398 - RNA, 64 nt, hsa; identical to SEQ ID NO: 218666

SEQ ID NO: 444399 - RNA, 64 nt, hsa; identical to SEQ ID NO: 218667

SEQ ID NO: 444400 - RNA, 64 nt, hsa; identical to SEQ ID NO: 218668

SEQ ID NO: 444401 - RNA, 64 nt, hsa; identical to SEQ ID NO: 218669

SEQ ID NO: 444402 - RNA, 64 nt, hsa; identical to SEQ ID NO: 218670

SEQ ID NO: 444403 - RNA, 64 nt, hsa; identical to SEQ ID NO: 218671

SEQ ID NO: 444404 - RNA, 64 nt, hsa; identical to SEQ ID NO: 218672

SEQ ID NO: 444405 - RNA, 64 nt, hsa; identical to SEQ ID NO: 218673

SEQ ID NO: 444406 - RNA, 64 nt, hsa; identical to SEQ ID NO: 218674

SEQ ID NO: 444407 - RNA, 64 nt, hsa; identical to SEQ ID NO: 218675

SEQ ID NO: 444408 - RNA, 64 nt, hsa; identical to SEQ ID NO: 218676

SEQ ID NO: 444409 - RNA, 64 nt, hsa; identical to SEQ ID NO: 218677

SEQ ID NO: 444410 - RNA, 64 nt, hsa; identical to SEQ ID NO: 218678

SEQ ID NO: 444411 - RNA, 64 nt, hsa; identical to SEQ ID NO: 218679

SEQ ID NO: 444412 - RNA, 64 nt, hsa; identical to SEQ ID NO: 218680

SEQ ID NO: 444413 - RNA, 64 nt, hsa; identical to SEQ ID NO: 218681

SEQ ID NO: 444414 - RNA, 64 nt, hsa; identical to SEQ ID NO: 218682

SEQ ID NO: 444415 - RNA, 64 nt, hsa; identical to SEQ ID NO: 218683

SEQ ID NO: 444416 - RNA, 64 nt, hsa; identical to SEQ ID NO: 218684

SEQ ID NO: 444417 - RNA, 64 nt, hsa; identical to SEQ ID NO: 218685

SEQ ID NO: 444418 - RNA, 59 nt, hsa; identical to SEQ ID NO: 218686

SEQ ID NO: 444419 - RNA, 64 nt, hsa; identical to SEQ ID NO: 218687

SEQ ID NO: 444420 - RNA, 64 nt, hsa; identical to SEQ ID NO: 218688

SEQ ID NO: 444421 - RNA, 64 nt, hsa; identical to SEQ ID NO: 218689

SEQ ID NO: 444422 - RNA, 64 nt, hsa; identical to SEQ ID NO: 218690

SEQ ID NO: 444423 - RNA, 64 nt, hsa; identical to SEQ ID NO: 218691

SEQ ID NO: 444424 - RNA, 64 nt, hsa; identical to SEQ ID NO: 218692

SEQ ID NO: 444425 - RNA, 64 nt, hsa; identical to SEQ ID NO: 218693

SEQ ID NO: 444426 - RNA, 64 nt, hsa; identical to SEQ ID NO: 218694

SEQ ID NO: 444427 - RNA, 64 nt, hsa; identical to SEQ ID NO: 218695

SEQ ID NO: 444428 - RNA, 64 nt, hsa; identical to SEQ ID NO: 218696

SEQ ID NO: 444429 - RNA, 64 nt, hsa; identical to SEQ ID NO: 218697

SEQ ID NO: 444430 - RNA, 64 nt, hsa; identical to SEQ ID NO: 218698

SEQ ID NO: 444431 - RNA, 64 nt, hsa; identical to SEQ ID NO: 218699

SEQ ID NO: 444432 - RNA, 64 nt, hsa; identical to SEQ ID NO: 218700

SEQ ID NO: 444433 - RNA, 64 nt, hsa; identical to SEQ ID NO: 218701

SEQ ID NO: 444434 - RNA, 64 nt, hsa; identical to SEQ ID NO: 218702

SEQ ID NO: 444435 - RNA, 64 nt, hsa; identical to SEQ ID NO: 218703

SEQ ID NO: 444436 - RNA, 64 nt, hsa; identical to SEQ ID NO: 218704

SEQ ID NO: 444437 - RNA, 64 nt, hsa; identical to SEQ ID NO: 218705

SEQ ID NO: 444438 - RNA, 64 nt, hsa; identical to SEQ ID NO: 218706

SEQ ID NO: 444439 - RNA, 64 nt, hsa; identical to SEQ ID NO: 218707

SEQ ID NO: 444440 - RNA, 64 nt, hsa; identical to SEQ ID NO: 218708

SEQ ID NO: 444441 - RNA, 64 nt, hsa; identical to SEQ ID NO: 218709

SEQ ID NO: 444442 - RNA, 64 nt, hsa; identical to SEQ ID NO: 218710

SEQ ID NO: 444443 - RNA, 64 nt, hsa; identical to SEQ ID NO: 218711

SEQ ID NO: 444444 - RNA, 64 nt, hsa; identical to SEQ ID NO: 218712

SEQ ID NO: 444445 - RNA, 64 nt, hsa; identical to SEQ ID NO: 218713

SEQ ID NO: 444446 - RNA, 64 nt, hsa; identical to SEQ ID NO: 218714

SEQ ID NO: 444447 - RNA, 64 nt, hsa; identical to SEQ ID NO: 218715

SEQ ID NO: 444448 - RNA, 64 nt, hsa; identical to SEQ ID NO: 218716

SEQ ID NO: 444449 - RNA, 64 nt, hsa; identical to SEQ ID NO: 218717

SEQ ID NO: 444450 - RNA, 64 nt, hsa; identical to SEQ ID NO: 218718

SEQ ID NO: 444451 - RNA, 64 nt, hsa; identical to SEQ ID NO: 218719

SEQ ID NO: 444452 - RNA, 64 nt, hsa; identical to SEQ ID NO: 218720

SEQ ID NO: 444453 - RNA, 64 nt, hsa; identical to SEQ ID NO: 218721

SEQ ID NO: 444454 - RNA, 64 nt, hsa; identical to SEQ ID NO: 218722

SEQ ID NO: 444455 - RNA, 64 nt, hsa; identical to SEQ ID NO: 218723

SEQ ID NO: 444456 - RNA, 64 nt, hsa; identical to SEQ ID NO: 218724

SEQ ID NO: 444457 - RNA, 64 nt, hsa; identical to SEQ ID NO: 218725

SEQ ID NO: 444458 - RNA, 64 nt, hsa; identical to SEQ ID NO: 218726

SEQ ID NO: 444459 - RNA, 64 nt, hsa; identical to SEQ ID NO: 218727

SEQ ID NO: 444460 - RNA, 64 nt, hsa; identical to SEQ ID NO: 218728

SEQ ID NO: 444461 - RNA, 64 nt, hsa; identical to SEQ ID NO: 218729

SEQ ID NO: 444462 - RNA, 64 nt, hsa; identical to SEQ ID NO: 218730

SEQ ID NO: 444463 - RNA, 64 nt, hsa; identical to SEQ ID NO: 218731

SEQ ID NO: 444464 - RNA, 64 nt, hsa; identical to SEQ ID NO: 218732

SEQ ID NO: 444465 - RNA, 64 nt, hsa; identical to SEQ ID NO: 218733

SEQ ID NO: 444466 - RNA, 64 nt, hsa; identical to SEQ ID NO: 218734

SEQ ID NO: 444467 - RNA, 64 nt, hsa; identical to SEQ ID NO: 218735

SEQ ID NO: 444468 - RNA, 64 nt, hsa; identical to SEQ ID NO: 218736

SEQ ID NO: 444469 - RNA, 64 nt, hsa; identical to SEQ ID NO: 218737

SEQ ID NO: 444470 - RNA, 64 nt, hsa; identical to SEQ ID NO: 218738

SEQ ID NO: 444471 - RNA, 64 nt, hsa; identical to SEQ ID NO: 218739

SEQ ID NO: 444472 - RNA, 64 nt, hsa; identical to SEQ ID NO: 218740

SEQ ID NO: 444473 - RNA, 64 nt, hsa; identical to SEQ ID NO: 218741

SEQ ID NO: 444474 - RNA, 64 nt, hsa; identical to SEQ ID NO: 218742

SEQ ID NO: 444475 - RNA, 64 nt, hsa; identical to SEQ ID NO: 218743

SEQ ID NO: 444476 - RNA, 64 nt, hsa; identical to SEQ ID NO: 218744

SEQ ID NO: 444477 - RNA, 64 nt, hsa; identical to SEQ ID NO: 218745

SEQ ID NO: 444478 - RNA, 64 nt, hsa; identical to SEQ ID NO: 218746

SEQ ID NO: 444479 - RNA, 64 nt, hsa; identical to SEQ ID NO: 218747

SEQ ID NO: 444480 - RNA, 64 nt, hsa; identical to SEQ ID NO: 218748

SEQ ID NO: 444481 - RNA, 64 nt, hsa; identical to SEQ ID NO: 218749

SEQ ID NO: 444482 - RNA, 64 nt, hsa; identical to SEQ ID NO: 218750

SEQ ID NO: 444483 - RNA, 64 nt, hsa; identical to SEQ ID NO: 218751

SEQ ID NO: 444484 - RNA, 64 nt, hsa; identical to SEQ ID NO: 218752

SEQ ID NO: 444485 - RNA, 64 nt, hsa; identical to SEQ ID NO: 218753

SEQ ID NO: 444486 - RNA, 64 nt, hsa; identical to SEQ ID NO: 218754

SEQ ID NO: 444487 - RNA, 64 nt, hsa; identical to SEQ ID NO: 218755

SEQ ID NO: 444488 - RNA, 64 nt, hsa; identical to SEQ ID NO: 218756

SEQ ID NO: 444489 - RNA, 64 nt, hsa; identical to SEQ ID NO: 218757

SEQ ID NO: 444490 - RNA, 64 nt, hsa; identical to SEQ ID NO: 218758

SEQ ID NO: 444491 - RNA, 64 nt, hsa; identical to SEQ ID NO: 218759

SEQ ID NO: 444492 - RNA, 64 nt, hsa; identical to SEQ ID NO: 218760

SEQ ID NO: 444493 - RNA, 64 nt, hsa; identical to SEQ ID NO: 218761

SEQ ID NO: 444494 - RNA, 64 nt, hsa; identical to SEQ ID NO: 218762

SEQ ID NO: 444495 - RNA, 64 nt, hsa; identical to SEQ ID NO: 218763

SEQ ID NO: 444496 - RNA, 64 nt, hsa; identical to SEQ ID NO: 218764

SEQ ID NO: 444497 - RNA, 64 nt, hsa; identical to SEQ ID NO: 218765

SEQ ID NO: 444498 - RNA, 64 nt, hsa; identical to SEQ ID NO: 218766

SEQ ID NO: 444499 - RNA, 64 nt, hsa; identical to SEQ ID NO: 218767

SEQ ID NO: 444500 - RNA, 64 nt, hsa; identical to SEQ ID NO: 218768

SEQ ID NO: 444501 - RNA, 64 nt, hsa; identical to SEQ ID NO: 218769

SEQ ID NO: 444502 - RNA, 64 nt, hsa; identical to SEQ ID NO: 218770

SEQ ID NO: 444503 - RNA, 64 nt, hsa; identical to SEQ ID NO: 218771

SEQ ID NO: 444504 - RNA, 64 nt, hsa; identical to SEQ ID NO: 218772

SEQ ID NO: 444505 - RNA, 64 nt, hsa; identical to SEQ ID NO: 218773

SEQ ID NO: 444506 - RNA, 64 nt, hsa; identical to SEQ ID NO: 218774

SEQ ID NO: 444507 - RNA, 64 nt, hsa; identical to SEQ ID NO: 218775

SEQ ID NO: 444508 - RNA, 64 nt, hsa; identical to SEQ ID NO: 218776

SEQ ID NO: 444509 - RNA, 64 nt, hsa; identical to SEQ ID NO: 218777

SEQ ID NO: 444510 - RNA, 64 nt, hsa; identical to SEQ ID NO: 218778

SEQ ID NO: 444511 - RNA, 64 nt, hsa; identical to SEQ ID NO: 218779

SEQ ID NO: 444512 - RNA, 64 nt, hsa; identical to SEQ ID NO: 218780

SEQ ID NO: 444513 - RNA, 64 nt, hsa; identical to SEQ ID NO: 218781

SEQ ID NO: 444514 - RNA, 64 nt, hsa; identical to SEQ ID NO: 218782

SEQ ID NO: 444515 - RNA, 64 nt, hsa; identical to SEQ ID NO: 218783

SEQ ID NO: 444516 - RNA, 64 nt, hsa; identical to SEQ ID NO: 218784

SEQ ID NO: 444517 - RNA, 64 nt, hsa; identical to SEQ ID NO: 218785

SEQ ID NO: 444518 - RNA, 64 nt, hsa; identical to SEQ ID NO: 218786

SEQ ID NO: 444519 - RNA, 64 nt, hsa; identical to SEQ ID NO: 218787

SEQ ID NO: 444520 - RNA, 64 nt, hsa; identical to SEQ ID NO: 218788

SEQ ID NO: 444521 - RNA, 64 nt, hsa; identical to SEQ ID NO: 218789

SEQ ID NO: 444522 - RNA, 64 nt, hsa; identical to SEQ ID NO: 218790

SEQ ID NO: 444523 - RNA, 64 nt, hsa; identical to SEQ ID NO: 218791

SEQ ID NO: 444524 - RNA, 64 nt, hsa; identical to SEQ ID NO: 218792

SEQ ID NO: 444525 - RNA, 64 nt, hsa; identical to SEQ ID NO: 218793

SEQ ID NO: 444526 - RNA, 64 nt, hsa; identical to SEQ ID NO: 218794

SEQ ID NO: 444527 - RNA, 64 nt, hsa; identical to SEQ ID NO: 218795

SEQ ID NO: 444528 - RNA, 64 nt, hsa; identical to SEQ ID NO: 218796

SEQ ID NO: 444529 - RNA, 64 nt, hsa; identical to SEQ ID NO: 218797

SEQ ID NO: 444530 - RNA, 64 nt, hsa; identical to SEQ ID NO: 218798

SEQ ID NO: 444531 - RNA, 64 nt, hsa; identical to SEQ ID NO: 218799

SEQ ID NO: 444532 - RNA, 64 nt, hsa; identical to SEQ ID NO: 218800

SEQ ID NO: 444533 - RNA, 64 nt, hsa; identical to SEQ ID NO: 218801

SEQ ID NO: 444534 - RNA, 64 nt, hsa; identical to SEQ ID NO: 218802

SEQ ID NO: 444535 - RNA, 64 nt, hsa; identical to SEQ ID NO: 218803

SEQ ID NO: 444536 - RNA, 64 nt, hsa; identical to SEQ ID NO: 218804

SEQ ID NO: 444537 - RNA, 64 nt, hsa; identical to SEQ ID NO: 218805

SEQ ID NO: 444538 - RNA, 64 nt, hsa; identical to SEQ ID NO: 218806

SEQ ID NO: 444539 - RNA, 64 nt, hsa; identical to SEQ ID NO: 218807

SEQ ID NO: 444540 - RNA, 64 nt, hsa; identical to SEQ ID NO: 218808

SEQ ID NO: 444541 - RNA, 59 nt, hsa; identical to SEQ ID NO: 218809

SEQ ID NO: 444542 - RNA, 64 nt, hsa; identical to SEQ ID NO: 218810

SEQ ID NO: 444543 - RNA, 64 nt, hsa; identical to SEQ ID NO: 218811

SEQ ID NO: 444544 - RNA, 64 nt, hsa
guauuccuacacauauuagaaacucuucuaauaaaugaaguaaaaaaauuaaaaagaauacaaa

SEQ ID NO: 444545 - RNA, 64 nt, hsa
aauucuguuuuaaaucaaugaccuaagaucaacaaugaaguauuuuauaaauguauuuaugcug

SEQ ID NO: 444546 - RNA, 64 nt, hsa
auguuguuauuuggauuucugcacuguuuaacaaaugaaguaaaagaaaaacacuacugcaauc

SEQ ID NO: 444547 - RNA, 64 nt, hsa
acugguaguuacagucuuagguuaaaguauucuaaugaaguaugggaacuaaauugcugguuuu

SEQ ID NO: 444548 - RNA, 64 nt, hsa
gggaagagugggagggggaguuaaauccagucuuaugaaguauuguuauuaaaugucuuuuuaa

SEQ ID NO: 444549 - RNA, 64 nt, hsa
uauauuuuuacuauuaaaauauucaguuuuuuaaaugaaguagaacuugaguucauguuuuaua

SEQ ID NO: 444550 - RNA, 64 nt, hsa
uggauuuugaccauugauuaccuuucucaauguaaugaaguauuuuacagucaauuuguggugu

SEQ ID NO: 444551 - RNA, 64 nt, hsa
aacuucaucaguucaaauaaguuuuaauugucaaaugaaguauaaacacaugaacuuucuagaa

SEQ ID NO: 444552 - RNA, 64 nt, hsa
gucagaacuauaacauucaauuugcuauuuacaaaugaaguauuucauguaauauaagugaaca

SEQ ID NO: 444553 - RNA, 64 nt, hsa
gacuaaguugcaagaucuuauuuauuaacuagguaugaaguauaaacccauuuuggugcaauau

SEQ ID NO: 444554 - RNA, 64 nt, hsa
aacuuuaaaauauuaaguuuuuaaaaaaucaaauaugaaguauguucagcaaaggcauaauuuu

SEQ ID NO: 444555 - RNA, 64 nt, hsa
uauuagaaaagaaaucagaccuaaauaaucauugaugaaguaugucaguuacaagcacaaaaga

SEQ ID NO: 444556 - RNA, 64 nt, hsa
aaguuaauaauuauauuagcaaaguguuaaucuaaugaaguaaaaaacuccuguguggcagaaa

SEQ ID NO: 444557 - RNA, 64 nt, hsa
uacacaauagacuacuuacuacucagcaauaaaaaugaaguaacuuucaauaaaugcaauauua

SEQ ID NO: 444558 - RNA, 64 nt, hsa
caacucuaauccauaaacgggucuuaugacaucuaugaaguaguagcaagacaugcuuagugug

SEQ ID NO: 444559 - RNA, 64 nt, hsa
caauuggaauacauuucaagaugguaacagccccaugaaguaccgcuuuaauuccuugcuggua

SEQ ID NO: 444560 - RNA, 64 nt, hsa
uuucuuuuaccauugaccauuauuauagggacccaugaaguaaaugucacaaucaucuuacuag

SEQ ID NO: 444561 - RNA, 64 nt, hsa
aaaaaguacgugaccagucugguaagaaguauuaaugaaguagcuaauauuacagcuucauuuu

SEQ ID NO: 444562 - RNA, 64 nt, hsa
caacucuuugcauuacaauaugaaguaaaguucuaugaaguaugcauuuuguguaacuaaugua

SEQ ID NO: 444563 - RNA, 64 nt, hsa
ucugccuaaaauaugcaacucuuugcauuacaauaugaaguaaaguucuaugaaguaugcauuu

SEQ ID NO: 444564 - RNA, 64 nt, hsa
caacugaguauuacccaguuauacccaaucccugaugaaguauuaaaauguuauuaguuuuauu

SEQ ID NO: 444565 - RNA, 64 nt, hsa
guaaauucauuucauuuaguucuuaaacauccccaugaaguaaacacuauuauuauccucauuu

SEQ ID NO: 444566 - RNA, 64 nt, hsa
aggccuuuugagcaagcgccaaugaguuucaggaaugaaguagaagguaguuauuuaaaaauaa

SEQ ID NO: 444567 - RNA, 64 nt, hsa
gcuucaugagcccagaccaaaagcccacagugaaaugaaguacccuuuuguaaauagcauuuuu

SEQ ID NO: 444568 - RNA, 64 nt, hsa
uaagugcauuucugcaaagaucaagauaagcuggaugaaguagugugcauuuguaauacuauug

SEQ ID NO: 444569 - RNA, 64 nt, hsa
cuugccuuauuuucuaguuugugaacaagaacgaaugaaguacuauuauugauaacuuauauau

SEQ ID NO: 444570 - RNA, 64 nt, hsa
acuugggaguuauuuacuguguuccucuggcagccaauaaaaucaucauaagcccuuuguaaua

SEQ ID NO: 444571 - RNA, 64 nt, hsa
guucuguaugcuucuauuccaaaucauucauuaccaauaaaaacgaaauaccacccuuuccauu

SEQ ID NO: 444572 - RNA, 64 nt, hsa
auuaaaucacauuuagugcuguauaauuugcaugcaauaaaauucaauaaaauuaaauguaaaa

SEQ ID NO: 444573 - RNA, 64 nt, hsa
auuuagugcuguauaauuugcaugcaauaaaauucaauaaaauuaaauguaaaauuaaaugagu

SEQ ID NO: 444574 - RNA, 64 nt, hsa
aagccuuggcaccuguuggagacuaugaccaagccaauaaaaagggcauuuaaaucagcccugu

SEQ ID NO: 444575 - RNA, 64 nt, hsa
ccuaucacacucuguuaaaaacacauagaaucaucaauaaaaacucaauauaacuuucuuuggg

SEQ ID NO: 444576 - RNA, 64 nt, hsa
uauuuuuauauaugguuaaagagaccugucauugcaauaaaagccagcauucacaaaaugagga

SEQ ID NO: 444577 - RNA, 64 nt, hsa
uaauacaaaauaagugggaaaugagaaguuauaccaauaaaaagcauuuaaaaauuuaggggau

SEQ ID NO: 444578 - RNA, 64 nt, hsa
auuuauauuuucccucucuugccuuucuuauuugcaauaaaagguauugagccauuuuuuaaau

SEQ ID NO: 444579 - RNA, 64 nt, hsa
augcaucacggaucaauagacuguacuuauuuuccaauaaaauuuucaaacuuuguacuguuau

SEQ ID NO: 444580 - RNA, 64 nt, hsa
cuuguaaccagauacauaaagagcucuuacaacucaauaaaaggcaaguaauuuaaaaauaggc

SEQ ID NO: 444581 - RNA, 64 nt, hsa
guaacaaaauaucacaugcauaaauauuauguaucaauaaaauuuuuuaaugggcaaaggauuu

SEQ ID NO: 444582 - RNA, 64 nt, hsa
ggcacaguuugaugaagggcuagagagcuguuugcaauaaaaagucagguuuuuuuccugauuu

SEQ ID NO: 444583 - RNA, 64 nt, hsa
aauaucaucucuagcacugccauccaauuuaguucaauaaaauucaaauauaaguuuccaugcu

SEQ ID NO: 444584 - RNA, 64 nt, hsa
uuuaaaaaccaaaccaauaaaauuuuuauuuauucaauaaaauaugcacagaacagaugcaaau

SEQ ID NO: 444585 - RNA, 64 nt, hsa
uaagaauauuguuuauagguuuuaaaaaccaaaccaauaaaauuuuuauuuauucaauaaaaua

SEQ ID NO: 444586 - RNA, 64 nt, hsa
uuauuugcacuacauauaugauaaguauagacagcaauaaaauguuaagaucauuuuuaagaag

SEQ ID NO: 444587 - RNA, 64 nt, hsa
aaacuguuucccaaaauaagugcauuuauuuugacaauaaaacuuaaggcuguucaugagaagg

SEQ ID NO: 444588 - RNA, 64 nt, hsa
cccuccguuccgcuagccuacccugucagccuuucaauaaaaguuaugcacaaaugugaacacc

SEQ ID NO: 444589 - RNA, 64 nt, hsa
ucuggucaugaucucugaucuccaccucaaaugacaauaaaaaacugguccaacgaagacacug

SEQ ID NO: 444590 - RNA, 64 nt, hsa
ccuuacuuucccauuguaacaauaaaaaaaguaucaauaaaauaauuauuggcaaauaaauugg

SEQ ID NO: 444591 - RNA, 64 nt, hsa
ucuauauccuugacaccuuacuuucccauuguaacaauaaaaaaaguaucaauaaaauaauuau

SEQ ID NO: 444592 - RNA, 64 nt, hsa
gaugcaacagggacccuuguaaauugucauacgccaauaaaaugucacaaguaauaacugcugu

SEQ ID NO: 444593 - RNA, 64 nt, hsa
ugcguuaacauacuuuguuuugccuagagaggggcaauaaaaaugaaccaaaggauauuuccag

SEQ ID NO: 444594 - RNA, 64 nt, hsa
uaguauuuuaaaaaaauuguuuuucaaaugucaccaauaaaaguuuuggcaggaagcuuguugc

SEQ ID NO: 444595 - RNA, 64 nt, hsa
ccacaccagaguucuauuuaccucaucuugguaucaauaaaaacuuauguggaagguaaauaua

SEQ ID NO: 444596 - RNA, 64 nt, hsa
auauccacuggucacaucauaacugucuauagggcaauaaaaucuguguuaaacucaauugcuu

SEQ ID NO: 444597 - RNA, 64 nt, hsa
ugcauggggguuaagcugauguuaaaacaguuugcaauaaaaaaaaaugaaucagcuuaaguca

SEQ ID NO: 444598 - RNA, 64 nt, hsa
ucaccauuugguccucuuuaaucuuugaggguuucaauaaaaauuguucacucauaucuguguu

SEQ ID NO: 444599 - RNA, 64 nt, hsa
gaaagcagaauuuguuugauaccuaacaagauuucaauaaaaauccaaacuuuguauguacguu

SEQ ID NO: 444600 - RNA, 64 nt, hsa
aacaucuuaacuguauaugaacauuucacgaggacaauaaaaauaagacauugaaggaccaauu

SEQ ID NO: 444601 - RNA, 64 nt, hsa
auagcaaucaaucauaauuaguaaacagguguaccaauaaaaagaauuuacaugauagguuaac

SEQ ID NO: 444602 - RNA, 64 nt, hsa
gauaaauaacaaguuauaguaccaucucccccgccaauaaaaaagagaagaaaaaagagaaacc

SEQ ID NO: 444603 - RNA, 64 nt, hsa
auucccagauuauccuuguaaugacacgaaucugcaauaaaagccaucagugcuauuuggaugu

SEQ ID NO: 444604 - RNA, 64 nt, hsa
agacaacucuuucuuuaaauaaauuaagucucuacaauaaaaacacaacugcaaaguaccuuca

SEQ ID NO: 444605 - RNA, 64 nt, hsa
cucccauucuaugugucaucaauaguguccuaugcaauaaaauuauuugcaggucuuuaaauca

SEQ ID NO: 444606 - RNA, 64 nt, hsa
gaaaggaugaucaaaaauaaugcauccagcaguacaauaaaaguaaaccacaaaaaaauaccuc

SEQ ID NO: 444607 - RNA, 64 nt, hsa
acuccagccugggugacagagugagacuccaucucaauaaaauuaauaauaauaaaaccuucca

SEQ ID NO: 444608 - RNA, 64 nt, hsa
agaguaaaaaucagugaaauugaaaagagaaaaucaauaaaacccaaaacuguucuuugaaaag

SEQ ID NO: 444609 - RNA, 64 nt, hsa
cugaauauguacuuuuaacacaagagagacuauucaauaaaaacucacugggucuuucaugucu

SEQ ID NO: 444610 - RNA, 64 nt, hsa
ucuuuuuuauauuguccuccaccuccaucauuuucaauaaaagauagggcuuuugcucccuugu

SEQ ID NO: 444611 - RNA, 64 nt, hsa
cacacacacacacacacaaacauauaaccuaugccaauaaaaaugucucagcaacaguggaauu

SEQ ID NO: 444612 - RNA, 64 nt, hsa
ccuggaacagugucuggugcacauaauaggugcucaauaaaaauguguucaauggaugaauuuc

SEQ ID NO: 444613 - RNA, 64 nt, hsa
aacauaaugugaucaugcucuaacuucaauauaccaauaaaauaaucagcuugcaauuucugau

SEQ ID NO: 444614 - RNA, 64 nt, hsa
auuuugaacuaacaguaauaacuucuugaaaauccaauaaaauuggcaaaagauugugaaaauu

SEQ ID NO: 444615 - RNA, 64 nt, hsa
uguugucuucaaaggcaggagaaaauaauguucacaauaaaaugugcuaacaauguuuuguuuc

SEQ ID NO: 444616 - RNA, 64 nt, hsa
gaauaaaagaaaagcugacaguauauucugguuucaauaaaaugaccuaucagaaaguagaauu

SEQ ID NO: 444617 - RNA, 64 nt, hsa
aaguccaggcaaguuacaaugccuuguugugccucaauaaaaaaguuacaugcaccuucagugu

SEQ ID NO: 444618 - RNA, 64 nt, hsa
ucuuuaucaagauugaaagucaguacaguauugacaauaaaaggaugguguucuaauuaguggg

SEQ ID NO: 444619 - RNA, 64 nt, hsa
aaaguauagccccacuuauacuauguaaaauuaccaauaaaauauuuuuaugacuacagauuuu

SEQ ID NO: 444620 - RNA, 64 nt, hsa
cauuuauuguaauguuuacuagcggacuaguaaacaauaaaacauugauuauuuagcuuuauaa

SEQ ID NO: 444621 - RNA, 64 nt, hsa
uauuuuuaggaaaauauuaagcuuuauaaaauagcaauaaaaaauaauucauuuaagaagagau

SEQ ID NO: 444622 - RNA, 64 nt, hsa
guguaggguuuuauuuuauuuuuauuuuuugacccaauaaaauguuauaugaaagaaugaaaau

SEQ ID NO: 444623 - RNA, 64 nt, hsa
agacuauuauuaucuuuguaauaaauuaaccuagcaauaaaaaauauucuguuucuuucguuag

SEQ ID NO: 444624 - RNA, 64 nt, hsa
aggucuaguuucgguaacuguuccagacaucaagcaauaaaaaaaugaauaccacaaaagaugu

SEQ ID NO: 444625 - RNA, 64 nt, hsa
aagucuucgauucucagagagcauuugucuaauacaauaaaaacuggcauuaauacaaaccuca

SEQ ID NO: 444626 - RNA, 64 nt, hsa
agauucugucucaaaauaaauacauacauacauacaauaaaaccgaaugagcugguucuuucca

SEQ ID NO: 444627 - RNA, 64 nt, hsa
cuacuaaauguacagauaugcaaauuccauagcucaauaaaagaaucugauacuuagaccaaaa

SEQ ID NO: 444628 - RNA, 64 nt, hsa
cugcagaaaaaauauuguaguuugaauauuuaagcaauaaaacugcuagugaguuauuguaagc

SEQ ID NO: 444629 - RNA, 64 nt, hsa
gugggggggaaagaugacaugguauuuaauaauacaauaaaaauauucuuaucacuuccuaucc

SEQ ID NO: 444630 - RNA, 64 nt, hsa
aauacacagaauguguacagauuauuuguuaugacaauaaaacacucaaaauaaauggucuuua

SEQ ID NO: 444631 - RNA, 64 nt, hsa
aaaauaccacagacacaguuaaagcaaaaggaaacaauaaaaggaaugucugcaugcuauuuua

SEQ ID NO: 444632 - RNA, 64 nt, hsa
guugcugaaucuguuuggguuccaguuuccuuggcaauaaaaugagcuaaaugggcuaggugaa

SEQ ID NO: 444633 - RNA, 64 nt, hsa
gaguucuguuucacaaguuuugggccaccuauuucaauaaaaaauaaaauauaaauuaaaaaag

SEQ ID NO: 444634 - RNA, 64 nt, hsa
aguaauacaguaaacugaaagaguauauagauagcaauaaaauaacauaaguggacauguuuau

SEQ ID NO: 444635 - RNA, 64 nt, hsa
ugacaugguuaaucuggaacuuacguucuuauaccaauaaaagguaccucaauacauguucuuu

SEQ ID NO: 444636 - RNA, 64 nt, hsa
gcuggcacugaagaucuccagggacuucagagaccaauaaaagcccauagggaagagagagagg

SEQ ID NO: 444637 - RNA, 64 nt, hsa
ugccaugcugcuaugaagacuacuuuuagaucaacaauaaaaaaaaaccuacaaaaaaaccuuu

SEQ ID NO: 444638 - RNA, 64 nt, hsa
ccuuauuuuuauuuauuuuuguacugugcugauucaauaaaaugcacugaccauccauuacaga

SEQ ID NO: 444639 - RNA, 64 nt, hsa
cuaaugaagaaaagagagaagaaucaaauagaugcaauaaaaaaugauaaagggaauaucauca

SEQ ID NO: 444640 - RNA, 64 nt, hsa
caauauccuugaugaacauugaugugaaaauccucaauaaaauacuggcaaaccgaauccagca

SEQ ID NO: 444641 - RNA, 64 nt, hsa
ugggccccaccacgcucucaagagaacgcaccugcaauaaaacagucuugucggccagcugccc

SEQ ID NO: 444642 - RNA, 64 nt, hsa
caagcugugaagaaaaauauauaucaauguuuuccaauaaaauacagugacuaccugauuuggc

SEQ ID NO: 444643 - RNA, 64 nt, hsa
ucuuuccaccuuccccuauccaugcacccccucgcaauaaaaccaacucuaaaaucacagcugu

SEQ ID NO: 444644 - RNA, 64 nt, hsa
gagagaaaauccacaaauuccaaugucacaaaagcaauaaaacaaacuagaaaaaaaaaagguu

SEQ ID NO: 444645 - RNA, 64 nt, hsa
gcucacguauuucuauugucagcgcuggcauaaacaauaaaaaguagacuugguuuuuuugugu

SEQ ID NO: 444646 - RNA, 64 nt, hsa
uaauucuacaagaggaaucaccugguuucccaaccaauaaaauggcauuuuaagaaauaaggug

SEQ ID NO: 444647 - RNA, 64 nt, hsa
guguuacuguuuaccauggcaguaauggggcaaacaauaaaaugcaaugugaaaugauuugaug

SEQ ID NO: 444648 - RNA, 64 nt, hsa
aaaaucauucuggagguggcauguccuugacucacaauaaaaauuuuagaaaacuauugaaaga

SEQ ID NO: 444649 - RNA, 64 nt, hsa
uggucaaagagaaagaacucuaauguccagcugcuccaucgauauacucauagaauggaaguga

SEQ ID NO: 444650 - RNA, 64 nt, hsa
ggccugccaaggugaagagauacagccuuccguauccaucgaagcagaugcucugaacccugag

SEQ ID NO: 444651 - RNA, 64 nt, hsa
ccagcuaggcuacacccaucaugcgccgcccuccuccaucgagggagaggccugaagggacugc

SEQ ID NO: 444652 - RNA, 64 nt, hsa
agacacugcucagcacuucagccaucaggacuaauccaucgaugacuggaaaagaggcuagcuu

SEQ ID NO: 444653 - RNA, 64 nt, hsa
aucauaaccacucaucuaauuucuaagaggcaccuccaucgagggccggucuccugcuucuuua

SEQ ID NO: 444654 - RNA, 64 nt, hsa
uccugcagcaucaccauaagcagugcagggugucuccaucgagcuguuugguuccauguguguu

SEQ ID NO: 444655 - RNA, 64 nt, hsa
uuuaaguugucaugugacagaaacuuuuccuuuguccaucgagguguuucauaaguuuuuuggu

SEQ ID NO: 444656 - RNA, 64 nt, hsa
gaccguccccuggaggaaagucauuccugccuaauccaucgagagaaagaggcuuacgaaaaac

SEQ ID NO: 444657 - RNA, 64 nt, hsa
uuggaagccugagaggcgccggcucucuugcuccuccaucgauggacacugcauugcuucucau

SEQ ID NO: 444658 - RNA, 64 nt, hsa
agcugcugcacugucucaguucugcuugaauaccuccaucgauggggaacucacuuccuuugga

SEQ ID NO: 444659 - RNA, 64 nt, hsa
uaccacacuguuaggccuuuauuuuauuuuauuuuccaucgaaagcauuggaggcccagugcaa

SEQ ID NO: 444660 - RNA, 64 nt, hsa
uuuacuaaauagaauuacuggugaagcagauuuauccaucgagacuaucugguaugcguuaugu

SEQ ID NO: 444661 - RNA, 64 nt, hsa
gucuccuuuaugcaucugcaacuuuaaggcauaguccaucgaucuacagggugaucucauuuga

SEQ ID NO: 444662 - RNA, 64 nt, hsa
uccgcuaauagggagggcugugcgauuaaaggcuuccaucgauuggguaguguccuucaagugg

SEQ ID NO: 444663 - RNA, 64 nt, hsa
uugcagcugcagcccaucccugggccauguccccuccaucgagugcccggugcuugggggagga

SEQ ID NO: 444664 - RNA, 64 nt, hsa
cccccgaugcccaaagcagcaucuuccagcacuuuccaucgaggacuuggguggcagagugugg

SEQ ID NO: 444665 - RNA, 64 nt, hsa
cggauccagagcacggcacucagaggcgagaaacuccaucgaguguuccauuauguccuggaua

SEQ ID NO: 444666 - RNA, 64 nt, hsa
uaaacggaggacuuggggaaaaaggaccacauaguccaucgaagaagaguccuuggaacaagca

SEQ ID NO: 444667 - RNA, 64 nt, hsa
guaaaccucugucaccuggaccuugcuuagauauuccaucgauuuuguccaacaaacaauuucu

SEQ ID NO: 444668 - RNA, 64 nt, hsa
uauuguccuuuuuuacuggaagacguacgcauacuccaucgauguuguauuugcaguggcugag

SEQ ID NO: 444669 - RNA, 64 nt, hsa
cagccccuucuuccuggacccaggaguugaagccuccaucgacucccccucaacuuugagacug

SEQ ID NO: 444670 - RNA, 64 nt, hsa
guaggaagaauucggauccuuaccauuggaaucuuccaucgaacauacucaaacacuuuuggac

SEQ ID NO: 444671 - RNA, 64 nt, hsa
guguccugcauguaugccauguauguugcaugaauccaucgauuuguauuaauguagggcagaa

SEQ ID NO: 444672 - RNA, 64 nt, hsa
cuauuuaagugcauaaggucuuuggccuucaagauccaucgaccuuaaacaggaaugcuuagca

SEQ ID NO: 444673 - RNA, 64 nt, hsa
ucccccagaaucuuggcuguuuacaaaucacguguccaucgagcacgucugaaaccccugguag

SEQ ID NO: 444674 - RNA, 64 nt, hsa
uucagcaauguugaucucauaaaaggaaaaacaaaagauuuaaguauucuauauaccaaguuuu

SEQ ID NO: 444675 - RNA, 64 nt, hsa
agagugauaugcuugcugcuuaaucaaaggauuaaagauuuaaagaugucuaugucuucuauuu

SEQ ID NO: 444676 - RNA, 64 nt, hsa
acuuucucuuauugguggguaauaacugaaaauaaagauuuauuuucaugcucacuucuuaaaa

SEQ ID NO: 444677 - RNA, 64 nt, hsa
gaaacuuuuauguuauaagaguuacuuuuuggauaagauuuauuaaucucaguuaccuacuauu

SEQ ID NO: 444678 - RNA, 64 nt, hsa
ggguuuuaaaaaauguuugcuaaacuacccaaguaagauuuacuguauuaaauggccuucgggu

SEQ ID NO: 444679 - RNA, 64 nt, hsa
uguuuuguggcauaauauaacugaauuucaugagaagauuuauuccaccagggguauuucagcu

SEQ ID NO: 444680 - RNA, 64 nt, hsa
cuuccuguuuuaagcagcucuaaaacauagacugaagauuuauuuuuaauauguugacuuuauu

SEQ ID NO: 444681 - RNA, 64 nt, hsa
aaaguagcaguuugguaugaguuggcaugcauacaagauuuacuaagugggauaagcuaauuau

SEQ ID NO: 444682 - RNA, 64 nt, hsa
aacucuacuaauuuuuagauauucauuaauaggaaagauuuaauguuacagcaucuacucuuug

SEQ ID NO: 444683 - RNA, 64 nt, hsa
aaaaguuguaccuugacccuagaauuccuuuuauaagauuuaauuguaauugucucaaagcauc

SEQ ID NO: 444684 - RNA, 64 nt, hsa
ugugcaagauuguuaacuaaggcugggaaauaauaagauuuagaguccuaauuuucaauauauc

SEQ ID NO: 444685 - RNA, 64 nt, hsa
gacuuuuuaauguaaaaguaauuauuguaagaaaaagauuuaauuguuccauguguauuuuauu

SEQ ID NO: 444686 - RNA, 64 nt, hsa
uagcauuuuuauacaaauaucuuuaaaggcacaaaagauuuauucacaaguuuuggagggcuuu

SEQ ID NO: 444687 - RNA, 64 nt, hsa
auuuuaguauacagagugauuggcaaauauuuucaagauuuaauaugagcaacccauuauuugc

SEQ ID NO: 444688 - RNA, 64 nt, hsa
uuagcaaaaauagcuuuuuacuucaucaguugcuaagauuuaauacuuuggauucaucaaagug

SEQ ID NO: 444689 - RNA, 64 nt, hsa
cuagauuaaaaauagacuagaacagguucauuuuaagauuuacuuggaagagcaaagaaggaaa

SEQ ID NO: 444690 - RNA, 64 nt, hsa
cuuuugaggaaugaugugauguguagagaauagaaagauuuagauauaugccugugacaggaau

SEQ ID NO: 444691 - RNA, 64 nt, hsa
guguuacguguuacauggagugaggguagaugugaagauuuaaaacgauugauggauuuaagga

SEQ ID NO: 444692 - RNA, 64 nt, hsa
gguaaauuucuuaaacauuauccagaaaaauaacaagauuuauaguaucuacuucugguacuaa

SEQ ID NO: 444693 - RNA, 64 nt, hsa
aaaaaaguuaacuuuucauacuaacaaacagaacaagauuuaagguaaauuucuuaaacauuau

SEQ ID NO: 444694 - RNA, 64 nt, hsa
guauuuuccaucauuucaaaccacaaacaaaauuaagauuuaaacugugggauggguaagaaau

SEQ ID NO: 444695 - RNA, 64 nt, hsa
acugaaaacauguuaaggcuauaguuuagccaguaagauuuaaucacaauuuuucuucuuuaau

SEQ ID NO: 444696 - RNA, 64 nt, hsa
uacuaaauccuauguuuacauuaauaugugaaaaaagauuuagaagauauuuuggagauaaaca

SEQ ID NO: 444697 - RNA, 64 nt, hsa
ccuuccuuugaggaaggauguggaucuccaaauaaagauuuaguguuuauuuugagcucugcau

SEQ ID NO: 444698 - RNA, 64 nt, hsa
acacacaaacgagagggcuuggcucccuuccaggaagauuuauuuaacaggcucccagcugaau

SEQ ID NO: 444699 - RNA, 64 nt, hsa
aguaauuuuuaugaaucuguuuuaugaguuagguaagauuuagccuuucugcagucugucucau

SEQ ID NO: 444700 - RNA, 64 nt, hsa
uagacaggacagauacucucaacagacaagaaaaaagauuuagcuuaucacaagaagcagacaa

SEQ ID NO: 444701 - RNA, 64 nt, hsa
agauuugaaaaucuuuaaugaacuggagaacacuaagauuuaaacucgaaaauucguuguucaa

SEQ ID NO: 444702 - RNA, 64 nt, hsa
auauaugccuccuguguacuuuuggagaaaacugaagauuuaguuuccauuuuucuuuauaaua

SEQ ID NO: 444703 - RNA, 64 nt, hsa
ccuuaccugaucacaaauuauguuggggaaaauaaagauuuaauauuucuuuaaauagaaaaag

SEQ ID NO: 444704 - RNA, 64 nt, hsa
cccguuuucuagaguucuugaccaucauuuugaaaagauuuauuaaaacuagcuaaagacaaca

SEQ ID NO: 444705 - RNA, 64 nt, hsa
caaccucacaaccuuggcugagucuugagacugaaagauuuagccauaauguaaacugccucaa

SEQ ID NO: 444706 - RNA, 64 nt, hsa
gauuuguauuuaagaauuguuuuuaaaaaauuuuaagauuuacacaauguuucucuguaaauau

SEQ ID NO: 444707 - RNA, 64 nt, hsa
uaagcauagggggaaaaacucucagggcccuauuaagauuuauaaccuuuguaauguucuucac

SEQ ID NO: 444708 - RNA, 64 nt, hsa
acuuuugccuccguccaaaagauuccuccaaaaaaagauuuaaaaaaagauuucggcaucgaca

SEQ ID NO: 444709 - RNA, 64 nt, hsa
aagaaaggccaugaaauagaaaagaaaucgcuugaagauuuacuuucugagaagcaggaaucgc

SEQ ID NO: 444710 - RNA, 64 nt, hsa
aacaaaacaacagacuucauccuuagguuuucucaagauuuaagugaacacauuuacacauauc

SEQ ID NO: 444711 - RNA, 64 nt, hsa
cauaucauagcacuaaaaagauugaguuaaaaauaagauuuaaaaaauauauauugauuaaaau

SEQ ID NO: 444712 - RNA, 64 nt, hsa
ucugccuuccuuguuaauuuuguaauaauuggagaagauuuaugucagcacacacuuacagagc

SEQ ID NO: 444713 - RNA, 64 nt, hsa
guaaauaauuggaaaaguaaucagcauauguguaaagauuuauacaguugaaaacuuguaaucu

SEQ ID NO: 444714 - RNA, 64 nt, hsa
cacaucucugcuggaaagucaacauguaguaagcaagauuuaacuguuugauuauaacugugca

SEQ ID NO: 444715 - RNA, 64 nt, hsa
acuugauuucuuaucuguguuuguguuggcaugcaagauuuagguacuuaucaaagauaauggg

SEQ ID NO: 444716 - RNA, 64 nt, hsa
aauuuguuuauuuuauuaaaaaucuagaauauuaaagauuuauacuuuuaauauugaauauagu

SEQ ID NO: 444717 - RNA, 64 nt, hsa
cuuaggcuuuuaaacaaauacauggaaugguugaaagauuuauuuugcucgugcuuagcuaaau

SEQ ID NO: 444718 - RNA, 64 nt, hsa
uccaugaauguuaaaauguacaggugggauugugaagauuuacugacaucaaaaguucuucugg

SEQ ID NO: 444719 - RNA, 64 nt, hsa
gaagaggagucacuaagcccuaacagcuuguccaaagauuuaaauucuuauuucaaauuugauu

SEQ ID NO: 444720 - RNA, 64 nt, hsa
aauaaaauguaaauuaucugaaaggacagaauauaagauuuaaccauguuugacguauuuuaau

SEQ ID NO: 444721 - RNA, 64 nt, hsa
auuacauuuuugaaagguuuaugauuccaaaauaaagauuuauaugacuggugauacuggcuuu

SEQ ID NO: 444722 - RNA, 64 nt, hsa
uccaaccugaguauuguaggggaaggaaauuuacaagauuuaauaggaaaugaaacagcuugaa

SEQ ID NO: 444723 - RNA, 64 nt, hsa
cguggucagaauaaguuuuacacgaagcaggugaaagauuuaguucuuuucaaaguaacuuauu

SEQ ID NO: 444724 - RNA, 64 nt, hsa
uucuacauggcuugauuacauagcaaacaagaccaagauuuagggcugucuuaaacaucacugc

SEQ ID NO: 444725 - RNA, 64 nt, hsa
gcagugguggcacguagagaacuagaugguaauaaagauuuaaaacuaugaagaagguuacagu

SEQ ID NO: 444726 - RNA, 64 nt, hsa
gguguguauuuacuuuagaaaaaaugaaaaagacaagauuuaugagaaauauuugaaggcagua

SEQ ID NO: 444727 - RNA, 64 nt, hsa
auugucauaaaauuaauaaauuuaggaaagaauaaagauuuauauauucauucuuuacauauaa

SEQ ID NO: 444728 - RNA, 64 nt, hsa; identical to SEQ ID NO: 51753

SEQ ID NO: 444729 - RNA, 64 nt, hsa; identical to SEQ ID NO: 51754

SEQ ID NO: 444730 - RNA, 64 nt, hsa; identical to SEQ ID NO: 51755

SEQ ID NO: 444731 - RNA, 64 nt, hsa; identical to SEQ ID NO: 51756

SEQ ID NO: 444732 - RNA, 64 nt, hsa; identical to SEQ ID NO: 51757

SEQ ID NO: 444733 - RNA, 64 nt, hsa; identical to SEQ ID NO: 51758

SEQ ID NO: 444734 - RNA, 64 nt, hsa; identical to SEQ ID NO: 51759

SEQ ID NO: 444735 - RNA, 64 nt, hsa; identical to SEQ ID NO: 51760

SEQ ID NO: 444736 - RNA, 64 nt, hsa; identical to SEQ ID NO: 51761

SEQ ID NO: 444737 - RNA, 64 nt, hsa; identical to SEQ ID NO: 51762

SEQ ID NO: 444738 - RNA, 64 nt, hsa; identical to SEQ ID NO: 51763

SEQ ID NO: 444739 - RNA, 64 nt, hsa; identical to SEQ ID NO: 51764

SEQ ID NO: 444740 - RNA, 64 nt, hsa
acuauggauuuuguaggugucagguuaaauggucaagggauaccuacauuaagucauauauuag

SEQ ID NO: 444741 - RNA, 64 nt, hsa
uacuacucauuuaucauuguauauugauuaguuaaagggauaauuaauuuaaugcugaggagag

SEQ ID NO: 444742 - RNA, 64 nt, hsa
aaguguggcaauacucuuucacuuaauucuuuacaagggauaucaaagccauaauggacuucau

SEQ ID NO: 444743 - RNA, 64 nt, hsa
agccauaauggacuucauuaguuuuaggguagggaagggauacuaauuacuuauuucuuucaaa

SEQ ID NO: 444744 - RNA, 64 nt, hsa
gcauaguuaacaacaaagagccaaaagaucaaagaagggauacuuucagaugguugucuugugu

SEQ ID NO: 444745 - RNA, 64 nt, hsa
uuuauuaccugcuuaaugguccaccuggaacuaaaagggauacuauuuucuaacaagguauauc

SEQ ID NO: 444746 - RNA, 64 nt, hsa
aucauuguuuauuacuggucacuuagaaaauuaaaagggauagggccaggcacaguggcuuaug

SEQ ID NO: 444747 - RNA, 64 nt, hsa
agacuccgucucaaagaaacaaacaaaaaauuaaaagggauagaauauaaugaaauauauuuug

SEQ ID NO: 444748 - RNA, 64 nt, hsa
uuuaauauuuaauaagauuuucugggauaacaguaagggauauuagauaauauaccguauguau

SEQ ID NO: 444749 - RNA, 64 nt, hsa
guauguauuuauuacuagucuuuuccucuaggaaaagggauacuuugauaauuaaggccagagg

SEQ ID NO: 444750 - RNA, 64 nt, hsa
cccuacuagcuggaaacucuggugacgugaugaaugugggaagggcuuugguggauguuccacc

SEQ ID NO: 444751 - RNA, 64 nt, hsa
ccauacuagugagaaaccacgugaauguaaugaaugugggaacgcuuugaucagaggaugcaua

SEQ ID NO: 444752 - RNA, 64 nt, hsa
ucauaucagagagagauccuaaagguguaauguaugugggaagaccacaucuuguuccacauca

SEQ ID NO: 444753 - RNA, 64 nt, hsa
aagaauuccuuccagagauaaacucuaugagauaugugggaaggccuuuugcaagugggcccac

SEQ ID NO: 444754 - RNA, 60 nt, hsa
cuggaggaaaaaaccuuugagugcaaaugaugugggaauuuguggguuuucuuuuuuuuu

SEQ ID NO: 444755 - RNA, 64 nt, hsa
auguccuuguaggcucuguuuuaagaaaacaauaugugggaaaugauuuaauuuuuccuauugc

SEQ ID NO: 444756 - RNA, 64 nt, hsa
uugcagccuacuguaguagauacgcaacagauaaugugggaaaaaaagagauaagaggaggaag

SEQ ID NO: 444757 - RNA, 64 nt, hsa
gcucuggcaucugagcccgagcuccugccccugcugugggaaagguggggaagaaggggaucuc

SEQ ID NO: 444758 - RNA, 64 nt, hsa
cuggguuugagcccugccuccccccacugccuaaugugggaacccaagcaaggcccuucuaccu

SEQ ID NO: 444759 - RNA, 64 nt, hsa
uucuucacuguguugagcugggaggagucuucaaugugggaagggauuuucugccaaaugccau

SEQ ID NO: 444760 - RNA, 64 nt, hsa
uucaugaauuccuggaauuucugugccucuuuuaugugggaaagggcaggcucugguuucugcu

SEQ ID NO: 444761 - RNA, 64 nt, hsa
ugcccucggguggggcuggugggucugcagcuggugugggaacuuccccacggauggcggugga

SEQ ID NO: 444762 - RNA, 52 nt, hsa
ugcugaaacuggccuuguaggcugugggaaccgagucagaauauuuuugaaa

SEQ ID NO: 444763 - RNA, 64 nt, hsa
cuuuguacuacugcaaacuuaaaaguuuuucaaaugugggaaacgugugggaaggcuuguugaa

SEQ ID NO: 444764 - RNA, 64 nt, hsa
ugcaaacuuaaaaguuuuucaaaugugggaaacgugugggaaggcuuguugaacuuuggcgcac

SEQ ID NO: 444765 - RNA, 64 nt, hsa
acggaagaagucucuaugagaagagcuccuuuaaugugggaauugauacacaagaagguacuua

SEQ ID NO: 444766 - RNA, 64 nt, hsa
caugaagcuggaggcagagauuggagugauacauugugggaacccucagaagauaggaaaaaag

SEQ ID NO: 444767 - RNA, 64 nt, hsa
aauuauuucccacugaccuaaacuuucagugauuugugggaaaaauaaauaaauguucuacacc

SEQ ID NO: 444768 - RNA, 64 nt, hsa
aucacaaugucauuuccuaauacaaggcaggauaugugggaagaauauguacaauuauuugauu

SEQ ID NO: 444769 - RNA, 64 nt, hsa
ugcaugguaauauaccuuauuggugcucaacauuugugggaaauuagaggguuggugagauuuu

SEQ ID NO: 444770 - RNA, 64 nt, hsa
uuccuucccuuuauucccuugaaaaaagagaaucugugggaaauaggcagauauagcuuuuuaa

SEQ ID NO: 444771 - RNA, 64 nt, hsa
uauuuauugauuuuaaaaguuuuacauguaggagugugggaaugaaggaauucuggagcuuuuu

SEQ ID NO: 444772 - RNA, 64 nt, hsa
auauauuaauuucuuauguuuguaaguuuggcuuugugggaauagguguggagaaauuaaagag

SEQ ID NO: 444773 - RNA, 64 nt, hsa
guuccaucccaagucacagcugcccuaggucccgugugggaaugcucgugugauggaugguccu

SEQ ID NO: 444774 - RNA, 64 nt, hsa
cguccuuuacucaacaacccuccaauccggaugcugugggaagggccgggucacucggauacca

SEQ ID NO: 444775 - RNA, 64 nt, hsa
agaaagucauuacuuacuacugcacuccugcuuuugugggaaaaauuuucuucuuccccagaag

SEQ ID NO: 444776 - RNA, 64 nt, hsa
caagugugcagguuccuuuguauguauguguacgugugggaaccuguguuugucauauuuuucu

SEQ ID NO: 444777 - RNA, 64 nt, hsa
cagcaggaaacggguaggugagguguugggcaguugugggaacuucugagaguauuacagagug

SEQ ID NO: 444778 - RNA, 64 nt, hsa
aagcaacauugugaucuuucuuccccgccacgugugugggaaugauugaguccuguuugcaagc

SEQ ID NO: 444779 - RNA, 64 nt, hsa
ucuuuaagaacaguugcaggaucuggcucgccucugugggaagccggcauuacaggugcuuggu

SEQ ID NO: 444780 - RNA, 64 nt, hsa
cauucauaguggcaauguacacagucauaaggaaugugggaagccuuccuuggugucucagauc

SEQ ID NO: 444781 - RNA, 64 nt, hsa
uccaauagaagagaagacauaugaauguaaggaaugugggaaaaucuuggcuccuuccauaggc

SEQ ID NO: 444782 - RNA, 64 nt, hsa
uuacacuggagagaaacccuaugaguguaagcaaugugggaaagccuuuguuuccuucacuucc

SEQ ID NO: 444783 - RNA, 64 nt, hsa
gcacagaggagagaagcucugugaauguaagcauugugggaaagcauucauaucugccaagauc

SEQ ID NO: 444784 - RNA, 64 nt, hsa
ucacacuggagagaagcccuaugaauauaagcaaugugggaaagccuucagaucagccucgcac

SEQ ID NO: 444785 - RNA, 64 nt, hsa
ucacaguggagaaaaacucuaugaguguaagcaaugugggaaagucuucagaucugucaagaac

SEQ ID NO: 444786 - RNA, 64 nt, hsa
gcacagaggagaggcgcccuaagaauguaagcauugugggaaagcauucauaucugccaagauc

SEQ ID NO: 444787 - RNA, 64 nt, hsa
ucauacgagagagaauccguaugaauguaaggauugugggaaagcauucagcuugcuuaauugc

SEQ ID NO: 444788 - RNA, 64 nt, hsa
ucacacuggggagaaaccguaucaauguaagcaaugugggaaagccgucagaucagccucaaga

SEQ ID NO: 444789 - RNA, 60 nt, hsa
ucuggagaaagaccuuauaaauguuagauaugugggaaaggccuuuauucugccaaguca

SEQ ID NO: 444790 - RNA, 64 nt, hsa
ucacacuggagagaaacccuaugaguguaagcaaugugggaaagccuucagaugugccccacac

SEQ ID NO: 444791 - RNA, 64 nt, hsa
acucacuggagagaaacccuaugaguguaaggaaugugggaaagccuucagaucugccucacac

SEQ ID NO: 444792 - RNA, 64 nt, hsa
acacucuggagaaagaccuuauaaauguaagacaugugggaaaggcuuuuauucucccacguca

SEQ ID NO: 444793 - RNA, 64 nt, hsa
ucacacuggagagaaacccuaugaguguaagcaaugugggaaagccuucagaucugccucaauc

SEQ ID NO: 444794 - RNA, 64 nt, hsa
ucacccugaagagaagcccuacgaguguaagcaaugugggaaagccuucagaucugccccacac

SEQ ID NO: 444795 - RNA, 64 nt, hsa
ucacacuggagagaaacccuaugaguguaaggaaugugggaaagccuucagaucugccaagaac

SEQ ID NO: 444796 - RNA, 64 nt, hsa
gcacucuguagaaagaccuuauaaauguaagauaugugggaaaggcuuuuauucugccaaguca

SEQ ID NO: 444797 - RNA, 64 nt, hsa
uuacacuggagagaaacccuaugaguguaagcaaugugggaaagccuuuauuucuuucacuucu

SEQ ID NO: 444798 - RNA, 64 nt, hsa
ucacauuagauugaaacccuacgaaugcaguauaugugggaaagccuuuagucauaggucgucc

SEQ ID NO: 444799 - RNA, 64 nt, hsa
ucauacuggagagaaaccuuacgaauguauuaaaugugggaagaccuucagcuguaguucaaac

SEQ ID NO: 444800 - RNA, 64 nt, hsa
ucauacuggagaaaagccauauaaauguagugagugugggaaagcuuuuagcaaaggcucgaau

SEQ ID NO: 444801 - RNA, 64 nt, hsa
uuauacuguagagaaaucauaugaagucaauaaaugugggaaagccuuugucaguauuaauccc

SEQ ID NO: 444802 - RNA, 64 nt, hsa
ucacacuaggaaaaaucuguguacauguagcaaaugugggaaagacuauaggcaauaggaaucu

SEQ ID NO: 444803 - RNA, 64 nt, hsa
ucacacuggagagaaaccuuaugaaugcagugaaugugggaaagcuuuuauucagaugucaaac

SEQ ID NO: 444804 - RNA, 64 nt, hsa
ucauacuggagagaaaccuuaucauuguaaucaaugugggaaagcuuucagucagagacaaaau

SEQ ID NO: 444805 - RNA, 64 nt, hsa
ucacacaggggagaaacccuaugaauguaauaaaugugggaaagccuuuucucagugcucauua

SEQ ID NO: 444806 - RNA, 64 nt, hsa
ucauacuggugagaaacccuuugaauguaaugaaugugggaaagcauucucucaaagagcaucc

SEQ ID NO: 444807 - RNA, 60 nt, hsa
gugggagaaaagccauauaaaugugagaagugugggaagggcuuuggcugggccucaacu

SEQ ID NO: 444808 - RNA, 64 nt, hsa
ccacagcagagaaaaaccauucaaauaugagaacugugggaagagcuuuguacauagaucauau

SEQ ID NO: 444809 - RNA, 64 nt, hsa
ucacacuggagaaagaccuuuugaaugcagcauuugugggaaauccuuuagaugucgcuccaca

SEQ ID NO: 444810 - RNA, 64 nt, hsa
ucacacuggugaaaggccuuaugaguguagugaaugugggaaauucuuuaggcacaacucaaau

SEQ ID NO: 444811 - RNA, 64 nt, hsa
ucacacuagggaaagaacuuacaaaugcagcaaaugugggaaauuuuuuauggacagcuccaca

SEQ ID NO: 444812 - RNA, 64 nt, hsa
ucauacuggagaaaagccuuaugagugcagugaaugugggaaagucuuuagauacaacuccagc

SEQ ID NO: 444813 - RNA, 51 nt, hsa
gaagaguucaugugcagugaaugugggaaauuauuuugucacuuuuuuuuu

SEQ ID NO: 444814 - RNA, 64 nt, hsa
caaacauccauggauuucccauaaauuugagguaugugggaagcauguguagcuauguuguacu

SEQ ID NO: 444815 - RNA, 64 nt, hsa
ucacacuagagaaaggccuuaugaauguagugaaugugggaaauccuuuagcuuaagguccaac

SEQ ID NO: 444816 - RNA, 64 nt, hsa
aguucauacuggagaaaggcaugagugcgggcagugugggaaauccuuuagccgaaaaucuagc

SEQ ID NO: 444817 - RNA, 64 nt, hsa
ucacacuggagaaaggccuuaugagugcagugacugugggaaauccuuugcugaaaacuccagc

SEQ ID NO: 444818 - RNA, 64 nt, hsa
gucauacaucaaauagcugcauacauuccagguaugugggaacugcauaguauuuuucgaccug

SEQ ID NO: 444819 - RNA, 62 nt, hsa
auacuggagagaaaccuuaggagugcagucauugugggaaagcuuucauccagaggucuccc

SEQ ID NO: 444820 - RNA, 64 nt, hsa
auauccuggagaaaagcccuacgaaugcauugauugugggaaagccuucaaugaucgcucaacc

SEQ ID NO: 444821 - RNA, 64 nt, hsa
gcacacugcaaagaaacaguaugaauguaaaaaaugugggaaaacauacauuacucuugcaggu

SEQ ID NO: 444822 - RNA, 64 nt, hsa
ucauacuggagagaaacccuacaaauguaaggaaugugggaaagccuuuuauuguugcaguucu

SEQ ID NO: 444823 - RNA, 64 nt, hsa
ucacacugcacagaaacacuaugaauguaaacugugugggaaaacuuacuugucuccuuuaggu

SEQ ID NO: 444824 - RNA, 64 nt, hsa
ucauacuggagagaaacccuacaaaugcaaggaaugugggaaagccuucaguuaccacuguacu

SEQ ID NO: 444825 - RNA, 64 nt, hsa
ucacacuggagaaaaacccuaugaauguaaaaaaugugggaaaguguucguauaucacaacucu

SEQ ID NO: 444826 - RNA, 64 nt, hsa
ucauacuggagagaaacccuacaaauguaaggaaugugggaaacccuucauuuaccgccauucu

SEQ ID NO: 444827 - RNA, 64 nt, hsa
acacagugcagggauagucuacaaauguaaggccugugggaaagccuucaguugucaacguucu

SEQ ID NO: 444828 - RNA, 64 nt, hsa
ggaauauggagagaagccauauaaauguaagaaaugugggaaacccuucaguuaucugcagucu

SEQ ID NO: 444829 - RNA, 64 nt, hsa
gauccuucacagaaaaaacucuacagagacgugaugugggaaaccuucaggaaccuggccacua

SEQ ID NO: 444830 - RNA, 64 nt, hsa
cucacacuggagagaugcuguaugauauaaggaaugugggaaagugaucgauuuuuuuuuaaca

SEQ ID NO: 444831 - RNA, 64 nt, hsa
aacuuacacuggacagaaacccuauaaauguaaaugugggaaagccuuucauaauuuuuauucc

SEQ ID NO: 444832 - RNA, 64 nt, hsa
acucauuggaaagauacucuauaaauguguggaaugugggaaagcauucauuaauuuuauuuua

SEQ ID NO: 444833 - RNA, 64 nt, hsa
ucauaugggagagaagccauaugaauguaaauaaugugggaaagcauuugguuguuuccaguac

SEQ ID NO: 444834 - RNA, 64 nt, hsa
gacucacacuagggagaaaaucuauaaauguaaaugugggaaagccuuuagugaucuuuauucc

SEQ ID NO: 444835 - RNA, 64 nt, hsa
cacacuggagauggaccucacaaaaugcaagauaugugggaaagccuuuguuuauuucauugga

SEQ ID NO: 444836 - RNA, 64 nt, hsa
cacuggagagaagaaacucuaugaaugcaagcagugugggaaagcguuaucucauagcucaagc

SEQ ID NO: 444837 - RNA, 64 nt, hsa
gcacacuagagauggaccucauaaauguaagauaugugggaaaggcuuugauuguuccaguaca

SEQ ID NO: 444838 - RNA, 64 nt, hsa
ucacagugcagagaaaccccaugaauguaagcaaugugggaaagcauuugaucaucugggaagc

SEQ ID NO: 444839 - RNA, 64 nt, hsa
ucacacuggagagaaacucuguacauguaaacaaugugggaaagccuucagugcuuccacuucc

SEQ ID NO: 444840 - RNA, 64 nt, hsa
gcagcauggagauggaccuuauaaauguaaguugugugggaaagcauuuuucuggcccaguuua

SEQ ID NO: 444841 - RNA, 64 nt, hsa
ucacauugcagagaaacuucagaaauauaagaaaugugggaaacacuuuuaccugucccucagc

SEQ ID NO: 444842 - RNA, 64 nt, hsa
ucauacuggugagaaacccuaugaguuuaaggaaugugggaaggccuuugcuuguuuccuaccu

SEQ ID NO: 444843 - RNA, 64 nt, hsa
ucacaaaggagagaaacccuaucaguguaaagaaugugggaagguuuuuaauaauuauccaacu

SEQ ID NO: 444844 - RNA, 64 nt, hsa
ucacaguggggagaaacccuaugaauguaaugaaugugggaaugccuucauuuguuuuuuugau

SEQ ID NO: 444845 - RNA, 64 nt, hsa
uuuuaggaaagugucuaugauauauagugaaaagugugggaaaagaauauagaaauaauauuca

SEQ ID NO: 444846 - RNA, 64 nt, hsa
auguaguuggaagaacuacuauaaaaacaauauaugugggaaaacuuccagcccucuguuaauu

SEQ ID NO: 444847 - RNA, 64 nt, hsa
aaauuugucaaaacuaggugagaaaauagagcauugugggaaaaacugaguccaacuagauuag

SEQ ID NO: 444848 - RNA, 64 nt, hsa
acuucuaguccaaauauaagaaacugucauguuuugugggaaaauaauuuuauaauccauuuaa

SEQ ID NO: 444849 - RNA, 64 nt, hsa
uggacuccaacaagcaugugacugugagauugugugugggaaaauguauuuaacuacucugugu

SEQ ID NO: 444850 - RNA, 64 nt, hsa
uauugugccagggauggggaaaugggggggguugugugggaagaguacuuauuauuguguuuuc

SEQ ID NO: 444851 - RNA, 64 nt, hsa
uuuguuacagaaaugaucccagagaccuacaagaugugggaaucagcauaacagggcaaugcag

SEQ ID NO: 444852 - RNA, 64 nt, hsa
acaaaauggauuaauugggugagccuuggagacaugugggaaacaccugcagacacaaaaugag

SEQ ID NO: 444853 - RNA, 64 nt, hsa; identical to SEQ ID NO: 414846

SEQ ID NO: 444854 - RNA, 64 nt, hsa; identical to SEQ ID NO: 414847

SEQ ID NO: 444855 - RNA, 64 nt, hsa; identical to SEQ ID NO: 414848

SEQ ID NO: 444856 - RNA, 64 nt, hsa; identical to SEQ ID NO: 414849

SEQ ID NO: 444857 - RNA, 64 nt, hsa; identical to SEQ ID NO: 414850

SEQ ID NO: 444858 - RNA, 64 nt, hsa; identical to SEQ ID NO: 414851

SEQ ID NO: 444859 - RNA, 64 nt, hsa; identical to SEQ ID NO: 414852

SEQ ID NO: 444860 - RNA, 64 nt, hsa; identical to SEQ ID NO: 414853

SEQ ID NO: 444861 - RNA, 64 nt, hsa; identical to SEQ ID NO: 414854

SEQ ID NO: 444862 - RNA, 64 nt, hsa; identical to SEQ ID NO: 414855

SEQ ID NO: 444863 - RNA, 64 nt, hsa; identical to SEQ ID NO: 414856

SEQ ID NO: 444864 - RNA, 64 nt, hsa; identical to SEQ ID NO: 414857

SEQ ID NO: 444865 - RNA, 64 nt, hsa; identical to SEQ ID NO: 414858

SEQ ID NO: 444866 - RNA, 64 nt, hsa; identical to SEQ ID NO: 414859

SEQ ID NO: 444867 - RNA, 64 nt, hsa; identical to SEQ ID NO: 414860

SEQ ID NO: 444868 - RNA, 64 nt, hsa; identical to SEQ ID NO: 414861

SEQ ID NO: 444869 - RNA, 64 nt, hsa; identical to SEQ ID NO: 414862

SEQ ID NO: 444870 - RNA, 61 nt, hsa; identical to SEQ ID NO: 414863

SEQ ID NO: 444871 - RNA, 64 nt, hsa; identical to SEQ ID NO: 414864

SEQ ID NO: 444872 - RNA, 64 nt, hsa; identical to SEQ ID NO: 414865

SEQ ID NO: 444873 - RNA, 64 nt, hsa
aauaccaaauuaauuuugaaugcuuuuguuuccuaagagauaauggcaugguuucauauguuau

SEQ ID NO: 444874 - RNA, 64 nt, hsa
auguucugaacaaacuugaaugaugaaaguauuaaagagauaucaguauuugagguuuguauuu

SEQ ID NO: 444875 - RNA, 64 nt, hsa
uguuccaaggccagggacaguaauaagaauggaaaagagauaugggaacacuggcagacugugu

SEQ ID NO: 444876 - RNA, 64 nt, hsa
agaaagggacaaugauaguagagugauauggagcaagagauauuuugggcaugugggcuucaac

SEQ ID NO: 444877 - RNA, 64 nt, hsa
accaccucugaagaaguucaaaaaaaauuauaugaagagauaaaccaaguuuuuggaaaugguc

SEQ ID NO: 444878 - RNA, 64 nt, hsa
aucaucaagggaagaagcuuggaucacugucucaaagagauauuaaaauuuuauacauuuaaaa

SEQ ID NO: 444879 - RNA, 64 nt, hsa
uccaucuuucuccuuucuuccagcacacacagcuaagagauaagaaggcugcaaggauugggga

SEQ ID NO: 444880 - RNA, 60 nt, hsa
ccugccuugucguucgguaaugagacuagaaagagauacacuguaaaggagggggaaggg

SEQ ID NO: 444881 - RNA, 64 nt, hsa
auugugaauuagaaacauuuuuaaaaguuuuugaaagagauaagugcaucaugaauuacaugua

SEQ ID NO: 444882 - RNA, 64 nt, hsa
uguuuguuuuagaaaaguuacaguaaaaauuaaaaagagauaccaaugguuuacacuuuaacaa

SEQ ID NO: 444883 - RNA, 64 nt, hsa
auaggguauugguaaagaaacggucaacauucuaaagagauacagucugaccuuuacuuuucuc

SEQ ID NO: 444884 - RNA, 64 nt, hsa
cuuuguuucauuguucugucaauaauuguuaccaaagagauaaaaauaaaagcagaauguauau

SEQ ID NO: 444885 - RNA, 64 nt, hsa
cuucagauagagggugguauucugguaaagaagaaagagauaagggacgcuaccuugcuuuucu

SEQ ID NO: 444886 - RNA, 64 nt, hsa
uucugguuuuuagcccuuucucugcacuaccaacaagagauaaaauuguuacucacacuuaugu

SEQ ID NO: 444887 - RNA, 64 nt, hsa
agagaccauaaaugacaagguuuugacauuuuugaagagauaauaaauguuuuaauuuggcagu

SEQ ID NO: 444888 - RNA, 64 nt, hsa
aagaauaaagccaucauaagaccucaugccacagaagagauaaaagugcuuuuuauaccaucca

SEQ ID NO: 444889 - RNA, 63 nt, hsa
ucuugaacaccugaggccuuccuggugcccaccaggcacuacggcuuccucuccagaaugugg

SEQ ID NO: 444890 - RNA, 63 nt, hsa
cccugacagacauccagccccuaguaauacuuaaggcacuauggcacuuagcuuugaagugac

SEQ ID NO: 444891 - RNA, 63 nt, hsa
uucaguuaggcugcacaaguaacauuaccuaaaaggcacuaacaugcucagguuccccagaaa

SEQ ID NO: 444892 - RNA, 63 nt, hsa
aggacucuggagccagaguagaggcuguggcccaggcacuaccugcuggcucccaccuauggu

SEQ ID NO: 444893 - RNA, 63 nt, hsa
uauuugguauuaaacuccaaaugagccauaggaaggcacuacaugaaauaaugcacugaguau

SEQ ID NO: 444894 - RNA, 63 nt, hsa
caggugagggucuucuggacucuaagacgguaaaggcacuaaagucacuuuaaagcuuuugga

SEQ ID NO: 444895 - RNA, 63 nt, hsa
uuguccaauguauuuguuucucagaccuugccuaggcacuaaaaauaaaauacuaggucauug

SEQ ID NO: 444896 - RNA, 63 nt, hsa
cauggcucuaaaaaguuuugcccuuuuuaaggaaggcacuaaaaagagcuguccugguaucua

SEQ ID NO: 444897 - RNA, 63 nt, hsa
aaauguaauguugauuccucaagaaugaaaugaaggcacuacauugaaauauguuuuguauaa

SEQ ID NO: 444898 - RNA, 63 nt, hsa
aggucaggauuagacuucaggcauucauaaggcaggcacuaucagaaaguguacgccaacuaa

SEQ ID NO: 444899 - RNA, 63 nt, hsa
ugguagauccaugugcaugcuagaauuugggacaggcacuauuugcauaaaguauuaaaguca

SEQ ID NO: 444900 - RNA, 63 nt, hsa
ucaaaagugaagaaaaaguuaguucauaaguaaaggcacuaaauccuuuccugacaauggcag

SEQ ID NO: 444901 - RNA, 63 nt, hsa
uaugaacggaugccucaguguccaagauacaaaaggcacuacauagaaguuugcuuuuucccu

SEQ ID NO: 444902 - RNA, 63 nt, hsa
ccaccaguucugccuggcuuccuccauccccagaggcacuaaaagcaguauuuuaagguuggu

SEQ ID NO: 444903 - RNA, 63 nt, hsa
caaagucggcugcaacauugguuauggaguauaaggcacuaaccucugcuuggacaaguuucu

SEQ ID NO: 444904 - RNA, 63 nt, hsa
caggggaugagaaguuuucaagggguauuacucaggcacuaaccccaggaaagaugacagcac

SEQ ID NO: 444905 - RNA, 63 nt, hsa
ucucuauauguauguguucccaguugugggagcaggcacuaaugaaauccugugccuggaaug

SEQ ID NO: 444906 - RNA, 63 nt, hsa
guauuuaaaauguaaaauaaacuuuuaaaaagcaggcacuaauauauauuucuuccagccuuu

SEQ ID NO: 444907 - RNA, 63 nt, hsa
cgguggcccugucccucccaccucugugaccucaggcacuagccuuuggcucuggagacagcc

SEQ ID NO: 444908 - RNA, 63 nt, hsa
uaugugaaaagucgcccaaaaugcaaccuugaaaggcacuacugacuuuguucuuauuggaua

SEQ ID NO: 444909 - RNA, 63 nt, hsa
aaauauuuuaugguugaaaaaacacuagacagaaggcacuaaaaaagaagaaugaauuaaggg

SEQ ID NO: 444910 - RNA, 63 nt, hsa
cccgcuggccaggggcuccacacagacuaacguaggcacuauaaggaccagcccaaccccaug

SEQ ID NO: 444911 - RNA, 63 nt, hsa
aaugguauuugaauuaaauguucaucuaguguuaggcacuauaguauuuauauugaagcuugu

SEQ ID NO: 444912 - RNA, 63 nt, hsa
uugggggaagucuucugagaccacccagugaauaggcacuacccugggauucaagacagucuu

SEQ ID NO: 444913 - RNA, 63 nt, hsa
agagcacuuuuucuuuguuuagaauuaugagaaaggcacuagaugacuuuaggauuugcauuu

SEQ ID NO: 444914 - RNA, 63 nt, hsa
agguuguguguggaaggugaucuggcucuggacaggcacuaucuggguuuuggggggacgcua

SEQ ID NO: 444915 - RNA, 63 nt, hsa
cagcugagucaagcuuggaggucccugaaccagaggcacuaggauuaccccagggccaucugu

SEQ ID NO: 444916 - RNA, 63 nt, hsa
augucuguaaagcauauuuaccucuugggagauaggcacuauguaaauaagguaaaauuucug

SEQ ID NO: 444917 - RNA, 63 nt, hsa
caggggaaaagugccucauaguuaggaaaguuuaggcacuaguugggaguaauauucaauuaa

SEQ ID NO: 444918 - RNA, 63 nt, hsa
cuuauucugaagugaccacuuuucuucucuuugaggcacuaccuggcagcaccaucuaaaccu

SEQ ID NO: 444919 - RNA, 63 nt, hsa
aucuaauugcuaacaaaugcucuuugcugucucaggcacuacaugucauugaucuugccccca

SEQ ID NO: 444920 - RNA, 63 nt, hsa
gcuaaauaugugccuuccucagggcuguggggcaggcacuagggggccuuucccuuccuuucc

SEQ ID NO: 444921 - RNA, 62 nt, hsa
aaacuguucagcaaagguagucauuagggagcaggcacuaccacuaagauaucccagaagaa

SEQ ID NO: 444922 - RNA, 63 nt, hsa
uucugggggagacaugcucuccccacaggggggaggcacuaagucaugguccuggcuggaagg

SEQ ID NO: 444923 - RNA, 63 nt, hsa
uaaaauguuuaaaaacaaaacaaaacaaaaaagaggcacuagucuaucugcaauuacucaacg

SEQ ID NO: 444924 - RNA, 63 nt, hsa
gguucuccuugcugugugugacacagcagacagaggcacuauuccuggugcaguauuucaggg

SEQ ID NO: 444925 - RNA, 63 nt, hsa
acaaacaaagcuauuggguguccaugauauaccaggcacuaugcuagguguugagaauguaaa

SEQ ID NO: 444926 - RNA, 63 nt, hsa
caaguacuucugcugaaacaaauuuauuuggcuaggcacuaaguuguuuuccagugaauagua

SEQ ID NO: 444927 - RNA, 63 nt, hsa
cuaauagggcagucgccagaaguagaccugucuaggcacuaagggaguuuggggaaagccaaa

SEQ ID NO: 444928 - RNA, 63 nt, hsa
cucagcuaugaaaugaccuccagggaaucagaaaggcacuaaugauguuaguaacuuuuagug

SEQ ID NO: 444929 - RNA, 63 nt, hsa
uuccuuuauuucuggcucacagaggcagccacgaggcacuacaccaaguauuauauaaaagcc

SEQ ID NO: 444930 - RNA, 63 nt, hsa
ucucuuuagcccucuuccugcacuugggagcaaaggcacuaccaguagagaagggccauccag

SEQ ID NO: 444931 - RNA, 63 nt, hsa
agagggugccggggaagggaguccgcccuguccaggcacuagaggcucccuugacguuuggca

SEQ ID NO: 444932 - RNA, 63 nt, hsa
uuuaggccuuuuuuuaaaaaaucaggguauaguaggcacuaaguuuuauuaggaaauauuuaa

SEQ ID NO: 444933 - RNA, 63 nt, hsa
auucacuucuuuuuaaaguaucuacuguguaacaggcacuaugcuauucucugaaagaugcag

SEQ ID NO: 444934 - RNA, 63 nt, hsa
aggcaacuuuaucaguaucaauggaaaaaugauaggcacuacaaugaaauggcaggaugccaa

SEQ ID NO: 444935 - RNA, 63 nt, hsa
gauuguguguauguauguuuaauauaacaugacaggcacuaggacgucugccuuuuuaaggca

SEQ ID NO: 444936 - RNA, 63 nt, hsa
caacaaagauguacucuuaaacucaguaucaccaggcacuauauuucaucuuugaggcuuuug

SEQ ID NO: 444937 - RNA, 63 nt, hsa
uacacgauucuuauuuuauaagaaacagcugagaggcacuauggauuagucuucugaagugaa

SEQ ID NO: 444938 - RNA, 63 nt, hsa
uucuuacaauaacuaaaccacuuaaaaugaucaaggcacuaauguuuuggucugaaaagcugu

SEQ ID NO: 444939 - RNA, 63 nt, hsa
gccuucugcaagccaagugguucugcaaggucaaggcacuaguaucagauggcaagcucagug

SEQ ID NO: 444940 - RNA, 63 nt, hsa
aaauguggauaauaacuaccaauaaacuacuugaggcacuaggagaacaguauuugacuuuga

SEQ ID NO: 444941 - RNA, 63 nt, hsa
auccucaggcuggcggccaaggccugccccuggaggcacuagaggagggcaucugucuguggg

SEQ ID NO: 444942 - RNA, 63 nt, hsa
ugauggggacgggguccaggagggccacugggaaggcacuauccagaaauaguggacagaggu

SEQ ID NO: 444943 - RNA, 63 nt, hsa
agcuccccgcccuaaaaggaggcagugaggaccaggcacuauuuccuccgagguuacuucuac

SEQ ID NO: 444944 - RNA, 63 nt, hsa
ucugaugcuguuuuuguuccaaauauaaacgaaaggcacuagucagccgccugcauagacuuu

SEQ ID NO: 444945 - RNA, 63 nt, hsa
cucagaagcccuucugaugcucuucagugagggaggcacuaccauuugaagugaccccauguc

SEQ ID NO: 444946 - RNA, 63 nt, hsa
cauucaagaaaucauuauugagucaccauugacaggcacuauucuaaucaguaguucacuuua

SEQ ID NO: 444947 - RNA, 63 nt, hsa
aagguaaacauggagacuuaaacauaaagaaauaggcacuauacaauggggacauaaaaaaag

SEQ ID NO: 444948 - RNA, 63 nt, hsa
ucaaggacuucugaggagccugguaccuugcauaggcacuauggacccuguuuugcuuaaccc

SEQ ID NO: 444949 - RNA, 63 nt, hsa
auuuucugccuccaucccacccaugagggcugcaggcacuacaaaagagcugacuacugagaa

SEQ ID NO: 444950 - RNA, 63 nt, hsa
uggaggauucuuugguaucuuacuguuugguuaaggcacuaauuuuacuuaccuauuagauuu

SEQ ID NO: 444951 - RNA, 63 nt, hsa
uucauuuucucauuaacgauaaaauaugcuguaaggcacuauaagaauauaaaugauucuauu

SEQ ID NO: 444952 - RNA, 63 nt, hsa
caaagcccugagaagaauauuucuuuggaccccaggcacuaggggccaccugccugggagucu

SEQ ID NO: 444953 - RNA, 63 nt, hsa
uuugcccccgacggcugugacgcagccggagggaggcacuagucaccgacagcggccuugaag

SEQ ID NO: 444954 - RNA, 63 nt, hsa
uaggguuaaaucauuuaagguccuuuuauaggcaggcacuaguaacuaaaacugaaaacuaag

SEQ ID NO: 444955 - RNA, 63 nt, hsa
aggaguguaaggaaacaucauguuuaccugugcaggcacuaguccuuuacagaugaccaugcu

SEQ ID NO: 444956 - RNA, 63 nt, hsa
agcagugugaagaagcuugguguauaccugugcaggcacuaguccuuuacagaugacaaugcu

SEQ ID NO: 444957 - RNA, 63 nt, hsa
aggaguguuaagaagcaucguguuuaccugugcaggcacuaguccuuuacagaugaccauucu

SEQ ID NO: 444958 - RNA, 63 nt, hsa
agcaguguaaagaagugucguguauaccugugcaggcacuaguccuuuacagaugaccauucu

SEQ ID NO: 444959 - RNA, 63 nt, hsa
aggaguguaaagaagcaucguguuuaccugugcaggcacuaguccuuuacagaugaccaugcu

SEQ ID NO: 444960 - RNA, 63 nt, hsa
agcaguguaaagaagcgucguguauaccugugcaggcacuaguacuuuacagaugaccaugcu

SEQ ID NO: 444961 - RNA, 63 nt, hsa
aggaguauuaaucaacauuguauucagcucuuaaggcacuagucccuuacagaggaccaugcu

SEQ ID NO: 444962 - RNA, 63 nt, hsa
gcagugcaggggaccuguguggggugugaaccaaggcacuacugccaccugccacaguaaagc

SEQ ID NO: 444963 - RNA, 63 nt, hsa
uagaaguaaucaaguagcaucugagacuguuggaggcacuagggccucucugggcccuacagc

SEQ ID NO: 444964 - RNA, 63 nt, hsa
aagauacuuguagcugucugugauuuacgaguuaggcacuacaucuccauuuucagacugagg

SEQ ID NO: 444965 - RNA, 63 nt, hsa
guuuucaucuguaaauaguuaaguauguacacgaggcacuacuucugauuuauugcaauguuc

SEQ ID NO: 444966 - RNA, 63 nt, hsa
caucacaggucaaguugaagucauucucuguuuaggcacuaaaaaucgguguugucacucacu

SEQ ID NO: 444967 - RNA, 63 nt, hsa
aaaaaaaaaaacaaaaaaacuagacaaggagagaggcacuagaacuccagcuggaagucacgg

SEQ ID NO: 444968 - RNA, 63 nt, hsa
caaggagagggcggugacauauuggaccagaagaggcacuagccauuuuaaggagaggaaaga

SEQ ID NO: 444969 - RNA, 63 nt, hsa
cagggacuuguguacugguuaugggggugccagaggcacuaggcuugggguggggaggucccg

SEQ ID NO: 444970 - RNA, 63 nt, hsa
aaggaggagguccuccgugguacauacugggucaggcacuagcauggaggagggucacagagu

SEQ ID NO: 444971 - RNA, 63 nt, hsa
auuggcacagaccaguuucagagaaauacuuucaggcacuaagacuaaucgaaugaacaaagu

SEQ ID NO: 444972 - RNA, 63 nt, hsa
aaaaaaagaaauuugaugcccagauaauauauuaggcacuacugauuuuuuaguuaaauugau

SEQ ID NO: 444973 - RNA, 63 nt, hsa
aaauugcaauccagcacacgugugagaaagaagaggcacuagucuaaaaggcugcauugcggg

SEQ ID NO: 444974 - RNA, 63 nt, hsa
uuaacuagguuuacaacugguggaccacacaccaggcacuaaucaccuggugaggauuuggca

SEQ ID NO: 444975 - RNA, 63 nt, hsa
gaguaaggggauuuggaaacugucaacuuacaaaggcacuauaacaauuacagaaucaugauu

SEQ ID NO: 444976 - RNA, 63 nt, hsa
ggggcugaggucaggaguauaaguaccugccuuaggcacuauuccuuauauaacaaaaauauu

SEQ ID NO: 444977 - RNA, 63 nt, hsa
gccuauuugaaugacaaaggugccaguagugccaggcacuacacagagaggaaguggauuugu

SEQ ID NO: 444978 - RNA, 63 nt, hsa
aucucacacugcaccaagcacccacugugcaccaggcacuaagucucuagccucuuucucccu

SEQ ID NO: 444979 - RNA, 63 nt, hsa
cuccucuccacgucccagaacuggcccagcugcaggcacuaagaagcuccuccccugagacaa

SEQ ID NO: 444980 - RNA, 63 nt, hsa
aggggacccccagaaacaggagucaggaaaaugaggcacuaagccuaagaaguucccugguuu

SEQ ID NO: 444981 - RNA, 63 nt, hsa
ucgucugcauuccagcaaaaauaucaacucguaaggcacuaguacaguuaaacugacaucuua

SEQ ID NO: 444982 - RNA, 63 nt, hsa
augacagaggaggcucaagggaagagauugcccaggcacuaccacucugcucacauguucccc

SEQ ID NO: 444983 - RNA, 63 nt, hsa
ugacggacuagaagacuguaaauaagauaccaaaggcacuauuuuagcuauguuuuucccauc

SEQ ID NO: 444984 - RNA, 63 nt, hsa
cucaguuucucugucuguaccuauuuaagccaaaggcacuagccugaauuuugcuugaagauc

SEQ ID NO: 444985 - RNA, 63 nt, hsa
ugacgcugagagagaaccaucauaccccaagccaggcacuagauuuuggagggggcgacuacc

SEQ ID NO: 444986 - RNA, 63 nt, hsa
aaauaaguauguauugagugccuacucugugcaaggcacuaugcuagaucuggugccuagaag

SEQ ID NO: 444987 - RNA, 63 nt, hsa
uuuguucucuuuuugggugauuaaaaaacugacaggcacuauaauuucuguaacacacuaaca

SEQ ID NO: 444988 - RNA, 63 nt, hsa
uucugagaacaugugaaacuauguuaaaacugaaggcacuauauauuuuuacauaaaagcuug

SEQ ID NO: 444989 - RNA, 63 nt, hsa
uuauacucuuguuaucaaaauggcuuauuuuucaggcacuaaggauuguuaagagaaaagcuu

SEQ ID NO: 444990 - RNA, 63 nt, hsa
caacagauaguucagaaacacuuuuuaucugcaaggcacuauucuagauccagaagaugcaau

SEQ ID NO: 444991 - RNA, 63 nt, hsa
gaagaaaaauagccucaaucucccaccccauguaggcacuaccuccccaauuacccuuagaaa

SEQ ID NO: 444992 - RNA, 63 nt, hsa
uguauugcuuuaguaugcuggcuuguacauaguaggcacuaaauacauguuuguugguugauu

SEQ ID NO: 444993 - RNA, 63 nt, hsa
aaaaucaagugcuagacacacuggcugcuacuaaggcacuagccucuguagcuggugguggca

SEQ ID NO: 444994 - RNA, 63 nt, hsa
caggugcccccuccaggccugacuggcuccgccaggcacuaaccugccauaacccuuugugcu

SEQ ID NO: 444995 - RNA, 63 nt, hsa
auuucugucuacuaagugaugcugugauaccuuaggcacuaaagcagagcuaguaaugcuuuu

SEQ ID NO: 444996 - RNA, 63 nt, hsa
caugcaauuaaaacaaaacaaacacaaacaaggaggcacuaagccuauucugacaccacuggu

SEQ ID NO: 444997 - RNA, 63 nt, hsa
gcacaccaaagccuccuccccuccccacuuccuaggcacuaggaucucucuguggcuuccccu

SEQ ID NO: 444998 - RNA, 63 nt, hsa
acgugaugugcaccaccucgaucucgguguuucaggcacuaaagcaacaaaacaacccauagu

SEQ ID NO: 444999 - RNA, 63 nt, hsa
cugggcccucacucugccuaggggagcugggccaggcacuagccuuugcccagggaggugggc

SEQ ID NO: 445000 - RNA, 63 nt, hsa
gagcccucugcucacuggcacuuccugacucaaaggcacuaacagugcucaugugccuuccag

SEQ ID NO: 445001 - RNA, 63 nt, hsa
cccucccgaacccagggucaaccugccuaccacaggcacuagaaggacgaaucugccuacugc

SEQ ID NO: 445002 - RNA, 63 nt, hsa
uacuaagaaauauguacagcuaccccuguuuucaggcacuauguuugagaacauuuuagccau

SEQ ID NO: 445003 - RNA, 63 nt, hsa
gugggcaaggauggguccagaagaccccacuucaggcacuaagaggggcuggaccuggcggca

SEQ ID NO: 445004 - RNA, 63 nt, hsa
agauuagaucuucuugguucccugugagguuucaggcacuaaaacucuauguggggaagggag

SEQ ID NO: 445005 - RNA, 63 nt, hsa
cuucggaggaaaaaaguugcuauugcccguuaaaggcacuagaguuaguguuuuaucccuaaa

SEQ ID NO: 445006 - RNA, 63 nt, hsa
ggauguauguguauaaaaacagauucaagggaaaggcacuaaaugguuuuuuccucuggaaga

SEQ ID NO: 445007 - RNA, 63 nt, hsa
ucuguuccuguucugauauucugagcagagaaaaggcacuaacgguuccucuuagcuauuuaa

SEQ ID NO: 445008 - RNA, 63 nt, hsa
caggccucuacacuucugcuuacuggugugggcaggcacuaguggacgucagcuucuucauuu

SEQ ID NO: 445009 - RNA, 63 nt, hsa
gguccaagguccucaucccauccucccucugccaggcacuaugugucuggggcuucgauccuu

SEQ ID NO: 445010 - RNA, 63 nt, hsa
cccaggcugcggagaacccaggugggauccugaaggcacuagcugacagacgggccccucaau

SEQ ID NO: 445011 - RNA, 63 nt, hsa
gaacaaguuaccugucacauugaagaaaaggguaggcacuaaagggagaacacagaaagaaga

SEQ ID NO: 445012 - RNA, 63 nt, hsa
gucaucaagcaguuacugaucagauuaagaaucaggcacuagugauacacauucauuuuuaaa

SEQ ID NO: 445013 - RNA, 63 nt, hsa
ccaucaugcacuugcuaugugcaaggccuuuuuaggcacuagagauauagcagugaccaaaac

SEQ ID NO: 445014 - RNA, 63 nt, hsa
ugcccauuguaaaaacacauccacagacaguccaggcacuaaggcugaaugggaucaggguau

SEQ ID NO: 445015 - RNA, 63 nt, hsa
gccacugucacaagccggcaggcacuggugaggaggcacuaaggagacucugacuuuuauuuc

SEQ ID NO: 445016 - RNA, 63 nt, hsa
ccagcgggcugccccuccucugccuggauucccaggcacuaagcucagcugagggggguguuu

SEQ ID NO: 445017 - RNA, 63 nt, hsa
acgcacaaauggggagagaaguguuuauuuuguaggcacuaaggguuucuaaaacccuuaaca

SEQ ID NO: 445018 - RNA, 63 nt, hsa
acuuggaacagggcucagguggguggagcaguaaggcacuacccagagagcuugcugcugcgg

SEQ ID NO: 445019 - RNA, 63 nt, hsa
cuuguucuauccaggcccucaacaaauuggaugaggcacuaugcccugggaucauccuuacuc

SEQ ID NO: 445020 - RNA, 63 nt, hsa
aaaauuuuuguuugguuauaucgaaauaguuacaggcacuaaaguuaguaaagaaaaguuuac

SEQ ID NO: 445021 - RNA, 63 nt, hsa
ugcuacugaugcugucauguggaaacuauuuaaaggcacuauuauaaauuuauccuauaagau

SEQ ID NO: 445022 - RNA, 63 nt, hsa
agaaggcuuuucagcaccaucuaauguuuuaaaaggcacuaguuuuaagugcacagcucauaa

SEQ ID NO: 445023 - RNA, 63 nt, hsa
acugaaguagcucuagaaagacacauguauacaaggcacuauuguacacacuuugcugaauau

SEQ ID NO: 445024 - RNA, 63 nt, hsa
agcuagaccuugacaaauugguaggauuuggucaggcacuaggaguggagcaugagcucuggg

SEQ ID NO: 445025 - RNA, 63 nt, hsa
ugcauuauacuaagacaccauuaagaacaguugaggcacuacacuaaaucaaaccauaaauga

SEQ ID NO: 445026 - RNA, 63 nt, hsa
aacuuucccagugacuuccccuagcccugacccaggcacuaggccuuggugacuuccuggggc

SEQ ID NO: 445027 - RNA, 65 nt, hsa
ugccuaugggugacugccuucucccagaguuuucuuuggagaacagaaagaagaaaggaaagaaa

SEQ ID NO: 445028 - RNA, 65 nt, hsa
uaguuucugaaaccgcucagauguuuuggggaaaguuggagaagccguggccuugcgagaggugg

SEQ ID NO: 445029 - RNA, 65 nt, hsa
gggacccgggcaggcccccagcaccccaugcugacuuggagaaccccagaucucuggggcccagc

SEQ ID NO: 445030 - RNA, 65 nt, hsa
cgcagacaccggggcuggguuucucuuuccucuuuuuggagaaaaggaacagggcaguggaauga

SEQ ID NO: 445031 - RNA, 65 nt, hsa
uaaacccuuuccuccucccauuuugacauuugcacuuggagaacacuugaguugugaagguuuug

SEQ ID NO: 445032 - RNA, 65 nt, hsa
ucuggaggggagagaaggauucuagggguguggaguuggagaaagaggcuuccuugagccacccu

SEQ ID NO: 445033 - RNA, 65 nt, hsa
uacauuaggaaacaauggcagucaaacccauggcuuuggagaaaguaaauguuugccagaaagga

SEQ ID NO: 445034 - RNA, 65 nt, hsa
ggugcuggugcggauggacacuaaugcagccacgauuggagaauacuuugcuucauaguauugga

SEQ ID NO: 445035 - RNA, 65 nt, hsa
uaucagagcaaacaucauguagauagcacaaguauuuggagaaacguuguuuguuuuguuaccaa

SEQ ID NO: 445036 - RNA, 65 nt, hsa
aauaauuuaaaauaauuauuguauaauaucuacauuuggagaauuuugaacuaucaagcauauac

SEQ ID NO: 445037 - RNA, 65 nt, hsa
aagacgguaaaggcacuaaagucacuuuaaagcuuuuggagaagcaggagggcauuggcuuaacc

SEQ ID NO: 445038 - RNA, 65 nt, hsa
caaaucugaaggacuucaucucccgcuuugagggcuuggagaagaucucugccuacaugaagucc

SEQ ID NO: 445039 - RNA, 65 nt, hsa
uaccuggcauggacugauguuuuuaggcacagaaguuggagaagagauuucaugaaagacaacau

SEQ ID NO: 445040 - RNA, 65 nt, hsa
ucuguguuuucagaauuuccauuucuacuaaccucuuggagaaaaagaaauugaauuagagguaa

SEQ ID NO: 445041 - RNA, 65 nt, hsa
gcccuaaaagcuggagacacagauguccagagugauuggagaauguccugggggaaugaaguucc

SEQ ID NO: 445042 - RNA, 65 nt, hsa
uuucccugaggcuuuggggucagaguauauguuguuuggagaaagagggcaaucaggacucuucu

SEQ ID NO: 445043 - RNA, 65 nt, hsa
uuucuggccuggcuuucccucucagacauagcucuuuggagaacuagguguuguaauucaguuau

SEQ ID NO: 445044 - RNA, 65 nt, hsa
acauugucaaaacuaccaauuccagguuaacuuuguuggagaauuucccccacccccauccagug

SEQ ID NO: 445045 - RNA, 65 nt, hsa
cugcugguuccccagcccuuuucccuggcccuggcuuggagaaucuguuuucaaucuccacugau

SEQ ID NO: 445046 - RNA, 65 nt, hsa
acuuggaggcaggauccaggcacagcuccccucacuuggagaaccuugacucucuugauggaaca

SEQ ID NO: 445047 - RNA, 65 nt, hsa
aauaaaacacugucuuuucaggauugcuucauggauuggagaacuuucuaaccaaaaauuaaaaa

SEQ ID NO: 445048 - RNA, 65 nt, hsa
uagacuuaguaccagaaccaaaaauaccuagauuuuuggagaacuuauuacauacauagaaacau

SEQ ID NO: 445049 - RNA, 65 nt, hsa
agaacccagccuacucuagaauuucagcagugacauuggagaauauuuuuaauuugcugcaguac

SEQ ID NO: 445050 - RNA, 55 nt, hsa
gcuacacaccccagccuuaagucucuuggagaagcuggugcugugagccagagga

SEQ ID NO: 445051 - RNA, 65 nt, hsa
gggcaaggagagaagugagagcuacaauuccagcauuggagaagcgaggggcggggcgucaacgg

SEQ ID NO: 445052 - RNA, 65 nt, hsa
caggggcuaguuuggcuuuuccaaguggguuuucuuuggagaaucugaugccaugcaauuggcau

SEQ ID NO: 445053 - RNA, 65 nt, hsa
uugucguagacuugugcaauauauacuguuguggguuggagaaaaguggaaagcuacacugggaa

SEQ ID NO: 445054 - RNA, 65 nt, hsa
cugguaggcaaauuguuaggcagaauaaugguauguuggagaaauacaccugucucuuauucuua

SEQ ID NO: 445055 - RNA, 65 nt, hsa
uaccuuugguaaauacaccauaccauaauaucugcuuggagaaccacaaugcacauuagcauauu

SEQ ID NO: 445056 - RNA, 65 nt, hsa
uaauuaacuagcauuuagccagcuuuuucuugcccuuggagaaaaagaaucauucucaaccugau

SEQ ID NO: 445057 - RNA, 65 nt, hsa
cuuuuauuuuaauacauuguaggaaaucuucauaauuggagaaaguucugcagcauggcuuuuua

SEQ ID NO: 445058 - RNA, 65 nt, hsa
gcuguggcuccauauuucaacuaaaaauauaucuguuggagaaagaaauuaacaauaaagaauuu

SEQ ID NO: 445059 - RNA, 65 nt, hsa
gucauuagaaacaauugguuaaugggggagccuaauuggagaaugaugcugagaauuuguauuga

SEQ ID NO: 445060 - RNA, 65 nt, hsa
gccaaggcggcggcagagcuggucuucuggucuccuuggagaaagguucuguugcccugauuuau

SEQ ID NO: 445061 - RNA, 65 nt, hsa
uauaaaacagacuuacucuccuuggaggauauauuuuggagaaugcuucauaaaaucuaugaaua

SEQ ID NO: 445062 - RNA, 65 nt, hsa
auguacgcaaagggcagccccaggcugucuggaaguuggagaauucccuaucagcacagggaucu

SEQ ID NO: 445063 - RNA, 65 nt, hsa
cuaggaaagacauguaagagcauggacauuuuacuuuggagaaacagaaaaaucuuggggcuucc

SEQ ID NO: 445064 - RNA, 65 nt, hsa
acgcuuuuuggaagacauuucuguagcaugucaguuuggagaaaugaugagcuacgccuugauga

SEQ ID NO: 445065 - RNA, 65 nt, hsa
uuccugaguuaaaagucuauuuauuuacuuccuuguuggagaagggcaggagaguaccugggaau

SEQ ID NO: 445066 - RNA, 65 nt, hsa
ggcuccagguggaagcaugcuuucccuuguuacuguuggagaaacucaaaccuucaagcccuagg

SEQ ID NO: 445067 - RNA, 65 nt, hsa
auuccauagaaaacuguagaaagauaucuguaucuuuggagaaggagaaagaaaggaaagaacuc

SEQ ID NO: 445068 - RNA, 65 nt, hsa
guuauaguuuuauaacuggcuuaaguuaaguuuuauuggagaaaucuugccuauaauucuauaaa

SEQ ID NO: 445069 - RNA, 65 nt, hsa
ucuuuuuacuguugaacuuagaacuaugcuaauuuuuggagaaaugucauaaauuacuguuuugc

SEQ ID NO: 445070 - RNA, 65 nt, hsa
ucaucccauccuugccaaaaaauaagaaaacugucuuggagaaugggucagaagccccaaacggc

SEQ ID NO: 445071 - RNA, 65 nt, hsa
uuuucuuggacuacuuuaauuuggauccuuuggguuuggagaaagggaaugugaaagcugucauu

SEQ ID NO: 445072 - RNA, 65 nt, hsa
auacaagccuuggguccauguuuacucucuucuauuuggagaauaagauggaugcuuauugaagc

SEQ ID NO: 445073 - RNA, 65 nt, hsa
aaaaaaugccuuuucauuggucuuaagagaccgcauuggagaauuucaggcuuuugauaaaugcu

SEQ ID NO: 445074 - RNA, 65 nt, hsa
ucccagagcugaggcaaggggauuucucaggucauuuggagaacaagugcuuuaguaguaguuua

SEQ ID NO: 445075 - RNA, 65 nt, hsa
aagugcuauguggcgagaaaaaaaguuuuaauguauuggagaaguuuuaaaaaacccagaaaaac

SEQ ID NO: 445076 - RNA, 65 nt, hsa
ugagaccaaagggauaucuguucccuguuaccuuuuuggagaauucauaacauuugaagaucaaa

SEQ ID NO: 445077 - RNA, 65 nt, hsa
guaggcacggacacacccagucucaaugcacgaaguuggagaaccugacagggcugguccaggcc

SEQ ID NO: 445078 - RNA, 65 nt, hsa
caggaaggcggcaggcagagaaguggagugacuauuuggagaauagcacccauaucugugugccc

SEQ ID NO: 445079 - RNA, 65 nt, hsa
auacacucuaucacauauuuaagcaaacaucacauuuggagaagaggaaaucauaaaaucauccu

SEQ ID NO: 445080 - RNA, 65 nt, hsa
cauguauauauuacucugcacuauaucccuucuuuuuggagaacuagccauuauuuuagccacag

SEQ ID NO: 445081 - RNA, 65 nt, hsa
cucuuccuguucugcaccccucuccccaugggaccuuggagaaaacugaacuguuacaaaccccu

SEQ ID NO: 445082 - RNA, 65 nt, hsa
ugaucaugagguuaaaauuuucuucauuaggggacuuggagaaccaguagucguaagauuaguug

SEQ ID NO: 445083 - RNA, 65 nt, hsa
uguaccagcagugugucaggugcugcagagcguucuuggagaaggcccacugaggcagguucgug

SEQ ID NO: 445084 - RNA, 65 nt, hsa
auaccuggcauagagaaaaauauauaccugguacauuggagaaaaauaauuacacuuucaaagag

SEQ ID NO: 445085 - RNA, 65 nt, hsa
ugguuguaaguggacaugcaaaccaaaauuggggauuggagaagucagacucacuagacuuuugg

SEQ ID NO: 445086 - RNA, 65 nt, hsa
uaaauuccugucaaaaucaauucagaaauucuaacuuggagaauuuaacauuuuacucuuguaaa

SEQ ID NO: 445087 - RNA, 65 nt, hsa
ucaucuugcaagcaaaucccauuucuugaaaagccuuggagaacucgguuugguagacuuggaca

SEQ ID NO: 445088 - RNA, 65 nt, hsa
ggcagugauuuuguuccaaaacuuuguauacacauuuggagaaaaguacuuuauauuuucagugu

SEQ ID NO: 445089 - RNA, 65 nt, hsa
ccugcaagaaauauacugacaugaacaggcaguucuuggagaagaaagagcauuucuuuaaguac

SEQ ID NO: 445090 - RNA, 65 nt, hsa
gcacuccagccugggcaacagagcaagacccugucuuggagaaaccagaauuuuggaagagcaaa

SEQ ID NO: 445091 - RNA, 65 nt, hsa
gugaguggcucuuugcaugaacacugugcaagguguuggagaaauccaaagcugaccaaaacaug

SEQ ID NO: 445092 - RNA, 65 nt, hsa
cuggccuucacgcucuugaucgucuuuccuuuguauuggagaaggacugggucagagaucuguug

SEQ ID NO: 445093 - RNA, 65 nt, hsa
aguguuuuuuacucuuuucucaugcacauguuacguuggagaaaauguuuacaaaaaugguuuug

SEQ ID NO: 445094 - RNA, 65 nt, hsa
agacugacaccucacugaggaagggagacauauucuuggagaacuuuccaucugcuuguauuuuc

SEQ ID NO: 445095 - RNA, 65 nt, hsa
agauaucaaguuuugaauauuauucaggaagcacuuuggagaaugugggaguccuacuguuuugc

SEQ ID NO: 445096 - RNA, 65 nt, hsa
ugggugagaagcaggcuggugagacugggcugagguuggagaaggggcagccgggggcacugcug

SEQ ID NO: 445097 - RNA, 65 nt, hsa
cucacuuuauucuuguauggcuuugguaggcauacuuggagaacauaucccacauuaggaauuga

SEQ ID NO: 445098 - RNA, 65 nt, hsa
agccugagaguuugagggcuuuaauccuuuaaaacuuggagaagcuggcugggcgcgguggcuca

SEQ ID NO: 445099 - RNA, 65 nt, hsa
gcauuuauuugaugacuuaauauuuuucacuaccuuuggagaacagaugaacauuauucaccaug

SEQ ID NO: 445100 - RNA, 65 nt, hsa
guucaauuagcaguucaaauuaaagaagaugguuauuggagaacuuuuuugaaugguuuuguauu

SEQ ID NO: 445101 - RNA, 65 nt, hsa
aaugcaucuuuuuuccucugccauucuuguguugauuggagaauuuuucuguauguaauuagaaa

SEQ ID NO: 445102 - RNA, 65 nt, hsa
guuucuggauuucauacuguaacauucaggaauucuuggagaaaauggguuuauucacugaacuc

SEQ ID NO: 445103 - RNA, 65 nt, hsa
ggcucggaaagccuuaagcaaagaugggaggauuuuuggagaauccaucaugauugguguaaaac

SEQ ID NO: 445104 - RNA, 65 nt, hsa
guccucucaaaacaaacacccucuugcaaccagcuuuggagaaagcccagcuccugugugcucac

SEQ ID NO: 445105 - RNA, 65 nt, hsa
cuggcuggcccuguaauuuaaauuaaaauaaaauuuuggagaaacagcauugucugucuuuauga

SEQ ID NO: 445106 - RNA, 65 nt, hsa
ugagggacacaaggacuugggugcaucaggacgccuuggagaagcguggcuuccugccacccugc

SEQ ID NO: 445107 - RNA, 65 nt, hsa
gugcagagagaggcaggaaggaucccugaagagucuuggagaaaagguucugugcccucaggugg

SEQ ID NO: 445108 - RNA, 65 nt, hsa
guaucugaaucacuggggauuaugauucacccucuuuggagaacaugcucucuuuucacccccca

SEQ ID NO: 445109 - RNA, 65 nt, hsa
ugcuuauauuuaucgcuuggcucaaguucugcccuuuggagaaauacugagcaagucuuucauuc

SEQ ID NO: 445110 - RNA, 65 nt, hsa
ugguuaaguauauaauaaauugaacaucuuugagauuggagaauuaugugagauuuccacauuau

SEQ ID NO: 445111 - RNA, 65 nt, hsa
cucagggccaugcugaggccugggccgcugccacguuggagaagcccgugugagaagugaaugcu

SEQ ID NO: 445112 - RNA, 65 nt, hsa
gggucugcgaugcagcggcgugaggccugggcugguuggagaaggucacaacccuucucuguugg

SEQ ID NO: 445113 - RNA, 65 nt, hsa
ucuugcacuacaccucuguugugaggacuaccauuuuggagaagguucuguuugucucuuuucau

SEQ ID NO: 445114 - RNA, 65 nt, hsa
gucuuuuccugugcuuacgggccaugcguauuucuuuggagaaaggucuauccagguccuuugcc

SEQ ID NO: 445115 - RNA, 65 nt, hsa
cacagaaauucuguugaagacaguugagaauuccuuuggagaaaacagcccagcuuggcgugggg

SEQ ID NO: 445116 - RNA, 65 nt, hsa
gugacgcuacuaaccugacaucaccaaguguggaauuggagaaaagcacaaucaacuuuucugag

SEQ ID NO: 445117 - RNA, 65 nt, hsa
auagaauuuuuaaauaguauauauucaguggcauuuuggagaacaaagugaauuuacuucgacuu

SEQ ID NO: 445118 - RNA, 65 nt, hsa
guguuuguuuuuaucaaaaugucaaaauaacauacuuggagaaguauguaauuuugucuuuggaa

SEQ ID NO: 445119 - RNA, 65 nt, hsa
uuuucuagagguuggcuuucaauucuguagcauacuuggagaaacugcauuaucuuaaaaggcag

SEQ ID NO: 445120 - RNA, 65 nt, hsa
gcaguguuccucaccaauaacuucagagaagucaguuggagaaaaugaagaaaaaggcuggcuga

SEQ ID NO: 445121 - RNA, 65 nt, hsa
cugguaccgucuaguacuaugcagcgguccucaaguuggagaaaaugugccuuucauucauuacc

SEQ ID NO: 445122 - RNA, 65 nt, hsa
agaauaugccugcucaaaauuaauagcacagcaguuuggagaagaaaugaaggugucaaagaguc

SEQ ID NO: 445123 - RNA, 65 nt, hsa
uuuggaaaaucacacaguuuucaggcuccaucuguuuggagaaaauacauucugaagcaucccca

SEQ ID NO: 445124 - RNA, 65 nt, hsa
gauggaaauggauuggauugucaaauuauuauuuauuggagaaaaaaaccugaucuacacauuuu

SEQ ID NO: 445125 - RNA, 65 nt, hsa
aaacuuaggaaauagugaauaaggugcauuuaacuuuggagaaauacuuuuauggcuuuggugga

SEQ ID NO: 445126 - RNA, 65 nt, hsa
gugguuuuugaacaggaaaaucauaauucauaucauuggagaaguauuuauuuucaaauaucaaa

SEQ ID NO: 445127 - RNA, 65 nt, hsa
gaggagucagagagaaucccuagucuucaagcagauuggagaaacccuugaaaagacaucaagca

SEQ ID NO: 445128 - RNA, 65 nt, hsa
cuaaaugaaaaggacacauucugaaaucccuuuuguuggagaauaagucagucugaggggaaaug

SEQ ID NO: 445129 - RNA, 65 nt, hsa
gaaauaaguccuagacuggacucuugagggacauauuggagaaucuuaagaaaugcaagcuuguu

SEQ ID NO: 445130 - RNA, 65 nt, hsa
uucccaggaaauuagcuuuccagccccuuuauauauuggagaaguuguuuuagcuucugcagaag

SEQ ID NO: 445131 - RNA, 65 nt, hsa
uacauuguucuugguuuuguuucucgaucuuuuguuuggagaacagcuggcuaaggaugacucua

SEQ ID NO: 445132 - RNA, 65 nt, hsa
guucauuuguuccuuggaccuuaaucauuugcauuuuggagaaaauuuuuucugcuuuaaaaguc

SEQ ID NO: 445133 - RNA, 65 nt, hsa
agaguuuaggaauucuacuagccagagauagucacuuggagaaacuuucuauauauccuucuaaa

SEQ ID NO: 445134 - RNA, 65 nt, hsa
aaaucuugaugucauuacuccugaauuauuacauuuuggagaauaagagggcauuuuauuuuauu

SEQ ID NO: 445135 - RNA, 65 nt, hsa
guuuugauccaagucaaguguagccucucagccuuuuggagaaaaaugaaacaauuuauuucaac

SEQ ID NO: 445136 - RNA, 65 nt, hsa
gugggcagagcccugacccacagcuguguuacugcuuggagaagcauauguaggggcauacccug

SEQ ID NO: 445137 - RNA, 65 nt, hsa
cuauuuaaaguugccugaagauuuugcugugguguuuggagaagcagagggugaacuugcuguug

SEQ ID NO: 445138 - RNA, 65 nt, hsa
agauuugcucagcuuuuugaaauguuaagauguguuuggagaaggcugcaugacuuuguuuuucc

SEQ ID NO: 445139 - RNA, 65 nt, hsa
ccuaggcagcagccaccuucucaggaaacaaggccuuggagaaaucagugccugugugaagaugg

SEQ ID NO: 445140 - RNA, 65 nt, hsa
agcuggaccuuccauucuagaauuaugagaccaccuuggagaaaggugugugguacaugacauug

SEQ ID NO: 445141 - RNA, 65 nt, hsa
uuucucuguuugccuuggguugaauaacuuaucuuuuggagaauagcuuuaaguggcuuagacac

SEQ ID NO: 445142 - RNA, 65 nt, hsa
acaaguuggaugacacuacucccaacuuuuuaaauuuggagaaaaccaucaaggucgaggaagcc

SEQ ID NO: 445143 - RNA, 65 nt, hsa
aagaaauugcuagauuacccaaagaaauagaucaguuggagaaaauacaaaacaauucaaagcuc

SEQ ID NO: 445144 - RNA, 65 nt, hsa
aguauuuaaaagaaauaccagugagugccuuaaaguuggagaaguaacugcccaugcccagaaau

SEQ ID NO: 445145 - RNA, 65 nt, hsa
augaauaaaaaauaauuuugcuguuguaguauacauuggagaaacuggcagguuuuauuuccauu

SEQ ID NO: 445146 - RNA, 65 nt, hsa
gucugaggguguacguuugauaugaucaugccagauuggagaagauccaagccaggaagaugggc

SEQ ID NO: 445147 - RNA, 65 nt, hsa
ggcaaagacacgggaacugaaaaacuccacaggguuuggagaauagaaaugaaaagccacgucau

SEQ ID NO: 445148 - RNA, 65 nt, hsa
acaagacuuugggcucuuaugucacaucacaugauuuggagaaauuagacacaaucucuuauuuu

SEQ ID NO: 445149 - RNA, 65 nt, hsa
uucaauuguccuucagauaauucauguggagauuuuuggagaaaccaugacggauaguuuaggau

SEQ ID NO: 445150 - RNA, 65 nt, hsa
ccuguacaguauuugcauuccacagauggaacgguuuggagaagcacuuuuucauacuuuuguga

SEQ ID NO: 445151 - RNA, 57 nt, hsa
aucccuuccauuuuguuuaaauugggcuuggagaaucuauucugaaaacauugacuc

SEQ ID NO: 445152 - RNA, 65 nt, hsa
guucagucugaaaugcagcucccuguccaagugccuuggagaacucacagcagcacgccuuaauc

SEQ ID NO: 445153 - RNA, 65 nt, hsa
ccugaagcacauacaagcacccugguggaagaagcuuggagaagaaucuggagaugagauugaug

SEQ ID NO: 445154 - RNA, 65 nt, hsa
ugccugggcuguggaccuacugggcauuugaggaauuggagaauggagauggcaagagggcaggc

SEQ ID NO: 445155 - RNA, 65 nt, hsa
cgaugccaaguacaccugcaaggcugucaacagucuuggagaagccaccugcacagcagagcuca

SEQ ID NO: 445156 - RNA, 65 nt, hsa
gcuugccaaaaaaaaaaaaaaaaaaaaaucagaaauuggagaaauccuuagcacaauuuucuaaa

SEQ ID NO: 445157 - RNA, 65 nt, hsa
gcugcccaggugggguuuccugcauggacaguuguuuggagaacaacaaggacaacuuuauguag

SEQ ID NO: 445158 - RNA, 65 nt, hsa
cuugaauuuuuuggggacuauuaaggguguuagucuuggagaagacacagccucaccuucucacu

SEQ ID NO: 445159 - RNA, 65 nt, hsa
cuuauuucuuaacugcuauuuggcagaagcugaaauuggagaaccaaggagcaaaaacaaauuuu

SEQ ID NO: 445160 - RNA, 65 nt, hsa
cucuuugugacacuucauccugaugccaagauuuuuuggagaacaucugcacuuucuuauauaua

SEQ ID NO: 445161 - RNA, 65 nt, hsa
aaaugauuguaugcuuaugcugaacaccuuucauauuggagaaucaugcauuugggucacuaauu

SEQ ID NO: 445162 - RNA, 65 nt, hsa
agaugaaauaaacuuauuacuuuaaaggaaaggauuuggagaauugaacucacaaacugauguua

SEQ ID NO: 445163 - RNA, 65 nt, hsa
guacuucggcugcaugagauaaucacuugggagcuuuggagaaaauagcaguaccaagggaucuc

SEQ ID NO: 445164 - RNA, 65 nt, hsa
ccacgcccaucuggagugggagcugggagucaguguuggagaagaaacaacaaaagccaauuaga

SEQ ID NO: 445165 - RNA, 65 nt, hsa
aucucuaauuccagugucuuuacacagcaaauaaauuggagaauauugcucccauauaaacuugu

SEQ ID NO: 445166 - RNA, 65 nt, hsa
guuuucaguuucuuuccuucugugaacgaugagacuuggagaacgggcugguccuucaccacuuc

SEQ ID NO: 445167 - RNA, 65 nt, hsa
gugaggugccgagcugggugcuugacaucauuugcuuggagaagcagcugcuaguagacccauuu

SEQ ID NO: 445168 - RNA, 65 nt, hsa
uacaucaauauguauauauguauuucuauauagacuuggagaauacugccaaaacauuuaugaca

SEQ ID NO: 445169 - RNA, 65 nt, hsa
uuuuggguguggaggccauuuuuagagauacagaauuggagaagacuugcaaaacagcuagauuu

SEQ ID NO: 445170 - RNA, 65 nt, hsa
ugugucauguugguuuuugguacuuguauugucauuuggagaaacaauaaaagauuucuaaacca

SEQ ID NO: 445171 - RNA, 65 nt, hsa
ucuaucugggaacacugagaagggugaccaaugcguuggagaacgagggagggcuucauagcaga

SEQ ID NO: 445172 - RNA, 65 nt, hsa
caaaagagcaugcagugcuguugaauaacccucacuuggagaaccaagagaauccugucguuuaa

SEQ ID NO: 445173 - RNA, 65 nt, hsa
ugccccugaauguggucgaugccaaaggaagauccuuggagaagucaucagugcguugaaacaaa

SEQ ID NO: 445174 - RNA, 65 nt, hsa
uuugcagagugugugcuuggcuguggcagccuagcuuggagaagcugcuguuggugcaagggaga

SEQ ID NO: 445175 - RNA, 65 nt, hsa
cccagcuuucuugcuugccuucugugcaauauuucuuggagaauuuggaugccuaaggcauaaag

SEQ ID NO: 445176 - RNA, 65 nt, hsa
auuuucugugccuucaagggacaacuuuuuuaacuuuggagaaaagaaaaacacucuauaacaga

SEQ ID NO: 445177 - RNA, 65 nt, hsa
gcuuuauaccuagcaagccacuucaggaaauucuuuuggagaauauuuucugauuauuguuaaac

SEQ ID NO: 445178 - RNA, 65 nt, hsa
uaaugcugggaacacaaauagugcaauuugugcaauuggagaaucuugccuuuuuucuuggcucc

SEQ ID NO: 445179 - RNA, 65 nt, hsa
aacaggauucacauuguuaauuuauaaaucuagacuuggagaauuaaggacugagaaaugaccau

SEQ ID NO: 445180 - RNA, 59 nt, hsa
acaauuaccagccauacuaaaggagaacauuggagaaaacagguguguauaagaguaca

SEQ ID NO: 445181 - RNA, 65 nt, hsa
uagcaacugcagcuaacaggcugauuuucuggccuuuggagaagugauucaaaauaguguagauu

SEQ ID NO: 445182 - RNA, 65 nt, hsa
aaaguauaugaaaauauacuggaaauauuggauucuuggagaaaacuguucagucacagauauau

SEQ ID NO: 445183 - RNA, 65 nt, hsa
uacaugugugccccuaaagacacauuuacucaauauuggagaaguagauaaugaauuaagcaacu

SEQ ID NO: 445184 - RNA, 65 nt, hsa
ccuaguguuuucauaauguaauucaaugaaaacuguuggagaaauauuuaaacaccucaauguag

SEQ ID NO: 445185 - RNA, 65 nt, hsa
uagguuuuaaaaauaaguuuuauacauaaacaguuuuggagaaaaauuacagaucauauaagcaa

SEQ ID NO: 445186 - RNA, 65 nt, hsa
uguaucuuguaaucaugauugagccucagaaucauuuggagaaacuauauuuuaaagaacaagac

SEQ ID NO: 445187 - RNA, 65 nt, hsa
accaaucaaucaaaaaauaaauaaaucacuaaggauuggagaacucauagaacaaggugaaagac

SEQ ID NO: 445188 - RNA, 65 nt, hsa
aaagacauaaacuuggaguccgucugguuuaauuauuggagaaucgauucccaaguccaggaaga

SEQ ID NO: 445189 - RNA, 65 nt, hsa
uuuuaguauuuugucuuuguaauuuacagaaguuauuggagaaaauaaacuuguuucauuuugca

SEQ ID NO: 445190 - RNA, 65 nt, hsa
cacccagggaaugggggucuaugagacaaccccacuuggagaagaaugggguuagggucucuaau

SEQ ID NO: 445191 - RNA, 65 nt, hsa
ggugcuuuuuauacaacuuuccaucccccacacaguuggagaauaauuuguagaccauggcaguu

SEQ ID NO: 445192 - RNA, 65 nt, hsa
aguauacauggugauguacaucuguagcaaagcucuuggagaaaaugaagacugaagaaagcaaa

SEQ ID NO: 445193 - RNA, 65 nt, hsa
caugaggaacauucauucuguauuuuuuuucccuguuggagaaagugggaaauuauaaugucgaa

SEQ ID NO: 445194 - RNA, 65 nt, hsa
uuauucugucuaucaaauaguacuucuaccacuguuuggagaaaauugaagaaaagaauaagaug

SEQ ID NO: 445195 - RNA, 65 nt, hsa
aguugaauaugauuuggucaguugcucguuguaacuuggagaaauuccuauaaaguaagaucucc

SEQ ID NO: 445196 - RNA, 65 nt, hsa
uuaauuccuucugcuauaugucacacaguuguuauuuggagaaccaaguauguauugcaugaaaa

SEQ ID NO: 445197 - RNA, 65 nt, hsa
gaaugccuuauuuuugaauucuuuagauuuuuaaauuggagaaaagcacuuaaaguuuuuuauau

SEQ ID NO: 445198 - RNA, 65 nt, hsa
gugugagcauuugcaauguaagggccucagcuuccuuggagaagccaccccagguuuccagacau

SEQ ID NO: 445199 - RNA, 65 nt, hsa
ugcaucucccugauugguauugcuguagaacauauuuggagaaguuuguuugucuuugguguuua

SEQ ID NO: 445200 - RNA, 65 nt, hsa
uuggaguuugaacccguuuugguugcauuucauuuuuggagaacuuaauuaacgugagauuggca

SEQ ID NO: 445201 - RNA, 65 nt, hsa
acuuagaacauuuuuugaaauucaguuuacagaaauuggagaaaaugcuuuuuaaacaaguguuu

SEQ ID NO: 445202 - RNA, 65 nt, hsa
ugaugggucuugcugggugcuguguggggcgcauauuggagaaggguaaugccagaagccaggaa

SEQ ID NO: 445203 - RNA, 65 nt, hsa
cccuuggaaccccaaggccaaguugguucaaacuguuggagaacagaguuggccugcaucuggaa

SEQ ID NO: 445204 - RNA, 65 nt, hsa
guacuauuuuuauaaagcaagaacuauuccaugccuuggagaaugaaucauuuuuagauugugac

SEQ ID NO: 445205 - RNA, 65 nt, hsa
cuuuuggaggugaaaucuaauuauuggugagagucuuggagaacaggcuguuuccagucucaaag

SEQ ID NO: 445206 - RNA, 65 nt, hsa
cagccuuugguagcuaacagucacugauuuuauaauuggagaaugcguaaagauucauuuuucaa

SEQ ID NO: 445207 - RNA, 65 nt, hsa
uuuuguuuuauuggaaugcauaucucuuuucaggguuggagaaauuagcacuugccuugaaaaga

SEQ ID NO: 445208 - RNA, 65 nt, hsa
ugugagacuuuauuguccucuaggauggauguauauuggagaagggugguuagcacauucaucag

SEQ ID NO: 445209 - RNA, 65 nt, hsa
gggguuaccuccaugugcccuuuuuagggaagcuguuggagaaaauacuccagcaaaaugaagga

SEQ ID NO: 445210 - RNA, 65 nt, hsa
uguucaacaauucugugaaaggucacaggacccaauuggagaaaucauaugaaaagcauaguugg

SEQ ID NO: 445211 - RNA, 65 nt, hsa
acaucccuuaauuugagguguuccagcagcuguuuuuggagaagacaaagaaaauuaaaguuuuc

SEQ ID NO: 445212 - RNA, 65 nt, hsa
guauguuccuuuguauguuccuaucaggcugauuuuuggagaaaugaauguuugucuggagcaga

SEQ ID NO: 445213 - RNA, 65 nt, hsa
ucugauguuaagcacauguuacuucaacaagaugcuuggagaacaacaagguacccagaauuuuu

SEQ ID NO: 445214 - RNA, 65 nt, hsa
gaagugagaucauacugguuuguuucuuauuuugauuggagaaaaauuaaauugcugcauuucgc

SEQ ID NO: 445215 - RNA, 65 nt, hsa
gccagcugguaguccaucagcacaaugaaggagacuuggagaagaggaagaauaacacuguugcu

SEQ ID NO: 445216 - RNA, 65 nt, hsa
augcuuuuugaauguuauuuguuauuuucaguauuuuggagaaauuauuuaauaaaaaaacaauc

SEQ ID NO: 445217 - RNA, 65 nt, hsa
cagcgcauccugcagggcuucuccuccucugucuuuuggagaaccagggcucuucucaggggcuc

SEQ ID NO: 445218 - RNA, 65 nt, hsa
acuuaaacccugugccucagcuggacauuggaaccuuggagaaugucuucacagccccgacauca

SEQ ID NO: 445219 - RNA, 65 nt, hsa
gccagggccgugccuggagcacugcagagaugacuuuggagaaagcaaagcagugacccagugac

SEQ ID NO: 445220 - RNA, 65 nt, hsa
guagaagaaagauacaagugaaaauuaggaguggauuggagaaauuggggggaaauagaagagua

SEQ ID NO: 445221 - RNA, 65 nt, hsa
aaggcuuuuuaacccauuuuugaagagggugaaguuuggagaacaaauuuaaaaaccaucaguca

SEQ ID NO: 445222 - RNA, 65 nt, hsa
uuaaaucucagaauuacuaagcauguggcauaaauuuggagaaaauaauaugacuagaaaaauua

SEQ ID NO: 445223 - RNA, 65 nt, hsa
ucuucguguccaccuggguccaguccugaaucaucuuggagaaacaccuugguuucuaggauggu

SEQ ID NO: 445224 - RNA, 65 nt, hsa
ggaguuguauuggcaagagggaggggugagagcuguuggagaacugagaaugagguuuuuuuuuu

SEQ ID NO: 445225 - RNA, 65 nt, hsa
ucuauugcccugcaacgucccaucuauacgagguguuggagaaggugaagaacccucccauucac

SEQ ID NO: 445226 - RNA, 65 nt, hsa
ucccugcuugugcaggccaguggaggcucuugggcuuggagaacacgugugucucuguguaugug

SEQ ID NO: 445227 - RNA, 65 nt, hsa
aaguggggcaacguguggaggaagccccucauaauuuggagaaaacuugauacaauagaagcuga

SEQ ID NO: 445228 - RNA, 65 nt, hsa
ccaaccuguucaagucuaccaauuauaagggcaaauuggagaaaaagaaaaaauauauacucaag

SEQ ID NO: 445229 - RNA, 65 nt, hsa
ccguuuguuuguuggaguggugccagguacugguuuuggagaacuugucuacaaccagggauuga

SEQ ID NO: 445230 - RNA, 65 nt, hsa
agagugcauaccagaauugaauauaccauaugggauuggagaaagacaaauguggaagaaaucau

SEQ ID NO: 445231 - RNA, 65 nt, hsa
gcugagaaagggaaaagacacacaagucgcguggguuggagaagccagagccauuccaccucccc

SEQ ID NO: 445232 - RNA, 65 nt, hsa
gguggcgugcucuagcccucucaguuaccagcucuuuggagaaggaucaaaauucagauggaaug

SEQ ID NO: 445233 - RNA, 65 nt, hsa
ccugaaacagacuacucuuugccuuuuugcugcaguuggagaagaaacugaauuugaaaaauguc

SEQ ID NO: 445234 - RNA, 65 nt, hsa
gcaaagaauuuaaaguggcuccuuuaauuggugacuuggagaaagcuaggucaaggguuuauuau

SEQ ID NO: 445235 - RNA, 65 nt, hsa
uaacagaguuugggggagagagcaagauggguuccuuggagaagcugauuugccaagaugcacau

SEQ ID NO: 445236 - RNA, 65 nt, hsa
uugccaccuaagcaguaaaacaugauauugaccacuuggagaacucagaaaauuauuuuaaauuu

SEQ ID NO: 445237 - RNA, 65 nt, hsa
agagaaguaaaggaauauaugccuccuguguacuuuuggagaaaacugaagauuuaguuuccauu

SEQ ID NO: 445238 - RNA, 65 nt, hsa
caggaucauccuuuuguacuugaugcuggaagcucuuggagaaaaagcuuaaacauuucaccaga

SEQ ID NO: 445239 - RNA, 65 nt, hsa
ugacaaaacacaaguuggaccaaggagaaagcccuuuggagaaacuggacccuaguucaguuuag

SEQ ID NO: 445240 - RNA, 65 nt, hsa
uugauuccuugaagagccuauuuaguuccauaaaauuggagaacugcugaaggucaguaauuccg

SEQ ID NO: 445241 - RNA, 65 nt, hsa
uaaacaugaugaauguggagaugcuugcuucagcauuggagaauucacaguaaagggaaacccug

SEQ ID NO: 445242 - RNA, 65 nt, hsa
cgaccaacaacaacgaggaggagaagucccggcuguuggagaaggagaaccgugaacuggaaaag

SEQ ID NO: 445243 - RNA, 65 nt, hsa
aguggagaugggggcgggggugguggugaagagaguuggagaaggaauggacgaauucuugagca

SEQ ID NO: 445244 - RNA, 65 nt, hsa
cauagucucagagaucuguagggccgagguuacauuuggagaacccguacucuagggccaaaucc

SEQ ID NO: 445245 - RNA, 65 nt, hsa
cgguggccagcccauuuucuggggugaggcuugacuuggagaaaggcagaagagacgucccgcuu

SEQ ID NO: 445246 - RNA, 65 nt, hsa
cauccagguuaaccuugauauacacagagauggucuuggagaauugugaauguauguacuguauu

SEQ ID NO: 445247 - RNA, 65 nt, hsa
caugccuauaauccuggcauuuuaggaggcugagguuggagaaucgcuugaggccagaagugcaa

SEQ ID NO: 445248 - RNA, 65 nt, hsa
ccaaguggccaaguccuuuaucaaaaagcugcuuuuuggagaagaugaugcauaaagcugugaua

SEQ ID NO: 445249 - RNA, 65 nt, hsa
gggcccuaaccuaaaaucggagaguaauuuaugcuuuggagaauuugacucaaauauauacuuga

SEQ ID NO: 445250 - RNA, 65 nt, hsa
caaugugggguuuguaauaggugagaaauauuugcuuggagaagcucuugugcaauuagccuggc

SEQ ID NO: 445251 - RNA, 65 nt, hsa
guuuuguuugguauguacaaaauggucagagcuaguuggagaaugagacaugcuuuuccagcugu

SEQ ID NO: 445252 - RNA, 65 nt, hsa
gcagucucuucagguagcuaaauuaggagcuuguuuuggagaaaugaagcaaaggugaaugacag

SEQ ID NO: 445253 - RNA, 65 nt, hsa
uauacuuugugcuuuaugguuuuuauaaugucuuuuuggagaaauugccgaaaaguugccaaaua

SEQ ID NO: 445254 - RNA, 65 nt, hsa
aaggaauauuuucuucuuaagauauauagaggauuuuggagaagagagacaggagggguaaaacc

SEQ ID NO: 445255 - RNA, 65 nt, hsa
acuuaacaauauacauauguuccgucuuugcuguuuuggagaaugauggauaaguaguguuuccu

SEQ ID NO: 445256 - RNA, 65 nt, hsa
gucuccauuuuuaucaagguuuuccaugguuaaguuuggagaaaauaccacacaaaacaaugaau

SEQ ID NO: 445257 - RNA, 65 nt, hsa
acuucgauuuuucuggucuguggagaaacugugaauuggagaaauggagcucuguggcuucccac

SEQ ID NO: 445258 - RNA, 65 nt, hsa
uguuuuuuucucucacuauaguauaagaaucuauuuuggagaaaaaaagaaaauaugagggucuc

SEQ ID NO: 445259 - RNA, 65 nt, hsa
guggggggagggggaugggguccuucuaggaguccuuggagaaaaguaagaaaccaggaguguuu

SEQ ID NO: 445260 - RNA, 65 nt, hsa
ucaccagggcaggagaggacucagccuccuguguuuuggagaaggggcccaauguguguugacga

SEQ ID NO: 445261 - RNA, 65 nt, hsa
uugcucaaauguuguucaacaccagaaaauuuauauuggagaaaagcacuguaaauguaaugcau

SEQ ID NO: 445262 - RNA, 65 nt, hsa
uuguucaaacuuuguucaauaccaggaaauuuauauuggagaaaaacccuaugaguguaaugaau

SEQ ID NO: 445263 - RNA, 65 nt, hsa
guugucacgcuugauuguagguaagauaauuuauauuggagaaaaauccuccaaguaugaagaau

SEQ ID NO: 445264 - RNA, 65 nt, hsa
uugcucaaacuuuguucgacaucagggaauuuguauuggagaaaaacccugcaaauguaauaaau

SEQ ID NO: 445265 - RNA, 65 nt, hsa
gauugccuugaucuggcacuuacugauacaagcauuuggagaagagaaaauucaaauauaagaaa

SEQ ID NO: 445266 - RNA, 65 nt, hsa
auggacuuuccugugauuuguuuuuaaucauucauuuggagaagaggcaugaccuuuguauuuca

SEQ ID NO: 445267 - RNA, 65 nt, hsa
uucaugcuauuaguauuuucauaccuuagucacauuuggagaauucacaugggaauaaaauucca

SEQ ID NO: 445268 - RNA, 65 nt, hsa
uugcagguuugguuuuuucucauuugucuguggcauuggagaauauucucgguuuaaacagacua

SEQ ID NO: 445269 - RNA, 65 nt, hsa
gcuuauugucuagugaaacucguuaauuuguaguguuggagaagaacugaaaucauacuucuuag

SEQ ID NO: 445270 - RNA, 65 nt, hsa
auuccauguagucuucaauuuuuaauuuuuaagaauuggagaauuucuaauguuaaaguuaguuu

SEQ ID NO: 445271 - RNA, 65 nt, hsa
auaauaucugcauuaugcuggaaaaaaauagaccuuuggagaauacuuaaauaaaacaugugcau

SEQ ID NO: 445272 - RNA, 65 nt, hsa
cccaggugauucuguaaguugucccucaacuguacuuggagaaaucguguuuuaaagcaguaguc

SEQ ID NO: 445273 - RNA, 65 nt, hsa
cgugcaggaauagcaacagcaauuuccgggaggucuuggagaagcuggagagcgaccccgucugc

SEQ ID NO: 445274 - RNA, 65 nt, hsa
gccuuuuauuaguucuuugauagcuaagaugguuguuggagaaagugcuuaagccacuguuuaug

SEQ ID NO: 445275 - RNA, 65 nt, hsa
aguccuguaaaugaaugcucugggcuagauacagcuuggagaaccugcuggccuuguuagacagc

SEQ ID NO: 445276 - RNA, 65 nt, hsa
uuaggaaagccuggguuggguggagcagaaccaucuuggagaagaugacaguucccuguccuccc

SEQ ID NO: 445277 - RNA, 65 nt, hsa
agacacccccuuccaaauucuguaacacauuguaauuggagaagaaggaaacucugcaaggcuaa

SEQ ID NO: 445278 - RNA, 65 nt, hsa
uuaagcuuguuguuggaagagcagcauuuugacccuuggagaagaaaaacuagcuguggcauucc

SEQ ID NO: 445279 - RNA, 65 nt, hsa
cuaccgagcuggaagcaagccauuuaauccgguucuuggagaaacauaugaauguauucgggagg

SEQ ID NO: 445280 - RNA, 65 nt, hsa
uaugucuucaagugaccuguacugcuuggggacuauuggagaaaauaagguggaguccuacuugu

SEQ ID NO: 445281 - RNA, 65 nt, hsa
guagucuuuuguauuuucccugccgaagugaauuguuggagaauguaaaccgccuccacguggcg

SEQ ID NO: 445282 - RNA, 65 nt, hsa
augaguguuccugugcccauauuuaaugugugaccuuggagaaguuacucuguaggcaugacagc

SEQ ID NO: 445283 - RNA, 65 nt, hsa
guguuugucauggugaaauuauaacuauuacaguguuggagaacaacaaauauguucucugaaug

SEQ ID NO: 445284 - RNA, 65 nt, hsa
agcugggugcagaagcuguggggucggagaggcguuuggagaaggucuguggugcagugugugaa

SEQ ID NO: 445285 - RNA, 65 nt, hsa
ugaauuacugaauauuucagagcaaagcuaucaacuuggagaaacagggauuaaaaauaaggaua

SEQ ID NO: 445286 - RNA, 65 nt, hsa
uuuuaaaaacuauauucaguaaaagccugcucaauuuggagaaauagaaccacaaacacagauca

SEQ ID NO: 445287 - RNA, 65 nt, hsa
ugcccacagaagucaucagaccuuaccaaaguagguuggagaauuagauugccuuuucaugcagu

SEQ ID NO: 445288 - RNA, 65 nt, hsa
auaugauaugaagggggacuuaucuccugcagagauuggagaagguagaggaggagaaagaaucc

SEQ ID NO: 445289 - RNA, 65 nt, hsa
cugggcgcuguaaguuaagcucuacauagauuaaauuggagaaacguguuaauuguguggaauga

SEQ ID NO: 445290 - RNA, 65 nt, hsa
guuuccuuuuuuuguuuguuuguuuguuuguuuuuuuggagaagagcauccucuuuuguguaguu

SEQ ID NO: 445291 - RNA, 65 nt, hsa
acuuaaaagaaagauuucccauugcauacagguuauuggagaaauuuuccuuuuguugcauuugu

SEQ ID NO: 445292 - RNA, 65 nt, hsa
aaucugaguguugccugcugaacucggaggggaguuuggagaaauuuuagacagcagcucugugu

SEQ ID NO: 445293 - RNA, 65 nt, hsa
uucacacuaccaggcccugcagccacaguguucuguuggagaaacuuggggaaguguuuucugaa

SEQ ID NO: 445294 - RNA, 65 nt, hsa
guuucccagaaucagacuuuugaagaugaaugacuuuggagaagcaaauuaaacauuuggcccug

SEQ ID NO: 445295 - RNA, 65 nt, hsa
caguggagauaaauguccuagagucaccaggucgcuuggagaagucauuuaagcugccucggguu

SEQ ID NO: 445296 - RNA, 65 nt, hsa
uuaaaauauaacuucaagaaaagaguaaacauccauuggagaacacggcugaaaauuauugugcu

SEQ ID NO: 445297 - RNA, 65 nt, hsa
uuaaagaucaugaauuugugacuuaguucugcccuuuggagaacaaaagaaagcagucuuccauc

SEQ ID NO: 445298 - RNA, 65 nt, hsa
uaaacaauggugccccagaaagcugcaggugguguuuggagaagcaguuacuuuucaguuacaag

SEQ ID NO: 445299 - RNA, 65 nt, hsa
uaaagcaguauuuaaugcaauuuccaguuauuucuuuggagaauuuuaugucauuguuccauuac

SEQ ID NO: 445300 - RNA, 65 nt, hsa
aaugaguucagaugaucacaaacaggugaguuuuguuggagaagaaaguuggaguaggagacuuu

SEQ ID NO: 445301 - RNA, 65 nt, hsa
cccaauaagaggcucuguuuuccacugaagcuuuguuggagaaagagaauaugaaaauuacacau

SEQ ID NO: 445302 - RNA, 65 nt, hsa
ugugugaagacaugaaaguuuaauguacagaaugguuggagaaaugccuauggugaauuaaagcu

SEQ ID NO: 445303 - RNA, 65 nt, hsa
acauugccuuuguguuaauagucaaauacuuaccuuuggagaauacuuaccuuuggaggaaugua

SEQ ID NO: 445304 - RNA, 65 nt, hsa
gaauaaccuugcugauaagaaaaaaagggacaauauuggagaaacuaccucuuguuuaauugauc

SEQ ID NO: 445305 - RNA, 65 nt, hsa
gucugguaccuuccccuccugccccugcaccagcuuuggagaauggauuuggagugucuugggcg

SEQ ID NO: 445306 - RNA, 65 nt, hsa
acagaaaucagaggagagacgguguugggagcccuuuggagaacgccagucucccaggcccccug

SEQ ID NO: 445307 - RNA, 65 nt, hsa
uaagcaguguagacaaacccuuggggcuuuuuuauuuggagaaccguccagcaugcauccuggcc

SEQ ID NO: 445308 - RNA, 65 nt, hsa
gccacguugucauugugagucuauagcuugacuccuuggagaacaauauucauuugguuguggag

SEQ ID NO: 445309 - RNA, 65 nt, hsa
cuuuucaucaacauguagagcugcuauuuuacuauuuggagaauaugaugugaaaauuggaccuc

SEQ ID NO: 445310 - RNA, 65 nt, hsa
uccaaaauagcagaaauuguaaaaauuaugaauuauuggagaaaaugccauuacuuguauaucug

SEQ ID NO: 445311 - RNA, 65 nt, hsa
uucugcagaauauuguaauugcaugcauaccgauauuggagaaaucugggucagccaaguuucau

SEQ ID NO: 445312 - RNA, 65 nt, hsa
ugcaaagucuuguacugaagcagucuccuuguugcuuggagaacaccuccuucagagcccuuugu

SEQ ID NO: 445313 - RNA, 65 nt, hsa
ggaugaggaaaagaagagccuuugcugauaaagaguuggagaacauuaugcuggagagagaauau

SEQ ID NO: 445314 - RNA, 65 nt, hsa
aaguggauuaauauuaaaacuauguauauuaaucauuggagaagggggaagaggaaaugaaaaua

SEQ ID NO: 445315 - RNA, 60 nt, hsa
uagccgagacuggagccuagaggcuggaucuuggagaaugugagaagccagccagaggca

SEQ ID NO: 445316 - RNA, 65 nt, hsa
uuugcaaaagaaauaggcuuuucuucuuuuuuaaauuggagaaaucucugcucugguugaccugg

SEQ ID NO: 445317 - RNA, 65 nt, hsa
gcaggcaucuguggggaaucccagccugcagguucuuggagaagcaggugaaccuaaggaugaaa

SEQ ID NO: 445318 - RNA, 65 nt, hsa
gcucaugcacaucagcugguggagcaggccuggccuuggagaacgagaccugugugccaggggca

SEQ ID NO: 445319 - RNA, 65 nt, hsa
ugcguccuugugaagcucgucuccauguggcuuucuuggagaaaggcuccccuggggcaagaggg

SEQ ID NO: 445320 - RNA, 65 nt, hsa
ucggagaggucaggagaccgaccccaccacuaacuuuggagaaaauguggguuugcuuuuuaaag

SEQ ID NO: 445321 - RNA, 65 nt, hsa
uuuuucuggaaaaguuaaaaaaaguuacaugucauuuggagaaaauacguaaucagaaauuugug

SEQ ID NO: 445322 - RNA, 65 nt, hsa
accggccaauguccaaaauuacgguuugaacauaauuggagaaccuuuccuucaagcagaaacaa

SEQ ID NO: 445323 - RNA, 65 nt, hsa
cacggccaagggccacgggaacuuggagagggagcuuggagaacucacugugggcuagggugguc

SEQ ID NO: 445324 - RNA, 65 nt, hsa
uacguguguuuuuuagagcuugguucuuuaaagauuuggagaagauauguaaauuaccaaggcac

SEQ ID NO: 445325 - RNA, 65 nt, hsa
uguguaaaaaguacucagaaaaacaucuaaagcuguuggagaagagggacucauauaaauaguug

SEQ ID NO: 445326 - RNA, 65 nt, hsa
ggugcuuuugcaagacuggaauuccuuggacaccauuggagaagccccgcuuuuucuggaacagc

SEQ ID NO: 445327 - RNA, 65 nt, hsa
agguuuuuaaaacauggauguuaaggcuguuuugcuuggagaagacuugggacugggacagucuu

SEQ ID NO: 445328 - RNA, 65 nt, hsa
aaagaacaaaagcuuuuaguuguuuuuguuuuguuuuggagaauuuguuuaccaguaaauacauc

SEQ ID NO: 445329 - RNA, 65 nt, hsa
uuuuuaaaaagaagagaaagaagauauacuuugcuuuggagaaaucuacuuuuugacuuacaugg

SEQ ID NO: 445330 - RNA, 65 nt, hsa
acuccgccccauccugcagggccuuguuuuuguauuuggagaaccucgcccaucccccccgcggc

SEQ ID NO: 445331 - RNA, 65 nt, hsa
ugauuccuuuuuucaaaauccaaaaagaaaugauguuggagaagggaaguugaacgagcauaguc

SEQ ID NO: 445332 - RNA, 65 nt, hsa
cuuuuacuaaauauacaagauuuacuacuagaaauuuggagaaagaacacuaacacauguacuug

SEQ ID NO: 445333 - RNA, 65 nt, hsa
agaacucaugagagacaagcaguaagaaacuucuuuuggagaaacaacagaccagaucuuuacuc

SEQ ID NO: 445334 - RNA, 65 nt, hsa
uacuacaguuucacagaauaccugagaagacacacuuggagaaaccuuuuggguguaaugaaugu

SEQ ID NO: 445335 - RNA, 65 nt, hsa
uagccuuacuucuacuuccagaugcagugccucuuuuggagaagacauguuuauuuuucauguuc

SEQ ID NO: 445336 - RNA, 65 nt, hsa
gggagggaagaguguguccuggcaggaagccaccauuggagaaggugaggccaguaaccaucuca

SEQ ID NO: 445337 - RNA, 65 nt, hsa
ugauuuuacauaucuguuuggauuauagcuaggauuuggagaauaaguguguacagaucacaaaa

SEQ ID NO: 445338 - RNA, 65 nt, hsa
uuuuuuaagcaagagaaagacaacuguucugcggguuggagaaaauacaauuuuuuuuuuuuuuu

SEQ ID NO: 445339 - RNA, 65 nt, hsa
uacuauugcugcauacccggggugggauggggugguuggagaaccagaacuauuuuuaaaacauu

SEQ ID NO: 445340 - RNA, 65 nt, hsa
ccugaacuggggaauuugaacauuccuuuacauuguuggagaaaugaagccaaaguuauucagau

SEQ ID NO: 445341 - RNA, 65 nt, hsa
gucuauaugguucuccaagaaacugaaugaauccauuggagaagcgguggauaacuagccagaca

SEQ ID NO: 445342 - RNA, 65 nt, hsa
aauuauguucuuuagacacugcuaccugaaaacuguuggagaaauaauguuuaaaguuauuuaag

SEQ ID NO: 445343 - RNA, 65 nt, hsa
cuuaaaacccugaugcaaacuucuccuuucagugguuggagaaauuggccgaguucaaccauuca

SEQ ID NO: 445344 - RNA, 65 nt, hsa
aaaauucuaaccaaaccccagacauagggagucauuuggagaaagccuguaugugguguuuuaac

SEQ ID NO: 445345 - RNA, 65 nt, hsa
gaauggucagccuaaggguaauguacagcccgugcuuggagaaccauggaagcuacaccccuaca

SEQ ID NO: 445346 - RNA, 65 nt, hsa
ccagaacuguggugccaaauugcuggugucucucuuuggagaaaccaaccagauacaucugcugg

SEQ ID NO: 445347 - RNA, 65 nt, hsa
auuugccaaauaacaaaagcauacaaugcauacuguuggagaacaagaaugcuacuguauuuuac

SEQ ID NO: 445348 - RNA, 65 nt, hsa
ugauaccuugaucuuucccacuuucuguuuucggauuggagaagauguaccuuuuuugucaacuc

SEQ ID NO: 445349 - RNA, 65 nt, hsa
acaccuuaaauaaaagugauugugacuaaggcacguuggagaacauuccaaucuuuccucccaag

SEQ ID NO: 445350 - RNA, 65 nt, hsa
gaaaagcuaaauaaccuuuaagaaugugggugguauuggagaaagaagaugaauuauagcuccgg

SEQ ID NO: 445351 - RNA, 65 nt, hsa
gcuguaucuacucuguggaguagaaccaagucuacuuggagaaaagaaccaaguccuuggauauc

SEQ ID NO: 445352 - RNA, 65 nt, hsa
uuaagucacaccuaccacugagcagcuguacgacuuuggagaaguuguuuaacauuuucaagccu

SEQ ID NO: 445353 - RNA, 65 nt, hsa
cacacuccaguauuaauauuugugcuaccaucuacuuggagaaguuuaaugagaaaauuuuagaa

SEQ ID NO: 445354 - RNA, 65 nt, hsa
gccccauaggaugucauauugaggcccaaacuugauuggagaauuugcaaacuaccgucgcucag

SEQ ID NO: 445355 - RNA, 65 nt, hsa
gaaugcagauuacacugaucuuauguguuacaaaauuggagaaaguauuuaauaaaaccuguuaa

SEQ ID NO: 445356 - RNA, 65 nt, hsa
cgugcguucugccuuccuuguuaauuuuguaauaauuggagaagauuuaugucagcacacacuua

SEQ ID NO: 445357 - RNA, 65 nt, hsa
cacauuggugucucuuuuuuccuuuccuuucgacauuggagaauuggagugcagucauaaucuua

SEQ ID NO: 445358 - RNA, 65 nt, hsa
auguccuuuccuuucugaaaauaaaguuuugugcuuuggagaaugacucgugagcacaucuuuag

SEQ ID NO: 445359 - RNA, 65 nt, hsa
gcacccuaggggggcaccugcgccuguguggaaauuuggagaaguugcggcagagaagccaugcg

SEQ ID NO: 445360 - RNA, 65 nt, hsa
uauuucccagugugucuuuuaugucuuugaauguuuuggagaaaagucuaugccugucuaaaaau

SEQ ID NO: 445361 - RNA, 65 nt, hsa
auauuuuaaauuaaagccuucuaauguuccacuguuuggagaacagaagauagcaggcuguguau

SEQ ID NO: 445362 - RNA, 65 nt, hsa
cugcaaacacuguguauagugagacuuguucuacuuuggagaacagguuaccuuuugaaaaugag

SEQ ID NO: 445363 - RNA, 55 nt, hsa
auggcucucucaagccaugaccacauuggagaaaugguuuuuauugucaaccuua

SEQ ID NO: 445364 - RNA, 65 nt, hsa
auagucaguuuaguucauauguucugaaaacuguuuuggagaaagauagacagaaaaaugucauc

SEQ ID NO: 445365 - RNA, 65 nt, hsa
guaauucucagaaccagucucagggagauauaugcuuggagaacucugccuuccaucaacugcag

SEQ ID NO: 445366 - RNA, 65 nt, hsa
ugccaugaauuaagauggaugacuggaaaaagguguuggagaaagaguuaaagaugaggaagaga

SEQ ID NO: 445367 - RNA, 65 nt, hsa
cgcaaguaccaggaggacauaaccgcuguggccuguuggagaacagccaguagccuugguaauau

SEQ ID NO: 445368 - RNA, 65 nt, hsa
cauuguuacaugaaagugauagauagcaacaaguuuuggagaagagagagggagauaaaaggggg

SEQ ID NO: 445369 - RNA, 65 nt, hsa
ugauuuucuacaugaaucaaacacagaaacaacuuuuggagaaauuaaauucugagugugacuuc

SEQ ID NO: 445370 - RNA, 65 nt, hsa
acgcuccccugacacugaagaggauccacaacuccuuggagaaacacccucacgucuguugccgc

SEQ ID NO: 445371 - RNA, 65 nt, hsa
uuuauauagauguaucuuuuaaaaauaguucacguuuggagaauucuuuuguacucauuugcuuu

SEQ ID NO: 445372 - RNA, 65 nt, hsa
cuagcucugacuuugcuguuuccagugguaugaccuuggagaagucacuuauccucuuggagccu

SEQ ID NO: 445373 - RNA, 65 nt, hsa
uguucucucuggacucuugccuagcucacaaggcuuuggagaauugucuuccuaaaucggggcac

SEQ ID NO: 445374 - RNA, 65 nt, hsa
auuggaaagcaucuaguccagugggaagccagggguuggagaaggugcuacaucccucuucccau

SEQ ID NO: 445375 - RNA, 65 nt, hsa
ugccuucuagaaucagaucuguuuggggcuggggguuggagaauaaaagcaggagaagucuaugg

SEQ ID NO: 445376 - RNA, 65 nt, hsa
uccucugcuguguucuguguguccaguguagccuauuggagaaucggucucauuagagugacucu

SEQ ID NO: 445377 - RNA, 65 nt, hsa
gaguuguuuaauagagaaaauguacacagacugauuuggagaacacauucucugaaaauacugua

SEQ ID NO: 445378 - RNA, 65 nt, hsa
uguccauauccagguuagcugguaagaggauuuuuuuggagaaaaaaaugauauuuagaaaguua

SEQ ID NO: 445379 - RNA, 65 nt, hsa
uaaacuuguauuacauaucaaauaaaugauacaucuuggagaagagggaggaauaggagcaaauc

SEQ ID NO: 445380 - RNA, 65 nt, hsa
gggaaggaguuuuauguuaaaccauccauguauuuuuggagaagagagaggaaagguuugagaag

SEQ ID NO: 445381 - RNA, 65 nt, hsa
uugucaagguuguccccagaccuugcuugcagugguuggagaacccagggggcugccuugggccc

SEQ ID NO: 445382 - RNA, 65 nt, hsa
augucuuugggagggaagaagguacagaagaaagauuggagaagggccucucuagcagucaacuc

SEQ ID NO: 445383 - RNA, 65 nt, hsa
gcugagggugcccaccaagcccaccuuccagaaacuuggagaaauggggguugggaacuuaugca

SEQ ID NO: 445384 - RNA, 65 nt, hsa
cccagcugugguuggaucaaggacucauuccugccuuggagaaaauacuucaaccagagcaggga

SEQ ID NO: 445385 - RNA, 65 nt, hsa
gagcaugaaagucaaaacuggaauuuucuaaagcuuuggagaaaaggagagaauuaguagggcaa

SEQ ID NO: 445386 - RNA, 65 nt, hsa
cugguucaguggcuggaguauuaggggccuggggauuggagaacggagaagaaguuguagcagag

SEQ ID NO: 445387 - RNA, 65 nt, hsa
cuaaaaaauuuuacugucuaaauaaguaccuuuuauuggagaaaaaucaaaaccccaaacaaaca

SEQ ID NO: 445388 - RNA, 65 nt, hsa
auguugaaauaaugauaguagguauguauuauggauuggagaagcacuuauuacacuaucuaacc

SEQ ID NO: 445389 - RNA, 65 nt, hsa
auaaugcucuauccucuaagguuggaacucugaaguuggagaagguggaauaaaguuacaccugg

SEQ ID NO: 445390 - RNA, 65 nt, hsa
gcagguuugaccaggaaagcagcgcuaguggaggguuggagaaggagguaaaggaugaggguuca

SEQ ID NO: 445391 - RNA, 65 nt, hsa
ccaggaacaagaagagacccuuguucaauaugaucuuggagaacacgguuuugaaagcaacuccu

SEQ ID NO: 445392 - RNA, 65 nt, hsa
ugaauaaaugugaaggcugugaagaguggacagucuuggagaacacagugcuugaaauggacaag

SEQ ID NO: 445393 - RNA, 65 nt, hsa
ccucgcugucucccuagagccagggcccugcggauuuggagaagggagcggggcaggacuuccag

SEQ ID NO: 445394 - RNA, 65 nt, hsa
cagagaaagguuuuagacuccaguuuaccuuucucuuggagaaacucaaugcuaaucccaccuuu

SEQ ID NO: 445395 - RNA, 65 nt, hsa
aauguucacacacuuuucuugcguacucaacuaaauuggagaauguuucugaagaaaauuggaug

SEQ ID NO: 445396 - RNA, 65 nt, hsa
ugaaggcucgaguucugcuguucuguaaaagagaauuggagaaugaaaccugcuccaacagagau

SEQ ID NO: 445397 - RNA, 65 nt, hsa
auccugucauuucuguucuugucccucauacaucuuuggagaaccgggcuccagacuuuguuccc

SEQ ID NO: 445398 - RNA, 65 nt, hsa
uuggacaggacccagcccugcaccguucacuguauuuggagaaaaugguaagaguuccauaccgg

SEQ ID NO: 445399 - RNA, 65 nt, hsa
cuguguauguguggaaauaaaaauguauuguacuuuuggagaauuuuuuguaggcauuuuucugu

SEQ ID NO: 445400 - RNA, 65 nt, hsa
ugggcucuggccaucugcaacccugaacgugcagguuggagaacgaaugaauacaaauuuuauug

SEQ ID NO: 445401 - RNA, 65 nt, hsa
acagccuuuccuacauccuucccucacucccaugauuggagaaaugauucauugggugaugagug

SEQ ID NO: 445402 - RNA, 65 nt, hsa
cagcagcugggcugucagggccauaguagcucccuuuggagaacagggaaagccuggaggcuucc

SEQ ID NO: 445403 - RNA, 65 nt, hsa
ggacagugcaacaaguaacgagacuauuuuguauuuuggagaauucauauuauggagaaccuaac

SEQ ID NO: 445404 - RNA, 65 nt, hsa
aaauuccuaccaggaaagaauacauauccaauagauuggagaaagccagagauuagcccucauuc

SEQ ID NO: 445405 - RNA, 65 nt, hsa
gaauuuuucacaaagagcaaugacuuuauuuugcauuggagaacuccuggagauaagcuguacaa

SEQ ID NO: 445406 - RNA, 65 nt, hsa
guguuagugagggccucaaguccaaggcuuuaucuuuggagaaggcaaggaaggaggcggugaca

SEQ ID NO: 445407 - RNA, 65 nt, hsa
aagucuucauuuggggccaaaggggaaacuuuuuuuuggagaaggcgucuugcuuugucacccac

SEQ ID NO: 445408 - RNA, 65 nt, hsa
uaaggaucugauacaucuaguuauuggucuggaaauuggagaaauggaggugagcaaauuaacgg

SEQ ID NO: 445409 - RNA, 65 nt, hsa
auaauuaaagaaccuggugggugugcacuaugagauuggagaaaugaauuaaguugacuugaaau

SEQ ID NO: 445410 - RNA, 65 nt, hsa
cuuguuuaaaagaaaaucaggugggugggaaucucuuggagaacugaggcugaggguagagggag

SEQ ID NO: 445411 - RNA, 65 nt, hsa
cacugacugggacccugaagaggcauuucagaguguuggagaagaaucuguagcuuguugaaaaa

SEQ ID NO: 445412 - RNA, 65 nt, hsa
auuuucaaaaaccuaauccguaguaauuccuaaucuuggagaauaaaaaagggcgguggagggga

SEQ ID NO: 445413 - RNA, 65 nt, hsa
agaauuaaauacauuucauugagcuuuaaaguacuuuggagaaacuuuggggcacguuuuccuac

SEQ ID NO: 445414 - RNA, 65 nt, hsa
cuagaggaacuuggaucuuccggagaaugauguucuuggagaacaggcagaucaaaagaggugaa

SEQ ID NO: 445415 - RNA, 65 nt, hsa
auauaaaagaaguugugcuauuuaacucugaauacuuggagaaacuaggugaagaugcaaccaga

SEQ ID NO: 445416 - RNA, 65 nt, hsa
ggucaaguaguuuuaauauguaaauuugcaaguuuuuggagaacccccaaacuccuucuccacug

SEQ ID NO: 445417 - RNA, 65 nt, hsa
gugaaaaaugcucucccagcaaagcugagacaaaauuggagaagcugcagccucacgcaccaucc

SEQ ID NO: 445418 - RNA, 65 nt, hsa
aauugcacaucaguaugugccaaaucuacuagacauuggagaaacaguaggaacaacacauggua

SEQ ID NO: 445419 - RNA, 65 nt, hsa
cuuuauuucugcagguuggugaaaacccuguguccuuggagaaagcugguucccguuuuccagag

SEQ ID NO: 445420 - RNA, 65 nt, hsa
agcuuguguggucagcucuucccuucaucacauacuuggagaacaaaggacaccguuacccaugc

SEQ ID NO: 445421 - RNA, 65 nt, hsa
aagauuuauggaguaaggacuuaaaaucauacaucuuggagaaccuuucuuacucauuucagucc

SEQ ID NO: 445422 - RNA, 65 nt, hsa
gacuggagccauaaaguuaauuugcaccuagcuuuuuggagaauagccaugauuaacugcuauuc

SEQ ID NO: 445423 - RNA, 65 nt, hsa
ucaguuuuuuaaaaauagacuguaguauccuuucauuggagaauuuacaaaaauaucaucuacag

SEQ ID NO: 445424 - RNA, 65 nt, hsa
uguucaaaccaaagaaacaaugaucuacucaaacauuggagaaaaaaacugccagaggaggaguu

SEQ ID NO: 445425 - RNA, 65 nt, hsa
uccagcuuucgucugucaucagacauugaagagauuuggagaaauguaaagcagcaguacucuuc

SEQ ID NO: 445426 - RNA, 65 nt, hsa
guagauggguauauaacaguuuggaaauacuaucuuuggagaauguauuuuuguauuuauaaauc

SEQ ID NO: 445427 - RNA, 65 nt, hsa
ggugagcaggcacauugacuuucuguugagguaccuuggagaagcugagccauucugaggacauc

SEQ ID NO: 445428 - RNA, 65 nt, hsa
agauuuuuaaaggaauauuucagaguuuaaucuuuuuggagaaguuauguucuuuaaucggguac

SEQ ID NO: 445429 - RNA, 65 nt, hsa
uuuauguauguucagccagauaguaaaugggauuuuuggagaaauaagauaacuacaaaguuucu

SEQ ID NO: 445430 - RNA, 65 nt, hsa
gaaaguauuaucuaauuaaguucaugauagugcuuuuggagaacuugucaaauuacagccaauga

SEQ ID NO: 445431 - RNA, 65 nt, hsa
uagcuaggaauuguuaagcacauugcagauuguucuuggagaauucuggaguuguuaugaacaug

SEQ ID NO: 445432 - RNA, 65 nt, hsa
uuugcaucacugaggaugaaacugacuuuugucuuuuggagaaaaaaaacuguacugcuuguuca

SEQ ID NO: 445433 - RNA, 65 nt, hsa
ccauaauagagauugauaagauuuagcaacugguguuggagaaaaaaagaaaagcaaaugagugu

SEQ ID NO: 445434 - RNA, 65 nt, hsa
ucuuuuccaguauuaaacacucauaugcuuauggcuuggagaaauuucuuaguugggugaauuaa

SEQ ID NO: 445435 - RNA, 65 nt, hsa
uuuucuuguucccguagaagaaagaagaaagguguuuggagaauucgagugccuaggaugccaga

SEQ ID NO: 445436 - RNA, 65 nt, hsa
cuaagacaaagauauuuagguugagcagcuauuaauuggagaauugguacagagacgcuccagau

SEQ ID NO: 445437 - RNA, 65 nt, hsa
gaagccuggcugcagcuucccauuugguuacgagguuggagaaaaagucaaaguccccuccuggg

SEQ ID NO: 445438 - RNA, 65 nt, hsa
auauagcaucuggaagaucauuuugaaauuguuccuuggagaaaugaaaacaguguguaaacaaa

SEQ ID NO: 445439 - RNA, 65 nt, hsa
uacuuucuugucaaacaaaaccaauggcucuggguuuggagaacacaguggcugguuuuaaaaau

SEQ ID NO: 445440 - RNA, 65 nt, hsa
gcugccuuucccaaaugggaaaggugcugacagaguuggagaaaaaagaauagacucauuuuucc

SEQ ID NO: 445441 - RNA, 65 nt, hsa
cugcuugugcugggaaaugcaacucacucauguauuuggagaaacaggaguguucacuuaucuag

SEQ ID NO: 445442 - RNA, 65 nt, hsa
gaaaacuucuuuuaaaccucaccuuugugggguuuuuggagaagguuaucaaaaauuucauggaa

SEQ ID NO: 445443 - RNA, 65 nt, hsa
ggggagagauauuuucuuauguuuauucggagaauuuggagaagugauugaacuuuucaagacau

SEQ ID NO: 445444 - RNA, 65 nt, hsa
gaucaauauaacaauauaauccuaaaccuugacaguuggagaagccaaugcagaacugaugggaa

SEQ ID NO: 445445 - RNA, 65 nt, hsa
gaaguuuaaaaauucuuuaaacagguauuuugauauuggagaauaacaugcauauaauucuguag

SEQ ID NO: 445446 - RNA, 65 nt, hsa
aucaaugcuuauauauuccuuagacuauugaaauuuuggagaaaauguauuuguguucacuucua

SEQ ID NO: 445447 - RNA, 65 nt, hsa
auacaaaaaugaaaauauuuauaauaggacucgacuuggagaaauugcuauucuuccuguugucc

SEQ ID NO: 445448 - RNA, 65 nt, hsa
aucuuaguugucauaaucccuuggagccuggguuuuuggagaaagagaucuccgugcccuacaga

SEQ ID NO: 445449 - RNA, 65 nt, hsa
ccuuuuagauaggaucuaggagugauuuuauuguuuuggagaauggaagggcccccauggcccug

SEQ ID NO: 445450 - RNA, 65 nt, hsa
aacuaaaaugaaccaaacccauauuucacuggugguuggagaaaaccauggccaaaacgauugug

SEQ ID NO: 445451 - RNA, 65 nt, hsa
uaucaauguguauguggcuguuuguagugaauuuauuggagaaugagguuguccguguccuuaac

SEQ ID NO: 445452 - RNA, 65 nt, hsa
aaaaugaauugaaccauuucaacuauuuucuauauuuggagaaaguuugugcccuguguuuuaua

SEQ ID NO: 445453 - RNA, 65 nt, hsa
uuaucaacagcaaacuucagccguuucacuuuuuguuggagaaaaauaguagauuuuaauuugac

SEQ ID NO: 445454 - RNA, 65 nt, hsa
ccacugugccucagagaccagggcuccagccccucuuggagaagucucagcuaagcucacguccu

SEQ ID NO: 445455 - RNA, 65 nt, hsa
ugaagccagcuggacuuccugggucgaguggggccuuggagaacuuuucugucuuacaagaggau

SEQ ID NO: 445456 - RNA, 65 nt, hsa
gagaauugcucauucauauuuuuucuguugcuugcuuggagaauuugcucuuuuuuuggcauaua

SEQ ID NO: 445457 - RNA, 65 nt, hsa
caaccuuugcacacucaccugagcccuggggacccuuggagaaauuaggugucaccugcuguggc

SEQ ID NO: 445458 - RNA, 65 nt, hsa
cacaugaaacauuugcaaaauuguuuuugguuggauuggagaaguaauccuagggaaggguggug

SEQ ID NO: 445459 - RNA, 65 nt, hsa
uuugauaccaaacaauucaaaaguuggaucugaguuuggagaaagauauuuccaaccuaaguggg

SEQ ID NO: 445460 - RNA, 65 nt, hsa
aacaaacuauguagugugucccuauuauaaaugcauuggagaaguauuuuuaugagacucuuuac

SEQ ID NO: 445461 - RNA, 65 nt, hsa
guuagaagucugcuaaagaucaaaugugaaaguacuuggagaaacugaggccucuuauguguaau

SEQ ID NO: 445462 - RNA, 65 nt, hsa
uuucuguggagguggaaaagcaacauucauagucuuuggagaaaugcuuagaaauucagcauuug

SEQ ID NO: 445463 - RNA, 65 nt, hsa
ugccuggagugacacuacacucuagaauuuccacuuuggagaauacucaguuccaacuugugauu

SEQ ID NO: 445464 - RNA, 65 nt, hsa
uuuuuaaaaauuuaacaugauugcuuuucucaauuuuggagaagauguuuaaauaguucuguugu

SEQ ID NO: 445465 - RNA, 65 nt, hsa
aauuuuuacuugcggugacuauucuugccacaauauuggagaauaaugauagaugauauacuaga

SEQ ID NO: 445466 - RNA, 65 nt, hsa
cagaaguucugccucugccuggggucuuggccacauuggagaaaaacaggcucaaaguggggcug

SEQ ID NO: 445467 - RNA, 65 nt, hsa
ccugccccgagcccuagguggggccaggaggugccuuggagaagccagccagagcagagagggcu

SEQ ID NO: 445468 - RNA, 65 nt, hsa
cacagacucugagaagcgaagaccaugucuccucguuggagaaacccaauagcaggggaagcugg

SEQ ID NO: 445469 - RNA, 65 nt, hsa
guguguguaaugcaaauuaguuaaaacaaauaguuuuggagaaaguuaaaacuagcuuuagagua

SEQ ID NO: 445470 - RNA, 65 nt, hsa
uccagaaucauucuccuuucugcccauaaagggccuuggagaauugcuuuaagaagagugaaugu

SEQ ID NO: 445471 - RNA, 65 nt, hsa
caggagccugggaccccgcaugucccaaaaugggauuggagaagcuggagagaaagcagaagagg

SEQ ID NO: 445472 - RNA, 65 nt, hsa
auuuuuggguguuccuggcaguuuaaaaaaauugguuggagaauuuagguuuuuauuaguaccau

SEQ ID NO: 445473 - RNA, 59 nt, hsa
gugcccagggcugcaccugaaaaggggcauuggagaagugcagcugccgugccugaugu

SEQ ID NO: 445474 - RNA, 65 nt, hsa
caguguggugaugccaugcccaucaugggaggcuuuuggagaaacagaauguuugggcaggggcu

SEQ ID NO: 445475 - RNA, 65 nt, hsa
caucuuccacuggaacguuucacugcaaacacaccuuggagaaguggcaucagucaacagagagg

SEQ ID NO: 445476 - RNA, 65 nt, hsa
gugaagccagcugggcuccugagucugguggggacuuggagaaccuuuaugucuagcuaagggau

SEQ ID NO: 445477 - RNA, 65 nt, hsa
auccacacucuguaucuggcuacucugguggggacuuggagaaccuuuguguccacacucuguau

SEQ ID NO: 445478 - RNA, 65 nt, hsa
aaacacccuccuggcacaacgcucuacccugcagcuuggagaacuccgcuggauggggagucuca

SEQ ID NO: 445479 - RNA, 65 nt, hsa
gguggaucaccugaauucucucagcugucaauggcuuggagaacaucucaugggcccaagucauc

SEQ ID NO: 445480 - RNA, 65 nt, hsa
uuuuguugaaauagcuuuacuguuucucaaguguuuuggagaaaaaaaucaacccugcaaucacu

SEQ ID NO: 445481 - RNA, 65 nt, hsa
guuggccaaagugaaggaaucuuuuuucaguuuuauuggagaaacugaaggguaacauucuaaca

SEQ ID NO: 445482 - RNA, 65 nt, hsa
cggcuguggcugacaguggcucuggccaggguugcuuggagaaggcucagugugccugggacagg

SEQ ID NO: 445483 - RNA, 65 nt, hsa
ggaaagcggauaaaacuuucauuggacuggaauguuuggagaauguuaauuuccaaaucaggaac

SEQ ID NO: 445484 - RNA, 65 nt, hsa
uuguuuguaguuacauuuaggauggacuuaucccuuuggagaagagugaaguuuguuuuuucgcc

SEQ ID NO: 445485 - RNA, 65 nt, hsa
ggcggccuggccuagaccaggggugcagccagcuuuuggagaaccuggauggccuuaggguuccu

SEQ ID NO: 445486 - RNA, 65 nt, hsa
cuuugugacuuggaaagguacgcugcuggccagcauuggagaagaagcugcugagcauggcuuuc

SEQ ID NO: 445487 - RNA, 65 nt, hsa
caggucccaguucacauguaguccccugcucaccauuggagaaucagcucacugcucucuagaaa

SEQ ID NO: 445488 - RNA, 65 nt, hsa
uaaccggccucaugacuagccuuguugccgucgaguuggagaaaguggugcugaaauccaccuuu

SEQ ID NO: 445489 - RNA, 65 nt, hsa
ugugugauggugcaaggaauggauucaggauguuguuggagaaacaaguuugugauuaguccuua

SEQ ID NO: 445490 - RNA, 65 nt, hsa
gcugccugacugccucagcagggaccgcaugccgcuuggagaagggguggccucgccggagcuag

SEQ ID NO: 445491 - RNA, 65 nt, hsa
ccuuuucuccagcaacugcagaggcauuucaggaguuggagaacggaguacauuuuuaaaauuuu

SEQ ID NO: 445492 - RNA, 65 nt, hsa
gcggauggugaggacacagcuaugaucagggaauuuuggagaaacuacagcaucauggaugcugu

SEQ ID NO: 445493 - RNA, 65 nt, hsa
aaagacauaaacuuggaguccaucugguuuaauuauuggagaaucgauucccaaguccaggaaga

SEQ ID NO: 445494 - RNA, 65 nt, hsa
uuuacuuuuccucagaagauugagcugucuuuuauuuggagaauaaaaugaaguucugaaaaaaa

SEQ ID NO: 445495 - RNA, 65 nt, hsa
guuugccaagaagugaucuguuuuaaaggucauauuuggagaaagggcaaggaauugggucugcu

SEQ ID NO: 445496 - RNA, 65 nt, hsa
uuggauguguuugggggcggggggauggaagugacuuggagaauguguuugggaugaaauaacua

SEQ ID NO: 445497 - RNA, 65 nt, hsa
uuuauaaaccacugaaagggauagagaagugaacauuggagaaagccaguagcaacugugagaaa

SEQ ID NO: 445498 - RNA, 65 nt, hsa
guggaggaucaguagcuguuaugaugccagaccauuuggagaaguaucagaggccugaccggaca

SEQ ID NO: 445499 - RNA, 65 nt, hsa
ccaagcccuuggggugacucggcuuccaggagcuguuggagaaaugaggaugucugucccugucu

SEQ ID NO: 445500 - RNA, 65 nt, hsa
cucaacugcugguagcauuuaucugacuuggaaaguuggagaagaggcauuccuacuggagaaaa

SEQ ID NO: 445501 - RNA, 65 nt, hsa
cacagguguggguguccuguuggaggagggcuuguuuggagaagggaggcuggcugggggagaaa

SEQ ID NO: 445502 - RNA, 65 nt, hsa
ggggcucggaccccucacuggggacagggccaguguuggagaauucugauuccuuuuuuguuguc

SEQ ID NO: 445503 - RNA, 65 nt, hsa
ucagugagaauucgugcaucucugcucugugggguuuggagaaaugcuuuggcagaagagugaaa

SEQ ID NO: 445504 - RNA, 65 nt, hsa
gucuuguguaaacguuugcagacacaggugcagcuuuggagaacucaccucuggcucuugugcuu

SEQ ID NO: 445505 - RNA, 65 nt, hsa
aggggaagaugcuggacucauugaaaggugguugcuuggagaagggacauggggcugaaucucag

SEQ ID NO: 445506 - RNA, 65 nt, hsa
uccaaaaacuacauauuuguaggaaaucugccuuauuggagaaaaucacccuuucccuuuuucuu

SEQ ID NO: 445507 - RNA, 65 nt, hsa
uacuccauagcuaccaaguuaaccugcucuaaacuuuggagaacuggaucuguccaauaaacgcu

SEQ ID NO: 445508 - RNA, 65 nt, hsa
auugccacucaguuccucugggugugcacauauguuuggagaaauagaggagagaaaagagggcc

SEQ ID NO: 445509 - RNA, 65 nt, hsa
gccagauaucaaaccugaggaaggcagaagugaauuuggagaacuaggguagagagagguugcua

SEQ ID NO: 445510 - RNA, 65 nt, hsa
gaguugaaguccaaccuauuuaaaaaccccaccauuuggagaauuacaaggguuuuguccugaau

SEQ ID NO: 445511 - RNA, 65 nt, hsa
ccagccuucaugccuuccccacccuccagcuccucuuggagaagcuguugcugagaccccccccc

SEQ ID NO: 445512 - RNA, 65 nt, hsa
cucagaaaucaggacauccccccuaucaggugguuuuggagaaaacaaggaaggcggaagaaugg

SEQ ID NO: 445513 - RNA, 65 nt, hsa
uauuaacaacugaggaaggccagugcagaauauuuuuggagaacgauuuuuuuuuuaaauaauau

SEQ ID NO: 445514 - RNA, 65 nt, hsa
acaacaacauaaaaauccuugcauaccuuguucaauuggagaauuuuaauguuuuucauuuauca

SEQ ID NO: 445515 - RNA, 65 nt, hsa
guacaccuggcaucuguggcauguguucuggucacuuggagaagggcauguguggggugugugug

SEQ ID NO: 445516 - RNA, 65 nt, hsa
ggugugggcgcgucugugguguguguccuagucacuuggagaagggugugugugggaugcgugug

SEQ ID NO: 445517 - RNA, 65 nt, hsa
ggaacugucugcccaggagccugagccucaggcuguuggagaagcaucugaugccuuuuucuuug

SEQ ID NO: 445518 - RNA, 65 nt, hsa
uuauggaagcauguguaaaauuauacuuucaguaauuggagaauucagagauugcauuucuagca

SEQ ID NO: 445519 - RNA, 65 nt, hsa
accuuguauugugauauuaacuggcaaagauccucuuggagaaaccuuucccagguacaguuuca

SEQ ID NO: 445520 - RNA, 65 nt, hsa
auaaugaagcugauuuuuuagcugagauagaagcuuuggagaaaaugaaugaagaucacguucag

SEQ ID NO: 445521 - RNA, 65 nt, hsa
uuucguuuuuguuucccuuuaguauuuaauggucuuuggagaaaaaauaauaaaacagaguguua

SEQ ID NO: 445522 - RNA, 65 nt, hsa
auuuugccucccacacccagccacuaccucccagcuuggagaacaccucagaauucagaagauau

SEQ ID NO: 445523 - RNA, 65 nt, hsa
gauugcacgaguguguuuuccucacacacuuugauuuggagaauuggugcuaguuggcaauagau

SEQ ID NO: 445524 - RNA, 65 nt, hsa
guucacagagauggaugcauguucugauugccucuuuggagaagcucaucagaaacucaaaagaa

SEQ ID NO: 445525 - RNA, 65 nt, hsa
ugagcaucguggaugggugcacggagacacgcaccuuggagaaaugaggggagauggaccaagaa

SEQ ID NO: 445526 - RNA, 65 nt, hsa
uaggguuguuacaacugucacuagcggaggucacuuuggagaagggugggccuuacauccagugu

SEQ ID NO: 445527 - RNA, 65 nt, hsa
ucaauaaaauugcugggaauauuugacucuccguauuggagaaaauaaaauuacaacauuacgac

SEQ ID NO: 445528 - RNA, 65 nt, hsa
acaucauuacuggaaaccuauuaaacauuagcaaauuggagaauaguuuuaauauaguaaaugua

SEQ ID NO: 445529 - RNA, 65 nt, hsa
gugguagcgcugggggugauuuuaggcagcaagaauuggagaacucacacugcgaaaagaaaacc

SEQ ID NO: 445530 - RNA, 65 nt, hsa
guuggggugugaaagccucaagugacucagccugguuggagaacugccccacccaguaucuucug

SEQ ID NO: 445531 - RNA, 65 nt, hsa
aaagucuucaguaacgcuacaacgauugcaaaucauuggagaauccauaaugaagagagaucuuc

SEQ ID NO: 445532 - RNA, 65 nt, hsa
caacucaaaucauauuagacaucggagaaaucacuuuggagaaaggucuuuugagugcacugagu

SEQ ID NO: 445533 - RNA, 65 nt, hsa
ccuaaucaggugagccacucacccuccugcuggccuuggagaagcaaaaagccagggugugccag

SEQ ID NO: 445534 - RNA, 65 nt, hsa
agacuccacagugacuugccacauuugccccccauuuggagaaugcuuuuauaucaaaaguggag

SEQ ID NO: 445535 - RNA, 65 nt, hsa
uggaaaacaagaaauacugucaaggauguggaauguuggagaacauugugcacuaucacugggaa

SEQ ID NO: 445536 - RNA, 65 nt, hsa
uccguauaagcucaaugaguauugauuuaggggcuuuggagaacuuugaaugcuaccccccaagu

SEQ ID NO: 445537 - RNA, 65 nt, hsa
uuacuuaaacuuuguucaacaucagggaauucagauuggagaaaaacccugcaaauguaauaaau

SEQ ID NO: 445538 - RNA, 65 nt, hsa
uuuuauuuaguuagaacacuucauuuuguuuuuaguuggagaacucuauagcccuuuaguuauuu

SEQ ID NO: 445539 - RNA, 65 nt, hsa
uggacuacagcuuauucagccugggaaaaauaauguuggagaaauacucuaugaauagaauauac

SEQ ID NO: 445540 - RNA, 65 nt, hsa
cuuggacugcacuaacuuguggagucugcacuaacuuggagaaguuagugucagaauugaauuau

SEQ ID NO: 445541 - RNA, 65 nt, hsa
aaagucuucaguaaugcuacaacgauuacaaaucauuggagaauccauaaugaagagagaucuua

SEQ ID NO: 445542 - RNA, 65 nt, hsa
aaagucuucaguaacgcuacaaccauugcaaaucauuggagaaucuauaaugaauaaagaucuaa

SEQ ID NO: 445543 - RNA, 65 nt, hsa
aaaguuuucaguaaugcuacaaccauugcaaaucauuggagaauccauaaugagagaucuuacaa

SEQ ID NO: 445544 - RNA, 65 nt, hsa
aaaguuuucaguaaugcuacaaccauugcacaucauuggagaauccacagugaagagaucuuaca

SEQ ID NO: 445545 - RNA, 65 nt, hsa
cuaggcuaauugugacugugacuuacuucucccucuuggagaaagacuugaagaauguaaugcca

SEQ ID NO: 445546 - RNA, 65 nt, hsa
cuguacuuguaccuaaggcccuggguucaagagaguuggagaaaccccucuagaaacauauuggc

SEQ ID NO: 445547 - RNA, 65 nt, hsa
gcuuaugagugcagugaguccagucucauuaaauauuggagaauacacaccugaguaagauccug

SEQ ID NO: 445548 - RNA, 65 nt, hsa
cauggguaaauauguguugaauugguaacucccucuuggagaauuucuugugaauuacacagcaa

SEQ ID NO: 445549 - RNA, 65 nt, hsa
gucaugugagugaagagaugucacugucuguggucuuggagaacuagucucguagcugaggggug

SEQ ID NO: 445550 - RNA, 65 nt, hsa
gccaaccaccuugaaaccuuuagaacaucucugcuuuggagaaagacccagagaucaggcagagg

SEQ ID NO: 445551 - RNA, 65 nt, hsa
aagauguuaaaacagucccguggaaggagcagggguuggagaaaggcaucccaaagcuucgaugg

SEQ ID NO: 445552 - RNA, 65 nt, hsa
acucucagagacucccaggaguuguugaacuauauuuggagaaaacagccacugaauauuaucau

SEQ ID NO: 445553 - RNA, 65 nt, hsa
uugggguaaaugcuuugaggcccagggaccaaucuuuggagaaaguagauauuuccaucaaagcc

SEQ ID NO: 445554 - RNA, 65 nt, hsa
augcgaauacagcucacagagaaacgcaugugcuauuggagaacaggucuuuguggagaucuaaa

SEQ ID NO: 445555 - RNA, 65 nt, hsa
auguaacauuuaaacauuaauuuaaaaagggaaccuuggagaauucuuuuguucacuaguuccuu

SEQ ID NO: 445556 - RNA, 65 nt, hsa
acugcagcgccaagcggcauccaccaagcaucaaguuggagaaaagggaacccaagcaguagaga

SEQ ID NO: 445557 - RNA, 65 nt, hsa
cucuagguuuccaggccucacagccaagcugaagcuuggagaaaacucugcauucccaugagggc

SEQ ID NO: 445558 - RNA, 65 nt, hsa
gaggcugaggugggagaaucacuugaguccuggaguuggagaacagccuggaaagccuggcgaua

SEQ ID NO: 445559 - RNA, 65 nt, hsa
cugagcaccuuggugagcaagccuggcuuuaaagauuggagaagagcuucuggcaccagaacccu

SEQ ID NO: 445560 - RNA, 65 nt, hsa
uaccuuugcaguguugccgaaucacagcaguucuguuggagaaacgcuugguuuccggauccaga

SEQ ID NO: 445561 - RNA, 65 nt, hsa
aaauuuccucccugccucaugugagaccacaggguuuggagaagcaguuggaacccacguguggu

SEQ ID NO: 445562 - RNA, 65 nt, hsa
ggaaagccacuuacuggcuuuugacaugacuucucuuggagaauaaguggacuccaagcuaacuc

SEQ ID NO: 445563 - RNA, 65 nt, hsa
agucagguguuccuuccuaaaaaaaaaagucuauuuuggagaauugaaauaauucauggaaggga

SEQ ID NO: 445564 - RNA, 65 nt, hsa
aaacaccuccugaguuuugcaauugagaaaaugauuuggagaacuucucuucugguaauuuuuau

SEQ ID NO: 445565 - RNA, 65 nt, hsa
cucuuccucuccaaagcgccagaaccuccuucucuuuggagaauggggaggccucuuggagacac

SEQ ID NO: 445566 - RNA, 65 nt, hsa
ugggacugguggugccaagauaaggguuucucaaauuggagaaccccuccuuguugcaugagguc

SEQ ID NO: 445567 - RNA, 65 nt, hsa
uccuguacaugaaccaggucauguuuggccuuguguuggagaaagagaauuauccccacuucaca

SEQ ID NO: 445568 - RNA, 65 nt, hsa
aaccaaccccaacaacaaaaaagaauguuuugguauuggagaagggauggucaguuagccugucu

SEQ ID NO: 445569 - RNA, 65 nt, hsa
gaccugccagcucucggaguccuuggugguugaacuuggagaaagaccgcaugaagauacuugua

SEQ ID NO: 445570 - RNA, 65 nt, hsa
caguuaucuuuagcagauauuaaaaauugaaaacuuuggagaacucauuucaaguuaugauucag

SEQ ID NO: 445571 - RNA, 65 nt, hsa
gugccuucagcaggacucuuaauaucugcugcaacuuggagaaccucccugcccugaaaugugaa

SEQ ID NO: 445572 - RNA, 65 nt, hsa
auuacaaacacgggcggaaggcacucaggcuuucguuggagaaacagaaauaaggccuucuuuug

SEQ ID NO: 445573 - RNA, 65 nt, hsa
uguaggaagaaaaaggaugcauucccuacagauuuuuggagaaaggauuucugaggaguguguga

SEQ ID NO: 445574 - RNA, 65 nt, hsa
gaaacucauucuuacgaaauuagaacgacuucacguuggagaaagcaugaagagguauucaucug

SEQ ID NO: 445575 - RNA, 65 nt, hsa
gcagcaagccugcacacgggcuuggguggguuccuuuggagaagauguggcuggaacacaaacaa

SEQ ID NO: 445576 - RNA, 65 nt, hsa
ucucgcugggaccuggucccuuuguugcaggcggcuuggagaaagggcagugggacgcuggccac

SEQ ID NO: 445577 - RNA, 65 nt, hsa
ggccaguugcagguuaagccccagaaaaguucaccuuggagaagcuccgagaacacacagauugu

SEQ ID NO: 445578 - RNA, 65 nt, hsa
aucaagaauauuuguggagguagguguggggaagguuggagaagaguuagguuugugcuuuguaa

SEQ ID NO: 445579 - RNA, 65 nt, hsa
aauuggcucuuuggaggcgagaggaaggggagaacuuggagaauaguuuuugcuuuggggguaga

SEQ ID NO: 445580 - RNA, 65 nt, hsa
ccuccccuacuucucccuugcucccaaagcuuuccuuggagaagggcccuccugcagcuggaccc

SEQ ID NO: 445581 - RNA, 65 nt, hsa
gcuggaggcugugugcgggcaggcuugugcuccccuuggagaagggcugcuacuuaacaaggaag

SEQ ID NO: 445582 - RNA, 65 nt, hsa
acaucaaugcuuuuccucaggaaauucggcaagacuuggagaaaaggaaagcuccaucaaagagg

SEQ ID NO: 445583 - RNA, 65 nt, hsa
aucuuuuccaaguucccaaggccuacagcugaagguuggagaaaugccagcugcccuuucguccc

SEQ ID NO: 445584 - RNA, 65 nt, hsa
aaggccgucuccccuuagccaaguccuccucaggcuuggagaacuuccucagcgucaccuccuuc

SEQ ID NO: 445585 - RNA, 65 nt, hsa
agucgcgcaccgaaaaacuaaaaauaaugggcgcuuuggagaagaguguggagucauucucauug

SEQ ID NO: 445586 - RNA, 65 nt, hsa
uuuuuuauuucagucacuccugauaaauaacaaauuuggagaaauaaaaauaucuaaaauaaauu

SEQ ID NO: 445587 - RNA, 65 nt, hsa
gaaagggcacuuggcaaccacuaugugaagggugauuggagaaggacaagacuguggaaugggga

SEQ ID NO: 445588 - RNA, 65 nt, hsa
caagacuguggaauggggaauaaggaaggaggaguuuggagaaugacuccaaagguuugagcuug

SEQ ID NO: 445589 - RNA, 65 nt, hsa
cggugaggcacucuggaauaugacccuaccagagguuggagaacaaacuugggcagccggaaccc

SEQ ID NO: 445590 - RNA, 65 nt, hsa
ccugaugaucaaccugccuccccuccauagucuuguuggagaagcccagagagaaugggacucca

SEQ ID NO: 445591 - RNA, 65 nt, hsa
gagauggcgucuaccagaaggggauggacuucauuuuggagaagcucaaccauggggacugggug

SEQ ID NO: 445592 - RNA, 65 nt, hsa
aacucaaugaaauaagcugcuaaucagauuuuaccuuggagaaaugaaaauuauuucuuggggau

SEQ ID NO: 445593 - RNA, 65 nt, hsa
gugcaauuuuuaaaaucuagaaguuagggguuuuguuggagaaaaauggacugaucuuuaaacua

SEQ ID NO: 445594 - RNA, 65 nt, hsa
cacaagacucucagguauagaaugaacugagcaauuuggagaauguauuggacuuuguccucucu

SEQ ID NO: 445595 - RNA, 65 nt, hsa
auugccuucuuugccuagccaagcagccaauuuuauuggagaaaagcaaguuauauguucacaaa

SEQ ID NO: 445596 - RNA, 65 nt, hsa
cuugguuggaagggaauagaaauguuugcugaacauuggagaaucucaacaugucuccuacugag

SEQ ID NO: 445597 - RNA, 65 nt, hsa
gugugcaauauucuuaaauacuacugcucuaaaaguuggagaagucuugcaguuaucuuagcauu

SEQ ID NO: 445598 - RNA, 65 nt, hsa
augaaugagcaacaccaugcauauagauugaguacuuggagaauacucacguuuuuuaacucaug

SEQ ID NO: 445599 - RNA, 65 nt, hsa
ggagggauagaacaucacaacacugcucuaguuucuuggagaaucacauuucuuuacagguuaaa

SEQ ID NO: 445600 - RNA, 65 nt, hsa
gauaaaacucagaggaaauuugcacagaugcugcuuuggagaacuuuacaaccuggguugcagaa

SEQ ID NO: 445601 - RNA, 65 nt, hsa
ucucuguugaucacagagggagccugaguacaggcuuggagaaauggcuaggacagggaacaggg

SEQ ID NO: 445602 - RNA, 65 nt, hsa
cuuccaucuugcugugauuugcaauagguauuuucuuggagaauguaagaacuuaacaauaaagc

SEQ ID NO: 445603 - RNA, 65 nt, hsa
cuguauaugcuggguauuucauuugucuuuuuauuuuggagaaagcguuuuuaacugcaacuuuc

SEQ ID NO: 445604 - RNA, 65 nt, hsa
uucauauaauuaaaaagaauuugguuaauaagaauuuggagaauggaaaauacauuuuuagguuc

SEQ ID NO: 445605 - RNA, 66 nt, hsa
augccuaugggugacugccuucucccagaguuuucuuuggagaacagaaagaagaaaggaaagaaa

SEQ ID NO: 445606 - RNA, 66 nt, hsa
auaguuucugaaaccgcucagauguuuuggggaaaguuggagaagccguggccuugcgagaggugg

SEQ ID NO: 445607 - RNA, 66 nt, hsa
agggacccgggcaggcccccagcaccccaugcugacuuggagaaccccagaucucuggggcccagc

SEQ ID NO: 445608 - RNA, 66 nt, hsa
ucgcagacaccggggcuggguuucucuuuccucuuuuuggagaaaaggaacagggcaguggaauga

SEQ ID NO: 445609 - RNA, 66 nt, hsa
uuaaacccuuuccuccucccauuuugacauuugcacuuggagaacacuugaguugugaagguuuug

SEQ ID NO: 445610 - RNA, 66 nt, hsa
aucuggaggggagagaaggauucuagggguguggaguuggagaaagaggcuuccuugagccacccu

SEQ ID NO: 445611 - RNA, 66 nt, hsa
cuacauuaggaaacaauggcagucaaacccauggcuuuggagaaaguaaauguuugccagaaagga

SEQ ID NO: 445612 - RNA, 66 nt, hsa
gggugcuggugcggauggacacuaaugcagccacgauuggagaauacuuugcuucauaguauugga

SEQ ID NO: 445613 - RNA, 66 nt, hsa
uuaucagagcaaacaucauguagauagcacaaguauuuggagaaacguuguuuguuuuguuaccaa

SEQ ID NO: 445614 - RNA, 66 nt, hsa
uaauaauuuaaaauaauuauuguauaauaucuacauuuggagaauuuugaacuaucaagcauauac

SEQ ID NO: 445615 - RNA, 66 nt, hsa
uaagacgguaaaggcacuaaagucacuuuaaagcuuuuggagaagcaggagggcauuggcuuaacc

SEQ ID NO: 445616 - RNA, 66 nt, hsa
ccaaaucugaaggacuucaucucccgcuuugagggcuuggagaagaucucugccuacaugaagucc

SEQ ID NO: 445617 - RNA, 66 nt, hsa
guaccuggcauggacugauguuuuuaggcacagaaguuggagaagagauuucaugaaagacaacau

SEQ ID NO: 445618 - RNA, 66 nt, hsa
uucuguguuuucagaauuuccauuucuacuaaccucuuggagaaaaagaaauugaauuagagguaa

SEQ ID NO: 445619 - RNA, 66 nt, hsa
agcccuaaaagcuggagacacagauguccagagugauuggagaauguccugggggaaugaaguucc

SEQ ID NO: 445620 - RNA, 66 nt, hsa
cuuucccugaggcuuuggggucagaguauauguuguuuggagaaagagggcaaucaggacucuucu

SEQ ID NO: 445621 - RNA, 66 nt, hsa
uuuucuggccuggcuuucccucucagacauagcucuuuggagaacuagguguuguaauucaguuau

SEQ ID NO: 445622 - RNA, 66 nt, hsa
uacauugucaaaacuaccaauuccagguuaacuuuguuggagaauuucccccacccccauccagug

SEQ ID NO: 445623 - RNA, 66 nt, hsa
ccugcugguuccccagcccuuuucccuggcccuggcuuggagaaucuguuuucaaucuccacugau

SEQ ID NO: 445624 - RNA, 66 nt, hsa
gacuuggaggcaggauccaggcacagcuccccucacuuggagaaccuugacucucuugauggaaca

SEQ ID NO: 445625 - RNA, 66 nt, hsa
uaauaaaacacugucuuuucaggauugcuucauggauuggagaacuuucuaaccaaaaauuaaaaa

SEQ ID NO: 445626 - RNA, 66 nt, hsa
uuagacuuaguaccagaaccaaaaauaccuagauuuuuggagaacuuauuacauacauagaaacau

SEQ ID NO: 445627 - RNA, 66 nt, hsa
uagaacccagccuacucuagaauuucagcagugacauuggagaauauuuuuaauuugcugcaguac

SEQ ID NO: 445628 - RNA, 55 nt, hsa; identical to SEQ ID NO: 445050

SEQ ID NO: 445629 - RNA, 66 nt, hsa
agggcaaggagagaagugagagcuacaauuccagcauuggagaagcgaggggcggggcgucaacgg

SEQ ID NO: 445630 - RNA, 66 nt, hsa
ccaggggcuaguuuggcuuuuccaaguggguuuucuuuggagaaucugaugccaugcaauuggcau

SEQ ID NO: 445631 - RNA, 66 nt, hsa
uuugucguagacuugugcaauauauacuguuguggguuggagaaaaguggaaagcuacacugggaa

SEQ ID NO: 445632 - RNA, 66 nt, hsa
gcugguaggcaaauuguuaggcagaauaaugguauguuggagaaauacaccugucucuuauucuua

SEQ ID NO: 445633 - RNA, 66 nt, hsa
guaccuuugguaaauacaccauaccauaauaucugcuuggagaaccacaaugcacauuagcauauu

SEQ ID NO: 445634 - RNA, 66 nt, hsa
uuaauuaacuagcauuuagccagcuuuuucuugcccuuggagaaaaagaaucauucucaaccugau

SEQ ID NO: 445635 - RNA, 66 nt, hsa
ucuuuuauuuuaauacauuguaggaaaucuucauaauuggagaaaguucugcagcauggcuuuuua

SEQ ID NO: 445636 - RNA, 66 nt, hsa
ugcuguggcuccauauuucaacuaaaaauauaucuguuggagaaagaaauuaacaauaaagaauuu

SEQ ID NO: 445637 - RNA, 66 nt, hsa
ggucauuagaaacaauugguuaaugggggagccuaauuggagaaugaugcugagaauuuguauuga

SEQ ID NO: 445638 - RNA, 66 nt, hsa
ugccaaggcggcggcagagcuggucuucuggucuccuuggagaaagguucuguugcccugauuuau

SEQ ID NO: 445639 - RNA, 66 nt, hsa
cuauaaaacagacuuacucuccuuggaggauauauuuuggagaaugcuucauaaaaucuaugaaua

SEQ ID NO: 445640 - RNA, 66 nt, hsa
cauguacgcaaagggcagccccaggcugucuggaaguuggagaauucccuaucagcacagggaucu

SEQ ID NO: 445641 - RNA, 66 nt, hsa
ucuaggaaagacauguaagagcauggacauuuuacuuuggagaaacagaaaaaucuuggggcuucc

SEQ ID NO: 445642 - RNA, 66 nt, hsa
aacgcuuuuuggaagacauuucuguagcaugucaguuuggagaaaugaugagcuacgccuugauga

SEQ ID NO: 445643 - RNA, 66 nt, hsa
guuccugaguuaaaagucuauuuauuuacuuccuuguuggagaagggcaggagaguaccugggaau

SEQ ID NO: 445644 - RNA, 66 nt, hsa
cggcuccagguggaagcaugcuuucccuuguuacuguuggagaaacucaaaccuucaagcccuagg

SEQ ID NO: 445645 - RNA, 66 nt, hsa
uauuccauagaaaacuguagaaagauaucuguaucuuuggagaaggagaaagaaaggaaagaacuc

SEQ ID NO: 445646 - RNA, 66 nt, hsa
aguuauaguuuuauaacuggcuuaaguuaaguuuuauuggagaaaucuugccuauaauucuauaaa

SEQ ID NO: 445647 - RNA, 66 nt, hsa
uucuuuuuacuguugaacuuagaacuaugcuaauuuuuggagaaaugucauaaauuacuguuuugc

SEQ ID NO: 445648 - RNA, 66 nt, hsa
uucaucccauccuugccaaaaaauaagaaaacugucuuggagaaugggucagaagccccaaacggc

SEQ ID NO: 445649 - RNA, 66 nt, hsa
uuuuucuuggacuacuuuaauuuggauccuuuggguuuggagaaagggaaugugaaagcugucauu

SEQ ID NO: 445650 - RNA, 66 nt, hsa
aauacaagccuuggguccauguuuacucucuucuauuuggagaauaagauggaugcuuauugaagc

SEQ ID NO: 445651 - RNA, 66 nt, hsa
uaaaaaaugccuuuucauuggucuuaagagaccgcauuggagaauuucaggcuuuugauaaaugcu

SEQ ID NO: 445652 - RNA, 66 nt, hsa
gucccagagcugaggcaaggggauuucucaggucauuuggagaacaagugcuuuaguaguaguuua

SEQ ID NO: 445653 - RNA, 66 nt, hsa
gaagugcuauguggcgagaaaaaaaguuuuaauguauuggagaaguuuuaaaaaacccagaaaaac

SEQ ID NO: 445654 - RNA, 66 nt, hsa
gugagaccaaagggauaucuguucccuguuaccuuuuuggagaauucauaacauuugaagaucaaa

SEQ ID NO: 445655 - RNA, 66 nt, hsa
cguaggcacggacacacccagucucaaugcacgaaguuggagaaccugacagggcugguccaggcc

SEQ ID NO: 445656 - RNA, 66 nt, hsa
ccaggaaggcggcaggcagagaaguggagugacuauuuggagaauagcacccauaucugugugccc

SEQ ID NO: 445657 - RNA, 66 nt, hsa
gauacacucuaucacauauuuaagcaaacaucacauuuggagaagaggaaaucauaaaaucauccu

SEQ ID NO: 445658 - RNA, 66 nt, hsa
ucauguauauauuacucugcacuauaucccuucuuuuuggagaacuagccauuauuuuagccacag

SEQ ID NO: 445659 - RNA, 66 nt, hsa
ucucuuccuguucugcaccccucuccccaugggaccuuggagaaaacugaacuguuacaaaccccu

SEQ ID NO: 445660 - RNA, 66 nt, hsa
augaucaugagguuaaaauuuucuucauuaggggacuuggagaaccaguagucguaagauuaguug

SEQ ID NO: 445661 - RNA, 66 nt, hsa
guguaccagcagugugucaggugcugcagagcguucuuggagaaggcccacugaggcagguucgug

SEQ ID NO: 445662 - RNA, 66 nt, hsa
uauaccuggcauagagaaaaauauauaccugguacauuggagaaaaauaauuacacuuucaaagag

SEQ ID NO: 445663 - RNA, 66 nt, hsa
augguuguaaguggacaugcaaaccaaaauuggggauuggagaagucagacucacuagacuuuugg

SEQ ID NO: 445664 - RNA, 66 nt, hsa
guaaauuccugucaaaaucaauucagaaauucuaacuuggagaauuuaacauuuuacucuuguaaa

SEQ ID NO: 445665 - RNA, 66 nt, hsa
uucaucuugcaagcaaaucccauuucuugaaaagccuuggagaacucgguuugguagacuuggaca

SEQ ID NO: 445666 - RNA, 66 nt, hsa
aggcagugauuuuguuccaaaacuuuguauacacauuuggagaaaaguacuuuauauuuucagugu

SEQ ID NO: 445667 - RNA, 66 nt, hsa
cccugcaagaaauauacugacaugaacaggcaguucuuggagaagaaagagcauuucuuuaaguac

SEQ ID NO: 445668 - RNA, 66 nt, hsa
ugcacuccagccugggcaacagagcaagacccugucuuggagaaaccagaauuuuggaagagcaaa

SEQ ID NO: 445669 - RNA, 66 nt, hsa
ugugaguggcucuuugcaugaacacugugcaagguguuggagaaauccaaagcugaccaaaacaug

SEQ ID NO: 445670 - RNA, 66 nt, hsa
gcuggccuucacgcucuugaucgucuuuccuuuguauuggagaaggacugggucagagaucuguug

SEQ ID NO: 445671 - RNA, 66 nt, hsa
caguguuuuuuacucuuuucucaugcacauguuacguuggagaaaauguuuacaaaaaugguuuug

SEQ ID NO: 445672 - RNA, 66 nt, hsa
gagacugacaccucacugaggaagggagacauauucuuggagaacuuuccaucugcuuguauuuuc

SEQ ID NO: 445673 - RNA, 66 nt, hsa
gagauaucaaguuuugaauauuauucaggaagcacuuuggagaaugugggaguccuacuguuuugc

SEQ ID NO: 445674 - RNA, 66 nt, hsa
gugggugagaagcaggcuggugagacugggcugagguuggagaaggggcagccgggggcacugcug

SEQ ID NO: 445675 - RNA, 66 nt, hsa
gcucacuuuauucuuguauggcuuugguaggcauacuuggagaacauaucccacauuaggaauuga

SEQ ID NO: 445676 - RNA, 66 nt, hsa
aagccugagaguuugagggcuuuaauccuuuaaaacuuggagaagcuggcugggcgcgguggcuca

SEQ ID NO: 445677 - RNA, 66 nt, hsa
agcauuuauuugaugacuuaauauuuuucacuaccuuuggagaacagaugaacauuauucaccaug

SEQ ID NO: 445678 - RNA, 66 nt, hsa
uguucaauuagcaguucaaauuaaagaagaugguuauuggagaacuuuuuugaaugguuuuguauu

SEQ ID NO: 445679 - RNA, 66 nt, hsa
uaaugcaucuuuuuuccucugccauucuuguguugauuggagaauuuuucuguauguaauuagaaa

SEQ ID NO: 445680 - RNA, 66 nt, hsa
uguuucuggauuucauacuguaacauucaggaauucuuggagaaaauggguuuauucacugaacuc

SEQ ID NO: 445681 - RNA, 66 nt, hsa
aggcucggaaagccuuaagcaaagaugggaggauuuuuggagaauccaucaugauugguguaaaac

SEQ ID NO: 445682 - RNA, 66 nt, hsa
aguccucucaaaacaaacacccucuugcaaccagcuuuggagaaagcccagcuccugugugcucac

SEQ ID NO: 445683 - RNA, 66 nt, hsa
ucuggcuggcccuguaauuuaaauuaaaauaaaauuuuggagaaacagcauugucugucuuuauga

SEQ ID NO: 445684 - RNA, 66 nt, hsa
cugagggacacaaggacuugggugcaucaggacgccuuggagaagcguggcuuccugccacccugc

SEQ ID NO: 445685 - RNA, 66 nt, hsa
ugugcagagagaggcaggaaggaucccugaagagucuuggagaaaagguucugugcccucaggugg

SEQ ID NO: 445686 - RNA, 66 nt, hsa
aguaucugaaucacuggggauuaugauucacccucuuuggagaacaugcucucuuuucacccccca

SEQ ID NO: 445687 - RNA, 66 nt, hsa
uugcuuauauuuaucgcuuggcucaaguucugcccuuuggagaaauacugagcaagucuuucauuc

SEQ ID NO: 445688 - RNA, 66 nt, hsa
augguuaaguauauaauaaauugaacaucuuugagauuggagaauuaugugagauuuccacauuau

SEQ ID NO: 445689 - RNA, 66 nt, hsa
gcucagggccaugcugaggccugggccgcugccacguuggagaagcccgugugagaagugaaugcu

SEQ ID NO: 445690 - RNA, 66 nt, hsa
ugggucugcgaugcagcggcgugaggccugggcugguuggagaaggucacaacccuucucuguugg

SEQ ID NO: 445691 - RNA, 66 nt, hsa
cucuugcacuacaccucuguugugaggacuaccauuuuggagaagguucuguuugucucuuuucau

SEQ ID NO: 445692 - RNA, 66 nt, hsa
ugucuuuuccugugcuuacgggccaugcguauuucuuuggagaaaggucuauccagguccuuugcc

SEQ ID NO: 445693 - RNA, 66 nt, hsa
gcacagaaauucuguugaagacaguugagaauuccuuuggagaaaacagcccagcuuggcgugggg

SEQ ID NO: 445694 - RNA, 66 nt, hsa
ugugacgcuacuaaccugacaucaccaaguguggaauuggagaaaagcacaaucaacuuuucugag

SEQ ID NO: 445695 - RNA, 66 nt, hsa
aauagaauuuuuaaauaguauauauucaguggcauuuuggagaacaaagugaauuuacuucgacuu

SEQ ID NO: 445696 - RNA, 66 nt, hsa
gguguuuguuuuuaucaaaaugucaaaauaacauacuuggagaaguauguaauuuugucuuuggaa

SEQ ID NO: 445697 - RNA, 66 nt, hsa
uuuuucuagagguuggcuuucaauucuguagcauacuuggagaaacugcauuaucuuaaaaggcag

SEQ ID NO: 445698 - RNA, 66 nt, hsa
ggcaguguuccucaccaauaacuucagagaagucaguuggagaaaaugaagaaaaaggcuggcuga

SEQ ID NO: 445699 - RNA, 66 nt, hsa
gcugguaccgucuaguacuaugcagcgguccucaaguuggagaaaaugugccuuucauucauuacc

SEQ ID NO: 445700 - RNA, 66 nt, hsa
cagaauaugccugcucaaaauuaauagcacagcaguuuggagaagaaaugaaggugucaaagaguc

SEQ ID NO: 445701 - RNA, 66 nt, hsa
guuuggaaaaucacacaguuuucaggcuccaucuguuuggagaaaauacauucugaagcaucccca

SEQ ID NO: 445702 - RNA, 66 nt, hsa
agauggaaauggauuggauugucaaauuauuauuuauuggagaaaaaaaccugaucuacacauuuu

SEQ ID NO: 445703 - RNA, 66 nt, hsa
gaaacuuaggaaauagugaauaaggugcauuuaacuuuggagaaauacuuuuauggcuuuggugga

SEQ ID NO: 445704 - RNA, 66 nt, hsa
ggugguuuuugaacaggaaaaucauaauucauaucauuggagaaguauuuauuuucaaauaucaaa

SEQ ID NO: 445705 - RNA, 66 nt, hsa
agaggagucagagagaaucccuagucuucaagcagauuggagaaacccuugaaaagacaucaagca

SEQ ID NO: 445706 - RNA, 66 nt, hsa
acuaaaugaaaaggacacauucugaaaucccuuuuguuggagaauaagucagucugaggggaaaug

SEQ ID NO: 445707 - RNA, 66 nt, hsa
agaaauaaguccuagacuggacucuugagggacauauuggagaaucuuaagaaaugcaagcuuguu

SEQ ID NO: 445708 - RNA, 66 nt, hsa
uuucccaggaaauuagcuuuccagccccuuuauauauuggagaaguuguuuuagcuucugcagaag

SEQ ID NO: 445709 - RNA, 66 nt, hsa
uuacauuguucuugguuuuguuucucgaucuuuuguuuggagaacagcuggcuaaggaugacucua

SEQ ID NO: 445710 - RNA, 66 nt, hsa
uguucauuuguuccuuggaccuuaaucauuugcauuuuggagaaaauuuuuucugcuuuaaaaguc

SEQ ID NO: 445711 - RNA, 66 nt, hsa
aagaguuuaggaauucuacuagccagagauagucacuuggagaaacuuucuauauauccuucuaaa

SEQ ID NO: 445712 - RNA, 66 nt, hsa
aaaaucuugaugucauuacuccugaauuauuacauuuuggagaauaagagggcauuuuauuuuauu

SEQ ID NO: 445713 - RNA, 66 nt, hsa
uguuuugauccaagucaaguguagccucucagccuuuuggagaaaaaugaaacaauuuauuucaac

SEQ ID NO: 445714 - RNA, 66 nt, hsa
ggugggcagagcccugacccacagcuguguuacugcuuggagaagcauauguaggggcauacccug

SEQ ID NO: 445715 - RNA, 66 nt, hsa
ucuauuuaaaguugccugaagauuuugcugugguguuuggagaagcagagggugaacuugcuguug

SEQ ID NO: 445716 - RNA, 66 nt, hsa
gagauuugcucagcuuuuugaaauguuaagauguguuuggagaaggcugcaugacuuuguuuuucc

SEQ ID NO: 445717 - RNA, 66 nt, hsa
accuaggcagcagccaccuucucaggaaacaaggccuuggagaaaucagugccugugugaagaugg

SEQ ID NO: 445718 - RNA, 66 nt, hsa
cagcuggaccuuccauucuagaauuaugagaccaccuuggagaaaggugugugguacaugacauug

SEQ ID NO: 445719 - RNA, 66 nt, hsa
cuuucucuguuugccuuggguugaauaacuuaucuuuuggagaauagcuuuaaguggcuuagacac

SEQ ID NO: 445720 - RNA, 66 nt, hsa
gacaaguuggaugacacuacucccaacuuuuuaaauuuggagaaaaccaucaaggucgaggaagcc

SEQ ID NO: 445721 - RNA, 66 nt, hsa
gaagaaauugcuagauuacccaaagaaauagaucaguuggagaaaauacaaaacaauucaaagcuc

SEQ ID NO: 445722 - RNA, 66 nt, hsa
aaguauuuaaaagaaauaccagugagugccuuaaaguuggagaaguaacugcccaugcccagaaau

SEQ ID NO: 445723 - RNA, 66 nt, hsa
caugaauaaaaaauaauuuugcuguuguaguauacauuggagaaacuggcagguuuuauuuccauu

SEQ ID NO: 445724 - RNA, 66 nt, hsa
ugucugaggguguacguuugauaugaucaugccagauuggagaagauccaagccaggaagaugggc

SEQ ID NO: 445725 - RNA, 66 nt, hsa
aggcaaagacacgggaacugaaaaacuccacaggguuuggagaauagaaaugaaaagccacgucau

SEQ ID NO: 445726 - RNA, 66 nt, hsa
uacaagacuuugggcucuuaugucacaucacaugauuuggagaaauuagacacaaucucuuauuuu

SEQ ID NO: 445727 - RNA, 66 nt, hsa
uuucaauuguccuucagauaauucauguggagauuuuuggagaaaccaugacggauaguuuaggau

SEQ ID NO: 445728 - RNA, 66 nt, hsa
accuguacaguauuugcauuccacagauggaacgguuuggagaagcacuuuuucauacuuuuguga

SEQ ID NO: 445729 - RNA, 57 nt, hsa; identical to SEQ ID NO: 445151

SEQ ID NO: 445730 - RNA, 66 nt, hsa
uguucagucugaaaugcagcucccuguccaagugccuuggagaacucacagcagcacgccuuaauc

SEQ ID NO: 445731 - RNA, 66 nt, hsa
cccugaagcacauacaagcacccugguggaagaagcuuggagaagaaucuggagaugagauugaug

SEQ ID NO: 445732 - RNA, 66 nt, hsa
augccugggcuguggaccuacugggcauuugaggaauuggagaauggagauggcaagagggcaggc

SEQ ID NO: 445733 - RNA, 66 nt, hsa
acgaugccaaguacaccugcaaggcugucaacagucuuggagaagccaccugcacagcagagcuca

SEQ ID NO: 445734 - RNA, 66 nt, hsa
ggcuugccaaaaaaaaaaaaaaaaaaaaaucagaaauuggagaaauccuuagcacaauuuucuaaa

SEQ ID NO: 445735 - RNA, 66 nt, hsa
cgcugcccaggugggguuuccugcauggacaguuguuuggagaacaacaaggacaacuuuauguag

SEQ ID NO: 445736 - RNA, 66 nt, hsa
acuugaauuuuuuggggacuauuaaggguguuagucuuggagaagacacagccucaccuucucacu

SEQ ID NO: 445737 - RNA, 66 nt, hsa
acuuauuucuuaacugcuauuuggcagaagcugaaauuggagaaccaaggagcaaaaacaaauuuu

SEQ ID NO: 445738 - RNA, 66 nt, hsa
ccucuuugugacacuucauccugaugccaagauuuuuuggagaacaucugcacuuucuuauauaua

SEQ ID NO: 445739 - RNA, 66 nt, hsa
uaaaugauuguaugcuuaugcugaacaccuuucauauuggagaaucaugcauuugggucacuaauu

SEQ ID NO: 445740 - RNA, 66 nt, hsa
aagaugaaauaaacuuauuacuuuaaaggaaaggauuuggagaauugaacucacaaacugauguua

SEQ ID NO: 445741 - RNA, 66 nt, hsa
cguacuucggcugcaugagauaaucacuugggagcuuuggagaaaauagcaguaccaagggaucuc

SEQ ID NO: 445742 - RNA, 66 nt, hsa
cccacgcccaucuggagugggagcugggagucaguguuggagaagaaacaacaaaagccaauuaga

SEQ ID NO: 445743 - RNA, 66 nt, hsa
aaucucuaauuccagugucuuuacacagcaaauaaauuggagaauauugcucccauauaaacuugu

SEQ ID NO: 445744 - RNA, 66 nt, hsa
uguuuucaguuucuuuccuucugugaacgaugagacuuggagaacgggcugguccuucaccacuuc

SEQ ID NO: 445745 - RNA, 66 nt, hsa
ugugaggugccgagcugggugcuugacaucauuugcuuggagaagcagcugcuaguagacccauuu

SEQ ID NO: 445746 - RNA, 66 nt, hsa
auacaucaauauguauauauguauuucuauauagacuuggagaauacugccaaaacauuuaugaca

SEQ ID NO: 445747 - RNA, 66 nt, hsa
uuuuuggguguggaggccauuuuuagagauacagaauuggagaagacuugcaaaacagcuagauuu

SEQ ID NO: 445748 - RNA, 66 nt, hsa
gugugucauguugguuuuugguacuuguauugucauuuggagaaacaauaaaagauuucuaaacca

SEQ ID NO: 445749 - RNA, 66 nt, hsa
aucuaucugggaacacugagaagggugaccaaugcguuggagaacgagggagggcuucauagcaga

SEQ ID NO: 445750 - RNA, 66 nt, hsa
gcaaaagagcaugcagugcuguugaauaacccucacuuggagaaccaagagaauccugucguuuaa

SEQ ID NO: 445751 - RNA, 66 nt, hsa
uugccccugaauguggucgaugccaaaggaagauccuuggagaagucaucagugcguugaaacaaa

SEQ ID NO: 445752 - RNA, 66 nt, hsa
guuugcagagugugugcuuggcuguggcagccuagcuuggagaagcugcuguuggugcaagggaga

SEQ ID NO: 445753 - RNA, 66 nt, hsa
ucccagcuuucuugcuugccuucugugcaauauuucuuggagaauuuggaugccuaaggcauaaag

SEQ ID NO: 445754 - RNA, 66 nt, hsa
uauuuucugugccuucaagggacaacuuuuuuaacuuuggagaaaagaaaaacacucuauaacaga

SEQ ID NO: 445755 - RNA, 66 nt, hsa
agcuuuauaccuagcaagccacuucaggaaauucuuuuggagaauauuuucugauuauuguuaaac

SEQ ID NO: 445756 - RNA, 66 nt, hsa
uuaaugcugggaacacaaauagugcaauuugugcaauuggagaaucuugccuuuuuucuuggcucc

SEQ ID NO: 445757 - RNA, 66 nt, hsa
caacaggauucacauuguuaauuuauaaaucuagacuuggagaauuaaggacugagaaaugaccau

SEQ ID NO: 445758 - RNA, 59 nt, hsa; identical to SEQ ID NO: 445180

SEQ ID NO: 445759 - RNA, 66 nt, hsa
auagcaacugcagcuaacaggcugauuuucuggccuuuggagaagugauucaaaauaguguagauu

SEQ ID NO: 445760 - RNA, 66 nt, hsa
gaaaguauaugaaaauauacuggaaauauuggauucuuggagaaaacuguucagucacagauauau

SEQ ID NO: 445761 - RNA, 66 nt, hsa
cuacaugugugccccuaaagacacauuuacucaauauuggagaaguagauaaugaauuaagcaacu

SEQ ID NO: 445762 - RNA, 66 nt, hsa
gccuaguguuuucauaauguaauucaaugaaaacuguuggagaaauauuuaaacaccucaauguag

SEQ ID NO: 445763 - RNA, 66 nt, hsa
guagguuuuaaaaauaaguuuuauacauaaacaguuuuggagaaaaauuacagaucauauaagcaa

SEQ ID NO: 445764 - RNA, 66 nt, hsa
auguaucuuguaaucaugauugagccucagaaucauuuggagaaacuauauuuuaaagaacaagac

SEQ ID NO: 445765 - RNA, 66 nt, hsa
caccaaucaaucaaaaaauaaauaaaucacuaaggauuggagaacucauagaacaaggugaaagac

SEQ ID NO: 445766 - RNA, 66 nt, hsa
gaaagacauaaacuuggaguccgucugguuuaauuauuggagaaucgauucccaaguccaggaaga

SEQ ID NO: 445767 - RNA, 66 nt, hsa
uuuuuaguauuuugucuuuguaauuuacagaaguuauuggagaaaauaaacuuguuucauuuugca

SEQ ID NO: 445768 - RNA, 66 nt, hsa
gcacccagggaaugggggucuaugagacaaccccacuuggagaagaaugggguuagggucucuaau

SEQ ID NO: 445769 - RNA, 66 nt, hsa
gggugcuuuuuauacaacuuuccaucccccacacaguuggagaauaauuuguagaccauggcaguu

SEQ ID NO: 445770 - RNA, 66 nt, hsa
caguauacauggugauguacaucuguagcaaagcucuuggagaaaaugaagacugaagaaagcaaa

SEQ ID NO: 445771 - RNA, 66 nt, hsa
gcaugaggaacauucauucuguauuuuuuuucccuguuggagaaagugggaaauuauaaugucgaa

SEQ ID NO: 445772 - RNA, 66 nt, hsa
uuuauucugucuaucaaauaguacuucuaccacuguuuggagaaaauugaagaaaagaauaagaug

SEQ ID NO: 445773 - RNA, 66 nt, hsa
uaguugaauaugauuuggucaguugcucguuguaacuuggagaaauuccuauaaaguaagaucucc

SEQ ID NO: 445774 - RNA, 66 nt, hsa
cuuaauuccuucugcuauaugucacacaguuguuauuuggagaaccaaguauguauugcaugaaaa

SEQ ID NO: 445775 - RNA, 66 nt, hsa
ugaaugccuuauuuuugaauucuuuagauuuuuaaauuggagaaaagcacuuaaaguuuuuuauau

SEQ ID NO: 445776 - RNA, 66 nt, hsa
ugugugagcauuugcaauguaagggccucagcuuccuuggagaagccaccccagguuuccagacau

SEQ ID NO: 445777 - RNA, 66 nt, hsa
uugcaucucccugauugguauugcuguagaacauauuuggagaaguuuguuugucuuugguguuua

SEQ ID NO: 445778 - RNA, 66 nt, hsa
uuuggaguuugaacccguuuugguugcauuucauuuuuggagaacuuaauuaacgugagauuggca

SEQ ID NO: 445779 - RNA, 66 nt, hsa
cacuuagaacauuuuuugaaauucaguuuacagaaauuggagaaaaugcuuuuuaaacaaguguuu

SEQ ID NO: 445780 - RNA, 66 nt, hsa
gugaugggucuugcugggugcuguguggggcgcauauuggagaaggguaaugccagaagccaggaa

SEQ ID NO: 445781 - RNA, 66 nt, hsa
acccuuggaaccccaaggccaaguugguucaaacuguuggagaacagaguuggccugcaucuggaa

SEQ ID NO: 445782 - RNA, 66 nt, hsa
aguacuauuuuuauaaagcaagaacuauuccaugccuuggagaaugaaucauuuuuagauugugac

SEQ ID NO: 445783 - RNA, 66 nt, hsa
ucuuuuggaggugaaaucuaauuauuggugagagucuuggagaacaggcuguuuccagucucaaag

SEQ ID NO: 445784 - RNA, 66 nt, hsa
gcagccuuugguagcuaacagucacugauuuuauaauuggagaaugcguaaagauucauuuuucaa

SEQ ID NO: 445785 - RNA, 66 nt, hsa
cuuuuguuuuauuggaaugcauaucucuuuucaggguuggagaaauuagcacuugccuugaaaaga

SEQ ID NO: 445786 - RNA, 66 nt, hsa
cugugagacuuuauuguccucuaggauggauguauauuggagaagggugguuagcacauucaucag

SEQ ID NO: 445787 - RNA, 66 nt, hsa
agggguuaccuccaugugcccuuuuuagggaagcuguuggagaaaauacuccagcaaaaugaagga

SEQ ID NO: 445788 - RNA, 66 nt, hsa
auguucaacaauucugugaaaggucacaggacccaauuggagaaaucauaugaaaagcauaguugg

SEQ ID NO: 445789 - RNA, 66 nt, hsa
aacaucccuuaauuugagguguuccagcagcuguuuuuggagaagacaaagaaaauuaaaguuuuc

SEQ ID NO: 445790 - RNA, 66 nt, hsa
uguauguuccuuuguauguuccuaucaggcugauuuuuggagaaaugaauguuugucuggagcaga

SEQ ID NO: 445791 - RNA, 66 nt, hsa
uucugauguuaagcacauguuacuucaacaagaugcuuggagaacaacaagguacccagaauuuuu

SEQ ID NO: 445792 - RNA, 66 nt, hsa
agaagugagaucauacugguuuguuucuuauuuugauuggagaaaaauuaaauugcugcauuucgc

SEQ ID NO: 445793 - RNA, 66 nt, hsa
ugccagcugguaguccaucagcacaaugaaggagacuuggagaagaggaagaauaacacuguugcu

SEQ ID NO: 445794 - RNA, 66 nt, hsa
aaugcuuuuugaauguuauuuguuauuuucaguauuuuggagaaauuauuuaauaaaaaaacaauc

SEQ ID NO: 445795 - RNA, 66 nt, hsa
ucagcgcauccugcagggcuucuccuccucugucuuuuggagaaccagggcucuucucaggggcuc

SEQ ID NO: 445796 - RNA, 66 nt, hsa
aacuuaaacccugugccucagcuggacauuggaaccuuggagaaugucuucacagccccgacauca

SEQ ID NO: 445797 - RNA, 66 nt, hsa
agccagggccgugccuggagcacugcagagaugacuuuggagaaagcaaagcagugacccagugac

SEQ ID NO: 445798 - RNA, 66 nt, hsa
uguagaagaaagauacaagugaaaauuaggaguggauuggagaaauuggggggaaauagaagagua

SEQ ID NO: 445799 - RNA, 66 nt, hsa
aaaggcuuuuuaacccauuuuugaagagggugaaguuuggagaacaaauuuaaaaaccaucaguca

SEQ ID NO: 445800 - RNA, 66 nt, hsa
cuuaaaucucagaauuacuaagcauguggcauaaauuuggagaaaauaauaugacuagaaaaauua

SEQ ID NO: 445801 - RNA, 66 nt, hsa
gucuucguguccaccuggguccaguccugaaucaucuuggagaaacaccuugguuucuaggauggu

SEQ ID NO: 445802 - RNA, 66 nt, hsa
aggaguuguauuggcaagagggaggggugagagcuguuggagaacugagaaugagguuuuuuuuuu

SEQ ID NO: 445803 - RNA, 66 nt, hsa
uucuauugcccugcaacgucccaucuauacgagguguuggagaaggugaagaacccucccauucac

SEQ ID NO: 445804 - RNA, 66 nt, hsa
aucccugcuugugcaggccaguggaggcucuugggcuuggagaacacgugugucucuguguaugug

SEQ ID NO: 445805 - RNA, 66 nt, hsa
caaguggggcaacguguggaggaagccccucauaauuuggagaaaacuugauacaauagaagcuga

SEQ ID NO: 445806 - RNA, 66 nt, hsa
accaaccuguucaagucuaccaauuauaagggcaaauuggagaaaaagaaaaaauauauacucaag

SEQ ID NO: 445807 - RNA, 66 nt, hsa
cccguuuguuuguuggaguggugccagguacugguuuuggagaacuugucuacaaccagggauuga

SEQ ID NO: 445808 - RNA, 66 nt, hsa
aagagugcauaccagaauugaauauaccauaugggauuggagaaagacaaauguggaagaaaucau

SEQ ID NO: 445809 - RNA, 66 nt, hsa
ggcugagaaagggaaaagacacacaagucgcguggguuggagaagccagagccauuccaccucccc

SEQ ID NO: 445810 - RNA, 66 nt, hsa
ugguggcgugcucuagcccucucaguuaccagcucuuuggagaaggaucaaaauucagauggaaug

SEQ ID NO: 445811 - RNA, 66 nt, hsa
uccugaaacagacuacucuuugccuuuuugcugcaguuggagaagaaacugaauuugaaaaauguc

SEQ ID NO: 445812 - RNA, 66 nt, hsa
agcaaagaauuuaaaguggcuccuuuaauuggugacuuggagaaagcuaggucaaggguuuauuau

SEQ ID NO: 445813 - RNA, 66 nt, hsa
uuaacagaguuugggggagagagcaagauggguuccuuggagaagcugauuugccaagaugcacau

SEQ ID NO: 445814 - RNA, 66 nt, hsa
uuugccaccuaagcaguaaaacaugauauugaccacuuggagaacucagaaaauuauuuuaaauuu

SEQ ID NO: 445815 - RNA, 66 nt, hsa
gagagaaguaaaggaauauaugccuccuguguacuuuuggagaaaacugaagauuuaguuuccauu

SEQ ID NO: 445816 - RNA, 66 nt, hsa
ucaggaucauccuuuuguacuugaugcuggaagcucuuggagaaaaagcuuaaacauuucaccaga

SEQ ID NO: 445817 - RNA, 66 nt, hsa
gugacaaaacacaaguuggaccaaggagaaagcccuuuggagaaacuggacccuaguucaguuuag

SEQ ID NO: 445818 - RNA, 66 nt, hsa
uuugauuccuugaagagccuauuuaguuccauaaaauuggagaacugcugaaggucaguaauuccg

SEQ ID NO: 445819 - RNA, 66 nt, hsa
auaaacaugaugaauguggagaugcuugcuucagcauuggagaauucacaguaaagggaaacccug

SEQ ID NO: 445820 - RNA, 66 nt, hsa
ucgaccaacaacaacgaggaggagaagucccggcuguuggagaaggagaaccgugaacuggaaaag

SEQ ID NO: 445821 - RNA, 66 nt, hsa
gaguggagaugggggcgggggugguggugaagagaguuggagaaggaauggacgaauucuugagca

SEQ ID NO: 445822 - RNA, 66 nt, hsa
acauagucucagagaucuguagggccgagguuacauuuggagaacccguacucuagggccaaaucc

SEQ ID NO: 445823 - RNA, 66 nt, hsa
gcgguggccagcccauuuucuggggugaggcuugacuuggagaaaggcagaagagacgucccgcuu

SEQ ID NO: 445824 - RNA, 66 nt, hsa
ucauccagguuaaccuugauauacacagagauggucuuggagaauugugaauguauguacuguauu

SEQ ID NO: 445825 - RNA, 66 nt, hsa
ucaugccuauaauccuggcauuuuaggaggcugagguuggagaaucgcuugaggccagaagugcaa

SEQ ID NO: 445826 - RNA, 66 nt, hsa
gccaaguggccaaguccuuuaucaaaaagcugcuuuuuggagaagaugaugcauaaagcugugaua

SEQ ID NO: 445827 - RNA, 66 nt, hsa
agggcccuaaccuaaaaucggagaguaauuuaugcuuuggagaauuugacucaaauauauacuuga

SEQ ID NO: 445828 - RNA, 66 nt, hsa
ucaaugugggguuuguaauaggugagaaauauuugcuuggagaagcucuugugcaauuagccuggc

SEQ ID NO: 445829 - RNA, 66 nt, hsa
uguuuuguuugguauguacaaaauggucagagcuaguuggagaaugagacaugcuuuuccagcugu

SEQ ID NO: 445830 - RNA, 66 nt, hsa
agcagucucuucagguagcuaaauuaggagcuuguuuuggagaaaugaagcaaaggugaaugacag

SEQ ID NO: 445831 - RNA, 66 nt, hsa
auauacuuugugcuuuaugguuuuuauaaugucuuuuuggagaaauugccgaaaaguugccaaaua

SEQ ID NO: 445832 - RNA, 66 nt, hsa
aaaggaauauuuucuucuuaagauauauagaggauuuuggagaagagagacaggagggguaaaacc

SEQ ID NO: 445833 - RNA, 66 nt, hsa
gacuuaacaauauacauauguuccgucuuugcuguuuuggagaaugauggauaaguaguguuuccu

SEQ ID NO: 445834 - RNA, 66 nt, hsa
ugucuccauuuuuaucaagguuuuccaugguuaaguuuggagaaaauaccacacaaaacaaugaau

SEQ ID NO: 445835 - RNA, 66 nt, hsa
cacuucgauuuuucuggucuguggagaaacugugaauuggagaaauggagcucuguggcuucccac

SEQ ID NO: 445836 - RNA, 66 nt, hsa
guguuuuuuucucucacuauaguauaagaaucuauuuuggagaaaaaaagaaaauaugagggucuc

SEQ ID NO: 445837 - RNA, 66 nt, hsa
gguggggggagggggaugggguccuucuaggaguccuuggagaaaaguaagaaaccaggaguguuu

SEQ ID NO: 445838 - RNA, 66 nt, hsa
cucaccagggcaggagaggacucagccuccuguguuuuggagaaggggcccaauguguguugacga

SEQ ID NO: 445839 - RNA, 66 nt, hsa
guugcucaaauguuguucaacaccagaaaauuuauauuggagaaaagcacuguaaauguaaugcau

SEQ ID NO: 445840 - RNA, 66 nt, hsa
guuguucaaacuuuguucaauaccaggaaauuuauauuggagaaaaacccuaugaguguaaugaau

SEQ ID NO: 445841 - RNA, 66 nt, hsa
gguugucacgcuugauuguagguaagauaauuuauauuggagaaaaauccuccaaguaugaagaau

SEQ ID NO: 445842 - RNA, 66 nt, hsa
guugcucaaacuuuguucgacaucagggaauuuguauuggagaaaaacccugcaaauguaauaaau

SEQ ID NO: 445843 - RNA, 66 nt, hsa
ggauugccuugaucuggcacuuacugauacaagcauuuggagaagagaaaauucaaauauaagaaa

SEQ ID NO: 445844 - RNA, 66 nt, hsa
aauggacuuuccugugauuuguuuuuaaucauucauuuggagaagaggcaugaccuuuguauuuca

SEQ ID NO: 445845 - RNA, 66 nt, hsa
uuucaugcuauuaguauuuucauaccuuagucacauuuggagaauucacaugggaauaaaauucca

SEQ ID NO: 445846 - RNA, 66 nt, hsa
uuugcagguuugguuuuuucucauuugucuguggcauuggagaauauucucgguuuaaacagacua

SEQ ID NO: 445847 - RNA, 66 nt, hsa
agcuuauugucuagugaaacucguuaauuuguaguguuggagaagaacugaaaucauacuucuuag

SEQ ID NO: 445848 - RNA, 66 nt, hsa
gauuccauguagucuucaauuuuuaauuuuuaagaauuggagaauuucuaauguuaaaguuaguuu

SEQ ID NO: 445849 - RNA, 66 nt, hsa
cauaauaucugcauuaugcuggaaaaaaauagaccuuuggagaauacuuaaauaaaacaugugcau

SEQ ID NO: 445850 - RNA, 66 nt, hsa
ucccaggugauucuguaaguugucccucaacuguacuuggagaaaucguguuuuaaagcaguaguc

SEQ ID NO: 445851 - RNA, 66 nt, hsa
ccgugcaggaauagcaacagcaauuuccgggaggucuuggagaagcuggagagcgaccccgucugc

SEQ ID NO: 445852 - RNA, 66 nt, hsa
agccuuuuauuaguucuuugauagcuaagaugguuguuggagaaagugcuuaagccacuguuuaug

SEQ ID NO: 445853 - RNA, 66 nt, hsa
gaguccuguaaaugaaugcucugggcuagauacagcuuggagaaccugcuggccuuguuagacagc

SEQ ID NO: 445854 - RNA, 66 nt, hsa
uuuaggaaagccuggguuggguggagcagaaccaucuuggagaagaugacaguucccuguccuccc

SEQ ID NO: 445855 - RNA, 66 nt, hsa
aagacacccccuuccaaauucuguaacacauuguaauuggagaagaaggaaacucugcaaggcuaa

SEQ ID NO: 445856 - RNA, 66 nt, hsa
uuuaagcuuguuguuggaagagcagcauuuugacccuuggagaagaaaaacuagcuguggcauucc

SEQ ID NO: 445857 - RNA, 66 nt, hsa
acuaccgagcuggaagcaagccauuuaauccgguucuuggagaaacauaugaauguauucgggagg

SEQ ID NO: 445858 - RNA, 66 nt, hsa
uuaugucuucaagugaccuguacugcuuggggacuauuggagaaaauaagguggaguccuacuugu

SEQ ID NO: 445859 - RNA, 66 nt, hsa
cguagucuuuuguauuuucccugccgaagugaauuguuggagaauguaaaccgccuccacguggcg

SEQ ID NO: 445860 - RNA, 66 nt, hsa
aaugaguguuccugugcccauauuuaaugugugaccuuggagaaguuacucuguaggcaugacagc

SEQ ID NO: 445861 - RNA, 66 nt, hsa
gguguuugucauggugaaauuauaacuauuacaguguuggagaacaacaaauauguucucugaaug

SEQ ID NO: 445862 - RNA, 66 nt, hsa
cagcugggugcagaagcuguggggucggagaggcguuuggagaaggucuguggugcagugugugaa

SEQ ID NO: 445863 - RNA, 66 nt, hsa
gugaauuacugaauauuucagagcaaagcuaucaacuuggagaaacagggauuaaaaauaaggaua

SEQ ID NO: 445864 - RNA, 66 nt, hsa
uuuuuaaaaacuauauucaguaaaagccugcucaauuuggagaaauagaaccacaaacacagauca

SEQ ID NO: 445865 - RNA, 66 nt, hsa
augcccacagaagucaucagaccuuaccaaaguagguuggagaauuagauugccuuuucaugcagu

SEQ ID NO: 445866 - RNA, 66 nt, hsa
gauaugauaugaagggggacuuaucuccugcagagauuggagaagguagaggaggagaaagaaucc

SEQ ID NO: 445867 - RNA, 66 nt, hsa
ucugggcgcuguaaguuaagcucuacauagauuaaauuggagaaacguguuaauuguguggaauga

SEQ ID NO: 445868 - RNA, 66 nt, hsa
uguuuccuuuuuuuguuuguuuguuuguuuguuuuuuuggagaagagcauccucuuuuguguaguu

SEQ ID NO: 445869 - RNA, 66 nt, hsa
uacuuaaaagaaagauuucccauugcauacagguuauuggagaaauuuuccuuuuguugcauuugu

SEQ ID NO: 445870 - RNA, 66 nt, hsa
aaaucugaguguugccugcugaacucggaggggaguuuggagaaauuuuagacagcagcucugugu

SEQ ID NO: 445871 - RNA, 66 nt, hsa
cuucacacuaccaggcccugcagccacaguguucuguuggagaaacuuggggaaguguuuucugaa

SEQ ID NO: 445872 - RNA, 66 nt, hsa
aguuucccagaaucagacuuuugaagaugaaugacuuuggagaagcaaauuaaacauuuggcccug

SEQ ID NO: 445873 - RNA, 66 nt, hsa
gcaguggagauaaauguccuagagucaccaggucgcuuggagaagucauuuaagcugccucggguu

SEQ ID NO: 445874 - RNA, 66 nt, hsa
uuuaaaauauaacuucaagaaaagaguaaacauccauuggagaacacggcugaaaauuauugugcu

SEQ ID NO: 445875 - RNA, 66 nt, hsa
uuuaaagaucaugaauuugugacuuaguucugcccuuuggagaacaaaagaaagcagucuuccauc

SEQ ID NO: 445876 - RNA, 66 nt, hsa
guaaacaauggugccccagaaagcugcaggugguguuuggagaagcaguuacuuuucaguuacaag

SEQ ID NO: 445877 - RNA, 66 nt, hsa
uuaaagcaguauuuaaugcaauuuccaguuauuucuuuggagaauuuuaugucauuguuccauuac

SEQ ID NO: 445878 - RNA, 66 nt, hsa
aaaugaguucagaugaucacaaacaggugaguuuuguuggagaagaaaguuggaguaggagacuuu

SEQ ID NO: 445879 - RNA, 66 nt, hsa
acccaauaagaggcucuguuuuccacugaagcuuuguuggagaaagagaauaugaaaauuacacau

SEQ ID NO: 445880 - RNA, 66 nt, hsa
augugugaagacaugaaaguuuaauguacagaaugguuggagaaaugccuauggugaauuaaagcu

SEQ ID NO: 445881 - RNA, 66 nt, hsa
cacauugccuuuguguuaauagucaaauacuuaccuuuggagaauacuuaccuuuggaggaaugua

SEQ ID NO: 445882 - RNA, 66 nt, hsa
ggaauaaccuugcugauaagaaaaaaagggacaauauuggagaaacuaccucuuguuuaauugauc

SEQ ID NO: 445883 - RNA, 66 nt, hsa
ugucugguaccuuccccuccugccccugcaccagcuuuggagaauggauuuggagugucuugggcg

SEQ ID NO: 445884 - RNA, 66 nt, hsa
cacagaaaucagaggagagacgguguugggagcccuuuggagaacgccagucucccaggcccccug

SEQ ID NO: 445885 - RNA, 66 nt, hsa
guaagcaguguagacaaacccuuggggcuuuuuuauuuggagaaccguccagcaugcauccuggcc

SEQ ID NO: 445886 - RNA, 66 nt, hsa
ggccacguugucauugugagucuauagcuugacuccuuggagaacaauauucauuugguuguggag

SEQ ID NO: 445887 - RNA, 66 nt, hsa
ucuuuucaucaacauguagagcugcuauuuuacuauuuggagaauaugaugugaaaauuggaccuc

SEQ ID NO: 445888 - RNA, 66 nt, hsa
uuccaaaauagcagaaauuguaaaaauuaugaauuauuggagaaaaugccauuacuuguauaucug

SEQ ID NO: 445889 - RNA, 66 nt, hsa
auucugcagaauauuguaauugcaugcauaccgauauuggagaaaucugggucagccaaguuucau

SEQ ID NO: 445890 - RNA, 66 nt, hsa
gugcaaagucuuguacugaagcagucuccuuguugcuuggagaacaccuccuucagagcccuuugu

SEQ ID NO: 445891 - RNA, 66 nt, hsa
aggaugaggaaaagaagagccuuugcugauaaagaguuggagaacauuaugcuggagagagaauau

SEQ ID NO: 445892 - RNA, 66 nt, hsa
uaaguggauuaauauuaaaacuauguauauuaaucauuggagaagggggaagaggaaaugaaaaua

SEQ ID NO: 445893 - RNA, 60 nt, hsa; identical to SEQ ID NO: 445315

SEQ ID NO: 445894 - RNA, 66 nt, hsa
auuugcaaaagaaauaggcuuuucuucuuuuuuaaauuggagaaaucucugcucugguugaccugg

SEQ ID NO: 445895 - RNA, 66 nt, hsa
ugcaggcaucuguggggaaucccagccugcagguucuuggagaagcaggugaaccuaaggaugaaa

SEQ ID NO: 445896 - RNA, 66 nt, hsa
agcucaugcacaucagcugguggagcaggccuggccuuggagaacgagaccugugugccaggggca

SEQ ID NO: 445897 - RNA, 66 nt, hsa
gugcguccuugugaagcucgucuccauguggcuuucuuggagaaaggcuccccuggggcaagaggg

SEQ ID NO: 445898 - RNA, 66 nt, hsa
cucggagaggucaggagaccgaccccaccacuaacuuuggagaaaauguggguuugcuuuuuaaag

SEQ ID NO: 445899 - RNA, 66 nt, hsa
auuuuucuggaaaaguuaaaaaaaguuacaugucauuuggagaaaauacguaaucagaaauuugug

SEQ ID NO: 445900 - RNA, 66 nt, hsa
uaccggccaauguccaaaauuacgguuugaacauaauuggagaaccuuuccuucaagcagaaacaa

SEQ ID NO: 445901 - RNA, 66 nt, hsa
ccacggccaagggccacgggaacuuggagagggagcuuggagaacucacugugggcuagggugguc

SEQ ID NO: 445902 - RNA, 66 nt, hsa
uuacguguguuuuuuagagcuugguucuuuaaagauuuggagaagauauguaaauuaccaaggcac

SEQ ID NO: 445903 - RNA, 66 nt, hsa
cuguguaaaaaguacucagaaaaacaucuaaagcuguuggagaagagggacucauauaaauaguug

SEQ ID NO: 445904 - RNA, 66 nt, hsa
aggugcuuuugcaagacuggaauuccuuggacaccauuggagaagccccgcuuuuucuggaacagc

SEQ ID NO: 445905 - RNA, 66 nt, hsa
aagguuuuuaaaacauggauguuaaggcuguuuugcuuggagaagacuugggacugggacagucuu

SEQ ID NO: 445906 - RNA, 66 nt, hsa
aaaagaacaaaagcuuuuaguuguuuuuguuuuguuuuggagaauuuguuuaccaguaaauacauc

SEQ ID NO: 445907 - RNA, 66 nt, hsa
guuuuuaaaaagaagagaaagaagauauacuuugcuuuggagaaaucuacuuuuugacuuacaugg

SEQ ID NO: 445908 - RNA, 66 nt, hsa
cacuccgccccauccugcagggccuuguuuuuguauuuggagaaccucgcccaucccccccgcggc

SEQ ID NO: 445909 - RNA, 66 nt, hsa
uugauuccuuuuuucaaaauccaaaaagaaaugauguuggagaagggaaguugaacgagcauaguc

SEQ ID NO: 445910 - RNA, 66 nt, hsa
gcuuuuacuaaauauacaagauuuacuacuagaaauuuggagaaagaacacuaacacauguacuug

SEQ ID NO: 445911 - RNA, 66 nt, hsa
cagaacucaugagagacaagcaguaagaaacuucuuuuggagaaacaacagaccagaucuuuacuc

SEQ ID NO: 445912 - RNA, 66 nt, hsa
cuacuacaguuucacagaauaccugagaagacacacuuggagaaaccuuuuggguguaaugaaugu

SEQ ID NO: 445913 - RNA, 66 nt, hsa
uuagccuuacuucuacuuccagaugcagugccucuuuuggagaagacauguuuauuuuucauguuc

SEQ ID NO: 445914 - RNA, 66 nt, hsa
ggggagggaagaguguguccuggcaggaagccaccauuggagaaggugaggccaguaaccaucuca

SEQ ID NO: 445915 - RNA, 66 nt, hsa
cugauuuuacauaucuguuuggauuauagcuaggauuuggagaauaaguguguacagaucacaaaa

SEQ ID NO: 445916 - RNA, 66 nt, hsa
uuuuuuuaagcaagagaaagacaacuguucugcggguuggagaaaauacaauuuuuuuuuuuuuuu

SEQ ID NO: 445917 - RNA, 66 nt, hsa
uuacuauugcugcauacccggggugggauggggugguuggagaaccagaacuauuuuuaaaacauu

SEQ ID NO: 445918 - RNA, 66 nt, hsa
accugaacuggggaauuugaacauuccuuuacauuguuggagaaaugaagccaaaguuauucagau

SEQ ID NO: 445919 - RNA, 66 nt, hsa
agucuauaugguucuccaagaaacugaaugaauccauuggagaagcgguggauaacuagccagaca

SEQ ID NO: 445920 - RNA, 66 nt, hsa
aaauuauguucuuuagacacugcuaccugaaaacuguuggagaaauaauguuuaaaguuauuuaag

SEQ ID NO: 445921 - RNA, 66 nt, hsa
gcuuaaaacccugaugcaaacuucuccuuucagugguuggagaaauuggccgaguucaaccauuca

SEQ ID NO: 445922 - RNA, 66 nt, hsa
uaaaauucuaaccaaaccccagacauagggagucauuuggagaaagccuguaugugguguuuuaac

SEQ ID NO: 445923 - RNA, 66 nt, hsa
ggaauggucagccuaaggguaauguacagcccgugcuuggagaaccauggaagcuacaccccuaca

SEQ ID NO: 445924 - RNA, 66 nt, hsa
accagaacuguggugccaaauugcuggugucucucuuuggagaaaccaaccagauacaucugcugg

SEQ ID NO: 445925 - RNA, 66 nt, hsa
gauuugccaaauaacaaaagcauacaaugcauacuguuggagaacaagaaugcuacuguauuuuac

SEQ ID NO: 445926 - RNA, 66 nt, hsa
gugauaccuugaucuuucccacuuucuguuuucggauuggagaagauguaccuuuuuugucaacuc

SEQ ID NO: 445927 - RNA, 66 nt, hsa
aacaccuuaaauaaaagugauugugacuaaggcacguuggagaacauuccaaucuuuccucccaag

SEQ ID NO: 445928 - RNA, 66 nt, hsa
agaaaagcuaaauaaccuuuaagaaugugggugguauuggagaaagaagaugaauuauagcuccgg

SEQ ID NO: 445929 - RNA, 66 nt, hsa
ggcuguaucuacucuguggaguagaaccaagucuacuuggagaaaagaaccaaguccuuggauauc

SEQ ID NO: 445930 - RNA, 66 nt, hsa
cuuaagucacaccuaccacugagcagcuguacgacuuuggagaaguuguuuaacauuuucaagccu

SEQ ID NO: 445931 - RNA, 66 nt, hsa
gcacacuccaguauuaauauuugugcuaccaucuacuuggagaaguuuaaugagaaaauuuuagaa

SEQ ID NO: 445932 - RNA, 66 nt, hsa
ugccccauaggaugucauauugaggcccaaacuugauuggagaauuugcaaacuaccgucgcucag

SEQ ID NO: 445933 - RNA, 66 nt, hsa
ugaaugcagauuacacugaucuuauguguuacaaaauuggagaaaguauuuaauaaaaccuguuaa

SEQ ID NO: 445934 - RNA, 66 nt, hsa
acgugcguucugccuuccuuguuaauuuuguaauaauuggagaagauuuaugucagcacacacuua

SEQ ID NO: 445935 - RNA, 66 nt, hsa
acacauuggugucucuuuuuuccuuuccuuucgacauuggagaauuggagugcagucauaaucuua

SEQ ID NO: 445936 - RNA, 66 nt, hsa
gauguccuuuccuuucugaaaauaaaguuuugugcuuuggagaaugacucgugagcacaucuuuag

SEQ ID NO: 445937 - RNA, 66 nt, hsa
agcacccuaggggggcaccugcgccuguguggaaauuuggagaaguugcggcagagaagccaugcg

SEQ ID NO: 445938 - RNA, 66 nt, hsa
guauuucccagugugucuuuuaugucuuugaauguuuuggagaaaagucuaugccugucuaaaaau

SEQ ID NO: 445939 - RNA, 66 nt, hsa
aauauuuuaaauuaaagccuucuaauguuccacuguuuggagaacagaagauagcaggcuguguau

SEQ ID NO: 445940 - RNA, 66 nt, hsa
ucugcaaacacuguguauagugagacuuguucuacuuuggagaacagguuaccuuuugaaaaugag

SEQ ID NO: 445941 - RNA, 55 nt, hsa; identical to SEQ ID NO: 445363

SEQ ID NO: 445942 - RNA, 66 nt, hsa
uauagucaguuuaguucauauguucugaaaacuguuuuggagaaagauagacagaaaaaugucauc

SEQ ID NO: 445943 - RNA, 66 nt, hsa
uguaauucucagaaccagucucagggagauauaugcuuggagaacucugccuuccaucaacugcag

SEQ ID NO: 445944 - RNA, 66 nt, hsa
gugccaugaauuaagauggaugacuggaaaaagguguuggagaaagaguuaaagaugaggaagaga

SEQ ID NO: 445945 - RNA, 66 nt, hsa
acgcaaguaccaggaggacauaaccgcuguggccuguuggagaacagccaguagccuugguaauau

SEQ ID NO: 445946 - RNA, 66 nt, hsa
ccauuguuacaugaaagugauagauagcaacaaguuuuggagaagagagagggagauaaaaggggg

SEQ ID NO: 445947 - RNA, 66 nt, hsa
gugauuuucuacaugaaucaaacacagaaacaacuuuuggagaaauuaaauucugagugugacuuc

SEQ ID NO: 445948 - RNA, 66 nt, hsa
cacgcuccccugacacugaagaggauccacaacuccuuggagaaacacccucacgucuguugccgc

SEQ ID NO: 445949 - RNA, 66 nt, hsa
uuuuauauagauguaucuuuuaaaaauaguucacguuuggagaauucuuuuguacucauuugcuuu

SEQ ID NO: 445950 - RNA, 66 nt, hsa
ucuagcucugacuuugcuguuuccagugguaugaccuuggagaagucacuuauccucuuggagccu

SEQ ID NO: 445951 - RNA, 66 nt, hsa
guguucucucuggacucuugccuagcucacaaggcuuuggagaauugucuuccuaaaucggggcac

SEQ ID NO: 445952 - RNA, 66 nt, hsa
cauuggaaagcaucuaguccagugggaagccagggguuggagaaggugcuacaucccucuucccau

SEQ ID NO: 445953 - RNA, 66 nt, hsa
cugccuucuagaaucagaucuguuuggggcuggggguuggagaauaaaagcaggagaagucuaugg

SEQ ID NO: 445954 - RNA, 66 nt, hsa
uuccucugcuguguucuguguguccaguguagccuauuggagaaucggucucauuagagugacucu

SEQ ID NO: 445955 - RNA, 66 nt, hsa
agaguuguuuaauagagaaaauguacacagacugauuuggagaacacauucucugaaaauacugua

SEQ ID NO: 445956 - RNA, 66 nt, hsa
uuguccauauccagguuagcugguaagaggauuuuuuuggagaaaaaaaugauauuuagaaaguua

SEQ ID NO: 445957 - RNA, 66 nt, hsa
cuaaacuuguauuacauaucaaauaaaugauacaucuuggagaagagggaggaauaggagcaaauc

SEQ ID NO: 445958 - RNA, 66 nt, hsa
ggggaaggaguuuuauguuaaaccauccauguauuuuuggagaagagagaggaaagguuugagaag

SEQ ID NO: 445959 - RNA, 66 nt, hsa
guugucaagguuguccccagaccuugcuugcagugguuggagaacccagggggcugccuugggccc

SEQ ID NO: 445960 - RNA, 66 nt, hsa
gaugucuuugggagggaagaagguacagaagaaagauuggagaagggccucucuagcagucaacuc

SEQ ID NO: 445961 - RNA, 66 nt, hsa
agcugagggugcccaccaagcccaccuuccagaaacuuggagaaauggggguugggaacuuaugca

SEQ ID NO: 445962 - RNA, 66 nt, hsa
ucccagcugugguuggaucaaggacucauuccugccuuggagaaaauacuucaaccagagcaggga

SEQ ID NO: 445963 - RNA, 66 nt, hsa
ugagcaugaaagucaaaacuggaauuuucuaaagcuuuggagaaaaggagagaauuaguagggcaa

SEQ ID NO: 445964 - RNA, 66 nt, hsa
acugguucaguggcuggaguauuaggggccuggggauuggagaacggagaagaaguuguagcagag

SEQ ID NO: 445965 - RNA, 66 nt, hsa
acuaaaaaauuuuacugucuaaauaaguaccuuuuauuggagaaaaaucaaaaccccaaacaaaca

SEQ ID NO: 445966 - RNA, 66 nt, hsa
gauguugaaauaaugauaguagguauguauuauggauuggagaagcacuuauuacacuaucuaacc

SEQ ID NO: 445967 - RNA, 66 nt, hsa
cauaaugcucuauccucuaagguuggaacucugaaguuggagaagguggaauaaaguuacaccugg

SEQ ID NO: 445968 - RNA, 66 nt, hsa
ugcagguuugaccaggaaagcagcgcuaguggaggguuggagaaggagguaaaggaugaggguuca

SEQ ID NO: 445969 - RNA, 66 nt, hsa
accaggaacaagaagagacccuuguucaauaugaucuuggagaacacgguuuugaaagcaacuccu

SEQ ID NO: 445970 - RNA, 66 nt, hsa
uugaauaaaugugaaggcugugaagaguggacagucuuggagaacacagugcuugaaauggacaag

SEQ ID NO: 445971 - RNA, 66 nt, hsa
gccucgcugucucccuagagccagggcccugcggauuuggagaagggagcggggcaggacuuccag

SEQ ID NO: 445972 - RNA, 66 nt, hsa
acagagaaagguuuuagacuccaguuuaccuuucucuuggagaaacucaaugcuaaucccaccuuu

SEQ ID NO: 445973 - RNA, 66 nt, hsa
gaauguucacacacuuuucuugcguacucaacuaaauuggagaauguuucugaagaaaauuggaug

SEQ ID NO: 445974 - RNA, 66 nt, hsa
augaaggcucgaguucugcuguucuguaaaagagaauuggagaaugaaaccugcuccaacagagau

SEQ ID NO: 445975 - RNA, 66 nt, hsa
cauccugucauuucuguucuugucccucauacaucuuuggagaaccgggcuccagacuuuguuccc

SEQ ID NO: 445976 - RNA, 66 nt, hsa
uuuggacaggacccagcccugcaccguucacuguauuuggagaaaaugguaagaguuccauaccgg

SEQ ID NO: 445977 - RNA, 66 nt, hsa
acuguguauguguggaaauaaaaauguauuguacuuuuggagaauuuuuuguaggcauuuuucugu

SEQ ID NO: 445978 - RNA, 66 nt, hsa
uugggcucuggccaucugcaacccugaacgugcagguuggagaacgaaugaauacaaauuuuauug

SEQ ID NO: 445979 - RNA, 66 nt, hsa
aacagccuuuccuacauccuucccucacucccaugauuggagaaaugauucauugggugaugagug

SEQ ID NO: 445980 - RNA, 66 nt, hsa
ucagcagcugggcugucagggccauaguagcucccuuuggagaacagggaaagccuggaggcuucc

SEQ ID NO: 445981 - RNA, 66 nt, hsa
gggacagugcaacaaguaacgagacuauuuuguauuuuggagaauucauauuauggagaaccuaac

SEQ ID NO: 445982 - RNA, 66 nt, hsa
uaaauuccuaccaggaaagaauacauauccaauagauuggagaaagccagagauuagcccucauuc

SEQ ID NO: 445983 - RNA, 66 nt, hsa
ggaauuuuucacaaagagcaaugacuuuauuuugcauuggagaacuccuggagauaagcuguacaa

SEQ ID NO: 445984 - RNA, 66 nt, hsa
gguguuagugagggccucaaguccaaggcuuuaucuuuggagaaggcaaggaaggaggcggugaca

SEQ ID NO: 445985 - RNA, 66 nt, hsa
caagucuucauuuggggccaaaggggaaacuuuuuuuuggagaaggcgucuugcuuugucacccac

SEQ ID NO: 445986 - RNA, 66 nt, hsa
uuaaggaucugauacaucuaguuauuggucuggaaauuggagaaauggaggugagcaaauuaacgg

SEQ ID NO: 445987 - RNA, 66 nt, hsa
cauaauuaaagaaccuggugggugugcacuaugagauuggagaaaugaauuaaguugacuugaaau

SEQ ID NO: 445988 - RNA, 66 nt, hsa
ucuuguuuaaaagaaaaucaggugggugggaaucucuuggagaacugaggcugaggguagagggag

SEQ ID NO: 445989 - RNA, 66 nt, hsa
ccacugacugggacccugaagaggcauuucagaguguuggagaagaaucuguagcuuguugaaaaa

SEQ ID NO: 445990 - RNA, 66 nt, hsa
uauuuucaaaaaccuaauccguaguaauuccuaaucuuggagaauaaaaaagggcgguggagggga

SEQ ID NO: 445991 - RNA, 66 nt, hsa
aagaauuaaauacauuucauugagcuuuaaaguacuuuggagaaacuuuggggcacguuuuccuac

SEQ ID NO: 445992 - RNA, 66 nt, hsa
acuagaggaacuuggaucuuccggagaaugauguucuuggagaacaggcagaucaaaagaggugaa

SEQ ID NO: 445993 - RNA, 66 nt, hsa
cauauaaaagaaguugugcuauuuaacucugaauacuuggagaaacuaggugaagaugcaaccaga

SEQ ID NO: 445994 - RNA, 66 nt, hsa
uggucaaguaguuuuaauauguaaauuugcaaguuuuuggagaacccccaaacuccuucuccacug

SEQ ID NO: 445995 - RNA, 66 nt, hsa
ugugaaaaaugcucucccagcaaagcugagacaaaauuggagaagcugcagccucacgcaccaucc

SEQ ID NO: 445996 - RNA, 66 nt, hsa
uaauugcacaucaguaugugccaaaucuacuagacauuggagaaacaguaggaacaacacauggua

SEQ ID NO: 445997 - RNA, 66 nt, hsa
ucuuuauuucugcagguuggugaaaacccuguguccuuggagaaagcugguucccguuuuccagag

SEQ ID NO: 445998 - RNA, 66 nt, hsa
cagcuuguguggucagcucuucccuucaucacauacuuggagaacaaaggacaccguuacccaugc

SEQ ID NO: 445999 - RNA, 66 nt, hsa
gaagauuuauggaguaaggacuuaaaaucauacaucuuggagaaccuuucuuacucauuucagucc

SEQ ID NO: 446000 - RNA, 66 nt, hsa
agacuggagccauaaaguuaauuugcaccuagcuuuuuggagaauagccaugauuaacugcuauuc

SEQ ID NO: 446001 - RNA, 66 nt, hsa
uucaguuuuuuaaaaauagacuguaguauccuuucauuggagaauuuacaaaaauaucaucuacag

SEQ ID NO: 446002 - RNA, 66 nt, hsa
guguucaaaccaaagaaacaaugaucuacucaaacauuggagaaaaaaacugccagaggaggaguu

SEQ ID NO: 446003 - RNA, 66 nt, hsa
uuccagcuuucgucugucaucagacauugaagagauuuggagaaauguaaagcagcaguacucuuc

SEQ ID NO: 446004 - RNA, 66 nt, hsa
aguagauggguauauaacaguuuggaaauacuaucuuuggagaauguauuuuuguauuuauaaauc

SEQ ID NO: 446005 - RNA, 66 nt, hsa
gggugagcaggcacauugacuuucuguugagguaccuuggagaagcugagccauucugaggacauc

SEQ ID NO: 446006 - RNA, 66 nt, hsa
uagauuuuuaaaggaauauuucagaguuuaaucuuuuuggagaaguuauguucuuuaaucggguac

SEQ ID NO: 446007 - RNA, 66 nt, hsa
guuuauguauguucagccagauaguaaaugggauuuuuggagaaauaagauaacuacaaaguuucu

SEQ ID NO: 446008 - RNA, 66 nt, hsa
ggaaaguauuaucuaauuaaguucaugauagugcuuuuggagaacuugucaaauuacagccaauga

SEQ ID NO: 446009 - RNA, 66 nt, hsa
uuagcuaggaauuguuaagcacauugcagauuguucuuggagaauucuggaguuguuaugaacaug

SEQ ID NO: 446010 - RNA, 66 nt, hsa
auuugcaucacugaggaugaaacugacuuuugucuuuuggagaaaaaaaacuguacugcuuguuca

SEQ ID NO: 446011 - RNA, 66 nt, hsa
uccauaauagagauugauaagauuuagcaacugguguuggagaaaaaaagaaaagcaaaugagugu

SEQ ID NO: 446012 - RNA, 66 nt, hsa
cucuuuuccaguauuaaacacucauaugcuuauggcuuggagaaauuucuuaguugggugaauuaa

SEQ ID NO: 446013 - RNA, 66 nt, hsa
auuuucuuguucccguagaagaaagaagaaagguguuuggagaauucgagugccuaggaugccaga

SEQ ID NO: 446014 - RNA, 66 nt, hsa
acuaagacaaagauauuuagguugagcagcuauuaauuggagaauugguacagagacgcuccagau

SEQ ID NO: 446015 - RNA, 66 nt, hsa
ggaagccuggcugcagcuucccauuugguuacgagguuggagaaaaagucaaaguccccuccuggg

SEQ ID NO: 446016 - RNA, 66 nt, hsa
uauauagcaucuggaagaucauuuugaaauuguuccuuggagaaaugaaaacaguguguaaacaaa

SEQ ID NO: 446017 - RNA, 66 nt, hsa
guacuuucuugucaaacaaaaccaauggcucuggguuuggagaacacaguggcugguuuuaaaaau

SEQ ID NO: 446018 - RNA, 66 nt, hsa
ggcugccuuucccaaaugggaaaggugcugacagaguuggagaaaaaagaauagacucauuuuucc

SEQ ID NO: 446019 - RNA, 66 nt, hsa
ccugcuugugcugggaaaugcaacucacucauguauuuggagaaacaggaguguucacuuaucuag

SEQ ID NO: 446020 - RNA, 66 nt, hsa
agaaaacuucuuuuaaaccucaccuuugugggguuuuuggagaagguuaucaaaaauuucauggaa

SEQ ID NO: 446021 - RNA, 66 nt, hsa
uggggagagauauuuucuuauguuuauucggagaauuuggagaagugauugaacuuuucaagacau

SEQ ID NO: 446022 - RNA, 66 nt, hsa
ugaucaauauaacaauauaauccuaaaccuugacaguuggagaagccaaugcagaacugaugggaa

SEQ ID NO: 446023 - RNA, 66 nt, hsa
ggaaguuuaaaaauucuuuaaacagguauuuugauauuggagaauaacaugcauauaauucuguag

SEQ ID NO: 446024 - RNA, 66 nt, hsa
uaucaaugcuuauauauuccuuagacuauugaaauuuuggagaaaauguauuuguguucacuucua

SEQ ID NO: 446025 - RNA, 66 nt, hsa
aauacaaaaaugaaaauauuuauaauaggacucgacuuggagaaauugcuauucuuccuguugucc

SEQ ID NO: 446026 - RNA, 66 nt, hsa
aaucuuaguugucauaaucccuuggagccuggguuuuuggagaaagagaucuccgugcccuacaga

SEQ ID NO: 446027 - RNA, 66 nt, hsa
gccuuuuagauaggaucuaggagugauuuuauuguuuuggagaauggaagggcccccauggcccug

SEQ ID NO: 446028 - RNA, 66 nt, hsa
aaacuaaaaugaaccaaacccauauuucacuggugguuggagaaaaccauggccaaaacgauugug

SEQ ID NO: 446029 - RNA, 66 nt, hsa
guaucaauguguauguggcuguuuguagugaauuuauuggagaaugagguuguccguguccuuaac

SEQ ID NO: 446030 - RNA, 66 nt, hsa
aaaaaugaauugaaccauuucaacuauuuucuauauuuggagaaaguuugugcccuguguuuuaua

SEQ ID NO: 446031 - RNA, 66 nt, hsa
uuuaucaacagcaaacuucagccguuucacuuuuuguuggagaaaaauaguagauuuuaauuugac

SEQ ID NO: 446032 - RNA, 66 nt, hsa
cccacugugccucagagaccagggcuccagccccucuuggagaagucucagcuaagcucacguccu

SEQ ID NO: 446033 - RNA, 66 nt, hsa
gugaagccagcuggacuuccugggucgaguggggccuuggagaacuuuucugucuuacaagaggau

SEQ ID NO: 446034 - RNA, 66 nt, hsa
ugagaauugcucauucauauuuuuucuguugcuugcuuggagaauuugcucuuuuuuuggcauaua

SEQ ID NO: 446035 - RNA, 66 nt, hsa
gcaaccuuugcacacucaccugagcccuggggacccuuggagaaauuaggugucaccugcuguggc

SEQ ID NO: 446036 - RNA, 66 nt, hsa
ucacaugaaacauuugcaaaauuguuuuugguuggauuggagaaguaauccuagggaaggguggug

SEQ ID NO: 446037 - RNA, 66 nt, hsa
cuuugauaccaaacaauucaaaaguuggaucugaguuuggagaaagauauuuccaaccuaaguggg

SEQ ID NO: 446038 - RNA, 66 nt, hsa
uaacaaacuauguagugugucccuauuauaaaugcauuggagaaguauuuuuaugagacucuuuac

SEQ ID NO: 446039 - RNA, 66 nt, hsa
gguuagaagucugcuaaagaucaaaugugaaaguacuuggagaaacugaggccucuuauguguaau

SEQ ID NO: 446040 - RNA, 66 nt, hsa
uuuucuguggagguggaaaagcaacauucauagucuuuggagaaaugcuuagaaauucagcauuug

SEQ ID NO: 446041 - RNA, 66 nt, hsa
uugccuggagugacacuacacucuagaauuuccacuuuggagaauacucaguuccaacuugugauu

SEQ ID NO: 446042 - RNA, 66 nt, hsa
cuuuuuaaaaauuuaacaugauugcuuuucucaauuuuggagaagauguuuaaauaguucuguugu

SEQ ID NO: 446043 - RNA, 66 nt, hsa
uaauuuuuacuugcggugacuauucuugccacaauauuggagaauaaugauagaugauauacuaga

SEQ ID NO: 446044 - RNA, 66 nt, hsa
gcagaaguucugccucugccuggggucuuggccacauuggagaaaaacaggcucaaaguggggcug

SEQ ID NO: 446045 - RNA, 66 nt, hsa
uccugccccgagcccuagguggggccaggaggugccuuggagaagccagccagagcagagagggcu

SEQ ID NO: 446046 - RNA, 66 nt, hsa
ccacagacucugagaagcgaagaccaugucuccucguuggagaaacccaauagcaggggaagcugg

SEQ ID NO: 446047 - RNA, 66 nt, hsa
uguguguguaaugcaaauuaguuaaaacaaauaguuuuggagaaaguuaaaacuagcuuuagagua

SEQ ID NO: 446048 - RNA, 66 nt, hsa
uuccagaaucauucuccuuucugcccauaaagggccuuggagaauugcuuuaagaagagugaaugu

SEQ ID NO: 446049 - RNA, 66 nt, hsa
ucaggagccugggaccccgcaugucccaaaaugggauuggagaagcuggagagaaagcagaagagg

SEQ ID NO: 446050 - RNA, 66 nt, hsa
uauuuuuggguguuccuggcaguuuaaaaaaauugguuggagaauuuagguuuuuauuaguaccau

SEQ ID NO: 446051 - RNA, 59 nt, hsa; identical to SEQ ID NO: 445473

SEQ ID NO: 446052 - RNA, 66 nt, hsa
ccaguguggugaugccaugcccaucaugggaggcuuuuggagaaacagaauguuugggcaggggcu

SEQ ID NO: 446053 - RNA, 66 nt, hsa
gcaucuuccacuggaacguuucacugcaaacacaccuuggagaaguggcaucagucaacagagagg

SEQ ID NO: 446054 - RNA, 66 nt, hsa
ggugaagccagcugggcuccugagucugguggggacuuggagaaccuuuaugucuagcuaagggau

SEQ ID NO: 446055 - RNA, 66 nt, hsa
aauccacacucuguaucuggcuacucugguggggacuuggagaaccuuuguguccacacucuguau

SEQ ID NO: 446056 - RNA, 66 nt, hsa
caaacacccuccuggcacaacgcucuacccugcagcuuggagaacuccgcuggauggggagucuca

SEQ ID NO: 446057 - RNA, 66 nt, hsa
agguggaucaccugaauucucucagcugucaauggcuuggagaacaucucaugggcccaagucauc

SEQ ID NO: 446058 - RNA, 66 nt, hsa
cuuuuguugaaauagcuuuacuguuucucaaguguuuuggagaaaaaaaucaacccugcaaucacu

SEQ ID NO: 446059 - RNA, 66 nt, hsa
uguuggccaaagugaaggaaucuuuuuucaguuuuauuggagaaacugaaggguaacauucuaaca

SEQ ID NO: 446060 - RNA, 66 nt, hsa
ccggcuguggcugacaguggcucuggccaggguugcuuggagaaggcucagugugccugggacagg

SEQ ID NO: 446061 - RNA, 66 nt, hsa
gggaaagcggauaaaacuuucauuggacuggaauguuuggagaauguuaauuuccaaaucaggaac

SEQ ID NO: 446062 - RNA, 66 nt, hsa
auuguuuguaguuacauuuaggauggacuuaucccuuuggagaagagugaaguuuguuuuuucgcc

SEQ ID NO: 446063 - RNA, 66 nt, hsa
uggcggccuggccuagaccaggggugcagccagcuuuuggagaaccuggauggccuuaggguuccu

SEQ ID NO: 446064 - RNA, 66 nt, hsa
gcuuugugacuuggaaagguacgcugcuggccagcauuggagaagaagcugcugagcauggcuuuc

SEQ ID NO: 446065 - RNA, 66 nt, hsa
gcaggucccaguucacauguaguccccugcucaccauuggagaaucagcucacugcucucuagaaa

SEQ ID NO: 446066 - RNA, 66 nt, hsa
cuaaccggccucaugacuagccuuguugccgucgaguuggagaaaguggugcugaaauccaccuuu

SEQ ID NO: 446067 - RNA, 66 nt, hsa
augugugauggugcaaggaauggauucaggauguuguuggagaaacaaguuugugauuaguccuua

SEQ ID NO: 446068 - RNA, 66 nt, hsa
agcugccugacugccucagcagggaccgcaugccgcuuggagaagggguggccucgccggagcuag

SEQ ID NO: 446069 - RNA, 66 nt, hsa
cccuuuucuccagcaacugcagaggcauuucaggaguuggagaacggaguacauuuuuaaaauuuu

SEQ ID NO: 446070 - RNA, 66 nt, hsa
agcggauggugaggacacagcuaugaucagggaauuuuggagaaacuacagcaucauggaugcugu

SEQ ID NO: 446071 - RNA, 66 nt, hsa
gaaagacauaaacuuggaguccaucugguuuaauuauuggagaaucgauucccaaguccaggaaga

SEQ ID NO: 446072 - RNA, 66 nt, hsa
uuuuacuuuuccucagaagauugagcugucuuuuauuuggagaauaaaaugaaguucugaaaaaaa

SEQ ID NO: 446073 - RNA, 66 nt, hsa
aguuugccaagaagugaucuguuuuaaaggucauauuuggagaaagggcaaggaauugggucugcu

SEQ ID NO: 446074 - RNA, 66 nt, hsa
auuggauguguuugggggcggggggauggaagugacuuggagaauguguuugggaugaaauaacua

SEQ ID NO: 446075 - RNA, 66 nt, hsa
auuuauaaaccacugaaagggauagagaagugaacauuggagaaagccaguagcaacugugagaaa

SEQ ID NO: 446076 - RNA, 66 nt, hsa
uguggaggaucaguagcuguuaugaugccagaccauuuggagaaguaucagaggccugaccggaca

SEQ ID NO: 446077 - RNA, 66 nt, hsa
uccaagcccuuggggugacucggcuuccaggagcuguuggagaaaugaggaugucugucccugucu

SEQ ID NO: 446078 - RNA, 66 nt, hsa
ucucaacugcugguagcauuuaucugacuuggaaaguuggagaagaggcauuccuacuggagaaaa

SEQ ID NO: 446079 - RNA, 66 nt, hsa
ccacagguguggguguccuguuggaggagggcuuguuuggagaagggaggcuggcugggggagaaa

SEQ ID NO: 446080 - RNA, 66 nt, hsa
gggggcucggaccccucacuggggacagggccaguguuggagaauucugauuccuuuuuuguuguc

SEQ ID NO: 446081 - RNA, 66 nt, hsa
aucagugagaauucgugcaucucugcucugugggguuuggagaaaugcuuuggcagaagagugaaa

SEQ ID NO: 446082 - RNA, 66 nt, hsa
ggucuuguguaaacguuugcagacacaggugcagcuuuggagaacucaccucuggcucuugugcuu

SEQ ID NO: 446083 - RNA, 66 nt, hsa
aaggggaagaugcuggacucauugaaaggugguugcuuggagaagggacauggggcugaaucucag

SEQ ID NO: 446084 - RNA, 66 nt, hsa
auccaaaaacuacauauuuguaggaaaucugccuuauuggagaaaaucacccuuucccuuuuucuu

SEQ ID NO: 446085 - RNA, 66 nt, hsa
auacuccauagcuaccaaguuaaccugcucuaaacuuuggagaacuggaucuguccaauaaacgcu

SEQ ID NO: 446086 - RNA, 66 nt, hsa
aauugccacucaguuccucugggugugcacauauguuuggagaaauagaggagagaaaagagggcc

SEQ ID NO: 446087 - RNA, 66 nt, hsa
ugccagauaucaaaccugaggaaggcagaagugaauuuggagaacuaggguagagagagguugcua

SEQ ID NO: 446088 - RNA, 66 nt, hsa
ggaguugaaguccaaccuauuuaaaaaccccaccauuuggagaauuacaaggguuuuguccugaau

SEQ ID NO: 446089 - RNA, 66 nt, hsa
cccagccuucaugccuuccccacccuccagcuccucuuggagaagcuguugcugagaccccccccc

SEQ ID NO: 446090 - RNA, 66 nt, hsa
ccucagaaaucaggacauccccccuaucaggugguuuuggagaaaacaaggaaggcggaagaaugg

SEQ ID NO: 446091 - RNA, 66 nt, hsa
cuauuaacaacugaggaaggccagugcagaauauuuuuggagaacgauuuuuuuuuuaaauaauau

SEQ ID NO: 446092 - RNA, 66 nt, hsa
aacaacaacauaaaaauccuugcauaccuuguucaauuggagaauuuuaauguuuuucauuuauca

SEQ ID NO: 446093 - RNA, 66 nt, hsa
uguacaccuggcaucuguggcauguguucuggucacuuggagaagggcauguguggggugugugug

SEQ ID NO: 446094 - RNA, 66 nt, hsa
uggugugggcgcgucugugguguguguccuagucacuuggagaagggugugugugggaugcgugug

SEQ ID NO: 446095 - RNA, 66 nt, hsa
gggaacugucugcccaggagccugagccucaggcuguuggagaagcaucugaugccuuuuucuuug

SEQ ID NO: 446096 - RNA, 66 nt, hsa
uuuauggaagcauguguaaaauuauacuuucaguaauuggagaauucagagauugcauuucuagca

SEQ ID NO: 446097 - RNA, 66 nt, hsa
uaccuuguauugugauauuaacuggcaaagauccucuuggagaaaccuuucccagguacaguuuca

SEQ ID NO: 446098 - RNA, 66 nt, hsa
gauaaugaagcugauuuuuuagcugagauagaagcuuuggagaaaaugaaugaagaucacguucag

SEQ ID NO: 446099 - RNA, 66 nt, hsa
auuucguuuuuguuucccuuuaguauuuaauggucuuuggagaaaaaauaauaaaacagaguguua

SEQ ID NO: 446100 - RNA, 66 nt, hsa
gauuuugccucccacacccagccacuaccucccagcuuggagaacaccucagaauucagaagauau

SEQ ID NO: 446101 - RNA, 66 nt, hsa
ggauugcacgaguguguuuuccucacacacuuugauuuggagaauuggugcuaguuggcaauagau

SEQ ID NO: 446102 - RNA, 66 nt, hsa
uguucacagagauggaugcauguucugauugccucuuuggagaagcucaucagaaacucaaaagaa

SEQ ID NO: 446103 - RNA, 66 nt, hsa
cugagcaucguggaugggugcacggagacacgcaccuuggagaaaugaggggagauggaccaagaa

SEQ ID NO: 446104 - RNA, 66 nt, hsa
auaggguuguuacaacugucacuagcggaggucacuuuggagaagggugggccuuacauccagugu

SEQ ID NO: 446105 - RNA, 66 nt, hsa
gucaauaaaauugcugggaauauuugacucuccguauuggagaaaauaaaauuacaacauuacgac

SEQ ID NO: 446106 - RNA, 66 nt, hsa
aacaucauuacuggaaaccuauuaaacauuagcaaauuggagaauaguuuuaauauaguaaaugua

SEQ ID NO: 446107 - RNA, 66 nt, hsa
ggugguagcgcugggggugauuuuaggcagcaagaauuggagaacucacacugcgaaaagaaaacc

SEQ ID NO: 446108 - RNA, 66 nt, hsa
uguuggggugugaaagccucaagugacucagccugguuggagaacugccccacccaguaucuucug

SEQ ID NO: 446109 - RNA, 66 nt, hsa
caaagucuucaguaacgcuacaacgauugcaaaucauuggagaauccauaaugaagagagaucuuc

SEQ ID NO: 446110 - RNA, 66 nt, hsa
acaacucaaaucauauuagacaucggagaaaucacuuuggagaaaggucuuuugagugcacugagu

SEQ ID NO: 446111 - RNA, 66 nt, hsa
gccuaaucaggugagccacucacccuccugcuggccuuggagaagcaaaaagccagggugugccag

SEQ ID NO: 446112 - RNA, 66 nt, hsa
cagacuccacagugacuugccacauuugccccccauuuggagaaugcuuuuauaucaaaaguggag

SEQ ID NO: 446113 - RNA, 66 nt, hsa
auggaaaacaagaaauacugucaaggauguggaauguuggagaacauugugcacuaucacugggaa

SEQ ID NO: 446114 - RNA, 66 nt, hsa
guccguauaagcucaaugaguauugauuuaggggcuuuggagaacuuugaaugcuaccccccaagu

SEQ ID NO: 446115 - RNA, 66 nt, hsa
guuacuuaaacuuuguucaacaucagggaauucagauuggagaaaaacccugcaaauguaauaaau

SEQ ID NO: 446116 - RNA, 66 nt, hsa
auuuuauuuaguuagaacacuucauuuuguuuuuaguuggagaacucuauagcccuuuaguuauuu

SEQ ID NO: 446117 - RNA, 66 nt, hsa
guggacuacagcuuauucagccugggaaaaauaauguuggagaaauacucuaugaauagaauauac

SEQ ID NO: 446118 - RNA, 66 nt, hsa
acuuggacugcacuaacuuguggagucugcacuaacuuggagaaguuagugucagaauugaauuau

SEQ ID NO: 446119 - RNA, 66 nt, hsa
caaagucuucaguaaugcuacaacgauuacaaaucauuggagaauccauaaugaagagagaucuua

SEQ ID NO: 446120 - RNA, 66 nt, hsa
caaagucuucaguaacgcuacaaccauugcaaaucauuggagaaucuauaaugaauaaagaucuaa

SEQ ID NO: 446121 - RNA, 66 nt, hsa
caaaguuuucaguaaugcuacaaccauugcaaaucauuggagaauccauaaugagagaucuuacaa

SEQ ID NO: 446122 - RNA, 66 nt, hsa
caaaguuuucaguaaugcuacaaccauugcacaucauuggagaauccacagugaagagaucuuaca

SEQ ID NO: 446123 - RNA, 66 nt, hsa
ccuaggcuaauugugacugugacuuacuucucccucuuggagaaagacuugaagaauguaaugcca

SEQ ID NO: 446124 - RNA, 66 nt, hsa
gcuguacuuguaccuaaggcccuggguucaagagaguuggagaaaccccucuagaaacauauuggc

SEQ ID NO: 446125 - RNA, 66 nt, hsa
ggcuuaugagugcagugaguccagucucauuaaauauuggagaauacacaccugaguaagauccug

SEQ ID NO: 446126 - RNA, 66 nt, hsa
ucauggguaaauauguguugaauugguaacucccucuuggagaauuucuugugaauuacacagcaa

SEQ ID NO: 446127 - RNA, 66 nt, hsa
cgucaugugagugaagagaugucacugucuguggucuuggagaacuagucucguagcugaggggug

SEQ ID NO: 446128 - RNA, 66 nt, hsa
agccaaccaccuugaaaccuuuagaacaucucugcuuuggagaaagacccagagaucaggcagagg

SEQ ID NO: 446129 - RNA, 66 nt, hsa
caagauguuaaaacagucccguggaaggagcagggguuggagaaaggcaucccaaagcuucgaugg

SEQ ID NO: 446130 - RNA, 66 nt, hsa
cacucucagagacucccaggaguuguugaacuauauuuggagaaaacagccacugaauauuaucau

SEQ ID NO: 446131 - RNA, 66 nt, hsa
cuugggguaaaugcuuugaggcccagggaccaaucuuuggagaaaguagauauuuccaucaaagcc

SEQ ID NO: 446132 - RNA, 66 nt, hsa
gaugcgaauacagcucacagagaaacgcaugugcuauuggagaacaggucuuuguggagaucuaaa

SEQ ID NO: 446133 - RNA, 66 nt, hsa
cauguaacauuuaaacauuaauuuaaaaagggaaccuuggagaauucuuuuguucacuaguuccuu

SEQ ID NO: 446134 - RNA, 66 nt, hsa
gacugcagcgccaagcggcauccaccaagcaucaaguuggagaaaagggaacccaagcaguagaga

SEQ ID NO: 446135 - RNA, 66 nt, hsa
acucuagguuuccaggccucacagccaagcugaagcuuggagaaaacucugcauucccaugagggc

SEQ ID NO: 446136 - RNA, 66 nt, hsa
ggaggcugaggugggagaaucacuugaguccuggaguuggagaacagccuggaaagccuggcgaua

SEQ ID NO: 446137 - RNA, 66 nt, hsa
acugagcaccuuggugagcaagccuggcuuuaaagauuggagaagagcuucuggcaccagaacccu

SEQ ID NO: 446138 - RNA, 66 nt, hsa
uuaccuuugcaguguugccgaaucacagcaguucuguuggagaaacgcuugguuuccggauccaga

SEQ ID NO: 446139 - RNA, 66 nt, hsa
caaauuuccucccugccucaugugagaccacaggguuuggagaagcaguuggaacccacguguggu

SEQ ID NO: 446140 - RNA, 66 nt, hsa
uggaaagccacuuacuggcuuuugacaugacuucucuuggagaauaaguggacuccaagcuaacuc

SEQ ID NO: 446141 - RNA, 65 nt, hsa; identical to SEQ ID NO: 445563

SEQ ID NO: 446142 - RNA, 66 nt, hsa
caaacaccuccugaguuuugcaauugagaaaaugauuuggagaacuucucuucugguaauuuuuau

SEQ ID NO: 446143 - RNA, 66 nt, hsa
ccucuuccucuccaaagcgccagaaccuccuucucuuuggagaauggggaggccucuuggagacac

SEQ ID NO: 446144 - RNA, 66 nt, hsa
uugggacugguggugccaagauaaggguuucucaaauuggagaaccccuccuuguugcaugagguc

SEQ ID NO: 446145 - RNA, 66 nt, hsa
cuccuguacaugaaccaggucauguuuggccuuguguuggagaaagagaauuauccccacuucaca

SEQ ID NO: 446146 - RNA, 66 nt, hsa
caaccaaccccaacaacaaaaaagaauguuuugguauuggagaagggauggucaguuagccugucu

SEQ ID NO: 446147 - RNA, 66 nt, hsa
agaccugccagcucucggaguccuuggugguugaacuuggagaaagaccgcaugaagauacuugua

SEQ ID NO: 446148 - RNA, 66 nt, hsa
ccaguuaucuuuagcagauauuaaaaauugaaaacuuuggagaacucauuucaaguuaugauucag

SEQ ID NO: 446149 - RNA, 66 nt, hsa
ugugccuucagcaggacucuuaauaucugcugcaacuuggagaaccucccugcccugaaaugugaa

SEQ ID NO: 446150 - RNA, 66 nt, hsa
cauuacaaacacgggcggaaggcacucaggcuuucguuggagaaacagaaauaaggccuucuuuug

SEQ ID NO: 446151 - RNA, 66 nt, hsa
cuguaggaagaaaaaggaugcauucccuacagauuuuuggagaaaggauuucugaggaguguguga

SEQ ID NO: 446152 - RNA, 66 nt, hsa
agaaacucauucuuacgaaauuagaacgacuucacguuggagaaagcaugaagagguauucaucug

SEQ ID NO: 446153 - RNA, 66 nt, hsa
ugcagcaagccugcacacgggcuuggguggguuccuuuggagaagauguggcuggaacacaaacaa

SEQ ID NO: 446154 - RNA, 66 nt, hsa
gucucgcugggaccuggucccuuuguugcaggcggcuuggagaaagggcagugggacgcuggccac

SEQ ID NO: 446155 - RNA, 66 nt, hsa
uggccaguugcagguuaagccccagaaaaguucaccuuggagaagcuccgagaacacacagauugu

SEQ ID NO: 446156 - RNA, 66 nt, hsa
aaucaagaauauuuguggagguagguguggggaagguuggagaagaguuagguuugugcuuuguaa

SEQ ID NO: 446157 - RNA, 66 nt, hsa
aaauuggcucuuuggaggcgagaggaaggggagaacuuggagaauaguuuuugcuuuggggguaga

SEQ ID NO: 446158 - RNA, 66 nt, hsa
cccuccccuacuucucccuugcucccaaagcuuuccuuggagaagggcccuccugcagcuggaccc

SEQ ID NO: 446159 - RNA, 66 nt, hsa
ugcuggaggcugugugcgggcaggcuugugcuccccuuggagaagggcugcuacuuaacaaggaag

SEQ ID NO: 446160 - RNA, 66 nt, hsa
aacaucaaugcuuuuccucaggaaauucggcaagacuuggagaaaaggaaagcuccaucaaagagg

SEQ ID NO: 446161 - RNA, 66 nt, hsa
gaucuuuuccaaguucccaaggccuacagcugaagguuggagaaaugccagcugcccuuucguccc

SEQ ID NO: 446162 - RNA, 66 nt, hsa
gaaggccgucuccccuuagccaaguccuccucaggcuuggagaacuuccucagcgucaccuccuuc

SEQ ID NO: 446163 - RNA, 66 nt, hsa
gagucgcgcaccgaaaaacuaaaaauaaugggcgcuuuggagaagaguguggagucauucucauug

SEQ ID NO: 446164 - RNA, 66 nt, hsa
auuuuuuauuucagucacuccugauaaauaacaaauuuggagaaauaaaaauaucuaaaauaaauu

SEQ ID NO: 446165 - RNA, 66 nt, hsa
agaaagggcacuuggcaaccacuaugugaagggugauuggagaaggacaagacuguggaaugggga

SEQ ID NO: 446166 - RNA, 66 nt, hsa
acaagacuguggaauggggaauaaggaaggaggaguuuggagaaugacuccaaagguuugagcuug

SEQ ID NO: 446167 - RNA, 66 nt, hsa
gcggugaggcacucuggaauaugacccuaccagagguuggagaacaaacuugggcagccggaaccc

SEQ ID NO: 446168 - RNA, 66 nt, hsa
cccugaugaucaaccugccuccccuccauagucuuguuggagaagcccagagagaaugggacucca

SEQ ID NO: 446169 - RNA, 66 nt, hsa
ggagauggcgucuaccagaaggggauggacuucauuuuggagaagcucaaccauggggacugggug

SEQ ID NO: 446170 - RNA, 66 nt, hsa
gaacucaaugaaauaagcugcuaaucagauuuuaccuuggagaaaugaaaauuauuucuuggggau

SEQ ID NO: 446171 - RNA, 66 nt, hsa
agugcaauuuuuaaaaucuagaaguuagggguuuuguuggagaaaaauggacugaucuuuaaacua

SEQ ID NO: 446172 - RNA, 66 nt, hsa
acacaagacucucagguauagaaugaacugagcaauuuggagaauguauuggacuuuguccucucu

SEQ ID NO: 446173 - RNA, 66 nt, hsa
aauugccuucuuugccuagccaagcagccaauuuuauuggagaaaagcaaguuauauguucacaaa

SEQ ID NO: 446174 - RNA, 66 nt, hsa
ccuugguuggaagggaauagaaauguuugcugaacauuggagaaucucaacaugucuccuacugag

SEQ ID NO: 446175 - RNA, 66 nt, hsa
ugugugcaauauucuuaaauacuacugcucuaaaaguuggagaagucuugcaguuaucuuagcauu

SEQ ID NO: 446176 - RNA, 66 nt, hsa
aaugaaugagcaacaccaugcauauagauugaguacuuggagaauacucacguuuuuuaacucaug

SEQ ID NO: 446177 - RNA, 66 nt, hsa
aggagggauagaacaucacaacacugcucuaguuucuuggagaaucacauuucuuuacagguuaaa

SEQ ID NO: 446178 - RNA, 66 nt, hsa
agauaaaacucagaggaaauuugcacagaugcugcuuuggagaacuuuacaaccuggguugcagaa

SEQ ID NO: 446179 - RNA, 66 nt, hsa
uucucuguugaucacagagggagccugaguacaggcuuggagaaauggcuaggacagggaacaggg

SEQ ID NO: 446180 - RNA, 66 nt, hsa
ucuuccaucuugcugugauuugcaauagguauuuucuuggagaauguaagaacuuaacaauaaagc

SEQ ID NO: 446181 - RNA, 66 nt, hsa
acuguauaugcuggguauuucauuugucuuuuuauuuuggagaaagcguuuuuaacugcaacuuuc

SEQ ID NO: 446182 - RNA, 66 nt, hsa
auucauauaauuaaaaagaauuugguuaauaagaauuuggagaauggaaaauacauuuuuagguuc

SEQ ID NO: 446183 - RNA, 63 nt, hsa; identical to SEQ ID NO: 444889

SEQ ID NO: 446184 - RNA, 63 nt, hsa; identical to SEQ ID NO: 444890

SEQ ID NO: 446185 - RNA, 63 nt, hsa; identical to SEQ ID NO: 444891

SEQ ID NO: 446186 - RNA, 63 nt, hsa; identical to SEQ ID NO: 444892

SEQ ID NO: 446187 - RNA, 63 nt, hsa; identical to SEQ ID NO: 444893

SEQ ID NO: 446188 - RNA, 63 nt, hsa; identical to SEQ ID NO: 444894

SEQ ID NO: 446189 - RNA, 63 nt, hsa; identical to SEQ ID NO: 444895

SEQ ID NO: 446190 - RNA, 63 nt, hsa; identical to SEQ ID NO: 444896

SEQ ID NO: 446191 - RNA, 63 nt, hsa; identical to SEQ ID NO: 444897

SEQ ID NO: 446192 - RNA, 63 nt, hsa; identical to SEQ ID NO: 444898

SEQ ID NO: 446193 - RNA, 63 nt, hsa; identical to SEQ ID NO: 444899

SEQ ID NO: 446194 - RNA, 63 nt, hsa; identical to SEQ ID NO: 444900

SEQ ID NO: 446195 - RNA, 63 nt, hsa; identical to SEQ ID NO: 444901

SEQ ID NO: 446196 - RNA, 63 nt, hsa; identical to SEQ ID NO: 444902

SEQ ID NO: 446197 - RNA, 63 nt, hsa; identical to SEQ ID NO: 444903

SEQ ID NO: 446198 - RNA, 63 nt, hsa; identical to SEQ ID NO: 444904

SEQ ID NO: 446199 - RNA, 63 nt, hsa; identical to SEQ ID NO: 444905

SEQ ID NO: 446200 - RNA, 63 nt, hsa; identical to SEQ ID NO: 444906

SEQ ID NO: 446201 - RNA, 63 nt, hsa; identical to SEQ ID NO: 444907

SEQ ID NO: 446202 - RNA, 63 nt, hsa; identical to SEQ ID NO: 444908

SEQ ID NO: 446203 - RNA, 63 nt, hsa; identical to SEQ ID NO: 444909

SEQ ID NO: 446204 - RNA, 63 nt, hsa; identical to SEQ ID NO: 444910

SEQ ID NO: 446205 - RNA, 63 nt, hsa; identical to SEQ ID NO: 444911

SEQ ID NO: 446206 - RNA, 63 nt, hsa; identical to SEQ ID NO: 444912

SEQ ID NO: 446207 - RNA, 63 nt, hsa; identical to SEQ ID NO: 444913

SEQ ID NO: 446208 - RNA, 63 nt, hsa; identical to SEQ ID NO: 444914

SEQ ID NO: 446209 - RNA, 63 nt, hsa; identical to SEQ ID NO: 444915

SEQ ID NO: 446210 - RNA, 63 nt, hsa; identical to SEQ ID NO: 444916

SEQ ID NO: 446211 - RNA, 63 nt, hsa; identical to SEQ ID NO: 444917

SEQ ID NO: 446212 - RNA, 63 nt, hsa; identical to SEQ ID NO: 444918

SEQ ID NO: 446213 - RNA, 63 nt, hsa; identical to SEQ ID NO: 444919

SEQ ID NO: 446214 - RNA, 63 nt, hsa; identical to SEQ ID NO: 444920

SEQ ID NO: 446215 - RNA, 62 nt, hsa; identical to SEQ ID NO: 444921

SEQ ID NO: 446216 - RNA, 63 nt, hsa; identical to SEQ ID NO: 444922

SEQ ID NO: 446217 - RNA, 63 nt, hsa; identical to SEQ ID NO: 444923

SEQ ID NO: 446218 - RNA, 63 nt, hsa; identical to SEQ ID NO: 444924

SEQ ID NO: 446219 - RNA, 63 nt, hsa; identical to SEQ ID NO: 444925

SEQ ID NO: 446220 - RNA, 63 nt, hsa; identical to SEQ ID NO: 444926

SEQ ID NO: 446221 - RNA, 63 nt, hsa; identical to SEQ ID NO: 444927

SEQ ID NO: 446222 - RNA, 63 nt, hsa; identical to SEQ ID NO: 444928

SEQ ID NO: 446223 - RNA, 63 nt, hsa; identical to SEQ ID NO: 444929

SEQ ID NO: 446224 - RNA, 63 nt, hsa; identical to SEQ ID NO: 444930

SEQ ID NO: 446225 - RNA, 63 nt, hsa; identical to SEQ ID NO: 444931

SEQ ID NO: 446226 - RNA, 63 nt, hsa; identical to SEQ ID NO: 444932

SEQ ID NO: 446227 - RNA, 63 nt, hsa; identical to SEQ ID NO: 444933

SEQ ID NO: 446228 - RNA, 63 nt, hsa; identical to SEQ ID NO: 444934

SEQ ID NO: 446229 - RNA, 63 nt, hsa; identical to SEQ ID NO: 444935

SEQ ID NO: 446230 - RNA, 63 nt, hsa; identical to SEQ ID NO: 444936

SEQ ID NO: 446231 - RNA, 63 nt, hsa; identical to SEQ ID NO: 444937

SEQ ID NO: 446232 - RNA, 63 nt, hsa; identical to SEQ ID NO: 444938

SEQ ID NO: 446233 - RNA, 63 nt, hsa; identical to SEQ ID NO: 444939

SEQ ID NO: 446234 - RNA, 63 nt, hsa; identical to SEQ ID NO: 444940

SEQ ID NO: 446235 - RNA, 63 nt, hsa; identical to SEQ ID NO: 444941

SEQ ID NO: 446236 - RNA, 63 nt, hsa; identical to SEQ ID NO: 444942

SEQ ID NO: 446237 - RNA, 63 nt, hsa; identical to SEQ ID NO: 444943

SEQ ID NO: 446238 - RNA, 63 nt, hsa; identical to SEQ ID NO: 444944

SEQ ID NO: 446239 - RNA, 63 nt, hsa; identical to SEQ ID NO: 444945

SEQ ID NO: 446240 - RNA, 63 nt, hsa; identical to SEQ ID NO: 444946

SEQ ID NO: 446241 - RNA, 63 nt, hsa; identical to SEQ ID NO: 444947

SEQ ID NO: 446242 - RNA, 63 nt, hsa; identical to SEQ ID NO: 444948

SEQ ID NO: 446243 - RNA, 63 nt, hsa; identical to SEQ ID NO: 444949

SEQ ID NO: 446244 - RNA, 63 nt, hsa; identical to SEQ ID NO: 444950

SEQ ID NO: 446245 - RNA, 63 nt, hsa; identical to SEQ ID NO: 444951

SEQ ID NO: 446246 - RNA, 63 nt, hsa; identical to SEQ ID NO: 444952

SEQ ID NO: 446247 - RNA, 63 nt, hsa; identical to SEQ ID NO: 444953

SEQ ID NO: 446248 - RNA, 63 nt, hsa; identical to SEQ ID NO: 444954

SEQ ID NO: 446249 - RNA, 63 nt, hsa; identical to SEQ ID NO: 444955

SEQ ID NO: 446250 - RNA, 63 nt, hsa; identical to SEQ ID NO: 444956

SEQ ID NO: 446251 - RNA, 63 nt, hsa; identical to SEQ ID NO: 444957

SEQ ID NO: 446252 - RNA, 63 nt, hsa; identical to SEQ ID NO: 444958

SEQ ID NO: 446253 - RNA, 63 nt, hsa; identical to SEQ ID NO: 444959

SEQ ID NO: 446254 - RNA, 63 nt, hsa; identical to SEQ ID NO: 444960

SEQ ID NO: 446255 - RNA, 63 nt, hsa; identical to SEQ ID NO: 444961

SEQ ID NO: 446256 - RNA, 63 nt, hsa; identical to SEQ ID NO: 444962

SEQ ID NO: 446257 - RNA, 63 nt, hsa; identical to SEQ ID NO: 444963

SEQ ID NO: 446258 - RNA, 63 nt, hsa; identical to SEQ ID NO: 444964

SEQ ID NO: 446259 - RNA, 63 nt, hsa; identical to SEQ ID NO: 444965

SEQ ID NO: 446260 - RNA, 63 nt, hsa; identical to SEQ ID NO: 444966

SEQ ID NO: 446261 - RNA, 63 nt, hsa; identical to SEQ ID NO: 444967

SEQ ID NO: 446262 - RNA, 63 nt, hsa; identical to SEQ ID NO: 444968

SEQ ID NO: 446263 - RNA, 63 nt, hsa; identical to SEQ ID NO: 444969

SEQ ID NO: 446264 - RNA, 63 nt, hsa; identical to SEQ ID NO: 444970

SEQ ID NO: 446265 - RNA, 63 nt, hsa; identical to SEQ ID NO: 444971

SEQ ID NO: 446266 - RNA, 63 nt, hsa; identical to SEQ ID NO: 444972

SEQ ID NO: 446267 - RNA, 63 nt, hsa; identical to SEQ ID NO: 444973

SEQ ID NO: 446268 - RNA, 63 nt, hsa; identical to SEQ ID NO: 444974

SEQ ID NO: 446269 - RNA, 63 nt, hsa; identical to SEQ ID NO: 444975

SEQ ID NO: 446270 - RNA, 63 nt, hsa; identical to SEQ ID NO: 444976

SEQ ID NO: 446271 - RNA, 63 nt, hsa; identical to SEQ ID NO: 444977

SEQ ID NO: 446272 - RNA, 63 nt, hsa; identical to SEQ ID NO: 444978

SEQ ID NO: 446273 - RNA, 63 nt, hsa; identical to SEQ ID NO: 444979

SEQ ID NO: 446274 - RNA, 63 nt, hsa; identical to SEQ ID NO: 444980

SEQ ID NO: 446275 - RNA, 63 nt, hsa; identical to SEQ ID NO: 444981

SEQ ID NO: 446276 - RNA, 63 nt, hsa; identical to SEQ ID NO: 444982

SEQ ID NO: 446277 - RNA, 63 nt, hsa; identical to SEQ ID NO: 444983

SEQ ID NO: 446278 - RNA, 63 nt, hsa; identical to SEQ ID NO: 444984

SEQ ID NO: 446279 - RNA, 63 nt, hsa; identical to SEQ ID NO: 444985

SEQ ID NO: 446280 - RNA, 63 nt, hsa; identical to SEQ ID NO: 444986

SEQ ID NO: 446281 - RNA, 63 nt, hsa; identical to SEQ ID NO: 444987

SEQ ID NO: 446282 - RNA, 63 nt, hsa; identical to SEQ ID NO: 444988

SEQ ID NO: 446283 - RNA, 63 nt, hsa; identical to SEQ ID NO: 444989

SEQ ID NO: 446284 - RNA, 63 nt, hsa; identical to SEQ ID NO: 444990

SEQ ID NO: 446285 - RNA, 63 nt, hsa; identical to SEQ ID NO: 444991

SEQ ID NO: 446286 - RNA, 63 nt, hsa; identical to SEQ ID NO: 444992

SEQ ID NO: 446287 - RNA, 63 nt, hsa; identical to SEQ ID NO: 444993

SEQ ID NO: 446288 - RNA, 63 nt, hsa; identical to SEQ ID NO: 444994

SEQ ID NO: 446289 - RNA, 63 nt, hsa; identical to SEQ ID NO: 444995

SEQ ID NO: 446290 - RNA, 63 nt, hsa; identical to SEQ ID NO: 444996

SEQ ID NO: 446291 - RNA, 63 nt, hsa; identical to SEQ ID NO: 444997

SEQ ID NO: 446292 - RNA, 63 nt, hsa; identical to SEQ ID NO: 444998

SEQ ID NO: 446293 - RNA, 63 nt, hsa; identical to SEQ ID NO: 444999

SEQ ID NO: 446294 - RNA, 63 nt, hsa; identical to SEQ ID NO: 445000

SEQ ID NO: 446295 - RNA, 63 nt, hsa; identical to SEQ ID NO: 445001

SEQ ID NO: 446296 - RNA, 63 nt, hsa; identical to SEQ ID NO: 445002

SEQ ID NO: 446297 - RNA, 63 nt, hsa; identical to SEQ ID NO: 445003

SEQ ID NO: 446298 - RNA, 63 nt, hsa; identical to SEQ ID NO: 445004

SEQ ID NO: 446299 - RNA, 63 nt, hsa; identical to SEQ ID NO: 445005

SEQ ID NO: 446300 - RNA, 63 nt, hsa; identical to SEQ ID NO: 445006

SEQ ID NO: 446301 - RNA, 63 nt, hsa; identical to SEQ ID NO: 445007

SEQ ID NO: 446302 - RNA, 63 nt, hsa; identical to SEQ ID NO: 445008

SEQ ID NO: 446303 - RNA, 63 nt, hsa; identical to SEQ ID NO: 445009

SEQ ID NO: 446304 - RNA, 63 nt, hsa; identical to SEQ ID NO: 445010

SEQ ID NO: 446305 - RNA, 63 nt, hsa; identical to SEQ ID NO: 445011

SEQ ID NO: 446306 - RNA, 63 nt, hsa; identical to SEQ ID NO: 445012

SEQ ID NO: 446307 - RNA, 63 nt, hsa; identical to SEQ ID NO: 445013

SEQ ID NO: 446308 - RNA, 63 nt, hsa; identical to SEQ ID NO: 445014

SEQ ID NO: 446309 - RNA, 63 nt, hsa; identical to SEQ ID NO: 445015

SEQ ID NO: 446310 - RNA, 63 nt, hsa; identical to SEQ ID NO: 445016

SEQ ID NO: 446311 - RNA, 63 nt, hsa; identical to SEQ ID NO: 445017

SEQ ID NO: 446312 - RNA, 63 nt, hsa; identical to SEQ ID NO: 445018

SEQ ID NO: 446313 - RNA, 63 nt, hsa; identical to SEQ ID NO: 445019

SEQ ID NO: 446314 - RNA, 63 nt, hsa; identical to SEQ ID NO: 445020

SEQ ID NO: 446315 - RNA, 63 nt, hsa; identical to SEQ ID NO: 445021

SEQ ID NO: 446316 - RNA, 63 nt, hsa; identical to SEQ ID NO: 445022

SEQ ID NO: 446317 - RNA, 63 nt, hsa; identical to SEQ ID NO: 445023

SEQ ID NO: 446318 - RNA, 63 nt, hsa; identical to SEQ ID NO: 445024

SEQ ID NO: 446319 - RNA, 63 nt, hsa; identical to SEQ ID NO: 445025

SEQ ID NO: 446320 - RNA, 63 nt, hsa; identical to SEQ ID NO: 445026

SEQ ID NO: 446321 - RNA, 65 nt, hsa; identical to SEQ ID NO: 445027

SEQ ID NO: 446322 - RNA, 65 nt, hsa; identical to SEQ ID NO: 445028

SEQ ID NO: 446323 - RNA, 65 nt, hsa; identical to SEQ ID NO: 445029

SEQ ID NO: 446324 - RNA, 65 nt, hsa; identical to SEQ ID NO: 445030

SEQ ID NO: 446325 - RNA, 65 nt, hsa; identical to SEQ ID NO: 445031

SEQ ID NO: 446326 - RNA, 65 nt, hsa; identical to SEQ ID NO: 445032

SEQ ID NO: 446327 - RNA, 65 nt, hsa; identical to SEQ ID NO: 445033

SEQ ID NO: 446328 - RNA, 65 nt, hsa; identical to SEQ ID NO: 445034

SEQ ID NO: 446329 - RNA, 65 nt, hsa; identical to SEQ ID NO: 445035

SEQ ID NO: 446330 - RNA, 65 nt, hsa; identical to SEQ ID NO: 445036

SEQ ID NO: 446331 - RNA, 65 nt, hsa; identical to SEQ ID NO: 445037

SEQ ID NO: 446332 - RNA, 65 nt, hsa; identical to SEQ ID NO: 445038

SEQ ID NO: 446333 - RNA, 65 nt, hsa; identical to SEQ ID NO: 445039

SEQ ID NO: 446334 - RNA, 65 nt, hsa; identical to SEQ ID NO: 445040

SEQ ID NO: 446335 - RNA, 65 nt, hsa; identical to SEQ ID NO: 445041

SEQ ID NO: 446336 - RNA, 65 nt, hsa; identical to SEQ ID NO: 445042

SEQ ID NO: 446337 - RNA, 65 nt, hsa; identical to SEQ ID NO: 445043

SEQ ID NO: 446338 - RNA, 65 nt, hsa; identical to SEQ ID NO: 445044

SEQ ID NO: 446339 - RNA, 65 nt, hsa; identical to SEQ ID NO: 445045

SEQ ID NO: 446340 - RNA, 65 nt, hsa; identical to SEQ ID NO: 445046

SEQ ID NO: 446341 - RNA, 65 nt, hsa; identical to SEQ ID NO: 445047

SEQ ID NO: 446342 - RNA, 65 nt, hsa; identical to SEQ ID NO: 445048

SEQ ID NO: 446343 - RNA, 65 nt, hsa; identical to SEQ ID NO: 445049

SEQ ID NO: 446344 - RNA, 55 nt, hsa; identical to SEQ ID NO: 445050

SEQ ID NO: 446345 - RNA, 65 nt, hsa; identical to SEQ ID NO: 445051

SEQ ID NO: 446346 - RNA, 65 nt, hsa; identical to SEQ ID NO: 445052

SEQ ID NO: 446347 - RNA, 65 nt, hsa; identical to SEQ ID NO: 445053

SEQ ID NO: 446348 - RNA, 65 nt, hsa; identical to SEQ ID NO: 445054

SEQ ID NO: 446349 - RNA, 65 nt, hsa; identical to SEQ ID NO: 445055

SEQ ID NO: 446350 - RNA, 65 nt, hsa; identical to SEQ ID NO: 445056

SEQ ID NO: 446351 - RNA, 65 nt, hsa; identical to SEQ ID NO: 445057

SEQ ID NO: 446352 - RNA, 65 nt, hsa; identical to SEQ ID NO: 445058

SEQ ID NO: 446353 - RNA, 65 nt, hsa; identical to SEQ ID NO: 445059

SEQ ID NO: 446354 - RNA, 65 nt, hsa; identical to SEQ ID NO: 445060

SEQ ID NO: 446355 - RNA, 65 nt, hsa; identical to SEQ ID NO: 445061

SEQ ID NO: 446356 - RNA, 65 nt, hsa; identical to SEQ ID NO: 445062

SEQ ID NO: 446357 - RNA, 65 nt, hsa; identical to SEQ ID NO: 445063

SEQ ID NO: 446358 - RNA, 65 nt, hsa; identical to SEQ ID NO: 445064

SEQ ID NO: 446359 - RNA, 65 nt, hsa; identical to SEQ ID NO: 445065

SEQ ID NO: 446360 - RNA, 65 nt, hsa; identical to SEQ ID NO: 445066

SEQ ID NO: 446361 - RNA, 65 nt, hsa; identical to SEQ ID NO: 445067

SEQ ID NO: 446362 - RNA, 65 nt, hsa; identical to SEQ ID NO: 445068

SEQ ID NO: 446363 - RNA, 65 nt, hsa; identical to SEQ ID NO: 445069

SEQ ID NO: 446364 - RNA, 65 nt, hsa; identical to SEQ ID NO: 445070

SEQ ID NO: 446365 - RNA, 65 nt, hsa; identical to SEQ ID NO: 445071

SEQ ID NO: 446366 - RNA, 65 nt, hsa; identical to SEQ ID NO: 445072

SEQ ID NO: 446367 - RNA, 65 nt, hsa; identical to SEQ ID NO: 445073

SEQ ID NO: 446368 - RNA, 65 nt, hsa; identical to SEQ ID NO: 445074

SEQ ID NO: 446369 - RNA, 65 nt, hsa; identical to SEQ ID NO: 445075

SEQ ID NO: 446370 - RNA, 65 nt, hsa; identical to SEQ ID NO: 445076

SEQ ID NO: 446371 - RNA, 65 nt, hsa; identical to SEQ ID NO: 445077

SEQ ID NO: 446372 - RNA, 65 nt, hsa; identical to SEQ ID NO: 445078

SEQ ID NO: 446373 - RNA, 65 nt, hsa; identical to SEQ ID NO: 445079

SEQ ID NO: 446374 - RNA, 65 nt, hsa; identical to SEQ ID NO: 445080

SEQ ID NO: 446375 - RNA, 65 nt, hsa; identical to SEQ ID NO: 445081

SEQ ID NO: 446376 - RNA, 65 nt, hsa; identical to SEQ ID NO: 445082

SEQ ID NO: 446377 - RNA, 65 nt, hsa; identical to SEQ ID NO: 445083

SEQ ID NO: 446378 - RNA, 65 nt, hsa; identical to SEQ ID NO: 445084

SEQ ID NO: 446379 - RNA, 65 nt, hsa; identical to SEQ ID NO: 445085

SEQ ID NO: 446380 - RNA, 65 nt, hsa; identical to SEQ ID NO: 445086

SEQ ID NO: 446381 - RNA, 65 nt, hsa; identical to SEQ ID NO: 445087

SEQ ID NO: 446382 - RNA, 65 nt, hsa; identical to SEQ ID NO: 445088

SEQ ID NO: 446383 - RNA, 65 nt, hsa; identical to SEQ ID NO: 445089

SEQ ID NO: 446384 - RNA, 65 nt, hsa; identical to SEQ ID NO: 445090

SEQ ID NO: 446385 - RNA, 65 nt, hsa; identical to SEQ ID NO: 445091

SEQ ID NO: 446386 - RNA, 65 nt, hsa; identical to SEQ ID NO: 445092

SEQ ID NO: 446387 - RNA, 65 nt, hsa; identical to SEQ ID NO: 445093

SEQ ID NO: 446388 - RNA, 65 nt, hsa; identical to SEQ ID NO: 445094

SEQ ID NO: 446389 - RNA, 65 nt, hsa; identical to SEQ ID NO: 445095

SEQ ID NO: 446390 - RNA, 65 nt, hsa; identical to SEQ ID NO: 445096

SEQ ID NO: 446391 - RNA, 65 nt, hsa; identical to SEQ ID NO: 445097

SEQ ID NO: 446392 - RNA, 65 nt, hsa; identical to SEQ ID NO: 445098

SEQ ID NO: 446393 - RNA, 65 nt, hsa; identical to SEQ ID NO: 445099

SEQ ID NO: 446394 - RNA, 65 nt, hsa; identical to SEQ ID NO: 445100

SEQ ID NO: 446395 - RNA, 65 nt, hsa; identical to SEQ ID NO: 445101

SEQ ID NO: 446396 - RNA, 65 nt, hsa; identical to SEQ ID NO: 445102

SEQ ID NO: 446397 - RNA, 65 nt, hsa; identical to SEQ ID NO: 445103

SEQ ID NO: 446398 - RNA, 65 nt, hsa; identical to SEQ ID NO: 445104

SEQ ID NO: 446399 - RNA, 65 nt, hsa; identical to SEQ ID NO: 445105

SEQ ID NO: 446400 - RNA, 65 nt, hsa; identical to SEQ ID NO: 445106

SEQ ID NO: 446401 - RNA, 65 nt, hsa; identical to SEQ ID NO: 445107

SEQ ID NO: 446402 - RNA, 65 nt, hsa; identical to SEQ ID NO: 445108

SEQ ID NO: 446403 - RNA, 65 nt, hsa; identical to SEQ ID NO: 445109

SEQ ID NO: 446404 - RNA, 65 nt, hsa; identical to SEQ ID NO: 445110

SEQ ID NO: 446405 - RNA, 65 nt, hsa; identical to SEQ ID NO: 445111

SEQ ID NO: 446406 - RNA, 65 nt, hsa; identical to SEQ ID NO: 445112

SEQ ID NO: 446407 - RNA, 65 nt, hsa; identical to SEQ ID NO: 445113

SEQ ID NO: 446408 - RNA, 65 nt, hsa; identical to SEQ ID NO: 445114

SEQ ID NO: 446409 - RNA, 65 nt, hsa; identical to SEQ ID NO: 445115

SEQ ID NO: 446410 - RNA, 65 nt, hsa; identical to SEQ ID NO: 445116

SEQ ID NO: 446411 - RNA, 65 nt, hsa; identical to SEQ ID NO: 445117

SEQ ID NO: 446412 - RNA, 65 nt, hsa; identical to SEQ ID NO: 445118

SEQ ID NO: 446413 - RNA, 65 nt, hsa; identical to SEQ ID NO: 445119

SEQ ID NO: 446414 - RNA, 65 nt, hsa; identical to SEQ ID NO: 445120

SEQ ID NO: 446415 - RNA, 65 nt, hsa; identical to SEQ ID NO: 445121

SEQ ID NO: 446416 - RNA, 65 nt, hsa; identical to SEQ ID NO: 445122

SEQ ID NO: 446417 - RNA, 65 nt, hsa; identical to SEQ ID NO: 445123

SEQ ID NO: 446418 - RNA, 65 nt, hsa; identical to SEQ ID NO: 445124

SEQ ID NO: 446419 - RNA, 65 nt, hsa; identical to SEQ ID NO: 445125

SEQ ID NO: 446420 - RNA, 65 nt, hsa; identical to SEQ ID NO: 445126

SEQ ID NO: 446421 - RNA, 65 nt, hsa; identical to SEQ ID NO: 445127

SEQ ID NO: 446422 - RNA, 65 nt, hsa; identical to SEQ ID NO: 445128

SEQ ID NO: 446423 - RNA, 65 nt, hsa; identical to SEQ ID NO: 445129

SEQ ID NO: 446424 - RNA, 65 nt, hsa; identical to SEQ ID NO: 445130

SEQ ID NO: 446425 - RNA, 65 nt, hsa; identical to SEQ ID NO: 445131

SEQ ID NO: 446426 - RNA, 65 nt, hsa; identical to SEQ ID NO: 445132

SEQ ID NO: 446427 - RNA, 65 nt, hsa; identical to SEQ ID NO: 445133

SEQ ID NO: 446428 - RNA, 65 nt, hsa; identical to SEQ ID NO: 445134

SEQ ID NO: 446429 - RNA, 65 nt, hsa; identical to SEQ ID NO: 445135

SEQ ID NO: 446430 - RNA, 65 nt, hsa; identical to SEQ ID NO: 445136

SEQ ID NO: 446431 - RNA, 65 nt, hsa; identical to SEQ ID NO: 445137

SEQ ID NO: 446432 - RNA, 65 nt, hsa; identical to SEQ ID NO: 445138

SEQ ID NO: 446433 - RNA, 65 nt, hsa; identical to SEQ ID NO: 445139

SEQ ID NO: 446434 - RNA, 65 nt, hsa; identical to SEQ ID NO: 445140

SEQ ID NO: 446435 - RNA, 65 nt, hsa; identical to SEQ ID NO: 445141

SEQ ID NO: 446436 - RNA, 65 nt, hsa; identical to SEQ ID NO: 445142

SEQ ID NO: 446437 - RNA, 65 nt, hsa; identical to SEQ ID NO: 445143

SEQ ID NO: 446438 - RNA, 65 nt, hsa; identical to SEQ ID NO: 445144

SEQ ID NO: 446439 - RNA, 65 nt, hsa; identical to SEQ ID NO: 445145

SEQ ID NO: 446440 - RNA, 65 nt, hsa; identical to SEQ ID NO: 445146

SEQ ID NO: 446441 - RNA, 65 nt, hsa; identical to SEQ ID NO: 445147

SEQ ID NO: 446442 - RNA, 65 nt, hsa; identical to SEQ ID NO: 445148

SEQ ID NO: 446443 - RNA, 65 nt, hsa; identical to SEQ ID NO: 445149

SEQ ID NO: 446444 - RNA, 65 nt, hsa; identical to SEQ ID NO: 445150

SEQ ID NO: 446445 - RNA, 57 nt, hsa; identical to SEQ ID NO: 445151

SEQ ID NO: 446446 - RNA, 65 nt, hsa; identical to SEQ ID NO: 445152

SEQ ID NO: 446447 - RNA, 65 nt, hsa; identical to SEQ ID NO: 445153

SEQ ID NO: 446448 - RNA, 65 nt, hsa; identical to SEQ ID NO: 445154

SEQ ID NO: 446449 - RNA, 65 nt, hsa; identical to SEQ ID NO: 445155

SEQ ID NO: 446450 - RNA, 65 nt, hsa; identical to SEQ ID NO: 445156

SEQ ID NO: 446451 - RNA, 65 nt, hsa; identical to SEQ ID NO: 445157

SEQ ID NO: 446452 - RNA, 65 nt, hsa; identical to SEQ ID NO: 445158

SEQ ID NO: 446453 - RNA, 65 nt, hsa; identical to SEQ ID NO: 445159

SEQ ID NO: 446454 - RNA, 65 nt, hsa; identical to SEQ ID NO: 445160

SEQ ID NO: 446455 - RNA, 65 nt, hsa; identical to SEQ ID NO: 445161

SEQ ID NO: 446456 - RNA, 65 nt, hsa; identical to SEQ ID NO: 445162

SEQ ID NO: 446457 - RNA, 65 nt, hsa; identical to SEQ ID NO: 445163

SEQ ID NO: 446458 - RNA, 65 nt, hsa; identical to SEQ ID NO: 445164

SEQ ID NO: 446459 - RNA, 65 nt, hsa; identical to SEQ ID NO: 445165

SEQ ID NO: 446460 - RNA, 65 nt, hsa; identical to SEQ ID NO: 445166

SEQ ID NO: 446461 - RNA, 65 nt, hsa; identical to SEQ ID NO: 445167

SEQ ID NO: 446462 - RNA, 65 nt, hsa; identical to SEQ ID NO: 445168

SEQ ID NO: 446463 - RNA, 65 nt, hsa; identical to SEQ ID NO: 445169

SEQ ID NO: 446464 - RNA, 65 nt, hsa; identical to SEQ ID NO: 445170

SEQ ID NO: 446465 - RNA, 65 nt, hsa; identical to SEQ ID NO: 445171

SEQ ID NO: 446466 - RNA, 65 nt, hsa; identical to SEQ ID NO: 445172

SEQ ID NO: 446467 - RNA, 65 nt, hsa; identical to SEQ ID NO: 445173

SEQ ID NO: 446468 - RNA, 65 nt, hsa; identical to SEQ ID NO: 445174

SEQ ID NO: 446469 - RNA, 65 nt, hsa; identical to SEQ ID NO: 445175

SEQ ID NO: 446470 - RNA, 65 nt, hsa; identical to SEQ ID NO: 445176

SEQ ID NO: 446471 - RNA, 65 nt, hsa; identical to SEQ ID NO: 445177

SEQ ID NO: 446472 - RNA, 65 nt, hsa; identical to SEQ ID NO: 445178

SEQ ID NO: 446473 - RNA, 65 nt, hsa; identical to SEQ ID NO: 445179

SEQ ID NO: 446474 - RNA, 59 nt, hsa; identical to SEQ ID NO: 445180

SEQ ID NO: 446475 - RNA, 65 nt, hsa; identical to SEQ ID NO: 445181

SEQ ID NO: 446476 - RNA, 65 nt, hsa; identical to SEQ ID NO: 445182

SEQ ID NO: 446477 - RNA, 65 nt, hsa; identical to SEQ ID NO: 445183

SEQ ID NO: 446478 - RNA, 65 nt, hsa; identical to SEQ ID NO: 445184

SEQ ID NO: 446479 - RNA, 65 nt, hsa; identical to SEQ ID NO: 445185

SEQ ID NO: 446480 - RNA, 65 nt, hsa; identical to SEQ ID NO: 445186

SEQ ID NO: 446481 - RNA, 65 nt, hsa; identical to SEQ ID NO: 445187

SEQ ID NO: 446482 - RNA, 65 nt, hsa; identical to SEQ ID NO: 445188

SEQ ID NO: 446483 - RNA, 65 nt, hsa; identical to SEQ ID NO: 445189

SEQ ID NO: 446484 - RNA, 65 nt, hsa; identical to SEQ ID NO: 445190

SEQ ID NO: 446485 - RNA, 65 nt, hsa; identical to SEQ ID NO: 445191

SEQ ID NO: 446486 - RNA, 65 nt, hsa; identical to SEQ ID NO: 445192

SEQ ID NO: 446487 - RNA, 65 nt, hsa; identical to SEQ ID NO: 445193

SEQ ID NO: 446488 - RNA, 65 nt, hsa; identical to SEQ ID NO: 445194

SEQ ID NO: 446489 - RNA, 65 nt, hsa; identical to SEQ ID NO: 445195

SEQ ID NO: 446490 - RNA, 65 nt, hsa; identical to SEQ ID NO: 445196

SEQ ID NO: 446491 - RNA, 65 nt, hsa; identical to SEQ ID NO: 445197

SEQ ID NO: 446492 - RNA, 65 nt, hsa; identical to SEQ ID NO: 445198

SEQ ID NO: 446493 - RNA, 65 nt, hsa; identical to SEQ ID NO: 445199

SEQ ID NO: 446494 - RNA, 65 nt, hsa; identical to SEQ ID NO: 445200

SEQ ID NO: 446495 - RNA, 65 nt, hsa; identical to SEQ ID NO: 445201

SEQ ID NO: 446496 - RNA, 65 nt, hsa; identical to SEQ ID NO: 445202

SEQ ID NO: 446497 - RNA, 65 nt, hsa; identical to SEQ ID NO: 445203

SEQ ID NO: 446498 - RNA, 65 nt, hsa; identical to SEQ ID NO: 445204

SEQ ID NO: 446499 - RNA, 65 nt, hsa; identical to SEQ ID NO: 445205

SEQ ID NO: 446500 - RNA, 65 nt, hsa; identical to SEQ ID NO: 445206

SEQ ID NO: 446501 - RNA, 65 nt, hsa; identical to SEQ ID NO: 445207

SEQ ID NO: 446502 - RNA, 65 nt, hsa; identical to SEQ ID NO: 445208

SEQ ID NO: 446503 - RNA, 65 nt, hsa; identical to SEQ ID NO: 445209

SEQ ID NO: 446504 - RNA, 65 nt, hsa; identical to SEQ ID NO: 445210

SEQ ID NO: 446505 - RNA, 65 nt, hsa; identical to SEQ ID NO: 445211

SEQ ID NO: 446506 - RNA, 65 nt, hsa; identical to SEQ ID NO: 445212

SEQ ID NO: 446507 - RNA, 65 nt, hsa; identical to SEQ ID NO: 445213

SEQ ID NO: 446508 - RNA, 65 nt, hsa; identical to SEQ ID NO: 445214

SEQ ID NO: 446509 - RNA, 65 nt, hsa; identical to SEQ ID NO: 445215

SEQ ID NO: 446510 - RNA, 65 nt, hsa; identical to SEQ ID NO: 445216

SEQ ID NO: 446511 - RNA, 65 nt, hsa; identical to SEQ ID NO: 445217

SEQ ID NO: 446512 - RNA, 65 nt, hsa; identical to SEQ ID NO: 445218

SEQ ID NO: 446513 - RNA, 65 nt, hsa; identical to SEQ ID NO: 445219

SEQ ID NO: 446514 - RNA, 65 nt, hsa; identical to SEQ ID NO: 445220

SEQ ID NO: 446515 - RNA, 65 nt, hsa; identical to SEQ ID NO: 445221

SEQ ID NO: 446516 - RNA, 65 nt, hsa; identical to SEQ ID NO: 445222

SEQ ID NO: 446517 - RNA, 65 nt, hsa; identical to SEQ ID NO: 445223

SEQ ID NO: 446518 - RNA, 65 nt, hsa; identical to SEQ ID NO: 445224

SEQ ID NO: 446519 - RNA, 65 nt, hsa; identical to SEQ ID NO: 445225

SEQ ID NO: 446520 - RNA, 65 nt, hsa; identical to SEQ ID NO: 445226

SEQ ID NO: 446521 - RNA, 65 nt, hsa; identical to SEQ ID NO: 445227

SEQ ID NO: 446522 - RNA, 65 nt, hsa; identical to SEQ ID NO: 445228

SEQ ID NO: 446523 - RNA, 65 nt, hsa; identical to SEQ ID NO: 445229

SEQ ID NO: 446524 - RNA, 65 nt, hsa; identical to SEQ ID NO: 445230

SEQ ID NO: 446525 - RNA, 65 nt, hsa; identical to SEQ ID NO: 445231

SEQ ID NO: 446526 - RNA, 65 nt, hsa; identical to SEQ ID NO: 445232

SEQ ID NO: 446527 - RNA, 65 nt, hsa; identical to SEQ ID NO: 445233

SEQ ID NO: 446528 - RNA, 65 nt, hsa; identical to SEQ ID NO: 445234

SEQ ID NO: 446529 - RNA, 65 nt, hsa; identical to SEQ ID NO: 445235

SEQ ID NO: 446530 - RNA, 65 nt, hsa; identical to SEQ ID NO: 445236

SEQ ID NO: 446531 - RNA, 65 nt, hsa; identical to SEQ ID NO: 445237

SEQ ID NO: 446532 - RNA, 65 nt, hsa; identical to SEQ ID NO: 445238

SEQ ID NO: 446533 - RNA, 65 nt, hsa; identical to SEQ ID NO: 445239

SEQ ID NO: 446534 - RNA, 65 nt, hsa; identical to SEQ ID NO: 445240

SEQ ID NO: 446535 - RNA, 65 nt, hsa; identical to SEQ ID NO: 445241

SEQ ID NO: 446536 - RNA, 65 nt, hsa; identical to SEQ ID NO: 445242

SEQ ID NO: 446537 - RNA, 65 nt, hsa; identical to SEQ ID NO: 445243

SEQ ID NO: 446538 - RNA, 65 nt, hsa; identical to SEQ ID NO: 445244

SEQ ID NO: 446539 - RNA, 65 nt, hsa; identical to SEQ ID NO: 445245

SEQ ID NO: 446540 - RNA, 65 nt, hsa; identical to SEQ ID NO: 445246

SEQ ID NO: 446541 - RNA, 65 nt, hsa; identical to SEQ ID NO: 445247

SEQ ID NO: 446542 - RNA, 65 nt, hsa; identical to SEQ ID NO: 445248

SEQ ID NO: 446543 - RNA, 65 nt, hsa; identical to SEQ ID NO: 445249

SEQ ID NO: 446544 - RNA, 65 nt, hsa; identical to SEQ ID NO: 445250

SEQ ID NO: 446545 - RNA, 65 nt, hsa; identical to SEQ ID NO: 445251

SEQ ID NO: 446546 - RNA, 65 nt, hsa; identical to SEQ ID NO: 445252

SEQ ID NO: 446547 - RNA, 65 nt, hsa; identical to SEQ ID NO: 445253

SEQ ID NO: 446548 - RNA, 65 nt, hsa; identical to SEQ ID NO: 445254

SEQ ID NO: 446549 - RNA, 65 nt, hsa; identical to SEQ ID NO: 445255

SEQ ID NO: 446550 - RNA, 65 nt, hsa; identical to SEQ ID NO: 445256

SEQ ID NO: 446551 - RNA, 65 nt, hsa; identical to SEQ ID NO: 445257

SEQ ID NO: 446552 - RNA, 65 nt, hsa; identical to SEQ ID NO: 445258

SEQ ID NO: 446553 - RNA, 65 nt, hsa; identical to SEQ ID NO: 445259

SEQ ID NO: 446554 - RNA, 65 nt, hsa; identical to SEQ ID NO: 445260

SEQ ID NO: 446555 - RNA, 65 nt, hsa; identical to SEQ ID NO: 445261

SEQ ID NO: 446556 - RNA, 65 nt, hsa; identical to SEQ ID NO: 445262

SEQ ID NO: 446557 - RNA, 65 nt, hsa; identical to SEQ ID NO: 445263

SEQ ID NO: 446558 - RNA, 65 nt, hsa; identical to SEQ ID NO: 445264

SEQ ID NO: 446559 - RNA, 65 nt, hsa; identical to SEQ ID NO: 445265

SEQ ID NO: 446560 - RNA, 65 nt, hsa; identical to SEQ ID NO: 445266

SEQ ID NO: 446561 - RNA, 65 nt, hsa; identical to SEQ ID NO: 445267

SEQ ID NO: 446562 - RNA, 65 nt, hsa; identical to SEQ ID NO: 445268

SEQ ID NO: 446563 - RNA, 65 nt, hsa; identical to SEQ ID NO: 445269

SEQ ID NO: 446564 - RNA, 65 nt, hsa; identical to SEQ ID NO: 445270

SEQ ID NO: 446565 - RNA, 65 nt, hsa; identical to SEQ ID NO: 445271

SEQ ID NO: 446566 - RNA, 65 nt, hsa; identical to SEQ ID NO: 445272

SEQ ID NO: 446567 - RNA, 65 nt, hsa; identical to SEQ ID NO: 445273

SEQ ID NO: 446568 - RNA, 65 nt, hsa; identical to SEQ ID NO: 445274

SEQ ID NO: 446569 - RNA, 65 nt, hsa; identical to SEQ ID NO: 445275

SEQ ID NO: 446570 - RNA, 65 nt, hsa; identical to SEQ ID NO: 445276

SEQ ID NO: 446571 - RNA, 65 nt, hsa; identical to SEQ ID NO: 445277

SEQ ID NO: 446572 - RNA, 65 nt, hsa; identical to SEQ ID NO: 445278

SEQ ID NO: 446573 - RNA, 65 nt, hsa; identical to SEQ ID NO: 445279

SEQ ID NO: 446574 - RNA, 65 nt, hsa; identical to SEQ ID NO: 445280

SEQ ID NO: 446575 - RNA, 65 nt, hsa; identical to SEQ ID NO: 445281

SEQ ID NO: 446576 - RNA, 65 nt, hsa; identical to SEQ ID NO: 445282

SEQ ID NO: 446577 - RNA, 65 nt, hsa; identical to SEQ ID NO: 445283

SEQ ID NO: 446578 - RNA, 65 nt, hsa; identical to SEQ ID NO: 445284

SEQ ID NO: 446579 - RNA, 65 nt, hsa; identical to SEQ ID NO: 445285

SEQ ID NO: 446580 - RNA, 65 nt, hsa; identical to SEQ ID NO: 445286

SEQ ID NO: 446581 - RNA, 65 nt, hsa; identical to SEQ ID NO: 445287

SEQ ID NO: 446582 - RNA, 65 nt, hsa; identical to SEQ ID NO: 445288

SEQ ID NO: 446583 - RNA, 65 nt, hsa; identical to SEQ ID NO: 445289

SEQ ID NO: 446584 - RNA, 65 nt, hsa; identical to SEQ ID NO: 445290

SEQ ID NO: 446585 - RNA, 65 nt, hsa; identical to SEQ ID NO: 445291

SEQ ID NO: 446586 - RNA, 65 nt, hsa; identical to SEQ ID NO: 445292

SEQ ID NO: 446587 - RNA, 65 nt, hsa; identical to SEQ ID NO: 445293

SEQ ID NO: 446588 - RNA, 65 nt, hsa; identical to SEQ ID NO: 445294

SEQ ID NO: 446589 - RNA, 65 nt, hsa; identical to SEQ ID NO: 445295

SEQ ID NO: 446590 - RNA, 65 nt, hsa; identical to SEQ ID NO: 445296

SEQ ID NO: 446591 - RNA, 65 nt, hsa; identical to SEQ ID NO: 445297

SEQ ID NO: 446592 - RNA, 65 nt, hsa; identical to SEQ ID NO: 445298

SEQ ID NO: 446593 - RNA, 65 nt, hsa; identical to SEQ ID NO: 445299

SEQ ID NO: 446594 - RNA, 65 nt, hsa; identical to SEQ ID NO: 445300

SEQ ID NO: 446595 - RNA, 65 nt, hsa; identical to SEQ ID NO: 445301

SEQ ID NO: 446596 - RNA, 65 nt, hsa; identical to SEQ ID NO: 445302

SEQ ID NO: 446597 - RNA, 65 nt, hsa; identical to SEQ ID NO: 445303

SEQ ID NO: 446598 - RNA, 65 nt, hsa; identical to SEQ ID NO: 445304

SEQ ID NO: 446599 - RNA, 65 nt, hsa; identical to SEQ ID NO: 445305

SEQ ID NO: 446600 - RNA, 65 nt, hsa; identical to SEQ ID NO: 445306

SEQ ID NO: 446601 - RNA, 65 nt, hsa; identical to SEQ ID NO: 445307

SEQ ID NO: 446602 - RNA, 65 nt, hsa; identical to SEQ ID NO: 445308

SEQ ID NO: 446603 - RNA, 65 nt, hsa; identical to SEQ ID NO: 445309

SEQ ID NO: 446604 - RNA, 65 nt, hsa; identical to SEQ ID NO: 445310

SEQ ID NO: 446605 - RNA, 65 nt, hsa; identical to SEQ ID NO: 445311

SEQ ID NO: 446606 - RNA, 65 nt, hsa; identical to SEQ ID NO: 445312

SEQ ID NO: 446607 - RNA, 65 nt, hsa; identical to SEQ ID NO: 445313

SEQ ID NO: 446608 - RNA, 65 nt, hsa; identical to SEQ ID NO: 445314

SEQ ID NO: 446609 - RNA, 60 nt, hsa; identical to SEQ ID NO: 445315

SEQ ID NO: 446610 - RNA, 65 nt, hsa; identical to SEQ ID NO: 445316

SEQ ID NO: 446611 - RNA, 65 nt, hsa; identical to SEQ ID NO: 445317

SEQ ID NO: 446612 - RNA, 65 nt, hsa; identical to SEQ ID NO: 445318

SEQ ID NO: 446613 - RNA, 65 nt, hsa; identical to SEQ ID NO: 445319

SEQ ID NO: 446614 - RNA, 65 nt, hsa; identical to SEQ ID NO: 445320

SEQ ID NO: 446615 - RNA, 65 nt, hsa; identical to SEQ ID NO: 445321

SEQ ID NO: 446616 - RNA, 65 nt, hsa; identical to SEQ ID NO: 445322

SEQ ID NO: 446617 - RNA, 65 nt, hsa; identical to SEQ ID NO: 445323

SEQ ID NO: 446618 - RNA, 65 nt, hsa; identical to SEQ ID NO: 445324

SEQ ID NO: 446619 - RNA, 65 nt, hsa; identical to SEQ ID NO: 445325

SEQ ID NO: 446620 - RNA, 65 nt, hsa; identical to SEQ ID NO: 445326

SEQ ID NO: 446621 - RNA, 65 nt, hsa; identical to SEQ ID NO: 445327

SEQ ID NO: 446622 - RNA, 65 nt, hsa; identical to SEQ ID NO: 445328

SEQ ID NO: 446623 - RNA, 65 nt, hsa; identical to SEQ ID NO: 445329

SEQ ID NO: 446624 - RNA, 65 nt, hsa; identical to SEQ ID NO: 445330

SEQ ID NO: 446625 - RNA, 65 nt, hsa; identical to SEQ ID NO: 445331

SEQ ID NO: 446626 - RNA, 65 nt, hsa; identical to SEQ ID NO: 445332

SEQ ID NO: 446627 - RNA, 65 nt, hsa; identical to SEQ ID NO: 445333

SEQ ID NO: 446628 - RNA, 65 nt, hsa; identical to SEQ ID NO: 445334

SEQ ID NO: 446629 - RNA, 65 nt, hsa; identical to SEQ ID NO: 445335

SEQ ID NO: 446630 - RNA, 65 nt, hsa; identical to SEQ ID NO: 445336

SEQ ID NO: 446631 - RNA, 65 nt, hsa; identical to SEQ ID NO: 445337

SEQ ID NO: 446632 - RNA, 65 nt, hsa; identical to SEQ ID NO: 445338

SEQ ID NO: 446633 - RNA, 65 nt, hsa; identical to SEQ ID NO: 445339

SEQ ID NO: 446634 - RNA, 65 nt, hsa; identical to SEQ ID NO: 445340

SEQ ID NO: 446635 - RNA, 65 nt, hsa; identical to SEQ ID NO: 445341

SEQ ID NO: 446636 - RNA, 65 nt, hsa; identical to SEQ ID NO: 445342

SEQ ID NO: 446637 - RNA, 65 nt, hsa; identical to SEQ ID NO: 445343

SEQ ID NO: 446638 - RNA, 65 nt, hsa; identical to SEQ ID NO: 445344

SEQ ID NO: 446639 - RNA, 65 nt, hsa; identical to SEQ ID NO: 445345

SEQ ID NO: 446640 - RNA, 65 nt, hsa; identical to SEQ ID NO: 445346

SEQ ID NO: 446641 - RNA, 65 nt, hsa; identical to SEQ ID NO: 445347

SEQ ID NO: 446642 - RNA, 65 nt, hsa; identical to SEQ ID NO: 445348

SEQ ID NO: 446643 - RNA, 65 nt, hsa; identical to SEQ ID NO: 445349

SEQ ID NO: 446644 - RNA, 65 nt, hsa; identical to SEQ ID NO: 445350

SEQ ID NO: 446645 - RNA, 65 nt, hsa; identical to SEQ ID NO: 445351

SEQ ID NO: 446646 - RNA, 65 nt, hsa; identical to SEQ ID NO: 445352

SEQ ID NO: 446647 - RNA, 65 nt, hsa; identical to SEQ ID NO: 445353

SEQ ID NO: 446648 - RNA, 65 nt, hsa; identical to SEQ ID NO: 445354

SEQ ID NO: 446649 - RNA, 65 nt, hsa; identical to SEQ ID NO: 445355

SEQ ID NO: 446650 - RNA, 65 nt, hsa; identical to SEQ ID NO: 445356

SEQ ID NO: 446651 - RNA, 65 nt, hsa; identical to SEQ ID NO: 445357

SEQ ID NO: 446652 - RNA, 65 nt, hsa; identical to SEQ ID NO: 445358

SEQ ID NO: 446653 - RNA, 65 nt, hsa; identical to SEQ ID NO: 445359

SEQ ID NO: 446654 - RNA, 65 nt, hsa; identical to SEQ ID NO: 445360

SEQ ID NO: 446655 - RNA, 65 nt, hsa; identical to SEQ ID NO: 445361

SEQ ID NO: 446656 - RNA, 65 nt, hsa; identical to SEQ ID NO: 445362

SEQ ID NO: 446657 - RNA, 55 nt, hsa; identical to SEQ ID NO: 445363

SEQ ID NO: 446658 - RNA, 65 nt, hsa; identical to SEQ ID NO: 445364

SEQ ID NO: 446659 - RNA, 65 nt, hsa; identical to SEQ ID NO: 445365

SEQ ID NO: 446660 - RNA, 65 nt, hsa; identical to SEQ ID NO: 445366

SEQ ID NO: 446661 - RNA, 65 nt, hsa; identical to SEQ ID NO: 445367

SEQ ID NO: 446662 - RNA, 65 nt, hsa; identical to SEQ ID NO: 445368

SEQ ID NO: 446663 - RNA, 65 nt, hsa; identical to SEQ ID NO: 445369

SEQ ID NO: 446664 - RNA, 65 nt, hsa; identical to SEQ ID NO: 445370

SEQ ID NO: 446665 - RNA, 65 nt, hsa; identical to SEQ ID NO: 445371

SEQ ID NO: 446666 - RNA, 65 nt, hsa; identical to SEQ ID NO: 445372

SEQ ID NO: 446667 - RNA, 65 nt, hsa; identical to SEQ ID NO: 445373

SEQ ID NO: 446668 - RNA, 65 nt, hsa; identical to SEQ ID NO: 445374

SEQ ID NO: 446669 - RNA, 65 nt, hsa; identical to SEQ ID NO: 445375

SEQ ID NO: 446670 - RNA, 65 nt, hsa; identical to SEQ ID NO: 445376

SEQ ID NO: 446671 - RNA, 65 nt, hsa; identical to SEQ ID NO: 445377

SEQ ID NO: 446672 - RNA, 65 nt, hsa; identical to SEQ ID NO: 445378

SEQ ID NO: 446673 - RNA, 65 nt, hsa; identical to SEQ ID NO: 445379

SEQ ID NO: 446674 - RNA, 65 nt, hsa; identical to SEQ ID NO: 445380

SEQ ID NO: 446675 - RNA, 65 nt, hsa; identical to SEQ ID NO: 445381

SEQ ID NO: 446676 - RNA, 65 nt, hsa; identical to SEQ ID NO: 445382

SEQ ID NO: 446677 - RNA, 65 nt, hsa; identical to SEQ ID NO: 445383

SEQ ID NO: 446678 - RNA, 65 nt, hsa; identical to SEQ ID NO: 445384

SEQ ID NO: 446679 - RNA, 65 nt, hsa; identical to SEQ ID NO: 445385

SEQ ID NO: 446680 - RNA, 65 nt, hsa; identical to SEQ ID NO: 445386

SEQ ID NO: 446681 - RNA, 65 nt, hsa; identical to SEQ ID NO: 445387

SEQ ID NO: 446682 - RNA, 65 nt, hsa; identical to SEQ ID NO: 445388

SEQ ID NO: 446683 - RNA, 65 nt, hsa; identical to SEQ ID NO: 445389

SEQ ID NO: 446684 - RNA, 65 nt, hsa; identical to SEQ ID NO: 445390

SEQ ID NO: 446685 - RNA, 65 nt, hsa; identical to SEQ ID NO: 445391

SEQ ID NO: 446686 - RNA, 65 nt, hsa; identical to SEQ ID NO: 445392

SEQ ID NO: 446687 - RNA, 65 nt, hsa; identical to SEQ ID NO: 445393

SEQ ID NO: 446688 - RNA, 65 nt, hsa; identical to SEQ ID NO: 445394

SEQ ID NO: 446689 - RNA, 65 nt, hsa; identical to SEQ ID NO: 445395

SEQ ID NO: 446690 - RNA, 65 nt, hsa; identical to SEQ ID NO: 445396

SEQ ID NO: 446691 - RNA, 65 nt, hsa; identical to SEQ ID NO: 445397

SEQ ID NO: 446692 - RNA, 65 nt, hsa; identical to SEQ ID NO: 445398

SEQ ID NO: 446693 - RNA, 65 nt, hsa; identical to SEQ ID NO: 445399

SEQ ID NO: 446694 - RNA, 65 nt, hsa; identical to SEQ ID NO: 445400

SEQ ID NO: 446695 - RNA, 65 nt, hsa; identical to SEQ ID NO: 445401

SEQ ID NO: 446696 - RNA, 65 nt, hsa; identical to SEQ ID NO: 445402

SEQ ID NO: 446697 - RNA, 65 nt, hsa; identical to SEQ ID NO: 445403

SEQ ID NO: 446698 - RNA, 65 nt, hsa; identical to SEQ ID NO: 445404

SEQ ID NO: 446699 - RNA, 65 nt, hsa; identical to SEQ ID NO: 445405

SEQ ID NO: 446700 - RNA, 65 nt, hsa; identical to SEQ ID NO: 445406

SEQ ID NO: 446701 - RNA, 65 nt, hsa; identical to SEQ ID NO: 445407

SEQ ID NO: 446702 - RNA, 65 nt, hsa; identical to SEQ ID NO: 445408

SEQ ID NO: 446703 - RNA, 65 nt, hsa; identical to SEQ ID NO: 445409

SEQ ID NO: 446704 - RNA, 65 nt, hsa; identical to SEQ ID NO: 445410

SEQ ID NO: 446705 - RNA, 65 nt, hsa; identical to SEQ ID NO: 445411

SEQ ID NO: 446706 - RNA, 65 nt, hsa; identical to SEQ ID NO: 445412

SEQ ID NO: 446707 - RNA, 65 nt, hsa; identical to SEQ ID NO: 445413

SEQ ID NO: 446708 - RNA, 65 nt, hsa; identical to SEQ ID NO: 445414

SEQ ID NO: 446709 - RNA, 65 nt, hsa; identical to SEQ ID NO: 445415

SEQ ID NO: 446710 - RNA, 65 nt, hsa; identical to SEQ ID NO: 445416

SEQ ID NO: 446711 - RNA, 65 nt, hsa; identical to SEQ ID NO: 445417

SEQ ID NO: 446712 - RNA, 65 nt, hsa; identical to SEQ ID NO: 445418

SEQ ID NO: 446713 - RNA, 65 nt, hsa; identical to SEQ ID NO: 445419

SEQ ID NO: 446714 - RNA, 65 nt, hsa; identical to SEQ ID NO: 445420

SEQ ID NO: 446715 - RNA, 65 nt, hsa; identical to SEQ ID NO: 445421

SEQ ID NO: 446716 - RNA, 65 nt, hsa; identical to SEQ ID NO: 445422

SEQ ID NO: 446717 - RNA, 65 nt, hsa; identical to SEQ ID NO: 445423

SEQ ID NO: 446718 - RNA, 65 nt, hsa; identical to SEQ ID NO: 445424

SEQ ID NO: 446719 - RNA, 65 nt, hsa; identical to SEQ ID NO: 445425

SEQ ID NO: 446720 - RNA, 65 nt, hsa; identical to SEQ ID NO: 445426

SEQ ID NO: 446721 - RNA, 65 nt, hsa; identical to SEQ ID NO: 445427

SEQ ID NO: 446722 - RNA, 65 nt, hsa; identical to SEQ ID NO: 445428

SEQ ID NO: 446723 - RNA, 65 nt, hsa; identical to SEQ ID NO: 445429

SEQ ID NO: 446724 - RNA, 65 nt, hsa; identical to SEQ ID NO: 445430

SEQ ID NO: 446725 - RNA, 65 nt, hsa; identical to SEQ ID NO: 445431

SEQ ID NO: 446726 - RNA, 65 nt, hsa; identical to SEQ ID NO: 445432

SEQ ID NO: 446727 - RNA, 65 nt, hsa; identical to SEQ ID NO: 445433

SEQ ID NO: 446728 - RNA, 65 nt, hsa; identical to SEQ ID NO: 445434

SEQ ID NO: 446729 - RNA, 65 nt, hsa; identical to SEQ ID NO: 445435

SEQ ID NO: 446730 - RNA, 65 nt, hsa; identical to SEQ ID NO: 445436

SEQ ID NO: 446731 - RNA, 65 nt, hsa; identical to SEQ ID NO: 445437

SEQ ID NO: 446732 - RNA, 65 nt, hsa; identical to SEQ ID NO: 445438

SEQ ID NO: 446733 - RNA, 65 nt, hsa; identical to SEQ ID NO: 445439

SEQ ID NO: 446734 - RNA, 65 nt, hsa; identical to SEQ ID NO: 445440

SEQ ID NO: 446735 - RNA, 65 nt, hsa; identical to SEQ ID NO: 445441

SEQ ID NO: 446736 - RNA, 65 nt, hsa; identical to SEQ ID NO: 445442

SEQ ID NO: 446737 - RNA, 65 nt, hsa; identical to SEQ ID NO: 445443

SEQ ID NO: 446738 - RNA, 65 nt, hsa; identical to SEQ ID NO: 445444

SEQ ID NO: 446739 - RNA, 65 nt, hsa; identical to SEQ ID NO: 445445

SEQ ID NO: 446740 - RNA, 65 nt, hsa; identical to SEQ ID NO: 445446

SEQ ID NO: 446741 - RNA, 65 nt, hsa; identical to SEQ ID NO: 445447

SEQ ID NO: 446742 - RNA, 65 nt, hsa; identical to SEQ ID NO: 445448

SEQ ID NO: 446743 - RNA, 65 nt, hsa; identical to SEQ ID NO: 445449

SEQ ID NO: 446744 - RNA, 65 nt, hsa; identical to SEQ ID NO: 445450

SEQ ID NO: 446745 - RNA, 65 nt, hsa; identical to SEQ ID NO: 445451

SEQ ID NO: 446746 - RNA, 65 nt, hsa; identical to SEQ ID NO: 445452

SEQ ID NO: 446747 - RNA, 65 nt, hsa; identical to SEQ ID NO: 445453

SEQ ID NO: 446748 - RNA, 65 nt, hsa; identical to SEQ ID NO: 445454

SEQ ID NO: 446749 - RNA, 65 nt, hsa; identical to SEQ ID NO: 445455

SEQ ID NO: 446750 - RNA, 65 nt, hsa; identical to SEQ ID NO: 445456

SEQ ID NO: 446751 - RNA, 65 nt, hsa; identical to SEQ ID NO: 445457

SEQ ID NO: 446752 - RNA, 65 nt, hsa; identical to SEQ ID NO: 445458

SEQ ID NO: 446753 - RNA, 65 nt, hsa; identical to SEQ ID NO: 445459

SEQ ID NO: 446754 - RNA, 65 nt, hsa; identical to SEQ ID NO: 445460

SEQ ID NO: 446755 - RNA, 65 nt, hsa; identical to SEQ ID NO: 445461

SEQ ID NO: 446756 - RNA, 65 nt, hsa; identical to SEQ ID NO: 445462

SEQ ID NO: 446757 - RNA, 65 nt, hsa; identical to SEQ ID NO: 445463

SEQ ID NO: 446758 - RNA, 65 nt, hsa; identical to SEQ ID NO: 445464

SEQ ID NO: 446759 - RNA, 65 nt, hsa; identical to SEQ ID NO: 445465

SEQ ID NO: 446760 - RNA, 65 nt, hsa; identical to SEQ ID NO: 445466

SEQ ID NO: 446761 - RNA, 65 nt, hsa; identical to SEQ ID NO: 445467

SEQ ID NO: 446762 - RNA, 65 nt, hsa; identical to SEQ ID NO: 445468

SEQ ID NO: 446763 - RNA, 65 nt, hsa; identical to SEQ ID NO: 445469

SEQ ID NO: 446764 - RNA, 65 nt, hsa; identical to SEQ ID NO: 445470

SEQ ID NO: 446765 - RNA, 65 nt, hsa; identical to SEQ ID NO: 445471

SEQ ID NO: 446766 - RNA, 65 nt, hsa; identical to SEQ ID NO: 445472

SEQ ID NO: 446767 - RNA, 59 nt, hsa; identical to SEQ ID NO: 445473

SEQ ID NO: 446768 - RNA, 65 nt, hsa; identical to SEQ ID NO: 445474

SEQ ID NO: 446769 - RNA, 65 nt, hsa; identical to SEQ ID NO: 445475

SEQ ID NO: 446770 - RNA, 65 nt, hsa; identical to SEQ ID NO: 445476

SEQ ID NO: 446771 - RNA, 65 nt, hsa; identical to SEQ ID NO: 445477

SEQ ID NO: 446772 - RNA, 65 nt, hsa; identical to SEQ ID NO: 445478

SEQ ID NO: 446773 - RNA, 65 nt, hsa; identical to SEQ ID NO: 445479

SEQ ID NO: 446774 - RNA, 65 nt, hsa; identical to SEQ ID NO: 445480

SEQ ID NO: 446775 - RNA, 65 nt, hsa; identical to SEQ ID NO: 445481

SEQ ID NO: 446776 - RNA, 65 nt, hsa; identical to SEQ ID NO: 445482

SEQ ID NO: 446777 - RNA, 65 nt, hsa; identical to SEQ ID NO: 445483

SEQ ID NO: 446778 - RNA, 65 nt, hsa; identical to SEQ ID NO: 445484

SEQ ID NO: 446779 - RNA, 65 nt, hsa; identical to SEQ ID NO: 445485

SEQ ID NO: 446780 - RNA, 65 nt, hsa; identical to SEQ ID NO: 445486

SEQ ID NO: 446781 - RNA, 65 nt, hsa; identical to SEQ ID NO: 445487

SEQ ID NO: 446782 - RNA, 65 nt, hsa; identical to SEQ ID NO: 445488

SEQ ID NO: 446783 - RNA, 65 nt, hsa; identical to SEQ ID NO: 445489

SEQ ID NO: 446784 - RNA, 65 nt, hsa; identical to SEQ ID NO: 445490

SEQ ID NO: 446785 - RNA, 65 nt, hsa; identical to SEQ ID NO: 445491

SEQ ID NO: 446786 - RNA, 65 nt, hsa; identical to SEQ ID NO: 445492

SEQ ID NO: 446787 - RNA, 65 nt, hsa; identical to SEQ ID NO: 445493

SEQ ID NO: 446788 - RNA, 65 nt, hsa; identical to SEQ ID NO: 445494

SEQ ID NO: 446789 - RNA, 65 nt, hsa; identical to SEQ ID NO: 445495

SEQ ID NO: 446790 - RNA, 65 nt, hsa; identical to SEQ ID NO: 445496

SEQ ID NO: 446791 - RNA, 65 nt, hsa; identical to SEQ ID NO: 445497

SEQ ID NO: 446792 - RNA, 65 nt, hsa; identical to SEQ ID NO: 445498

SEQ ID NO: 446793 - RNA, 65 nt, hsa; identical to SEQ ID NO: 445499

SEQ ID NO: 446794 - RNA, 65 nt, hsa; identical to SEQ ID NO: 445500

SEQ ID NO: 446795 - RNA, 65 nt, hsa; identical to SEQ ID NO: 445501

SEQ ID NO: 446796 - RNA, 65 nt, hsa; identical to SEQ ID NO: 445502

SEQ ID NO: 446797 - RNA, 65 nt, hsa; identical to SEQ ID NO: 445503

SEQ ID NO: 446798 - RNA, 65 nt, hsa; identical to SEQ ID NO: 445504

SEQ ID NO: 446799 - RNA, 65 nt, hsa; identical to SEQ ID NO: 445505

SEQ ID NO: 446800 - RNA, 65 nt, hsa; identical to SEQ ID NO: 445506

SEQ ID NO: 446801 - RNA, 65 nt, hsa; identical to SEQ ID NO: 445507

SEQ ID NO: 446802 - RNA, 65 nt, hsa; identical to SEQ ID NO: 445508

SEQ ID NO: 446803 - RNA, 65 nt, hsa; identical to SEQ ID NO: 445509

SEQ ID NO: 446804 - RNA, 65 nt, hsa; identical to SEQ ID NO: 445510

SEQ ID NO: 446805 - RNA, 65 nt, hsa; identical to SEQ ID NO: 445511

SEQ ID NO: 446806 - RNA, 65 nt, hsa; identical to SEQ ID NO: 445512

SEQ ID NO: 446807 - RNA, 65 nt, hsa; identical to SEQ ID NO: 445513

SEQ ID NO: 446808 - RNA, 65 nt, hsa; identical to SEQ ID NO: 445514

SEQ ID NO: 446809 - RNA, 65 nt, hsa; identical to SEQ ID NO: 445515

SEQ ID NO: 446810 - RNA, 65 nt, hsa; identical to SEQ ID NO: 445516

SEQ ID NO: 446811 - RNA, 65 nt, hsa; identical to SEQ ID NO: 445517

SEQ ID NO: 446812 - RNA, 65 nt, hsa; identical to SEQ ID NO: 445518

SEQ ID NO: 446813 - RNA, 65 nt, hsa; identical to SEQ ID NO: 445519

SEQ ID NO: 446814 - RNA, 65 nt, hsa; identical to SEQ ID NO: 445520

SEQ ID NO: 446815 - RNA, 65 nt, hsa; identical to SEQ ID NO: 445521

SEQ ID NO: 446816 - RNA, 65 nt, hsa; identical to SEQ ID NO: 445522

SEQ ID NO: 446817 - RNA, 65 nt, hsa; identical to SEQ ID NO: 445523

SEQ ID NO: 446818 - RNA, 65 nt, hsa; identical to SEQ ID NO: 445524

SEQ ID NO: 446819 - RNA, 65 nt, hsa; identical to SEQ ID NO: 445525

SEQ ID NO: 446820 - RNA, 65 nt, hsa; identical to SEQ ID NO: 445526

SEQ ID NO: 446821 - RNA, 65 nt, hsa; identical to SEQ ID NO: 445527

SEQ ID NO: 446822 - RNA, 65 nt, hsa; identical to SEQ ID NO: 445528

SEQ ID NO: 446823 - RNA, 65 nt, hsa; identical to SEQ ID NO: 445529

SEQ ID NO: 446824 - RNA, 65 nt, hsa; identical to SEQ ID NO: 445530

SEQ ID NO: 446825 - RNA, 65 nt, hsa; identical to SEQ ID NO: 445531

SEQ ID NO: 446826 - RNA, 65 nt, hsa; identical to SEQ ID NO: 445532

SEQ ID NO: 446827 - RNA, 65 nt, hsa; identical to SEQ ID NO: 445533

SEQ ID NO: 446828 - RNA, 65 nt, hsa; identical to SEQ ID NO: 445534

SEQ ID NO: 446829 - RNA, 65 nt, hsa; identical to SEQ ID NO: 445535

SEQ ID NO: 446830 - RNA, 65 nt, hsa; identical to SEQ ID NO: 445536

SEQ ID NO: 446831 - RNA, 65 nt, hsa; identical to SEQ ID NO: 445537

SEQ ID NO: 446832 - RNA, 65 nt, hsa; identical to SEQ ID NO: 445538

SEQ ID NO: 446833 - RNA, 65 nt, hsa; identical to SEQ ID NO: 445539

SEQ ID NO: 446834 - RNA, 65 nt, hsa; identical to SEQ ID NO: 445540

SEQ ID NO: 446835 - RNA, 65 nt, hsa; identical to SEQ ID NO: 445541

SEQ ID NO: 446836 - RNA, 65 nt, hsa; identical to SEQ ID NO: 445542

SEQ ID NO: 446837 - RNA, 65 nt, hsa; identical to SEQ ID NO: 445543

SEQ ID NO: 446838 - RNA, 65 nt, hsa; identical to SEQ ID NO: 445544

SEQ ID NO: 446839 - RNA, 65 nt, hsa; identical to SEQ ID NO: 445545

SEQ ID NO: 446840 - RNA, 65 nt, hsa; identical to SEQ ID NO: 445546

SEQ ID NO: 446841 - RNA, 65 nt, hsa; identical to SEQ ID NO: 445547

SEQ ID NO: 446842 - RNA, 65 nt, hsa; identical to SEQ ID NO: 445548

SEQ ID NO: 446843 - RNA, 65 nt, hsa; identical to SEQ ID NO: 445549

SEQ ID NO: 446844 - RNA, 65 nt, hsa; identical to SEQ ID NO: 445550

SEQ ID NO: 446845 - RNA, 65 nt, hsa; identical to SEQ ID NO: 445551

SEQ ID NO: 446846 - RNA, 65 nt, hsa; identical to SEQ ID NO: 445552

SEQ ID NO: 446847 - RNA, 65 nt, hsa; identical to SEQ ID NO: 445553

SEQ ID NO: 446848 - RNA, 65 nt, hsa; identical to SEQ ID NO: 445554

SEQ ID NO: 446849 - RNA, 65 nt, hsa; identical to SEQ ID NO: 445555

SEQ ID NO: 446850 - RNA, 65 nt, hsa; identical to SEQ ID NO: 445556

SEQ ID NO: 446851 - RNA, 65 nt, hsa; identical to SEQ ID NO: 445557

SEQ ID NO: 446852 - RNA, 65 nt, hsa; identical to SEQ ID NO: 445558

SEQ ID NO: 446853 - RNA, 65 nt, hsa; identical to SEQ ID NO: 445559

SEQ ID NO: 446854 - RNA, 65 nt, hsa; identical to SEQ ID NO: 445560

SEQ ID NO: 446855 - RNA, 65 nt, hsa; identical to SEQ ID NO: 445561

SEQ ID NO: 446856 - RNA, 65 nt, hsa; identical to SEQ ID NO: 445562

SEQ ID NO: 446857 - RNA, 65 nt, hsa; identical to SEQ ID NO: 445563

SEQ ID NO: 446858 - RNA, 65 nt, hsa; identical to SEQ ID NO: 445564

SEQ ID NO: 446859 - RNA, 65 nt, hsa; identical to SEQ ID NO: 445565

SEQ ID NO: 446860 - RNA, 65 nt, hsa; identical to SEQ ID NO: 445566

SEQ ID NO: 446861 - RNA, 65 nt, hsa; identical to SEQ ID NO: 445567

SEQ ID NO: 446862 - RNA, 65 nt, hsa; identical to SEQ ID NO: 445568

SEQ ID NO: 446863 - RNA, 65 nt, hsa; identical to SEQ ID NO: 445569

SEQ ID NO: 446864 - RNA, 65 nt, hsa; identical to SEQ ID NO: 445570

SEQ ID NO: 446865 - RNA, 65 nt, hsa; identical to SEQ ID NO: 445571

SEQ ID NO: 446866 - RNA, 65 nt, hsa; identical to SEQ ID NO: 445572

SEQ ID NO: 446867 - RNA, 65 nt, hsa; identical to SEQ ID NO: 445573

SEQ ID NO: 446868 - RNA, 65 nt, hsa; identical to SEQ ID NO: 445574

SEQ ID NO: 446869 - RNA, 65 nt, hsa; identical to SEQ ID NO: 445575

SEQ ID NO: 446870 - RNA, 65 nt, hsa; identical to SEQ ID NO: 445576

SEQ ID NO: 446871 - RNA, 65 nt, hsa; identical to SEQ ID NO: 445577

SEQ ID NO: 446872 - RNA, 65 nt, hsa; identical to SEQ ID NO: 445578

SEQ ID NO: 446873 - RNA, 65 nt, hsa; identical to SEQ ID NO: 445579

SEQ ID NO: 446874 - RNA, 65 nt, hsa; identical to SEQ ID NO: 445580

SEQ ID NO: 446875 - RNA, 65 nt, hsa; identical to SEQ ID NO: 445581

SEQ ID NO: 446876 - RNA, 65 nt, hsa; identical to SEQ ID NO: 445582

SEQ ID NO: 446877 - RNA, 65 nt, hsa; identical to SEQ ID NO: 445583

SEQ ID NO: 446878 - RNA, 65 nt, hsa; identical to SEQ ID NO: 445584

SEQ ID NO: 446879 - RNA, 65 nt, hsa; identical to SEQ ID NO: 445585

SEQ ID NO: 446880 - RNA, 65 nt, hsa; identical to SEQ ID NO: 445586

SEQ ID NO: 446881 - RNA, 65 nt, hsa; identical to SEQ ID NO: 445587

SEQ ID NO: 446882 - RNA, 65 nt, hsa; identical to SEQ ID NO: 445588

SEQ ID NO: 446883 - RNA, 65 nt, hsa; identical to SEQ ID NO: 445589

SEQ ID NO: 446884 - RNA, 65 nt, hsa; identical to SEQ ID NO: 445590

SEQ ID NO: 446885 - RNA, 65 nt, hsa; identical to SEQ ID NO: 445591

SEQ ID NO: 446886 - RNA, 65 nt, hsa; identical to SEQ ID NO: 445592

SEQ ID NO: 446887 - RNA, 65 nt, hsa; identical to SEQ ID NO: 445593

SEQ ID NO: 446888 - RNA, 65 nt, hsa; identical to SEQ ID NO: 445594

SEQ ID NO: 446889 - RNA, 65 nt, hsa; identical to SEQ ID NO: 445595

SEQ ID NO: 446890 - RNA, 65 nt, hsa; identical to SEQ ID NO: 445596

SEQ ID NO: 446891 - RNA, 65 nt, hsa; identical to SEQ ID NO: 445597

SEQ ID NO: 446892 - RNA, 65 nt, hsa; identical to SEQ ID NO: 445598

SEQ ID NO: 446893 - RNA, 65 nt, hsa; identical to SEQ ID NO: 445599

SEQ ID NO: 446894 - RNA, 65 nt, hsa; identical to SEQ ID NO: 445600

SEQ ID NO: 446895 - RNA, 65 nt, hsa; identical to SEQ ID NO: 445601

SEQ ID NO: 446896 - RNA, 65 nt, hsa; identical to SEQ ID NO: 445602

SEQ ID NO: 446897 - RNA, 65 nt, hsa; identical to SEQ ID NO: 445603

SEQ ID NO: 446898 - RNA, 65 nt, hsa; identical to SEQ ID NO: 445604

SEQ ID NO: 446899 - RNA, 66 nt, hsa; identical to SEQ ID NO: 445605

SEQ ID NO: 446900 - RNA, 66 nt, hsa; identical to SEQ ID NO: 445606

SEQ ID NO: 446901 - RNA, 66 nt, hsa; identical to SEQ ID NO: 445607

SEQ ID NO: 446902 - RNA, 66 nt, hsa; identical to SEQ ID NO: 445608

SEQ ID NO: 446903 - RNA, 66 nt, hsa; identical to SEQ ID NO: 445609

SEQ ID NO: 446904 - RNA, 66 nt, hsa; identical to SEQ ID NO: 445610

SEQ ID NO: 446905 - RNA, 66 nt, hsa; identical to SEQ ID NO: 445611

SEQ ID NO: 446906 - RNA, 66 nt, hsa; identical to SEQ ID NO: 445612

SEQ ID NO: 446907 - RNA, 66 nt, hsa; identical to SEQ ID NO: 445613

SEQ ID NO: 446908 - RNA, 66 nt, hsa; identical to SEQ ID NO: 445614

SEQ ID NO: 446909 - RNA, 66 nt, hsa; identical to SEQ ID NO: 445615

SEQ ID NO: 446910 - RNA, 66 nt, hsa; identical to SEQ ID NO: 445616

SEQ ID NO: 446911 - RNA, 66 nt, hsa; identical to SEQ ID NO: 445617

SEQ ID NO: 446912 - RNA, 66 nt, hsa; identical to SEQ ID NO: 445618

SEQ ID NO: 446913 - RNA, 66 nt, hsa; identical to SEQ ID NO: 445619

SEQ ID NO: 446914 - RNA, 66 nt, hsa; identical to SEQ ID NO: 445620

SEQ ID NO: 446915 - RNA, 66 nt, hsa; identical to SEQ ID NO: 445621

SEQ ID NO: 446916 - RNA, 66 nt, hsa; identical to SEQ ID NO: 445622

SEQ ID NO: 446917 - RNA, 66 nt, hsa; identical to SEQ ID NO: 445623

SEQ ID NO: 446918 - RNA, 66 nt, hsa; identical to SEQ ID NO: 445624

SEQ ID NO: 446919 - RNA, 66 nt, hsa; identical to SEQ ID NO: 445625

SEQ ID NO: 446920 - RNA, 66 nt, hsa; identical to SEQ ID NO: 445626

SEQ ID NO: 446921 - RNA, 66 nt, hsa; identical to SEQ ID NO: 445627

SEQ ID NO: 446922 - RNA, 55 nt, hsa; identical to SEQ ID NO: 445050

SEQ ID NO: 446923 - RNA, 66 nt, hsa; identical to SEQ ID NO: 445629

SEQ ID NO: 446924 - RNA, 66 nt, hsa; identical to SEQ ID NO: 445630

SEQ ID NO: 446925 - RNA, 66 nt, hsa; identical to SEQ ID NO: 445631

SEQ ID NO: 446926 - RNA, 66 nt, hsa; identical to SEQ ID NO: 445632

SEQ ID NO: 446927 - RNA, 66 nt, hsa; identical to SEQ ID NO: 445633

SEQ ID NO: 446928 - RNA, 66 nt, hsa; identical to SEQ ID NO: 445634

SEQ ID NO: 446929 - RNA, 66 nt, hsa; identical to SEQ ID NO: 445635

SEQ ID NO: 446930 - RNA, 66 nt, hsa; identical to SEQ ID NO: 445636

SEQ ID NO: 446931 - RNA, 66 nt, hsa; identical to SEQ ID NO: 445637

SEQ ID NO: 446932 - RNA, 66 nt, hsa; identical to SEQ ID NO: 445638

SEQ ID NO: 446933 - RNA, 66 nt, hsa; identical to SEQ ID NO: 445639

SEQ ID NO: 446934 - RNA, 66 nt, hsa; identical to SEQ ID NO: 445640

SEQ ID NO: 446935 - RNA, 66 nt, hsa; identical to SEQ ID NO: 445641

SEQ ID NO: 446936 - RNA, 66 nt, hsa; identical to SEQ ID NO: 445642

SEQ ID NO: 446937 - RNA, 66 nt, hsa; identical to SEQ ID NO: 445643

SEQ ID NO: 446938 - RNA, 66 nt, hsa; identical to SEQ ID NO: 445644

SEQ ID NO: 446939 - RNA, 66 nt, hsa; identical to SEQ ID NO: 445645

SEQ ID NO: 446940 - RNA, 66 nt, hsa; identical to SEQ ID NO: 445646

SEQ ID NO: 446941 - RNA, 66 nt, hsa; identical to SEQ ID NO: 445647

SEQ ID NO: 446942 - RNA, 66 nt, hsa; identical to SEQ ID NO: 445648

SEQ ID NO: 446943 - RNA, 66 nt, hsa; identical to SEQ ID NO: 445649

SEQ ID NO: 446944 - RNA, 66 nt, hsa; identical to SEQ ID NO: 445650

SEQ ID NO: 446945 - RNA, 66 nt, hsa; identical to SEQ ID NO: 445651

SEQ ID NO: 446946 - RNA, 66 nt, hsa; identical to SEQ ID NO: 445652

SEQ ID NO: 446947 - RNA, 66 nt, hsa; identical to SEQ ID NO: 445653

SEQ ID NO: 446948 - RNA, 66 nt, hsa; identical to SEQ ID NO: 445654

SEQ ID NO: 446949 - RNA, 66 nt, hsa; identical to SEQ ID NO: 445655

SEQ ID NO: 446950 - RNA, 66 nt, hsa; identical to SEQ ID NO: 445656

SEQ ID NO: 446951 - RNA, 66 nt, hsa; identical to SEQ ID NO: 445657

SEQ ID NO: 446952 - RNA, 66 nt, hsa; identical to SEQ ID NO: 445658

SEQ ID NO: 446953 - RNA, 66 nt, hsa; identical to SEQ ID NO: 445659

SEQ ID NO: 446954 - RNA, 66 nt, hsa; identical to SEQ ID NO: 445660

SEQ ID NO: 446955 - RNA, 66 nt, hsa; identical to SEQ ID NO: 445661

SEQ ID NO: 446956 - RNA, 66 nt, hsa; identical to SEQ ID NO: 445662

SEQ ID NO: 446957 - RNA, 66 nt, hsa; identical to SEQ ID NO: 445663

SEQ ID NO: 446958 - RNA, 66 nt, hsa; identical to SEQ ID NO: 445664

SEQ ID NO: 446959 - RNA, 66 nt, hsa; identical to SEQ ID NO: 445665

SEQ ID NO: 446960 - RNA, 66 nt, hsa; identical to SEQ ID NO: 445666

SEQ ID NO: 446961 - RNA, 66 nt, hsa; identical to SEQ ID NO: 445667

SEQ ID NO: 446962 - RNA, 66 nt, hsa; identical to SEQ ID NO: 445668

SEQ ID NO: 446963 - RNA, 66 nt, hsa; identical to SEQ ID NO: 445669

SEQ ID NO: 446964 - RNA, 66 nt, hsa; identical to SEQ ID NO: 445670

SEQ ID NO: 446965 - RNA, 66 nt, hsa; identical to SEQ ID NO: 445671

SEQ ID NO: 446966 - RNA, 66 nt, hsa; identical to SEQ ID NO: 445672

SEQ ID NO: 446967 - RNA, 66 nt, hsa; identical to SEQ ID NO: 445673

SEQ ID NO: 446968 - RNA, 66 nt, hsa; identical to SEQ ID NO: 445674

SEQ ID NO: 446969 - RNA, 66 nt, hsa; identical to SEQ ID NO: 445675

SEQ ID NO: 446970 - RNA, 66 nt, hsa; identical to SEQ ID NO: 445676

SEQ ID NO: 446971 - RNA, 66 nt, hsa; identical to SEQ ID NO: 445677

SEQ ID NO: 446972 - RNA, 66 nt, hsa; identical to SEQ ID NO: 445678

SEQ ID NO: 446973 - RNA, 66 nt, hsa; identical to SEQ ID NO: 445679

SEQ ID NO: 446974 - RNA, 66 nt, hsa; identical to SEQ ID NO: 445680

SEQ ID NO: 446975 - RNA, 66 nt, hsa; identical to SEQ ID NO: 445681

SEQ ID NO: 446976 - RNA, 66 nt, hsa; identical to SEQ ID NO: 445682

SEQ ID NO: 446977 - RNA, 66 nt, hsa; identical to SEQ ID NO: 445683

SEQ ID NO: 446978 - RNA, 66 nt, hsa; identical to SEQ ID NO: 445684

SEQ ID NO: 446979 - RNA, 66 nt, hsa; identical to SEQ ID NO: 445685

SEQ ID NO: 446980 - RNA, 66 nt, hsa; identical to SEQ ID NO: 445686

SEQ ID NO: 446981 - RNA, 66 nt, hsa; identical to SEQ ID NO: 445687

SEQ ID NO: 446982 - RNA, 66 nt, hsa; identical to SEQ ID NO: 445688

SEQ ID NO: 446983 - RNA, 66 nt, hsa; identical to SEQ ID NO: 445689

SEQ ID NO: 446984 - RNA, 66 nt, hsa; identical to SEQ ID NO: 445690

SEQ ID NO: 446985 - RNA, 66 nt, hsa; identical to SEQ ID NO: 445691

SEQ ID NO: 446986 - RNA, 66 nt, hsa; identical to SEQ ID NO: 445692

SEQ ID NO: 446987 - RNA, 66 nt, hsa; identical to SEQ ID NO: 445693

SEQ ID NO: 446988 - RNA, 66 nt, hsa; identical to SEQ ID NO: 445694

SEQ ID NO: 446989 - RNA, 66 nt, hsa; identical to SEQ ID NO: 445695

SEQ ID NO: 446990 - RNA, 66 nt, hsa; identical to SEQ ID NO: 445696

SEQ ID NO: 446991 - RNA, 66 nt, hsa; identical to SEQ ID NO: 445697

SEQ ID NO: 446992 - RNA, 66 nt, hsa; identical to SEQ ID NO: 445698

SEQ ID NO: 446993 - RNA, 66 nt, hsa; identical to SEQ ID NO: 445699

SEQ ID NO: 446994 - RNA, 66 nt, hsa; identical to SEQ ID NO: 445700

SEQ ID NO: 446995 - RNA, 66 nt, hsa; identical to SEQ ID NO: 445701

SEQ ID NO: 446996 - RNA, 66 nt, hsa; identical to SEQ ID NO: 445702

SEQ ID NO: 446997 - RNA, 66 nt, hsa; identical to SEQ ID NO: 445703

SEQ ID NO: 446998 - RNA, 66 nt, hsa; identical to SEQ ID NO: 445704

SEQ ID NO: 446999 - RNA, 66 nt, hsa; identical to SEQ ID NO: 445705

SEQ ID NO: 447000 - RNA, 66 nt, hsa; identical to SEQ ID NO: 445706

SEQ ID NO: 447001 - RNA, 66 nt, hsa; identical to SEQ ID NO: 445707

SEQ ID NO: 447002 - RNA, 66 nt, hsa; identical to SEQ ID NO: 445708

SEQ ID NO: 447003 - RNA, 66 nt, hsa; identical to SEQ ID NO: 445709

SEQ ID NO: 447004 - RNA, 66 nt, hsa; identical to SEQ ID NO: 445710

SEQ ID NO: 447005 - RNA, 66 nt, hsa; identical to SEQ ID NO: 445711

SEQ ID NO: 447006 - RNA, 66 nt, hsa; identical to SEQ ID NO: 445712

SEQ ID NO: 447007 - RNA, 66 nt, hsa; identical to SEQ ID NO: 445713

SEQ ID NO: 447008 - RNA, 66 nt, hsa; identical to SEQ ID NO: 445714

SEQ ID NO: 447009 - RNA, 66 nt, hsa; identical to SEQ ID NO: 445715

SEQ ID NO: 447010 - RNA, 66 nt, hsa; identical to SEQ ID NO: 445716

SEQ ID NO: 447011 - RNA, 66 nt, hsa; identical to SEQ ID NO: 445717

SEQ ID NO: 447012 - RNA, 66 nt, hsa; identical to SEQ ID NO: 445718

SEQ ID NO: 447013 - RNA, 66 nt, hsa; identical to SEQ ID NO: 445719

SEQ ID NO: 447014 - RNA, 66 nt, hsa; identical to SEQ ID NO: 445720

SEQ ID NO: 447015 - RNA, 66 nt, hsa; identical to SEQ ID NO: 445721

SEQ ID NO: 447016 - RNA, 66 nt, hsa; identical to SEQ ID NO: 445722

SEQ ID NO: 447017 - RNA, 66 nt, hsa; identical to SEQ ID NO: 445723

SEQ ID NO: 447018 - RNA, 66 nt, hsa; identical to SEQ ID NO: 445724

SEQ ID NO: 447019 - RNA, 66 nt, hsa; identical to SEQ ID NO: 445725

SEQ ID NO: 447020 - RNA, 66 nt, hsa; identical to SEQ ID NO: 445726

SEQ ID NO: 447021 - RNA, 66 nt, hsa; identical to SEQ ID NO: 445727

SEQ ID NO: 447022 - RNA, 66 nt, hsa; identical to SEQ ID NO: 445728

SEQ ID NO: 447023 - RNA, 57 nt, hsa; identical to SEQ ID NO: 445151

SEQ ID NO: 447024 - RNA, 66 nt, hsa; identical to SEQ ID NO: 445730

SEQ ID NO: 447025 - RNA, 66 nt, hsa; identical to SEQ ID NO: 445731

SEQ ID NO: 447026 - RNA, 66 nt, hsa; identical to SEQ ID NO: 445732

SEQ ID NO: 447027 - RNA, 66 nt, hsa; identical to SEQ ID NO: 445733

SEQ ID NO: 447028 - RNA, 66 nt, hsa; identical to SEQ ID NO: 445734

SEQ ID NO: 447029 - RNA, 66 nt, hsa; identical to SEQ ID NO: 445735

SEQ ID NO: 447030 - RNA, 66 nt, hsa; identical to SEQ ID NO: 445736

SEQ ID NO: 447031 - RNA, 66 nt, hsa; identical to SEQ ID NO: 445737

SEQ ID NO: 447032 - RNA, 66 nt, hsa; identical to SEQ ID NO: 445738

SEQ ID NO: 447033 - RNA, 66 nt, hsa; identical to SEQ ID NO: 445739

SEQ ID NO: 447034 - RNA, 66 nt, hsa; identical to SEQ ID NO: 445740

SEQ ID NO: 447035 - RNA, 66 nt, hsa; identical to SEQ ID NO: 445741

SEQ ID NO: 447036 - RNA, 66 nt, hsa; identical to SEQ ID NO: 445742

SEQ ID NO: 447037 - RNA, 66 nt, hsa; identical to SEQ ID NO: 445743

SEQ ID NO: 447038 - RNA, 66 nt, hsa; identical to SEQ ID NO: 445744

SEQ ID NO: 447039 - RNA, 66 nt, hsa; identical to SEQ ID NO: 445745

SEQ ID NO: 447040 - RNA, 66 nt, hsa; identical to SEQ ID NO: 445746

SEQ ID NO: 447041 - RNA, 66 nt, hsa; identical to SEQ ID NO: 445747

SEQ ID NO: 447042 - RNA, 66 nt, hsa; identical to SEQ ID NO: 445748

SEQ ID NO: 447043 - RNA, 66 nt, hsa; identical to SEQ ID NO: 445749

SEQ ID NO: 447044 - RNA, 66 nt, hsa; identical to SEQ ID NO: 445750

SEQ ID NO: 447045 - RNA, 66 nt, hsa; identical to SEQ ID NO: 445751

SEQ ID NO: 447046 - RNA, 66 nt, hsa; identical to SEQ ID NO: 445752

SEQ ID NO: 447047 - RNA, 66 nt, hsa; identical to SEQ ID NO: 445753

SEQ ID NO: 447048 - RNA, 66 nt, hsa; identical to SEQ ID NO: 445754

SEQ ID NO: 447049 - RNA, 66 nt, hsa; identical to SEQ ID NO: 445755

SEQ ID NO: 447050 - RNA, 66 nt, hsa; identical to SEQ ID NO: 445756

SEQ ID NO: 447051 - RNA, 66 nt, hsa; identical to SEQ ID NO: 445757

SEQ ID NO: 447052 - RNA, 59 nt, hsa; identical to SEQ ID NO: 445180

SEQ ID NO: 447053 - RNA, 66 nt, hsa; identical to SEQ ID NO: 445759

SEQ ID NO: 447054 - RNA, 66 nt, hsa; identical to SEQ ID NO: 445760

SEQ ID NO: 447055 - RNA, 66 nt, hsa; identical to SEQ ID NO: 445761

SEQ ID NO: 447056 - RNA, 66 nt, hsa; identical to SEQ ID NO: 445762

SEQ ID NO: 447057 - RNA, 66 nt, hsa; identical to SEQ ID NO: 445763

SEQ ID NO: 447058 - RNA, 66 nt, hsa; identical to SEQ ID NO: 445764

SEQ ID NO: 447059 - RNA, 66 nt, hsa; identical to SEQ ID NO: 445765

SEQ ID NO: 447060 - RNA, 66 nt, hsa; identical to SEQ ID NO: 445766

SEQ ID NO: 447061 - RNA, 66 nt, hsa; identical to SEQ ID NO: 445767

SEQ ID NO: 447062 - RNA, 66 nt, hsa; identical to SEQ ID NO: 445768

SEQ ID NO: 447063 - RNA, 66 nt, hsa; identical to SEQ ID NO: 445769

SEQ ID NO: 447064 - RNA, 66 nt, hsa; identical to SEQ ID NO: 445770

SEQ ID NO: 447065 - RNA, 66 nt, hsa; identical to SEQ ID NO: 445771

SEQ ID NO: 447066 - RNA, 66 nt, hsa; identical to SEQ ID NO: 445772

SEQ ID NO: 447067 - RNA, 66 nt, hsa; identical to SEQ ID NO: 445773

SEQ ID NO: 447068 - RNA, 66 nt, hsa; identical to SEQ ID NO: 445774

SEQ ID NO: 447069 - RNA, 66 nt, hsa; identical to SEQ ID NO: 445775

SEQ ID NO: 447070 - RNA, 66 nt, hsa; identical to SEQ ID NO: 445776

SEQ ID NO: 447071 - RNA, 66 nt, hsa; identical to SEQ ID NO: 445777

SEQ ID NO: 447072 - RNA, 66 nt, hsa; identical to SEQ ID NO: 445778

SEQ ID NO: 447073 - RNA, 66 nt, hsa; identical to SEQ ID NO: 445779

SEQ ID NO: 447074 - RNA, 66 nt, hsa; identical to SEQ ID NO: 445780

SEQ ID NO: 447075 - RNA, 66 nt, hsa; identical to SEQ ID NO: 445781

SEQ ID NO: 447076 - RNA, 66 nt, hsa; identical to SEQ ID NO: 445782

SEQ ID NO: 447077 - RNA, 66 nt, hsa; identical to SEQ ID NO: 445783

SEQ ID NO: 447078 - RNA, 66 nt, hsa; identical to SEQ ID NO: 445784

SEQ ID NO: 447079 - RNA, 66 nt, hsa; identical to SEQ ID NO: 445785

SEQ ID NO: 447080 - RNA, 66 nt, hsa; identical to SEQ ID NO: 445786

SEQ ID NO: 447081 - RNA, 66 nt, hsa; identical to SEQ ID NO: 445787

SEQ ID NO: 447082 - RNA, 66 nt, hsa; identical to SEQ ID NO: 445788

SEQ ID NO: 447083 - RNA, 66 nt, hsa; identical to SEQ ID NO: 445789

SEQ ID NO: 447084 - RNA, 66 nt, hsa; identical to SEQ ID NO: 445790

SEQ ID NO: 447085 - RNA, 66 nt, hsa; identical to SEQ ID NO: 445791

SEQ ID NO: 447086 - RNA, 66 nt, hsa; identical to SEQ ID NO: 445792

SEQ ID NO: 447087 - RNA, 66 nt, hsa; identical to SEQ ID NO: 445793

SEQ ID NO: 447088 - RNA, 66 nt, hsa; identical to SEQ ID NO: 445794

SEQ ID NO: 447089 - RNA, 66 nt, hsa; identical to SEQ ID NO: 445795

SEQ ID NO: 447090 - RNA, 66 nt, hsa; identical to SEQ ID NO: 445796

SEQ ID NO: 447091 - RNA, 66 nt, hsa; identical to SEQ ID NO: 445797

SEQ ID NO: 447092 - RNA, 66 nt, hsa; identical to SEQ ID NO: 445798

SEQ ID NO: 447093 - RNA, 66 nt, hsa; identical to SEQ ID NO: 445799

SEQ ID NO: 447094 - RNA, 66 nt, hsa; identical to SEQ ID NO: 445800

SEQ ID NO: 447095 - RNA, 66 nt, hsa; identical to SEQ ID NO: 445801

SEQ ID NO: 447096 - RNA, 66 nt, hsa; identical to SEQ ID NO: 445802

SEQ ID NO: 447097 - RNA, 66 nt, hsa; identical to SEQ ID NO: 445803

SEQ ID NO: 447098 - RNA, 66 nt, hsa; identical to SEQ ID NO: 445804

SEQ ID NO: 447099 - RNA, 66 nt, hsa; identical to SEQ ID NO: 445805

SEQ ID NO: 447100 - RNA, 66 nt, hsa; identical to SEQ ID NO: 445806

SEQ ID NO: 447101 - RNA, 66 nt, hsa; identical to SEQ ID NO: 445807

SEQ ID NO: 447102 - RNA, 66 nt, hsa; identical to SEQ ID NO: 445808

SEQ ID NO: 447103 - RNA, 66 nt, hsa; identical to SEQ ID NO: 445809

SEQ ID NO: 447104 - RNA, 66 nt, hsa; identical to SEQ ID NO: 445810

SEQ ID NO: 447105 - RNA, 66 nt, hsa; identical to SEQ ID NO: 445811

SEQ ID NO: 447106 - RNA, 66 nt, hsa; identical to SEQ ID NO: 445812

SEQ ID NO: 447107 - RNA, 66 nt, hsa; identical to SEQ ID NO: 445813

SEQ ID NO: 447108 - RNA, 66 nt, hsa; identical to SEQ ID NO: 445814

SEQ ID NO: 447109 - RNA, 66 nt, hsa; identical to SEQ ID NO: 445815

SEQ ID NO: 447110 - RNA, 66 nt, hsa; identical to SEQ ID NO: 445816

SEQ ID NO: 447111 - RNA, 66 nt, hsa; identical to SEQ ID NO: 445817

SEQ ID NO: 447112 - RNA, 66 nt, hsa; identical to SEQ ID NO: 445818

SEQ ID NO: 447113 - RNA, 66 nt, hsa; identical to SEQ ID NO: 445819

SEQ ID NO: 447114 - RNA, 66 nt, hsa; identical to SEQ ID NO: 445820

SEQ ID NO: 447115 - RNA, 66 nt, hsa; identical to SEQ ID NO: 445821

SEQ ID NO: 447116 - RNA, 66 nt, hsa; identical to SEQ ID NO: 445822

SEQ ID NO: 447117 - RNA, 66 nt, hsa; identical to SEQ ID NO: 445823

SEQ ID NO: 447118 - RNA, 66 nt, hsa; identical to SEQ ID NO: 445824

SEQ ID NO: 447119 - RNA, 66 nt, hsa; identical to SEQ ID NO: 445825

SEQ ID NO: 447120 - RNA, 66 nt, hsa; identical to SEQ ID NO: 445826

SEQ ID NO: 447121 - RNA, 66 nt, hsa; identical to SEQ ID NO: 445827

SEQ ID NO: 447122 - RNA, 66 nt, hsa; identical to SEQ ID NO: 445828

SEQ ID NO: 447123 - RNA, 66 nt, hsa; identical to SEQ ID NO: 445829

SEQ ID NO: 447124 - RNA, 66 nt, hsa; identical to SEQ ID NO: 445830

SEQ ID NO: 447125 - RNA, 66 nt, hsa; identical to SEQ ID NO: 445831

SEQ ID NO: 447126 - RNA, 66 nt, hsa; identical to SEQ ID NO: 445832

SEQ ID NO: 447127 - RNA, 66 nt, hsa; identical to SEQ ID NO: 445833

SEQ ID NO: 447128 - RNA, 66 nt, hsa; identical to SEQ ID NO: 445834

SEQ ID NO: 447129 - RNA, 66 nt, hsa; identical to SEQ ID NO: 445835

SEQ ID NO: 447130 - RNA, 66 nt, hsa; identical to SEQ ID NO: 445836

SEQ ID NO: 447131 - RNA, 66 nt, hsa; identical to SEQ ID NO: 445837

SEQ ID NO: 447132 - RNA, 66 nt, hsa; identical to SEQ ID NO: 445838

SEQ ID NO: 447133 - RNA, 66 nt, hsa; identical to SEQ ID NO: 445839

SEQ ID NO: 447134 - RNA, 66 nt, hsa; identical to SEQ ID NO: 445840

SEQ ID NO: 447135 - RNA, 66 nt, hsa; identical to SEQ ID NO: 445841

SEQ ID NO: 447136 - RNA, 66 nt, hsa; identical to SEQ ID NO: 445842

SEQ ID NO: 447137 - RNA, 66 nt, hsa; identical to SEQ ID NO: 445843

SEQ ID NO: 447138 - RNA, 66 nt, hsa; identical to SEQ ID NO: 445844

SEQ ID NO: 447139 - RNA, 66 nt, hsa; identical to SEQ ID NO: 445845

SEQ ID NO: 447140 - RNA, 66 nt, hsa; identical to SEQ ID NO: 445846

SEQ ID NO: 447141 - RNA, 66 nt, hsa; identical to SEQ ID NO: 445847

SEQ ID NO: 447142 - RNA, 66 nt, hsa; identical to SEQ ID NO: 445848

SEQ ID NO: 447143 - RNA, 66 nt, hsa; identical to SEQ ID NO: 445849

SEQ ID NO: 447144 - RNA, 66 nt, hsa; identical to SEQ ID NO: 445850

SEQ ID NO: 447145 - RNA, 66 nt, hsa; identical to SEQ ID NO: 445851

SEQ ID NO: 447146 - RNA, 66 nt, hsa; identical to SEQ ID NO: 445852

SEQ ID NO: 447147 - RNA, 66 nt, hsa; identical to SEQ ID NO: 445853

SEQ ID NO: 447148 - RNA, 66 nt, hsa; identical to SEQ ID NO: 445854

SEQ ID NO: 447149 - RNA, 66 nt, hsa; identical to SEQ ID NO: 445855

SEQ ID NO: 447150 - RNA, 66 nt, hsa; identical to SEQ ID NO: 445856

SEQ ID NO: 447151 - RNA, 66 nt, hsa; identical to SEQ ID NO: 445857

SEQ ID NO: 447152 - RNA, 66 nt, hsa; identical to SEQ ID NO: 445858

SEQ ID NO: 447153 - RNA, 66 nt, hsa; identical to SEQ ID NO: 445859

SEQ ID NO: 447154 - RNA, 66 nt, hsa; identical to SEQ ID NO: 445860

SEQ ID NO: 447155 - RNA, 66 nt, hsa; identical to SEQ ID NO: 445861

SEQ ID NO: 447156 - RNA, 66 nt, hsa; identical to SEQ ID NO: 445862

SEQ ID NO: 447157 - RNA, 66 nt, hsa; identical to SEQ ID NO: 445863

SEQ ID NO: 447158 - RNA, 66 nt, hsa; identical to SEQ ID NO: 445864

SEQ ID NO: 447159 - RNA, 66 nt, hsa; identical to SEQ ID NO: 445865

SEQ ID NO: 447160 - RNA, 66 nt, hsa; identical to SEQ ID NO: 445866

SEQ ID NO: 447161 - RNA, 66 nt, hsa; identical to SEQ ID NO: 445867

SEQ ID NO: 447162 - RNA, 66 nt, hsa; identical to SEQ ID NO: 445868

SEQ ID NO: 447163 - RNA, 66 nt, hsa; identical to SEQ ID NO: 445869

SEQ ID NO: 447164 - RNA, 66 nt, hsa; identical to SEQ ID NO: 445870

SEQ ID NO: 447165 - RNA, 66 nt, hsa; identical to SEQ ID NO: 445871

SEQ ID NO: 447166 - RNA, 66 nt, hsa; identical to SEQ ID NO: 445872

SEQ ID NO: 447167 - RNA, 66 nt, hsa; identical to SEQ ID NO: 445873

SEQ ID NO: 447168 - RNA, 66 nt, hsa; identical to SEQ ID NO: 445874

SEQ ID NO: 447169 - RNA, 66 nt, hsa; identical to SEQ ID NO: 445875

SEQ ID NO: 447170 - RNA, 66 nt, hsa; identical to SEQ ID NO: 445876

SEQ ID NO: 447171 - RNA, 66 nt, hsa; identical to SEQ ID NO: 445877

SEQ ID NO: 447172 - RNA, 66 nt, hsa; identical to SEQ ID NO: 445878

SEQ ID NO: 447173 - RNA, 66 nt, hsa; identical to SEQ ID NO: 445879

SEQ ID NO: 447174 - RNA, 66 nt, hsa; identical to SEQ ID NO: 445880

SEQ ID NO: 447175 - RNA, 66 nt, hsa; identical to SEQ ID NO: 445881

SEQ ID NO: 447176 - RNA, 66 nt, hsa; identical to SEQ ID NO: 445882

SEQ ID NO: 447177 - RNA, 66 nt, hsa; identical to SEQ ID NO: 445883

SEQ ID NO: 447178 - RNA, 66 nt, hsa; identical to SEQ ID NO: 445884

SEQ ID NO: 447179 - RNA, 66 nt, hsa; identical to SEQ ID NO: 445885

SEQ ID NO: 447180 - RNA, 66 nt, hsa; identical to SEQ ID NO: 445886

SEQ ID NO: 447181 - RNA, 66 nt, hsa; identical to SEQ ID NO: 445887

SEQ ID NO: 447182 - RNA, 66 nt, hsa; identical to SEQ ID NO: 445888

SEQ ID NO: 447183 - RNA, 66 nt, hsa; identical to SEQ ID NO: 445889

SEQ ID NO: 447184 - RNA, 66 nt, hsa; identical to SEQ ID NO: 445890

SEQ ID NO: 447185 - RNA, 66 nt, hsa; identical to SEQ ID NO: 445891

SEQ ID NO: 447186 - RNA, 66 nt, hsa; identical to SEQ ID NO: 445892

SEQ ID NO: 447187 - RNA, 60 nt, hsa; identical to SEQ ID NO: 445315

SEQ ID NO: 447188 - RNA, 66 nt, hsa; identical to SEQ ID NO: 445894

SEQ ID NO: 447189 - RNA, 66 nt, hsa; identical to SEQ ID NO: 445895

SEQ ID NO: 447190 - RNA, 66 nt, hsa; identical to SEQ ID NO: 445896

SEQ ID NO: 447191 - RNA, 66 nt, hsa; identical to SEQ ID NO: 445897

SEQ ID NO: 447192 - RNA, 66 nt, hsa; identical to SEQ ID NO: 445898

SEQ ID NO: 447193 - RNA, 66 nt, hsa; identical to SEQ ID NO: 445899

SEQ ID NO: 447194 - RNA, 66 nt, hsa; identical to SEQ ID NO: 445900

SEQ ID NO: 447195 - RNA, 66 nt, hsa; identical to SEQ ID NO: 445901

SEQ ID NO: 447196 - RNA, 66 nt, hsa; identical to SEQ ID NO: 445902

SEQ ID NO: 447197 - RNA, 66 nt, hsa; identical to SEQ ID NO: 445903

SEQ ID NO: 447198 - RNA, 66 nt, hsa; identical to SEQ ID NO: 445904

SEQ ID NO: 447199 - RNA, 66 nt, hsa; identical to SEQ ID NO: 445905

SEQ ID NO: 447200 - RNA, 66 nt, hsa; identical to SEQ ID NO: 445906

SEQ ID NO: 447201 - RNA, 66 nt, hsa; identical to SEQ ID NO: 445907

SEQ ID NO: 447202 - RNA, 66 nt, hsa; identical to SEQ ID NO: 445908

SEQ ID NO: 447203 - RNA, 66 nt, hsa; identical to SEQ ID NO: 445909

SEQ ID NO: 447204 - RNA, 66 nt, hsa; identical to SEQ ID NO: 445910

SEQ ID NO: 447205 - RNA, 66 nt, hsa; identical to SEQ ID NO: 445911

SEQ ID NO: 447206 - RNA, 66 nt, hsa; identical to SEQ ID NO: 445912

SEQ ID NO: 447207 - RNA, 66 nt, hsa; identical to SEQ ID NO: 445913

SEQ ID NO: 447208 - RNA, 66 nt, hsa; identical to SEQ ID NO: 445914

SEQ ID NO: 447209 - RNA, 66 nt, hsa; identical to SEQ ID NO: 445915

SEQ ID NO: 447210 - RNA, 66 nt, hsa; identical to SEQ ID NO: 445916

SEQ ID NO: 447211 - RNA, 66 nt, hsa; identical to SEQ ID NO: 445917

SEQ ID NO: 447212 - RNA, 66 nt, hsa; identical to SEQ ID NO: 445918

SEQ ID NO: 447213 - RNA, 66 nt, hsa; identical to SEQ ID NO: 445919

SEQ ID NO: 447214 - RNA, 66 nt, hsa; identical to SEQ ID NO: 445920

SEQ ID NO: 447215 - RNA, 66 nt, hsa; identical to SEQ ID NO: 445921

SEQ ID NO: 447216 - RNA, 66 nt, hsa; identical to SEQ ID NO: 445922

SEQ ID NO: 447217 - RNA, 66 nt, hsa; identical to SEQ ID NO: 445923

SEQ ID NO: 447218 - RNA, 66 nt, hsa; identical to SEQ ID NO: 445924

SEQ ID NO: 447219 - RNA, 66 nt, hsa; identical to SEQ ID NO: 445925

SEQ ID NO: 447220 - RNA, 66 nt, hsa; identical to SEQ ID NO: 445926

SEQ ID NO: 447221 - RNA, 66 nt, hsa; identical to SEQ ID NO: 445927

SEQ ID NO: 447222 - RNA, 66 nt, hsa; identical to SEQ ID NO: 445928

SEQ ID NO: 447223 - RNA, 66 nt, hsa; identical to SEQ ID NO: 445929

SEQ ID NO: 447224 - RNA, 66 nt, hsa; identical to SEQ ID NO: 445930

SEQ ID NO: 447225 - RNA, 66 nt, hsa; identical to SEQ ID NO: 445931

SEQ ID NO: 447226 - RNA, 66 nt, hsa; identical to SEQ ID NO: 445932

SEQ ID NO: 447227 - RNA, 66 nt, hsa; identical to SEQ ID NO: 445933

SEQ ID NO: 447228 - RNA, 66 nt, hsa; identical to SEQ ID NO: 445934

SEQ ID NO: 447229 - RNA, 66 nt, hsa; identical to SEQ ID NO: 445935

SEQ ID NO: 447230 - RNA, 66 nt, hsa; identical to SEQ ID NO: 445936

SEQ ID NO: 447231 - RNA, 66 nt, hsa; identical to SEQ ID NO: 445937

SEQ ID NO: 447232 - RNA, 66 nt, hsa; identical to SEQ ID NO: 445938

SEQ ID NO: 447233 - RNA, 66 nt, hsa; identical to SEQ ID NO: 445939

SEQ ID NO: 447234 - RNA, 66 nt, hsa; identical to SEQ ID NO: 445940

SEQ ID NO: 447235 - RNA, 55 nt, hsa; identical to SEQ ID NO: 445363

SEQ ID NO: 447236 - RNA, 66 nt, hsa; identical to SEQ ID NO: 445942

SEQ ID NO: 447237 - RNA, 66 nt, hsa; identical to SEQ ID NO: 445943

SEQ ID NO: 447238 - RNA, 66 nt, hsa; identical to SEQ ID NO: 445944

SEQ ID NO: 447239 - RNA, 66 nt, hsa; identical to SEQ ID NO: 445945

SEQ ID NO: 447240 - RNA, 66 nt, hsa; identical to SEQ ID NO: 445946

SEQ ID NO: 447241 - RNA, 66 nt, hsa; identical to SEQ ID NO: 445947

SEQ ID NO: 447242 - RNA, 66 nt, hsa; identical to SEQ ID NO: 445948

SEQ ID NO: 447243 - RNA, 66 nt, hsa; identical to SEQ ID NO: 445949

SEQ ID NO: 447244 - RNA, 66 nt, hsa; identical to SEQ ID NO: 445950

SEQ ID NO: 447245 - RNA, 66 nt, hsa; identical to SEQ ID NO: 445951

SEQ ID NO: 447246 - RNA, 66 nt, hsa; identical to SEQ ID NO: 445952

SEQ ID NO: 447247 - RNA, 66 nt, hsa; identical to SEQ ID NO: 445953

SEQ ID NO: 447248 - RNA, 66 nt, hsa; identical to SEQ ID NO: 445954

SEQ ID NO: 447249 - RNA, 66 nt, hsa; identical to SEQ ID NO: 445955

SEQ ID NO: 447250 - RNA, 66 nt, hsa; identical to SEQ ID NO: 445956

SEQ ID NO: 447251 - RNA, 66 nt, hsa; identical to SEQ ID NO: 445957

SEQ ID NO: 447252 - RNA, 66 nt, hsa; identical to SEQ ID NO: 445958

SEQ ID NO: 447253 - RNA, 66 nt, hsa; identical to SEQ ID NO: 445959

SEQ ID NO: 447254 - RNA, 66 nt, hsa; identical to SEQ ID NO: 445960

SEQ ID NO: 447255 - RNA, 66 nt, hsa; identical to SEQ ID NO: 445961

SEQ ID NO: 447256 - RNA, 66 nt, hsa; identical to SEQ ID NO: 445962

SEQ ID NO: 447257 - RNA, 66 nt, hsa; identical to SEQ ID NO: 445963

SEQ ID NO: 447258 - RNA, 66 nt, hsa; identical to SEQ ID NO: 445964

SEQ ID NO: 447259 - RNA, 66 nt, hsa; identical to SEQ ID NO: 445965

SEQ ID NO: 447260 - RNA, 66 nt, hsa; identical to SEQ ID NO: 445966

SEQ ID NO: 447261 - RNA, 66 nt, hsa; identical to SEQ ID NO: 445967

SEQ ID NO: 447262 - RNA, 66 nt, hsa; identical to SEQ ID NO: 445968

SEQ ID NO: 447263 - RNA, 66 nt, hsa; identical to SEQ ID NO: 445969

SEQ ID NO: 447264 - RNA, 66 nt, hsa; identical to SEQ ID NO: 445970

SEQ ID NO: 447265 - RNA, 66 nt, hsa; identical to SEQ ID NO: 445971

SEQ ID NO: 447266 - RNA, 66 nt, hsa; identical to SEQ ID NO: 445972

SEQ ID NO: 447267 - RNA, 66 nt, hsa; identical to SEQ ID NO: 445973

SEQ ID NO: 447268 - RNA, 66 nt, hsa; identical to SEQ ID NO: 445974

SEQ ID NO: 447269 - RNA, 66 nt, hsa; identical to SEQ ID NO: 445975

SEQ ID NO: 447270 - RNA, 66 nt, hsa; identical to SEQ ID NO: 445976

SEQ ID NO: 447271 - RNA, 66 nt, hsa; identical to SEQ ID NO: 445977

SEQ ID NO: 447272 - RNA, 66 nt, hsa; identical to SEQ ID NO: 445978

SEQ ID NO: 447273 - RNA, 66 nt, hsa; identical to SEQ ID NO: 445979

SEQ ID NO: 447274 - RNA, 66 nt, hsa; identical to SEQ ID NO: 445980

SEQ ID NO: 447275 - RNA, 66 nt, hsa; identical to SEQ ID NO: 445981

SEQ ID NO: 447276 - RNA, 66 nt, hsa; identical to SEQ ID NO: 445982

SEQ ID NO: 447277 - RNA, 66 nt, hsa; identical to SEQ ID NO: 445983

SEQ ID NO: 447278 - RNA, 66 nt, hsa; identical to SEQ ID NO: 445984

SEQ ID NO: 447279 - RNA, 66 nt, hsa; identical to SEQ ID NO: 445985

SEQ ID NO: 447280 - RNA, 66 nt, hsa; identical to SEQ ID NO: 445986

SEQ ID NO: 447281 - RNA, 66 nt, hsa; identical to SEQ ID NO: 445987

SEQ ID NO: 447282 - RNA, 66 nt, hsa; identical to SEQ ID NO: 445988

SEQ ID NO: 447283 - RNA, 66 nt, hsa; identical to SEQ ID NO: 445989

SEQ ID NO: 447284 - RNA, 66 nt, hsa; identical to SEQ ID NO: 445990

SEQ ID NO: 447285 - RNA, 66 nt, hsa; identical to SEQ ID NO: 445991

SEQ ID NO: 447286 - RNA, 66 nt, hsa; identical to SEQ ID NO: 445992

SEQ ID NO: 447287 - RNA, 66 nt, hsa; identical to SEQ ID NO: 445993

SEQ ID NO: 447288 - RNA, 66 nt, hsa; identical to SEQ ID NO: 445994

SEQ ID NO: 447289 - RNA, 66 nt, hsa; identical to SEQ ID NO: 445995

SEQ ID NO: 447290 - RNA, 66 nt, hsa; identical to SEQ ID NO: 445996

SEQ ID NO: 447291 - RNA, 66 nt, hsa; identical to SEQ ID NO: 445997

SEQ ID NO: 447292 - RNA, 66 nt, hsa; identical to SEQ ID NO: 445998

SEQ ID NO: 447293 - RNA, 66 nt, hsa; identical to SEQ ID NO: 445999

SEQ ID NO: 447294 - RNA, 66 nt, hsa; identical to SEQ ID NO: 446000

SEQ ID NO: 447295 - RNA, 66 nt, hsa; identical to SEQ ID NO: 446001

SEQ ID NO: 447296 - RNA, 66 nt, hsa; identical to SEQ ID NO: 446002

SEQ ID NO: 447297 - RNA, 66 nt, hsa; identical to SEQ ID NO: 446003

SEQ ID NO: 447298 - RNA, 66 nt, hsa; identical to SEQ ID NO: 446004

SEQ ID NO: 447299 - RNA, 66 nt, hsa; identical to SEQ ID NO: 446005

SEQ ID NO: 447300 - RNA, 66 nt, hsa; identical to SEQ ID NO: 446006

SEQ ID NO: 447301 - RNA, 66 nt, hsa; identical to SEQ ID NO: 446007

SEQ ID NO: 447302 - RNA, 66 nt, hsa; identical to SEQ ID NO: 446008

SEQ ID NO: 447303 - RNA, 66 nt, hsa; identical to SEQ ID NO: 446009

SEQ ID NO: 447304 - RNA, 66 nt, hsa; identical to SEQ ID NO: 446010

SEQ ID NO: 447305 - RNA, 66 nt, hsa; identical to SEQ ID NO: 446011

SEQ ID NO: 447306 - RNA, 66 nt, hsa; identical to SEQ ID NO: 446012

SEQ ID NO: 447307 - RNA, 66 nt, hsa; identical to SEQ ID NO: 446013

SEQ ID NO: 447308 - RNA, 66 nt, hsa; identical to SEQ ID NO: 446014

SEQ ID NO: 447309 - RNA, 66 nt, hsa; identical to SEQ ID NO: 446015

SEQ ID NO: 447310 - RNA, 66 nt, hsa; identical to SEQ ID NO: 446016

SEQ ID NO: 447311 - RNA, 66 nt, hsa; identical to SEQ ID NO: 446017

SEQ ID NO: 447312 - RNA, 66 nt, hsa; identical to SEQ ID NO: 446018

SEQ ID NO: 447313 - RNA, 66 nt, hsa; identical to SEQ ID NO: 446019

SEQ ID NO: 447314 - RNA, 66 nt, hsa; identical to SEQ ID NO: 446020

SEQ ID NO: 447315 - RNA, 66 nt, hsa; identical to SEQ ID NO: 446021

SEQ ID NO: 447316 - RNA, 66 nt, hsa; identical to SEQ ID NO: 446022

SEQ ID NO: 447317 - RNA, 66 nt, hsa; identical to SEQ ID NO: 446023

SEQ ID NO: 447318 - RNA, 66 nt, hsa; identical to SEQ ID NO: 446024

SEQ ID NO: 447319 - RNA, 66 nt, hsa; identical to SEQ ID NO: 446025

SEQ ID NO: 447320 - RNA, 66 nt, hsa; identical to SEQ ID NO: 446026

SEQ ID NO: 447321 - RNA, 66 nt, hsa; identical to SEQ ID NO: 446027

SEQ ID NO: 447322 - RNA, 66 nt, hsa; identical to SEQ ID NO: 446028

SEQ ID NO: 447323 - RNA, 66 nt, hsa; identical to SEQ ID NO: 446029

SEQ ID NO: 447324 - RNA, 66 nt, hsa; identical to SEQ ID NO: 446030

SEQ ID NO: 447325 - RNA, 66 nt, hsa; identical to SEQ ID NO: 446031

SEQ ID NO: 447326 - RNA, 66 nt, hsa; identical to SEQ ID NO: 446032

SEQ ID NO: 447327 - RNA, 66 nt, hsa; identical to SEQ ID NO: 446033

SEQ ID NO: 447328 - RNA, 66 nt, hsa; identical to SEQ ID NO: 446034

SEQ ID NO: 447329 - RNA, 66 nt, hsa; identical to SEQ ID NO: 446035

SEQ ID NO: 447330 - RNA, 66 nt, hsa; identical to SEQ ID NO: 446036

SEQ ID NO: 447331 - RNA, 66 nt, hsa; identical to SEQ ID NO: 446037

SEQ ID NO: 447332 - RNA, 66 nt, hsa; identical to SEQ ID NO: 446038

SEQ ID NO: 447333 - RNA, 66 nt, hsa; identical to SEQ ID NO: 446039

SEQ ID NO: 447334 - RNA, 66 nt, hsa; identical to SEQ ID NO: 446040

SEQ ID NO: 447335 - RNA, 66 nt, hsa; identical to SEQ ID NO: 446041

SEQ ID NO: 447336 - RNA, 66 nt, hsa; identical to SEQ ID NO: 446042

SEQ ID NO: 447337 - RNA, 66 nt, hsa; identical to SEQ ID NO: 446043

SEQ ID NO: 447338 - RNA, 66 nt, hsa; identical to SEQ ID NO: 446044

SEQ ID NO: 447339 - RNA, 66 nt, hsa; identical to SEQ ID NO: 446045

SEQ ID NO: 447340 - RNA, 66 nt, hsa; identical to SEQ ID NO: 446046

SEQ ID NO: 447341 - RNA, 66 nt, hsa; identical to SEQ ID NO: 446047

SEQ ID NO: 447342 - RNA, 66 nt, hsa; identical to SEQ ID NO: 446048

SEQ ID NO: 447343 - RNA, 66 nt, hsa; identical to SEQ ID NO: 446049

SEQ ID NO: 447344 - RNA, 66 nt, hsa; identical to SEQ ID NO: 446050

SEQ ID NO: 447345 - RNA, 59 nt, hsa; identical to SEQ ID NO: 445473

SEQ ID NO: 447346 - RNA, 66 nt, hsa; identical to SEQ ID NO: 446052

SEQ ID NO: 447347 - RNA, 66 nt, hsa; identical to SEQ ID NO: 446053

SEQ ID NO: 447348 - RNA, 66 nt, hsa; identical to SEQ ID NO: 446054

SEQ ID NO: 447349 - RNA, 66 nt, hsa; identical to SEQ ID NO: 446055

SEQ ID NO: 447350 - RNA, 66 nt, hsa; identical to SEQ ID NO: 446056

SEQ ID NO: 447351 - RNA, 66 nt, hsa; identical to SEQ ID NO: 446057

SEQ ID NO: 447352 - RNA, 66 nt, hsa; identical to SEQ ID NO: 446058

SEQ ID NO: 447353 - RNA, 66 nt, hsa; identical to SEQ ID NO: 446059

SEQ ID NO: 447354 - RNA, 66 nt, hsa; identical to SEQ ID NO: 446060

SEQ ID NO: 447355 - RNA, 66 nt, hsa; identical to SEQ ID NO: 446061

SEQ ID NO: 447356 - RNA, 66 nt, hsa; identical to SEQ ID NO: 446062

SEQ ID NO: 447357 - RNA, 66 nt, hsa; identical to SEQ ID NO: 446063

SEQ ID NO: 447358 - RNA, 66 nt, hsa; identical to SEQ ID NO: 446064

SEQ ID NO: 447359 - RNA, 66 nt, hsa; identical to SEQ ID NO: 446065

SEQ ID NO: 447360 - RNA, 66 nt, hsa; identical to SEQ ID NO: 446066

SEQ ID NO: 447361 - RNA, 66 nt, hsa; identical to SEQ ID NO: 446067

SEQ ID NO: 447362 - RNA, 66 nt, hsa; identical to SEQ ID NO: 446068

SEQ ID NO: 447363 - RNA, 66 nt, hsa; identical to SEQ ID NO: 446069

SEQ ID NO: 447364 - RNA, 66 nt, hsa; identical to SEQ ID NO: 446070

SEQ ID NO: 447365 - RNA, 66 nt, hsa; identical to SEQ ID NO: 446071

SEQ ID NO: 447366 - RNA, 66 nt, hsa; identical to SEQ ID NO: 446072

SEQ ID NO: 447367 - RNA, 66 nt, hsa; identical to SEQ ID NO: 446073

SEQ ID NO: 447368 - RNA, 66 nt, hsa; identical to SEQ ID NO: 446074

SEQ ID NO: 447369 - RNA, 66 nt, hsa; identical to SEQ ID NO: 446075

SEQ ID NO: 447370 - RNA, 66 nt, hsa; identical to SEQ ID NO: 446076

SEQ ID NO: 447371 - RNA, 66 nt, hsa; identical to SEQ ID NO: 446077

SEQ ID NO: 447372 - RNA, 66 nt, hsa; identical to SEQ ID NO: 446078

SEQ ID NO: 447373 - RNA, 66 nt, hsa; identical to SEQ ID NO: 446079

SEQ ID NO: 447374 - RNA, 66 nt, hsa; identical to SEQ ID NO: 446080

SEQ ID NO: 447375 - RNA, 66 nt, hsa; identical to SEQ ID NO: 446081

SEQ ID NO: 447376 - RNA, 66 nt, hsa; identical to SEQ ID NO: 446082

SEQ ID NO: 447377 - RNA, 66 nt, hsa; identical to SEQ ID NO: 446083

SEQ ID NO: 447378 - RNA, 66 nt, hsa; identical to SEQ ID NO: 446084

SEQ ID NO: 447379 - RNA, 66 nt, hsa; identical to SEQ ID NO: 446085

SEQ ID NO: 447380 - RNA, 66 nt, hsa; identical to SEQ ID NO: 446086

SEQ ID NO: 447381 - RNA, 66 nt, hsa; identical to SEQ ID NO: 446087

SEQ ID NO: 447382 - RNA, 66 nt, hsa; identical to SEQ ID NO: 446088

SEQ ID NO: 447383 - RNA, 66 nt, hsa; identical to SEQ ID NO: 446089

SEQ ID NO: 447384 - RNA, 66 nt, hsa; identical to SEQ ID NO: 446090

SEQ ID NO: 447385 - RNA, 66 nt, hsa; identical to SEQ ID NO: 446091

SEQ ID NO: 447386 - RNA, 66 nt, hsa; identical to SEQ ID NO: 446092

SEQ ID NO: 447387 - RNA, 66 nt, hsa; identical to SEQ ID NO: 446093

SEQ ID NO: 447388 - RNA, 66 nt, hsa; identical to SEQ ID NO: 446094

SEQ ID NO: 447389 - RNA, 66 nt, hsa; identical to SEQ ID NO: 446095

SEQ ID NO: 447390 - RNA, 66 nt, hsa; identical to SEQ ID NO: 446096

SEQ ID NO: 447391 - RNA, 66 nt, hsa; identical to SEQ ID NO: 446097

SEQ ID NO: 447392 - RNA, 66 nt, hsa; identical to SEQ ID NO: 446098

SEQ ID NO: 447393 - RNA, 66 nt, hsa; identical to SEQ ID NO: 446099

SEQ ID NO: 447394 - RNA, 66 nt, hsa; identical to SEQ ID NO: 446100

SEQ ID NO: 447395 - RNA, 66 nt, hsa; identical to SEQ ID NO: 446101

SEQ ID NO: 447396 - RNA, 66 nt, hsa; identical to SEQ ID NO: 446102

SEQ ID NO: 447397 - RNA, 66 nt, hsa; identical to SEQ ID NO: 446103

SEQ ID NO: 447398 - RNA, 66 nt, hsa; identical to SEQ ID NO: 446104

SEQ ID NO: 447399 - RNA, 66 nt, hsa; identical to SEQ ID NO: 446105

SEQ ID NO: 447400 - RNA, 66 nt, hsa; identical to SEQ ID NO: 446106

SEQ ID NO: 447401 - RNA, 66 nt, hsa; identical to SEQ ID NO: 446107

SEQ ID NO: 447402 - RNA, 66 nt, hsa; identical to SEQ ID NO: 446108

SEQ ID NO: 447403 - RNA, 66 nt, hsa; identical to SEQ ID NO: 446109

SEQ ID NO: 447404 - RNA, 66 nt, hsa; identical to SEQ ID NO: 446110

SEQ ID NO: 447405 - RNA, 66 nt, hsa; identical to SEQ ID NO: 446111

SEQ ID NO: 447406 - RNA, 66 nt, hsa; identical to SEQ ID NO: 446112

SEQ ID NO: 447407 - RNA, 66 nt, hsa; identical to SEQ ID NO: 446113

SEQ ID NO: 447408 - RNA, 66 nt, hsa; identical to SEQ ID NO: 446114

SEQ ID NO: 447409 - RNA, 66 nt, hsa; identical to SEQ ID NO: 446115

SEQ ID NO: 447410 - RNA, 66 nt, hsa; identical to SEQ ID NO: 446116

SEQ ID NO: 447411 - RNA, 66 nt, hsa; identical to SEQ ID NO: 446117

SEQ ID NO: 447412 - RNA, 66 nt, hsa; identical to SEQ ID NO: 446118

SEQ ID NO: 447413 - RNA, 66 nt, hsa; identical to SEQ ID NO: 446119

SEQ ID NO: 447414 - RNA, 66 nt, hsa; identical to SEQ ID NO: 446120

SEQ ID NO: 447415 - RNA, 66 nt, hsa; identical to SEQ ID NO: 446121

SEQ ID NO: 447416 - RNA, 66 nt, hsa; identical to SEQ ID NO: 446122

SEQ ID NO: 447417 - RNA, 66 nt, hsa; identical to SEQ ID NO: 446123

SEQ ID NO: 447418 - RNA, 66 nt, hsa; identical to SEQ ID NO: 446124

SEQ ID NO: 447419 - RNA, 66 nt, hsa; identical to SEQ ID NO: 446125

SEQ ID NO: 447420 - RNA, 66 nt, hsa; identical to SEQ ID NO: 446126

SEQ ID NO: 447421 - RNA, 66 nt, hsa; identical to SEQ ID NO: 446127

SEQ ID NO: 447422 - RNA, 66 nt, hsa; identical to SEQ ID NO: 446128

SEQ ID NO: 447423 - RNA, 66 nt, hsa; identical to SEQ ID NO: 446129

SEQ ID NO: 447424 - RNA, 66 nt, hsa; identical to SEQ ID NO: 446130

SEQ ID NO: 447425 - RNA, 66 nt, hsa; identical to SEQ ID NO: 446131

SEQ ID NO: 447426 - RNA, 66 nt, hsa; identical to SEQ ID NO: 446132

SEQ ID NO: 447427 - RNA, 66 nt, hsa; identical to SEQ ID NO: 446133

SEQ ID NO: 447428 - RNA, 66 nt, hsa; identical to SEQ ID NO: 446134

SEQ ID NO: 447429 - RNA, 66 nt, hsa; identical to SEQ ID NO: 446135

SEQ ID NO: 447430 - RNA, 66 nt, hsa; identical to SEQ ID NO: 446136

SEQ ID NO: 447431 - RNA, 66 nt, hsa; identical to SEQ ID NO: 446137

SEQ ID NO: 447432 - RNA, 66 nt, hsa; identical to SEQ ID NO: 446138

SEQ ID NO: 447433 - RNA, 66 nt, hsa; identical to SEQ ID NO: 446139

SEQ ID NO: 447434 - RNA, 66 nt, hsa; identical to SEQ ID NO: 446140

SEQ ID NO: 447435 - RNA, 65 nt, hsa; identical to SEQ ID NO: 445563

SEQ ID NO: 447436 - RNA, 66 nt, hsa; identical to SEQ ID NO: 446142

SEQ ID NO: 447437 - RNA, 66 nt, hsa; identical to SEQ ID NO: 446143

SEQ ID NO: 447438 - RNA, 66 nt, hsa; identical to SEQ ID NO: 446144

SEQ ID NO: 447439 - RNA, 66 nt, hsa; identical to SEQ ID NO: 446145

SEQ ID NO: 447440 - RNA, 66 nt, hsa; identical to SEQ ID NO: 446146

SEQ ID NO: 447441 - RNA, 66 nt, hsa; identical to SEQ ID NO: 446147

SEQ ID NO: 447442 - RNA, 66 nt, hsa; identical to SEQ ID NO: 446148

SEQ ID NO: 447443 - RNA, 66 nt, hsa; identical to SEQ ID NO: 446149

SEQ ID NO: 447444 - RNA, 66 nt, hsa; identical to SEQ ID NO: 446150

SEQ ID NO: 447445 - RNA, 66 nt, hsa; identical to SEQ ID NO: 446151

SEQ ID NO: 447446 - RNA, 66 nt, hsa; identical to SEQ ID NO: 446152

SEQ ID NO: 447447 - RNA, 66 nt, hsa; identical to SEQ ID NO: 446153

SEQ ID NO: 447448 - RNA, 66 nt, hsa; identical to SEQ ID NO: 446154

SEQ ID NO: 447449 - RNA, 66 nt, hsa; identical to SEQ ID NO: 446155

SEQ ID NO: 447450 - RNA, 66 nt, hsa; identical to SEQ ID NO: 446156

SEQ ID NO: 447451 - RNA, 66 nt, hsa; identical to SEQ ID NO: 446157

SEQ ID NO: 447452 - RNA, 66 nt, hsa; identical to SEQ ID NO: 446158

SEQ ID NO: 447453 - RNA, 66 nt, hsa; identical to SEQ ID NO: 446159

SEQ ID NO: 447454 - RNA, 66 nt, hsa; identical to SEQ ID NO: 446160

SEQ ID NO: 447455 - RNA, 66 nt, hsa; identical to SEQ ID NO: 446161

SEQ ID NO: 447456 - RNA, 66 nt, hsa; identical to SEQ ID NO: 446162

SEQ ID NO: 447457 - RNA, 66 nt, hsa; identical to SEQ ID NO: 446163

SEQ ID NO: 447458 - RNA, 66 nt, hsa; identical to SEQ ID NO: 446164

SEQ ID NO: 447459 - RNA, 66 nt, hsa; identical to SEQ ID NO: 446165

SEQ ID NO: 447460 - RNA, 66 nt, hsa; identical to SEQ ID NO: 446166

SEQ ID NO: 447461 - RNA, 66 nt, hsa; identical to SEQ ID NO: 446167

SEQ ID NO: 447462 - RNA, 66 nt, hsa; identical to SEQ ID NO: 446168

SEQ ID NO: 447463 - RNA, 66 nt, hsa; identical to SEQ ID NO: 446169

SEQ ID NO: 447464 - RNA, 66 nt, hsa; identical to SEQ ID NO: 446170

SEQ ID NO: 447465 - RNA, 66 nt, hsa; identical to SEQ ID NO: 446171

SEQ ID NO: 447466 - RNA, 66 nt, hsa; identical to SEQ ID NO: 446172

SEQ ID NO: 447467 - RNA, 66 nt, hsa; identical to SEQ ID NO: 446173

SEQ ID NO: 447468 - RNA, 66 nt, hsa; identical to SEQ ID NO: 446174

SEQ ID NO: 447469 - RNA, 66 nt, hsa; identical to SEQ ID NO: 446175

SEQ ID NO: 447470 - RNA, 66 nt, hsa; identical to SEQ ID NO: 446176

SEQ ID NO: 447471 - RNA, 66 nt, hsa; identical to SEQ ID NO: 446177

SEQ ID NO: 447472 - RNA, 66 nt, hsa; identical to SEQ ID NO: 446178

SEQ ID NO: 447473 - RNA, 66 nt, hsa; identical to SEQ ID NO: 446179

SEQ ID NO: 447474 - RNA, 66 nt, hsa; identical to SEQ ID NO: 446180

SEQ ID NO: 447475 - RNA, 66 nt, hsa; identical to SEQ ID NO: 446181

SEQ ID NO: 447476 - RNA, 66 nt, hsa; identical to SEQ ID NO: 446182

SEQ ID NO: 447477 - RNA, 64 nt, hsa
gacauccagccccuaguaauacuuaaggcacuauggcacuuagcuuugaagugacacgacccug

SEQ ID NO: 447478 - RNA, 64 nt, hsa
gagauuuacuuucuuagaaauuaauaggggaaauggcacuuaauagagguuuaauggaaugaag

SEQ ID NO: 447479 - RNA, 64 nt, hsa
ucuagggaccacccccgaugcauuggugagggugggcacuuauaaaugccugcuauuguuaagc

SEQ ID NO: 447480 - RNA, 64 nt, hsa
uaagaaauggguccuuuuuccuccuaauguuuuuggcacuuaaaacauaaaauucauuauccua

SEQ ID NO: 447481 - RNA, 64 nt, hsa
uuuaguugagaagauacaaaauguuuacaguguuggcacuuagaguuuuuaaauucaaguacau

SEQ ID NO: 447482 - RNA, 64 nt, hsa
uuucucugacucgccccagaggucguggcucaaaggcacuuaggacgccuuaaauuuguaaaua

SEQ ID NO: 447483 - RNA, 64 nt, hsa
uuuaauguuuguuacuguauuucuuuugaguugaggcacuuacauaacaaucuucuuugcuuuu

SEQ ID NO: 447484 - RNA, 64 nt, hsa
gccggggauuaaaaagacuacccaaaagauuuuuggcacuuacaauuuuuaaaauaguuuaugu

SEQ ID NO: 447485 - RNA, 64 nt, hsa
aucugaucaauuugaagucccuguuugggaaugaggcacuuaucagcaugaagaauuuuuucuc

SEQ ID NO: 447486 - RNA, 64 nt, hsa
aggauuguugcugccagaacugauaugcaugaauggcacuuaaaauaaauauauuauguuaacu

SEQ ID NO: 447487 - RNA, 64 nt, hsa
uaaaugguaacgcuacggccccaggucacugcgaggcacuuaccauguagauacgggcucaaaa

SEQ ID NO: 447488 - RNA, 64 nt, hsa
ccugaagcccuaguagcuggcgcccauccuagugggcacuuaagcuuaauuggggaaacugcuu

SEQ ID NO: 447489 - RNA, 64 nt, hsa; identical to SEQ ID NO: 179148

SEQ ID NO: 447490 - RNA, 64 nt, hsa; identical to SEQ ID NO: 179149

SEQ ID NO: 447491 - RNA, 64 nt, hsa
acaaccuccacuggggcaacuuugugaacacguaggcacuuagucauaggaaacauauuaugug

SEQ ID NO: 447492 - RNA, 64 nt, hsa
uauauuuaaaaauuguuucuugacaagcugacuuggcacuuaagugcacuuuuuuaugaagaaa

SEQ ID NO: 447493 - RNA, 64 nt, hsa
aauacuucagaaaauuucugcagagcccugcccuggcacuuaaaauagcuuccaauaaguaacu

SEQ ID NO: 447494 - RNA, 64 nt, hsa
uccaaacuauucucuuguagaaaauuuuccagugggcacuuaauggugcccuugaagaacuucc

SEQ ID NO: 447495 - RNA, 64 nt, hsa
ggcuaccucugcacuuugucaaugcuucucuuguggcacuuaucacacuguauuuuacuuguuu

SEQ ID NO: 447496 - RNA, 64 nt, hsa
agaaaacuggcaacugggaagaaguggccucaaaggcacuuaauuugauuuuuauuuuuuaaau

SEQ ID NO: 447497 - RNA, 64 nt, hsa
uuuauuauugcuuaugugcccuguucaaaacagaggcacuuaauuugaucuuuuauuuuucuuu

SEQ ID NO: 447498 - RNA, 64 nt, hsa
ccuguucuuaagacgugauuuugcuguagaagauggcacuuauaaccaaagcccaaagugguau

SEQ ID NO: 447499 - RNA, 64 nt, hsa
uagucuuacugaugucaguuauugcuuuuucgguggcacuuacuuuuuuugccccucuaagggu

SEQ ID NO: 447500 - RNA, 64 nt, hsa
gaguuuauaugcaaugccuucauuagguaccaccggcacuuacaaaaugugcggacugaauccc

SEQ ID NO: 447501 - RNA, 64 nt, hsa
ggcuucccaaugcuuucacucuuaucuacccuuuggcacuuaucuugcuuaucaacauaauaau

SEQ ID NO: 447502 - RNA, 64 nt, hsa
cauggagucccuagugugacuggaauccugaaagggcacuuaauuuguaaacuucugaagacug

SEQ ID NO: 447503 - RNA, 64 nt, hsa
ucugucugggucauucauuuaaacuagaagcagaggcacuuaaaacauguaccaggaaccauuu

SEQ ID NO: 447504 - RNA, 64 nt, hsa
gcaaacuguuugcuccuccucuugaaaaugauuaggcacuuaaggacaguaaagcuguauuuuc

SEQ ID NO: 447505 - RNA, 64 nt, hsa
aaugccucugauucugcaguuuuagaaacuugguggcacuuauuaauccucuuggccccuuucc

SEQ ID NO: 447506 - RNA, 64 nt, hsa
ucuuuaggaauuuuuaacuuucuuucacuacauuggcacuuaaauuuuuucuuuauaaagcuuu

SEQ ID NO: 447507 - RNA, 64 nt, hsa
uucugcagacacgccuuccccucagccacacccaggcacuuaagcacaagcagagugcacagcu

SEQ ID NO: 447508 - RNA, 64 nt, hsa
cagggcuugaaacaauauuaggauuacuacccagggcacuuacuggugcauguuguaacauauc

SEQ ID NO: 447509 - RNA, 64 nt, hsa
ggcccgagugucugccccucggcccucaggguggggcacuuagcacccagaagggaccaaaagc

SEQ ID NO: 447510 - RNA, 64 nt, hsa
ggagcuugccaggaacccaguggccagggagcguggcacuuaccuuugucccuugcuucauucu

SEQ ID NO: 447511 - RNA, 64 nt, hsa
gcugugccaggacugugacucauucccaguaaaaggcacuuaucgaagcugauaaccguccuuc

SEQ ID NO: 447512 - RNA, 64 nt, hsa
gauucaaaucguuuauuucacacgcuguucuaauggcacuuaucauuagaaucuuaccuugugc

SEQ ID NO: 447513 - RNA, 64 nt, hsa
uagccauucauguaugucagaagugcagaauuggggcacuuaauggucaccuuguaacaguuuu

SEQ ID NO: 447514 - RNA, 64 nt, hsa
agaagacuguugccacuuaaccauuccaugcguuggcacuuaucuauuccugaaauuucuuuua

SEQ ID NO: 447515 - RNA, 64 nt, hsa
gguuuccauguggacauacagugccuauguagcaggcacuuagaguaaauggacuugccuuaau

SEQ ID NO: 447516 - RNA, 64 nt, hsa
ugaugacuacagcagaagugauguuauacguacaggcacuuacacucucucacauauucacacg

SEQ ID NO: 447517 - RNA, 64 nt, hsa
cugugugaaaauggguuggugcuucuaaccugauggcacuuagcuaucagaagaccacaaaaau

SEQ ID NO: 447518 - RNA, 64 nt, hsa
ccuugucaccacucuggggcucuguggaagaaagggcacuuaaaacucccaguaaaucuuggaa

SEQ ID NO: 447519 - RNA, 64 nt, hsa
ugcuucuggaacuuugaaacacaaaacacaaguuggcacuuacaauuuuaaagaugcagccagc

SEQ ID NO: 447520 - RNA, 64 nt, hsa
uuuauauuuuuuuaaaguagcuaacauagcaguaggcacuuaagcauuuagucaaugauauugg

SEQ ID NO: 447521 - RNA, 64 nt, hsa
caccccaggagggugaguggccugagguaguuacggcacuuaaaacucccuugcuaccgaucug

SEQ ID NO: 447522 - RNA, 64 nt, hsa
caguggagcucagaggacggggagauagaacuguggcacuuaggggagaugacauuugcuuugg

SEQ ID NO: 447523 - RNA, 64 nt, hsa
uacugagcagacuuuauaaaugagauaucuacaaggcacuuaaaguguuacagauguuuuaccu

SEQ ID NO: 447524 - RNA, 64 nt, hsa
uaguauuucuuccagaagaagcuaaaauaagacuggcacuuacccugaagugcauuaauaaaac

SEQ ID NO: 447525 - RNA, 64 nt, hsa
ggcuaccuucuauccucuguucccaaauggugguggcacuuauccugaagucgucaaugauuuc

SEQ ID NO: 447526 - RNA, 64 nt, hsa
aguuuugggauauauacaaggauugccuugaucuggcacuuacugauacaagcauuuggagaag

SEQ ID NO: 447527 - RNA, 64 nt, hsa
uggccagggaaacaguuggcuauucaucaucuucggcacuuaugacaacauuaacacagaaugc

SEQ ID NO: 447528 - RNA, 64 nt, hsa
ccugucucugaauuguucccucccccgcaaugugggcacuuaccauguuccuggcacacuggac

SEQ ID NO: 447529 - RNA, 64 nt, hsa
ugcaacagaaggguagguuagaugcuauuaagaaggcacuuaauaguacaucauguaagauggc

SEQ ID NO: 447530 - RNA, 64 nt, hsa
ggcuaccuucuauccucuguucccaaauggugguggcacuuauccugaagucaucaaugauuuc

SEQ ID NO: 447531 - RNA, 64 nt, hsa
acaagugacugaacacuuccuggggagcuacaggggcacuuaacccaccacagcacagccucau

SEQ ID NO: 447532 - RNA, 64 nt, hsa
uggacuuugagugagaagaugugauuuggaccauggcacuuaaaaacucuauaaccucaggcaa

SEQ ID NO: 447533 - RNA, 64 nt, hsa
aaacuauucaucugucauauacuauugauccuuuggcacuuaaauaaaugugaaauccuccagg

SEQ ID NO: 447534 - RNA, 64 nt, hsa
uagugacggagggagaaauccucccucugugggaggcacuuacugcauuccaguucucccuccu

SEQ ID NO: 447535 - RNA, 64 nt, hsa
gaagcuuccgggguggccuccaccuccuggcuggggcacuuaugcucccagagccuuuggugcc

SEQ ID NO: 447536 - RNA, 64 nt, hsa
ccaaccuuucauuuccuacuucauuccagcaggaggcacuuaggggagacucggauggggacau

SEQ ID NO: 447537 - RNA, 64 nt, hsa
cuuaauaaaguuauuuugguaacuaauguuuuauggcacuuaagaauaauuagcagcguuaaau

SEQ ID NO: 447538 - RNA, 64 nt, hsa; identical to SEQ ID NO: 179150

SEQ ID NO: 447539 - RNA, 64 nt, hsa; identical to SEQ ID NO: 179151

SEQ ID NO: 447540 - RNA, 64 nt, hsa
uaugcguauuauaccaaaauguugcugaaaaaugggcacuuaaagcuuucagaauaugucagug

SEQ ID NO: 447541 - RNA, 64 nt, hsa
uuuagugggaacaccaaaguuugccuauaguuuaggcacuuaauaggaagaagcucuguacaga

SEQ ID NO: 447542 - RNA, 64 nt, hsa
gcugcaaagccauugguugggcuacuucuucauaggcacuuacuuacccagggaugccacccuu

SEQ ID NO: 447543 - RNA, 64 nt, hsa
uggauaagguuucagaguucaaaugcuugacguuggcacuuaacaugaaagccuauaggucauu

SEQ ID NO: 447544 - RNA, 64 nt, hsa
ccgugucacuccugggccaugggggcaccuccugggcacuuagguguuucagcauagauuccag

SEQ ID NO: 447545 - RNA, 64 nt, hsa
gcccaagagaucugugccauagaacaagauaccaggcacuuaaagccuuuuccugaauuggaaa

SEQ ID NO: 447546 - RNA, 64 nt, hsa
ugcaguaaauuacuguauuguaaauucucaguguggcacuuaccuguaaaugcaaugaaacuuu

SEQ ID NO: 447547 - RNA, 64 nt, hsa
aaaaaaaugguaauuauuucacgcaucaaccuuuggcacuuacaaaguuuuuuuuguuuauuuu

SEQ ID NO: 447548 - RNA, 64 nt, hsa
aauauuccucaguucauccauucuauuguuaauaggcacuuaaguggcuuccaauuuuuggcca

SEQ ID NO: 447549 - RNA, 64 nt, hsa
uggaugcuaaaauuacaugaauaggaaucuuccuggcacuuaguguuucuauguuauugaaaaa

SEQ ID NO: 447550 - RNA, 64 nt, hsa
uguuuguaguaauuaauuaccuuguacaggaccuggcacuuaguagcauucuucaaauguuccc

SEQ ID NO: 447551 - RNA, 64 nt, hsa
ggcugcaugauauuccccugggagcaaagugacaggcacuuagaugcagcauuucaccacucau

SEQ ID NO: 447552 - RNA, 64 nt, hsa
ggacagcuccuggaccaggucucauaaugcauguggcacuuagguccaaggucuccagagggug

SEQ ID NO: 447553 - RNA, 64 nt, hsa
cagaauagauuucuucacuuacaaaugcauauugggcacuuauaauacagcaggaacucuucuc

SEQ ID NO: 447554 - RNA, 64 nt, hsa
cguaggcaagaaguugaaaaacaguugauuugggggcacuuagguaccauaugccccauuccca

SEQ ID NO: 447555 - RNA, 64 nt, hsa
ugugaagacugaaguguucuucaguaauugugcuggcacuuaggagagagaggagggggaauaa

SEQ ID NO: 447556 - RNA, 64 nt, hsa
guggauuuaucuaaauggaggcagaccugaagauggcacuuaugccuggggcaaaacuauuuca

SEQ ID NO: 447557 - RNA, 64 nt, hsa
aacuucuuuugcccccuucuuguccccuuugaggggcacuuaagauggagaaaucaguuguggu

SEQ ID NO: 447558 - RNA, 64 nt, hsa
cucuuuuccucaagggguuuggggcaggagccugggcacuuacuccccguuuuugcuguuucuc

SEQ ID NO: 447559 - RNA, 64 nt, hsa
ccacagugccuauugauacuuggggagggugcuuggcacuuauugaauauaugaucggccauca

SEQ ID NO: 447560 - RNA, 64 nt, hsa
gagcagcauuuuauuuaccccuccccuaucccuaggcacuuaaccaagacaaaaagccacaaug

SEQ ID NO: 447561 - RNA, 64 nt, hsa
caggcaaagggagagaggaagggugacggcuucuggcacuuagaaaacaaaaagaacaaaaaaa

SEQ ID NO: 447562 - RNA, 64 nt, hsa
gugcgaguggcuugaaucucccaugauguuggagggcacuuagugggguugaaguaugacauaa

SEQ ID NO: 447563 - RNA, 64 nt, hsa
ggggaagcugcggcuacacauuccacaaagugcuggcacuuacacccacaacccggaaggcugu

SEQ ID NO: 447564 - RNA, 64 nt, hsa
uaaaacugaaagaggauucuaguucuucauaaacggcacuuaauuccagcugggagcagaacua

SEQ ID NO: 447565 - RNA, 64 nt, hsa
agccauguauuacagcuacuacaugcuaccggacggcacuuacugccuggcgccgcccccuccc

SEQ ID NO: 447566 - RNA, 64 nt, hsa
acuggcuuggguuggagggagaccauggggauggggcacuuaacaauggagagaccugaauguc

SEQ ID NO: 447567 - RNA, 64 nt, hsa
gaaucggaaucucuggggguugggacccagcaagggcacuuaacaaacccucguuucugauuaa

SEQ ID NO: 447568 - RNA, 64 nt, hsa
aauucacaagugcauuaauauaaacagaacugguggcacuuaaaaugauaaugauuaacuuaua

SEQ ID NO: 447569 - RNA, 64 nt, hsa
guugcacuuggaagagauccucgcgucuucaugaggcacuuaaagcuuauaaaagaacugcggc

SEQ ID NO: 447570 - RNA, 64 nt, hsa
ugaauggugcuuucaaucuccuagcaccgagccuggcacuuaggcagcuuucaguaagugggug

SEQ ID NO: 447571 - RNA, 64 nt, hsa
cccgcaauagaagggcaccacuuggaugaccacaggcacuuaguuuuuggcuaguuuuugucug

SEQ ID NO: 447572 - RNA, 64 nt, hsa
uccucugauccccguguaagacugcccuggugucggcacuuaggaauguguaaaugguaaaguc

SEQ ID NO: 447573 - RNA, 64 nt, hsa
aagacauagcgccugccagggaauaggaaaugagggcacuuacacauuaaugugaauuaguaau

SEQ ID NO: 447574 - RNA, 64 nt, hsa
uuuuguuuuucguuuguugugauauagaacaaagggcacuuagcaaauuugaauuuguauaaua

SEQ ID NO: 447575 - RNA, 64 nt, hsa
ucugccaggcaugguagcucaugccuguaacccuggcacuuaaggggccaaggcaggaggauca

SEQ ID NO: 447576 - RNA, 64 nt, hsa
cugacuggcguuagcugauuaacccauguaaauaggcacuuaaauagaagcaggaaagggagac

SEQ ID NO: 447577 - RNA, 64 nt, hsa
uguaaccuggcucuagggcacaggccccuccccuggcacuuagugggucuaauaaaguauguug

SEQ ID NO: 447578 - RNA, 64 nt, hsa
aaaaaauguaaaaagucugagagaaacuacuuagggcacuuaggaauuggcaggacuuucugug

SEQ ID NO: 447579 - RNA, 64 nt, hsa
gcugaacuggacagacaguguuccugagaggcugggcacuuagcuggaaaccgcccaccucccu

SEQ ID NO: 447580 - RNA, 64 nt, hsa
ccauugaaaucagcaugacaaaaauaacacuguuggcacuuauagguaacgugauugauucagu

SEQ ID NO: 447581 - RNA, 64 nt, hsa
guauguguggguguguguuacauacacagaaucaggcacuuaccugcaaacuccuuguaggucu

SEQ ID NO: 447582 - RNA, 64 nt, hsa
ugccugugcacgucuucccuucucucccugcugcggcacuuauggagaggaucuaaagcagccg

SEQ ID NO: 447583 - RNA, 64 nt, hsa
auaucacuguauuuggagauggggucuuuagaaaggcacuuaaauuaaaaugagcucacugaua

SEQ ID NO: 447584 - RNA, 64 nt, hsa
caauggggcugauaccuucacagcccacagcaugggcacuuaugaggacaaagugaauuuaacc

SEQ ID NO: 447585 - RNA, 64 nt, hsa
cagcgggucuccaguccccugacccagcucuaaaggcacuuaggacccagggaacauuucucac

SEQ ID NO: 447586 - RNA, 64 nt, hsa
gagaacugaaagaggggaaaggaguacauuugagggcacuuaauacaaaguuaaugucagaaug

SEQ ID NO: 447587 - RNA, 64 nt, hsa
cuacaaagauguaaaaaaauuagccacaugugcuggcacuuaccuguagucccagcuacuuggg

SEQ ID NO: 447588 - RNA, 64 nt, hsa
ccaaugaacuuuagagaguucuugcauuggaacuggcacuuauuuucugaccaucgcugcuguu

SEQ ID NO: 447589 - RNA, 64 nt, hsa
uuaagcaacugaaguuaaaauuguugaaggaaaaggcacuuaaauugguuacuuucauguccag

SEQ ID NO: 447590 - RNA, 64 nt, hsa
cugagucacaggugugggauggagaguggggagaggcacuuaaucuguaacccccaaggaggaa

SEQ ID NO: 447591 - RNA, 64 nt, hsa
cuuugguguuacacagcccaagaggacugagacuggcacuuagcccaagaggucugagcccugg

SEQ ID NO: 447592 - RNA, 64 nt, hsa
cuucccuggcuuuuucaacuggaccaaagaugaaggcacuuauggacccuuugauggcuuggag

SEQ ID NO: 447593 - RNA, 64 nt, hsa
cacaucgggaaaaugaaaaacuggauacaaacgaggcacuuaauacauguauauaauguauuuc

SEQ ID NO: 447594 - RNA, 64 nt, hsa
guuuuuguuuuuuuucaucuuaauauguaccaguggcacuuaaccaaaagauacagugauauag

SEQ ID NO: 447595 - RNA, 64 nt, hsa
gaaugcuucucacuuuuuuuuuuuguuugaugcaggcacuuauuguaaauuuuagaaaccccuc

SEQ ID NO: 447596 - RNA, 64 nt, hsa
cauagcaaagcucacuguauugggcuaauaauuuggcacuuauuagcuucucucauaaacugau

SEQ ID NO: 447597 - RNA, 64 nt, hsa
accuuccucuuccagcaacugaaccucgccauaaggcacuuaucccugguuccuagcaccgcuu

SEQ ID NO: 447598 - RNA, 64 nt, hsa
aauuccaaacauauaagaggcucccucuuaacacggcacuuagauacgugcuauuccaccuuuc

SEQ ID NO: 447599 - RNA, 64 nt, hsa
aauuccaaacauacaagaggcucccucuuaacacggcacuuagacacgugcuguuccaccuucc

SEQ ID NO: 447600 - RNA, 64 nt, hsa
aauuccaaacauacaagaggcucucucuuaacacggcacuuagacacgugcuguuccaccuucc

SEQ ID NO: 447601 - RNA, 64 nt, hsa
aauuccaaacauacaagaggcucccucuugacguggcacuuacccacgugcuguuccaccuucc

SEQ ID NO: 447602 - RNA, 64 nt, hsa
aauuccaaacauacaagaggcucccucuuaacacggcacuuacacacuugcuguuccaccuucc

SEQ ID NO: 447603 - RNA, 64 nt, hsa; identical to SEQ ID NO: 179152

SEQ ID NO: 447604 - RNA, 64 nt, hsa; identical to SEQ ID NO: 179153

SEQ ID NO: 447605 - RNA, 64 nt, hsa
cccagcccugccuguggcccguugaaauguugguggcacuuaauaaauauuaguaaauccuuca

SEQ ID NO: 447606 - RNA, 64 nt, hsa
cgccccucuucccccgacaucugggggcgcugguggcacuuacucuagguuggucucagacuau

SEQ ID NO: 447607 - RNA, 64 nt, hsa
uucgccaucugauccccaugccuagcagagugcuggcacuuaguagguccucaauaaauauuua

SEQ ID NO: 447608 - RNA, 64 nt, hsa
ugcauuuucugcugaaagaucauuauguuuaacaggcacuuaaucucaguaaagucaguugcca

SEQ ID NO: 447609 - RNA, 64 nt, hsa
uugucauucaagccugugaauaaaaacccuguauggcacuuauuaugaggcuauuaaaagaauc

SEQ ID NO: 447610 - RNA, 64 nt, hsa
gaggggguucugccccuugugaaggcccauuccuggcacuuagagacagaaagaacucagcaau

SEQ ID NO: 447611 - RNA, 64 nt, hsa
ggcauaaaagauaagaauuggcucuccuguacagggcacuuacuacgaauggagcuugcagggc

SEQ ID NO: 447612 - RNA, 64 nt, hsa
gagguuuuccugucuggcuucugagguuggagggggcacuuagcagugaaccuuaagucugggu

SEQ ID NO: 447613 - RNA, 64 nt, hsa
guggcagggagugagguuggugagagaacaugugggcacuuaacucuucauguuccaguucauc

SEQ ID NO: 447614 - RNA, 64 nt, hsa
uguguugugagcccucccgguucucaccucgccuggcacuuaaccacacccugguuuuguguag

SEQ ID NO: 447615 - RNA, 64 nt, hsa
ggccacggcugagccuucagaguacguccugccuggcacuuacugguccuuaccagagacgccc

SEQ ID NO: 447616 - RNA, 64 nt, hsa
aagaaaacugucaaucagcuuauaacgacaauguggcacuuaauaaauacuugucagaacuuua

SEQ ID NO: 447617 - RNA, 64 nt, hsa
uaaauuuuuuuuugaaacagcuuuuggaaaaguuggcacuuacccaguugucucuucaaccucu

SEQ ID NO: 447618 - RNA, 64 nt, hsa
aauuuauuuuuuugaaacagcugcagcaagaguuggcacuuauucagauguaucuucaaccucu

SEQ ID NO: 447619 - RNA, 65 nt, hsa
acugugccuggguguauucuuuauacuguagauaauggagaaauuuucuaucucugucccuauuu

SEQ ID NO: 447620 - RNA, 65 nt, hsa
gcagacaccggggcuggguuucucuuuccucuuuuuggagaaaaggaacagggcaguggaaugaa

SEQ ID NO: 447621 - RNA, 65 nt, hsa
ccccuggcagcaguauuggaggggcuacaggcagcuggagaaaggggcccagccgcugacccacu

SEQ ID NO: 447622 - RNA, 65 nt, hsa
uuuugcuaucaggaaguuuugaggagcaggcagaguggagaaagugggaauagggugcauugggg

SEQ ID NO: 447623 - RNA, 65 nt, hsa
gucacuaauagaaugucuccaaagcuggauugauguggagaaaacaccuuucccuucuaguuuug

SEQ ID NO: 447624 - RNA, 65 nt, hsa
cugaggucaggaguuuaagaccagccugaccaacauggagaaaccucgucucuacuaaaaauaca

SEQ ID NO: 447625 - RNA, 65 nt, hsa
cuggaggggagagaaggauucuagggguguggaguuggagaaagaggcuuccuugagccacccuu

SEQ ID NO: 447626 - RNA, 65 nt, hsa
cagcaacucacaaaacguagcacaaacauucauuauggagaaagcaucaggacuguugaguaacu

SEQ ID NO: 447627 - RNA, 65 nt, hsa
acauuaggaaacaauggcagucaaacccauggcuuuggagaaaguaaauguuugccagaaaggaa

SEQ ID NO: 447628 - RNA, 65 nt, hsa
gaagagaauccaacucaaccugcacacuugacaaguggagaaacagaagcccagagagagcacug

SEQ ID NO: 447629 - RNA, 65 nt, hsa
cuccauccuguccccaaggacucacauacagugccuggagaaagccaaagaccuuuauuucuucc

SEQ ID NO: 447630 - RNA, 65 nt, hsa
acaaacaagggagaagagugucagaaucagaaucauggagaaaaugggcggggguggugugggug

SEQ ID NO: 447631 - RNA, 65 nt, hsa
gcaaccaaccauugcacuggccaaaucauuauuuauggagaaauccucuuugugucucuacucua

SEQ ID NO: 447632 - RNA, 65 nt, hsa
aucagagcaaacaucauguagauagcacaaguauuuggagaaacguuguuuguuuuguuaccaaa

SEQ ID NO: 447633 - RNA, 65 nt, hsa
gaauuuagaucuuauauugguuugcacaaguucccuggagaaaaaaauugcucuguguauaucuc

SEQ ID NO: 447634 - RNA, 65 nt, hsa
cuguguuuucagaauuuccauuucuacuaaccucuuggagaaaaagaaauugaauuagagguaaa

SEQ ID NO: 447635 - RNA, 65 nt, hsa
uucccugaggcuuuggggucagaguauauguuguuuggagaaagagggcaaucaggacucuucug

SEQ ID NO: 447636 - RNA, 65 nt, hsa
cugaccagaccucgaacaucacagagcaacccuuauggagaaacuugcaaccaggaccuguccca

SEQ ID NO: 447637 - RNA, 65 nt, hsa
ccgacagugccauccccaccuucaccucggagggauggagaaagaaguggagacaguccuuuccc

SEQ ID NO: 447638 - RNA, 65 nt, hsa
ccaugcugggccagccagauaagucaggguccugguggagaaagaaaggcuaggaccauguccuc

SEQ ID NO: 447639 - RNA, 65 nt, hsa
aaaccuguaaauaugaaagaacaaagguuauuuccuggagaaaagacaauuuauucaacaccaac

SEQ ID NO: 447640 - RNA, 65 nt, hsa
acucaucauaugggcacaacucugguguccuucuauggagaaaaccucaaguaaaguuuuauucu

SEQ ID NO: 447641 - RNA, 65 nt, hsa
agcugggcagcgucugcucuguguucuguguggaauggagaaaaaaacgccugcccugcugccuu

SEQ ID NO: 447642 - RNA, 65 nt, hsa
agaaguauaaaaacaacuguauugaguugaggcuguggagaaauaaggacacauauaugggaaug

SEQ ID NO: 447643 - RNA, 65 nt, hsa
cugcuccccccuccgaugcaugcucuucucucacauggagaaaaccaagacagaauugggaagcc

SEQ ID NO: 447644 - RNA, 65 nt, hsa
acaacucucagucauucauuucacagauuuuuuuguggagaaauuucuguuuauauggaugaaau

SEQ ID NO: 447645 - RNA, 65 nt, hsa
ucgcuauuaaauaaagaaaauuggaugcaagacaauggagaaacuuuaaaacuaaacaggaccac

SEQ ID NO: 447646 - RNA, 65 nt, hsa
ugucguagacuugugcaauauauacuguuguggguuggagaaaaguggaaagcuacacugggaag

SEQ ID NO: 447647 - RNA, 65 nt, hsa
ugguaggcaaauuguuaggcagaauaaugguauguuggagaaauacaccugucucuuauucuuau

SEQ ID NO: 447648 - RNA, 65 nt, hsa
gggccggcccccuuccuggccccucauggcgggacuggagaaaugguccgcuuuccuggagccaa

SEQ ID NO: 447649 - RNA, 65 nt, hsa
uccuucaagguggcagcuguuagggcugaaucuucuggagaaaaaggugccaucucaggagaaua

SEQ ID NO: 447650 - RNA, 65 nt, hsa
aauuaacuagcauuuagccagcuuuuucuugcccuuggagaaaaagaaucauucucaaccugaua

SEQ ID NO: 447651 - RNA, 65 nt, hsa
ugaaaaauaacacaaugcuugauuugaaaacaguguggagaaaaacuaggcaaacuacacccugu

SEQ ID NO: 447652 - RNA, 65 nt, hsa
uagaguaauauauauucagaauaauaaacucaagcuggagaaaugaguccugauagacugaaaau

SEQ ID NO: 447653 - RNA, 65 nt, hsa
uuuuauuuuaauacauuguaggaaaucuucauaauuggagaaaguucugcagcauggcuuuuuac

SEQ ID NO: 447654 - RNA, 65 nt, hsa
cuguggcuccauauuucaacuaaaaauauaucuguuggagaaagaaauuaacaauaaagaauuuu

SEQ ID NO: 447655 - RNA, 65 nt, hsa
gcucacuggcaggugugggaucuggggagagcggcuggagaaagaugcaguccucaggaaggggg

SEQ ID NO: 447656 - RNA, 65 nt, hsa
ccaaggcggcggcagagcuggucuucuggucuccuuggagaaagguucuguugcccugauuuaug

SEQ ID NO: 447657 - RNA, 65 nt, hsa
gagccuuuuguuuuguuuuuauuuugauaaauuaguggagaaauggcauuuuaagaggagucucu

SEQ ID NO: 447658 - RNA, 65 nt, hsa
cagggaguccagcccuaccuucuucccuuggcagcuggagaaaucugguuucaauauaacucauu

SEQ ID NO: 447659 - RNA, 65 nt, hsa
ucaccccccugucacccucccaguggcauccaggguggagaaagcucuuuggaaagaccuagauu

SEQ ID NO: 447660 - RNA, 65 nt, hsa
uaggaaagacauguaagagcauggacauuuuacuuuggagaaacagaaaaaucuuggggcuucca

SEQ ID NO: 447661 - RNA, 65 nt, hsa
cgcuuuuuggaagacauuucuguagcaugucaguuuggagaaaugaugagcuacgccuugaugaa

SEQ ID NO: 447662 - RNA, 65 nt, hsa
cuguccagggccucacagggaggcauucauggagcuggagaaaccagggauccugaccgcagggc

SEQ ID NO: 447663 - RNA, 65 nt, hsa
uuuguaagaaaauguucauuuuaagugauagauaguggagaaaauuuaucaccuaaaauauaccc

SEQ ID NO: 447664 - RNA, 65 nt, hsa
gcuccagguggaagcaugcuuucccuuguuacuguuggagaaacucaaaccuucaagcccuaggu

SEQ ID NO: 447665 - RNA, 65 nt, hsa
cuuuugcuucuuucugucuuuccuucucuuuugucuggagaaaucacuuagacucugugugccuc

SEQ ID NO: 447666 - RNA, 65 nt, hsa
uuauaguuuuauaacuggcuuaaguuaaguuuuauuggagaaaucuugccuauaauucuauaaag

SEQ ID NO: 447667 - RNA, 65 nt, hsa
cuuuuuacuguugaacuuagaacuaugcuaauuuuuggagaaaugucauaaauuacuguuuugcc

SEQ ID NO: 447668 - RNA, 65 nt, hsa
uuucuuggacuacuuuaauuuggauccuuuggguuuggagaaagggaaugugaaagcugucauua

SEQ ID NO: 447669 - RNA, 65 nt, hsa
uaccuaaaacacauacguuagccaugcugcugguauggagaaauuccacaccaugauuauuagcc

SEQ ID NO: 447670 - RNA, 65 nt, hsa
uugguguuuuaaaguaaaaauuaugauguuacuuguggagaaacuaaaaauguuguacaacugac

SEQ ID NO: 447671 - RNA, 65 nt, hsa
gugccaucucaauugugcuuuguaucagucagugcuggagaaaucuugaauagcuuauguacaaa

SEQ ID NO: 447672 - RNA, 65 nt, hsa
cuuucuaacugaauacuuguuuuauagaaaaugcauggagaaaaggaauuuguuuaaauaacauu

SEQ ID NO: 447673 - RNA, 65 nt, hsa
cugaggucaggaguucaagaucagccugaccaacauggagaaacccuacuaaaaauacaaaguua

SEQ ID NO: 447674 - RNA, 65 nt, hsa
gcucaacaagagacuggaaggaccauaaauuuaaauggagaaaggacccucaagacaaaugaccc

SEQ ID NO: 447675 - RNA, 65 nt, hsa
gacuggagcaucugacucacaagaagaccagacuguggagaaauaaaaauaccucuuuauuuuuu

SEQ ID NO: 447676 - RNA, 65 nt, hsa
aucucuuugaugucauauggaagaguuaaaacagguggagaaauuccuugauucacaaugaaaug

SEQ ID NO: 447677 - RNA, 65 nt, hsa
cagaaacuccccguuuugcugacucauuccauaacuggagaaagaagcuccauugaccgaagcca

SEQ ID NO: 447678 - RNA, 65 nt, hsa
gaagcugacuuucuauaggcaauuuuguaccuuuguggagaaaugugucaccucccccaacccga

SEQ ID NO: 447679 - RNA, 65 nt, hsa
ugacucauuuaaacuuugaugcuuaguuauguugcuggagaaaagauacuuauguuuugcucauc

SEQ ID NO: 447680 - RNA, 65 nt, hsa
gaugggcugcugugugaauguugacguucguuucauggagaaaggggaggugaaagauugaagag

SEQ ID NO: 447681 - RNA, 65 nt, hsa
acucaauauguuauauuuguuuuccuguauuuagguggagaaaugagaaaaagcuuuaguuccaa

SEQ ID NO: 447682 - RNA, 65 nt, hsa
ucuuccuguucugcaccccucuccccaugggaccuuggagaaaacugaacuguuacaaaccccug

SEQ ID NO: 447683 - RNA, 65 nt, hsa
ugcccuuuaaugggauugaaagcacuuuuaccacauggagaaauauauuuuuaauuugugaugcu

SEQ ID NO: 447684 - RNA, 65 nt, hsa
cauuguaaagauugccuuuguucugucuaaaagucuggagaaaucccaaagacuuuuccuaugua

SEQ ID NO: 447685 - RNA, 65 nt, hsa
ccaacugaaacauauaacguuuucaucuccuuuccuggagaaagcagcugcagagguucuguauu

SEQ ID NO: 447686 - RNA, 65 nt, hsa
acauacacauuauuccaccaauugacuuugaaaaguggagaaaguguauucuuuaaagagaauuu

SEQ ID NO: 447687 - RNA, 65 nt, hsa
uaccuggcauagagaaaaauauauaccugguacauuggagaaaaauaauuacacuuucaaagaga

SEQ ID NO: 447688 - RNA, 65 nt, hsa
uagauacauaaauaugguggucagcguuaauaaaguggagaaauauuggagaacuguuuaccuca

SEQ ID NO: 447689 - RNA, 65 nt, hsa
cucccuucguguuguuuugcauggcuuugcaguuauggagaaaguggaaacccagcagucccuaa

SEQ ID NO: 447690 - RNA, 65 nt, hsa
aguauccucguuugaaagauaauuaagaucccccguggagaaagcagugacacauucacacagcu

SEQ ID NO: 447691 - RNA, 65 nt, hsa
acuggucacuguagcagguaaacacuacucuaacguggagaaaugagcuucaugcugagguagug

SEQ ID NO: 447692 - RNA, 65 nt, hsa
gcagugauuuuguuccaaaacuuuguauacacauuuggagaaaaguacuuuauauuuucaguguu

SEQ ID NO: 447693 - RNA, 65 nt, hsa
gggcacgcacggugcaucaagucuugggcagggcauggagaaacaaaugucuuguuauuauucuu

SEQ ID NO: 447694 - RNA, 65 nt, hsa
cugaggucagcaguuaaagaccagccugaccaaaauggagaaaccccaucucuacuaaaaauaca

SEQ ID NO: 447695 - RNA, 65 nt, hsa
uguauuauaggacucacgggaugccaucuagcaaguggagaaauagcaguccauuuucucuugca

SEQ ID NO: 447696 - RNA, 65 nt, hsa
ugauggguuugauuuuuauaucaaaucaucaggcauggagaaauaucuuuuagaaguguuaaaau

SEQ ID NO: 447697 - RNA, 65 nt, hsa
ucagugggcccgaacucgccagccccagcuuucaguggagaaagcgguccucugaaaugguuucc

SEQ ID NO: 447698 - RNA, 65 nt, hsa
aacagaagggagggcagagcuggugcggcuggccauggagaaagcugacuuggcuggugugguac

SEQ ID NO: 447699 - RNA, 65 nt, hsa
cacuccagccugggcaacagagcaagacccugucuuggagaaaccagaauuuuggaagagcaaau

SEQ ID NO: 447700 - RNA, 65 nt, hsa
cugaggucgggaguucgaggccagccugaccaacauggagaaaccccgucucuucuaaaaauaca

SEQ ID NO: 447701 - RNA, 65 nt, hsa
gacucuguuucgaauauagccacagaaauaaaggauggagaaaaaucugggacagguaauuuugc

SEQ ID NO: 447702 - RNA, 65 nt, hsa
gauucuguuucgaacauagccacagaaauaaaggauggagaaaaaucugggacagguaauuuugc

SEQ ID NO: 447703 - RNA, 65 nt, hsa
gguucuguuuugaguauagccagagaaaacaaggauggagaaaaaucuaggacagguaauuuuga

SEQ ID NO: 447704 - RNA, 65 nt, hsa
gauucuuuuucgaauauaaccagaggaaaaaaggauggagaaauaucuaggaaagguaauuuugc

SEQ ID NO: 447705 - RNA, 65 nt, hsa
gauucuuuuucgaauauaaccagagaaaaaaaggauggagaaauaucuaggaaagguaauuuugc

SEQ ID NO: 447706 - RNA, 65 nt, hsa
gauucuguuuuggguauagccagagaaaacaaggauggagaaaaaucuaggacagguaauuuuga

SEQ ID NO: 447707 - RNA, 65 nt, hsa
cugaggucaagaguucgagaccagccugaccaacauggagaaacccccaucucuacugaaaauac

SEQ ID NO: 447708 - RNA, 65 nt, hsa
ugaguggcucuuugcaugaacacugugcaagguguuggagaaauccaaagcugaccaaaacaugg

SEQ ID NO: 447709 - RNA, 65 nt, hsa
guguuuuuuacucuuuucucaugcacauguuacguuggagaaaauguuuacaaaaaugguuuugu

SEQ ID NO: 447710 - RNA, 65 nt, hsa
aauacccuucccuucaacaacucuccagcucugaauggagaaacucucuaggccauccccucuuc

SEQ ID NO: 447711 - RNA, 65 nt, hsa
ggauuuuggcaucuuguuuuucuaacaacaaacaauggagaaaaagaauugauucuuagugacac

SEQ ID NO: 447712 - RNA, 65 nt, hsa
auaaaacaguauacugacaacuguuuacaagaaaguggagaaaaauguacauacauuuuuguaug

SEQ ID NO: 447713 - RNA, 65 nt, hsa
uuaaaaagaguugccuauugaaaugaucauguuucuggagaaauuaagcuuauagacagcaugug

SEQ ID NO: 447714 - RNA, 65 nt, hsa
gagaccucuggucagcaaacuggaacucaguaaacuggagaaauaguaucgaugggagguuucua

SEQ ID NO: 447715 - RNA, 65 nt, hsa
uugguagaggguauaucuagugaauggagaauacauggagaaacuuaacuaaguuacacaagcau

SEQ ID NO: 447716 - RNA, 65 nt, hsa
uuucuggauuucauacuguaacauucaggaauucuuggagaaaauggguuuauucacugaacucu

SEQ ID NO: 447717 - RNA, 65 nt, hsa
guuuggaacuuagauuuccaauguguauauucuaauggagaaagcaagagguagaguuuguaugu

SEQ ID NO: 447718 - RNA, 65 nt, hsa
uuggaauguacccaucugaaucaaaugcaaacuucuggagaaaacagagugccucuucccagaug

SEQ ID NO: 447719 - RNA, 65 nt, hsa
uccucucaaaacaaacacccucuugcaaccagcuuuggagaaagcccagcuccugugugcucacu

SEQ ID NO: 447720 - RNA, 65 nt, hsa
uacucugaaacaugguggccugagagaagaagagcuggagaaaaugaaagaagagcgugaaaggu

SEQ ID NO: 447721 - RNA, 65 nt, hsa
gcaggagcaggggcagggggccacuguagugagcguggagaaauuuggaaacaccuauuucuuaa

SEQ ID NO: 447722 - RNA, 64 nt, hsa
uggcuggcccuguaauuuaaauuaaaauaaaauuuuggagaaacagcauugucugucuuuauga

SEQ ID NO: 447723 - RNA, 65 nt, hsa
ugcagagagaggcaggaaggaucccugaagagucuuggagaaaagguucugugcccucagguggg

SEQ ID NO: 447724 - RNA, 65 nt, hsa
gcuaauaaaaucaaauaaaacuguaugaacucuaauggagaaaaaucuaauuauagcaaggugag

SEQ ID NO: 447725 - RNA, 65 nt, hsa
gcuuauauuuaucgcuuggcucaaguucugcccuuuggagaaauacugagcaagucuuucauucu

SEQ ID NO: 447726 - RNA, 65 nt, hsa
gacagaugaaaggagacaaugguuguguagggagauggagaaaaugcuuaaucugaggaugagac

SEQ ID NO: 447727 - RNA, 65 nt, hsa
cacguugccuucugcgcaaaggguuucaccaaggauggagaaagggagacagcuugcagauggcg

SEQ ID NO: 447728 - RNA, 65 nt, hsa
gaucguucucugccucacauagcuuacaagccagcuggagaaauaugguacucauuaaaaaaaaa

SEQ ID NO: 447729 - RNA, 65 nt, hsa
aaggacagcaacaugaaaagagcauaucaaugugguggagaaagggaagggguuggcuuuuuaau

SEQ ID NO: 447730 - RNA, 65 nt, hsa
uuuggcuggucuuucaauuuucuuaagaggggaacuggagaaaccuugcuaaagguuuuagcuua

SEQ ID NO: 447731 - RNA, 65 nt, hsa
uaaauauuugaguauuuuuauauugacaaauaaaauggagaaaaugaaacgauugcucugauggg

SEQ ID NO: 447732 - RNA, 65 nt, hsa
ucuuuuccugugcuuacgggccaugcguauuucuuuggagaaaggucuauccagguccuuugccu

SEQ ID NO: 447733 - RNA, 65 nt, hsa
uuuuacuugagggggacgucccaaaauuaaaggaauggagaaauaaucaaaaucauguauaccau

SEQ ID NO: 447734 - RNA, 65 nt, hsa
gagcggaguuguuaaggacugaagaaaaacuucucuggagaaaaauaaaauugcaauucuacuua

SEQ ID NO: 447735 - RNA, 65 nt, hsa
acagaaauucuguugaagacaguugagaauuccuuuggagaaaacagcccagcuuggcguggggu

SEQ ID NO: 447736 - RNA, 65 nt, hsa
ugacgcuacuaaccugacaucaccaaguguggaauuggagaaaagcacaaucaacuuuucugagc

SEQ ID NO: 447737 - RNA, 65 nt, hsa
uuucuagagguuggcuuucaauucuguagcauacuuggagaaacugcauuaucuuaaaaggcagu

SEQ ID NO: 447738 - RNA, 65 nt, hsa
caguguuccucaccaauaacuucagagaagucaguuggagaaaaugaagaaaaaggcuggcugaa

SEQ ID NO: 447739 - RNA, 65 nt, hsa
ugguaccgucuaguacuaugcagcgguccucaaguuggagaaaaugugccuuucauucauuaccu

SEQ ID NO: 447740 - RNA, 65 nt, hsa
ccgaggucaggaauucgagaccagccugaccaacauggagaaaccccgucucuacuaaaaauaca

SEQ ID NO: 447741 - RNA, 65 nt, hsa
gggaaagauuuaaagugcaggcugcaauuaaaacauggagaaaaguagaaauaaugccauaaguc

SEQ ID NO: 447742 - RNA, 65 nt, hsa
aagcugcauuguuggguaaaagccccguggagugcuggagaaaugcacuagcagagugcaggauc

SEQ ID NO: 447743 - RNA, 65 nt, hsa
uuaagcaugacuuuagaugggaagccuguguaucguggagaaacaagagaccaacuuuuucauuc

SEQ ID NO: 447744 - RNA, 65 nt, hsa
uuggaaaaucacacaguuuucaggcuccaucuguuuggagaaaauacauucugaagcauccccaa

SEQ ID NO: 447745 - RNA, 65 nt, hsa
uugaggccaggaguucaagaccagucuggccaauauggagaaaccuugucucuacuaaaaacaca

SEQ ID NO: 447746 - RNA, 65 nt, hsa
gcaaaaggauuuguuuucacucugggaggagaggguggagaaagcacuugcuuucauccucuggc

SEQ ID NO: 447747 - RNA, 50 nt, hsa
agaucacacaacuucagugauggagaaaucucaaguuacuggcuuuuaua

SEQ ID NO: 447748 - RNA, 65 nt, hsa
auggaaauggauuggauugucaaauuauuauuuauuggagaaaaaaaccugaucuacacauuuuu

SEQ ID NO: 447749 - RNA, 65 nt, hsa
aauauauacaagguaucauguagugauaauugcuguggagaaaaauaaagcaggggagggaguaa

SEQ ID NO: 447750 - RNA, 65 nt, hsa
aacuuaggaaauagugaauaaggugcauuuaacuuuggagaaauacuuuuauggcuuugguggag

SEQ ID NO: 447751 - RNA, 65 nt, hsa
aaguugcagacugccuuuaaaauagauuuuaucaguggagaaauggugauaguuuuuucuucagu

SEQ ID NO: 447752 - RNA, 65 nt, hsa
aggcuccgccccagcccucagccccaggccccagcuggagaaaaaacauugcccagggauuagga

SEQ ID NO: 447753 - RNA, 65 nt, hsa
aauuaugaaaacaccaaguuugaauaagaggaucauggagaaaaaaugagacccuaaaaaguuuc

SEQ ID NO: 447754 - RNA, 65 nt, hsa
augcuaggcacuuuuguccagagccugcugucccauggagaaaaaguuuuaagcacugaaaaaau

SEQ ID NO: 447755 - RNA, 65 nt, hsa
gaaaugcagagauuaagagcauauagaccaccuaguggagaaaaauggaguaaaggagauaagua

SEQ ID NO: 447756 - RNA, 65 nt, hsa
aaacaggacagcagcucugcuagcuuggcuagugcuggagaaaguaccgggaagaaggagguggc

SEQ ID NO: 447757 - RNA, 65 nt, hsa
aggagucagagagaaucccuagucuucaagcagauuggagaaacccuugaaaagacaucaagcac

SEQ ID NO: 447758 - RNA, 65 nt, hsa
cuuccuccugcaguucuggaccauguggagcuacauggagaaauugcacagacagaaucacuuug

SEQ ID NO: 447759 - RNA, 65 nt, hsa
gccaagauucugaguuuuacuaccaggcugaaugcuggagaaaacuggcuaucaucuuucagaag

SEQ ID NO: 447760 - RNA, 65 nt, hsa
uucauuuguuccuuggaccuuaaucauuugcauuuuggagaaaauuuuuucugcuuuaaaagucu

SEQ ID NO: 447761 - RNA, 65 nt, hsa
gaguuuaggaauucuacuagccagagauagucacuuggagaaacuuucuauauauccuucuaaau

SEQ ID NO: 447762 - RNA, 65 nt, hsa
auagggaaauuuuuauugaaguaaauuugaaaugauggagaaauuucagaagcauaauaaaguuc

SEQ ID NO: 447763 - RNA, 65 nt, hsa
guaccuagaaauucacaaaaaaauuaauaccucuguggagaaaacuucaaaacuuaaaaaaggac

SEQ ID NO: 447764 - RNA, 65 nt, hsa
uuuugauccaagucaaguguagccucucagccuuuuggagaaaaaugaaacaauuuauuucaacu

SEQ ID NO: 447765 - RNA, 65 nt, hsa
gcagagucugagggucccggggcccgguuggcagcuggagaaagaggcaaaaagcccguagccgg

SEQ ID NO: 447766 - RNA, 65 nt, hsa
aaugaaggcagugggaaagcaaugccaaaugguuguggagaaaguggccggagccucccuggagu

SEQ ID NO: 447767 - RNA, 65 nt, hsa
aaauuaacugagcuccuagagaagaacaauccucauggagaaacucuggaaaccuugacaauggc

SEQ ID NO: 447768 - RNA, 50 nt, hsa
auguguuuccuuucagcugauggagaaacuuccucuuuuucaugaagaaa

SEQ ID NO: 447769 - RNA, 65 nt, hsa
aacuagaauauccucagcagguggccuggccacucuggagaaagaaacccaaggaaagugagcac

SEQ ID NO: 447770 - RNA, 65 nt, hsa
cuaggcagcagccaccuucucaggaaacaaggccuuggagaaaucagugccugugugaagauggu

SEQ ID NO: 447771 - RNA, 65 nt, hsa
gcuggaccuuccauucuagaauuaugagaccaccuuggagaaaggugugugguacaugacauugg

SEQ ID NO: 447772 - RNA, 65 nt, hsa
acauguuaagaguaauuuggauguggggguggggguggagaaaggggaagugguccagaaacaaa

SEQ ID NO: 447773 - RNA, 65 nt, hsa
caaguuggaugacacuacucccaacuuuuuaaauuuggagaaaaccaucaaggucgaggaagccc

SEQ ID NO: 447774 - RNA, 65 nt, hsa
uacaaaaauaugacaaucuuguaaguagcagacuauggagaaaaaugaguuaccuggagggucag

SEQ ID NO: 447775 - RNA, 65 nt, hsa
cauauaaauuuuuguucauuuagaacugaguauucuggagaaaaccaauggucagcacuuuuggu

SEQ ID NO: 447776 - RNA, 65 nt, hsa
agaaauugcuagauuacccaaagaaauagaucaguuggagaaaauacaaaacaauucaaagcucu

SEQ ID NO: 447777 - RNA, 65 nt, hsa
uccccaaagaagguuuaaaauguacuaauaaaaacuggagaaauaggaauuugugaacuccuaaa

SEQ ID NO: 447778 - RNA, 65 nt, hsa
gggaggggugcaaaagaggagaguaagaaacagcauggagaaaacccgguacgcucaaaaagaaa

SEQ ID NO: 447779 - RNA, 65 nt, hsa
uccagcagccccagagaccagaacugauccagagcuggagaaagaagccgaaggcucuuagggag

SEQ ID NO: 447780 - RNA, 65 nt, hsa
ugaauaaaaaauaauuuugcuguuguaguauacauuggagaaacuggcagguuuuauuuccauua

SEQ ID NO: 447781 - RNA, 65 nt, hsa
auuccauagugcuuuaaacgugaugcauguuuuaauggagaaaaaauagcugguuucuauuaauu

SEQ ID NO: 447782 - RNA, 65 nt, hsa
ucagggcugggccaugugguugauuuuucuaaagcuggagaaaggaagaauugugccuugcauau

SEQ ID NO: 447783 - RNA, 65 nt, hsa
gaaaaaaaaauuuucuguuuugcaauagaaggauguggagaaaugcuuucagucuacuuuucuua

SEQ ID NO: 447784 - RNA, 65 nt, hsa
caagacuuugggcucuuaugucacaucacaugauuuggagaaauuagacacaaucucuuauuuuu

SEQ ID NO: 447785 - RNA, 65 nt, hsa
uuuggaaaaaaugaggggagggaguuuggcaagaauggagaaaaugaaugaagaaggccuaaucu

SEQ ID NO: 447786 - RNA, 65 nt, hsa
cuuucggggagcucagccgccugguggggacagaauggagaaaucuugagacagccaagaaagca

SEQ ID NO: 447787 - RNA, 65 nt, hsa
gaaaucagaagggaauauagaaagaacucuggauguggagaaaugccgguaccugagcauuuugu

SEQ ID NO: 447788 - RNA, 65 nt, hsa
ucaauuguccuucagauaauucauguggagauuuuuggagaaaccaugacggauaguuuaggaug

SEQ ID NO: 447789 - RNA, 65 nt, hsa
cagaaugggcaugaccuucagcucacgagcacaccuggagaaauucagaaccagguucugaauca

SEQ ID NO: 447790 - RNA, 65 nt, hsa
uguggccaagaagugaugucuuuguccugauccaauggagaaagaaagccauuuuuccguaaaaa

SEQ ID NO: 447791 - RNA, 65 nt, hsa
uggacaaaagggaguuacagaggcugcuuaaaagauggagaaaagccugagauugaaggaggaaa

SEQ ID NO: 447792 - RNA, 65 nt, hsa
aacacauacuccuuaauuuaccuguuguuggaaacuggagaaaugauugucgggcaaccguuuau

SEQ ID NO: 447793 - RNA, 65 nt, hsa
gcugaguaugcucgaaauaguucauccaggucagguggagaaacacuaucgggaaauggaagaga

SEQ ID NO: 447794 - RNA, 65 nt, hsa
cuugccaaaaaaaaaaaaaaaaaaaaaucagaaauuggagaaauccuuagcacaauuuucuaaaa

SEQ ID NO: 447795 - RNA, 65 nt, hsa
gcaaccuauuuggguaaagaaaccauuugcuaaaauggagaaaguaaauagauuuuuauuuaaau

SEQ ID NO: 447796 - RNA, 65 nt, hsa
aauacuagauaaacauuucgcauugaauauuuacauggagaaaaaucaucaaacaucaacaauua

SEQ ID NO: 447797 - RNA, 65 nt, hsa
cagugucauacauauuuguucuccauugauauaucuggagaaaucaaugcuacagccuauagcug

SEQ ID NO: 447798 - RNA, 65 nt, hsa
augagcucacuggaaauucauucuaauccccaagcuggagaaacagguuaagagauccuguuuca

SEQ ID NO: 447799 - RNA, 65 nt, hsa
agccuuuccucuucuggucuuuccucuucuguuuauggagaaauaauagaaaguaguaagucguu

SEQ ID NO: 447800 - RNA, 65 nt, hsa
uacuucggcugcaugagauaaucacuugggagcuuuggagaaaauagcaguaccaagggaucuca

SEQ ID NO: 447801 - RNA, 65 nt, hsa
aagucagccagcgcauaggugcucccucuauauuauggagaaagcaaaacccugcaaaugaccaa

SEQ ID NO: 447802 - RNA, 65 nt, hsa
gugucauguugguuuuugguacuuguauugucauuuggagaaacaauaaaagauuucuaaaccac

SEQ ID NO: 447803 - RNA, 65 nt, hsa
auuaauaaaauuaugucuaugguauuuucaguuucuggagaaaaauacuuauagacaguuuaacu

SEQ ID NO: 447804 - RNA, 65 nt, hsa
aauugugaaauuacuuucagugguuuaagaagcaauggagaaaaugauaauacagcauaauuuuu

SEQ ID NO: 447805 - RNA, 65 nt, hsa
cuucaugccucuccaaaugugguuauucuaauaaauggagaaaugagccaaauaaaaguaguacu

SEQ ID NO: 447806 - RNA, 65 nt, hsa
cccuacacccuuuagcuggaugcugucagaggcgauggagaaacgcaaaggugcguuaauuuuac

SEQ ID NO: 447807 - RNA, 65 nt, hsa
ugucugacugcaaguuuuuuaaagaaaagaggaacuggagaaacgacuuccauugauguggacuu

SEQ ID NO: 447808 - RNA, 65 nt, hsa
gugaugauagaaccagauauaaaauuguucagugauggagaaaagaaacgauaaauacuuuccaa

SEQ ID NO: 447809 - RNA, 65 nt, hsa
gaaagcuauggaagaugauguacaaauguuauugauggagaaaaugguuggguguguccuuucug

SEQ ID NO: 447810 - RNA, 65 nt, hsa
uugagccuaggaguucgagaccagccuaggcaacauggagaaaccccgucucuaucagaaauaca

SEQ ID NO: 447811 - RNA, 65 nt, hsa
gguaguaagcuuggaaaaauaauuuaagaauacaauggagaaauguaaauaaguaucuauguaaa

SEQ ID NO: 447812 - RNA, 65 nt, hsa
guagaaauauaucuguuauaauuauacaggcucuguggagaaauaaaguucaaaauauauuaauu

SEQ ID NO: 447813 - RNA, 65 nt, hsa
aggaacaaggcaaggcugucaauuacaggaaguacuggagaaaauggacguguuaugacuccaga

SEQ ID NO: 447814 - RNA, 65 nt, hsa
uuuucugugccuucaagggacaacuuuuuuaacuuuggagaaaagaaaaacacucuauaacagag

SEQ ID NO: 447815 - RNA, 65 nt, hsa
caaagcaaaagcuagagaagcaaguggagaaaugcuggagaaagcugcacccuacaggcaaccag

SEQ ID NO: 447816 - RNA, 65 nt, hsa
ccaccacugcccaaagcaaaagcuagagaagcaaguggagaaaugcuggagaaagcugcacccua

SEQ ID NO: 447817 - RNA, 65 nt, hsa
ugauaucaaugaguuccuggaggccuuccgccuuguggagaaauccugcccagagggcgaugccu

SEQ ID NO: 447818 - RNA, 60 nt, hsa
acaauuaccagccauacuaaaggagaacauuggagaaaacagguguguauaagaguacag

SEQ ID NO: 447819 - RNA, 65 nt, hsa
aaaguucauguuggccauggugaaaggguuugauauggagaaacaaaauccucaggaaauuagau

SEQ ID NO: 447820 - RNA, 65 nt, hsa
auuuuacagauagaugcuuccccuuggcuaugacauggagaaagauuuucccauaauaauaacua

SEQ ID NO: 447821 - RNA, 65 nt, hsa
aaguauaugaaaauauacuggaaauauuggauucuuggagaaaacuguucagucacagauauauu

SEQ ID NO: 447822 - RNA, 65 nt, hsa
guugauauguuuuauuucauugguuaauuuuuacauggagaaaaccaaaaugauacuuacugaac

SEQ ID NO: 447823 - RNA, 65 nt, hsa
uugcaaaaugcaacuugugcucugucuuauaaaaauggagaaaggagucauggcucucuuucuug

SEQ ID NO: 447824 - RNA, 65 nt, hsa
cugaggucgggaguucuagaccagccugaccaacauggagaaaccccaucucuacuaaaaauaca

SEQ ID NO: 447825 - RNA, 65 nt, hsa
cuaguguuuucauaauguaauucaaugaaaacuguuggagaaauauuuaaacaccucaauguagg

SEQ ID NO: 447826 - RNA, 65 nt, hsa
agguuuuaaaaauaaguuuuauacauaaacaguuuuggagaaaaauuacagaucauauaagcaag

SEQ ID NO: 447827 - RNA, 65 nt, hsa
auuccuuggaacagagcuauuacuugccuguucuguggagaaacuuuucuuuuugagggcugugg

SEQ ID NO: 447828 - RNA, 65 nt, hsa
guaucuuguaaucaugauugagccucagaaucauuuggagaaacuauauuuuaaagaacaagaca

SEQ ID NO: 447829 - RNA, 65 nt, hsa
gauuuaagauggacuuucuuauugcaugaaaaagauggagaaacaugccauuuuucagugaagau

SEQ ID NO: 447830 - RNA, 65 nt, hsa
auuauugcggaccgugguacccaguuuuaggaauguggagaaaggaauucuguugauuccguuga

SEQ ID NO: 447831 - RNA, 65 nt, hsa
uuuaguauuuugucuuuguaauuuacagaaguuauuggagaaaauaaacuuguuucauuuugcau

SEQ ID NO: 447832 - RNA, 65 nt, hsa
aaguuuuuguucuuuuuuuuuuuuccaucacucaguggagaaaagcuuuguuaaugaaagauuuu

SEQ ID NO: 447833 - RNA, 65 nt, hsa
guauacauggugauguacaucuguagcaaagcucuuggagaaaaugaagacugaagaaagcaaag

SEQ ID NO: 447834 - RNA, 65 nt, hsa
augaggaacauucauucuguauuuuuuuucccuguuggagaaagugggaaauuauaaugucgaac

SEQ ID NO: 447835 - RNA, 65 nt, hsa
uauucugucuaucaaauaguacuucuaccacuguuuggagaaaauugaagaaaagaauaagauga

SEQ ID NO: 447836 - RNA, 65 nt, hsa
guugaauaugauuuggucaguugcucguuguaacuuggagaaauuccuauaaaguaagaucuccu

SEQ ID NO: 447837 - RNA, 65 nt, hsa
aaaucgugcaauaaccauaugcgacuauuuugccauggagaaaucugacagcauugcaaacaaua

SEQ ID NO: 447838 - RNA, 65 nt, hsa
uuuggugaagugaaaaacagaaaaauaagacccuguggagaaauucguuguucccacugaaaugg

SEQ ID NO: 447839 - RNA, 65 nt, hsa
aaugccuuauuuuugaauucuuuagauuuuuaaauuggagaaaagcacuuaaaguuuuuuauaua

SEQ ID NO: 447840 - RNA, 65 nt, hsa
guccuggcacaguuuuuguaaagcccuugcacagcuggagaaauggcaucauuauaagcuaugag

SEQ ID NO: 447841 - RNA, 53 nt, hsa
ccaaacuggcaagguccuaggcauggagaaacuccaagcuccucugugaagca

SEQ ID NO: 447842 - RNA, 65 nt, hsa
aguuagaagaaaacuauuguacucuuuuguuuuaguggagaaauaauagaugucuguucaugugu

SEQ ID NO: 447843 - RNA, 65 nt, hsa
cagaaaggcuuagccaaggccacaucugggaagaguggagaaauuugccacuugacgaucacgga

SEQ ID NO: 447844 - RNA, 65 nt, hsa
cuuagaacauuuuuugaaauucaguuuacagaaauuggagaaaaugcuuuuuaaacaaguguuuc

SEQ ID NO: 447845 - RNA, 65 nt, hsa
gggacagagccagauucagaguaaucuugacugaauggagaaaguuucugugcuaccccuacaaa

SEQ ID NO: 447846 - RNA, 65 nt, hsa
gcagcuggaggcugcuguggggaccacacugauccuggagaaaagggauggagcugaaaaagaug

SEQ ID NO: 447847 - RNA, 65 nt, hsa
guuucuucuuugagagucaugacuaccuucugguguggagaaauugccauuggaaaauuugacaa

SEQ ID NO: 447848 - RNA, 65 nt, hsa
ucccaccaucaucacaacuguagucucauuugcaguggagaaaagaacccgacgucccacagcca

SEQ ID NO: 447849 - RNA, 65 nt, hsa
ugagaccucagggaggcucugucucucuuaaaagguggagaaagaugccauucucucccuaaggu

SEQ ID NO: 447850 - RNA, 65 nt, hsa
cugaggucgggaguucgagaccagcgugaccaacguggagaaacccccgucucuacuaaaaauac

SEQ ID NO: 447851 - RNA, 65 nt, hsa
cacacacacacacacacacacacacacacacaaaguggagaaaaauguauacucaacaaugucau

SEQ ID NO: 447852 - RNA, 65 nt, hsa
aaugcugaaaaguggcucagaugcagaguguucuguggagaaacugcagccccacuucuguuucc

SEQ ID NO: 447853 - RNA, 65 nt, hsa
cugaggucaggaguucgagaccagccugaccaacguggagaaaccccaucucuacuaaaaauaca

SEQ ID NO: 447854 - RNA, 65 nt, hsa
uuuguuuuauuggaaugcauaucucuuuucaggguuggagaaauuagcacuugccuugaaaagaa

SEQ ID NO: 447855 - RNA, 65 nt, hsa
gugagguggggaguucgagaccagccugaccaacauggagaaaccccgucucuacuaaaaauaca

SEQ ID NO: 447856 - RNA, 65 nt, hsa
cuugauagcacuacuuggaguuuccaugaauaagauggagaaagcucauuguauuagggcauacu

SEQ ID NO: 447857 - RNA, 65 nt, hsa
gugaaccaaaaauagaaauuagauuugugcaaacauggagaaaucuacugaauuggcuuccagau

SEQ ID NO: 447858 - RNA, 65 nt, hsa
auauuuuauuauaaauuagaugccauauuaguuaguggagaaaaggggcauuagguauuaauugc

SEQ ID NO: 447859 - RNA, 65 nt, hsa
ggguuaccuccaugugcccuuuuuagggaagcuguuggagaaaauacuccagcaaaaugaaggag

SEQ ID NO: 447860 - RNA, 65 nt, hsa
agcaaggucuucaagcucucauuauggacugaaacuggagaaaauucuauggaacuauuaucagc

SEQ ID NO: 447861 - RNA, 65 nt, hsa
guucaacaauucugugaaaggucacaggacccaauuggagaaaucauaugaaaagcauaguuggu

SEQ ID NO: 447862 - RNA, 65 nt, hsa
uuugaaaaaggagaauugcaaauuuuaccaaaagauggagaaaagcacauuaaaaagauaccaac

SEQ ID NO: 447863 - RNA, 65 nt, hsa
guauuauccuagauccucaggaguagcauggcaacuggagaaaaugggaggaaagacaagaagaa

SEQ ID NO: 447864 - RNA, 65 nt, hsa
uauagauguuuauuuauuuuuaaugcaguaauauauggagaaaugaacaaacuauguaaacaaaa

SEQ ID NO: 447865 - RNA, 65 nt, hsa
uauguuccuuuguauguuccuaucaggcugauuuuuggagaaaugaauguuugucuggagcagag

SEQ ID NO: 447866 - RNA, 65 nt, hsa
ugggaugucaucuuuuuauaauuaguguucccauguggagaaaauuauucacacuacuugcaugu

SEQ ID NO: 447867 - RNA, 65 nt, hsa
aagugagaucauacugguuuguuucuuauuuugauuggagaaaaauuaaauugcugcauuucgca

SEQ ID NO: 447868 - RNA, 65 nt, hsa
ugcuuuuugaauguuauuuguuauuuucaguauuuuggagaaauuauuuaauaaaaaaacaauca

SEQ ID NO: 447869 - RNA, 65 nt, hsa
aaaaguuaacuaaaugguugacacacaaaaauugguggagaaauugugcauaugccaauuuuuug

SEQ ID NO: 447870 - RNA, 65 nt, hsa
ccagggccgugccuggagcacugcagagaugacuuuggagaaagcaaagcagugacccagugacc

SEQ ID NO: 447871 - RNA, 65 nt, hsa
uagaagaaagauacaagugaaaauuaggaguggauuggagaaauuggggggaaauagaagaguac

SEQ ID NO: 447872 - RNA, 65 nt, hsa
acugcacuauuauaaacuauuaaaaugauagauuguggagaaaguaauuauuccaacacccaucu

SEQ ID NO: 447873 - RNA, 65 nt, hsa
aagacacacacugcccuaaccucacuccaaaugucuggagaaauguguguagugcuuuuguuaaa

SEQ ID NO: 447874 - RNA, 65 nt, hsa
uaaaucucagaauuacuaagcauguggcauaaauuuggagaaaauaauaugacuagaaaaauuag

SEQ ID NO: 447875 - RNA, 65 nt, hsa
cuucguguccaccuggguccaguccugaaucaucuuggagaaacaccuugguuucuaggaugguu

SEQ ID NO: 447876 - RNA, 65 nt, hsa
gagaauuuauuuccuucuccacucucuccaugcccuggagaaaaaaaaguccagaagaaaucaua

SEQ ID NO: 447877 - RNA, 65 nt, hsa
aguggggcaacguguggaggaagccccucauaauuuggagaaaacuugauacaauagaagcugac

SEQ ID NO: 447878 - RNA, 65 nt, hsa
caaccuguucaagucuaccaauuauaagggcaaauuggagaaaaagaaaaaauauauacucaaga

SEQ ID NO: 447879 - RNA, 65 nt, hsa
auaaauaucaguuuuauucucauguaccuaaguuguggagaaaauaauugcauccuauaaacugc

SEQ ID NO: 447880 - RNA, 65 nt, hsa
aagggaagauauuuugacacaagaaagcaggaacguggagaaauuggagcaggaaaagaaauuau

SEQ ID NO: 447881 - RNA, 65 nt, hsa
acagcauguauuaugcacuucauuucucuacuguguggagaaagcaauaaacauuaugagaaugu

SEQ ID NO: 447882 - RNA, 65 nt, hsa
gagugcauaccagaauugaauauaccauaugggauuggagaaagacaaauguggaagaaaucaua

SEQ ID NO: 447883 - RNA, 65 nt, hsa
caguuacacaagcucuagucucaaaaugaaaguaauggagaaagacacugaaauuuagaaaauuu

SEQ ID NO: 447884 - RNA, 65 nt, hsa
caaagaauuuaaaguggcuccuuuaauuggugacuuggagaaagcuaggucaaggguuuauuaua

SEQ ID NO: 447885 - RNA, 65 nt, hsa
gagaaguaaaggaauauaugccuccuguguacuuuuggagaaaacugaagauuuaguuuccauuu

SEQ ID NO: 447886 - RNA, 65 nt, hsa
aggaucauccuuuuguacuugaugcuggaagcucuuggagaaaaagcuuaaacauuucaccagaa

SEQ ID NO: 447887 - RNA, 65 nt, hsa
gacaaaacacaaguuggaccaaggagaaagcccuuuggagaaacuggacccuaguucaguuuaga

SEQ ID NO: 447888 - RNA, 65 nt, hsa
gguggccagcccauuuucuggggugaggcuugacuuggagaaaggcagaagagacgucccgcuuc

SEQ ID NO: 447889 - RNA, 65 nt, hsa
uuuucauugaugauaaacgacuacagacuuaguaguggagaaaugguguccucuaguggaagaaa

SEQ ID NO: 447890 - RNA, 65 nt, hsa
uacuuguacucuucuuaugcuaauaugcucugggcuggagaaaugaaauccucaagccaucagga

SEQ ID NO: 447891 - RNA, 65 nt, hsa
guauuguauagcuuugaaaauaauuaugccuaguauggagaaacaggaauaagaucugauuuucu

SEQ ID NO: 447892 - RNA, 65 nt, hsa
cagucucuucagguagcuaaauuaggagcuuguuuuggagaaaugaagcaaaggugaaugacagc

SEQ ID NO: 447893 - RNA, 65 nt, hsa
auacuuugugcuuuaugguuuuuauaaugucuuuuuggagaaauugccgaaaaguugccaaauac

SEQ ID NO: 447894 - RNA, 65 nt, hsa
gcuaacauccuaucucauaauuauuuuauguuuuguggagaaauuuguugauuuuguaccaaagu

SEQ ID NO: 447895 - RNA, 65 nt, hsa
cauaagccaaagacucaaguguaaauaugucuauauggagaaagcacauuauauuuauugguuac

SEQ ID NO: 447896 - RNA, 65 nt, hsa
cuuuaccaguaacucagugaagccagacuguacuguggagaaaguagaaauauauccgucuuuga

SEQ ID NO: 447897 - RNA, 65 nt, hsa
gcuaggaacuaucaggugucuauaauuguagcacauggagaaagcaaauguaaaacuggauaaga

SEQ ID NO: 447898 - RNA, 65 nt, hsa
ucuccauuuuuaucaagguuuuccaugguuaaguuuggagaaaauaccacacaaaacaaugaauu

SEQ ID NO: 447899 - RNA, 65 nt, hsa
cuucgauuuuucuggucuguggagaaacugugaauuggagaaauggagcucuguggcuucccacc

SEQ ID NO: 447900 - RNA, 65 nt, hsa
gguuuugcuguguucacuucgauuuuucuggucuguggagaaacugugaauuggagaaauggagc

SEQ ID NO: 447901 - RNA, 65 nt, hsa
uuugcuguucuggggggugaaaauagacuaacuacuggagaaacaaagagagaaagaaaacccag

SEQ ID NO: 447902 - RNA, 65 nt, hsa
guuuuuuucucucacuauaguauaagaaucuauuuuggagaaaaaaagaaaauaugagggucucg

SEQ ID NO: 447903 - RNA, 65 nt, hsa
gcuugaaaaaccaagaggauaugaaaaucugucucuggagaaacaaagacgcaggcauacucagc

SEQ ID NO: 447904 - RNA, 65 nt, hsa
ccccauugucuuauguagaauguggcaaugccaacuggagaaagggaagaaggacauauuaccuu

SEQ ID NO: 447905 - RNA, 65 nt, hsa
uggggggagggggaugggguccuucuaggaguccuuggagaaaaguaagaaaccaggaguguuuc

SEQ ID NO: 447906 - RNA, 65 nt, hsa
ccugccuguugcaaacgugaugcucccggauggaguggagaaacuaggagacugggacaagcaaa

SEQ ID NO: 447907 - RNA, 65 nt, hsa
gcugcaaacaacccagaagcccauccucagaagacuggagaaaugauugaggaaugcaugggcac

SEQ ID NO: 447908 - RNA, 65 nt, hsa
uccucaacuuuuacuaaacauaagguaauucauacuggagaaaagccauacaaaugagaagaaug

SEQ ID NO: 447909 - RNA, 65 nt, hsa
ugcucaaauguuguucaacaccagaaaauuuauauuggagaaaagcacuguaaauguaaugcauu

SEQ ID NO: 447910 - RNA, 65 nt, hsa
uccgcaaagcucacugaacauaaguuaauucauacuggagaaaaacccuacaaauguaaagaaug

SEQ ID NO: 447911 - RNA, 65 nt, hsa
uccucaacucuuauuacacauaagauaauucacaguggagaaaaacccuacaaaugugaagaaug

SEQ ID NO: 447912 - RNA, 65 nt, hsa
uugucacacuugauuguauauaagauaauucauacuggagaaaacucccagaaguggaguuuucc

SEQ ID NO: 447913 - RNA, 65 nt, hsa
uguucaaacuuuguucaauaccaggaaauuuauauuggagaaaaacccuaugaguguaaugaauu

SEQ ID NO: 447914 - RNA, 65 nt, hsa
uugucacgcuugauuguagguaagauaauuuauauuggagaaaaauccuccaaguaugaagaaug

SEQ ID NO: 447915 - RNA, 65 nt, hsa
ugcucaaacuuuguucgacaucagggaauuuguauuggagaaaaacccugcaaauguaauaaaua

SEQ ID NO: 447916 - RNA, 65 nt, hsa
uuccauccauucuguuacacuuuguauuuucuaacuggagaaaagagugaggaacagaauguuuu

SEQ ID NO: 447917 - RNA, 65 nt, hsa
agggaccuuggaggaugaaggcgaguaugugacacuggagaaaaguggaccaggcaugucuuuug

SEQ ID NO: 447918 - RNA, 65 nt, hsa
ugagaucgggaguuugagaccaagccugaccaauauggagaaacccugucucuacuaagaacaca

SEQ ID NO: 447919 - RNA, 65 nt, hsa
agaaguauagcucuuuuccuaccugaacucuucccuggagaaaagauguuggcauugcugauugu

SEQ ID NO: 447920 - RNA, 65 nt, hsa
auuacaguucagagcauugauccuggaaugugugcuggagaaauuuaaaauacugggguuuuuug

SEQ ID NO: 447921 - RNA, 65 nt, hsa
ccaggugauucuguaaguugucccucaacuguacuuggagaaaucguguuuuaaagcaguagucc

SEQ ID NO: 447922 - RNA, 65 nt, hsa
cccauuuccacuuuuagauucaagagguccagccguggagaaacauccgggacccucagacacug

SEQ ID NO: 447923 - RNA, 65 nt, hsa
agccuacaagccccgagagaaugaugaauuggcacuggagaaagccgacguggugauggugacuc

SEQ ID NO: 447924 - RNA, 65 nt, hsa
ccuuuuauuaguucuuugauagcuaagaugguuguuggagaaagugcuuaagccacuguuuaugu

SEQ ID NO: 447925 - RNA, 65 nt, hsa
aaaguuaucaagagaaagaggugaggauggaaggauggagaaaaacagacugugggaaggaucag

SEQ ID NO: 447926 - RNA, 65 nt, hsa
accauuaguaggucuuugguuuugauggcacacuauggagaaaggacacacugguuuuaaucugu

SEQ ID NO: 447927 - RNA, 65 nt, hsa
uaccgagcuggaagcaagccauuuaauccgguucuuggagaaacauaugaauguauucgggagga

SEQ ID NO: 447928 - RNA, 65 nt, hsa
gcggugccccuauacaaaacaccagacccuggaacuggagaaagaguuucuguucaacauguacc

SEQ ID NO: 447929 - RNA, 65 nt, hsa
gaauuggcauuucccaauauuugcuaaacauuugcuggagaaaucauuuuucuuuuuucuuuuuu

SEQ ID NO: 447930 - RNA, 65 nt, hsa
uauaagcacaguugacaguugugcauugggauggguggagaaagacgacaagagagcagagaauc

SEQ ID NO: 447931 - RNA, 65 nt, hsa
cugagaucgcacguucgagaccagccugaccaacauggagaaaccccaucucuacuaaaaacaca

SEQ ID NO: 447932 - RNA, 65 nt, hsa
augucuucaagugaccuguacugcuuggggacuauuggagaaaauaagguggaguccuacuuguu

SEQ ID NO: 447933 - RNA, 65 nt, hsa
gaauuacugaauauuucagagcaaagcuaucaacuuggagaaacagggauuaaaaauaaggauaa

SEQ ID NO: 447934 - RNA, 65 nt, hsa
uuuaaaaacuauauucaguaaaagccugcucaauuuggagaaauagaaccacaaacacagaucac

SEQ ID NO: 447935 - RNA, 63 nt, hsa
aggaaauggugcauucuuaaaagccccagucucuggagaaaagagagaaagggauaaucaccu

SEQ ID NO: 447936 - RNA, 65 nt, hsa
cugaggucaggaguucaagaccagccuggccaacauggagaaacuccgucucuacuaaaaauaca

SEQ ID NO: 447937 - RNA, 65 nt, hsa
ugggcgcuguaaguuaagcucuacauagauuaaauuggagaaacguguuaauuguguggaaugaa

SEQ ID NO: 447938 - RNA, 65 nt, hsa
cuuaaaagaaagauuucccauugcauacagguuauuggagaaauuuuccuuuuguugcauuugug

SEQ ID NO: 447939 - RNA, 65 nt, hsa
aucugaguguugccugcugaacucggaggggaguuuggagaaauuuuagacagcagcucuguguu

SEQ ID NO: 447940 - RNA, 65 nt, hsa
ucacacuaccaggcccugcagccacaguguucuguuggagaaacuuggggaaguguuuucugaac

SEQ ID NO: 447941 - RNA, 65 nt, hsa
caauaugcucugguuggcaggcaacccuguagucauggagaaagguauuucaagaucuaguccaa

SEQ ID NO: 447942 - RNA, 65 nt, hsa
ccacuucuugagcuuuaucuuuuuugacaauauacuggagaaacuuugaagaacaaguucaaacu

SEQ ID NO: 447943 - RNA, 65 nt, hsa
aaaaaauuuaaauuguccugauucuauuuuguaaauggagaaacaaucauaucuuucuaagcggu

SEQ ID NO: 447944 - RNA, 65 nt, hsa
aagauacuaugcaagaaaauguacaguugucgaaguggagaaaaugaggauauauucuugcagac

SEQ ID NO: 447945 - RNA, 65 nt, hsa
cuaccguugagaagggaagaaaggcugagucuagguggagaaaaauaucaacagaacucuagcca

SEQ ID NO: 447946 - RNA, 65 nt, hsa
caacaauaaucacaauauauucaucccuucaguucuggagaaagccugauaccaggcacagccua

SEQ ID NO: 447947 - RNA, 65 nt, hsa
ggggguaacagucugcaucaucaucacaaccuaaauggagaaagcugugcagaggaaacuuaagc

SEQ ID NO: 447948 - RNA, 65 nt, hsa
aaaaugucagaaaauaacagaugcuggugagguuguggagaaaaagauaugcuuauacacuguug

SEQ ID NO: 447949 - RNA, 65 nt, hsa
cugaggucaggaguucaagaccagccuggccaacauggagaaaccccaucuuuacuaaaaauaca

SEQ ID NO: 447950 - RNA, 65 nt, hsa
guugauuuguugaacaauucaggaaucaagggcuguggagaaacucccucauguuguuggcaaca

SEQ ID NO: 447951 - RNA, 65 nt, hsa
cuaugucauuagguggguacaaaacccaacugauguggagaaaaauugauguuugauguugauag

SEQ ID NO: 447952 - RNA, 65 nt, hsa
gaagcugcuucugcccacaccgcagggacaagcccuggagaaaugggagcuuggggagaggaugg

SEQ ID NO: 447953 - RNA, 65 nt, hsa
uacuggcaugguuaaagugguuuucacuuuuuaaauggagaaaauuucaguuaaauuaauaggau

SEQ ID NO: 447954 - RNA, 65 nt, hsa
agugugccauucgacaacacauuguuauagcuacauggagaaagcucuguggauucaucacugug

SEQ ID NO: 447955 - RNA, 65 nt, hsa
uuugauuuuuuaagguggauuuugguuguuauaaauggagaaagguaagaguucaaguucaaccc

SEQ ID NO: 447956 - RNA, 65 nt, hsa
aauauuagacacuaauauuuucauagaaauuaggcuggagaaagaaggaagaaaugguuuucuua

SEQ ID NO: 447957 - RNA, 65 nt, hsa
agcuuaaggaaugauacugugcucugcuuggugcauggagaaaaaggaagacccguacucuccac

SEQ ID NO: 447958 - RNA, 65 nt, hsa
acauuccagaaguuaaucauuugaauucugaacacuggagaaaaaccgaaaaauggacggggcau

SEQ ID NO: 447959 - RNA, 65 nt, hsa
uggaggacaacuuaucuucacuaagcugaaucagguggagaaaguaaucuccuugcaaucaugug

SEQ ID NO: 447960 - RNA, 65 nt, hsa
aaagagcuuacauucaugugcuacuuuaacaugaauggagaaaauccguuuauggaaguacagug

SEQ ID NO: 447961 - RNA, 65 nt, hsa
ccaauaagaggcucuguuuuccacugaagcuuuguuggagaaagagaauaugaaaauuacacauu

SEQ ID NO: 447962 - RNA, 65 nt, hsa
gugugaagacaugaaaguuuaauguacagaaugguuggagaaaugccuauggugaauuaaagcuu

SEQ ID NO: 447963 - RNA, 65 nt, hsa
aauaaccuugcugauaagaaaaaaagggacaauauuggagaaacuaccucuuguuuaauugaucu

SEQ ID NO: 447964 - RNA, 65 nt, hsa
uggaaacucacuccccuacaaaagauggagcuuaauggagaaauugcaacuuucauuaaaaaaca

SEQ ID NO: 447965 - RNA, 65 nt, hsa
gaagcgaaaagaccaagaucaaauaauagcugggguggagaaaaaaauagcucaagacacaguua

SEQ ID NO: 447966 - RNA, 65 nt, hsa
gaaacugcaucaacaggacaucaaguuaaugaaaauggagaaacugguauguuuccuucagaaug

SEQ ID NO: 447967 - RNA, 65 nt, hsa
ugcuccuccuggcuucuggcuuccauaagaagaaauggagaaaaaaauauauauauauauauugu

SEQ ID NO: 447968 - RNA, 65 nt, hsa
guucugggggaagguguccaccccgaucaagaacauggagaaaguccucuuucaaggcucccauu

SEQ ID NO: 447969 - RNA, 65 nt, hsa
aaucaccugagggcaggagaccagccugacuaacauggagaaaccccaucucuacuaaaaauaca

SEQ ID NO: 447970 - RNA, 65 nt, hsa
acauuauuuaaaauauuugggaguaguauaauuuguggagaaauguaaauuguaauaauguaaau

SEQ ID NO: 447971 - RNA, 65 nt, hsa
ccaaaauagcagaaauuguaaaaauuaugaauuauuggagaaaaugccauuacuuguauaucuga

SEQ ID NO: 447972 - RNA, 65 nt, hsa
gcuggaaauagcuucuauauagucagcaguucaccuggagaaagaucuuaauuccuuguuguuuu

SEQ ID NO: 447973 - RNA, 65 nt, hsa
aaaagucaccuaggcaacugccaaaauagcugaaauggagaaagggcuucaggcuggugacuagc

SEQ ID NO: 447974 - RNA, 65 nt, hsa
agccacagugaguuggucaaaugcuccugacaguguggagaaaccaacaggcaaaacgugggugc

SEQ ID NO: 447975 - RNA, 65 nt, hsa
aaauuugagaccaauuaaauuucaacuguuuaggguggagaaagagguacuggaaaacaugcaga

SEQ ID NO: 447976 - RNA, 65 nt, hsa
ggaaacugauuagauggguuguguuuguguucugauggagaaaacagcaccccaaggacucagaa

SEQ ID NO: 447977 - RNA, 65 nt, hsa
ucugcagaauauuguaauugcaugcauaccgauauuggagaaaucugggucagccaaguuucaug

SEQ ID NO: 447978 - RNA, 65 nt, hsa
aauuuugccacaggguacuaaaagaaacuaugauguggagaaaggacuaacaucuccuccaauaa

SEQ ID NO: 447979 - RNA, 65 nt, hsa
ccuggaauucuccaauggggucgccaaacaacaaauggagaaaaaaaguuuuacuuccuugcauu

SEQ ID NO: 447980 - RNA, 65 nt, hsa
uugcaaaagaaauaggcuuuucuucuuuuuuaaauuggagaaaucucugcucugguugaccuggg

SEQ ID NO: 447981 - RNA, 65 nt, hsa
uuugaaagggaaggaaaauagcuggcauuucuugcuggagaaaguuaucacaaguggaaagguua

SEQ ID NO: 447982 - RNA, 65 nt, hsa
aagacguuuuuaguuuauuuguuguuaaguuaaacuggagaaaguuugucauccucauuuucaaa

SEQ ID NO: 447983 - RNA, 65 nt, hsa
guaucccuuugugaaauuagcacuuuuggggccaauggagaaaugcagcauucacucucccuguc

SEQ ID NO: 447984 - RNA, 65 nt, hsa
ccggggcccccuggucaccgagacucagccucugcuggagaaagccacgcccucccugcuagcac

SEQ ID NO: 447985 - RNA, 65 nt, hsa
gggagccacugagcacagcaaggcaccaaagccccuggagaaaccgccagggcgaggugcgacca

SEQ ID NO: 447986 - RNA, 65 nt, hsa
cuggggauucuagcuccacaaccaggccgugaggcuggagaaacuggcaguuauugcugucaaaa

SEQ ID NO: 447987 - RNA, 65 nt, hsa
gcguccuugugaagcucgucuccauguggcuuucuuggagaaaggcuccccuggggcaagagggu

SEQ ID NO: 447988 - RNA, 65 nt, hsa
cggagaggucaggagaccgaccccaccacuaacuuuggagaaaauguggguuugcuuuuuaaagg

SEQ ID NO: 447989 - RNA, 65 nt, hsa
uuuucuggaaaaguuaaaaaaaguuacaugucauuuggagaaaauacguaaucagaaauuugugc

SEQ ID NO: 447990 - RNA, 65 nt, hsa
uugcaggguuuauauuuuguauagaaucacaguuguggagaaaaaguaauaauuucucaaugaau

SEQ ID NO: 447991 - RNA, 65 nt, hsa
uacuuuuggugucauuauuccaucuucuccauaaguggagaaaugaaaaguaagaacagcucauc

SEQ ID NO: 447992 - RNA, 65 nt, hsa
augguaggacguguaccucuguguguucauggagcuggagaaaccaaaacugggucucucuccac

SEQ ID NO: 447993 - RNA, 65 nt, hsa
uugugagauuaaccuugggacacaguggguuagccuggagaaaaugagaggcccugccuggaccc

SEQ ID NO: 447994 - RNA, 50 nt, hsa
cucccgaugaccgcaugugauggagaaauggucuuagaaacauugaucau

SEQ ID NO: 447995 - RNA, 65 nt, hsa
auuuggucagucacaaauucuuuuuuagccuucccuggagaaaaacaaguccccaagaaaaaauu

SEQ ID NO: 447996 - RNA, 65 nt, hsa
agggaucugggauaaagccacacugucuugcuguauggagaaauucuucaaggggagucaggguc

SEQ ID NO: 447997 - RNA, 65 nt, hsa
gaacuagacuuuccuuugcaccaugugaaguguuguggagaaaagagccagaaguugauguggga

SEQ ID NO: 447998 - RNA, 65 nt, hsa
uuuuaaaaagaagagaaagaagauauacuuugcuuuggagaaaucuacuuuuugacuuacauggg

SEQ ID NO: 447999 - RNA, 65 nt, hsa
uuaaaaauugugaauuauuugaauauucaaagcaauggagaaacaaguuauauaugcugacaguu

SEQ ID NO: 448000 - RNA, 65 nt, hsa
gaggccagugagggaaguggcugggcccuaggccauggagaaaaccuuaaacaaacccuggagac

SEQ ID NO: 448001 - RNA, 65 nt, hsa
cuugauggcauggacuggagcggggacaguggggauggagaaaggggaauggauuguggaugugu

SEQ ID NO: 448002 - RNA, 65 nt, hsa
cuaaggccgggaguucaagaccagccugaccaacguggagaaaccccaucucuacuaaaaauaca

SEQ ID NO: 448003 - RNA, 65 nt, hsa
cugaggucgggaguuugagaccagccugaccaacauggagaaacccagucucuacugaaaauaca

SEQ ID NO: 448004 - RNA, 65 nt, hsa
aggccugccaacucaggggacagauggagcaggaguggagaaagggaaaggcaggucuggggugu

SEQ ID NO: 448005 - RNA, 65 nt, hsa
ugaaaauacauuugacauagaaugaauauuuuuaauggagaaagacucuaguugagaaaaaacau

SEQ ID NO: 448006 - RNA, 65 nt, hsa
gggaagauuuacugguuuaacuagguuguuuuugauggagaaaaaccuuauuuucuuuuguaaga

SEQ ID NO: 448007 - RNA, 65 nt, hsa
uuuuacuaaauauacaagauuuacuacuagaaauuuggagaaagaacacuaacacauguacuugu

SEQ ID NO: 448008 - RNA, 65 nt, hsa
gaacucaugagagacaagcaguaagaaacuucuuuuggagaaacaacagaccagaucuuuacuca

SEQ ID NO: 448009 - RNA, 65 nt, hsa
acuacaguuucacagaauaccugagaagacacacuuggagaaaccuuuuggguguaaugaaugug

SEQ ID NO: 448010 - RNA, 65 nt, hsa
auuugaaaaugucaagcugauuuacuuuauucacauggagaaaagaauccacaaauuaaacugag

SEQ ID NO: 448011 - RNA, 65 nt, hsa
ugaucuuuacacuguaauucucagcauacugauuauggagaaacacuuguuuugauuuuguuaua

SEQ ID NO: 448012 - RNA, 65 nt, hsa
uuuaaacagcaacaauuuaaagcuaugaagucaccuggagaaaaggaacguugcucuuggacagc

SEQ ID NO: 448013 - RNA, 65 nt, hsa
gaaagccuuaagaagauaaaugagcgcagcagagauggagaaauagacuuugccuuuuaccugag

SEQ ID NO: 448014 - RNA, 65 nt, hsa
ggaaugcugguuuaucuuuguagauuguaaucgaauggagaaauuugcaguauuuuagccacuau

SEQ ID NO: 448015 - RNA, 65 nt, hsa
uuuuuaagcaagagaaagacaacuguucugcggguuggagaaaauacaauuuuuuuuuuuuuuuu

SEQ ID NO: 448016 - RNA, 65 nt, hsa
cagccuuuuuaccacugcagaagaaagacacaauguggagaaaucuuaggacugacaucccuuua

SEQ ID NO: 448017 - RNA, 65 nt, hsa
cugaacuggggaauuugaacauuccuuuacauuguuggagaaaugaagccaaaguuauucagaug

SEQ ID NO: 448018 - RNA, 65 nt, hsa
auuuugcuuuuugagccuuaaguguguuaguaggauggagaaacugugauggggacugggaaccu

SEQ ID NO: 448019 - RNA, 65 nt, hsa
auuauguucuuuagacacugcuaccugaaaacuguuggagaaauaauguuuaaaguuauuuaaga

SEQ ID NO: 448020 - RNA, 65 nt, hsa
uuaauagacuuaauacaugcaacagaagugacuucuggagaaagcucauggcuguguccacugca

SEQ ID NO: 448021 - RNA, 65 nt, hsa
uuaaaacccugaugcaaacuucuccuuucagugguuggagaaauuggccgaguucaaccauucac

SEQ ID NO: 448022 - RNA, 65 nt, hsa
aaaaauaauaauuuaagagucucauauggcuaagauggagaaacagguacuggacuuuucccucc

SEQ ID NO: 448023 - RNA, 65 nt, hsa
aaauucuaaccaaaccccagacauagggagucauuuggagaaagccuguaugugguguuuuaacc

SEQ ID NO: 448024 - RNA, 65 nt, hsa
guucuacaucaugcauaguagcuugaaaucuagucuggagaaaacuggaucaagauucuagccca

SEQ ID NO: 448025 - RNA, 65 nt, hsa
uucuggcuugucauucuguacacugaccuuaggcauggagaaaauuacuuguuaaacucuaguuc

SEQ ID NO: 448026 - RNA, 65 nt, hsa
cagaacuguggugccaaauugcuggugucucucuuuggagaaaccaaccagauacaucugcugga

SEQ ID NO: 448027 - RNA, 65 nt, hsa
guaaauuugccaugacuuccuggaggacagcagcauggagaaagauccuagaaaaggucagaccc

SEQ ID NO: 448028 - RNA, 65 nt, hsa
cuuugagcagcuccaggccaagaaacaaauggccauggagaaacgcagagcaguccagaaccagu

SEQ ID NO: 448029 - RNA, 65 nt, hsa
uuacaaggucugcauguaaauggguugccuuauuauggagaaaaaaaaucacucccugaguuuag

SEQ ID NO: 448030 - RNA, 65 nt, hsa
auagggcagcucuuugugaaagugguuuauuccacuggagaaaggggauugaaaaucaguuagaa

SEQ ID NO: 448031 - RNA, 65 nt, hsa
ugcccaguuauuuugccucauuagacaucaagaaauggagaaagacugaaaguuaauaucuuaag

SEQ ID NO: 448032 - RNA, 65 nt, hsa
guaaucagggagcugagagccugguucugugaucauggagaaauacaaaguccuauugauugcuu

SEQ ID NO: 448033 - RNA, 65 nt, hsa
aaaagcuaaauaaccuuuaagaaugugggugguauuggagaaagaagaugaauuauagcuccgga

SEQ ID NO: 448034 - RNA, 65 nt, hsa
cuggaggggaaaaagauccauucuacguauccuuguggagaaaagcuaaauaaccuuuaagaaug

SEQ ID NO: 448035 - RNA, 65 nt, hsa
cuguaucuacucuguggaguagaaccaagucuacuuggagaaaagaaccaaguccuuggauaucu

SEQ ID NO: 448036 - RNA, 65 nt, hsa
ccuuucugcugcuuuugcugcuguaacagcaauaguggagaaaaauguaaaauuuggucuuccag

SEQ ID NO: 448037 - RNA, 65 nt, hsa
cagccgcggcgaggccgucggagaaaacuuaagcguggagaaauguaugcgccagggugcuuccg

SEQ ID NO: 448038 - RNA, 65 nt, hsa
aaaacaaguuuggcagagcaagagacagaagaccguggagaaaucagaagggggaacagucaguu

SEQ ID NO: 448039 - RNA, 65 nt, hsa
ccccugggccuuauccuauagaggcauuuguaauauggagaaaauaauuuuucauuuuugcucau

SEQ ID NO: 448040 - RNA, 65 nt, hsa
agggagggguguuggagagccagugcccuuaagacuggagaaagcugcaauuuaccaaguugccu

SEQ ID NO: 448041 - RNA, 65 nt, hsa
cugaggucgggaguucgagaccagccuuaccaacauggagaaaccccaucucuacuaaaaauaca

SEQ ID NO: 448042 - RNA, 65 nt, hsa
acuuuuccagugcauuacaugguauuguauaucaguggagaaauguauuauuuccaugaucaaau

SEQ ID NO: 448043 - RNA, 65 nt, hsa
gaaucuguuaaauuucacaaagucaugaggguaaauggagaaaauauuucugggauuacaaugaa

SEQ ID NO: 448044 - RNA, 65 nt, hsa
aaugcagauuacacugaucuuauguguuacaaaauuggagaaaguauuuaauaaaaccuguuaau

SEQ ID NO: 448045 - RNA, 65 nt, hsa
cugggaccuucucugguagcugccagaccggcugguggagaaacaggagacaaucuggggacuga

SEQ ID NO: 448046 - RNA, 65 nt, hsa
auuucccagugugucuuuuaugucuuugaauguuuuggagaaaagucuaugccugucuaaaaaug

SEQ ID NO: 448047 - RNA, 56 nt, hsa
auggcucucucaagccaugaccacauuggagaaaugguuuuuauugucaaccuuaa

SEQ ID NO: 448048 - RNA, 65 nt, hsa
uagucaguuuaguucauauguucugaaaacuguuuuggagaaagauagacagaaaaaugucauca

SEQ ID NO: 448049 - RNA, 65 nt, hsa
gccaugaauuaagauggaugacuggaaaaagguguuggagaaagaguuaaagaugaggaagagau

SEQ ID NO: 448050 - RNA, 58 nt, hsa
agaauccccugacuggauaacucagggcuggagaaacaaagauuauaaagcacgagaa

SEQ ID NO: 448051 - RNA, 65 nt, hsa
auaguaaaagaaaaagggguaucagucuaaucucauggagaaaaacuacuugcaaaaacuucuua

SEQ ID NO: 448052 - RNA, 65 nt, hsa
ugaaacccaaucuuucaaaacaugaaagggggugauggagaaaaccuuagcuugguugucuaaag

SEQ ID NO: 448053 - RNA, 65 nt, hsa
gauuuucuacaugaaucaaacacagaaacaacuuuuggagaaauuaaauucugagugugacuucu

SEQ ID NO: 448054 - RNA, 65 nt, hsa
uggccuccaccccuucccuguuuguaaauauucuguggagaaaagaggacuucagggaguaaaaa

SEQ ID NO: 448055 - RNA, 65 nt, hsa
cgcuccccugacacugaagaggauccacaacuccuuggagaaacacccucacgucuguugccgca

SEQ ID NO: 448056 - RNA, 65 nt, hsa
gauggggugggcagggcugggagaacuuuguacaguggagaaauauuuauaaacuuaauuuugua

SEQ ID NO: 448057 - RNA, 65 nt, hsa
guaccuagguuggaguccagccuaaucaagucaaauggagaaacaggcccagagaggaagguggc

SEQ ID NO: 448058 - RNA, 65 nt, hsa
ggacaacccagcagggaguuccggggaguccgaaguggagaaaggcuggugggaacauggaggcc

SEQ ID NO: 448059 - RNA, 65 nt, hsa
caauucacuuucuugagaggacaaaugaaaagcuguggagaaaauguccucauuaaaguauuaaa

SEQ ID NO: 448060 - RNA, 65 nt, hsa
ugccaaguucaguguggauuuuucuuggugcucuauggagaaauggagucugugugcuuacugaa

SEQ ID NO: 448061 - RNA, 65 nt, hsa
uggagugcuugggcagaaaguuguaaaguuugugcuggagaaagguuuauuuggacuuugauuac

SEQ ID NO: 448062 - RNA, 65 nt, hsa
ucauguugcacacucuuugacagcaugcuguuuuguggagaaacuugcauucaugaagagcccau

SEQ ID NO: 448063 - RNA, 65 nt, hsa
ucuuauuccuauaagcuauguguucagacugaaacuggagaaauuaugacuauuuuauuuauagu

SEQ ID NO: 448064 - RNA, 65 nt, hsa
aaaaguauauucucacaguuuuuccccaggaagucuggagaaaaaguccucaugucaccaauuuc

SEQ ID NO: 448065 - RNA, 65 nt, hsa
agguuuaaaauaagugugcacuuggacauaaagacuggagaaauaaacacugaggacuccaaaag

SEQ ID NO: 448066 - RNA, 65 nt, hsa
ccacaggcacauaauucaacagcuuuaggggaacauggagaaagaaggagaccacauaccccaaa

SEQ ID NO: 448067 - RNA, 65 nt, hsa
acuugagcuugccacucuguauaauucuaacauccuggagaaaaauggcaguuugaccgaaccug

SEQ ID NO: 448068 - RNA, 65 nt, hsa
cuguucauguauguaggaguuaaaauaggccaaacuggagaaauaaacgcauucuguccaccaug

SEQ ID NO: 448069 - RNA, 65 nt, hsa
cacuuagcagcaacugaagacaauuaucaaccacguggagaaaaucaaaccgagcagggcugugu

SEQ ID NO: 448070 - RNA, 65 nt, hsa
guccauauccagguuagcugguaagaggauuuuuuuggagaaaaaaaugauauuuagaaaguuaa

SEQ ID NO: 448071 - RNA, 65 nt, hsa
ugauuagagggucucuggucauuuccacuuguguguggagaaauacaucauuugcauauguaucu

SEQ ID NO: 448072 - RNA, 65 nt, hsa
uauagcuugcccucacuugcucaaaaacaacuaccuggagaaaacagugccuuuccuugcccugu

SEQ ID NO: 448073 - RNA, 65 nt, hsa
uuaacaagcugauguagaggguggagcacuguauguggagaaauuccuucuacaauauuccacac

SEQ ID NO: 448074 - RNA, 65 nt, hsa
gcauguggacucuuaacuguacguguaguuucuaguggagaaaucaaggcucugaucauuuuguu

SEQ ID NO: 448075 - RNA, 65 nt, hsa
gcccccuucuuguccccuuugaggggcacuuaagauggagaaaucaguugugguuucagugaauc

SEQ ID NO: 448076 - RNA, 65 nt, hsa
cugagggugcccaccaagcccaccuuccagaaacuuggagaaauggggguugggaacuuaugcag

SEQ ID NO: 448077 - RNA, 65 nt, hsa
ccagcugugguuggaucaaggacucauuccugccuuggagaaaauacuucaaccagagcagggag

SEQ ID NO: 448078 - RNA, 65 nt, hsa
uaugaaaaggaaucugaaggucaugaaaaguccaguggagaaaaucucaaugcuuacuguuacua

SEQ ID NO: 448079 - RNA, 65 nt, hsa
agcaugaaagucaaaacuggaauuuucuaaagcuuuggagaaaaggagagaauuaguagggcaag

SEQ ID NO: 448080 - RNA, 65 nt, hsa
uugccaaguugucuuugcucuuagguggguuauccuggagaaaauggacucaggagcuaauacug

SEQ ID NO: 448081 - RNA, 65 nt, hsa
aacagaaagcaucagcucugcuucgugacagucucuggagaaaucccuuaggaagacuaugagag

SEQ ID NO: 448082 - RNA, 65 nt, hsa
uaaaaaauuuuacugucuaaauaaguaccuuuuauuggagaaaaaucaaaaccccaaacaaacac

SEQ ID NO: 448083 - RNA, 65 nt, hsa
ucauuccaagaaccagcccauugcuacagcuagaguggagaaaaacagagugacucaaaagccau

SEQ ID NO: 448084 - RNA, 65 nt, hsa
gaaguaccauuagguuuaauuuuaauuuguuuugcuggagaaacaucagguuuguaggagacuga

SEQ ID NO: 448085 - RNA, 65 nt, hsa
gucacaaauuucuagucaauguguucuuaacuggguggagaaagaauggaaaaccuucaagaucu

SEQ ID NO: 448086 - RNA, 65 nt, hsa
gcucuaacauuacugccuucaguaucaaggcugccuggagaaaggauggcagccucagggcuucc

SEQ ID NO: 448087 - RNA, 65 nt, hsa
aagaaucauccugucccaugucaacauuauacccauggagaaacacuggcauggauuugcacuag

SEQ ID NO: 448088 - RNA, 65 nt, hsa
agcccaccucauguccagcuguccacuuuccauccuggagaaagaacagugugccucaaacuccu

SEQ ID NO: 448089 - RNA, 65 nt, hsa
acucuuugugcaagugccuuccugagcagaagaacuggagaaagggaaccacagagccaggagga

SEQ ID NO: 448090 - RNA, 65 nt, hsa
cugagguagggaguucgagaccagccugaccaacauggagaaaccccaucucuacuaaaaauaaa

SEQ ID NO: 448091 - RNA, 56 nt, hsa
uccucaaaaucuggaacugaggaggcuggagaaagggaaguggaaggcagugaaca

SEQ ID NO: 448092 - RNA, 65 nt, hsa
guuucuuuuuuuuuuuuuuuccuauuggaucuuccuggagaaaauacuuuuuuuuuuuuuuuuuu

SEQ ID NO: 448093 - RNA, 65 nt, hsa
agagaaagguuuuagacuccaguuuaccuuucucuuggagaaacucaaugcuaaucccaccuuuu

SEQ ID NO: 448094 - RNA, 65 nt, hsa
uguuuacaaauucagaauuuugauagggguagauauggagaaagaccuauuuccugggucucugc

SEQ ID NO: 448095 - RNA, 65 nt, hsa
aaaaagauaagagauagcaagugucagcaagggucuggagaaaagggaauuuuuguauacuguug

SEQ ID NO: 448096 - RNA, 65 nt, hsa
gaaccugauguaccugaagcagauccuguauuugcuggagaaauucguggcugugcuagggggug

SEQ ID NO: 448097 - RNA, 65 nt, hsa
auucacucacuccacccugccucugcaucccuuaauggagaaacgggccuaaaaccaaacgggua

SEQ ID NO: 448098 - RNA, 65 nt, hsa
uggacaggacccagcccugcaccguucacuguauuuggagaaaaugguaagaguuccauaccggc

SEQ ID NO: 448099 - RNA, 65 nt, hsa
cuucaagaggaagauagauuuucuaaccaagcagauggagaaaauccaaccagcucuucaggaga

SEQ ID NO: 448100 - RNA, 65 nt, hsa
cuguauguuguaucuuuugcauguagcuuccuuaauggagaaaaaaaaaccuaauaaauuuccag

SEQ ID NO: 448101 - RNA, 65 nt, hsa
gcugaguucuuaaagacugaagacaggcuauucucuggagaaaaauaaaauggaaauuguacuua

SEQ ID NO: 448102 - RNA, 61 nt, hsa
aacuggcacaacguccuuaauuggguuuuuguggagaaaagaauguugucccaagaagaua

SEQ ID NO: 448103 - RNA, 65 nt, hsa
uugaggucaggaguucgagaccagccugaccaacauggagaaacccugucucaacuaauaauaca

SEQ ID NO: 448104 - RNA, 65 nt, hsa
guaguaagcuaaacugaaaauaaggugggcuucacuggagaaauggacuuacugcaaaugcugug

SEQ ID NO: 448105 - RNA, 65 nt, hsa
acaugagauggaaucaggcagagaggcugggaugauggagaaagcucgaggugaaguuuuaaaaa

SEQ ID NO: 448106 - RNA, 65 nt, hsa
uugcucuuuucaaaaccuaccagucccacuguggguggagaaauaaauggucuuucuccuccucg

SEQ ID NO: 448107 - RNA, 65 nt, hsa
cagccuuuccuacauccuucccucacucccaugauuggagaaaugauucauugggugaugagugu

SEQ ID NO: 448108 - RNA, 65 nt, hsa
acuggggagcucacuugagcucuugauaagaaauguggagaaaaguaaaaaccaagcuuugaaga

SEQ ID NO: 448109 - RNA, 65 nt, hsa
uguccauugauugacaugagcaccccuguuuucucuggagaaauaccuccccucucuggggugcu

SEQ ID NO: 448110 - RNA, 65 nt, hsa
gugaaguaauauggcccacacuuuauucaccacccuggagaaaaaaaaacccaggaauaugugga

SEQ ID NO: 448111 - RNA, 65 nt, hsa
aauuccuaccaggaaagaauacauauccaauagauuggagaaagccagagauuagcccucauucc

SEQ ID NO: 448112 - RNA, 65 nt, hsa
gcacagcacuccuguaacugucucagaaccacuccuggagaaagacuuccuugcaggagugacuc

SEQ ID NO: 448113 - RNA, 65 nt, hsa
ucuccacagugagagcaacauuaagggcaaagccauggagaaaugugggagaggccggccucaaa

SEQ ID NO: 448114 - RNA, 65 nt, hsa
aaggaucugauacaucuaguuauuggucuggaaauuggagaaauggaggugagcaaauuaacggu

SEQ ID NO: 448115 - RNA, 65 nt, hsa
cucuugugugcugugggcacuggaguagagauuucuggagaaaaaaaaacaguuuauuucaucuu

SEQ ID NO: 448116 - RNA, 65 nt, hsa
ugccagaaaaggcuucuguucacaacaguggcccauggagaaagaggcucuuauuaaacuuagau

SEQ ID NO: 448117 - RNA, 65 nt, hsa
acauguucccgccugcaaauauauuguuauuuugguggagaaaaaaauaguauauucuacauaaa

SEQ ID NO: 448118 - RNA, 65 nt, hsa
uaauuaaagaaccuggugggugugcacuaugagauuggagaaaugaauuaaguugacuugaaauu

SEQ ID NO: 448119 - RNA, 65 nt, hsa
cugaggucgggaguucgagaccaaccugaccaacauggagaaacccugucucuauuaaaaauaca

SEQ ID NO: 448120 - RNA, 65 nt, hsa
ccucuucuguugccaaauagaaaagggucagggcauggagaaaggugacccugaucccaaaccug

SEQ ID NO: 448121 - RNA, 65 nt, hsa
ggucuucucugcaccaaccacucucugcagauggcuggagaaagggugugccaacucuucaccuu

SEQ ID NO: 448122 - RNA, 65 nt, hsa
cacaggacugaagcuuaauugggaauuuggcuuuauggagaaaagaaucuuuuucaaaguuugug

SEQ ID NO: 448123 - RNA, 65 nt, hsa
cuugcagacuggauaugcaagcaaacgggcaacucuggagaaaaauaaggaaaggaaugcugacu

SEQ ID NO: 448124 - RNA, 65 nt, hsa
aagugggaauggcuauauacauggcuuuaguagucuggagaaaucuacuccccuuggccaggaca

SEQ ID NO: 448125 - RNA, 65 nt, hsa
acugcaacccuaacucacucuagugggaccuugacuggagaaacuccacgaucuuccugaagaag

SEQ ID NO: 448126 - RNA, 65 nt, hsa
auuucuuucugcuuccacuauuugguguugggcacuggagaaaaacgaagccaagagaauaugaa

SEQ ID NO: 448127 - RNA, 65 nt, hsa
gaauuaaauacauuucauugagcuuuaaaguacuuuggagaaacuuuggggcacguuuuccuacu

SEQ ID NO: 448128 - RNA, 65 nt, hsa
uauaaaagaaguugugcuauuuaacucugaauacuuggagaaacuaggugaagaugcaaccagaa

SEQ ID NO: 448129 - RNA, 65 nt, hsa
uaauuugaaauaacagccuuaaauccuuuacaagauggagaaacaacaaauaagucaaaauaauc

SEQ ID NO: 448130 - RNA, 65 nt, hsa
cccacugcuggacacguccccgacucguggccacauggagaaacaggcaaaccagaaucacugug

SEQ ID NO: 448131 - RNA, 65 nt, hsa
ugauauuuggaacuuuauuccaaaaguagugcauguggagaaagaaucuagacuuucuuguauac

SEQ ID NO: 448132 - RNA, 65 nt, hsa
auugcacaucaguaugugccaaaucuacuagacauuggagaaacaguaggaacaacacaugguac

SEQ ID NO: 448133 - RNA, 65 nt, hsa
uuuauuucugcagguuggugaaaacccuguguccuuggagaaagcugguucccguuuuccagagg

SEQ ID NO: 448134 - RNA, 65 nt, hsa
caagaagggacauugucaccaagaaccaggaucucuggagaaacaguugggcuguugcaucgagu

SEQ ID NO: 448135 - RNA, 65 nt, hsa
cugaggucaggaguucuagaccagccugaccaacauggagaaaccucgucucuacuaaaaauuca

SEQ ID NO: 448136 - RNA, 65 nt, hsa
cugaggucacgaguucgagaccagccugaccaacauggagaaacccugucucuacuaaaaauaca

SEQ ID NO: 448137 - RNA, 65 nt, hsa
aggcccugguggggcuggagucucaccuguuugcauggagaaaugggcuggccccacagccucac

SEQ ID NO: 448138 - RNA, 65 nt, hsa
uagagcccugauuaacuucaaggacaaacacuggcuggagaaagccagacugaugggaaugagac

SEQ ID NO: 448139 - RNA, 65 nt, hsa
cuugagacucuugaagaaaauucagaaugaaguucuggagaaagguauguuacuguaguaauuac

SEQ ID NO: 448140 - RNA, 65 nt, hsa
guucaaaccaaagaaacaaugaucuacucaaacauuggagaaaaaaacugccagaggaggaguug

SEQ ID NO: 448141 - RNA, 65 nt, hsa
uaauuuaagaugcuauguaucuguuauuuaaaacauggagaaacagggccuuuauuccauucaua

SEQ ID NO: 448142 - RNA, 65 nt, hsa
aaguuuccuaaaguuucuucaaguauuuuuuaagguggagaaaugcaggaauuguauaaccagaa

SEQ ID NO: 448143 - RNA, 65 nt, hsa
ccagcuuucgucugucaucagacauugaagagauuuggagaaauguaaagcagcaguacucuucu

SEQ ID NO: 448144 - RNA, 65 nt, hsa
cuccuagauagauucauucuaucuaguuguggggauggagaaaucuuuaaugguauauuuucggu

SEQ ID NO: 448145 - RNA, 65 nt, hsa
ccuuuuaagccaugggugggucuaacuggcuuuuguggagaaauuagcacaccccaacuuuaaua

SEQ ID NO: 448146 - RNA, 65 nt, hsa
uuauguuuguaaguuuggcuuugugggaauagguguggagaaauuaaagagugaaggccauauuu

SEQ ID NO: 448147 - RNA, 65 nt, hsa
uuauguauguucagccagauaguaaaugggauuuuuggagaaauaagauaacuacaaaguuucua

SEQ ID NO: 448148 - RNA, 65 nt, hsa
cccgcccccagcagugucgcuccaauucaaauuaguggagaaaagauuacaguaggcccugagcc

SEQ ID NO: 448149 - RNA, 65 nt, hsa
uugcaucacugaggaugaaacugacuuuugucuuuuggagaaaaaaaacuguacugcuuguucaa

SEQ ID NO: 448150 - RNA, 65 nt, hsa
cauaauagagauugauaagauuuagcaacugguguuggagaaaaaaagaaaagcaaaugaguguu

SEQ ID NO: 448151 - RNA, 65 nt, hsa
acccccacaaggggagaaaaaguaggggaagcggauggagaaaaacccaaagccacuaguauuag

SEQ ID NO: 448152 - RNA, 65 nt, hsa
ggccaaaagucggaaaaugagaaugaggguaauccuggagaaauugugacaacaauuugaaaauu

SEQ ID NO: 448153 - RNA, 65 nt, hsa
auuugugggggaaaaaaaaggagaguauagaaugauggagaaaaauggaccaaaggcuaaaaaua

SEQ ID NO: 448154 - RNA, 65 nt, hsa
cuuuuccaguauuaaacacucauaugcuuauggcuuggagaaauuucuuaguugggugaauuaaa

SEQ ID NO: 448155 - RNA, 65 nt, hsa
aagccuggcugcagcuucccauuugguuacgagguuggagaaaaagucaaaguccccuccugggc

SEQ ID NO: 448156 - RNA, 65 nt, hsa
agagauuagagauaauugucuaguuagggggcagcuggagaaaauaagcuaaguuugcaauaaca

SEQ ID NO: 448157 - RNA, 65 nt, hsa
uauagcaucuggaagaucauuuugaaauuguuccuuggagaaaugaaaacaguguguaaacaaaa

SEQ ID NO: 448158 - RNA, 65 nt, hsa
uuugugaaaauaaagaacucuguagcucaccaagguggagaaacgcaauucagaaaaguaauuuc

SEQ ID NO: 448159 - RNA, 65 nt, hsa
uaauauggaaaggggggaaaagaguaacuuuacaguggagaaaucugacagacaccagcucagcc

SEQ ID NO: 448160 - RNA, 65 nt, hsa
cugccuuucccaaaugggaaaggugcugacagaguuggagaaaaaagaauagacucauuuuuccc

SEQ ID NO: 448161 - RNA, 65 nt, hsa
aggccuggggcuaugcauacgcauuaagggccugcuggagaaaccuucacuccagacagacaggg

SEQ ID NO: 448162 - RNA, 65 nt, hsa
agacaguuacuagcaauggggaaugcuugucacuguggagaaagaguuuuguauaugucugauac

SEQ ID NO: 448163 - RNA, 65 nt, hsa
guagccucagaagcagagcuguuuggcagacuggcuggagaaauucccucuaggagacuugccug

SEQ ID NO: 448164 - RNA, 65 nt, hsa
ugcuugugcugggaaaugcaacucacucauguauuuggagaaacaggaguguucacuuaucuagu

SEQ ID NO: 448165 - RNA, 65 nt, hsa
uuauuugguuagagugauauguauuuagccauagauggagaaacaaagcucaggguuuguugaau

SEQ ID NO: 448166 - RNA, 65 nt, hsa
ucaaugcuuauauauuccuuagacuauugaaauuuuggagaaaauguauuuguguucacuucuau

SEQ ID NO: 448167 - RNA, 65 nt, hsa
ccaucugucaugacuguuuggcaaauggaaaccgcuggagaaacaaaauugcuauuuaccaggaa

SEQ ID NO: 448168 - RNA, 65 nt, hsa
aucuagugaauaaaaaaauuaguuugaaagauaucuggagaaaucgcauucauaaaacaauugga

SEQ ID NO: 448169 - RNA, 65 nt, hsa
uacaaaaaugaaaauauuuauaauaggacucgacuuggagaaauugcuauucuuccuguugucca

SEQ ID NO: 448170 - RNA, 65 nt, hsa
ucuuaguugucauaaucccuuggagccuggguuuuuggagaaagagaucuccgugcccuacagac

SEQ ID NO: 448171 - RNA, 65 nt, hsa
cccccuaagagacacauacagagugggccccgggcuggagaaagagcugccuggaugagaaacag

SEQ ID NO: 448172 - RNA, 65 nt, hsa
ucugggugccagaucccagcacuacuuuuuauuacuggagaaaugggggggauagaaaauucuac

SEQ ID NO: 448173 - RNA, 65 nt, hsa
aagaauuucuggaagaaaggcuguggaagggccaauggagaaaaugaauggacaaagcucaggaa

SEQ ID NO: 448174 - RNA, 65 nt, hsa
augugugcagacaauucucccugagguuagcccaauggagaaaugaagcagaggaaggaaacaua

SEQ ID NO: 448175 - RNA, 65 nt, hsa
acuaaaaugaaccaaacccauauuucacuggugguuggagaaaaccauggccaaaacgauugugg

SEQ ID NO: 448176 - RNA, 65 nt, hsa
aaaugaauugaaccauuucaacuauuuucuauauuuggagaaaguuugugcccuguguuuuauaa

SEQ ID NO: 448177 - RNA, 65 nt, hsa
uaucaacagcaaacuucagccguuucacuuuuuguuggagaaaaauaguagauuuuaauuugacu

SEQ ID NO: 448178 - RNA, 65 nt, hsa
cacugugccccacaaaacuucagugugguacaagguggagaaagcauaucccaccaaccuccagu

SEQ ID NO: 448179 - RNA, 65 nt, hsa
cucagggacccccaggaccaggaugugucucagccuggagaaauggugggggggcagugucuagg

SEQ ID NO: 448180 - RNA, 65 nt, hsa
cugaagucaggaguucgagaccagccugaccaccauggagaaaccccgucucuacuaaaaauaca

SEQ ID NO: 448181 - RNA, 65 nt, hsa
gagggcaggcuuggggaaaauggccaugcaggagguggagaaaauuggaacucuacucaacccau

SEQ ID NO: 448182 - RNA, 65 nt, hsa
aaccuuugcacacucaccugagcccuggggacccuuggagaaauuaggugucaccugcuguggca

SEQ ID NO: 448183 - RNA, 65 nt, hsa
ucucccuuaauaaaggagaaaaauauacugauggcuggagaaauuuuucucugccuuucaguuuu

SEQ ID NO: 448184 - RNA, 65 nt, hsa
cugagguugggaguucgagaccagccugaccaacguggagaaaccccgucucuacuaaaaauaug

SEQ ID NO: 448185 - RNA, 65 nt, hsa
caggcagucagguccaugugcacugcaaugccagguggagaaaucacagagagguaaaauggagg

SEQ ID NO: 448186 - RNA, 65 nt, hsa
uugauaccaaacaauucaaaaguuggaucugaguuuggagaaagauauuuccaaccuaagugggu

SEQ ID NO: 448187 - RNA, 65 nt, hsa
caagucagggggccacucugccucauuuaugcaaauggagaaaggcgcccucccuggggucccuu

SEQ ID NO: 448188 - RNA, 65 nt, hsa
gagggccguaccccacccucagcaccccuuccauguggagaaaggagugaaaccuuuagggcagc

SEQ ID NO: 448189 - RNA, 65 nt, hsa
ugguggcacugagcccccccaacacugugcccugguggagaaagcacugaccugucaugcccccc

SEQ ID NO: 448190 - RNA, 65 nt, hsa
caaggaguccuuccacccugccuucagguucucucuggagaaagguuagagaccccaggacaauc

SEQ ID NO: 448191 - RNA, 65 nt, hsa
gugcauuuaaggagauugggagacaauuagcagaauggagaaaguaagucuuuuuuuuuuccaaa

SEQ ID NO: 448192 - RNA, 65 nt, hsa
uuagaagucugcuaaagaucaaaugugaaaguacuuggagaaacugaggccucuuauguguaaug

SEQ ID NO: 448193 - RNA, 65 nt, hsa
aagagaaauuguccaaagaguccucagaaccugccuggagaaaugcgcaugggggugggccuggu

SEQ ID NO: 448194 - RNA, 65 nt, hsa
gauaccaauugaccugaacuuuagaaucuuauuuauggagaaaaacuuguaaagcugcauauuca

SEQ ID NO: 448195 - RNA, 65 nt, hsa
uucuguggagguggaaaagcaacauucauagucuuuggagaaaugcuuagaaauucagcauuuga

SEQ ID NO: 448196 - RNA, 65 nt, hsa
uaauaucuuuuaucaguguucagaucauagauuaauggagaaaacauuuaaaauuguuuuaaauu

SEQ ID NO: 448197 - RNA, 65 nt, hsa
caaucaucuaaaagccagccacugucagcaaagccuggagaaaugggaccagagagucugccccu

SEQ ID NO: 448198 - RNA, 65 nt, hsa
ccgcuuuauggagcucaugcaggagaaugagcggguggagaaacuggaaugucgcugcauucagc

SEQ ID NO: 448199 - RNA, 65 nt, hsa
aagcuaaacuucuucaccccugagagcaugucagcuggagaaaagcaguucuuccuugcccacuu

SEQ ID NO: 448200 - RNA, 65 nt, hsa
cacccacuuggcuaugggagagccagcagggguucuggagaaagaaacugguggguuagggccuu

SEQ ID NO: 448201 - RNA, 65 nt, hsa
agaaguucugccucugccuggggucuuggccacauuggagaaaaacaggcucaaaguggggcugg

SEQ ID NO: 448202 - RNA, 65 nt, hsa
uggagggacagugauggccuuugacucaugaggccuggagaaaaguaucaaaggucucaccaugu

SEQ ID NO: 448203 - RNA, 65 nt, hsa
ccuaccccggcaggggcuuccggggccuuuucaccuggagaaacauucccacuccccuuuggccu

SEQ ID NO: 448204 - RNA, 65 nt, hsa
acagacucugagaagcgaagaccaugucuccucguuggagaaacccaauagcaggggaagcuggg

SEQ ID NO: 448205 - RNA, 65 nt, hsa
uuuccuuggggcugcaguuuugugguugaggggccuggagaaaaucauuuucuccccuuggcagu

SEQ ID NO: 448206 - RNA, 65 nt, hsa
cuaaguuggggaguucaagaccagccugaccaacguggagaaacuccgucuccacuaaaauacaa

SEQ ID NO: 448207 - RNA, 65 nt, hsa
uguguguaaugcaaauuaguuaaaacaaauaguuuuggagaaaguuaaaacuagcuuuagaguaa

SEQ ID NO: 448208 - RNA, 65 nt, hsa
ccguuugugaauaaacuguucuucaucauugacacuggagaaagguguccuccaugcccucaggc

SEQ ID NO: 448209 - RNA, 65 nt, hsa
aagucuguuauuaggaauaauccuuagccauguaauggagaaaggagcagucagcauucuuccaa

SEQ ID NO: 448210 - RNA, 65 nt, hsa
augaaccagcuguaaaaacacauuucuggaacaacuggagaaaccggaguaugcccuggacugga

SEQ ID NO: 448211 - RNA, 65 nt, hsa
uuuccuuccuuggaagagaaugucugaucuaaauguggagaaacuguagucucaggaccuaggga

SEQ ID NO: 448212 - RNA, 65 nt, hsa
acaacuaggauguguugggugagauguuucagaucuggagaaaugagcaggugucgggaaaugug

SEQ ID NO: 448213 - RNA, 65 nt, hsa
agggaauguucuaaaacuuuuucuuccuuaaaaaauggagaaaauugcacuugugcuugcugugu

SEQ ID NO: 448214 - RNA, 65 nt, hsa
auaggaacaugcacaaagcaguuaauuaggcagccuggagaaaaccagagauccaguacagaaag

SEQ ID NO: 448215 - RNA, 65 nt, hsa
ccaccuccccuugggcccacaccuccuucccucucuggagaaagggcccugggccugccucacca

SEQ ID NO: 448216 - RNA, 65 nt, hsa
aguguggugaugccaugcccaucaugggaggcuuuuggagaaacagaauguuugggcaggggcug

SEQ ID NO: 448217 - RNA, 65 nt, hsa
cugaggucgggaauucgagaccagccugaccaacauggagaaacuccaucucuacuaaaaauaca

SEQ ID NO: 448218 - RNA, 65 nt, hsa
agcagggguuggagccauggccuucugggaaccuauggagaaagggaauccaaggaagcagccaa

SEQ ID NO: 448219 - RNA, 65 nt, hsa
uuuguugaaauagcuuuacuguuucucaaguguuuuggagaaaaaaaucaacccugcaaucacuu

SEQ ID NO: 448220 - RNA, 65 nt, hsa
uuggccaaagugaaggaaucuuuuuucaguuuuauuggagaaacugaaggguaacauucuaacaa

SEQ ID NO: 448221 - RNA, 65 nt, hsa
aauuuauaauuuugaucgaguuucuuaaaagacccuggagaaagaguggcauuucuucuguuuca

SEQ ID NO: 448222 - RNA, 65 nt, hsa
aucagaauucucccacaccaagugcaugucaguuguggagaaaacauagcaaaaagagccguacg

SEQ ID NO: 448223 - RNA, 65 nt, hsa
uugcugcccaucuggccugugugcccaucuuuuucuggagaaagucagauucacagcaugacaga

SEQ ID NO: 448224 - RNA, 65 nt, hsa
cucccagaaaaauuacaggcagaagucacagaaaauggagaaaacuucucaguaggggaacguca

SEQ ID NO: 448225 - RNA, 65 nt, hsa
cguggacagccucagggggcugucggccaagagccuggagaaagggagcaagcugcccccuccuu

SEQ ID NO: 448226 - RNA, 65 nt, hsa
aaccggccucaugacuagccuuguugccgucgaguuggagaaaguggugcugaaauccaccuuua

SEQ ID NO: 448227 - RNA, 65 nt, hsa
auuuucuagaaauaaacaguuauggaggacuuguauggagaaauuuaagucuucacugagggcca

SEQ ID NO: 448228 - RNA, 65 nt, hsa
caguuguuugaaguuuucagggauaacauaccugauggagaaauguuuuguguguaugauauaug

SEQ ID NO: 448229 - RNA, 65 nt, hsa
aauuaguuuuccucucacuuggccuugcagcuaaauggagaaauguuucaauuucuuugaauacu

SEQ ID NO: 448230 - RNA, 65 nt, hsa
cuaugucggcugagcuaccaagguggaaguuuucauggagaaaagcaccuggcuccagggccagu

SEQ ID NO: 448231 - RNA, 65 nt, hsa
gugugauggugcaaggaauggauucaggauguuguuggagaaacaaguuugugauuaguccuuaa

SEQ ID NO: 448232 - RNA, 65 nt, hsa
gccggccugggagaaagacucacgagaaaagccaguggagaaagcgcccuuccagggcggcagca

SEQ ID NO: 448233 - RNA, 65 nt, hsa
cggauggugaggacacagcuaugaucagggaauuuuggagaaacuacagcaucauggaugcugug

SEQ ID NO: 448234 - RNA, 65 nt, hsa
caccugaggucaggaguucgagaccagccucaacauggagaaaccccgucucuauuaaaaauaca

SEQ ID NO: 448235 - RNA, 65 nt, hsa
uuuuccugaaguuuuauuccauuauauugacaagauggagaaagcaagaucaugaaggugugcaa

SEQ ID NO: 448236 - RNA, 65 nt, hsa
aacugaagaaagagaagucacaacaaaaggaagacuggagaaaugcuuacuucuagagggagaag

SEQ ID NO: 448237 - RNA, 65 nt, hsa
cugaggucaggaguuugagaccagccuggccaacauggagaaacuccgucuccgcuaaaaauacg

SEQ ID NO: 448238 - RNA, 65 nt, hsa
cugaggucgggaguuugagaccagcccgaccaacauggagaaacccugucucuacuaaaaauaca

SEQ ID NO: 448239 - RNA, 65 nt, hsa
guuuucuuuuuuuagggagaagggcuuuucuuuaguggagaaauggaacucgccccccuaccccc

SEQ ID NO: 448240 - RNA, 65 nt, hsa
uuugccaagaagugaucuguuuuaaaggucauauuuggagaaagggcaaggaauugggucugcuu

SEQ ID NO: 448241 - RNA, 65 nt, hsa
uuaccuggugcugcgucuugcuuuugguuuccagcuggagaaaagaagacaagaaagucuugggc

SEQ ID NO: 448242 - RNA, 65 nt, hsa
ccacuguggacgcccuggggcuuggcacccaccucuggagaaacucggggccaccuccacuccau

SEQ ID NO: 448243 - RNA, 65 nt, hsa
uuauaaaccacugaaagggauagagaagugaacauuggagaaagccaguagcaacugugagaaau

SEQ ID NO: 448244 - RNA, 65 nt, hsa
ccccucccgcugccccagaaguuucuaucauuccauggagaaagcuguguuccaaugaauccuac

SEQ ID NO: 448245 - RNA, 65 nt, hsa
aagccaaagcugggcucaguggggaaggucaggaauggagaaauugccuuuucucguuagccucc

SEQ ID NO: 448246 - RNA, 65 nt, hsa
cugaggucaggaguucgaaaccagccuggccaacauggagaaaccccaucucuacuaaaaauaca

SEQ ID NO: 448247 - RNA, 65 nt, hsa
caagcccuuggggugacucggcuuccaggagcuguuggagaaaugaggaugucugucccugucug

SEQ ID NO: 448248 - RNA, 65 nt, hsa
cugaggucaggauuucgagaccaaccugaccuacauggagaaacuccgccucuaguaaaaauaca

SEQ ID NO: 448249 - RNA, 65 nt, hsa
ucugacuuggaaaguuggagaagaggcauuccuacuggagaaaaaugucaguguuuuccuauaag

SEQ ID NO: 448250 - RNA, 65 nt, hsa
uaguuagugauaagauguucaucccagcauugcaauggagaaaaaugggaagcaaugguuugguu

SEQ ID NO: 448251 - RNA, 65 nt, hsa
aucguuccgagaggucuggagggccccgugguuccuggagaaagcaggacgcagagaagaacaaa

SEQ ID NO: 448252 - RNA, 65 nt, hsa
gggagagcuugaccuccaucuagguuucuuuuaucuggagaaaaagaacacuuuugaacuaugua

SEQ ID NO: 448253 - RNA, 65 nt, hsa
cagugagaauucgugcaucucugcucugugggguuuggagaaaugcuuuggcagaagagugaaag

SEQ ID NO: 448254 - RNA, 65 nt, hsa
gguacugaaaguguaauuucuuagagccaaaaaacuggagaaacaaauauccugccaccucuaac

SEQ ID NO: 448255 - RNA, 65 nt, hsa
uuuuccugaaguuuuauuccauucuguugacaagauggagaaagcaagaucaugaaggugugcaa

SEQ ID NO: 448256 - RNA, 65 nt, hsa
ccaaaaacuacauauuuguaggaaaucugccuuauuggagaaaaucacccuuucccuuuuucuuu

SEQ ID NO: 448257 - RNA, 65 nt, hsa
uaacuucucugagucugaauuuccugccuacaaaauggagaaauaggaccuuccacacagggugc

SEQ ID NO: 448258 - RNA, 65 nt, hsa
uacaugacuuagggaacuugaaaccaacuggcucauggagaaaacaaauuugacuugggaaaggg

SEQ ID NO: 448259 - RNA, 65 nt, hsa
uugccacucaguuccucugggugugcacauauguuuggagaaauagaggagagaaaagagggcca

SEQ ID NO: 448260 - RNA, 65 nt, hsa
aauaaugcugaagaccccaaagaucucauguuaaguggagaaaggguuuugcaaacugaaagauc

SEQ ID NO: 448261 - RNA, 65 nt, hsa
cugagcugcucaccggagucauugggaaggaaaaguggagaaauggcaagucuagagucucagaa

SEQ ID NO: 448262 - RNA, 54 nt, hsa
aggaggaagaggaagagugagggauggagaaagggcagaggaagagacaugaga

SEQ ID NO: 448263 - RNA, 65 nt, hsa
aaacauuauaccucuucugauaguuuuauuaagcauggagaaauugccaauuuuuaaaaacugca

SEQ ID NO: 448264 - RNA, 65 nt, hsa
uaguuuucuucuaaccccuguuggaguccaggggcuggagaaaaggacagauuuaugcagcuauu

SEQ ID NO: 448265 - RNA, 65 nt, hsa
uuuuccugaaguuuuauuccauuauauugacaagauggagaaagcaagaucacgaaggugugcaa

SEQ ID NO: 448266 - RNA, 65 nt, hsa
ucagaaaucaggacauccccccuaucaggugguuuuggagaaaacaaggaaggcggaagaaugga

SEQ ID NO: 448267 - RNA, 65 nt, hsa
aggccugggguggguaaguccugcgauguggacacuggagaaaguggauccucuaaacugcagau

SEQ ID NO: 448268 - RNA, 65 nt, hsa
augaauuguugaguuuauuuuuacacaguaaagaguggagaaagacuguggucuccucaggaugu

SEQ ID NO: 448269 - RNA, 65 nt, hsa
uuggaccauuauuuauaaucaggguagcauuaaaauggagaaaagaaaguuuucugaaaaaaugc

SEQ ID NO: 448270 - RNA, 65 nt, hsa
aaccuggucugauuccuuccaacgugcacuucagcuggagaaagaaaccaagaagggaagcggcc

SEQ ID NO: 448271 - RNA, 65 nt, hsa
uccagggugacucuccaaagaaauuggccuucagcuggagaaaacauuggguggagacucucacu

SEQ ID NO: 448272 - RNA, 65 nt, hsa
ccuuguauugugauauuaacuggcaaagauccucuuggagaaaccuuucccagguacaguuucaa

SEQ ID NO: 448273 - RNA, 65 nt, hsa
uaaugaagcugauuuuuuagcugagauagaagcuuuggagaaaaugaaugaagaucacguucaga

SEQ ID NO: 448274 - RNA, 65 nt, hsa
uucguuuuuguuucccuuuaguauuuaauggucuuuggagaaaaaauaauaaaacagaguguuau

SEQ ID NO: 448275 - RNA, 65 nt, hsa
cauucuucuuauucuagaggucucucuggaaaagauggagaaaaugaacaggacauggggcuccu

SEQ ID NO: 448276 - RNA, 65 nt, hsa
uccggcugugaagucacugaacagaacgucgcugauggagaaagggcucccgcagaaggaacggc

SEQ ID NO: 448277 - RNA, 65 nt, hsa
ccugaauuugcaaccucugguauacuguuauguucuggagaaaauauucaaagaucugccaaaua

SEQ ID NO: 448278 - RNA, 57 nt, hsa
uacuuuuauuauuuggaugaauaucaguggagaaaauggagacucagaagaggacau

SEQ ID NO: 448279 - RNA, 65 nt, hsa
caccaguuaauucugggauacaguaagaauucauauggagaaagucccuuugucuuaugcccaaa

SEQ ID NO: 448280 - RNA, 65 nt, hsa
ccuacuauuuaguuauucuaaaauagaaaguuugcuggagaaagcguccacucacagauuguucu

SEQ ID NO: 448281 - RNA, 65 nt, hsa
uugugcccuugaaaaugcuguuugcucaaucuuucuggagaaaguuugccacauauucggacuua

SEQ ID NO: 448282 - RNA, 65 nt, hsa
agacuucagacccucagaccugccccggggccagguggagaaagugagggccguacaaggaagug

SEQ ID NO: 448283 - RNA, 65 nt, hsa
gcccuggacucaggcuggcagaggggcuggugcccuggagaaaauaaagagaaggcuggagagaa

SEQ ID NO: 448284 - RNA, 65 nt, hsa
aagcgucuuaauguucaaaacgccucucuuuggucuggagaaaaaaaaaaaaaaaaaaaaacaac

SEQ ID NO: 448285 - RNA, 65 nt, hsa
caggguggugagauccauccacgauccagcuccgguggagaaagggcccaugucaagccuuguuc

SEQ ID NO: 448286 - RNA, 65 nt, hsa
uagugguuccaucuuuaaggaagaagaauguuugauggagaaaauuuguggccaaugaagucuga

SEQ ID NO: 448287 - RNA, 65 nt, hsa
uucuguuucuuucaacuacgugaaaggauucacaguggagaaagacccuguaagauaauuggcuu

SEQ ID NO: 448288 - RNA, 65 nt, hsa
gccucgcaccuucaaaugcauggaaggacucacacuggagaaaaacccuaugaauguaagcagua

SEQ ID NO: 448289 - RNA, 65 nt, hsa
uuccaguuccuuucgauaucuaaaaggacucacaguggagaaaaacucuaugaguguaagcaaug

SEQ ID NO: 448290 - RNA, 65 nt, hsa
caugaaaggacacaaacacacauaagaauacacucuggagaaagaccuuauaaauguaagacaug

SEQ ID NO: 448291 - RNA, 65 nt, hsa
uuuaguuccuuucaaauacaugaaagaacucaucauggagaaaaccaaacaaaugcuuuuuggaa

SEQ ID NO: 448292 - RNA, 65 nt, hsa
gagcaucguggaugggugcacggagacacgcaccuuggagaaaugaggggagauggaccaagaaa

SEQ ID NO: 448293 - RNA, 64 nt, hsa
cuguuuuguacaauuauuuuuuaaaaguaaacguguggagaaagaauccgggcuucuugguuua

SEQ ID NO: 448294 - RNA, 65 nt, hsa
uugucacacuucauuguagguaagauaauucauacuggagaaaacgccuacaugugugaacaaua

SEQ ID NO: 448295 - RNA, 65 nt, hsa
uuuucaaaccuuacuaaacauaagauaacucauacuggagaaaaaucuuacaaaugugaagaaug

SEQ ID NO: 448296 - RNA, 50 nt, hsa
uuacuaaacauaauucauaauggagaaaaacccuacaaaugugaagaaug

SEQ ID NO: 448297 - RNA, 65 nt, hsa
uugucacacuugauuguagguaagauaauucauacuggagaaaacuaccagugugaacaacgugg

SEQ ID NO: 448298 - RNA, 65 nt, hsa
ccuggccuugugacagcuccccaaguguucuccgguggagaaacugcagaggacuggugggcggg

SEQ ID NO: 448299 - RNA, 65 nt, hsa
aguucaaaccuuacuguacaucagagaauucauacuggagaaaagccauauaaauguagugagug

SEQ ID NO: 448300 - RNA, 65 nt, hsa
caauaaaauugcugggaauauuugacucuccguauuggagaaaauaaaauuacaacauuacgaca

SEQ ID NO: 448301 - RNA, 65 nt, hsa
cuaaggcaguggcaaagguagaacucaggcagggguggagaaaaggcguuggucgcagugauugg

SEQ ID NO: 448302 - RNA, 65 nt, hsa
caccugaggucaggaguucaagaccagccucaacauggagaaaccccaucucuacuaaaaauaca

SEQ ID NO: 448303 - RNA, 65 nt, hsa
cugagguccggauuucaagaccagcaugaccaacauggagaaaccccgucucuacuaaaaauaca

SEQ ID NO: 448304 - RNA, 65 nt, hsa
acgaugacuccuggauucuccuuccugggugggccuggagaaagaggcugguguuaccugagauc

SEQ ID NO: 448305 - RNA, 65 nt, hsa
aaucagcaaacaaaacagauguauagauuagaguguggagaaaacagaggaaaacuugcaguuac

SEQ ID NO: 448306 - RNA, 65 nt, hsa
cuugcuuacaaaugucuaagguccccacugccugcuggagaaaaaacacacuccuuugcuuaacc

SEQ ID NO: 448307 - RNA, 65 nt, hsa
caacauauuguggcuggacagcaggcaguacacacuggagaaagacugaaugccgugaacguggg

SEQ ID NO: 448308 - RNA, 65 nt, hsa
agcuguacacugaagagucaucagagaguucacacuggagaaagaccuuuugaaugcagcauuug

SEQ ID NO: 448309 - RNA, 65 nt, hsa
aacucaaaucauauuagacaucggagaaaucacuuuggagaaaggucuuuugagugcacugagug

SEQ ID NO: 448310 - RNA, 65 nt, hsa
agcuccacacucauuagucaugagagaguucauacuggagaaaagccuuaugagugcagugaaug

SEQ ID NO: 448311 - RNA, 65 nt, hsa
aggccuaacccuauucaacaccagaaaguuuacacuggagaaaggccuuagggugacagguuaug

SEQ ID NO: 448312 - RNA, 65 nt, hsa
auuggggaaggcaggguuuuguauuguccagucccuggagaaaaucaugaaaugccugaguucau

SEQ ID NO: 448313 - RNA, 65 nt, hsa
agguccaaccucauucaccaucagcgaguucauacuggagaaaggcaugagugcgggcagugugg

SEQ ID NO: 448314 - RNA, 65 nt, hsa
aaaucuagccuuauuauacaucugagaguucacacuggagaaaggccuuaugagugcagugacug

SEQ ID NO: 448315 - RNA, 65 nt, hsa
aacuccagccuuauuaaacacuugagaguucacacuggagaaaggccauaugaaugcauugauug

SEQ ID NO: 448316 - RNA, 65 nt, hsa
ucaccugacguagagaguccaaggccugacaaacauggagaaaugucaucccuauuuaaaaaaau

SEQ ID NO: 448317 - RNA, 65 nt, hsa
cgguugugacucauugaacaucagaggacauauccuggagaaaagcccuacgaaugcauugauug

SEQ ID NO: 448318 - RNA, 65 nt, hsa
ggccacugagacacaaaccuauuuauuucuaggccuggagaaaggagaucggacugggguucccg

SEQ ID NO: 448319 - RNA, 65 nt, hsa
gauucuucucuuucuuguauaugagagaacuuauauggagaaaccccuaggaauguaaucagugu

SEQ ID NO: 448320 - RNA, 65 nt, hsa
ucuguagguuuucaagcacaugaaagaacucacacuggagaaaaacccuaugaauguaaaaaaug

SEQ ID NO: 448321 - RNA, 65 nt, hsa
gagcgcuucggugaaaguaaagacaguagucauuguggagaaacaucuagccagauuggagauac

SEQ ID NO: 448322 - RNA, 65 nt, hsa
uugauacuauuuuuuuuucuuuuaauguuguacuguggagaaaaacuauuuugagccaugggguu

SEQ ID NO: 448323 - RNA, 65 nt, hsa
uacuuaaacuuuguucaacaucagggaauucagauuggagaaaaacccugcaaauguaauaaauu

SEQ ID NO: 448324 - RNA, 65 nt, hsa
uugucacacuugauuguagguaagguaaguuauacuggagaaaacuucuacaugugugaacagug

SEQ ID NO: 448325 - RNA, 65 nt, hsa
ggcugucacacuugauuguagguaagauaauauacuggagaaaacuacuagaauaaacaaugugg

SEQ ID NO: 448326 - RNA, 65 nt, hsa
ggacuacagcuuauucagccugggaaaaauaauguuggagaaauacucuaugaauagaauauacu

SEQ ID NO: 448327 - RNA, 65 nt, hsa
cugaguuugggaguuugagaccagccugaccaacauggagaaagcccaucucuacuaaaaauaca

SEQ ID NO: 448328 - RNA, 65 nt, hsa
ucauguccccaacucaaggcuagaaaacagcaagauggagaaauaauguucugcugcguccccac

SEQ ID NO: 448329 - RNA, 65 nt, hsa
aaaauaaaacuucaacagauugagagaguucacacuggagaaauacuuuccucuggcaaaccccu

SEQ ID NO: 448330 - RNA, 65 nt, hsa
cauuaaagccuuguaagacauacaauaauuuauacuggagaaaaacuuugcaaguauaaugaaug

SEQ ID NO: 448331 - RNA, 65 nt, hsa
acaaaucacagcuugaaagacaggagaauucauacuggagaaaaaacauacaaauguaagguuug

SEQ ID NO: 448332 - RNA, 65 nt, hsa
caaauccagcuucaaauacauaggagaauucacacuggagaaaagccauagaaauguaagguuug

SEQ ID NO: 448333 - RNA, 65 nt, hsa
cugaggucgggaguucgagaccagccugaccaacauggagaaaccccaauuguacuaaaaauaca

SEQ ID NO: 448334 - RNA, 65 nt, hsa
uaggcuaauugugacugugacuuacuucucccucuuggagaaagacuugaagaauguaaugccag

SEQ ID NO: 448335 - RNA, 65 nt, hsa
gcgaggucaggagaucgagaccauccuggcuaacguggagaaaccccgucucuacuaaaaaaaaa

SEQ ID NO: 448336 - RNA, 65 nt, hsa
caaaaaaaaaaccggauagaauaaugaccaaaaaauggagaaaaaguaggcugacucaggaaaca

SEQ ID NO: 448337 - RNA, 65 nt, hsa
uguacuuguaccuaaggcccuggguucaagagaguuggagaaaccccucuagaaacauauuggcu

SEQ ID NO: 448338 - RNA, 65 nt, hsa
uggaaggcauuccaucaacaucagagaacucaugcuggagaaagacauuccaaauauaacuauua

SEQ ID NO: 448339 - RNA, 65 nt, hsa
uaugaguggcaaauguggaaaaucuguuagcacccuggagaaaguccuugaguacacagugaaug

SEQ ID NO: 448340 - RNA, 65 nt, hsa
acaucccgucucauuaaacacaggagaguucauacuggagaaaggccuuaugagugcugucaauc

SEQ ID NO: 448341 - RNA, 65 nt, hsa
augugcacauauggauguauguugaaaguggaugauggagaaauaaaaugugguuuucuuugggg

SEQ ID NO: 448342 - RNA, 65 nt, hsa
ccaaccaccuugaaaccuuuagaacaucucugcuuuggagaaagacccagagaucaggcagaggu

SEQ ID NO: 448343 - RNA, 65 nt, hsa
agauguuaaaacagucccguggaaggagcagggguuggagaaaggcaucccaaagcuucgaugga

SEQ ID NO: 448344 - RNA, 65 nt, hsa
cucucagagacucccaggaguuguugaacuauauuuggagaaaacagccacugaauauuaucauu

SEQ ID NO: 448345 - RNA, 65 nt, hsa
uuuucagaaagcacgaaaaauuauuuauaauagucuggagaaaaaacacacuguaauauuucaag

SEQ ID NO: 448346 - RNA, 65 nt, hsa
ugggguaaaugcuuugaggcccagggaccaaucuuuggagaaaguagauauuuccaucaaagcca

SEQ ID NO: 448347 - RNA, 65 nt, hsa
acuuaaucucucuggccucaauuuccuggugaauguggagaaaaauaauagugcccuucccaugg

SEQ ID NO: 448348 - RNA, 65 nt, hsa
cugcagcgccaagcggcauccaccaagcaucaaguuggagaaaagggaacccaagcaguagagag

SEQ ID NO: 448349 - RNA, 65 nt, hsa
agauguuauguaauaugcugagguggcgaccucaguggagaaauguaaagacugaauugaauuuu

SEQ ID NO: 448350 - RNA, 65 nt, hsa
ucuagguuuccaggccucacagccaagcugaagcuuggagaaaacucugcauucccaugagggca

SEQ ID NO: 448351 - RNA, 65 nt, hsa
ccugacccuccauguccugcccucaaaaaacuggguggagaaauaauuguuucuuuaaaggauau

SEQ ID NO: 448352 - RNA, 65 nt, hsa
accuuugcaguguugccgaaucacagcaguucuguuggagaaacgcuugguuuccggauccagag

SEQ ID NO: 448353 - RNA, 65 nt, hsa
uuggguugucagccauggacauggauuucaaccccuggagaaaacgaugucauuguucagcagcu

SEQ ID NO: 448354 - RNA, 65 nt, hsa
cugaggucgggaguucgagaccagccugaccaacauggagaaaccccgucccuacuaaaaauaca

SEQ ID NO: 448355 - RNA, 65 nt, hsa
cugagguugggaguucaagaccagccugaccaacauggagaaaccccgucucuacuaaaaauaca

SEQ ID NO: 448356 - RNA, 65 nt, hsa
agagauugaguuccuggaagccaggggucaccacguggagaaaguagaugucuuauccugggucc

SEQ ID NO: 448357 - RNA, 65 nt, hsa
uaauuuguuuucuugaaaauuguuaauuucaagacuggagaaauaaacucaccuucuauuuacuc

SEQ ID NO: 448358 - RNA, 65 nt, hsa
cggaggucaggaguucgagaccagccugaccaacauggagaaaccccaucucuacuaaaaauaca

SEQ ID NO: 448359 - RNA, 65 nt, hsa
uuucugacccuacaaacaggucccuaauacugauguggagaaagcucaagagggaaucaucuggc

SEQ ID NO: 448360 - RNA, 65 nt, hsa
ccuguacaugaaccaggucauguuuggccuuguguuggagaaagagaauuauccccacuucacag

SEQ ID NO: 448361 - RNA, 65 nt, hsa
aacucuuaaguuaggcauuauccccauuuuauagauggagaaacuggccccaaaaggugggaacu

SEQ ID NO: 448362 - RNA, 65 nt, hsa
ggagcuggcaaugcccuaccugccuguucuccagauggagaaacaggcucugagauuucacaggu

SEQ ID NO: 448363 - RNA, 65 nt, hsa
accugccagcucucggaguccuuggugguugaacuuggagaaagaccgcaugaagauacuuguaa

SEQ ID NO: 448364 - RNA, 65 nt, hsa
cuugccggcucuuauuuuucuaagcaauauugugauggagaaaaauaacauauuuauugggauuu

SEQ ID NO: 448365 - RNA, 65 nt, hsa
accccucagcucggaggcugugggcuccucaaagcuggagaaagaggccaagauuuuucugcaca

SEQ ID NO: 448366 - RNA, 65 nt, hsa
agaagcggauaguguuuauggagaauggguuccuguggagaaaaauggugaagaaaacaaagaug

SEQ ID NO: 448367 - RNA, 65 nt, hsa
cauaagaguaacaaaaaggaccagccugaccaacguggagaaacucugucucuacuaaaaauaca

SEQ ID NO: 448368 - RNA, 65 nt, hsa
uuacaaacacgggcggaaggcacucaggcuuucguuggagaaacagaaauaaggccuucuuuuga

SEQ ID NO: 448369 - RNA, 65 nt, hsa
cugaggucaggaguuugagaccagacugaccaacauggagaaaccccaucucuacuaaaauacaa

SEQ ID NO: 448370 - RNA, 65 nt, hsa
auagagguagguugaguuuucuaggggaaaacaaauggagaaaagaggcaugaagaaaaguaaac

SEQ ID NO: 448371 - RNA, 65 nt, hsa
agagguuuucuuaauuaacaaaaggacguaugccauggagaaacacacccgcgcacacagcugcu

SEQ ID NO: 448372 - RNA, 65 nt, hsa
aaaauguuuguugaaguaucuuauuuuagaaugaauggagaaaugccaaagaugaauccuucacu

SEQ ID NO: 448373 - RNA, 65 nt, hsa
guaggaagaaaaaggaugcauucccuacagauuuuuggagaaaggauuucugaggagugugugau

SEQ ID NO: 448374 - RNA, 65 nt, hsa
ggaaucuucucugaaaacuaauccauaaaguucccuggagaaauuggucagaaugaucugucaga

SEQ ID NO: 448375 - RNA, 65 nt, hsa
cagcacauguuaccaugucugaccugcaaaaaugcuggagaaaaaugaaggaaaaaauuauguuu

SEQ ID NO: 448376 - RNA, 65 nt, hsa
aaacucauucuuacgaaauuagaacgacuucacguuggagaaagcaugaagagguauucaucugu

SEQ ID NO: 448377 - RNA, 65 nt, hsa
ccaaacccaguguuaggagaaaggacacagcguaauggagaaaggggaaguaguagaauucagaa

SEQ ID NO: 448378 - RNA, 65 nt, hsa
agcuucucaaguuaugaaauaaaacugagagauaauggagaaaauaauuuuuauggguuuuuuug

SEQ ID NO: 448379 - RNA, 65 nt, hsa
agccggaggaacgggcaggccgcugaccugaggucuggagaaaccccuggagaagggugucccca

SEQ ID NO: 448380 - RNA, 65 nt, hsa
cucgcugggaccuggucccuuuguugcaggcggcuuggagaaagggcagugggacgcuggccacg

SEQ ID NO: 448381 - RNA, 65 nt, hsa
ccaggaagggguguccaggacaauuaccuuccuucuggagaaacuucccuuaaucaaauaagaga

SEQ ID NO: 448382 - RNA, 65 nt, hsa
gcaaugagaaggccaggaaaagaaagagcugaaaauggagaaagcccaagaguuagaacaguugg

SEQ ID NO: 448383 - RNA, 65 nt, hsa
gcacccuuggguuggcaauagaaggugacauggaauggagaaaaccaagauuccagauggggaua

SEQ ID NO: 448384 - RNA, 65 nt, hsa
cugggccagaagcuguugaccauaccaggagucacuggagaaaggggcugugcuggggccagacu

SEQ ID NO: 448385 - RNA, 65 nt, hsa
caaggaauccgccaucuuggcuguagacauaggucuggagaaaucucucccuuuuuccuugauuu

SEQ ID NO: 448386 - RNA, 65 nt, hsa
cacuugcuggacagucugagccaagucccuccugcuggagaaaagccuggaacugccaaaacaaa

SEQ ID NO: 448387 - RNA, 65 nt, hsa
acccgaucucuuccuuugugcuggggccaggcgaguggagaaacgcccuccagucugagagcagg

SEQ ID NO: 448388 - RNA, 65 nt, hsa
gcaaugagaagaccaggaaaagaaagagcugaaaauggagaaagccacaguuagaacuguuggau

SEQ ID NO: 448389 - RNA, 65 nt, hsa
gcaaugagaaggccaggaaaagaaagagcugaaaauggagaaaaccagaguuagaacuguuggau

SEQ ID NO: 448390 - RNA, 65 nt, hsa
gcuggagggagaagcugucagggacccagggcgccuggagaaagaggcccuguuacuauuccuuu

SEQ ID NO: 448391 - RNA, 65 nt, hsa
uugaggucaggaguucaagaccagccuggccaacauggagaaaccccaucucuacuaaaaauaca

SEQ ID NO: 448392 - RNA, 65 nt, hsa
acuccauggcuaagaccacagacgggcacacagacuggagaaaaccccucccacggugcccaaac

SEQ ID NO: 448393 - RNA, 65 nt, hsa
cgguucuuaauacugaagucaugauguguauuuccuggagaaauuccucuuuaaaugaacaagua

SEQ ID NO: 448394 - RNA, 65 nt, hsa
caucaaugcuuuuccucaggaaauucggcaagacuuggagaaaaggaaagcuccaucaaagagga

SEQ ID NO: 448395 - RNA, 65 nt, hsa
ucuuuuccaaguucccaaggccuacagcugaagguuggagaaaugccagcugcccuuucgucccc

SEQ ID NO: 448396 - RNA, 65 nt, hsa; identical to SEQ ID NO: 447710

SEQ ID NO: 448397 - RNA, 65 nt, hsa
ugucuugaaaauaaacugcuagaauaaagaaaugcuggagaaauugauuauaagagacuauagcu

SEQ ID NO: 448398 - RNA, 65 nt, hsa
acagucuuuuuauuguggauugugaaaucaaaaucuggagaaaugcuuauaaaauauacuacuag

SEQ ID NO: 448399 - RNA, 65 nt, hsa
uuuuuauuucagucacuccugauaaauaacaaauuuggagaaauaaaaauaucuaaaauaaauuu

SEQ ID NO: 448400 - RNA, 65 nt, hsa
caaucaacaaaacuuuguuuuaaauauuguaauuguggagaaaaguaaacuuauaagcagaacuu

SEQ ID NO: 448401 - RNA, 65 nt, hsa
aaccccugcauucugcucugcucuaauacacuaccuggagaaagucuuuuccuuauuuucaauaa

SEQ ID NO: 448402 - RNA, 65 nt, hsa
ggugaaagcguuccguagcucgcucuaugaaggccuggagaaaccagaauccaagaccuccauuc

SEQ ID NO: 448403 - RNA, 65 nt, hsa
ugcauauacaugaauauaccuugagcaugaaucccuggagaaaucguuuucguagcucaccaaug

SEQ ID NO: 448404 - RNA, 65 nt, hsa
acucaaugaaauaagcugcuaaucagauuuuaccuuggagaaaugaaaauuauuucuuggggaug

SEQ ID NO: 448405 - RNA, 65 nt, hsa
gauuggugaagacagacaccaguucccuacaagcauggagaaaaugaagaauaggccuguuuaau

SEQ ID NO: 448406 - RNA, 65 nt, hsa
ugcaauuuuuaaaaucuagaaguuagggguuuuguuggagaaaaauggacugaucuuuaaacuau

SEQ ID NO: 448407 - RNA, 65 nt, hsa
uugccuucuuugccuagccaagcagccaauuuuauuggagaaaagcaaguuauauguucacaaaa

SEQ ID NO: 448408 - RNA, 65 nt, hsa
uaaauauaugaacaaaaaagcugcaaggauaaauguggagaaaaugaugagaauuagcuaacauu

SEQ ID NO: 448409 - RNA, 65 nt, hsa
aucgucagaggagggugaggaagacuaauuaaacauggagaaaccaaauuggacaaauccucacc

SEQ ID NO: 448410 - RNA, 65 nt, hsa
ugcuguuauuuuagucuuuauucucuuccuuuagguggagaaacaaaguaccaauuugaagggau

SEQ ID NO: 448411 - RNA, 65 nt, hsa
uuugguauccuuaucuaguguuugauugucaaugcuggagaaaaauaucuguaagaguguuuaua

SEQ ID NO: 448412 - RNA, 65 nt, hsa
gcucauaaucagucuccuuuuuaucaguuuugguguggagaaagaggccaguuuaaauaggcuuu

SEQ ID NO: 448413 - RNA, 65 nt, hsa
ugcuguuuuguauaguuacuauccugugcagcagcuggagaaagcacucaccucaggcuuacaaa

SEQ ID NO: 448414 - RNA, 65 nt, hsa
uuaccuacucaaugccuuuuaaaagaaaguuauaauggagaaaaaauugagccuuaaacaaaugg

SEQ ID NO: 448415 - RNA, 65 nt, hsa
cucuguugaucacagagggagccugaguacaggcuuggagaaauggcuaggacagggaacaggga

SEQ ID NO: 448416 - RNA, 57 nt, hsa
aggacaguggggaggauuagucacacauggagaaaccaaauuggacaaaucaucacc

SEQ ID NO: 448417 - RNA, 57 nt, hsa
aggaggguggggaggacuagucaaacauggagaaaccaaauuggacaaauccucacu

SEQ ID NO: 448418 - RNA, 65 nt, hsa
gaggguaauaaccagacacaaacugccaaguuggguggagaaaggaguuucuuuagcugacagaa

SEQ ID NO: 448419 - RNA, 65 nt, hsa
uguauaugcuggguauuucauuugucuuuuuauuuuggagaaagcguuuuuaacugcaacuuucu

SEQ ID NO: 448420 - RNA, 65 nt, hsa
aucauccagaagcacugugauauuguguaagcaucuggagaaaauucaguuaaaagaauaaaagu

SEQ ID NO: 448421 - RNA, 65 nt, hsa
ucgccgcuagucuuaugagcuaucuacuaaaacuauggagaaacuuuguaugugcacacaaaagu

SEQ ID NO: 448422 - RNA, 63 nt, hsa
ccuaugggugacugccuucucccagaguuuucuuuggagaacagaaagaagaaaggaaagaaa

SEQ ID NO: 448423 - RNA, 63 nt, hsa
guuucugaaaccgcucagauguuuuggggaaaguuggagaagccguggccuugcgagaggugg

SEQ ID NO: 448424 - RNA, 63 nt, hsa
gacccgggcaggcccccagcaccccaugcugacuuggagaaccccagaucucuggggcccagc

SEQ ID NO: 448425 - RNA, 63 nt, hsa
cagacaccggggcuggguuucucuuuccucuuuuuggagaaaaggaacagggcaguggaauga

SEQ ID NO: 448426 - RNA, 63 nt, hsa
aacccuuuccuccucccauuuugacauuugcacuuggagaacacuugaguugugaagguuuug

SEQ ID NO: 448427 - RNA, 63 nt, hsa
uggaggggagagaaggauucuagggguguggaguuggagaaagaggcuuccuugagccacccu

SEQ ID NO: 448428 - RNA, 63 nt, hsa
cauuaggaaacaauggcagucaaacccauggcuuuggagaaaguaaauguuugccagaaagga

SEQ ID NO: 448429 - RNA, 63 nt, hsa
ugcuggugcggauggacacuaaugcagccacgauuggagaauacuuugcuucauaguauugga

SEQ ID NO: 448430 - RNA, 63 nt, hsa
ucagagcaaacaucauguagauagcacaaguauuuggagaaacguuguuuguuuuguuaccaa

SEQ ID NO: 448431 - RNA, 63 nt, hsa
uaauuuaaaauaauuauuguauaauaucuacauuuggagaauuuugaacuaucaagcauauac

SEQ ID NO: 448432 - RNA, 63 nt, hsa
gacgguaaaggcacuaaagucacuuuaaagcuuuuggagaagcaggagggcauuggcuuaacc

SEQ ID NO: 448433 - RNA, 63 nt, hsa
aaucugaaggacuucaucucccgcuuugagggcuuggagaagaucucugccuacaugaagucc

SEQ ID NO: 448434 - RNA, 63 nt, hsa
ccuggcauggacugauguuuuuaggcacagaaguuggagaagagauuucaugaaagacaacau

SEQ ID NO: 448435 - RNA, 63 nt, hsa
uguguuuucagaauuuccauuucuacuaaccucuuggagaaaaagaaauugaauuagagguaa

SEQ ID NO: 448436 - RNA, 63 nt, hsa
ccuaaaagcuggagacacagauguccagagugauuggagaauguccugggggaaugaaguucc

SEQ ID NO: 448437 - RNA, 63 nt, hsa
ucccugaggcuuuggggucagaguauauguuguuuggagaaagagggcaaucaggacucuucu

SEQ ID NO: 448438 - RNA, 63 nt, hsa
ucuggccuggcuuucccucucagacauagcucuuuggagaacuagguguuguaauucaguuau

SEQ ID NO: 448439 - RNA, 63 nt, hsa
auugucaaaacuaccaauuccagguuaacuuuguuggagaauuucccccacccccauccagug

SEQ ID NO: 448440 - RNA, 63 nt, hsa
gcugguuccccagcccuuuucccuggcccuggcuuggagaaucuguuuucaaucuccacugau

SEQ ID NO: 448441 - RNA, 63 nt, hsa
uuggaggcaggauccaggcacagcuccccucacuuggagaaccuugacucucuugauggaaca

SEQ ID NO: 448442 - RNA, 63 nt, hsa
uaaaacacugucuuuucaggauugcuucauggauuggagaacuuucuaaccaaaaauuaaaaa

SEQ ID NO: 448443 - RNA, 63 nt, hsa
gacuuaguaccagaaccaaaaauaccuagauuuuuggagaacuuauuacauacauagaaacau

SEQ ID NO: 448444 - RNA, 63 nt, hsa
aacccagccuacucuagaauuucagcagugacauuggagaauauuuuuaauuugcugcaguac

SEQ ID NO: 448445 - RNA, 55 nt, hsa; identical to SEQ ID NO: 445050

SEQ ID NO: 448446 - RNA, 63 nt, hsa
gcaaggagagaagugagagcuacaauuccagcauuggagaagcgaggggcggggcgucaacgg

SEQ ID NO: 448447 - RNA, 63 nt, hsa
ggggcuaguuuggcuuuuccaaguggguuuucuuuggagaaucugaugccaugcaauuggcau

SEQ ID NO: 448448 - RNA, 63 nt, hsa
gucguagacuugugcaauauauacuguuguggguuggagaaaaguggaaagcuacacugggaa

SEQ ID NO: 448449 - RNA, 63 nt, hsa
gguaggcaaauuguuaggcagaauaaugguauguuggagaaauacaccugucucuuauucuua

SEQ ID NO: 448450 - RNA, 63 nt, hsa
ccuuugguaaauacaccauaccauaauaucugcuuggagaaccacaaugcacauuagcauauu

SEQ ID NO: 448451 - RNA, 63 nt, hsa
auuaacuagcauuuagccagcuuuuucuugcccuuggagaaaaagaaucauucucaaccugau

SEQ ID NO: 448452 - RNA, 63 nt, hsa
uuuauuuuaauacauuguaggaaaucuucauaauuggagaaaguucugcagcauggcuuuuua

SEQ ID NO: 448453 - RNA, 63 nt, hsa
uguggcuccauauuucaacuaaaaauauaucuguuggagaaagaaauuaacaauaaagaauuu

SEQ ID NO: 448454 - RNA, 63 nt, hsa
cauuagaaacaauugguuaaugggggagccuaauuggagaaugaugcugagaauuuguauuga

SEQ ID NO: 448455 - RNA, 63 nt, hsa
caaggcggcggcagagcuggucuucuggucuccuuggagaaagguucuguugcccugauuuau

SEQ ID NO: 448456 - RNA, 63 nt, hsa
uaaaacagacuuacucuccuuggaggauauauuuuggagaaugcuucauaaaaucuaugaaua

SEQ ID NO: 448457 - RNA, 63 nt, hsa
guacgcaaagggcagccccaggcugucuggaaguuggagaauucccuaucagcacagggaucu

SEQ ID NO: 448458 - RNA, 63 nt, hsa
aggaaagacauguaagagcauggacauuuuacuuuggagaaacagaaaaaucuuggggcuucc

SEQ ID NO: 448459 - RNA, 63 nt, hsa
gcuuuuuggaagacauuucuguagcaugucaguuuggagaaaugaugagcuacgccuugauga

SEQ ID NO: 448460 - RNA, 63 nt, hsa
ccugaguuaaaagucuauuuauuuacuuccuuguuggagaagggcaggagaguaccugggaau

SEQ ID NO: 448461 - RNA, 63 nt, hsa
cuccagguggaagcaugcuuucccuuguuacuguuggagaaacucaaaccuucaagcccuagg

SEQ ID NO: 448462 - RNA, 63 nt, hsa
uccauagaaaacuguagaaagauaucuguaucuuuggagaaggagaaagaaaggaaagaacuc

SEQ ID NO: 448463 - RNA, 63 nt, hsa
uauaguuuuauaacuggcuuaaguuaaguuuuauuggagaaaucuugccuauaauucuauaaa

SEQ ID NO: 448464 - RNA, 63 nt, hsa
uuuuuacuguugaacuuagaacuaugcuaauuuuuggagaaaugucauaaauuacuguuuugc

SEQ ID NO: 448465 - RNA, 63 nt, hsa
aucccauccuugccaaaaaauaagaaaacugucuuggagaaugggucagaagccccaaacggc

SEQ ID NO: 448466 - RNA, 63 nt, hsa
uucuuggacuacuuuaauuuggauccuuuggguuuggagaaagggaaugugaaagcugucauu

SEQ ID NO: 448467 - RNA, 63 nt, hsa
acaagccuuggguccauguuuacucucuucuauuuggagaauaagauggaugcuuauugaagc

SEQ ID NO: 448468 - RNA, 63 nt, hsa
aaaaugccuuuucauuggucuuaagagaccgcauuggagaauuucaggcuuuugauaaaugcu

SEQ ID NO: 448469 - RNA, 63 nt, hsa
ccagagcugaggcaaggggauuucucaggucauuuggagaacaagugcuuuaguaguaguuua

SEQ ID NO: 448470 - RNA, 63 nt, hsa
gugcuauguggcgagaaaaaaaguuuuaauguauuggagaaguuuuaaaaaacccagaaaaac

SEQ ID NO: 448471 - RNA, 63 nt, hsa
agaccaaagggauaucuguucccuguuaccuuuuuggagaauucauaacauuugaagaucaaa

SEQ ID NO: 448472 - RNA, 63 nt, hsa
aggcacggacacacccagucucaaugcacgaaguuggagaaccugacagggcugguccaggcc

SEQ ID NO: 448473 - RNA, 63 nt, hsa
ggaaggcggcaggcagagaaguggagugacuauuuggagaauagcacccauaucugugugccc

SEQ ID NO: 448474 - RNA, 63 nt, hsa
acacucuaucacauauuuaagcaaacaucacauuuggagaagaggaaaucauaaaaucauccu

SEQ ID NO: 448475 - RNA, 63 nt, hsa
uguauauauuacucugcacuauaucccuucuuuuuggagaacuagccauuauuuuagccacag

SEQ ID NO: 448476 - RNA, 63 nt, hsa
cuuccuguucugcaccccucuccccaugggaccuuggagaaaacugaacuguuacaaaccccu

SEQ ID NO: 448477 - RNA, 63 nt, hsa
aucaugagguuaaaauuuucuucauuaggggacuuggagaaccaguagucguaagauuaguug

SEQ ID NO: 448478 - RNA, 63 nt, hsa
uaccagcagugugucaggugcugcagagcguucuuggagaaggcccacugaggcagguucgug

SEQ ID NO: 448479 - RNA, 63 nt, hsa
accuggcauagagaaaaauauauaccugguacauuggagaaaaauaauuacacuuucaaagag

SEQ ID NO: 448480 - RNA, 63 nt, hsa
guuguaaguggacaugcaaaccaaaauuggggauuggagaagucagacucacuagacuuuugg

SEQ ID NO: 448481 - RNA, 63 nt, hsa
aauuccugucaaaaucaauucagaaauucuaacuuggagaauuuaacauuuuacucuuguaaa

SEQ ID NO: 448482 - RNA, 63 nt, hsa
aucuugcaagcaaaucccauuucuugaaaagccuuggagaacucgguuugguagacuuggaca

SEQ ID NO: 448483 - RNA, 63 nt, hsa
cagugauuuuguuccaaaacuuuguauacacauuuggagaaaaguacuuuauauuuucagugu

SEQ ID NO: 448484 - RNA, 63 nt, hsa
ugcaagaaauauacugacaugaacaggcaguucuuggagaagaaagagcauuucuuuaaguac

SEQ ID NO: 448485 - RNA, 63 nt, hsa
acuccagccugggcaacagagcaagacccugucuuggagaaaccagaauuuuggaagagcaaa

SEQ ID NO: 448486 - RNA, 63 nt, hsa
gaguggcucuuugcaugaacacugugcaagguguuggagaaauccaaagcugaccaaaacaug

SEQ ID NO: 448487 - RNA, 63 nt, hsa
ggccuucacgcucuugaucgucuuuccuuuguauuggagaaggacugggucagagaucuguug

SEQ ID NO: 448488 - RNA, 63 nt, hsa
uguuuuuuacucuuuucucaugcacauguuacguuggagaaaauguuuacaaaaaugguuuug

SEQ ID NO: 448489 - RNA, 63 nt, hsa
acugacaccucacugaggaagggagacauauucuuggagaacuuuccaucugcuuguauuuuc

SEQ ID NO: 448490 - RNA, 63 nt, hsa
auaucaaguuuugaauauuauucaggaagcacuuuggagaaugugggaguccuacuguuuugc

SEQ ID NO: 448491 - RNA, 63 nt, hsa
ggugagaagcaggcuggugagacugggcugagguuggagaaggggcagccgggggcacugcug

SEQ ID NO: 448492 - RNA, 63 nt, hsa
cacuuuauucuuguauggcuuugguaggcauacuuggagaacauaucccacauuaggaauuga

SEQ ID NO: 448493 - RNA, 63 nt, hsa
ccugagaguuugagggcuuuaauccuuuaaaacuuggagaagcuggcugggcgcgguggcuca

SEQ ID NO: 448494 - RNA, 63 nt, hsa
auuuauuugaugacuuaauauuuuucacuaccuuuggagaacagaugaacauuauucaccaug

SEQ ID NO: 448495 - RNA, 63 nt, hsa
ucaauuagcaguucaaauuaaagaagaugguuauuggagaacuuuuuugaaugguuuuguauu

SEQ ID NO: 448496 - RNA, 63 nt, hsa
ugcaucuuuuuuccucugccauucuuguguugauuggagaauuuuucuguauguaauuagaaa

SEQ ID NO: 448497 - RNA, 63 nt, hsa
uucuggauuucauacuguaacauucaggaauucuuggagaaaauggguuuauucacugaacuc

SEQ ID NO: 448498 - RNA, 63 nt, hsa
cucggaaagccuuaagcaaagaugggaggauuuuuggagaauccaucaugauugguguaaaac

SEQ ID NO: 448499 - RNA, 63 nt, hsa
ccucucaaaacaaacacccucuugcaaccagcuuuggagaaagcccagcuccugugugcucac

SEQ ID NO: 448500 - RNA, 63 nt, hsa
ggcuggcccuguaauuuaaauuaaaauaaaauuuuggagaaacagcauugucugucuuuauga

SEQ ID NO: 448501 - RNA, 63 nt, hsa
agggacacaaggacuugggugcaucaggacgccuuggagaagcguggcuuccugccacccugc

SEQ ID NO: 448502 - RNA, 63 nt, hsa
gcagagagaggcaggaaggaucccugaagagucuuggagaaaagguucugugcccucaggugg

SEQ ID NO: 448503 - RNA, 63 nt, hsa
aucugaaucacuggggauuaugauucacccucuuuggagaacaugcucucuuuucacccccca

SEQ ID NO: 448504 - RNA, 63 nt, hsa
cuuauauuuaucgcuuggcucaaguucugcccuuuggagaaauacugagcaagucuuucauuc

SEQ ID NO: 448505 - RNA, 63 nt, hsa
guuaaguauauaauaaauugaacaucuuugagauuggagaauuaugugagauuuccacauuau

SEQ ID NO: 448506 - RNA, 63 nt, hsa
cagggccaugcugaggccugggccgcugccacguuggagaagcccgugugagaagugaaugcu

SEQ ID NO: 448507 - RNA, 63 nt, hsa
gucugcgaugcagcggcgugaggccugggcugguuggagaaggucacaacccuucucuguugg

SEQ ID NO: 448508 - RNA, 63 nt, hsa
uugcacuacaccucuguugugaggacuaccauuuuggagaagguucuguuugucucuuuucau

SEQ ID NO: 448509 - RNA, 63 nt, hsa
cuuuuccugugcuuacgggccaugcguauuucuuuggagaaaggucuauccagguccuuugcc

SEQ ID NO: 448510 - RNA, 63 nt, hsa
cagaaauucuguugaagacaguugagaauuccuuuggagaaaacagcccagcuuggcgugggg

SEQ ID NO: 448511 - RNA, 63 nt, hsa
gacgcuacuaaccugacaucaccaaguguggaauuggagaaaagcacaaucaacuuuucugag

SEQ ID NO: 448512 - RNA, 63 nt, hsa
agaauuuuuaaauaguauauauucaguggcauuuuggagaacaaagugaauuuacuucgacuu

SEQ ID NO: 448513 - RNA, 63 nt, hsa
guuuguuuuuaucaaaaugucaaaauaacauacuuggagaaguauguaauuuugucuuuggaa

SEQ ID NO: 448514 - RNA, 63 nt, hsa
uucuagagguuggcuuucaauucuguagcauacuuggagaaacugcauuaucuuaaaaggcag

SEQ ID NO: 448515 - RNA, 63 nt, hsa
aguguuccucaccaauaacuucagagaagucaguuggagaaaaugaagaaaaaggcuggcuga

SEQ ID NO: 448516 - RNA, 63 nt, hsa
gguaccgucuaguacuaugcagcgguccucaaguuggagaaaaugugccuuucauucauuacc

SEQ ID NO: 448517 - RNA, 63 nt, hsa
aauaugccugcucaaaauuaauagcacagcaguuuggagaagaaaugaaggugucaaagaguc

SEQ ID NO: 448518 - RNA, 63 nt, hsa
uggaaaaucacacaguuuucaggcuccaucuguuuggagaaaauacauucugaagcaucccca

SEQ ID NO: 448519 - RNA, 63 nt, hsa
uggaaauggauuggauugucaaauuauuauuuauuggagaaaaaaaccugaucuacacauuuu

SEQ ID NO: 448520 - RNA, 63 nt, hsa
acuuaggaaauagugaauaaggugcauuuaacuuuggagaaauacuuuuauggcuuuggugga

SEQ ID NO: 448521 - RNA, 63 nt, hsa
gguuuuugaacaggaaaaucauaauucauaucauuggagaaguauuuauuuucaaauaucaaa

SEQ ID NO: 448522 - RNA, 63 nt, hsa
ggagucagagagaaucccuagucuucaagcagauuggagaaacccuugaaaagacaucaagca

SEQ ID NO: 448523 - RNA, 63 nt, hsa
aaaugaaaaggacacauucugaaaucccuuuuguuggagaauaagucagucugaggggaaaug

SEQ ID NO: 448524 - RNA, 63 nt, hsa
aauaaguccuagacuggacucuugagggacauauuggagaaucuuaagaaaugcaagcuuguu

SEQ ID NO: 448525 - RNA, 63 nt, hsa
cccaggaaauuagcuuuccagccccuuuauauauuggagaaguuguuuuagcuucugcagaag

SEQ ID NO: 448526 - RNA, 63 nt, hsa
cauuguucuugguuuuguuucucgaucuuuuguuuggagaacagcuggcuaaggaugacucua

SEQ ID NO: 448527 - RNA, 63 nt, hsa
ucauuuguuccuuggaccuuaaucauuugcauuuuggagaaaauuuuuucugcuuuaaaaguc

SEQ ID NO: 448528 - RNA, 63 nt, hsa
aguuuaggaauucuacuagccagagauagucacuuggagaaacuuucuauauauccuucuaaa

SEQ ID NO: 448529 - RNA, 63 nt, hsa
aucuugaugucauuacuccugaauuauuacauuuuggagaauaagagggcauuuuauuuuauu

SEQ ID NO: 448530 - RNA, 63 nt, hsa
uuugauccaagucaaguguagccucucagccuuuuggagaaaaaugaaacaauuuauuucaac

SEQ ID NO: 448531 - RNA, 63 nt, hsa
gggcagagcccugacccacagcuguguuacugcuuggagaagcauauguaggggcauacccug

SEQ ID NO: 448532 - RNA, 63 nt, hsa
auuuaaaguugccugaagauuuugcugugguguuuggagaagcagagggugaacuugcuguug

SEQ ID NO: 448533 - RNA, 63 nt, hsa
auuugcucagcuuuuugaaauguuaagauguguuuggagaaggcugcaugacuuuguuuuucc

SEQ ID NO: 448534 - RNA, 63 nt, hsa
uaggcagcagccaccuucucaggaaacaaggccuuggagaaaucagugccugugugaagaugg

SEQ ID NO: 448535 - RNA, 63 nt, hsa
cuggaccuuccauucuagaauuaugagaccaccuuggagaaaggugugugguacaugacauug

SEQ ID NO: 448536 - RNA, 63 nt, hsa
ucucuguuugccuuggguugaauaacuuaucuuuuggagaauagcuuuaaguggcuuagacac

SEQ ID NO: 448537 - RNA, 63 nt, hsa
aaguuggaugacacuacucccaacuuuuuaaauuuggagaaaaccaucaaggucgaggaagcc

SEQ ID NO: 448538 - RNA, 63 nt, hsa
gaaauugcuagauuacccaaagaaauagaucaguuggagaaaauacaaaacaauucaaagcuc

SEQ ID NO: 448539 - RNA, 63 nt, hsa
uauuuaaaagaaauaccagugagugccuuaaaguuggagaaguaacugcccaugcccagaaau

SEQ ID NO: 448540 - RNA, 63 nt, hsa
gaauaaaaaauaauuuugcuguuguaguauacauuggagaaacuggcagguuuuauuuccauu

SEQ ID NO: 448541 - RNA, 63 nt, hsa
cugaggguguacguuugauaugaucaugccagauuggagaagauccaagccaggaagaugggc

SEQ ID NO: 448542 - RNA, 63 nt, hsa
caaagacacgggaacugaaaaacuccacaggguuuggagaauagaaaugaaaagccacgucau

SEQ ID NO: 448543 - RNA, 63 nt, hsa
aagacuuugggcucuuaugucacaucacaugauuuggagaaauuagacacaaucucuuauuuu

SEQ ID NO: 448544 - RNA, 63 nt, hsa
caauuguccuucagauaauucauguggagauuuuuggagaaaccaugacggauaguuuaggau

SEQ ID NO: 448545 - RNA, 63 nt, hsa
uguacaguauuugcauuccacagauggaacgguuuggagaagcacuuuuucauacuuuuguga

SEQ ID NO: 448546 - RNA, 57 nt, hsa; identical to SEQ ID NO: 445151

SEQ ID NO: 448547 - RNA, 63 nt, hsa
ucagucugaaaugcagcucccuguccaagugccuuggagaacucacagcagcacgccuuaauc

SEQ ID NO: 448548 - RNA, 63 nt, hsa
ugaagcacauacaagcacccugguggaagaagcuuggagaagaaucuggagaugagauugaug

SEQ ID NO: 448549 - RNA, 63 nt, hsa
ccugggcuguggaccuacugggcauuugaggaauuggagaauggagauggcaagagggcaggc

SEQ ID NO: 448550 - RNA, 63 nt, hsa
augccaaguacaccugcaaggcugucaacagucuuggagaagccaccugcacagcagagcuca

SEQ ID NO: 448551 - RNA, 63 nt, hsa
uugccaaaaaaaaaaaaaaaaaaaaaucagaaauuggagaaauccuuagcacaauuuucuaaa

SEQ ID NO: 448552 - RNA, 63 nt, hsa
ugcccaggugggguuuccugcauggacaguuguuuggagaacaacaaggacaacuuuauguag

SEQ ID NO: 448553 - RNA, 63 nt, hsa
ugaauuuuuuggggacuauuaaggguguuagucuuggagaagacacagccucaccuucucacu

SEQ ID NO: 448554 - RNA, 63 nt, hsa
uauuucuuaacugcuauuuggcagaagcugaaauuggagaaccaaggagcaaaaacaaauuuu

SEQ ID NO: 448555 - RNA, 63 nt, hsa
cuuugugacacuucauccugaugccaagauuuuuuggagaacaucugcacuuucuuauauaua

SEQ ID NO: 448556 - RNA, 63 nt, hsa
augauuguaugcuuaugcugaacaccuuucauauuggagaaucaugcauuugggucacuaauu

SEQ ID NO: 448557 - RNA, 63 nt, hsa
augaaauaaacuuauuacuuuaaaggaaaggauuuggagaauugaacucacaaacugauguua

SEQ ID NO: 448558 - RNA, 63 nt, hsa
acuucggcugcaugagauaaucacuugggagcuuuggagaaaauagcaguaccaagggaucuc

SEQ ID NO: 448559 - RNA, 63 nt, hsa
acgcccaucuggagugggagcugggagucaguguuggagaagaaacaacaaaagccaauuaga

SEQ ID NO: 448560 - RNA, 63 nt, hsa
cucuaauuccagugucuuuacacagcaaauaaauuggagaauauugcucccauauaaacuugu

SEQ ID NO: 448561 - RNA, 63 nt, hsa
uuucaguuucuuuccuucugugaacgaugagacuuggagaacgggcugguccuucaccacuuc

SEQ ID NO: 448562 - RNA, 63 nt, hsa
gaggugccgagcugggugcuugacaucauuugcuuggagaagcagcugcuaguagacccauuu

SEQ ID NO: 448563 - RNA, 63 nt, hsa
caucaauauguauauauguauuucuauauagacuuggagaauacugccaaaacauuuaugaca

SEQ ID NO: 448564 - RNA, 63 nt, hsa
uuggguguggaggccauuuuuagagauacagaauuggagaagacuugcaaaacagcuagauuu

SEQ ID NO: 448565 - RNA, 63 nt, hsa
ugucauguugguuuuugguacuuguauugucauuuggagaaacaauaaaagauuucuaaacca

SEQ ID NO: 448566 - RNA, 63 nt, hsa
uaucugggaacacugagaagggugaccaaugcguuggagaacgagggagggcuucauagcaga

SEQ ID NO: 448567 - RNA, 63 nt, hsa
aaagagcaugcagugcuguugaauaacccucacuuggagaaccaagagaauccugucguuuaa

SEQ ID NO: 448568 - RNA, 63 nt, hsa
ccccugaauguggucgaugccaaaggaagauccuuggagaagucaucagugcguugaaacaaa

SEQ ID NO: 448569 - RNA, 63 nt, hsa
ugcagagugugugcuuggcuguggcagccuagcuuggagaagcugcuguuggugcaagggaga

SEQ ID NO: 448570 - RNA, 63 nt, hsa
cagcuuucuugcuugccuucugugcaauauuucuuggagaauuuggaugccuaaggcauaaag

SEQ ID NO: 448571 - RNA, 63 nt, hsa
uuucugugccuucaagggacaacuuuuuuaacuuuggagaaaagaaaaacacucuauaacaga

SEQ ID NO: 448572 - RNA, 63 nt, hsa
uuuauaccuagcaagccacuucaggaaauucuuuuggagaauauuuucugauuauuguuaaac

SEQ ID NO: 448573 - RNA, 63 nt, hsa
augcugggaacacaaauagugcaauuugugcaauuggagaaucuugccuuuuuucuuggcucc

SEQ ID NO: 448574 - RNA, 63 nt, hsa
caggauucacauuguuaauuuauaaaucuagacuuggagaauuaaggacugagaaaugaccau

SEQ ID NO: 448575 - RNA, 59 nt, hsa; identical to SEQ ID NO: 445180

SEQ ID NO: 448576 - RNA, 63 nt, hsa
gcaacugcagcuaacaggcugauuuucuggccuuuggagaagugauucaaaauaguguagauu

SEQ ID NO: 448577 - RNA, 63 nt, hsa
aguauaugaaaauauacuggaaauauuggauucuuggagaaaacuguucagucacagauauau

SEQ ID NO: 448578 - RNA, 63 nt, hsa
caugugugccccuaaagacacauuuacucaauauuggagaaguagauaaugaauuaagcaacu

SEQ ID NO: 448579 - RNA, 63 nt, hsa
uaguguuuucauaauguaauucaaugaaaacuguuggagaaauauuuaaacaccucaauguag

SEQ ID NO: 448580 - RNA, 63 nt, hsa
gguuuuaaaaauaaguuuuauacauaaacaguuuuggagaaaaauuacagaucauauaagcaa

SEQ ID NO: 448581 - RNA, 63 nt, hsa
uaucuuguaaucaugauugagccucagaaucauuuggagaaacuauauuuuaaagaacaagac

SEQ ID NO: 448582 - RNA, 63 nt, hsa
caaucaaucaaaaaauaaauaaaucacuaaggauuggagaacucauagaacaaggugaaagac

SEQ ID NO: 448583 - RNA, 63 nt, hsa
agacauaaacuuggaguccgucugguuuaauuauuggagaaucgauucccaaguccaggaaga

SEQ ID NO: 448584 - RNA, 63 nt, hsa
uuaguauuuugucuuuguaauuuacagaaguuauuggagaaaauaaacuuguuucauuuugca

SEQ ID NO: 448585 - RNA, 63 nt, hsa
cccagggaaugggggucuaugagacaaccccacuuggagaagaaugggguuagggucucuaau

SEQ ID NO: 448586 - RNA, 63 nt, hsa
ugcuuuuuauacaacuuuccaucccccacacaguuggagaauaauuuguagaccauggcaguu

SEQ ID NO: 448587 - RNA, 63 nt, hsa
uauacauggugauguacaucuguagcaaagcucuuggagaaaaugaagacugaagaaagcaaa

SEQ ID NO: 448588 - RNA, 63 nt, hsa
ugaggaacauucauucuguauuuuuuuucccuguuggagaaagugggaaauuauaaugucgaa

SEQ ID NO: 448589 - RNA, 63 nt, hsa
auucugucuaucaaauaguacuucuaccacuguuuggagaaaauugaagaaaagaauaagaug

SEQ ID NO: 448590 - RNA, 63 nt, hsa
uugaauaugauuuggucaguugcucguuguaacuuggagaaauuccuauaaaguaagaucucc

SEQ ID NO: 448591 - RNA, 63 nt, hsa
aauuccuucugcuauaugucacacaguuguuauuuggagaaccaaguauguauugcaugaaaa

SEQ ID NO: 448592 - RNA, 63 nt, hsa
augccuuauuuuugaauucuuuagauuuuuaaauuggagaaaagcacuuaaaguuuuuuauau

SEQ ID NO: 448593 - RNA, 63 nt, hsa
gugagcauuugcaauguaagggccucagcuuccuuggagaagccaccccagguuuccagacau

SEQ ID NO: 448594 - RNA, 63 nt, hsa
caucucccugauugguauugcuguagaacauauuuggagaaguuuguuugucuuugguguuua

SEQ ID NO: 448595 - RNA, 63 nt, hsa
ggaguuugaacccguuuugguugcauuucauuuuuggagaacuuaauuaacgugagauuggca

SEQ ID NO: 448596 - RNA, 63 nt, hsa
uuagaacauuuuuugaaauucaguuuacagaaauuggagaaaaugcuuuuuaaacaaguguuu

SEQ ID NO: 448597 - RNA, 63 nt, hsa
augggucuugcugggugcuguguggggcgcauauuggagaaggguaaugccagaagccaggaa

SEQ ID NO: 448598 - RNA, 63 nt, hsa
cuuggaaccccaaggccaaguugguucaaacuguuggagaacagaguuggccugcaucuggaa

SEQ ID NO: 448599 - RNA, 63 nt, hsa
acuauuuuuauaaagcaagaacuauuccaugccuuggagaaugaaucauuuuuagauugugac

SEQ ID NO: 448600 - RNA, 63 nt, hsa
uuuggaggugaaaucuaauuauuggugagagucuuggagaacaggcuguuuccagucucaaag

SEQ ID NO: 448601 - RNA, 63 nt, hsa
gccuuugguagcuaacagucacugauuuuauaauuggagaaugcguaaagauucauuuuucaa

SEQ ID NO: 448602 - RNA, 63 nt, hsa
uuguuuuauuggaaugcauaucucuuuucaggguuggagaaauuagcacuugccuugaaaaga

SEQ ID NO: 448603 - RNA, 63 nt, hsa
ugagacuuuauuguccucuaggauggauguauauuggagaagggugguuagcacauucaucag

SEQ ID NO: 448604 - RNA, 63 nt, hsa
gguuaccuccaugugcccuuuuuagggaagcuguuggagaaaauacuccagcaaaaugaagga

SEQ ID NO: 448605 - RNA, 63 nt, hsa
uucaacaauucugugaaaggucacaggacccaauuggagaaaucauaugaaaagcauaguugg

SEQ ID NO: 448606 - RNA, 63 nt, hsa
aucccuuaauuugagguguuccagcagcuguuuuuggagaagacaaagaaaauuaaaguuuuc

SEQ ID NO: 448607 - RNA, 63 nt, hsa
auguuccuuuguauguuccuaucaggcugauuuuuggagaaaugaauguuugucuggagcaga

SEQ ID NO: 448608 - RNA, 63 nt, hsa
ugauguuaagcacauguuacuucaacaagaugcuuggagaacaacaagguacccagaauuuuu

SEQ ID NO: 448609 - RNA, 63 nt, hsa
agugagaucauacugguuuguuucuuauuuugauuggagaaaaauuaaauugcugcauuucgc

SEQ ID NO: 448610 - RNA, 63 nt, hsa
cagcugguaguccaucagcacaaugaaggagacuuggagaagaggaagaauaacacuguugcu

SEQ ID NO: 448611 - RNA, 63 nt, hsa
gcuuuuugaauguuauuuguuauuuucaguauuuuggagaaauuauuuaauaaaaaaacaauc

SEQ ID NO: 448612 - RNA, 63 nt, hsa
gcgcauccugcagggcuucuccuccucugucuuuuggagaaccagggcucuucucaggggcuc

SEQ ID NO: 448613 - RNA, 63 nt, hsa
uuaaacccugugccucagcuggacauuggaaccuuggagaaugucuucacagccccgacauca

SEQ ID NO: 448614 - RNA, 63 nt, hsa
cagggccgugccuggagcacugcagagaugacuuuggagaaagcaaagcagugacccagugac

SEQ ID NO: 448615 - RNA, 63 nt, hsa
agaagaaagauacaagugaaaauuaggaguggauuggagaaauuggggggaaauagaagagua

SEQ ID NO: 448616 - RNA, 63 nt, hsa
ggcuuuuuaacccauuuuugaagagggugaaguuuggagaacaaauuuaaaaaccaucaguca

SEQ ID NO: 448617 - RNA, 63 nt, hsa
aaaucucagaauuacuaagcauguggcauaaauuuggagaaaauaauaugacuagaaaaauua

SEQ ID NO: 448618 - RNA, 63 nt, hsa
uucguguccaccuggguccaguccugaaucaucuuggagaaacaccuugguuucuaggauggu

SEQ ID NO: 448619 - RNA, 63 nt, hsa
aguuguauuggcaagagggaggggugagagcuguuggagaacugagaaugagguuuuuuuuuu

SEQ ID NO: 448620 - RNA, 63 nt, hsa
uauugcccugcaacgucccaucuauacgagguguuggagaaggugaagaacccucccauucac

SEQ ID NO: 448621 - RNA, 63 nt, hsa
ccugcuugugcaggccaguggaggcucuugggcuuggagaacacgugugucucuguguaugug

SEQ ID NO: 448622 - RNA, 63 nt, hsa
guggggcaacguguggaggaagccccucauaauuuggagaaaacuugauacaauagaagcuga

SEQ ID NO: 448623 - RNA, 63 nt, hsa
aaccuguucaagucuaccaauuauaagggcaaauuggagaaaaagaaaaaauauauacucaag

SEQ ID NO: 448624 - RNA, 63 nt, hsa
guuuguuuguuggaguggugccagguacugguuuuggagaacuugucuacaaccagggauuga

SEQ ID NO: 448625 - RNA, 63 nt, hsa
agugcauaccagaauugaauauaccauaugggauuggagaaagacaaauguggaagaaaucau

SEQ ID NO: 448626 - RNA, 63 nt, hsa
ugagaaagggaaaagacacacaagucgcguggguuggagaagccagagccauuccaccucccc

SEQ ID NO: 448627 - RNA, 63 nt, hsa
uggcgugcucuagcccucucaguuaccagcucuuuggagaaggaucaaaauucagauggaaug

SEQ ID NO: 448628 - RNA, 63 nt, hsa
ugaaacagacuacucuuugccuuuuugcugcaguuggagaagaaacugaauuugaaaaauguc

SEQ ID NO: 448629 - RNA, 63 nt, hsa
aaagaauuuaaaguggcuccuuuaauuggugacuuggagaaagcuaggucaaggguuuauuau

SEQ ID NO: 448630 - RNA, 63 nt, hsa
acagaguuugggggagagagcaagauggguuccuuggagaagcugauuugccaagaugcacau

SEQ ID NO: 448631 - RNA, 63 nt, hsa
gccaccuaagcaguaaaacaugauauugaccacuuggagaacucagaaaauuauuuuaaauuu

SEQ ID NO: 448632 - RNA, 63 nt, hsa
agaaguaaaggaauauaugccuccuguguacuuuuggagaaaacugaagauuuaguuuccauu

SEQ ID NO: 448633 - RNA, 63 nt, hsa
ggaucauccuuuuguacuugaugcuggaagcucuuggagaaaaagcuuaaacauuucaccaga

SEQ ID NO: 448634 - RNA, 63 nt, hsa
acaaaacacaaguuggaccaaggagaaagcccuuuggagaaacuggacccuaguucaguuuag

SEQ ID NO: 448635 - RNA, 63 nt, hsa
gauuccuugaagagccuauuuaguuccauaaaauuggagaacugcugaaggucaguaauuccg

SEQ ID NO: 448636 - RNA, 63 nt, hsa
aacaugaugaauguggagaugcuugcuucagcauuggagaauucacaguaaagggaaacccug

SEQ ID NO: 448637 - RNA, 63 nt, hsa
accaacaacaacgaggaggagaagucccggcuguuggagaaggagaaccgugaacuggaaaag

SEQ ID NO: 448638 - RNA, 63 nt, hsa
uggagaugggggcgggggugguggugaagagaguuggagaaggaauggacgaauucuugagca

SEQ ID NO: 448639 - RNA, 63 nt, hsa
uagucucagagaucuguagggccgagguuacauuuggagaacccguacucuagggccaaaucc

SEQ ID NO: 448640 - RNA, 63 nt, hsa
guggccagcccauuuucuggggugaggcuugacuuggagaaaggcagaagagacgucccgcuu

SEQ ID NO: 448641 - RNA, 63 nt, hsa
uccagguuaaccuugauauacacagagauggucuuggagaauugugaauguauguacuguauu

SEQ ID NO: 448642 - RNA, 63 nt, hsa
ugccuauaauccuggcauuuuaggaggcugagguuggagaaucgcuugaggccagaagugcaa

SEQ ID NO: 448643 - RNA, 63 nt, hsa
aaguggccaaguccuuuaucaaaaagcugcuuuuuggagaagaugaugcauaaagcugugaua

SEQ ID NO: 448644 - RNA, 63 nt, hsa
gcccuaaccuaaaaucggagaguaauuuaugcuuuggagaauuugacucaaauauauacuuga

SEQ ID NO: 448645 - RNA, 63 nt, hsa
augugggguuuguaauaggugagaaauauuugcuuggagaagcucuugugcaauuagccuggc

SEQ ID NO: 448646 - RNA, 63 nt, hsa
uuuguuugguauguacaaaauggucagagcuaguuggagaaugagacaugcuuuuccagcugu

SEQ ID NO: 448647 - RNA, 63 nt, hsa
agucucuucagguagcuaaauuaggagcuuguuuuggagaaaugaagcaaaggugaaugacag

SEQ ID NO: 448648 - RNA, 63 nt, hsa
uacuuugugcuuuaugguuuuuauaaugucuuuuuggagaaauugccgaaaaguugccaaaua

SEQ ID NO: 448649 - RNA, 63 nt, hsa
ggaauauuuucuucuuaagauauauagaggauuuuggagaagagagacaggagggguaaaacc

SEQ ID NO: 448650 - RNA, 63 nt, hsa
uuaacaauauacauauguuccgucuuugcuguuuuggagaaugauggauaaguaguguuuccu

SEQ ID NO: 448651 - RNA, 63 nt, hsa
cuccauuuuuaucaagguuuuccaugguuaaguuuggagaaaauaccacacaaaacaaugaau

SEQ ID NO: 448652 - RNA, 63 nt, hsa
uucgauuuuucuggucuguggagaaacugugaauuggagaaauggagcucuguggcuucccac

SEQ ID NO: 448653 - RNA, 63 nt, hsa
uuuuuuucucucacuauaguauaagaaucuauuuuggagaaaaaaagaaaauaugagggucuc

SEQ ID NO: 448654 - RNA, 63 nt, hsa
ggggggagggggaugggguccuucuaggaguccuuggagaaaaguaagaaaccaggaguguuu

SEQ ID NO: 448655 - RNA, 63 nt, hsa
accagggcaggagaggacucagccuccuguguuuuggagaaggggcccaauguguguugacga

SEQ ID NO: 448656 - RNA, 63 nt, hsa
gcucaaauguuguucaacaccagaaaauuuauauuggagaaaagcacuguaaauguaaugcau

SEQ ID NO: 448657 - RNA, 63 nt, hsa
guucaaacuuuguucaauaccaggaaauuuauauuggagaaaaacccuaugaguguaaugaau

SEQ ID NO: 448658 - RNA, 63 nt, hsa
ugucacgcuugauuguagguaagauaauuuauauuggagaaaaauccuccaaguaugaagaau

SEQ ID NO: 448659 - RNA, 63 nt, hsa
gcucaaacuuuguucgacaucagggaauuuguauuggagaaaaacccugcaaauguaauaaau

SEQ ID NO: 448660 - RNA, 63 nt, hsa
uugccuugaucuggcacuuacugauacaagcauuuggagaagagaaaauucaaauauaagaaa

SEQ ID NO: 448661 - RNA, 63 nt, hsa
ggacuuuccugugauuuguuuuuaaucauucauuuggagaagaggcaugaccuuuguauuuca

SEQ ID NO: 448662 - RNA, 63 nt, hsa
caugcuauuaguauuuucauaccuuagucacauuuggagaauucacaugggaauaaaauucca

SEQ ID NO: 448663 - RNA, 63 nt, hsa
gcagguuugguuuuuucucauuugucuguggcauuggagaauauucucgguuuaaacagacua

SEQ ID NO: 448664 - RNA, 63 nt, hsa
uuauugucuagugaaacucguuaauuuguaguguuggagaagaacugaaaucauacuucuuag

SEQ ID NO: 448665 - RNA, 63 nt, hsa
uccauguagucuucaauuuuuaauuuuuaagaauuggagaauuucuaauguuaaaguuaguuu

SEQ ID NO: 448666 - RNA, 63 nt, hsa
aauaucugcauuaugcuggaaaaaaauagaccuuuggagaauacuuaaauaaaacaugugcau

SEQ ID NO: 448667 - RNA, 63 nt, hsa
caggugauucuguaaguugucccucaacuguacuuggagaaaucguguuuuaaagcaguaguc

SEQ ID NO: 448668 - RNA, 63 nt, hsa
ugcaggaauagcaacagcaauuuccgggaggucuuggagaagcuggagagcgaccccgucugc

SEQ ID NO: 448669 - RNA, 63 nt, hsa
cuuuuauuaguucuuugauagcuaagaugguuguuggagaaagugcuuaagccacuguuuaug

SEQ ID NO: 448670 - RNA, 63 nt, hsa
uccuguaaaugaaugcucugggcuagauacagcuuggagaaccugcuggccuuguuagacagc

SEQ ID NO: 448671 - RNA, 63 nt, hsa
aggaaagccuggguuggguggagcagaaccaucuuggagaagaugacaguucccuguccuccc

SEQ ID NO: 448672 - RNA, 63 nt, hsa
acacccccuuccaaauucuguaacacauuguaauuggagaagaaggaaacucugcaaggcuaa

SEQ ID NO: 448673 - RNA, 63 nt, hsa
aagcuuguuguuggaagagcagcauuuugacccuuggagaagaaaaacuagcuguggcauucc

SEQ ID NO: 448674 - RNA, 63 nt, hsa
accgagcuggaagcaagccauuuaauccgguucuuggagaaacauaugaauguauucgggagg

SEQ ID NO: 448675 - RNA, 63 nt, hsa
ugucuucaagugaccuguacugcuuggggacuauuggagaaaauaagguggaguccuacuugu

SEQ ID NO: 448676 - RNA, 63 nt, hsa
agucuuuuguauuuucccugccgaagugaauuguuggagaauguaaaccgccuccacguggcg

SEQ ID NO: 448677 - RNA, 63 nt, hsa
gaguguuccugugcccauauuuaaugugugaccuuggagaaguuacucuguaggcaugacagc

SEQ ID NO: 448678 - RNA, 63 nt, hsa
guuugucauggugaaauuauaacuauuacaguguuggagaacaacaaauauguucucugaaug

SEQ ID NO: 448679 - RNA, 63 nt, hsa
cugggugcagaagcuguggggucggagaggcguuuggagaaggucuguggugcagugugugaa

SEQ ID NO: 448680 - RNA, 63 nt, hsa
aauuacugaauauuucagagcaaagcuaucaacuuggagaaacagggauuaaaaauaaggaua

SEQ ID NO: 448681 - RNA, 63 nt, hsa
uuaaaaacuauauucaguaaaagccugcucaauuuggagaaauagaaccacaaacacagauca

SEQ ID NO: 448682 - RNA, 63 nt, hsa
cccacagaagucaucagaccuuaccaaaguagguuggagaauuagauugccuuuucaugcagu

SEQ ID NO: 448683 - RNA, 63 nt, hsa
augauaugaagggggacuuaucuccugcagagauuggagaagguagaggaggagaaagaaucc

SEQ ID NO: 448684 - RNA, 63 nt, hsa
gggcgcuguaaguuaagcucuacauagauuaaauuggagaaacguguuaauuguguggaauga

SEQ ID NO: 448685 - RNA, 63 nt, hsa
uuccuuuuuuuguuuguuuguuuguuuguuuuuuuggagaagagcauccucuuuuguguaguu

SEQ ID NO: 448686 - RNA, 63 nt, hsa
uuaaaagaaagauuucccauugcauacagguuauuggagaaauuuuccuuuuguugcauuugu

SEQ ID NO: 448687 - RNA, 63 nt, hsa
ucugaguguugccugcugaacucggaggggaguuuggagaaauuuuagacagcagcucugugu

SEQ ID NO: 448688 - RNA, 63 nt, hsa
cacacuaccaggcccugcagccacaguguucuguuggagaaacuuggggaaguguuuucugaa

SEQ ID NO: 448689 - RNA, 63 nt, hsa
uucccagaaucagacuuuugaagaugaaugacuuuggagaagcaaauuaaacauuuggcccug

SEQ ID NO: 448690 - RNA, 63 nt, hsa
guggagauaaauguccuagagucaccaggucgcuuggagaagucauuuaagcugccucggguu

SEQ ID NO: 448691 - RNA, 63 nt, hsa
aaaauauaacuucaagaaaagaguaaacauccauuggagaacacggcugaaaauuauugugcu

SEQ ID NO: 448692 - RNA, 63 nt, hsa
aaagaucaugaauuugugacuuaguucugcccuuuggagaacaaaagaaagcagucuuccauc

SEQ ID NO: 448693 - RNA, 63 nt, hsa
aacaauggugccccagaaagcugcaggugguguuuggagaagcaguuacuuuucaguuacaag

SEQ ID NO: 448694 - RNA, 63 nt, hsa
aagcaguauuuaaugcaauuuccaguuauuucuuuggagaauuuuaugucauuguuccauuac

SEQ ID NO: 448695 - RNA, 63 nt, hsa
ugaguucagaugaucacaaacaggugaguuuuguuggagaagaaaguuggaguaggagacuuu

SEQ ID NO: 448696 - RNA, 63 nt, hsa
caauaagaggcucuguuuuccacugaagcuuuguuggagaaagagaauaugaaaauuacacau

SEQ ID NO: 448697 - RNA, 63 nt, hsa
ugugaagacaugaaaguuuaauguacagaaugguuggagaaaugccuauggugaauuaaagcu

SEQ ID NO: 448698 - RNA, 63 nt, hsa
auugccuuuguguuaauagucaaauacuuaccuuuggagaauacuuaccuuuggaggaaugua

SEQ ID NO: 448699 - RNA, 63 nt, hsa
auaaccuugcugauaagaaaaaaagggacaauauuggagaaacuaccucuuguuuaauugauc

SEQ ID NO: 448700 - RNA, 63 nt, hsa
cugguaccuuccccuccugccccugcaccagcuuuggagaauggauuuggagugucuugggcg

SEQ ID NO: 448701 - RNA, 63 nt, hsa
agaaaucagaggagagacgguguugggagcccuuuggagaacgccagucucccaggcccccug

SEQ ID NO: 448702 - RNA, 63 nt, hsa
agcaguguagacaaacccuuggggcuuuuuuauuuggagaaccguccagcaugcauccuggcc

SEQ ID NO: 448703 - RNA, 63 nt, hsa
cacguugucauugugagucuauagcuugacuccuuggagaacaauauucauuugguuguggag

SEQ ID NO: 448704 - RNA, 63 nt, hsa
uuucaucaacauguagagcugcuauuuuacuauuuggagaauaugaugugaaaauuggaccuc

SEQ ID NO: 448705 - RNA, 63 nt, hsa
caaaauagcagaaauuguaaaaauuaugaauuauuggagaaaaugccauuacuuguauaucug

SEQ ID NO: 448706 - RNA, 63 nt, hsa
cugcagaauauuguaauugcaugcauaccgauauuggagaaaucugggucagccaaguuucau

SEQ ID NO: 448707 - RNA, 63 nt, hsa
caaagucuuguacugaagcagucuccuuguugcuuggagaacaccuccuucagagcccuuugu

SEQ ID NO: 448708 - RNA, 63 nt, hsa
augaggaaaagaagagccuuugcugauaaagaguuggagaacauuaugcuggagagagaauau

SEQ ID NO: 448709 - RNA, 63 nt, hsa
guggauuaauauuaaaacuauguauauuaaucauuggagaagggggaagaggaaaugaaaaua

SEQ ID NO: 448710 - RNA, 60 nt, hsa; identical to SEQ ID NO: 445315

SEQ ID NO: 448711 - RNA, 63 nt, hsa
ugcaaaagaaauaggcuuuucuucuuuuuuaaauuggagaaaucucugcucugguugaccugg

SEQ ID NO: 448712 - RNA, 63 nt, hsa
aggcaucuguggggaaucccagccugcagguucuuggagaagcaggugaaccuaaggaugaaa

SEQ ID NO: 448713 - RNA, 63 nt, hsa
ucaugcacaucagcugguggagcaggccuggccuuggagaacgagaccugugugccaggggca

SEQ ID NO: 448714 - RNA, 63 nt, hsa
cguccuugugaagcucgucuccauguggcuuucuuggagaaaggcuccccuggggcaagaggg

SEQ ID NO: 448715 - RNA, 63 nt, hsa
ggagaggucaggagaccgaccccaccacuaacuuuggagaaaauguggguuugcuuuuuaaag

SEQ ID NO: 448716 - RNA, 63 nt, hsa
uuucuggaaaaguuaaaaaaaguuacaugucauuuggagaaaauacguaaucagaaauuugug

SEQ ID NO: 448717 - RNA, 63 nt, hsa
cggccaauguccaaaauuacgguuugaacauaauuggagaaccuuuccuucaagcagaaacaa

SEQ ID NO: 448718 - RNA, 63 nt, hsa
cggccaagggccacgggaacuuggagagggagcuuggagaacucacugugggcuagggugguc

SEQ ID NO: 448719 - RNA, 63 nt, hsa
cguguguuuuuuagagcuugguucuuuaaagauuuggagaagauauguaaauuaccaaggcac

SEQ ID NO: 448720 - RNA, 63 nt, hsa
uguaaaaaguacucagaaaaacaucuaaagcuguuggagaagagggacucauauaaauaguug

SEQ ID NO: 448721 - RNA, 63 nt, hsa
ugcuuuugcaagacuggaauuccuuggacaccauuggagaagccccgcuuuuucuggaacagc

SEQ ID NO: 448722 - RNA, 63 nt, hsa
guuuuuaaaacauggauguuaaggcuguuuugcuuggagaagacuugggacugggacagucuu

SEQ ID NO: 448723 - RNA, 63 nt, hsa
agaacaaaagcuuuuaguuguuuuuguuuuguuuuggagaauuuguuuaccaguaaauacauc

SEQ ID NO: 448724 - RNA, 63 nt, hsa
uuuaaaaagaagagaaagaagauauacuuugcuuuggagaaaucuacuuuuugacuuacaugg

SEQ ID NO: 448725 - RNA, 63 nt, hsa
uccgccccauccugcagggccuuguuuuuguauuuggagaaccucgcccaucccccccgcggc

SEQ ID NO: 448726 - RNA, 63 nt, hsa
auuccuuuuuucaaaauccaaaaagaaaugauguuggagaagggaaguugaacgagcauaguc

SEQ ID NO: 448727 - RNA, 63 nt, hsa
uuuacuaaauauacaagauuuacuacuagaaauuuggagaaagaacacuaacacauguacuug

SEQ ID NO: 448728 - RNA, 63 nt, hsa
aacucaugagagacaagcaguaagaaacuucuuuuggagaaacaacagaccagaucuuuacuc

SEQ ID NO: 448729 - RNA, 63 nt, hsa
cuacaguuucacagaauaccugagaagacacacuuggagaaaccuuuuggguguaaugaaugu

SEQ ID NO: 448730 - RNA, 63 nt, hsa
gccuuacuucuacuuccagaugcagugccucuuuuggagaagacauguuuauuuuucauguuc

SEQ ID NO: 448731 - RNA, 63 nt, hsa
gagggaagaguguguccuggcaggaagccaccauuggagaaggugaggccaguaaccaucuca

SEQ ID NO: 448732 - RNA, 63 nt, hsa
auuuuacauaucuguuuggauuauagcuaggauuuggagaauaaguguguacagaucacaaaa

SEQ ID NO: 448733 - RNA, 63 nt, hsa
uuuuaagcaagagaaagacaacuguucugcggguuggagaaaauacaauuuuuuuuuuuuuuu

SEQ ID NO: 448734 - RNA, 63 nt, hsa
cuauugcugcauacccggggugggauggggugguuggagaaccagaacuauuuuuaaaacauu

SEQ ID NO: 448735 - RNA, 63 nt, hsa
ugaacuggggaauuugaacauuccuuuacauuguuggagaaaugaagccaaaguuauucagau

SEQ ID NO: 448736 - RNA, 63 nt, hsa
cuauaugguucuccaagaaacugaaugaauccauuggagaagcgguggauaacuagccagaca

SEQ ID NO: 448737 - RNA, 63 nt, hsa
uuauguucuuuagacacugcuaccugaaaacuguuggagaaauaauguuuaaaguuauuuaag

SEQ ID NO: 448738 - RNA, 63 nt, hsa
uaaaacccugaugcaaacuucuccuuucagugguuggagaaauuggccgaguucaaccauuca

SEQ ID NO: 448739 - RNA, 63 nt, hsa
aauucuaaccaaaccccagacauagggagucauuuggagaaagccuguaugugguguuuuaac

SEQ ID NO: 448740 - RNA, 63 nt, hsa
auggucagccuaaggguaauguacagcccgugcuuggagaaccauggaagcuacaccccuaca

SEQ ID NO: 448741 - RNA, 63 nt, hsa
agaacuguggugccaaauugcuggugucucucuuuggagaaaccaaccagauacaucugcugg

SEQ ID NO: 448742 - RNA, 63 nt, hsa
uugccaaauaacaaaagcauacaaugcauacuguuggagaacaagaaugcuacuguauuuuac

SEQ ID NO: 448743 - RNA, 63 nt, hsa
auaccuugaucuuucccacuuucuguuuucggauuggagaagauguaccuuuuuugucaacuc

SEQ ID NO: 448744 - RNA, 63 nt, hsa
accuuaaauaaaagugauugugacuaaggcacguuggagaacauuccaaucuuuccucccaag

SEQ ID NO: 448745 - RNA, 63 nt, hsa
aaagcuaaauaaccuuuaagaaugugggugguauuggagaaagaagaugaauuauagcuccgg

SEQ ID NO: 448746 - RNA, 63 nt, hsa
uguaucuacucuguggaguagaaccaagucuacuuggagaaaagaaccaaguccuuggauauc

SEQ ID NO: 448747 - RNA, 63 nt, hsa
aagucacaccuaccacugagcagcuguacgacuuuggagaaguuguuuaacauuuucaagccu

SEQ ID NO: 448748 - RNA, 63 nt, hsa
cacuccaguauuaauauuugugcuaccaucuacuuggagaaguuuaaugagaaaauuuuagaa

SEQ ID NO: 448749 - RNA, 63 nt, hsa
cccauaggaugucauauugaggcccaaacuugauuggagaauuugcaaacuaccgucgcucag

SEQ ID NO: 448750 - RNA, 63 nt, hsa
augcagauuacacugaucuuauguguuacaaaauuggagaaaguauuuaauaaaaccuguuaa

SEQ ID NO: 448751 - RNA, 63 nt, hsa
ugcguucugccuuccuuguuaauuuuguaauaauuggagaagauuuaugucagcacacacuua

SEQ ID NO: 448752 - RNA, 63 nt, hsa
cauuggugucucuuuuuuccuuuccuuucgacauuggagaauuggagugcagucauaaucuua

SEQ ID NO: 448753 - RNA, 63 nt, hsa
guccuuuccuuucugaaaauaaaguuuugugcuuuggagaaugacucgugagcacaucuuuag

SEQ ID NO: 448754 - RNA, 63 nt, hsa
acccuaggggggcaccugcgccuguguggaaauuuggagaaguugcggcagagaagccaugcg

SEQ ID NO: 448755 - RNA, 63 nt, hsa
uuucccagugugucuuuuaugucuuugaauguuuuggagaaaagucuaugccugucuaaaaau

SEQ ID NO: 448756 - RNA, 63 nt, hsa
auuuuaaauuaaagccuucuaauguuccacuguuuggagaacagaagauagcaggcuguguau

SEQ ID NO: 448757 - RNA, 63 nt, hsa
gcaaacacuguguauagugagacuuguucuacuuuggagaacagguuaccuuuugaaaaugag

SEQ ID NO: 448758 - RNA, 55 nt, hsa; identical to SEQ ID NO: 445363

SEQ ID NO: 448759 - RNA, 63 nt, hsa
agucaguuuaguucauauguucugaaaacuguuuuggagaaagauagacagaaaaaugucauc

SEQ ID NO: 448760 - RNA, 63 nt, hsa
aauucucagaaccagucucagggagauauaugcuuggagaacucugccuuccaucaacugcag

SEQ ID NO: 448761 - RNA, 63 nt, hsa
ccaugaauuaagauggaugacuggaaaaagguguuggagaaagaguuaaagaugaggaagaga

SEQ ID NO: 448762 - RNA, 63 nt, hsa
caaguaccaggaggacauaaccgcuguggccuguuggagaacagccaguagccuugguaauau

SEQ ID NO: 448763 - RNA, 63 nt, hsa
uuguuacaugaaagugauagauagcaacaaguuuuggagaagagagagggagauaaaaggggg

SEQ ID NO: 448764 - RNA, 63 nt, hsa
auuuucuacaugaaucaaacacagaaacaacuuuuggagaaauuaaauucugagugugacuuc

SEQ ID NO: 448765 - RNA, 63 nt, hsa
gcuccccugacacugaagaggauccacaacuccuuggagaaacacccucacgucuguugccgc

SEQ ID NO: 448766 - RNA, 63 nt, hsa
uauauagauguaucuuuuaaaaauaguucacguuuggagaauucuuuuguacucauuugcuuu

SEQ ID NO: 448767 - RNA, 63 nt, hsa
agcucugacuuugcuguuuccagugguaugaccuuggagaagucacuuauccucuuggagccu

SEQ ID NO: 448768 - RNA, 63 nt, hsa
uucucucuggacucuugccuagcucacaaggcuuuggagaauugucuuccuaaaucggggcac

SEQ ID NO: 448769 - RNA, 63 nt, hsa
uggaaagcaucuaguccagugggaagccagggguuggagaaggugcuacaucccucuucccau

SEQ ID NO: 448770 - RNA, 63 nt, hsa
ccuucuagaaucagaucuguuuggggcuggggguuggagaauaaaagcaggagaagucuaugg

SEQ ID NO: 448771 - RNA, 63 nt, hsa
cucugcuguguucuguguguccaguguagccuauuggagaaucggucucauuagagugacucu

SEQ ID NO: 448772 - RNA, 63 nt, hsa
guuguuuaauagagaaaauguacacagacugauuuggagaacacauucucugaaaauacugua

SEQ ID NO: 448773 - RNA, 63 nt, hsa
uccauauccagguuagcugguaagaggauuuuuuuggagaaaaaaaugauauuuagaaaguua

SEQ ID NO: 448774 - RNA, 63 nt, hsa
aacuuguauuacauaucaaauaaaugauacaucuuggagaagagggaggaauaggagcaaauc

SEQ ID NO: 448775 - RNA, 63 nt, hsa
gaaggaguuuuauguuaaaccauccauguauuuuuggagaagagagaggaaagguuugagaag

SEQ ID NO: 448776 - RNA, 63 nt, hsa
gucaagguuguccccagaccuugcuugcagugguuggagaacccagggggcugccuugggccc

SEQ ID NO: 448777 - RNA, 63 nt, hsa
gucuuugggagggaagaagguacagaagaaagauuggagaagggccucucuagcagucaacuc

SEQ ID NO: 448778 - RNA, 63 nt, hsa
ugagggugcccaccaagcccaccuuccagaaacuuggagaaauggggguugggaacuuaugca

SEQ ID NO: 448779 - RNA, 63 nt, hsa
cagcugugguuggaucaaggacucauuccugccuuggagaaaauacuucaaccagagcaggga

SEQ ID NO: 448780 - RNA, 63 nt, hsa
gcaugaaagucaaaacuggaauuuucuaaagcuuuggagaaaaggagagaauuaguagggcaa

SEQ ID NO: 448781 - RNA, 63 nt, hsa
gguucaguggcuggaguauuaggggccuggggauuggagaacggagaagaaguuguagcagag

SEQ ID NO: 448782 - RNA, 63 nt, hsa
aaaaaauuuuacugucuaaauaaguaccuuuuauuggagaaaaaucaaaaccccaaacaaaca

SEQ ID NO: 448783 - RNA, 63 nt, hsa
guugaaauaaugauaguagguauguauuauggauuggagaagcacuuauuacacuaucuaacc

SEQ ID NO: 448784 - RNA, 63 nt, hsa
aaugcucuauccucuaagguuggaacucugaaguuggagaagguggaauaaaguuacaccugg

SEQ ID NO: 448785 - RNA, 63 nt, hsa
agguuugaccaggaaagcagcgcuaguggaggguuggagaaggagguaaaggaugaggguuca

SEQ ID NO: 448786 - RNA, 63 nt, hsa
aggaacaagaagagacccuuguucaauaugaucuuggagaacacgguuuugaaagcaacuccu

SEQ ID NO: 448787 - RNA, 63 nt, hsa
aauaaaugugaaggcugugaagaguggacagucuuggagaacacagugcuugaaauggacaag

SEQ ID NO: 448788 - RNA, 63 nt, hsa
ucgcugucucccuagagccagggcccugcggauuuggagaagggagcggggcaggacuuccag

SEQ ID NO: 448789 - RNA, 63 nt, hsa
gagaaagguuuuagacuccaguuuaccuuucucuuggagaaacucaaugcuaaucccaccuuu

SEQ ID NO: 448790 - RNA, 63 nt, hsa
uguucacacacuuuucuugcguacucaacuaaauuggagaauguuucugaagaaaauuggaug

SEQ ID NO: 448791 - RNA, 63 nt, hsa
aaggcucgaguucugcuguucuguaaaagagaauuggagaaugaaaccugcuccaacagagau

SEQ ID NO: 448792 - RNA, 63 nt, hsa
ccugucauuucuguucuugucccucauacaucuuuggagaaccgggcuccagacuuuguuccc

SEQ ID NO: 448793 - RNA, 63 nt, hsa
ggacaggacccagcccugcaccguucacuguauuuggagaaaaugguaagaguuccauaccgg

SEQ ID NO: 448794 - RNA, 63 nt, hsa
guguauguguggaaauaaaaauguauuguacuuuuggagaauuuuuuguaggcauuuuucugu

SEQ ID NO: 448795 - RNA, 63 nt, hsa
ggcucuggccaucugcaacccugaacgugcagguuggagaacgaaugaauacaaauuuuauug

SEQ ID NO: 448796 - RNA, 63 nt, hsa
agccuuuccuacauccuucccucacucccaugauuggagaaaugauucauugggugaugagug

SEQ ID NO: 448797 - RNA, 63 nt, hsa
gcagcugggcugucagggccauaguagcucccuuuggagaacagggaaagccuggaggcuucc

SEQ ID NO: 448798 - RNA, 63 nt, hsa
acagugcaacaaguaacgagacuauuuuguauuuuggagaauucauauuauggagaaccuaac

SEQ ID NO: 448799 - RNA, 63 nt, hsa
auuccuaccaggaaagaauacauauccaauagauuggagaaagccagagauuagcccucauuc

SEQ ID NO: 448800 - RNA, 63 nt, hsa
auuuuucacaaagagcaaugacuuuauuuugcauuggagaacuccuggagauaagcuguacaa

SEQ ID NO: 448801 - RNA, 63 nt, hsa
guuagugagggccucaaguccaaggcuuuaucuuuggagaaggcaaggaaggaggcggugaca

SEQ ID NO: 448802 - RNA, 63 nt, hsa
gucuucauuuggggccaaaggggaaacuuuuuuuuggagaaggcgucuugcuuugucacccac

SEQ ID NO: 448803 - RNA, 63 nt, hsa
aggaucugauacaucuaguuauuggucuggaaauuggagaaauggaggugagcaaauuaacgg

SEQ ID NO: 448804 - RNA, 63 nt, hsa
aauuaaagaaccuggugggugugcacuaugagauuggagaaaugaauuaaguugacuugaaau

SEQ ID NO: 448805 - RNA, 63 nt, hsa
uguuuaaaagaaaaucaggugggugggaaucucuuggagaacugaggcugaggguagagggag

SEQ ID NO: 448806 - RNA, 63 nt, hsa
cugacugggacccugaagaggcauuucagaguguuggagaagaaucuguagcuuguugaaaaa

SEQ ID NO: 448807 - RNA, 63 nt, hsa
uuucaaaaaccuaauccguaguaauuccuaaucuuggagaauaaaaaagggcgguggagggga

SEQ ID NO: 448808 - RNA, 63 nt, hsa
aauuaaauacauuucauugagcuuuaaaguacuuuggagaaacuuuggggcacguuuuccuac

SEQ ID NO: 448809 - RNA, 63 nt, hsa
agaggaacuuggaucuuccggagaaugauguucuuggagaacaggcagaucaaaagaggugaa

SEQ ID NO: 448810 - RNA, 63 nt, hsa
auaaaagaaguugugcuauuuaacucugaauacuuggagaaacuaggugaagaugcaaccaga

SEQ ID NO: 448811 - RNA, 63 nt, hsa
ucaaguaguuuuaauauguaaauuugcaaguuuuuggagaacccccaaacuccuucuccacug

SEQ ID NO: 448812 - RNA, 63 nt, hsa
gaaaaaugcucucccagcaaagcugagacaaaauuggagaagcugcagccucacgcaccaucc

SEQ ID NO: 448813 - RNA, 63 nt, hsa
uugcacaucaguaugugccaaaucuacuagacauuggagaaacaguaggaacaacacauggua

SEQ ID NO: 448814 - RNA, 63 nt, hsa
uuauuucugcagguuggugaaaacccuguguccuuggagaaagcugguucccguuuuccagag

SEQ ID NO: 448815 - RNA, 63 nt, hsa
cuuguguggucagcucuucccuucaucacauacuuggagaacaaaggacaccguuacccaugc

SEQ ID NO: 448816 - RNA, 63 nt, hsa
gauuuauggaguaaggacuuaaaaucauacaucuuggagaaccuuucuuacucauuucagucc

SEQ ID NO: 448817 - RNA, 63 nt, hsa
cuggagccauaaaguuaauuugcaccuagcuuuuuggagaauagccaugauuaacugcuauuc

SEQ ID NO: 448818 - RNA, 63 nt, hsa
aguuuuuuaaaaauagacuguaguauccuuucauuggagaauuuacaaaaauaucaucuacag

SEQ ID NO: 448819 - RNA, 63 nt, hsa
uucaaaccaaagaaacaaugaucuacucaaacauuggagaaaaaaacugccagaggaggaguu

SEQ ID NO: 448820 - RNA, 63 nt, hsa
cagcuuucgucugucaucagacauugaagagauuuggagaaauguaaagcagcaguacucuuc

SEQ ID NO: 448821 - RNA, 63 nt, hsa
agauggguauauaacaguuuggaaauacuaucuuuggagaauguauuuuuguauuuauaaauc

SEQ ID NO: 448822 - RNA, 63 nt, hsa
ugagcaggcacauugacuuucuguugagguaccuuggagaagcugagccauucugaggacauc

SEQ ID NO: 448823 - RNA, 63 nt, hsa
auuuuuaaaggaauauuucagaguuuaaucuuuuuggagaaguuauguucuuuaaucggguac

SEQ ID NO: 448824 - RNA, 63 nt, hsa
uauguauguucagccagauaguaaaugggauuuuuggagaaauaagauaacuacaaaguuucu

SEQ ID NO: 448825 - RNA, 63 nt, hsa
aaguauuaucuaauuaaguucaugauagugcuuuuggagaacuugucaaauuacagccaauga

SEQ ID NO: 448826 - RNA, 63 nt, hsa
gcuaggaauuguuaagcacauugcagauuguucuuggagaauucuggaguuguuaugaacaug

SEQ ID NO: 448827 - RNA, 63 nt, hsa
ugcaucacugaggaugaaacugacuuuugucuuuuggagaaaaaaaacuguacugcuuguuca

SEQ ID NO: 448828 - RNA, 63 nt, hsa
auaauagagauugauaagauuuagcaacugguguuggagaaaaaaagaaaagcaaaugagugu

SEQ ID NO: 448829 - RNA, 63 nt, hsa
uuuuccaguauuaaacacucauaugcuuauggcuuggagaaauuucuuaguugggugaauuaa

SEQ ID NO: 448830 - RNA, 63 nt, hsa
uucuuguucccguagaagaaagaagaaagguguuuggagaauucgagugccuaggaugccaga

SEQ ID NO: 448831 - RNA, 63 nt, hsa
aagacaaagauauuuagguugagcagcuauuaauuggagaauugguacagagacgcuccagau

SEQ ID NO: 448832 - RNA, 63 nt, hsa
agccuggcugcagcuucccauuugguuacgagguuggagaaaaagucaaaguccccuccuggg

SEQ ID NO: 448833 - RNA, 63 nt, hsa
auagcaucuggaagaucauuuugaaauuguuccuuggagaaaugaaaacaguguguaaacaaa

SEQ ID NO: 448834 - RNA, 63 nt, hsa
cuuucuugucaaacaaaaccaauggcucuggguuuggagaacacaguggcugguuuuaaaaau

SEQ ID NO: 448835 - RNA, 63 nt, hsa
ugccuuucccaaaugggaaaggugcugacagaguuggagaaaaaagaauagacucauuuuucc

SEQ ID NO: 448836 - RNA, 63 nt, hsa
gcuugugcugggaaaugcaacucacucauguauuuggagaaacaggaguguucacuuaucuag

SEQ ID NO: 448837 - RNA, 63 nt, hsa
aaacuucuuuuaaaccucaccuuugugggguuuuuggagaagguuaucaaaaauuucauggaa

SEQ ID NO: 448838 - RNA, 63 nt, hsa
ggagagauauuuucuuauguuuauucggagaauuuggagaagugauugaacuuuucaagacau

SEQ ID NO: 448839 - RNA, 63 nt, hsa
ucaauauaacaauauaauccuaaaccuugacaguuggagaagccaaugcagaacugaugggaa

SEQ ID NO: 448840 - RNA, 63 nt, hsa
aguuuaaaaauucuuuaaacagguauuuugauauuggagaauaacaugcauauaauucuguag

SEQ ID NO: 448841 - RNA, 63 nt, hsa
caaugcuuauauauuccuuagacuauugaaauuuuggagaaaauguauuuguguucacuucua

SEQ ID NO: 448842 - RNA, 63 nt, hsa
acaaaaaugaaaauauuuauaauaggacucgacuuggagaaauugcuauucuuccuguugucc

SEQ ID NO: 448843 - RNA, 63 nt, hsa
cuuaguugucauaaucccuuggagccuggguuuuuggagaaagagaucuccgugcccuacaga

SEQ ID NO: 448844 - RNA, 63 nt, hsa
uuuuagauaggaucuaggagugauuuuauuguuuuggagaauggaagggcccccauggcccug

SEQ ID NO: 448845 - RNA, 63 nt, hsa
cuaaaaugaaccaaacccauauuucacuggugguuggagaaaaccauggccaaaacgauugug

SEQ ID NO: 448846 - RNA, 63 nt, hsa
ucaauguguauguggcuguuuguagugaauuuauuggagaaugagguuguccguguccuuaac

SEQ ID NO: 448847 - RNA, 63 nt, hsa
aaugaauugaaccauuucaacuauuuucuauauuuggagaaaguuugugcccuguguuuuaua

SEQ ID NO: 448848 - RNA, 63 nt, hsa
aucaacagcaaacuucagccguuucacuuuuuguuggagaaaaauaguagauuuuaauuugac

SEQ ID NO: 448849 - RNA, 63 nt, hsa
acugugccucagagaccagggcuccagccccucuuggagaagucucagcuaagcucacguccu

SEQ ID NO: 448850 - RNA, 63 nt, hsa
aagccagcuggacuuccugggucgaguggggccuuggagaacuuuucugucuuacaagaggau

SEQ ID NO: 448851 - RNA, 63 nt, hsa
gaauugcucauucauauuuuuucuguugcuugcuuggagaauuugcucuuuuuuuggcauaua

SEQ ID NO: 448852 - RNA, 63 nt, hsa
accuuugcacacucaccugagcccuggggacccuuggagaaauuaggugucaccugcuguggc

SEQ ID NO: 448853 - RNA, 63 nt, hsa
caugaaacauuugcaaaauuguuuuugguuggauuggagaaguaauccuagggaaggguggug

SEQ ID NO: 448854 - RNA, 63 nt, hsa
ugauaccaaacaauucaaaaguuggaucugaguuuggagaaagauauuuccaaccuaaguggg

SEQ ID NO: 448855 - RNA, 63 nt, hsa
caaacuauguagugugucccuauuauaaaugcauuggagaaguauuuuuaugagacucuuuac

SEQ ID NO: 448856 - RNA, 63 nt, hsa
uagaagucugcuaaagaucaaaugugaaaguacuuggagaaacugaggccucuuauguguaau

SEQ ID NO: 448857 - RNA, 63 nt, hsa
ucuguggagguggaaaagcaacauucauagucuuuggagaaaugcuuagaaauucagcauuug

SEQ ID NO: 448858 - RNA, 63 nt, hsa
ccuggagugacacuacacucuagaauuuccacuuuggagaauacucaguuccaacuugugauu

SEQ ID NO: 448859 - RNA, 63 nt, hsa
uuuaaaaauuuaacaugauugcuuuucucaauuuuggagaagauguuuaaauaguucuguugu

SEQ ID NO: 448860 - RNA, 63 nt, hsa
uuuuuacuugcggugacuauucuugccacaauauuggagaauaaugauagaugauauacuaga

SEQ ID NO: 448861 - RNA, 63 nt, hsa
gaaguucugccucugccuggggucuuggccacauuggagaaaaacaggcucaaaguggggcug

SEQ ID NO: 448862 - RNA, 63 nt, hsa
ugccccgagcccuagguggggccaggaggugccuuggagaagccagccagagcagagagggcu

SEQ ID NO: 448863 - RNA, 63 nt, hsa
cagacucugagaagcgaagaccaugucuccucguuggagaaacccaauagcaggggaagcugg

SEQ ID NO: 448864 - RNA, 63 nt, hsa
guguguaaugcaaauuaguuaaaacaaauaguuuuggagaaaguuaaaacuagcuuuagagua

SEQ ID NO: 448865 - RNA, 63 nt, hsa
cagaaucauucuccuuucugcccauaaagggccuuggagaauugcuuuaagaagagugaaugu

SEQ ID NO: 448866 - RNA, 63 nt, hsa
ggagccugggaccccgcaugucccaaaaugggauuggagaagcuggagagaaagcagaagagg

SEQ ID NO: 448867 - RNA, 63 nt, hsa
uuuuggguguuccuggcaguuuaaaaaaauugguuggagaauuuagguuuuuauuaguaccau

SEQ ID NO: 448868 - RNA, 59 nt, hsa; identical to SEQ ID NO: 445473

SEQ ID NO: 448869 - RNA, 63 nt, hsa
guguggugaugccaugcccaucaugggaggcuuuuggagaaacagaauguuugggcaggggcu

SEQ ID NO: 448870 - RNA, 63 nt, hsa
ucuuccacuggaacguuucacugcaaacacaccuuggagaaguggcaucagucaacagagagg

SEQ ID NO: 448871 - RNA, 63 nt, hsa
gaagccagcugggcuccugagucugguggggacuuggagaaccuuuaugucuagcuaagggau

SEQ ID NO: 448872 - RNA, 63 nt, hsa
ccacacucuguaucuggcuacucugguggggacuuggagaaccuuuguguccacacucuguau

SEQ ID NO: 448873 - RNA, 63 nt, hsa
acacccuccuggcacaacgcucuacccugcagcuuggagaacuccgcuggauggggagucuca

SEQ ID NO: 448874 - RNA, 63 nt, hsa
uggaucaccugaauucucucagcugucaauggcuuggagaacaucucaugggcccaagucauc

SEQ ID NO: 448875 - RNA, 63 nt, hsa
uuguugaaauagcuuuacuguuucucaaguguuuuggagaaaaaaaucaacccugcaaucacu

SEQ ID NO: 448876 - RNA, 63 nt, hsa
uggccaaagugaaggaaucuuuuuucaguuuuauuggagaaacugaaggguaacauucuaaca

SEQ ID NO: 448877 - RNA, 63 nt, hsa
gcuguggcugacaguggcucuggccaggguugcuuggagaaggcucagugugccugggacagg

SEQ ID NO: 448878 - RNA, 63 nt, hsa
aaagcggauaaaacuuucauuggacuggaauguuuggagaauguuaauuuccaaaucaggaac

SEQ ID NO: 448879 - RNA, 63 nt, hsa
guuuguaguuacauuuaggauggacuuaucccuuuggagaagagugaaguuuguuuuuucgcc

SEQ ID NO: 448880 - RNA, 63 nt, hsa
cggccuggccuagaccaggggugcagccagcuuuuggagaaccuggauggccuuaggguuccu

SEQ ID NO: 448881 - RNA, 63 nt, hsa
uugugacuuggaaagguacgcugcuggccagcauuggagaagaagcugcugagcauggcuuuc

SEQ ID NO: 448882 - RNA, 63 nt, hsa
ggucccaguucacauguaguccccugcucaccauuggagaaucagcucacugcucucuagaaa

SEQ ID NO: 448883 - RNA, 63 nt, hsa
accggccucaugacuagccuuguugccgucgaguuggagaaaguggugcugaaauccaccuuu

SEQ ID NO: 448884 - RNA, 63 nt, hsa
ugugauggugcaaggaauggauucaggauguuguuggagaaacaaguuugugauuaguccuua

SEQ ID NO: 448885 - RNA, 63 nt, hsa
ugccugacugccucagcagggaccgcaugccgcuuggagaagggguggccucgccggagcuag

SEQ ID NO: 448886 - RNA, 63 nt, hsa
uuuucuccagcaacugcagaggcauuucaggaguuggagaacggaguacauuuuuaaaauuuu

SEQ ID NO: 448887 - RNA, 63 nt, hsa
ggauggugaggacacagcuaugaucagggaauuuuggagaaacuacagcaucauggaugcugu

SEQ ID NO: 448888 - RNA, 63 nt, hsa
agacauaaacuuggaguccaucugguuuaauuauuggagaaucgauucccaaguccaggaaga

SEQ ID NO: 448889 - RNA, 63 nt, hsa
uacuuuuccucagaagauugagcugucuuuuauuuggagaauaaaaugaaguucugaaaaaaa

SEQ ID NO: 448890 - RNA, 63 nt, hsa
uugccaagaagugaucuguuuuaaaggucauauuuggagaaagggcaaggaauugggucugcu

SEQ ID NO: 448891 - RNA, 63 nt, hsa
ggauguguuugggggcggggggauggaagugacuuggagaauguguuugggaugaaauaacua

SEQ ID NO: 448892 - RNA, 63 nt, hsa
uauaaaccacugaaagggauagagaagugaacauuggagaaagccaguagcaacugugagaaa

SEQ ID NO: 448893 - RNA, 63 nt, hsa
ggaggaucaguagcuguuaugaugccagaccauuuggagaaguaucagaggccugaccggaca

SEQ ID NO: 448894 - RNA, 63 nt, hsa
aagcccuuggggugacucggcuuccaggagcuguuggagaaaugaggaugucugucccugucu

SEQ ID NO: 448895 - RNA, 63 nt, hsa
caacugcugguagcauuuaucugacuuggaaaguuggagaagaggcauuccuacuggagaaaa

SEQ ID NO: 448896 - RNA, 63 nt, hsa
cagguguggguguccuguuggaggagggcuuguuuggagaagggaggcuggcugggggagaaa

SEQ ID NO: 448897 - RNA, 63 nt, hsa
ggcucggaccccucacuggggacagggccaguguuggagaauucugauuccuuuuuuguuguc

SEQ ID NO: 448898 - RNA, 63 nt, hsa
agugagaauucgugcaucucugcucugugggguuuggagaaaugcuuuggcagaagagugaaa

SEQ ID NO: 448899 - RNA, 63 nt, hsa
cuuguguaaacguuugcagacacaggugcagcuuuggagaacucaccucuggcucuugugcuu

SEQ ID NO: 448900 - RNA, 63 nt, hsa
gggaagaugcuggacucauugaaaggugguugcuuggagaagggacauggggcugaaucucag

SEQ ID NO: 448901 - RNA, 63 nt, hsa
caaaaacuacauauuuguaggaaaucugccuuauuggagaaaaucacccuuucccuuuuucuu

SEQ ID NO: 448902 - RNA, 63 nt, hsa
cuccauagcuaccaaguuaaccugcucuaaacuuuggagaacuggaucuguccaauaaacgcu

SEQ ID NO: 448903 - RNA, 63 nt, hsa
ugccacucaguuccucugggugugcacauauguuuggagaaauagaggagagaaaagagggcc

SEQ ID NO: 448904 - RNA, 63 nt, hsa
cagauaucaaaccugaggaaggcagaagugaauuuggagaacuaggguagagagagguugcua

SEQ ID NO: 448905 - RNA, 63 nt, hsa
guugaaguccaaccuauuuaaaaaccccaccauuuggagaauuacaaggguuuuguccugaau

SEQ ID NO: 448906 - RNA, 63 nt, hsa
agccuucaugccuuccccacccuccagcuccucuuggagaagcuguugcugagaccccccccc

SEQ ID NO: 448907 - RNA, 63 nt, hsa
cagaaaucaggacauccccccuaucaggugguuuuggagaaaacaaggaaggcggaagaaugg

SEQ ID NO: 448908 - RNA, 63 nt, hsa
uuaacaacugaggaaggccagugcagaauauuuuuggagaacgauuuuuuuuuuaaauaauau

SEQ ID NO: 448909 - RNA, 63 nt, hsa
aacaacauaaaaauccuugcauaccuuguucaauuggagaauuuuaauguuuuucauuuauca

SEQ ID NO: 448910 - RNA, 63 nt, hsa
acaccuggcaucuguggcauguguucuggucacuuggagaagggcauguguggggugugugug

SEQ ID NO: 448911 - RNA, 63 nt, hsa
ugugggcgcgucugugguguguguccuagucacuuggagaagggugugugugggaugcgugug

SEQ ID NO: 448912 - RNA, 63 nt, hsa
aacugucugcccaggagccugagccucaggcuguuggagaagcaucugaugccuuuuucuuug

SEQ ID NO: 448913 - RNA, 63 nt, hsa
auggaagcauguguaaaauuauacuuucaguaauuggagaauucagagauugcauuucuagca

SEQ ID NO: 448914 - RNA, 63 nt, hsa
cuuguauugugauauuaacuggcaaagauccucuuggagaaaccuuucccagguacaguuuca

SEQ ID NO: 448915 - RNA, 63 nt, hsa
aaugaagcugauuuuuuagcugagauagaagcuuuggagaaaaugaaugaagaucacguucag

SEQ ID NO: 448916 - RNA, 63 nt, hsa
ucguuuuuguuucccuuuaguauuuaauggucuuuggagaaaaaauaauaaaacagaguguua

SEQ ID NO: 448917 - RNA, 63 nt, hsa
uuugccucccacacccagccacuaccucccagcuuggagaacaccucagaauucagaagauau

SEQ ID NO: 448918 - RNA, 63 nt, hsa
uugcacgaguguguuuuccucacacacuuugauuuggagaauuggugcuaguuggcaauagau

SEQ ID NO: 448919 - RNA, 63 nt, hsa
ucacagagauggaugcauguucugauugccucuuuggagaagcucaucagaaacucaaaagaa

SEQ ID NO: 448920 - RNA, 63 nt, hsa
agcaucguggaugggugcacggagacacgcaccuuggagaaaugaggggagauggaccaagaa

SEQ ID NO: 448921 - RNA, 63 nt, hsa
ggguuguuacaacugucacuagcggaggucacuuuggagaagggugggccuuacauccagugu

SEQ ID NO: 448922 - RNA, 63 nt, hsa
aauaaaauugcugggaauauuugacucuccguauuggagaaaauaaaauuacaacauuacgac

SEQ ID NO: 448923 - RNA, 63 nt, hsa
aucauuacuggaaaccuauuaaacauuagcaaauuggagaauaguuuuaauauaguaaaugua

SEQ ID NO: 448924 - RNA, 63 nt, hsa
gguagcgcugggggugauuuuaggcagcaagaauuggagaacucacacugcgaaaagaaaacc

SEQ ID NO: 448925 - RNA, 63 nt, hsa
uggggugugaaagccucaagugacucagccugguuggagaacugccccacccaguaucuucug

SEQ ID NO: 448926 - RNA, 63 nt, hsa
agucuucaguaacgcuacaacgauugcaaaucauuggagaauccauaaugaagagagaucuuc

SEQ ID NO: 448927 - RNA, 63 nt, hsa
acucaaaucauauuagacaucggagaaaucacuuuggagaaaggucuuuugagugcacugagu

SEQ ID NO: 448928 - RNA, 63 nt, hsa
uaaucaggugagccacucacccuccugcuggccuuggagaagcaaaaagccagggugugccag

SEQ ID NO: 448929 - RNA, 63 nt, hsa
acuccacagugacuugccacauuugccccccauuuggagaaugcuuuuauaucaaaaguggag

SEQ ID NO: 448930 - RNA, 63 nt, hsa
gaaaacaagaaauacugucaaggauguggaauguuggagaacauugugcacuaucacugggaa

SEQ ID NO: 448931 - RNA, 63 nt, hsa
cguauaagcucaaugaguauugauuuaggggcuuuggagaacuuugaaugcuaccccccaagu

SEQ ID NO: 448932 - RNA, 63 nt, hsa
acuuaaacuuuguucaacaucagggaauucagauuggagaaaaacccugcaaauguaauaaau

SEQ ID NO: 448933 - RNA, 63 nt, hsa
uuauuuaguuagaacacuucauuuuguuuuuaguuggagaacucuauagcccuuuaguuauuu

SEQ ID NO: 448934 - RNA, 63 nt, hsa
gacuacagcuuauucagccugggaaaaauaauguuggagaaauacucuaugaauagaauauac

SEQ ID NO: 448935 - RNA, 63 nt, hsa
uggacugcacuaacuuguggagucugcacuaacuuggagaaguuagugucagaauugaauuau

SEQ ID NO: 448936 - RNA, 63 nt, hsa
agucuucaguaaugcuacaacgauuacaaaucauuggagaauccauaaugaagagagaucuua

SEQ ID NO: 448937 - RNA, 63 nt, hsa
agucuucaguaacgcuacaaccauugcaaaucauuggagaaucuauaaugaauaaagaucuaa

SEQ ID NO: 448938 - RNA, 63 nt, hsa
aguuuucaguaaugcuacaaccauugcaaaucauuggagaauccauaaugagagaucuuacaa

SEQ ID NO: 448939 - RNA, 63 nt, hsa
aguuuucaguaaugcuacaaccauugcacaucauuggagaauccacagugaagagaucuuaca

SEQ ID NO: 448940 - RNA, 63 nt, hsa
aggcuaauugugacugugacuuacuucucccucuuggagaaagacuugaagaauguaaugcca

SEQ ID NO: 448941 - RNA, 63 nt, hsa
guacuuguaccuaaggcccuggguucaagagaguuggagaaaccccucuagaaacauauuggc

SEQ ID NO: 448942 - RNA, 63 nt, hsa
uuaugagugcagugaguccagucucauuaaauauuggagaauacacaccugaguaagauccug

SEQ ID NO: 448943 - RNA, 63 nt, hsa
uggguaaauauguguugaauugguaacucccucuuggagaauuucuugugaauuacacagcaa

SEQ ID NO: 448944 - RNA, 63 nt, hsa
caugugagugaagagaugucacugucuguggucuuggagaacuagucucguagcugaggggug

SEQ ID NO: 448945 - RNA, 63 nt, hsa
caaccaccuugaaaccuuuagaacaucucugcuuuggagaaagacccagagaucaggcagagg

SEQ ID NO: 448946 - RNA, 63 nt, hsa
gauguuaaaacagucccguggaaggagcagggguuggagaaaggcaucccaaagcuucgaugg

SEQ ID NO: 448947 - RNA, 63 nt, hsa
ucucagagacucccaggaguuguugaacuauauuuggagaaaacagccacugaauauuaucau

SEQ ID NO: 448948 - RNA, 63 nt, hsa
gggguaaaugcuuugaggcccagggaccaaucuuuggagaaaguagauauuuccaucaaagcc

SEQ ID NO: 448949 - RNA, 63 nt, hsa
gcgaauacagcucacagagaaacgcaugugcuauuggagaacaggucuuuguggagaucuaaa

SEQ ID NO: 448950 - RNA, 63 nt, hsa
guaacauuuaaacauuaauuuaaaaagggaaccuuggagaauucuuuuguucacuaguuccuu

SEQ ID NO: 448951 - RNA, 63 nt, hsa
ugcagcgccaagcggcauccaccaagcaucaaguuggagaaaagggaacccaagcaguagaga

SEQ ID NO: 448952 - RNA, 63 nt, hsa
cuagguuuccaggccucacagccaagcugaagcuuggagaaaacucugcauucccaugagggc

SEQ ID NO: 448953 - RNA, 63 nt, hsa
ggcugaggugggagaaucacuugaguccuggaguuggagaacagccuggaaagccuggcgaua

SEQ ID NO: 448954 - RNA, 63 nt, hsa
gagcaccuuggugagcaagccuggcuuuaaagauuggagaagagcuucuggcaccagaacccu

SEQ ID NO: 448955 - RNA, 63 nt, hsa
ccuuugcaguguugccgaaucacagcaguucuguuggagaaacgcuugguuuccggauccaga

SEQ ID NO: 448956 - RNA, 63 nt, hsa
auuuccucccugccucaugugagaccacaggguuuggagaagcaguuggaacccacguguggu

SEQ ID NO: 448957 - RNA, 63 nt, hsa
aaagccacuuacuggcuuuugacaugacuucucuuggagaauaaguggacuccaagcuaacuc

SEQ ID NO: 448958 - RNA, 63 nt, hsa
ucagguguuccuuccuaaaaaaaaaagucuauuuuggagaauugaaauaauucauggaaggga

SEQ ID NO: 448959 - RNA, 63 nt, hsa
acaccuccugaguuuugcaauugagaaaaugauuuggagaacuucucuucugguaauuuuuau

SEQ ID NO: 448960 - RNA, 63 nt, hsa
cuuccucuccaaagcgccagaaccuccuucucuuuggagaauggggaggccucuuggagacac

SEQ ID NO: 448961 - RNA, 63 nt, hsa
ggacugguggugccaagauaaggguuucucaaauuggagaaccccuccuuguugcaugagguc

SEQ ID NO: 448962 - RNA, 63 nt, hsa
cuguacaugaaccaggucauguuuggccuuguguuggagaaagagaauuauccccacuucaca

SEQ ID NO: 448963 - RNA, 63 nt, hsa
ccaaccccaacaacaaaaaagaauguuuugguauuggagaagggauggucaguuagccugucu

SEQ ID NO: 448964 - RNA, 63 nt, hsa
ccugccagcucucggaguccuuggugguugaacuuggagaaagaccgcaugaagauacuugua

SEQ ID NO: 448965 - RNA, 63 nt, hsa
guuaucuuuagcagauauuaaaaauugaaaacuuuggagaacucauuucaaguuaugauucag

SEQ ID NO: 448966 - RNA, 63 nt, hsa
gccuucagcaggacucuuaauaucugcugcaacuuggagaaccucccugcccugaaaugugaa

SEQ ID NO: 448967 - RNA, 63 nt, hsa
uacaaacacgggcggaaggcacucaggcuuucguuggagaaacagaaauaaggccuucuuuug

SEQ ID NO: 448968 - RNA, 63 nt, hsa
uaggaagaaaaaggaugcauucccuacagauuuuuggagaaaggauuucugaggaguguguga

SEQ ID NO: 448969 - RNA, 63 nt, hsa
aacucauucuuacgaaauuagaacgacuucacguuggagaaagcaugaagagguauucaucug

SEQ ID NO: 448970 - RNA, 63 nt, hsa
agcaagccugcacacgggcuuggguggguuccuuuggagaagauguggcuggaacacaaacaa

SEQ ID NO: 448971 - RNA, 63 nt, hsa
ucgcugggaccuggucccuuuguugcaggcggcuuggagaaagggcagugggacgcuggccac

SEQ ID NO: 448972 - RNA, 63 nt, hsa
ccaguugcagguuaagccccagaaaaguucaccuuggagaagcuccgagaacacacagauugu

SEQ ID NO: 448973 - RNA, 63 nt, hsa
caagaauauuuguggagguagguguggggaagguuggagaagaguuagguuugugcuuuguaa

SEQ ID NO: 448974 - RNA, 63 nt, hsa
uuggcucuuuggaggcgagaggaaggggagaacuuggagaauaguuuuugcuuuggggguaga

SEQ ID NO: 448975 - RNA, 63 nt, hsa
uccccuacuucucccuugcucccaaagcuuuccuuggagaagggcccuccugcagcuggaccc

SEQ ID NO: 448976 - RNA, 63 nt, hsa
uggaggcugugugcgggcaggcuugugcuccccuuggagaagggcugcuacuuaacaaggaag

SEQ ID NO: 448977 - RNA, 63 nt, hsa
aucaaugcuuuuccucaggaaauucggcaagacuuggagaaaaggaaagcuccaucaaagagg

SEQ ID NO: 448978 - RNA, 63 nt, hsa
cuuuuccaaguucccaaggccuacagcugaagguuggagaaaugccagcugcccuuucguccc

SEQ ID NO: 448979 - RNA, 63 nt, hsa
ggccgucuccccuuagccaaguccuccucaggcuuggagaacuuccucagcgucaccuccuuc

SEQ ID NO: 448980 - RNA, 63 nt, hsa
ucgcgcaccgaaaaacuaaaaauaaugggcgcuuuggagaagaguguggagucauucucauug

SEQ ID NO: 448981 - RNA, 63 nt, hsa
uuuuauuucagucacuccugauaaauaacaaauuuggagaaauaaaaauaucuaaaauaaauu

SEQ ID NO: 448982 - RNA, 63 nt, hsa
aagggcacuuggcaaccacuaugugaagggugauuggagaaggacaagacuguggaaugggga

SEQ ID NO: 448983 - RNA, 63 nt, hsa
agacuguggaauggggaauaaggaaggaggaguuuggagaaugacuccaaagguuugagcuug

SEQ ID NO: 448984 - RNA, 63 nt, hsa
gugaggcacucuggaauaugacccuaccagagguuggagaacaaacuugggcagccggaaccc

SEQ ID NO: 448985 - RNA, 63 nt, hsa
ugaugaucaaccugccuccccuccauagucuuguuggagaagcccagagagaaugggacucca

SEQ ID NO: 448986 - RNA, 63 nt, hsa
gauggcgucuaccagaaggggauggacuucauuuuggagaagcucaaccauggggacugggug

SEQ ID NO: 448987 - RNA, 63 nt, hsa
cucaaugaaauaagcugcuaaucagauuuuaccuuggagaaaugaaaauuauuucuuggggau

SEQ ID NO: 448988 - RNA, 63 nt, hsa
gcaauuuuuaaaaucuagaaguuagggguuuuguuggagaaaaauggacugaucuuuaaacua

SEQ ID NO: 448989 - RNA, 63 nt, hsa
caagacucucagguauagaaugaacugagcaauuuggagaauguauuggacuuuguccucucu

SEQ ID NO: 448990 - RNA, 63 nt, hsa
ugccuucuuugccuagccaagcagccaauuuuauuggagaaaagcaaguuauauguucacaaa

SEQ ID NO: 448991 - RNA, 63 nt, hsa
ugguuggaagggaauagaaauguuugcugaacauuggagaaucucaacaugucuccuacugag

SEQ ID NO: 448992 - RNA, 63 nt, hsa
gugcaauauucuuaaauacuacugcucuaaaaguuggagaagucuugcaguuaucuuagcauu

SEQ ID NO: 448993 - RNA, 63 nt, hsa
gaaugagcaacaccaugcauauagauugaguacuuggagaauacucacguuuuuuaacucaug

SEQ ID NO: 448994 - RNA, 63 nt, hsa
agggauagaacaucacaacacugcucuaguuucuuggagaaucacauuucuuuacagguuaaa

SEQ ID NO: 448995 - RNA, 63 nt, hsa
uaaaacucagaggaaauuugcacagaugcugcuuuggagaacuuuacaaccuggguugcagaa

SEQ ID NO: 448996 - RNA, 63 nt, hsa
ucuguugaucacagagggagccugaguacaggcuuggagaaauggcuaggacagggaacaggg

SEQ ID NO: 448997 - RNA, 63 nt, hsa
uccaucuugcugugauuugcaauagguauuuucuuggagaauguaagaacuuaacaauaaagc

SEQ ID NO: 448998 - RNA, 63 nt, hsa
guauaugcuggguauuucauuugucuuuuuauuuuggagaaagcguuuuuaacugcaacuuuc

SEQ ID NO: 448999 - RNA, 63 nt, hsa
cauauaauuaaaaagaauuugguuaauaagaauuuggagaauggaaaauacauuuuuagguuc

SEQ ID NO: 449000 - RNA, 64 nt, hsa
gccuaugggugacugccuucucccagaguuuucuuuggagaacagaaagaagaaaggaaagaaa

SEQ ID NO: 449001 - RNA, 64 nt, hsa
aguuucugaaaccgcucagauguuuuggggaaaguuggagaagccguggccuugcgagaggugg

SEQ ID NO: 449002 - RNA, 64 nt, hsa
ggacccgggcaggcccccagcaccccaugcugacuuggagaaccccagaucucuggggcccagc

SEQ ID NO: 449003 - RNA, 64 nt, hsa
gcagacaccggggcuggguuucucuuuccucuuuuuggagaaaaggaacagggcaguggaauga

SEQ ID NO: 449004 - RNA, 64 nt, hsa
aaacccuuuccuccucccauuuugacauuugcacuuggagaacacuugaguugugaagguuuug

SEQ ID NO: 449005 - RNA, 64 nt, hsa
cuggaggggagagaaggauucuagggguguggaguuggagaaagaggcuuccuugagccacccu

SEQ ID NO: 449006 - RNA, 64 nt, hsa
acauuaggaaacaauggcagucaaacccauggcuuuggagaaaguaaauguuugccagaaagga

SEQ ID NO: 449007 - RNA, 64 nt, hsa
gugcuggugcggauggacacuaaugcagccacgauuggagaauacuuugcuucauaguauugga

SEQ ID NO: 449008 - RNA, 64 nt, hsa
aucagagcaaacaucauguagauagcacaaguauuuggagaaacguuguuuguuuuguuaccaa

SEQ ID NO: 449009 - RNA, 64 nt, hsa
auaauuuaaaauaauuauuguauaauaucuacauuuggagaauuuugaacuaucaagcauauac

SEQ ID NO: 449010 - RNA, 64 nt, hsa
agacgguaaaggcacuaaagucacuuuaaagcuuuuggagaagcaggagggcauuggcuuaacc

SEQ ID NO: 449011 - RNA, 64 nt, hsa
aaaucugaaggacuucaucucccgcuuugagggcuuggagaagaucucugccuacaugaagucc

SEQ ID NO: 449012 - RNA, 64 nt, hsa
accuggcauggacugauguuuuuaggcacagaaguuggagaagagauuucaugaaagacaacau

SEQ ID NO: 449013 - RNA, 64 nt, hsa
cuguguuuucagaauuuccauuucuacuaaccucuuggagaaaaagaaauugaauuagagguaa

SEQ ID NO: 449014 - RNA, 64 nt, hsa
cccuaaaagcuggagacacagauguccagagugauuggagaauguccugggggaaugaaguucc

SEQ ID NO: 449015 - RNA, 64 nt, hsa
uucccugaggcuuuggggucagaguauauguuguuuggagaaagagggcaaucaggacucuucu

SEQ ID NO: 449016 - RNA, 64 nt, hsa
uucuggccuggcuuucccucucagacauagcucuuuggagaacuagguguuguaauucaguuau

SEQ ID NO: 449017 - RNA, 64 nt, hsa
cauugucaaaacuaccaauuccagguuaacuuuguuggagaauuucccccacccccauccagug

SEQ ID NO: 449018 - RNA, 64 nt, hsa
ugcugguuccccagcccuuuucccuggcccuggcuuggagaaucuguuuucaaucuccacugau

SEQ ID NO: 449019 - RNA, 64 nt, hsa
cuuggaggcaggauccaggcacagcuccccucacuuggagaaccuugacucucuugauggaaca

SEQ ID NO: 449020 - RNA, 64 nt, hsa
auaaaacacugucuuuucaggauugcuucauggauuggagaacuuucuaaccaaaaauuaaaaa

SEQ ID NO: 449021 - RNA, 64 nt, hsa
agacuuaguaccagaaccaaaaauaccuagauuuuuggagaacuuauuacauacauagaaacau

SEQ ID NO: 449022 - RNA, 64 nt, hsa
gaacccagccuacucuagaauuucagcagugacauuggagaauauuuuuaauuugcugcaguac

SEQ ID NO: 449023 - RNA, 55 nt, hsa; identical to SEQ ID NO: 445050

SEQ ID NO: 449024 - RNA, 64 nt, hsa
ggcaaggagagaagugagagcuacaauuccagcauuggagaagcgaggggcggggcgucaacgg

SEQ ID NO: 449025 - RNA, 64 nt, hsa
aggggcuaguuuggcuuuuccaaguggguuuucuuuggagaaucugaugccaugcaauuggcau

SEQ ID NO: 449026 - RNA, 64 nt, hsa
ugucguagacuugugcaauauauacuguuguggguuggagaaaaguggaaagcuacacugggaa

SEQ ID NO: 449027 - RNA, 64 nt, hsa
ugguaggcaaauuguuaggcagaauaaugguauguuggagaaauacaccugucucuuauucuua

SEQ ID NO: 449028 - RNA, 64 nt, hsa
accuuugguaaauacaccauaccauaauaucugcuuggagaaccacaaugcacauuagcauauu

SEQ ID NO: 449029 - RNA, 64 nt, hsa
aauuaacuagcauuuagccagcuuuuucuugcccuuggagaaaaagaaucauucucaaccugau

SEQ ID NO: 449030 - RNA, 64 nt, hsa
uuuuauuuuaauacauuguaggaaaucuucauaauuggagaaaguucugcagcauggcuuuuua

SEQ ID NO: 449031 - RNA, 64 nt, hsa
cuguggcuccauauuucaacuaaaaauauaucuguuggagaaagaaauuaacaauaaagaauuu

SEQ ID NO: 449032 - RNA, 64 nt, hsa
ucauuagaaacaauugguuaaugggggagccuaauuggagaaugaugcugagaauuuguauuga

SEQ ID NO: 449033 - RNA, 64 nt, hsa
ccaaggcggcggcagagcuggucuucuggucuccuuggagaaagguucuguugcccugauuuau

SEQ ID NO: 449034 - RNA, 64 nt, hsa
auaaaacagacuuacucuccuuggaggauauauuuuggagaaugcuucauaaaaucuaugaaua

SEQ ID NO: 449035 - RNA, 64 nt, hsa
uguacgcaaagggcagccccaggcugucuggaaguuggagaauucccuaucagcacagggaucu

SEQ ID NO: 449036 - RNA, 64 nt, hsa
uaggaaagacauguaagagcauggacauuuuacuuuggagaaacagaaaaaucuuggggcuucc

SEQ ID NO: 449037 - RNA, 64 nt, hsa
cgcuuuuuggaagacauuucuguagcaugucaguuuggagaaaugaugagcuacgccuugauga

SEQ ID NO: 449038 - RNA, 64 nt, hsa
uccugaguuaaaagucuauuuauuuacuuccuuguuggagaagggcaggagaguaccugggaau

SEQ ID NO: 449039 - RNA, 64 nt, hsa
gcuccagguggaagcaugcuuucccuuguuacuguuggagaaacucaaaccuucaagcccuagg

SEQ ID NO: 449040 - RNA, 64 nt, hsa
uuccauagaaaacuguagaaagauaucuguaucuuuggagaaggagaaagaaaggaaagaacuc

SEQ ID NO: 449041 - RNA, 64 nt, hsa
uuauaguuuuauaacuggcuuaaguuaaguuuuauuggagaaaucuugccuauaauucuauaaa

SEQ ID NO: 449042 - RNA, 64 nt, hsa
cuuuuuacuguugaacuuagaacuaugcuaauuuuuggagaaaugucauaaauuacuguuuugc

SEQ ID NO: 449043 - RNA, 64 nt, hsa
caucccauccuugccaaaaaauaagaaaacugucuuggagaaugggucagaagccccaaacggc

SEQ ID NO: 449044 - RNA, 64 nt, hsa
uuucuuggacuacuuuaauuuggauccuuuggguuuggagaaagggaaugugaaagcugucauu

SEQ ID NO: 449045 - RNA, 64 nt, hsa
uacaagccuuggguccauguuuacucucuucuauuuggagaauaagauggaugcuuauugaagc

SEQ ID NO: 449046 - RNA, 64 nt, hsa
aaaaaugccuuuucauuggucuuaagagaccgcauuggagaauuucaggcuuuugauaaaugcu

SEQ ID NO: 449047 - RNA, 64 nt, hsa
cccagagcugaggcaaggggauuucucaggucauuuggagaacaagugcuuuaguaguaguuua

SEQ ID NO: 449048 - RNA, 64 nt, hsa
agugcuauguggcgagaaaaaaaguuuuaauguauuggagaaguuuuaaaaaacccagaaaaac

SEQ ID NO: 449049 - RNA, 64 nt, hsa
gagaccaaagggauaucuguucccuguuaccuuuuuggagaauucauaacauuugaagaucaaa

SEQ ID NO: 449050 - RNA, 64 nt, hsa
uaggcacggacacacccagucucaaugcacgaaguuggagaaccugacagggcugguccaggcc

SEQ ID NO: 449051 - RNA, 64 nt, hsa
aggaaggcggcaggcagagaaguggagugacuauuuggagaauagcacccauaucugugugccc

SEQ ID NO: 449052 - RNA, 64 nt, hsa
uacacucuaucacauauuuaagcaaacaucacauuuggagaagaggaaaucauaaaaucauccu

SEQ ID NO: 449053 - RNA, 64 nt, hsa
auguauauauuacucugcacuauaucccuucuuuuuggagaacuagccauuauuuuagccacag

SEQ ID NO: 449054 - RNA, 64 nt, hsa
ucuuccuguucugcaccccucuccccaugggaccuuggagaaaacugaacuguuacaaaccccu

SEQ ID NO: 449055 - RNA, 64 nt, hsa
gaucaugagguuaaaauuuucuucauuaggggacuuggagaaccaguagucguaagauuaguug

SEQ ID NO: 449056 - RNA, 64 nt, hsa
guaccagcagugugucaggugcugcagagcguucuuggagaaggcccacugaggcagguucgug

SEQ ID NO: 449057 - RNA, 64 nt, hsa
uaccuggcauagagaaaaauauauaccugguacauuggagaaaaauaauuacacuuucaaagag

SEQ ID NO: 449058 - RNA, 64 nt, hsa
gguuguaaguggacaugcaaaccaaaauuggggauuggagaagucagacucacuagacuuuugg

SEQ ID NO: 449059 - RNA, 64 nt, hsa
aaauuccugucaaaaucaauucagaaauucuaacuuggagaauuuaacauuuuacucuuguaaa

SEQ ID NO: 449060 - RNA, 64 nt, hsa
caucuugcaagcaaaucccauuucuugaaaagccuuggagaacucgguuugguagacuuggaca

SEQ ID NO: 449061 - RNA, 64 nt, hsa
gcagugauuuuguuccaaaacuuuguauacacauuuggagaaaaguacuuuauauuuucagugu

SEQ ID NO: 449062 - RNA, 64 nt, hsa
cugcaagaaauauacugacaugaacaggcaguucuuggagaagaaagagcauuucuuuaaguac

SEQ ID NO: 449063 - RNA, 64 nt, hsa
cacuccagccugggcaacagagcaagacccugucuuggagaaaccagaauuuuggaagagcaaa

SEQ ID NO: 449064 - RNA, 64 nt, hsa
ugaguggcucuuugcaugaacacugugcaagguguuggagaaauccaaagcugaccaaaacaug

SEQ ID NO: 449065 - RNA, 64 nt, hsa
uggccuucacgcucuugaucgucuuuccuuuguauuggagaaggacugggucagagaucuguug

SEQ ID NO: 449066 - RNA, 64 nt, hsa
guguuuuuuacucuuuucucaugcacauguuacguuggagaaaauguuuacaaaaaugguuuug

SEQ ID NO: 449067 - RNA, 64 nt, hsa
gacugacaccucacugaggaagggagacauauucuuggagaacuuuccaucugcuuguauuuuc

SEQ ID NO: 449068 - RNA, 64 nt, hsa
gauaucaaguuuugaauauuauucaggaagcacuuuggagaaugugggaguccuacuguuuugc

SEQ ID NO: 449069 - RNA, 64 nt, hsa
gggugagaagcaggcuggugagacugggcugagguuggagaaggggcagccgggggcacugcug

SEQ ID NO: 449070 - RNA, 64 nt, hsa
ucacuuuauucuuguauggcuuugguaggcauacuuggagaacauaucccacauuaggaauuga

SEQ ID NO: 449071 - RNA, 64 nt, hsa
gccugagaguuugagggcuuuaauccuuuaaaacuuggagaagcuggcugggcgcgguggcuca

SEQ ID NO: 449072 - RNA, 64 nt, hsa
cauuuauuugaugacuuaauauuuuucacuaccuuuggagaacagaugaacauuauucaccaug

SEQ ID NO: 449073 - RNA, 64 nt, hsa
uucaauuagcaguucaaauuaaagaagaugguuauuggagaacuuuuuugaaugguuuuguauu

SEQ ID NO: 449074 - RNA, 64 nt, hsa
augcaucuuuuuuccucugccauucuuguguugauuggagaauuuuucuguauguaauuagaaa

SEQ ID NO: 449075 - RNA, 64 nt, hsa
uuucuggauuucauacuguaacauucaggaauucuuggagaaaauggguuuauucacugaacuc

SEQ ID NO: 449076 - RNA, 64 nt, hsa
gcucggaaagccuuaagcaaagaugggaggauuuuuggagaauccaucaugauugguguaaaac

SEQ ID NO: 449077 - RNA, 64 nt, hsa
uccucucaaaacaaacacccucuugcaaccagcuuuggagaaagcccagcuccugugugcucac

SEQ ID NO: 449078 - RNA, 64 nt, hsa; identical to SEQ ID NO: 447722

SEQ ID NO: 449079 - RNA, 64 nt, hsa
gagggacacaaggacuugggugcaucaggacgccuuggagaagcguggcuuccugccacccugc

SEQ ID NO: 449080 - RNA, 64 nt, hsa
ugcagagagaggcaggaaggaucccugaagagucuuggagaaaagguucugugcccucaggugg

SEQ ID NO: 449081 - RNA, 64 nt, hsa
uaucugaaucacuggggauuaugauucacccucuuuggagaacaugcucucuuuucacccccca

SEQ ID NO: 449082 - RNA, 64 nt, hsa
gcuuauauuuaucgcuuggcucaaguucugcccuuuggagaaauacugagcaagucuuucauuc

SEQ ID NO: 449083 - RNA, 64 nt, hsa
gguuaaguauauaauaaauugaacaucuuugagauuggagaauuaugugagauuuccacauuau

SEQ ID NO: 449084 - RNA, 64 nt, hsa
ucagggccaugcugaggccugggccgcugccacguuggagaagcccgugugagaagugaaugcu

SEQ ID NO: 449085 - RNA, 64 nt, hsa
ggucugcgaugcagcggcgugaggccugggcugguuggagaaggucacaacccuucucuguugg

SEQ ID NO: 449086 - RNA, 64 nt, hsa
cuugcacuacaccucuguugugaggacuaccauuuuggagaagguucuguuugucucuuuucau

SEQ ID NO: 449087 - RNA, 64 nt, hsa
ucuuuuccugugcuuacgggccaugcguauuucuuuggagaaaggucuauccagguccuuugcc

SEQ ID NO: 449088 - RNA, 64 nt, hsa
acagaaauucuguugaagacaguugagaauuccuuuggagaaaacagcccagcuuggcgugggg

SEQ ID NO: 449089 - RNA, 64 nt, hsa
ugacgcuacuaaccugacaucaccaaguguggaauuggagaaaagcacaaucaacuuuucugag

SEQ ID NO: 449090 - RNA, 64 nt, hsa
uagaauuuuuaaauaguauauauucaguggcauuuuggagaacaaagugaauuuacuucgacuu

SEQ ID NO: 449091 - RNA, 64 nt, hsa
uguuuguuuuuaucaaaaugucaaaauaacauacuuggagaaguauguaauuuugucuuuggaa

SEQ ID NO: 449092 - RNA, 64 nt, hsa
uuucuagagguuggcuuucaauucuguagcauacuuggagaaacugcauuaucuuaaaaggcag

SEQ ID NO: 449093 - RNA, 64 nt, hsa
caguguuccucaccaauaacuucagagaagucaguuggagaaaaugaagaaaaaggcuggcuga

SEQ ID NO: 449094 - RNA, 64 nt, hsa
ugguaccgucuaguacuaugcagcgguccucaaguuggagaaaaugugccuuucauucauuacc

SEQ ID NO: 449095 - RNA, 64 nt, hsa
gaauaugccugcucaaaauuaauagcacagcaguuuggagaagaaaugaaggugucaaagaguc

SEQ ID NO: 449096 - RNA, 64 nt, hsa
uuggaaaaucacacaguuuucaggcuccaucuguuuggagaaaauacauucugaagcaucccca

SEQ ID NO: 449097 - RNA, 64 nt, hsa
auggaaauggauuggauugucaaauuauuauuuauuggagaaaaaaaccugaucuacacauuuu

SEQ ID NO: 449098 - RNA, 64 nt, hsa
aacuuaggaaauagugaauaaggugcauuuaacuuuggagaaauacuuuuauggcuuuggugga

SEQ ID NO: 449099 - RNA, 64 nt, hsa
ugguuuuugaacaggaaaaucauaauucauaucauuggagaaguauuuauuuucaaauaucaaa

SEQ ID NO: 449100 - RNA, 64 nt, hsa
aggagucagagagaaucccuagucuucaagcagauuggagaaacccuugaaaagacaucaagca

SEQ ID NO: 449101 - RNA, 64 nt, hsa
uaaaugaaaaggacacauucugaaaucccuuuuguuggagaauaagucagucugaggggaaaug

SEQ ID NO: 449102 - RNA, 64 nt, hsa
aaauaaguccuagacuggacucuugagggacauauuggagaaucuuaagaaaugcaagcuuguu

SEQ ID NO: 449103 - RNA, 64 nt, hsa
ucccaggaaauuagcuuuccagccccuuuauauauuggagaaguuguuuuagcuucugcagaag

SEQ ID NO: 449104 - RNA, 64 nt, hsa
acauuguucuugguuuuguuucucgaucuuuuguuuggagaacagcuggcuaaggaugacucua

SEQ ID NO: 449105 - RNA, 64 nt, hsa
uucauuuguuccuuggaccuuaaucauuugcauuuuggagaaaauuuuuucugcuuuaaaaguc

SEQ ID NO: 449106 - RNA, 64 nt, hsa
gaguuuaggaauucuacuagccagagauagucacuuggagaaacuuucuauauauccuucuaaa

SEQ ID NO: 449107 - RNA, 64 nt, hsa
aaucuugaugucauuacuccugaauuauuacauuuuggagaauaagagggcauuuuauuuuauu

SEQ ID NO: 449108 - RNA, 64 nt, hsa
uuuugauccaagucaaguguagccucucagccuuuuggagaaaaaugaaacaauuuauuucaac

SEQ ID NO: 449109 - RNA, 64 nt, hsa
ugggcagagcccugacccacagcuguguuacugcuuggagaagcauauguaggggcauacccug

SEQ ID NO: 449110 - RNA, 64 nt, hsa
uauuuaaaguugccugaagauuuugcugugguguuuggagaagcagagggugaacuugcuguug

SEQ ID NO: 449111 - RNA, 64 nt, hsa
gauuugcucagcuuuuugaaauguuaagauguguuuggagaaggcugcaugacuuuguuuuucc

SEQ ID NO: 449112 - RNA, 64 nt, hsa
cuaggcagcagccaccuucucaggaaacaaggccuuggagaaaucagugccugugugaagaugg

SEQ ID NO: 449113 - RNA, 64 nt, hsa
gcuggaccuuccauucuagaauuaugagaccaccuuggagaaaggugugugguacaugacauug

SEQ ID NO: 449114 - RNA, 64 nt, hsa
uucucuguuugccuuggguugaauaacuuaucuuuuggagaauagcuuuaaguggcuuagacac

SEQ ID NO: 449115 - RNA, 64 nt, hsa
caaguuggaugacacuacucccaacuuuuuaaauuuggagaaaaccaucaaggucgaggaagcc

SEQ ID NO: 449116 - RNA, 64 nt, hsa
agaaauugcuagauuacccaaagaaauagaucaguuggagaaaauacaaaacaauucaaagcuc

SEQ ID NO: 449117 - RNA, 64 nt, hsa
guauuuaaaagaaauaccagugagugccuuaaaguuggagaaguaacugcccaugcccagaaau

SEQ ID NO: 449118 - RNA, 64 nt, hsa
ugaauaaaaaauaauuuugcuguuguaguauacauuggagaaacuggcagguuuuauuuccauu

SEQ ID NO: 449119 - RNA, 64 nt, hsa
ucugaggguguacguuugauaugaucaugccagauuggagaagauccaagccaggaagaugggc

SEQ ID NO: 449120 - RNA, 64 nt, hsa
gcaaagacacgggaacugaaaaacuccacaggguuuggagaauagaaaugaaaagccacgucau

SEQ ID NO: 449121 - RNA, 64 nt, hsa
caagacuuugggcucuuaugucacaucacaugauuuggagaaauuagacacaaucucuuauuuu

SEQ ID NO: 449122 - RNA, 64 nt, hsa
ucaauuguccuucagauaauucauguggagauuuuuggagaaaccaugacggauaguuuaggau

SEQ ID NO: 449123 - RNA, 64 nt, hsa
cuguacaguauuugcauuccacagauggaacgguuuggagaagcacuuuuucauacuuuuguga

SEQ ID NO: 449124 - RNA, 57 nt, hsa; identical to SEQ ID NO: 445151

SEQ ID NO: 449125 - RNA, 64 nt, hsa
uucagucugaaaugcagcucccuguccaagugccuuggagaacucacagcagcacgccuuaauc

SEQ ID NO: 449126 - RNA, 64 nt, hsa
cugaagcacauacaagcacccugguggaagaagcuuggagaagaaucuggagaugagauugaug

SEQ ID NO: 449127 - RNA, 64 nt, hsa
gccugggcuguggaccuacugggcauuugaggaauuggagaauggagauggcaagagggcaggc

SEQ ID NO: 449128 - RNA, 64 nt, hsa
gaugccaaguacaccugcaaggcugucaacagucuuggagaagccaccugcacagcagagcuca

SEQ ID NO: 449129 - RNA, 64 nt, hsa
cuugccaaaaaaaaaaaaaaaaaaaaaucagaaauuggagaaauccuuagcacaauuuucuaaa

SEQ ID NO: 449130 - RNA, 64 nt, hsa
cugcccaggugggguuuccugcauggacaguuguuuggagaacaacaaggacaacuuuauguag

SEQ ID NO: 449131 - RNA, 64 nt, hsa
uugaauuuuuuggggacuauuaaggguguuagucuuggagaagacacagccucaccuucucacu

SEQ ID NO: 449132 - RNA, 64 nt, hsa
uuauuucuuaacugcuauuuggcagaagcugaaauuggagaaccaaggagcaaaaacaaauuuu

SEQ ID NO: 449133 - RNA, 64 nt, hsa
ucuuugugacacuucauccugaugccaagauuuuuuggagaacaucugcacuuucuuauauaua

SEQ ID NO: 449134 - RNA, 64 nt, hsa
aaugauuguaugcuuaugcugaacaccuuucauauuggagaaucaugcauuugggucacuaauu

SEQ ID NO: 449135 - RNA, 64 nt, hsa
gaugaaauaaacuuauuacuuuaaaggaaaggauuuggagaauugaacucacaaacugauguua

SEQ ID NO: 449136 - RNA, 64 nt, hsa
uacuucggcugcaugagauaaucacuugggagcuuuggagaaaauagcaguaccaagggaucuc

SEQ ID NO: 449137 - RNA, 64 nt, hsa
cacgcccaucuggagugggagcugggagucaguguuggagaagaaacaacaaaagccaauuaga

SEQ ID NO: 449138 - RNA, 64 nt, hsa
ucucuaauuccagugucuuuacacagcaaauaaauuggagaauauugcucccauauaaacuugu

SEQ ID NO: 449139 - RNA, 64 nt, hsa
uuuucaguuucuuuccuucugugaacgaugagacuuggagaacgggcugguccuucaccacuuc

SEQ ID NO: 449140 - RNA, 64 nt, hsa
ugaggugccgagcugggugcuugacaucauuugcuuggagaagcagcugcuaguagacccauuu

SEQ ID NO: 449141 - RNA, 64 nt, hsa
acaucaauauguauauauguauuucuauauagacuuggagaauacugccaaaacauuuaugaca

SEQ ID NO: 449142 - RNA, 64 nt, hsa
uuuggguguggaggccauuuuuagagauacagaauuggagaagacuugcaaaacagcuagauuu

SEQ ID NO: 449143 - RNA, 64 nt, hsa
gugucauguugguuuuugguacuuguauugucauuuggagaaacaauaaaagauuucuaaacca

SEQ ID NO: 449144 - RNA, 64 nt, hsa
cuaucugggaacacugagaagggugaccaaugcguuggagaacgagggagggcuucauagcaga

SEQ ID NO: 449145 - RNA, 64 nt, hsa
aaaagagcaugcagugcuguugaauaacccucacuuggagaaccaagagaauccugucguuuaa

SEQ ID NO: 449146 - RNA, 64 nt, hsa
gccccugaauguggucgaugccaaaggaagauccuuggagaagucaucagugcguugaaacaaa

SEQ ID NO: 449147 - RNA, 64 nt, hsa
uugcagagugugugcuuggcuguggcagccuagcuuggagaagcugcuguuggugcaagggaga

SEQ ID NO: 449148 - RNA, 64 nt, hsa
ccagcuuucuugcuugccuucugugcaauauuucuuggagaauuuggaugccuaaggcauaaag

SEQ ID NO: 449149 - RNA, 64 nt, hsa
uuuucugugccuucaagggacaacuuuuuuaacuuuggagaaaagaaaaacacucuauaacaga

SEQ ID NO: 449150 - RNA, 64 nt, hsa
cuuuauaccuagcaagccacuucaggaaauucuuuuggagaauauuuucugauuauuguuaaac

SEQ ID NO: 449151 - RNA, 64 nt, hsa
aaugcugggaacacaaauagugcaauuugugcaauuggagaaucuugccuuuuuucuuggcucc

SEQ ID NO: 449152 - RNA, 64 nt, hsa
acaggauucacauuguuaauuuauaaaucuagacuuggagaauuaaggacugagaaaugaccau

SEQ ID NO: 449153 - RNA, 59 nt, hsa; identical to SEQ ID NO: 445180

SEQ ID NO: 449154 - RNA, 64 nt, hsa
agcaacugcagcuaacaggcugauuuucuggccuuuggagaagugauucaaaauaguguagauu

SEQ ID NO: 449155 - RNA, 64 nt, hsa
aaguauaugaaaauauacuggaaauauuggauucuuggagaaaacuguucagucacagauauau

SEQ ID NO: 449156 - RNA, 64 nt, hsa
acaugugugccccuaaagacacauuuacucaauauuggagaaguagauaaugaauuaagcaacu

SEQ ID NO: 449157 - RNA, 64 nt, hsa
cuaguguuuucauaauguaauucaaugaaaacuguuggagaaauauuuaaacaccucaauguag

SEQ ID NO: 449158 - RNA, 64 nt, hsa
agguuuuaaaaauaaguuuuauacauaaacaguuuuggagaaaaauuacagaucauauaagcaa

SEQ ID NO: 449159 - RNA, 64 nt, hsa
guaucuuguaaucaugauugagccucagaaucauuuggagaaacuauauuuuaaagaacaagac

SEQ ID NO: 449160 - RNA, 64 nt, hsa
ccaaucaaucaaaaaauaaauaaaucacuaaggauuggagaacucauagaacaaggugaaagac

SEQ ID NO: 449161 - RNA, 64 nt, hsa
aagacauaaacuuggaguccgucugguuuaauuauuggagaaucgauucccaaguccaggaaga

SEQ ID NO: 449162 - RNA, 64 nt, hsa
uuuaguauuuugucuuuguaauuuacagaaguuauuggagaaaauaaacuuguuucauuuugca

SEQ ID NO: 449163 - RNA, 64 nt, hsa
acccagggaaugggggucuaugagacaaccccacuuggagaagaaugggguuagggucucuaau

SEQ ID NO: 449164 - RNA, 64 nt, hsa
gugcuuuuuauacaacuuuccaucccccacacaguuggagaauaauuuguagaccauggcaguu

SEQ ID NO: 449165 - RNA, 64 nt, hsa
guauacauggugauguacaucuguagcaaagcucuuggagaaaaugaagacugaagaaagcaaa

SEQ ID NO: 449166 - RNA, 64 nt, hsa
augaggaacauucauucuguauuuuuuuucccuguuggagaaagugggaaauuauaaugucgaa

SEQ ID NO: 449167 - RNA, 64 nt, hsa
uauucugucuaucaaauaguacuucuaccacuguuuggagaaaauugaagaaaagaauaagaug

SEQ ID NO: 449168 - RNA, 64 nt, hsa
guugaauaugauuuggucaguugcucguuguaacuuggagaaauuccuauaaaguaagaucucc

SEQ ID NO: 449169 - RNA, 64 nt, hsa
uaauuccuucugcuauaugucacacaguuguuauuuggagaaccaaguauguauugcaugaaaa

SEQ ID NO: 449170 - RNA, 64 nt, hsa
aaugccuuauuuuugaauucuuuagauuuuuaaauuggagaaaagcacuuaaaguuuuuuauau

SEQ ID NO: 449171 - RNA, 64 nt, hsa
ugugagcauuugcaauguaagggccucagcuuccuuggagaagccaccccagguuuccagacau

SEQ ID NO: 449172 - RNA, 64 nt, hsa
gcaucucccugauugguauugcuguagaacauauuuggagaaguuuguuugucuuugguguuua

SEQ ID NO: 449173 - RNA, 64 nt, hsa
uggaguuugaacccguuuugguugcauuucauuuuuggagaacuuaauuaacgugagauuggca

SEQ ID NO: 449174 - RNA, 64 nt, hsa
cuuagaacauuuuuugaaauucaguuuacagaaauuggagaaaaugcuuuuuaaacaaguguuu

SEQ ID NO: 449175 - RNA, 64 nt, hsa
gaugggucuugcugggugcuguguggggcgcauauuggagaaggguaaugccagaagccaggaa

SEQ ID NO: 449176 - RNA, 64 nt, hsa
ccuuggaaccccaaggccaaguugguucaaacuguuggagaacagaguuggccugcaucuggaa

SEQ ID NO: 449177 - RNA, 64 nt, hsa
uacuauuuuuauaaagcaagaacuauuccaugccuuggagaaugaaucauuuuuagauugugac

SEQ ID NO: 449178 - RNA, 64 nt, hsa
uuuuggaggugaaaucuaauuauuggugagagucuuggagaacaggcuguuuccagucucaaag

SEQ ID NO: 449179 - RNA, 64 nt, hsa
agccuuugguagcuaacagucacugauuuuauaauuggagaaugcguaaagauucauuuuucaa

SEQ ID NO: 449180 - RNA, 64 nt, hsa
uuuguuuuauuggaaugcauaucucuuuucaggguuggagaaauuagcacuugccuugaaaaga

SEQ ID NO: 449181 - RNA, 64 nt, hsa
gugagacuuuauuguccucuaggauggauguauauuggagaagggugguuagcacauucaucag

SEQ ID NO: 449182 - RNA, 64 nt, hsa
ggguuaccuccaugugcccuuuuuagggaagcuguuggagaaaauacuccagcaaaaugaagga

SEQ ID NO: 449183 - RNA, 64 nt, hsa
guucaacaauucugugaaaggucacaggacccaauuggagaaaucauaugaaaagcauaguugg

SEQ ID NO: 449184 - RNA, 64 nt, hsa
caucccuuaauuugagguguuccagcagcuguuuuuggagaagacaaagaaaauuaaaguuuuc

SEQ ID NO: 449185 - RNA, 64 nt, hsa
uauguuccuuuguauguuccuaucaggcugauuuuuggagaaaugaauguuugucuggagcaga

SEQ ID NO: 449186 - RNA, 64 nt, hsa
cugauguuaagcacauguuacuucaacaagaugcuuggagaacaacaagguacccagaauuuuu

SEQ ID NO: 449187 - RNA, 64 nt, hsa
aagugagaucauacugguuuguuucuuauuuugauuggagaaaaauuaaauugcugcauuucgc

SEQ ID NO: 449188 - RNA, 64 nt, hsa
ccagcugguaguccaucagcacaaugaaggagacuuggagaagaggaagaauaacacuguugcu

SEQ ID NO: 449189 - RNA, 64 nt, hsa
ugcuuuuugaauguuauuuguuauuuucaguauuuuggagaaauuauuuaauaaaaaaacaauc

SEQ ID NO: 449190 - RNA, 64 nt, hsa
agcgcauccugcagggcuucuccuccucugucuuuuggagaaccagggcucuucucaggggcuc

SEQ ID NO: 449191 - RNA, 64 nt, hsa
cuuaaacccugugccucagcuggacauuggaaccuuggagaaugucuucacagccccgacauca

SEQ ID NO: 449192 - RNA, 64 nt, hsa
ccagggccgugccuggagcacugcagagaugacuuuggagaaagcaaagcagugacccagugac

SEQ ID NO: 449193 - RNA, 64 nt, hsa
uagaagaaagauacaagugaaaauuaggaguggauuggagaaauuggggggaaauagaagagua

SEQ ID NO: 449194 - RNA, 64 nt, hsa
aggcuuuuuaacccauuuuugaagagggugaaguuuggagaacaaauuuaaaaaccaucaguca

SEQ ID NO: 449195 - RNA, 64 nt, hsa
uaaaucucagaauuacuaagcauguggcauaaauuuggagaaaauaauaugacuagaaaaauua

SEQ ID NO: 449196 - RNA, 64 nt, hsa
cuucguguccaccuggguccaguccugaaucaucuuggagaaacaccuugguuucuaggauggu

SEQ ID NO: 449197 - RNA, 64 nt, hsa
gaguuguauuggcaagagggaggggugagagcuguuggagaacugagaaugagguuuuuuuuuu

SEQ ID NO: 449198 - RNA, 64 nt, hsa
cuauugcccugcaacgucccaucuauacgagguguuggagaaggugaagaacccucccauucac

SEQ ID NO: 449199 - RNA, 64 nt, hsa
cccugcuugugcaggccaguggaggcucuugggcuuggagaacacgugugucucuguguaugug

SEQ ID NO: 449200 - RNA, 64 nt, hsa
aguggggcaacguguggaggaagccccucauaauuuggagaaaacuugauacaauagaagcuga

SEQ ID NO: 449201 - RNA, 64 nt, hsa
caaccuguucaagucuaccaauuauaagggcaaauuggagaaaaagaaaaaauauauacucaag

SEQ ID NO: 449202 - RNA, 64 nt, hsa
cguuuguuuguuggaguggugccagguacugguuuuggagaacuugucuacaaccagggauuga

SEQ ID NO: 449203 - RNA, 64 nt, hsa
gagugcauaccagaauugaauauaccauaugggauuggagaaagacaaauguggaagaaaucau

SEQ ID NO: 449204 - RNA, 64 nt, hsa
cugagaaagggaaaagacacacaagucgcguggguuggagaagccagagccauuccaccucccc

SEQ ID NO: 449205 - RNA, 64 nt, hsa
guggcgugcucuagcccucucaguuaccagcucuuuggagaaggaucaaaauucagauggaaug

SEQ ID NO: 449206 - RNA, 64 nt, hsa
cugaaacagacuacucuuugccuuuuugcugcaguuggagaagaaacugaauuugaaaaauguc

SEQ ID NO: 449207 - RNA, 64 nt, hsa
caaagaauuuaaaguggcuccuuuaauuggugacuuggagaaagcuaggucaaggguuuauuau

SEQ ID NO: 449208 - RNA, 64 nt, hsa
aacagaguuugggggagagagcaagauggguuccuuggagaagcugauuugccaagaugcacau

SEQ ID NO: 449209 - RNA, 64 nt, hsa
ugccaccuaagcaguaaaacaugauauugaccacuuggagaacucagaaaauuauuuuaaauuu

SEQ ID NO: 449210 - RNA, 64 nt, hsa
gagaaguaaaggaauauaugccuccuguguacuuuuggagaaaacugaagauuuaguuuccauu

SEQ ID NO: 449211 - RNA, 64 nt, hsa
aggaucauccuuuuguacuugaugcuggaagcucuuggagaaaaagcuuaaacauuucaccaga

SEQ ID NO: 449212 - RNA, 64 nt, hsa
gacaaaacacaaguuggaccaaggagaaagcccuuuggagaaacuggacccuaguucaguuuag

SEQ ID NO: 449213 - RNA, 64 nt, hsa
ugauuccuugaagagccuauuuaguuccauaaaauuggagaacugcugaaggucaguaauuccg

SEQ ID NO: 449214 - RNA, 64 nt, hsa
aaacaugaugaauguggagaugcuugcuucagcauuggagaauucacaguaaagggaaacccug

SEQ ID NO: 449215 - RNA, 64 nt, hsa
gaccaacaacaacgaggaggagaagucccggcuguuggagaaggagaaccgugaacuggaaaag

SEQ ID NO: 449216 - RNA, 64 nt, hsa
guggagaugggggcgggggugguggugaagagaguuggagaaggaauggacgaauucuugagca

SEQ ID NO: 449217 - RNA, 64 nt, hsa
auagucucagagaucuguagggccgagguuacauuuggagaacccguacucuagggccaaaucc

SEQ ID NO: 449218 - RNA, 64 nt, hsa
gguggccagcccauuuucuggggugaggcuugacuuggagaaaggcagaagagacgucccgcuu

SEQ ID NO: 449219 - RNA, 64 nt, hsa
auccagguuaaccuugauauacacagagauggucuuggagaauugugaauguauguacuguauu

SEQ ID NO: 449220 - RNA, 64 nt, hsa
augccuauaauccuggcauuuuaggaggcugagguuggagaaucgcuugaggccagaagugcaa

SEQ ID NO: 449221 - RNA, 64 nt, hsa
caaguggccaaguccuuuaucaaaaagcugcuuuuuggagaagaugaugcauaaagcugugaua

SEQ ID NO: 449222 - RNA, 64 nt, hsa
ggcccuaaccuaaaaucggagaguaauuuaugcuuuggagaauuugacucaaauauauacuuga

SEQ ID NO: 449223 - RNA, 64 nt, hsa
aaugugggguuuguaauaggugagaaauauuugcuuggagaagcucuugugcaauuagccuggc

SEQ ID NO: 449224 - RNA, 64 nt, hsa
uuuuguuugguauguacaaaauggucagagcuaguuggagaaugagacaugcuuuuccagcugu

SEQ ID NO: 449225 - RNA, 64 nt, hsa
cagucucuucagguagcuaaauuaggagcuuguuuuggagaaaugaagcaaaggugaaugacag

SEQ ID NO: 449226 - RNA, 64 nt, hsa
auacuuugugcuuuaugguuuuuauaaugucuuuuuggagaaauugccgaaaaguugccaaaua

SEQ ID NO: 449227 - RNA, 64 nt, hsa
aggaauauuuucuucuuaagauauauagaggauuuuggagaagagagacaggagggguaaaacc

SEQ ID NO: 449228 - RNA, 64 nt, hsa
cuuaacaauauacauauguuccgucuuugcuguuuuggagaaugauggauaaguaguguuuccu

SEQ ID NO: 449229 - RNA, 64 nt, hsa
ucuccauuuuuaucaagguuuuccaugguuaaguuuggagaaaauaccacacaaaacaaugaau

SEQ ID NO: 449230 - RNA, 64 nt, hsa
cuucgauuuuucuggucuguggagaaacugugaauuggagaaauggagcucuguggcuucccac

SEQ ID NO: 449231 - RNA, 64 nt, hsa
guuuuuuucucucacuauaguauaagaaucuauuuuggagaaaaaaagaaaauaugagggucuc

SEQ ID NO: 449232 - RNA, 64 nt, hsa
uggggggagggggaugggguccuucuaggaguccuuggagaaaaguaagaaaccaggaguguuu

SEQ ID NO: 449233 - RNA, 64 nt, hsa
caccagggcaggagaggacucagccuccuguguuuuggagaaggggcccaauguguguugacga

SEQ ID NO: 449234 - RNA, 64 nt, hsa
ugcucaaauguuguucaacaccagaaaauuuauauuggagaaaagcacuguaaauguaaugcau

SEQ ID NO: 449235 - RNA, 64 nt, hsa
uguucaaacuuuguucaauaccaggaaauuuauauuggagaaaaacccuaugaguguaaugaau

SEQ ID NO: 449236 - RNA, 64 nt, hsa
uugucacgcuugauuguagguaagauaauuuauauuggagaaaaauccuccaaguaugaagaau

SEQ ID NO: 449237 - RNA, 64 nt, hsa
ugcucaaacuuuguucgacaucagggaauuuguauuggagaaaaacccugcaaauguaauaaau

SEQ ID NO: 449238 - RNA, 64 nt, hsa
auugccuugaucuggcacuuacugauacaagcauuuggagaagagaaaauucaaauauaagaaa

SEQ ID NO: 449239 - RNA, 64 nt, hsa
uggacuuuccugugauuuguuuuuaaucauucauuuggagaagaggcaugaccuuuguauuuca

SEQ ID NO: 449240 - RNA, 64 nt, hsa
ucaugcuauuaguauuuucauaccuuagucacauuuggagaauucacaugggaauaaaauucca

SEQ ID NO: 449241 - RNA, 64 nt, hsa
ugcagguuugguuuuuucucauuugucuguggcauuggagaauauucucgguuuaaacagacua

SEQ ID NO: 449242 - RNA, 64 nt, hsa
cuuauugucuagugaaacucguuaauuuguaguguuggagaagaacugaaaucauacuucuuag

SEQ ID NO: 449243 - RNA, 64 nt, hsa
uuccauguagucuucaauuuuuaauuuuuaagaauuggagaauuucuaauguuaaaguuaguuu

SEQ ID NO: 449244 - RNA, 64 nt, hsa
uaauaucugcauuaugcuggaaaaaaauagaccuuuggagaauacuuaaauaaaacaugugcau

SEQ ID NO: 449245 - RNA, 64 nt, hsa
ccaggugauucuguaaguugucccucaacuguacuuggagaaaucguguuuuaaagcaguaguc

SEQ ID NO: 449246 - RNA, 64 nt, hsa
gugcaggaauagcaacagcaauuuccgggaggucuuggagaagcuggagagcgaccccgucugc

SEQ ID NO: 449247 - RNA, 64 nt, hsa
ccuuuuauuaguucuuugauagcuaagaugguuguuggagaaagugcuuaagccacuguuuaug

SEQ ID NO: 449248 - RNA, 64 nt, hsa
guccuguaaaugaaugcucugggcuagauacagcuuggagaaccugcuggccuuguuagacagc

SEQ ID NO: 449249 - RNA, 64 nt, hsa
uaggaaagccuggguuggguggagcagaaccaucuuggagaagaugacaguucccuguccuccc

SEQ ID NO: 449250 - RNA, 64 nt, hsa
gacacccccuuccaaauucuguaacacauuguaauuggagaagaaggaaacucugcaaggcuaa

SEQ ID NO: 449251 - RNA, 64 nt, hsa
uaagcuuguuguuggaagagcagcauuuugacccuuggagaagaaaaacuagcuguggcauucc

SEQ ID NO: 449252 - RNA, 64 nt, hsa
uaccgagcuggaagcaagccauuuaauccgguucuuggagaaacauaugaauguauucgggagg

SEQ ID NO: 449253 - RNA, 64 nt, hsa
augucuucaagugaccuguacugcuuggggacuauuggagaaaauaagguggaguccuacuugu

SEQ ID NO: 449254 - RNA, 64 nt, hsa
uagucuuuuguauuuucccugccgaagugaauuguuggagaauguaaaccgccuccacguggcg

SEQ ID NO: 449255 - RNA, 64 nt, hsa
ugaguguuccugugcccauauuuaaugugugaccuuggagaaguuacucuguaggcaugacagc

SEQ ID NO: 449256 - RNA, 64 nt, hsa
uguuugucauggugaaauuauaacuauuacaguguuggagaacaacaaauauguucucugaaug

SEQ ID NO: 449257 - RNA, 64 nt, hsa
gcugggugcagaagcuguggggucggagaggcguuuggagaaggucuguggugcagugugugaa

SEQ ID NO: 449258 - RNA, 64 nt, hsa
gaauuacugaauauuucagagcaaagcuaucaacuuggagaaacagggauuaaaaauaaggaua

SEQ ID NO: 449259 - RNA, 64 nt, hsa
uuuaaaaacuauauucaguaaaagccugcucaauuuggagaaauagaaccacaaacacagauca

SEQ ID NO: 449260 - RNA, 64 nt, hsa
gcccacagaagucaucagaccuuaccaaaguagguuggagaauuagauugccuuuucaugcagu

SEQ ID NO: 449261 - RNA, 64 nt, hsa
uaugauaugaagggggacuuaucuccugcagagauuggagaagguagaggaggagaaagaaucc

SEQ ID NO: 449262 - RNA, 64 nt, hsa
ugggcgcuguaaguuaagcucuacauagauuaaauuggagaaacguguuaauuguguggaauga

SEQ ID NO: 449263 - RNA, 64 nt, hsa
uuuccuuuuuuuguuuguuuguuuguuuguuuuuuuggagaagagcauccucuuuuguguaguu

SEQ ID NO: 449264 - RNA, 64 nt, hsa
cuuaaaagaaagauuucccauugcauacagguuauuggagaaauuuuccuuuuguugcauuugu

SEQ ID NO: 449265 - RNA, 64 nt, hsa
aucugaguguugccugcugaacucggaggggaguuuggagaaauuuuagacagcagcucugugu

SEQ ID NO: 449266 - RNA, 64 nt, hsa
ucacacuaccaggcccugcagccacaguguucuguuggagaaacuuggggaaguguuuucugaa

SEQ ID NO: 449267 - RNA, 64 nt, hsa
uuucccagaaucagacuuuugaagaugaaugacuuuggagaagcaaauuaaacauuuggcccug

SEQ ID NO: 449268 - RNA, 64 nt, hsa
aguggagauaaauguccuagagucaccaggucgcuuggagaagucauuuaagcugccucggguu

SEQ ID NO: 449269 - RNA, 64 nt, hsa
uaaaauauaacuucaagaaaagaguaaacauccauuggagaacacggcugaaaauuauugugcu

SEQ ID NO: 449270 - RNA, 64 nt, hsa
uaaagaucaugaauuugugacuuaguucugcccuuuggagaacaaaagaaagcagucuuccauc

SEQ ID NO: 449271 - RNA, 64 nt, hsa
aaacaauggugccccagaaagcugcaggugguguuuggagaagcaguuacuuuucaguuacaag

SEQ ID NO: 449272 - RNA, 64 nt, hsa
aaagcaguauuuaaugcaauuuccaguuauuucuuuggagaauuuuaugucauuguuccauuac

SEQ ID NO: 449273 - RNA, 64 nt, hsa
augaguucagaugaucacaaacaggugaguuuuguuggagaagaaaguuggaguaggagacuuu

SEQ ID NO: 449274 - RNA, 64 nt, hsa
ccaauaagaggcucuguuuuccacugaagcuuuguuggagaaagagaauaugaaaauuacacau

SEQ ID NO: 449275 - RNA, 64 nt, hsa
gugugaagacaugaaaguuuaauguacagaaugguuggagaaaugccuauggugaauuaaagcu

SEQ ID NO: 449276 - RNA, 64 nt, hsa
cauugccuuuguguuaauagucaaauacuuaccuuuggagaauacuuaccuuuggaggaaugua

SEQ ID NO: 449277 - RNA, 64 nt, hsa
aauaaccuugcugauaagaaaaaaagggacaauauuggagaaacuaccucuuguuuaauugauc

SEQ ID NO: 449278 - RNA, 64 nt, hsa
ucugguaccuuccccuccugccccugcaccagcuuuggagaauggauuuggagugucuugggcg

SEQ ID NO: 449279 - RNA, 64 nt, hsa
cagaaaucagaggagagacgguguugggagcccuuuggagaacgccagucucccaggcccccug

SEQ ID NO: 449280 - RNA, 64 nt, hsa
aagcaguguagacaaacccuuggggcuuuuuuauuuggagaaccguccagcaugcauccuggcc

SEQ ID NO: 449281 - RNA, 64 nt, hsa
ccacguugucauugugagucuauagcuugacuccuuggagaacaauauucauuugguuguggag

SEQ ID NO: 449282 - RNA, 64 nt, hsa
uuuucaucaacauguagagcugcuauuuuacuauuuggagaauaugaugugaaaauuggaccuc

SEQ ID NO: 449283 - RNA, 64 nt, hsa
ccaaaauagcagaaauuguaaaaauuaugaauuauuggagaaaaugccauuacuuguauaucug

SEQ ID NO: 449284 - RNA, 64 nt, hsa
ucugcagaauauuguaauugcaugcauaccgauauuggagaaaucugggucagccaaguuucau

SEQ ID NO: 449285 - RNA, 64 nt, hsa
gcaaagucuuguacugaagcagucuccuuguugcuuggagaacaccuccuucagagcccuuugu

SEQ ID NO: 449286 - RNA, 64 nt, hsa
gaugaggaaaagaagagccuuugcugauaaagaguuggagaacauuaugcuggagagagaauau

SEQ ID NO: 449287 - RNA, 64 nt, hsa
aguggauuaauauuaaaacuauguauauuaaucauuggagaagggggaagaggaaaugaaaaua

SEQ ID NO: 449288 - RNA, 60 nt, hsa; identical to SEQ ID NO: 445315

SEQ ID NO: 449289 - RNA, 64 nt, hsa
uugcaaaagaaauaggcuuuucuucuuuuuuaaauuggagaaaucucugcucugguugaccugg

SEQ ID NO: 449290 - RNA, 64 nt, hsa
caggcaucuguggggaaucccagccugcagguucuuggagaagcaggugaaccuaaggaugaaa

SEQ ID NO: 449291 - RNA, 64 nt, hsa
cucaugcacaucagcugguggagcaggccuggccuuggagaacgagaccugugugccaggggca

SEQ ID NO: 449292 - RNA, 64 nt, hsa
gcguccuugugaagcucgucuccauguggcuuucuuggagaaaggcuccccuggggcaagaggg

SEQ ID NO: 449293 - RNA, 64 nt, hsa
cggagaggucaggagaccgaccccaccacuaacuuuggagaaaauguggguuugcuuuuuaaag

SEQ ID NO: 449294 - RNA, 64 nt, hsa
uuuucuggaaaaguuaaaaaaaguuacaugucauuuggagaaaauacguaaucagaaauuugug

SEQ ID NO: 449295 - RNA, 64 nt, hsa
ccggccaauguccaaaauuacgguuugaacauaauuggagaaccuuuccuucaagcagaaacaa

SEQ ID NO: 449296 - RNA, 64 nt, hsa
acggccaagggccacgggaacuuggagagggagcuuggagaacucacugugggcuagggugguc

SEQ ID NO: 449297 - RNA, 64 nt, hsa
acguguguuuuuuagagcuugguucuuuaaagauuuggagaagauauguaaauuaccaaggcac

SEQ ID NO: 449298 - RNA, 64 nt, hsa
guguaaaaaguacucagaaaaacaucuaaagcuguuggagaagagggacucauauaaauaguug

SEQ ID NO: 449299 - RNA, 64 nt, hsa
gugcuuuugcaagacuggaauuccuuggacaccauuggagaagccccgcuuuuucuggaacagc

SEQ ID NO: 449300 - RNA, 64 nt, hsa
gguuuuuaaaacauggauguuaaggcuguuuugcuuggagaagacuugggacugggacagucuu

SEQ ID NO: 449301 - RNA, 64 nt, hsa
aagaacaaaagcuuuuaguuguuuuuguuuuguuuuggagaauuuguuuaccaguaaauacauc

SEQ ID NO: 449302 - RNA, 64 nt, hsa
uuuuaaaaagaagagaaagaagauauacuuugcuuuggagaaaucuacuuuuugacuuacaugg

SEQ ID NO: 449303 - RNA, 64 nt, hsa
cuccgccccauccugcagggccuuguuuuuguauuuggagaaccucgcccaucccccccgcggc

SEQ ID NO: 449304 - RNA, 64 nt, hsa
gauuccuuuuuucaaaauccaaaaagaaaugauguuggagaagggaaguugaacgagcauaguc

SEQ ID NO: 449305 - RNA, 64 nt, hsa
uuuuacuaaauauacaagauuuacuacuagaaauuuggagaaagaacacuaacacauguacuug

SEQ ID NO: 449306 - RNA, 64 nt, hsa
gaacucaugagagacaagcaguaagaaacuucuuuuggagaaacaacagaccagaucuuuacuc

SEQ ID NO: 449307 - RNA, 64 nt, hsa
acuacaguuucacagaauaccugagaagacacacuuggagaaaccuuuuggguguaaugaaugu

SEQ ID NO: 449308 - RNA, 64 nt, hsa
agccuuacuucuacuuccagaugcagugccucuuuuggagaagacauguuuauuuuucauguuc

SEQ ID NO: 449309 - RNA, 64 nt, hsa
ggagggaagaguguguccuggcaggaagccaccauuggagaaggugaggccaguaaccaucuca

SEQ ID NO: 449310 - RNA, 64 nt, hsa
gauuuuacauaucuguuuggauuauagcuaggauuuggagaauaaguguguacagaucacaaaa

SEQ ID NO: 449311 - RNA, 64 nt, hsa
uuuuuaagcaagagaaagacaacuguucugcggguuggagaaaauacaauuuuuuuuuuuuuuu

SEQ ID NO: 449312 - RNA, 64 nt, hsa
acuauugcugcauacccggggugggauggggugguuggagaaccagaacuauuuuuaaaacauu

SEQ ID NO: 449313 - RNA, 64 nt, hsa
cugaacuggggaauuugaacauuccuuuacauuguuggagaaaugaagccaaaguuauucagau

SEQ ID NO: 449314 - RNA, 64 nt, hsa
ucuauaugguucuccaagaaacugaaugaauccauuggagaagcgguggauaacuagccagaca

SEQ ID NO: 449315 - RNA, 64 nt, hsa
auuauguucuuuagacacugcuaccugaaaacuguuggagaaauaauguuuaaaguuauuuaag

SEQ ID NO: 449316 - RNA, 64 nt, hsa
uuaaaacccugaugcaaacuucuccuuucagugguuggagaaauuggccgaguucaaccauuca

SEQ ID NO: 449317 - RNA, 64 nt, hsa
aaauucuaaccaaaccccagacauagggagucauuuggagaaagccuguaugugguguuuuaac

SEQ ID NO: 449318 - RNA, 64 nt, hsa
aauggucagccuaaggguaauguacagcccgugcuuggagaaccauggaagcuacaccccuaca

SEQ ID NO: 449319 - RNA, 64 nt, hsa
cagaacuguggugccaaauugcuggugucucucuuuggagaaaccaaccagauacaucugcugg

SEQ ID NO: 449320 - RNA, 64 nt, hsa
uuugccaaauaacaaaagcauacaaugcauacuguuggagaacaagaaugcuacuguauuuuac

SEQ ID NO: 449321 - RNA, 64 nt, hsa
gauaccuugaucuuucccacuuucuguuuucggauuggagaagauguaccuuuuuugucaacuc

SEQ ID NO: 449322 - RNA, 64 nt, hsa
caccuuaaauaaaagugauugugacuaaggcacguuggagaacauuccaaucuuuccucccaag

SEQ ID NO: 449323 - RNA, 64 nt, hsa
aaaagcuaaauaaccuuuaagaaugugggugguauuggagaaagaagaugaauuauagcuccgg

SEQ ID NO: 449324 - RNA, 64 nt, hsa
cuguaucuacucuguggaguagaaccaagucuacuuggagaaaagaaccaaguccuuggauauc

SEQ ID NO: 449325 - RNA, 64 nt, hsa
uaagucacaccuaccacugagcagcuguacgacuuuggagaaguuguuuaacauuuucaagccu

SEQ ID NO: 449326 - RNA, 64 nt, hsa
acacuccaguauuaauauuugugcuaccaucuacuuggagaaguuuaaugagaaaauuuuagaa

SEQ ID NO: 449327 - RNA, 64 nt, hsa
ccccauaggaugucauauugaggcccaaacuugauuggagaauuugcaaacuaccgucgcucag

SEQ ID NO: 449328 - RNA, 64 nt, hsa
aaugcagauuacacugaucuuauguguuacaaaauuggagaaaguauuuaauaaaaccuguuaa

SEQ ID NO: 449329 - RNA, 64 nt, hsa
gugcguucugccuuccuuguuaauuuuguaauaauuggagaagauuuaugucagcacacacuua

SEQ ID NO: 449330 - RNA, 64 nt, hsa
acauuggugucucuuuuuuccuuuccuuucgacauuggagaauuggagugcagucauaaucuua

SEQ ID NO: 449331 - RNA, 64 nt, hsa
uguccuuuccuuucugaaaauaaaguuuugugcuuuggagaaugacucgugagcacaucuuuag

SEQ ID NO: 449332 - RNA, 64 nt, hsa
cacccuaggggggcaccugcgccuguguggaaauuuggagaaguugcggcagagaagccaugcg

SEQ ID NO: 449333 - RNA, 64 nt, hsa
auuucccagugugucuuuuaugucuuugaauguuuuggagaaaagucuaugccugucuaaaaau

SEQ ID NO: 449334 - RNA, 64 nt, hsa
uauuuuaaauuaaagccuucuaauguuccacuguuuggagaacagaagauagcaggcuguguau

SEQ ID NO: 449335 - RNA, 64 nt, hsa
ugcaaacacuguguauagugagacuuguucuacuuuggagaacagguuaccuuuugaaaaugag

SEQ ID NO: 449336 - RNA, 55 nt, hsa; identical to SEQ ID NO: 445363

SEQ ID NO: 449337 - RNA, 64 nt, hsa
uagucaguuuaguucauauguucugaaaacuguuuuggagaaagauagacagaaaaaugucauc

SEQ ID NO: 449338 - RNA, 64 nt, hsa
uaauucucagaaccagucucagggagauauaugcuuggagaacucugccuuccaucaacugcag

SEQ ID NO: 449339 - RNA, 64 nt, hsa
gccaugaauuaagauggaugacuggaaaaagguguuggagaaagaguuaaagaugaggaagaga

SEQ ID NO: 449340 - RNA, 64 nt, hsa
gcaaguaccaggaggacauaaccgcuguggccuguuggagaacagccaguagccuugguaauau

SEQ ID NO: 449341 - RNA, 64 nt, hsa
auuguuacaugaaagugauagauagcaacaaguuuuggagaagagagagggagauaaaaggggg

SEQ ID NO: 449342 - RNA, 64 nt, hsa
gauuuucuacaugaaucaaacacagaaacaacuuuuggagaaauuaaauucugagugugacuuc

SEQ ID NO: 449343 - RNA, 64 nt, hsa
cgcuccccugacacugaagaggauccacaacuccuuggagaaacacccucacgucuguugccgc

SEQ ID NO: 449344 - RNA, 64 nt, hsa
uuauauagauguaucuuuuaaaaauaguucacguuuggagaauucuuuuguacucauuugcuuu

SEQ ID NO: 449345 - RNA, 64 nt, hsa
uagcucugacuuugcuguuuccagugguaugaccuuggagaagucacuuauccucuuggagccu

SEQ ID NO: 449346 - RNA, 64 nt, hsa
guucucucuggacucuugccuagcucacaaggcuuuggagaauugucuuccuaaaucggggcac

SEQ ID NO: 449347 - RNA, 64 nt, hsa
uuggaaagcaucuaguccagugggaagccagggguuggagaaggugcuacaucccucuucccau

SEQ ID NO: 449348 - RNA, 64 nt, hsa
gccuucuagaaucagaucuguuuggggcuggggguuggagaauaaaagcaggagaagucuaugg

SEQ ID NO: 449349 - RNA, 64 nt, hsa
ccucugcuguguucuguguguccaguguagccuauuggagaaucggucucauuagagugacucu

SEQ ID NO: 449350 - RNA, 64 nt, hsa
aguuguuuaauagagaaaauguacacagacugauuuggagaacacauucucugaaaauacugua

SEQ ID NO: 449351 - RNA, 64 nt, hsa
guccauauccagguuagcugguaagaggauuuuuuuggagaaaaaaaugauauuuagaaaguua

SEQ ID NO: 449352 - RNA, 64 nt, hsa
aaacuuguauuacauaucaaauaaaugauacaucuuggagaagagggaggaauaggagcaaauc

SEQ ID NO: 449353 - RNA, 64 nt, hsa
ggaaggaguuuuauguuaaaccauccauguauuuuuggagaagagagaggaaagguuugagaag

SEQ ID NO: 449354 - RNA, 64 nt, hsa
ugucaagguuguccccagaccuugcuugcagugguuggagaacccagggggcugccuugggccc

SEQ ID NO: 449355 - RNA, 64 nt, hsa
ugucuuugggagggaagaagguacagaagaaagauuggagaagggccucucuagcagucaacuc

SEQ ID NO: 449356 - RNA, 64 nt, hsa
cugagggugcccaccaagcccaccuuccagaaacuuggagaaauggggguugggaacuuaugca

SEQ ID NO: 449357 - RNA, 64 nt, hsa
ccagcugugguuggaucaaggacucauuccugccuuggagaaaauacuucaaccagagcaggga

SEQ ID NO: 449358 - RNA, 64 nt, hsa
agcaugaaagucaaaacuggaauuuucuaaagcuuuggagaaaaggagagaauuaguagggcaa

SEQ ID NO: 449359 - RNA, 64 nt, hsa
ugguucaguggcuggaguauuaggggccuggggauuggagaacggagaagaaguuguagcagag

SEQ ID NO: 449360 - RNA, 64 nt, hsa
uaaaaaauuuuacugucuaaauaaguaccuuuuauuggagaaaaaucaaaaccccaaacaaaca

SEQ ID NO: 449361 - RNA, 64 nt, hsa
uguugaaauaaugauaguagguauguauuauggauuggagaagcacuuauuacacuaucuaacc

SEQ ID NO: 449362 - RNA, 64 nt, hsa
uaaugcucuauccucuaagguuggaacucugaaguuggagaagguggaauaaaguuacaccugg

SEQ ID NO: 449363 - RNA, 64 nt, hsa
cagguuugaccaggaaagcagcgcuaguggaggguuggagaaggagguaaaggaugaggguuca

SEQ ID NO: 449364 - RNA, 64 nt, hsa
caggaacaagaagagacccuuguucaauaugaucuuggagaacacgguuuugaaagcaacuccu

SEQ ID NO: 449365 - RNA, 64 nt, hsa
gaauaaaugugaaggcugugaagaguggacagucuuggagaacacagugcuugaaauggacaag

SEQ ID NO: 449366 - RNA, 64 nt, hsa
cucgcugucucccuagagccagggcccugcggauuuggagaagggagcggggcaggacuuccag

SEQ ID NO: 449367 - RNA, 64 nt, hsa
agagaaagguuuuagacuccaguuuaccuuucucuuggagaaacucaaugcuaaucccaccuuu

SEQ ID NO: 449368 - RNA, 64 nt, hsa
auguucacacacuuuucuugcguacucaacuaaauuggagaauguuucugaagaaaauuggaug

SEQ ID NO: 449369 - RNA, 64 nt, hsa
gaaggcucgaguucugcuguucuguaaaagagaauuggagaaugaaaccugcuccaacagagau

SEQ ID NO: 449370 - RNA, 64 nt, hsa
uccugucauuucuguucuugucccucauacaucuuuggagaaccgggcuccagacuuuguuccc

SEQ ID NO: 449371 - RNA, 64 nt, hsa
uggacaggacccagcccugcaccguucacuguauuuggagaaaaugguaagaguuccauaccgg

SEQ ID NO: 449372 - RNA, 64 nt, hsa
uguguauguguggaaauaaaaauguauuguacuuuuggagaauuuuuuguaggcauuuuucugu

SEQ ID NO: 449373 - RNA, 64 nt, hsa
gggcucuggccaucugcaacccugaacgugcagguuggagaacgaaugaauacaaauuuuauug

SEQ ID NO: 449374 - RNA, 64 nt, hsa
cagccuuuccuacauccuucccucacucccaugauuggagaaaugauucauugggugaugagug

SEQ ID NO: 449375 - RNA, 64 nt, hsa
agcagcugggcugucagggccauaguagcucccuuuggagaacagggaaagccuggaggcuucc

SEQ ID NO: 449376 - RNA, 64 nt, hsa
gacagugcaacaaguaacgagacuauuuuguauuuuggagaauucauauuauggagaaccuaac

SEQ ID NO: 449377 - RNA, 64 nt, hsa
aauuccuaccaggaaagaauacauauccaauagauuggagaaagccagagauuagcccucauuc

SEQ ID NO: 449378 - RNA, 64 nt, hsa
aauuuuucacaaagagcaaugacuuuauuuugcauuggagaacuccuggagauaagcuguacaa

SEQ ID NO: 449379 - RNA, 64 nt, hsa
uguuagugagggccucaaguccaaggcuuuaucuuuggagaaggcaaggaaggaggcggugaca

SEQ ID NO: 449380 - RNA, 64 nt, hsa
agucuucauuuggggccaaaggggaaacuuuuuuuuggagaaggcgucuugcuuugucacccac

SEQ ID NO: 449381 - RNA, 64 nt, hsa
aaggaucugauacaucuaguuauuggucuggaaauuggagaaauggaggugagcaaauuaacgg

SEQ ID NO: 449382 - RNA, 64 nt, hsa
uaauuaaagaaccuggugggugugcacuaugagauuggagaaaugaauuaaguugacuugaaau

SEQ ID NO: 449383 - RNA, 64 nt, hsa
uuguuuaaaagaaaaucaggugggugggaaucucuuggagaacugaggcugaggguagagggag

SEQ ID NO: 449384 - RNA, 64 nt, hsa
acugacugggacccugaagaggcauuucagaguguuggagaagaaucuguagcuuguugaaaaa

SEQ ID NO: 449385 - RNA, 64 nt, hsa
uuuucaaaaaccuaauccguaguaauuccuaaucuuggagaauaaaaaagggcgguggagggga

SEQ ID NO: 449386 - RNA, 64 nt, hsa
gaauuaaauacauuucauugagcuuuaaaguacuuuggagaaacuuuggggcacguuuuccuac

SEQ ID NO: 449387 - RNA, 64 nt, hsa
uagaggaacuuggaucuuccggagaaugauguucuuggagaacaggcagaucaaaagaggugaa

SEQ ID NO: 449388 - RNA, 64 nt, hsa
uauaaaagaaguugugcuauuuaacucugaauacuuggagaaacuaggugaagaugcaaccaga

SEQ ID NO: 449389 - RNA, 64 nt, hsa
gucaaguaguuuuaauauguaaauuugcaaguuuuuggagaacccccaaacuccuucuccacug

SEQ ID NO: 449390 - RNA, 64 nt, hsa
ugaaaaaugcucucccagcaaagcugagacaaaauuggagaagcugcagccucacgcaccaucc

SEQ ID NO: 449391 - RNA, 64 nt, hsa
auugcacaucaguaugugccaaaucuacuagacauuggagaaacaguaggaacaacacauggua

SEQ ID NO: 449392 - RNA, 64 nt, hsa
uuuauuucugcagguuggugaaaacccuguguccuuggagaaagcugguucccguuuuccagag

SEQ ID NO: 449393 - RNA, 64 nt, hsa
gcuuguguggucagcucuucccuucaucacauacuuggagaacaaaggacaccguuacccaugc

SEQ ID NO: 449394 - RNA, 64 nt, hsa
agauuuauggaguaaggacuuaaaaucauacaucuuggagaaccuuucuuacucauuucagucc

SEQ ID NO: 449395 - RNA, 64 nt, hsa
acuggagccauaaaguuaauuugcaccuagcuuuuuggagaauagccaugauuaacugcuauuc

SEQ ID NO: 449396 - RNA, 64 nt, hsa
caguuuuuuaaaaauagacuguaguauccuuucauuggagaauuuacaaaaauaucaucuacag

SEQ ID NO: 449397 - RNA, 64 nt, hsa
guucaaaccaaagaaacaaugaucuacucaaacauuggagaaaaaaacugccagaggaggaguu

SEQ ID NO: 449398 - RNA, 64 nt, hsa
ccagcuuucgucugucaucagacauugaagagauuuggagaaauguaaagcagcaguacucuuc

SEQ ID NO: 449399 - RNA, 64 nt, hsa
uagauggguauauaacaguuuggaaauacuaucuuuggagaauguauuuuuguauuuauaaauc

SEQ ID NO: 449400 - RNA, 64 nt, hsa
gugagcaggcacauugacuuucuguugagguaccuuggagaagcugagccauucugaggacauc

SEQ ID NO: 449401 - RNA, 64 nt, hsa
gauuuuuaaaggaauauuucagaguuuaaucuuuuuggagaaguuauguucuuuaaucggguac

SEQ ID NO: 449402 - RNA, 64 nt, hsa
uuauguauguucagccagauaguaaaugggauuuuuggagaaauaagauaacuacaaaguuucu

SEQ ID NO: 449403 - RNA, 64 nt, hsa
aaaguauuaucuaauuaaguucaugauagugcuuuuggagaacuugucaaauuacagccaauga

SEQ ID NO: 449404 - RNA, 64 nt, hsa
agcuaggaauuguuaagcacauugcagauuguucuuggagaauucuggaguuguuaugaacaug

SEQ ID NO: 449405 - RNA, 64 nt, hsa
uugcaucacugaggaugaaacugacuuuugucuuuuggagaaaaaaaacuguacugcuuguuca

SEQ ID NO: 449406 - RNA, 64 nt, hsa
cauaauagagauugauaagauuuagcaacugguguuggagaaaaaaagaaaagcaaaugagugu

SEQ ID NO: 449407 - RNA, 64 nt, hsa
cuuuuccaguauuaaacacucauaugcuuauggcuuggagaaauuucuuaguugggugaauuaa

SEQ ID NO: 449408 - RNA, 64 nt, hsa
uuucuuguucccguagaagaaagaagaaagguguuuggagaauucgagugccuaggaugccaga

SEQ ID NO: 449409 - RNA, 64 nt, hsa
uaagacaaagauauuuagguugagcagcuauuaauuggagaauugguacagagacgcuccagau

SEQ ID NO: 449410 - RNA, 64 nt, hsa
aagccuggcugcagcuucccauuugguuacgagguuggagaaaaagucaaaguccccuccuggg

SEQ ID NO: 449411 - RNA, 64 nt, hsa
uauagcaucuggaagaucauuuugaaauuguuccuuggagaaaugaaaacaguguguaaacaaa

SEQ ID NO: 449412 - RNA, 64 nt, hsa
acuuucuugucaaacaaaaccaauggcucuggguuuggagaacacaguggcugguuuuaaaaau

SEQ ID NO: 449413 - RNA, 64 nt, hsa
cugccuuucccaaaugggaaaggugcugacagaguuggagaaaaaagaauagacucauuuuucc

SEQ ID NO: 449414 - RNA, 64 nt, hsa
ugcuugugcugggaaaugcaacucacucauguauuuggagaaacaggaguguucacuuaucuag

SEQ ID NO: 449415 - RNA, 64 nt, hsa
aaaacuucuuuuaaaccucaccuuugugggguuuuuggagaagguuaucaaaaauuucauggaa

SEQ ID NO: 449416 - RNA, 64 nt, hsa
gggagagauauuuucuuauguuuauucggagaauuuggagaagugauugaacuuuucaagacau

SEQ ID NO: 449417 - RNA, 64 nt, hsa
aucaauauaacaauauaauccuaaaccuugacaguuggagaagccaaugcagaacugaugggaa

SEQ ID NO: 449418 - RNA, 64 nt, hsa
aaguuuaaaaauucuuuaaacagguauuuugauauuggagaauaacaugcauauaauucuguag

SEQ ID NO: 449419 - RNA, 64 nt, hsa
ucaaugcuuauauauuccuuagacuauugaaauuuuggagaaaauguauuuguguucacuucua

SEQ ID NO: 449420 - RNA, 64 nt, hsa
uacaaaaaugaaaauauuuauaauaggacucgacuuggagaaauugcuauucuuccuguugucc

SEQ ID NO: 449421 - RNA, 64 nt, hsa
ucuuaguugucauaaucccuuggagccuggguuuuuggagaaagagaucuccgugcccuacaga

SEQ ID NO: 449422 - RNA, 64 nt, hsa
cuuuuagauaggaucuaggagugauuuuauuguuuuggagaauggaagggcccccauggcccug

SEQ ID NO: 449423 - RNA, 64 nt, hsa
acuaaaaugaaccaaacccauauuucacuggugguuggagaaaaccauggccaaaacgauugug

SEQ ID NO: 449424 - RNA, 64 nt, hsa
aucaauguguauguggcuguuuguagugaauuuauuggagaaugagguuguccguguccuuaac

SEQ ID NO: 449425 - RNA, 64 nt, hsa
aaaugaauugaaccauuucaacuauuuucuauauuuggagaaaguuugugcccuguguuuuaua

SEQ ID NO: 449426 - RNA, 64 nt, hsa
uaucaacagcaaacuucagccguuucacuuuuuguuggagaaaaauaguagauuuuaauuugac

SEQ ID NO: 449427 - RNA, 64 nt, hsa
cacugugccucagagaccagggcuccagccccucuuggagaagucucagcuaagcucacguccu

SEQ ID NO: 449428 - RNA, 64 nt, hsa
gaagccagcuggacuuccugggucgaguggggccuuggagaacuuuucugucuuacaagaggau

SEQ ID NO: 449429 - RNA, 64 nt, hsa
agaauugcucauucauauuuuuucuguugcuugcuuggagaauuugcucuuuuuuuggcauaua

SEQ ID NO: 449430 - RNA, 64 nt, hsa
aaccuuugcacacucaccugagcccuggggacccuuggagaaauuaggugucaccugcuguggc

SEQ ID NO: 449431 - RNA, 64 nt, hsa
acaugaaacauuugcaaaauuguuuuugguuggauuggagaaguaauccuagggaaggguggug

SEQ ID NO: 449432 - RNA, 64 nt, hsa
uugauaccaaacaauucaaaaguuggaucugaguuuggagaaagauauuuccaaccuaaguggg

SEQ ID NO: 449433 - RNA, 64 nt, hsa
acaaacuauguagugugucccuauuauaaaugcauuggagaaguauuuuuaugagacucuuuac

SEQ ID NO: 449434 - RNA, 64 nt, hsa
uuagaagucugcuaaagaucaaaugugaaaguacuuggagaaacugaggccucuuauguguaau

SEQ ID NO: 449435 - RNA, 64 nt, hsa
uucuguggagguggaaaagcaacauucauagucuuuggagaaaugcuuagaaauucagcauuug

SEQ ID NO: 449436 - RNA, 64 nt, hsa
gccuggagugacacuacacucuagaauuuccacuuuggagaauacucaguuccaacuugugauu

SEQ ID NO: 449437 - RNA, 64 nt, hsa
uuuuaaaaauuuaacaugauugcuuuucucaauuuuggagaagauguuuaaauaguucuguugu

SEQ ID NO: 449438 - RNA, 64 nt, hsa
auuuuuacuugcggugacuauucuugccacaauauuggagaauaaugauagaugauauacuaga

SEQ ID NO: 449439 - RNA, 64 nt, hsa
agaaguucugccucugccuggggucuuggccacauuggagaaaaacaggcucaaaguggggcug

SEQ ID NO: 449440 - RNA, 64 nt, hsa
cugccccgagcccuagguggggccaggaggugccuuggagaagccagccagagcagagagggcu

SEQ ID NO: 449441 - RNA, 64 nt, hsa
acagacucugagaagcgaagaccaugucuccucguuggagaaacccaauagcaggggaagcugg

SEQ ID NO: 449442 - RNA, 64 nt, hsa
uguguguaaugcaaauuaguuaaaacaaauaguuuuggagaaaguuaaaacuagcuuuagagua

SEQ ID NO: 449443 - RNA, 64 nt, hsa
ccagaaucauucuccuuucugcccauaaagggccuuggagaauugcuuuaagaagagugaaugu

SEQ ID NO: 449444 - RNA, 64 nt, hsa
aggagccugggaccccgcaugucccaaaaugggauuggagaagcuggagagaaagcagaagagg

SEQ ID NO: 449445 - RNA, 64 nt, hsa
uuuuuggguguuccuggcaguuuaaaaaaauugguuggagaauuuagguuuuuauuaguaccau

SEQ ID NO: 449446 - RNA, 59 nt, hsa; identical to SEQ ID NO: 445473

SEQ ID NO: 449447 - RNA, 64 nt, hsa
aguguggugaugccaugcccaucaugggaggcuuuuggagaaacagaauguuugggcaggggcu

SEQ ID NO: 449448 - RNA, 64 nt, hsa
aucuuccacuggaacguuucacugcaaacacaccuuggagaaguggcaucagucaacagagagg

SEQ ID NO: 449449 - RNA, 64 nt, hsa
ugaagccagcugggcuccugagucugguggggacuuggagaaccuuuaugucuagcuaagggau

SEQ ID NO: 449450 - RNA, 64 nt, hsa
uccacacucuguaucuggcuacucugguggggacuuggagaaccuuuguguccacacucuguau

SEQ ID NO: 449451 - RNA, 64 nt, hsa
aacacccuccuggcacaacgcucuacccugcagcuuggagaacuccgcuggauggggagucuca

SEQ ID NO: 449452 - RNA, 64 nt, hsa
guggaucaccugaauucucucagcugucaauggcuuggagaacaucucaugggcccaagucauc

SEQ ID NO: 449453 - RNA, 64 nt, hsa
uuuguugaaauagcuuuacuguuucucaaguguuuuggagaaaaaaaucaacccugcaaucacu

SEQ ID NO: 449454 - RNA, 64 nt, hsa
uuggccaaagugaaggaaucuuuuuucaguuuuauuggagaaacugaaggguaacauucuaaca

SEQ ID NO: 449455 - RNA, 64 nt, hsa
ggcuguggcugacaguggcucuggccaggguugcuuggagaaggcucagugugccugggacagg

SEQ ID NO: 449456 - RNA, 64 nt, hsa
gaaagcggauaaaacuuucauuggacuggaauguuuggagaauguuaauuuccaaaucaggaac

SEQ ID NO: 449457 - RNA, 64 nt, hsa
uguuuguaguuacauuuaggauggacuuaucccuuuggagaagagugaaguuuguuuuuucgcc

SEQ ID NO: 449458 - RNA, 64 nt, hsa
gcggccuggccuagaccaggggugcagccagcuuuuggagaaccuggauggccuuaggguuccu

SEQ ID NO: 449459 - RNA, 64 nt, hsa
uuugugacuuggaaagguacgcugcuggccagcauuggagaagaagcugcugagcauggcuuuc

SEQ ID NO: 449460 - RNA, 64 nt, hsa
aggucccaguucacauguaguccccugcucaccauuggagaaucagcucacugcucucuagaaa

SEQ ID NO: 449461 - RNA, 64 nt, hsa
aaccggccucaugacuagccuuguugccgucgaguuggagaaaguggugcugaaauccaccuuu

SEQ ID NO: 449462 - RNA, 64 nt, hsa
gugugauggugcaaggaauggauucaggauguuguuggagaaacaaguuugugauuaguccuua

SEQ ID NO: 449463 - RNA, 64 nt, hsa
cugccugacugccucagcagggaccgcaugccgcuuggagaagggguggccucgccggagcuag

SEQ ID NO: 449464 - RNA, 64 nt, hsa
cuuuucuccagcaacugcagaggcauuucaggaguuggagaacggaguacauuuuuaaaauuuu

SEQ ID NO: 449465 - RNA, 64 nt, hsa
cggauggugaggacacagcuaugaucagggaauuuuggagaaacuacagcaucauggaugcugu

SEQ ID NO: 449466 - RNA, 64 nt, hsa
aagacauaaacuuggaguccaucugguuuaauuauuggagaaucgauucccaaguccaggaaga

SEQ ID NO: 449467 - RNA, 64 nt, hsa
uuacuuuuccucagaagauugagcugucuuuuauuuggagaauaaaaugaaguucugaaaaaaa

SEQ ID NO: 449468 - RNA, 64 nt, hsa
uuugccaagaagugaucuguuuuaaaggucauauuuggagaaagggcaaggaauugggucugcu

SEQ ID NO: 449469 - RNA, 64 nt, hsa
uggauguguuugggggcggggggauggaagugacuuggagaauguguuugggaugaaauaacua

SEQ ID NO: 449470 - RNA, 64 nt, hsa
uuauaaaccacugaaagggauagagaagugaacauuggagaaagccaguagcaacugugagaaa

SEQ ID NO: 449471 - RNA, 64 nt, hsa
uggaggaucaguagcuguuaugaugccagaccauuuggagaaguaucagaggccugaccggaca

SEQ ID NO: 449472 - RNA, 64 nt, hsa
caagcccuuggggugacucggcuuccaggagcuguuggagaaaugaggaugucugucccugucu

SEQ ID NO: 449473 - RNA, 64 nt, hsa
ucaacugcugguagcauuuaucugacuuggaaaguuggagaagaggcauuccuacuggagaaaa

SEQ ID NO: 449474 - RNA, 64 nt, hsa
acagguguggguguccuguuggaggagggcuuguuuggagaagggaggcuggcugggggagaaa

SEQ ID NO: 449475 - RNA, 64 nt, hsa
gggcucggaccccucacuggggacagggccaguguuggagaauucugauuccuuuuuuguuguc

SEQ ID NO: 449476 - RNA, 64 nt, hsa
cagugagaauucgugcaucucugcucugugggguuuggagaaaugcuuuggcagaagagugaaa

SEQ ID NO: 449477 - RNA, 64 nt, hsa
ucuuguguaaacguuugcagacacaggugcagcuuuggagaacucaccucuggcucuugugcuu

SEQ ID NO: 449478 - RNA, 64 nt, hsa
ggggaagaugcuggacucauugaaaggugguugcuuggagaagggacauggggcugaaucucag

SEQ ID NO: 449479 - RNA, 64 nt, hsa
ccaaaaacuacauauuuguaggaaaucugccuuauuggagaaaaucacccuuucccuuuuucuu

SEQ ID NO: 449480 - RNA, 64 nt, hsa
acuccauagcuaccaaguuaaccugcucuaaacuuuggagaacuggaucuguccaauaaacgcu

SEQ ID NO: 449481 - RNA, 64 nt, hsa
uugccacucaguuccucugggugugcacauauguuuggagaaauagaggagagaaaagagggcc

SEQ ID NO: 449482 - RNA, 64 nt, hsa
ccagauaucaaaccugaggaaggcagaagugaauuuggagaacuaggguagagagagguugcua

SEQ ID NO: 449483 - RNA, 64 nt, hsa
aguugaaguccaaccuauuuaaaaaccccaccauuuggagaauuacaaggguuuuguccugaau

SEQ ID NO: 449484 - RNA, 64 nt, hsa
cagccuucaugccuuccccacccuccagcuccucuuggagaagcuguugcugagaccccccccc

SEQ ID NO: 449485 - RNA, 64 nt, hsa
ucagaaaucaggacauccccccuaucaggugguuuuggagaaaacaaggaaggcggaagaaugg

SEQ ID NO: 449486 - RNA, 64 nt, hsa
auuaacaacugaggaaggccagugcagaauauuuuuggagaacgauuuuuuuuuuaaauaauau

SEQ ID NO: 449487 - RNA, 64 nt, hsa
caacaacauaaaaauccuugcauaccuuguucaauuggagaauuuuaauguuuuucauuuauca

SEQ ID NO: 449488 - RNA, 64 nt, hsa
uacaccuggcaucuguggcauguguucuggucacuuggagaagggcauguguggggugugugug

SEQ ID NO: 449489 - RNA, 64 nt, hsa
gugugggcgcgucugugguguguguccuagucacuuggagaagggugugugugggaugcgugug

SEQ ID NO: 449490 - RNA, 64 nt, hsa
gaacugucugcccaggagccugagccucaggcuguuggagaagcaucugaugccuuuuucuuug

SEQ ID NO: 449491 - RNA, 64 nt, hsa
uauggaagcauguguaaaauuauacuuucaguaauuggagaauucagagauugcauuucuagca

SEQ ID NO: 449492 - RNA, 64 nt, hsa
ccuuguauugugauauuaacuggcaaagauccucuuggagaaaccuuucccagguacaguuuca

SEQ ID NO: 449493 - RNA, 64 nt, hsa
uaaugaagcugauuuuuuagcugagauagaagcuuuggagaaaaugaaugaagaucacguucag

SEQ ID NO: 449494 - RNA, 64 nt, hsa
uucguuuuuguuucccuuuaguauuuaauggucuuuggagaaaaaauaauaaaacagaguguua

SEQ ID NO: 449495 - RNA, 64 nt, hsa
uuuugccucccacacccagccacuaccucccagcuuggagaacaccucagaauucagaagauau

SEQ ID NO: 449496 - RNA, 64 nt, hsa
auugcacgaguguguuuuccucacacacuuugauuuggagaauuggugcuaguuggcaauagau

SEQ ID NO: 449497 - RNA, 64 nt, hsa
uucacagagauggaugcauguucugauugccucuuuggagaagcucaucagaaacucaaaagaa

SEQ ID NO: 449498 - RNA, 64 nt, hsa
gagcaucguggaugggugcacggagacacgcaccuuggagaaaugaggggagauggaccaagaa

SEQ ID NO: 449499 - RNA, 64 nt, hsa
aggguuguuacaacugucacuagcggaggucacuuuggagaagggugggccuuacauccagugu

SEQ ID NO: 449500 - RNA, 64 nt, hsa
caauaaaauugcugggaauauuugacucuccguauuggagaaaauaaaauuacaacauuacgac

SEQ ID NO: 449501 - RNA, 64 nt, hsa
caucauuacuggaaaccuauuaaacauuagcaaauuggagaauaguuuuaauauaguaaaugua

SEQ ID NO: 449502 - RNA, 64 nt, hsa
ugguagcgcugggggugauuuuaggcagcaagaauuggagaacucacacugcgaaaagaaaacc

SEQ ID NO: 449503 - RNA, 64 nt, hsa
uuggggugugaaagccucaagugacucagccugguuggagaacugccccacccaguaucuucug

SEQ ID NO: 449504 - RNA, 64 nt, hsa
aagucuucaguaacgcuacaacgauugcaaaucauuggagaauccauaaugaagagagaucuuc

SEQ ID NO: 449505 - RNA, 64 nt, hsa
aacucaaaucauauuagacaucggagaaaucacuuuggagaaaggucuuuugagugcacugagu

SEQ ID NO: 449506 - RNA, 64 nt, hsa
cuaaucaggugagccacucacccuccugcuggccuuggagaagcaaaaagccagggugugccag

SEQ ID NO: 449507 - RNA, 64 nt, hsa
gacuccacagugacuugccacauuugccccccauuuggagaaugcuuuuauaucaaaaguggag

SEQ ID NO: 449508 - RNA, 64 nt, hsa
ggaaaacaagaaauacugucaaggauguggaauguuggagaacauugugcacuaucacugggaa

SEQ ID NO: 449509 - RNA, 64 nt, hsa
ccguauaagcucaaugaguauugauuuaggggcuuuggagaacuuugaaugcuaccccccaagu

SEQ ID NO: 449510 - RNA, 64 nt, hsa
uacuuaaacuuuguucaacaucagggaauucagauuggagaaaaacccugcaaauguaauaaau

SEQ ID NO: 449511 - RNA, 64 nt, hsa
uuuauuuaguuagaacacuucauuuuguuuuuaguuggagaacucuauagcccuuuaguuauuu

SEQ ID NO: 449512 - RNA, 64 nt, hsa
ggacuacagcuuauucagccugggaaaaauaauguuggagaaauacucuaugaauagaauauac

SEQ ID NO: 449513 - RNA, 64 nt, hsa
uuggacugcacuaacuuguggagucugcacuaacuuggagaaguuagugucagaauugaauuau

SEQ ID NO: 449514 - RNA, 64 nt, hsa
aagucuucaguaaugcuacaacgauuacaaaucauuggagaauccauaaugaagagagaucuua

SEQ ID NO: 449515 - RNA, 64 nt, hsa
aagucuucaguaacgcuacaaccauugcaaaucauuggagaaucuauaaugaauaaagaucuaa

SEQ ID NO: 449516 - RNA, 64 nt, hsa
aaguuuucaguaaugcuacaaccauugcaaaucauuggagaauccauaaugagagaucuuacaa

SEQ ID NO: 449517 - RNA, 64 nt, hsa
aaguuuucaguaaugcuacaaccauugcacaucauuggagaauccacagugaagagaucuuaca

SEQ ID NO: 449518 - RNA, 64 nt, hsa
uaggcuaauugugacugugacuuacuucucccucuuggagaaagacuugaagaauguaaugcca

SEQ ID NO: 449519 - RNA, 64 nt, hsa
uguacuuguaccuaaggcccuggguucaagagaguuggagaaaccccucuagaaacauauuggc

SEQ ID NO: 449520 - RNA, 64 nt, hsa
cuuaugagugcagugaguccagucucauuaaauauuggagaauacacaccugaguaagauccug

SEQ ID NO: 449521 - RNA, 64 nt, hsa
auggguaaauauguguugaauugguaacucccucuuggagaauuucuugugaauuacacagcaa

SEQ ID NO: 449522 - RNA, 64 nt, hsa
ucaugugagugaagagaugucacugucuguggucuuggagaacuagucucguagcugaggggug

SEQ ID NO: 449523 - RNA, 64 nt, hsa
ccaaccaccuugaaaccuuuagaacaucucugcuuuggagaaagacccagagaucaggcagagg

SEQ ID NO: 449524 - RNA, 64 nt, hsa
agauguuaaaacagucccguggaaggagcagggguuggagaaaggcaucccaaagcuucgaugg

SEQ ID NO: 449525 - RNA, 64 nt, hsa
cucucagagacucccaggaguuguugaacuauauuuggagaaaacagccacugaauauuaucau

SEQ ID NO: 449526 - RNA, 64 nt, hsa
ugggguaaaugcuuugaggcccagggaccaaucuuuggagaaaguagauauuuccaucaaagcc

SEQ ID NO: 449527 - RNA, 64 nt, hsa
ugcgaauacagcucacagagaaacgcaugugcuauuggagaacaggucuuuguggagaucuaaa

SEQ ID NO: 449528 - RNA, 64 nt, hsa
uguaacauuuaaacauuaauuuaaaaagggaaccuuggagaauucuuuuguucacuaguuccuu

SEQ ID NO: 449529 - RNA, 64 nt, hsa
cugcagcgccaagcggcauccaccaagcaucaaguuggagaaaagggaacccaagcaguagaga

SEQ ID NO: 449530 - RNA, 64 nt, hsa
ucuagguuuccaggccucacagccaagcugaagcuuggagaaaacucugcauucccaugagggc

SEQ ID NO: 449531 - RNA, 64 nt, hsa
aggcugaggugggagaaucacuugaguccuggaguuggagaacagccuggaaagccuggcgaua

SEQ ID NO: 449532 - RNA, 64 nt, hsa
ugagcaccuuggugagcaagccuggcuuuaaagauuggagaagagcuucuggcaccagaacccu

SEQ ID NO: 449533 - RNA, 64 nt, hsa
accuuugcaguguugccgaaucacagcaguucuguuggagaaacgcuugguuuccggauccaga

SEQ ID NO: 449534 - RNA, 64 nt, hsa
aauuuccucccugccucaugugagaccacaggguuuggagaagcaguuggaacccacguguggu

SEQ ID NO: 449535 - RNA, 64 nt, hsa
gaaagccacuuacuggcuuuugacaugacuucucuuggagaauaaguggacuccaagcuaacuc

SEQ ID NO: 449536 - RNA, 64 nt, hsa
gucagguguuccuuccuaaaaaaaaaagucuauuuuggagaauugaaauaauucauggaaggga

SEQ ID NO: 449537 - RNA, 64 nt, hsa
aacaccuccugaguuuugcaauugagaaaaugauuuggagaacuucucuucugguaauuuuuau

SEQ ID NO: 449538 - RNA, 64 nt, hsa
ucuuccucuccaaagcgccagaaccuccuucucuuuggagaauggggaggccucuuggagacac

SEQ ID NO: 449539 - RNA, 64 nt, hsa
gggacugguggugccaagauaaggguuucucaaauuggagaaccccuccuuguugcaugagguc

SEQ ID NO: 449540 - RNA, 64 nt, hsa
ccuguacaugaaccaggucauguuuggccuuguguuggagaaagagaauuauccccacuucaca

SEQ ID NO: 449541 - RNA, 64 nt, hsa
accaaccccaacaacaaaaaagaauguuuugguauuggagaagggauggucaguuagccugucu

SEQ ID NO: 449542 - RNA, 64 nt, hsa
accugccagcucucggaguccuuggugguugaacuuggagaaagaccgcaugaagauacuugua

SEQ ID NO: 449543 - RNA, 64 nt, hsa
aguuaucuuuagcagauauuaaaaauugaaaacuuuggagaacucauuucaaguuaugauucag

SEQ ID NO: 449544 - RNA, 64 nt, hsa
ugccuucagcaggacucuuaauaucugcugcaacuuggagaaccucccugcccugaaaugugaa

SEQ ID NO: 449545 - RNA, 64 nt, hsa
uuacaaacacgggcggaaggcacucaggcuuucguuggagaaacagaaauaaggccuucuuuug

SEQ ID NO: 449546 - RNA, 64 nt, hsa
guaggaagaaaaaggaugcauucccuacagauuuuuggagaaaggauuucugaggaguguguga

SEQ ID NO: 449547 - RNA, 64 nt, hsa
aaacucauucuuacgaaauuagaacgacuucacguuggagaaagcaugaagagguauucaucug

SEQ ID NO: 449548 - RNA, 64 nt, hsa
cagcaagccugcacacgggcuuggguggguuccuuuggagaagauguggcuggaacacaaacaa

SEQ ID NO: 449549 - RNA, 64 nt, hsa
cucgcugggaccuggucccuuuguugcaggcggcuuggagaaagggcagugggacgcuggccac

SEQ ID NO: 449550 - RNA, 64 nt, hsa
gccaguugcagguuaagccccagaaaaguucaccuuggagaagcuccgagaacacacagauugu

SEQ ID NO: 449551 - RNA, 64 nt, hsa
ucaagaauauuuguggagguagguguggggaagguuggagaagaguuagguuugugcuuuguaa

SEQ ID NO: 449552 - RNA, 64 nt, hsa
auuggcucuuuggaggcgagaggaaggggagaacuuggagaauaguuuuugcuuuggggguaga

SEQ ID NO: 449553 - RNA, 64 nt, hsa
cuccccuacuucucccuugcucccaaagcuuuccuuggagaagggcccuccugcagcuggaccc

SEQ ID NO: 449554 - RNA, 64 nt, hsa
cuggaggcugugugcgggcaggcuugugcuccccuuggagaagggcugcuacuuaacaaggaag

SEQ ID NO: 449555 - RNA, 64 nt, hsa
caucaaugcuuuuccucaggaaauucggcaagacuuggagaaaaggaaagcuccaucaaagagg

SEQ ID NO: 449556 - RNA, 64 nt, hsa
ucuuuuccaaguucccaaggccuacagcugaagguuggagaaaugccagcugcccuuucguccc

SEQ ID NO: 449557 - RNA, 64 nt, hsa
aggccgucuccccuuagccaaguccuccucaggcuuggagaacuuccucagcgucaccuccuuc

SEQ ID NO: 449558 - RNA, 64 nt, hsa
gucgcgcaccgaaaaacuaaaaauaaugggcgcuuuggagaagaguguggagucauucucauug

SEQ ID NO: 449559 - RNA, 64 nt, hsa
uuuuuauuucagucacuccugauaaauaacaaauuuggagaaauaaaaauaucuaaaauaaauu

SEQ ID NO: 449560 - RNA, 64 nt, hsa
aaagggcacuuggcaaccacuaugugaagggugauuggagaaggacaagacuguggaaugggga

SEQ ID NO: 449561 - RNA, 64 nt, hsa
aagacuguggaauggggaauaaggaaggaggaguuuggagaaugacuccaaagguuugagcuug

SEQ ID NO: 449562 - RNA, 64 nt, hsa
ggugaggcacucuggaauaugacccuaccagagguuggagaacaaacuugggcagccggaaccc

SEQ ID NO: 449563 - RNA, 64 nt, hsa
cugaugaucaaccugccuccccuccauagucuuguuggagaagcccagagagaaugggacucca

SEQ ID NO: 449564 - RNA, 64 nt, hsa
agauggcgucuaccagaaggggauggacuucauuuuggagaagcucaaccauggggacugggug

SEQ ID NO: 449565 - RNA, 64 nt, hsa
acucaaugaaauaagcugcuaaucagauuuuaccuuggagaaaugaaaauuauuucuuggggau

SEQ ID NO: 449566 - RNA, 64 nt, hsa
ugcaauuuuuaaaaucuagaaguuagggguuuuguuggagaaaaauggacugaucuuuaaacua

SEQ ID NO: 449567 - RNA, 64 nt, hsa
acaagacucucagguauagaaugaacugagcaauuuggagaauguauuggacuuuguccucucu

SEQ ID NO: 449568 - RNA, 64 nt, hsa
uugccuucuuugccuagccaagcagccaauuuuauuggagaaaagcaaguuauauguucacaaa

SEQ ID NO: 449569 - RNA, 64 nt, hsa
uugguuggaagggaauagaaauguuugcugaacauuggagaaucucaacaugucuccuacugag

SEQ ID NO: 449570 - RNA, 64 nt, hsa
ugugcaauauucuuaaauacuacugcucuaaaaguuggagaagucuugcaguuaucuuagcauu

SEQ ID NO: 449571 - RNA, 64 nt, hsa
ugaaugagcaacaccaugcauauagauugaguacuuggagaauacucacguuuuuuaacucaug

SEQ ID NO: 449572 - RNA, 64 nt, hsa
gagggauagaacaucacaacacugcucuaguuucuuggagaaucacauuucuuuacagguuaaa

SEQ ID NO: 449573 - RNA, 64 nt, hsa
auaaaacucagaggaaauuugcacagaugcugcuuuggagaacuuuacaaccuggguugcagaa

SEQ ID NO: 449574 - RNA, 64 nt, hsa
cucuguugaucacagagggagccugaguacaggcuuggagaaauggcuaggacagggaacaggg

SEQ ID NO: 449575 - RNA, 64 nt, hsa
uuccaucuugcugugauuugcaauagguauuuucuuggagaauguaagaacuuaacaauaaagc

SEQ ID NO: 449576 - RNA, 64 nt, hsa
uguauaugcuggguauuucauuugucuuuuuauuuuggagaaagcguuuuuaacugcaacuuuc

SEQ ID NO: 449577 - RNA, 64 nt, hsa
ucauauaauuaaaaagaauuugguuaauaagaauuuggagaauggaaaauacauuuuuagguuc

SEQ ID NO: 449578 - RNA, 64 nt, hsa; identical to SEQ ID NO: 133532

SEQ ID NO: 449579 - RNA, 64 nt, hsa; identical to SEQ ID NO: 133533

SEQ ID NO: 449580 - RNA, 64 nt, hsa; identical to SEQ ID NO: 133534

SEQ ID NO: 449581 - RNA, 64 nt, hsa; identical to SEQ ID NO: 133535

SEQ ID NO: 449582 - RNA, 64 nt, hsa; identical to SEQ ID NO: 133536

SEQ ID NO: 449583 - RNA, 64 nt, hsa; identical to SEQ ID NO: 133537

SEQ ID NO: 449584 - RNA, 64 nt, hsa; identical to SEQ ID NO: 133538

SEQ ID NO: 449585 - RNA, 64 nt, hsa; identical to SEQ ID NO: 133539

SEQ ID NO: 449586 - RNA, 64 nt, hsa
agugauccagccccaccaaggggccuccagagaccccaggaacaauaagugucuccucccacca

SEQ ID NO: 449587 - RNA, 64 nt, hsa
auaaaucugcgagguaguuucuuugguauucuugcccaggaaauggguugauucaucacagauu

SEQ ID NO: 449588 - RNA, 64 nt, hsa
cccacgaaggguuuuuagccagggaaaacugagccccaggaaaaccuaaccacugggcaggcag

SEQ ID NO: 449589 - RNA, 64 nt, hsa
ccagagaugagacucuuagaaucaaaguguucagcccaggaagucuuggagaucccaccuucug

SEQ ID NO: 449590 - RNA, 64 nt, hsa
aaaccagagcagugagggcgggcggggcauuucacccaggaauauugagaaugagggccuggag

SEQ ID NO: 449591 - RNA, 64 nt, hsa
gguggagacuggaggugguggggcuugaaaugagcccaggaaaccagagcagugagggcgggcg

SEQ ID NO: 449592 - RNA, 64 nt, hsa
ggaucucuuccugaucuucccugcccauuggguacccaggaaacugcaagcauugccuguguuc

SEQ ID NO: 449593 - RNA, 64 nt, hsa
gaacuuaacagccuugcuccugaagaacuggcugcccaggaagccaagcuagcuuuuuagggga

SEQ ID NO: 449594 - RNA, 64 nt, hsa
gggaaagaugagcuuuucuaggcuacaauuuucucccaggaagcuuugauuuuuaccguuucuu

SEQ ID NO: 449595 - RNA, 64 nt, hsa
gugugacgggggaaagccaaggucuggagaagcucccaggaacaaucgauggccuugcagcacu

SEQ ID NO: 449596 - RNA, 51 nt, hsa
ggcgguuccaggucuugugagcccaggaaugaaagaggagaagaaacgcaa

SEQ ID NO: 449597 - RNA, 64 nt, hsa
ugguugguugaacugaacauaucuugucuuagcacccaggaaacagaacuuuaagauauauaca

SEQ ID NO: 449598 - RNA, 64 nt, hsa
gggggaggaugacaagccgcugcccaccuccaagcccaggaaacaguacaagauggcuaaggag

SEQ ID NO: 449599 - RNA, 64 nt, hsa
ugcugacccagcaccacuucccagccaggagccccccaggaacagcacagaacagcagggccug

SEQ ID NO: 449600 - RNA, 64 nt, hsa
uacucaggaggcugaggcaggagaauugcuugaacccaggaagcagagguugcaguaagcugag

SEQ ID NO: 449601 - RNA, 64 nt, hsa
acuaugggaggcugaggcaagcagguuguuugagcccaggaauuugagaacaggauuuugagaa

SEQ ID NO: 449602 - RNA, 64 nt, hsa
augggcucugguucugccaggagccugugacacccccaggaaggggguggaacugaggaagagc

SEQ ID NO: 449603 - RNA, 64 nt, hsa
agagagccuuggcgccucuguuugccaccacuuccccaggaaggagggacagcauuucucuggc

SEQ ID NO: 449604 - RNA, 64 nt, hsa
gccgccacugcaguucugcuaggucugcuuccugcccaggaaggugccugcacaugagaggaga

SEQ ID NO: 449605 - RNA, 64 nt, hsa
ggcauccuggugccugcauaccucuggcagcuggcccaggaagagccagcaagagcaaggcaug

SEQ ID NO: 449606 - RNA, 64 nt, hsa
aauucaguagcaacauagcuggcuuguucccagacccaggaaguauaagucauugacaguuucc

SEQ ID NO: 449607 - RNA, 64 nt, hsa
uguaaccagcuuaguaaccagaguaucuggauuacccaggaagguugagcugcugagauuucag

SEQ ID NO: 449608 - RNA, 64 nt, hsa
guucuuauaccacguuccacggaggagugaggagcccaggaacgacguggucuuccagcccauc

SEQ ID NO: 449609 - RNA, 64 nt, hsa
gaaggcuggcacgugcagcguccuuggcaguuggcccaggaacuggagccacagagcuggugcu

SEQ ID NO: 449610 - RNA, 64 nt, hsa
uucaaaaaguguggccucagcucuggaggccacccccaggaaggaguuugagguucauugucau

SEQ ID NO: 449611 - RNA, 64 nt, hsa
agugaugucauuuuauuccccucccaaaacaugccccaggaacaagcaccccuugccucugugg

SEQ ID NO: 449612 - RNA, 64 nt, hsa
caccuugaagcauccuguucuccuucugugcugucccaggaagugucuggcgggcgugggcagc

SEQ ID NO: 449613 - RNA, 64 nt, hsa
uaauaauaaaacaacuuguuuccuuuuggccacccccaggaagggcugauuucaaaaucugggg

SEQ ID NO: 449614 - RNA, 64 nt, hsa
ccaaaagcuggagugugaggcaggaggcuggaaacccaggaaagcugauggugcaagguccagu

SEQ ID NO: 449615 - RNA, 64 nt, hsa
aaagagagcuaugauguccuaggacugagaguaccccaggaaagaauacccuugaaagggucuc

SEQ ID NO: 449616 - RNA, 64 nt, hsa
aagagaagggcccaggaaggaugcucucauaaggcccaggaaggaugcucucauaagcaccuug

SEQ ID NO: 449617 - RNA, 64 nt, hsa
cugccauccacggccuuuucuggcaagagaagggcccaggaaggaugcucucauaaggcccagg

SEQ ID NO: 449618 - RNA, 64 nt, hsa
auagaugguaguuugguacuucugguucccagugcccaggaaugguccacucccaagaaauuca

SEQ ID NO: 449619 - RNA, 64 nt, hsa
caaaaauuaggcugagacaggagaauugcuugaacccaggaagcagagguugcaaugagcugag

SEQ ID NO: 449620 - RNA, 61 nt, hsa
aggaagaagacaacgaauaaacuuccuucaacccaggaagcgucuuuggugcuugggagac

SEQ ID NO: 449621 - RNA, 64 nt, hsa
acgaaaaggaaguccccccaucagacucuggacacccaggaaucaaaagagaaaggacuuuuuu

SEQ ID NO: 449622 - RNA, 64 nt, hsa
ucuuucauaaaggaccucauuccuugcgucccagcccaggaacagugcugucuuugcugucuua

SEQ ID NO: 449623 - RNA, 64 nt, hsa
ccuggacaaggaauguaggaagugagugcugugucccaggaagcugcucacacucuuaaaaugg

SEQ ID NO: 449624 - RNA, 64 nt, hsa
gcccauuugggccugcauagugccaugauuggaacccaggaacucuggucuccuugccuagugc

SEQ ID NO: 449625 - RNA, 64 nt, hsa
ugguagaccgaagccuugugcauaaggauuuuuucccaggaaaagauagacuuuauaaacagug

SEQ ID NO: 449626 - RNA, 64 nt, hsa
gaagccaagacaguggcagcaaaggaagacuuggcccaggaaaaaccuguggguugugcuaauu

SEQ ID NO: 449627 - RNA, 64 nt, hsa
ccacuccaaucacccuacaagaugccaaggaggucccaggaaguccagcuccuuaaacugacgc

SEQ ID NO: 449628 - RNA, 64 nt, hsa
auagggaccucagggagccccagcuucuuacccacccaggaaacccuugguccagagaggacag

SEQ ID NO: 449629 - RNA, 64 nt, hsa
auaagcccuaagggugguaggaacccaggagggacccaggaaacuaagauuugagauucagugc

SEQ ID NO: 449630 - RNA, 64 nt, hsa
caaguacagccacuguaaauaacccucgucccugcccaggaacccagacuggacuucagucucc

SEQ ID NO: 449631 - RNA, 64 nt, hsa
aggagggucaggccuguaccccagccuccugucccccaggaaccucacagggguaucaaaaaga

SEQ ID NO: 449632 - RNA, 64 nt, hsa
ggcccuucacauuuuuggccuggguggggcugggcccaggaaggggugggcuggauuuuguaaa

SEQ ID NO: 449633 - RNA, 64 nt, hsa
gaagccuagcaggauuucagaugcaggagagagacccaggaagcccggcagagcccugagcccc

SEQ ID NO: 449634 - RNA, 64 nt, hsa
ccuggcccuccccuccuuggcauucaugggggagcccaggaaccccccacaccuaugggguuag

SEQ ID NO: 449635 - RNA, 61 nt, hsa
agucggaggucucagaguaaggcggcuggaccccaggaaccccagggcacuccacugcagc

SEQ ID NO: 449636 - RNA, 64 nt, hsa
gucagaccagguucggauacaaucaucugcucaucccaggaauaguuucuugggggacucacuc

SEQ ID NO: 449637 - RNA, 64 nt, hsa
auugauuuugguccuccuccgcugucccccaacacccaggaaugggaaucuggcuugguucgag

SEQ ID NO: 449638 - RNA, 64 nt, hsa
uggguuucugaaauauuuuauggacuuauuucuccccaggaaaugauucuuacggaaaaaaauu

SEQ ID NO: 449639 - RNA, 64 nt, hsa
uagguauaaaccucuguaugaagagaagauuucucccaggaaaucuuuguacagcuuuaaguug

SEQ ID NO: 449640 - RNA, 64 nt, hsa
aaaaucuaguuaaaauaauccaauggacagaagccccaggaagggguauuuccaacacuuggcg

SEQ ID NO: 449641 - RNA, 59 nt, hsa
agggcuucaagaucuucugaggcccccuccccaggaagccuaggcucgguggcuggaca

SEQ ID NO: 449642 - RNA, 64 nt, hsa
ugaccagaugcccugcuccaucacaaccuccuuccccaggaaaacccacuuuccaaaagcccaa

SEQ ID NO: 449643 - RNA, 64 nt, hsa
gcuggccuuccuucucuucugagcccuccccugccccaggaacccuggccucaccaaaacagca

SEQ ID NO: 449644 - RNA, 64 nt, hsa
ccaggcgcccagcccugcggaggaggccggggcucccaggaagcggacgcccgguccccacaca

SEQ ID NO: 449645 - RNA, 64 nt, hsa
uagugacauuggugagacaacagcccuaacacuucccaggaacugaagugccucaugugauuga

SEQ ID NO: 449646 - RNA, 64 nt, hsa
gagcagaggaggucccagauaccaaguggcgccucccaggaaaggcugggagaagagguggccu

SEQ ID NO: 449647 - RNA, 64 nt, hsa
cugggcacacgccaucccagagggcucaggaugccccaggaaggaaagaagggcaacagacuac

SEQ ID NO: 449648 - RNA, 64 nt, hsa
acacuggaaaacugggaaauggccagcugugugucccaggaaauuccuccccuuauucuuccuu

SEQ ID NO: 449649 - RNA, 64 nt, hsa
acuuugggaggugcaggcaggcagauggcuugagcccaggaauucaagaccaguccgagcaaca

SEQ ID NO: 449650 - RNA, 64 nt, hsa
gggcaccccaggaaccgccauugcccauaagacccccaggaagcuaggcacuuucuuuccaugg

SEQ ID NO: 449651 - RNA, 64 nt, hsa
aaucugagccaugagaacgaggggaucugggcaccccaggaaccgccauugcccauaagacccc

SEQ ID NO: 449652 - RNA, 64 nt, hsa
cuguuuggggaagaugcaaggaaguaaugagaagcccaggaaauuucuccaccuguguuuaugg

SEQ ID NO: 449653 - RNA, 64 nt, hsa
caccagugcccaggaauuugaacauuuuccuuuacccaggaaaucuccggagccaacaccacca

SEQ ID NO: 449654 - RNA, 64 nt, hsa
uguggcaaggcuuggaugagauggggcaccagugcccaggaauuugaacauuuuccuuuaccca

SEQ ID NO: 449655 - RNA, 64 nt, hsa
uuucagauauauuuuaguaacacauucccagcuccccaggaaagccagucucaucuaauuucuu

SEQ ID NO: 449656 - RNA, 64 nt, hsa
ccccuccaguuugcuuuccuuuggccuuccagaccccaggaaguuggccuucccuuccuagugc

SEQ ID NO: 449657 - RNA, 64 nt, hsa
ugaucagcuggauccccacgugagcaacagcuggcccaggaaaggcugccugcagaggacaggu

SEQ ID NO: 449658 - RNA, 64 nt, hsa
cagcaggugccucgauucccugcccuugugaccucccaggaaacagaacugaucugggacacua

SEQ ID NO: 449659 - RNA, 64 nt, hsa
uggcucccuccuccccaucaagcacaagagagggcccaggaaaaaagguuucacauaaguguag

SEQ ID NO: 449660 - RNA, 64 nt, hsa
gcugccucuaccaaccacccucuaucagcaguggcccaggaaggaggucaagcaucuucggccg

SEQ ID NO: 449661 - RNA, 64 nt, hsa
agaaagggaagucaggguucuagggguuauucgucccaggaaauagaagugaaauugucuuuau

SEQ ID NO: 449662 - RNA, 64 nt, hsa
gucucuuuguugcuauguuuuuuuguuugaaguucccaggaauauuugagggguuccggugaug

SEQ ID NO: 449663 - RNA, 64 nt, hsa
aagggugucugaugugggguggggcuggcauccucccaggaagguucuaggugggaccccgucu

SEQ ID NO: 449664 - RNA, 64 nt, hsa
gaugaaggaaggggcuauccugggaccuccccagcccaggaaaaacuggaagccuucccccagc

SEQ ID NO: 449665 - RNA, 64 nt, hsa
gaucaggccucaccccuccccugggacuuucccacccaggaaaggaggaccagucaggaugagg

SEQ ID NO: 449666 - RNA, 64 nt, hsa
uucggcaugucugcagccuguucuccuagccugcugcuuggagucagguugagcaucagugaga

SEQ ID NO: 449667 - RNA, 64 nt, hsa
uuaaaaaaauaauugaaguguaagcuaaauaaaaugcuuggaguuuugccugggcuagugagag

SEQ ID NO: 449668 - RNA, 64 nt, hsa
gacaaggcagcuuggucuaguggagauagcacugugcuuggaguucaggggaccuaggacaaau

SEQ ID NO: 449669 - RNA, 64 nt, hsa
uguaagggaaaaauuaauuuuuuaaaaaacaccaugcuuggaggguggggguagaaauagacac

SEQ ID NO: 449670 - RNA, 64 nt, hsa
ccucaagugaucuaccugccucugccucccgaagugcuuggauuacaggugugagccacugugu

SEQ ID NO: 449671 - RNA, 64 nt, hsa
aagugaauauacuuaauauauucuaguacagguaugcuuggaaauagggcguuuccuuuucaug

SEQ ID NO: 449672 - RNA, 64 nt, hsa
aaagguuuuuaaaacauggauguuaaggcuguuuugcuuggagaagacuugggacugggacagu

SEQ ID NO: 449673 - RNA, 64 nt, hsa
gugccuaauuuuauaaaaagucacuaagcucaagugcuuggaugaaaggacagcguggauaaaa

SEQ ID NO: 449674 - RNA, 64 nt, hsa
auuaucuuuguaauuauuuuuaauauguaaggaaugcuuggaauaucugcuguaugucaacuuu

SEQ ID NO: 449675 - RNA, 64 nt, hsa
uucagagguggcucuggaaugacaugugucaagcugcuuggaccucgugcuuuaagugccuaca

SEQ ID NO: 449676 - RNA, 64 nt, hsa
uguuugguaaaugccagguugauagggcgcuggcugcuuggagcaaagggugcauuucagggug

SEQ ID NO: 449677 - RNA, 64 nt, hsa
gagaggcaccucugcucuuguugggagggguggcugcuuggaaauaggcccaggggcucugcca

SEQ ID NO: 449678 - RNA, 64 nt, hsa
caugaccauuuauuugccccuuucuccauccuguugcuuggaauguggaucugguagugagcca

SEQ ID NO: 449679 - RNA, 63 nt, hsa
uuuucucuugcuauuuauauauauaugauaaaaaugcuuggaagaguccuuuaauuuaugguu

SEQ ID NO: 449680 - RNA, 64 nt, hsa
cacagaaacgccugagagucacuuacccggccacugcuuggaagguuucccuccggggaaugcc

SEQ ID NO: 449681 - RNA, 64 nt, hsa
uccggcuguggcugacaguggcucuggccaggguugcuuggagaaggcucagugugccugggac

SEQ ID NO: 449682 - RNA, 64 nt, hsa
cuguguuuguuuuucaagaaaugauucaaauugcugcuuggauuuugaaauuuacuguaacugu

SEQ ID NO: 449683 - RNA, 64 nt, hsa
cgugcgcccguggggucugcgcuuggucuuucugugcuuggauuugcauauuuauugcauugcu

SEQ ID NO: 449684 - RNA, 64 nt, hsa
ucccuuuguagccauccaaugggcauugugugggugcuuggaacccgggaugacugagggggac

SEQ ID NO: 449685 - RNA, 64 nt, hsa
ggaccaggggucccggaggaacccauuugugcucugcuuggacagcaggccuggcacugggagg

SEQ ID NO: 449686 - RNA, 64 nt, hsa; identical to SEQ ID NO: 331879

SEQ ID NO: 449687 - RNA, 64 nt, hsa; identical to SEQ ID NO: 331880

SEQ ID NO: 449688 - RNA, 64 nt, hsa; identical to SEQ ID NO: 331881

SEQ ID NO: 449689 - RNA, 64 nt, hsa; identical to SEQ ID NO: 331882

SEQ ID NO: 449690 - RNA, 64 nt, hsa; identical to SEQ ID NO: 331883

SEQ ID NO: 449691 - RNA, 64 nt, hsa; identical to SEQ ID NO: 331884

SEQ ID NO: 449692 - RNA, 64 nt, hsa
gcuuuagaaauaguuuuaacuagcuuaguuuucugguuuccaaaacuaaaauagauuaaauccu

SEQ ID NO: 449693 - RNA, 64 nt, hsa
aaucugaccacuaucuauaaauacauuggacauugguuuccaaaucucccuuucuucuucaguu

SEQ ID NO: 449694 - RNA, 64 nt, hsa
cugaagugugugccaggcucuggacuaggugcuagguuuccagggaggagccaaacacgggccu

SEQ ID NO: 449695 - RNA, 64 nt, hsa
cacuuccaucccucgggcccagcaguacacacuugguuuccagagcucccaguggacaugucag

SEQ ID NO: 449696 - RNA, 64 nt, hsa
cauuugugauuaauuaauuuauauaugaaauaaugguuuccauuuuaugcgaguauuuguaacu

SEQ ID NO: 449697 - RNA, 64 nt, hsa
cauucuguaggacugucuugcauaccuucugucugguuuccacugauuccuucuuagccaugga

SEQ ID NO: 449698 - RNA, 64 nt, hsa
ucuugggucauugaucccuggcucagaggauagcgguuuccaucauaaaccaagaugaugaguu

SEQ ID NO: 449699 - RNA, 64 nt, hsa
agacuuccuccuguucccugggucagaggauagcgguuuccaucauaaaccaagaugaugaguu

SEQ ID NO: 449700 - RNA, 64 nt, hsa
gacacaggaccaguuuggaaaagggucagguaaggguuuccacucugcacauuguagagggaac

SEQ ID NO: 449701 - RNA, 64 nt, hsa
ggaccagagccagccuagucauuauuugcugucggguuuccaguuucaccguguguuaggguga

SEQ ID NO: 449702 - RNA, 64 nt, hsa
ugggguagugucagucggacugcacagggaacacgguuuccaguggcuuuggccccuacucggg

SEQ ID NO: 449703 - RNA, 64 nt, hsa
guguuaaucauuugccuuacaagauguaccagacgguuuccaguacuaacaaagggaauaaaaa

SEQ ID NO: 449704 - RNA, 64 nt, hsa
caaaauaaugaauuuuuuuuaaaaagcaauaccugguuuccaccuuggacugacuuugauccug

SEQ ID NO: 449705 - RNA, 64 nt, hsa
augaauuaauuuaaauuaauucuaaagugacucugguuuccauuuuagucuauuagcuagaggg

SEQ ID NO: 449706 - RNA, 64 nt, hsa
auaucaggggauuuuaguuccaagcagggacccugguuuccauacugcccucagcuggaguuug

SEQ ID NO: 449707 - RNA, 63 nt, hsa
gcaguaaguaaaaacauucuccuagcauuaaaaugguuuccauaacuacuuuuguccuggcuu

SEQ ID NO: 449708 - RNA, 64 nt, hsa
ggguccccgauuccaaugcuguuuuuuggggagugguuuccaggagcugccuggugucugcugu

SEQ ID NO: 449709 - RNA, 64 nt, hsa
guggcaagaacuguggaccaugccagucccgucugguuuccaucccaccacuccaaggacugag

SEQ ID NO: 449710 - RNA, 64 nt, hsa
gcgauuuagggauucuucaguuuugcuugcuuuagguuuccaaaaguuauacauugguguuuug

SEQ ID NO: 449711 - RNA, 64 nt, hsa
ccagugguuagcucacauugccucucaagagacagguuuccaggugucuucauuguagugggua

SEQ ID NO: 449712 - RNA, 64 nt, hsa
uuucuacaacugaucauuugcagcugcugguuuugguuuccaccuuacccuacuggcuguaaaa

SEQ ID NO: 449713 - RNA, 64 nt, hsa
ggcacagacuucacacagcaccuccucucugcuggguuuccacacagccugucuucagauccug

SEQ ID NO: 449714 - RNA, 64 nt, hsa
ccugagaagccucaugggagucagggagcccugggguuuccacacaggcccaugcccuccgucc

SEQ ID NO: 449715 - RNA, 64 nt, hsa
cagaccugggcccugguucccccaggacccugaggguuuccaccuuggcgcgcagcccgggaga

SEQ ID NO: 449716 - RNA, 64 nt, hsa
aacagaagcaaaucauaucaaacggggauagaaugguuuccacugaggacauucagccugggaa

SEQ ID NO: 449717 - RNA, 64 nt, hsa
aaggaggaagucaccagcucgaggcguguggauugguuuccacccggaacaggcucugugaugg

SEQ ID NO: 449718 - RNA, 64 nt, hsa; identical to SEQ ID NO: 286103

SEQ ID NO: 449719 - RNA, 64 nt, hsa; identical to SEQ ID NO: 286104

SEQ ID NO: 449720 - RNA, 64 nt, hsa; identical to SEQ ID NO: 286105

SEQ ID NO: 449721 - RNA, 64 nt, hsa; identical to SEQ ID NO: 286106

SEQ ID NO: 449722 - RNA, 64 nt, hsa; identical to SEQ ID NO: 286107

SEQ ID NO: 449723 - RNA, 64 nt, hsa; identical to SEQ ID NO: 286108

SEQ ID NO: 449724 - RNA, 64 nt, hsa; identical to SEQ ID NO: 286109

SEQ ID NO: 449725 - RNA, 64 nt, hsa; identical to SEQ ID NO: 286110

SEQ ID NO: 449726 - RNA, 64 nt, hsa; identical to SEQ ID NO: 286111

SEQ ID NO: 449727 - RNA, 64 nt, hsa; identical to SEQ ID NO: 286112

SEQ ID NO: 449728 - RNA, 64 nt, hsa; identical to SEQ ID NO: 286113

SEQ ID NO: 449729 - RNA, 64 nt, hsa; identical to SEQ ID NO: 286114

SEQ ID NO: 449730 - RNA, 64 nt, hsa; identical to SEQ ID NO: 286115

SEQ ID NO: 449731 - RNA, 64 nt, hsa; identical to SEQ ID NO: 286116

SEQ ID NO: 449732 - RNA, 64 nt, hsa; identical to SEQ ID NO: 286117

SEQ ID NO: 449733 - RNA, 64 nt, hsa; identical to SEQ ID NO: 286118

SEQ ID NO: 449734 - RNA, 64 nt, hsa; identical to SEQ ID NO: 286119

SEQ ID NO: 449735 - RNA, 64 nt, hsa; identical to SEQ ID NO: 286120

SEQ ID NO: 449736 - RNA, 64 nt, hsa; identical to SEQ ID NO: 286121

SEQ ID NO: 449737 - RNA, 64 nt, hsa; identical to SEQ ID NO: 286122

SEQ ID NO: 449738 - RNA, 64 nt, hsa; identical to SEQ ID NO: 286123

SEQ ID NO: 449739 - RNA, 64 nt, hsa; identical to SEQ ID NO: 286124

SEQ ID NO: 449740 - RNA, 64 nt, hsa
ccauucauguacuuuuccuuauauuuccaaaacuguuacugagaaugggucaagaucagugaga

SEQ ID NO: 449741 - RNA, 64 nt, hsa
uaacuucuaaaagguauuuuuauaagcaguucaaguuacugaaaaccuuuuaaaccuuucugaa

SEQ ID NO: 449742 - RNA, 64 nt, hsa
cauccugguguuacugaaaaacaggugugauccuguuacugauacuauaagugaccuaaaaugu

SEQ ID NO: 449743 - RNA, 64 nt, hsa
agaccggcguagggacagauguauucauccugguguuacugaaaaacaggugugauccuguuac

SEQ ID NO: 449744 - RNA, 64 nt, hsa
aaagccccuccucuuggcaccucagaaucacaguguuacugaucagggaugugaggcugcuguu

SEQ ID NO: 449745 - RNA, 64 nt, hsa
uggugcugguugggguggggccugcagagucuuaguuacugauuucauuuucaauaaauguagg

SEQ ID NO: 449746 - RNA, 64 nt, hsa
auuuaaauguguuuguaugguguuaugacuaauuguuacugauuuagagacuaagcccucuuaa

SEQ ID NO: 449747 - RNA, 64 nt, hsa
ggcuugcugcuguaaucuuuuguuuuguuguuguguuacugaauguggcauuucaggguuaaca

SEQ ID NO: 449748 - RNA, 64 nt, hsa
uccagauacuguuuuaggugagcugagcuauuucguuacugagaaaaugauaaguauccauuua

SEQ ID NO: 449749 - RNA, 64 nt, hsa
gaaguauuguuuaugauaagaaaggaggguaucaguuacugauacccaaaaauauauuccaggu

SEQ ID NO: 449750 - RNA, 64 nt, hsa; identical to SEQ ID NO: 99880

SEQ ID NO: 449751 - RNA, 64 nt, hsa; identical to SEQ ID NO: 99881

SEQ ID NO: 449752 - RNA, 64 nt, hsa; identical to SEQ ID NO: 99882

SEQ ID NO: 449753 - RNA, 64 nt, hsa; identical to SEQ ID NO: 99883

SEQ ID NO: 449754 - RNA, 64 nt, hsa; identical to SEQ ID NO: 99884

SEQ ID NO: 449755 - RNA, 64 nt, hsa; identical to SEQ ID NO: 99885

SEQ ID NO: 449756 - RNA, 64 nt, hsa; identical to SEQ ID NO: 99886

SEQ ID NO: 449757 - RNA, 64 nt, hsa; identical to SEQ ID NO: 99887

SEQ ID NO: 449758 - RNA, 64 nt, hsa; identical to SEQ ID NO: 99888

SEQ ID NO: 449759 - RNA, 64 nt, hsa; identical to SEQ ID NO: 99889

SEQ ID NO: 449760 - RNA, 64 nt, hsa; identical to SEQ ID NO: 99890

SEQ ID NO: 449761 - RNA, 64 nt, hsa; identical to SEQ ID NO: 99891

SEQ ID NO: 449762 - RNA, 64 nt, hsa; identical to SEQ ID NO: 99892

SEQ ID NO: 449763 - RNA, 64 nt, hsa; identical to SEQ ID NO: 99893

SEQ ID NO: 449764 - RNA, 64 nt, hsa; identical to SEQ ID NO: 99894

SEQ ID NO: 449765 - RNA, 64 nt, hsa; identical to SEQ ID NO: 99895

SEQ ID NO: 449766 - RNA, 64 nt, hsa; identical to SEQ ID NO: 99896

SEQ ID NO: 449767 - RNA, 64 nt, hsa; identical to SEQ ID NO: 99897

SEQ ID NO: 449768 - RNA, 64 nt, hsa
acagggguguuuguuggauggguuuaaaaauaacuagaaaaacucaggcccauccauuuucuca

SEQ ID NO: 449769 - RNA, 64 nt, hsa
uucuuaaaaucaguguuuccccuuugugcacuuguagaaaaaaaagaaaaaccuucuagagcug

SEQ ID NO: 449770 - RNA, 64 nt, hsa
uuuuuuuucagaauaaacaacuaaauaacuguauuagaaaaaaaagaaacuuacuaaauaucau

SEQ ID NO: 449771 - RNA, 64 nt, hsa
cauuuacuguuucuguuauaauaaaaggguauguuagaaaaacaaaaaggaggcugggcauggu

SEQ ID NO: 449772 - RNA, 64 nt, hsa
ugcuguuaacuaaaaaugcugagaccccuuuuuauagaaaaacaaaaagacaucaagucuucuu

SEQ ID NO: 449773 - RNA, 64 nt, hsa
cuguaauuugauuuacaugcauuagagcacacaguagaaaaacuuuagcuucauuaguaauaug

SEQ ID NO: 449774 - RNA, 64 nt, hsa
aaaauuuuauuuuaucauccuagaaagccuugacuagaaaaaugaauaaauauugaggguuucc

SEQ ID NO: 449775 - RNA, 64 nt, hsa
acagauaaaauacauucuuuuaauucugggaaauuagaaaaaguggggugaucuuuccaggaaa

SEQ ID NO: 449776 - RNA, 64 nt, hsa
aaugacauuuaucuucaaaacaccaaauugucuuuagaaaaauuaaugugauuacagguagagg

SEQ ID NO: 449777 - RNA, 64 nt, hsa
gguagccuccaucuuuuaaacuuuuugaacucaguagaaaaacagacugaaauuuuaaagacau

SEQ ID NO: 449778 - RNA, 64 nt, hsa
uuuagcuguaacauccgauucuguauaagccacauagaaaaaaguugccuuucuuuuuuuauga

SEQ ID NO: 449779 - RNA, 64 nt, hsa
aguacauauggauuuuguauauauaggagauuuuuagaaaaaucaacaaccuaacaccagauuc

SEQ ID NO: 449780 - RNA, 64 nt, hsa
cccagauaucauuaggaucacacagaguuaaauauagaaaaaugaaaccaucauuauauucuuu

SEQ ID NO: 449781 - RNA, 64 nt, hsa
cuaauaaucucuauuuauaacuaaaucauugagauagaaaaagauucccauugacuguagacuu

SEQ ID NO: 449782 - RNA, 64 nt, hsa
auaauuuuagaucugaucagguaguagcuaaaauuagaaaaaaacaaaauagaugcuuaaagaa

SEQ ID NO: 449783 - RNA, 64 nt, hsa
auucaaacaaacagcacuuacaggaaauguaaaguagaaaaagauuucugcccacuuuaccuac

SEQ ID NO: 449784 - RNA, 64 nt, hsa
uaauauucugugugaugggauaugaaaugguccauagaaaaaaaccggaaaaauacgccaaggu

SEQ ID NO: 449785 - RNA, 64 nt, hsa
gcuguugucuuauuauuauauagaaaaauaacuuuagaaaaauauugaagacauuguauuacca

SEQ ID NO: 449786 - RNA, 64 nt, hsa
uuccuauaugcuaugcuguugucuuauuauuauauagaaaaauaacuuuagaaaaauauugaag

SEQ ID NO: 449787 - RNA, 64 nt, hsa
uuggguuuuuuucuuauuguuuucuccccaggguuagaaaaauugguauaaguuccuaauuaaa

SEQ ID NO: 449788 - RNA, 64 nt, hsa
gcuaaagguucugggaagcuaauaauugaauuauuagaaaaacauuucagaauaggaaguaaau

SEQ ID NO: 449789 - RNA, 64 nt, hsa
gggccagguuuauuuucuccuuuuuugagauuucuagaaaaaaugcugcuugcacauguugguu

SEQ ID NO: 449790 - RNA, 64 nt, hsa
gugugcaguguguaaauacuuuaaauuauuaugcuagaaaaauaaaguuacauaccuugcugug

SEQ ID NO: 449791 - RNA, 64 nt, hsa
aauggccaaaaugguugcaaucauucauacuaguuagaaaaauuauguguugaaauaaguggaa

SEQ ID NO: 449792 - RNA, 64 nt, hsa
uuccagaaauaccugauuuugaaucauucaacaguagaaaaagaggcauauuuucauuacuuga

SEQ ID NO: 449793 - RNA, 64 nt, hsa
gcauguggcauaaauuuggagaaaauaauaugacuagaaaaauuaguguuauauugggugugag

SEQ ID NO: 449794 - RNA, 64 nt, hsa
acauauacagaauuagccaaaugguauaagacaauagaaaaaggcuguggauucuuugaggaca

SEQ ID NO: 449795 - RNA, 64 nt, hsa
uucugaugaaauguuaacaaugccuauuguaauauagaaaaaaacauucuaucuacugauuugg

SEQ ID NO: 449796 - RNA, 64 nt, hsa
cagcuaugaagagcuagagaaauucuuguuaugguagaaaaauuucacgauucauuuuugaaac

SEQ ID NO: 449797 - RNA, 64 nt, hsa
guuauuugauauuuuaauuuauuuuuugauugacuagaaaaaucauuuuaauuucacuaaaaug

SEQ ID NO: 449798 - RNA, 64 nt, hsa
uguguuuucccacauuuaggaccaaagacggcuauagaaaaacucaaauggauugcuucccaaa

SEQ ID NO: 449799 - RNA, 64 nt, hsa
cagauccuuauagauacgguaagagccacauucguagaaaaacuucugguguggccagguuuua

SEQ ID NO: 449800 - RNA, 64 nt, hsa
uaaguagcuugucaucaauccccuugucgaaaacuagaaaaaaaggaguugacccauauaaauu

SEQ ID NO: 449801 - RNA, 64 nt, hsa
uuaacucaaauacugugaacuaucucuaaaacacuagaaaaaagaaauguuaguaucucaauua

SEQ ID NO: 449802 - RNA, 64 nt, hsa
cuuacccgugucaauuaacauuuaaacuggcauauagaaaaaaaggaggauuuuucugcauugu

SEQ ID NO: 449803 - RNA, 64 nt, hsa
uaaguuuuuaaaaauaaauuauaaacuuggagauuagaaaaauaaagcaguugcuguagaauag

SEQ ID NO: 449804 - RNA, 64 nt, hsa
uuugcuuuagaguuaaauauuccuaucuuaaguuuagaaaaauacaaaaaaccauuccaaggau

SEQ ID NO: 449805 - RNA, 64 nt, hsa
auuggaacuagucauuaacccaucucugaacugguagaaaaacaucugaagagcuagucuauca

SEQ ID NO: 449806 - RNA, 64 nt, hsa
uguuaucucaggugagcugguagaggggagacauuagaaaaaaaugaaacaacaaaacaauuac

SEQ ID NO: 449807 - RNA, 64 nt, hsa
aggccuuacuuugugauuauacguuaucuccggcuagaaaaaaauaaugguaguaaagaaacug

SEQ ID NO: 449808 - RNA, 64 nt, hsa
gauuaaaaacauucauuugaacacaguaguccccuagaaaaacaacucuacaaaaauuuugcag

SEQ ID NO: 449809 - RNA, 64 nt, hsa
gauuaucaccuuagcaacuuagaauaguuugaaauagaaaaaaaguauuuaauuuggaucugga

SEQ ID NO: 449810 - RNA, 64 nt, hsa
uugaaagaaguauuaaaaagagugaggauggauuuagaaaaaaacaugaauuuagaaauauuca

SEQ ID NO: 449811 - RNA, 64 nt, hsa
auaggcguuuuuuggggauguggagguaguuggguagaaaaauuauuagaacauucacuuuugu

SEQ ID NO: 449812 - RNA, 64 nt, hsa
uuucuguagacucuaagauacacugcacuuuguuuagaaaaaaaacugaagaugaaauauauau

SEQ ID NO: 449813 - RNA, 64 nt, hsa
uuuugacacuuuuaauuuucauuuaacaauggauuagaaaaauauuuuggucuagccacuaaac

SEQ ID NO: 449814 - RNA, 64 nt, hsa
ucacccaaaaaccauuuggcuggcagaaauuaucuagaaaaauuauuauuuugcaguuaucuga

SEQ ID NO: 449815 - RNA, 64 nt, hsa
acuaaaaauagcacauuugaguacauuugaaaaguagaaaaauuagaaauuauuaacuuuauug

SEQ ID NO: 449816 - RNA, 64 nt, hsa
uaacauagcuguuuuaacaaaugaaaaaaagacguagaaaaauguuuagaugucuuuuugugau

SEQ ID NO: 449817 - RNA, 64 nt, hsa
ucugagaaggugaacuguuacgacccaggacaauuagaaaaauucacccaccaugccgcacauu

SEQ ID NO: 449818 - RNA, 64 nt, hsa
uauuaugggauuggaagaaacacguggucaugaauagaaaaaaaacaaacccaaagguaggaag

SEQ ID NO: 449819 - RNA, 64 nt, hsa
uugagcuuucauuuuuaaaaauuauauuuuacuuuagaaaaauaucaccuuuuuucuuccucuu

SEQ ID NO: 449820 - RNA, 64 nt, hsa
gaaaucuaggacuuccagcuucccucaugucagauagaaaaaaagucaggaaaccagcucgugg

SEQ ID NO: 449821 - RNA, 64 nt, hsa
gccauaugccuguggaguggaauauucuguuuaguagaaaaauccuuuagaguucagcucuaac

SEQ ID NO: 449822 - RNA, 64 nt, hsa
cacuuuagacuuaguaguaauuaugaaccucacauagaaaaauuucauccagccauaugccugu

SEQ ID NO: 449823 - RNA, 64 nt, hsa
guuuaaaaaaaagcauaaaaacauuuuaaaaacauagaaaaauucagcaaaccauuuuuaaagu

SEQ ID NO: 449824 - RNA, 64 nt, hsa
gcaaaccauuuuuaaaguagaagaggguuuuagguagaaaaacauauucuugugcuuuuccuga

SEQ ID NO: 449825 - RNA, 64 nt, hsa
uuuuugaauacuuguuucuuuagcacuuugaagauagaaaaaccacuuuuuaaguacuaaguca

SEQ ID NO: 449826 - RNA, 64 nt, hsa
uugcugugcauuuuaaccaauaaucugaugaauauagaaaaaaaugauccaaaauauggauaug

SEQ ID NO: 449827 - RNA, 64 nt, hsa
agaaguugaccuuugcacuggcauuaaagagucauagaaaaagaaucauggauauuuaugaauu

SEQ ID NO: 449828 - RNA, 64 nt, hsa
uauuuucuuugcauuugaauaauugucuuguacuuagaaaaaaggcgucuaugaaugaccagug

SEQ ID NO: 449829 - RNA, 64 nt, hsa
guuucuuggcuuuccgaaggccaugaucuagagauagaaaaaucccuacuaagucccaacagga

SEQ ID NO: 449830 - RNA, 64 nt, hsa
ugccaacaauggugugcugggggugggguuacuuuagaaaaaguggacacagaccagacuaagg

SEQ ID NO: 449831 - RNA, 64 nt, hsa
cuguauuauauacaaguguaauacaugcauauaauagaaaaaaaacauggaauuucaaauauac

SEQ ID NO: 449832 - RNA, 64 nt, hsa
guuugaaugcuuauauauuuguucaaucuguugauagaaaaaauuguucauuuuccucagucuc

SEQ ID NO: 449833 - RNA, 64 nt, hsa
auuucuaccagaaauuuccagagcauuauguagguagaaaaaaaugcaagcaagcuguuaaaga

SEQ ID NO: 449834 - RNA, 64 nt, hsa
gugaaugcauuucguaguucuuuauaugaaggguuagaaaaaccggaaucaagaaguucgauuc

SEQ ID NO: 449835 - RNA, 64 nt, hsa
gaaucaaauuauauaaacaguaccaauaucauuauagaaaaaaauaacauuuuaauguauauug

SEQ ID NO: 449836 - RNA, 64 nt, hsa
guuaauaaaauucuauugcaaaaauuucuuuuucuagaaaaaauaaauacaaaaaaaaaaaaga

SEQ ID NO: 449837 - RNA, 64 nt, hsa
gugguguuuuuuuuguuuguuuguuuguuuguuuuagaaaaauugggauuuccccccaccccgc

SEQ ID NO: 449838 - RNA, 64 nt, hsa
ccagcacaagagaauuagagcuucagugagaauuuagaaaaauuauacuaaagugagaugcauu

SEQ ID NO: 449839 - RNA, 64 nt, hsa
gaacucuucugcaaaaauggauauuauuagaaauuagaaaaaaauuacuaauuuuacacauuag

SEQ ID NO: 449840 - RNA, 64 nt, hsa
uuugugcaaaagcuucaaauuaaaacagcugcauuagaaaaagaggcgcuucuccccuccccua

SEQ ID NO: 449841 - RNA, 64 nt, hsa
uucccucucucuuuuuuuaacaaaugccuucuuauagaaaaacuuucuaagaggcaacaauuua

SEQ ID NO: 449842 - RNA, 64 nt, hsa
auuguaacaguuuuaugucaaaugaucugugcuguagaaaaacauuaacccuuguucaaaaaag

SEQ ID NO: 449843 - RNA, 64 nt, hsa
auuuagauguauagaaaaguaagaaaaucuuacuuagaaaaaagccccuugaaacuugcaggau

SEQ ID NO: 449844 - RNA, 64 nt, hsa
caaauagcauucuuauucacuuuaugccgguauuuagaaaaaauaaauuauagcaaguaugauu

SEQ ID NO: 449845 - RNA, 64 nt, hsa
uccagcuuuggcaacagaacgagaucccaucucuuagaaaaacaaaguugauaguuaaagaaca

SEQ ID NO: 449846 - RNA, 64 nt, hsa
uguggcaauaacuuuugaauuuuaauuuuuauaauagaaaaaugauuaggaauugcuagauagu

SEQ ID NO: 449847 - RNA, 64 nt, hsa
ggagaggaaaaguugauuaacuucugguuugguuuagaaaaaguaauguuugaaauacgaaggu

SEQ ID NO: 449848 - RNA, 64 nt, hsa
auuuaauuuacuauuucagauuuuuaaaauaguauagaaaaaaguaggagugauagagaacaaa

SEQ ID NO: 449849 - RNA, 64 nt, hsa
uuuauauuugucacuuuaaaaaauccauuucuuuuagaaaaaauuagggugauaggauauucau

SEQ ID NO: 449850 - RNA, 64 nt, hsa
uucaauacaauuguaauguagaaauauaagaauuuagaaaaaaguaaacuugccauuugguuaa

SEQ ID NO: 449851 - RNA, 64 nt, hsa
ccaaacaaaucuuucuacgcuuaaaugaucaaauuagaaaaaccaauuccuauaauuaauaugc

SEQ ID NO: 449852 - RNA, 64 nt, hsa
aagauuuauacuuuuaauauugaauauaguuucguagaaaaacauuuuauauguacuauucuua

SEQ ID NO: 449853 - RNA, 64 nt, hsa
ucucaaguuaccaaauuuuuuguaauccuuuuacuagaaaaaucuuuuuugaagaguuuuucuu

SEQ ID NO: 449854 - RNA, 64 nt, hsa
cuugugcuugcuucggcagcauauauacugaaauuagaaaaagaaaacuuuucuuuuuuauuau

SEQ ID NO: 449855 - RNA, 64 nt, hsa
uuaaagcaacuuauguguucgaucauguaugagauagaaaaauuuuuauuacucaaaguaaaau

SEQ ID NO: 449856 - RNA, 64 nt, hsa
gaggccuuaugauucagcagcuuggucacuugauuagaaaaauaaaccauuguuucuucaauug

SEQ ID NO: 449857 - RNA, 64 nt, hsa
aaaggggauugcuacaccauguagaaaaaguauguagaaaaaaagugcuuaauauuguuauugc

SEQ ID NO: 449858 - RNA, 64 nt, hsa
uauuuggggauucaaaggggauugcuacaccauguagaaaaaguauguagaaaaaaagugcuua

SEQ ID NO: 449859 - RNA, 64 nt, hsa
aguuccgugguugaauauauuugagaugguaccuuagaaaaaguuucacgcagauccuugguug

SEQ ID NO: 449860 - RNA, 64 nt, hsa
ccaaucccaggccuugugauuugagaugguaccuuagaaaaaguuacacgcaguuccgugguug

SEQ ID NO: 449861 - RNA, 64 nt, hsa
guaugucgauugauaucgcugcuacaucagacucuagaaaaaagggcugagaggaagcaagacg

SEQ ID NO: 449862 - RNA, 64 nt, hsa
cauugugagcucugguuauuuuucucuuguaccauagaaaaauguauaaaaauuaucaaaaagc

SEQ ID NO: 449863 - RNA, 64 nt, hsa
ggggagaaaaagaaaacucuggcguuagaggauauagaaaaauauaaguacaauuguuacaaau

SEQ ID NO: 449864 - RNA, 64 nt, hsa
ucugaacgcccccagaaaauugugccaaagaguuuagaaaaauaaauauacaauaaaaguaaac

SEQ ID NO: 449865 - RNA, 64 nt, hsa
gggacugcagugcccaaggaauuucugcucugguuagaaaaaggacucugcuucaguccacuuc

SEQ ID NO: 449866 - RNA, 64 nt, hsa
aaaggacucugcuucaguccacuucugcucugguuagaaaaaggacucugcuucaguccacagu

SEQ ID NO: 449867 - RNA, 64 nt, hsa
uuugcaaguuuaauuugauuuauuucagagaaaauagaaaaaacaauguuagaagguuauuuaa

SEQ ID NO: 449868 - RNA, 64 nt, hsa
ugauacauaaucuacaauaagggucuuagugcuuuagaaaaaaguuaaaauuggaagucauuaa

SEQ ID NO: 449869 - RNA, 64 nt, hsa
gcucagaaagucuuuauaaccacuggucaacgauuagaaaaauauaacuggauuuaggccuacc

SEQ ID NO: 449870 - RNA, 64 nt, hsa
agauuuucaaauuauuuagaagcagauuuuccuguagaaaaacuaauuuuucugccuuuuacca

SEQ ID NO: 449871 - RNA, 64 nt, hsa
caaucuuuggucuuaguuuucuagaaaaaaggaguagaaaaaacaauucuggcuuuauauuaaa

SEQ ID NO: 449872 - RNA, 64 nt, hsa
uacacaauuucuucaaucuuuggucuuaguuuucuagaaaaaaggaguagaaaaaacaauucug

SEQ ID NO: 449873 - RNA, 64 nt, hsa
gcaguaccauuggagaguuaacagaauaaucuaguagaaaaauaacugguugcauguaaaauuc

SEQ ID NO: 449874 - RNA, 64 nt, hsa
ggaaaguguuaacuuacggguauuuuugugggaauagaaaaaaauuguuuauuuuuuauucuuc

SEQ ID NO: 449875 - RNA, 64 nt, hsa; identical to SEQ ID NO: 169308

SEQ ID NO: 449876 - RNA, 64 nt, hsa; identical to SEQ ID NO: 169309

SEQ ID NO: 449877 - RNA, 64 nt, hsa; identical to SEQ ID NO: 169310

SEQ ID NO: 449878 - RNA, 64 nt, hsa; identical to SEQ ID NO: 169311

SEQ ID NO: 449879 - RNA, 64 nt, hsa; identical to SEQ ID NO: 169312

SEQ ID NO: 449880 - RNA, 64 nt, hsa; identical to SEQ ID NO: 169313

SEQ ID NO: 449881 - RNA, 64 nt, hsa; identical to SEQ ID NO: 169314

SEQ ID NO: 449882 - RNA, 64 nt, hsa; identical to SEQ ID NO: 169315

SEQ ID NO: 449883 - RNA, 64 nt, hsa; identical to SEQ ID NO: 169316

SEQ ID NO: 449884 - RNA, 64 nt, hsa; identical to SEQ ID NO: 169317

SEQ ID NO: 449885 - RNA, 64 nt, hsa; identical to SEQ ID NO: 169318

SEQ ID NO: 449886 - RNA, 64 nt, hsa; identical to SEQ ID NO: 169319

SEQ ID NO: 449887 - RNA, 64 nt, hsa; identical to SEQ ID NO: 169320

SEQ ID NO: 449888 - RNA, 64 nt, hsa; identical to SEQ ID NO: 169321

SEQ ID NO: 449889 - RNA, 64 nt, hsa; identical to SEQ ID NO: 169322

SEQ ID NO: 449890 - RNA, 64 nt, hsa; identical to SEQ ID NO: 169323

SEQ ID NO: 449891 - RNA, 64 nt, hsa; identical to SEQ ID NO: 169324

SEQ ID NO: 449892 - RNA, 64 nt, hsa; identical to SEQ ID NO: 169325

SEQ ID NO: 449893 - RNA, 64 nt, hsa; identical to SEQ ID NO: 169326

SEQ ID NO: 449894 - RNA, 64 nt, hsa; identical to SEQ ID NO: 169327

SEQ ID NO: 449895 - RNA, 64 nt, hsa; identical to SEQ ID NO: 169328

SEQ ID NO: 449896 - RNA, 64 nt, hsa; identical to SEQ ID NO: 169329

SEQ ID NO: 449897 - RNA, 64 nt, hsa
ugcuaauggagaugaugguaaugauaaagacaacaacaaugauuaucaaguuccuguacacucu

SEQ ID NO: 449898 - RNA, 64 nt, hsa
uccuacagcuaaagccucaggccauugccuaauuaacaaugaagauuucauggacauccuacac

SEQ ID NO: 449899 - RNA, 64 nt, hsa
caucaagccccacaguucuuaauacaggagacccaacaaugaguggacaagucauggacauuca

SEQ ID NO: 449900 - RNA, 64 nt, hsa
uaaaucgggaaggaugggaaaaacugcagucaucaacaaugauuaaucagcuguugcaggcagu

SEQ ID NO: 449901 - RNA, 64 nt, hsa
cuguuacaaauuggaccuuuauacauuuucugaaaacaaugaaaagaguauauuuaaccuuuuc

SEQ ID NO: 449902 - RNA, 64 nt, hsa
uuaaagcuuaaauuuaugaaccaccuuugugguaaacaaugaauuaugaauaccgcagggcagc

SEQ ID NO: 449903 - RNA, 64 nt, hsa
ucugacaagcuuuagccuauguuaugggauucagaacaaugagaucauaauaauucucacugac

SEQ ID NO: 449904 - RNA, 64 nt, hsa
acagccagcccaccagcccaccauuaacucacugaacaaugagacaauguugaggacucaaaug

SEQ ID NO: 449905 - RNA, 64 nt, hsa
agcgugcuggcccugaguacugaacuuucugaguaacaaugagauacguuacagaaccuauguu

SEQ ID NO: 449906 - RNA, 64 nt, hsa
cugaaaccccacuuaagcauuguuuuuauauaaaaacaaugauaaagaugugaaacugugaaau

SEQ ID NO: 449907 - RNA, 64 nt, hsa
auuuuuuaaaauuuggcuuuccuaggauuuuaagaacaaugaaaguuagcuucacaccuucaaa

SEQ ID NO: 449908 - RNA, 64 nt, hsa
aauggcccuacugauauucacaucuaaguugacuaacaaugacaaaggccuuaugaacuguacg

SEQ ID NO: 449909 - RNA, 64 nt, hsa
agcaucugagaucuaagaacacaauuauuauucuaacaaugauuauuagcucauucacuuauuu

SEQ ID NO: 449910 - RNA, 64 nt, hsa
aaaugaaaguacaccuacacuaauagucugucucaacaaugaguaaaggaacuuaaguauuggu

SEQ ID NO: 449911 - RNA, 64 nt, hsa
acuaaagccuuuauuuguuaauaguuccugcuaaaacaaugaauaaaaacucaaggagcaacua

SEQ ID NO: 449912 - RNA, 64 nt, hsa
cccccaccguugucucaugccaguaacaggcucaaacaaugacaaagcagauucagaaaugagg

SEQ ID NO: 449913 - RNA, 64 nt, hsa
auuccucaaucugaaacaaugaguuaaauauaauaacaaugacuuuaugaggaauuaaagguua

SEQ ID NO: 449914 - RNA, 64 nt, hsa
uggaagccaaaauugucacaauuccucaaucugaaacaaugaguuaaauauaauaacaaugacu

SEQ ID NO: 449915 - RNA, 64 nt, hsa
guaagauacuuuagaaagcauguaaaguacuagaaacaaugagguggcuucaauuagugcucau

SEQ ID NO: 449916 - RNA, 64 nt, hsa
aacaccacauguucucacucauagauaggaauugaacaaugagaacacauggagacaggaaggg

SEQ ID NO: 449917 - RNA, 64 nt, hsa
gcuacccugaaaagucaacaacuccucucgaaagaacaaugaccacagucaacauccucugagg

SEQ ID NO: 449918 - RNA, 64 nt, hsa
cucauggcccuucacaagaggaagcacacuggguaacaaugaacagugacucagggaacuuaug

SEQ ID NO: 449919 - RNA, 64 nt, hsa
ugggaaggggucagggugagaggcugcucuggagaacaaugagguccucauagcagcaggcagc

SEQ ID NO: 449920 - RNA, 64 nt, hsa
gcucaauaaauguggaucaucagagacauuuaugaacaaugacagaagaaaaauuacccaaaua

SEQ ID NO: 449921 - RNA, 64 nt, hsa
cagaaagggcuuugcuauuuuucccuuuugggaaaacaaugaaguguuuuaaguccugggugga

SEQ ID NO: 449922 - RNA, 64 nt, hsa
aaaauugugaguaauaaaaugaacucacaguuucaacaaugacccacauuuuaccagucuaguu

SEQ ID NO: 449923 - RNA, 63 nt, hsa
ucaccuugguuuccgcacaccuucgcaaugugaacaggucaggagucccucccguccaccucc

SEQ ID NO: 449924 - RNA, 63 nt, hsa
ccuuucucuuccuucuaaacaugugucucucccacaggucauucuccugugacacguguacug

SEQ ID NO: 449925 - RNA, 63 nt, hsa
gaucccuggucaagaucuguugcccaagauguuacaggucacaaugaccacauuugaaauugu

SEQ ID NO: 449926 - RNA, 63 nt, hsa
ggugcucuaagcuuaaucccucagaauguguggacaggucagcuuagaagagauggggagauu

SEQ ID NO: 449927 - RNA, 63 nt, hsa
ccacaggccaggcccagucacagcugggcuuccacaggucagaauaugggacaggacaugguc

SEQ ID NO: 449928 - RNA, 63 nt, hsa
uacaagaagcaaaacugcccaugcaaagagaacacaggucacuuuucaaaacacuugcaucau

SEQ ID NO: 449929 - RNA, 63 nt, hsa
cauuuauuucauuuuggucuuaaugcuuuguaaacaggucaaaaaauacugucauacucuaag

SEQ ID NO: 449930 - RNA, 63 nt, hsa
uccagugggguggggggagggcaagcuggauuuacaggucacggcuggacugaaugggccuuu

SEQ ID NO: 449931 - RNA, 63 nt, hsa
uggaccucaaagaauucuucagaccucauaguuacaggucauuauaucuacuauguugauuua

SEQ ID NO: 449932 - RNA, 63 nt, hsa
cagggccacauuugcaugagacauggcugucucacaggucacagagccauuacaacagcuuac

SEQ ID NO: 449933 - RNA, 63 nt, hsa
gcagagcccaucuacgcccaacacagagcucacacaggucacugcucucuaggcggacacacc

SEQ ID NO: 449934 - RNA, 63 nt, hsa
cggucccagaggaggaccuagugacaucaugggacaggucaaagcauuagggccaccuccaug

SEQ ID NO: 449935 - RNA, 64 nt, hsa
uacaggauuauaaaauaauauuuuguguauaaauuuguuauaaguucacauucauacauuuauu

SEQ ID NO: 449936 - RNA, 64 nt, hsa
uagauccuccccugcuauuuuugguuuauuuuuauuguuauaaaugcuuucuuucuuugacucc

SEQ ID NO: 449937 - RNA, 64 nt, hsa
aaaugugcaugcuuuucucuugcuaaucucucuuuuguuauagagaucucagcccuaaaccuag

SEQ ID NO: 449938 - RNA, 64 nt, hsa
cgaaauacaguuauuaaaauguuaaaagauaaguuuguuauauauuaauaugcaugcuucuuua

SEQ ID NO: 449939 - RNA, 64 nt, hsa
uuuucccccuuagugaauuaguuuuaaaaugauauuguuauauacauacuaugaaauauguaua

SEQ ID NO: 449940 - RNA, 64 nt, hsa
ugaaauauauuuaaaauauauugaauauuuuauauuguuauauccugacaagauuauaauauuu

SEQ ID NO: 449941 - RNA, 64 nt, hsa
ccuacccuuaaggaauacucucuguaguaggcuguuguuauauuagacuuccuggaacacacug

SEQ ID NO: 449942 - RNA, 64 nt, hsa
ucugaagaccugcagcagauuuaaauuacaacucuuguuauaacuuuuuaaaagauugugaaaa

SEQ ID NO: 449943 - RNA, 64 nt, hsa
uagagugaaugaaaaaccacuuuccugcuuuccauuguuauaaauucuaagcuuaagauaaaag

SEQ ID NO: 449944 - RNA, 64 nt, hsa
uugcauuauuccaguaauauauaaaaacugugucuuguuauaguaguacauuaugaaucacaua

SEQ ID NO: 449945 - RNA, 64 nt, hsa
guauuauugguauucugauuacucucaauucuaauuguuauauauuugagcccauacaguguau

SEQ ID NO: 449946 - RNA, 64 nt, hsa
ugagaaaguuaacuccaggauagguagguuucuauuguuauagcuagauguaaaucuuuaguuc

SEQ ID NO: 449947 - RNA, 64 nt, hsa
caucaguaauauugaaggucauaaucagugauuuuuguuauaugaaaauaauaguguuucacag

SEQ ID NO: 449948 - RNA, 64 nt, hsa
auuguugucuuaaaacuuacuaguuuugugggacuuguuauaaugcucuauagucauccacagu

SEQ ID NO: 449949 - RNA, 64 nt, hsa
uuauaacacuuaauacaauguaaaugcuauguaguuguuauaccauacugguuagugaauaauu

SEQ ID NO: 449950 - RNA, 64 nt, hsa
uucuguuuuaagauuguaauuaaaaauuacuauuuuguuauauggaaugguuaauuuuuaccua

SEQ ID NO: 449951 - RNA, 64 nt, hsa
gccuauuguuuuucagaauugagauauuuaaaacuuguuauaacuucuuccuaaaaauagaaga

SEQ ID NO: 449952 - RNA, 64 nt, hsa
cccguaaacauuuuuguuugcaaucuuguuucuuuuguuauaagucaaguuugaauguuacaau

SEQ ID NO: 449953 - RNA, 64 nt, hsa
auaaaaauugugugaugaaugaaucacauguucguuguuauaaguguuaaccuuuuuuugacaa

SEQ ID NO: 449954 - RNA, 64 nt, hsa
aaaggcaaagucuacuauaauuauaaucacagacuuguuauauaaaguuuguauuauucuauua

SEQ ID NO: 449955 - RNA, 64 nt, hsa
cuaaauacuguaauguuucaaaacauccaacuguuuguuauaaaguggcuagaacaucaauuac

SEQ ID NO: 449956 - RNA, 64 nt, hsa
gcauauuuucucauaaauggcuucuucagugccauuguuauauguuuuuuauuucuuucuuccu

SEQ ID NO: 449957 - RNA, 64 nt, hsa
uguuuauagcagguccuugaaaaauguuuuuguuuuguuauaauguuauaauuguuaugauguu

SEQ ID NO: 449958 - RNA, 64 nt, hsa
uguuuguauccauuagucuaugguaaaauugguuuuguuauacaucauuucacuuaaaguugca

SEQ ID NO: 449959 - RNA, 64 nt, hsa
aaauauacuuaaacaacaaacuuugaagaaaguguuguuauaaaauuauugaagcgauuucuau

SEQ ID NO: 449960 - RNA, 64 nt, hsa
uaugaauaauugaaaaacaaaacacucacuggauuuguuauaauccguguuggcacuggauucu

SEQ ID NO: 449961 - RNA, 64 nt, hsa
ccuccgcacuguuacccaguguguauauaaugacuuguuauagcucagugugcccuugaaucca

SEQ ID NO: 449962 - RNA, 64 nt, hsa
uggauuaucugggguaauuuucuucaaagggaguuuguuauacacagugaaaauguauuauaga

SEQ ID NO: 449963 - RNA, 64 nt, hsa
agagcauuuucauagugugcucauuucuaugguuuuguuauauagcauuuuucaacauuuaaug

SEQ ID NO: 449964 - RNA, 64 nt, hsa
ugcuaaauucuucaccugugguaacucauuuugauuguuauaacaucucagcaccguuauuccc

SEQ ID NO: 449965 - RNA, 64 nt, hsa
cccccuccucaagcugggccugcccuccaagugcuuguuauauaccuccacgggugucagccca

SEQ ID NO: 449966 - RNA, 64 nt, hsa
uuucuaaccauuguuauaaaggcuaauauaauuguuguuauauagcaguaagauauauuugugu

SEQ ID NO: 449967 - RNA, 64 nt, hsa
gaaauaccaaaaaguaagcuuuuguuucuaaccauuguuauaaaggcuaauauaauuguuguua

SEQ ID NO: 449968 - RNA, 64 nt, hsa; identical to SEQ ID NO: 21335

SEQ ID NO: 449969 - RNA, 64 nt, hsa; identical to SEQ ID NO: 21336

SEQ ID NO: 449970 - RNA, 64 nt, hsa; identical to SEQ ID NO: 21337

SEQ ID NO: 449971 - RNA, 64 nt, hsa; identical to SEQ ID NO: 21338

SEQ ID NO: 449972 - RNA, 64 nt, hsa; identical to SEQ ID NO: 21339

SEQ ID NO: 449973 - RNA, 64 nt, hsa; identical to SEQ ID NO: 21340

SEQ ID NO: 449974 - RNA, 64 nt, hsa; identical to SEQ ID NO: 21341

SEQ ID NO: 449975 - RNA, 64 nt, hsa; identical to SEQ ID NO: 21342

SEQ ID NO: 449976 - RNA, 64 nt, hsa; identical to SEQ ID NO: 21343

SEQ ID NO: 449977 - RNA, 64 nt, hsa; identical to SEQ ID NO: 21344

SEQ ID NO: 449978 - RNA, 64 nt, hsa; identical to SEQ ID NO: 21345

SEQ ID NO: 449979 - RNA, 64 nt, hsa; identical to SEQ ID NO: 21346

SEQ ID NO: 449980 - RNA, 64 nt, hsa; identical to SEQ ID NO: 21347

SEQ ID NO: 449981 - RNA, 64 nt, hsa; identical to SEQ ID NO: 21348

SEQ ID NO: 449982 - RNA, 64 nt, hsa; identical to SEQ ID NO: 21349

SEQ ID NO: 449983 - RNA, 64 nt, hsa; identical to SEQ ID NO: 114759

SEQ ID NO: 449984 - RNA, 64 nt, hsa; identical to SEQ ID NO: 114760

SEQ ID NO: 449985 - RNA, 64 nt, hsa; identical to SEQ ID NO: 114761

SEQ ID NO: 449986 - RNA, 64 nt, hsa; identical to SEQ ID NO: 114762

SEQ ID NO: 449987 - RNA, 64 nt, hsa; identical to SEQ ID NO: 114763

SEQ ID NO: 449988 - RNA, 64 nt, hsa; identical to SEQ ID NO: 114764

SEQ ID NO: 449989 - RNA, 64 nt, hsa; identical to SEQ ID NO: 114765

SEQ ID NO: 449990 - RNA, 64 nt, hsa; identical to SEQ ID NO: 114766

SEQ ID NO: 449991 - RNA, 64 nt, hsa; identical to SEQ ID NO: 114767

SEQ ID NO: 449992 - RNA, 64 nt, hsa; identical to SEQ ID NO: 114768

SEQ ID NO: 449993 - RNA, 64 nt, hsa; identical to SEQ ID NO: 114769

SEQ ID NO: 449994 - RNA, 64 nt, hsa; identical to SEQ ID NO: 114770

SEQ ID NO: 449995 - RNA, 64 nt, hsa; identical to SEQ ID NO: 114771

SEQ ID NO: 449996 - RNA, 64 nt, hsa; identical to SEQ ID NO: 114772

SEQ ID NO: 449997 - RNA, 64 nt, hsa; identical to SEQ ID NO: 114773

SEQ ID NO: 449998 - RNA, 64 nt, hsa; identical to SEQ ID NO: 114774

SEQ ID NO: 449999 - RNA, 64 nt, hsa; identical to SEQ ID NO: 114775

SEQ ID NO: 450000 - RNA, 64 nt, hsa; identical to SEQ ID NO: 114776

SEQ ID NO: 450001 - RNA, 64 nt, hsa; identical to SEQ ID NO: 114777

SEQ ID NO: 450002 - RNA, 64 nt, hsa; identical to SEQ ID NO: 114778

SEQ ID NO: 450003 - RNA, 64 nt, hsa; identical to SEQ ID NO: 114779

SEQ ID NO: 450004 - RNA, 64 nt, hsa; identical to SEQ ID NO: 114780

SEQ ID NO: 450005 - RNA, 64 nt, hsa; identical to SEQ ID NO: 114781

SEQ ID NO: 450006 - RNA, 64 nt, hsa; identical to SEQ ID NO: 114782

SEQ ID NO: 450007 - RNA, 64 nt, hsa; identical to SEQ ID NO: 114783

SEQ ID NO: 450008 - RNA, 64 nt, hsa; identical to SEQ ID NO: 114784

SEQ ID NO: 450009 - RNA, 64 nt, hsa; identical to SEQ ID NO: 114785

SEQ ID NO: 450010 - RNA, 64 nt, hsa; identical to SEQ ID NO: 114786

SEQ ID NO: 450011 - RNA, 64 nt, hsa; identical to SEQ ID NO: 114787

SEQ ID NO: 450012 - RNA, 64 nt, hsa; identical to SEQ ID NO: 114788

SEQ ID NO: 450013 - RNA, 64 nt, hsa; identical to SEQ ID NO: 114789

SEQ ID NO: 450014 - RNA, 64 nt, hsa; identical to SEQ ID NO: 114790

SEQ ID NO: 450015 - RNA, 64 nt, hsa; identical to SEQ ID NO: 114791

SEQ ID NO: 450016 - RNA, 64 nt, hsa; identical to SEQ ID NO: 114792

SEQ ID NO: 450017 - RNA, 64 nt, hsa; identical to SEQ ID NO: 114793

SEQ ID NO: 450018 - RNA, 64 nt, hsa; identical to SEQ ID NO: 114794

SEQ ID NO: 450019 - RNA, 64 nt, hsa; identical to SEQ ID NO: 114795

SEQ ID NO: 450020 - RNA, 64 nt, hsa; identical to SEQ ID NO: 114796

SEQ ID NO: 450021 - RNA, 64 nt, hsa; identical to SEQ ID NO: 114797

SEQ ID NO: 450022 - RNA, 64 nt, hsa; identical to SEQ ID NO: 114798

SEQ ID NO: 450023 - RNA, 64 nt, hsa; identical to SEQ ID NO: 114799

SEQ ID NO: 450024 - RNA, 64 nt, hsa; identical to SEQ ID NO: 114800

SEQ ID NO: 450025 - RNA, 64 nt, hsa; identical to SEQ ID NO: 114801

SEQ ID NO: 450026 - RNA, 64 nt, hsa; identical to SEQ ID NO: 114802

SEQ ID NO: 450027 - RNA, 64 nt, hsa; identical to SEQ ID NO: 114803

SEQ ID NO: 450028 - RNA, 64 nt, hsa; identical to SEQ ID NO: 114804

SEQ ID NO: 450029 - RNA, 64 nt, hsa; identical to SEQ ID NO: 114805

SEQ ID NO: 450030 - RNA, 64 nt, hsa; identical to SEQ ID NO: 114806

SEQ ID NO: 450031 - RNA, 64 nt, hsa; identical to SEQ ID NO: 114807

SEQ ID NO: 450032 - RNA, 62 nt, hsa
gcugcugacgggcuuugucuguggaaggagacagaaggaaauugacccacucuccuaucucc

SEQ ID NO: 450033 - RNA, 62 nt, hsa
uagaagcacauggagugcaauaggacauugugagaaggaauuuuucagggauucaucuacua

SEQ ID NO: 450034 - RNA, 62 nt, hsa
uuaccuuuuggacaguaauuucuaucacaguuagaaggaaaugauagucaaauacacguuua

SEQ ID NO: 450035 - RNA, 62 nt, hsa
gcucucaguauaagauuuuacuuuauuaaugcagaaggaauauggauauauuucuuuaaguc

SEQ ID NO: 450036 - RNA, 62 nt, hsa
acccaggcugaguccauacugccccugaucccagaaggaaugcugaccccucgucguaugaa

SEQ ID NO: 450037 - RNA, 62 nt, hsa
cucccucuauggggauggcuauuuuauuuuugagaaggaaaaaaaaagucauguauauauac

SEQ ID NO: 450038 - RNA, 62 nt, hsa
cagagguaagaggaagaggcagcagcaucccaagaaggaaagagcuggagucagcacugucc

SEQ ID NO: 450039 - RNA, 62 nt, hsa
agaaaaagcaagaagaagaaaaggcgacaucaagaaggaaaggucucagaugaaagagaggg

SEQ ID NO: 450040 - RNA, 62 nt, hsa
uuuuucugaaaguggcugauguaagaacaggcagaaggaaaacccuuuuugucaauaacucu

SEQ ID NO: 450041 - RNA, 62 nt, hsa
cuggucaagccccauuuggucuacagcccaugagaaggaaugaggcugguucugcacucuca

SEQ ID NO: 450042 - RNA, 62 nt, hsa
agacuuggguggugggaagaaggaaggugggaagaaggaauuagacacucugccugccacuc

SEQ ID NO: 450043 - RNA, 62 nt, hsa
uuaauaaguaaagugagacuuggguggugggaagaaggaaggugggaagaaggaauuagaca

SEQ ID NO: 450044 - RNA, 62 nt, hsa
caucccguccggaaaagaaggacccagagggaagaaggaacaguggaggcgggacgcccucc

SEQ ID NO: 450045 - RNA, 62 nt, hsa
uucgggaggaacucuguugcuucgccuggacaagaaggaaaaugcugauuuccuccuugggu

SEQ ID NO: 450046 - RNA, 61 nt, hsa; identical to SEQ ID NO: 106651

SEQ ID NO: 450047 - RNA, 62 nt, hsa
uguuguguucauuuguugagccauaucucagaagaaggaaagggagcuacagaaaggagguu

SEQ ID NO: 450048 - RNA, 62 nt, hsa
ccauauugugaaaaacuuuaguggacaagggcagaaggaagagggaagaccuguuaggaagc

SEQ ID NO: 450049 - RNA, 62 nt, hsa
gauuugcugagaguuugaauguggaguguaagagaaggaagaguuaaugaugacauuaaggu

SEQ ID NO: 450050 - RNA, 62 nt, hsa
aaugcacuugguuuauuguugggggugcucucagaaggaaccugugaaagccuuuaucaguc

SEQ ID NO: 450051 - RNA, 62 nt, hsa
ccaaaacaugggaugaagcuaaaucaaugcuuagaaggaaauuuauagcuucaaauacuuau

SEQ ID NO: 450052 - RNA, 62 nt, hsa
uaauugauaauaacaguccaaagaaagcagaaagaaggaaagccuagaacagaaauaaauga

SEQ ID NO: 450053 - RNA, 62 nt, hsa
aaggaaauaugaaggcacuuccuuuuuuucuaagaaggaaguugcuagaugauuccuucauc

SEQ ID NO: 450054 - RNA, 62 nt, hsa
cuguaaauaaaaggguuccaaccuuuuaaaaaagaaggaaaaaacuuuuuggugcuccagug

SEQ ID NO: 450055 - RNA, 62 nt, hsa
auggaggaguuguuuggggagggaaaggagagagaaggaaaggagugagguauuucccgucu

SEQ ID NO: 450056 - RNA, 62 nt, hsa
uuaaauaaaaugcugcugcuuugacaguaaagagaaggaaguauucugauuagcuguaucug

SEQ ID NO: 450057 - RNA, 62 nt, hsa
gagaucaggaagagaaggagcagagcugauggagaaggaaggcuccaucuccagugggaacu

SEQ ID NO: 450058 - RNA, 62 nt, hsa
ccccagugagauguccccugacccuccaccgcagaaggaaggcagggaggaggcagagaaga

SEQ ID NO: 450059 - RNA, 62 nt, hsa
ccaaccucugagaggugaaaagcuauguaaauagaaggaauggccaguucaaaagaauagua

SEQ ID NO: 450060 - RNA, 62 nt, hsa
uauuacuaaaaauauauauagacaaaauuaaaagaaggaaugauaagaauaaauuuaauuua

SEQ ID NO: 450061 - RNA, 62 nt, hsa
ucuggagaagguauuagcaaagcaaaaggcugagaaggaacagggaacauuggagcugacug

SEQ ID NO: 450062 - RNA, 62 nt, hsa
gaaaaaaaaaaagaagaagaagaaggagagcaagaaggaaagauuugugaacuggaagaaag

SEQ ID NO: 450063 - RNA, 62 nt, hsa
agcuaaaaagcuaaaguaccagucaucuagagagaaggaaauuaauguuucuuaauaauccu

SEQ ID NO: 450064 - RNA, 62 nt, hsa
ugauucagggauuccuaugaauagaaaugcugagaaggaacgcauuuuauugcagaagcuaa

SEQ ID NO: 450065 - RNA, 62 nt, hsa
uaugucugccaaguuguuagaaucuuugaaucagaaggaaaaaaagcagcgcugguugacaa

SEQ ID NO: 450066 - RNA, 62 nt, hsa
caaccugagauuuguaguccaggauuacaaccagaaggaaaguaugacagauuucuacuuaa

SEQ ID NO: 450067 - RNA, 62 nt, hsa
uugcagcacuuucugaggcuuucacuguagggagaaggaaaccccaaggguagaauagccau

SEQ ID NO: 450068 - RNA, 62 nt, hsa
ggauccaggaaccagugggauuggaugggagaagaaggaaggggguggcccgucacccccgc

SEQ ID NO: 450069 - RNA, 62 nt, hsa
ggagaagccuggggaggagggggaggaagacaagaaggaagaggaggaggagaaggaagacg

SEQ ID NO: 450070 - RNA, 62 nt, hsa
gggggaggaagacaagaaggaagaggaggaggagaaggaagacgaggagcuggacugggccu

SEQ ID NO: 450071 - RNA, 62 nt, hsa
guuguucccccagggggcucugccccaccuggagaaggaagcugccugguguggagugacuc

SEQ ID NO: 450072 - RNA, 62 nt, hsa
auuucuaccaaauaguagagcauaccacuugaagaaggaaagaaccgaagagcaaacaaaag

SEQ ID NO: 450073 - RNA, 62 nt, hsa
uaguauauuuaaaaacuguucaaaagcaaaagagaaggaacaggaaugaaaggaaaccuucc

SEQ ID NO: 450074 - RNA, 62 nt, hsa
auaaauauauuuauuaaguagcgcugcggcuaagaaggaagagugaggggucuguccauggg

SEQ ID NO: 450075 - RNA, 62 nt, hsa
uuuucauaaaaauuaaaugcuuuaagaaauggagaaggaaaaauagcuuuuaucaauuuuuu

SEQ ID NO: 450076 - RNA, 62 nt, hsa
guauugauaauuggacaaagagagagaaagaaagaaggaaggaaggaaaaacuuguuacuga

SEQ ID NO: 450077 - RNA, 62 nt, hsa
auccuuuucuauuucccuagaaccuuaaugguagaaggaauugcaaagaaucaaguccaccc

SEQ ID NO: 450078 - RNA, 62 nt, hsa
cucaugugacagauggggaaacugaggccuugagaaggaaaaaggcuaaucuaaguuccugc

SEQ ID NO: 450079 - RNA, 62 nt, hsa
cugaacaaggucucagggguauugcuaagccaagaaggaacuuucccacacuacugaaugga

SEQ ID NO: 450080 - RNA, 62 nt, hsa
guaaaagcccagaucacugugggcuggagaggagaaggaaagggucugcgccagcccugucc

SEQ ID NO: 450081 - RNA, 62 nt, hsa
cuugcuucaagaauaaaccacaccagugaacaagaaggaaaggccuuuuggagugugucuuu

SEQ ID NO: 450082 - RNA, 62 nt, hsa
gcuuauuaaaacaaaugauguauggggagaggagaaggaagggcaaggaaggaauugacaga

SEQ ID NO: 450083 - RNA, 62 nt, hsa
ucugugaggugauaggcaaggaugaaagacaaagaaggaaaagaguaucaaaggcagaaagg

SEQ ID NO: 450084 - RNA, 62 nt, hsa
uccccacccaccaaaugccucugccuugauggagaaggaaaaggcuggcaagguggguucca

SEQ ID NO: 450085 - RNA, 62 nt, hsa
uggcaugauuagauugcaaagcaaugaacucaagaaggaauugaaauaaggagggacaugau

SEQ ID NO: 450086 - RNA, 62 nt, hsa
uaggcuuuucugccugcuccugcuuaaacacaagaaggaauccuggauuuugcccucuccuu

SEQ ID NO: 450087 - RNA, 62 nt, hsa
agggcaacaaugaaggaggacccagccaagcuagaaggaauuuuguggaugggagacagcag

SEQ ID NO: 450088 - RNA, 62 nt, hsa
cucaacacaucccuucagugacucagagucucagaaggaaacccugacuccuggggccauuu

SEQ ID NO: 450089 - RNA, 62 nt, hsa
cuggcaccaguauaacuauaaagcacuagcugagaaggaacugauacuuacauuucauggac

SEQ ID NO: 450090 - RNA, 62 nt, hsa
ccugagaacagcuuuagucauggaauacugggagaaggaauaacuuucacaaaauaaacuua

SEQ ID NO: 450091 - RNA, 62 nt, hsa
agcaagaccuuguuucucaaaaauaaauaaauagaaggaaauaaauguaaaaaugcugcaaa

SEQ ID NO: 450092 - RNA, 62 nt, hsa
ucgagucgaguguaagggcccuucacaaaagcagaaggaacacuggcccaaacccccagcac

SEQ ID NO: 450093 - RNA, 62 nt, hsa
augggagaagggcaaagacuucaugggaagagagaaggaaggcccuggguagaaacgcuugg

SEQ ID NO: 450094 - RNA, 62 nt, hsa
uggggaacugagcucagaggcaggugcuucagagaaggaaacaaaaugagggguggcaggga

SEQ ID NO: 450095 - RNA, 62 nt, hsa
ucuuucuccccauggccccacugcagaauuaaagaaggaagaagggaaggcggaggagucua

SEQ ID NO: 450096 - RNA, 62 nt, hsa
agaaggaagaagggaaggcggaggagucuauaagaaggaaucaugauuucuauuuagcagau

SEQ ID NO: 450097 - RNA, 62 nt, hsa
ccgcauuccccccaauguggagaagucuaucaagaaggaaauggcucaguaugcuagcaaca

SEQ ID NO: 450098 - RNA, 62 nt, hsa
caucacaauuggcaauaaaaccuguguguuugagaaggaaaaugacccaucggugaugcgcu

SEQ ID NO: 450099 - RNA, 62 nt, hsa
cagaauggcauguuuuauaauuaacugaauaaagaaggaagcauuauuauauauuauugugg

SEQ ID NO: 450100 - RNA, 62 nt, hsa
uaacaugaauugauggucaauuucccuucagcagaaggaaaaggugauuuagaucaguagcu

SEQ ID NO: 450101 - RNA, 62 nt, hsa
cauuaauaugugcaaagauuggcucuccaacaagaaggaaagcagggaggaagggagaccac

SEQ ID NO: 450102 - RNA, 62 nt, hsa
cagaacgucgcugauggagaaagggcucccgcagaaggaacggccuguaccgugcgcuccgg

SEQ ID NO: 450103 - RNA, 62 nt, hsa
ucauggaagagaugaacgccaugcuggcccggagaaggaaagccacgcaaguuggggagaaa

SEQ ID NO: 450104 - RNA, 62 nt, hsa
ccauuaauuuuaggagcuucuggaagaggugaagaaggaauugcagaaagugaaagaggaaa

SEQ ID NO: 450105 - RNA, 62 nt, hsa
guaagaggcgcugggcucggagccuguuuccaagaaggaauugguugucaucuggcaguguu

SEQ ID NO: 450106 - RNA, 62 nt, hsa
ggaaaggcaguccuggacagaagacugucagcagaaggaaaguacuggacuacccgugggua

SEQ ID NO: 450107 - RNA, 62 nt, hsa
acugugcacagguuugagaggacaaguucaucagaaggaaggcaguccuuagaagucacaua

SEQ ID NO: 450108 - RNA, 62 nt, hsa
gaacauguuugugggccuuuugacugaguggcagaaggaaacugcucaggaagagaaacagg

SEQ ID NO: 450109 - RNA, 62 nt, hsa
gacuucuuccuccuccuccuucccugacucacagaaggaaugcaaucacccagcaaguccua

SEQ ID NO: 450110 - RNA, 62 nt, hsa
cucuugagccucugggaaugggaggggccaagagaaggaaaacccugucuuuagcacccuuu

SEQ ID NO: 450111 - RNA, 62 nt, hsa
guuuuuuaaaggauauuuaacuuuuauggacuagaaggaaucacgagggcuacugcacaaua

SEQ ID NO: 450112 - RNA, 62 nt, hsa
ccccagaagcagguggucugccccaggcauaaagaaggaaaauuggccaucuuucccaccuc

SEQ ID NO: 450113 - RNA, 62 nt, hsa
gcaagcagcuagacuggugaauugggggaaauagaaggaacuaguaacugagacuccuccag

SEQ ID NO: 450114 - RNA, 62 nt, hsa
gagaaaccaacaagagaucucgaacccugucuagaaggaauguauuuguugcuaaauuucgu

SEQ ID NO: 450115 - RNA, 62 nt, hsa
aacaaaguggaaggaaagaugcucagguacagagaaggaaugucuuugguccucuugccauc

SEQ ID NO: 450116 - RNA, 62 nt, hsa
gacaacccugugguuuccaaggagcugagaauagaaggaaacuagcuuacaugagaacagac

SEQ ID NO: 450117 - RNA, 62 nt, hsa
uuuugcccagcacauggagcuguaauccagagagaaggaaacguagaaauuuauuauuaaaa

SEQ ID NO: 450118 - RNA, 62 nt, hsa
cgcucagcaacauagaagagggaaggaaagagagaaggaaagagagagagaaagaaagucuc

SEQ ID NO: 450119 - RNA, 62 nt, hsa
aggaaggagggaagaaaagaaagcaaaggaacagaaggaaggaaagaaagaugggaggaagu

SEQ ID NO: 450120 - RNA, 62 nt, hsa
ggcggagaggggagaagaaggaagggaagggcagaaggaaggagggaagaaaagaaagcaaa

SEQ ID NO: 450121 - RNA, 62 nt, hsa
gcuuuuccuuugggggaggcggagaggggagaagaaggaagggaagggcagaaggaaggagg

SEQ ID NO: 450122 - RNA, 62 nt, hsa
uuuuacacagcacaugaagcaguaauccagaaagaaggaaaugcagaauuuuauuaucaaag

SEQ ID NO: 450123 - RNA, 62 nt, hsa
cauuuucaggaaaguuuguaguauuacaaggcagaaggaaacacaguagcaaugguugcucu

SEQ ID NO: 450124 - RNA, 64 nt, hsa
uccacacccuaaggcuucagcuugagaagcacuucgaagccagagcagaaccaaaacucacuuc

SEQ ID NO: 450125 - RNA, 64 nt, hsa
ugccuucagaccccgcugggaccgaagccguaaccgaagccaggcccgcagccgcuacucacuc

SEQ ID NO: 450126 - RNA, 64 nt, hsa
agggaaguuuuagucuuggcggguggaaaugagacgaagccacaguuaucacacuccagacucc

SEQ ID NO: 450127 - RNA, 64 nt, hsa
cagggcgggguaggggagggcaggggcugagccccgaagccagcucaguaccugaggggcugcu

SEQ ID NO: 450128 - RNA, 64 nt, hsa; identical to SEQ ID NO: 162601

SEQ ID NO: 450129 - RNA, 64 nt, hsa; identical to SEQ ID NO: 162602

SEQ ID NO: 450130 - RNA, 64 nt, hsa; identical to SEQ ID NO: 162603

SEQ ID NO: 450131 - RNA, 64 nt, hsa; identical to SEQ ID NO: 162604

SEQ ID NO: 450132 - RNA, 64 nt, hsa; identical to SEQ ID NO: 162605

SEQ ID NO: 450133 - RNA, 64 nt, hsa; identical to SEQ ID NO: 162606

SEQ ID NO: 450134 - RNA, 64 nt, hsa; identical to SEQ ID NO: 162607

SEQ ID NO: 450135 - RNA, 64 nt, hsa; identical to SEQ ID NO: 162608

SEQ ID NO: 450136 - RNA, 64 nt, hsa; identical to SEQ ID NO: 162609

SEQ ID NO: 450137 - RNA, 64 nt, hsa; identical to SEQ ID NO: 162610

SEQ ID NO: 450138 - RNA, 64 nt, hsa; identical to SEQ ID NO: 162611

SEQ ID NO: 450139 - RNA, 64 nt, hsa; identical to SEQ ID NO: 162612

SEQ ID NO: 450140 - RNA, 64 nt, hsa; identical to SEQ ID NO: 162613

SEQ ID NO: 450141 - RNA, 64 nt, hsa; identical to SEQ ID NO: 162614

SEQ ID NO: 450142 - RNA, 64 nt, hsa; identical to SEQ ID NO: 162615

SEQ ID NO: 450143 - RNA, 64 nt, hsa; identical to SEQ ID NO: 162616

SEQ ID NO: 450144 - RNA, 64 nt, hsa; identical to SEQ ID NO: 162617

SEQ ID NO: 450145 - RNA, 64 nt, hsa; identical to SEQ ID NO: 162618

SEQ ID NO: 450146 - RNA, 64 nt, hsa; identical to SEQ ID NO: 162619

SEQ ID NO: 450147 - RNA, 64 nt, hsa; identical to SEQ ID NO: 162620

SEQ ID NO: 450148 - RNA, 64 nt, hsa; identical to SEQ ID NO: 162621

SEQ ID NO: 450149 - RNA, 64 nt, hsa; identical to SEQ ID NO: 162622

SEQ ID NO: 450150 - RNA, 64 nt, hsa; identical to SEQ ID NO: 162623

SEQ ID NO: 450151 - RNA, 64 nt, hsa; identical to SEQ ID NO: 162624

SEQ ID NO: 450152 - RNA, 64 nt, hsa; identical to SEQ ID NO: 162625

SEQ ID NO: 450153 - RNA, 64 nt, hsa; identical to SEQ ID NO: 162626

SEQ ID NO: 450154 - RNA, 64 nt, hsa; identical to SEQ ID NO: 162627

SEQ ID NO: 450155 - RNA, 64 nt, hsa; identical to SEQ ID NO: 162628

SEQ ID NO: 450156 - RNA, 64 nt, hsa; identical to SEQ ID NO: 162629

SEQ ID NO: 450157 - RNA, 64 nt, hsa; identical to SEQ ID NO: 162630

SEQ ID NO: 450158 - RNA, 64 nt, hsa; identical to SEQ ID NO: 162631

SEQ ID NO: 450159 - RNA, 64 nt, hsa; identical to SEQ ID NO: 162632

SEQ ID NO: 450160 - RNA, 64 nt, hsa; identical to SEQ ID NO: 162633

SEQ ID NO: 450161 - RNA, 64 nt, hsa; identical to SEQ ID NO: 162634

SEQ ID NO: 450162 - RNA, 64 nt, hsa; identical to SEQ ID NO: 162635

SEQ ID NO: 450163 - RNA, 64 nt, hsa; identical to SEQ ID NO: 162636

SEQ ID NO: 450164 - RNA, 64 nt, hsa; identical to SEQ ID NO: 162637

SEQ ID NO: 450165 - RNA, 64 nt, hsa; identical to SEQ ID NO: 162638

SEQ ID NO: 450166 - RNA, 64 nt, hsa; identical to SEQ ID NO: 162639

SEQ ID NO: 450167 - RNA, 64 nt, hsa; identical to SEQ ID NO: 162640

SEQ ID NO: 450168 - RNA, 64 nt, hsa; identical to SEQ ID NO: 162641

SEQ ID NO: 450169 - RNA, 64 nt, hsa; identical to SEQ ID NO: 162642

SEQ ID NO: 450170 - RNA, 64 nt, hsa; identical to SEQ ID NO: 162643

SEQ ID NO: 450171 - RNA, 64 nt, hsa; identical to SEQ ID NO: 162644

SEQ ID NO: 450172 - RNA, 64 nt, hsa; identical to SEQ ID NO: 162645

SEQ ID NO: 450173 - RNA, 64 nt, hsa; identical to SEQ ID NO: 162646

SEQ ID NO: 450174 - RNA, 64 nt, hsa; identical to SEQ ID NO: 162647

SEQ ID NO: 450175 - RNA, 64 nt, hsa; identical to SEQ ID NO: 162648

SEQ ID NO: 450176 - RNA, 64 nt, hsa; identical to SEQ ID NO: 162649

SEQ ID NO: 450177 - RNA, 64 nt, hsa; identical to SEQ ID NO: 162650

SEQ ID NO: 450178 - RNA, 64 nt, hsa; identical to SEQ ID NO: 162651

SEQ ID NO: 450179 - RNA, 64 nt, hsa; identical to SEQ ID NO: 162652

SEQ ID NO: 450180 - RNA, 64 nt, hsa; identical to SEQ ID NO: 162653

SEQ ID NO: 450181 - RNA, 64 nt, hsa; identical to SEQ ID NO: 162654

SEQ ID NO: 450182 - RNA, 64 nt, hsa; identical to SEQ ID NO: 162655

SEQ ID NO: 450183 - RNA, 64 nt, hsa; identical to SEQ ID NO: 162656

SEQ ID NO: 450184 - RNA, 64 nt, hsa; identical to SEQ ID NO: 162657

SEQ ID NO: 450185 - RNA, 64 nt, hsa; identical to SEQ ID NO: 162658

SEQ ID NO: 450186 - RNA, 64 nt, hsa; identical to SEQ ID NO: 162659

SEQ ID NO: 450187 - RNA, 64 nt, hsa; identical to SEQ ID NO: 162660

SEQ ID NO: 450188 - RNA, 64 nt, hsa; identical to SEQ ID NO: 162661

SEQ ID NO: 450189 - RNA, 64 nt, hsa; identical to SEQ ID NO: 162662

SEQ ID NO: 450190 - RNA, 64 nt, hsa; identical to SEQ ID NO: 162663

SEQ ID NO: 450191 - RNA, 64 nt, hsa; identical to SEQ ID NO: 162664

SEQ ID NO: 450192 - RNA, 64 nt, hsa; identical to SEQ ID NO: 162665

SEQ ID NO: 450193 - RNA, 64 nt, hsa; identical to SEQ ID NO: 162666

SEQ ID NO: 450194 - RNA, 64 nt, hsa; identical to SEQ ID NO: 162667

SEQ ID NO: 450195 - RNA, 64 nt, hsa; identical to SEQ ID NO: 162668

SEQ ID NO: 450196 - RNA, 64 nt, hsa; identical to SEQ ID NO: 162669

SEQ ID NO: 450197 - RNA, 64 nt, hsa; identical to SEQ ID NO: 162670

SEQ ID NO: 450198 - RNA, 64 nt, hsa; identical to SEQ ID NO: 162671

SEQ ID NO: 450199 - RNA, 64 nt, hsa; identical to SEQ ID NO: 162672

SEQ ID NO: 450200 - RNA, 64 nt, hsa; identical to SEQ ID NO: 162673

SEQ ID NO: 450201 - RNA, 64 nt, hsa; identical to SEQ ID NO: 162674

SEQ ID NO: 450202 - RNA, 64 nt, hsa; identical to SEQ ID NO: 162675

SEQ ID NO: 450203 - RNA, 64 nt, hsa; identical to SEQ ID NO: 162676

SEQ ID NO: 450204 - RNA, 64 nt, hsa; identical to SEQ ID NO: 162677

SEQ ID NO: 450205 - RNA, 64 nt, hsa; identical to SEQ ID NO: 162678

SEQ ID NO: 450206 - RNA, 64 nt, hsa; identical to SEQ ID NO: 162679

SEQ ID NO: 450207 - RNA, 64 nt, hsa; identical to SEQ ID NO: 162680

SEQ ID NO: 450208 - RNA, 64 nt, hsa; identical to SEQ ID NO: 162681

SEQ ID NO: 450209 - RNA, 64 nt, hsa; identical to SEQ ID NO: 162682

SEQ ID NO: 450210 - RNA, 64 nt, hsa; identical to SEQ ID NO: 162683

SEQ ID NO: 450211 - RNA, 64 nt, hsa; identical to SEQ ID NO: 162684

SEQ ID NO: 450212 - RNA, 64 nt, hsa; identical to SEQ ID NO: 162685

SEQ ID NO: 450213 - RNA, 64 nt, hsa; identical to SEQ ID NO: 162686

SEQ ID NO: 450214 - RNA, 64 nt, hsa; identical to SEQ ID NO: 162687

SEQ ID NO: 450215 - RNA, 64 nt, hsa; identical to SEQ ID NO: 162688

SEQ ID NO: 450216 - RNA, 64 nt, hsa; identical to SEQ ID NO: 162689

SEQ ID NO: 450217 - RNA, 64 nt, hsa; identical to SEQ ID NO: 162690

SEQ ID NO: 450218 - RNA, 64 nt, hsa; identical to SEQ ID NO: 162691

SEQ ID NO: 450219 - RNA, 64 nt, hsa; identical to SEQ ID NO: 162692

SEQ ID NO: 450220 - RNA, 64 nt, hsa; identical to SEQ ID NO: 162693

SEQ ID NO: 450221 - RNA, 64 nt, hsa; identical to SEQ ID NO: 162694

SEQ ID NO: 450222 - RNA, 64 nt, hsa; identical to SEQ ID NO: 162695

SEQ ID NO: 450223 - RNA, 64 nt, hsa; identical to SEQ ID NO: 162696

SEQ ID NO: 450224 - RNA, 64 nt, hsa; identical to SEQ ID NO: 162697

SEQ ID NO: 450225 - RNA, 64 nt, hsa; identical to SEQ ID NO: 162698

SEQ ID NO: 450226 - RNA, 64 nt, hsa; identical to SEQ ID NO: 162699

SEQ ID NO: 450227 - RNA, 64 nt, hsa; identical to SEQ ID NO: 162700

SEQ ID NO: 450228 - RNA, 64 nt, hsa; identical to SEQ ID NO: 162701

SEQ ID NO: 450229 - RNA, 64 nt, hsa; identical to SEQ ID NO: 162702

SEQ ID NO: 450230 - RNA, 64 nt, hsa; identical to SEQ ID NO: 162703

SEQ ID NO: 450231 - RNA, 64 nt, hsa; identical to SEQ ID NO: 162704

SEQ ID NO: 450232 - RNA, 64 nt, hsa; identical to SEQ ID NO: 162705

SEQ ID NO: 450233 - RNA, 64 nt, hsa; identical to SEQ ID NO: 162706

SEQ ID NO: 450234 - RNA, 64 nt, hsa; identical to SEQ ID NO: 162707

SEQ ID NO: 450235 - RNA, 64 nt, hsa; identical to SEQ ID NO: 162708

SEQ ID NO: 450236 - RNA, 64 nt, hsa; identical to SEQ ID NO: 162709

SEQ ID NO: 450237 - RNA, 64 nt, hsa; identical to SEQ ID NO: 162710

SEQ ID NO: 450238 - RNA, 64 nt, hsa; identical to SEQ ID NO: 162711

SEQ ID NO: 450239 - RNA, 64 nt, hsa; identical to SEQ ID NO: 162712

SEQ ID NO: 450240 - RNA, 64 nt, hsa; identical to SEQ ID NO: 162713

SEQ ID NO: 450241 - RNA, 64 nt, hsa; identical to SEQ ID NO: 162714

SEQ ID NO: 450242 - RNA, 64 nt, hsa; identical to SEQ ID NO: 162715

SEQ ID NO: 450243 - RNA, 64 nt, hsa; identical to SEQ ID NO: 162716

SEQ ID NO: 450244 - RNA, 64 nt, hsa; identical to SEQ ID NO: 162717

SEQ ID NO: 450245 - RNA, 64 nt, hsa; identical to SEQ ID NO: 162718

SEQ ID NO: 450246 - RNA, 64 nt, hsa; identical to SEQ ID NO: 162719

SEQ ID NO: 450247 - RNA, 64 nt, hsa; identical to SEQ ID NO: 162720

SEQ ID NO: 450248 - RNA, 64 nt, hsa; identical to SEQ ID NO: 162721

SEQ ID NO: 450249 - RNA, 64 nt, hsa; identical to SEQ ID NO: 162722

SEQ ID NO: 450250 - RNA, 64 nt, hsa; identical to SEQ ID NO: 162723

SEQ ID NO: 450251 - RNA, 64 nt, hsa; identical to SEQ ID NO: 162724

SEQ ID NO: 450252 - RNA, 64 nt, hsa; identical to SEQ ID NO: 162725

SEQ ID NO: 450253 - RNA, 64 nt, hsa; identical to SEQ ID NO: 162726

SEQ ID NO: 450254 - RNA, 64 nt, hsa; identical to SEQ ID NO: 162727

SEQ ID NO: 450255 - RNA, 64 nt, hsa; identical to SEQ ID NO: 162728

SEQ ID NO: 450256 - RNA, 64 nt, hsa; identical to SEQ ID NO: 162729

SEQ ID NO: 450257 - RNA, 64 nt, hsa; identical to SEQ ID NO: 162730

SEQ ID NO: 450258 - RNA, 64 nt, hsa; identical to SEQ ID NO: 162731

SEQ ID NO: 450259 - RNA, 64 nt, hsa; identical to SEQ ID NO: 162732

SEQ ID NO: 450260 - RNA, 64 nt, hsa; identical to SEQ ID NO: 162733

SEQ ID NO: 450261 - RNA, 64 nt, hsa; identical to SEQ ID NO: 162734

SEQ ID NO: 450262 - RNA, 64 nt, hsa; identical to SEQ ID NO: 162735

SEQ ID NO: 450263 - RNA, 64 nt, hsa; identical to SEQ ID NO: 162736

SEQ ID NO: 450264 - RNA, 64 nt, hsa; identical to SEQ ID NO: 162737

SEQ ID NO: 450265 - RNA, 64 nt, hsa; identical to SEQ ID NO: 162738

SEQ ID NO: 450266 - RNA, 64 nt, hsa; identical to SEQ ID NO: 162739

SEQ ID NO: 450267 - RNA, 64 nt, hsa; identical to SEQ ID NO: 162740

SEQ ID NO: 450268 - RNA, 64 nt, hsa; identical to SEQ ID NO: 162741

SEQ ID NO: 450269 - RNA, 64 nt, hsa; identical to SEQ ID NO: 162742

SEQ ID NO: 450270 - RNA, 64 nt, hsa; identical to SEQ ID NO: 162743

SEQ ID NO: 450271 - RNA, 64 nt, hsa; identical to SEQ ID NO: 162744

SEQ ID NO: 450272 - RNA, 63 nt, hsa; identical to SEQ ID NO: 162745

SEQ ID NO: 450273 - RNA, 64 nt, hsa; identical to SEQ ID NO: 162746

SEQ ID NO: 450274 - RNA, 64 nt, hsa; identical to SEQ ID NO: 162747

SEQ ID NO: 450275 - RNA, 64 nt, hsa; identical to SEQ ID NO: 162748

SEQ ID NO: 450276 - RNA, 64 nt, hsa; identical to SEQ ID NO: 162749

SEQ ID NO: 450277 - RNA, 64 nt, hsa; identical to SEQ ID NO: 162750

SEQ ID NO: 450278 - RNA, 64 nt, hsa; identical to SEQ ID NO: 162751

SEQ ID NO: 450279 - RNA, 64 nt, hsa; identical to SEQ ID NO: 162752

SEQ ID NO: 450280 - RNA, 64 nt, hsa; identical to SEQ ID NO: 162753

SEQ ID NO: 450281 - RNA, 64 nt, hsa; identical to SEQ ID NO: 162754

SEQ ID NO: 450282 - RNA, 64 nt, hsa; identical to SEQ ID NO: 162755

SEQ ID NO: 450283 - RNA, 64 nt, hsa; identical to SEQ ID NO: 162756

SEQ ID NO: 450284 - RNA, 64 nt, hsa; identical to SEQ ID NO: 162757

SEQ ID NO: 450285 - RNA, 64 nt, hsa; identical to SEQ ID NO: 162758

SEQ ID NO: 450286 - RNA, 64 nt, hsa; identical to SEQ ID NO: 162759

SEQ ID NO: 450287 - RNA, 64 nt, hsa; identical to SEQ ID NO: 162760

SEQ ID NO: 450288 - RNA, 64 nt, hsa; identical to SEQ ID NO: 162761

SEQ ID NO: 450289 - RNA, 64 nt, hsa; identical to SEQ ID NO: 162762

SEQ ID NO: 450290 - RNA, 64 nt, hsa; identical to SEQ ID NO: 162763

SEQ ID NO: 450291 - RNA, 64 nt, hsa; identical to SEQ ID NO: 162764

SEQ ID NO: 450292 - RNA, 64 nt, hsa; identical to SEQ ID NO: 162765

SEQ ID NO: 450293 - RNA, 64 nt, hsa; identical to SEQ ID NO: 162766

SEQ ID NO: 450294 - RNA, 64 nt, hsa; identical to SEQ ID NO: 162767

SEQ ID NO: 450295 - RNA, 64 nt, hsa; identical to SEQ ID NO: 162768

SEQ ID NO: 450296 - RNA, 64 nt, hsa; identical to SEQ ID NO: 162769

SEQ ID NO: 450297 - RNA, 64 nt, hsa; identical to SEQ ID NO: 162770

SEQ ID NO: 450298 - RNA, 64 nt, hsa; identical to SEQ ID NO: 162771

SEQ ID NO: 450299 - RNA, 64 nt, hsa; identical to SEQ ID NO: 162772

SEQ ID NO: 450300 - RNA, 64 nt, hsa; identical to SEQ ID NO: 162773

SEQ ID NO: 450301 - RNA, 64 nt, hsa; identical to SEQ ID NO: 162774

SEQ ID NO: 450302 - RNA, 64 nt, hsa; identical to SEQ ID NO: 162775

SEQ ID NO: 450303 - RNA, 64 nt, hsa; identical to SEQ ID NO: 162776

SEQ ID NO: 450304 - RNA, 64 nt, hsa; identical to SEQ ID NO: 162777

SEQ ID NO: 450305 - RNA, 64 nt, hsa; identical to SEQ ID NO: 162778

SEQ ID NO: 450306 - RNA, 64 nt, hsa; identical to SEQ ID NO: 162779

SEQ ID NO: 450307 - RNA, 64 nt, hsa; identical to SEQ ID NO: 162780

SEQ ID NO: 450308 - RNA, 64 nt, hsa; identical to SEQ ID NO: 162781

SEQ ID NO: 450309 - RNA, 64 nt, hsa; identical to SEQ ID NO: 162782

SEQ ID NO: 450310 - RNA, 64 nt, hsa; identical to SEQ ID NO: 162783

SEQ ID NO: 450311 - RNA, 64 nt, hsa; identical to SEQ ID NO: 162784

SEQ ID NO: 450312 - RNA, 64 nt, hsa; identical to SEQ ID NO: 162785

SEQ ID NO: 450313 - RNA, 64 nt, hsa; identical to SEQ ID NO: 162786

SEQ ID NO: 450314 - RNA, 64 nt, hsa; identical to SEQ ID NO: 162787

SEQ ID NO: 450315 - RNA, 64 nt, hsa; identical to SEQ ID NO: 162788

SEQ ID NO: 450316 - RNA, 64 nt, hsa; identical to SEQ ID NO: 162789

SEQ ID NO: 450317 - RNA, 64 nt, hsa; identical to SEQ ID NO: 162790

SEQ ID NO: 450318 - RNA, 64 nt, hsa; identical to SEQ ID NO: 162791

SEQ ID NO: 450319 - RNA, 64 nt, hsa; identical to SEQ ID NO: 162792

SEQ ID NO: 450320 - RNA, 64 nt, hsa; identical to SEQ ID NO: 162793

SEQ ID NO: 450321 - RNA, 64 nt, hsa; identical to SEQ ID NO: 162794

SEQ ID NO: 450322 - RNA, 64 nt, hsa; identical to SEQ ID NO: 162795

SEQ ID NO: 450323 - RNA, 64 nt, hsa; identical to SEQ ID NO: 162796

SEQ ID NO: 450324 - RNA, 64 nt, hsa; identical to SEQ ID NO: 162797

SEQ ID NO: 450325 - RNA, 64 nt, hsa; identical to SEQ ID NO: 162798

SEQ ID NO: 450326 - RNA, 64 nt, hsa; identical to SEQ ID NO: 162799

SEQ ID NO: 450327 - RNA, 64 nt, hsa; identical to SEQ ID NO: 162800

SEQ ID NO: 450328 - RNA, 64 nt, hsa; identical to SEQ ID NO: 162801

SEQ ID NO: 450329 - RNA, 64 nt, hsa; identical to SEQ ID NO: 162802

SEQ ID NO: 450330 - RNA, 64 nt, hsa; identical to SEQ ID NO: 162803

SEQ ID NO: 450331 - RNA, 64 nt, hsa; identical to SEQ ID NO: 162804

SEQ ID NO: 450332 - RNA, 64 nt, hsa; identical to SEQ ID NO: 162805

SEQ ID NO: 450333 - RNA, 64 nt, hsa; identical to SEQ ID NO: 162806

SEQ ID NO: 450334 - RNA, 64 nt, hsa; identical to SEQ ID NO: 162807

SEQ ID NO: 450335 - RNA, 64 nt, hsa; identical to SEQ ID NO: 162808

SEQ ID NO: 450336 - RNA, 64 nt, hsa; identical to SEQ ID NO: 162809

SEQ ID NO: 450337 - RNA, 64 nt, hsa; identical to SEQ ID NO: 162810

SEQ ID NO: 450338 - RNA, 64 nt, hsa; identical to SEQ ID NO: 162811

SEQ ID NO: 450339 - RNA, 64 nt, hsa; identical to SEQ ID NO: 162812

SEQ ID NO: 450340 - RNA, 64 nt, hsa; identical to SEQ ID NO: 162813

SEQ ID NO: 450341 - RNA, 62 nt, hsa; identical to SEQ ID NO: 162814

SEQ ID NO: 450342 - RNA, 64 nt, hsa; identical to SEQ ID NO: 162815

SEQ ID NO: 450343 - RNA, 64 nt, hsa; identical to SEQ ID NO: 162816

SEQ ID NO: 450344 - RNA, 64 nt, hsa; identical to SEQ ID NO: 162817

SEQ ID NO: 450345 - RNA, 64 nt, hsa; identical to SEQ ID NO: 162818

SEQ ID NO: 450346 - RNA, 64 nt, hsa; identical to SEQ ID NO: 162819

SEQ ID NO: 450347 - RNA, 64 nt, hsa; identical to SEQ ID NO: 162820

SEQ ID NO: 450348 - RNA, 64 nt, hsa; identical to SEQ ID NO: 162821

SEQ ID NO: 450349 - RNA, 64 nt, hsa; identical to SEQ ID NO: 162822

SEQ ID NO: 450350 - RNA, 64 nt, hsa; identical to SEQ ID NO: 162823

SEQ ID NO: 450351 - RNA, 64 nt, hsa; identical to SEQ ID NO: 162824

SEQ ID NO: 450352 - RNA, 64 nt, hsa; identical to SEQ ID NO: 162825

SEQ ID NO: 450353 - RNA, 64 nt, hsa; identical to SEQ ID NO: 162826

SEQ ID NO: 450354 - RNA, 64 nt, hsa; identical to SEQ ID NO: 162827

SEQ ID NO: 450355 - RNA, 64 nt, hsa; identical to SEQ ID NO: 162828

SEQ ID NO: 450356 - RNA, 64 nt, hsa; identical to SEQ ID NO: 162829

SEQ ID NO: 450357 - RNA, 64 nt, hsa; identical to SEQ ID NO: 162830

SEQ ID NO: 450358 - RNA, 64 nt, hsa; identical to SEQ ID NO: 162831

SEQ ID NO: 450359 - RNA, 64 nt, hsa; identical to SEQ ID NO: 162832

SEQ ID NO: 450360 - RNA, 64 nt, hsa; identical to SEQ ID NO: 162833

SEQ ID NO: 450361 - RNA, 64 nt, hsa; identical to SEQ ID NO: 162834

SEQ ID NO: 450362 - RNA, 64 nt, hsa; identical to SEQ ID NO: 162835

SEQ ID NO: 450363 - RNA, 64 nt, hsa; identical to SEQ ID NO: 162836

SEQ ID NO: 450364 - RNA, 64 nt, hsa; identical to SEQ ID NO: 162837

SEQ ID NO: 450365 - RNA, 64 nt, hsa; identical to SEQ ID NO: 162838

SEQ ID NO: 450366 - RNA, 64 nt, hsa; identical to SEQ ID NO: 162839

SEQ ID NO: 450367 - RNA, 64 nt, hsa; identical to SEQ ID NO: 162840

SEQ ID NO: 450368 - RNA, 64 nt, hsa; identical to SEQ ID NO: 162841

SEQ ID NO: 450369 - RNA, 64 nt, hsa; identical to SEQ ID NO: 162842

SEQ ID NO: 450370 - RNA, 64 nt, hsa; identical to SEQ ID NO: 162843

SEQ ID NO: 450371 - RNA, 64 nt, hsa; identical to SEQ ID NO: 162844

SEQ ID NO: 450372 - RNA, 64 nt, hsa; identical to SEQ ID NO: 162845

SEQ ID NO: 450373 - RNA, 64 nt, hsa; identical to SEQ ID NO: 162846

SEQ ID NO: 450374 - RNA, 64 nt, hsa; identical to SEQ ID NO: 162847

SEQ ID NO: 450375 - RNA, 64 nt, hsa; identical to SEQ ID NO: 162848

SEQ ID NO: 450376 - RNA, 64 nt, hsa; identical to SEQ ID NO: 162849

SEQ ID NO: 450377 - RNA, 64 nt, hsa; identical to SEQ ID NO: 162850

SEQ ID NO: 450378 - RNA, 64 nt, hsa; identical to SEQ ID NO: 162851

SEQ ID NO: 450379 - RNA, 64 nt, hsa; identical to SEQ ID NO: 162852

SEQ ID NO: 450380 - RNA, 64 nt, hsa; identical to SEQ ID NO: 162853

SEQ ID NO: 450381 - RNA, 64 nt, hsa; identical to SEQ ID NO: 162854

SEQ ID NO: 450382 - RNA, 64 nt, hsa; identical to SEQ ID NO: 162855

SEQ ID NO: 450383 - RNA, 64 nt, hsa; identical to SEQ ID NO: 162856

SEQ ID NO: 450384 - RNA, 64 nt, hsa; identical to SEQ ID NO: 162857

SEQ ID NO: 450385 - RNA, 64 nt, hsa; identical to SEQ ID NO: 162858

SEQ ID NO: 450386 - RNA, 64 nt, hsa; identical to SEQ ID NO: 162859

SEQ ID NO: 450387 - RNA, 64 nt, hsa; identical to SEQ ID NO: 162860

SEQ ID NO: 450388 - RNA, 64 nt, hsa; identical to SEQ ID NO: 162861

SEQ ID NO: 450389 - RNA, 64 nt, hsa; identical to SEQ ID NO: 162862

SEQ ID NO: 450390 - RNA, 64 nt, hsa; identical to SEQ ID NO: 162863

SEQ ID NO: 450391 - RNA, 64 nt, hsa; identical to SEQ ID NO: 162864

SEQ ID NO: 450392 - RNA, 64 nt, hsa; identical to SEQ ID NO: 162865

SEQ ID NO: 450393 - RNA, 64 nt, hsa; identical to SEQ ID NO: 162866

SEQ ID NO: 450394 - RNA, 64 nt, hsa; identical to SEQ ID NO: 162867

SEQ ID NO: 450395 - RNA, 64 nt, hsa; identical to SEQ ID NO: 162868

SEQ ID NO: 450396 - RNA, 64 nt, hsa; identical to SEQ ID NO: 162869

SEQ ID NO: 450397 - RNA, 64 nt, hsa; identical to SEQ ID NO: 162870

SEQ ID NO: 450398 - RNA, 64 nt, hsa; identical to SEQ ID NO: 162871

SEQ ID NO: 450399 - RNA, 64 nt, hsa; identical to SEQ ID NO: 162872

SEQ ID NO: 450400 - RNA, 64 nt, hsa; identical to SEQ ID NO: 162873

SEQ ID NO: 450401 - RNA, 64 nt, hsa; identical to SEQ ID NO: 162874

SEQ ID NO: 450402 - RNA, 64 nt, hsa; identical to SEQ ID NO: 162875

SEQ ID NO: 450403 - RNA, 64 nt, hsa; identical to SEQ ID NO: 162876

SEQ ID NO: 450404 - RNA, 64 nt, hsa; identical to SEQ ID NO: 162877

SEQ ID NO: 450405 - RNA, 64 nt, hsa; identical to SEQ ID NO: 162878

SEQ ID NO: 450406 - RNA, 64 nt, hsa; identical to SEQ ID NO: 162879

SEQ ID NO: 450407 - RNA, 64 nt, hsa; identical to SEQ ID NO: 162880

SEQ ID NO: 450408 - RNA, 64 nt, hsa; identical to SEQ ID NO: 162881

SEQ ID NO: 450409 - RNA, 64 nt, hsa; identical to SEQ ID NO: 162882

SEQ ID NO: 450410 - RNA, 64 nt, hsa; identical to SEQ ID NO: 162883

SEQ ID NO: 450411 - RNA, 64 nt, hsa; identical to SEQ ID NO: 162884

SEQ ID NO: 450412 - RNA, 64 nt, hsa; identical to SEQ ID NO: 162885

SEQ ID NO: 450413 - RNA, 64 nt, hsa; identical to SEQ ID NO: 162886

SEQ ID NO: 450414 - RNA, 64 nt, hsa; identical to SEQ ID NO: 162887

SEQ ID NO: 450415 - RNA, 64 nt, hsa; identical to SEQ ID NO: 162888

SEQ ID NO: 450416 - RNA, 64 nt, hsa; identical to SEQ ID NO: 162889

SEQ ID NO: 450417 - RNA, 64 nt, hsa; identical to SEQ ID NO: 162890

SEQ ID NO: 450418 - RNA, 64 nt, hsa; identical to SEQ ID NO: 162891

SEQ ID NO: 450419 - RNA, 64 nt, hsa; identical to SEQ ID NO: 162892

SEQ ID NO: 450420 - RNA, 64 nt, hsa; identical to SEQ ID NO: 162893

SEQ ID NO: 450421 - RNA, 64 nt, hsa; identical to SEQ ID NO: 162894

SEQ ID NO: 450422 - RNA, 64 nt, hsa; identical to SEQ ID NO: 162895

SEQ ID NO: 450423 - RNA, 64 nt, hsa; identical to SEQ ID NO: 162896

SEQ ID NO: 450424 - RNA, 64 nt, hsa; identical to SEQ ID NO: 162897

SEQ ID NO: 450425 - RNA, 64 nt, hsa; identical to SEQ ID NO: 162898

SEQ ID NO: 450426 - RNA, 64 nt, hsa; identical to SEQ ID NO: 162899

SEQ ID NO: 450427 - RNA, 64 nt, hsa; identical to SEQ ID NO: 162900

SEQ ID NO: 450428 - RNA, 64 nt, hsa; identical to SEQ ID NO: 162901

SEQ ID NO: 450429 - RNA, 64 nt, hsa; identical to SEQ ID NO: 162902

SEQ ID NO: 450430 - RNA, 64 nt, hsa; identical to SEQ ID NO: 162903

SEQ ID NO: 450431 - RNA, 64 nt, hsa; identical to SEQ ID NO: 162904

SEQ ID NO: 450432 - RNA, 64 nt, hsa; identical to SEQ ID NO: 162905

SEQ ID NO: 450433 - RNA, 64 nt, hsa; identical to SEQ ID NO: 162906

SEQ ID NO: 450434 - RNA, 64 nt, hsa; identical to SEQ ID NO: 162907

SEQ ID NO: 450435 - RNA, 64 nt, hsa; identical to SEQ ID NO: 162908

SEQ ID NO: 450436 - RNA, 64 nt, hsa; identical to SEQ ID NO: 162909

SEQ ID NO: 450437 - RNA, 64 nt, hsa; identical to SEQ ID NO: 162910

SEQ ID NO: 450438 - RNA, 64 nt, hsa; identical to SEQ ID NO: 162911

SEQ ID NO: 450439 - RNA, 64 nt, hsa; identical to SEQ ID NO: 162912

SEQ ID NO: 450440 - RNA, 64 nt, hsa; identical to SEQ ID NO: 162913

SEQ ID NO: 450441 - RNA, 64 nt, hsa; identical to SEQ ID NO: 162914

SEQ ID NO: 450442 - RNA, 64 nt, hsa; identical to SEQ ID NO: 162915

SEQ ID NO: 450443 - RNA, 64 nt, hsa; identical to SEQ ID NO: 162916

SEQ ID NO: 450444 - RNA, 64 nt, hsa; identical to SEQ ID NO: 162917

SEQ ID NO: 450445 - RNA, 64 nt, hsa; identical to SEQ ID NO: 162918

SEQ ID NO: 450446 - RNA, 64 nt, hsa; identical to SEQ ID NO: 162919

SEQ ID NO: 450447 - RNA, 64 nt, hsa; identical to SEQ ID NO: 162920

SEQ ID NO: 450448 - RNA, 64 nt, hsa; identical to SEQ ID NO: 162921

SEQ ID NO: 450449 - RNA, 64 nt, hsa; identical to SEQ ID NO: 162922

SEQ ID NO: 450450 - RNA, 53 nt, hsa; identical to SEQ ID NO: 162923

SEQ ID NO: 450451 - RNA, 64 nt, hsa; identical to SEQ ID NO: 162924

SEQ ID NO: 450452 - RNA, 64 nt, hsa; identical to SEQ ID NO: 162925

SEQ ID NO: 450453 - RNA, 64 nt, hsa; identical to SEQ ID NO: 162926

SEQ ID NO: 450454 - RNA, 64 nt, hsa; identical to SEQ ID NO: 162927

SEQ ID NO: 450455 - RNA, 64 nt, hsa; identical to SEQ ID NO: 162928

SEQ ID NO: 450456 - RNA, 64 nt, hsa; identical to SEQ ID NO: 162929

SEQ ID NO: 450457 - RNA, 64 nt, hsa; identical to SEQ ID NO: 162930

SEQ ID NO: 450458 - RNA, 64 nt, hsa; identical to SEQ ID NO: 162931

SEQ ID NO: 450459 - RNA, 64 nt, hsa; identical to SEQ ID NO: 162932

SEQ ID NO: 450460 - RNA, 64 nt, hsa; identical to SEQ ID NO: 162933

SEQ ID NO: 450461 - RNA, 64 nt, hsa; identical to SEQ ID NO: 162934

SEQ ID NO: 450462 - RNA, 64 nt, hsa; identical to SEQ ID NO: 162935

SEQ ID NO: 450463 - RNA, 64 nt, hsa; identical to SEQ ID NO: 162936

SEQ ID NO: 450464 - RNA, 64 nt, hsa; identical to SEQ ID NO: 162937

SEQ ID NO: 450465 - RNA, 64 nt, hsa; identical to SEQ ID NO: 162938

SEQ ID NO: 450466 - RNA, 64 nt, hsa; identical to SEQ ID NO: 162939

SEQ ID NO: 450467 - RNA, 64 nt, hsa; identical to SEQ ID NO: 162940

SEQ ID NO: 450468 - RNA, 64 nt, hsa; identical to SEQ ID NO: 162941

SEQ ID NO: 450469 - RNA, 64 nt, hsa; identical to SEQ ID NO: 162942

SEQ ID NO: 450470 - RNA, 64 nt, hsa; identical to SEQ ID NO: 162943

SEQ ID NO: 450471 - RNA, 64 nt, hsa; identical to SEQ ID NO: 162944

SEQ ID NO: 450472 - RNA, 64 nt, hsa; identical to SEQ ID NO: 162945

SEQ ID NO: 450473 - RNA, 64 nt, hsa; identical to SEQ ID NO: 162946

SEQ ID NO: 450474 - RNA, 64 nt, hsa; identical to SEQ ID NO: 162947

SEQ ID NO: 450475 - RNA, 64 nt, hsa; identical to SEQ ID NO: 162948

SEQ ID NO: 450476 - RNA, 64 nt, hsa; identical to SEQ ID NO: 162949

SEQ ID NO: 450477 - RNA, 64 nt, hsa; identical to SEQ ID NO: 162950

SEQ ID NO: 450478 - RNA, 64 nt, hsa; identical to SEQ ID NO: 162951

SEQ ID NO: 450479 - RNA, 64 nt, hsa; identical to SEQ ID NO: 162952

SEQ ID NO: 450480 - RNA, 64 nt, hsa; identical to SEQ ID NO: 162953

SEQ ID NO: 450481 - RNA, 64 nt, hsa; identical to SEQ ID NO: 162954

SEQ ID NO: 450482 - RNA, 64 nt, hsa; identical to SEQ ID NO: 162955

SEQ ID NO: 450483 - RNA, 64 nt, hsa; identical to SEQ ID NO: 162956

SEQ ID NO: 450484 - RNA, 64 nt, hsa; identical to SEQ ID NO: 162957

SEQ ID NO: 450485 - RNA, 64 nt, hsa; identical to SEQ ID NO: 162958

SEQ ID NO: 450486 - RNA, 64 nt, hsa; identical to SEQ ID NO: 162959

SEQ ID NO: 450487 - RNA, 64 nt, hsa; identical to SEQ ID NO: 162960

SEQ ID NO: 450488 - RNA, 64 nt, hsa; identical to SEQ ID NO: 162961

SEQ ID NO: 450489 - RNA, 64 nt, hsa; identical to SEQ ID NO: 162962

SEQ ID NO: 450490 - RNA, 64 nt, hsa; identical to SEQ ID NO: 162963

SEQ ID NO: 450491 - RNA, 64 nt, hsa; identical to SEQ ID NO: 162964

SEQ ID NO: 450492 - RNA, 64 nt, hsa; identical to SEQ ID NO: 162965

SEQ ID NO: 450493 - RNA, 64 nt, hsa; identical to SEQ ID NO: 162966

SEQ ID NO: 450494 - RNA, 64 nt, hsa; identical to SEQ ID NO: 162967

SEQ ID NO: 450495 - RNA, 64 nt, hsa; identical to SEQ ID NO: 162968

SEQ ID NO: 450496 - RNA, 64 nt, hsa; identical to SEQ ID NO: 162969

SEQ ID NO: 450497 - RNA, 64 nt, hsa; identical to SEQ ID NO: 162970

SEQ ID NO: 450498 - RNA, 64 nt, hsa; identical to SEQ ID NO: 162971

SEQ ID NO: 450499 - RNA, 64 nt, hsa; identical to SEQ ID NO: 162972

SEQ ID NO: 450500 - RNA, 64 nt, hsa; identical to SEQ ID NO: 162973

SEQ ID NO: 450501 - RNA, 64 nt, hsa; identical to SEQ ID NO: 162974

SEQ ID NO: 450502 - RNA, 64 nt, hsa; identical to SEQ ID NO: 162975

SEQ ID NO: 450503 - RNA, 64 nt, hsa; identical to SEQ ID NO: 162976

SEQ ID NO: 450504 - RNA, 64 nt, hsa; identical to SEQ ID NO: 162977

SEQ ID NO: 450505 - RNA, 64 nt, hsa; identical to SEQ ID NO: 162978

SEQ ID NO: 450506 - RNA, 64 nt, hsa; identical to SEQ ID NO: 162979

SEQ ID NO: 450507 - RNA, 64 nt, hsa; identical to SEQ ID NO: 162980

SEQ ID NO: 450508 - RNA, 64 nt, hsa; identical to SEQ ID NO: 162981

SEQ ID NO: 450509 - RNA, 64 nt, hsa; identical to SEQ ID NO: 162982

SEQ ID NO: 450510 - RNA, 64 nt, hsa; identical to SEQ ID NO: 162983

SEQ ID NO: 450511 - RNA, 64 nt, hsa; identical to SEQ ID NO: 162984

SEQ ID NO: 450512 - RNA, 64 nt, hsa; identical to SEQ ID NO: 162985

SEQ ID NO: 450513 - RNA, 64 nt, hsa; identical to SEQ ID NO: 162986

SEQ ID NO: 450514 - RNA, 64 nt, hsa; identical to SEQ ID NO: 162987

SEQ ID NO: 450515 - RNA, 64 nt, hsa; identical to SEQ ID NO: 162988

SEQ ID NO: 450516 - RNA, 64 nt, hsa; identical to SEQ ID NO: 162989

SEQ ID NO: 450517 - RNA, 64 nt, hsa; identical to SEQ ID NO: 162990

SEQ ID NO: 450518 - RNA, 64 nt, hsa; identical to SEQ ID NO: 162991

SEQ ID NO: 450519 - RNA, 64 nt, hsa; identical to SEQ ID NO: 162992

SEQ ID NO: 450520 - RNA, 64 nt, hsa; identical to SEQ ID NO: 162993

SEQ ID NO: 450521 - RNA, 64 nt, hsa; identical to SEQ ID NO: 162994

SEQ ID NO: 450522 - RNA, 64 nt, hsa; identical to SEQ ID NO: 162995

SEQ ID NO: 450523 - RNA, 64 nt, hsa; identical to SEQ ID NO: 162996

SEQ ID NO: 450524 - RNA, 64 nt, hsa; identical to SEQ ID NO: 162997

SEQ ID NO: 450525 - RNA, 64 nt, hsa; identical to SEQ ID NO: 162998

SEQ ID NO: 450526 - RNA, 64 nt, hsa; identical to SEQ ID NO: 162999

SEQ ID NO: 450527 - RNA, 64 nt, hsa; identical to SEQ ID NO: 163000

SEQ ID NO: 450528 - RNA, 64 nt, hsa; identical to SEQ ID NO: 163001

SEQ ID NO: 450529 - RNA, 64 nt, hsa; identical to SEQ ID NO: 163002

SEQ ID NO: 450530 - RNA, 64 nt, hsa; identical to SEQ ID NO: 163003

SEQ ID NO: 450531 - RNA, 64 nt, hsa; identical to SEQ ID NO: 163004

SEQ ID NO: 450532 - RNA, 64 nt, hsa; identical to SEQ ID NO: 163005

SEQ ID NO: 450533 - RNA, 64 nt, hsa; identical to SEQ ID NO: 163006

SEQ ID NO: 450534 - RNA, 64 nt, hsa; identical to SEQ ID NO: 163007

SEQ ID NO: 450535 - RNA, 64 nt, hsa; identical to SEQ ID NO: 163008

SEQ ID NO: 450536 - RNA, 64 nt, hsa; identical to SEQ ID NO: 163009

SEQ ID NO: 450537 - RNA, 64 nt, hsa; identical to SEQ ID NO: 163010

SEQ ID NO: 450538 - RNA, 64 nt, hsa; identical to SEQ ID NO: 163011

SEQ ID NO: 450539 - RNA, 64 nt, hsa; identical to SEQ ID NO: 163012

SEQ ID NO: 450540 - RNA, 64 nt, hsa; identical to SEQ ID NO: 163013

SEQ ID NO: 450541 - RNA, 64 nt, hsa; identical to SEQ ID NO: 163014

SEQ ID NO: 450542 - RNA, 64 nt, hsa; identical to SEQ ID NO: 163015

SEQ ID NO: 450543 - RNA, 64 nt, hsa; identical to SEQ ID NO: 163016

SEQ ID NO: 450544 - RNA, 64 nt, hsa; identical to SEQ ID NO: 163017

SEQ ID NO: 450545 - RNA, 64 nt, hsa; identical to SEQ ID NO: 163018

SEQ ID NO: 450546 - RNA, 64 nt, hsa; identical to SEQ ID NO: 163019

SEQ ID NO: 450547 - RNA, 64 nt, hsa; identical to SEQ ID NO: 163020

SEQ ID NO: 450548 - RNA, 64 nt, hsa; identical to SEQ ID NO: 163021

SEQ ID NO: 450549 - RNA, 64 nt, hsa; identical to SEQ ID NO: 163022

SEQ ID NO: 450550 - RNA, 64 nt, hsa; identical to SEQ ID NO: 163023

SEQ ID NO: 450551 - RNA, 64 nt, hsa; identical to SEQ ID NO: 163024

SEQ ID NO: 450552 - RNA, 64 nt, hsa; identical to SEQ ID NO: 163025

SEQ ID NO: 450553 - RNA, 64 nt, hsa; identical to SEQ ID NO: 163026

SEQ ID NO: 450554 - RNA, 64 nt, hsa; identical to SEQ ID NO: 163027

SEQ ID NO: 450555 - RNA, 64 nt, hsa; identical to SEQ ID NO: 163028

SEQ ID NO: 450556 - RNA, 64 nt, hsa; identical to SEQ ID NO: 163029

SEQ ID NO: 450557 - RNA, 64 nt, hsa; identical to SEQ ID NO: 163030

SEQ ID NO: 450558 - RNA, 64 nt, hsa; identical to SEQ ID NO: 163031

SEQ ID NO: 450559 - RNA, 64 nt, hsa; identical to SEQ ID NO: 163032

SEQ ID NO: 450560 - RNA, 64 nt, hsa; identical to SEQ ID NO: 163033

SEQ ID NO: 450561 - RNA, 64 nt, hsa; identical to SEQ ID NO: 163034

SEQ ID NO: 450562 - RNA, 64 nt, hsa; identical to SEQ ID NO: 163035

SEQ ID NO: 450563 - RNA, 64 nt, hsa; identical to SEQ ID NO: 163036

SEQ ID NO: 450564 - RNA, 64 nt, hsa; identical to SEQ ID NO: 163037

SEQ ID NO: 450565 - RNA, 64 nt, hsa; identical to SEQ ID NO: 163038

SEQ ID NO: 450566 - RNA, 64 nt, hsa; identical to SEQ ID NO: 163039

SEQ ID NO: 450567 - RNA, 64 nt, hsa; identical to SEQ ID NO: 163040

SEQ ID NO: 450568 - RNA, 64 nt, hsa; identical to SEQ ID NO: 163041

SEQ ID NO: 450569 - RNA, 64 nt, hsa; identical to SEQ ID NO: 163042

SEQ ID NO: 450570 - RNA, 64 nt, hsa; identical to SEQ ID NO: 163043

SEQ ID NO: 450571 - RNA, 64 nt, hsa; identical to SEQ ID NO: 163044

SEQ ID NO: 450572 - RNA, 64 nt, hsa; identical to SEQ ID NO: 163045

SEQ ID NO: 450573 - RNA, 64 nt, hsa; identical to SEQ ID NO: 163046

SEQ ID NO: 450574 - RNA, 64 nt, hsa; identical to SEQ ID NO: 162809

SEQ ID NO: 450575 - RNA, 64 nt, hsa; identical to SEQ ID NO: 163048

SEQ ID NO: 450576 - RNA, 64 nt, hsa; identical to SEQ ID NO: 163049

SEQ ID NO: 450577 - RNA, 64 nt, hsa; identical to SEQ ID NO: 163050

SEQ ID NO: 450578 - RNA, 64 nt, hsa; identical to SEQ ID NO: 163051

SEQ ID NO: 450579 - RNA, 64 nt, hsa; identical to SEQ ID NO: 163052

SEQ ID NO: 450580 - RNA, 64 nt, hsa; identical to SEQ ID NO: 163053

SEQ ID NO: 450581 - RNA, 64 nt, hsa; identical to SEQ ID NO: 163054

SEQ ID NO: 450582 - RNA, 64 nt, hsa; identical to SEQ ID NO: 163055

SEQ ID NO: 450583 - RNA, 64 nt, hsa; identical to SEQ ID NO: 163056

SEQ ID NO: 450584 - RNA, 64 nt, hsa; identical to SEQ ID NO: 163057

SEQ ID NO: 450585 - RNA, 64 nt, hsa; identical to SEQ ID NO: 163058

SEQ ID NO: 450586 - RNA, 64 nt, hsa; identical to SEQ ID NO: 163059

SEQ ID NO: 450587 - RNA, 64 nt, hsa; identical to SEQ ID NO: 163060

SEQ ID NO: 450588 - RNA, 64 nt, hsa; identical to SEQ ID NO: 163061

SEQ ID NO: 450589 - RNA, 64 nt, hsa; identical to SEQ ID NO: 163062

SEQ ID NO: 450590 - RNA, 64 nt, hsa; identical to SEQ ID NO: 163063

SEQ ID NO: 450591 - RNA, 64 nt, hsa; identical to SEQ ID NO: 163064

SEQ ID NO: 450592 - RNA, 64 nt, hsa; identical to SEQ ID NO: 163065

SEQ ID NO: 450593 - RNA, 64 nt, hsa; identical to SEQ ID NO: 163066

SEQ ID NO: 450594 - RNA, 64 nt, hsa; identical to SEQ ID NO: 163067

SEQ ID NO: 450595 - RNA, 64 nt, hsa; identical to SEQ ID NO: 163068

SEQ ID NO: 450596 - RNA, 64 nt, hsa; identical to SEQ ID NO: 163069

SEQ ID NO: 450597 - RNA, 64 nt, hsa; identical to SEQ ID NO: 163070

SEQ ID NO: 450598 - RNA, 64 nt, hsa; identical to SEQ ID NO: 163071

SEQ ID NO: 450599 - RNA, 64 nt, hsa; identical to SEQ ID NO: 163072

SEQ ID NO: 450600 - RNA, 64 nt, hsa; identical to SEQ ID NO: 163073

SEQ ID NO: 450601 - RNA, 64 nt, hsa; identical to SEQ ID NO: 163074

SEQ ID NO: 450602 - RNA, 64 nt, hsa; identical to SEQ ID NO: 163075

SEQ ID NO: 450603 - RNA, 64 nt, hsa; identical to SEQ ID NO: 163076

SEQ ID NO: 450604 - RNA, 64 nt, hsa; identical to SEQ ID NO: 163077

SEQ ID NO: 450605 - RNA, 64 nt, hsa; identical to SEQ ID NO: 163078

SEQ ID NO: 450606 - RNA, 64 nt, hsa; identical to SEQ ID NO: 163079

SEQ ID NO: 450607 - RNA, 64 nt, hsa; identical to SEQ ID NO: 163080

SEQ ID NO: 450608 - RNA, 64 nt, hsa; identical to SEQ ID NO: 163081

SEQ ID NO: 450609 - RNA, 64 nt, hsa; identical to SEQ ID NO: 163082

SEQ ID NO: 450610 - RNA, 64 nt, hsa; identical to SEQ ID NO: 163083

SEQ ID NO: 450611 - RNA, 64 nt, hsa; identical to SEQ ID NO: 163084

SEQ ID NO: 450612 - RNA, 64 nt, hsa; identical to SEQ ID NO: 163085

SEQ ID NO: 450613 - RNA, 64 nt, hsa; identical to SEQ ID NO: 163086

SEQ ID NO: 450614 - RNA, 64 nt, hsa; identical to SEQ ID NO: 163087

SEQ ID NO: 450615 - RNA, 64 nt, hsa; identical to SEQ ID NO: 163088

SEQ ID NO: 450616 - RNA, 64 nt, hsa; identical to SEQ ID NO: 163089

SEQ ID NO: 450617 - RNA, 64 nt, hsa; identical to SEQ ID NO: 163090

SEQ ID NO: 450618 - RNA, 64 nt, hsa; identical to SEQ ID NO: 163091

SEQ ID NO: 450619 - RNA, 64 nt, hsa; identical to SEQ ID NO: 163092

SEQ ID NO: 450620 - RNA, 64 nt, hsa; identical to SEQ ID NO: 163093

SEQ ID NO: 450621 - RNA, 64 nt, hsa; identical to SEQ ID NO: 163094

SEQ ID NO: 450622 - RNA, 64 nt, hsa; identical to SEQ ID NO: 163095

SEQ ID NO: 450623 - RNA, 64 nt, hsa; identical to SEQ ID NO: 163096

SEQ ID NO: 450624 - RNA, 64 nt, hsa; identical to SEQ ID NO: 163097

SEQ ID NO: 450625 - RNA, 64 nt, hsa; identical to SEQ ID NO: 163098

SEQ ID NO: 450626 - RNA, 64 nt, hsa; identical to SEQ ID NO: 163099

SEQ ID NO: 450627 - RNA, 64 nt, hsa; identical to SEQ ID NO: 163100

SEQ ID NO: 450628 - RNA, 64 nt, hsa; identical to SEQ ID NO: 163101

SEQ ID NO: 450629 - RNA, 64 nt, hsa; identical to SEQ ID NO: 163102

SEQ ID NO: 450630 - RNA, 64 nt, hsa; identical to SEQ ID NO: 163103

SEQ ID NO: 450631 - RNA, 64 nt, hsa; identical to SEQ ID NO: 163104

SEQ ID NO: 450632 - RNA, 64 nt, hsa; identical to SEQ ID NO: 163105

SEQ ID NO: 450633 - RNA, 64 nt, hsa; identical to SEQ ID NO: 163106

SEQ ID NO: 450634 - RNA, 64 nt, hsa; identical to SEQ ID NO: 163107

SEQ ID NO: 450635 - RNA, 64 nt, hsa; identical to SEQ ID NO: 163108

SEQ ID NO: 450636 - RNA, 64 nt, hsa; identical to SEQ ID NO: 163109

SEQ ID NO: 450637 - RNA, 64 nt, hsa; identical to SEQ ID NO: 163110

SEQ ID NO: 450638 - RNA, 64 nt, hsa; identical to SEQ ID NO: 163111

SEQ ID NO: 450639 - RNA, 64 nt, hsa; identical to SEQ ID NO: 163112

SEQ ID NO: 450640 - RNA, 64 nt, hsa; identical to SEQ ID NO: 163113

SEQ ID NO: 450641 - RNA, 64 nt, hsa; identical to SEQ ID NO: 163114

SEQ ID NO: 450642 - RNA, 64 nt, hsa; identical to SEQ ID NO: 163115

SEQ ID NO: 450643 - RNA, 64 nt, hsa; identical to SEQ ID NO: 163116

SEQ ID NO: 450644 - RNA, 64 nt, hsa; identical to SEQ ID NO: 163117

SEQ ID NO: 450645 - RNA, 64 nt, hsa; identical to SEQ ID NO: 163118

SEQ ID NO: 450646 - RNA, 64 nt, hsa; identical to SEQ ID NO: 163119

SEQ ID NO: 450647 - RNA, 64 nt, hsa; identical to SEQ ID NO: 163120

SEQ ID NO: 450648 - RNA, 64 nt, hsa; identical to SEQ ID NO: 163121

SEQ ID NO: 450649 - RNA, 64 nt, hsa; identical to SEQ ID NO: 163122

SEQ ID NO: 450650 - RNA, 64 nt, hsa; identical to SEQ ID NO: 163123

SEQ ID NO: 450651 - RNA, 64 nt, hsa; identical to SEQ ID NO: 163124

SEQ ID NO: 450652 - RNA, 64 nt, hsa; identical to SEQ ID NO: 163125

SEQ ID NO: 450653 - RNA, 64 nt, hsa; identical to SEQ ID NO: 163126

SEQ ID NO: 450654 - RNA, 64 nt, hsa; identical to SEQ ID NO: 163127

SEQ ID NO: 450655 - RNA, 64 nt, hsa; identical to SEQ ID NO: 163128

SEQ ID NO: 450656 - RNA, 64 nt, hsa; identical to SEQ ID NO: 163129

SEQ ID NO: 450657 - RNA, 64 nt, hsa; identical to SEQ ID NO: 163130

SEQ ID NO: 450658 - RNA, 64 nt, hsa; identical to SEQ ID NO: 163131

SEQ ID NO: 450659 - RNA, 64 nt, hsa; identical to SEQ ID NO: 163132

SEQ ID NO: 450660 - RNA, 64 nt, hsa; identical to SEQ ID NO: 163133

SEQ ID NO: 450661 - RNA, 64 nt, hsa; identical to SEQ ID NO: 163134

SEQ ID NO: 450662 - RNA, 64 nt, hsa; identical to SEQ ID NO: 163135

SEQ ID NO: 450663 - RNA, 64 nt, hsa; identical to SEQ ID NO: 163136

SEQ ID NO: 450664 - RNA, 64 nt, hsa; identical to SEQ ID NO: 163137

SEQ ID NO: 450665 - RNA, 64 nt, hsa; identical to SEQ ID NO: 163138

SEQ ID NO: 450666 - RNA, 64 nt, hsa; identical to SEQ ID NO: 163139

SEQ ID NO: 450667 - RNA, 64 nt, hsa; identical to SEQ ID NO: 163140

SEQ ID NO: 450668 - RNA, 64 nt, hsa; identical to SEQ ID NO: 163141

SEQ ID NO: 450669 - RNA, 64 nt, hsa; identical to SEQ ID NO: 163142

SEQ ID NO: 450670 - RNA, 64 nt, hsa; identical to SEQ ID NO: 163143

SEQ ID NO: 450671 - RNA, 64 nt, hsa; identical to SEQ ID NO: 163144

SEQ ID NO: 450672 - RNA, 64 nt, hsa; identical to SEQ ID NO: 163145

SEQ ID NO: 450673 - RNA, 64 nt, hsa; identical to SEQ ID NO: 163146

SEQ ID NO: 450674 - RNA, 64 nt, hsa; identical to SEQ ID NO: 163147

SEQ ID NO: 450675 - RNA, 64 nt, hsa; identical to SEQ ID NO: 163148

SEQ ID NO: 450676 - RNA, 64 nt, hsa; identical to SEQ ID NO: 163149

SEQ ID NO: 450677 - RNA, 64 nt, hsa; identical to SEQ ID NO: 163150

SEQ ID NO: 450678 - RNA, 64 nt, hsa; identical to SEQ ID NO: 163151

SEQ ID NO: 450679 - RNA, 64 nt, hsa; identical to SEQ ID NO: 163152

SEQ ID NO: 450680 - RNA, 64 nt, hsa; identical to SEQ ID NO: 163153

SEQ ID NO: 450681 - RNA, 64 nt, hsa; identical to SEQ ID NO: 163154

SEQ ID NO: 450682 - RNA, 64 nt, hsa; identical to SEQ ID NO: 163155

SEQ ID NO: 450683 - RNA, 64 nt, hsa; identical to SEQ ID NO: 163156

SEQ ID NO: 450684 - RNA, 64 nt, hsa; identical to SEQ ID NO: 163157

SEQ ID NO: 450685 - RNA, 64 nt, hsa; identical to SEQ ID NO: 163158

SEQ ID NO: 450686 - RNA, 64 nt, hsa; identical to SEQ ID NO: 163159

SEQ ID NO: 450687 - RNA, 64 nt, hsa; identical to SEQ ID NO: 163160

SEQ ID NO: 450688 - RNA, 64 nt, hsa; identical to SEQ ID NO: 163161

SEQ ID NO: 450689 - RNA, 64 nt, hsa; identical to SEQ ID NO: 163162

SEQ ID NO: 450690 - RNA, 64 nt, hsa; identical to SEQ ID NO: 163163

SEQ ID NO: 450691 - RNA, 64 nt, hsa; identical to SEQ ID NO: 163164

SEQ ID NO: 450692 - RNA, 64 nt, hsa; identical to SEQ ID NO: 163165

SEQ ID NO: 450693 - RNA, 64 nt, hsa; identical to SEQ ID NO: 163166

SEQ ID NO: 450694 - RNA, 64 nt, hsa; identical to SEQ ID NO: 162657

SEQ ID NO: 450695 - RNA, 64 nt, hsa; identical to SEQ ID NO: 163168

SEQ ID NO: 450696 - RNA, 64 nt, hsa; identical to SEQ ID NO: 163169

SEQ ID NO: 450697 - RNA, 64 nt, hsa; identical to SEQ ID NO: 163170

SEQ ID NO: 450698 - RNA, 64 nt, hsa; identical to SEQ ID NO: 163171

SEQ ID NO: 450699 - RNA, 64 nt, hsa; identical to SEQ ID NO: 163172

SEQ ID NO: 450700 - RNA, 64 nt, hsa; identical to SEQ ID NO: 163173

SEQ ID NO: 450701 - RNA, 64 nt, hsa; identical to SEQ ID NO: 163174

SEQ ID NO: 450702 - RNA, 64 nt, hsa; identical to SEQ ID NO: 163175

SEQ ID NO: 450703 - RNA, 64 nt, hsa; identical to SEQ ID NO: 163176

SEQ ID NO: 450704 - RNA, 64 nt, hsa; identical to SEQ ID NO: 163177

SEQ ID NO: 450705 - RNA, 64 nt, hsa; identical to SEQ ID NO: 163178

SEQ ID NO: 450706 - RNA, 64 nt, hsa; identical to SEQ ID NO: 163179

SEQ ID NO: 450707 - RNA, 64 nt, hsa; identical to SEQ ID NO: 163180

SEQ ID NO: 450708 - RNA, 64 nt, hsa; identical to SEQ ID NO: 163181

SEQ ID NO: 450709 - RNA, 64 nt, hsa; identical to SEQ ID NO: 163182

SEQ ID NO: 450710 - RNA, 64 nt, hsa; identical to SEQ ID NO: 163183

SEQ ID NO: 450711 - RNA, 64 nt, hsa; identical to SEQ ID NO: 163184

SEQ ID NO: 450712 - RNA, 64 nt, hsa
uuguaggagguaggauauuuuauauucugccgcaggauagaacccacgcaaggauuuucuuuaa

SEQ ID NO: 450713 - RNA, 64 nt, hsa
aaccuaaccacugggcaggcagaauuuguuugagggauagaacgacaacaaaauaaauguuccu

SEQ ID NO: 450714 - RNA, 64 nt, hsa
cauggaugauguuaaggauagaagccacucaguaggauagaagaaaagaaagauggaagaagga

SEQ ID NO: 450715 - RNA, 64 nt, hsa
uccagcagugaacuugggccauggaugauguuaaggauagaagccacucaguaggauagaagaa

SEQ ID NO: 450716 - RNA, 64 nt, hsa
auuuuucuuuaaaugauaucacagaauuaauguuggauagaaauaucauuggauagaaaucugu

SEQ ID NO: 450717 - RNA, 64 nt, hsa
uaucacagaauuaauguuggauagaaauaucauuggauagaaaucuguuugaaggaauuuuccu

SEQ ID NO: 450718 - RNA, 64 nt, hsa
ggaagguggcagaaagucucauuucaggaaggagggauagaaggaaggaaggaaggaacccccc

SEQ ID NO: 450719 - RNA, 64 nt, hsa
auucccaguuagggggugccuaacugagcaguagggauagaaggugugaaccugggagugcuuu

SEQ ID NO: 450720 - RNA, 64 nt, hsa
cucagguugcaaaauuagcuaauccuucagugccagcacucagaagucuggcaggugggggaau

SEQ ID NO: 450721 - RNA, 64 nt, hsa
cggggaaccugcuuccugccuucacugcccccgcagcacucacagacaucucccuggggucugg

SEQ ID NO: 450722 - RNA, 64 nt, hsa
ugugccugcucagcagagccucguuucugcuuucagcacucacucucccccuccucuucugguc

SEQ ID NO: 450723 - RNA, 52 nt, hsa
ccaaugaaacuucgcuuuaaucagcacucacgcaccggaguucugcccaugg

SEQ ID NO: 450724 - RNA, 64 nt, hsa
aaagacaaaauaaagguuaaagagggcauaaaggagcacucaauugcagagauuugaggacauu

SEQ ID NO: 450725 - RNA, 64 nt, hsa
gugaccuugguuacuuuuuuacccugaggggcucagcacucauuaggacuuggugccuaauuuu

SEQ ID NO: 450726 - RNA, 64 nt, hsa
uuuggaguguuuuccauuuuacaguuuauauuccagcacucaaaacucagggucaaguuuuaac

SEQ ID NO: 450727 - RNA, 64 nt, hsa
ugccaucugggcauacaaauaagaaguuugucacagcacucaggauuuuggguaucuuuuguag

SEQ ID NO: 450728 - RNA, 64 nt, hsa
acggccugucuucucguucaggccugccucugacagcacucaccaugaggacauuccauccuuc

SEQ ID NO: 450729 - RNA, 64 nt, hsa
gcuugugcucaaguccucuugcuguguuuucagaagcacucacauguucuuucuuuuccugagu

SEQ ID NO: 450730 - RNA, 63 nt, hsa
guaauaugcuaaccugaugcacugcugaaagaaaaugugaauuuuucguaauaauugcauuuu

SEQ ID NO: 450731 - RNA, 63 nt, hsa
cauuccugcaaagcuugcuuuggggaguuggauaaugugaaaauuuuaaguaccuaggggaga

SEQ ID NO: 450732 - RNA, 63 nt, hsa
caaguuuauguaguacuuaauguacaugauaugaaugugaagcauaaaauuaaauaaaauuuu

SEQ ID NO: 450733 - RNA, 63 nt, hsa
aaagggaacauaauuuguuuaggcucccacauaaaugugaaucuggccaacaacuuugguuca

SEQ ID NO: 450734 - RNA, 63 nt, hsa
ucuguuauuauacuuaaucuucuaaacuaaacuaaugugaacaguagggaagcaagggcccaa

SEQ ID NO: 450735 - RNA, 63 nt, hsa
agcuguauuccuaaacaaauuguuuccuaaacaaaugugaaaaugugaacagugcugaaaggu

SEQ ID NO: 450736 - RNA, 63 nt, hsa
uccuaaacaaauuguuuccuaaacaaaugugaaaaugugaacagugcugaaagguuuugugaa

SEQ ID NO: 450737 - RNA, 63 nt, hsa
aauuauaauuaguuccucauuagcauuuugcuaaaugugaaugaugauccuaggcauuugcug

SEQ ID NO: 450738 - RNA, 63 nt, hsa
uggguaacuagggaagauaauauuaaggaagacaaugugaaaagaaaaaugagccuggcaaga

SEQ ID NO: 450739 - RNA, 63 nt, hsa
cuaguuuaaaaaauuauaaaugaaucuaaucaaaaugugaauaguagucaaaaggauaauuua

SEQ ID NO: 450740 - RNA, 63 nt, hsa
guugaauugaaugucuauaaggucuaaagguagaaugugaauauugccacagaguucauugcu

SEQ ID NO: 450741 - RNA, 63 nt, hsa
uagaaacauagacucccaaguuuuaaacaccuaaaugugaauaacccauauauacaacaaagu

SEQ ID NO: 450742 - RNA, 63 nt, hsa
ugagauauaaaaguaggaaacagguauaauuuuaaugugaaaauuaagucuucacuuucugug

SEQ ID NO: 450743 - RNA, 63 nt, hsa
gugaaaaguccaucuugcugauuugaugauugaaaugugaaagugaaguggaaggaaugaaug

SEQ ID NO: 450744 - RNA, 63 nt, hsa
uguaggucaaaucaaauuaaagaugauuuuuuuaaugugaauaaaguuauguucugauaguuu

SEQ ID NO: 450745 - RNA, 63 nt, hsa
uaguucucuuaucuuugaucguauauuucucauaaugugaaauaugaugagauucacuuaggg

SEQ ID NO: 450746 - RNA, 63 nt, hsa
ccagccauuuuuuuaguuaguaaaaauccuauuaaugugaaccagccaggaauaacaguguua

SEQ ID NO: 450747 - RNA, 63 nt, hsa
aacuaauagaucaccuuagaaaauuaugcaauuaaugugaaaauaauugauguuugcaaugug

SEQ ID NO: 450748 - RNA, 63 nt, hsa
uuguuacaugauuuuuuaaaaaaaggaaaagaaaaugugaaacacaauuuaguccucauuauu

SEQ ID NO: 450749 - RNA, 63 nt, hsa
aaauugcuuuagcuucuggucagcacugauuaaaaugugaauagugaaguggcuauccuaaac

SEQ ID NO: 450750 - RNA, 63 nt, hsa
auaagccugccgccaaaauaaaucacuuaucaaaaugugaacuguuuuccucauguucaguua

SEQ ID NO: 450751 - RNA, 63 nt, hsa
gcuaauuuaugagaaaauguaauaauugcaaugaaugugaauuauacagacaggcaaacauuu

SEQ ID NO: 450752 - RNA, 63 nt, hsa
cacuuguacccgaucauaauaaaaauggauaauaaugugaaggaagaaaagagccgcuugaau

SEQ ID NO: 450753 - RNA, 63 nt, hsa
augagaaaauuuauacuguagagaaacccuggaaaugugaagaacguggcaaaguucuuuacc

SEQ ID NO: 450754 - RNA, 63 nt, hsa
auaagagaauucauaccggagagaaacuguacaaaugugaagaauauggcaaagccugugaau

SEQ ID NO: 450755 - RNA, 63 nt, hsa
aagauaauucauucuggggaaaaaaaugcuacaaaugugaaaaacguggcagagccuucagac

SEQ ID NO: 450756 - RNA, 63 nt, hsa
uaaugagaacucauacuggaggaaagucuuacaaaugugaagaauguggcagucuuuaaaucu

SEQ ID NO: 450757 - RNA, 63 nt, hsa
uauuguaagacuuuugagaauauacuugauuaaaaugugaaagaagggauuguuaacuuauug

SEQ ID NO: 450758 - RNA, 63 nt, hsa
uauauaauguuaauuuauugacuaguuugaaauaaugugaaguguuuuuuauaucagauuaau

SEQ ID NO: 450759 - RNA, 63 nt, hsa
uuucacuuuuggcgacuagaaacaauuccaguaaaugugaaucucgacaaaucgaggacugaa

SEQ ID NO: 450760 - RNA, 63 nt, hsa
gaacgagcgaacaacugagcccaagccggugagaaugugaaacaguuucucaaaggaaagaau

SEQ ID NO: 450761 - RNA, 63 nt, hsa
caguucucucacaccaagggccccauaguuauaaaugugaaauuauauuccaggucaaaauuu

SEQ ID NO: 450762 - RNA, 63 nt, hsa
uuaaauuuaaaaugcagagagaccaaugguuaaaaugugaauaguauuguaacuauuuuaagg

SEQ ID NO: 450763 - RNA, 63 nt, hsa
gggaugaaaauaaugggaguauaauacccauuuaaugugaaaaacauaagagucuuaaaagaa

SEQ ID NO: 450764 - RNA, 63 nt, hsa
aguacgcucuaugcauaguaugacuucuauuuuaaugugaagaauuuuuugucucucuccuga

SEQ ID NO: 450765 - RNA, 63 nt, hsa
gacaccacuaaagaaacgaucagacagaucuggaaugugaagcguuauagaagauaacuggcc

SEQ ID NO: 450766 - RNA, 63 nt, hsa
uucuugauuaaaaguuauguaauaaccaaaugcaaugugaaauauuuuacuggacucuauuuu

SEQ ID NO: 450767 - RNA, 63 nt, hsa; identical to SEQ ID NO: 450765

SEQ ID NO: 450768 - RNA, 63 nt, hsa; identical to SEQ ID NO: 450766

SEQ ID NO: 450769 - RNA, 63 nt, hsa
cuaggaaagauuuacacaauagauaaucaucuuaaugugaaagauauuugaaguauuaauuuu

SEQ ID NO: 450770 - RNA, 63 nt, hsa
uacauacucauucccaaagcaauccaaaaacaaaaugugaaccauuuggguuucaaauguuaa

SEQ ID NO: 450771 - RNA, 63 nt, hsa
acuuuggucauucugcuguguucauuaggugccaaugugaagucuggauuuuaauuggcaugu

SEQ ID NO: 450772 - RNA, 63 nt, hsa
auuucagucuaggaaagauuuuccuucucuuggaaugugaagaucugucgauucaucuccaau

SEQ ID NO: 450773 - RNA, 63 nt, hsa
uggugaauaaguuauaaauucccacagaagaaaaaugugaaagacugggugcuagacaagaag

SEQ ID NO: 450774 - RNA, 63 nt, hsa
ccuuuucuuuagucccaaccacuaguuuuaacaaaugugaauuauugaaaugugaagggacaa

SEQ ID NO: 450775 - RNA, 63 nt, hsa
caaccacuaguuuuaacaaaugugaauuauugaaaugugaagggacaaaaagaaucauacauu

SEQ ID NO: 450776 - RNA, 63 nt, hsa
guugaaugacugacccaaaaugugaaugaagcuaaugugaaugugagugaagcucccuucagg

SEQ ID NO: 450777 - RNA, 63 nt, hsa
auuugacacacaguuguugaaugacugacccaaaaugugaaugaagcuaaugugaaugugagu

SEQ ID NO: 450778 - RNA, 63 nt, hsa
ucuguauuaucaauuucucauagacacugugcuaaugugaauuuuaaaugaccugcaucaagu

SEQ ID NO: 450779 - RNA, 63 nt, hsa
uucauuuucuguauuauauaugaaaaguaaauuaaugugaaaccuggcccagcuugcuggaaa

SEQ ID NO: 450780 - RNA, 63 nt, hsa
acauaggaaaauucauacuggagagaaacuacaaaugugaagaauguguuaaagccuuuaaca

SEQ ID NO: 450781 - RNA, 63 nt, hsa
guugagaaaauucguacuggagagaauccuacaaaugugaaaaauguggcaaauccuuuaacu

SEQ ID NO: 450782 - RNA, 63 nt, hsa
auaagaaaauucauacuggaaagaaacccuacaaaugugaagucuguggcaaagcuuuuaacu

SEQ ID NO: 450783 - RNA, 63 nt, hsa
uaagacaguuuauacuuugagagaaacccugcaaaugugaauaauguggcaauacuuuaaacc

SEQ ID NO: 450784 - RNA, 63 nt, hsa
cuaacauaaaucauacuggugaaaaauccuagaaaugugaaaaauaucacaaagccuuuaaau

SEQ ID NO: 450785 - RNA, 63 nt, hsa
auaagaaaauuuacacuagagagaaagccuacaaaugugaagaauguggcaaagccuuuaacc

SEQ ID NO: 450786 - RNA, 63 nt, hsa
auaagauaauucauagcggagagaaaccccacaaaugugaagaauguggcagagcuuuuaacc

SEQ ID NO: 450787 - RNA, 63 nt, hsa
auaagauaauucacaguggagaaaaacccuacaaaugugaagaauguggcaaagcuuuuaacc

SEQ ID NO: 450788 - RNA, 63 nt, hsa
auaagaaaauucauaguaaagagaaacccuacaaaugugaacaguguggcaaggucuuuaaga

SEQ ID NO: 450789 - RNA, 63 nt, hsa
acaagaagauucauacuagagagaaacccuacaaaugugaagaauguggcauaucuuuuaacc

SEQ ID NO: 450790 - RNA, 63 nt, hsa
auaagaugauucacacuugaaugaaacccuacaaaugugaacgauguggcaguuguuuuaacu

SEQ ID NO: 450791 - RNA, 63 nt, hsa
auaagaaaauucaaacuggagagaaacucuacaaaugugaagaauguggcaaagcuuuuaacc

SEQ ID NO: 450792 - RNA, 63 nt, hsa
caccuaaaauucaugcaggagagaaacaccacaaaugugaaaaauuugguaaauucuuuaaca

SEQ ID NO: 450793 - RNA, 63 nt, hsa
uccauacuagagagaagcccuacaaauguaaagaaugugaaaagucuuucagucagagcucaa

SEQ ID NO: 450794 - RNA, 63 nt, hsa
auaaaagaauacacacuagagaaaaaccuuacaaaugugaagcaucugauaaauccugugaag

SEQ ID NO: 450795 - RNA, 63 nt, hsa
uucacaugggaauaaaauuccauugcugcaaugaaugugaaaaagccaucagucaaagaaacu

SEQ ID NO: 450796 - RNA, 63 nt, hsa
acuguuugagaaugaugcuacucugaucuaaugaaugugaacauguagauguuuuguguguau

SEQ ID NO: 450797 - RNA, 63 nt, hsa
acacacuuguauauacauucuugagaacacugcaaugugaaaaucacguuugcuauuuauaaa

SEQ ID NO: 450798 - RNA, 63 nt, hsa
agaaaacacugacuuuguuuuuauaaguuauuaaaugugaaauugaucugcaucagcuuauuu

SEQ ID NO: 450799 - RNA, 63 nt, hsa
gaaaacauuuguaaggcugcaacauaauauuaaaaugugaauaaauaaauguucugauaaaau

SEQ ID NO: 450800 - RNA, 63 nt, hsa
cuuuaaugaaagguggaaaauaauuuaacuuacaaugugaaaauacaaugugaaauguacaau

SEQ ID NO: 450801 - RNA, 63 nt, hsa
uggaaaauaauuuaacuuacaaugugaaaauacaaugugaaauguacaauaaaucauauuuau

SEQ ID NO: 450802 - RNA, 63 nt, hsa
uauaugccacuaauaaaaugaaucuaaacauugaaugugaauggcccucagaaaaucaucuag

SEQ ID NO: 450803 - RNA, 63 nt, hsa
gucauauacuauugauccuuuggcacuuaaauaaaugugaaauccuccaggaauuuuccugug

SEQ ID NO: 450804 - RNA, 63 nt, hsa
gaaaauguguuuacuucagaacggcacuacauaaaugugaaaaguuguugaucuugaaauauc

SEQ ID NO: 450805 - RNA, 63 nt, hsa
uugacuuuaaugaaucuuugguguggaaugaaaaaugugaacuucuuacucauagugugguuu

SEQ ID NO: 450806 - RNA, 63 nt, hsa
acggaaaauuuacaagcaaccuagagguccagcaaugugaaaagaaucaaguaauucugcuua

SEQ ID NO: 450807 - RNA, 63 nt, hsa
gaauuuacugguauacuaagugauuuaaauuugaaugugaaauacugauaggcuuuuaagcuu

SEQ ID NO: 450808 - RNA, 63 nt, hsa
aauuugccagacagagaucagaauugaaccgucaaugugaaauaaagaguucuccuuguacuu

SEQ ID NO: 450809 - RNA, 63 nt, hsa
uauguaaacaucauaaauaguaaauaaugauucaaugugaauuuuaaaaugcaaauauugcua

SEQ ID NO: 450810 - RNA, 63 nt, hsa
gcgagccacggcagcccccuguaucuggauuguaaugugaaucuuuaggguaauuccuccagu

SEQ ID NO: 450811 - RNA, 63 nt, hsa
ccaaacaggauuaacugugaagacuaauuuauaaaugugaaccuaagaaaacuccaccucuga

SEQ ID NO: 450812 - RNA, 63 nt, hsa
ugcauuaagaaaauaaaauuucuauauaccaaaaaugugaaguuauaccaaauaaaguuucua

SEQ ID NO: 450813 - RNA, 63 nt, hsa
uuuacugcauaugaggcuuucuguuaauuuuuuaaugugaauaauuuauauauugcacauucu

SEQ ID NO: 450814 - RNA, 63 nt, hsa
ugggaacaaaccucacuugagcugugccuagacaaugugaauuccuguguugcuaacagaagu

SEQ ID NO: 450815 - RNA, 63 nt, hsa
acauuucuggaacauggauuuguguucaccuuaaaugugaaaauaaauccuauuuucuaugga

SEQ ID NO: 450816 - RNA, 63 nt, hsa
auaugauuuuuaagagauuuauguucuacuuaaaaugugaauuguacuucugagcugccuuaa

SEQ ID NO: 450817 - RNA, 63 nt, hsa
gcugugcacuugccuuguugcugaaguuccaauaaugugaaaaccaaaguagagguuuuuuuc

SEQ ID NO: 450818 - RNA, 63 nt, hsa
aacguuacaaucauuuuuaggguuauuguaaucaaugugaauaucauguuuuuucaaaucugu

SEQ ID NO: 450819 - RNA, 63 nt, hsa
gaaacucucaagggaaggugaugcaggggagaaaaugugaauuaaauuacauagauggguguu

SEQ ID NO: 450820 - RNA, 63 nt, hsa
ucauuaacaguuuguccuuaggaugcaaaugaaaaugugaauacauaccuuguuguacuguug

SEQ ID NO: 450821 - RNA, 63 nt, hsa
uuaaucauaagccuuaauaagauuuuucuaagaaaugugaaauagaacaauuuucaucuaauu

SEQ ID NO: 450822 - RNA, 63 nt, hsa
gagcuaguuuacaggcuuacugugauuuaagcaaaugugaaaagugaaaccuuaauuuuauca

SEQ ID NO: 450823 - RNA, 63 nt, hsa
ggguuuccugaaacuggguuaauucuuuauagaaaugugaacacugaauuuauuuuaaaaaau

SEQ ID NO: 450824 - RNA, 63 nt, hsa
ccuggugucuccugcccacccuggucccagguaaaugugaauggagacagguaugagaggcug

SEQ ID NO: 450825 - RNA, 63 nt, hsa
ggugauaacugccucguuuaaauggucacaagaaaugugaagagagagcuagggcagacaugc

SEQ ID NO: 450826 - RNA, 63 nt, hsa
auauuauuuggcuagaaauugcuguuuuuaauaaaugugaauuuuuuaaaaauaaagauuuuu

SEQ ID NO: 450827 - RNA, 63 nt, hsa
auuucuguuagcugauugugguaaacaauguuuaaugugaaaagaaauuaaaacuuucuucau

SEQ ID NO: 450828 - RNA, 63 nt, hsa
guuaaauauuuauaugcuuuguugacuagcugaaaugugaauucuguuaguguugacuaaaga

SEQ ID NO: 450829 - RNA, 63 nt, hsa
ucauuuuuugaagcuuucuacauauagugucugaaugugaagucuuacucaacuugcuuuuuu

SEQ ID NO: 450830 - RNA, 63 nt, hsa
aaaagaauaaguauucuugcaucuggccuuagaaaugugaaguuauauucucaaguuuauuuu

SEQ ID NO: 450831 - RNA, 63 nt, hsa
uuuuuuuggguaacaaucccgcagcugacaaaaaaugugaaauuuccacaaaauauccaacuu

SEQ ID NO: 450832 - RNA, 63 nt, hsa
uagccagaaagcaaaaaaacaauaguaaugauaaaugugaacauuuuugcuuauucauugaau

SEQ ID NO: 450833 - RNA, 63 nt, hsa
gaauaagagcuuuuuuguuucuuggguuuuuaaaaugugaaucugcaaugaucauaaaaauua

SEQ ID NO: 450834 - RNA, 63 nt, hsa
aaaaugugaaucugcaaugaucauaaaaauuaaaaugugaaugucaacaauaaaaagcaagac

SEQ ID NO: 450835 - RNA, 63 nt, hsa
uguagacugccauuauguguggucuucccauuaaaugugaacauuuuaauauguaugcauuca

SEQ ID NO: 450836 - RNA, 63 nt, hsa
ccacuccugcuuuccuaaggaugaaacagugauaaugugaacucaaaugagguuuccugggua

SEQ ID NO: 450837 - RNA, 63 nt, hsa
cauguugcagaagaccagaucauuuuuauacagaaugugaaauacugauacaguuauucuuuu

SEQ ID NO: 450838 - RNA, 63 nt, hsa
aaacccuguuugcaccucgauuuguuugcugaaaaugugaaauaguaaaaaugaaauaacugg

SEQ ID NO: 450839 - RNA, 63 nt, hsa
uauuuauuugacaaaaaauccaguuaauauauuaaugugaaauaaacccuguuugcaccucga

SEQ ID NO: 450840 - RNA, 63 nt, hsa
auaagauaauuaaugcuggagagaaacccuacaaaugugaagaauguggcaaagauuucuauu

SEQ ID NO: 450841 - RNA, 63 nt, hsa
auaaaauaauucauaaaggagauaaauuauacaaaugugaagaauguggcaaagcuuuuaaca

SEQ ID NO: 450842 - RNA, 63 nt, hsa
auaagauaauuuauacuggagagaagcccuacaaaugugaaaaauguggcaaaccuuuuaacc

SEQ ID NO: 450843 - RNA, 63 nt, hsa
auuagauaauucaugcuggagagaaacccuacaaaugugaaaaauguggcaaagcuuuuaacc

SEQ ID NO: 450844 - RNA, 63 nt, hsa
auaagauaacucauacuggagaaaaaucuuacaaaugugaagaauguggcaaagccuuuaucc

SEQ ID NO: 450845 - RNA, 63 nt, hsa
acaaaauaauucauacaggagagaaacccuacaaaugugaagaaugugacaaagccuuuaacc

SEQ ID NO: 450846 - RNA, 63 nt, hsa
uaaacauaauucauaauggagaaaaacccuacaaaugugaagaaugugucaaagcuuuuaacu

SEQ ID NO: 450847 - RNA, 63 nt, hsa
acauaagggaauucauaauagagaaacccuacaaaugugaagaacguggccuggcuuuuaaca

SEQ ID NO: 450848 - RNA, 63 nt, hsa
uuaaagaaaaucauucugcugaaaaauccuagaaaugugaagaaugugaaaaagccuuuaaau

SEQ ID NO: 450849 - RNA, 63 nt, hsa
aucauucugcugaaaaauccuagaaaugugaagaaugugaaaaagccuuuaaaugauugucac

SEQ ID NO: 450850 - RNA, 63 nt, hsa
auaaaagaaaucauaugaaugagaaauccuagaaaugugaagaaugugacaaagccuuuaaau

SEQ ID NO: 450851 - RNA, 63 nt, hsa
auaagggaauuuauacaggagggaaacccuacaaaugugaagaauguggcaagccuuuuagcu

SEQ ID NO: 450852 - RNA, 63 nt, hsa
uaaaagaauucauacuggaggaaaagcccuacaaaugugaaaaacguggcaaagcuuuucauu

SEQ ID NO: 450853 - RNA, 51 nt, hsa; identical to SEQ ID NO: 250138

SEQ ID NO: 450854 - RNA, 63 nt, hsa
uguauccuguuagcuccauucucagggcguuugaaugugaauuaggaccagcgcaaugaaugc

SEQ ID NO: 450855 - RNA, 63 nt, hsa
uguauucucaguaguuccgauauguacccucgaaaugugaauguuaucuuaugagacucuguu

SEQ ID NO: 450856 - RNA, 63 nt, hsa
ggauggggccuggaaaggcaacuuuuccugauuaaugugaaaaauaauuccuauggacacucc

SEQ ID NO: 450857 - RNA, 63 nt, hsa
gaaaauauuuccugacuugaguguuccuuuuuaaaugugaauuuuuauuucuuuuuaauuauu

SEQ ID NO: 450858 - RNA, 63 nt, hsa
aaaaauggaaaaaaacauaaaaagcagaauuuuaaugugaagacauuuuuugcuauaaucauu

SEQ ID NO: 450859 - RNA, 63 nt, hsa
ucguguccuccuuauuuaaaaagguauacuuacaaugugaaguaacuuaugaauaaaaggaaa

SEQ ID NO: 450860 - RNA, 63 nt, hsa
auucuugagaaaaagauaaaggguuauaauuugaaugugaacugauccagaaauaagugcugu

SEQ ID NO: 450861 - RNA, 63 nt, hsa
aaauaagaugguguguauguaagaaauuuguaaaaugugaagagcuaucuacacuaaguucgu

SEQ ID NO: 450862 - RNA, 63 nt, hsa
ggggggacuaugagaucaaaauauuuuuauuauaaugugaagacauugucuuuucacucuauc

SEQ ID NO: 450863 - RNA, 63 nt, hsa
ucagaaaugacuuggccucauuuuggauuucauaaugugaaguauucaugauuuugaacuggu

SEQ ID NO: 450864 - RNA, 63 nt, hsa
accauggcaguaauggggcaaacaauaaaaugcaaugugaaaugauuugaugauuugggaaau

SEQ ID NO: 450865 - RNA, 63 nt, hsa
uuuuuuacaucuacguuguugcuuucuaaaaugaaugugaaugccaucuuuuaugacugcaac

SEQ ID NO: 450866 - RNA, 63 nt, hsa
guuuagccuucuaauuaguucacuugaaacauaaaugugaaaugucuucauucaauguuaaac

SEQ ID NO: 450867 - RNA, 64 nt, hsa
uuuuaaagcuaaacaauggagaaggguuugagaagaacccaacaaugugggagugcuacagcag

SEQ ID NO: 450868 - RNA, 64 nt, hsa
cagcagucuacaggcuggaagaaggcccucaccagaacccaacccuuggacuucagccuccaga

SEQ ID NO: 450869 - RNA, 64 nt, hsa
ccccauagauaggccccuggggcucccgaagaaugaacccaagagcaagggcuugauggugaca

SEQ ID NO: 450870 - RNA, 64 nt, hsa
uccagagaaacccagggaggaagacuguaaauacgaacccaaucugcacacuccaggccucuag

SEQ ID NO: 450871 - RNA, 64 nt, hsa
acccagcccagaucggaggacaaguuccucucuagaacccaauccaauuuggagccccagccca

SEQ ID NO: 450872 - RNA, 64 nt, hsa
acccaauccaauuuggagccccagcccaacuccagaacccaacccuucucuagaauccagccca

SEQ ID NO: 450873 - RNA, 64 nt, hsa
uuuauuuaaaauuuuuuugccaauggugccaaguaaugugaaugcuaauacugcuuaagaaaau

SEQ ID NO: 450874 - RNA, 64 nt, hsa
guguucucuucuguuacugauauguaaguguggcaaugugaacugaagcugaugggcugagaac

SEQ ID NO: 450875 - RNA, 64 nt, hsa
cuggccagagccaagaaacacuuucagaaaaacaaaugugaaggggagagacaggggccgcccu

SEQ ID NO: 450876 - RNA, 64 nt, hsa; identical to SEQ ID NO: 250015

SEQ ID NO: 450877 - RNA, 64 nt, hsa; identical to SEQ ID NO: 250016

SEQ ID NO: 450878 - RNA, 64 nt, hsa; identical to SEQ ID NO: 250017

SEQ ID NO: 450879 - RNA, 64 nt, hsa
gaacuccugauguuuuuucuacaaaaguccauaaaaugugaaaacuggagaagaucuuagaggu

SEQ ID NO: 450880 - RNA, 64 nt, hsa
gucggcuugugaaaaguuguuaaacaacaugcuaaaugugaaaugucaacccucacucuaaacu

SEQ ID NO: 450881 - RNA, 64 nt, hsa; identical to SEQ ID NO: 250018

SEQ ID NO: 450882 - RNA, 64 nt, hsa; identical to SEQ ID NO: 250019

SEQ ID NO: 450883 - RNA, 64 nt, hsa
gauuucauuaccuccuacuugccauucacccaucaaugugaaagucagggucacagcuggucug

SEQ ID NO: 450884 - RNA, 64 nt, hsa
uuuacuuucuuccuugccuaugcagggcaaacaaaaugugaaauucugcccucagcugagcuga

SEQ ID NO: 450885 - RNA, 64 nt, hsa; identical to SEQ ID NO: 250020

SEQ ID NO: 450886 - RNA, 64 nt, hsa; identical to SEQ ID NO: 250021

SEQ ID NO: 450887 - RNA, 64 nt, hsa
uuaaaguucauuauuuauuuuaccuuuuacugacaaugugaaacucgaagaaaauguucucuuu

SEQ ID NO: 450888 - RNA, 64 nt, hsa
cuguuaacauauguucggacugcuucccuucaccaaugugaacaacuuuuuuucccaaacagug

SEQ ID NO: 450889 - RNA, 64 nt, hsa
caguguaaaguuuaacacgguuugacaguaaauaaaugugaauuuuuucaaguaguuaacaugu

SEQ ID NO: 450890 - RNA, 64 nt, hsa
aaauuagaguaccaacuuaauguuuuucucgaagaaugugaaaauaauuagaccuguuaaauua

SEQ ID NO: 450891 - RNA, 64 nt, hsa
uuguuuuguuuuguuuuucucuuucacucagccaaaugugaaaguugugaauuuaggaaaauca

SEQ ID NO: 450892 - RNA, 64 nt, hsa
uugcaauuugaaauauauucugguuguuuuucuaaaugugaagacuuaccaaaugaauuuuaga

SEQ ID NO: 450893 - RNA, 64 nt, hsa
caacuuuccaggaagaaaagagggcaaagggaacaaugugaaaagaagcagaaaaucauaaaag

SEQ ID NO: 450894 - RNA, 64 nt, hsa; identical to SEQ ID NO: 250022

SEQ ID NO: 450895 - RNA, 64 nt, hsa; identical to SEQ ID NO: 250023

SEQ ID NO: 450896 - RNA, 64 nt, hsa
agaagcugaggauccucacaggagcagacagagaaaugugaagggugggguuuuauguguggga

SEQ ID NO: 450897 - RNA, 64 nt, hsa
aagagacuugccuuuuaaggaucgaaaguacgccaaugugaauuuccauuauuuucaauggaag

SEQ ID NO: 450898 - RNA, 64 nt, hsa
aggcuuuggaaauuuaauguuaguugaaauguaaaaugugaaaacuuuagaucauuuguaguaa

SEQ ID NO: 450899 - RNA, 64 nt, hsa
gugguuucuauauuuugagauguuuuuuccuuacaaugugaacucaucgugaucuuggaaauca

SEQ ID NO: 450900 - RNA, 64 nt, hsa; identical to SEQ ID NO: 250024

SEQ ID NO: 450901 - RNA, 64 nt, hsa; identical to SEQ ID NO: 250025

SEQ ID NO: 450902 - RNA, 64 nt, hsa
aaggauacaguuuguuuuuagauguccuuuguccaaugugaacauuuauucauauuguuuugau

SEQ ID NO: 450903 - RNA, 64 nt, hsa
uuuuuggugccuuacuuuuaucuuaauuuuugccaaugugaaaauuaaggauaaaucagaguua

SEQ ID NO: 450904 - RNA, 64 nt, hsa
ugaauuuuggguuaaagguuuuggcugcuguaagaaugugaauuugaauguauuuugaauugua

SEQ ID NO: 450905 - RNA, 64 nt, hsa
uuuuugcugguuaaccuuuaucauuuaucuuuguaaugugaacaugcuucagaguguaccuuuu

SEQ ID NO: 450906 - RNA, 64 nt, hsa
cuaauucccuuuuucuaaggcacagagcugguaaaaugugaaguaauagugaaccuaacaguca

SEQ ID NO: 450907 - RNA, 64 nt, hsa
cuccggauguugaaacaaccacaggucaagaaggaaugugaaucuguuguuuuauaagaguuua

SEQ ID NO: 450908 - RNA, 64 nt, hsa
auuaggaggaucuagggacagaaggaaagugaaaaaugugaaaauacaaaauacccaagauuua

SEQ ID NO: 450909 - RNA, 64 nt, hsa
ugcagcuucagcaguguugaacuguguguuuaaaaaugugaauuacuguuauuguauacuguaa

SEQ ID NO: 450910 - RNA, 64 nt, hsa
ccaugcaguguugcgguggcacugaagaagugugaaugugaaggcggcgucggcgcggggccag

SEQ ID NO: 450911 - RNA, 64 nt, hsa
agcucuggugcuuuaguuaggucauuuuuuuagaaaugugaagaggucugauuggcugcuuaaa

SEQ ID NO: 450912 - RNA, 64 nt, hsa
uugugccauuuagagggaacucuugguaccuggaaaugugaaucuggaauauuaccugugucau

SEQ ID NO: 450913 - RNA, 64 nt, hsa
caaguauuaggcuuugggguggggggaggucuguaaugugaaacaacuucuugucuuuuuuucu

SEQ ID NO: 450914 - RNA, 63 nt, hsa
gccgugaugcucaggcuugaaaugcauuauuuugaaugugaaguaaauacuguaccuuuauug

SEQ ID NO: 450915 - RNA, 64 nt, hsa
accaccuucccugacucagaacccacauccacucaaugugaacucuacuaccacgaccucccca

SEQ ID NO: 450916 - RNA, 64 nt, hsa
agacugcuuguuuugcacaagaagugauuuugugaaugugaaguggagaggccgagcagcagcc

SEQ ID NO: 450917 - RNA, 64 nt, hsa
uguuugggguuacuucuuuguuucuaaguauaagaaugugaagaauauuugaaaacucaaugaa

SEQ ID NO: 450918 - RNA, 64 nt, hsa
ucuccaccagccccucacaggcuuggggguuuucaaugugaaacacaugccaguuuuuaaaaug

SEQ ID NO: 450919 - RNA, 64 nt, hsa; identical to SEQ ID NO: 250026

SEQ ID NO: 450920 - RNA, 64 nt, hsa; identical to SEQ ID NO: 250027

SEQ ID NO: 450921 - RNA, 64 nt, hsa
ucaauaaccaggugugagcuacaggucucuguguaaugugaagcucucccguauuucauuucug

SEQ ID NO: 450922 - RNA, 64 nt, hsa
cuuuaauuuggauccuuuggguuuggagaaagggaaugugaaagcugucauuacagacaacagg

SEQ ID NO: 450923 - RNA, 64 nt, hsa
uaucuaaaugggauuuugaguucuccagcuauagaaugugaaugagauaaaaagugaacuaucu

SEQ ID NO: 450924 - RNA, 64 nt, hsa
aggccauuuccuguccuggaauuaguuuuucuaaaaugugaauaaacuuguuuuauaaaaagca

SEQ ID NO: 450925 - RNA, 64 nt, hsa
gaaauugauuugcugaauuuuucugcuaguucaaaaugugaauuaggaccuggucaguuugaaa

SEQ ID NO: 450926 - RNA, 64 nt, hsa
ggauuagauaauagauggggucaaauucugugugaaugugaacuugccuaguaagcacuuuguc

SEQ ID NO: 450927 - RNA, 64 nt, hsa
aaugugugaggcaaacuaugcaugggaauagcuuaaugugaagauaaucauuuggacaacucaa

SEQ ID NO: 450928 - RNA, 64 nt, hsa
gauuugcauuaaaauauagaagucuuuuaaaguaaaugugaaccuugucuaaguacuguaaucc

SEQ ID NO: 450929 - RNA, 64 nt, hsa
cuuuccccuccacuugcugccaagaucauauucuaaugugaaaugucauagguguucaaaagcg

SEQ ID NO: 450930 - RNA, 64 nt, hsa
uaugggggaaaauuauuuugacaugacgugguaaaaugugaaaaacuaaugugucucaggcuca

SEQ ID NO: 450931 - RNA, 64 nt, hsa
ucaauaauucuacagaaauaaaacuguaaagugcaaugugaaaucaaagauuauagucauugua

SEQ ID NO: 450932 - RNA, 64 nt, hsa
uguuuuaggaaaagugaaucuugcuguuuucaauaaugugaaugcuauguucugggaaaaucca

SEQ ID NO: 450933 - RNA, 64 nt, hsa
agucuucucaaguuucaagcaagaccauuuacuuaaugugaaguuuuggaaaguuauaaaggug

SEQ ID NO: 450934 - RNA, 64 nt, hsa
cauuuucaguauuuuaaauaaaauuuuguaaaguaaugugaauuaaaaauuuuggaacaauuag

SEQ ID NO: 450935 - RNA, 64 nt, hsa
gcuucccugugaguaaugcuuauggaaucugacaaaugugaaugagcugccauuggugggaauc

SEQ ID NO: 450936 - RNA, 64 nt, hsa
cacacacugguccugcagcuuauugaaucagagaaaugugaagauaagaugaacuaaacaaaca

SEQ ID NO: 450937 - RNA, 64 nt, hsa
cagcagcuacugacugaauaaccacuuuuaaaggaaugugaaauuuaaauaauagacauacaga

SEQ ID NO: 450938 - RNA, 64 nt, hsa
uggggcccccaucggagcccugcaaauuccgagaaaugugaaacuugguggggucagggaggaa

SEQ ID NO: 450939 - RNA, 64 nt, hsa
uaauaggaauccuuuuuuuuuuuuuuaaagacuaaaugugaaaaaauaaucacuacuuaagcua

SEQ ID NO: 450940 - RNA, 64 nt, hsa
agcugacucuuugcucuaauuuuggaaaaaaagaaaugugaagggucaacuccaacguaugugg

SEQ ID NO: 450941 - RNA, 64 nt, hsa
auauuacguuguuucuuauagauuuuuuaaaaaaaaugugaaauuuuuccacacuauguguguu

SEQ ID NO: 450942 - RNA, 64 nt, hsa
aguuucaaaaauuaaagaccuacaucacaggguuaaugugaagaaagcuuuauuuuucaaauga

SEQ ID NO: 450943 - RNA, 64 nt, hsa
agcaugaauuuguaaugucuugagcucuauuaugaaugugaagccuuccccuuauccucccugu

SEQ ID NO: 450944 - RNA, 64 nt, hsa
aaugcuugccaguacugccaaagcacugcugugaaaugugaaguacuuuguuuuuuuauuuuua

SEQ ID NO: 450945 - RNA, 64 nt, hsa
agaagaugcagguuuaagaaguuaauauuuauaaaaugugaaagacacaguuacuaggauaacu

SEQ ID NO: 450946 - RNA, 64 nt, hsa
caaaguugaaaugcaaaaauacuaauuagagaauaaugugaauaaaaugggaaucuucuuggua

SEQ ID NO: 450947 - RNA, 64 nt, hsa
uuguguucuaaguggaaggagaguuacugaagggaaugugaauuuuuaccguuuguacuuaaga

SEQ ID NO: 450948 - RNA, 64 nt, hsa
auuucuggcagugugggauggaugaaugaaguggaaugugaacuuugggcaaguuaagugggac

SEQ ID NO: 450949 - RNA, 64 nt, hsa
aguagugaacuuauuuucaguagacauagaaaacaaugugaauauuuaaggucugugacuauag

SEQ ID NO: 450950 - RNA, 64 nt, hsa
cuguuauuauuaacauuuauuuauuauuuuucuaaaugugaaagcaauacauaauuuagggaaa

SEQ ID NO: 450951 - RNA, 64 nt, hsa
agaacuugcguucuguuaauggugccgaaauaacaaugugaaccugagacuggccugcaugaau

SEQ ID NO: 450952 - RNA, 64 nt, hsa
cauggagccuuuacagaagcaucacauuuaaaccaaugugaauucaaaaaagagaaggaaacuu

SEQ ID NO: 450953 - RNA, 64 nt, hsa
caacccuccccugcaaguuuguagcucaaguuguaaugugaaagucauauuuuauuuguggcau

SEQ ID NO: 450954 - RNA, 64 nt, hsa; identical to SEQ ID NO: 250028

SEQ ID NO: 450955 - RNA, 64 nt, hsa; identical to SEQ ID NO: 250029

SEQ ID NO: 450956 - RNA, 64 nt, hsa
uaacauguugcuuuguauaaaaaucuuauuuauaaaugugaagcuuuuugaugccaucaaaacu

SEQ ID NO: 450957 - RNA, 64 nt, hsa
uucagacuucguggguuuuguuuuuaagcaaaacaaugugaaaacauuuaaguuugaaauguug

SEQ ID NO: 450958 - RNA, 64 nt, hsa
ccaggaguccugggucccuggccuccaaagcuggaaugugaacgcaugccacgguggucugacc

SEQ ID NO: 450959 - RNA, 64 nt, hsa
auauuuuuuagacuuaaguuuuaucuucugucagaaugugaaaaguucugcccaguuucugagc

SEQ ID NO: 450960 - RNA, 55 nt, hsa
gucauuuagcccaaaacuaaaacacaaugugaaaauguaucugaguauugaauga

SEQ ID NO: 450961 - RNA, 64 nt, hsa
gaggaaaaaaaaguauggaggccuuauuuucaaaaaugugaaauauaaggcacguuuucacaca

SEQ ID NO: 450962 - RNA, 64 nt, hsa
ggaggggcaggccuuuuugagccaaucccaccauaaugugaauaugccagugacugcugcgcug

SEQ ID NO: 450963 - RNA, 64 nt, hsa
ucuccuugcugucaucccacauagcccuggggugaaugugaauccagagucuauuuuucuaaau

SEQ ID NO: 450964 - RNA, 64 nt, hsa
ccugaauuucuuucagcuuuuuguucacauaaagaaugugaaauuuuuacagaaucagacagau

SEQ ID NO: 450965 - RNA, 64 nt, hsa
cccaagauuaagaggccaggaagagguuagacgcaaugugaaacuguccuccuaggauaagguu

SEQ ID NO: 450966 - RNA, 64 nt, hsa
gacaaguuguacauuuguguaugaacugacauaaaaugugaaagccuguaaguguacauguagu

SEQ ID NO: 450967 - RNA, 64 nt, hsa
cuaccuuuucucagaaugguuuccugauugugucaaugugaaaguuaaauaaaauuuaugugcc

SEQ ID NO: 450968 - RNA, 64 nt, hsa
cucaacuugccuugaugucugagcuuuccagugcaaugugaauuugagcagccagaaaucuauu

SEQ ID NO: 450969 - RNA, 64 nt, hsa
uuuuuccuucuaaacaaggacaaaugagaccagcaaugugaacuguauuuacauaaacgugcaa

SEQ ID NO: 450970 - RNA, 64 nt, hsa
agcaaauuucuugugguuuguacagauuuguuaaaaugugaacguuuucuaacugccucguagg

SEQ ID NO: 450971 - RNA, 64 nt, hsa
uacccccccccccccaugaaaugcagguucacuaaaugugaacagcuuugcuuuucacgugauu

SEQ ID NO: 450972 - RNA, 64 nt, hsa
caaccucucugagccucaguugucucuucuguaaaaugugaaaagaugugcucccaccacaugc

SEQ ID NO: 450973 - RNA, 64 nt, hsa
aggagugguuaguaaacugcacuguuucugugauaaugugaaaugagaaguauuuacauuggag

SEQ ID NO: 450974 - RNA, 64 nt, hsa
aaaguuugucaauccuuguuuuagaagauggaaaaaugugaagaucuuuggagauucucuugag

SEQ ID NO: 450975 - RNA, 64 nt, hsa
aaaaaaacaaauuguguuuuauugcgguaucaacaaugugaauaaggauuaacauauuguaaau

SEQ ID NO: 450976 - RNA, 64 nt, hsa
cuugagagaaaaggaauguugcacaaggguugugaaugugaaagggggaauggaggaauggaaa

SEQ ID NO: 450977 - RNA, 64 nt, hsa
gcccugccuuuuacuagcuacuuuagaaauagaaaaugugaagagugacuauuuacauguauac

SEQ ID NO: 450978 - RNA, 64 nt, hsa
uagggauagguccuugggucaaaaguuguaaauaaaugugaaacaucuucucaugcaauuauuu

SEQ ID NO: 450979 - RNA, 64 nt, hsa
cccuguagagaucaucuuuacaguuccucgggaaaaugugaaugugcugcguuuuguuuucuuu

SEQ ID NO: 450980 - RNA, 64 nt, hsa
uacaaccugauggcauuaauucugugguuggggaaaugugaaagugaaaucgauaauaccacag

SEQ ID NO: 450981 - RNA, 64 nt, hsa
uuacucuauuuuuaaagaucacaaaguaauuuuaaaugugaacagguucccauaccaugaaugc

SEQ ID NO: 450982 - RNA, 64 nt, hsa
ugagcacugacaaaggauaugguacuaaaaauaaaaugugaaaugucaaagacaugucagugcu

SEQ ID NO: 450983 - RNA, 64 nt, hsa
uuuccacuaauuuugcaugcguauuuauaagaaaaaugugaauuuggugguuuuauucuaucgg

SEQ ID NO: 450984 - RNA, 64 nt, hsa
aaaaagaaauaauugaccaaguaaguuugcauaaaaugugaauacuaaauguguccccaguugc

SEQ ID NO: 450985 - RNA, 64 nt, hsa
ccauuuaaacacauuugaaacauacaaaaauagaaaugugaaagcauuuggugaaagccaaagc

SEQ ID NO: 450986 - RNA, 64 nt, hsa
ggcaggaagacuuccagcuuucucuuuguucuucaaugugaaacugagaccaagucucucuaag

SEQ ID NO: 450987 - RNA, 64 nt, hsa
cuucucuuuuuaauggagauugaaaagggagaauaaugugaauaucacggcuuauauuauuaaa

SEQ ID NO: 450988 - RNA, 64 nt, hsa
ccucaucaucccaggggagaacuacauugggauaaaugugaagaaggcuuuuaagguaggucau

SEQ ID NO: 450989 - RNA, 64 nt, hsa
uguuuuuacagacaacaucgaguaauggcuuguaaaugugaauuuugccagaggugguuuuuga

SEQ ID NO: 450990 - RNA, 64 nt, hsa
uccaauuugugggaacaggaggggagaggaaacaaaugugaaguuguggacucuacccaggcag

SEQ ID NO: 450991 - RNA, 64 nt, hsa
aucuuugagaaucucauacaucugugaaaaagauaaugugaaauaaacaguaaaaaaaaaaagu

SEQ ID NO: 450992 - RNA, 64 nt, hsa
cauacaggauuugaacucagaucugucugauaggaaugugaaagcacggacucuuacugcuaac

SEQ ID NO: 450993 - RNA, 64 nt, hsa
gaaugaaaccucuguggcucuuucgaaacgugaaaaugugaagaaagcuacuaacuuagcugua

SEQ ID NO: 450994 - RNA, 64 nt, hsa
caggagcugauggcucacugggcucuuggaggggaaugugaagaaaccaaggagucacuuuuuc

SEQ ID NO: 450995 - RNA, 64 nt, hsa
uauauugugguagcauguucaaaauccaacaaguaaugugaauuuuagauguaaauaucugcca

SEQ ID NO: 450996 - RNA, 64 nt, hsa
ccuuugguaccuuaauuugacuguccucgcagagaaugugaacauguguguguguuguguuaau

SEQ ID NO: 450997 - RNA, 64 nt, hsa
gaaagguaacuuauuucucuucugcacagagcauaaugugaaguuuuauaccuacuuuuaaaau

SEQ ID NO: 450998 - RNA, 64 nt, hsa
uucaggaggguuuuuaaaaaguguuuaaaugucaaaugugaauuggugaugggugauggagggu

SEQ ID NO: 450999 - RNA, 64 nt, hsa
aucucuacuccucaugacaugaagaaaaagacugaaugugaagggaguuucuguacuguaagcu

SEQ ID NO: 451000 - RNA, 64 nt, hsa
guguuugagugcuucagauacauuuuucagauacaaugugaagacauugaagauaugugguccu

SEQ ID NO: 451001 - RNA, 64 nt, hsa
uuauuguacuccuuccuuggagcugaaugcaaggaaugugaauucugaggaauuaagguagaau

SEQ ID NO: 451002 - RNA, 64 nt, hsa
uauguuuugauuuuuuuugcuacugugcaaguuuaaugugaauaaaaucuuuguggaaugauga

SEQ ID NO: 451003 - RNA, 64 nt, hsa
ugccucuuccuccccaccccacugcccccaccuuaaugugaauuugacugaugaaugaagagcg

SEQ ID NO: 451004 - RNA, 64 nt, hsa
gaauggcaagaauguucuaguaaauguguaccaaaaugugaauuacuuuguacgauuacagucu

SEQ ID NO: 451005 - RNA, 64 nt, hsa
uguuucccauagggcauuaguucucagauuuuggaaugugaaauaaucaccuaggaaguugguu

SEQ ID NO: 451006 - RNA, 64 nt, hsa
aaaauaccuuuuuuugcaucuuuuuucaaaguuuaaugugaacuuuuagaaaagugauuaaugu

SEQ ID NO: 451007 - RNA, 64 nt, hsa
uuuucaaccuacuuucauacugaagaugcagcaaaaugugaaugggaaaagagauggccugaga

SEQ ID NO: 451008 - RNA, 64 nt, hsa; identical to SEQ ID NO: 250030

SEQ ID NO: 451009 - RNA, 64 nt, hsa; identical to SEQ ID NO: 250031

SEQ ID NO: 451010 - RNA, 64 nt, hsa
uuuggcaauuugucuuuuaagucuuaaccuugcuaaugugaauacugggaaagugauuuuuucu

SEQ ID NO: 451011 - RNA, 64 nt, hsa
gaagaaaaguaugugauuuuuaccuuuuuuaacaaaugugaaaaagucaguuuuagaaauuucg

SEQ ID NO: 451012 - RNA, 64 nt, hsa
uguguuaaaaaaaaaaaaaaucuuaaauuccuacaaugugaaacugaaacuaauaauuugaucc

SEQ ID NO: 451013 - RNA, 64 nt, hsa
uguauuugcuuaaaugcuggaaaguaacuguuaaaaugugaaauuguaauuuuuaaaaaggcua

SEQ ID NO: 451014 - RNA, 64 nt, hsa
gccuccaggaagaugucuuuguggacccacuaugaaugugaauaacccuuccuacggggaaucu

SEQ ID NO: 451015 - RNA, 64 nt, hsa; identical to SEQ ID NO: 250032

SEQ ID NO: 451016 - RNA, 64 nt, hsa; identical to SEQ ID NO: 250033

SEQ ID NO: 451017 - RNA, 64 nt, hsa
cacagucuuucuaaaguguguguauguuugugugaaugugaaugauacugaucuuauaucuguu

SEQ ID NO: 451018 - RNA, 64 nt, hsa
aauggaauuggagauuguagacgugguuuuacaaaaugugaaaugucuaaauaucuguucauaa

SEQ ID NO: 451019 - RNA, 64 nt, hsa
guggacagaucaaggcacuucaacucauuuggaaaaugugaacacugaugacaugguauaggag

SEQ ID NO: 451020 - RNA, 64 nt, hsa
uuugacauuguauguaucuauuuauuaaguucucaaugugaaaaaugugucuguaagauugucc

SEQ ID NO: 451021 - RNA, 64 nt, hsa
acucuauuugaugauaaacuauaaauucauugaaaaugugaauucuauuauggguagccuuuuu

SEQ ID NO: 451022 - RNA, 64 nt, hsa
cuguaagaauccugaggaccuggagugcaaugagaaugugaaacacaaaaccaaggaguacauu

SEQ ID NO: 451023 - RNA, 64 nt, hsa
agcucaguuggcuuugugaagugugaaacccuacaaugugaaaggaaagugcuugcugugaugu

SEQ ID NO: 451024 - RNA, 64 nt, hsa
gaaaggagggaaaaaccauaaaaggaauacuuauaaugugaagguuuguaaauaguccaugaug

SEQ ID NO: 451025 - RNA, 64 nt, hsa
ugagcacauuuuauaauuuggaagacacaaaucaaaugugaaggauuugauuuucuacauuuaa

SEQ ID NO: 451026 - RNA, 64 nt, hsa
cacaaaauaugugaauuugcugcuucugagaggcaaugugaaagagggaguauuacuuuuaugu

SEQ ID NO: 451027 - RNA, 64 nt, hsa
aguagucagaaaccauggauuuauuuuacugcacaaugugaaguuuacauuuuauuaacacuug

SEQ ID NO: 451028 - RNA, 64 nt, hsa
cuuaaagggaacaaauaauguuucauccuauggaaaugugaaggaugaauugagcuccuggccc

SEQ ID NO: 451029 - RNA, 64 nt, hsa
uagcccaaaaguaaucgcucuggaguagaaaccaaaugugaauagccacaucuuaccuguaaag

SEQ ID NO: 451030 - RNA, 64 nt, hsa
aaagcugaagacaaccaagaggcuuaugagaucuaaugugaaaaucaucacucaagaugccucc

SEQ ID NO: 451031 - RNA, 64 nt, hsa; identical to SEQ ID NO: 250034

SEQ ID NO: 451032 - RNA, 64 nt, hsa; identical to SEQ ID NO: 250035

SEQ ID NO: 451033 - RNA, 64 nt, hsa
uuguuuguuaauguugggauucucugcacuuuugaaugugaaagcuuauaucccugaauucuga

SEQ ID NO: 451034 - RNA, 64 nt, hsa
auacggcuuuggagacaaucaaguaacaacugaaaaugugaaaguaaccauaucugacaaaauu

SEQ ID NO: 451035 - RNA, 64 nt, hsa
uuuaugauucuaaucaagcuguauguagagacugaaugugaagucaagucugagcacaaaaaga

SEQ ID NO: 451036 - RNA, 64 nt, hsa
augcacacuuuauaaccuuaaguuuuuauuugagaaugugaaaguacaaagugcaguagacuuc

SEQ ID NO: 451037 - RNA, 64 nt, hsa
uaauaaauaugucuaucaaauaccucuguaguaaaaugugaaaaagcuuugaguguuccuucgu

SEQ ID NO: 451038 - RNA, 64 nt, hsa
cugaaaaaaaauaagaaagaaagaguuggaugaaaaugugaaagcccaaguuuagaugugcauu

SEQ ID NO: 451039 - RNA, 64 nt, hsa
caaaccuccugcuucucccaccuugggaaggagaaaugugaaacccggcagcggccgaccuagg

SEQ ID NO: 451040 - RNA, 64 nt, hsa
aaacccagggcuuaaccugcuagaaaaugcauggaaugugaacacaaguuaauuauuucaaaau

SEQ ID NO: 451041 - RNA, 64 nt, hsa; identical to SEQ ID NO: 250036

SEQ ID NO: 451042 - RNA, 64 nt, hsa; identical to SEQ ID NO: 250037

SEQ ID NO: 451043 - RNA, 64 nt, hsa
auaguccuaaucuuuacuauccacuucuaaauuuaaugugaauuucauacauguuauuaguugu

SEQ ID NO: 451044 - RNA, 64 nt, hsa
augggaucugcugcugcauuaaaucgggaaagaaaaugugaagauuucauuuggaaucacagaa

SEQ ID NO: 451045 - RNA, 64 nt, hsa
acaaauauaagguuuuaauuauacugcugaagcaaaugugaaugccaaagacuacguuuugcag

SEQ ID NO: 451046 - RNA, 64 nt, hsa
uuucagcugugucccccaguccgugucuuuuuagaaugugaaugaugauaaaguugugaaauaa

SEQ ID NO: 451047 - RNA, 64 nt, hsa
uuugcugaacaccuuguggaagcaaaaaucugaaaaugugaauaaaauuauuuuggauuuugua

SEQ ID NO: 451048 - RNA, 64 nt, hsa
ucccauaggugccacaucuaugagauguuugauaaaugugaauaugcuuuuacauuugggcuua

SEQ ID NO: 451049 - RNA, 64 nt, hsa
guaaagggagugcuuugugaucuaguaaagcuggaaugugaagcucuuuccuaucauggaaucu

SEQ ID NO: 451050 - RNA, 64 nt, hsa; identical to SEQ ID NO: 250038

SEQ ID NO: 451051 - RNA, 64 nt, hsa; identical to SEQ ID NO: 250039

SEQ ID NO: 451052 - RNA, 64 nt, hsa; identical to SEQ ID NO: 250040

SEQ ID NO: 451053 - RNA, 64 nt, hsa; identical to SEQ ID NO: 250041

SEQ ID NO: 451054 - RNA, 64 nt, hsa
auuucugccagcgcauguguccuuucaaggggaaaaugugaagcugaacccccuccagacaccc

SEQ ID NO: 451055 - RNA, 64 nt, hsa
cagcacaauauggccuaaacugccauaguuuuagaaugugaaaaaaaugcauguuuacuuaccu

SEQ ID NO: 451056 - RNA, 64 nt, hsa
uccucccucuccuuaccacgggucagaccuaaagaaugugaacacuuuuuuuuuuuuuucuggg

SEQ ID NO: 451057 - RNA, 64 nt, hsa
acuuagauuuuugaggauuaugugacuaguaauaaaugugaaauaaauuuucaaaaaaguugac

SEQ ID NO: 451058 - RNA, 55 nt, hsa
aaaauccacacauugcaugaaauacaaugugaaagcuccuuuguauaucuuggua

SEQ ID NO: 451059 - RNA, 64 nt, hsa
uccuuauuuucauuuccaaacaacuacuaugauaaaugugaagaagauucuguuuuuuugugac

SEQ ID NO: 451060 - RNA, 64 nt, hsa
uuuagagccagaaguaacuuugucccaguccuacaaugugaaaagagugaauaguugccucuuu

SEQ ID NO: 451061 - RNA, 64 nt, hsa
uauaugcacacacacacagauaaugcuuccagugaaugugaacuucuuuucccuguggcacuga

SEQ ID NO: 451062 - RNA, 64 nt, hsa
gucauucguuagucuacauguuucuaaacauauaaaugugaauuuaaucaauuccuuucauagu

SEQ ID NO: 451063 - RNA, 64 nt, hsa; identical to SEQ ID NO: 250042

SEQ ID NO: 451064 - RNA, 64 nt, hsa; identical to SEQ ID NO: 250043

SEQ ID NO: 451065 - RNA, 64 nt, hsa
guuacgggguugauucugaccauaggaaguaugcaaugugaaucacuauuuacagagaaaccua

SEQ ID NO: 451066 - RNA, 64 nt, hsa; identical to SEQ ID NO: 250044

SEQ ID NO: 451067 - RNA, 64 nt, hsa; identical to SEQ ID NO: 250045

SEQ ID NO: 451068 - RNA, 64 nt, hsa
auucuugcacaaaagugaucguuuucuuccaaacaaugugaauuuaaaaggucacacaaaagaa

SEQ ID NO: 451069 - RNA, 64 nt, hsa
gugggaaugugugaaaauaauuggauuuuuaaacaaugugaauaaagaggcuuguguuuugauu

SEQ ID NO: 451070 - RNA, 64 nt, hsa
uuggauacaguguaaaccagauccauauaaggugaaugugaaaugggagucuucugagggugau

SEQ ID NO: 451071 - RNA, 64 nt, hsa
aauagaaaaauugcauuggaauagauuuuauuuaaaugugaaccaucaacaaccuacaacaaga

SEQ ID NO: 451072 - RNA, 64 nt, hsa
cuuguacaauuaacugaagaauugauaauaacugaaugugaaacaucaauaaagaccacuuaau

SEQ ID NO: 451073 - RNA, 64 nt, hsa
uguuuguauucaaaugacgauuauuuuucuacucaaugugaauaucccuggccagccuuuccac

SEQ ID NO: 451074 - RNA, 64 nt, hsa
uaacuugucaaauagauccugaauccaacagacaaaugugaacuauucuaccacccuuaaaguu

SEQ ID NO: 451075 - RNA, 64 nt, hsa
cuaaauuuguaccuaugugacagacauuuucaauaaugugaacugcugauuugauggagcuacu

SEQ ID NO: 451076 - RNA, 64 nt, hsa; identical to SEQ ID NO: 250046

SEQ ID NO: 451077 - RNA, 64 nt, hsa; identical to SEQ ID NO: 250047

SEQ ID NO: 451078 - RNA, 64 nt, hsa
uuguacaaaaaagcuuaucauaaauuauuucaugaaugugaauagauuucuggccuugaggacg

SEQ ID NO: 451079 - RNA, 64 nt, hsa
acucuuauuuuucuguaaaauauuucacaucccaaaugugaagaagugaaaaagacuucgcagc

SEQ ID NO: 451080 - RNA, 64 nt, hsa
ugcauccacugaugaacaugcaaacuuugggcauaaugugaacuaaaauugaaauggaaaaugu

SEQ ID NO: 451081 - RNA, 64 nt, hsa
augugauaugucugagacugaaugcgggagguucaaugugaagcuguguguggugucaaaguuu

SEQ ID NO: 451082 - RNA, 64 nt, hsa
ugugcaaugggauacuuauuaaauaauuaauaagaaugugaauaagugucauacuuuugugauu

SEQ ID NO: 451083 - RNA, 64 nt, hsa; identical to SEQ ID NO: 250048

SEQ ID NO: 451084 - RNA, 64 nt, hsa; identical to SEQ ID NO: 250049

SEQ ID NO: 451085 - RNA, 64 nt, hsa
auaucuuauacuuaguaugaguccuaaaauuaaaaaugugaaacuguuguacuauacguauaac

SEQ ID NO: 451086 - RNA, 64 nt, hsa
aaaauacaacucuuuuuuuuaaaccaggaaggaaaaugugaacauggaaacaacuucuaguauu

SEQ ID NO: 451087 - RNA, 64 nt, hsa
uagaauuuucuaagacaguccucuggauccucuaaaugugaauuuugauguaauaacugcuaau

SEQ ID NO: 451088 - RNA, 64 nt, hsa
gacuuaaaaaggcucagguuuuugaccaaaauacaaugugaauuuauucugacauuccuaaaau

SEQ ID NO: 451089 - RNA, 64 nt, hsa
uacagaauugaaaaagauaaacacucaaccaaacaaugugaaaacggguucuguaguauuugua

SEQ ID NO: 451090 - RNA, 64 nt, hsa
ucaauuugaguuguucaggcuacugaaacauuaaaaugugaauucccaaacuuuucuuuuuggc

SEQ ID NO: 451091 - RNA, 64 nt, hsa
cuaugugaagacucugcuaauauagguauuuuagaaugugaauugaagaauggaucccaaaaac

SEQ ID NO: 451092 - RNA, 64 nt, hsa
gucaaaugaaguaguguuaaccucaaauaggcuaaaugugaacaaauaaaauacagcaaauacu

SEQ ID NO: 451093 - RNA, 64 nt, hsa
acacgcuuuacuaagccucggcuucuucaucuauaaugugaaggguuuaauaacaugagucccc

SEQ ID NO: 451094 - RNA, 64 nt, hsa
uaacuguagcuuauauucuuuauuugugcauaccaaugugaaaauccacucuuuuauuauguug

SEQ ID NO: 451095 - RNA, 64 nt, hsa
ugaaguaauagcguaaaguaaaguaugauauggaaaugugaaguuugcaagagaaugauuucca

SEQ ID NO: 451096 - RNA, 64 nt, hsa
auuugccugggaguagagauaaagacacaaaccgaaugugaaauaccagguaauaauuauuuug

SEQ ID NO: 451097 - RNA, 64 nt, hsa
ugugugugugugcucaggcaauuauuuugcuaagaaugugaauucaagugcagcucaauacuag

SEQ ID NO: 451098 - RNA, 64 nt, hsa
caagguggaguggaugccucagaacggacgagauaaugugaacuagcuggaauuuuuuauucuu

SEQ ID NO: 451099 - RNA, 64 nt, hsa
auaaaaaccccaaacuguugauuauuagccagguaaugugaauaaauucuauaggaacauauga

SEQ ID NO: 451100 - RNA, 64 nt, hsa
gagaaggguugucacauuauaaaaucuuuaggaaaaugugaacuggaaaacgcuucggucaguu

SEQ ID NO: 451101 - RNA, 64 nt, hsa
uuauaguuaagcaauuucaaaaaugcuccaaagaaaugugaaaggaccuuuugucacagcacuu

SEQ ID NO: 451102 - RNA, 64 nt, hsa
cauaaugcggcccccuuccccagagcuuaccucgaaugugaaaucccuacuucuuauaaugcag

SEQ ID NO: 451103 - RNA, 64 nt, hsa
uuauggaugauuuaagugucucacuaaagcaugaaaugugaauuuuuauuguuguacauacgau

SEQ ID NO: 451104 - RNA, 64 nt, hsa
uucaaauaaagggcuguuucuacagguaacauuaaaugugaacucaacacuuccagagucuuua

SEQ ID NO: 451105 - RNA, 64 nt, hsa; identical to SEQ ID NO: 250050

SEQ ID NO: 451106 - RNA, 64 nt, hsa; identical to SEQ ID NO: 250051

SEQ ID NO: 451107 - RNA, 64 nt, hsa; identical to SEQ ID NO: 250050

SEQ ID NO: 451108 - RNA, 64 nt, hsa; identical to SEQ ID NO: 250051

SEQ ID NO: 451109 - RNA, 64 nt, hsa
uacagaugugagcuucuauuuguuuagaagcauaaaugugaauuauauacaguuugaauuuugc

SEQ ID NO: 451110 - RNA, 64 nt, hsa
uucugaaaagcgaauagcaguguuuucagaaacaaaugugaaagcagucaaauuaaguagauac

SEQ ID NO: 451111 - RNA, 64 nt, hsa
ggcaccaggagacggccacagacacacacugcuaaaugugaagauggaacuaaacuggaaauua

SEQ ID NO: 451112 - RNA, 64 nt, hsa
gaguuauaaagaaauacacuaaggagagguaguaaaugugaaccuuguugcaguguauaaggug

SEQ ID NO: 451113 - RNA, 64 nt, hsa
uguacuguuacuaaaagcuuuauaugaaauuauuaaugugaaguuuuucauuuauaauucaagg

SEQ ID NO: 451114 - RNA, 64 nt, hsa
uuagaggguuuugaaauguuuuucaaauaugugaaaugugaaacugcugucuuuuauauuaaag

SEQ ID NO: 451115 - RNA, 64 nt, hsa
cguaauccaguauuuggaaaguaauccaguuugaaaugugaagauguauuccggcagaauagug

SEQ ID NO: 451116 - RNA, 64 nt, hsa
ucauauaguggcucuacguaauguagccuguauuaaugugaaauauuuaccagaauauucaaua

SEQ ID NO: 451117 - RNA, 64 nt, hsa
gguuggggucugcuccuaccccaccccauuuaacaaugugaagugacugaggcuggggugccuc

SEQ ID NO: 451118 - RNA, 64 nt, hsa
ucugugaagcauucaaaucaaagcuaaaagccuaaaugugaaaugcuaaugacaagccugagaa

SEQ ID NO: 451119 - RNA, 64 nt, hsa
uccugccucacaggugaagauuaaagagacaacgaaugugaaucaugcuugcagguuugagggc

SEQ ID NO: 451120 - RNA, 64 nt, hsa
auuuuuauggaacucaguauuaaaagaaaaauauaaugugaauuagccacuuugcagaauaugu

SEQ ID NO: 451121 - RNA, 64 nt, hsa; identical to SEQ ID NO: 250054

SEQ ID NO: 451122 - RNA, 64 nt, hsa; identical to SEQ ID NO: 250055

SEQ ID NO: 451123 - RNA, 64 nt, hsa; identical to SEQ ID NO: 250056

SEQ ID NO: 451124 - RNA, 64 nt, hsa
uuuuauuuuuuauggauacucugaauggcaauuaaaugugaaacccaguuucuugggcaaguca

SEQ ID NO: 451125 - RNA, 64 nt, hsa
gguuuuguaaaacuguuauuuuuuuuuuuuucacaaugugaaacugaaggucaauaaauuauua

SEQ ID NO: 451126 - RNA, 64 nt, hsa
cgccaggcccaguuaaugcuagucuuucaugugaaaugugaagcugccauguugccuuuucucu

SEQ ID NO: 451127 - RNA, 64 nt, hsa
auguauuucauuagauucucugauucuauauaagaaugugaaaagauugauauauuguuguuag

SEQ ID NO: 451128 - RNA, 64 nt, hsa
gcauaucaaacguuuaacuuuauuuaaaaaguauaaugugaaaacauaaaauauauuaaaacuu

SEQ ID NO: 451129 - RNA, 64 nt, hsa; identical to SEQ ID NO: 250057

SEQ ID NO: 451130 - RNA, 64 nt, hsa; identical to SEQ ID NO: 250058

SEQ ID NO: 451131 - RNA, 64 nt, hsa
acaacauagaacugugauauuuugcuauuacuucaaugugaauaaauaagguaaaguauaucau

SEQ ID NO: 451132 - RNA, 64 nt, hsa
uauauuauuaacaugaauauauuauuuugcuauuaaugugaaaguugucucuaaauauuuuuua

SEQ ID NO: 451133 - RNA, 64 nt, hsa
gccugugccuggcuagaaaacaagcguuuauuugaaugugaauaguguuucaaagguauguagu

SEQ ID NO: 451134 - RNA, 64 nt, hsa
ccuuguacaagcacauaugauguagacauuuuuaaaugugaagcuuuaacaggaauaggauagc

SEQ ID NO: 451135 - RNA, 64 nt, hsa
aagaaaaaaaaaggcauucuaguaaaucgaauguaaugugaauggaauuucaaaacaggaucua

SEQ ID NO: 451136 - RNA, 64 nt, hsa
gcugcugcuacuuuaaaguguggucauuaugaugaaugugaaaagaguuuuggcuuguucuaaa

SEQ ID NO: 451137 - RNA, 64 nt, hsa
agcugagcccuggggacuguuccaaagccagugaaaugugaaggaaagugggguccuucggggc

SEQ ID NO: 451138 - RNA, 64 nt, hsa
aagcgaucaugucaguuggcccuuuaauauuuccaaugugaaagauuauuuaaaugcuuuuaaa

SEQ ID NO: 451139 - RNA, 64 nt, hsa
gaaugauuuuguugacaugacuacagacugaaauaaugugaaugaauuaacugaauuugcucug

SEQ ID NO: 451140 - RNA, 64 nt, hsa
uauuuuaacccucgcauuccucugcuuuuccaagaaugugaaucuugccaagcuguccgugaga

SEQ ID NO: 451141 - RNA, 64 nt, hsa
aauucugaaugcuuuuccacguagacuuaucuggaaugugaacacaacucuuugguuaauagua

SEQ ID NO: 451142 - RNA, 64 nt, hsa
uuaaugauuuugcuacauuuggaauucaauaaaaaaugugaacaauaauaucuuuaauauaacu

SEQ ID NO: 451143 - RNA, 64 nt, hsa
agccccagagccugggcucugcuggacuuaguauaaugugaaaaaaauguguucuccuauuccu

SEQ ID NO: 451144 - RNA, 64 nt, hsa
uauuuauguaacauuugcuagcuuguaaaaggcgaaugugaaauauugcaucugcauuuuccaa

SEQ ID NO: 451145 - RNA, 64 nt, hsa
cacugugcguuuguaugugucugggauccagggcaaugugaauuuucuuuuuauuugggagauu

SEQ ID NO: 451146 - RNA, 64 nt, hsa
accugauccaucaggaucagucccuauuaugcaaaaugugaauuuaauuuuauuuguacugaca

SEQ ID NO: 451147 - RNA, 64 nt, hsa
ccuccggcggggccugucccugggcccaggagccaaugugaacuuuuuuuuuuaccgggauuau

SEQ ID NO: 451148 - RNA, 64 nt, hsa
auacuugagagaaaaacuuagaucugagugauggaaugugaagcaaaucuucaaaaucaguaga

SEQ ID NO: 451149 - RNA, 64 nt, hsa
uaauacugagaaaaaguccugucaguucagaaaaaaugugaagucuacuuuaguauuccuguaa

SEQ ID NO: 451150 - RNA, 64 nt, hsa
uagagagccacuaggaggccugcaguuauuuuugaaugugaaaaugcauuugcguucaucuugu

SEQ ID NO: 451151 - RNA, 64 nt, hsa
uacaucuugugguuauucuggguuguggaaggaaaaugugaaugaaaguagugcuggaugcaau

SEQ ID NO: 451152 - RNA, 64 nt, hsa
gacaaaaaagaugcaguuuuccuuuguauugggaaaugugaaaauaaaauugucaacucuuuca

SEQ ID NO: 451153 - RNA, 64 nt, hsa
cucucuccuccaccccaggcuuagaggacagaaaaaugugaagagacgccccacccacccucag

SEQ ID NO: 451154 - RNA, 64 nt, hsa
aauagacucacacaguugccugaagcaguuggggaaugugaaagucucacugaguuaguucuua

SEQ ID NO: 451155 - RNA, 64 nt, hsa
uuugacccuuuauauuuguucuaaaauaagucaaaaugugaaaauaauauuaaaucuaagauau

SEQ ID NO: 451156 - RNA, 64 nt, hsa
aagaagaaucuaauaggaugcugguuguguauuaaaugugaaauugcauagauaaagguagaug

SEQ ID NO: 451157 - RNA, 64 nt, hsa
agaaacagcugucaaaucucaaggugaagaucuaaaugugaacaguuuacuaaugcacuacuga

SEQ ID NO: 451158 - RNA, 64 nt, hsa
ccacaugacuuuugcauccauuguauuaucagaaaaugugaagaagaaaaaaaugccauguuuu

SEQ ID NO: 451159 - RNA, 64 nt, hsa
uagggccugugauuuccugucaguguccucagcuaaugugaacaguguuggucugcugguuaga

SEQ ID NO: 451160 - RNA, 64 nt, hsa; identical to SEQ ID NO: 250059

SEQ ID NO: 451161 - RNA, 64 nt, hsa; identical to SEQ ID NO: 250060

SEQ ID NO: 451162 - RNA, 64 nt, hsa
uaauuuucugugagcacacuaaaagcgaaaaauaaaugugaauaaaauguacaaauuuguugug

SEQ ID NO: 451163 - RNA, 64 nt, hsa
ucccugaaauuccguaaguacauagucaaaacacaaugugaagaauuuguuuaaaaacauccug

SEQ ID NO: 451164 - RNA, 64 nt, hsa
cuugaguuccucauuuguugguaaaaagaaaaagaaugugaaaaugucucuuuuuuucuuggcu

SEQ ID NO: 451165 - RNA, 64 nt, hsa
ugugacuucaccugaggcaucacagagacaaaagaaugugaagcuacuuaacaaaguaaggcaa

SEQ ID NO: 451166 - RNA, 64 nt, hsa
uuaauauuuuguguugaucauuauuuccauucuuaaugugaaaaaaaguaauuauuuauacuua

SEQ ID NO: 451167 - RNA, 64 nt, hsa
uaaugucuuuaagaaaaagaaaucaaucugcagaaaugugaagauuugcaagcaguguaaacug

SEQ ID NO: 451168 - RNA, 64 nt, hsa
uacaguuaaacucauugucuguuuggaagaccagaaugugaagacaaguaguagaagaaaauga

SEQ ID NO: 451169 - RNA, 64 nt, hsa
aacuucccuuucugcuuguguuaaguauguguaaaaugugaagugaaugaaacacucaguuguu

SEQ ID NO: 451170 - RNA, 64 nt, hsa
agcgugguagccgacugugaggaaaagcagagggaaugugaaagaaaauaagagaauccacggg

SEQ ID NO: 451171 - RNA, 64 nt, hsa
uucucugcucaccuugguuuccgcacaccuucgcaaugugaacaggucaggagucccucccguc

SEQ ID NO: 451172 - RNA, 64 nt, hsa
cugguagucuuagcagggggagcccucgacccugaaugugaacuugaacuggagugccucugcu

SEQ ID NO: 451173 - RNA, 64 nt, hsa
uacccugucagccuuucaauaaaaguuaugcacaaaugugaacaccugagauggagcugaacau

SEQ ID NO: 451174 - RNA, 64 nt, hsa
uaauagcagugugcaugcaggcaggaggcagggaaaugugaaauggcaaugaucucuuauugag

SEQ ID NO: 451175 - RNA, 64 nt, hsa
gauauugaaaguuucaaugugguuuaaagggaugaaugugaauuaugaacuaguaugugacaau

SEQ ID NO: 451176 - RNA, 64 nt, hsa
cuugggcaggucuagugagcuguagaauugaaucaaugugaacucagggaacuggggaaggcug

SEQ ID NO: 451177 - RNA, 64 nt, hsa
uuuuccuauuuucgaugaaguucugagauacugaaaugugaaaagagcaaucagaauugugcuu

SEQ ID NO: 451178 - RNA, 64 nt, hsa
cuugguugggcucugccaaagacuaauggacuaaaaugugaaacagccucuugcccuguaccuu

SEQ ID NO: 451179 - RNA, 64 nt, hsa
ugacguuuuguguagaucuuuauaagcuuuugagaaugugaaauagcaccaucaaaauauaaug

SEQ ID NO: 451180 - RNA, 64 nt, hsa; identical to SEQ ID NO: 250061

SEQ ID NO: 451181 - RNA, 64 nt, hsa; identical to SEQ ID NO: 250062

SEQ ID NO: 451182 - RNA, 64 nt, hsa; identical to SEQ ID NO: 250063

SEQ ID NO: 451183 - RNA, 64 nt, hsa; identical to SEQ ID NO: 250064

SEQ ID NO: 451184 - RNA, 64 nt, hsa
aaaaacaaaagguucuaagaugauuucaggaaauaaugugaacauguaauaaaauggaaaugaa

SEQ ID NO: 451185 - RNA, 64 nt, hsa
ugaauaaugccuuuguaaccacaacuuucacuauaaugugaaauguaacuguccguaguaucag

SEQ ID NO: 451186 - RNA, 64 nt, hsa
uguggaaaacuggugacagugagaauauaaacucaaugugaaucacgugauacuucgcaggcgu

SEQ ID NO: 451187 - RNA, 64 nt, hsa
uuuuuauuaaaguauguguguguaucagugucucaaugugaagauuguaaccucaagauuagga

SEQ ID NO: 451188 - RNA, 64 nt, hsa
accggcaucuuguuacugcaauaguuggaaauaaaaugugaaaauuagcaaaaccaugaauggu

SEQ ID NO: 451189 - RNA, 64 nt, hsa
aaaaucuacaauuucuucuuuaaaaauauuuauuaaugugaauggaauauaacaauucagcuua

SEQ ID NO: 451190 - RNA, 64 nt, hsa
aauguuuaugaucccagcaauacacuuuuuaaaaaaugugaaagucaaagaauuaaguucuagu

SEQ ID NO: 451191 - RNA, 64 nt, hsa
uggauuucaaagaccacugucuucauugcacaacaaugugaauauaaucaacacuauugaacug

SEQ ID NO: 451192 - RNA, 64 nt, hsa
cuaaugaagaaaacacuguaauugcuacucagcaaaugugaauaaaagguguuugcguuauuag

SEQ ID NO: 451193 - RNA, 64 nt, hsa
uaagaguucuauucuucagguagauaauuuuucaaaugugaauuaucuuuugugucuauauuga

SEQ ID NO: 451194 - RNA, 64 nt, hsa
acuccuuuugcaaaagcagacuaaaauguuuuaaaaugugaaaaaacauuauuuuuucaaagca

SEQ ID NO: 451195 - RNA, 64 nt, hsa
cguaagaaagagauuguguuuggagucagauuucaaugugaaacccaugccuuacauuuacaca

SEQ ID NO: 451196 - RNA, 64 nt, hsa
guagagccuguuugucuugcuuccccagagauagaaugugaagacacgcgcuagaaaucgcagu

SEQ ID NO: 451197 - RNA, 64 nt, hsa
uauugauaucuccaugaugauaguugaauguugcaaugugaaaaaucugcuguuaacugcaacc

SEQ ID NO: 451198 - RNA, 64 nt, hsa
aagaaaacuugaaaaaguauaagcauuuguuaaaaaugugaauuucuugaaugaauuucacauu

SEQ ID NO: 451199 - RNA, 64 nt, hsa
acauauaauuuacuucuuauaaauugaagucuuaaaugugaaaccaagaaauguaaucaagcag

SEQ ID NO: 451200 - RNA, 64 nt, hsa
ugauguuccuaagacccuugucccagauacucuaaaugugaauguaugagcugggggagucaac

SEQ ID NO: 451201 - RNA, 64 nt, hsa
accacuuuuagaacuaugaguacuacuuuuguuaaaugugaaaaacccucacagaaagucaucg

SEQ ID NO: 451202 - RNA, 64 nt, hsa
uaacucucagagaccuuaaaaagaaguuuacugcaaugugaauaauuuaaucucugguugccaa

SEQ ID NO: 451203 - RNA, 64 nt, hsa; identical to SEQ ID NO: 250065

SEQ ID NO: 451204 - RNA, 64 nt, hsa; identical to SEQ ID NO: 250066

SEQ ID NO: 451205 - RNA, 64 nt, hsa; identical to SEQ ID NO: 250067

SEQ ID NO: 451206 - RNA, 64 nt, hsa; identical to SEQ ID NO: 250068

SEQ ID NO: 451207 - RNA, 64 nt, hsa; identical to SEQ ID NO: 250069

SEQ ID NO: 451208 - RNA, 64 nt, hsa; identical to SEQ ID NO: 250070

SEQ ID NO: 451209 - RNA, 64 nt, hsa; identical to SEQ ID NO: 250071

SEQ ID NO: 451210 - RNA, 64 nt, hsa; identical to SEQ ID NO: 250072

SEQ ID NO: 451211 - RNA, 64 nt, hsa; identical to SEQ ID NO: 250073

SEQ ID NO: 451212 - RNA, 64 nt, hsa; identical to SEQ ID NO: 250074

SEQ ID NO: 451213 - RNA, 64 nt, hsa; identical to SEQ ID NO: 250075

SEQ ID NO: 451214 - RNA, 64 nt, hsa; identical to SEQ ID NO: 250076

SEQ ID NO: 451215 - RNA, 64 nt, hsa; identical to SEQ ID NO: 250077

SEQ ID NO: 451216 - RNA, 51 nt, hsa
auaugggugagaaauccuagaaaugugaagaaugugacaaagccuuuaagc

SEQ ID NO: 451217 - RNA, 64 nt, hsa
cuuuuguauuuuauuuuucaaaauaaaagcuuucaaugugaagcauucugguaguuacauguuu

SEQ ID NO: 451218 - RNA, 64 nt, hsa
ugcugcuaguuuuuaugagaaguauauuauauuaaaugugaauuuuuuaaauuuugcuucuuau

SEQ ID NO: 451219 - RNA, 64 nt, hsa
ccuggcugugacuguggccgccacggccacccggaaugugaagggcgcuccgggcucugagccc

SEQ ID NO: 451220 - RNA, 64 nt, hsa
auguggaggagacugcccuguccugagccuggaaaaugugaaacugucuccugcaaccugcugg

SEQ ID NO: 451221 - RNA, 64 nt, hsa; identical to SEQ ID NO: 250078

SEQ ID NO: 451222 - RNA, 64 nt, hsa; identical to SEQ ID NO: 250079

SEQ ID NO: 451223 - RNA, 64 nt, hsa; identical to SEQ ID NO: 250080

SEQ ID NO: 451224 - RNA, 64 nt, hsa
auuaaaaggaaaacagaaaaaggaaaaguaggcaaaugugaaaauaguuucaauauaucuuaug

SEQ ID NO: 451225 - RNA, 64 nt, hsa
acaguaaauaauuguaucuuuccauagcuuuucaaaugugaaaucauuuuuggaagcuuggauc

SEQ ID NO: 451226 - RNA, 64 nt, hsa; identical to SEQ ID NO: 250081

SEQ ID NO: 451227 - RNA, 64 nt, hsa; identical to SEQ ID NO: 250082

SEQ ID NO: 451228 - RNA, 64 nt, hsa
uaauaauuccacagccucuucuaacaaugccuacaaugugaauuccucccaaccucugggaucc

SEQ ID NO: 451229 - RNA, 64 nt, hsa
uggauucauuuuaucgagaugccaagaugaacacaaugugaauaucauuuccauuucuaagcag

SEQ ID NO: 451230 - RNA, 64 nt, hsa
auuacccccucaauaucaugaucauccaaucucaaaugugaaaaaaaaaaagaaauuugauuuu

SEQ ID NO: 451231 - RNA, 64 nt, hsa
aggguauaugaacaaauuuucuagucgaguuuucaaugugaauuuguucuuacauuauggcucc

SEQ ID NO: 451232 - RNA, 64 nt, hsa
cuaggugcccagaaugaggcugcuuuccaaagccaaugugaacagcggcuggacuuggagguag

SEQ ID NO: 451233 - RNA, 63 nt, hsa
auaagacaauucauauuugagagaaacccugcaaaugugaagaauguggcaaugcuuguaacu

SEQ ID NO: 451234 - RNA, 64 nt, hsa
cauaagagaauucauacuggagagaaacccuacaaaugugaagaauguggcaaagcuuuuaacc

SEQ ID NO: 451235 - RNA, 64 nt, hsa
aaauuauuuucuccaaauaaaaauuagauggaaaaaugugaaaaaaauuauucaugcucucaua

SEQ ID NO: 451236 - RNA, 64 nt, hsa
uuuauaaagucuuaaaugugugcauaaaaaacuaaaugugaauauaaaaucuaaauaaaggaau

SEQ ID NO: 451237 - RNA, 64 nt, hsa
acauagguagcacauuuaucauuugugacagaauaaugugaaguuaaguaauuacugaacuuua

SEQ ID NO: 451238 - RNA, 64 nt, hsa
ucagcugucaaagcuuagguggucuuuaugcuguaaugugaaagcaaauauuucuucguguugg

SEQ ID NO: 451239 - RNA, 64 nt, hsa
gaaugugugaaugccauaucuguagaugacgaugaaugugaaggguuaauguagaaauguuugu

SEQ ID NO: 451240 - RNA, 64 nt, hsa
cuacuucuuuaaaaacuccuucuaagcauauuaaaaugugaaauuuugcguacucucucucucu

SEQ ID NO: 451241 - RNA, 64 nt, hsa; identical to SEQ ID NO: 250083

SEQ ID NO: 451242 - RNA, 64 nt, hsa; identical to SEQ ID NO: 250084

SEQ ID NO: 451243 - RNA, 64 nt, hsa
uauacccaaucaagaauagacccuucacacaggaaaugugaacaauuguuauauaugaacacuc

SEQ ID NO: 451244 - RNA, 64 nt, hsa
ucuuccuccucaccagaaaucccugggcuuccacaaugugaacucacucauugucagguguccg

SEQ ID NO: 451245 - RNA, 64 nt, hsa
uccuucagugauauacuuguucguucauuucuaaaaugugaagcuuuaggaccaaauuguuaga

SEQ ID NO: 451246 - RNA, 64 nt, hsa; identical to SEQ ID NO: 250085

SEQ ID NO: 451247 - RNA, 64 nt, hsa; identical to SEQ ID NO: 250086

SEQ ID NO: 451248 - RNA, 64 nt, hsa
uuugagauuaaaguuagucuuaaaauguaaauaaaaugugaaacguguccucagagacugugcc

SEQ ID NO: 451249 - RNA, 64 nt, hsa
gucccgaggcgcagcaauaauaaggcagcuguugaaugugaagggucccuuuggaaaauuaacc

SEQ ID NO: 451250 - RNA, 64 nt, hsa; identical to SEQ ID NO: 250087

SEQ ID NO: 451251 - RNA, 64 nt, hsa; identical to SEQ ID NO: 250088

SEQ ID NO: 451252 - RNA, 64 nt, hsa; identical to SEQ ID NO: 250089

SEQ ID NO: 451253 - RNA, 64 nt, hsa; identical to SEQ ID NO: 250090

SEQ ID NO: 451254 - RNA, 64 nt, hsa
ugcuuuauuauagagacauuugaaaauauccauuaaugugaauaucaccugaauucagucuguu

SEQ ID NO: 451255 - RNA, 64 nt, hsa
cccuucaucucuuacuugauagacuuacuaauaaaaugugaagacuagaccaauugucaugcuu

SEQ ID NO: 451256 - RNA, 64 nt, hsa
aaaguaucugagauauacaaaucucccuguaggaaaugugaaagaaaagcacaacaaaacuagg

SEQ ID NO: 451257 - RNA, 64 nt, hsa
aaaguaacacuuuguacauaacaaauacucagcaaaugugaaacuuuauuugcucuuacuucaa

SEQ ID NO: 451258 - RNA, 64 nt, hsa
auuuuaugaauaauaugcagagaugcauauuaggaaugugaagccagaaugggucaguuguagc

SEQ ID NO: 451259 - RNA, 64 nt, hsa
ugucugaauaaccugcgugucuaaaaccacgugaaaugugaaugauuauuggcaauauuaccuu

SEQ ID NO: 451260 - RNA, 64 nt, hsa
uugagaaguucccauuauuauuucuguucuuacaaaugugaaacggaagcucauagaggugaga

SEQ ID NO: 451261 - RNA, 64 nt, hsa
gagaaaacacuugaauugacgcaauauaaaacaaaaugugaaaaccaaaguggauuuauccugc

SEQ ID NO: 451262 - RNA, 64 nt, hsa
cauuuauuggcgguauacaaaguaaaauguuauaaaugugaaguuauaaaauaaauauaugcua

SEQ ID NO: 451263 - RNA, 64 nt, hsa
cuggccaggcucucccgagucguggcaccuccacaaugugaauuuucugaaucccuauuccagg

SEQ ID NO: 451264 - RNA, 64 nt, hsa
aaguauuauuuuuacuguuaaaaaauuuuuuaaaaaugugaaauguaauguuuuuacagcaaca

SEQ ID NO: 451265 - RNA, 64 nt, hsa
uuacuggugaauuacagaccugaugaauuuauagaaugugaagacccaguggaucauguuggaa

SEQ ID NO: 451266 - RNA, 64 nt, hsa
caacagcuucagaaagagcucaaaauaaauuggaaaugugaaucgcagcuguggguuuuaccac

SEQ ID NO: 451267 - RNA, 64 nt, hsa
ugggaaaguguaaauguuuuucaugguuucuaucaaugugaaauaaaauuuaauucugacuuuu

SEQ ID NO: 451268 - RNA, 64 nt, hsa
caacaguccuacuccgauguuaucuuucugauucaaugugaauccaucuuuccuugcaauauuu

SEQ ID NO: 451269 - RNA, 64 nt, hsa
aauagcaucuauguuacacucuccuagaguauaaaaugugaauguuuuuguagcuaaauuguaa

SEQ ID NO: 451270 - RNA, 64 nt, hsa
ccuuugcaaaauuggauuaaauuccaccuaucuuaaugugaauuaaaaaccaccauuuauaaua

SEQ ID NO: 451271 - RNA, 64 nt, hsa
cccaaugguguuuuucuuguaaauguguuggacaaaugugaagaugcauuguaguuuaaccaua

SEQ ID NO: 451272 - RNA, 64 nt, hsa
auuaagccuauuguuuaaugcaaaauauggaacaaaugugaacugguaaaggucgaucuugaua

SEQ ID NO: 451273 - RNA, 64 nt, hsa
ccaaaucuuuuucauagguaaugacagaugccuuaaugugaagcuuauuuauaauagcaauaaa

SEQ ID NO: 451274 - RNA, 64 nt, hsa; identical to SEQ ID NO: 250091

SEQ ID NO: 451275 - RNA, 64 nt, hsa; identical to SEQ ID NO: 250092

SEQ ID NO: 451276 - RNA, 64 nt, hsa
cuuaaaaaauuuauacuuaaaaaauccugcccaaaaugugaagcuugguugacugauguucaug

SEQ ID NO: 451277 - RNA, 64 nt, hsa
uagggugaagcuuugaaauaaauacugcaccaaaaaugugaaaaagaaucacguaguaaaugua

SEQ ID NO: 451278 - RNA, 64 nt, hsa
ggggagaaaugcaguugcugacugggaauuuaagaaugugaacuucucacuagaauugguaugg

SEQ ID NO: 451279 - RNA, 64 nt, hsa
ccaaauacauccaaaaggguaaggcaguuuuaaaaaugugaaaacauuuaaaaaugauaauagc

SEQ ID NO: 451280 - RNA, 64 nt, hsa; identical to SEQ ID NO: 250093

SEQ ID NO: 451281 - RNA, 64 nt, hsa; identical to SEQ ID NO: 250094

SEQ ID NO: 451282 - RNA, 64 nt, hsa
auuauguaccuuuugauagauccacauaaaaagaaaugugaaguuuucuuuuacuaucuuuuca

SEQ ID NO: 451283 - RNA, 64 nt, hsa
uuuugucuuuuucugcccaucugucuacuaauaaaaugugaaauaaaauaccuguauugcuacu

SEQ ID NO: 451284 - RNA, 64 nt, hsa
agcugccuucaaggacuguuucagugugagucagaaugugaaaaaggaauaaaaaauacuguug

SEQ ID NO: 451285 - RNA, 64 nt, hsa
gucucaaaaaaaauaaaauaaaaagucaauuuagaaugugaaauucugaccaccuuuuggcuuu

SEQ ID NO: 451286 - RNA, 64 nt, hsa
aagacauuuuuccguuugcuuuuguuccaaugucaaugugaacguccacaugaaaccuacacac

SEQ ID NO: 451287 - RNA, 64 nt, hsa
gugguuguaguugaaaauuuuauaaaauaccguuaaugugaaguuuuucuuuagucacagaagu

SEQ ID NO: 451288 - RNA, 64 nt, hsa
ggagagcaagcaaaucuuuuuaaaaaauaguaugaaugugaauacuagaaaagauuuaaaaaau

SEQ ID NO: 451289 - RNA, 64 nt, hsa
ugaagacugccaaggagcagauuuucucccuggaaaugugaaaacugaaccuauaacucugaua

SEQ ID NO: 451290 - RNA, 64 nt, hsa; identical to SEQ ID NO: 250095

SEQ ID NO: 451291 - RNA, 64 nt, hsa; identical to SEQ ID NO: 250096

SEQ ID NO: 451292 - RNA, 64 nt, hsa
cacugugggagggaaggacaaggguucccuuggaaaugugaagggucuuggccucaucccucag

SEQ ID NO: 451293 - RNA, 64 nt, hsa
guaaacugugcaagcuuucuuuuuaucauuaggaaaugugaaacguuggacaaauuuugaguuu

SEQ ID NO: 451294 - RNA, 64 nt, hsa
cccaccaaauuuacacaacaaaaugacauguucgaaugugaaaggucauaauagcuuucccauc

SEQ ID NO: 451295 - RNA, 64 nt, hsa
uuucuguccuuaauuuuuugagcaaaaucuggaaaaugugaaagcauauuuagauuuuauauac

SEQ ID NO: 451296 - RNA, 64 nt, hsa
agacuaacuguaacuuaagugcugggggaaaaaaaaugugaacuaacuuauuuaauuuauggca

SEQ ID NO: 451297 - RNA, 64 nt, hsa
gcuuuaugaaguaaaguuaaaaacaaacauaggaaaugugaaaauauuuguguuuguuuugucu

SEQ ID NO: 451298 - RNA, 64 nt, hsa
aaaugacucacaaaacugauuuuaaaaucaaguuaaugugaauuuugaaaauuacuacuuaauc

SEQ ID NO: 451299 - RNA, 64 nt, hsa; identical to SEQ ID NO: 250097

SEQ ID NO: 451300 - RNA, 64 nt, hsa; identical to SEQ ID NO: 250098

SEQ ID NO: 451301 - RNA, 64 nt, hsa
ccaaaauaauaaaugucagcugguuuugauacugaaugugaacaaggcucaccuaaggaaacug

SEQ ID NO: 451302 - RNA, 64 nt, hsa
uugcuguuagaaaaacagaauuaacaaagacaguaaugugaagagugcauuacacuauucuuau

SEQ ID NO: 451303 - RNA, 64 nt, hsa
cucuuucccugcagugucuuugaaacuugaacauaaugugaaggcugaaugauagagauauuuu

SEQ ID NO: 451304 - RNA, 64 nt, hsa
uaggggaugaggguuagccauaguauucuuugcaaaugugaaagcgagacauuauaucuucucu

SEQ ID NO: 451305 - RNA, 64 nt, hsa
gacagguuuggaagccacaggcgauucuauggucaaugugaaggacuagaaauaaaaacccaca

SEQ ID NO: 451306 - RNA, 64 nt, hsa
ugugacugcgggcugggggggcauucccaguaggaaugugaagccagagguuucggauucguga

SEQ ID NO: 451307 - RNA, 64 nt, hsa
aaugacagcaauuuucuaauauuugguuuaauaaaaugugaauaaugucccuuuuaaccauggu

SEQ ID NO: 451308 - RNA, 64 nt, hsa
gauauauucccaugaaggauucuuuuuuuaaaaaaaugugaaaugucaucuuguacuuacaccu

SEQ ID NO: 451309 - RNA, 64 nt, hsa
caaugagauuaagcuucaaucacugcuccucagcaaugugaagaaucaaagucagggcaagaaa

SEQ ID NO: 451310 - RNA, 64 nt, hsa
uuggcccacuuccagggcccaggugcugcaacuaaaugugaaagcucaguggccgcuccuucuu

SEQ ID NO: 451311 - RNA, 64 nt, hsa
gugugccagacaccgggcaguacacuuuggaaagaaugugaaauccuuuuaauuuuuaauccau

SEQ ID NO: 451312 - RNA, 64 nt, hsa
gaaugcagccaaugcauuuucuuacaguuuacagaaugugaagauguuuaauguuacaguguug

SEQ ID NO: 451313 - RNA, 64 nt, hsa
uagccagcagaacugaagugugcugugacaagccaaugugaauuucuaccaaauaguagagcau

SEQ ID NO: 451314 - RNA, 64 nt, hsa
uacacaguaauguuauuaucuauguauuguagacaaugugaaaauacauuugacauagaaugaa

SEQ ID NO: 451315 - RNA, 64 nt, hsa
gcaaagccugucuuccgcuagaacaacgucuacaaaugugaagaugaugacuucuggcacgcgg

SEQ ID NO: 451316 - RNA, 64 nt, hsa
ggugaacaguagggcauuacauuugugugaauuaaaugugaacuucuguauuacguugcggcgu

SEQ ID NO: 451317 - RNA, 64 nt, hsa
ugugaccucaucuagcuaugaauucugggaagucaaugugaaaaacauugcugcauucaugcaa

SEQ ID NO: 451318 - RNA, 64 nt, hsa
aacuguaaauuugcauaacuggauguacuuagauaaugugaaauaaacauuaaagacaaggucu

SEQ ID NO: 451319 - RNA, 64 nt, hsa
uuugauuuuguuauacuugacuuaacuuuauugcaaugugaauuaauugcacugcuaaguagga

SEQ ID NO: 451320 - RNA, 64 nt, hsa
uuaggaacuacugaggaucagaguaauccaagcaaaugugaaucauuuuaccuuugacaaaggu

SEQ ID NO: 451321 - RNA, 64 nt, hsa
auagucaauagucuucccauccaaacuauaagagaaugugaauuucuucaacaucauacuuaaa

SEQ ID NO: 451322 - RNA, 64 nt, hsa
gcauugaucuuuuccacaaguauuaaacugccaaaaugugaauaugcaaagccuuucugaaucu

SEQ ID NO: 451323 - RNA, 64 nt, hsa
gucugcagaacuuuguucuguuuucugccacaaaaaugugaauaguucagagugaaaaccuuuu

SEQ ID NO: 451324 - RNA, 64 nt, hsa; identical to SEQ ID NO: 250099

SEQ ID NO: 451325 - RNA, 64 nt, hsa; identical to SEQ ID NO: 250100

SEQ ID NO: 451326 - RNA, 64 nt, hsa
ucucauguuugagugauuuuaaaauguuuuggugaaugugaaaacuaaaguuugugucaugaga

SEQ ID NO: 451327 - RNA, 64 nt, hsa
uccuacguuuaaauaucuuugaaaguuuguauuaaaugugaauuuuaagaaauaauauuuauau

SEQ ID NO: 451328 - RNA, 64 nt, hsa
ucccagucuaucaucaaccuugaguauucuacacaaugugaauucaagugccugauuaauugag

SEQ ID NO: 451329 - RNA, 64 nt, hsa
cauuucaaagugacuucuaugaagcuuuuuuuuuaaugugaaauuuucagaauguuguuuuuuu

SEQ ID NO: 451330 - RNA, 64 nt, hsa
acgggguaugugagauguuuugacacaggcaugcaaugugaaauacguguaucauggagaauga

SEQ ID NO: 451331 - RNA, 64 nt, hsa
caucuugcccacaggccuguggcaaaaggauaaaaaugugaacgaaguuuaacauucugacuug

SEQ ID NO: 451332 - RNA, 64 nt, hsa
cucaaauauuugcacuguauuaaauuuaaauguuaaugugaaaugguuuaaauuuuacaugcug

SEQ ID NO: 451333 - RNA, 64 nt, hsa
gcuguaauuauaaaauauauuggcuuuuguuuucaaugugaaagauacauuaaauggacacaua

SEQ ID NO: 451334 - RNA, 64 nt, hsa
ucccuccuuucaguauuuuucacuuguugccccaaaugugaaagcauuucauuccuuuaagagg

SEQ ID NO: 451335 - RNA, 64 nt, hsa
cugccugaaaucaaacuugauuuaacucaguaagaaugugaauuauuuguucuacuuggguggu

SEQ ID NO: 451336 - RNA, 64 nt, hsa
ggguguggucuguuacuuuaauguuucuguuuuuaaugugaaggccaagcaggcccugggaugg

SEQ ID NO: 451337 - RNA, 64 nt, hsa
ggggaaaaggcaauaauuuucuaagacccgugugaaugugaagaaaagcaguauguuacugguu

SEQ ID NO: 451338 - RNA, 64 nt, hsa
ggauuuuuuuuuaaauaaaaaaguuuacagaucaaaugugaaauaaauaugaauggaguggucc

SEQ ID NO: 451339 - RNA, 64 nt, hsa
agaagaacaagaaauggauguaagccuggcccauaaugugaacauaaguaaucacuaaugcuca

SEQ ID NO: 451340 - RNA, 64 nt, hsa
uccugggguaagagaaaaaaagcacaucacaacaaaugugaaagccuucauuauuacacguucc

SEQ ID NO: 451341 - RNA, 64 nt, hsa; identical to SEQ ID NO: 250101

SEQ ID NO: 451342 - RNA, 64 nt, hsa; identical to SEQ ID NO: 250102

SEQ ID NO: 451343 - RNA, 64 nt, hsa
cccaugccguucuucuguguaauauuaagaacugaaugugaaguuuauagcuagccugggugua

SEQ ID NO: 451344 - RNA, 64 nt, hsa
augaaaggacaagacacuguuaugcccuguccuaaaugugaagacagagguugaauuuuuuaaa

SEQ ID NO: 451345 - RNA, 64 nt, hsa
guauuuuguauuguuucaauugcaucucccagauaaugugaaaaugguccaggagaaggccaau

SEQ ID NO: 451346 - RNA, 64 nt, hsa
ggcuucuaacagaauucaaccagaaauaauugauaaugugaauuuuuguuaauuguucacuugu

SEQ ID NO: 451347 - RNA, 64 nt, hsa
caaaaaauguuuucuuacccuugacuuacaaugaaaugugaaauuacuugucugaaccccgugg

SEQ ID NO: 451348 - RNA, 64 nt, hsa
aaaaugcccauauuguaucuaucuguagucguuuaaugugaauuauaugugaauuuuuuucaaa

SEQ ID NO: 451349 - RNA, 64 nt, hsa
ucuaugagacgagagagagaagccuccgcuccuuaaugugaaacuucaugaaguuuuaaacuuc

SEQ ID NO: 451350 - RNA, 64 nt, hsa
cuaaguaauuuagaagauauuauuugucuuaaaaaaugugaaaugcuuuuauauucuaauaguu

SEQ ID NO: 451351 - RNA, 64 nt, hsa
cccaucuuccugaaaggauguuaguuucugccacaaugugaagaaggccuucaccuugacucuu

SEQ ID NO: 451352 - RNA, 64 nt, hsa
guccaaaccuaguuucccaugaguugcgacugaaaaugugaaacgacacuguauugcuguauac

SEQ ID NO: 451353 - RNA, 64 nt, hsa
uuggauguagcuuguuaguaguuaaaucuauagaaaugugaaauacacuuuguguggaaaaacc

SEQ ID NO: 451354 - RNA, 64 nt, hsa
guaguauuauugagucuuuucauacacuucuuaaaaugugaaaaucuauguuuucaguauuaug

SEQ ID NO: 451355 - RNA, 64 nt, hsa
aacuccugcaaugaauguuuaugugauugaagcaaaugugaaucguauuauuuuaaaaaguggc

SEQ ID NO: 451356 - RNA, 64 nt, hsa
aagaacaaaacugugcuguuacaacucaguguucaaugugaaauugcugccaaauguuauguag

SEQ ID NO: 451357 - RNA, 64 nt, hsa
cauacuuagauucacaaugguuguguaucucuauaaugugaaauauuuuuuuguggugauaaaa

SEQ ID NO: 451358 - RNA, 64 nt, hsa
uuuguuuuucuauuaaaaagcaaucaagaaagauaaugugaaaaagaaaggaauuuagagguag

SEQ ID NO: 451359 - RNA, 64 nt, hsa
augggauguaauccggauggccgcuucuguacuuaaugugaaauauuuagauaccuuuuugaac

SEQ ID NO: 451360 - RNA, 64 nt, hsa
ccauucaagagcaaucuuugcuaaggaguaagugaaugugaagaguaccaacuacaacaauucu

SEQ ID NO: 451361 - RNA, 64 nt, hsa
cuccuaauacugucaccuugggggugagaauuccaaugugaauuugcagggggagugggggaca

SEQ ID NO: 451362 - RNA, 64 nt, hsa
cccacauuauuuauagaaaauguacaguugugugaaugugaaauaaauguccucaacucccuuc

SEQ ID NO: 451363 - RNA, 64 nt, hsa
gguugcucugaggguuaaaugaaaauaaaaagaaaaugugaaacagcaccacagguacuugaca

SEQ ID NO: 451364 - RNA, 64 nt, hsa
aggcugugagcuccuugggggcaggcccucaauaaaugugaacugcugcugccgccucugccgu

SEQ ID NO: 451365 - RNA, 64 nt, hsa
aaauaaauauaauugggauuuuaaaaacaugagaaaugugaacugugauggggugggcagggcu

SEQ ID NO: 451366 - RNA, 64 nt, hsa
gguuucuacugagcaaaauaccaucuaaaaggagaaugugaauaguuguauuuugaaaugaugu

SEQ ID NO: 451367 - RNA, 64 nt, hsa
gcugagccaauagugauuuguuugcauaucaccuaaugugaaaagugcucaucugugaacucua

SEQ ID NO: 451368 - RNA, 64 nt, hsa
uuaaugaaacccuauggagaauuuaucccuuuacaaugugaauagucaucuccuaauuuguuuc

SEQ ID NO: 451369 - RNA, 64 nt, hsa
uucaaguucuaaggaagaaaagagucuccuuucgaaugugaagaaguaaauuuagaggaaauca

SEQ ID NO: 451370 - RNA, 64 nt, hsa
aauaaauuguuauuuucgcacaaugggaaucucuaaugugaaaauguauucuaugaaaauaauu

SEQ ID NO: 451371 - RNA, 64 nt, hsa
aaaagugagaagacauaaccaagacauggaaauaaaugugaaagcuggagccgaagagucaaag

SEQ ID NO: 451372 - RNA, 64 nt, hsa
aucuccgugugugcaugugacugugcuggguuggaaugugaacaauaaagaggaauguccaagu

SEQ ID NO: 451373 - RNA, 64 nt, hsa
cuguuacucuaaauagaaauauaggguuuuuuuuaaugugaauuuuugccuaucuuuaaacauu

SEQ ID NO: 451374 - RNA, 64 nt, hsa
cugaaaauacuguaaauacguuggggauuuguucaaugugaaaucagauaguuguuuucauaca

SEQ ID NO: 451375 - RNA, 64 nt, hsa
gaaaucuaaaagaauuuuaccauucaguuaauucaaugugaacacuggcacacugcucuuaaga

SEQ ID NO: 451376 - RNA, 64 nt, hsa
ucuacaguuugucuuugcuuuuccaaguuuuucuaaugugaagaaauuguauuacucuacuucu

SEQ ID NO: 451377 - RNA, 64 nt, hsa
ucauguguuuuccagguggauauaguuuguaaacaaugugaauaaaguauuuaacauguucaac

SEQ ID NO: 451378 - RNA, 64 nt, hsa
gaucuggagcccgggagagccacacugugggcuuaaugugaauagaggaacaaguggguaucuc

SEQ ID NO: 451379 - RNA, 64 nt, hsa
gcuauaugugaaaacauucuguaagcuucguacaaaugugaaguauuaauauuaucgcaguauu

SEQ ID NO: 451380 - RNA, 64 nt, hsa
agauucgauccucuuaaggcauuaucagugagcaaaugugaaggaaauggugucuggaagaaag

SEQ ID NO: 451381 - RNA, 64 nt, hsa
aucaauuuuguauaguuuauuucaaucuaaauaaaaugugaauuuuguuuaaagcuuaggcaca

SEQ ID NO: 451382 - RNA, 64 nt, hsa
uuuauguuuuuguugcauuuauguuuuugcagucaaugugaauucuuacgaauguacaacacaa

SEQ ID NO: 451383 - RNA, 64 nt, hsa
cuccaucugauacuccauugccuaugaaauguaaaaugugaacucccugugcugcuuguagaca

SEQ ID NO: 451384 - RNA, 64 nt, hsa
uuuguaauucaaacaugcuauauuuuuuaaaaucaaugugaaaacauagacuuauuuuuaaauu

SEQ ID NO: 451385 - RNA, 64 nt, hsa
caauucuugagaguuguaucugucguuauuucugaaugugaagcucagagaagugacacagagu

SEQ ID NO: 451386 - RNA, 64 nt, hsa
uaucuguguucccuuagauacuccuguaauucuuaaugugaauaguuuguuaauauugcuguaa

SEQ ID NO: 451387 - RNA, 64 nt, hsa
ccaacauaccauuauagucucuucuuucugagaaaaugugaaaccagaauugcaagacugggug

SEQ ID NO: 451388 - RNA, 64 nt, hsa
cugguugaaaauguugacccuauccuguuauuuaaaugugaacauuuauuguacauucagugag

SEQ ID NO: 451389 - RNA, 64 nt, hsa; identical to SEQ ID NO: 250103

SEQ ID NO: 451390 - RNA, 64 nt, hsa; identical to SEQ ID NO: 250104

SEQ ID NO: 451391 - RNA, 64 nt, hsa
acugaugauaaauuuguuacuuuggaguugaauaaaugugaaggcugugaagaguggacagucu

SEQ ID NO: 451392 - RNA, 64 nt, hsa
ucaguuuuucuugguuuauggaaauaucuauauuaaugugaaaauaauuaauuuagaauuguga

SEQ ID NO: 451393 - RNA, 64 nt, hsa
uccuuucucuuucucucuucccucagaaacuagaaaugugaaugaggauuauuauaaaaggggg

SEQ ID NO: 451394 - RNA, 64 nt, hsa
uuuaaaccaucuuggcuugugcuuuauucaaacuaaugugaaacaauaaauuuaaauauuauuu

SEQ ID NO: 451395 - RNA, 64 nt, hsa
uuucacuuuuuggauugcaucuccccaaaaacuaaaugugaaaucccuaccauuucuagccucu

SEQ ID NO: 451396 - RNA, 64 nt, hsa
uuguuuacaaucuacucaccaggcucauaccuacaaugugaacauacaguaugcccuuauuagc

SEQ ID NO: 451397 - RNA, 64 nt, hsa
caucauccucagcagcaucgaggaagggccgaggaaugugaagccagaucucgggacucagauu

SEQ ID NO: 451398 - RNA, 64 nt, hsa
ugaagcuggguagccuauugggguugagagggaaaaugugaaaucucagaauuuaucucccuua

SEQ ID NO: 451399 - RNA, 64 nt, hsa
uuacaaguauugaaauaauuacuaauuaaucacaaaugugaaguuaugcaugauguaaaaaaua

SEQ ID NO: 451400 - RNA, 64 nt, hsa
ccucuagauguguaauuacauggaaaauacuagcaaugugaaugcuuuuguaguaaccaucuug

SEQ ID NO: 451401 - RNA, 64 nt, hsa
auaaauauuucaguagaaauuacuugcaaaaugaaaugugaauuguaaaacuuggccuaaacaa

SEQ ID NO: 451402 - RNA, 64 nt, hsa; identical to SEQ ID NO: 250105

SEQ ID NO: 451403 - RNA, 64 nt, hsa; identical to SEQ ID NO: 250106

SEQ ID NO: 451404 - RNA, 64 nt, hsa; identical to SEQ ID NO: 250107

SEQ ID NO: 451405 - RNA, 64 nt, hsa
auacucucaccauuuggauccuguguggagagggaaugugaaauuuacaucauuucuuuuuggg

SEQ ID NO: 451406 - RNA, 64 nt, hsa
uuuuuguuacaaaucuucugaaaaaaaacaaaacaaugugaaacauuaaaauuaaaaggcauua

SEQ ID NO: 451407 - RNA, 64 nt, hsa; identical to SEQ ID NO: 250108

SEQ ID NO: 451408 - RNA, 64 nt, hsa; identical to SEQ ID NO: 250109

SEQ ID NO: 451409 - RNA, 64 nt, hsa
uuauugcacagacugaauggcuuuacauguuucuaaugugaauuaggcaugugaagcagugggu

SEQ ID NO: 451410 - RNA, 64 nt, hsa
cgauugcggccccucaccuuguccacguaucaggaaugugaaugugggaccuuuccuccauccc

SEQ ID NO: 451411 - RNA, 64 nt, hsa
ugaacccaccaccacaaagcaaauuagacaacuuaaugugaaaucauaccauugguugacguuu

SEQ ID NO: 451412 - RNA, 64 nt, hsa
uugcuucucccaccucugagauuaggacaggaaaaaugugaaauuucccaauuacaggauuaua

SEQ ID NO: 451413 - RNA, 64 nt, hsa
guaccagaauaggagauuauggccuauugaacaaaaugugaaacugggaguccacaaagacaua

SEQ ID NO: 451414 - RNA, 64 nt, hsa
guuauuugucauuuacaguauugggguuuuuaugaaugugaagcaaacaaaaaaaauuuguaug

SEQ ID NO: 451415 - RNA, 64 nt, hsa
uuagggcuuaugguacauggcuuccuggaaucaaaaugugaauucauguggaagggacauuaau

SEQ ID NO: 451416 - RNA, 64 nt, hsa
ggucuuuaauaguguugaguggcacaaccuuguaaaugugaaaguacaacgcauauuuaucucu

SEQ ID NO: 451417 - RNA, 64 nt, hsa
cagacuuugcacacagccucaggcuccacacagaaaugugaacuuggccucagacaggcuggcc

SEQ ID NO: 451418 - RNA, 64 nt, hsa
cagaaggagaaggaaggagacucaccucugccucaaugugaaucagacccuaccccaccacgau

SEQ ID NO: 451419 - RNA, 64 nt, hsa
ggucuuuaauaguguugaguggcacaaccuuguaaaugugaaaguacaacucguauuuaucucu

SEQ ID NO: 451420 - RNA, 64 nt, hsa
ccuuucucacauacuguacacagguaguauuuucaaugugaauccaaagcuugucugguucucu

SEQ ID NO: 451421 - RNA, 64 nt, hsa
cugugggcccagucauuggguuuuaucagugcuuaaugugaacuaaguuuuuuacuuccacaga

SEQ ID NO: 451422 - RNA, 55 nt, hsa
ugcacauauucuucaaauaaaguaaaaugugaaacucaacccacaucaccaccug

SEQ ID NO: 451423 - RNA, 64 nt, hsa
gaauccaaggaauaguucaguaauuauugccuaaaaugugaaagcauauuuuguauccuaaaau

SEQ ID NO: 451424 - RNA, 64 nt, hsa
cuuccuuucugagaaguuaguguuaaggucuuggaaugugaacacauuguuuguagugcuaucc

SEQ ID NO: 451425 - RNA, 64 nt, hsa
uuuagaagagccacgugaaacccaugacaaaaugaaugugaauauucuuucuaaaaauuuagaa

SEQ ID NO: 451426 - RNA, 64 nt, hsa
gauuguauuauugauuguauuguauacuauauuaaaugugaauuuguaccccuucauuuuaaaa

SEQ ID NO: 451427 - RNA, 64 nt, hsa
aggaauagcugcauaagacauuuugaaauaauguaaugugaaguguuucuuaaagcucugaaca

SEQ ID NO: 451428 - RNA, 64 nt, hsa
aaggcauaccuaaggacuaauuuaaacacauaucaaugugaaggacuaauuuaaauuacuauca

SEQ ID NO: 451429 - RNA, 64 nt, hsa
aaguaaauacauuauugaaaagcaaaucuguauaaaugugaaauuuuuauuuguauuaguaaua

SEQ ID NO: 451430 - RNA, 64 nt, hsa
gcgaguuuugcccaggccugcugucuugaguacaaaugugaaugaucgacugacugcuuguugc

SEQ ID NO: 451431 - RNA, 64 nt, hsa
agagguaacuaugcaaagcauccaggcgguucugaaugugaagcacuacacccagcagaguccc

SEQ ID NO: 451432 - RNA, 64 nt, hsa
ggguuagaagagagacaggggagugagcuagucaaaugugaaaaaugcucucccagcaaagcug

SEQ ID NO: 451433 - RNA, 64 nt, hsa
uuuuuuaguuacucaaaagccccuucuuguucugaaugugaaagcucuucccguuccugcuuac

SEQ ID NO: 451434 - RNA, 64 nt, hsa
aaacauuauauuaaaaaaaaaguuguguggugggaaugugaaagcagagaaauaacuuguaaau

SEQ ID NO: 451435 - RNA, 64 nt, hsa
aagaaaccuuuuuuaaacuauuucuagguuugugaaugugaagccccaggccgcagggggcaag

SEQ ID NO: 451436 - RNA, 64 nt, hsa
gaaauaguguaauuaaaaauaauugaaaguguuaaaugugaacuugagcuguuugaccagucac

SEQ ID NO: 451437 - RNA, 64 nt, hsa
agacaagagaaugcugucaauauugguguacuguaaugugaaucuaugcuggugaaaacaauuu

SEQ ID NO: 451438 - RNA, 64 nt, hsa
uaaggguacucuaguuuuauguagaugauuucagaaugugaaggcugguuugccugucagucau

SEQ ID NO: 451439 - RNA, 64 nt, hsa
gccagggaauaggaaaugagggcacuuacacauuaaugugaauuaguaauugugguauagaaau

SEQ ID NO: 451440 - RNA, 64 nt, hsa
guauauuucagugagguauauuuuaauacugaucaaugugaacuuuucuaaauacucuauuguc

SEQ ID NO: 451441 - RNA, 64 nt, hsa; identical to SEQ ID NO: 250110

SEQ ID NO: 451442 - RNA, 64 nt, hsa; identical to SEQ ID NO: 250111

SEQ ID NO: 451443 - RNA, 64 nt, hsa
ccaaaauuuucuacagagaguuaauuaucaccaaaaugugaaugguacauacaaaaccuggcau

SEQ ID NO: 451444 - RNA, 64 nt, hsa
uuuaauuguaaaagauuaguugaaaaacuguaugaaugugaagaucacaugcuuagucauuuuu

SEQ ID NO: 451445 - RNA, 64 nt, hsa
uuacuucaaguaacaugcuuagcuuucccuccuuaaugugaaaaaucaagggcuuacugacaua

SEQ ID NO: 451446 - RNA, 64 nt, hsa
agacugcaucaacccgacauuccuuucuuauaccaaugugaaauuuccagaucaucuguaaacc

SEQ ID NO: 451447 - RNA, 64 nt, hsa
auaaaauuauugaagcgauuucuauguggaaauaaaugugaaaaauaacuaugauauuuuggua

SEQ ID NO: 451448 - RNA, 64 nt, hsa
ugauaagcauaggagguucuguuauuaaagaaacaaugugaaauaauguggaaauuaauacuga

SEQ ID NO: 451449 - RNA, 64 nt, hsa
cucagucgggaagcuuuccagcuuccagcccuugaaugugaagugucauuggcaugucuggcag

SEQ ID NO: 451450 - RNA, 64 nt, hsa
uuucuggcaaacguuucucaaaucugcuucauccaaugugaaguucaucuugcagcauuuacua

SEQ ID NO: 451451 - RNA, 64 nt, hsa; identical to SEQ ID NO: 250112

SEQ ID NO: 451452 - RNA, 64 nt, hsa; identical to SEQ ID NO: 250113

SEQ ID NO: 451453 - RNA, 64 nt, hsa
acguggugcauauuaaaauaagcagagaaaaaaaaaugugaauaaacuacugaaaacacuuggu

SEQ ID NO: 451454 - RNA, 64 nt, hsa; identical to SEQ ID NO: 250114

SEQ ID NO: 451455 - RNA, 64 nt, hsa; identical to SEQ ID NO: 250115

SEQ ID NO: 451456 - RNA, 64 nt, hsa
gaauugccugagaacugcaaugaacaaucugacaaaugugaagcuggccaaaagucggaaaaug

SEQ ID NO: 451457 - RNA, 64 nt, hsa
uguaucuucugauuucaaagguaauacaacauuuaaugugaaacauuuagugaauacaguaaag

SEQ ID NO: 451458 - RNA, 64 nt, hsa
caaucacuguucuauaggcuuaugaucugagcaaaaugugaacuucaguauguuuacuauugcu

SEQ ID NO: 451459 - RNA, 64 nt, hsa
cagugaccuuuucuucauuuugguuuauuuuuguaaugugaaaaguaucacucuaaaaaacauu

SEQ ID NO: 451460 - RNA, 64 nt, hsa
agcuggcucugggugagucaguaagugguuagugaaugugaaggccaugauauuacugugcacu

SEQ ID NO: 451461 - RNA, 64 nt, hsa
auaauuagacacuuuagaggauauacuuggugauaaugugaaugauguaaucagacuaacaguu

SEQ ID NO: 451462 - RNA, 64 nt, hsa
aaaauauuauacuaauauguuguacauucggaagaaugugaaucaaucaguauguuuuuagauu

SEQ ID NO: 451463 - RNA, 64 nt, hsa
ccuuuaacauagguuuuuaaagacuaggauauugaaugugaaacauccguuuucauuguucacu

SEQ ID NO: 451464 - RNA, 64 nt, hsa
aagauuguacacauuuuuuucaaugaaguacaauaaugugaacugcauguguaaacagcaucac

SEQ ID NO: 451465 - RNA, 64 nt, hsa
augccaagaacuguauuuacugugguuguggacaaaugugaaaguaacuuuaugcuuaaauaaa

SEQ ID NO: 451466 - RNA, 64 nt, hsa
uuuaggauagugugauguguaacaaacaaccucaaaugugaaugccuugauuuuauuuuuaugg

SEQ ID NO: 451467 - RNA, 64 nt, hsa
auugugagaucuguaauuuuuuuuuuuuguagaaaaugugaauuuuuugguccucuaauuuguu

SEQ ID NO: 451468 - RNA, 64 nt, hsa
caggaguguuauguuuugccacuauuauuuucagaaugugaagauuuuacucuuggcuuaauuu

SEQ ID NO: 451469 - RNA, 64 nt, hsa
cuaugaauucuuuaggguagaaauuuauuuagcaaaugugaauucuuuugagaaaguaugaagu

SEQ ID NO: 451470 - RNA, 64 nt, hsa
gaaaauagcaaaacaacaaaaaagcaaaccuuaaaaugugaagaaagugugaauuuuaguuuug

SEQ ID NO: 451471 - RNA, 64 nt, hsa
ugugaaugcauauguaugugugguuacuuuuuauaaugugaaauaaugaauaaugaauuuacuc

SEQ ID NO: 451472 - RNA, 64 nt, hsa
ucuugccaagaggucucccaggagauauuugggaaaugugaaguucguaucuuuaaggagcauu

SEQ ID NO: 451473 - RNA, 64 nt, hsa
uuagagugguuuuuguuuuuucuuuucagauguuaaugugaaagaaaggguguugcauuuuuac

SEQ ID NO: 451474 - RNA, 64 nt, hsa
ccuugcagcaagcacuacaauguaugugaucgucaaugugaauagcuuagaauacugcaaagga

SEQ ID NO: 451475 - RNA, 64 nt, hsa
agcggcgaccgcccuccgcgaaaauaguuuguuuaaugugaacuuguagcuguaaaacgcuguc

SEQ ID NO: 451476 - RNA, 64 nt, hsa; identical to SEQ ID NO: 250116

SEQ ID NO: 451477 - RNA, 64 nt, hsa; identical to SEQ ID NO: 250117

SEQ ID NO: 451478 - RNA, 64 nt, hsa
uuaauguaaucaaaaugaaauauagauuaguuuaaaugugaauucagugacucuagggccaaag

SEQ ID NO: 451479 - RNA, 52 nt, hsa
uuggguuaacugcacuuugacaaaugugaacucucggaaauaguaugguggu

SEQ ID NO: 451480 - RNA, 64 nt, hsa
cucuuacuaaauccagauuuuuuaaacuguuuuaaaugugaauucuucccagaaauuucaaugc

SEQ ID NO: 451481 - RNA, 64 nt, hsa
guuggcuugugaaaaguuguuaaacaacaugcuaaaugugaaauguuaacccucuaaacuuucc

SEQ ID NO: 451482 - RNA, 64 nt, hsa
uuuaucacuagcagagaguaugauacaauuuucaaaugugaacaaucuuaaauuuagcuugucu

SEQ ID NO: 451483 - RNA, 64 nt, hsa
ccaaggcauguaggaaaauauugguacguuggaaaaugugaaaagagcuuuacuuucaaaaugu

SEQ ID NO: 451484 - RNA, 64 nt, hsa
gugggaggagggaggaaagaugaaaaaccacuuaaaugugaaggaacaacagcaacaagaccag

SEQ ID NO: 451485 - RNA, 64 nt, hsa
uccccauuccccuacuccugagcuaggaggaaaaaaugugaaucuuaccagcaguuccagccaa

SEQ ID NO: 451486 - RNA, 64 nt, hsa
cacgcgaaccuaugacacuucuuauuccacacugaaugugaaauugcauguucagauguuuacu

SEQ ID NO: 451487 - RNA, 64 nt, hsa
cuagagauuuagguuuaauuaauuuuacacaucuaaugugaacugcugccuaaccacucaagag

SEQ ID NO: 451488 - RNA, 64 nt, hsa
gccaccacacccagccuccaucuuuaaacuuuuaaaugugaaauuucuaucauguaccguuagc

SEQ ID NO: 451489 - RNA, 64 nt, hsa
ccaccccuccugccccacuuuggcccagaaaccaaaugugaacuuccugucucccaccucagca

SEQ ID NO: 451490 - RNA, 64 nt, hsa
ucuauuaaaucuuuuuuaaugcuguacuaagauaaaugugaagucugaguaagguugcucucag

SEQ ID NO: 451491 - RNA, 64 nt, hsa
cuuaauggugcucacuuuagcagacagcguccacaaugugaauccuacaguuuccaggugaggc

SEQ ID NO: 451492 - RNA, 64 nt, hsa; identical to SEQ ID NO: 250118

SEQ ID NO: 451493 - RNA, 64 nt, hsa; identical to SEQ ID NO: 250119

SEQ ID NO: 451494 - RNA, 64 nt, hsa
aaaucuggaggagaggauaauuuccacuguguggaaugugaauaguuaaaugaaaaguuauggu

SEQ ID NO: 451495 - RNA, 64 nt, hsa
gccuccuccucucaguauucucuccaaagauugaaaugugaagccccagccccacccucugccc

SEQ ID NO: 451496 - RNA, 64 nt, hsa
caccuuaaacucuuguucaguucacauuaauugaaaugugaacuugccugucguuugcaacuuc

SEQ ID NO: 451497 - RNA, 64 nt, hsa
gucgguucaugaaaagcuaugaaacagcaugcuaaaugugaaaugucaacccucacuaaacuuu

SEQ ID NO: 451498 - RNA, 64 nt, hsa
cagaauuguauuucaguuuugaagauuuaaaaaaaaugugaaaauaaauauauauuaguauccu

SEQ ID NO: 451499 - RNA, 64 nt, hsa; identical to SEQ ID NO: 250120

SEQ ID NO: 451500 - RNA, 64 nt, hsa; identical to SEQ ID NO: 250121

SEQ ID NO: 451501 - RNA, 64 nt, hsa; identical to SEQ ID NO: 250122

SEQ ID NO: 451502 - RNA, 64 nt, hsa
gauccauccagacauuugcaaacgucaggagaaaaaugugaauuauuuauccagaugcauguca

SEQ ID NO: 451503 - RNA, 64 nt, hsa
aauuauugcuuucauuccuuaccccccucaagcaaaugugaaaaguauacugaccuaagauucu

SEQ ID NO: 451504 - RNA, 64 nt, hsa
cugcuuugugcugauaucagaacagcagaaauuaaaugugaaauguuucugaugacuuauguuc

SEQ ID NO: 451505 - RNA, 64 nt, hsa
aggccccaggccagagccacccaaugaacagugcaaugugaaggaaggcaggagccugcagggg

SEQ ID NO: 451506 - RNA, 64 nt, hsa
ccaaugcugauguccucaccacaugcggagaacaaaugugaagggaguaggauauugggucagu

SEQ ID NO: 451507 - RNA, 64 nt, hsa
guaaacugagcccuuuguuuaaaaaacaauuccaaaugugaaacuagaaugagagggaagagau

SEQ ID NO: 451508 - RNA, 64 nt, hsa
ccauuuauaucauagcagaagaaauaggauuaucaaugugaacugcuuagcauggugccuggua

SEQ ID NO: 451509 - RNA, 64 nt, hsa
aagcuugucgguucaaagaggaaagaugaauuucaaugugaaaacacguuuuguugagggcugu

SEQ ID NO: 451510 - RNA, 64 nt, hsa
caaguauggacucaugagcuauuguugguugcuaaaugugaaucacgcgggagugagugugccc

SEQ ID NO: 451511 - RNA, 64 nt, hsa
ccacuuuuaacucuugaaauauaggaacuuaaauaaugugaaacuggauuaaacuuaaucuaaa

SEQ ID NO: 451512 - RNA, 64 nt, hsa
ucaagcaacagaggaccaaugcaacaagaacacaaaugugaaaucaugggcugacugagacaau

SEQ ID NO: 451513 - RNA, 64 nt, hsa
cugucucugcagguuagaagucugcuaaagaucaaaugugaaaguacuuggagaaacugaggcc

SEQ ID NO: 451514 - RNA, 64 nt, hsa
ugcauuuuggaaauguccucauuauguagaauggaaugugaaaauuauuuuuguuaaaacagga

SEQ ID NO: 451515 - RNA, 64 nt, hsa
uaaauagguacaguaaugaaaacuauacuaucaaaaugugaauaaaauuauagucagccauaaa

SEQ ID NO: 451516 - RNA, 64 nt, hsa
cuaaccaacuaguuaccuuuggacugcaacaaaaaaugugaaaaugaagauuuauuucuuuuaa

SEQ ID NO: 451517 - RNA, 64 nt, hsa
ucagaacuuuauaaaaaucuugaguuuguucacuaaugugaaauaagcuauguguccaggguau

SEQ ID NO: 451518 - RNA, 64 nt, hsa
uuauuuauaggaaaguuauauuaaugagauuaauaaugugaaauacaguuuuccugcaaaauua

SEQ ID NO: 451519 - RNA, 64 nt, hsa
cccugccuguuccccuucucccggccuccuucacaaugugaagcugugggugcagugggcccaa

SEQ ID NO: 451520 - RNA, 64 nt, hsa
uucccuugucaaaaauuaguugaaauuguucauuaaugugaauacagacugcauuuuaaaauug

SEQ ID NO: 451521 - RNA, 64 nt, hsa
cuagacacuuugaggcaagcaggaggcucugccuaaugugaauuuauuuauuugugaauaaacu

SEQ ID NO: 451522 - RNA, 64 nt, hsa
guuuacagggcauuccaagugauucuuaucaggaaaugugaaaaacacuccuguacauaaucgg

SEQ ID NO: 451523 - RNA, 64 nt, hsa
cagaggcguucguaugugacccacagauggcgucaaugugaacaccucucuuugugcugaauuu

SEQ ID NO: 451524 - RNA, 64 nt, hsa
auuccaggaaagagagauucccuggaaaauugaaaaugugaauccuagggggaaauuggggauu

SEQ ID NO: 451525 - RNA, 64 nt, hsa
aaacagguguacaguuaucguuguacuuuuguacaaugugaauuuuguuaauaaauuauaaggu

SEQ ID NO: 451526 - RNA, 64 nt, hsa
accaccauuaauuaguugggguggaguuuacuguaaugugaaauuuucacauuugaauuuuuua

SEQ ID NO: 451527 - RNA, 64 nt, hsa
guuugaauacuugaaucaugcaggccaauauuauaaugugaaaagguaucuacucuauuuacac

SEQ ID NO: 451528 - RNA, 64 nt, hsa
uuguuugucaaugauuugucagagaaccuguugaaaugugaauuaagaagcuaagaaaauauuu

SEQ ID NO: 451529 - RNA, 64 nt, hsa
gccaagcacagugccugcauguauuuauccaauaaaugugaaauucuguccaguuuuguggugg

SEQ ID NO: 451530 - RNA, 64 nt, hsa
auaauccauacuagagaaacacuauagauguaaaaaugugaaaaguuuuauucaaaauaucaaa

SEQ ID NO: 451531 - RNA, 64 nt, hsa
gauuuugcuguauauuugugauagcacuuucuacaaugugaacuuuauuaaauacaaaacuucc

SEQ ID NO: 451532 - RNA, 64 nt, hsa
gugaccguuugcuauauuccuuuuucuaugaaauaaugugaaugauaauaaaacagcuuugacu

SEQ ID NO: 451533 - RNA, 64 nt, hsa
gacucaaggucacuagaaaugggccagcugggucaaugugaagccccaaauuugcccagauuca

SEQ ID NO: 451534 - RNA, 64 nt, hsa
guaauuuaaaccuuggaucuucaaaaaauaaaauaaugugaagcaaaaccaacuaaaaagugau

SEQ ID NO: 451535 - RNA, 64 nt, hsa
agugaggaucuugauuuggaucucuuuuuauuuaaaugugaauuucaacuuuugacaaucaaag

SEQ ID NO: 451536 - RNA, 64 nt, hsa
gauuuucuagaagcacuauuuacacaaauaugcaaaugugaaauaaccgaucuauaacgugaag

SEQ ID NO: 451537 - RNA, 64 nt, hsa
uaggcgagggguucggaguguauuuucagguuggaaugugaagguuccuggcuuccaugugacu

SEQ ID NO: 451538 - RNA, 64 nt, hsa
aauuuggaaauccuagccaaggggauuucguguaaaugugaacacugacgaacugaaaagcuaa

SEQ ID NO: 451539 - RNA, 64 nt, hsa
gccgaguccaacagagaaaggacgucgcuguugaaaugugaaucccggcggacacgccaaauug

SEQ ID NO: 451540 - RNA, 64 nt, hsa
caagcucacaccuguaccugaugggaaugaacauaaugugaagaaacuuauuucccaguguaaa

SEQ ID NO: 451541 - RNA, 64 nt, hsa
caaaugacagagccuucaaaaauauuuuuggaauaaugugaaucaaccgaaaacugggggcaag

SEQ ID NO: 451542 - RNA, 64 nt, hsa
cuguugacuucuucccgacccagaaagcauggggaaugugaaggguaugcagaauguuguuggu

SEQ ID NO: 451543 - RNA, 64 nt, hsa
gcccgccagaggccugaagcugagcguguacguuaaugugaauguauauagucuuugcagaggu

SEQ ID NO: 451544 - RNA, 64 nt, hsa
ugaugcuccaaccucccggggggacgacgaugacaaugugaaaccaucacagcugggaagacau

SEQ ID NO: 451545 - RNA, 64 nt, hsa
augcuggguagaagcuguuuuaauuccccuguugaaugugaaaaagguaguaguauuccugggu

SEQ ID NO: 451546 - RNA, 60 nt, hsa
acacugaagagcaacccugaaaaauuacugaaugugaagaaauguaaguugguuuuauca

SEQ ID NO: 451547 - RNA, 64 nt, hsa
gaggcugcauauccaugggcgggcagcauaagagaaugugaagcccuucagugagacgagacga

SEQ ID NO: 451548 - RNA, 64 nt, hsa
auggcccaucacucggcuguggagaacaaagaccaaugugaagacacuacagaggauucugucu

SEQ ID NO: 451549 - RNA, 64 nt, hsa
aaucuaauucuaaggaauaugagcuuuauguaauaaugugaaucaugguuuuucuuaguagauu

SEQ ID NO: 451550 - RNA, 64 nt, hsa
cuugcagaagagcuugaaugggacgugcagcgagaaugugaaggauggagcagguagcucaucu

SEQ ID NO: 451551 - RNA, 64 nt, hsa
uuuuauaucaucuugucaaauugcuucaguuguaaaugugaaaaaugggcuggggaaaggaggu

SEQ ID NO: 451552 - RNA, 64 nt, hsa
ucauuuaaucccaggaaagaggcaucaaagcuagaaugugaauauaacuuuuguggaccaauac

SEQ ID NO: 451553 - RNA, 64 nt, hsa
ucagauuucaagagagcucaagcuuucagaagucaaugugaaaauuccuuccuaggcuguccca

SEQ ID NO: 451554 - RNA, 64 nt, hsa
uugaaucccacgcuucucuuuggaaacaauaugcaaugugaagcggucguguugugaguuuagu

SEQ ID NO: 451555 - RNA, 64 nt, hsa
uuucuuguuuuccuuuuuagaaguuuuuuuccuuaaugugaaaguaauuugaccaaguuauaau

SEQ ID NO: 451556 - RNA, 64 nt, hsa
aacacuuccugagcaccugcuacaugccaggcaaaaugugaaauuugcaugcuaugaggcuaaa

SEQ ID NO: 451557 - RNA, 64 nt, hsa
ucuuuaaaagauuuuuuuauuguuaucaauaauaaaugugaacuauuuaaagaaaagaaugucu

SEQ ID NO: 451558 - RNA, 64 nt, hsa
uugcccuugacaggugggggcuggcuggggccuuaaugugaaaagacaguggcaggcagcugga

SEQ ID NO: 451559 - RNA, 64 nt, hsa
aauugagacggacuuugacaaaacacgaaaugguaaugugaagcuaagagcagagagugaccaa

SEQ ID NO: 451560 - RNA, 64 nt, hsa
uaaugaaagaaaaugugaccaaagaaaugcacgaaaugugaaguucuuugucacuguccuguau

SEQ ID NO: 451561 - RNA, 64 nt, hsa
cuaacugcugaaaggugaccaaagaaaugcacaaaaugugaaaaucuuugucacuccauuuugu

SEQ ID NO: 451562 - RNA, 64 nt, hsa
gaaguagugguauggauauaaccuauuuagauuuaaugugaaauuuaagaaggaaacuugacuu

SEQ ID NO: 451563 - RNA, 64 nt, hsa
uauuacuagagcaagauggguuuuuaaggaaaauaaugugaaauucuggaaauuuucuuugggg

SEQ ID NO: 451564 - RNA, 64 nt, hsa
auugucuucuaugccacccuacagauuuuauuuuaaugugaauuauuuuuuucauuucauuuuu

SEQ ID NO: 451565 - RNA, 64 nt, hsa
gacgugacauugacaucaaacaaggauuacagugaaugugaaaaaaaaaaaaaaagauaccuga

SEQ ID NO: 451566 - RNA, 64 nt, hsa
uuuuccuagaccugguugucagccaaaguccuacaaugugaaaagaguuagauacuauuuuacu

SEQ ID NO: 451567 - RNA, 64 nt, hsa
ccaugaaucgcuucucuuuugaaacaauacucauaaugugaaguguuaauacuaguugugaccu

SEQ ID NO: 451568 - RNA, 64 nt, hsa
uccuuaaagaaacaaaguccaaaagucacuuuugaaugugaacaaaaggaagaaaaucaaggaa

SEQ ID NO: 451569 - RNA, 64 nt, hsa
cuggagaacccuccuaaauccauagaguuuucaaaaugugaaucuuuggaagccuugaguucag

SEQ ID NO: 451570 - RNA, 64 nt, hsa
cacugauugguuuucuuucuuuuuccuuggauuaaaugugaaagcaaaggcuucuggcucugcu

SEQ ID NO: 451571 - RNA, 64 nt, hsa
guacagcagaagccucucuccuagacugaaaaugaaugugaaacuaggaaauaaaaugugcccc

SEQ ID NO: 451572 - RNA, 64 nt, hsa
cccaggaaaaaaaaaaaaagaaauucgcauguuuaaugugaacucuccccuccccaucuguguu

SEQ ID NO: 451573 - RNA, 64 nt, hsa
caauaucacagaaucagaccaugugucccauggcaaugugaauccaauagucaauuacauaaug

SEQ ID NO: 451574 - RNA, 64 nt, hsa
aguauauauauauauauauaacuugaacuucauaaaugugaagauuaccacuucuuuuuauggc

SEQ ID NO: 451575 - RNA, 64 nt, hsa
uguagcaacagcucacaugacugaguagguagaaaaugugaaauaaaucucauauauauaguuu

SEQ ID NO: 451576 - RNA, 64 nt, hsa
uucauaacuaaugcauagaaaagauacauaaagcaaugugaaaguuucuugcuucuccuuuuua

SEQ ID NO: 451577 - RNA, 64 nt, hsa; identical to SEQ ID NO: 250123

SEQ ID NO: 451578 - RNA, 64 nt, hsa; identical to SEQ ID NO: 250124

SEQ ID NO: 451579 - RNA, 64 nt, hsa
ggagugaaagugacucucagguggugggguggggaaugugaauaaacaugauuucuugccgggc

SEQ ID NO: 451580 - RNA, 64 nt, hsa
gcccagagguuuacaaguuuucuaagcuuuugauaaugugaagcuccaggccgagaggaugcug

SEQ ID NO: 451581 - RNA, 64 nt, hsa
uuguauugaaaaagaucgcgaauaaaaaucaacaaaugugaaagcccagaaaaauauauucgua

SEQ ID NO: 451582 - RNA, 64 nt, hsa
agggaaauuaaaccauucaugaauaaacuuuaaaaaugugaaguguccuuuuccuuuucacaau

SEQ ID NO: 451583 - RNA, 64 nt, hsa
agucuuaaguuguuuaugcuuuaucagacuggcuaaugugaaagcauaauauuaugaaguuuau

SEQ ID NO: 451584 - RNA, 64 nt, hsa
acuauaaggcagggaagguucauuuguaaguaguaaugugaacugaauugcauuaagagugugu

SEQ ID NO: 451585 - RNA, 64 nt, hsa
caauuugaagaaagacugcauuguaauugagaggaaugugaaggugcauucaugggugcccuug

SEQ ID NO: 451586 - RNA, 64 nt, hsa
acuuuuauaacaguuuaccacuaugcuugauuauaaugugaaaggcggaauucugaguguguua

SEQ ID NO: 451587 - RNA, 64 nt, hsa
gauuuuaaaucaguguauaaucuagaugguaaaaaaugugaaauugggauuagggaccaaccaa

SEQ ID NO: 451588 - RNA, 64 nt, hsa
ugaauuauguuucaucaaugugcagaauaaucacaaugugaauuaucaaauucuccucaaugcc

SEQ ID NO: 451589 - RNA, 64 nt, hsa
ggguugauuuaugcugggcaguggaacgauuuccaaugugaagacgucaauaacuucauuugcg

SEQ ID NO: 451590 - RNA, 64 nt, hsa
auggcauauauguucaaauucaaaccauuuuuaaaaugugaagauggacuucaugcaaguuggc

SEQ ID NO: 451591 - RNA, 64 nt, hsa
uuuacaguucuguaaugcaaggaugcaguuuaaaaaugugaaguagugaugguuuuugaaauaa

SEQ ID NO: 451592 - RNA, 64 nt, hsa
ugaaaguauacuaaguaaguuaguuuuuauuauuaaugugaaagcaaaaacuuguauguuaacu

SEQ ID NO: 451593 - RNA, 64 nt, hsa
gaaaauguacuguuuuagaauguauuacaauaucaaugugaauaucuugaauccuguuacaaau

SEQ ID NO: 451594 - RNA, 64 nt, hsa
ugaucgagcuguuaauuuuuagacuauagaucaaaaugugaaacauuuuauguucaauccauau

SEQ ID NO: 451595 - RNA, 64 nt, hsa
uugcucagaaaagaugcugacucuuucauuauggaaugugaaauaucaguguugucuauaaaua

SEQ ID NO: 451596 - RNA, 64 nt, hsa
cagcacaaaauaugcauauaaaagugauggaauuaaugugaaauaaaacaaaaauauaauggcu

SEQ ID NO: 451597 - RNA, 64 nt, hsa
guaauugaacuuauccuaaaacaaauaguuuauaaaugugaacuuaaacucuaauuaauuccaa

SEQ ID NO: 451598 - RNA, 64 nt, hsa
ggaccccccacccaggggaccugcuccgugagauaaugugaaauacgacuguggaccaaacgca

SEQ ID NO: 451599 - RNA, 64 nt, hsa
uuuuuuaaucugcugccauauuguagcucaauacaaugugaauuuguuuuucguuuugggguuu

SEQ ID NO: 451600 - RNA, 64 nt, hsa
cauguaagaauguacccuggaucaaaacacuauaaaugugaaaacuacaaggaagguuuuccau

SEQ ID NO: 451601 - RNA, 64 nt, hsa
uuuaacuacuguaaggagaggagcggcguuggcaaaugugaaccaugagaauaucagugauacu

SEQ ID NO: 451602 - RNA, 64 nt, hsa
uauaaaaguaaucauacuggugagaaauucuaaaaaugugaagacuauggcaaagucuuuaaau

SEQ ID NO: 451603 - RNA, 64 nt, hsa; identical to SEQ ID NO: 250125

SEQ ID NO: 451604 - RNA, 64 nt, hsa; identical to SEQ ID NO: 250126

SEQ ID NO: 451605 - RNA, 64 nt, hsa; identical to SEQ ID NO: 250127

SEQ ID NO: 451606 - RNA, 64 nt, hsa; identical to SEQ ID NO: 250128

SEQ ID NO: 451607 - RNA, 64 nt, hsa; identical to SEQ ID NO: 250129

SEQ ID NO: 451608 - RNA, 64 nt, hsa; identical to SEQ ID NO: 250130

SEQ ID NO: 451609 - RNA, 64 nt, hsa; identical to SEQ ID NO: 250131

SEQ ID NO: 451610 - RNA, 64 nt, hsa; identical to SEQ ID NO: 250132

SEQ ID NO: 451611 - RNA, 64 nt, hsa; identical to SEQ ID NO: 250133

SEQ ID NO: 451612 - RNA, 64 nt, hsa; identical to SEQ ID NO: 250134

SEQ ID NO: 451613 - RNA, 64 nt, hsa
acaucggggaauuuaugcugguaggaaacuuucaaaugugaagaauauuggcaggucuauucuc

SEQ ID NO: 451614 - RNA, 64 nt, hsa
gggaaacucaaucaauguuauugugaaaacugggaaugugaauguaauauauguagaaaaacau

SEQ ID NO: 451615 - RNA, 64 nt, hsa
guucucugguuguuagcagcaaagaauucucacaaaugugaauaugggcgcacauuugccucau

SEQ ID NO: 451616 - RNA, 64 nt, hsa
aggacacagacugcgaccagaacagaaauaugaaaaugugaaugacagcgucccccgugugugg

SEQ ID NO: 451617 - RNA, 64 nt, hsa
aguacccccaaguccucucacuccuccagccuggaaugugaagugacuccccaaccccuuuggc

SEQ ID NO: 451618 - RNA, 64 nt, hsa
gaauaaucucauccccccacccgacuucuuuugaaaugugaacguccuuccuugacugucuagc

SEQ ID NO: 451619 - RNA, 64 nt, hsa
accucagagggcuuuucugaggauuaaauaaauaaaugugaagcacuuagaacugauggccagc

SEQ ID NO: 451620 - RNA, 64 nt, hsa
caucauagacuucauacuggagagaaaccuuacaaaugugaagcaugugacaaaguuuucaguc

SEQ ID NO: 451621 - RNA, 64 nt, hsa
gacagaggcggccccucccacggcucccaauaaaaaugugaaaaccaacccccgaacgugagca

SEQ ID NO: 451622 - RNA, 64 nt, hsa
gcacagauuauuuuuauagugauuuuugcagcuaaaugugaaggcaacugucuuaagucccuuc

SEQ ID NO: 451623 - RNA, 64 nt, hsa
gcaaguaacauugacuguaagaccucuguagggcaaugugaaaaucaugauugcuacagaagca

SEQ ID NO: 451624 - RNA, 64 nt, hsa
uaacaugcacaggccugcuugugaaucaggacugaaugugaaagggaaguauugagugaggaca

SEQ ID NO: 451625 - RNA, 64 nt, hsa
cuccaacagggaaggcucuguccagaaaggauugaaugugaacgggggcacccccuuuucuugc

SEQ ID NO: 451626 - RNA, 64 nt, hsa
aaguaaauccugccaccauguuguagcucaauacaaugugaacucacuuuuuuuuuuuuuuuaa

SEQ ID NO: 451627 - RNA, 58 nt, hsa
ccucuccgcaggcucaaugaaucgaaugaaugugaacuucuucaucugugaaaaaucu

SEQ ID NO: 451628 - RNA, 64 nt, hsa
gcaggggaaauguauuuaugcagcgacaccccacaaugugaacaaacagacaaaaaaucugugc

SEQ ID NO: 451629 - RNA, 64 nt, hsa
agauauugcaggcuccacuccagaucaccacaauaaugugaauauugcaauaaagcaagucaua

SEQ ID NO: 451630 - RNA, 64 nt, hsa
caaaacauaaaucauaguguugagaaauccuagaaaugugaagaaugugauaaaguuuuaaaug

SEQ ID NO: 451631 - RNA, 64 nt, hsa; identical to SEQ ID NO: 250135

SEQ ID NO: 451632 - RNA, 64 nt, hsa; identical to SEQ ID NO: 250136

SEQ ID NO: 451633 - RNA, 64 nt, hsa; identical to SEQ ID NO: 250137

SEQ ID NO: 451634 - RNA, 51 nt, hsa; identical to SEQ ID NO: 250138

SEQ ID NO: 451635 - RNA, 64 nt, hsa
auauguaagaauugaugauguauuugcaaacauuaaugugaaauaaauugaauuuaauguugaa

SEQ ID NO: 451636 - RNA, 64 nt, hsa
uaucuggccucugugccccagcagugccuugugcaaugugaaugugcgcgucucugcuaaacca

SEQ ID NO: 451637 - RNA, 64 nt, hsa
aagcacacauuauaaaaauucaaaaauuaccaaaaaugugaaaauuaauucuccccuaacaucc

SEQ ID NO: 451638 - RNA, 64 nt, hsa
ggcgucuuuuccgacuucaguuuuugugauaaagaaugugaacaguuguuagauguucucagug

SEQ ID NO: 451639 - RNA, 64 nt, hsa; identical to SEQ ID NO: 250139

SEQ ID NO: 451640 - RNA, 64 nt, hsa; identical to SEQ ID NO: 250140

SEQ ID NO: 451641 - RNA, 64 nt, hsa; identical to SEQ ID NO: 250141

SEQ ID NO: 451642 - RNA, 64 nt, hsa
acuuuuuuuuguuuguuuugagcagacaggcuaaaaugugaacguggggugagggaucacugcc

SEQ ID NO: 451643 - RNA, 64 nt, hsa
auuuuagguucugugaacuugcgagucauguagaaaugugaagaguccagugguagaauuugag

SEQ ID NO: 451644 - RNA, 64 nt, hsa
uagccucccggagggccccaguuucccucccgugaaugugaaguuccccaucuugguggccugc

SEQ ID NO: 451645 - RNA, 51 nt, hsa
auacuggagagaaaccuuagaaaugugaagcaugugacaaaguuuccauuu

SEQ ID NO: 451646 - RNA, 64 nt, hsa
caucauagucuucauacugcagagaaaucuuacaaaugugaagacugugacaaaguugucaguc

SEQ ID NO: 451647 - RNA, 64 nt, hsa
uugagguuuuuuggaaagccuacuauugcguuucaaugugaacuuugaaaucuuauugugcauc

SEQ ID NO: 451648 - RNA, 64 nt, hsa
accagaagugauuuggaagagaaauccuaaaaugaaugugaacaacagagugaucagaagagug

SEQ ID NO: 451649 - RNA, 64 nt, hsa
gaaugucgacacuguagccacaguuuuggccguaaaugugaauuuggcaaguaaccacuguucc

SEQ ID NO: 451650 - RNA, 64 nt, hsa
gagaagccucccucauuccucccaggaauuaauaaaugugaagagaggcucuguuuaaaauguc

SEQ ID NO: 451651 - RNA, 64 nt, hsa
acaucucgcuguggacgccuguaaauuacugagaaaugugaaacgugcaaucuugaaacugagg

SEQ ID NO: 451652 - RNA, 64 nt, hsa
gccgguuggcgaucucccgacagcuggauccggcaaugugaagcuuuuguuuggguuuccccgc

SEQ ID NO: 451653 - RNA, 64 nt, hsa
aauugucuuuaauuucugucagaaugcuauugaaaaugugaauugcaugacuuguagcauauuc

SEQ ID NO: 451654 - RNA, 64 nt, hsa
ggagaaauguaaagacugaauugaauuuuaagcuaaugugaaaucagagaauguuguaauaagu

SEQ ID NO: 451655 - RNA, 64 nt, hsa
gucccuccuugagcucaucagaaagguuuuaugaaaugugaaccauuuugggaaaagcugauca

SEQ ID NO: 451656 - RNA, 64 nt, hsa; identical to SEQ ID NO: 250142

SEQ ID NO: 451657 - RNA, 64 nt, hsa; identical to SEQ ID NO: 250143

SEQ ID NO: 451658 - RNA, 64 nt, hsa
uagggcauucacagaguagcugugaguucuugguaaugugaaaaaggccuuguuuuucagaaau

SEQ ID NO: 451659 - RNA, 64 nt, hsa
ugagguccagcccagaucugagaggaacccuggaaaugugaagucucuguugguuugggagaga

SEQ ID NO: 451660 - RNA, 64 nt, hsa
agggugcugggagccccuagaaguuccaaaagagaaugugaagcagaucaaggaaacuucuguu

SEQ ID NO: 451661 - RNA, 64 nt, hsa
uauuuuuugucuguuuauuuacgcuuuuauuggaaaugugaauaaguaaagaauuacuuguguu

SEQ ID NO: 451662 - RNA, 64 nt, hsa
uuuugggacaagcuuuacauggguggggagggaaaaugugaaacacauuagcaauaaguuaaac

SEQ ID NO: 451663 - RNA, 64 nt, hsa
uggaaauuccucuuuuagccucuccuuagaggugaaugugaaugaagccucccaggcacccgcu

SEQ ID NO: 451664 - RNA, 64 nt, hsa
aacugauaugccuucacucagaagaaaagaaaugaaugugaaagaaagccaagcaucacuugca

SEQ ID NO: 451665 - RNA, 64 nt, hsa
gaccagugaauaaagagaaucuaaggauuuguacaaugugaaauaacguguuaaauaaauguca

SEQ ID NO: 451666 - RNA, 64 nt, hsa
gccgcugcccucuggagaaccuucuucaaccggaaaugugaagacccucgacaucuugaauugc

SEQ ID NO: 451667 - RNA, 64 nt, hsa
ggcgccuuuuuggccugugauguuuuauccuuacaaugugaauaauggcacugaccggugcuuu

SEQ ID NO: 451668 - RNA, 64 nt, hsa
accaguggccucgugguuauuagcaaggcuggguaaugugaaggcccaagagcagagucugggc

SEQ ID NO: 451669 - RNA, 63 nt, hsa
ucuucucagaaacagacugaauuugaucugauuaaugugaaggacuggccagucugggaaacc

SEQ ID NO: 451670 - RNA, 64 nt, hsa
caggcaaagggauccauaugugcaauggcaaagaaaugugaaaaggcauugggagaagcagucu

SEQ ID NO: 451671 - RNA, 64 nt, hsa
gcuucagaaccuucucugacagacacgguaacuaaaugugaaaaaccaauaagcuggugacuca

SEQ ID NO: 451672 - RNA, 64 nt, hsa
uauugaaaauaucacaaguucagaaucccuauacaaugugaauauguggaaauaauuucccagc

SEQ ID NO: 451673 - RNA, 64 nt, hsa
auuuuuuuugucagcuuaucaaucagacugaucuaaugugaaauguaaguauccuuaaaaacaa

SEQ ID NO: 451674 - RNA, 64 nt, hsa
accccgccccaccccaccccaccccacccucugaaaugugaaaagccugcacucuuccuguggg

SEQ ID NO: 451675 - RNA, 64 nt, hsa
aucugcugcaacuuggagaaccucccugcccugaaaugugaaccaagcacacuuugguuccuuc

SEQ ID NO: 451676 - RNA, 64 nt, hsa
uaaaaucaagugcaccuacaccaacugcucucaaaaugugaacugacuuuuuuuuuuuuuuuuu

SEQ ID NO: 451677 - RNA, 64 nt, hsa
aaacagugagaaaagaaaggcuaaacacuauguaaaugugaauggaaacuuggaaauacucguu

SEQ ID NO: 451678 - RNA, 64 nt, hsa
auguacuagugaacaccguccucgaucuguacgaaaugugaaauguuuagggacaucuccaugc

SEQ ID NO: 451679 - RNA, 64 nt, hsa
uacauggagguaucucccgaaucauacaaaauuaaaugugaagaccguuuaugcauaccuucau

SEQ ID NO: 451680 - RNA, 64 nt, hsa
guuauauucggucuuugaaacugacaaucuuugaaaugugaauacuguaacaauauguuuucuu

SEQ ID NO: 451681 - RNA, 64 nt, hsa
ucugggggaauuuuuguuuuuuucuguuuucuauaaugugaaacuuuuguaguauguauuuuuc

SEQ ID NO: 451682 - RNA, 64 nt, hsa
uaaacagcaguauuacuauaagcaguugcuucaaaaugugaauuaacuuguugaaacuguggcu

SEQ ID NO: 451683 - RNA, 64 nt, hsa
uuuggaucaugcuaugucuguugcaagugaccacaaugugaaagaauuuaagucuuugaucgaa

SEQ ID NO: 451684 - RNA, 64 nt, hsa
ugccacaaugcaaaugcuuaaggcacggagugugaaugugaagacacaagcucuuucuggauac

SEQ ID NO: 451685 - RNA, 64 nt, hsa
uuuacuucugggcaauuuuuguauccaaggaaauaaugugaaugcgaggaaaugucuuuagagc

SEQ ID NO: 451686 - RNA, 64 nt, hsa; identical to SEQ ID NO: 250144

SEQ ID NO: 451687 - RNA, 64 nt, hsa; identical to SEQ ID NO: 250145

SEQ ID NO: 451688 - RNA, 64 nt, hsa
ugauagagauugauauuaauguaccauguauguuaaugugaaucugugggcaggauacuuuucc

SEQ ID NO: 451689 - RNA, 64 nt, hsa
uugaaguauguuuagucagcaugcucaggaaauaaaugugaauugcccuugagaccugcuucua

SEQ ID NO: 451690 - RNA, 64 nt, hsa
gaguugcuccagaugagucagugaguggugaaugaaugugaaggccuagggcauuacuguauac

SEQ ID NO: 451691 - RNA, 64 nt, hsa
gggcugggacgugaccugugcugagggcugugagaaugugaaacaacagugugaaaauuggcug

SEQ ID NO: 451692 - RNA, 64 nt, hsa
aaagaauggaguuguuggggcaggacaugcacacaaugugaaacagacaaaaugcauuacaccu

SEQ ID NO: 451693 - RNA, 64 nt, hsa
aagaaccucuuaagaaguccucagaaccagaagcaaugugaacucucagcgcugguccuggugg

SEQ ID NO: 451694 - RNA, 64 nt, hsa
ccgccacccuccucgcugccauucucugggcuggaaugugaagccucagucacucuaaaugaag

SEQ ID NO: 451695 - RNA, 64 nt, hsa
uguuguaaagaaacuguugaaaauaaagagaagcaaugugaagcaccuggugucuuguaguaua

SEQ ID NO: 451696 - RNA, 64 nt, hsa
cuggcugguuggauuuugggguggcaguuggacuaaugugaaaaaaacauugcugaaaaccuaa

SEQ ID NO: 451697 - RNA, 64 nt, hsa
gauacacacagaggggaaccgauuuuuuuuauccaaugugaauuauaaaugagauaauccacag

SEQ ID NO: 451698 - RNA, 64 nt, hsa
cacuuuuguauggcguuuuuauugugagauauuuaaugugaaugguuggggggacucuggcuga

SEQ ID NO: 451699 - RNA, 64 nt, hsa
gggucucucccgagggauggcuuuagucuugaugaaugugaaccaugucggaauuguuagguag

SEQ ID NO: 451700 - RNA, 64 nt, hsa
caguauuguggucauuuugaugauauguguguaaaaugugaauaauccaauuggugucuguacu

SEQ ID NO: 451701 - RNA, 64 nt, hsa
gaaaauguggcauuagaguagaaauaucuuuggaaaugugaaagaccccauagugaaauauuug

SEQ ID NO: 451702 - RNA, 64 nt, hsa; identical to SEQ ID NO: 250146

SEQ ID NO: 451703 - RNA, 64 nt, hsa; identical to SEQ ID NO: 250147

SEQ ID NO: 451704 - RNA, 64 nt, hsa
caauuuuaagucuuucuuuggucaacuuuuuuuuaaugugaaaaguuagguaagacacuuuuuu

SEQ ID NO: 451705 - RNA, 64 nt, hsa
auuucacaccagcaggugucuggacgaaaacaucaaugugaauaagggccaagugcaguccugu

SEQ ID NO: 451706 - RNA, 64 nt, hsa
cauuuaaauaagagagaaaugaugccguuuuuuaaaugugaagcagacuauaauucucagcucu

SEQ ID NO: 451707 - RNA, 64 nt, hsa
uaggcuuuguagcaagaugagcaaugcuguuggaaaugugaagucaccaguggccuuaccccug

SEQ ID NO: 451708 - RNA, 64 nt, hsa
cucccagcaccccauucuuguauacacauggcaaaaugugaagaaacuccuuucaucucagcag

SEQ ID NO: 451709 - RNA, 64 nt, hsa
aaauuauuaugcaaaaaugaauguuuuuucaaaaaaugugaaauguauuuuauuuucuuuauuu

SEQ ID NO: 451710 - RNA, 64 nt, hsa
uacuugauuaaggacuacagaauugggcccuuagaaugugaaaaaaaaaaguaauuaaaaagac

SEQ ID NO: 451711 - RNA, 64 nt, hsa
uuuuuuucacauuuaagcaggaaugcaauauaaaaaugugaaucucuuaauucucagccaugug

SEQ ID NO: 451712 - RNA, 64 nt, hsa
ccaagaaggcagggcaguuaaccuuuuuggugccaaugugaaauguaaaugauuuuauguuuuu

SEQ ID NO: 451713 - RNA, 64 nt, hsa; identical to SEQ ID NO: 250148

SEQ ID NO: 451714 - RNA, 64 nt, hsa; identical to SEQ ID NO: 250149

SEQ ID NO: 451715 - RNA, 64 nt, hsa
aaaggcuguauucagcaaggcgcuaacuugcuuaaaugugaauuacuaacuucuaaaacuguac

SEQ ID NO: 451716 - RNA, 64 nt, hsa
cacuacaagagcagaggauuaagguuuuuuuagaaaugugaaacaacauagcaguaaaauacau

SEQ ID NO: 451717 - RNA, 64 nt, hsa
uaacaguugcuuuggauucucuaagaugaauccaaaugugaaagaugcauguuacugccaaaac

SEQ ID NO: 451718 - RNA, 64 nt, hsa
ucuccagagcaucuugaacaggaauauuaagauaaaugugaaucugcaauggcugaaaagaguu

SEQ ID NO: 451719 - RNA, 64 nt, hsa
auuuagcgugcgguuucccaucaguuuuaccgugaaugugaaaaggugaaacuggugcugacuu

SEQ ID NO: 451720 - RNA, 64 nt, hsa
auguguggcauccauguugguuucgucugucuguaaugugaauuccaguauuuguuuaguauuu

SEQ ID NO: 451721 - RNA, 64 nt, hsa
uuacuguauuugacaaaggaaacucuuaaauuauaaugugaaaccugguuuuaugaaaccaaag

SEQ ID NO: 451722 - RNA, 64 nt, hsa
uuugcuuuuuuucuuccuauucagaaaagagcaaaaugugaaaagacacaagacucucagguau

SEQ ID NO: 451723 - RNA, 64 nt, hsa
aucgaccugcccuauuuucuauccucacugcaguaaugugaaagugaaguggaaauauugucac

SEQ ID NO: 451724 - RNA, 64 nt, hsa
agccuaaaccuauugauuccucgugauuauuuccaaugugaaaacaguuguguaugauugcauu

SEQ ID NO: 451725 - RNA, 64 nt, hsa
aguuugacugcuugaaaaagauuagcauacaucuaaugugaaaagaccacauuugauucaacug

SEQ ID NO: 451726 - RNA, 64 nt, hsa
ucaucuuuuuaugacuaauaguuuuuugauuaaaaaugugaacaagaaaauacuaaaauaaaaa

SEQ ID NO: 451727 - RNA, 64 nt, hsa
gacauauuacagccaguuuggggccccugacugcaaugugaaaccucucgcugcugcuagguuu

SEQ ID NO: 451728 - RNA, 64 nt, hsa
uaauuuuuuuaaaaauugaguggcacaucaaagaaaugugaaauuaaaaagaauucuuccaaaa

SEQ ID NO: 451729 - RNA, 64 nt, hsa
acggaaacaacucuauuaucuggugacuuuggguaaugugaaucagugccugaggaccuuugcu

SEQ ID NO: 451730 - RNA, 64 nt, hsa
ggacacaacugauaccuguucuuucuuuccaagaaaugugaauuauuugacugugagacguccu

SEQ ID NO: 451731 - RNA, 64 nt, hsa
gaaguuauucuugaucagauagaauuuaaccuaaaaugugaacucuuacuuacuuuuuguacau

SEQ ID NO: 451732 - RNA, 64 nt, hsa
ccgauaaccuaaaauaauuuagaaaugaauuaaaaaugugaaaucggguuaaagugaugaugau

SEQ ID NO: 451733 - RNA, 64 nt, hsa
cugcccuugcaaagcagcuggccaaggcuuauuaaaugugaacccaacuuuuccccagggcuuu

SEQ ID NO: 451734 - RNA, 64 nt, hsa; identical to SEQ ID NO: 250150

SEQ ID NO: 451735 - RNA, 64 nt, hsa; identical to SEQ ID NO: 250151

SEQ ID NO: 451736 - RNA, 64 nt, hsa
auaguuacagcaguggaauaaguauucauuuagaaaugugaaugagcaguaaaacugaugacau

SEQ ID NO: 451737 - RNA, 64 nt, hsa
ugggauaauaacagcaguggaauaaguacuuagaaaugugaaaaaugagcaguaaaauagauga

SEQ ID NO: 451738 - RNA, 64 nt, hsa
auacuuuuccucacuuuguugugcacuguaaugaaaugugaaaaaugcuuuauuuagcuguaug

SEQ ID NO: 451739 - RNA, 64 nt, hsa
auuuagcgugcgguuucccaucaguuuuacugugaaugugaaaaggugaaacuguugcugacuu

SEQ ID NO: 451740 - RNA, 64 nt, hsa
uccaguauugugagaucaauuucugaccauaugaaaugugaaaaguauauguuucuguuacaau

SEQ ID NO: 451741 - RNA, 64 nt, hsa
aucuuaauuugagacuuuuuuauaaugguuucguaaugugaaaucaaauacuaauuuaaacucu

SEQ ID NO: 451742 - RNA, 64 nt, hsa
cuaacaauccuucgcuuuuccucacucacguggaaaugugaacugucccggcucugucuucauu

SEQ ID NO: 451743 - RNA, 64 nt, hsa; identical to SEQ ID NO: 160748

SEQ ID NO: 451744 - RNA, 64 nt, hsa; identical to SEQ ID NO: 160749

SEQ ID NO: 451745 - RNA, 64 nt, hsa; identical to SEQ ID NO: 160750

SEQ ID NO: 451746 - RNA, 64 nt, hsa; identical to SEQ ID NO: 160751

SEQ ID NO: 451747 - RNA, 64 nt, hsa; identical to SEQ ID NO: 160752

SEQ ID NO: 451748 - RNA, 64 nt, hsa; identical to SEQ ID NO: 160753

SEQ ID NO: 451749 - RNA, 64 nt, hsa; identical to SEQ ID NO: 160754

SEQ ID NO: 451750 - RNA, 64 nt, hsa; identical to SEQ ID NO: 160755

SEQ ID NO: 451751 - RNA, 64 nt, hsa; identical to SEQ ID NO: 160756

SEQ ID NO: 451752 - RNA, 64 nt, hsa; identical to SEQ ID NO: 160757

SEQ ID NO: 451753 - RNA, 64 nt, hsa; identical to SEQ ID NO: 160758

SEQ ID NO: 451754 - RNA, 64 nt, hsa; identical to SEQ ID NO: 160759

SEQ ID NO: 451755 - RNA, 64 nt, hsa; identical to SEQ ID NO: 160760

SEQ ID NO: 451756 - RNA, 64 nt, hsa; identical to SEQ ID NO: 160761

SEQ ID NO: 451757 - RNA, 64 nt, hsa; identical to SEQ ID NO: 160762

SEQ ID NO: 451758 - RNA, 64 nt, hsa; identical to SEQ ID NO: 160763

SEQ ID NO: 451759 - RNA, 64 nt, hsa; identical to SEQ ID NO: 160764

SEQ ID NO: 451760 - RNA, 64 nt, hsa; identical to SEQ ID NO: 160765

SEQ ID NO: 451761 - RNA, 64 nt, hsa; identical to SEQ ID NO: 160766

SEQ ID NO: 451762 - RNA, 64 nt, hsa; identical to SEQ ID NO: 160767

SEQ ID NO: 451763 - RNA, 64 nt, hsa; identical to SEQ ID NO: 160768

SEQ ID NO: 451764 - RNA, 64 nt, hsa; identical to SEQ ID NO: 160769

SEQ ID NO: 451765 - RNA, 64 nt, hsa; identical to SEQ ID NO: 160770

SEQ ID NO: 451766 - RNA, 61 nt, hsa; identical to SEQ ID NO: 160771

SEQ ID NO: 451767 - RNA, 64 nt, hsa; identical to SEQ ID NO: 368902

SEQ ID NO: 451768 - RNA, 64 nt, hsa; identical to SEQ ID NO: 368903

SEQ ID NO: 451769 - RNA, 64 nt, hsa; identical to SEQ ID NO: 368904

SEQ ID NO: 451770 - RNA, 64 nt, hsa; identical to SEQ ID NO: 368905

SEQ ID NO: 451771 - RNA, 64 nt, hsa; identical to SEQ ID NO: 368906

SEQ ID NO: 451772 - RNA, 64 nt, hsa; identical to SEQ ID NO: 368907

SEQ ID NO: 451773 - RNA, 64 nt, hsa; identical to SEQ ID NO: 368908

SEQ ID NO: 451774 - RNA, 64 nt, hsa; identical to SEQ ID NO: 368909

SEQ ID NO: 451775 - RNA, 64 nt, hsa; identical to SEQ ID NO: 368910

SEQ ID NO: 451776 - RNA, 64 nt, hsa; identical to SEQ ID NO: 368911

SEQ ID NO: 451777 - RNA, 64 nt, hsa; identical to SEQ ID NO: 368912

SEQ ID NO: 451778 - RNA, 64 nt, hsa; identical to SEQ ID NO: 368913

SEQ ID NO: 451779 - RNA, 64 nt, hsa; identical to SEQ ID NO: 368914

SEQ ID NO: 451780 - RNA, 64 nt, hsa; identical to SEQ ID NO: 368915

SEQ ID NO: 451781 - RNA, 64 nt, hsa; identical to SEQ ID NO: 368916

SEQ ID NO: 451782 - RNA, 64 nt, hsa; identical to SEQ ID NO: 368917

SEQ ID NO: 451783 - RNA, 64 nt, hsa; identical to SEQ ID NO: 368917

SEQ ID NO: 451784 - RNA, 64 nt, hsa; identical to SEQ ID NO: 368919

SEQ ID NO: 451785 - RNA, 64 nt, hsa; identical to SEQ ID NO: 368920

SEQ ID NO: 451786 - RNA, 64 nt, hsa; identical to SEQ ID NO: 167062

SEQ ID NO: 451787 - RNA, 64 nt, hsa; identical to SEQ ID NO: 167063

SEQ ID NO: 451788 - RNA, 64 nt, hsa; identical to SEQ ID NO: 167064

SEQ ID NO: 451789 - RNA, 64 nt, hsa; identical to SEQ ID NO: 167065

SEQ ID NO: 451790 - RNA, 64 nt, hsa; identical to SEQ ID NO: 167066

SEQ ID NO: 451791 - RNA, 64 nt, hsa; identical to SEQ ID NO: 167067

SEQ ID NO: 451792 - RNA, 64 nt, hsa; identical to SEQ ID NO: 167068

SEQ ID NO: 451793 - RNA, 64 nt, hsa; identical to SEQ ID NO: 167069

SEQ ID NO: 451794 - RNA, 64 nt, hsa; identical to SEQ ID NO: 167070

SEQ ID NO: 451795 - RNA, 64 nt, hsa; identical to SEQ ID NO: 167071

SEQ ID NO: 451796 - RNA, 64 nt, hsa; identical to SEQ ID NO: 167072

SEQ ID NO: 451797 - RNA, 64 nt, hsa; identical to SEQ ID NO: 167073

SEQ ID NO: 451798 - RNA, 64 nt, hsa; identical to SEQ ID NO: 167074

SEQ ID NO: 451799 - RNA, 64 nt, hsa; identical to SEQ ID NO: 167075

SEQ ID NO: 451800 - RNA, 64 nt, hsa; identical to SEQ ID NO: 167076

SEQ ID NO: 451801 - RNA, 64 nt, hsa; identical to SEQ ID NO: 167077

SEQ ID NO: 451802 - RNA, 64 nt, hsa; identical to SEQ ID NO: 167078

SEQ ID NO: 451803 - RNA, 64 nt, hsa; identical to SEQ ID NO: 167079

SEQ ID NO: 451804 - RNA, 64 nt, hsa; identical to SEQ ID NO: 167080

SEQ ID NO: 451805 - RNA, 64 nt, hsa; identical to SEQ ID NO: 167081

SEQ ID NO: 451806 - RNA, 64 nt, hsa; identical to SEQ ID NO: 167082

SEQ ID NO: 451807 - RNA, 64 nt, hsa; identical to SEQ ID NO: 167083

SEQ ID NO: 451808 - RNA, 64 nt, hsa; identical to SEQ ID NO: 167084

SEQ ID NO: 451809 - RNA, 64 nt, hsa; identical to SEQ ID NO: 167085

SEQ ID NO: 451810 - RNA, 64 nt, hsa; identical to SEQ ID NO: 167086

SEQ ID NO: 451811 - RNA, 64 nt, hsa; identical to SEQ ID NO: 167087

SEQ ID NO: 451812 - RNA, 64 nt, hsa; identical to SEQ ID NO: 162601

SEQ ID NO: 451813 - RNA, 64 nt, hsa; identical to SEQ ID NO: 162602

SEQ ID NO: 451814 - RNA, 64 nt, hsa; identical to SEQ ID NO: 162603

SEQ ID NO: 451815 - RNA, 64 nt, hsa; identical to SEQ ID NO: 162604

SEQ ID NO: 451816 - RNA, 64 nt, hsa; identical to SEQ ID NO: 162605

SEQ ID NO: 451817 - RNA, 64 nt, hsa; identical to SEQ ID NO: 162606

SEQ ID NO: 451818 - RNA, 64 nt, hsa; identical to SEQ ID NO: 162607

SEQ ID NO: 451819 - RNA, 64 nt, hsa; identical to SEQ ID NO: 162608

SEQ ID NO: 451820 - RNA, 64 nt, hsa; identical to SEQ ID NO: 162609

SEQ ID NO: 451821 - RNA, 64 nt, hsa; identical to SEQ ID NO: 162610

SEQ ID NO: 451822 - RNA, 64 nt, hsa; identical to SEQ ID NO: 162611

SEQ ID NO: 451823 - RNA, 64 nt, hsa; identical to SEQ ID NO: 162612

SEQ ID NO: 451824 - RNA, 64 nt, hsa; identical to SEQ ID NO: 162613

SEQ ID NO: 451825 - RNA, 64 nt, hsa; identical to SEQ ID NO: 162614

SEQ ID NO: 451826 - RNA, 64 nt, hsa; identical to SEQ ID NO: 162615

SEQ ID NO: 451827 - RNA, 64 nt, hsa; identical to SEQ ID NO: 162616

SEQ ID NO: 451828 - RNA, 64 nt, hsa; identical to SEQ ID NO: 162617

SEQ ID NO: 451829 - RNA, 64 nt, hsa; identical to SEQ ID NO: 162618

SEQ ID NO: 451830 - RNA, 64 nt, hsa; identical to SEQ ID NO: 162619

SEQ ID NO: 451831 - RNA, 64 nt, hsa; identical to SEQ ID NO: 162620

SEQ ID NO: 451832 - RNA, 64 nt, hsa; identical to SEQ ID NO: 162621

SEQ ID NO: 451833 - RNA, 64 nt, hsa; identical to SEQ ID NO: 162622

SEQ ID NO: 451834 - RNA, 64 nt, hsa; identical to SEQ ID NO: 162623

SEQ ID NO: 451835 - RNA, 64 nt, hsa; identical to SEQ ID NO: 162624

SEQ ID NO: 451836 - RNA, 64 nt, hsa; identical to SEQ ID NO: 162625

SEQ ID NO: 451837 - RNA, 64 nt, hsa; identical to SEQ ID NO: 162626

SEQ ID NO: 451838 - RNA, 64 nt, hsa; identical to SEQ ID NO: 162627

SEQ ID NO: 451839 - RNA, 64 nt, hsa; identical to SEQ ID NO: 162628

SEQ ID NO: 451840 - RNA, 64 nt, hsa; identical to SEQ ID NO: 162629

SEQ ID NO: 451841 - RNA, 64 nt, hsa; identical to SEQ ID NO: 162630

SEQ ID NO: 451842 - RNA, 64 nt, hsa; identical to SEQ ID NO: 162631

SEQ ID NO: 451843 - RNA, 64 nt, hsa; identical to SEQ ID NO: 162632

SEQ ID NO: 451844 - RNA, 64 nt, hsa; identical to SEQ ID NO: 162633

SEQ ID NO: 451845 - RNA, 64 nt, hsa; identical to SEQ ID NO: 162634

SEQ ID NO: 451846 - RNA, 64 nt, hsa; identical to SEQ ID NO: 162635

SEQ ID NO: 451847 - RNA, 64 nt, hsa; identical to SEQ ID NO: 162636

SEQ ID NO: 451848 - RNA, 64 nt, hsa; identical to SEQ ID NO: 162637

SEQ ID NO: 451849 - RNA, 64 nt, hsa; identical to SEQ ID NO: 162638

SEQ ID NO: 451850 - RNA, 64 nt, hsa; identical to SEQ ID NO: 162639

SEQ ID NO: 451851 - RNA, 64 nt, hsa; identical to SEQ ID NO: 162640

SEQ ID NO: 451852 - RNA, 64 nt, hsa; identical to SEQ ID NO: 162641

SEQ ID NO: 451853 - RNA, 64 nt, hsa; identical to SEQ ID NO: 162642

SEQ ID NO: 451854 - RNA, 64 nt, hsa; identical to SEQ ID NO: 162643

SEQ ID NO: 451855 - RNA, 64 nt, hsa; identical to SEQ ID NO: 162644

SEQ ID NO: 451856 - RNA, 64 nt, hsa; identical to SEQ ID NO: 162645

SEQ ID NO: 451857 - RNA, 64 nt, hsa; identical to SEQ ID NO: 162646

SEQ ID NO: 451858 - RNA, 64 nt, hsa; identical to SEQ ID NO: 162647

SEQ ID NO: 451859 - RNA, 64 nt, hsa; identical to SEQ ID NO: 162648

SEQ ID NO: 451860 - RNA, 64 nt, hsa; identical to SEQ ID NO: 162649

SEQ ID NO: 451861 - RNA, 64 nt, hsa; identical to SEQ ID NO: 162650

SEQ ID NO: 451862 - RNA, 64 nt, hsa; identical to SEQ ID NO: 162651

SEQ ID NO: 451863 - RNA, 64 nt, hsa; identical to SEQ ID NO: 162652

SEQ ID NO: 451864 - RNA, 64 nt, hsa; identical to SEQ ID NO: 162653

SEQ ID NO: 451865 - RNA, 64 nt, hsa; identical to SEQ ID NO: 162654

SEQ ID NO: 451866 - RNA, 64 nt, hsa; identical to SEQ ID NO: 162655

SEQ ID NO: 451867 - RNA, 64 nt, hsa; identical to SEQ ID NO: 162656

SEQ ID NO: 451868 - RNA, 64 nt, hsa; identical to SEQ ID NO: 162657

SEQ ID NO: 451869 - RNA, 64 nt, hsa; identical to SEQ ID NO: 162658

SEQ ID NO: 451870 - RNA, 64 nt, hsa; identical to SEQ ID NO: 162659

SEQ ID NO: 451871 - RNA, 64 nt, hsa; identical to SEQ ID NO: 162660

SEQ ID NO: 451872 - RNA, 64 nt, hsa; identical to SEQ ID NO: 162661

SEQ ID NO: 451873 - RNA, 64 nt, hsa; identical to SEQ ID NO: 162662

SEQ ID NO: 451874 - RNA, 64 nt, hsa; identical to SEQ ID NO: 162663

SEQ ID NO: 451875 - RNA, 64 nt, hsa; identical to SEQ ID NO: 162664

SEQ ID NO: 451876 - RNA, 64 nt, hsa; identical to SEQ ID NO: 162665

SEQ ID NO: 451877 - RNA, 64 nt, hsa; identical to SEQ ID NO: 162666

SEQ ID NO: 451878 - RNA, 64 nt, hsa; identical to SEQ ID NO: 162667

SEQ ID NO: 451879 - RNA, 64 nt, hsa; identical to SEQ ID NO: 162668

SEQ ID NO: 451880 - RNA, 64 nt, hsa; identical to SEQ ID NO: 162669

SEQ ID NO: 451881 - RNA, 64 nt, hsa; identical to SEQ ID NO: 162670

SEQ ID NO: 451882 - RNA, 64 nt, hsa; identical to SEQ ID NO: 162671

SEQ ID NO: 451883 - RNA, 64 nt, hsa; identical to SEQ ID NO: 162672

SEQ ID NO: 451884 - RNA, 64 nt, hsa; identical to SEQ ID NO: 162673

SEQ ID NO: 451885 - RNA, 64 nt, hsa; identical to SEQ ID NO: 162674

SEQ ID NO: 451886 - RNA, 64 nt, hsa; identical to SEQ ID NO: 162675

SEQ ID NO: 451887 - RNA, 64 nt, hsa; identical to SEQ ID NO: 162676

SEQ ID NO: 451888 - RNA, 64 nt, hsa; identical to SEQ ID NO: 162677

SEQ ID NO: 451889 - RNA, 64 nt, hsa; identical to SEQ ID NO: 162678

SEQ ID NO: 451890 - RNA, 64 nt, hsa; identical to SEQ ID NO: 162679

SEQ ID NO: 451891 - RNA, 64 nt, hsa; identical to SEQ ID NO: 162680

SEQ ID NO: 451892 - RNA, 64 nt, hsa; identical to SEQ ID NO: 162681

SEQ ID NO: 451893 - RNA, 64 nt, hsa; identical to SEQ ID NO: 162682

SEQ ID NO: 451894 - RNA, 64 nt, hsa; identical to SEQ ID NO: 162683

SEQ ID NO: 451895 - RNA, 64 nt, hsa; identical to SEQ ID NO: 162684

SEQ ID NO: 451896 - RNA, 64 nt, hsa; identical to SEQ ID NO: 162685

SEQ ID NO: 451897 - RNA, 64 nt, hsa; identical to SEQ ID NO: 162686

SEQ ID NO: 451898 - RNA, 64 nt, hsa; identical to SEQ ID NO: 162687

SEQ ID NO: 451899 - RNA, 64 nt, hsa; identical to SEQ ID NO: 162688

SEQ ID NO: 451900 - RNA, 64 nt, hsa; identical to SEQ ID NO: 162689

SEQ ID NO: 451901 - RNA, 64 nt, hsa; identical to SEQ ID NO: 162690

SEQ ID NO: 451902 - RNA, 64 nt, hsa; identical to SEQ ID NO: 162691

SEQ ID NO: 451903 - RNA, 64 nt, hsa; identical to SEQ ID NO: 162692

SEQ ID NO: 451904 - RNA, 64 nt, hsa; identical to SEQ ID NO: 162693

SEQ ID NO: 451905 - RNA, 64 nt, hsa; identical to SEQ ID NO: 162694

SEQ ID NO: 451906 - RNA, 64 nt, hsa; identical to SEQ ID NO: 162695

SEQ ID NO: 451907 - RNA, 64 nt, hsa; identical to SEQ ID NO: 162696

SEQ ID NO: 451908 - RNA, 64 nt, hsa; identical to SEQ ID NO: 162697

SEQ ID NO: 451909 - RNA, 64 nt, hsa; identical to SEQ ID NO: 162698

SEQ ID NO: 451910 - RNA, 64 nt, hsa; identical to SEQ ID NO: 162699

SEQ ID NO: 451911 - RNA, 64 nt, hsa; identical to SEQ ID NO: 162700

SEQ ID NO: 451912 - RNA, 64 nt, hsa; identical to SEQ ID NO: 162701

SEQ ID NO: 451913 - RNA, 64 nt, hsa; identical to SEQ ID NO: 162702

SEQ ID NO: 451914 - RNA, 64 nt, hsa; identical to SEQ ID NO: 162703

SEQ ID NO: 451915 - RNA, 64 nt, hsa; identical to SEQ ID NO: 162704

SEQ ID NO: 451916 - RNA, 64 nt, hsa; identical to SEQ ID NO: 162705

SEQ ID NO: 451917 - RNA, 64 nt, hsa; identical to SEQ ID NO: 162706

SEQ ID NO: 451918 - RNA, 64 nt, hsa; identical to SEQ ID NO: 162707

SEQ ID NO: 451919 - RNA, 64 nt, hsa; identical to SEQ ID NO: 162708

SEQ ID NO: 451920 - RNA, 64 nt, hsa; identical to SEQ ID NO: 162709

SEQ ID NO: 451921 - RNA, 64 nt, hsa; identical to SEQ ID NO: 162710

SEQ ID NO: 451922 - RNA, 64 nt, hsa; identical to SEQ ID NO: 162711

SEQ ID NO: 451923 - RNA, 64 nt, hsa; identical to SEQ ID NO: 162712

SEQ ID NO: 451924 - RNA, 64 nt, hsa; identical to SEQ ID NO: 162713

SEQ ID NO: 451925 - RNA, 64 nt, hsa; identical to SEQ ID NO: 162714

SEQ ID NO: 451926 - RNA, 64 nt, hsa; identical to SEQ ID NO: 162715

SEQ ID NO: 451927 - RNA, 64 nt, hsa; identical to SEQ ID NO: 162716

SEQ ID NO: 451928 - RNA, 64 nt, hsa; identical to SEQ ID NO: 162717

SEQ ID NO: 451929 - RNA, 64 nt, hsa; identical to SEQ ID NO: 162718

SEQ ID NO: 451930 - RNA, 64 nt, hsa; identical to SEQ ID NO: 162719

SEQ ID NO: 451931 - RNA, 64 nt, hsa; identical to SEQ ID NO: 162720

SEQ ID NO: 451932 - RNA, 64 nt, hsa; identical to SEQ ID NO: 162721

SEQ ID NO: 451933 - RNA, 64 nt, hsa; identical to SEQ ID NO: 162722

SEQ ID NO: 451934 - RNA, 64 nt, hsa; identical to SEQ ID NO: 162723

SEQ ID NO: 451935 - RNA, 64 nt, hsa; identical to SEQ ID NO: 162724

SEQ ID NO: 451936 - RNA, 64 nt, hsa; identical to SEQ ID NO: 162725

SEQ ID NO: 451937 - RNA, 64 nt, hsa; identical to SEQ ID NO: 162726

SEQ ID NO: 451938 - RNA, 64 nt, hsa; identical to SEQ ID NO: 162727

SEQ ID NO: 451939 - RNA, 64 nt, hsa; identical to SEQ ID NO: 162728

SEQ ID NO: 451940 - RNA, 64 nt, hsa; identical to SEQ ID NO: 162729

SEQ ID NO: 451941 - RNA, 64 nt, hsa; identical to SEQ ID NO: 162730

SEQ ID NO: 451942 - RNA, 64 nt, hsa; identical to SEQ ID NO: 162731

SEQ ID NO: 451943 - RNA, 64 nt, hsa; identical to SEQ ID NO: 162732

SEQ ID NO: 451944 - RNA, 64 nt, hsa; identical to SEQ ID NO: 162733

SEQ ID NO: 451945 - RNA, 64 nt, hsa; identical to SEQ ID NO: 162734

SEQ ID NO: 451946 - RNA, 64 nt, hsa; identical to SEQ ID NO: 162735

SEQ ID NO: 451947 - RNA, 64 nt, hsa; identical to SEQ ID NO: 162736

SEQ ID NO: 451948 - RNA, 64 nt, hsa; identical to SEQ ID NO: 162737

SEQ ID NO: 451949 - RNA, 64 nt, hsa; identical to SEQ ID NO: 162738

SEQ ID NO: 451950 - RNA, 64 nt, hsa; identical to SEQ ID NO: 162739

SEQ ID NO: 451951 - RNA, 64 nt, hsa; identical to SEQ ID NO: 162740

SEQ ID NO: 451952 - RNA, 64 nt, hsa; identical to SEQ ID NO: 162741

SEQ ID NO: 451953 - RNA, 64 nt, hsa; identical to SEQ ID NO: 162742

SEQ ID NO: 451954 - RNA, 64 nt, hsa; identical to SEQ ID NO: 162743

SEQ ID NO: 451955 - RNA, 64 nt, hsa; identical to SEQ ID NO: 162744

SEQ ID NO: 451956 - RNA, 63 nt, hsa; identical to SEQ ID NO: 162745

SEQ ID NO: 451957 - RNA, 64 nt, hsa; identical to SEQ ID NO: 162746

SEQ ID NO: 451958 - RNA, 64 nt, hsa; identical to SEQ ID NO: 162747

SEQ ID NO: 451959 - RNA, 64 nt, hsa; identical to SEQ ID NO: 162748

SEQ ID NO: 451960 - RNA, 64 nt, hsa; identical to SEQ ID NO: 162749

SEQ ID NO: 451961 - RNA, 64 nt, hsa; identical to SEQ ID NO: 162750

SEQ ID NO: 451962 - RNA, 64 nt, hsa; identical to SEQ ID NO: 162751

SEQ ID NO: 451963 - RNA, 64 nt, hsa; identical to SEQ ID NO: 162752

SEQ ID NO: 451964 - RNA, 64 nt, hsa; identical to SEQ ID NO: 162753

SEQ ID NO: 451965 - RNA, 64 nt, hsa; identical to SEQ ID NO: 162754

SEQ ID NO: 451966 - RNA, 64 nt, hsa; identical to SEQ ID NO: 162755

SEQ ID NO: 451967 - RNA, 64 nt, hsa; identical to SEQ ID NO: 162756

SEQ ID NO: 451968 - RNA, 64 nt, hsa; identical to SEQ ID NO: 162757

SEQ ID NO: 451969 - RNA, 64 nt, hsa; identical to SEQ ID NO: 162758

SEQ ID NO: 451970 - RNA, 64 nt, hsa; identical to SEQ ID NO: 162759

SEQ ID NO: 451971 - RNA, 64 nt, hsa; identical to SEQ ID NO: 162760

SEQ ID NO: 451972 - RNA, 64 nt, hsa; identical to SEQ ID NO: 162761

SEQ ID NO: 451973 - RNA, 64 nt, hsa; identical to SEQ ID NO: 162762

SEQ ID NO: 451974 - RNA, 64 nt, hsa; identical to SEQ ID NO: 162763

SEQ ID NO: 451975 - RNA, 64 nt, hsa; identical to SEQ ID NO: 162764

SEQ ID NO: 451976 - RNA, 64 nt, hsa; identical to SEQ ID NO: 162765

SEQ ID NO: 451977 - RNA, 64 nt, hsa; identical to SEQ ID NO: 162766

SEQ ID NO: 451978 - RNA, 64 nt, hsa; identical to SEQ ID NO: 162767

SEQ ID NO: 451979 - RNA, 64 nt, hsa; identical to SEQ ID NO: 162768

SEQ ID NO: 451980 - RNA, 64 nt, hsa; identical to SEQ ID NO: 162769

SEQ ID NO: 451981 - RNA, 64 nt, hsa; identical to SEQ ID NO: 162770

SEQ ID NO: 451982 - RNA, 64 nt, hsa; identical to SEQ ID NO: 162771

SEQ ID NO: 451983 - RNA, 64 nt, hsa; identical to SEQ ID NO: 162772

SEQ ID NO: 451984 - RNA, 64 nt, hsa; identical to SEQ ID NO: 162773

SEQ ID NO: 451985 - RNA, 64 nt, hsa; identical to SEQ ID NO: 162774

SEQ ID NO: 451986 - RNA, 64 nt, hsa; identical to SEQ ID NO: 162775

SEQ ID NO: 451987 - RNA, 64 nt, hsa; identical to SEQ ID NO: 162776

SEQ ID NO: 451988 - RNA, 64 nt, hsa; identical to SEQ ID NO: 162777

SEQ ID NO: 451989 - RNA, 64 nt, hsa; identical to SEQ ID NO: 162778

SEQ ID NO: 451990 - RNA, 64 nt, hsa; identical to SEQ ID NO: 162779

SEQ ID NO: 451991 - RNA, 64 nt, hsa; identical to SEQ ID NO: 162780

SEQ ID NO: 451992 - RNA, 64 nt, hsa; identical to SEQ ID NO: 162781

SEQ ID NO: 451993 - RNA, 64 nt, hsa; identical to SEQ ID NO: 162782

SEQ ID NO: 451994 - RNA, 64 nt, hsa; identical to SEQ ID NO: 162783

SEQ ID NO: 451995 - RNA, 64 nt, hsa; identical to SEQ ID NO: 162784

SEQ ID NO: 451996 - RNA, 64 nt, hsa; identical to SEQ ID NO: 162785

SEQ ID NO: 451997 - RNA, 64 nt, hsa; identical to SEQ ID NO: 162786

SEQ ID NO: 451998 - RNA, 64 nt, hsa; identical to SEQ ID NO: 162787

SEQ ID NO: 451999 - RNA, 64 nt, hsa; identical to SEQ ID NO: 162788

SEQ ID NO: 452000 - RNA, 64 nt, hsa; identical to SEQ ID NO: 162789

SEQ ID NO: 452001 - RNA, 64 nt, hsa; identical to SEQ ID NO: 162790

SEQ ID NO: 452002 - RNA, 64 nt, hsa; identical to SEQ ID NO: 162791

SEQ ID NO: 452003 - RNA, 64 nt, hsa; identical to SEQ ID NO: 162792

SEQ ID NO: 452004 - RNA, 64 nt, hsa; identical to SEQ ID NO: 162793

SEQ ID NO: 452005 - RNA, 64 nt, hsa; identical to SEQ ID NO: 162794

SEQ ID NO: 452006 - RNA, 64 nt, hsa; identical to SEQ ID NO: 162795

SEQ ID NO: 452007 - RNA, 64 nt, hsa; identical to SEQ ID NO: 162796

SEQ ID NO: 452008 - RNA, 64 nt, hsa; identical to SEQ ID NO: 162797

SEQ ID NO: 452009 - RNA, 64 nt, hsa; identical to SEQ ID NO: 162798

SEQ ID NO: 452010 - RNA, 64 nt, hsa; identical to SEQ ID NO: 162799

SEQ ID NO: 452011 - RNA, 64 nt, hsa; identical to SEQ ID NO: 162800

SEQ ID NO: 452012 - RNA, 64 nt, hsa; identical to SEQ ID NO: 162801

SEQ ID NO: 452013 - RNA, 64 nt, hsa; identical to SEQ ID NO: 162802

SEQ ID NO: 452014 - RNA, 64 nt, hsa; identical to SEQ ID NO: 162803

SEQ ID NO: 452015 - RNA, 64 nt, hsa; identical to SEQ ID NO: 162804

SEQ ID NO: 452016 - RNA, 64 nt, hsa; identical to SEQ ID NO: 162805

SEQ ID NO: 452017 - RNA, 64 nt, hsa; identical to SEQ ID NO: 162806

SEQ ID NO: 452018 - RNA, 64 nt, hsa; identical to SEQ ID NO: 162807

SEQ ID NO: 452019 - RNA, 64 nt, hsa; identical to SEQ ID NO: 162808

SEQ ID NO: 452020 - RNA, 64 nt, hsa; identical to SEQ ID NO: 162809

SEQ ID NO: 452021 - RNA, 64 nt, hsa; identical to SEQ ID NO: 162810

SEQ ID NO: 452022 - RNA, 64 nt, hsa; identical to SEQ ID NO: 162811

SEQ ID NO: 452023 - RNA, 64 nt, hsa; identical to SEQ ID NO: 162812

SEQ ID NO: 452024 - RNA, 64 nt, hsa; identical to SEQ ID NO: 162813

SEQ ID NO: 452025 - RNA, 62 nt, hsa; identical to SEQ ID NO: 162814

SEQ ID NO: 452026 - RNA, 64 nt, hsa; identical to SEQ ID NO: 162815

SEQ ID NO: 452027 - RNA, 64 nt, hsa; identical to SEQ ID NO: 162816

SEQ ID NO: 452028 - RNA, 64 nt, hsa; identical to SEQ ID NO: 162817

SEQ ID NO: 452029 - RNA, 64 nt, hsa; identical to SEQ ID NO: 162818

SEQ ID NO: 452030 - RNA, 64 nt, hsa; identical to SEQ ID NO: 162819

SEQ ID NO: 452031 - RNA, 64 nt, hsa; identical to SEQ ID NO: 162820

SEQ ID NO: 452032 - RNA, 64 nt, hsa; identical to SEQ ID NO: 162821

SEQ ID NO: 452033 - RNA, 64 nt, hsa; identical to SEQ ID NO: 162822

SEQ ID NO: 452034 - RNA, 64 nt, hsa; identical to SEQ ID NO: 162823

SEQ ID NO: 452035 - RNA, 64 nt, hsa; identical to SEQ ID NO: 162824

SEQ ID NO: 452036 - RNA, 64 nt, hsa; identical to SEQ ID NO: 162825

SEQ ID NO: 452037 - RNA, 64 nt, hsa; identical to SEQ ID NO: 162826

SEQ ID NO: 452038 - RNA, 64 nt, hsa; identical to SEQ ID NO: 162827

SEQ ID NO: 452039 - RNA, 64 nt, hsa; identical to SEQ ID NO: 162828

SEQ ID NO: 452040 - RNA, 64 nt, hsa; identical to SEQ ID NO: 162829

SEQ ID NO: 452041 - RNA, 64 nt, hsa; identical to SEQ ID NO: 162830

SEQ ID NO: 452042 - RNA, 64 nt, hsa; identical to SEQ ID NO: 162831

SEQ ID NO: 452043 - RNA, 64 nt, hsa; identical to SEQ ID NO: 162832

SEQ ID NO: 452044 - RNA, 64 nt, hsa; identical to SEQ ID NO: 162833

SEQ ID NO: 452045 - RNA, 64 nt, hsa; identical to SEQ ID NO: 162834

SEQ ID NO: 452046 - RNA, 64 nt, hsa; identical to SEQ ID NO: 162835

SEQ ID NO: 452047 - RNA, 64 nt, hsa; identical to SEQ ID NO: 162836

SEQ ID NO: 452048 - RNA, 64 nt, hsa; identical to SEQ ID NO: 162837

SEQ ID NO: 452049 - RNA, 64 nt, hsa; identical to SEQ ID NO: 162838

SEQ ID NO: 452050 - RNA, 64 nt, hsa; identical to SEQ ID NO: 162839

SEQ ID NO: 452051 - RNA, 64 nt, hsa; identical to SEQ ID NO: 162840

SEQ ID NO: 452052 - RNA, 64 nt, hsa; identical to SEQ ID NO: 162841

SEQ ID NO: 452053 - RNA, 64 nt, hsa; identical to SEQ ID NO: 162842

SEQ ID NO: 452054 - RNA, 64 nt, hsa; identical to SEQ ID NO: 162843

SEQ ID NO: 452055 - RNA, 64 nt, hsa; identical to SEQ ID NO: 162844

SEQ ID NO: 452056 - RNA, 64 nt, hsa; identical to SEQ ID NO: 162845

SEQ ID NO: 452057 - RNA, 64 nt, hsa; identical to SEQ ID NO: 162846

SEQ ID NO: 452058 - RNA, 64 nt, hsa; identical to SEQ ID NO: 162847

SEQ ID NO: 452059 - RNA, 64 nt, hsa; identical to SEQ ID NO: 162848

SEQ ID NO: 452060 - RNA, 64 nt, hsa; identical to SEQ ID NO: 162849

SEQ ID NO: 452061 - RNA, 64 nt, hsa; identical to SEQ ID NO: 162850

SEQ ID NO: 452062 - RNA, 64 nt, hsa; identical to SEQ ID NO: 162851

SEQ ID NO: 452063 - RNA, 64 nt, hsa; identical to SEQ ID NO: 162852

SEQ ID NO: 452064 - RNA, 64 nt, hsa; identical to SEQ ID NO: 162853

SEQ ID NO: 452065 - RNA, 64 nt, hsa; identical to SEQ ID NO: 162854

SEQ ID NO: 452066 - RNA, 64 nt, hsa; identical to SEQ ID NO: 162855

SEQ ID NO: 452067 - RNA, 64 nt, hsa; identical to SEQ ID NO: 162856

SEQ ID NO: 452068 - RNA, 64 nt, hsa; identical to SEQ ID NO: 162857

SEQ ID NO: 452069 - RNA, 64 nt, hsa; identical to SEQ ID NO: 162858

SEQ ID NO: 452070 - RNA, 64 nt, hsa; identical to SEQ ID NO: 162859

SEQ ID NO: 452071 - RNA, 64 nt, hsa; identical to SEQ ID NO: 162860

SEQ ID NO: 452072 - RNA, 64 nt, hsa; identical to SEQ ID NO: 162861

SEQ ID NO: 452073 - RNA, 64 nt, hsa; identical to SEQ ID NO: 162862

SEQ ID NO: 452074 - RNA, 64 nt, hsa; identical to SEQ ID NO: 162863

SEQ ID NO: 452075 - RNA, 64 nt, hsa; identical to SEQ ID NO: 162864

SEQ ID NO: 452076 - RNA, 64 nt, hsa; identical to SEQ ID NO: 162865

SEQ ID NO: 452077 - RNA, 64 nt, hsa; identical to SEQ ID NO: 162866

SEQ ID NO: 452078 - RNA, 64 nt, hsa; identical to SEQ ID NO: 162867

SEQ ID NO: 452079 - RNA, 64 nt, hsa; identical to SEQ ID NO: 162868

SEQ ID NO: 452080 - RNA, 64 nt, hsa; identical to SEQ ID NO: 162869

SEQ ID NO: 452081 - RNA, 64 nt, hsa; identical to SEQ ID NO: 162870

SEQ ID NO: 452082 - RNA, 64 nt, hsa; identical to SEQ ID NO: 162871

SEQ ID NO: 452083 - RNA, 64 nt, hsa; identical to SEQ ID NO: 162872

SEQ ID NO: 452084 - RNA, 64 nt, hsa; identical to SEQ ID NO: 162873

SEQ ID NO: 452085 - RNA, 64 nt, hsa; identical to SEQ ID NO: 162874

SEQ ID NO: 452086 - RNA, 64 nt, hsa; identical to SEQ ID NO: 162875

SEQ ID NO: 452087 - RNA, 64 nt, hsa; identical to SEQ ID NO: 162876

SEQ ID NO: 452088 - RNA, 64 nt, hsa; identical to SEQ ID NO: 162877

SEQ ID NO: 452089 - RNA, 64 nt, hsa; identical to SEQ ID NO: 162878

SEQ ID NO: 452090 - RNA, 64 nt, hsa; identical to SEQ ID NO: 162879

SEQ ID NO: 452091 - RNA, 64 nt, hsa; identical to SEQ ID NO: 162880

SEQ ID NO: 452092 - RNA, 64 nt, hsa; identical to SEQ ID NO: 162881

SEQ ID NO: 452093 - RNA, 64 nt, hsa; identical to SEQ ID NO: 162882

SEQ ID NO: 452094 - RNA, 64 nt, hsa; identical to SEQ ID NO: 162883

SEQ ID NO: 452095 - RNA, 64 nt, hsa; identical to SEQ ID NO: 162884

SEQ ID NO: 452096 - RNA, 64 nt, hsa; identical to SEQ ID NO: 162885

SEQ ID NO: 452097 - RNA, 64 nt, hsa; identical to SEQ ID NO: 162886

SEQ ID NO: 452098 - RNA, 64 nt, hsa; identical to SEQ ID NO: 162887

SEQ ID NO: 452099 - RNA, 64 nt, hsa; identical to SEQ ID NO: 162888

SEQ ID NO: 452100 - RNA, 64 nt, hsa; identical to SEQ ID NO: 162889

SEQ ID NO: 452101 - RNA, 64 nt, hsa; identical to SEQ ID NO: 162890

SEQ ID NO: 452102 - RNA, 64 nt, hsa; identical to SEQ ID NO: 162891

SEQ ID NO: 452103 - RNA, 64 nt, hsa; identical to SEQ ID NO: 162892

SEQ ID NO: 452104 - RNA, 64 nt, hsa; identical to SEQ ID NO: 162893

SEQ ID NO: 452105 - RNA, 64 nt, hsa; identical to SEQ ID NO: 162894

SEQ ID NO: 452106 - RNA, 64 nt, hsa; identical to SEQ ID NO: 162895

SEQ ID NO: 452107 - RNA, 64 nt, hsa; identical to SEQ ID NO: 162896

SEQ ID NO: 452108 - RNA, 64 nt, hsa; identical to SEQ ID NO: 162897

SEQ ID NO: 452109 - RNA, 64 nt, hsa; identical to SEQ ID NO: 162898

SEQ ID NO: 452110 - RNA, 64 nt, hsa; identical to SEQ ID NO: 162899

SEQ ID NO: 452111 - RNA, 64 nt, hsa; identical to SEQ ID NO: 162900

SEQ ID NO: 452112 - RNA, 64 nt, hsa; identical to SEQ ID NO: 162901

SEQ ID NO: 452113 - RNA, 64 nt, hsa; identical to SEQ ID NO: 162902

SEQ ID NO: 452114 - RNA, 64 nt, hsa; identical to SEQ ID NO: 162903

SEQ ID NO: 452115 - RNA, 64 nt, hsa; identical to SEQ ID NO: 162904

SEQ ID NO: 452116 - RNA, 64 nt, hsa; identical to SEQ ID NO: 162905

SEQ ID NO: 452117 - RNA, 64 nt, hsa; identical to SEQ ID NO: 162906

SEQ ID NO: 452118 - RNA, 64 nt, hsa; identical to SEQ ID NO: 162907

SEQ ID NO: 452119 - RNA, 64 nt, hsa; identical to SEQ ID NO: 162908

SEQ ID NO: 452120 - RNA, 64 nt, hsa; identical to SEQ ID NO: 162909

SEQ ID NO: 452121 - RNA, 64 nt, hsa; identical to SEQ ID NO: 162910

SEQ ID NO: 452122 - RNA, 64 nt, hsa; identical to SEQ ID NO: 162911

SEQ ID NO: 452123 - RNA, 64 nt, hsa; identical to SEQ ID NO: 162912

SEQ ID NO: 452124 - RNA, 64 nt, hsa; identical to SEQ ID NO: 162913

SEQ ID NO: 452125 - RNA, 64 nt, hsa; identical to SEQ ID NO: 162914

SEQ ID NO: 452126 - RNA, 64 nt, hsa; identical to SEQ ID NO: 162915

SEQ ID NO: 452127 - RNA, 64 nt, hsa; identical to SEQ ID NO: 162916

SEQ ID NO: 452128 - RNA, 64 nt, hsa; identical to SEQ ID NO: 162917

SEQ ID NO: 452129 - RNA, 64 nt, hsa; identical to SEQ ID NO: 162918

SEQ ID NO: 452130 - RNA, 64 nt, hsa; identical to SEQ ID NO: 162919

SEQ ID NO: 452131 - RNA, 64 nt, hsa; identical to SEQ ID NO: 162920

SEQ ID NO: 452132 - RNA, 64 nt, hsa; identical to SEQ ID NO: 162921

SEQ ID NO: 452133 - RNA, 64 nt, hsa; identical to SEQ ID NO: 162922

SEQ ID NO: 452134 - RNA, 53 nt, hsa; identical to SEQ ID NO: 162923

SEQ ID NO: 452135 - RNA, 64 nt, hsa; identical to SEQ ID NO: 162924

SEQ ID NO: 452136 - RNA, 64 nt, hsa; identical to SEQ ID NO: 162925

SEQ ID NO: 452137 - RNA, 64 nt, hsa; identical to SEQ ID NO: 162926

SEQ ID NO: 452138 - RNA, 64 nt, hsa; identical to SEQ ID NO: 162927

SEQ ID NO: 452139 - RNA, 64 nt, hsa; identical to SEQ ID NO: 162928

SEQ ID NO: 452140 - RNA, 64 nt, hsa; identical to SEQ ID NO: 162929

SEQ ID NO: 452141 - RNA, 64 nt, hsa; identical to SEQ ID NO: 162930

SEQ ID NO: 452142 - RNA, 64 nt, hsa; identical to SEQ ID NO: 162931

SEQ ID NO: 452143 - RNA, 64 nt, hsa; identical to SEQ ID NO: 162932

SEQ ID NO: 452144 - RNA, 64 nt, hsa; identical to SEQ ID NO: 162933

SEQ ID NO: 452145 - RNA, 64 nt, hsa; identical to SEQ ID NO: 162934

SEQ ID NO: 452146 - RNA, 64 nt, hsa; identical to SEQ ID NO: 162935

SEQ ID NO: 452147 - RNA, 64 nt, hsa; identical to SEQ ID NO: 162936

SEQ ID NO: 452148 - RNA, 64 nt, hsa; identical to SEQ ID NO: 162937

SEQ ID NO: 452149 - RNA, 64 nt, hsa; identical to SEQ ID NO: 162938

SEQ ID NO: 452150 - RNA, 64 nt, hsa; identical to SEQ ID NO: 162939

SEQ ID NO: 452151 - RNA, 64 nt, hsa; identical to SEQ ID NO: 162940

SEQ ID NO: 452152 - RNA, 64 nt, hsa; identical to SEQ ID NO: 162941

SEQ ID NO: 452153 - RNA, 64 nt, hsa; identical to SEQ ID NO: 162942

SEQ ID NO: 452154 - RNA, 64 nt, hsa; identical to SEQ ID NO: 162943

SEQ ID NO: 452155 - RNA, 64 nt, hsa; identical to SEQ ID NO: 162944

SEQ ID NO: 452156 - RNA, 64 nt, hsa; identical to SEQ ID NO: 162945

SEQ ID NO: 452157 - RNA, 64 nt, hsa; identical to SEQ ID NO: 162946

SEQ ID NO: 452158 - RNA, 64 nt, hsa; identical to SEQ ID NO: 162947

SEQ ID NO: 452159 - RNA, 64 nt, hsa; identical to SEQ ID NO: 162948

SEQ ID NO: 452160 - RNA, 64 nt, hsa; identical to SEQ ID NO: 162949

SEQ ID NO: 452161 - RNA, 64 nt, hsa; identical to SEQ ID NO: 162950

SEQ ID NO: 452162 - RNA, 64 nt, hsa; identical to SEQ ID NO: 162951

SEQ ID NO: 452163 - RNA, 64 nt, hsa; identical to SEQ ID NO: 162952

SEQ ID NO: 452164 - RNA, 64 nt, hsa; identical to SEQ ID NO: 162953

SEQ ID NO: 452165 - RNA, 64 nt, hsa; identical to SEQ ID NO: 162954

SEQ ID NO: 452166 - RNA, 64 nt, hsa; identical to SEQ ID NO: 162955

SEQ ID NO: 452167 - RNA, 64 nt, hsa; identical to SEQ ID NO: 162956

SEQ ID NO: 452168 - RNA, 64 nt, hsa; identical to SEQ ID NO: 162957

SEQ ID NO: 452169 - RNA, 64 nt, hsa; identical to SEQ ID NO: 162958

SEQ ID NO: 452170 - RNA, 64 nt, hsa; identical to SEQ ID NO: 162959

SEQ ID NO: 452171 - RNA, 64 nt, hsa; identical to SEQ ID NO: 162960

SEQ ID NO: 452172 - RNA, 64 nt, hsa; identical to SEQ ID NO: 162961

SEQ ID NO: 452173 - RNA, 64 nt, hsa; identical to SEQ ID NO: 162962

SEQ ID NO: 452174 - RNA, 64 nt, hsa; identical to SEQ ID NO: 162963

SEQ ID NO: 452175 - RNA, 64 nt, hsa; identical to SEQ ID NO: 162964

SEQ ID NO: 452176 - RNA, 64 nt, hsa; identical to SEQ ID NO: 162965

SEQ ID NO: 452177 - RNA, 64 nt, hsa; identical to SEQ ID NO: 162966

SEQ ID NO: 452178 - RNA, 64 nt, hsa; identical to SEQ ID NO: 162967

SEQ ID NO: 452179 - RNA, 64 nt, hsa; identical to SEQ ID NO: 162968

SEQ ID NO: 452180 - RNA, 64 nt, hsa; identical to SEQ ID NO: 162969

SEQ ID NO: 452181 - RNA, 64 nt, hsa; identical to SEQ ID NO: 162970

SEQ ID NO: 452182 - RNA, 64 nt, hsa; identical to SEQ ID NO: 162971

SEQ ID NO: 452183 - RNA, 64 nt, hsa; identical to SEQ ID NO: 162972

SEQ ID NO: 452184 - RNA, 64 nt, hsa; identical to SEQ ID NO: 162973

SEQ ID NO: 452185 - RNA, 64 nt, hsa; identical to SEQ ID NO: 162974

SEQ ID NO: 452186 - RNA, 64 nt, hsa; identical to SEQ ID NO: 162975

SEQ ID NO: 452187 - RNA, 64 nt, hsa; identical to SEQ ID NO: 162976

SEQ ID NO: 452188 - RNA, 64 nt, hsa; identical to SEQ ID NO: 162977

SEQ ID NO: 452189 - RNA, 64 nt, hsa; identical to SEQ ID NO: 162978

SEQ ID NO: 452190 - RNA, 64 nt, hsa; identical to SEQ ID NO: 162979

SEQ ID NO: 452191 - RNA, 64 nt, hsa; identical to SEQ ID NO: 162980

SEQ ID NO: 452192 - RNA, 64 nt, hsa; identical to SEQ ID NO: 162981

SEQ ID NO: 452193 - RNA, 64 nt, hsa; identical to SEQ ID NO: 162982

SEQ ID NO: 452194 - RNA, 64 nt, hsa; identical to SEQ ID NO: 162983

SEQ ID NO: 452195 - RNA, 64 nt, hsa; identical to SEQ ID NO: 162984

SEQ ID NO: 452196 - RNA, 64 nt, hsa; identical to SEQ ID NO: 162985

SEQ ID NO: 452197 - RNA, 64 nt, hsa; identical to SEQ ID NO: 162986

SEQ ID NO: 452198 - RNA, 64 nt, hsa; identical to SEQ ID NO: 162987

SEQ ID NO: 452199 - RNA, 64 nt, hsa; identical to SEQ ID NO: 162988

SEQ ID NO: 452200 - RNA, 64 nt, hsa; identical to SEQ ID NO: 162989

SEQ ID NO: 452201 - RNA, 64 nt, hsa; identical to SEQ ID NO: 162990

SEQ ID NO: 452202 - RNA, 64 nt, hsa; identical to SEQ ID NO: 162991

SEQ ID NO: 452203 - RNA, 64 nt, hsa; identical to SEQ ID NO: 162992

SEQ ID NO: 452204 - RNA, 64 nt, hsa; identical to SEQ ID NO: 162993

SEQ ID NO: 452205 - RNA, 64 nt, hsa; identical to SEQ ID NO: 162994

SEQ ID NO: 452206 - RNA, 64 nt, hsa; identical to SEQ ID NO: 162995

SEQ ID NO: 452207 - RNA, 64 nt, hsa; identical to SEQ ID NO: 162996

SEQ ID NO: 452208 - RNA, 64 nt, hsa; identical to SEQ ID NO: 162997

SEQ ID NO: 452209 - RNA, 64 nt, hsa; identical to SEQ ID NO: 162998

SEQ ID NO: 452210 - RNA, 64 nt, hsa; identical to SEQ ID NO: 162999

SEQ ID NO: 452211 - RNA, 64 nt, hsa; identical to SEQ ID NO: 163000

SEQ ID NO: 452212 - RNA, 64 nt, hsa; identical to SEQ ID NO: 163001

SEQ ID NO: 452213 - RNA, 64 nt, hsa; identical to SEQ ID NO: 163002

SEQ ID NO: 452214 - RNA, 64 nt, hsa; identical to SEQ ID NO: 163003

SEQ ID NO: 452215 - RNA, 64 nt, hsa; identical to SEQ ID NO: 163004

SEQ ID NO: 452216 - RNA, 64 nt, hsa; identical to SEQ ID NO: 163005

SEQ ID NO: 452217 - RNA, 64 nt, hsa; identical to SEQ ID NO: 163006

SEQ ID NO: 452218 - RNA, 64 nt, hsa; identical to SEQ ID NO: 163007

SEQ ID NO: 452219 - RNA, 64 nt, hsa; identical to SEQ ID NO: 163008

SEQ ID NO: 452220 - RNA, 64 nt, hsa; identical to SEQ ID NO: 163009

SEQ ID NO: 452221 - RNA, 64 nt, hsa; identical to SEQ ID NO: 163010

SEQ ID NO: 452222 - RNA, 64 nt, hsa; identical to SEQ ID NO: 163011

SEQ ID NO: 452223 - RNA, 64 nt, hsa; identical to SEQ ID NO: 163012

SEQ ID NO: 452224 - RNA, 64 nt, hsa; identical to SEQ ID NO: 163013

SEQ ID NO: 452225 - RNA, 64 nt, hsa; identical to SEQ ID NO: 163014

SEQ ID NO: 452226 - RNA, 64 nt, hsa; identical to SEQ ID NO: 163015

SEQ ID NO: 452227 - RNA, 64 nt, hsa; identical to SEQ ID NO: 163016

SEQ ID NO: 452228 - RNA, 64 nt, hsa; identical to SEQ ID NO: 163017

SEQ ID NO: 452229 - RNA, 64 nt, hsa; identical to SEQ ID NO: 163018

SEQ ID NO: 452230 - RNA, 64 nt, hsa; identical to SEQ ID NO: 163019

SEQ ID NO: 452231 - RNA, 64 nt, hsa; identical to SEQ ID NO: 163020

SEQ ID NO: 452232 - RNA, 64 nt, hsa; identical to SEQ ID NO: 163021

SEQ ID NO: 452233 - RNA, 64 nt, hsa; identical to SEQ ID NO: 163022

SEQ ID NO: 452234 - RNA, 64 nt, hsa; identical to SEQ ID NO: 163023

SEQ ID NO: 452235 - RNA, 64 nt, hsa; identical to SEQ ID NO: 163024

SEQ ID NO: 452236 - RNA, 64 nt, hsa; identical to SEQ ID NO: 163025

SEQ ID NO: 452237 - RNA, 64 nt, hsa; identical to SEQ ID NO: 163026

SEQ ID NO: 452238 - RNA, 64 nt, hsa; identical to SEQ ID NO: 163027

SEQ ID NO: 452239 - RNA, 64 nt, hsa; identical to SEQ ID NO: 163028

SEQ ID NO: 452240 - RNA, 64 nt, hsa; identical to SEQ ID NO: 163029

SEQ ID NO: 452241 - RNA, 64 nt, hsa; identical to SEQ ID NO: 163030

SEQ ID NO: 452242 - RNA, 64 nt, hsa; identical to SEQ ID NO: 163031

SEQ ID NO: 452243 - RNA, 64 nt, hsa; identical to SEQ ID NO: 163032

SEQ ID NO: 452244 - RNA, 64 nt, hsa; identical to SEQ ID NO: 163033

SEQ ID NO: 452245 - RNA, 64 nt, hsa; identical to SEQ ID NO: 163034

SEQ ID NO: 452246 - RNA, 64 nt, hsa; identical to SEQ ID NO: 163035

SEQ ID NO: 452247 - RNA, 64 nt, hsa; identical to SEQ ID NO: 163036

SEQ ID NO: 452248 - RNA, 64 nt, hsa; identical to SEQ ID NO: 163037

SEQ ID NO: 452249 - RNA, 64 nt, hsa; identical to SEQ ID NO: 163038

SEQ ID NO: 452250 - RNA, 64 nt, hsa; identical to SEQ ID NO: 163039

SEQ ID NO: 452251 - RNA, 64 nt, hsa; identical to SEQ ID NO: 163040

SEQ ID NO: 452252 - RNA, 64 nt, hsa; identical to SEQ ID NO: 163041

SEQ ID NO: 452253 - RNA, 64 nt, hsa; identical to SEQ ID NO: 163042

SEQ ID NO: 452254 - RNA, 64 nt, hsa; identical to SEQ ID NO: 163043

SEQ ID NO: 452255 - RNA, 64 nt, hsa; identical to SEQ ID NO: 163044

SEQ ID NO: 452256 - RNA, 64 nt, hsa; identical to SEQ ID NO: 163045

SEQ ID NO: 452257 - RNA, 64 nt, hsa; identical to SEQ ID NO: 163046

SEQ ID NO: 452258 - RNA, 64 nt, hsa; identical to SEQ ID NO: 162809

SEQ ID NO: 452259 - RNA, 64 nt, hsa; identical to SEQ ID NO: 163048

SEQ ID NO: 452260 - RNA, 64 nt, hsa; identical to SEQ ID NO: 163049

SEQ ID NO: 452261 - RNA, 64 nt, hsa; identical to SEQ ID NO: 163050

SEQ ID NO: 452262 - RNA, 64 nt, hsa; identical to SEQ ID NO: 163051

SEQ ID NO: 452263 - RNA, 64 nt, hsa; identical to SEQ ID NO: 163052

SEQ ID NO: 452264 - RNA, 64 nt, hsa; identical to SEQ ID NO: 163053

SEQ ID NO: 452265 - RNA, 64 nt, hsa; identical to SEQ ID NO: 163054

SEQ ID NO: 452266 - RNA, 64 nt, hsa; identical to SEQ ID NO: 163055

SEQ ID NO: 452267 - RNA, 64 nt, hsa; identical to SEQ ID NO: 163056

SEQ ID NO: 452268 - RNA, 64 nt, hsa; identical to SEQ ID NO: 163057

SEQ ID NO: 452269 - RNA, 64 nt, hsa; identical to SEQ ID NO: 163058

SEQ ID NO: 452270 - RNA, 64 nt, hsa; identical to SEQ ID NO: 163059

SEQ ID NO: 452271 - RNA, 64 nt, hsa; identical to SEQ ID NO: 163060

SEQ ID NO: 452272 - RNA, 64 nt, hsa; identical to SEQ ID NO: 163061

SEQ ID NO: 452273 - RNA, 64 nt, hsa; identical to SEQ ID NO: 163062

SEQ ID NO: 452274 - RNA, 64 nt, hsa; identical to SEQ ID NO: 163063

SEQ ID NO: 452275 - RNA, 64 nt, hsa; identical to SEQ ID NO: 163064

SEQ ID NO: 452276 - RNA, 64 nt, hsa; identical to SEQ ID NO: 163065

SEQ ID NO: 452277 - RNA, 64 nt, hsa; identical to SEQ ID NO: 163066

SEQ ID NO: 452278 - RNA, 64 nt, hsa; identical to SEQ ID NO: 163067

SEQ ID NO: 452279 - RNA, 64 nt, hsa; identical to SEQ ID NO: 163068

SEQ ID NO: 452280 - RNA, 64 nt, hsa; identical to SEQ ID NO: 163069

SEQ ID NO: 452281 - RNA, 64 nt, hsa; identical to SEQ ID NO: 163070

SEQ ID NO: 452282 - RNA, 64 nt, hsa; identical to SEQ ID NO: 163071

SEQ ID NO: 452283 - RNA, 64 nt, hsa; identical to SEQ ID NO: 163072

SEQ ID NO: 452284 - RNA, 64 nt, hsa; identical to SEQ ID NO: 163073

SEQ ID NO: 452285 - RNA, 64 nt, hsa; identical to SEQ ID NO: 163074

SEQ ID NO: 452286 - RNA, 64 nt, hsa; identical to SEQ ID NO: 163075

SEQ ID NO: 452287 - RNA, 64 nt, hsa; identical to SEQ ID NO: 163076

SEQ ID NO: 452288 - RNA, 64 nt, hsa; identical to SEQ ID NO: 163077

SEQ ID NO: 452289 - RNA, 64 nt, hsa; identical to SEQ ID NO: 163078

SEQ ID NO: 452290 - RNA, 64 nt, hsa; identical to SEQ ID NO: 163079

SEQ ID NO: 452291 - RNA, 64 nt, hsa; identical to SEQ ID NO: 163080

SEQ ID NO: 452292 - RNA, 64 nt, hsa; identical to SEQ ID NO: 163081

SEQ ID NO: 452293 - RNA, 64 nt, hsa; identical to SEQ ID NO: 163082

SEQ ID NO: 452294 - RNA, 64 nt, hsa; identical to SEQ ID NO: 163083

SEQ ID NO: 452295 - RNA, 64 nt, hsa; identical to SEQ ID NO: 163084

SEQ ID NO: 452296 - RNA, 64 nt, hsa; identical to SEQ ID NO: 163085

SEQ ID NO: 452297 - RNA, 64 nt, hsa; identical to SEQ ID NO: 163086

SEQ ID NO: 452298 - RNA, 64 nt, hsa; identical to SEQ ID NO: 163087

SEQ ID NO: 452299 - RNA, 64 nt, hsa; identical to SEQ ID NO: 163088

SEQ ID NO: 452300 - RNA, 64 nt, hsa; identical to SEQ ID NO: 163089

SEQ ID NO: 452301 - RNA, 64 nt, hsa; identical to SEQ ID NO: 163090

SEQ ID NO: 452302 - RNA, 64 nt, hsa; identical to SEQ ID NO: 163091

SEQ ID NO: 452303 - RNA, 64 nt, hsa; identical to SEQ ID NO: 163092

SEQ ID NO: 452304 - RNA, 64 nt, hsa; identical to SEQ ID NO: 163093

SEQ ID NO: 452305 - RNA, 64 nt, hsa; identical to SEQ ID NO: 163094

SEQ ID NO: 452306 - RNA, 64 nt, hsa; identical to SEQ ID NO: 163095

SEQ ID NO: 452307 - RNA, 64 nt, hsa; identical to SEQ ID NO: 163096

SEQ ID NO: 452308 - RNA, 64 nt, hsa; identical to SEQ ID NO: 163097

SEQ ID NO: 452309 - RNA, 64 nt, hsa; identical to SEQ ID NO: 163098

SEQ ID NO: 452310 - RNA, 64 nt, hsa; identical to SEQ ID NO: 163099

SEQ ID NO: 452311 - RNA, 64 nt, hsa; identical to SEQ ID NO: 163100

SEQ ID NO: 452312 - RNA, 64 nt, hsa; identical to SEQ ID NO: 163101

SEQ ID NO: 452313 - RNA, 64 nt, hsa; identical to SEQ ID NO: 163102

SEQ ID NO: 452314 - RNA, 64 nt, hsa; identical to SEQ ID NO: 163103

SEQ ID NO: 452315 - RNA, 64 nt, hsa; identical to SEQ ID NO: 163104

SEQ ID NO: 452316 - RNA, 64 nt, hsa; identical to SEQ ID NO: 163105

SEQ ID NO: 452317 - RNA, 64 nt, hsa; identical to SEQ ID NO: 163106

SEQ ID NO: 452318 - RNA, 64 nt, hsa; identical to SEQ ID NO: 163107

SEQ ID NO: 452319 - RNA, 64 nt, hsa; identical to SEQ ID NO: 163108

SEQ ID NO: 452320 - RNA, 64 nt, hsa; identical to SEQ ID NO: 163109

SEQ ID NO: 452321 - RNA, 64 nt, hsa; identical to SEQ ID NO: 163110

SEQ ID NO: 452322 - RNA, 64 nt, hsa; identical to SEQ ID NO: 163111

SEQ ID NO: 452323 - RNA, 64 nt, hsa; identical to SEQ ID NO: 163112

SEQ ID NO: 452324 - RNA, 64 nt, hsa; identical to SEQ ID NO: 163113

SEQ ID NO: 452325 - RNA, 64 nt, hsa; identical to SEQ ID NO: 163114

SEQ ID NO: 452326 - RNA, 64 nt, hsa; identical to SEQ ID NO: 163115

SEQ ID NO: 452327 - RNA, 64 nt, hsa; identical to SEQ ID NO: 163116

SEQ ID NO: 452328 - RNA, 64 nt, hsa; identical to SEQ ID NO: 163117

SEQ ID NO: 452329 - RNA, 64 nt, hsa; identical to SEQ ID NO: 163118

SEQ ID NO: 452330 - RNA, 64 nt, hsa; identical to SEQ ID NO: 163119

SEQ ID NO: 452331 - RNA, 64 nt, hsa; identical to SEQ ID NO: 163120

SEQ ID NO: 452332 - RNA, 64 nt, hsa; identical to SEQ ID NO: 163121

SEQ ID NO: 452333 - RNA, 64 nt, hsa; identical to SEQ ID NO: 163122

SEQ ID NO: 452334 - RNA, 64 nt, hsa; identical to SEQ ID NO: 163123

SEQ ID NO: 452335 - RNA, 64 nt, hsa; identical to SEQ ID NO: 163124

SEQ ID NO: 452336 - RNA, 64 nt, hsa; identical to SEQ ID NO: 163125

SEQ ID NO: 452337 - RNA, 64 nt, hsa; identical to SEQ ID NO: 163126

SEQ ID NO: 452338 - RNA, 64 nt, hsa; identical to SEQ ID NO: 163127

SEQ ID NO: 452339 - RNA, 64 nt, hsa; identical to SEQ ID NO: 163128

SEQ ID NO: 452340 - RNA, 64 nt, hsa; identical to SEQ ID NO: 163129

SEQ ID NO: 452341 - RNA, 64 nt, hsa; identical to SEQ ID NO: 163130

SEQ ID NO: 452342 - RNA, 64 nt, hsa; identical to SEQ ID NO: 163131

SEQ ID NO: 452343 - RNA, 64 nt, hsa; identical to SEQ ID NO: 163132

SEQ ID NO: 452344 - RNA, 64 nt, hsa; identical to SEQ ID NO: 163133

SEQ ID NO: 452345 - RNA, 64 nt, hsa; identical to SEQ ID NO: 163134

SEQ ID NO: 452346 - RNA, 64 nt, hsa; identical to SEQ ID NO: 163135

SEQ ID NO: 452347 - RNA, 64 nt, hsa; identical to SEQ ID NO: 163136

SEQ ID NO: 452348 - RNA, 64 nt, hsa; identical to SEQ ID NO: 163137

SEQ ID NO: 452349 - RNA, 64 nt, hsa; identical to SEQ ID NO: 163138

SEQ ID NO: 452350 - RNA, 64 nt, hsa; identical to SEQ ID NO: 163139

SEQ ID NO: 452351 - RNA, 64 nt, hsa; identical to SEQ ID NO: 163140

SEQ ID NO: 452352 - RNA, 64 nt, hsa; identical to SEQ ID NO: 163141

SEQ ID NO: 452353 - RNA, 64 nt, hsa; identical to SEQ ID NO: 163142

SEQ ID NO: 452354 - RNA, 64 nt, hsa; identical to SEQ ID NO: 163143

SEQ ID NO: 452355 - RNA, 64 nt, hsa; identical to SEQ ID NO: 163144

SEQ ID NO: 452356 - RNA, 64 nt, hsa; identical to SEQ ID NO: 163145

SEQ ID NO: 452357 - RNA, 64 nt, hsa; identical to SEQ ID NO: 163146

SEQ ID NO: 452358 - RNA, 64 nt, hsa; identical to SEQ ID NO: 163147

SEQ ID NO: 452359 - RNA, 64 nt, hsa; identical to SEQ ID NO: 163148

SEQ ID NO: 452360 - RNA, 64 nt, hsa; identical to SEQ ID NO: 163149

SEQ ID NO: 452361 - RNA, 64 nt, hsa; identical to SEQ ID NO: 163150

SEQ ID NO: 452362 - RNA, 64 nt, hsa; identical to SEQ ID NO: 163151

SEQ ID NO: 452363 - RNA, 64 nt, hsa; identical to SEQ ID NO: 163152

SEQ ID NO: 452364 - RNA, 64 nt, hsa; identical to SEQ ID NO: 163153

SEQ ID NO: 452365 - RNA, 64 nt, hsa; identical to SEQ ID NO: 163154

SEQ ID NO: 452366 - RNA, 64 nt, hsa; identical to SEQ ID NO: 163155

SEQ ID NO: 452367 - RNA, 64 nt, hsa; identical to SEQ ID NO: 163156

SEQ ID NO: 452368 - RNA, 64 nt, hsa; identical to SEQ ID NO: 163157

SEQ ID NO: 452369 - RNA, 64 nt, hsa; identical to SEQ ID NO: 163158

SEQ ID NO: 452370 - RNA, 64 nt, hsa; identical to SEQ ID NO: 163159

SEQ ID NO: 452371 - RNA, 64 nt, hsa; identical to SEQ ID NO: 163160

SEQ ID NO: 452372 - RNA, 64 nt, hsa; identical to SEQ ID NO: 163161

SEQ ID NO: 452373 - RNA, 64 nt, hsa; identical to SEQ ID NO: 163162

SEQ ID NO: 452374 - RNA, 64 nt, hsa; identical to SEQ ID NO: 163163

SEQ ID NO: 452375 - RNA, 64 nt, hsa; identical to SEQ ID NO: 163164

SEQ ID NO: 452376 - RNA, 64 nt, hsa; identical to SEQ ID NO: 163165

SEQ ID NO: 452377 - RNA, 64 nt, hsa; identical to SEQ ID NO: 163166

SEQ ID NO: 452378 - RNA, 64 nt, hsa; identical to SEQ ID NO: 162657

SEQ ID NO: 452379 - RNA, 64 nt, hsa; identical to SEQ ID NO: 163168

SEQ ID NO: 452380 - RNA, 64 nt, hsa; identical to SEQ ID NO: 163169

SEQ ID NO: 452381 - RNA, 64 nt, hsa; identical to SEQ ID NO: 163170

SEQ ID NO: 452382 - RNA, 64 nt, hsa; identical to SEQ ID NO: 163171

SEQ ID NO: 452383 - RNA, 64 nt, hsa; identical to SEQ ID NO: 163172

SEQ ID NO: 452384 - RNA, 64 nt, hsa; identical to SEQ ID NO: 163173

SEQ ID NO: 452385 - RNA, 64 nt, hsa; identical to SEQ ID NO: 163174

SEQ ID NO: 452386 - RNA, 64 nt, hsa; identical to SEQ ID NO: 163175

SEQ ID NO: 452387 - RNA, 64 nt, hsa; identical to SEQ ID NO: 163176

SEQ ID NO: 452388 - RNA, 64 nt, hsa; identical to SEQ ID NO: 163177

SEQ ID NO: 452389 - RNA, 64 nt, hsa; identical to SEQ ID NO: 163178

SEQ ID NO: 452390 - RNA, 64 nt, hsa; identical to SEQ ID NO: 163179

SEQ ID NO: 452391 - RNA, 64 nt, hsa; identical to SEQ ID NO: 163180

SEQ ID NO: 452392 - RNA, 64 nt, hsa; identical to SEQ ID NO: 163181

SEQ ID NO: 452393 - RNA, 64 nt, hsa; identical to SEQ ID NO: 163182

SEQ ID NO: 452394 - RNA, 64 nt, hsa; identical to SEQ ID NO: 163183

SEQ ID NO: 452395 - RNA, 64 nt, hsa; identical to SEQ ID NO: 163184

SEQ ID NO: 452396 - RNA, 64 nt, hsa; identical to SEQ ID NO: 243585

SEQ ID NO: 452397 - RNA, 64 nt, hsa; identical to SEQ ID NO: 243586

SEQ ID NO: 452398 - RNA, 64 nt, hsa; identical to SEQ ID NO: 243587

SEQ ID NO: 452399 - RNA, 64 nt, hsa; identical to SEQ ID NO: 243588

SEQ ID NO: 452400 - RNA, 64 nt, hsa; identical to SEQ ID NO: 243589

SEQ ID NO: 452401 - RNA, 64 nt, hsa; identical to SEQ ID NO: 243590

SEQ ID NO: 452402 - RNA, 64 nt, hsa; identical to SEQ ID NO: 243591

SEQ ID NO: 452403 - RNA, 64 nt, hsa; identical to SEQ ID NO: 243592

SEQ ID NO: 452404 - RNA, 64 nt, hsa; identical to SEQ ID NO: 243593

SEQ ID NO: 452405 - RNA, 64 nt, hsa; identical to SEQ ID NO: 243594

SEQ ID NO: 452406 - RNA, 64 nt, hsa; identical to SEQ ID NO: 243595

SEQ ID NO: 452407 - RNA, 64 nt, hsa; identical to SEQ ID NO: 243596

SEQ ID NO: 452408 - RNA, 64 nt, hsa; identical to SEQ ID NO: 243597

SEQ ID NO: 452409 - RNA, 64 nt, hsa; identical to SEQ ID NO: 243598

SEQ ID NO: 452410 - RNA, 64 nt, hsa; identical to SEQ ID NO: 243599

SEQ ID NO: 452411 - RNA, 64 nt, hsa; identical to SEQ ID NO: 243600

SEQ ID NO: 452412 - RNA, 64 nt, hsa; identical to SEQ ID NO: 243601

SEQ ID NO: 452413 - RNA, 64 nt, hsa; identical to SEQ ID NO: 243602

SEQ ID NO: 452414 - RNA, 64 nt, hsa; identical to SEQ ID NO: 243603

SEQ ID NO: 452415 - RNA, 64 nt, hsa; identical to SEQ ID NO: 243604

SEQ ID NO: 452416 - RNA, 64 nt, hsa; identical to SEQ ID NO: 243605

SEQ ID NO: 452417 - RNA, 64 nt, hsa; identical to SEQ ID NO: 243606

SEQ ID NO: 452418 - RNA, 64 nt, hsa; identical to SEQ ID NO: 243607

SEQ ID NO: 452419 - RNA, 64 nt, hsa; identical to SEQ ID NO: 243608

SEQ ID NO: 452420 - RNA, 64 nt, hsa; identical to SEQ ID NO: 243609

SEQ ID NO: 452421 - RNA, 64 nt, hsa; identical to SEQ ID NO: 243610

SEQ ID NO: 452422 - RNA, 57 nt, hsa; identical to SEQ ID NO: 243611

SEQ ID NO: 452423 - RNA, 64 nt, hsa; identical to SEQ ID NO: 243612

SEQ ID NO: 452424 - RNA, 64 nt, hsa; identical to SEQ ID NO: 243613

SEQ ID NO: 452425 - RNA, 64 nt, hsa; identical to SEQ ID NO: 243614

SEQ ID NO: 452426 - RNA, 64 nt, hsa; identical to SEQ ID NO: 243615

SEQ ID NO: 452427 - RNA, 64 nt, hsa; identical to SEQ ID NO: 243616

SEQ ID NO: 452428 - RNA, 64 nt, hsa; identical to SEQ ID NO: 243617

SEQ ID NO: 452429 - RNA, 64 nt, hsa; identical to SEQ ID NO: 243618

SEQ ID NO: 452430 - RNA, 64 nt, hsa; identical to SEQ ID NO: 243619

SEQ ID NO: 452431 - RNA, 64 nt, hsa; identical to SEQ ID NO: 243620

SEQ ID NO: 452432 - RNA, 64 nt, hsa; identical to SEQ ID NO: 243621

SEQ ID NO: 452433 - RNA, 64 nt, hsa; identical to SEQ ID NO: 243622

SEQ ID NO: 452434 - RNA, 64 nt, hsa; identical to SEQ ID NO: 243623

SEQ ID NO: 452435 - RNA, 64 nt, hsa; identical to SEQ ID NO: 243624

SEQ ID NO: 452436 - RNA, 64 nt, hsa; identical to SEQ ID NO: 243625

SEQ ID NO: 452437 - RNA, 64 nt, hsa; identical to SEQ ID NO: 243626

SEQ ID NO: 452438 - RNA, 64 nt, hsa; identical to SEQ ID NO: 243627

SEQ ID NO: 452439 - RNA, 64 nt, hsa; identical to SEQ ID NO: 243628

SEQ ID NO: 452440 - RNA, 64 nt, hsa; identical to SEQ ID NO: 243629

SEQ ID NO: 452441 - RNA, 64 nt, hsa; identical to SEQ ID NO: 243630

SEQ ID NO: 452442 - RNA, 64 nt, hsa; identical to SEQ ID NO: 243631

SEQ ID NO: 452443 - RNA, 64 nt, hsa; identical to SEQ ID NO: 243632

SEQ ID NO: 452444 - RNA, 64 nt, hsa; identical to SEQ ID NO: 243633

SEQ ID NO: 452445 - RNA, 59 nt, hsa; identical to SEQ ID NO: 243634

SEQ ID NO: 452446 - RNA, 64 nt, hsa; identical to SEQ ID NO: 243635

SEQ ID NO: 452447 - RNA, 64 nt, hsa; identical to SEQ ID NO: 243636

SEQ ID NO: 452448 - RNA, 64 nt, hsa; identical to SEQ ID NO: 243637

SEQ ID NO: 452449 - RNA, 64 nt, hsa; identical to SEQ ID NO: 243638

SEQ ID NO: 452450 - RNA, 64 nt, hsa; identical to SEQ ID NO: 243639

SEQ ID NO: 452451 - RNA, 64 nt, hsa; identical to SEQ ID NO: 243640

SEQ ID NO: 452452 - RNA, 64 nt, hsa; identical to SEQ ID NO: 243641

SEQ ID NO: 452453 - RNA, 64 nt, hsa; identical to SEQ ID NO: 243642

SEQ ID NO: 452454 - RNA, 64 nt, hsa; identical to SEQ ID NO: 243643

SEQ ID NO: 452455 - RNA, 60 nt, hsa
guauguaaauguacagaaauaaaaacguugccccauuaacagauuuccucuggaaugucu

SEQ ID NO: 452456 - RNA, 60 nt, hsa
uacuugcuauaaagccaccugucaacaaacccccauuauguacagaauaggaccuaucca

SEQ ID NO: 452457 - RNA, 60 nt, hsa
aagugguuuucuuaaugcagcccugcugguccccauuaacaauugcuugaaauucacaug

SEQ ID NO: 452458 - RNA, 60 nt, hsa
caccccagguucgcugaucuaucaacaucaccccauuaagaauacaaagcacuacauucu

SEQ ID NO: 452459 - RNA, 60 nt, hsa
uugaaucacccaacccuggaucagaaaccuccccauuaacaaacacugccccuuaagucc

SEQ ID NO: 452460 - RNA, 60 nt, hsa
ccccuguuagccagcccucgaucauugaggccccauuauuaacagauacucccauaauaa

SEQ ID NO: 452461 - RNA, 60 nt, hsa
uuauuuuugguuuguauuauuuuuauuuggccccauuauuuuaaauaggaaaaacaguau

SEQ ID NO: 452462 - RNA, 60 nt, hsa
gggauuacaaaugugagccaccacaucuggccccauuauuuuauuuuugguuuguauuau

SEQ ID NO: 452463 - RNA, 64 nt, hsa
aucggugguuccgcuccguggacuggaaagcuguuccgcagagaaaacugaagguacaacaugu

SEQ ID NO: 452464 - RNA, 64 nt, hsa
gaggagauuagcauggcccccugcgcgaggaagauccgcagauucaugcagcauuccauauuuu

SEQ ID NO: 452465 - RNA, 64 nt, hsa; identical to SEQ ID NO: 94908

SEQ ID NO: 452466 - RNA, 64 nt, hsa; identical to SEQ ID NO: 94909

SEQ ID NO: 452467 - RNA, 64 nt, hsa; identical to SEQ ID NO: 94910

SEQ ID NO: 452468 - RNA, 64 nt, hsa; identical to SEQ ID NO: 94911

SEQ ID NO: 452469 - RNA, 64 nt, hsa; identical to SEQ ID NO: 94912

SEQ ID NO: 452470 - RNA, 64 nt, hsa; identical to SEQ ID NO: 94913

SEQ ID NO: 452471 - RNA, 64 nt, hsa; identical to SEQ ID NO: 94914

SEQ ID NO: 452472 - RNA, 64 nt, hsa; identical to SEQ ID NO: 94915

SEQ ID NO: 452473 - RNA, 64 nt, hsa; identical to SEQ ID NO: 94916

SEQ ID NO: 452474 - RNA, 64 nt, hsa; identical to SEQ ID NO: 94917

SEQ ID NO: 452475 - RNA, 64 nt, hsa; identical to SEQ ID NO: 94918

SEQ ID NO: 452476 - RNA, 64 nt, hsa; identical to SEQ ID NO: 94919

SEQ ID NO: 452477 - RNA, 64 nt, hsa; identical to SEQ ID NO: 94920

SEQ ID NO: 452478 - RNA, 64 nt, hsa; identical to SEQ ID NO: 94921

SEQ ID NO: 452479 - RNA, 64 nt, hsa; identical to SEQ ID NO: 94922

SEQ ID NO: 452480 - RNA, 64 nt, hsa; identical to SEQ ID NO: 94923

SEQ ID NO: 452481 - RNA, 64 nt, hsa; identical to SEQ ID NO: 94924

SEQ ID NO: 452482 - RNA, 64 nt, hsa; identical to SEQ ID NO: 94925

SEQ ID NO: 452483 - RNA, 64 nt, hsa; identical to SEQ ID NO: 94926

SEQ ID NO: 452484 - RNA, 64 nt, hsa; identical to SEQ ID NO: 94927

SEQ ID NO: 452485 - RNA, 64 nt, hsa; identical to SEQ ID NO: 94928

SEQ ID NO: 452486 - RNA, 64 nt, hsa; identical to SEQ ID NO: 94929

SEQ ID NO: 452487 - RNA, 64 nt, hsa; identical to SEQ ID NO: 94930

SEQ ID NO: 452488 - RNA, 64 nt, hsa; identical to SEQ ID NO: 94931

SEQ ID NO: 452489 - RNA, 64 nt, hsa; identical to SEQ ID NO: 138852

SEQ ID NO: 452490 - RNA, 64 nt, hsa; identical to SEQ ID NO: 138853

SEQ ID NO: 452491 - RNA, 64 nt, hsa; identical to SEQ ID NO: 138854

SEQ ID NO: 452492 - RNA, 64 nt, hsa; identical to SEQ ID NO: 138855

SEQ ID NO: 452493 - RNA, 64 nt, hsa; identical to SEQ ID NO: 138856

SEQ ID NO: 452494 - RNA, 64 nt, hsa; identical to SEQ ID NO: 138857

SEQ ID NO: 452495 - RNA, 64 nt, hsa; identical to SEQ ID NO: 138858

SEQ ID NO: 452496 - RNA, 64 nt, hsa; identical to SEQ ID NO: 138859

SEQ ID NO: 452497 - RNA, 64 nt, hsa; identical to SEQ ID NO: 138860

SEQ ID NO: 452498 - RNA, 64 nt, hsa; identical to SEQ ID NO: 138861

SEQ ID NO: 452499 - RNA, 64 nt, hsa; identical to SEQ ID NO: 138862

SEQ ID NO: 452500 - RNA, 64 nt, hsa; identical to SEQ ID NO: 138863

SEQ ID NO: 452501 - RNA, 64 nt, hsa; identical to SEQ ID NO: 138864

SEQ ID NO: 452502 - RNA, 64 nt, hsa; identical to SEQ ID NO: 138865

SEQ ID NO: 452503 - RNA, 64 nt, hsa; identical to SEQ ID NO: 138866

SEQ ID NO: 452504 - RNA, 64 nt, hsa; identical to SEQ ID NO: 138867

SEQ ID NO: 452505 - RNA, 64 nt, hsa; identical to SEQ ID NO: 138868

SEQ ID NO: 452506 - RNA, 64 nt, hsa; identical to SEQ ID NO: 138869

SEQ ID NO: 452507 - RNA, 64 nt, hsa; identical to SEQ ID NO: 138870

SEQ ID NO: 452508 - RNA, 64 nt, hsa; identical to SEQ ID NO: 138871

SEQ ID NO: 452509 - RNA, 64 nt, hsa; identical to SEQ ID NO: 138872

SEQ ID NO: 452510 - RNA, 64 nt, hsa; identical to SEQ ID NO: 138873

SEQ ID NO: 452511 - RNA, 64 nt, hsa; identical to SEQ ID NO: 138874

SEQ ID NO: 452512 - RNA, 64 nt, hsa; identical to SEQ ID NO: 138875

SEQ ID NO: 452513 - RNA, 64 nt, hsa; identical to SEQ ID NO: 138876

SEQ ID NO: 452514 - RNA, 64 nt, hsa; identical to SEQ ID NO: 138877

SEQ ID NO: 452515 - RNA, 64 nt, hsa; identical to SEQ ID NO: 138878

SEQ ID NO: 452516 - RNA, 64 nt, hsa; identical to SEQ ID NO: 138879

SEQ ID NO: 452517 - RNA, 64 nt, hsa; identical to SEQ ID NO: 138880

SEQ ID NO: 452518 - RNA, 64 nt, hsa; identical to SEQ ID NO: 138881

SEQ ID NO: 452519 - RNA, 64 nt, hsa; identical to SEQ ID NO: 138882

SEQ ID NO: 452520 - RNA, 64 nt, hsa; identical to SEQ ID NO: 138883

SEQ ID NO: 452521 - RNA, 64 nt, hsa; identical to SEQ ID NO: 138884

SEQ ID NO: 452522 - RNA, 64 nt, hsa; identical to SEQ ID NO: 138885

SEQ ID NO: 452523 - RNA, 64 nt, hsa; identical to SEQ ID NO: 138886

SEQ ID NO: 452524 - RNA, 64 nt, hsa; identical to SEQ ID NO: 138887

SEQ ID NO: 452525 - RNA, 64 nt, hsa; identical to SEQ ID NO: 138888

SEQ ID NO: 452526 - RNA, 64 nt, hsa; identical to SEQ ID NO: 138889

SEQ ID NO: 452527 - RNA, 64 nt, hsa; identical to SEQ ID NO: 138890

SEQ ID NO: 452528 - RNA, 64 nt, hsa; identical to SEQ ID NO: 138891

SEQ ID NO: 452529 - RNA, 64 nt, hsa; identical to SEQ ID NO: 138892

SEQ ID NO: 452530 - RNA, 64 nt, hsa
ccaccccuagcccaggucagcuuuccuggagcuggcuaaugaaagccuccucaccucuucccaa

SEQ ID NO: 452531 - RNA, 64 nt, hsa
ccaacgauaguuacucacaaguaaguaccuuaaugcuaaugagguccacuaaaaaggggaggaa

SEQ ID NO: 452532 - RNA, 64 nt, hsa
ggcuuuaagaacauguggaauaaguuuuuuagcugcuaaugacaaaacaaauccuguaacuacc

SEQ ID NO: 452533 - RNA, 64 nt, hsa
guguuugugugcagagaaguauaugauccaccaugcuaaugacacuugccuuuuuuuccaccau

SEQ ID NO: 452534 - RNA, 64 nt, hsa; identical to SEQ ID NO: 353564

SEQ ID NO: 452535 - RNA, 64 nt, hsa; identical to SEQ ID NO: 353565

SEQ ID NO: 452536 - RNA, 64 nt, hsa; identical to SEQ ID NO: 353566

SEQ ID NO: 452537 - RNA, 64 nt, hsa; identical to SEQ ID NO: 353567

SEQ ID NO: 452538 - RNA, 64 nt, hsa; identical to SEQ ID NO: 353568

SEQ ID NO: 452539 - RNA, 64 nt, hsa; identical to SEQ ID NO: 353569

SEQ ID NO: 452540 - RNA, 64 nt, hsa; identical to SEQ ID NO: 353570

SEQ ID NO: 452541 - RNA, 64 nt, hsa; identical to SEQ ID NO: 353571

SEQ ID NO: 452542 - RNA, 64 nt, hsa; identical to SEQ ID NO: 353572

SEQ ID NO: 452543 - RNA, 64 nt, hsa; identical to SEQ ID NO: 353573

SEQ ID NO: 452544 - RNA, 64 nt, hsa; identical to SEQ ID NO: 353574

SEQ ID NO: 452545 - RNA, 64 nt, hsa
cuguugagugacugugaggaugaaccuucauacccuuuccaagacguguuacacagacagaccu

SEQ ID NO: 452546 - RNA, 64 nt, hsa
aaauuuucauucuuaccaaaacaguuaacucuuucuuuccaaucaauuuauacaaaagaggucg

SEQ ID NO: 452547 - RNA, 64 nt, hsa
cauguacgauuaaugugccccuuuuggagauaagcuuuccaaaauaugcguaugaguaaaauua

SEQ ID NO: 452548 - RNA, 64 nt, hsa
agacaggaaacaggcccaagugcauacucggguucuuuccaacucagaaucaucucugauucca

SEQ ID NO: 452549 - RNA, 64 nt, hsa
cugagggagaaaaagaaaacauacauuaugaagccuuuccaaaauuaggugcuugguaaucacg

SEQ ID NO: 452550 - RNA, 64 nt, hsa
agagucaaugauucuguucgacuaaauagcuguccuuuccaacacauugcuacuuuuuuaaaua

SEQ ID NO: 452551 - RNA, 64 nt, hsa
gagaagaggggaguauccugaguuguaggaacugcuuuccaacuccaagcucccuccacaaguu

SEQ ID NO: 452552 - RNA, 64 nt, hsa
uggcuuucuuuggccucugacccugcugcccauucuuuccaacaucacagaugaacugccucuc

SEQ ID NO: 452553 - RNA, 64 nt, hsa
ugggauuacaggcaugagccaccacacccagccccuuuccaaccauuucuaaguagauuuuuug

SEQ ID NO: 452554 - RNA, 64 nt, hsa
uugaauaaauaguaauauuuaucaguaaauacuccuuuccaacuuccuuuuuuuuuuuuuuuuu

SEQ ID NO: 452555 - RNA, 64 nt, hsa
aaagagagggagguauggacugggggccagaguccuuuccaaggcuucuccaauucugcccaaa

SEQ ID NO: 452556 - RNA, 64 nt, hsa
uaaccauuugcacuggaguucuaugcucucgcaccuuuccaaaguuaacagauuuugggguugu

SEQ ID NO: 452557 - RNA, 64 nt, hsa
aaggugaguuuugaucucuuuuuaaggagaggcacuuuccaacugaaggugauugauguaggga

SEQ ID NO: 452558 - RNA, 64 nt, hsa
ccuguauccggcacugcuaagcuuuucaagguaucuuuccaauccugcugauguggcagucaau

SEQ ID NO: 452559 - RNA, 64 nt, hsa
uacuuuauuuauagagacuuuccaaguauguugucuuuccaauggugccuugcuuggugcucuc

SEQ ID NO: 452560 - RNA, 64 nt, hsa
ucgaccagauuagcauuuacuuuauuuauagagacuuuccaaguauguugucuuuccaauggug

SEQ ID NO: 452561 - RNA, 64 nt, hsa
ucuaauuaaggcgagugcuccagagucgggucugcuuuccaaaguauaggacauuugaagaacu

SEQ ID NO: 452562 - RNA, 64 nt, hsa
ccuguuuugucucuacuguguacucugaucguaucuuuccaaagugcagacucuugugaaguuu

SEQ ID NO: 452563 - RNA, 64 nt, hsa
auucuaaugcuagucaccaagagcuagacuccaucuuuccaauaaaaaugagcccuauguagca

SEQ ID NO: 452564 - RNA, 64 nt, hsa
uuauuguauuacaaaggaaccaugaaaaaaaacacuuuccaacuauuauauaauacauuucgau

SEQ ID NO: 452565 - RNA, 64 nt, hsa
caugacacugauuacaaauacuuuccuauucauacuuuccaauuaugagauggacuguggguac

SEQ ID NO: 452566 - RNA, 64 nt, hsa
agcguuaauuaugcucuguuuccaacugcauuuccuuuccaauugaauuaaaguguggccucgu

SEQ ID NO: 452567 - RNA, 64 nt, hsa
uuguccaacucuccuccagguugcauuucaguuucuuuccaaaacuuauuaccuccccuaaucc

SEQ ID NO: 452568 - RNA, 64 nt, hsa
ccagagccagcucaucuuccaggugcugaaaccacuuuccaaauaaacuaaagccuggauuuga

SEQ ID NO: 452569 - RNA, 64 nt, hsa
ccauuguagauuagucucuucucacuaaaauuuacuuuccaacguagggccuaaaggaaaccuu

SEQ ID NO: 452570 - RNA, 64 nt, hsa
auguccuggaggcagaugacaucuaaaauaugugcuuuccaaccagcacagcuggcgcucuuag

SEQ ID NO: 452571 - RNA, 64 nt, hsa
cauuugggagauucuuuugccaggagagauucaacuuuccaaucuaaguauuccagagcauugc

SEQ ID NO: 452572 - RNA, 64 nt, hsa
uuuucagugcagccaggagggcucuugggauuuccuuuccaaagcacaaaaauacugggaccca

SEQ ID NO: 452573 - RNA, 64 nt, hsa
caucagcagacuuccugcucaucggcagaucccccuuuccaaccuguaacucugaugugcucug

SEQ ID NO: 452574 - RNA, 64 nt, hsa
aauaccauuuuuuucuccuuuuguguuuuucccacuuuccaauguacucaagaaaauugaacaa

SEQ ID NO: 452575 - RNA, 64 nt, hsa
uccucccucccuuccuucccuccuucccuucucccuuuccaaccccuuccuuccuuuuccuccc

SEQ ID NO: 452576 - RNA, 64 nt, hsa
ccauccuuccauucuuccccucccucccuucuuccuuuccaaccccuuccuuccuuuuccuccc

SEQ ID NO: 452577 - RNA, 64 nt, hsa
auauugaguuuaacaccugugugauuaaagacaacuuuccaauguaguaucuguagccaugucc

SEQ ID NO: 452578 - RNA, 64 nt, hsa
aguagggcagugcaugacuggccuuagguuuuuucuuuccaaguuuauuuucuugugcuucagc

SEQ ID NO: 452579 - RNA, 64 nt, hsa
ucauuucaagugaauuauuuuaaucuuuuucucucuuuccaaaaauuuaggaauguuuagugua

SEQ ID NO: 452580 - RNA, 64 nt, hsa
uaauaauuaaccaucuaccucuguuuuuaauuuucuuuccaaaaggcagcuugaaauguugguc

SEQ ID NO: 452581 - RNA, 64 nt, hsa
gaguagcagaaaacuacuuauguccuuuucuugccuuuccaagaaaaauguuuuuuguuuuuuu

SEQ ID NO: 452582 - RNA, 64 nt, hsa
guagauaaaauagagcacaaacugugaagugcaucuuuccaagaccaucauggaccagguccuc

SEQ ID NO: 452583 - RNA, 64 nt, hsa
uccuugaaagauuggucguuauggaucacccagccuuuccaagucaguggcuguuguucugucu

SEQ ID NO: 452584 - RNA, 64 nt, hsa
agacuaggcauauuucaggcuuuaaauuauucuacuuuccaaacugaauucuccugcagugcca

SEQ ID NO: 452585 - RNA, 64 nt, hsa
ggaaauacugcaacauguccaguuggccagaucacuuuccaagggagcgauacuaaggcagacu

SEQ ID NO: 452586 - RNA, 64 nt, hsa
ugaagcuggggcgauguuugcagucaagaccauucuuuccaaccucuggguucuugcaaguugc

SEQ ID NO: 452587 - RNA, 64 nt, hsa
gaggcccucugaguuggaaguugagcuccaccuccuuuccaagugagcacucaguguugaauca

SEQ ID NO: 452588 - RNA, 64 nt, hsa
uuuaauccuuggagacagggaaagggacagauagcuuuccaaggacaugagacugugcaaagcc

SEQ ID NO: 452589 - RNA, 61 nt, hsa
gugauuucacgaaaaagugaccuuacucgugcuuuccaacuucaagaccacagaaaaucag

SEQ ID NO: 452590 - RNA, 64 nt, hsa
cugaaacagcuaggcccaaaucacaaguacaguccuuuccaacaccccugaaauucauagucag

SEQ ID NO: 452591 - RNA, 64 nt, hsa
uggcuaccaacccauucaaagaggacauaugauucuuuccaagaugaacuugaagauuacauaa

SEQ ID NO: 452592 - RNA, 64 nt, hsa
aagcaguuaccucauucaaagaagacauaugacucuuuccaagaugaacuugaagauuacauca

SEQ ID NO: 452593 - RNA, 64 nt, hsa; identical to SEQ ID NO: 333540

SEQ ID NO: 452594 - RNA, 64 nt, hsa; identical to SEQ ID NO: 333541

SEQ ID NO: 452595 - RNA, 64 nt, hsa; identical to SEQ ID NO: 333542

SEQ ID NO: 452596 - RNA, 64 nt, hsa; identical to SEQ ID NO: 333543

SEQ ID NO: 452597 - RNA, 64 nt, hsa; identical to SEQ ID NO: 333544

SEQ ID NO: 452598 - RNA, 64 nt, hsa; identical to SEQ ID NO: 333545

SEQ ID NO: 452599 - RNA, 54 nt, hsa; identical to SEQ ID NO: 333546

SEQ ID NO: 452600 - RNA, 64 nt, hsa; identical to SEQ ID NO: 333547

SEQ ID NO: 452601 - RNA, 60 nt, hsa; identical to SEQ ID NO: 333548

SEQ ID NO: 452602 - RNA, 64 nt, hsa; identical to SEQ ID NO: 333549

SEQ ID NO: 452603 - RNA, 64 nt, hsa; identical to SEQ ID NO: 333550

SEQ ID NO: 452604 - RNA, 64 nt, hsa; identical to SEQ ID NO: 333551

SEQ ID NO: 452605 - RNA, 64 nt, hsa; identical to SEQ ID NO: 333552

SEQ ID NO: 452606 - RNA, 64 nt, hsa; identical to SEQ ID NO: 333553

SEQ ID NO: 452607 - RNA, 64 nt, hsa; identical to SEQ ID NO: 333554

SEQ ID NO: 452608 - RNA, 64 nt, hsa; identical to SEQ ID NO: 333555

SEQ ID NO: 452609 - RNA, 64 nt, hsa; identical to SEQ ID NO: 333556

SEQ ID NO: 452610 - RNA, 64 nt, hsa; identical to SEQ ID NO: 333557

SEQ ID NO: 452611 - RNA, 64 nt, hsa; identical to SEQ ID NO: 333558

SEQ ID NO: 452612 - RNA, 64 nt, hsa; identical to SEQ ID NO: 333559

SEQ ID NO: 452613 - RNA, 64 nt, hsa; identical to SEQ ID NO: 333560

SEQ ID NO: 452614 - RNA, 64 nt, hsa; identical to SEQ ID NO: 333561

SEQ ID NO: 452615 - RNA, 64 nt, hsa; identical to SEQ ID NO: 333562

SEQ ID NO: 452616 - RNA, 64 nt, hsa; identical to SEQ ID NO: 333563

SEQ ID NO: 452617 - RNA, 64 nt, hsa; identical to SEQ ID NO: 333564

SEQ ID NO: 452618 - RNA, 64 nt, hsa; identical to SEQ ID NO: 333565

SEQ ID NO: 452619 - RNA, 64 nt, hsa; identical to SEQ ID NO: 333566

SEQ ID NO: 452620 - RNA, 64 nt, hsa; identical to SEQ ID NO: 333567

SEQ ID NO: 452621 - RNA, 64 nt, hsa; identical to SEQ ID NO: 333568

SEQ ID NO: 452622 - RNA, 64 nt, hsa; identical to SEQ ID NO: 333569

SEQ ID NO: 452623 - RNA, 64 nt, hsa; identical to SEQ ID NO: 333570

SEQ ID NO: 452624 - RNA, 64 nt, hsa; identical to SEQ ID NO: 333571

SEQ ID NO: 452625 - RNA, 64 nt, hsa; identical to SEQ ID NO: 333572

SEQ ID NO: 452626 - RNA, 64 nt, hsa; identical to SEQ ID NO: 333573

SEQ ID NO: 452627 - RNA, 64 nt, hsa; identical to SEQ ID NO: 333574

SEQ ID NO: 452628 - RNA, 64 nt, hsa; identical to SEQ ID NO: 333575

SEQ ID NO: 452629 - RNA, 64 nt, hsa; identical to SEQ ID NO: 333576

SEQ ID NO: 452630 - RNA, 64 nt, hsa; identical to SEQ ID NO: 333577

SEQ ID NO: 452631 - RNA, 64 nt, hsa; identical to SEQ ID NO: 333578

SEQ ID NO: 452632 - RNA, 64 nt, hsa; identical to SEQ ID NO: 333579

SEQ ID NO: 452633 - RNA, 64 nt, hsa; identical to SEQ ID NO: 333580

SEQ ID NO: 452634 - RNA, 64 nt, hsa; identical to SEQ ID NO: 333581

SEQ ID NO: 452635 - RNA, 64 nt, hsa; identical to SEQ ID NO: 333582

SEQ ID NO: 452636 - RNA, 64 nt, hsa; identical to SEQ ID NO: 333583

SEQ ID NO: 452637 - RNA, 64 nt, hsa; identical to SEQ ID NO: 333584

SEQ ID NO: 452638 - RNA, 64 nt, hsa; identical to SEQ ID NO: 333585

SEQ ID NO: 452639 - RNA, 64 nt, hsa; identical to SEQ ID NO: 333586

SEQ ID NO: 452640 - RNA, 64 nt, hsa; identical to SEQ ID NO: 333587

SEQ ID NO: 452641 - RNA, 64 nt, hsa; identical to SEQ ID NO: 333588

SEQ ID NO: 452642 - RNA, 64 nt, hsa; identical to SEQ ID NO: 333589

SEQ ID NO: 452643 - RNA, 64 nt, hsa; identical to SEQ ID NO: 333590

SEQ ID NO: 452644 - RNA, 64 nt, hsa
auuacccaguaugaucauggcauccaagaccagagucucagaacucauuaagaaacaguuuacu

SEQ ID NO: 452645 - RNA, 64 nt, hsa
uuuuuuuuuuugaggcaucugacaaagucacaaagucucagacuagaaauaauuacccaguaug

SEQ ID NO: 452646 - RNA, 64 nt, hsa
uuguucagacaugugaagagaagcaagacagagggucucagauggacgagggcucuccaaggga

SEQ ID NO: 452647 - RNA, 64 nt, hsa
agggccccgcuucuccguacaccccagcuccuaggucucagagaacucccccaccugugguuuu

SEQ ID NO: 452648 - RNA, 64 nt, hsa
cuuaaggauaauaggacaagacaaauuacagauugucucagagaaaacaaaugaguuacucucu

SEQ ID NO: 452649 - RNA, 64 nt, hsa
ucugaugauuccaauguguuggaaaguuuaccuugucucagauguaacugguaaaggcugauuu

SEQ ID NO: 452650 - RNA, 64 nt, hsa
gucggccuccggcaucuucgggaggcucucgcaggucucagaggugccuuugaugguggucuca

SEQ ID NO: 452651 - RNA, 64 nt, hsa
gcacccaagcgcagcugggggaccccucagcuccgucucagagugcucuccgagacgcugaaga

SEQ ID NO: 452652 - RNA, 64 nt, hsa
augugaaucgcagcuguggguuuuaccaccgucugucucagagucccaggaccuugagugucau

SEQ ID NO: 452653 - RNA, 64 nt, hsa
uuccgugugauugucuuugaaucugaaucagccagucucagaugccccaaaguuucgguuccua

SEQ ID NO: 452654 - RNA, 64 nt, hsa
gucaggcuuccuggugagccucagggagugcauggucucagaugccauccuucucuucuccagc

SEQ ID NO: 452655 - RNA, 62 nt, hsa
uuccucucaccuccguguucucggggagugcguggucucagaucccauccugcuccucucca

SEQ ID NO: 452656 - RNA, 64 nt, hsa
aaagauuuuucuagccaucagaugcaauuacgaugucucagagcucugcuaucgcuugcaugcu

SEQ ID NO: 452657 - RNA, 64 nt, hsa
ggagggucugguggacuuucuccccacuccccaagucucagagcuuuuagccuggaaguuugua

SEQ ID NO: 452658 - RNA, 64 nt, hsa
ugggcgcuacccugcagggugccaggcaggaguggucucagaacgugcgcuucugauuauuuua

SEQ ID NO: 452659 - RNA, 64 nt, hsa
gaccacucagacggaggggccccugggauucccugucucagauggccuggucuuacgccugugu

SEQ ID NO: 452660 - RNA, 64 nt, hsa
cggauacauuauuuuuucuuucuuucauagcugugucucagaaaggacccauuuguggcucuuu

SEQ ID NO: 452661 - RNA, 64 nt, hsa
uuucuagccaucuaaauugacucuuccaauauaggucucagaaauccaauauuuggaguacaau

SEQ ID NO: 452662 - RNA, 64 nt, hsa
gucacugauucacacccagucccugccacagaccgucucagacacgcacagugggccugcugca

SEQ ID NO: 452663 - RNA, 64 nt, hsa
cugcaugauucacacccagucccugccacagaccgucucagacacgcacagugggccugcugca

SEQ ID NO: 452664 - RNA, 64 nt, hsa; identical to SEQ ID NO: 452663

SEQ ID NO: 452665 - RNA, 64 nt, hsa
aaguaguuucuguaccaauuaaaggauugacguggucucagauauugaugcaaaaaauuuuucc

SEQ ID NO: 452666 - RNA, 64 nt, hsa
agguggucccugcuuucucuuucucuuucucugugucucagauggcgauuuugcugacagcugc

SEQ ID NO: 452667 - RNA, 64 nt, hsa; identical to SEQ ID NO: 160465

SEQ ID NO: 452668 - RNA, 64 nt, hsa; identical to SEQ ID NO: 160466

SEQ ID NO: 452669 - RNA, 64 nt, hsa; identical to SEQ ID NO: 160467

SEQ ID NO: 452670 - RNA, 64 nt, hsa; identical to SEQ ID NO: 160468

SEQ ID NO: 452671 - RNA, 64 nt, hsa; identical to SEQ ID NO: 160469

SEQ ID NO: 452672 - RNA, 64 nt, hsa; identical to SEQ ID NO: 160470

SEQ ID NO: 452673 - RNA, 64 nt, hsa; identical to SEQ ID NO: 160471

SEQ ID NO: 452674 - RNA, 64 nt, hsa; identical to SEQ ID NO: 160472

SEQ ID NO: 452675 - RNA, 64 nt, hsa; identical to SEQ ID NO: 160473

SEQ ID NO: 452676 - RNA, 64 nt, hsa; identical to SEQ ID NO: 160474

SEQ ID NO: 452677 - RNA, 64 nt, hsa; identical to SEQ ID NO: 160475

SEQ ID NO: 452678 - RNA, 64 nt, hsa; identical to SEQ ID NO: 154299

SEQ ID NO: 452679 - RNA, 64 nt, hsa; identical to SEQ ID NO: 154300

SEQ ID NO: 452680 - RNA, 64 nt, hsa; identical to SEQ ID NO: 154301

SEQ ID NO: 452681 - RNA, 64 nt, hsa; identical to SEQ ID NO: 154302

SEQ ID NO: 452682 - RNA, 64 nt, hsa; identical to SEQ ID NO: 154303

SEQ ID NO: 452683 - RNA, 64 nt, hsa; identical to SEQ ID NO: 154304

SEQ ID NO: 452684 - RNA, 64 nt, hsa; identical to SEQ ID NO: 154305

SEQ ID NO: 452685 - RNA, 64 nt, hsa; identical to SEQ ID NO: 154306

SEQ ID NO: 452686 - RNA, 64 nt, hsa; identical to SEQ ID NO: 154307

SEQ ID NO: 452687 - RNA, 64 nt, hsa; identical to SEQ ID NO: 154308

SEQ ID NO: 452688 - RNA, 64 nt, hsa; identical to SEQ ID NO: 154309

SEQ ID NO: 452689 - RNA, 64 nt, hsa; identical to SEQ ID NO: 154310

SEQ ID NO: 452690 - RNA, 64 nt, hsa; identical to SEQ ID NO: 154311

SEQ ID NO: 452691 - RNA, 64 nt, hsa; identical to SEQ ID NO: 154312

SEQ ID NO: 452692 - RNA, 64 nt, hsa; identical to SEQ ID NO: 154313

SEQ ID NO: 452693 - RNA, 54 nt, hsa; identical to SEQ ID NO: 154314

SEQ ID NO: 452694 - RNA, 64 nt, hsa; identical to SEQ ID NO: 154315

SEQ ID NO: 452695 - RNA, 64 nt, hsa; identical to SEQ ID NO: 154316

SEQ ID NO: 452696 - RNA, 64 nt, hsa; identical to SEQ ID NO: 154317

SEQ ID NO: 452697 - RNA, 64 nt, hsa; identical to SEQ ID NO: 154318

SEQ ID NO: 452698 - RNA, 64 nt, hsa; identical to SEQ ID NO: 154319

SEQ ID NO: 452699 - RNA, 64 nt, hsa; identical to SEQ ID NO: 154320

SEQ ID NO: 452700 - RNA, 64 nt, hsa; identical to SEQ ID NO: 154321

SEQ ID NO: 452701 - RNA, 64 nt, hsa; identical to SEQ ID NO: 154322

SEQ ID NO: 452702 - RNA, 64 nt, hsa; identical to SEQ ID NO: 154323

SEQ ID NO: 452703 - RNA, 64 nt, hsa; identical to SEQ ID NO: 154324

SEQ ID NO: 452704 - RNA, 64 nt, hsa; identical to SEQ ID NO: 154325

SEQ ID NO: 452705 - RNA, 64 nt, hsa; identical to SEQ ID NO: 154326

SEQ ID NO: 452706 - RNA, 64 nt, hsa; identical to SEQ ID NO: 154327

SEQ ID NO: 452707 - RNA, 64 nt, hsa; identical to SEQ ID NO: 154328

SEQ ID NO: 452708 - RNA, 64 nt, hsa; identical to SEQ ID NO: 154329

SEQ ID NO: 452709 - RNA, 64 nt, hsa; identical to SEQ ID NO: 154330

SEQ ID NO: 452710 - RNA, 64 nt, hsa; identical to SEQ ID NO: 154331

SEQ ID NO: 452711 - RNA, 64 nt, hsa; identical to SEQ ID NO: 154332

SEQ ID NO: 452712 - RNA, 64 nt, hsa; identical to SEQ ID NO: 154333

SEQ ID NO: 452713 - RNA, 64 nt, hsa; identical to SEQ ID NO: 154334

SEQ ID NO: 452714 - RNA, 64 nt, hsa; identical to SEQ ID NO: 154335

SEQ ID NO: 452715 - RNA, 64 nt, hsa; identical to SEQ ID NO: 154336

SEQ ID NO: 452716 - RNA, 64 nt, hsa; identical to SEQ ID NO: 154337

SEQ ID NO: 452717 - RNA, 64 nt, hsa; identical to SEQ ID NO: 154338

SEQ ID NO: 452718 - RNA, 64 nt, hsa; identical to SEQ ID NO: 154339

SEQ ID NO: 452719 - RNA, 64 nt, hsa; identical to SEQ ID NO: 154340

SEQ ID NO: 452720 - RNA, 64 nt, hsa; identical to SEQ ID NO: 154341

SEQ ID NO: 452721 - RNA, 64 nt, hsa; identical to SEQ ID NO: 154342

SEQ ID NO: 452722 - RNA, 64 nt, hsa; identical to SEQ ID NO: 154343

SEQ ID NO: 452723 - RNA, 64 nt, hsa; identical to SEQ ID NO: 154344

SEQ ID NO: 452724 - RNA, 64 nt, hsa; identical to SEQ ID NO: 154345

SEQ ID NO: 452725 - RNA, 55 nt, hsa; identical to SEQ ID NO: 154346

SEQ ID NO: 452726 - RNA, 64 nt, hsa; identical to SEQ ID NO: 154347

SEQ ID NO: 452727 - RNA, 64 nt, hsa; identical to SEQ ID NO: 154348

SEQ ID NO: 452728 - RNA, 64 nt, hsa; identical to SEQ ID NO: 154349

SEQ ID NO: 452729 - RNA, 64 nt, hsa; identical to SEQ ID NO: 154350

SEQ ID NO: 452730 - RNA, 64 nt, hsa; identical to SEQ ID NO: 154351

SEQ ID NO: 452731 - RNA, 64 nt, hsa; identical to SEQ ID NO: 154352

SEQ ID NO: 452732 - RNA, 64 nt, hsa; identical to SEQ ID NO: 154353

SEQ ID NO: 452733 - RNA, 64 nt, hsa; identical to SEQ ID NO: 154354

SEQ ID NO: 452734 - RNA, 64 nt, hsa; identical to SEQ ID NO: 154355

SEQ ID NO: 452735 - RNA, 64 nt, hsa; identical to SEQ ID NO: 154356

SEQ ID NO: 452736 - RNA, 64 nt, hsa
cagcuaagauaauugcgugaacucuguuaaaacugauuaucacucaucaauggcuuuauuuuua

SEQ ID NO: 452737 - RNA, 64 nt, hsa
ccuuuuguuuacacauuuuuguaugguauuuuaagauuaucaaucacuucaacauuucuauaac

SEQ ID NO: 452738 - RNA, 64 nt, hsa
agguugcagcaguacaucucgucaccuaggaauagauuaucaggccuugccaacuaguaugcag

SEQ ID NO: 452739 - RNA, 64 nt, hsa
cuuuguauaagauaccugggagagguagcauaaggauuaucauugcuaauacuuaggacaacga

SEQ ID NO: 452740 - RNA, 64 nt, hsa
uaacugggacuauagcaugccaccacacccagcugauuaucauauuuuuuuuuguagagguggg

SEQ ID NO: 452741 - RNA, 64 nt, hsa; identical to SEQ ID NO: 452740

SEQ ID NO: 452742 - RNA, 64 nt, hsa; identical to SEQ ID NO: 155373

SEQ ID NO: 452743 - RNA, 64 nt, hsa; identical to SEQ ID NO: 155374

SEQ ID NO: 452744 - RNA, 62 nt, hsa
ccuaccuccucuaccagugacguucgccaucauaccgccagcgcgacagccaccuggugcca

SEQ ID NO: 452745 - RNA, 58 nt, hsa
ccugcuuggggccacccugaccuacacauaccgccacugcuggccucacaagccccug

SEQ ID NO: 452746 - RNA, 64 nt, hsa
gaaaaugguaaaugcaaacgucccguuacaauuuuaccgccagugugcugucguucccccuccc

SEQ ID NO: 452747 - RNA, 64 nt, hsa
aaacuauucuuuggcauugguguccauggcccuauaccgccaucuuacacgaaagccacagagu

SEQ ID NO: 452748 - RNA, 64 nt, hsa
acagcaggacacgccaccauuccaggguagcugguaccgccagaaacaggagugggucuugucc

SEQ ID NO: 452749 - RNA, 64 nt, hsa
cucaggcacccaaauagcuggaacuacaggcauauaccgccacacccagcuaauuuuauuuuuu

SEQ ID NO: 452750 - RNA, 64 nt, hsa
aauccgcaucaggcauucucauucgccacgaaguuaccgccaguaucgcaggucccaguguuca

SEQ ID NO: 452751 - RNA, 64 nt, hsa
aauaauagagagcccagaaaucaaccugcacaccuaccgccaucuaaucuucaauagaaauggg

SEQ ID NO: 452752 - RNA, 64 nt, hsa
acacauugaacccuagaucucaggcuuccugaccuaccgccaguggccccuugcuggccacccu

SEQ ID NO: 452753 - RNA, 64 nt, hsa
ggggcacaguggagacgcaggggcucugggcccguaccgccaacucgggucacaccugaacgcu

SEQ ID NO: 452754 - RNA, 64 nt, hsa
uagcugcacugggcauggggugguggugggagcuuaccgccaccuauucaagcucucagcuacu

SEQ ID NO: 452755 - RNA, 64 nt, hsa
gcccacaggccacgacagacgcuggaugcccuccuaccgccagacaccuccccagaggccuugg

SEQ ID NO: 452756 - RNA, 64 nt, hsa
uggcaguccccguucgcaucauggucuccauguguaccgccaaagucaauuauguuugaaagcc

SEQ ID NO: 452757 - RNA, 64 nt, hsa
ugcacaaugguauaauccccacuguccucaucucuaccgccaccuucuggcgcaacaagaaguu

SEQ ID NO: 452758 - RNA, 64 nt, hsa
auaucaaagcaagauaagcagaugugugauccacuaccgccaaagcaaauacuccuuaucguua

SEQ ID NO: 452759 - RNA, 64 nt, hsa
uggagagaaaagguaguguuuuuguacaaggucauaccgccagaagccccaaauccuauuuugg

SEQ ID NO: 452760 - RNA, 64 nt, hsa
acuguguccacuccugaggaugguuccagggaaauaccgccagaaaacaagaaggucagcccac

SEQ ID NO: 452761 - RNA, 64 nt, hsa
ggguccacgagccugggccugacauucccagaacuaccgccagguggcgccaggcccccacagu

SEQ ID NO: 452762 - RNA, 64 nt, hsa
acauaaacauuaaaccuuaaccaaagaagaacuuuaccgccaccaaaacagaaacaaccccaaa

SEQ ID NO: 452763 - RNA, 64 nt, hsa
ucguuauuucuguuuguuuaagcugagccacggauaccgccacggguuucccucggcguuaguc

SEQ ID NO: 452764 - RNA, 64 nt, hsa
gaaucuuccaguuauuagcaaacucagacgaauguaccgccaguauuaucagcagucaacaagc

SEQ ID NO: 452765 - RNA, 64 nt, hsa
cugggacccucaauuaugcagaauggaugagugguaccgccaaaauucaaaccccagacucccg

SEQ ID NO: 452766 - RNA, 64 nt, hsa
gcuggcugggguauucuuuuaccaaacucuguuuuaccgccagccccuuguacaccccaauccc

SEQ ID NO: 452767 - RNA, 64 nt, hsa
uccuacaaaggagaaagauaaaaggcacaaagguuaccgccaaggcccgucagcuguguagugg

SEQ ID NO: 452768 - RNA, 64 nt, hsa
gcaugaaauaaacugcuauccuccccuuggaaucuaccgccacucuacauccuacugcuuuggc

SEQ ID NO: 452769 - RNA, 64 nt, hsa
cccagcuguaaggaccgggggucucccuccucacuaccgccagacaccccgguggaagcauuua

SEQ ID NO: 452770 - RNA, 64 nt, hsa
cuacaaauguaaggaaugugggaaacccuucauuuaccgccauucugcucgagcacaugaaagg

SEQ ID NO: 452771 - RNA, 64 nt, hsa
auguaagcaguccccaccgggaguuccccccugcuaccgccagagagguggacccacuccggau

SEQ ID NO: 452772 - RNA, 64 nt, hsa
auucccagugcuucccaaggcccucggggacaucuaccgccaacccagcugcuucuggcagggg

SEQ ID NO: 452773 - RNA, 64 nt, hsa; identical to SEQ ID NO: 171830

SEQ ID NO: 452774 - RNA, 64 nt, hsa; identical to SEQ ID NO: 171831

SEQ ID NO: 452775 - RNA, 64 nt, hsa; identical to SEQ ID NO: 171832

SEQ ID NO: 452776 - RNA, 64 nt, hsa; identical to SEQ ID NO: 171833

SEQ ID NO: 452777 - RNA, 64 nt, hsa; identical to SEQ ID NO: 171834

SEQ ID NO: 452778 - RNA, 64 nt, hsa; identical to SEQ ID NO: 171835

SEQ ID NO: 452779 - RNA, 64 nt, hsa; identical to SEQ ID NO: 171836

SEQ ID NO: 452780 - RNA, 64 nt, hsa; identical to SEQ ID NO: 171837

SEQ ID NO: 452781 - RNA, 64 nt, hsa; identical to SEQ ID NO: 171838

SEQ ID NO: 452782 - RNA, 64 nt, hsa; identical to SEQ ID NO: 171839

SEQ ID NO: 452783 - RNA, 64 nt, hsa; identical to SEQ ID NO: 171840

SEQ ID NO: 452784 - RNA, 61 nt, hsa; identical to SEQ ID NO: 171841

SEQ ID NO: 452785 - RNA, 64 nt, hsa; identical to SEQ ID NO: 171842

SEQ ID NO: 452786 - RNA, 54 nt, hsa; identical to SEQ ID NO: 171843

SEQ ID NO: 452787 - RNA, 64 nt, hsa; identical to SEQ ID NO: 171844

SEQ ID NO: 452788 - RNA, 64 nt, hsa; identical to SEQ ID NO: 171845

SEQ ID NO: 452789 - RNA, 64 nt, hsa; identical to SEQ ID NO: 171846

SEQ ID NO: 452790 - RNA, 64 nt, hsa; identical to SEQ ID NO: 171847

SEQ ID NO: 452791 - RNA, 64 nt, hsa; identical to SEQ ID NO: 171848

SEQ ID NO: 452792 - RNA, 64 nt, hsa; identical to SEQ ID NO: 171849

SEQ ID NO: 452793 - RNA, 64 nt, hsa; identical to SEQ ID NO: 171850

SEQ ID NO: 452794 - RNA, 64 nt, hsa; identical to SEQ ID NO: 171851

SEQ ID NO: 452795 - RNA, 64 nt, hsa; identical to SEQ ID NO: 171852

SEQ ID NO: 452796 - RNA, 64 nt, hsa; identical to SEQ ID NO: 171853

SEQ ID NO: 452797 - RNA, 64 nt, hsa; identical to SEQ ID NO: 171854

SEQ ID NO: 452798 - RNA, 64 nt, hsa; identical to SEQ ID NO: 171855

SEQ ID NO: 452799 - RNA, 64 nt, hsa; identical to SEQ ID NO: 171856

SEQ ID NO: 452800 - RNA, 64 nt, hsa; identical to SEQ ID NO: 171857

SEQ ID NO: 452801 - RNA, 64 nt, hsa; identical to SEQ ID NO: 171858

SEQ ID NO: 452802 - RNA, 64 nt, hsa; identical to SEQ ID NO: 171859

SEQ ID NO: 452803 - RNA, 64 nt, hsa; identical to SEQ ID NO: 171860

SEQ ID NO: 452804 - RNA, 64 nt, hsa; identical to SEQ ID NO: 171861

SEQ ID NO: 452805 - RNA, 64 nt, hsa; identical to SEQ ID NO: 171862

SEQ ID NO: 452806 - RNA, 64 nt, hsa; identical to SEQ ID NO: 171863

SEQ ID NO: 452807 - RNA, 64 nt, hsa; identical to SEQ ID NO: 171864

SEQ ID NO: 452808 - RNA, 64 nt, hsa; identical to SEQ ID NO: 171865

SEQ ID NO: 452809 - RNA, 64 nt, hsa; identical to SEQ ID NO: 171866

SEQ ID NO: 452810 - RNA, 64 nt, hsa; identical to SEQ ID NO: 171867

SEQ ID NO: 452811 - RNA, 64 nt, hsa; identical to SEQ ID NO: 171868

SEQ ID NO: 452812 - RNA, 64 nt, hsa; identical to SEQ ID NO: 171869

SEQ ID NO: 452813 - RNA, 64 nt, hsa; identical to SEQ ID NO: 171870

SEQ ID NO: 452814 - RNA, 64 nt, hsa; identical to SEQ ID NO: 171871

SEQ ID NO: 452815 - RNA, 64 nt, hsa; identical to SEQ ID NO: 171872

SEQ ID NO: 452816 - RNA, 64 nt, hsa; identical to SEQ ID NO: 171873

SEQ ID NO: 452817 - RNA, 64 nt, hsa; identical to SEQ ID NO: 171874

SEQ ID NO: 452818 - RNA, 64 nt, hsa; identical to SEQ ID NO: 171875

SEQ ID NO: 452819 - RNA, 64 nt, hsa
uguggucuuuuuaaaaaauuguaacccucuagaaaauaucaaagaaaugaaccagacgugguuu

SEQ ID NO: 452820 - RNA, 64 nt, hsa
uaacugaaucauuuuuuaacuuaaaaagcuggaaaauaucaaaugcuguuuuuuuuuuuucauu

SEQ ID NO: 452821 - RNA, 64 nt, hsa
ugauuuuaaauaaaaaacauuccaucuuucauuuaauaucaauaucaaaagaagaagacaaaca

SEQ ID NO: 452822 - RNA, 64 nt, hsa
uaaauaaaaaacauuccaucuuucauuuaauaucaauaucaaaagaagaagacaaacaucuauc

SEQ ID NO: 452823 - RNA, 64 nt, hsa
uuuucuauuuuucuacuucauacuguuaaugucaaauaucaaaaauguuuuccagcaauaucaa

SEQ ID NO: 452824 - RNA, 64 nt, hsa
cuguuaaugucaaauaucaaaaauguuuuccagcaauaucaaguuauggcaauggcaaaagucc

SEQ ID NO: 452825 - RNA, 64 nt, hsa
cuaucuuauuagucuugugccaauaagagaaguaaauaucaaacauuaaaauggucacuuuaca

SEQ ID NO: 452826 - RNA, 64 nt, hsa
aaagugagugugagaucacccagggaagcaguaaaauaucaauuuucauuuuaaguguauuagu

SEQ ID NO: 452827 - RNA, 64 nt, hsa
caguguguauaaaguguguuugaacauuaugccaaauaucaagaugugaaggacuaauucagga

SEQ ID NO: 452828 - RNA, 64 nt, hsa
auucaggaugcaaaaacguuauugggggguuguaaauaucaacuauucaacaguuuaggaugca

SEQ ID NO: 452829 - RNA, 64 nt, hsa
aagaauacuuuaugauuuagaccaauauucuagaaauaucaaaugucaguaucuugaaaucauc

SEQ ID NO: 452830 - RNA, 64 nt, hsa
aauuaagguauuuuaguaugcaauuuacugccauaauaucaaaggucaguaacaguguucuuuc

SEQ ID NO: 452831 - RNA, 64 nt, hsa
agaaagaucuuaauuccuuguuguuuugacuaggaauaucaauauuugguauaaaauaacuaga

SEQ ID NO: 452832 - RNA, 64 nt, hsa
auuucucuguaaugcauuguugaaagacaaccagaauaucaagaaaauguauauaggaauaugc

SEQ ID NO: 452833 - RNA, 64 nt, hsa
guuauuuucccccccaagcuauccuguuucagauaauaucaauuuauuuccaauccaucagacu

SEQ ID NO: 452834 - RNA, 64 nt, hsa
uauuuucauucaaaugaggaugaugagucacuguaauaucaaaaaauccccagcagcugggacu

SEQ ID NO: 452835 - RNA, 64 nt, hsa
agaucagaauauucuauguauugagaaaauguuuaauaucaaucuauaaaucuugaauuucuaa

SEQ ID NO: 452836 - RNA, 64 nt, hsa
ggugaucaguguuuacuuauugaucuugcuagacaauaucaaaauaacuucccacauuuuccag

SEQ ID NO: 452837 - RNA, 64 nt, hsa
acgguaaauauaguaucgucugcauuccagcaaaaauaucaacucguaaggcacuaguacaguu

SEQ ID NO: 452838 - RNA, 64 nt, hsa
uagugaugcucugaaaugaaaguuugucuucacaaauaucaaaacaaaauggaggaaaacuaag

SEQ ID NO: 452839 - RNA, 64 nt, hsa
uggcuguagauguuggaggcuagggaggcuaguaaauaucaaaaggaaaagggagugggaauug

SEQ ID NO: 452840 - RNA, 64 nt, hsa
aaaggaaaagggagugggaauugcuaucauguaaaauaucaaaguuaaaauacuaaggugcauu

SEQ ID NO: 452841 - RNA, 64 nt, hsa
uaaaaaaaaaaaaaaaaaagagagggcggggacaaauaucaaauuaagcaaguaaagaaaaaga

SEQ ID NO: 452842 - RNA, 64 nt, hsa
guuguagucuuuuugcaaacucugauucuucagcaauaucaacguuuuaacaugcucaccucag

SEQ ID NO: 452843 - RNA, 64 nt, hsa
uguugcuguuguuguuaauuuuguuaagaauuucaauaucaagacugacuggcaccaacacuuu

SEQ ID NO: 452844 - RNA, 64 nt, hsa
cucagcuucaaauaaaguaaauugaaaugggaacaauaucaauauggugucuugauauauuuau

SEQ ID NO: 452845 - RNA, 64 nt, hsa
uuuaaucuuccucuagcaggcaugcaguccaaggaauaucaaaauucugguuguauugggaacc

SEQ ID NO: 452846 - RNA, 64 nt, hsa
uuuaauuuuccucuagcaggcaugcaguccaaggaauaucaaaauucugauuguaugggaacca

SEQ ID NO: 452847 - RNA, 64 nt, hsa; identical to SEQ ID NO: 250930

SEQ ID NO: 452848 - RNA, 64 nt, hsa; identical to SEQ ID NO: 250931

SEQ ID NO: 452849 - RNA, 64 nt, hsa; identical to SEQ ID NO: 250932

SEQ ID NO: 452850 - RNA, 64 nt, hsa; identical to SEQ ID NO: 250933

SEQ ID NO: 452851 - RNA, 64 nt, hsa; identical to SEQ ID NO: 250934

SEQ ID NO: 452852 - RNA, 64 nt, hsa; identical to SEQ ID NO: 250935

SEQ ID NO: 452853 - RNA, 64 nt, hsa; identical to SEQ ID NO: 452819

SEQ ID NO: 452854 - RNA, 64 nt, hsa; identical to SEQ ID NO: 452820

SEQ ID NO: 452855 - RNA, 64 nt, hsa; identical to SEQ ID NO: 452821

SEQ ID NO: 452856 - RNA, 64 nt, hsa; identical to SEQ ID NO: 452822

SEQ ID NO: 452857 - RNA, 64 nt, hsa; identical to SEQ ID NO: 452823

SEQ ID NO: 452858 - RNA, 64 nt, hsa; identical to SEQ ID NO: 452824

SEQ ID NO: 452859 - RNA, 64 nt, hsa; identical to SEQ ID NO: 452825

SEQ ID NO: 452860 - RNA, 64 nt, hsa; identical to SEQ ID NO: 452826

SEQ ID NO: 452861 - RNA, 64 nt, hsa; identical to SEQ ID NO: 452827

SEQ ID NO: 452862 - RNA, 64 nt, hsa; identical to SEQ ID NO: 452828

SEQ ID NO: 452863 - RNA, 64 nt, hsa; identical to SEQ ID NO: 452829

SEQ ID NO: 452864 - RNA, 64 nt, hsa; identical to SEQ ID NO: 452830

SEQ ID NO: 452865 - RNA, 64 nt, hsa; identical to SEQ ID NO: 452831

SEQ ID NO: 452866 - RNA, 64 nt, hsa; identical to SEQ ID NO: 452832

SEQ ID NO: 452867 - RNA, 64 nt, hsa; identical to SEQ ID NO: 452833

SEQ ID NO: 452868 - RNA, 64 nt, hsa; identical to SEQ ID NO: 452834

SEQ ID NO: 452869 - RNA, 64 nt, hsa; identical to SEQ ID NO: 452835

SEQ ID NO: 452870 - RNA, 64 nt, hsa; identical to SEQ ID NO: 452836

SEQ ID NO: 452871 - RNA, 64 nt, hsa; identical to SEQ ID NO: 452837

SEQ ID NO: 452872 - RNA, 64 nt, hsa; identical to SEQ ID NO: 452838

SEQ ID NO: 452873 - RNA, 64 nt, hsa; identical to SEQ ID NO: 452839

SEQ ID NO: 452874 - RNA, 64 nt, hsa; identical to SEQ ID NO: 452840

SEQ ID NO: 452875 - RNA, 64 nt, hsa; identical to SEQ ID NO: 452841

SEQ ID NO: 452876 - RNA, 64 nt, hsa; identical to SEQ ID NO: 452842

SEQ ID NO: 452877 - RNA, 64 nt, hsa; identical to SEQ ID NO: 452843

SEQ ID NO: 452878 - RNA, 64 nt, hsa; identical to SEQ ID NO: 452844

SEQ ID NO: 452879 - RNA, 64 nt, hsa; identical to SEQ ID NO: 452845

SEQ ID NO: 452880 - RNA, 64 nt, hsa; identical to SEQ ID NO: 452846

SEQ ID NO: 452881 - RNA, 64 nt, hsa; identical to SEQ ID NO: 250930

SEQ ID NO: 452882 - RNA, 64 nt, hsa; identical to SEQ ID NO: 250931

SEQ ID NO: 452883 - RNA, 64 nt, hsa; identical to SEQ ID NO: 250932

SEQ ID NO: 452884 - RNA, 64 nt, hsa; identical to SEQ ID NO: 250933

SEQ ID NO: 452885 - RNA, 64 nt, hsa; identical to SEQ ID NO: 250934

SEQ ID NO: 452886 - RNA, 64 nt, hsa; identical to SEQ ID NO: 250935

SEQ ID NO: 452887 - RNA, 64 nt, hsa; identical to SEQ ID NO: 452819

SEQ ID NO: 452888 - RNA, 64 nt, hsa; identical to SEQ ID NO: 452820

SEQ ID NO: 452889 - RNA, 64 nt, hsa; identical to SEQ ID NO: 452821

SEQ ID NO: 452890 - RNA, 64 nt, hsa; identical to SEQ ID NO: 452822

SEQ ID NO: 452891 - RNA, 64 nt, hsa; identical to SEQ ID NO: 452823

SEQ ID NO: 452892 - RNA, 64 nt, hsa; identical to SEQ ID NO: 452824

SEQ ID NO: 452893 - RNA, 64 nt, hsa; identical to SEQ ID NO: 452825

SEQ ID NO: 452894 - RNA, 64 nt, hsa; identical to SEQ ID NO: 452826

SEQ ID NO: 452895 - RNA, 64 nt, hsa; identical to SEQ ID NO: 452827

SEQ ID NO: 452896 - RNA, 64 nt, hsa; identical to SEQ ID NO: 452828

SEQ ID NO: 452897 - RNA, 64 nt, hsa; identical to SEQ ID NO: 452829

SEQ ID NO: 452898 - RNA, 64 nt, hsa; identical to SEQ ID NO: 452830

SEQ ID NO: 452899 - RNA, 64 nt, hsa; identical to SEQ ID NO: 452831

SEQ ID NO: 452900 - RNA, 64 nt, hsa; identical to SEQ ID NO: 452832

SEQ ID NO: 452901 - RNA, 64 nt, hsa; identical to SEQ ID NO: 452833

SEQ ID NO: 452902 - RNA, 64 nt, hsa; identical to SEQ ID NO: 452834

SEQ ID NO: 452903 - RNA, 64 nt, hsa; identical to SEQ ID NO: 452835

SEQ ID NO: 452904 - RNA, 64 nt, hsa; identical to SEQ ID NO: 452836

SEQ ID NO: 452905 - RNA, 64 nt, hsa; identical to SEQ ID NO: 452837

SEQ ID NO: 452906 - RNA, 64 nt, hsa; identical to SEQ ID NO: 452838

SEQ ID NO: 452907 - RNA, 64 nt, hsa; identical to SEQ ID NO: 452839

SEQ ID NO: 452908 - RNA, 64 nt, hsa; identical to SEQ ID NO: 452840

SEQ ID NO: 452909 - RNA, 64 nt, hsa; identical to SEQ ID NO: 452841

SEQ ID NO: 452910 - RNA, 64 nt, hsa; identical to SEQ ID NO: 452842

SEQ ID NO: 452911 - RNA, 64 nt, hsa; identical to SEQ ID NO: 452843

SEQ ID NO: 452912 - RNA, 64 nt, hsa; identical to SEQ ID NO: 452844

SEQ ID NO: 452913 - RNA, 64 nt, hsa; identical to SEQ ID NO: 452845

SEQ ID NO: 452914 - RNA, 64 nt, hsa; identical to SEQ ID NO: 452846

SEQ ID NO: 452915 - RNA, 64 nt, hsa; identical to SEQ ID NO: 250930

SEQ ID NO: 452916 - RNA, 64 nt, hsa; identical to SEQ ID NO: 250931

SEQ ID NO: 452917 - RNA, 64 nt, hsa; identical to SEQ ID NO: 250932

SEQ ID NO: 452918 - RNA, 64 nt, hsa; identical to SEQ ID NO: 250933

SEQ ID NO: 452919 - RNA, 64 nt, hsa; identical to SEQ ID NO: 250934

SEQ ID NO: 452920 - RNA, 64 nt, hsa; identical to SEQ ID NO: 250935

SEQ ID NO: 452921 - RNA, 64 nt, hsa; identical to SEQ ID NO: 86201

SEQ ID NO: 452922 - RNA, 64 nt, hsa; identical to SEQ ID NO: 86202

SEQ ID NO: 452923 - RNA, 64 nt, hsa; identical to SEQ ID NO: 86203

SEQ ID NO: 452924 - RNA, 64 nt, hsa; identical to SEQ ID NO: 86204

SEQ ID NO: 452925 - RNA, 64 nt, hsa; identical to SEQ ID NO: 86205

SEQ ID NO: 452926 - RNA, 64 nt, hsa; identical to SEQ ID NO: 86206

SEQ ID NO: 452927 - RNA, 64 nt, hsa; identical to SEQ ID NO: 86207

SEQ ID NO: 452928 - RNA, 64 nt, hsa; identical to SEQ ID NO: 86208

SEQ ID NO: 452929 - RNA, 64 nt, hsa; identical to SEQ ID NO: 86209

SEQ ID NO: 452930 - RNA, 64 nt, hsa; identical to SEQ ID NO: 86210

SEQ ID NO: 452931 - RNA, 64 nt, hsa; identical to SEQ ID NO: 86211

SEQ ID NO: 452932 - RNA, 64 nt, hsa; identical to SEQ ID NO: 86212

SEQ ID NO: 452933 - RNA, 64 nt, hsa; identical to SEQ ID NO: 86213

SEQ ID NO: 452934 - RNA, 64 nt, hsa; identical to SEQ ID NO: 86214

SEQ ID NO: 452935 - RNA, 64 nt, hsa; identical to SEQ ID NO: 86215

SEQ ID NO: 452936 - RNA, 64 nt, hsa; identical to SEQ ID NO: 86216

SEQ ID NO: 452937 - RNA, 64 nt, hsa; identical to SEQ ID NO: 86217

SEQ ID NO: 452938 - RNA, 64 nt, hsa; identical to SEQ ID NO: 86218

SEQ ID NO: 452939 - RNA, 64 nt, hsa; identical to SEQ ID NO: 86219

SEQ ID NO: 452940 - RNA, 64 nt, hsa; identical to SEQ ID NO: 86220

SEQ ID NO: 452941 - RNA, 64 nt, hsa; identical to SEQ ID NO: 86221

SEQ ID NO: 452942 - RNA, 64 nt, hsa; identical to SEQ ID NO: 86222

SEQ ID NO: 452943 - RNA, 64 nt, hsa; identical to SEQ ID NO: 86223

SEQ ID NO: 452944 - RNA, 64 nt, hsa; identical to SEQ ID NO: 86224

SEQ ID NO: 452945 - RNA, 64 nt, hsa; identical to SEQ ID NO: 86225

SEQ ID NO: 452946 - RNA, 64 nt, hsa; identical to SEQ ID NO: 86226

SEQ ID NO: 452947 - RNA, 64 nt, hsa; identical to SEQ ID NO: 86227

SEQ ID NO: 452948 - RNA, 64 nt, hsa; identical to SEQ ID NO: 86228

SEQ ID NO: 452949 - RNA, 64 nt, hsa; identical to SEQ ID NO: 86229

SEQ ID NO: 452950 - RNA, 64 nt, hsa; identical to SEQ ID NO: 86230

SEQ ID NO: 452951 - RNA, 64 nt, hsa; identical to SEQ ID NO: 86231

SEQ ID NO: 452952 - RNA, 64 nt, hsa; identical to SEQ ID NO: 86232

SEQ ID NO: 452953 - RNA, 64 nt, hsa; identical to SEQ ID NO: 86233

SEQ ID NO: 452954 - RNA, 64 nt, hsa; identical to SEQ ID NO: 86234

SEQ ID NO: 452955 - RNA, 64 nt, hsa; identical to SEQ ID NO: 86235

SEQ ID NO: 452956 - RNA, 64 nt, hsa; identical to SEQ ID NO: 86236

SEQ ID NO: 452957 - RNA, 64 nt, hsa; identical to SEQ ID NO: 86237

SEQ ID NO: 452958 - RNA, 64 nt, hsa; identical to SEQ ID NO: 86238

SEQ ID NO: 452959 - RNA, 64 nt, hsa; identical to SEQ ID NO: 86239

SEQ ID NO: 452960 - RNA, 64 nt, hsa; identical to SEQ ID NO: 86240

SEQ ID NO: 452961 - RNA, 64 nt, hsa; identical to SEQ ID NO: 86241

SEQ ID NO: 452962 - RNA, 64 nt, hsa; identical to SEQ ID NO: 86242

SEQ ID NO: 452963 - RNA, 64 nt, hsa; identical to SEQ ID NO: 86243

SEQ ID NO: 452964 - RNA, 64 nt, hsa; identical to SEQ ID NO: 86244

SEQ ID NO: 452965 - RNA, 64 nt, hsa; identical to SEQ ID NO: 86245

SEQ ID NO: 452966 - RNA, 64 nt, hsa; identical to SEQ ID NO: 86246

SEQ ID NO: 452967 - RNA, 64 nt, hsa; identical to SEQ ID NO: 86247

SEQ ID NO: 452968 - RNA, 64 nt, hsa; identical to SEQ ID NO: 86248

SEQ ID NO: 452969 - RNA, 64 nt, hsa; identical to SEQ ID NO: 86249

SEQ ID NO: 452970 - RNA, 64 nt, hsa; identical to SEQ ID NO: 86250

SEQ ID NO: 452971 - RNA, 64 nt, hsa; identical to SEQ ID NO: 86251

SEQ ID NO: 452972 - RNA, 64 nt, hsa; identical to SEQ ID NO: 86252

SEQ ID NO: 452973 - RNA, 64 nt, hsa; identical to SEQ ID NO: 86253

SEQ ID NO: 452974 - RNA, 64 nt, hsa; identical to SEQ ID NO: 86254

SEQ ID NO: 452975 - RNA, 64 nt, hsa; identical to SEQ ID NO: 86255

SEQ ID NO: 452976 - RNA, 64 nt, hsa; identical to SEQ ID NO: 86256

SEQ ID NO: 452977 - RNA, 55 nt, hsa; identical to SEQ ID NO: 86257

SEQ ID NO: 452978 - RNA, 64 nt, hsa; identical to SEQ ID NO: 86258

SEQ ID NO: 452979 - RNA, 64 nt, hsa; identical to SEQ ID NO: 86259

SEQ ID NO: 452980 - RNA, 64 nt, hsa; identical to SEQ ID NO: 86260

SEQ ID NO: 452981 - RNA, 64 nt, hsa; identical to SEQ ID NO: 86261

SEQ ID NO: 452982 - RNA, 64 nt, hsa; identical to SEQ ID NO: 86262

SEQ ID NO: 452983 - RNA, 64 nt, hsa; identical to SEQ ID NO: 86263

SEQ ID NO: 452984 - RNA, 64 nt, hsa; identical to SEQ ID NO: 86264

SEQ ID NO: 452985 - RNA, 64 nt, hsa; identical to SEQ ID NO: 86265

SEQ ID NO: 452986 - RNA, 64 nt, hsa; identical to SEQ ID NO: 86266

SEQ ID NO: 452987 - RNA, 64 nt, hsa; identical to SEQ ID NO: 86267

SEQ ID NO: 452988 - RNA, 64 nt, hsa; identical to SEQ ID NO: 86268

SEQ ID NO: 452989 - RNA, 64 nt, hsa; identical to SEQ ID NO: 86269

SEQ ID NO: 452990 - RNA, 64 nt, hsa; identical to SEQ ID NO: 86270

SEQ ID NO: 452991 - RNA, 64 nt, hsa; identical to SEQ ID NO: 86271

SEQ ID NO: 452992 - RNA, 64 nt, hsa; identical to SEQ ID NO: 86272

SEQ ID NO: 452993 - RNA, 64 nt, hsa; identical to SEQ ID NO: 86273

SEQ ID NO: 452994 - RNA, 64 nt, hsa; identical to SEQ ID NO: 86274

SEQ ID NO: 452995 - RNA, 64 nt, hsa; identical to SEQ ID NO: 86275

SEQ ID NO: 452996 - RNA, 64 nt, hsa; identical to SEQ ID NO: 86276

SEQ ID NO: 452997 - RNA, 64 nt, hsa; identical to SEQ ID NO: 86277

SEQ ID NO: 452998 - RNA, 64 nt, hsa; identical to SEQ ID NO: 86278

SEQ ID NO: 452999 - RNA, 64 nt, hsa; identical to SEQ ID NO: 213150

SEQ ID NO: 453000 - RNA, 64 nt, hsa; identical to SEQ ID NO: 213151

SEQ ID NO: 453001 - RNA, 64 nt, hsa; identical to SEQ ID NO: 213152

SEQ ID NO: 453002 - RNA, 64 nt, hsa; identical to SEQ ID NO: 213153

SEQ ID NO: 453003 - RNA, 64 nt, hsa; identical to SEQ ID NO: 213154

SEQ ID NO: 453004 - RNA, 64 nt, hsa; identical to SEQ ID NO: 213155

SEQ ID NO: 453005 - RNA, 64 nt, hsa; identical to SEQ ID NO: 277303

SEQ ID NO: 453006 - RNA, 64 nt, hsa; identical to SEQ ID NO: 277304

SEQ ID NO: 453007 - RNA, 64 nt, hsa; identical to SEQ ID NO: 277305

SEQ ID NO: 453008 - RNA, 64 nt, hsa; identical to SEQ ID NO: 277306

SEQ ID NO: 453009 - RNA, 64 nt, hsa; identical to SEQ ID NO: 277307

SEQ ID NO: 453010 - RNA, 64 nt, hsa; identical to SEQ ID NO: 277308

SEQ ID NO: 453011 - RNA, 64 nt, hsa; identical to SEQ ID NO: 277309

SEQ ID NO: 453012 - RNA, 64 nt, hsa; identical to SEQ ID NO: 277310

SEQ ID NO: 453013 - RNA, 64 nt, hsa; identical to SEQ ID NO: 277311

SEQ ID NO: 453014 - RNA, 64 nt, hsa; identical to SEQ ID NO: 277312

SEQ ID NO: 453015 - RNA, 64 nt, hsa; identical to SEQ ID NO: 277313

SEQ ID NO: 453016 - RNA, 64 nt, hsa; identical to SEQ ID NO: 277314

SEQ ID NO: 453017 - RNA, 64 nt, hsa; identical to SEQ ID NO: 277315

SEQ ID NO: 453018 - RNA, 64 nt, hsa; identical to SEQ ID NO: 277316

SEQ ID NO: 453019 - RNA, 64 nt, hsa; identical to SEQ ID NO: 277317

SEQ ID NO: 453020 - RNA, 64 nt, hsa; identical to SEQ ID NO: 277318

SEQ ID NO: 453021 - RNA, 64 nt, hsa; identical to SEQ ID NO: 277319

SEQ ID NO: 453022 - RNA, 64 nt, hsa; identical to SEQ ID NO: 277320

SEQ ID NO: 453023 - RNA, 64 nt, hsa; identical to SEQ ID NO: 277321

SEQ ID NO: 453024 - RNA, 64 nt, hsa; identical to SEQ ID NO: 277322

SEQ ID NO: 453025 - RNA, 62 nt, hsa; identical to SEQ ID NO: 277323

SEQ ID NO: 453026 - RNA, 64 nt, hsa; identical to SEQ ID NO: 277324

SEQ ID NO: 453027 - RNA, 64 nt, hsa; identical to SEQ ID NO: 277325

SEQ ID NO: 453028 - RNA, 64 nt, hsa; identical to SEQ ID NO: 277326

SEQ ID NO: 453029 - RNA, 64 nt, hsa; identical to SEQ ID NO: 277327

SEQ ID NO: 453030 - RNA, 64 nt, hsa; identical to SEQ ID NO: 277328

SEQ ID NO: 453031 - RNA, 64 nt, hsa; identical to SEQ ID NO: 277329

SEQ ID NO: 453032 - RNA, 64 nt, hsa; identical to SEQ ID NO: 277330

SEQ ID NO: 453033 - RNA, 64 nt, hsa; identical to SEQ ID NO: 277331

SEQ ID NO: 453034 - RNA, 64 nt, hsa; identical to SEQ ID NO: 277332

SEQ ID NO: 453035 - RNA, 64 nt, hsa
uauucauaauucuaucaagucaucuuugauuccuggaccuaauaaauuuuuuuucccuuucuuu

SEQ ID NO: 453036 - RNA, 64 nt, hsa
ugugucuacugauuggcuaucagaaccuuaggcuggaccuaaauagauugauuucauuucuaac

SEQ ID NO: 453037 - RNA, 64 nt, hsa; identical to SEQ ID NO: 79755

SEQ ID NO: 453038 - RNA, 64 nt, hsa; identical to SEQ ID NO: 79756

SEQ ID NO: 453039 - RNA, 64 nt, hsa; identical to SEQ ID NO: 79757

SEQ ID NO: 453040 - RNA, 64 nt, hsa; identical to SEQ ID NO: 79758

SEQ ID NO: 453041 - RNA, 64 nt, hsa; identical to SEQ ID NO: 79759

SEQ ID NO: 453042 - RNA, 64 nt, hsa; identical to SEQ ID NO: 79760

SEQ ID NO: 453043 - RNA, 64 nt, hsa; identical to SEQ ID NO: 79761

SEQ ID NO: 453044 - RNA, 64 nt, hsa; identical to SEQ ID NO: 79762

SEQ ID NO: 453045 - RNA, 64 nt, hsa; identical to SEQ ID NO: 79763

SEQ ID NO: 453046 - RNA, 64 nt, hsa; identical to SEQ ID NO: 79764

SEQ ID NO: 453047 - RNA, 64 nt, hsa; identical to SEQ ID NO: 79765

SEQ ID NO: 453048 - RNA, 64 nt, hsa; identical to SEQ ID NO: 79766

SEQ ID NO: 453049 - RNA, 64 nt, hsa; identical to SEQ ID NO: 79767

SEQ ID NO: 453050 - RNA, 64 nt, hsa; identical to SEQ ID NO: 79768

SEQ ID NO: 453051 - RNA, 64 nt, hsa; identical to SEQ ID NO: 79769

SEQ ID NO: 453052 - RNA, 64 nt, hsa; identical to SEQ ID NO: 79770

SEQ ID NO: 453053 - RNA, 64 nt, hsa; identical to SEQ ID NO: 79771

SEQ ID NO: 453054 - RNA, 64 nt, hsa; identical to SEQ ID NO: 79772

SEQ ID NO: 453055 - RNA, 64 nt, hsa; identical to SEQ ID NO: 79773

SEQ ID NO: 453056 - RNA, 64 nt, hsa; identical to SEQ ID NO: 79774

SEQ ID NO: 453057 - RNA, 64 nt, hsa; identical to SEQ ID NO: 79775

SEQ ID NO: 453058 - RNA, 64 nt, hsa; identical to SEQ ID NO: 79776

SEQ ID NO: 453059 - RNA, 64 nt, hsa; identical to SEQ ID NO: 79777

SEQ ID NO: 453060 - RNA, 64 nt, hsa; identical to SEQ ID NO: 79778

SEQ ID NO: 453061 - RNA, 64 nt, hsa; identical to SEQ ID NO: 79779

SEQ ID NO: 453062 - RNA, 64 nt, hsa; identical to SEQ ID NO: 79780

SEQ ID NO: 453063 - RNA, 64 nt, hsa; identical to SEQ ID NO: 79781

SEQ ID NO: 453064 - RNA, 64 nt, hsa; identical to SEQ ID NO: 79782

SEQ ID NO: 453065 - RNA, 64 nt, hsa; identical to SEQ ID NO: 79783

SEQ ID NO: 453066 - RNA, 64 nt, hsa; identical to SEQ ID NO: 79784

SEQ ID NO: 453067 - RNA, 64 nt, hsa; identical to SEQ ID NO: 79785

SEQ ID NO: 453068 - RNA, 64 nt, hsa; identical to SEQ ID NO: 79786

SEQ ID NO: 453069 - RNA, 64 nt, hsa; identical to SEQ ID NO: 79787

SEQ ID NO: 453070 - RNA, 64 nt, hsa; identical to SEQ ID NO: 79788

SEQ ID NO: 453071 - RNA, 64 nt, hsa; identical to SEQ ID NO: 79789

SEQ ID NO: 453072 - RNA, 64 nt, hsa; identical to SEQ ID NO: 79790

SEQ ID NO: 453073 - RNA, 64 nt, hsa; identical to SEQ ID NO: 79791

SEQ ID NO: 453074 - RNA, 64 nt, hsa; identical to SEQ ID NO: 79792

SEQ ID NO: 453075 - RNA, 64 nt, hsa; identical to SEQ ID NO: 79793

SEQ ID NO: 453076 - RNA, 64 nt, hsa; identical to SEQ ID NO: 79794

SEQ ID NO: 453077 - RNA, 64 nt, hsa; identical to SEQ ID NO: 79795

SEQ ID NO: 453078 - RNA, 64 nt, hsa; identical to SEQ ID NO: 79796

SEQ ID NO: 453079 - RNA, 64 nt, hsa; identical to SEQ ID NO: 79797

SEQ ID NO: 453080 - RNA, 64 nt, hsa; identical to SEQ ID NO: 79798

SEQ ID NO: 453081 - RNA, 64 nt, hsa; identical to SEQ ID NO: 79799

SEQ ID NO: 453082 - RNA, 64 nt, hsa; identical to SEQ ID NO: 79800

SEQ ID NO: 453083 - RNA, 64 nt, hsa; identical to SEQ ID NO: 79801

SEQ ID NO: 453084 - RNA, 64 nt, hsa; identical to SEQ ID NO: 79802

SEQ ID NO: 453085 - RNA, 64 nt, hsa; identical to SEQ ID NO: 79803

SEQ ID NO: 453086 - RNA, 64 nt, hsa; identical to SEQ ID NO: 227775

SEQ ID NO: 453087 - RNA, 64 nt, hsa; identical to SEQ ID NO: 227776

SEQ ID NO: 453088 - RNA, 64 nt, hsa; identical to SEQ ID NO: 227777

SEQ ID NO: 453089 - RNA, 64 nt, hsa; identical to SEQ ID NO: 227778

SEQ ID NO: 453090 - RNA, 64 nt, hsa; identical to SEQ ID NO: 227779

SEQ ID NO: 453091 - RNA, 64 nt, hsa; identical to SEQ ID NO: 227780

SEQ ID NO: 453092 - RNA, 64 nt, hsa; identical to SEQ ID NO: 227781

SEQ ID NO: 453093 - RNA, 64 nt, hsa; identical to SEQ ID NO: 227782

SEQ ID NO: 453094 - RNA, 64 nt, hsa; identical to SEQ ID NO: 227783

SEQ ID NO: 453095 - RNA, 64 nt, hsa; identical to SEQ ID NO: 227784

SEQ ID NO: 453096 - RNA, 64 nt, hsa; identical to SEQ ID NO: 227785

SEQ ID NO: 453097 - RNA, 64 nt, hsa
uuuguuguuuccugacuuuaagcaaugaagauugagacaauaaauagcacucagagaaugaagc

SEQ ID NO: 453098 - RNA, 64 nt, hsa
aauuuaguguuugacauugcuuccucugccacaaagacaauacucuggugacacaugucuagac

SEQ ID NO: 453099 - RNA, 64 nt, hsa
ugugcaugugugugucugucuuugugggaggguaagacaauaugaacaaacuaugaucacagug

SEQ ID NO: 453100 - RNA, 64 nt, hsa
cuuggcuguaaucaguuaugccguauaggaugucagacaauaccacugguuaaaauaaagccua

SEQ ID NO: 453101 - RNA, 64 nt, hsa
gaaauuuguugauuuuguaccaaaguguuucugaagacaauaaauugugagucaacuuuagaac

SEQ ID NO: 453102 - RNA, 64 nt, hsa
aucuaguuaaucauaauauuugauggaaagaaaaagacaauaaaauuguaauauaauaaauuug

SEQ ID NO: 453103 - RNA, 64 nt, hsa
aguuuugcuaaggcacaagacaauaaucugaauaagacaauaugugaugaauauaagaaagggc

SEQ ID NO: 453104 - RNA, 64 nt, hsa
auaaaugcuucccauggaguuuugcuaaggcacaagacaauaaucugaauaagacaauauguga

SEQ ID NO: 453105 - RNA, 64 nt, hsa
auugcaaaauaaagaaaaaugccaaccuuagaaaagacaauaaaugcacaaaagauauaaacag

SEQ ID NO: 453106 - RNA, 64 nt, hsa
aauuccaaaucuaucugaguuguauacccaucaaagacaauacaguuauuaacauagaugaagg

SEQ ID NO: 453107 - RNA, 64 nt, hsa
auuucccaaacaauacaaaaagcaaauuacacacccucaccacuguucuuaucucuauagugau

SEQ ID NO: 453108 - RNA, 64 nt, hsa
cucagggcugcaaaugucaagacauaacccuguuccucaccaucaugauaccagauacagguga

SEQ ID NO: 453109 - RNA, 64 nt, hsa
ucguugaaguccucaccaguacuacaccacuuuuccucaccaacccccauccuauucuugguaa

SEQ ID NO: 453110 - RNA, 64 nt, hsa
uuccuacagagucuaggcuggccgucguugaaguccucaccaguacuacaccacuuuuccucac

SEQ ID NO: 453111 - RNA, 64 nt, hsa
ucaaggugccaggccugccccaguaccuccagagccucaccagacuagccauugcugcagugug

SEQ ID NO: 453112 - RNA, 64 nt, hsa
acucucucuccauuaucgaacgacugacuguaaaccucaccacacaggguggugcccuggcccc

SEQ ID NO: 453113 - RNA, 64 nt, hsa
uuagcaucucugcuccccagaaaauuguaagcauccucaccagccuguggauacauucuuuauu

SEQ ID NO: 453114 - RNA, 64 nt, hsa
ugucuccccaaggcuggggugcugagccugccuuccucaccaccuagccauagucucaaaccug

SEQ ID NO: 453115 - RNA, 64 nt, hsa
uuacgaucagcgugacagaguagaagcuggagugccucaccacacggcccggaaacagcgggaa

SEQ ID NO: 453116 - RNA, 64 nt, hsa
acacacaacacaccucaccucacaccacagcacaccucaccacaccacaccgcacugcaccaua

SEQ ID NO: 453117 - RNA, 64 nt, hsa
cacaccucaccacaccacaccgcacugcaccauaccucaccacaucucaccacaccacagcaca

SEQ ID NO: 453118 - RNA, 64 nt, hsa
cauaccucaccacaucucaccacaccacagcacaccucaccacacaacacaccacaccccacac

SEQ ID NO: 453119 - RNA, 64 nt, hsa
auccaaagugguugucugagacagaguuggaaacccucaccaacuggccucuucaccuuccaca

SEQ ID NO: 453120 - RNA, 64 nt, hsa
cucagggaccagagggcuagguuggcacugcggcccucaccagguccugggcucggacccaacu

SEQ ID NO: 453121 - RNA, 64 nt, hsa
guucauugcugucaccuccugagucacuggggucccucaccagcaccucccugacaccugggcu

SEQ ID NO: 453122 - RNA, 64 nt, hsa
gcauccaucucaguguggaggacagugacgggacccucaccauccucuugcguuuuggccccca

SEQ ID NO: 453123 - RNA, 64 nt, hsa
cccugaccauugcccuagccagguucccaggaggccucaccauacucccuuucagggccagggc

SEQ ID NO: 453124 - RNA, 64 nt, hsa
ccagaaucauguggccagcccacccccuguuggcccucaccagccuuggagucuguucuaggga

SEQ ID NO: 453125 - RNA, 64 nt, hsa
ugucuccuucugggggucagggacgcagcuccacccucaccacuagcccacccugcccgugggc

SEQ ID NO: 453126 - RNA, 64 nt, hsa
guggcgggcagaugguggaaggcagcuuaggagaccucaccaaagagaagauggaccggcucuu

SEQ ID NO: 453127 - RNA, 64 nt, hsa
aagcaacaacgacaaaaaaaauuagccaagcauaguggcacaccccuguagucccagcuacuug

SEQ ID NO: 453128 - RNA, 64 nt, hsa
accccagcucuacaaaaaaaauuagccuggugugguggcacaugccuguaguuccagcuacuca

SEQ ID NO: 453129 - RNA, 64 nt, hsa
auacaaaaaaaaaaaaaaaaaaaagccaggcaugguggcacacaccuguaaucccagcuacucg

SEQ ID NO: 453130 - RNA, 64 nt, hsa
aaauacaaaaaaaaaaaaaaauuagcugggcaugguggcacacaccuguagucccagcuacuug

SEQ ID NO: 453131 - RNA, 64 nt, hsa
ucucuaucagaaauacaaaauuuagccgagugugguggcacaugccuguggccccagccacucu

SEQ ID NO: 453132 - RNA, 64 nt, hsa
agggucgugcucuugucucccagacuggacugcaguggcacaaucauagcucacugcagcuuug

SEQ ID NO: 453133 - RNA, 64 nt, hsa
ccuccauuccugcucucccacugcacacagggugguggcacauuaucccucuggggggugggga

SEQ ID NO: 453134 - RNA, 64 nt, hsa
aacccccagccacccucccggaauccgagauaggguggcacaucuguccugacagacgaggagu

SEQ ID NO: 453135 - RNA, 64 nt, hsa
agucuuacucugucucccaggcugcuggagugcaguggcacaaucucggcccgcugcagccucu

SEQ ID NO: 453136 - RNA, 64 nt, hsa
cagagucuugcucugucucccaggcuggagugcaguggcacaaucauggcucacugcagccuug

SEQ ID NO: 453137 - RNA, 64 nt, hsa
gucucuacuaaaaauacaaaauuggcagggugugguggcacaugccuauaaucccagcuacuug

SEQ ID NO: 453138 - RNA, 64 nt, hsa
ucucuacaaaaaauacaaaaauuagccagacaugguggcacaugccuuuagucccagcuacucu

SEQ ID NO: 453139 - RNA, 64 nt, hsa
ggcuggggcaggaggcuccuggagcgcuggauucguggcacagucugaggcccugagagggaaa

SEQ ID NO: 453140 - RNA, 64 nt, hsa
agcugccauaggaagagggugcuggcuggccaugguggcacacaccuguccucccagcacuuug

SEQ ID NO: 453141 - RNA, 64 nt, hsa
agaaagcaaaugugaccugugucacuacgugacuguggcacacgccuuguucuuggccaaagac

SEQ ID NO: 453142 - RNA, 64 nt, hsa
cccaucucuacuaaaaauacaaaauccaggcgugguggcacacaccuguagucccagcuacuca

SEQ ID NO: 453143 - RNA, 64 nt, hsa
gacuguucuguucugucuucucuguccauuuuagguggcacaauguaaguggcagugucucuua

SEQ ID NO: 453144 - RNA, 64 nt, hsa
ugaucccagccccuguugguuaguggcugccaguguggcacauucaugucaaaauuuaccagaa

SEQ ID NO: 453145 - RNA, 64 nt, hsa
ucucuacuaaaaauacaaaaauuagccgggugugguggcacaugccuguaaucccagcuacucg

SEQ ID NO: 453146 - RNA, 64 nt, hsa
ucuguacacaaaauuuaaaaauuaguucaucgggguggcacacaucaguagucccagcuacucu

SEQ ID NO: 453147 - RNA, 64 nt, hsa
gucucuacuaaaaacagaaaauuauccgggcgugguggcacaugacuguaaucccagcuacuca

SEQ ID NO: 453148 - RNA, 64 nt, hsa
aaaauaguaauaauacaaaaauuagcugggcgugguggcacaugccaguaauuccaucuacucg

SEQ ID NO: 453149 - RNA, 64 nt, hsa; identical to SEQ ID NO: 218381

SEQ ID NO: 453150 - RNA, 64 nt, hsa; identical to SEQ ID NO: 218382

SEQ ID NO: 453151 - RNA, 64 nt, hsa; identical to SEQ ID NO: 218383

SEQ ID NO: 453152 - RNA, 64 nt, hsa; identical to SEQ ID NO: 218384

SEQ ID NO: 453153 - RNA, 64 nt, hsa; identical to SEQ ID NO: 218385

SEQ ID NO: 453154 - RNA, 64 nt, hsa; identical to SEQ ID NO: 218386

SEQ ID NO: 453155 - RNA, 64 nt, hsa; identical to SEQ ID NO: 218387

SEQ ID NO: 453156 - RNA, 64 nt, hsa; identical to SEQ ID NO: 218388

SEQ ID NO: 453157 - RNA, 64 nt, hsa; identical to SEQ ID NO: 218389

SEQ ID NO: 453158 - RNA, 64 nt, hsa; identical to SEQ ID NO: 218390

SEQ ID NO: 453159 - RNA, 64 nt, hsa; identical to SEQ ID NO: 218391

SEQ ID NO: 453160 - RNA, 64 nt, hsa; identical to SEQ ID NO: 218392

SEQ ID NO: 453161 - RNA, 64 nt, hsa; identical to SEQ ID NO: 218393

SEQ ID NO: 453162 - RNA, 64 nt, hsa; identical to SEQ ID NO: 218394

SEQ ID NO: 453163 - RNA, 64 nt, hsa; identical to SEQ ID NO: 218395

SEQ ID NO: 453164 - RNA, 64 nt, hsa; identical to SEQ ID NO: 218396

SEQ ID NO: 453165 - RNA, 64 nt, hsa; identical to SEQ ID NO: 218397

SEQ ID NO: 453166 - RNA, 64 nt, hsa; identical to SEQ ID NO: 218398

SEQ ID NO: 453167 - RNA, 64 nt, hsa; identical to SEQ ID NO: 218399

SEQ ID NO: 453168 - RNA, 64 nt, hsa; identical to SEQ ID NO: 218400

SEQ ID NO: 453169 - RNA, 64 nt, hsa; identical to SEQ ID NO: 218401

SEQ ID NO: 453170 - RNA, 64 nt, hsa; identical to SEQ ID NO: 218402

SEQ ID NO: 453171 - RNA, 64 nt, hsa; identical to SEQ ID NO: 218403

SEQ ID NO: 453172 - RNA, 64 nt, hsa; identical to SEQ ID NO: 218404

SEQ ID NO: 453173 - RNA, 64 nt, hsa; identical to SEQ ID NO: 218405

SEQ ID NO: 453174 - RNA, 64 nt, hsa; identical to SEQ ID NO: 218406

SEQ ID NO: 453175 - RNA, 64 nt, hsa; identical to SEQ ID NO: 218407

SEQ ID NO: 453176 - RNA, 64 nt, hsa; identical to SEQ ID NO: 218408

SEQ ID NO: 453177 - RNA, 64 nt, hsa; identical to SEQ ID NO: 218409

SEQ ID NO: 453178 - RNA, 64 nt, hsa; identical to SEQ ID NO: 218410

SEQ ID NO: 453179 - RNA, 64 nt, hsa; identical to SEQ ID NO: 218411

SEQ ID NO: 453180 - RNA, 64 nt, hsa; identical to SEQ ID NO: 218412

SEQ ID NO: 453181 - RNA, 64 nt, hsa; identical to SEQ ID NO: 218413

SEQ ID NO: 453182 - RNA, 64 nt, hsa; identical to SEQ ID NO: 218414

SEQ ID NO: 453183 - RNA, 64 nt, hsa; identical to SEQ ID NO: 218415

SEQ ID NO: 453184 - RNA, 64 nt, hsa; identical to SEQ ID NO: 218416

SEQ ID NO: 453185 - RNA, 64 nt, hsa
aacagaaaugcaugaguaugugcaccaacaggcaugacaaaaauauuuauaguagugguguuca

SEQ ID NO: 453186 - RNA, 64 nt, hsa
gauugggacaccuuuuuuucccccugaggaucacugacaaaaaacacugcaccaguaaggaagc

SEQ ID NO: 453187 - RNA, 64 nt, hsa
aucaguuguuauuguuaucccuugaaagcgagggugacaaaaacaacaaaacaccguuauaaac

SEQ ID NO: 453188 - RNA, 64 nt, hsa
guauaucuuaauucuggguugcuuguuuuuuaggugacaaaaauaaaauauuguauuuuaauuc

SEQ ID NO: 453189 - RNA, 64 nt, hsa
ucugcaaagauauguuuuauauuguuauuuauugugacaaaaggaaauaaaaagccuaaauguu

SEQ ID NO: 453190 - RNA, 64 nt, hsa
auaaaaaacuagugucauguaccugccaugaacaugacaaaagguuagucuucaauagacugaa

SEQ ID NO: 453191 - RNA, 64 nt, hsa
aguaauuguguuuacauuuuauggugccuaguauugacaaaauguuauuucccuacauuaaaca

SEQ ID NO: 453192 - RNA, 64 nt, hsa
auugcaaagucaggaaucaucaggaacguuuagcugacaaaauacuugucuguuuuaaaaaccu

SEQ ID NO: 453193 - RNA, 64 nt, hsa
gguauuaaaauacagaggaguauggucaaaucuuugacaaaauuuucaugaucuucucuaacaa

SEQ ID NO: 453194 - RNA, 64 nt, hsa
ucgugagaaccugugggcaguauucaagcccugaugacaaaacccaguguuuuuuguuguuguu

SEQ ID NO: 453195 - RNA, 64 nt, hsa
aguaaaauccauuuccuuucucuguuucagccuaugacaaaauugauguuuacaggccugcuuu

SEQ ID NO: 453196 - RNA, 64 nt, hsa
uuccucuuuuccccgccugcacccacucugaacaugacaaaaguugccagaguuggggcauuga

SEQ ID NO: 453197 - RNA, 64 nt, hsa
ggcuggagucuucuagucccaagggauugggagaugacaaaaugaauuuuuuuuuucuuuuuug

SEQ ID NO: 453198 - RNA, 64 nt, hsa
gcugggauuacaggcaugaaccacugugcccagcugacaaaaugaguucuuaaacuuuuuuuuu

SEQ ID NO: 453199 - RNA, 64 nt, hsa; identical to SEQ ID NO: 453198

SEQ ID NO: 453200 - RNA, 64 nt, hsa
ggcuggagucuucuagucccaagggauugggagaugacaaaaugaauuuuuuuuucuuuuuuga

SEQ ID NO: 453201 - RNA, 64 nt, hsa
augagaaguuauuauucauacuguguugcucauuugacaaaauaagguaaggauuucauaauca

SEQ ID NO: 453202 - RNA, 64 nt, hsa
cagaaagucgugguucaggcaguaugggccgcugugacaaaacaccuaagacuggguaguuuau

SEQ ID NO: 453203 - RNA, 64 nt, hsa
cucuuggugcuauuucauuccugcuguaagagaaugacaaaaauauucauguauagccaauuga

SEQ ID NO: 453204 - RNA, 64 nt, hsa
ugugccacagaagcucagccugggcuucagcaauugacaaaauuugaagaaauauuaaacaaaa

SEQ ID NO: 453205 - RNA, 64 nt, hsa
cuuuuauauauagaucuacauaaaaacugcuacaugacaaaaaccacaccuaaagaaauuuuaa

SEQ ID NO: 453206 - RNA, 64 nt, hsa
uucucaaacaauggaugacacaaaacuaugagagugacaaaauggugacagguagcugggaccu

SEQ ID NO: 453207 - RNA, 64 nt, hsa
uugguuuuaucuaaaaaguaaauguauuugccuuugacaaaagacugacacaagagcaaauaag

SEQ ID NO: 453208 - RNA, 64 nt, hsa
cgaaagcuacucucuuaguuauguucuugugaugugacaaaaugucaagaagauaggagaagag

SEQ ID NO: 453209 - RNA, 64 nt, hsa
uuugcaacaauaggucuauuauuagagucaccuaugacaaaaaauagggguuaccuagauaaug

SEQ ID NO: 453210 - RNA, 64 nt, hsa
uuuagaguuuuaugaaagaugguauaguuuuuauugacaaaagcaaaguaaucuuacaacuaug

SEQ ID NO: 453211 - RNA, 64 nt, hsa
acauggaagauggagaagcuguagugucuccaucugacaaaacuaaaaaugaugaugauauuau

SEQ ID NO: 453212 - RNA, 64 nt, hsa
cacaggauuauuucaagcuagucauugagguauaugacaaaauguaaauaacaaaaaacugaaa

SEQ ID NO: 453213 - RNA, 64 nt, hsa
ucagaauucccaggcugaaaucagccauagcaguugacaaaacagcuauccccacaagugauga

SEQ ID NO: 453214 - RNA, 64 nt, hsa
gauauaccggauuaaauuuaucuguuuaaaaaaaugacaaaaguuaucaccaaaacccccuuuc

SEQ ID NO: 453215 - RNA, 64 nt, hsa
gugccuuguuuuuuauuuaaacuaugucuguaguugacaaaaguggcuucaucacaaauuuuuu

SEQ ID NO: 453216 - RNA, 64 nt, hsa
aaggaacauaccucaaaauaauaagagccaucuaugacaaaaccacagccaacaucauacugaa

SEQ ID NO: 453217 - RNA, 64 nt, hsa
uacacaccuacaaccaucuaaucuuugacaaaguugacaaaaauacgcaauggggaaagaauuc

SEQ ID NO: 453218 - RNA, 64 nt, hsa
ggaggcacuugugacuagccugccaauggacccaugacaaaaguuuaaccuaaccuucauccga

SEQ ID NO: 453219 - RNA, 64 nt, hsa
caguaagaaggccacagucucuucugcguguuagugacaaaaaguggguaagcugaaacuaaua

SEQ ID NO: 453220 - RNA, 64 nt, hsa
auaaaccagucucuuggagggcacaacccuuauuugacaaaacuuggauguuggcuugacugug

SEQ ID NO: 453221 - RNA, 64 nt, hsa
uccaaaacaaaaauaaagaccuguccaaaaguuuugacaaaaauacugauugcucccaaauaaa

SEQ ID NO: 453222 - RNA, 64 nt, hsa
aggggcauucacaaggcacaccagugcaagcagaugacaaaaaggugcagaaggcaaucuuaaa

SEQ ID NO: 453223 - RNA, 64 nt, hsa
ucggcucucauucgaucgagcuauucucuuaaaaugacaaaaaguguccauaaagaggcugcug

SEQ ID NO: 453224 - RNA, 64 nt, hsa
guuggcucaguaaugcucacgauaccaauuguuuugacaaaauaaauuuacuaaacuuggccua

SEQ ID NO: 453225 - RNA, 64 nt, hsa
uuuaaaaacaaaucuuuucaauggcauaagaaguugacaaaaauuucuuaaagugcaauagauu

SEQ ID NO: 453226 - RNA, 64 nt, hsa
cagacccggcauuggcaauguagcuguaauuuucugacaaaauuuaagacaaaauugucaacuu

SEQ ID NO: 453227 - RNA, 64 nt, hsa
ggccacugacauugaaugcaacaacugauuucauacaacugaguuacucuguucacuccacuga

SEQ ID NO: 453228 - RNA, 64 nt, hsa
ccccaaguuuuuugggccacugacauugaaugcaacaacugauuucauacaacugaguuacucu

SEQ ID NO: 453229 - RNA, 64 nt, hsa
agugucuucucagaaacaaccagccuugaaggcuacaacugacgaggaagacucuguuucgaau

SEQ ID NO: 453230 - RNA, 64 nt, hsa
agugucuucucagaaacaaccagccuugaaggcuacaacugaugagaaagauucuguuucgaac

SEQ ID NO: 453231 - RNA, 64 nt, hsa
uacauguaguggugugguguucugucuagaggauacaacugaauguuuuuaauuugcugacuua

SEQ ID NO: 453232 - RNA, 64 nt, hsa
gggagucgguuucucucuuaaagacacucacuguacaacugaaagcagcugucauauuucuggc

SEQ ID NO: 453233 - RNA, 64 nt, hsa
gcaaaacaaaacgaaaaaagauuucucaguauacacaacugaaugaugauacuuacaauuuuua

SEQ ID NO: 453234 - RNA, 64 nt, hsa
agugaguuuaaaaaaaaucuauaguuuccaauaaacaacugaaaaauuaucaugagauguguau

SEQ ID NO: 453235 - RNA, 64 nt, hsa
ccacaccuuaauuaucauucaacuugcaaaagagacaacugauaagaagaaaauugaaaugaga

SEQ ID NO: 453236 - RNA, 64 nt, hsa
aauugcaaaagaaaugucgcuguaaauaagauuuacaacugauguuucuagaaaauuuccacuu

SEQ ID NO: 453237 - RNA, 64 nt, hsa
gguaauccuccuaaugaacccacaaggucaauucacaacugauaucuuagcuauuaaagaagua

SEQ ID NO: 453238 - RNA, 64 nt, hsa
ggcaggcuuaggucucacugacagcaugccagacacaacugaaucgaagcaggccugaagccua

SEQ ID NO: 453239 - RNA, 64 nt, hsa
uuuuuugcuaugacagaguaaugcuaacguaaggacaacugaguuugaucaguguuuaaucgca

SEQ ID NO: 453240 - RNA, 64 nt, hsa
aagaaguuuugggcucacugcuaaaauagaguauacaacugaauguuuuuaagucaagauacug

SEQ ID NO: 453241 - RNA, 64 nt, hsa
gacuccugauugcucuggaagccugcugauuucuacaacugaucauuugcagcugcugguuuug

SEQ ID NO: 453242 - RNA, 64 nt, hsa
ccccuugcacuggucaucaguauuguguaaaggaacaacugauauacuugagugugcaagcaaa

SEQ ID NO: 453243 - RNA, 64 nt, hsa
uuuuuguguggcauaaauaauauauuaaccuguuacaacugacaacauugguuuucugcagcua

SEQ ID NO: 453244 - RNA, 64 nt, hsa
guucaaagaugagagcugaaaaaucguggccuuaacaacugaaagcuuuacaguguucaugcua

SEQ ID NO: 453245 - RNA, 64 nt, hsa; identical to SEQ ID NO: 53765

SEQ ID NO: 453246 - RNA, 64 nt, hsa; identical to SEQ ID NO: 53766

SEQ ID NO: 453247 - RNA, 64 nt, hsa; identical to SEQ ID NO: 53767

SEQ ID NO: 453248 - RNA, 64 nt, hsa; identical to SEQ ID NO: 53768

SEQ ID NO: 453249 - RNA, 64 nt, hsa; identical to SEQ ID NO: 234645

SEQ ID NO: 453250 - RNA, 64 nt, hsa; identical to SEQ ID NO: 234646

SEQ ID NO: 453251 - RNA, 64 nt, hsa; identical to SEQ ID NO: 234647

SEQ ID NO: 453252 - RNA, 64 nt, hsa; identical to SEQ ID NO: 234648

SEQ ID NO: 453253 - RNA, 64 nt, hsa; identical to SEQ ID NO: 234649

SEQ ID NO: 453254 - RNA, 64 nt, hsa; identical to SEQ ID NO: 234650

SEQ ID NO: 453255 - RNA, 64 nt, hsa; identical to SEQ ID NO: 234651

SEQ ID NO: 453256 - RNA, 64 nt, hsa; identical to SEQ ID NO: 234652

SEQ ID NO: 453257 - RNA, 64 nt, hsa; identical to SEQ ID NO: 234653

SEQ ID NO: 453258 - RNA, 64 nt, hsa; identical to SEQ ID NO: 234654

SEQ ID NO: 453259 - RNA, 64 nt, hsa; identical to SEQ ID NO: 234655

SEQ ID NO: 453260 - RNA, 64 nt, hsa; identical to SEQ ID NO: 234656

SEQ ID NO: 453261 - RNA, 64 nt, hsa; identical to SEQ ID NO: 234657

SEQ ID NO: 453262 - RNA, 64 nt, hsa; identical to SEQ ID NO: 234658

SEQ ID NO: 453263 - RNA, 64 nt, hsa; identical to SEQ ID NO: 234659

SEQ ID NO: 453264 - RNA, 64 nt, hsa; identical to SEQ ID NO: 234660

SEQ ID NO: 453265 - RNA, 64 nt, hsa; identical to SEQ ID NO: 234661

SEQ ID NO: 453266 - RNA, 64 nt, hsa; identical to SEQ ID NO: 234662

SEQ ID NO: 453267 - RNA, 64 nt, hsa; identical to SEQ ID NO: 234663

SEQ ID NO: 453268 - RNA, 64 nt, hsa; identical to SEQ ID NO: 234664

SEQ ID NO: 453269 - RNA, 64 nt, hsa; identical to SEQ ID NO: 234665

SEQ ID NO: 453270 - RNA, 63 nt, hsa; identical to SEQ ID NO: 234666

SEQ ID NO: 453271 - RNA, 64 nt, hsa; identical to SEQ ID NO: 234667

SEQ ID NO: 453272 - RNA, 64 nt, hsa; identical to SEQ ID NO: 234668

SEQ ID NO: 453273 - RNA, 64 nt, hsa; identical to SEQ ID NO: 234669

SEQ ID NO: 453274 - RNA, 64 nt, hsa; identical to SEQ ID NO: 234670

SEQ ID NO: 453275 - RNA, 64 nt, hsa; identical to SEQ ID NO: 234671

SEQ ID NO: 453276 - RNA, 64 nt, hsa; identical to SEQ ID NO: 234672

SEQ ID NO: 453277 - RNA, 64 nt, hsa; identical to SEQ ID NO: 234673

SEQ ID NO: 453278 - RNA, 64 nt, hsa; identical to SEQ ID NO: 234674

SEQ ID NO: 453279 - RNA, 64 nt, hsa; identical to SEQ ID NO: 234675

SEQ ID NO: 453280 - RNA, 64 nt, hsa; identical to SEQ ID NO: 234676

SEQ ID NO: 453281 - RNA, 64 nt, hsa; identical to SEQ ID NO: 234677

SEQ ID NO: 453282 - RNA, 64 nt, hsa; identical to SEQ ID NO: 234678

SEQ ID NO: 453283 - RNA, 64 nt, hsa; identical to SEQ ID NO: 234679

SEQ ID NO: 453284 - RNA, 64 nt, hsa; identical to SEQ ID NO: 234680

SEQ ID NO: 453285 - RNA, 64 nt, hsa; identical to SEQ ID NO: 234681

SEQ ID NO: 453286 - RNA, 64 nt, hsa; identical to SEQ ID NO: 234682

SEQ ID NO: 453287 - RNA, 64 nt, hsa; identical to SEQ ID NO: 234683

SEQ ID NO: 453288 - RNA, 64 nt, hsa; identical to SEQ ID NO: 234684

SEQ ID NO: 453289 - RNA, 64 nt, hsa; identical to SEQ ID NO: 234685

SEQ ID NO: 453290 - RNA, 64 nt, hsa; identical to SEQ ID NO: 234686

SEQ ID NO: 453291 - RNA, 64 nt, hsa; identical to SEQ ID NO: 234687

SEQ ID NO: 453292 - RNA, 64 nt, hsa; identical to SEQ ID NO: 234688

SEQ ID NO: 453293 - RNA, 64 nt, hsa; identical to SEQ ID NO: 234689

SEQ ID NO: 453294 - RNA, 64 nt, hsa; identical to SEQ ID NO: 234690

SEQ ID NO: 453295 - RNA, 64 nt, hsa; identical to SEQ ID NO: 234691

SEQ ID NO: 453296 - RNA, 64 nt, hsa; identical to SEQ ID NO: 234692

SEQ ID NO: 453297 - RNA, 64 nt, hsa; identical to SEQ ID NO: 234693

SEQ ID NO: 453298 - RNA, 64 nt, hsa; identical to SEQ ID NO: 234694

SEQ ID NO: 453299 - RNA, 64 nt, hsa; identical to SEQ ID NO: 234695

SEQ ID NO: 453300 - RNA, 64 nt, hsa; identical to SEQ ID NO: 234696

SEQ ID NO: 453301 - RNA, 64 nt, hsa
gaagaaggcaaaaaacuuuuuuuuuuuuuuuuuugagacggagucucgcucugucgcccaggcu

SEQ ID NO: 453302 - RNA, 64 nt, hsa
uauaagggauaauuuuucuuuuuuuuuuuuuuuugagacggagucucacucuuccgcccaggcu

SEQ ID NO: 453303 - RNA, 64 nt, hsa
cagugguauauuggggaauuuuuuuuuuuuuuuugagacggagucuggcucugucacccaggcu

SEQ ID NO: 453304 - RNA, 64 nt, hsa
cacccagcuaauuuuuuuuuuuuuuuuuuuauuugagacggaguuucgcucugucgcccaggcu

SEQ ID NO: 453305 - RNA, 64 nt, hsa
caccaugccuggcuaauuuuuuuuauuuuuaguagagacggaauuuuaccauguuggcuaggcu

SEQ ID NO: 453306 - RNA, 64 nt, hsa
cuuuuucuuuuuuuuuuuuuuauuuuaauuuuuugagacggaguuucccucuugucacccaggc

SEQ ID NO: 453307 - RNA, 64 nt, hsa
ccaccaugcccggcuaauuuuuguauuuuuaguagagacggaguuucaccauguuggccaggcu

SEQ ID NO: 453308 - RNA, 64 nt, hsa
ccauccucuucuuuuuuuuuuuuuuuuuuuuuuugagacggaguuucgcucuugucaccccagc

SEQ ID NO: 453309 - RNA, 64 nt, hsa
guguauuuuguuuuguuuugcuuugcuuuguuuugagacggagucucgcucugucauccaggcu

SEQ ID NO: 453310 - RNA, 64 nt, hsa
ucuaauaccugagccaagaauggaagcuugugaggagacggacucuauguugcccaggcuguua

SEQ ID NO: 453311 - RNA, 64 nt, hsa
gccaccaugcccggcuaauuuuguauuuuuaguagagacggaguugcaccauguuggccaggcu

SEQ ID NO: 453312 - RNA, 64 nt, hsa
cagagaacgcuacuaaugauuuuuuuuuuuuuuugagacggaguuuuguucuuguugcccaggc

SEQ ID NO: 453313 - RNA, 64 nt, hsa; identical to SEQ ID NO: 238476

SEQ ID NO: 453314 - RNA, 64 nt, hsa; identical to SEQ ID NO: 238477

SEQ ID NO: 453315 - RNA, 53 nt, hsa; identical to SEQ ID NO: 238478

SEQ ID NO: 453316 - RNA, 64 nt, hsa; identical to SEQ ID NO: 238479

SEQ ID NO: 453317 - RNA, 64 nt, hsa; identical to SEQ ID NO: 238480

SEQ ID NO: 453318 - RNA, 64 nt, hsa; identical to SEQ ID NO: 238481

SEQ ID NO: 453319 - RNA, 64 nt, hsa; identical to SEQ ID NO: 238482

SEQ ID NO: 453320 - RNA, 64 nt, hsa; identical to SEQ ID NO: 238483

SEQ ID NO: 453321 - RNA, 64 nt, hsa; identical to SEQ ID NO: 238484

SEQ ID NO: 453322 - RNA, 64 nt, hsa; identical to SEQ ID NO: 238485

SEQ ID NO: 453323 - RNA, 64 nt, hsa; identical to SEQ ID NO: 238486

SEQ ID NO: 453324 - RNA, 64 nt, hsa; identical to SEQ ID NO: 238487

SEQ ID NO: 453325 - RNA, 64 nt, hsa; identical to SEQ ID NO: 238488

SEQ ID NO: 453326 - RNA, 64 nt, hsa; identical to SEQ ID NO: 238489

SEQ ID NO: 453327 - RNA, 64 nt, hsa; identical to SEQ ID NO: 102259

SEQ ID NO: 453328 - RNA, 64 nt, hsa; identical to SEQ ID NO: 102260

SEQ ID NO: 453329 - RNA, 64 nt, hsa; identical to SEQ ID NO: 102261

SEQ ID NO: 453330 - RNA, 64 nt, hsa; identical to SEQ ID NO: 102262

SEQ ID NO: 453331 - RNA, 64 nt, hsa; identical to SEQ ID NO: 102263

SEQ ID NO: 453332 - RNA, 64 nt, hsa; identical to SEQ ID NO: 102264

SEQ ID NO: 453333 - RNA, 64 nt, hsa; identical to SEQ ID NO: 102265

SEQ ID NO: 453334 - RNA, 64 nt, hsa; identical to SEQ ID NO: 102266

SEQ ID NO: 453335 - RNA, 64 nt, hsa; identical to SEQ ID NO: 102267

SEQ ID NO: 453336 - RNA, 64 nt, hsa; identical to SEQ ID NO: 102268

SEQ ID NO: 453337 - RNA, 64 nt, hsa
aauggugauaauggauuaauuccucaaaggaagagcagaacaccugaaaaucagcaauuuccug

SEQ ID NO: 453338 - RNA, 64 nt, hsa
aauggugaugauggauuaauuccuccaaggaagagcagaacaccugaaagccagcaauuuccug

SEQ ID NO: 453339 - RNA, 64 nt, hsa
gguguuucagaaacuuggaaaccugaagcagcaggcagaacaggagcgggacaagcugcagagg

SEQ ID NO: 453340 - RNA, 64 nt, hsa
ugcucugcagccagcuucagguagcggauuuccugcagaacauccuggcucaggaggacacugc

SEQ ID NO: 453341 - RNA, 64 nt, hsa
aguaguggaggagcguaugguuaagcccaaaggggcagaacaagaaagccacgggauuguauga

SEQ ID NO: 453342 - RNA, 64 nt, hsa
ugagaggcaguaaagcagugaugaagacagugcagcagaacauugaaguccugauugcagcagu

SEQ ID NO: 453343 - RNA, 64 nt, hsa
caagaaauggcgucugcucugguggcuuaagugagcagaacagguaguauuacaccaccggccc

SEQ ID NO: 453344 - RNA, 64 nt, hsa
agaaaaaagaguccucuucuuuucccagccuuuugcagaacacaguagacagaacugccaccuu

SEQ ID NO: 453345 - RNA, 64 nt, hsa
uaacugccagcugcucuccccgagugcucagcuggcagaacaccuuuccuuucucacccagaac

SEQ ID NO: 453346 - RNA, 64 nt, hsa
gaugaccacccccucccucacaccugugggcagggcagaacagccuggcgggcuacaguuuagc

SEQ ID NO: 453347 - RNA, 64 nt, hsa
aggguuuuacagaggaccaguuaguucugguggagcagaacacacugaugguggaagagcggga

SEQ ID NO: 453348 - RNA, 64 nt, hsa
caaaacugaagaugguuugaaacagcuucacaaggcagaacaguaucaaaagaagaaucggaag

SEQ ID NO: 453349 - RNA, 64 nt, hsa
ccggcuucugaccggccuuuguccuggcuccguagcagaacacuguaaaagugcccgcgucuuu

SEQ ID NO: 453350 - RNA, 64 nt, hsa
gagugcagcuggagggaucugagcgcaggaagacgcagaacaacagaaauagccgccccucccc

SEQ ID NO: 453351 - RNA, 64 nt, hsa
gggaagauuuggguuccuaagaugcacaagcguuuuacaccaguggugauuaacucaacuaaaa

SEQ ID NO: 453352 - RNA, 64 nt, hsa
gacuuuuuuuuucuuauuaagaaaaugaaaucccuuacaccagauaucaguuaauucaaacaga

SEQ ID NO: 453353 - RNA, 64 nt, hsa
gcucugguggcuuaagugagcagaacagguaguauuacaccaccggcccccuccccccagacuc

SEQ ID NO: 453354 - RNA, 64 nt, hsa
ccucaugagggucuccacagggccggagcucagguuacaccacuccuucguccuuacaggagau

SEQ ID NO: 453355 - RNA, 64 nt, hsa
augaggguuggguaggagcuuccaggccugggauuuacaccacgccuagcccagcagaggccuu

SEQ ID NO: 453356 - RNA, 64 nt, hsa
agauucucugguuuuauggcuuuuuucccuuucuuuacaccauccucucccauaagcacccaug

SEQ ID NO: 453357 - RNA, 64 nt, hsa; identical to SEQ ID NO: 296629

SEQ ID NO: 453358 - RNA, 64 nt, hsa; identical to SEQ ID NO: 296630

SEQ ID NO: 453359 - RNA, 64 nt, hsa; identical to SEQ ID NO: 296631

SEQ ID NO: 453360 - RNA, 64 nt, hsa; identical to SEQ ID NO: 296632

SEQ ID NO: 453361 - RNA, 64 nt, hsa; identical to SEQ ID NO: 296633

SEQ ID NO: 453362 - RNA, 64 nt, hsa; identical to SEQ ID NO: 296634

SEQ ID NO: 453363 - RNA, 64 nt, hsa; identical to SEQ ID NO: 296635

SEQ ID NO: 453364 - RNA, 64 nt, hsa; identical to SEQ ID NO: 296636

SEQ ID NO: 453365 - RNA, 64 nt, hsa; identical to SEQ ID NO: 296637

SEQ ID NO: 453366 - RNA, 64 nt, hsa; identical to SEQ ID NO: 296638

SEQ ID NO: 453367 - RNA, 64 nt, hsa; identical to SEQ ID NO: 296639

SEQ ID NO: 453368 - RNA, 64 nt, hsa; identical to SEQ ID NO: 296640

SEQ ID NO: 453369 - RNA, 64 nt, hsa; identical to SEQ ID NO: 296641

SEQ ID NO: 453370 - RNA, 64 nt, hsa; identical to SEQ ID NO: 296642

SEQ ID NO: 453371 - RNA, 64 nt, hsa; identical to SEQ ID NO: 296643

SEQ ID NO: 453372 - RNA, 64 nt, hsa; identical to SEQ ID NO: 296644

SEQ ID NO: 453373 - RNA, 64 nt, hsa; identical to SEQ ID NO: 296645

SEQ ID NO: 453374 - RNA, 64 nt, hsa; identical to SEQ ID NO: 296646

SEQ ID NO: 453375 - RNA, 64 nt, hsa; identical to SEQ ID NO: 296647

SEQ ID NO: 453376 - RNA, 64 nt, hsa; identical to SEQ ID NO: 296648

SEQ ID NO: 453377 - RNA, 64 nt, hsa; identical to SEQ ID NO: 296649

SEQ ID NO: 453378 - RNA, 64 nt, hsa; identical to SEQ ID NO: 296650

SEQ ID NO: 453379 - RNA, 64 nt, hsa; identical to SEQ ID NO: 296651

SEQ ID NO: 453380 - RNA, 64 nt, hsa; identical to SEQ ID NO: 296652

SEQ ID NO: 453381 - RNA, 64 nt, hsa; identical to SEQ ID NO: 296653

SEQ ID NO: 453382 - RNA, 64 nt, hsa; identical to SEQ ID NO: 296654

SEQ ID NO: 453383 - RNA, 64 nt, hsa; identical to SEQ ID NO: 296655

SEQ ID NO: 453384 - RNA, 64 nt, hsa; identical to SEQ ID NO: 296656

SEQ ID NO: 453385 - RNA, 64 nt, hsa; identical to SEQ ID NO: 296657

SEQ ID NO: 453386 - RNA, 64 nt, hsa; identical to SEQ ID NO: 296658

SEQ ID NO: 453387 - RNA, 64 nt, hsa; identical to SEQ ID NO: 296659

SEQ ID NO: 453388 - RNA, 64 nt, hsa; identical to SEQ ID NO: 296660

SEQ ID NO: 453389 - RNA, 64 nt, hsa; identical to SEQ ID NO: 296661

SEQ ID NO: 453390 - RNA, 64 nt, hsa; identical to SEQ ID NO: 296662

SEQ ID NO: 453391 - RNA, 64 nt, hsa; identical to SEQ ID NO: 296663

SEQ ID NO: 453392 - RNA, 64 nt, hsa; identical to SEQ ID NO: 296664

SEQ ID NO: 453393 - RNA, 64 nt, hsa; identical to SEQ ID NO: 296665

SEQ ID NO: 453394 - RNA, 64 nt, hsa; identical to SEQ ID NO: 296666

SEQ ID NO: 453395 - RNA, 64 nt, hsa; identical to SEQ ID NO: 296667

SEQ ID NO: 453396 - RNA, 64 nt, hsa; identical to SEQ ID NO: 296668

SEQ ID NO: 453397 - RNA, 64 nt, hsa; identical to SEQ ID NO: 296669

SEQ ID NO: 453398 - RNA, 64 nt, hsa; identical to SEQ ID NO: 296670

SEQ ID NO: 453399 - RNA, 64 nt, hsa; identical to SEQ ID NO: 296671

SEQ ID NO: 453400 - RNA, 64 nt, hsa; identical to SEQ ID NO: 296672

SEQ ID NO: 453401 - RNA, 64 nt, hsa; identical to SEQ ID NO: 296673

SEQ ID NO: 453402 - RNA, 64 nt, hsa; identical to SEQ ID NO: 296674

SEQ ID NO: 453403 - RNA, 64 nt, hsa; identical to SEQ ID NO: 296675

SEQ ID NO: 453404 - RNA, 64 nt, hsa; identical to SEQ ID NO: 296676

SEQ ID NO: 453405 - RNA, 64 nt, hsa; identical to SEQ ID NO: 296677

SEQ ID NO: 453406 - RNA, 64 nt, hsa; identical to SEQ ID NO: 296678

SEQ ID NO: 453407 - RNA, 64 nt, hsa; identical to SEQ ID NO: 296679

SEQ ID NO: 453408 - RNA, 64 nt, hsa; identical to SEQ ID NO: 296680

SEQ ID NO: 453409 - RNA, 64 nt, hsa; identical to SEQ ID NO: 296681

SEQ ID NO: 453410 - RNA, 64 nt, hsa; identical to SEQ ID NO: 296682

SEQ ID NO: 453411 - RNA, 64 nt, hsa; identical to SEQ ID NO: 296683

SEQ ID NO: 453412 - RNA, 64 nt, hsa; identical to SEQ ID NO: 216180

SEQ ID NO: 453413 - RNA, 64 nt, hsa; identical to SEQ ID NO: 216181

SEQ ID NO: 453414 - RNA, 64 nt, hsa; identical to SEQ ID NO: 216182

SEQ ID NO: 453415 - RNA, 64 nt, hsa; identical to SEQ ID NO: 216183

SEQ ID NO: 453416 - RNA, 64 nt, hsa; identical to SEQ ID NO: 216184

SEQ ID NO: 453417 - RNA, 64 nt, hsa; identical to SEQ ID NO: 216185

SEQ ID NO: 453418 - RNA, 64 nt, hsa; identical to SEQ ID NO: 216186

SEQ ID NO: 453419 - RNA, 64 nt, hsa; identical to SEQ ID NO: 216187

SEQ ID NO: 453420 - RNA, 64 nt, hsa; identical to SEQ ID NO: 216188

SEQ ID NO: 453421 - RNA, 64 nt, hsa; identical to SEQ ID NO: 216189

SEQ ID NO: 453422 - RNA, 64 nt, hsa; identical to SEQ ID NO: 216190

SEQ ID NO: 453423 - RNA, 64 nt, hsa; identical to SEQ ID NO: 216191

SEQ ID NO: 453424 - RNA, 64 nt, hsa; identical to SEQ ID NO: 216192

SEQ ID NO: 453425 - RNA, 64 nt, hsa; identical to SEQ ID NO: 216193

SEQ ID NO: 453426 - RNA, 64 nt, hsa; identical to SEQ ID NO: 216194

SEQ ID NO: 453427 - RNA, 64 nt, hsa; identical to SEQ ID NO: 216195

SEQ ID NO: 453428 - RNA, 64 nt, hsa; identical to SEQ ID NO: 216196

SEQ ID NO: 453429 - RNA, 64 nt, hsa; identical to SEQ ID NO: 216197

SEQ ID NO: 453430 - RNA, 64 nt, hsa; identical to SEQ ID NO: 216198

SEQ ID NO: 453431 - RNA, 64 nt, hsa; identical to SEQ ID NO: 216199

SEQ ID NO: 453432 - RNA, 64 nt, hsa; identical to SEQ ID NO: 216200

SEQ ID NO: 453433 - RNA, 64 nt, hsa; identical to SEQ ID NO: 216201

SEQ ID NO: 453434 - RNA, 64 nt, hsa; identical to SEQ ID NO: 216202

SEQ ID NO: 453435 - RNA, 64 nt, hsa; identical to SEQ ID NO: 216203

SEQ ID NO: 453436 - RNA, 64 nt, hsa; identical to SEQ ID NO: 216204

SEQ ID NO: 453437 - RNA, 64 nt, hsa; identical to SEQ ID NO: 216205

SEQ ID NO: 453438 - RNA, 64 nt, hsa; identical to SEQ ID NO: 216206

SEQ ID NO: 453439 - RNA, 64 nt, hsa; identical to SEQ ID NO: 216207

SEQ ID NO: 453440 - RNA, 64 nt, hsa; identical to SEQ ID NO: 216208

SEQ ID NO: 453441 - RNA, 64 nt, hsa; identical to SEQ ID NO: 216209

SEQ ID NO: 453442 - RNA, 64 nt, hsa; identical to SEQ ID NO: 216210

SEQ ID NO: 453443 - RNA, 64 nt, hsa; identical to SEQ ID NO: 216211

SEQ ID NO: 453444 - RNA, 64 nt, hsa; identical to SEQ ID NO: 216212

SEQ ID NO: 453445 - RNA, 64 nt, hsa; identical to SEQ ID NO: 216213

SEQ ID NO: 453446 - RNA, 64 nt, hsa; identical to SEQ ID NO: 216214

SEQ ID NO: 453447 - RNA, 64 nt, hsa; identical to SEQ ID NO: 97841

SEQ ID NO: 453448 - RNA, 64 nt, hsa; identical to SEQ ID NO: 97842

SEQ ID NO: 453449 - RNA, 64 nt, hsa; identical to SEQ ID NO: 97843

SEQ ID NO: 453450 - RNA, 64 nt, hsa; identical to SEQ ID NO: 97844

SEQ ID NO: 453451 - RNA, 64 nt, hsa; identical to SEQ ID NO: 97845

SEQ ID NO: 453452 - RNA, 64 nt, hsa; identical to SEQ ID NO: 97846

SEQ ID NO: 453453 - RNA, 64 nt, hsa; identical to SEQ ID NO: 97847

SEQ ID NO: 453454 - RNA, 64 nt, hsa; identical to SEQ ID NO: 97848

SEQ ID NO: 453455 - RNA, 64 nt, hsa
cucaaugaaaagggaguuucguaagcaaaauagaggacagaaaugcaguucaugaacuugcugg

SEQ ID NO: 453456 - RNA, 64 nt, hsa
gugguuaugagccuccaggcgcaugcuguccaguggacagaacaucuggcgguugguugauugc

SEQ ID NO: 453457 - RNA, 64 nt, hsa
uuguuuucccuuauuuuaaaagugauuuuuuuaaggacagaacuucuuccaaaagagagggaug

SEQ ID NO: 453458 - RNA, 64 nt, hsa
agcaaggggagacauugugguagcuaucagacauggacagaaacugacuuagugcucacaagcc

SEQ ID NO: 453459 - RNA, 64 nt, hsa
aacucaacucaaucugaaaguagagugucugagaggacagaagguaaugggaacuguagcugga

SEQ ID NO: 453460 - RNA, 64 nt, hsa
gugagaagacauagggauuucaaccacacaguugggacagaagggacagugcaucuguucaucc

SEQ ID NO: 453461 - RNA, 64 nt, hsa
uccaugccgcguggaugggcccaguucugggagaggacagaaaaggugguacaggguugucugc

SEQ ID NO: 453462 - RNA, 64 nt, hsa
uuguuuuuacguuuucaaguucagcauuguauucggacagaagcugugacugaagacucagugc

SEQ ID NO: 453463 - RNA, 64 nt, hsa
auuuacuauaggugaagauagcccucauauucaaggacagaagcucuggcaggaguaaauuagc

SEQ ID NO: 453464 - RNA, 64 nt, hsa
gcaugcuugugcagaaagaagccauagccagaaaggacagaaucucucccccacucccuugccc

SEQ ID NO: 453465 - RNA, 64 nt, hsa
gaauugcuacucgaaggugccagaaugacacaaaggacagaauuccuuucccaguuguuacccu

SEQ ID NO: 453466 - RNA, 64 nt, hsa
agaugaagugacuuccucaaaaucacaugguucaggacagaaacaagauuaaaaccuggaucca

SEQ ID NO: 453467 - RNA, 64 nt, hsa
aaggcccuaccagagggaacacggccuacugagcggacagaaugaugccaaaauauugcuuaug

SEQ ID NO: 453468 - RNA, 64 nt, hsa
cuuugagagaguuuaucauugggagaagccgcagggacagaacugaacguccugcagcuucggg

SEQ ID NO: 453469 - RNA, 64 nt, hsa
gagguggcccuaucccuaggcaguggugcuaggaggacagaaggcuauaugggcguggcagagg

SEQ ID NO: 453470 - RNA, 64 nt, hsa
cccgccuugugagccaggaagcagcgucucaucaggacagaagguaggaugaagacauggggua

SEQ ID NO: 453471 - RNA, 64 nt, hsa
agguaggggggcuugauaacuuaacuuuccacguggacagaauuuuuuuuuuuguuuuguuuuu

SEQ ID NO: 453472 - RNA, 64 nt, hsa
guccuaaagccaggaagagugacaaggcagguggggacagaaggaagaagccaggagccucccu

SEQ ID NO: 453473 - RNA, 64 nt, hsa
aauuauuuauucaugggagauaauuuauuuuaaaggacagaauuaccaagcguuacaaaaucag

SEQ ID NO: 453474 - RNA, 64 nt, hsa
cacaggaaagagaaaaagaaaucuguugaagaaaggacagaagaggaaaugcuuugggaugagu

SEQ ID NO: 453475 - RNA, 64 nt, hsa; identical to SEQ ID NO: 363385

SEQ ID NO: 453476 - RNA, 64 nt, hsa; identical to SEQ ID NO: 363386

SEQ ID NO: 453477 - RNA, 64 nt, hsa; identical to SEQ ID NO: 363387

SEQ ID NO: 453478 - RNA, 64 nt, hsa; identical to SEQ ID NO: 363388

SEQ ID NO: 453479 - RNA, 64 nt, hsa; identical to SEQ ID NO: 363389

SEQ ID NO: 453480 - RNA, 64 nt, hsa; identical to SEQ ID NO: 363390

SEQ ID NO: 453481 - RNA, 64 nt, hsa; identical to SEQ ID NO: 363391

SEQ ID NO: 453482 - RNA, 64 nt, hsa; identical to SEQ ID NO: 363392

SEQ ID NO: 453483 - RNA, 64 nt, hsa; identical to SEQ ID NO: 363393

SEQ ID NO: 453484 - RNA, 64 nt, hsa; identical to SEQ ID NO: 363394

SEQ ID NO: 453485 - RNA, 64 nt, hsa; identical to SEQ ID NO: 363395

SEQ ID NO: 453486 - RNA, 64 nt, hsa; identical to SEQ ID NO: 363396

SEQ ID NO: 453487 - RNA, 64 nt, hsa; identical to SEQ ID NO: 363397

SEQ ID NO: 453488 - RNA, 64 nt, hsa; identical to SEQ ID NO: 363398

SEQ ID NO: 453489 - RNA, 64 nt, hsa; identical to SEQ ID NO: 363399

SEQ ID NO: 453490 - RNA, 64 nt, hsa; identical to SEQ ID NO: 363400

SEQ ID NO: 453491 - RNA, 64 nt, hsa; identical to SEQ ID NO: 363401

SEQ ID NO: 453492 - RNA, 64 nt, hsa; identical to SEQ ID NO: 363402

SEQ ID NO: 453493 - RNA, 64 nt, hsa; identical to SEQ ID NO: 363403

SEQ ID NO: 453494 - RNA, 64 nt, hsa; identical to SEQ ID NO: 363404

SEQ ID NO: 453495 - RNA, 64 nt, hsa; identical to SEQ ID NO: 363405

SEQ ID NO: 453496 - RNA, 64 nt, hsa; identical to SEQ ID NO: 363406

SEQ ID NO: 453497 - RNA, 64 nt, hsa; identical to SEQ ID NO: 363407

SEQ ID NO: 453498 - RNA, 64 nt, hsa; identical to SEQ ID NO: 363408

SEQ ID NO: 453499 - RNA, 64 nt, hsa; identical to SEQ ID NO: 363409

SEQ ID NO: 453500 - RNA, 64 nt, hsa; identical to SEQ ID NO: 363410

SEQ ID NO: 453501 - RNA, 64 nt, hsa; identical to SEQ ID NO: 363411

SEQ ID NO: 453502 - RNA, 64 nt, hsa; identical to SEQ ID NO: 363412

SEQ ID NO: 453503 - RNA, 64 nt, hsa; identical to SEQ ID NO: 363413

SEQ ID NO: 453504 - RNA, 64 nt, hsa; identical to SEQ ID NO: 363414

SEQ ID NO: 453505 - RNA, 64 nt, hsa; identical to SEQ ID NO: 363415

SEQ ID NO: 453506 - RNA, 64 nt, hsa; identical to SEQ ID NO: 363416

SEQ ID NO: 453507 - RNA, 64 nt, hsa; identical to SEQ ID NO: 363417

SEQ ID NO: 453508 - RNA, 64 nt, hsa; identical to SEQ ID NO: 363418

SEQ ID NO: 453509 - RNA, 64 nt, hsa; identical to SEQ ID NO: 363419

SEQ ID NO: 453510 - RNA, 64 nt, hsa; identical to SEQ ID NO: 363420

SEQ ID NO: 453511 - RNA, 64 nt, hsa; identical to SEQ ID NO: 363421

SEQ ID NO: 453512 - RNA, 64 nt, hsa; identical to SEQ ID NO: 363422

SEQ ID NO: 453513 - RNA, 64 nt, hsa; identical to SEQ ID NO: 363423

SEQ ID NO: 453514 - RNA, 64 nt, hsa; identical to SEQ ID NO: 363424

SEQ ID NO: 453515 - RNA, 64 nt, hsa; identical to SEQ ID NO: 363425

SEQ ID NO: 453516 - RNA, 64 nt, hsa; identical to SEQ ID NO: 363426

SEQ ID NO: 453517 - RNA, 64 nt, hsa; identical to SEQ ID NO: 363427

SEQ ID NO: 453518 - RNA, 64 nt, hsa; identical to SEQ ID NO: 363428

SEQ ID NO: 453519 - RNA, 64 nt, hsa; identical to SEQ ID NO: 363429

SEQ ID NO: 453520 - RNA, 64 nt, hsa; identical to SEQ ID NO: 127504

SEQ ID NO: 453521 - RNA, 64 nt, hsa; identical to SEQ ID NO: 127505

SEQ ID NO: 453522 - RNA, 64 nt, hsa; identical to SEQ ID NO: 127506

SEQ ID NO: 453523 - RNA, 64 nt, hsa; identical to SEQ ID NO: 127507

SEQ ID NO: 453524 - RNA, 64 nt, hsa; identical to SEQ ID NO: 127508

SEQ ID NO: 453525 - RNA, 64 nt, hsa; identical to SEQ ID NO: 127509

SEQ ID NO: 453526 - RNA, 64 nt, hsa; identical to SEQ ID NO: 127510

SEQ ID NO: 453527 - RNA, 64 nt, hsa; identical to SEQ ID NO: 127511

SEQ ID NO: 453528 - RNA, 64 nt, hsa; identical to SEQ ID NO: 127512

SEQ ID NO: 453529 - RNA, 64 nt, hsa; identical to SEQ ID NO: 127513

SEQ ID NO: 453530 - RNA, 64 nt, hsa; identical to SEQ ID NO: 127514

SEQ ID NO: 453531 - RNA, 64 nt, hsa; identical to SEQ ID NO: 127514

SEQ ID NO: 453532 - RNA, 64 nt, hsa; identical to SEQ ID NO: 127516

SEQ ID NO: 453533 - RNA, 64 nt, hsa; identical to SEQ ID NO: 127517

SEQ ID NO: 453534 - RNA, 64 nt, hsa; identical to SEQ ID NO: 127518

SEQ ID NO: 453535 - RNA, 64 nt, hsa; identical to SEQ ID NO: 127519

SEQ ID NO: 453536 - RNA, 64 nt, hsa; identical to SEQ ID NO: 127520

SEQ ID NO: 453537 - RNA, 64 nt, hsa; identical to SEQ ID NO: 127521

SEQ ID NO: 453538 - RNA, 64 nt, hsa; identical to SEQ ID NO: 127522

SEQ ID NO: 453539 - RNA, 64 nt, hsa; identical to SEQ ID NO: 127523

SEQ ID NO: 453540 - RNA, 64 nt, hsa; identical to SEQ ID NO: 127524

SEQ ID NO: 453541 - RNA, 64 nt, hsa; identical to SEQ ID NO: 127525

SEQ ID NO: 453542 - RNA, 64 nt, hsa; identical to SEQ ID NO: 127526

SEQ ID NO: 453543 - RNA, 64 nt, hsa; identical to SEQ ID NO: 127527

SEQ ID NO: 453544 - RNA, 64 nt, hsa; identical to SEQ ID NO: 127528

SEQ ID NO: 453545 - RNA, 64 nt, hsa; identical to SEQ ID NO: 127529

SEQ ID NO: 453546 - RNA, 64 nt, hsa; identical to SEQ ID NO: 127530

SEQ ID NO: 453547 - RNA, 64 nt, hsa; identical to SEQ ID NO: 127531

SEQ ID NO: 453548 - RNA, 64 nt, hsa; identical to SEQ ID NO: 127532

SEQ ID NO: 453549 - RNA, 64 nt, hsa; identical to SEQ ID NO: 127533

SEQ ID NO: 453550 - RNA, 64 nt, hsa; identical to SEQ ID NO: 127534

SEQ ID NO: 453551 - RNA, 64 nt, hsa; identical to SEQ ID NO: 127535

SEQ ID NO: 453552 - RNA, 64 nt, hsa; identical to SEQ ID NO: 127536

SEQ ID NO: 453553 - RNA, 64 nt, hsa; identical to SEQ ID NO: 127537

SEQ ID NO: 453554 - RNA, 64 nt, hsa; identical to SEQ ID NO: 127538

SEQ ID NO: 453555 - RNA, 64 nt, hsa; identical to SEQ ID NO: 127539

SEQ ID NO: 453556 - RNA, 64 nt, hsa; identical to SEQ ID NO: 127540

SEQ ID NO: 453557 - RNA, 64 nt, hsa; identical to SEQ ID NO: 127541

SEQ ID NO: 453558 - RNA, 64 nt, hsa; identical to SEQ ID NO: 127542

SEQ ID NO: 453559 - RNA, 64 nt, hsa; identical to SEQ ID NO: 127543

SEQ ID NO: 453560 - RNA, 64 nt, hsa; identical to SEQ ID NO: 127544

SEQ ID NO: 453561 - RNA, 64 nt, hsa; identical to SEQ ID NO: 127545

SEQ ID NO: 453562 - RNA, 64 nt, hsa; identical to SEQ ID NO: 127546

SEQ ID NO: 453563 - RNA, 64 nt, hsa; identical to SEQ ID NO: 127547

SEQ ID NO: 453564 - RNA, 64 nt, hsa; identical to SEQ ID NO: 127548

SEQ ID NO: 453565 - RNA, 64 nt, hsa; identical to SEQ ID NO: 127549

SEQ ID NO: 453566 - RNA, 64 nt, hsa; identical to SEQ ID NO: 127550

SEQ ID NO: 453567 - RNA, 64 nt, hsa; identical to SEQ ID NO: 127551

SEQ ID NO: 453568 - RNA, 64 nt, hsa; identical to SEQ ID NO: 127552

SEQ ID NO: 453569 - RNA, 64 nt, hsa; identical to SEQ ID NO: 127553

SEQ ID NO: 453570 - RNA, 64 nt, hsa; identical to SEQ ID NO: 127554

SEQ ID NO: 453571 - RNA, 64 nt, hsa; identical to SEQ ID NO: 127555

SEQ ID NO: 453572 - RNA, 64 nt, hsa; identical to SEQ ID NO: 127556

SEQ ID NO: 453573 - RNA, 64 nt, hsa; identical to SEQ ID NO: 379229

SEQ ID NO: 453574 - RNA, 64 nt, hsa; identical to SEQ ID NO: 379230

SEQ ID NO: 453575 - RNA, 64 nt, hsa; identical to SEQ ID NO: 379231

SEQ ID NO: 453576 - RNA, 64 nt, hsa; identical to SEQ ID NO: 379232

SEQ ID NO: 453577 - RNA, 64 nt, hsa; identical to SEQ ID NO: 379233

SEQ ID NO: 453578 - RNA, 64 nt, hsa; identical to SEQ ID NO: 379234

SEQ ID NO: 453579 - RNA, 64 nt, hsa; identical to SEQ ID NO: 379235

SEQ ID NO: 453580 - RNA, 64 nt, hsa; identical to SEQ ID NO: 379236

SEQ ID NO: 453581 - RNA, 64 nt, hsa; identical to SEQ ID NO: 379237

SEQ ID NO: 453582 - RNA, 64 nt, hsa; identical to SEQ ID NO: 379238

SEQ ID NO: 453583 - RNA, 64 nt, hsa; identical to SEQ ID NO: 379239

SEQ ID NO: 453584 - RNA, 64 nt, hsa; identical to SEQ ID NO: 379240

SEQ ID NO: 453585 - RNA, 64 nt, hsa; identical to SEQ ID NO: 379241

SEQ ID NO: 453586 - RNA, 64 nt, hsa; identical to SEQ ID NO: 379242

SEQ ID NO: 453587 - RNA, 64 nt, hsa; identical to SEQ ID NO: 379243

SEQ ID NO: 453588 - RNA, 64 nt, hsa; identical to SEQ ID NO: 379244

SEQ ID NO: 453589 - RNA, 64 nt, hsa; identical to SEQ ID NO: 379245

SEQ ID NO: 453590 - RNA, 64 nt, hsa; identical to SEQ ID NO: 379246

SEQ ID NO: 453591 - RNA, 64 nt, hsa; identical to SEQ ID NO: 379247

SEQ ID NO: 453592 - RNA, 64 nt, hsa; identical to SEQ ID NO: 379248

SEQ ID NO: 453593 - RNA, 64 nt, hsa; identical to SEQ ID NO: 379249

SEQ ID NO: 453594 - RNA, 64 nt, hsa; identical to SEQ ID NO: 379250

SEQ ID NO: 453595 - RNA, 64 nt, hsa; identical to SEQ ID NO: 379251

SEQ ID NO: 453596 - RNA, 64 nt, hsa; identical to SEQ ID NO: 379252

SEQ ID NO: 453597 - RNA, 64 nt, hsa; identical to SEQ ID NO: 379253

SEQ ID NO: 453598 - RNA, 64 nt, hsa; identical to SEQ ID NO: 379254

SEQ ID NO: 453599 - RNA, 64 nt, hsa; identical to SEQ ID NO: 379255

SEQ ID NO: 453600 - RNA, 64 nt, hsa; identical to SEQ ID NO: 379256

SEQ ID NO: 453601 - RNA, 64 nt, hsa; identical to SEQ ID NO: 379257

SEQ ID NO: 453602 - RNA, 64 nt, hsa; identical to SEQ ID NO: 379258

SEQ ID NO: 453603 - RNA, 64 nt, hsa; identical to SEQ ID NO: 379259

SEQ ID NO: 453604 - RNA, 64 nt, hsa; identical to SEQ ID NO: 108826

SEQ ID NO: 453605 - RNA, 64 nt, hsa; identical to SEQ ID NO: 108827

SEQ ID NO: 453606 - RNA, 64 nt, hsa; identical to SEQ ID NO: 108828

SEQ ID NO: 453607 - RNA, 64 nt, hsa; identical to SEQ ID NO: 108829

SEQ ID NO: 453608 - RNA, 64 nt, hsa; identical to SEQ ID NO: 108830

SEQ ID NO: 453609 - RNA, 64 nt, hsa; identical to SEQ ID NO: 108831

SEQ ID NO: 453610 - RNA, 64 nt, hsa; identical to SEQ ID NO: 108832

SEQ ID NO: 453611 - RNA, 64 nt, hsa; identical to SEQ ID NO: 108833

SEQ ID NO: 453612 - RNA, 64 nt, hsa; identical to SEQ ID NO: 108834

SEQ ID NO: 453613 - RNA, 64 nt, hsa; identical to SEQ ID NO: 108835

SEQ ID NO: 453614 - RNA, 64 nt, hsa; identical to SEQ ID NO: 108836

SEQ ID NO: 453615 - RNA, 64 nt, hsa; identical to SEQ ID NO: 108837

SEQ ID NO: 453616 - RNA, 64 nt, hsa; identical to SEQ ID NO: 108838

SEQ ID NO: 453617 - RNA, 64 nt, hsa; identical to SEQ ID NO: 108839

SEQ ID NO: 453618 - RNA, 64 nt, hsa; identical to SEQ ID NO: 108840

SEQ ID NO: 453619 - RNA, 64 nt, hsa; identical to SEQ ID NO: 108841

SEQ ID NO: 453620 - RNA, 64 nt, hsa; identical to SEQ ID NO: 108842

SEQ ID NO: 453621 - RNA, 64 nt, hsa; identical to SEQ ID NO: 108843

SEQ ID NO: 453622 - RNA, 64 nt, hsa; identical to SEQ ID NO: 108844

SEQ ID NO: 453623 - RNA, 64 nt, hsa; identical to SEQ ID NO: 108845

SEQ ID NO: 453624 - RNA, 64 nt, hsa; identical to SEQ ID NO: 108846

SEQ ID NO: 453625 - RNA, 64 nt, hsa; identical to SEQ ID NO: 108847

SEQ ID NO: 453626 - RNA, 64 nt, hsa; identical to SEQ ID NO: 108848

SEQ ID NO: 453627 - RNA, 64 nt, hsa; identical to SEQ ID NO: 108849

SEQ ID NO: 453628 - RNA, 64 nt, hsa; identical to SEQ ID NO: 108850

SEQ ID NO: 453629 - RNA, 64 nt, hsa; identical to SEQ ID NO: 108851

SEQ ID NO: 453630 - RNA, 64 nt, hsa; identical to SEQ ID NO: 108852

SEQ ID NO: 453631 - RNA, 63 nt, hsa; identical to SEQ ID NO: 108853

SEQ ID NO: 453632 - RNA, 64 nt, hsa; identical to SEQ ID NO: 108854

SEQ ID NO: 453633 - RNA, 64 nt, hsa
gccacaaaacuaaaaggccuggccccauucuggaaaaggcaaagcugcaugagacacagccuuc

SEQ ID NO: 453634 - RNA, 64 nt, hsa
cauucaguugagugaggcugaaggcuggguuugaaaaggcaaaaagacaagacauccaggcagg

SEQ ID NO: 453635 - RNA, 64 nt, hsa
gauugcucuuuauccagcccacagcaggggaaagaaaggcaacucgcaaagaugagauggaaga

SEQ ID NO: 453636 - RNA, 64 nt, hsa
uugaacaugaugagaugugagaacuuacaaugaaaaaggcaauaaugauagaaauuauuucuua

SEQ ID NO: 453637 - RNA, 64 nt, hsa
uucuauccaccaacagaaauuauaccauauagugaaaggcaauuuucuaaauaauuucauuacu

SEQ ID NO: 453638 - RNA, 64 nt, hsa
aaccagauacauaaagagcucuuacaacucaauaaaaggcaaguaauuuaaaaauaggcaaaag

SEQ ID NO: 453639 - RNA, 64 nt, hsa
uuuuuauggaugagcauaaaccuagucuuaguuuaaaggcaaacuaaaguugaggggaaauaau

SEQ ID NO: 453640 - RNA, 64 nt, hsa
caguuauucacuuacagaugaaacuaaaacaaauaaaggcaagcuauuaucaguuugguaguuc

SEQ ID NO: 453641 - RNA, 64 nt, hsa
aaucuggauuugccuuguguccuucugaguuuucaaaggcaaguauucaacagucccuguguga

SEQ ID NO: 453642 - RNA, 64 nt, hsa
augaaaguaacaguuauugauacugcuggacuucaaaggcaaaguucauuucuuccauuaacug

SEQ ID NO: 453643 - RNA, 64 nt, hsa
aaaaucaguugacaauuagaauaauaaaguggauaaaggcaaauuaagauauaggaccaaaaca

SEQ ID NO: 453644 - RNA, 64 nt, hsa
uaaacuaccaaaaaaaaaguggggguggaggaaaaaaggcaaaggcgccuucugagaucaaaag

SEQ ID NO: 453645 - RNA, 64 nt, hsa
gaaaaucaaguauaaucccugagauuuguagacuaaaggcaaugaugugggacuacuuggucga

SEQ ID NO: 453646 - RNA, 64 nt, hsa
auguuuacuuuuggacuggguuuguaacacgguuaaaggcaaugagaaacaagcagaauuccag

SEQ ID NO: 453647 - RNA, 64 nt, hsa
acaggcagaucugcuuggggaagcuaguuaugugaaaggcaaauagagucauacaguagcucaa

SEQ ID NO: 453648 - RNA, 64 nt, hsa
augugaaaggcaaauagagucauacaguagcucaaaaggcaaccauaauucucuuuggugcagg

SEQ ID NO: 453649 - RNA, 64 nt, hsa
acgggucaaaggcaaaggccuuugugaugugagcaaaggcaaccaaaacuuagccucacuccac

SEQ ID NO: 453650 - RNA, 64 nt, hsa
gaagggccucacagugauggguucaggacgggucaaaggcaaaggccuuugugaugugagcaaa

SEQ ID NO: 453651 - RNA, 64 nt, hsa
ucccaucgccuucccacccauucgccaacgcgggaaaggcaaggccuggcuuacuuagagcuuc

SEQ ID NO: 453652 - RNA, 64 nt, hsa
ugucugugucccccugccgaacaaagcugggaguaaaggcaaaaccuugacacguguugguagc

SEQ ID NO: 453653 - RNA, 64 nt, hsa
uuauuagauagcaguggcaugcuuuaaaaaaaaaaaaggcaaugaaaauuuagcaagccacuga

SEQ ID NO: 453654 - RNA, 64 nt, hsa
cuagguggagaaaaauaucaacagaacucuagccaaaggcaagccccagaacucagacaacaga

SEQ ID NO: 453655 - RNA, 64 nt, hsa
aggaaacagggaguucauuuggccacacuggaagaaaggcaagaaagaggaagacaagucuugg

SEQ ID NO: 453656 - RNA, 64 nt, hsa
cuuuauugucuaguuguuuuuuuucccccaagacaaaggcaaguuucccuaaguuugaguugau

SEQ ID NO: 453657 - RNA, 64 nt, hsa
ugauaguuauuaaaaagaaaacaaaacaaaaaaaaaaggcaaggcacaacaaaaaaauauccug

SEQ ID NO: 453658 - RNA, 64 nt, hsa
gaucaauacuguaaauugggucuuuuguaaacaaaaaggcaaugauguaugcauuuuuuuuaau

SEQ ID NO: 453659 - RNA, 64 nt, hsa
ucugaacggaucagaguuucauaguuucuauaguaaaggcaaugucuauuucagggauuguaaa

SEQ ID NO: 453660 - RNA, 64 nt, hsa
auggugugugccuuuuauaaaggaaaagagagaaaaaggcaaagcaagguuguggccuuagguu

SEQ ID NO: 453661 - RNA, 64 nt, hsa
auaccaugcuuucagaacaaaagcucugggccagaaaggcaauuuggcuaaaaaaugaauaaga

SEQ ID NO: 453662 - RNA, 64 nt, hsa
ugcaccuguuaacuguguucgacauugaagggagaaaggcaagaugugcacucuggacucaaga

SEQ ID NO: 453663 - RNA, 64 nt, hsa
cugguuaggauggcaggacgugggcugggcccacaaaggcaaaggguccagaaggagacaggca

SEQ ID NO: 453664 - RNA, 64 nt, hsa
aauugucacucagcauaaugagcauuuaacauacaaaggcaauguacuguuuuguguugaucua

SEQ ID NO: 453665 - RNA, 64 nt, hsa
ggaaucuccuacuuaauauaugaccaugacuuugaaaggcaaaagaggaaucaagaauaaauaa

SEQ ID NO: 453666 - RNA, 64 nt, hsa
aucacuuuucaacuuccauauucuucauauaguaaaaggcaaaguguugaagauacuacggugu

SEQ ID NO: 453667 - RNA, 64 nt, hsa
auccuggauucacagugggaacaaguuucuauuaaaaggcaaaugcuguuacaaauuuuuggca

SEQ ID NO: 453668 - RNA, 64 nt, hsa
guaauaacuucucaguguuuugaguugauucaccaaaggcaaauuuuggaauguucuugcgcuu

SEQ ID NO: 453669 - RNA, 64 nt, hsa
agacuccaucucaaaaaaaaaaaaaaaaaaaaaaaaaggcaauugugcggagccaaccaucacu

SEQ ID NO: 453670 - RNA, 64 nt, hsa
gucaaucauccgagauggguuuuccauuccaaagaaaggcaauaugguuccuuccuucccuccu

SEQ ID NO: 453671 - RNA, 64 nt, hsa
aggauuuuaaagggcauugauagcauaccaaacaaaaggcaaaauaaagugaccuuuuuauaua

SEQ ID NO: 453672 - RNA, 64 nt, hsa
auaaaauaagaagggggagugaaacagagaaagaaaaggcaaaagacugguuuguuugcuuaau

SEQ ID NO: 453673 - RNA, 64 nt, hsa
ccaugaaaauaccauaggaagacauaaaacuuuaaaaggcaacucaaagaugauggaaacgcac

SEQ ID NO: 453674 - RNA, 64 nt, hsa
auggcggcccccccagcugucaucaauuaaaggcaaaggcaaucgaaucuaacaggcacagugg

SEQ ID NO: 453675 - RNA, 64 nt, hsa
gaaggcauggcggcccccccagcugucaucaauuaaaggcaaaggcaaucgaaucuaacaggca

SEQ ID NO: 453676 - RNA, 64 nt, hsa
accugcagcucuguggaaagaggcaaaguccugaaaaggcaaaggguugucacuuagggcagcu

SEQ ID NO: 453677 - RNA, 64 nt, hsa
ggccauagccaaggaucgauuccccaaccacagcaaaggcaacacucuuccuccagagaucacc

SEQ ID NO: 453678 - RNA, 64 nt, hsa
cuucuucuucuucuuccuuaaagacauuuaagcuaaaggcaacucguacccaaauuuccaagac

SEQ ID NO: 453679 - RNA, 64 nt, hsa
uuugcuuguucacugcagucuuaagaaagagguaaaaggcaagcaaaggagaugaaaucuguuc

SEQ ID NO: 453680 - RNA, 64 nt, hsa
cugucaucaacuugggcaacaaaugacccacuggaaaggcaaauccacuuaaaagaucucugua

SEQ ID NO: 453681 - RNA, 64 nt, hsa
uauauauacauauauauauauauaguuauuuaaaaaaggcaacugaaaguaauuagacuucuua

SEQ ID NO: 453682 - RNA, 64 nt, hsa
acagagcaaaacucugucucaaaaaaaaaaaaaaaaaggcaaaauuaaagaauuucaagucccu

SEQ ID NO: 453683 - RNA, 64 nt, hsa
acugaccucuacaguucauauuugcagugacauaaaaggcaaagaggagcuggcauggugguac

SEQ ID NO: 453684 - RNA, 64 nt, hsa
cuuuuucaguucagauaucacaccccaaguggauaaaggcaacuugcaggagaggagagccagc

SEQ ID NO: 453685 - RNA, 64 nt, hsa
guuagcccugcccaacagccagggcuacacuacaaaaggcaagaaugcccauguaaggagccca

SEQ ID NO: 453686 - RNA, 64 nt, hsa
caccaacaugggagggaguuuaugaagcaaaggcaaaggcaacacgucggcuagcuucagggua

SEQ ID NO: 453687 - RNA, 64 nt, hsa
agaaaacaccaacaugggagggaguuuaugaagcaaaggcaaaggcaacacgucggcuagcuuc

SEQ ID NO: 453688 - RNA, 64 nt, hsa
cuaauaugaaagaaaaauggaucccaaucugagaaaaggcaaaagaauggcuacuuuuuucuau

SEQ ID NO: 453689 - RNA, 64 nt, hsa
guuucaggaucagaucaauacaaucuuggagucaaaaggcaaaucauuuggacaaucugcaaaa

SEQ ID NO: 453690 - RNA, 64 nt, hsa; identical to SEQ ID NO: 199867

SEQ ID NO: 453691 - RNA, 64 nt, hsa; identical to SEQ ID NO: 199868

SEQ ID NO: 453692 - RNA, 64 nt, hsa; identical to SEQ ID NO: 199869

SEQ ID NO: 453693 - RNA, 64 nt, hsa; identical to SEQ ID NO: 199870

SEQ ID NO: 453694 - RNA, 64 nt, hsa; identical to SEQ ID NO: 199871

SEQ ID NO: 453695 - RNA, 64 nt, hsa; identical to SEQ ID NO: 199872

SEQ ID NO: 453696 - RNA, 64 nt, hsa; identical to SEQ ID NO: 199873

SEQ ID NO: 453697 - RNA, 64 nt, hsa; identical to SEQ ID NO: 199874

SEQ ID NO: 453698 - RNA, 64 nt, hsa; identical to SEQ ID NO: 199875

SEQ ID NO: 453699 - RNA, 64 nt, hsa; identical to SEQ ID NO: 199876

SEQ ID NO: 453700 - RNA, 64 nt, hsa; identical to SEQ ID NO: 76580

SEQ ID NO: 453701 - RNA, 64 nt, hsa; identical to SEQ ID NO: 76581

SEQ ID NO: 453702 - RNA, 64 nt, hsa; identical to SEQ ID NO: 76582

SEQ ID NO: 453703 - RNA, 64 nt, hsa; identical to SEQ ID NO: 76583

SEQ ID NO: 453704 - RNA, 64 nt, hsa; identical to SEQ ID NO: 76584

SEQ ID NO: 453705 - RNA, 64 nt, hsa; identical to SEQ ID NO: 76585

SEQ ID NO: 453706 - RNA, 64 nt, hsa; identical to SEQ ID NO: 76586

SEQ ID NO: 453707 - RNA, 64 nt, hsa; identical to SEQ ID NO: 76587

SEQ ID NO: 453708 - RNA, 64 nt, hsa; identical to SEQ ID NO: 76588

SEQ ID NO: 453709 - RNA, 64 nt, hsa; identical to SEQ ID NO: 76589

SEQ ID NO: 453710 - RNA, 64 nt, hsa; identical to SEQ ID NO: 76590

SEQ ID NO: 453711 - RNA, 64 nt, hsa; identical to SEQ ID NO: 76591

SEQ ID NO: 453712 - RNA, 64 nt, hsa; identical to SEQ ID NO: 76592

SEQ ID NO: 453713 - RNA, 64 nt, hsa; identical to SEQ ID NO: 76593

SEQ ID NO: 453714 - RNA, 64 nt, hsa; identical to SEQ ID NO: 212638

SEQ ID NO: 453715 - RNA, 64 nt, hsa; identical to SEQ ID NO: 212639

SEQ ID NO: 453716 - RNA, 64 nt, hsa; identical to SEQ ID NO: 212640

SEQ ID NO: 453717 - RNA, 64 nt, hsa; identical to SEQ ID NO: 212641

SEQ ID NO: 453718 - RNA, 64 nt, hsa; identical to SEQ ID NO: 212642

SEQ ID NO: 453719 - RNA, 64 nt, hsa; identical to SEQ ID NO: 212643

SEQ ID NO: 453720 - RNA, 64 nt, hsa; identical to SEQ ID NO: 212644

SEQ ID NO: 453721 - RNA, 64 nt, hsa; identical to SEQ ID NO: 212645

SEQ ID NO: 453722 - RNA, 64 nt, hsa; identical to SEQ ID NO: 212646

SEQ ID NO: 453723 - RNA, 64 nt, hsa; identical to SEQ ID NO: 212647

SEQ ID NO: 453724 - RNA, 64 nt, hsa; identical to SEQ ID NO: 212648

SEQ ID NO: 453725 - RNA, 64 nt, hsa; identical to SEQ ID NO: 212649

SEQ ID NO: 453726 - RNA, 64 nt, hsa; identical to SEQ ID NO: 212650

SEQ ID NO: 453727 - RNA, 64 nt, hsa; identical to SEQ ID NO: 212651

SEQ ID NO: 453728 - RNA, 64 nt, hsa; identical to SEQ ID NO: 212652

SEQ ID NO: 453729 - RNA, 64 nt, hsa; identical to SEQ ID NO: 212653

SEQ ID NO: 453730 - RNA, 64 nt, hsa; identical to SEQ ID NO: 212654

SEQ ID NO: 453731 - RNA, 64 nt, hsa; identical to SEQ ID NO: 212655

SEQ ID NO: 453732 - RNA, 64 nt, hsa; identical to SEQ ID NO: 212656

SEQ ID NO: 453733 - RNA, 64 nt, hsa; identical to SEQ ID NO: 212657

SEQ ID NO: 453734 - RNA, 64 nt, hsa; identical to SEQ ID NO: 212658

SEQ ID NO: 453735 - RNA, 64 nt, hsa; identical to SEQ ID NO: 212659

SEQ ID NO: 453736 - RNA, 64 nt, hsa; identical to SEQ ID NO: 212660

SEQ ID NO: 453737 - RNA, 64 nt, hsa; identical to SEQ ID NO: 212661

SEQ ID NO: 453738 - RNA, 64 nt, hsa; identical to SEQ ID NO: 212662

SEQ ID NO: 453739 - RNA, 64 nt, hsa; identical to SEQ ID NO: 212663

SEQ ID NO: 453740 - RNA, 64 nt, hsa; identical to SEQ ID NO: 212664

SEQ ID NO: 453741 - RNA, 64 nt, hsa; identical to SEQ ID NO: 212665

SEQ ID NO: 453742 - RNA, 64 nt, hsa; identical to SEQ ID NO: 212666

SEQ ID NO: 453743 - RNA, 62 nt, hsa; identical to SEQ ID NO: 212667

SEQ ID NO: 453744 - RNA, 64 nt, hsa; identical to SEQ ID NO: 212668

SEQ ID NO: 453745 - RNA, 64 nt, hsa; identical to SEQ ID NO: 212669

SEQ ID NO: 453746 - RNA, 64 nt, hsa; identical to SEQ ID NO: 212670

SEQ ID NO: 453747 - RNA, 64 nt, hsa; identical to SEQ ID NO: 212671

SEQ ID NO: 453748 - RNA, 64 nt, hsa; identical to SEQ ID NO: 212672

SEQ ID NO: 453749 - RNA, 64 nt, hsa; identical to SEQ ID NO: 212673

SEQ ID NO: 453750 - RNA, 64 nt, hsa; identical to SEQ ID NO: 212674

SEQ ID NO: 453751 - RNA, 64 nt, hsa; identical to SEQ ID NO: 212675

SEQ ID NO: 453752 - RNA, 64 nt, hsa; identical to SEQ ID NO: 212676

SEQ ID NO: 453753 - RNA, 64 nt, hsa; identical to SEQ ID NO: 212677

SEQ ID NO: 453754 - RNA, 64 nt, hsa; identical to SEQ ID NO: 212678

SEQ ID NO: 453755 - RNA, 64 nt, hsa; identical to SEQ ID NO: 212679

SEQ ID NO: 453756 - RNA, 64 nt, hsa
aagaggagcccgcuuccuguacauauauuuaagugacaaacacggucaaaagcuuaagggacag

SEQ ID NO: 453757 - RNA, 64 nt, hsa
ugugggaguaugucugccgguuucaacacacacagacaaacacagccacacgcgcacacaagua

SEQ ID NO: 453758 - RNA, 64 nt, hsa
uugcaagauaaacagcuguaauucggacaaacaugacaaacacagugaagccaacuaucccaua

SEQ ID NO: 453759 - RNA, 64 nt, hsa
aucuuaaaguugcaagauaaacagcuguaauucggacaaacaugacaaacacagugaagccaac

SEQ ID NO: 453760 - RNA, 64 nt, hsa
ggaccucucuugugagccauagagauauuuaaaagacaaacaccuuauuugucggggaagauga

SEQ ID NO: 453761 - RNA, 64 nt, hsa
ugcaagugggagaugaaaaccugcauuuuuaaaggacaaacagugaauuuaagcaugaguggcc

SEQ ID NO: 453762 - RNA, 64 nt, hsa
gaucucaaggccaucaauuauugggggagggagggacaaacacucccaaucauccaccagucag

SEQ ID NO: 453763 - RNA, 64 nt, hsa
cccuaaacuugaaccauuuccuagugccuugcuagacaaacauaaaggggcaggguugugggga

SEQ ID NO: 453764 - RNA, 64 nt, hsa
aguagugaucuaugccagcaaaacaucauuuugagacaaacauuuuuguggcagauguuuuucc

SEQ ID NO: 453765 - RNA, 64 nt, hsa
uaguauaagugaauuacuaguuucucuuuauuuagacaaacacacacacaccagauaauauaaa

SEQ ID NO: 453766 - RNA, 64 nt, hsa
guaacaaguuucaagcaacuccaaaauugaaugugacaaacaguauuaaaccuuaagccucaag

SEQ ID NO: 453767 - RNA, 64 nt, hsa
gaugcucuaagaaaacgccauagacuggguugcugacaaacaucagaauucuauuucucauggu

SEQ ID NO: 453768 - RNA, 64 nt, hsa
accaaggcccaccaaggcagcagacuguuaaucagacaaacagaucucugagaaggugcaucag

SEQ ID NO: 453769 - RNA, 64 nt, hsa
gggagcauuuccaggcaucuuuuaagggaacugugacaaacagccucgggcagaugaacacgga

SEQ ID NO: 453770 - RNA, 64 nt, hsa
cccggacagacagacacagccugaaacagacccagacaaacagacagacagacacagccugaaa

SEQ ID NO: 453771 - RNA, 64 nt, hsa
ccuagacagacagacacagauugaaacagacccagacaaacagacagacacagccugaaacaga

SEQ ID NO: 453772 - RNA, 51 nt, hsa
uuaacgaaugguacgucugaggacaaacacaaacccuguuaauuauagaau

SEQ ID NO: 453773 - RNA, 64 nt, hsa
aauccauuuaaucuucagugaagcaacucauuuggacaaacaguucuuuuacagugguuauaug

SEQ ID NO: 453774 - RNA, 64 nt, hsa; identical to SEQ ID NO: 143712

SEQ ID NO: 453775 - RNA, 64 nt, hsa; identical to SEQ ID NO: 143713

SEQ ID NO: 453776 - RNA, 64 nt, hsa; identical to SEQ ID NO: 143714

SEQ ID NO: 453777 - RNA, 64 nt, hsa; identical to SEQ ID NO: 143715

SEQ ID NO: 453778 - RNA, 64 nt, hsa; identical to SEQ ID NO: 143716

SEQ ID NO: 453779 - RNA, 64 nt, hsa; identical to SEQ ID NO: 143717

SEQ ID NO: 453780 - RNA, 64 nt, hsa; identical to SEQ ID NO: 143718

SEQ ID NO: 453781 - RNA, 64 nt, hsa; identical to SEQ ID NO: 143719

SEQ ID NO: 453782 - RNA, 64 nt, hsa; identical to SEQ ID NO: 143720

SEQ ID NO: 453783 - RNA, 64 nt, hsa; identical to SEQ ID NO: 143721

SEQ ID NO: 453784 - RNA, 64 nt, hsa; identical to SEQ ID NO: 143722

SEQ ID NO: 453785 - RNA, 64 nt, hsa; identical to SEQ ID NO: 143723

SEQ ID NO: 453786 - RNA, 64 nt, hsa; identical to SEQ ID NO: 143724

SEQ ID NO: 453787 - RNA, 64 nt, hsa; identical to SEQ ID NO: 143725

SEQ ID NO: 453788 - RNA, 64 nt, hsa; identical to SEQ ID NO: 143726

SEQ ID NO: 453789 - RNA, 64 nt, hsa; identical to SEQ ID NO: 143727

SEQ ID NO: 453790 - RNA, 64 nt, hsa; identical to SEQ ID NO: 143728

SEQ ID NO: 453791 - RNA, 64 nt, hsa; identical to SEQ ID NO: 143729

SEQ ID NO: 453792 - RNA, 64 nt, hsa; identical to SEQ ID NO: 143730

SEQ ID NO: 453793 - RNA, 64 nt, hsa; identical to SEQ ID NO: 143731

SEQ ID NO: 453794 - RNA, 64 nt, hsa; identical to SEQ ID NO: 143732

SEQ ID NO: 453795 - RNA, 64 nt, hsa; identical to SEQ ID NO: 143733

SEQ ID NO: 453796 - RNA, 64 nt, hsa; identical to SEQ ID NO: 143734

SEQ ID NO: 453797 - RNA, 64 nt, hsa; identical to SEQ ID NO: 143735

SEQ ID NO: 453798 - RNA, 64 nt, hsa; identical to SEQ ID NO: 143736

SEQ ID NO: 453799 - RNA, 64 nt, hsa; identical to SEQ ID NO: 143737

SEQ ID NO: 453800 - RNA, 64 nt, hsa; identical to SEQ ID NO: 143738

SEQ ID NO: 453801 - RNA, 64 nt, hsa; identical to SEQ ID NO: 143739

SEQ ID NO: 453802 - RNA, 64 nt, hsa; identical to SEQ ID NO: 143740

SEQ ID NO: 453803 - RNA, 64 nt, hsa; identical to SEQ ID NO: 143741

SEQ ID NO: 453804 - RNA, 64 nt, hsa; identical to SEQ ID NO: 143742

SEQ ID NO: 453805 - RNA, 64 nt, hsa; identical to SEQ ID NO: 143743

SEQ ID NO: 453806 - RNA, 64 nt, hsa; identical to SEQ ID NO: 143744

SEQ ID NO: 453807 - RNA, 64 nt, hsa; identical to SEQ ID NO: 143745

SEQ ID NO: 453808 - RNA, 64 nt, hsa; identical to SEQ ID NO: 143746

SEQ ID NO: 453809 - RNA, 64 nt, hsa; identical to SEQ ID NO: 143747

SEQ ID NO: 453810 - RNA, 64 nt, hsa; identical to SEQ ID NO: 143748

SEQ ID NO: 453811 - RNA, 64 nt, hsa; identical to SEQ ID NO: 143749

SEQ ID NO: 453812 - RNA, 64 nt, hsa; identical to SEQ ID NO: 143750

SEQ ID NO: 453813 - RNA, 64 nt, hsa; identical to SEQ ID NO: 143751

SEQ ID NO: 453814 - RNA, 64 nt, hsa; identical to SEQ ID NO: 143752

SEQ ID NO: 453815 - RNA, 64 nt, hsa; identical to SEQ ID NO: 143753

SEQ ID NO: 453816 - RNA, 64 nt, hsa; identical to SEQ ID NO: 143754

SEQ ID NO: 453817 - RNA, 64 nt, hsa; identical to SEQ ID NO: 143755

SEQ ID NO: 453818 - RNA, 64 nt, hsa; identical to SEQ ID NO: 143756

SEQ ID NO: 453819 - RNA, 64 nt, hsa; identical to SEQ ID NO: 143757

SEQ ID NO: 453820 - RNA, 64 nt, hsa; identical to SEQ ID NO: 143758

SEQ ID NO: 453821 - RNA, 64 nt, hsa; identical to SEQ ID NO: 143759

SEQ ID NO: 453822 - RNA, 64 nt, hsa; identical to SEQ ID NO: 143760

SEQ ID NO: 453823 - RNA, 64 nt, hsa; identical to SEQ ID NO: 143761

SEQ ID NO: 453824 - RNA, 64 nt, hsa; identical to SEQ ID NO: 143762

SEQ ID NO: 453825 - RNA, 64 nt, hsa; identical to SEQ ID NO: 143763

SEQ ID NO: 453826 - RNA, 64 nt, hsa; identical to SEQ ID NO: 143764

SEQ ID NO: 453827 - RNA, 64 nt, hsa; identical to SEQ ID NO: 143765

SEQ ID NO: 453828 - RNA, 64 nt, hsa; identical to SEQ ID NO: 143766

SEQ ID NO: 453829 - RNA, 64 nt, hsa; identical to SEQ ID NO: 143767

SEQ ID NO: 453830 - RNA, 64 nt, hsa; identical to SEQ ID NO: 143768

SEQ ID NO: 453831 - RNA, 64 nt, hsa; identical to SEQ ID NO: 143769

SEQ ID NO: 453832 - RNA, 64 nt, hsa; identical to SEQ ID NO: 143770

SEQ ID NO: 453833 - RNA, 64 nt, hsa; identical to SEQ ID NO: 143771

SEQ ID NO: 453834 - RNA, 64 nt, hsa; identical to SEQ ID NO: 143772

SEQ ID NO: 453835 - RNA, 64 nt, hsa; identical to SEQ ID NO: 143773

SEQ ID NO: 453836 - RNA, 64 nt, hsa; identical to SEQ ID NO: 143774

SEQ ID NO: 453837 - RNA, 64 nt, hsa; identical to SEQ ID NO: 143775

SEQ ID NO: 453838 - RNA, 64 nt, hsa; identical to SEQ ID NO: 143776

SEQ ID NO: 453839 - RNA, 64 nt, hsa; identical to SEQ ID NO: 143777

SEQ ID NO: 453840 - RNA, 64 nt, hsa; identical to SEQ ID NO: 143778

SEQ ID NO: 453841 - RNA, 64 nt, hsa; identical to SEQ ID NO: 143779

SEQ ID NO: 453842 - RNA, 64 nt, hsa; identical to SEQ ID NO: 143780

SEQ ID NO: 453843 - RNA, 64 nt, hsa; identical to SEQ ID NO: 143781

SEQ ID NO: 453844 - RNA, 64 nt, hsa; identical to SEQ ID NO: 143782

SEQ ID NO: 453845 - RNA, 64 nt, hsa; identical to SEQ ID NO: 143783

SEQ ID NO: 453846 - RNA, 64 nt, hsa; identical to SEQ ID NO: 143784

SEQ ID NO: 453847 - RNA, 64 nt, hsa; identical to SEQ ID NO: 143785

SEQ ID NO: 453848 - RNA, 64 nt, hsa; identical to SEQ ID NO: 143786

SEQ ID NO: 453849 - RNA, 64 nt, hsa; identical to SEQ ID NO: 143787

SEQ ID NO: 453850 - RNA, 64 nt, hsa; identical to SEQ ID NO: 143788

SEQ ID NO: 453851 - RNA, 64 nt, hsa; identical to SEQ ID NO: 143789

SEQ ID NO: 453852 - RNA, 57 nt, hsa; identical to SEQ ID NO: 143790

SEQ ID NO: 453853 - RNA, 64 nt, hsa; identical to SEQ ID NO: 143791

SEQ ID NO: 453854 - RNA, 64 nt, hsa; identical to SEQ ID NO: 143792

SEQ ID NO: 453855 - RNA, 64 nt, hsa; identical to SEQ ID NO: 143793

SEQ ID NO: 453856 - RNA, 64 nt, hsa; identical to SEQ ID NO: 143794

SEQ ID NO: 453857 - RNA, 64 nt, hsa; identical to SEQ ID NO: 143795

SEQ ID NO: 453858 - RNA, 64 nt, hsa; identical to SEQ ID NO: 143796

SEQ ID NO: 453859 - RNA, 64 nt, hsa; identical to SEQ ID NO: 143797

SEQ ID NO: 453860 - RNA, 64 nt, hsa; identical to SEQ ID NO: 143798

SEQ ID NO: 453861 - RNA, 64 nt, hsa; identical to SEQ ID NO: 143799

SEQ ID NO: 453862 - RNA, 64 nt, hsa; identical to SEQ ID NO: 143800

SEQ ID NO: 453863 - RNA, 64 nt, hsa; identical to SEQ ID NO: 143801

SEQ ID NO: 453864 - RNA, 64 nt, hsa; identical to SEQ ID NO: 143802

SEQ ID NO: 453865 - RNA, 64 nt, hsa; identical to SEQ ID NO: 143803

SEQ ID NO: 453866 - RNA, 64 nt, hsa; identical to SEQ ID NO: 143804

SEQ ID NO: 453867 - RNA, 64 nt, hsa; identical to SEQ ID NO: 143805

SEQ ID NO: 453868 - RNA, 64 nt, hsa; identical to SEQ ID NO: 143806

SEQ ID NO: 453869 - RNA, 64 nt, hsa; identical to SEQ ID NO: 143807

SEQ ID NO: 453870 - RNA, 64 nt, hsa; identical to SEQ ID NO: 143808

SEQ ID NO: 453871 - RNA, 64 nt, hsa; identical to SEQ ID NO: 143809

SEQ ID NO: 453872 - RNA, 64 nt, hsa; identical to SEQ ID NO: 143810

SEQ ID NO: 453873 - RNA, 64 nt, hsa; identical to SEQ ID NO: 143811

SEQ ID NO: 453874 - RNA, 64 nt, hsa; identical to SEQ ID NO: 143812

SEQ ID NO: 453875 - RNA, 64 nt, hsa; identical to SEQ ID NO: 307517

SEQ ID NO: 453876 - RNA, 64 nt, hsa; identical to SEQ ID NO: 307518

SEQ ID NO: 453877 - RNA, 64 nt, hsa; identical to SEQ ID NO: 307519

SEQ ID NO: 453878 - RNA, 64 nt, hsa; identical to SEQ ID NO: 307520

SEQ ID NO: 453879 - RNA, 64 nt, hsa; identical to SEQ ID NO: 307521

SEQ ID NO: 453880 - RNA, 64 nt, hsa; identical to SEQ ID NO: 307522

SEQ ID NO: 453881 - RNA, 64 nt, hsa; identical to SEQ ID NO: 307523

SEQ ID NO: 453882 - RNA, 64 nt, hsa; identical to SEQ ID NO: 143712

SEQ ID NO: 453883 - RNA, 64 nt, hsa; identical to SEQ ID NO: 143713

SEQ ID NO: 453884 - RNA, 64 nt, hsa; identical to SEQ ID NO: 143714

SEQ ID NO: 453885 - RNA, 64 nt, hsa; identical to SEQ ID NO: 143715

SEQ ID NO: 453886 - RNA, 64 nt, hsa; identical to SEQ ID NO: 143716

SEQ ID NO: 453887 - RNA, 64 nt, hsa; identical to SEQ ID NO: 143717

SEQ ID NO: 453888 - RNA, 64 nt, hsa; identical to SEQ ID NO: 143718

SEQ ID NO: 453889 - RNA, 64 nt, hsa; identical to SEQ ID NO: 143719

SEQ ID NO: 453890 - RNA, 64 nt, hsa; identical to SEQ ID NO: 143720

SEQ ID NO: 453891 - RNA, 64 nt, hsa; identical to SEQ ID NO: 143721

SEQ ID NO: 453892 - RNA, 64 nt, hsa; identical to SEQ ID NO: 143722

SEQ ID NO: 453893 - RNA, 64 nt, hsa; identical to SEQ ID NO: 143723

SEQ ID NO: 453894 - RNA, 64 nt, hsa; identical to SEQ ID NO: 143724

SEQ ID NO: 453895 - RNA, 64 nt, hsa; identical to SEQ ID NO: 143725

SEQ ID NO: 453896 - RNA, 64 nt, hsa; identical to SEQ ID NO: 143726

SEQ ID NO: 453897 - RNA, 64 nt, hsa; identical to SEQ ID NO: 143727

SEQ ID NO: 453898 - RNA, 64 nt, hsa; identical to SEQ ID NO: 143728

SEQ ID NO: 453899 - RNA, 64 nt, hsa; identical to SEQ ID NO: 143729

SEQ ID NO: 453900 - RNA, 64 nt, hsa; identical to SEQ ID NO: 143730

SEQ ID NO: 453901 - RNA, 64 nt, hsa; identical to SEQ ID NO: 143731

SEQ ID NO: 453902 - RNA, 64 nt, hsa; identical to SEQ ID NO: 143732

SEQ ID NO: 453903 - RNA, 64 nt, hsa; identical to SEQ ID NO: 143733

SEQ ID NO: 453904 - RNA, 64 nt, hsa; identical to SEQ ID NO: 143734

SEQ ID NO: 453905 - RNA, 64 nt, hsa; identical to SEQ ID NO: 143735

SEQ ID NO: 453906 - RNA, 64 nt, hsa; identical to SEQ ID NO: 143736

SEQ ID NO: 453907 - RNA, 64 nt, hsa; identical to SEQ ID NO: 143737

SEQ ID NO: 453908 - RNA, 64 nt, hsa; identical to SEQ ID NO: 143738

SEQ ID NO: 453909 - RNA, 64 nt, hsa; identical to SEQ ID NO: 143739

SEQ ID NO: 453910 - RNA, 64 nt, hsa; identical to SEQ ID NO: 143740

SEQ ID NO: 453911 - RNA, 64 nt, hsa; identical to SEQ ID NO: 143741

SEQ ID NO: 453912 - RNA, 64 nt, hsa; identical to SEQ ID NO: 143742

SEQ ID NO: 453913 - RNA, 64 nt, hsa; identical to SEQ ID NO: 143743

SEQ ID NO: 453914 - RNA, 64 nt, hsa; identical to SEQ ID NO: 143744

SEQ ID NO: 453915 - RNA, 64 nt, hsa; identical to SEQ ID NO: 143745

SEQ ID NO: 453916 - RNA, 64 nt, hsa; identical to SEQ ID NO: 143746

SEQ ID NO: 453917 - RNA, 64 nt, hsa; identical to SEQ ID NO: 143747

SEQ ID NO: 453918 - RNA, 64 nt, hsa; identical to SEQ ID NO: 143748

SEQ ID NO: 453919 - RNA, 64 nt, hsa; identical to SEQ ID NO: 143749

SEQ ID NO: 453920 - RNA, 64 nt, hsa; identical to SEQ ID NO: 143750

SEQ ID NO: 453921 - RNA, 64 nt, hsa; identical to SEQ ID NO: 143751

SEQ ID NO: 453922 - RNA, 64 nt, hsa; identical to SEQ ID NO: 143752

SEQ ID NO: 453923 - RNA, 64 nt, hsa; identical to SEQ ID NO: 143753

SEQ ID NO: 453924 - RNA, 64 nt, hsa; identical to SEQ ID NO: 143754

SEQ ID NO: 453925 - RNA, 64 nt, hsa; identical to SEQ ID NO: 143755

SEQ ID NO: 453926 - RNA, 64 nt, hsa; identical to SEQ ID NO: 143756

SEQ ID NO: 453927 - RNA, 64 nt, hsa; identical to SEQ ID NO: 143757

SEQ ID NO: 453928 - RNA, 64 nt, hsa; identical to SEQ ID NO: 143758

SEQ ID NO: 453929 - RNA, 64 nt, hsa; identical to SEQ ID NO: 143759

SEQ ID NO: 453930 - RNA, 64 nt, hsa; identical to SEQ ID NO: 143760

SEQ ID NO: 453931 - RNA, 64 nt, hsa; identical to SEQ ID NO: 143761

SEQ ID NO: 453932 - RNA, 64 nt, hsa; identical to SEQ ID NO: 143762

SEQ ID NO: 453933 - RNA, 64 nt, hsa; identical to SEQ ID NO: 143763

SEQ ID NO: 453934 - RNA, 64 nt, hsa; identical to SEQ ID NO: 143764

SEQ ID NO: 453935 - RNA, 64 nt, hsa; identical to SEQ ID NO: 143765

SEQ ID NO: 453936 - RNA, 64 nt, hsa; identical to SEQ ID NO: 143766

SEQ ID NO: 453937 - RNA, 64 nt, hsa; identical to SEQ ID NO: 143767

SEQ ID NO: 453938 - RNA, 64 nt, hsa; identical to SEQ ID NO: 143768

SEQ ID NO: 453939 - RNA, 64 nt, hsa; identical to SEQ ID NO: 143769

SEQ ID NO: 453940 - RNA, 64 nt, hsa; identical to SEQ ID NO: 143770

SEQ ID NO: 453941 - RNA, 64 nt, hsa; identical to SEQ ID NO: 143771

SEQ ID NO: 453942 - RNA, 64 nt, hsa; identical to SEQ ID NO: 143772

SEQ ID NO: 453943 - RNA, 64 nt, hsa; identical to SEQ ID NO: 143773

SEQ ID NO: 453944 - RNA, 64 nt, hsa; identical to SEQ ID NO: 143774

SEQ ID NO: 453945 - RNA, 64 nt, hsa; identical to SEQ ID NO: 143775

SEQ ID NO: 453946 - RNA, 64 nt, hsa; identical to SEQ ID NO: 143776

SEQ ID NO: 453947 - RNA, 64 nt, hsa; identical to SEQ ID NO: 143777

SEQ ID NO: 453948 - RNA, 64 nt, hsa; identical to SEQ ID NO: 143778

SEQ ID NO: 453949 - RNA, 64 nt, hsa; identical to SEQ ID NO: 143779

SEQ ID NO: 453950 - RNA, 64 nt, hsa; identical to SEQ ID NO: 143780

SEQ ID NO: 453951 - RNA, 64 nt, hsa; identical to SEQ ID NO: 143781

SEQ ID NO: 453952 - RNA, 64 nt, hsa; identical to SEQ ID NO: 143782

SEQ ID NO: 453953 - RNA, 64 nt, hsa; identical to SEQ ID NO: 143783

SEQ ID NO: 453954 - RNA, 64 nt, hsa; identical to SEQ ID NO: 143784

SEQ ID NO: 453955 - RNA, 64 nt, hsa; identical to SEQ ID NO: 143785

SEQ ID NO: 453956 - RNA, 64 nt, hsa; identical to SEQ ID NO: 143786

SEQ ID NO: 453957 - RNA, 64 nt, hsa; identical to SEQ ID NO: 143787

SEQ ID NO: 453958 - RNA, 64 nt, hsa; identical to SEQ ID NO: 143788

SEQ ID NO: 453959 - RNA, 64 nt, hsa; identical to SEQ ID NO: 143789

SEQ ID NO: 453960 - RNA, 57 nt, hsa; identical to SEQ ID NO: 143790

SEQ ID NO: 453961 - RNA, 64 nt, hsa; identical to SEQ ID NO: 143791

SEQ ID NO: 453962 - RNA, 64 nt, hsa; identical to SEQ ID NO: 143792

SEQ ID NO: 453963 - RNA, 64 nt, hsa; identical to SEQ ID NO: 143793

SEQ ID NO: 453964 - RNA, 64 nt, hsa; identical to SEQ ID NO: 143794

SEQ ID NO: 453965 - RNA, 64 nt, hsa; identical to SEQ ID NO: 143795

SEQ ID NO: 453966 - RNA, 64 nt, hsa; identical to SEQ ID NO: 143796

SEQ ID NO: 453967 - RNA, 64 nt, hsa; identical to SEQ ID NO: 143797

SEQ ID NO: 453968 - RNA, 64 nt, hsa; identical to SEQ ID NO: 143798

SEQ ID NO: 453969 - RNA, 64 nt, hsa; identical to SEQ ID NO: 143799

SEQ ID NO: 453970 - RNA, 64 nt, hsa; identical to SEQ ID NO: 143800

SEQ ID NO: 453971 - RNA, 64 nt, hsa; identical to SEQ ID NO: 143801

SEQ ID NO: 453972 - RNA, 64 nt, hsa; identical to SEQ ID NO: 143802

SEQ ID NO: 453973 - RNA, 64 nt, hsa; identical to SEQ ID NO: 143803

SEQ ID NO: 453974 - RNA, 64 nt, hsa; identical to SEQ ID NO: 143804

SEQ ID NO: 453975 - RNA, 64 nt, hsa; identical to SEQ ID NO: 143805

SEQ ID NO: 453976 - RNA, 64 nt, hsa; identical to SEQ ID NO: 143806

SEQ ID NO: 453977 - RNA, 64 nt, hsa; identical to SEQ ID NO: 143807

SEQ ID NO: 453978 - RNA, 64 nt, hsa; identical to SEQ ID NO: 143808

SEQ ID NO: 453979 - RNA, 64 nt, hsa; identical to SEQ ID NO: 143809

SEQ ID NO: 453980 - RNA, 64 nt, hsa; identical to SEQ ID NO: 143810

SEQ ID NO: 453981 - RNA, 64 nt, hsa; identical to SEQ ID NO: 143811

SEQ ID NO: 453982 - RNA, 64 nt, hsa; identical to SEQ ID NO: 143812

SEQ ID NO: 453983 - RNA, 64 nt, hsa; identical to SEQ ID NO: 307517

SEQ ID NO: 453984 - RNA, 64 nt, hsa; identical to SEQ ID NO: 307518

SEQ ID NO: 453985 - RNA, 64 nt, hsa; identical to SEQ ID NO: 307519

SEQ ID NO: 453986 - RNA, 64 nt, hsa; identical to SEQ ID NO: 307520

SEQ ID NO: 453987 - RNA, 64 nt, hsa; identical to SEQ ID NO: 307521

SEQ ID NO: 453988 - RNA, 64 nt, hsa; identical to SEQ ID NO: 307522

SEQ ID NO: 453989 - RNA, 64 nt, hsa; identical to SEQ ID NO: 307523

SEQ ID NO: 453990 - RNA, 64 nt, hsa; identical to SEQ ID NO: 143712

SEQ ID NO: 453991 - RNA, 64 nt, hsa; identical to SEQ ID NO: 143713

SEQ ID NO: 453992 - RNA, 64 nt, hsa; identical to SEQ ID NO: 143714

SEQ ID NO: 453993 - RNA, 64 nt, hsa; identical to SEQ ID NO: 143715

SEQ ID NO: 453994 - RNA, 64 nt, hsa; identical to SEQ ID NO: 143716

SEQ ID NO: 453995 - RNA, 64 nt, hsa; identical to SEQ ID NO: 143717

SEQ ID NO: 453996 - RNA, 64 nt, hsa; identical to SEQ ID NO: 143718

SEQ ID NO: 453997 - RNA, 64 nt, hsa; identical to SEQ ID NO: 143719

SEQ ID NO: 453998 - RNA, 64 nt, hsa; identical to SEQ ID NO: 143720

SEQ ID NO: 453999 - RNA, 64 nt, hsa; identical to SEQ ID NO: 143721

SEQ ID NO: 454000 - RNA, 64 nt, hsa; identical to SEQ ID NO: 143722

SEQ ID NO: 454001 - RNA, 64 nt, hsa; identical to SEQ ID NO: 143723

SEQ ID NO: 454002 - RNA, 64 nt, hsa; identical to SEQ ID NO: 143724

SEQ ID NO: 454003 - RNA, 64 nt, hsa; identical to SEQ ID NO: 143725

SEQ ID NO: 454004 - RNA, 64 nt, hsa; identical to SEQ ID NO: 143726

SEQ ID NO: 454005 - RNA, 64 nt, hsa; identical to SEQ ID NO: 143727

SEQ ID NO: 454006 - RNA, 64 nt, hsa; identical to SEQ ID NO: 143728

SEQ ID NO: 454007 - RNA, 64 nt, hsa; identical to SEQ ID NO: 143729

SEQ ID NO: 454008 - RNA, 64 nt, hsa; identical to SEQ ID NO: 143730

SEQ ID NO: 454009 - RNA, 64 nt, hsa; identical to SEQ ID NO: 143731

SEQ ID NO: 454010 - RNA, 64 nt, hsa; identical to SEQ ID NO: 143732

SEQ ID NO: 454011 - RNA, 64 nt, hsa; identical to SEQ ID NO: 143733

SEQ ID NO: 454012 - RNA, 64 nt, hsa; identical to SEQ ID NO: 143734

SEQ ID NO: 454013 - RNA, 64 nt, hsa; identical to SEQ ID NO: 143735

SEQ ID NO: 454014 - RNA, 64 nt, hsa; identical to SEQ ID NO: 143736

SEQ ID NO: 454015 - RNA, 64 nt, hsa; identical to SEQ ID NO: 143737

SEQ ID NO: 454016 - RNA, 64 nt, hsa; identical to SEQ ID NO: 143738

SEQ ID NO: 454017 - RNA, 64 nt, hsa; identical to SEQ ID NO: 143739

SEQ ID NO: 454018 - RNA, 64 nt, hsa; identical to SEQ ID NO: 143740

SEQ ID NO: 454019 - RNA, 64 nt, hsa; identical to SEQ ID NO: 143741

SEQ ID NO: 454020 - RNA, 64 nt, hsa; identical to SEQ ID NO: 143742

SEQ ID NO: 454021 - RNA, 64 nt, hsa; identical to SEQ ID NO: 143743

SEQ ID NO: 454022 - RNA, 64 nt, hsa; identical to SEQ ID NO: 143744

SEQ ID NO: 454023 - RNA, 64 nt, hsa; identical to SEQ ID NO: 143745

SEQ ID NO: 454024 - RNA, 64 nt, hsa; identical to SEQ ID NO: 143746

SEQ ID NO: 454025 - RNA, 64 nt, hsa; identical to SEQ ID NO: 143747

SEQ ID NO: 454026 - RNA, 64 nt, hsa; identical to SEQ ID NO: 143748

SEQ ID NO: 454027 - RNA, 64 nt, hsa; identical to SEQ ID NO: 143749

SEQ ID NO: 454028 - RNA, 64 nt, hsa; identical to SEQ ID NO: 143750

SEQ ID NO: 454029 - RNA, 64 nt, hsa; identical to SEQ ID NO: 143751

SEQ ID NO: 454030 - RNA, 64 nt, hsa; identical to SEQ ID NO: 143752

SEQ ID NO: 454031 - RNA, 64 nt, hsa; identical to SEQ ID NO: 143753

SEQ ID NO: 454032 - RNA, 64 nt, hsa; identical to SEQ ID NO: 143754

SEQ ID NO: 454033 - RNA, 64 nt, hsa; identical to SEQ ID NO: 143755

SEQ ID NO: 454034 - RNA, 64 nt, hsa; identical to SEQ ID NO: 143756

SEQ ID NO: 454035 - RNA, 64 nt, hsa; identical to SEQ ID NO: 143757

SEQ ID NO: 454036 - RNA, 64 nt, hsa; identical to SEQ ID NO: 143758

SEQ ID NO: 454037 - RNA, 64 nt, hsa; identical to SEQ ID NO: 143759

SEQ ID NO: 454038 - RNA, 64 nt, hsa; identical to SEQ ID NO: 143760

SEQ ID NO: 454039 - RNA, 64 nt, hsa; identical to SEQ ID NO: 143761

SEQ ID NO: 454040 - RNA, 64 nt, hsa; identical to SEQ ID NO: 143762

SEQ ID NO: 454041 - RNA, 64 nt, hsa; identical to SEQ ID NO: 143763

SEQ ID NO: 454042 - RNA, 64 nt, hsa; identical to SEQ ID NO: 143764

SEQ ID NO: 454043 - RNA, 64 nt, hsa; identical to SEQ ID NO: 143765

SEQ ID NO: 454044 - RNA, 64 nt, hsa; identical to SEQ ID NO: 143766

SEQ ID NO: 454045 - RNA, 64 nt, hsa; identical to SEQ ID NO: 143767

SEQ ID NO: 454046 - RNA, 64 nt, hsa; identical to SEQ ID NO: 143768

SEQ ID NO: 454047 - RNA, 64 nt, hsa; identical to SEQ ID NO: 143769

SEQ ID NO: 454048 - RNA, 64 nt, hsa; identical to SEQ ID NO: 143770

SEQ ID NO: 454049 - RNA, 64 nt, hsa; identical to SEQ ID NO: 143771

SEQ ID NO: 454050 - RNA, 64 nt, hsa; identical to SEQ ID NO: 143772

SEQ ID NO: 454051 - RNA, 64 nt, hsa; identical to SEQ ID NO: 143773

SEQ ID NO: 454052 - RNA, 64 nt, hsa; identical to SEQ ID NO: 143774

SEQ ID NO: 454053 - RNA, 64 nt, hsa; identical to SEQ ID NO: 143775

SEQ ID NO: 454054 - RNA, 64 nt, hsa; identical to SEQ ID NO: 143776

SEQ ID NO: 454055 - RNA, 64 nt, hsa; identical to SEQ ID NO: 143777

SEQ ID NO: 454056 - RNA, 64 nt, hsa; identical to SEQ ID NO: 143778

SEQ ID NO: 454057 - RNA, 64 nt, hsa; identical to SEQ ID NO: 143779

SEQ ID NO: 454058 - RNA, 64 nt, hsa; identical to SEQ ID NO: 143780

SEQ ID NO: 454059 - RNA, 64 nt, hsa; identical to SEQ ID NO: 143781

SEQ ID NO: 454060 - RNA, 64 nt, hsa; identical to SEQ ID NO: 143782

SEQ ID NO: 454061 - RNA, 64 nt, hsa; identical to SEQ ID NO: 143783

SEQ ID NO: 454062 - RNA, 64 nt, hsa; identical to SEQ ID NO: 143784

SEQ ID NO: 454063 - RNA, 64 nt, hsa; identical to SEQ ID NO: 143785

SEQ ID NO: 454064 - RNA, 64 nt, hsa; identical to SEQ ID NO: 143786

SEQ ID NO: 454065 - RNA, 64 nt, hsa; identical to SEQ ID NO: 143787

SEQ ID NO: 454066 - RNA, 64 nt, hsa; identical to SEQ ID NO: 143788

SEQ ID NO: 454067 - RNA, 64 nt, hsa; identical to SEQ ID NO: 143789

SEQ ID NO: 454068 - RNA, 57 nt, hsa; identical to SEQ ID NO: 143790

SEQ ID NO: 454069 - RNA, 64 nt, hsa; identical to SEQ ID NO: 143791

SEQ ID NO: 454070 - RNA, 64 nt, hsa; identical to SEQ ID NO: 143792

SEQ ID NO: 454071 - RNA, 64 nt, hsa; identical to SEQ ID NO: 143793

SEQ ID NO: 454072 - RNA, 64 nt, hsa; identical to SEQ ID NO: 143794

SEQ ID NO: 454073 - RNA, 64 nt, hsa; identical to SEQ ID NO: 143795

SEQ ID NO: 454074 - RNA, 64 nt, hsa; identical to SEQ ID NO: 143796

SEQ ID NO: 454075 - RNA, 64 nt, hsa; identical to SEQ ID NO: 143797

SEQ ID NO: 454076 - RNA, 64 nt, hsa; identical to SEQ ID NO: 143798

SEQ ID NO: 454077 - RNA, 64 nt, hsa; identical to SEQ ID NO: 143799

SEQ ID NO: 454078 - RNA, 64 nt, hsa; identical to SEQ ID NO: 143800

SEQ ID NO: 454079 - RNA, 64 nt, hsa; identical to SEQ ID NO: 143801

SEQ ID NO: 454080 - RNA, 64 nt, hsa; identical to SEQ ID NO: 143802

SEQ ID NO: 454081 - RNA, 64 nt, hsa; identical to SEQ ID NO: 143803

SEQ ID NO: 454082 - RNA, 64 nt, hsa; identical to SEQ ID NO: 143804

SEQ ID NO: 454083 - RNA, 64 nt, hsa; identical to SEQ ID NO: 143805

SEQ ID NO: 454084 - RNA, 64 nt, hsa; identical to SEQ ID NO: 143806

SEQ ID NO: 454085 - RNA, 64 nt, hsa; identical to SEQ ID NO: 143807

SEQ ID NO: 454086 - RNA, 64 nt, hsa; identical to SEQ ID NO: 143808

SEQ ID NO: 454087 - RNA, 64 nt, hsa; identical to SEQ ID NO: 143809

SEQ ID NO: 454088 - RNA, 64 nt, hsa; identical to SEQ ID NO: 143810

SEQ ID NO: 454089 - RNA, 64 nt, hsa; identical to SEQ ID NO: 143811

SEQ ID NO: 454090 - RNA, 64 nt, hsa; identical to SEQ ID NO: 143812

SEQ ID NO: 454091 - RNA, 64 nt, hsa; identical to SEQ ID NO: 307517

SEQ ID NO: 454092 - RNA, 64 nt, hsa; identical to SEQ ID NO: 307518

SEQ ID NO: 454093 - RNA, 64 nt, hsa; identical to SEQ ID NO: 307519

SEQ ID NO: 454094 - RNA, 64 nt, hsa; identical to SEQ ID NO: 307520

SEQ ID NO: 454095 - RNA, 64 nt, hsa; identical to SEQ ID NO: 307521

SEQ ID NO: 454096 - RNA, 64 nt, hsa; identical to SEQ ID NO: 307522

SEQ ID NO: 454097 - RNA, 64 nt, hsa; identical to SEQ ID NO: 307523

SEQ ID NO: 454098 - RNA, 64 nt, hsa; identical to SEQ ID NO: 143712

SEQ ID NO: 454099 - RNA, 64 nt, hsa; identical to SEQ ID NO: 143713

SEQ ID NO: 454100 - RNA, 64 nt, hsa; identical to SEQ ID NO: 143714

SEQ ID NO: 454101 - RNA, 64 nt, hsa; identical to SEQ ID NO: 143715

SEQ ID NO: 454102 - RNA, 64 nt, hsa; identical to SEQ ID NO: 143716

SEQ ID NO: 454103 - RNA, 64 nt, hsa; identical to SEQ ID NO: 143717

SEQ ID NO: 454104 - RNA, 64 nt, hsa; identical to SEQ ID NO: 143718

SEQ ID NO: 454105 - RNA, 64 nt, hsa; identical to SEQ ID NO: 143719

SEQ ID NO: 454106 - RNA, 64 nt, hsa; identical to SEQ ID NO: 143720

SEQ ID NO: 454107 - RNA, 64 nt, hsa; identical to SEQ ID NO: 143721

SEQ ID NO: 454108 - RNA, 64 nt, hsa; identical to SEQ ID NO: 143722

SEQ ID NO: 454109 - RNA, 64 nt, hsa; identical to SEQ ID NO: 143723

SEQ ID NO: 454110 - RNA, 64 nt, hsa; identical to SEQ ID NO: 143724

SEQ ID NO: 454111 - RNA, 64 nt, hsa; identical to SEQ ID NO: 143725

SEQ ID NO: 454112 - RNA, 64 nt, hsa; identical to SEQ ID NO: 143726

SEQ ID NO: 454113 - RNA, 64 nt, hsa; identical to SEQ ID NO: 143727

SEQ ID NO: 454114 - RNA, 64 nt, hsa; identical to SEQ ID NO: 143728

SEQ ID NO: 454115 - RNA, 64 nt, hsa; identical to SEQ ID NO: 143729

SEQ ID NO: 454116 - RNA, 64 nt, hsa; identical to SEQ ID NO: 143730

SEQ ID NO: 454117 - RNA, 64 nt, hsa; identical to SEQ ID NO: 143731

SEQ ID NO: 454118 - RNA, 64 nt, hsa; identical to SEQ ID NO: 143732

SEQ ID NO: 454119 - RNA, 64 nt, hsa; identical to SEQ ID NO: 143733

SEQ ID NO: 454120 - RNA, 64 nt, hsa; identical to SEQ ID NO: 143734

SEQ ID NO: 454121 - RNA, 64 nt, hsa; identical to SEQ ID NO: 143735

SEQ ID NO: 454122 - RNA, 64 nt, hsa; identical to SEQ ID NO: 143736

SEQ ID NO: 454123 - RNA, 64 nt, hsa; identical to SEQ ID NO: 143737

SEQ ID NO: 454124 - RNA, 64 nt, hsa; identical to SEQ ID NO: 143738

SEQ ID NO: 454125 - RNA, 64 nt, hsa; identical to SEQ ID NO: 143739

SEQ ID NO: 454126 - RNA, 64 nt, hsa; identical to SEQ ID NO: 143740

SEQ ID NO: 454127 - RNA, 64 nt, hsa; identical to SEQ ID NO: 143741

SEQ ID NO: 454128 - RNA, 64 nt, hsa; identical to SEQ ID NO: 143742

SEQ ID NO: 454129 - RNA, 64 nt, hsa; identical to SEQ ID NO: 143743

SEQ ID NO: 454130 - RNA, 64 nt, hsa; identical to SEQ ID NO: 143744

SEQ ID NO: 454131 - RNA, 64 nt, hsa; identical to SEQ ID NO: 143745

SEQ ID NO: 454132 - RNA, 64 nt, hsa; identical to SEQ ID NO: 143746

SEQ ID NO: 454133 - RNA, 64 nt, hsa; identical to SEQ ID NO: 143747

SEQ ID NO: 454134 - RNA, 64 nt, hsa; identical to SEQ ID NO: 143748

SEQ ID NO: 454135 - RNA, 64 nt, hsa; identical to SEQ ID NO: 143749

SEQ ID NO: 454136 - RNA, 64 nt, hsa; identical to SEQ ID NO: 143750

SEQ ID NO: 454137 - RNA, 64 nt, hsa; identical to SEQ ID NO: 143751

SEQ ID NO: 454138 - RNA, 64 nt, hsa; identical to SEQ ID NO: 143752

SEQ ID NO: 454139 - RNA, 64 nt, hsa; identical to SEQ ID NO: 143753

SEQ ID NO: 454140 - RNA, 64 nt, hsa; identical to SEQ ID NO: 143754

SEQ ID NO: 454141 - RNA, 64 nt, hsa; identical to SEQ ID NO: 143755

SEQ ID NO: 454142 - RNA, 64 nt, hsa; identical to SEQ ID NO: 143756

SEQ ID NO: 454143 - RNA, 64 nt, hsa; identical to SEQ ID NO: 143757

SEQ ID NO: 454144 - RNA, 64 nt, hsa; identical to SEQ ID NO: 143758

SEQ ID NO: 454145 - RNA, 64 nt, hsa; identical to SEQ ID NO: 143759

SEQ ID NO: 454146 - RNA, 64 nt, hsa; identical to SEQ ID NO: 143760

SEQ ID NO: 454147 - RNA, 64 nt, hsa; identical to SEQ ID NO: 143761

SEQ ID NO: 454148 - RNA, 64 nt, hsa; identical to SEQ ID NO: 143762

SEQ ID NO: 454149 - RNA, 64 nt, hsa; identical to SEQ ID NO: 143763

SEQ ID NO: 454150 - RNA, 64 nt, hsa; identical to SEQ ID NO: 143764

SEQ ID NO: 454151 - RNA, 64 nt, hsa; identical to SEQ ID NO: 143765

SEQ ID NO: 454152 - RNA, 64 nt, hsa; identical to SEQ ID NO: 143766

SEQ ID NO: 454153 - RNA, 64 nt, hsa; identical to SEQ ID NO: 143767

SEQ ID NO: 454154 - RNA, 64 nt, hsa; identical to SEQ ID NO: 143768

SEQ ID NO: 454155 - RNA, 64 nt, hsa; identical to SEQ ID NO: 143769

SEQ ID NO: 454156 - RNA, 64 nt, hsa; identical to SEQ ID NO: 143770

SEQ ID NO: 454157 - RNA, 64 nt, hsa; identical to SEQ ID NO: 143771

SEQ ID NO: 454158 - RNA, 64 nt, hsa; identical to SEQ ID NO: 143772

SEQ ID NO: 454159 - RNA, 64 nt, hsa; identical to SEQ ID NO: 143773

SEQ ID NO: 454160 - RNA, 64 nt, hsa; identical to SEQ ID NO: 143774

SEQ ID NO: 454161 - RNA, 64 nt, hsa; identical to SEQ ID NO: 143775

SEQ ID NO: 454162 - RNA, 64 nt, hsa; identical to SEQ ID NO: 143776

SEQ ID NO: 454163 - RNA, 64 nt, hsa; identical to SEQ ID NO: 143777

SEQ ID NO: 454164 - RNA, 64 nt, hsa; identical to SEQ ID NO: 143778

SEQ ID NO: 454165 - RNA, 64 nt, hsa; identical to SEQ ID NO: 143779

SEQ ID NO: 454166 - RNA, 64 nt, hsa; identical to SEQ ID NO: 143780

SEQ ID NO: 454167 - RNA, 64 nt, hsa; identical to SEQ ID NO: 143781

SEQ ID NO: 454168 - RNA, 64 nt, hsa; identical to SEQ ID NO: 143782

SEQ ID NO: 454169 - RNA, 64 nt, hsa; identical to SEQ ID NO: 143783

SEQ ID NO: 454170 - RNA, 64 nt, hsa; identical to SEQ ID NO: 143784

SEQ ID NO: 454171 - RNA, 64 nt, hsa; identical to SEQ ID NO: 143785

SEQ ID NO: 454172 - RNA, 64 nt, hsa; identical to SEQ ID NO: 143786

SEQ ID NO: 454173 - RNA, 64 nt, hsa; identical to SEQ ID NO: 143787

SEQ ID NO: 454174 - RNA, 64 nt, hsa; identical to SEQ ID NO: 143788

SEQ ID NO: 454175 - RNA, 64 nt, hsa; identical to SEQ ID NO: 143789

SEQ ID NO: 454176 - RNA, 57 nt, hsa; identical to SEQ ID NO: 143790

SEQ ID NO: 454177 - RNA, 64 nt, hsa; identical to SEQ ID NO: 143791

SEQ ID NO: 454178 - RNA, 64 nt, hsa; identical to SEQ ID NO: 143792

SEQ ID NO: 454179 - RNA, 64 nt, hsa; identical to SEQ ID NO: 143793

SEQ ID NO: 454180 - RNA, 64 nt, hsa; identical to SEQ ID NO: 143794

SEQ ID NO: 454181 - RNA, 64 nt, hsa; identical to SEQ ID NO: 143795

SEQ ID NO: 454182 - RNA, 64 nt, hsa; identical to SEQ ID NO: 143796

SEQ ID NO: 454183 - RNA, 64 nt, hsa; identical to SEQ ID NO: 143797

SEQ ID NO: 454184 - RNA, 64 nt, hsa; identical to SEQ ID NO: 143798

SEQ ID NO: 454185 - RNA, 64 nt, hsa; identical to SEQ ID NO: 143799

SEQ ID NO: 454186 - RNA, 64 nt, hsa; identical to SEQ ID NO: 143800

SEQ ID NO: 454187 - RNA, 64 nt, hsa; identical to SEQ ID NO: 143801

SEQ ID NO: 454188 - RNA, 64 nt, hsa; identical to SEQ ID NO: 143802

SEQ ID NO: 454189 - RNA, 64 nt, hsa; identical to SEQ ID NO: 143803

SEQ ID NO: 454190 - RNA, 64 nt, hsa; identical to SEQ ID NO: 143804

SEQ ID NO: 454191 - RNA, 64 nt, hsa; identical to SEQ ID NO: 143805

SEQ ID NO: 454192 - RNA, 64 nt, hsa; identical to SEQ ID NO: 143806

SEQ ID NO: 454193 - RNA, 64 nt, hsa; identical to SEQ ID NO: 143807

SEQ ID NO: 454194 - RNA, 64 nt, hsa; identical to SEQ ID NO: 143808

SEQ ID NO: 454195 - RNA, 64 nt, hsa; identical to SEQ ID NO: 143809

SEQ ID NO: 454196 - RNA, 64 nt, hsa; identical to SEQ ID NO: 143810

SEQ ID NO: 454197 - RNA, 64 nt, hsa; identical to SEQ ID NO: 143811

SEQ ID NO: 454198 - RNA, 64 nt, hsa; identical to SEQ ID NO: 143812

SEQ ID NO: 454199 - RNA, 64 nt, hsa; identical to SEQ ID NO: 307517

SEQ ID NO: 454200 - RNA, 64 nt, hsa; identical to SEQ ID NO: 307518

SEQ ID NO: 454201 - RNA, 64 nt, hsa; identical to SEQ ID NO: 307519

SEQ ID NO: 454202 - RNA, 64 nt, hsa; identical to SEQ ID NO: 307520

SEQ ID NO: 454203 - RNA, 64 nt, hsa; identical to SEQ ID NO: 307521

SEQ ID NO: 454204 - RNA, 64 nt, hsa; identical to SEQ ID NO: 307522

SEQ ID NO: 454205 - RNA, 64 nt, hsa; identical to SEQ ID NO: 307523

SEQ ID NO: 454206 - RNA, 64 nt, hsa; identical to SEQ ID NO: 143712

SEQ ID NO: 454207 - RNA, 64 nt, hsa; identical to SEQ ID NO: 143713

SEQ ID NO: 454208 - RNA, 64 nt, hsa; identical to SEQ ID NO: 143714

SEQ ID NO: 454209 - RNA, 64 nt, hsa; identical to SEQ ID NO: 143715

SEQ ID NO: 454210 - RNA, 64 nt, hsa; identical to SEQ ID NO: 143716

SEQ ID NO: 454211 - RNA, 64 nt, hsa; identical to SEQ ID NO: 143717

SEQ ID NO: 454212 - RNA, 64 nt, hsa; identical to SEQ ID NO: 143718

SEQ ID NO: 454213 - RNA, 64 nt, hsa; identical to SEQ ID NO: 143719

SEQ ID NO: 454214 - RNA, 64 nt, hsa; identical to SEQ ID NO: 143720

SEQ ID NO: 454215 - RNA, 64 nt, hsa; identical to SEQ ID NO: 143721

SEQ ID NO: 454216 - RNA, 64 nt, hsa; identical to SEQ ID NO: 143722

SEQ ID NO: 454217 - RNA, 64 nt, hsa; identical to SEQ ID NO: 143723

SEQ ID NO: 454218 - RNA, 64 nt, hsa; identical to SEQ ID NO: 143724

SEQ ID NO: 454219 - RNA, 64 nt, hsa; identical to SEQ ID NO: 143725

SEQ ID NO: 454220 - RNA, 64 nt, hsa; identical to SEQ ID NO: 143726

SEQ ID NO: 454221 - RNA, 64 nt, hsa; identical to SEQ ID NO: 143727

SEQ ID NO: 454222 - RNA, 64 nt, hsa; identical to SEQ ID NO: 143728

SEQ ID NO: 454223 - RNA, 64 nt, hsa; identical to SEQ ID NO: 143729

SEQ ID NO: 454224 - RNA, 64 nt, hsa; identical to SEQ ID NO: 143730

SEQ ID NO: 454225 - RNA, 64 nt, hsa; identical to SEQ ID NO: 143731

SEQ ID NO: 454226 - RNA, 64 nt, hsa; identical to SEQ ID NO: 143732

SEQ ID NO: 454227 - RNA, 64 nt, hsa; identical to SEQ ID NO: 143733

SEQ ID NO: 454228 - RNA, 64 nt, hsa; identical to SEQ ID NO: 143734

SEQ ID NO: 454229 - RNA, 64 nt, hsa; identical to SEQ ID NO: 143735

SEQ ID NO: 454230 - RNA, 64 nt, hsa; identical to SEQ ID NO: 143736

SEQ ID NO: 454231 - RNA, 64 nt, hsa; identical to SEQ ID NO: 143737

SEQ ID NO: 454232 - RNA, 64 nt, hsa; identical to SEQ ID NO: 143738

SEQ ID NO: 454233 - RNA, 64 nt, hsa; identical to SEQ ID NO: 143739

SEQ ID NO: 454234 - RNA, 64 nt, hsa; identical to SEQ ID NO: 143740

SEQ ID NO: 454235 - RNA, 64 nt, hsa; identical to SEQ ID NO: 143741

SEQ ID NO: 454236 - RNA, 64 nt, hsa; identical to SEQ ID NO: 143742

SEQ ID NO: 454237 - RNA, 64 nt, hsa; identical to SEQ ID NO: 143743

SEQ ID NO: 454238 - RNA, 64 nt, hsa; identical to SEQ ID NO: 143744

SEQ ID NO: 454239 - RNA, 64 nt, hsa; identical to SEQ ID NO: 143745

SEQ ID NO: 454240 - RNA, 64 nt, hsa; identical to SEQ ID NO: 143746

SEQ ID NO: 454241 - RNA, 64 nt, hsa; identical to SEQ ID NO: 143747

SEQ ID NO: 454242 - RNA, 64 nt, hsa; identical to SEQ ID NO: 143748

SEQ ID NO: 454243 - RNA, 64 nt, hsa; identical to SEQ ID NO: 143749

SEQ ID NO: 454244 - RNA, 64 nt, hsa; identical to SEQ ID NO: 143750

SEQ ID NO: 454245 - RNA, 64 nt, hsa; identical to SEQ ID NO: 143751

SEQ ID NO: 454246 - RNA, 64 nt, hsa; identical to SEQ ID NO: 143752

SEQ ID NO: 454247 - RNA, 64 nt, hsa; identical to SEQ ID NO: 143753

SEQ ID NO: 454248 - RNA, 64 nt, hsa; identical to SEQ ID NO: 143754

SEQ ID NO: 454249 - RNA, 64 nt, hsa; identical to SEQ ID NO: 143755

SEQ ID NO: 454250 - RNA, 64 nt, hsa; identical to SEQ ID NO: 143756

SEQ ID NO: 454251 - RNA, 64 nt, hsa; identical to SEQ ID NO: 143757

SEQ ID NO: 454252 - RNA, 64 nt, hsa; identical to SEQ ID NO: 143758

SEQ ID NO: 454253 - RNA, 64 nt, hsa; identical to SEQ ID NO: 143759

SEQ ID NO: 454254 - RNA, 64 nt, hsa; identical to SEQ ID NO: 143760

SEQ ID NO: 454255 - RNA, 64 nt, hsa; identical to SEQ ID NO: 143761

SEQ ID NO: 454256 - RNA, 64 nt, hsa; identical to SEQ ID NO: 143762

SEQ ID NO: 454257 - RNA, 64 nt, hsa; identical to SEQ ID NO: 143763

SEQ ID NO: 454258 - RNA, 64 nt, hsa; identical to SEQ ID NO: 143764

SEQ ID NO: 454259 - RNA, 64 nt, hsa; identical to SEQ ID NO: 143765

SEQ ID NO: 454260 - RNA, 64 nt, hsa; identical to SEQ ID NO: 143766

SEQ ID NO: 454261 - RNA, 64 nt, hsa; identical to SEQ ID NO: 143767

SEQ ID NO: 454262 - RNA, 64 nt, hsa; identical to SEQ ID NO: 143768

SEQ ID NO: 454263 - RNA, 64 nt, hsa; identical to SEQ ID NO: 143769

SEQ ID NO: 454264 - RNA, 64 nt, hsa; identical to SEQ ID NO: 143770

SEQ ID NO: 454265 - RNA, 64 nt, hsa; identical to SEQ ID NO: 143771

SEQ ID NO: 454266 - RNA, 64 nt, hsa; identical to SEQ ID NO: 143772

SEQ ID NO: 454267 - RNA, 64 nt, hsa; identical to SEQ ID NO: 143773

SEQ ID NO: 454268 - RNA, 64 nt, hsa; identical to SEQ ID NO: 143774

SEQ ID NO: 454269 - RNA, 64 nt, hsa; identical to SEQ ID NO: 143775

SEQ ID NO: 454270 - RNA, 64 nt, hsa; identical to SEQ ID NO: 143776

SEQ ID NO: 454271 - RNA, 64 nt, hsa; identical to SEQ ID NO: 143777

SEQ ID NO: 454272 - RNA, 64 nt, hsa; identical to SEQ ID NO: 143778

SEQ ID NO: 454273 - RNA, 64 nt, hsa; identical to SEQ ID NO: 143779

SEQ ID NO: 454274 - RNA, 64 nt, hsa; identical to SEQ ID NO: 143780

SEQ ID NO: 454275 - RNA, 64 nt, hsa; identical to SEQ ID NO: 143781

SEQ ID NO: 454276 - RNA, 64 nt, hsa; identical to SEQ ID NO: 143782

SEQ ID NO: 454277 - RNA, 64 nt, hsa; identical to SEQ ID NO: 143783

SEQ ID NO: 454278 - RNA, 64 nt, hsa; identical to SEQ ID NO: 143784

SEQ ID NO: 454279 - RNA, 64 nt, hsa; identical to SEQ ID NO: 143785

SEQ ID NO: 454280 - RNA, 64 nt, hsa; identical to SEQ ID NO: 143786

SEQ ID NO: 454281 - RNA, 64 nt, hsa; identical to SEQ ID NO: 143787

SEQ ID NO: 454282 - RNA, 64 nt, hsa; identical to SEQ ID NO: 143788

SEQ ID NO: 454283 - RNA, 64 nt, hsa; identical to SEQ ID NO: 143789

SEQ ID NO: 454284 - RNA, 57 nt, hsa; identical to SEQ ID NO: 143790

SEQ ID NO: 454285 - RNA, 64 nt, hsa; identical to SEQ ID NO: 143791

SEQ ID NO: 454286 - RNA, 64 nt, hsa; identical to SEQ ID NO: 143792

SEQ ID NO: 454287 - RNA, 64 nt, hsa; identical to SEQ ID NO: 143793

SEQ ID NO: 454288 - RNA, 64 nt, hsa; identical to SEQ ID NO: 143794

SEQ ID NO: 454289 - RNA, 64 nt, hsa; identical to SEQ ID NO: 143795

SEQ ID NO: 454290 - RNA, 64 nt, hsa; identical to SEQ ID NO: 143796

SEQ ID NO: 454291 - RNA, 64 nt, hsa; identical to SEQ ID NO: 143797

SEQ ID NO: 454292 - RNA, 64 nt, hsa; identical to SEQ ID NO: 143798

SEQ ID NO: 454293 - RNA, 64 nt, hsa; identical to SEQ ID NO: 143799

SEQ ID NO: 454294 - RNA, 64 nt, hsa; identical to SEQ ID NO: 143800

SEQ ID NO: 454295 - RNA, 64 nt, hsa; identical to SEQ ID NO: 143801

SEQ ID NO: 454296 - RNA, 64 nt, hsa; identical to SEQ ID NO: 143802

SEQ ID NO: 454297 - RNA, 64 nt, hsa; identical to SEQ ID NO: 143803

SEQ ID NO: 454298 - RNA, 64 nt, hsa; identical to SEQ ID NO: 143804

SEQ ID NO: 454299 - RNA, 64 nt, hsa; identical to SEQ ID NO: 143805

SEQ ID NO: 454300 - RNA, 64 nt, hsa; identical to SEQ ID NO: 143806

SEQ ID NO: 454301 - RNA, 64 nt, hsa; identical to SEQ ID NO: 143807

SEQ ID NO: 454302 - RNA, 64 nt, hsa; identical to SEQ ID NO: 143808

SEQ ID NO: 454303 - RNA, 64 nt, hsa; identical to SEQ ID NO: 143809

SEQ ID NO: 454304 - RNA, 64 nt, hsa; identical to SEQ ID NO: 143810

SEQ ID NO: 454305 - RNA, 64 nt, hsa; identical to SEQ ID NO: 143811

SEQ ID NO: 454306 - RNA, 64 nt, hsa; identical to SEQ ID NO: 143812

SEQ ID NO: 454307 - RNA, 64 nt, hsa; identical to SEQ ID NO: 307517

SEQ ID NO: 454308 - RNA, 64 nt, hsa; identical to SEQ ID NO: 307518

SEQ ID NO: 454309 - RNA, 64 nt, hsa; identical to SEQ ID NO: 307519

SEQ ID NO: 454310 - RNA, 64 nt, hsa; identical to SEQ ID NO: 307520

SEQ ID NO: 454311 - RNA, 64 nt, hsa; identical to SEQ ID NO: 307521

SEQ ID NO: 454312 - RNA, 64 nt, hsa; identical to SEQ ID NO: 307522

SEQ ID NO: 454313 - RNA, 64 nt, hsa; identical to SEQ ID NO: 307523

SEQ ID NO: 454314 - RNA, 64 nt, hsa; identical to SEQ ID NO: 143712

SEQ ID NO: 454315 - RNA, 64 nt, hsa; identical to SEQ ID NO: 143713

SEQ ID NO: 454316 - RNA, 64 nt, hsa; identical to SEQ ID NO: 143714

SEQ ID NO: 454317 - RNA, 64 nt, hsa; identical to SEQ ID NO: 143715

SEQ ID NO: 454318 - RNA, 64 nt, hsa; identical to SEQ ID NO: 143716

SEQ ID NO: 454319 - RNA, 64 nt, hsa; identical to SEQ ID NO: 143717

SEQ ID NO: 454320 - RNA, 64 nt, hsa; identical to SEQ ID NO: 143718

SEQ ID NO: 454321 - RNA, 64 nt, hsa; identical to SEQ ID NO: 143719

SEQ ID NO: 454322 - RNA, 64 nt, hsa; identical to SEQ ID NO: 143720

SEQ ID NO: 454323 - RNA, 64 nt, hsa; identical to SEQ ID NO: 143721

SEQ ID NO: 454324 - RNA, 64 nt, hsa; identical to SEQ ID NO: 143722

SEQ ID NO: 454325 - RNA, 64 nt, hsa; identical to SEQ ID NO: 143723

SEQ ID NO: 454326 - RNA, 64 nt, hsa; identical to SEQ ID NO: 143724

SEQ ID NO: 454327 - RNA, 64 nt, hsa; identical to SEQ ID NO: 143725

SEQ ID NO: 454328 - RNA, 64 nt, hsa; identical to SEQ ID NO: 143726

SEQ ID NO: 454329 - RNA, 64 nt, hsa; identical to SEQ ID NO: 143727

SEQ ID NO: 454330 - RNA, 64 nt, hsa; identical to SEQ ID NO: 143728

SEQ ID NO: 454331 - RNA, 64 nt, hsa; identical to SEQ ID NO: 143729

SEQ ID NO: 454332 - RNA, 64 nt, hsa; identical to SEQ ID NO: 143730

SEQ ID NO: 454333 - RNA, 64 nt, hsa; identical to SEQ ID NO: 143731

SEQ ID NO: 454334 - RNA, 64 nt, hsa; identical to SEQ ID NO: 143732

SEQ ID NO: 454335 - RNA, 64 nt, hsa; identical to SEQ ID NO: 143733

SEQ ID NO: 454336 - RNA, 64 nt, hsa; identical to SEQ ID NO: 143734

SEQ ID NO: 454337 - RNA, 64 nt, hsa; identical to SEQ ID NO: 143735

SEQ ID NO: 454338 - RNA, 64 nt, hsa; identical to SEQ ID NO: 143736

SEQ ID NO: 454339 - RNA, 64 nt, hsa; identical to SEQ ID NO: 143737

SEQ ID NO: 454340 - RNA, 64 nt, hsa; identical to SEQ ID NO: 143738

SEQ ID NO: 454341 - RNA, 64 nt, hsa; identical to SEQ ID NO: 143739

SEQ ID NO: 454342 - RNA, 64 nt, hsa; identical to SEQ ID NO: 143740

SEQ ID NO: 454343 - RNA, 64 nt, hsa; identical to SEQ ID NO: 143741

SEQ ID NO: 454344 - RNA, 64 nt, hsa; identical to SEQ ID NO: 143742

SEQ ID NO: 454345 - RNA, 64 nt, hsa; identical to SEQ ID NO: 143743

SEQ ID NO: 454346 - RNA, 64 nt, hsa; identical to SEQ ID NO: 143744

SEQ ID NO: 454347 - RNA, 64 nt, hsa; identical to SEQ ID NO: 143745

SEQ ID NO: 454348 - RNA, 64 nt, hsa; identical to SEQ ID NO: 143746

SEQ ID NO: 454349 - RNA, 64 nt, hsa; identical to SEQ ID NO: 143747

SEQ ID NO: 454350 - RNA, 64 nt, hsa; identical to SEQ ID NO: 143748

SEQ ID NO: 454351 - RNA, 64 nt, hsa; identical to SEQ ID NO: 143749

SEQ ID NO: 454352 - RNA, 64 nt, hsa; identical to SEQ ID NO: 143750

SEQ ID NO: 454353 - RNA, 64 nt, hsa; identical to SEQ ID NO: 143751

SEQ ID NO: 454354 - RNA, 64 nt, hsa; identical to SEQ ID NO: 143752

SEQ ID NO: 454355 - RNA, 64 nt, hsa; identical to SEQ ID NO: 143753

SEQ ID NO: 454356 - RNA, 64 nt, hsa; identical to SEQ ID NO: 143754

SEQ ID NO: 454357 - RNA, 64 nt, hsa; identical to SEQ ID NO: 143755

SEQ ID NO: 454358 - RNA, 64 nt, hsa; identical to SEQ ID NO: 143756

SEQ ID NO: 454359 - RNA, 64 nt, hsa; identical to SEQ ID NO: 143757

SEQ ID NO: 454360 - RNA, 64 nt, hsa; identical to SEQ ID NO: 143758

SEQ ID NO: 454361 - RNA, 64 nt, hsa; identical to SEQ ID NO: 143759

SEQ ID NO: 454362 - RNA, 64 nt, hsa; identical to SEQ ID NO: 143760

SEQ ID NO: 454363 - RNA, 64 nt, hsa; identical to SEQ ID NO: 143761

SEQ ID NO: 454364 - RNA, 64 nt, hsa; identical to SEQ ID NO: 143762

SEQ ID NO: 454365 - RNA, 64 nt, hsa; identical to SEQ ID NO: 143763

SEQ ID NO: 454366 - RNA, 64 nt, hsa; identical to SEQ ID NO: 143764

SEQ ID NO: 454367 - RNA, 64 nt, hsa; identical to SEQ ID NO: 143765

SEQ ID NO: 454368 - RNA, 64 nt, hsa; identical to SEQ ID NO: 143766

SEQ ID NO: 454369 - RNA, 64 nt, hsa; identical to SEQ ID NO: 143767

SEQ ID NO: 454370 - RNA, 64 nt, hsa; identical to SEQ ID NO: 143768

SEQ ID NO: 454371 - RNA, 64 nt, hsa; identical to SEQ ID NO: 143769

SEQ ID NO: 454372 - RNA, 64 nt, hsa; identical to SEQ ID NO: 143770

SEQ ID NO: 454373 - RNA, 64 nt, hsa; identical to SEQ ID NO: 143771

SEQ ID NO: 454374 - RNA, 64 nt, hsa; identical to SEQ ID NO: 143772

SEQ ID NO: 454375 - RNA, 64 nt, hsa; identical to SEQ ID NO: 143773

SEQ ID NO: 454376 - RNA, 64 nt, hsa; identical to SEQ ID NO: 143774

SEQ ID NO: 454377 - RNA, 64 nt, hsa; identical to SEQ ID NO: 143775

SEQ ID NO: 454378 - RNA, 64 nt, hsa; identical to SEQ ID NO: 143776

SEQ ID NO: 454379 - RNA, 64 nt, hsa; identical to SEQ ID NO: 143777

SEQ ID NO: 454380 - RNA, 64 nt, hsa; identical to SEQ ID NO: 143778

SEQ ID NO: 454381 - RNA, 64 nt, hsa; identical to SEQ ID NO: 143779

SEQ ID NO: 454382 - RNA, 64 nt, hsa; identical to SEQ ID NO: 143780

SEQ ID NO: 454383 - RNA, 64 nt, hsa; identical to SEQ ID NO: 143781

SEQ ID NO: 454384 - RNA, 64 nt, hsa; identical to SEQ ID NO: 143782

SEQ ID NO: 454385 - RNA, 64 nt, hsa; identical to SEQ ID NO: 143783

SEQ ID NO: 454386 - RNA, 64 nt, hsa; identical to SEQ ID NO: 143784

SEQ ID NO: 454387 - RNA, 64 nt, hsa; identical to SEQ ID NO: 143785

SEQ ID NO: 454388 - RNA, 64 nt, hsa; identical to SEQ ID NO: 143786

SEQ ID NO: 454389 - RNA, 64 nt, hsa; identical to SEQ ID NO: 143787

SEQ ID NO: 454390 - RNA, 64 nt, hsa; identical to SEQ ID NO: 143788

SEQ ID NO: 454391 - RNA, 64 nt, hsa; identical to SEQ ID NO: 143789

SEQ ID NO: 454392 - RNA, 57 nt, hsa; identical to SEQ ID NO: 143790

SEQ ID NO: 454393 - RNA, 64 nt, hsa; identical to SEQ ID NO: 143791

SEQ ID NO: 454394 - RNA, 64 nt, hsa; identical to SEQ ID NO: 143792

SEQ ID NO: 454395 - RNA, 64 nt, hsa; identical to SEQ ID NO: 143793

SEQ ID NO: 454396 - RNA, 64 nt, hsa; identical to SEQ ID NO: 143794

SEQ ID NO: 454397 - RNA, 64 nt, hsa; identical to SEQ ID NO: 143795

SEQ ID NO: 454398 - RNA, 64 nt, hsa; identical to SEQ ID NO: 143796

SEQ ID NO: 454399 - RNA, 64 nt, hsa; identical to SEQ ID NO: 143797

SEQ ID NO: 454400 - RNA, 64 nt, hsa; identical to SEQ ID NO: 143798

SEQ ID NO: 454401 - RNA, 64 nt, hsa; identical to SEQ ID NO: 143799

SEQ ID NO: 454402 - RNA, 64 nt, hsa; identical to SEQ ID NO: 143800

SEQ ID NO: 454403 - RNA, 64 nt, hsa; identical to SEQ ID NO: 143801

SEQ ID NO: 454404 - RNA, 64 nt, hsa; identical to SEQ ID NO: 143802

SEQ ID NO: 454405 - RNA, 64 nt, hsa; identical to SEQ ID NO: 143803

SEQ ID NO: 454406 - RNA, 64 nt, hsa; identical to SEQ ID NO: 143804

SEQ ID NO: 454407 - RNA, 64 nt, hsa; identical to SEQ ID NO: 143805

SEQ ID NO: 454408 - RNA, 64 nt, hsa; identical to SEQ ID NO: 143806

SEQ ID NO: 454409 - RNA, 64 nt, hsa; identical to SEQ ID NO: 143807

SEQ ID NO: 454410 - RNA, 64 nt, hsa; identical to SEQ ID NO: 143808

SEQ ID NO: 454411 - RNA, 64 nt, hsa; identical to SEQ ID NO: 143809

SEQ ID NO: 454412 - RNA, 64 nt, hsa; identical to SEQ ID NO: 143810

SEQ ID NO: 454413 - RNA, 64 nt, hsa; identical to SEQ ID NO: 143811

SEQ ID NO: 454414 - RNA, 64 nt, hsa; identical to SEQ ID NO: 143812

SEQ ID NO: 454415 - RNA, 64 nt, hsa; identical to SEQ ID NO: 307517

SEQ ID NO: 454416 - RNA, 64 nt, hsa; identical to SEQ ID NO: 307518

SEQ ID NO: 454417 - RNA, 64 nt, hsa; identical to SEQ ID NO: 307519

SEQ ID NO: 454418 - RNA, 64 nt, hsa; identical to SEQ ID NO: 307520

SEQ ID NO: 454419 - RNA, 64 nt, hsa; identical to SEQ ID NO: 307521

SEQ ID NO: 454420 - RNA, 64 nt, hsa; identical to SEQ ID NO: 307522

SEQ ID NO: 454421 - RNA, 64 nt, hsa; identical to SEQ ID NO: 307523

SEQ ID NO: 454422 - RNA, 64 nt, hsa; identical to SEQ ID NO: 143712

SEQ ID NO: 454423 - RNA, 64 nt, hsa; identical to SEQ ID NO: 143713

SEQ ID NO: 454424 - RNA, 64 nt, hsa; identical to SEQ ID NO: 143714

SEQ ID NO: 454425 - RNA, 64 nt, hsa; identical to SEQ ID NO: 143715

SEQ ID NO: 454426 - RNA, 64 nt, hsa; identical to SEQ ID NO: 143716

SEQ ID NO: 454427 - RNA, 64 nt, hsa; identical to SEQ ID NO: 143717

SEQ ID NO: 454428 - RNA, 64 nt, hsa; identical to SEQ ID NO: 143718

SEQ ID NO: 454429 - RNA, 64 nt, hsa; identical to SEQ ID NO: 143719

SEQ ID NO: 454430 - RNA, 64 nt, hsa; identical to SEQ ID NO: 143720

SEQ ID NO: 454431 - RNA, 64 nt, hsa; identical to SEQ ID NO: 143721

SEQ ID NO: 454432 - RNA, 64 nt, hsa; identical to SEQ ID NO: 143722

SEQ ID NO: 454433 - RNA, 64 nt, hsa; identical to SEQ ID NO: 143723

SEQ ID NO: 454434 - RNA, 64 nt, hsa; identical to SEQ ID NO: 143724

SEQ ID NO: 454435 - RNA, 64 nt, hsa; identical to SEQ ID NO: 143725

SEQ ID NO: 454436 - RNA, 64 nt, hsa; identical to SEQ ID NO: 143726

SEQ ID NO: 454437 - RNA, 64 nt, hsa; identical to SEQ ID NO: 143727

SEQ ID NO: 454438 - RNA, 64 nt, hsa; identical to SEQ ID NO: 143728

SEQ ID NO: 454439 - RNA, 64 nt, hsa; identical to SEQ ID NO: 143729

SEQ ID NO: 454440 - RNA, 64 nt, hsa; identical to SEQ ID NO: 143730

SEQ ID NO: 454441 - RNA, 64 nt, hsa; identical to SEQ ID NO: 143731

SEQ ID NO: 454442 - RNA, 64 nt, hsa; identical to SEQ ID NO: 143732

SEQ ID NO: 454443 - RNA, 64 nt, hsa; identical to SEQ ID NO: 143733

SEQ ID NO: 454444 - RNA, 64 nt, hsa; identical to SEQ ID NO: 143734

SEQ ID NO: 454445 - RNA, 64 nt, hsa; identical to SEQ ID NO: 143735

SEQ ID NO: 454446 - RNA, 64 nt, hsa; identical to SEQ ID NO: 143736

SEQ ID NO: 454447 - RNA, 64 nt, hsa; identical to SEQ ID NO: 143737

SEQ ID NO: 454448 - RNA, 64 nt, hsa; identical to SEQ ID NO: 143738

SEQ ID NO: 454449 - RNA, 64 nt, hsa; identical to SEQ ID NO: 143739

SEQ ID NO: 454450 - RNA, 64 nt, hsa; identical to SEQ ID NO: 143740

SEQ ID NO: 454451 - RNA, 64 nt, hsa; identical to SEQ ID NO: 143741

SEQ ID NO: 454452 - RNA, 64 nt, hsa; identical to SEQ ID NO: 143742

SEQ ID NO: 454453 - RNA, 64 nt, hsa; identical to SEQ ID NO: 143743

SEQ ID NO: 454454 - RNA, 64 nt, hsa; identical to SEQ ID NO: 143744

SEQ ID NO: 454455 - RNA, 64 nt, hsa; identical to SEQ ID NO: 143745

SEQ ID NO: 454456 - RNA, 64 nt, hsa; identical to SEQ ID NO: 143746

SEQ ID NO: 454457 - RNA, 64 nt, hsa; identical to SEQ ID NO: 143747

SEQ ID NO: 454458 - RNA, 64 nt, hsa; identical to SEQ ID NO: 143748

SEQ ID NO: 454459 - RNA, 64 nt, hsa; identical to SEQ ID NO: 143749

SEQ ID NO: 454460 - RNA, 64 nt, hsa; identical to SEQ ID NO: 143750

SEQ ID NO: 454461 - RNA, 64 nt, hsa; identical to SEQ ID NO: 143751

SEQ ID NO: 454462 - RNA, 64 nt, hsa; identical to SEQ ID NO: 143752

SEQ ID NO: 454463 - RNA, 64 nt, hsa; identical to SEQ ID NO: 143753

SEQ ID NO: 454464 - RNA, 64 nt, hsa; identical to SEQ ID NO: 143754

SEQ ID NO: 454465 - RNA, 64 nt, hsa; identical to SEQ ID NO: 143755

SEQ ID NO: 454466 - RNA, 64 nt, hsa; identical to SEQ ID NO: 143756

SEQ ID NO: 454467 - RNA, 64 nt, hsa; identical to SEQ ID NO: 143757

SEQ ID NO: 454468 - RNA, 64 nt, hsa; identical to SEQ ID NO: 143758

SEQ ID NO: 454469 - RNA, 64 nt, hsa; identical to SEQ ID NO: 143759

SEQ ID NO: 454470 - RNA, 64 nt, hsa; identical to SEQ ID NO: 143760

SEQ ID NO: 454471 - RNA, 64 nt, hsa; identical to SEQ ID NO: 143761

SEQ ID NO: 454472 - RNA, 64 nt, hsa; identical to SEQ ID NO: 143762

SEQ ID NO: 454473 - RNA, 64 nt, hsa; identical to SEQ ID NO: 143763

SEQ ID NO: 454474 - RNA, 64 nt, hsa; identical to SEQ ID NO: 143764

SEQ ID NO: 454475 - RNA, 64 nt, hsa; identical to SEQ ID NO: 143765

SEQ ID NO: 454476 - RNA, 64 nt, hsa; identical to SEQ ID NO: 143766

SEQ ID NO: 454477 - RNA, 64 nt, hsa; identical to SEQ ID NO: 143767

SEQ ID NO: 454478 - RNA, 64 nt, hsa; identical to SEQ ID NO: 143768

SEQ ID NO: 454479 - RNA, 64 nt, hsa; identical to SEQ ID NO: 143769

SEQ ID NO: 454480 - RNA, 64 nt, hsa; identical to SEQ ID NO: 143770

SEQ ID NO: 454481 - RNA, 64 nt, hsa; identical to SEQ ID NO: 143771

SEQ ID NO: 454482 - RNA, 64 nt, hsa; identical to SEQ ID NO: 143772

SEQ ID NO: 454483 - RNA, 64 nt, hsa; identical to SEQ ID NO: 143773

SEQ ID NO: 454484 - RNA, 64 nt, hsa; identical to SEQ ID NO: 143774

SEQ ID NO: 454485 - RNA, 64 nt, hsa; identical to SEQ ID NO: 143775

SEQ ID NO: 454486 - RNA, 64 nt, hsa; identical to SEQ ID NO: 143776

SEQ ID NO: 454487 - RNA, 64 nt, hsa; identical to SEQ ID NO: 143777

SEQ ID NO: 454488 - RNA, 64 nt, hsa; identical to SEQ ID NO: 143778

SEQ ID NO: 454489 - RNA, 64 nt, hsa; identical to SEQ ID NO: 143779

SEQ ID NO: 454490 - RNA, 64 nt, hsa; identical to SEQ ID NO: 143780

SEQ ID NO: 454491 - RNA, 64 nt, hsa; identical to SEQ ID NO: 143781

SEQ ID NO: 454492 - RNA, 64 nt, hsa; identical to SEQ ID NO: 143782

SEQ ID NO: 454493 - RNA, 64 nt, hsa; identical to SEQ ID NO: 143783

SEQ ID NO: 454494 - RNA, 64 nt, hsa; identical to SEQ ID NO: 143784

SEQ ID NO: 454495 - RNA, 64 nt, hsa; identical to SEQ ID NO: 143785

SEQ ID NO: 454496 - RNA, 64 nt, hsa; identical to SEQ ID NO: 143786

SEQ ID NO: 454497 - RNA, 64 nt, hsa; identical to SEQ ID NO: 143787

SEQ ID NO: 454498 - RNA, 64 nt, hsa; identical to SEQ ID NO: 143788

SEQ ID NO: 454499 - RNA, 64 nt, hsa; identical to SEQ ID NO: 143789

SEQ ID NO: 454500 - RNA, 57 nt, hsa; identical to SEQ ID NO: 143790

SEQ ID NO: 454501 - RNA, 64 nt, hsa; identical to SEQ ID NO: 143791

SEQ ID NO: 454502 - RNA, 64 nt, hsa; identical to SEQ ID NO: 143792

SEQ ID NO: 454503 - RNA, 64 nt, hsa; identical to SEQ ID NO: 143793

SEQ ID NO: 454504 - RNA, 64 nt, hsa; identical to SEQ ID NO: 143794

SEQ ID NO: 454505 - RNA, 64 nt, hsa; identical to SEQ ID NO: 143795

SEQ ID NO: 454506 - RNA, 64 nt, hsa; identical to SEQ ID NO: 143796

SEQ ID NO: 454507 - RNA, 64 nt, hsa; identical to SEQ ID NO: 143797

SEQ ID NO: 454508 - RNA, 64 nt, hsa; identical to SEQ ID NO: 143798

SEQ ID NO: 454509 - RNA, 64 nt, hsa; identical to SEQ ID NO: 143799

SEQ ID NO: 454510 - RNA, 64 nt, hsa; identical to SEQ ID NO: 143800

SEQ ID NO: 454511 - RNA, 64 nt, hsa; identical to SEQ ID NO: 143801

SEQ ID NO: 454512 - RNA, 64 nt, hsa; identical to SEQ ID NO: 143802

SEQ ID NO: 454513 - RNA, 64 nt, hsa; identical to SEQ ID NO: 143803

SEQ ID NO: 454514 - RNA, 64 nt, hsa; identical to SEQ ID NO: 143804

SEQ ID NO: 454515 - RNA, 64 nt, hsa; identical to SEQ ID NO: 143805

SEQ ID NO: 454516 - RNA, 64 nt, hsa; identical to SEQ ID NO: 143806

SEQ ID NO: 454517 - RNA, 64 nt, hsa; identical to SEQ ID NO: 143807

SEQ ID NO: 454518 - RNA, 64 nt, hsa; identical to SEQ ID NO: 143808

SEQ ID NO: 454519 - RNA, 64 nt, hsa; identical to SEQ ID NO: 143809

SEQ ID NO: 454520 - RNA, 64 nt, hsa; identical to SEQ ID NO: 143810

SEQ ID NO: 454521 - RNA, 64 nt, hsa; identical to SEQ ID NO: 143811

SEQ ID NO: 454522 - RNA, 64 nt, hsa; identical to SEQ ID NO: 143812

SEQ ID NO: 454523 - RNA, 64 nt, hsa; identical to SEQ ID NO: 307517

SEQ ID NO: 454524 - RNA, 64 nt, hsa; identical to SEQ ID NO: 307518

SEQ ID NO: 454525 - RNA, 64 nt, hsa; identical to SEQ ID NO: 307519

SEQ ID NO: 454526 - RNA, 64 nt, hsa; identical to SEQ ID NO: 307520

SEQ ID NO: 454527 - RNA, 64 nt, hsa; identical to SEQ ID NO: 307521

SEQ ID NO: 454528 - RNA, 64 nt, hsa; identical to SEQ ID NO: 307522

SEQ ID NO: 454529 - RNA, 64 nt, hsa; identical to SEQ ID NO: 307523

SEQ ID NO: 454530 - RNA, 64 nt, hsa; identical to SEQ ID NO: 143712

SEQ ID NO: 454531 - RNA, 64 nt, hsa; identical to SEQ ID NO: 143713

SEQ ID NO: 454532 - RNA, 64 nt, hsa; identical to SEQ ID NO: 143714

SEQ ID NO: 454533 - RNA, 64 nt, hsa; identical to SEQ ID NO: 143715

SEQ ID NO: 454534 - RNA, 64 nt, hsa; identical to SEQ ID NO: 143716

SEQ ID NO: 454535 - RNA, 64 nt, hsa; identical to SEQ ID NO: 143717

SEQ ID NO: 454536 - RNA, 64 nt, hsa; identical to SEQ ID NO: 143718

SEQ ID NO: 454537 - RNA, 64 nt, hsa; identical to SEQ ID NO: 143719

SEQ ID NO: 454538 - RNA, 64 nt, hsa; identical to SEQ ID NO: 143720

SEQ ID NO: 454539 - RNA, 64 nt, hsa; identical to SEQ ID NO: 143721

SEQ ID NO: 454540 - RNA, 64 nt, hsa; identical to SEQ ID NO: 143722

SEQ ID NO: 454541 - RNA, 64 nt, hsa; identical to SEQ ID NO: 143723

SEQ ID NO: 454542 - RNA, 64 nt, hsa; identical to SEQ ID NO: 143724

SEQ ID NO: 454543 - RNA, 64 nt, hsa; identical to SEQ ID NO: 143725

SEQ ID NO: 454544 - RNA, 64 nt, hsa; identical to SEQ ID NO: 143726

SEQ ID NO: 454545 - RNA, 64 nt, hsa; identical to SEQ ID NO: 143727

SEQ ID NO: 454546 - RNA, 64 nt, hsa; identical to SEQ ID NO: 143728

SEQ ID NO: 454547 - RNA, 64 nt, hsa; identical to SEQ ID NO: 143729

SEQ ID NO: 454548 - RNA, 64 nt, hsa; identical to SEQ ID NO: 143730

SEQ ID NO: 454549 - RNA, 64 nt, hsa; identical to SEQ ID NO: 143731

SEQ ID NO: 454550 - RNA, 64 nt, hsa; identical to SEQ ID NO: 143732

SEQ ID NO: 454551 - RNA, 64 nt, hsa; identical to SEQ ID NO: 143733

SEQ ID NO: 454552 - RNA, 64 nt, hsa; identical to SEQ ID NO: 143734

SEQ ID NO: 454553 - RNA, 64 nt, hsa; identical to SEQ ID NO: 143735

SEQ ID NO: 454554 - RNA, 64 nt, hsa; identical to SEQ ID NO: 143736

SEQ ID NO: 454555 - RNA, 64 nt, hsa; identical to SEQ ID NO: 143737

SEQ ID NO: 454556 - RNA, 64 nt, hsa; identical to SEQ ID NO: 143738

SEQ ID NO: 454557 - RNA, 64 nt, hsa; identical to SEQ ID NO: 143739

SEQ ID NO: 454558 - RNA, 64 nt, hsa; identical to SEQ ID NO: 143740

SEQ ID NO: 454559 - RNA, 64 nt, hsa; identical to SEQ ID NO: 143741

SEQ ID NO: 454560 - RNA, 64 nt, hsa; identical to SEQ ID NO: 143742

SEQ ID NO: 454561 - RNA, 64 nt, hsa; identical to SEQ ID NO: 143743

SEQ ID NO: 454562 - RNA, 64 nt, hsa; identical to SEQ ID NO: 143744

SEQ ID NO: 454563 - RNA, 64 nt, hsa; identical to SEQ ID NO: 143745

SEQ ID NO: 454564 - RNA, 64 nt, hsa; identical to SEQ ID NO: 143746

SEQ ID NO: 454565 - RNA, 64 nt, hsa; identical to SEQ ID NO: 143747

SEQ ID NO: 454566 - RNA, 64 nt, hsa; identical to SEQ ID NO: 143748

SEQ ID NO: 454567 - RNA, 64 nt, hsa; identical to SEQ ID NO: 143749

SEQ ID NO: 454568 - RNA, 64 nt, hsa; identical to SEQ ID NO: 143750

SEQ ID NO: 454569 - RNA, 64 nt, hsa; identical to SEQ ID NO: 143751

SEQ ID NO: 454570 - RNA, 64 nt, hsa; identical to SEQ ID NO: 143752

SEQ ID NO: 454571 - RNA, 64 nt, hsa; identical to SEQ ID NO: 143753

SEQ ID NO: 454572 - RNA, 64 nt, hsa; identical to SEQ ID NO: 143754

SEQ ID NO: 454573 - RNA, 64 nt, hsa; identical to SEQ ID NO: 143755

SEQ ID NO: 454574 - RNA, 64 nt, hsa; identical to SEQ ID NO: 143756

SEQ ID NO: 454575 - RNA, 64 nt, hsa; identical to SEQ ID NO: 143757

SEQ ID NO: 454576 - RNA, 64 nt, hsa; identical to SEQ ID NO: 143758

SEQ ID NO: 454577 - RNA, 64 nt, hsa; identical to SEQ ID NO: 143759

SEQ ID NO: 454578 - RNA, 64 nt, hsa; identical to SEQ ID NO: 143760

SEQ ID NO: 454579 - RNA, 64 nt, hsa; identical to SEQ ID NO: 143761

SEQ ID NO: 454580 - RNA, 64 nt, hsa; identical to SEQ ID NO: 143762

SEQ ID NO: 454581 - RNA, 64 nt, hsa; identical to SEQ ID NO: 143763

SEQ ID NO: 454582 - RNA, 64 nt, hsa; identical to SEQ ID NO: 143764

SEQ ID NO: 454583 - RNA, 64 nt, hsa; identical to SEQ ID NO: 143765

SEQ ID NO: 454584 - RNA, 64 nt, hsa; identical to SEQ ID NO: 143766

SEQ ID NO: 454585 - RNA, 64 nt, hsa; identical to SEQ ID NO: 143767

SEQ ID NO: 454586 - RNA, 64 nt, hsa; identical to SEQ ID NO: 143768

SEQ ID NO: 454587 - RNA, 64 nt, hsa; identical to SEQ ID NO: 143769

SEQ ID NO: 454588 - RNA, 64 nt, hsa; identical to SEQ ID NO: 143770

SEQ ID NO: 454589 - RNA, 64 nt, hsa; identical to SEQ ID NO: 143771

SEQ ID NO: 454590 - RNA, 64 nt, hsa; identical to SEQ ID NO: 143772

SEQ ID NO: 454591 - RNA, 64 nt, hsa; identical to SEQ ID NO: 143773

SEQ ID NO: 454592 - RNA, 64 nt, hsa; identical to SEQ ID NO: 143774

SEQ ID NO: 454593 - RNA, 64 nt, hsa; identical to SEQ ID NO: 143775

SEQ ID NO: 454594 - RNA, 64 nt, hsa; identical to SEQ ID NO: 143776

SEQ ID NO: 454595 - RNA, 64 nt, hsa; identical to SEQ ID NO: 143777

SEQ ID NO: 454596 - RNA, 64 nt, hsa; identical to SEQ ID NO: 143778

SEQ ID NO: 454597 - RNA, 64 nt, hsa; identical to SEQ ID NO: 143779

SEQ ID NO: 454598 - RNA, 64 nt, hsa; identical to SEQ ID NO: 143780

SEQ ID NO: 454599 - RNA, 64 nt, hsa; identical to SEQ ID NO: 143781

SEQ ID NO: 454600 - RNA, 64 nt, hsa; identical to SEQ ID NO: 143782

SEQ ID NO: 454601 - RNA, 64 nt, hsa; identical to SEQ ID NO: 143783

SEQ ID NO: 454602 - RNA, 64 nt, hsa; identical to SEQ ID NO: 143784

SEQ ID NO: 454603 - RNA, 64 nt, hsa; identical to SEQ ID NO: 143785

SEQ ID NO: 454604 - RNA, 64 nt, hsa; identical to SEQ ID NO: 143786

SEQ ID NO: 454605 - RNA, 64 nt, hsa; identical to SEQ ID NO: 143787

SEQ ID NO: 454606 - RNA, 64 nt, hsa; identical to SEQ ID NO: 143788

SEQ ID NO: 454607 - RNA, 64 nt, hsa; identical to SEQ ID NO: 143789

SEQ ID NO: 454608 - RNA, 57 nt, hsa; identical to SEQ ID NO: 143790

SEQ ID NO: 454609 - RNA, 64 nt, hsa; identical to SEQ ID NO: 143791

SEQ ID NO: 454610 - RNA, 64 nt, hsa; identical to SEQ ID NO: 143792

SEQ ID NO: 454611 - RNA, 64 nt, hsa; identical to SEQ ID NO: 143793

SEQ ID NO: 454612 - RNA, 64 nt, hsa; identical to SEQ ID NO: 143794

SEQ ID NO: 454613 - RNA, 64 nt, hsa; identical to SEQ ID NO: 143795

SEQ ID NO: 454614 - RNA, 64 nt, hsa; identical to SEQ ID NO: 143796

SEQ ID NO: 454615 - RNA, 64 nt, hsa; identical to SEQ ID NO: 143797

SEQ ID NO: 454616 - RNA, 64 nt, hsa; identical to SEQ ID NO: 143798

SEQ ID NO: 454617 - RNA, 64 nt, hsa; identical to SEQ ID NO: 143799

SEQ ID NO: 454618 - RNA, 64 nt, hsa; identical to SEQ ID NO: 143800

SEQ ID NO: 454619 - RNA, 64 nt, hsa; identical to SEQ ID NO: 143801

SEQ ID NO: 454620 - RNA, 64 nt, hsa; identical to SEQ ID NO: 143802

SEQ ID NO: 454621 - RNA, 64 nt, hsa; identical to SEQ ID NO: 143803

SEQ ID NO: 454622 - RNA, 64 nt, hsa; identical to SEQ ID NO: 143804

SEQ ID NO: 454623 - RNA, 64 nt, hsa; identical to SEQ ID NO: 143805

SEQ ID NO: 454624 - RNA, 64 nt, hsa; identical to SEQ ID NO: 143806

SEQ ID NO: 454625 - RNA, 64 nt, hsa; identical to SEQ ID NO: 143807

SEQ ID NO: 454626 - RNA, 64 nt, hsa; identical to SEQ ID NO: 143808

SEQ ID NO: 454627 - RNA, 64 nt, hsa; identical to SEQ ID NO: 143809

SEQ ID NO: 454628 - RNA, 64 nt, hsa; identical to SEQ ID NO: 143810

SEQ ID NO: 454629 - RNA, 64 nt, hsa; identical to SEQ ID NO: 143811

SEQ ID NO: 454630 - RNA, 64 nt, hsa; identical to SEQ ID NO: 143812

SEQ ID NO: 454631 - RNA, 64 nt, hsa; identical to SEQ ID NO: 307517

SEQ ID NO: 454632 - RNA, 64 nt, hsa; identical to SEQ ID NO: 307518

SEQ ID NO: 454633 - RNA, 64 nt, hsa; identical to SEQ ID NO: 307519

SEQ ID NO: 454634 - RNA, 64 nt, hsa; identical to SEQ ID NO: 307520

SEQ ID NO: 454635 - RNA, 64 nt, hsa; identical to SEQ ID NO: 307521

SEQ ID NO: 454636 - RNA, 64 nt, hsa; identical to SEQ ID NO: 307522

SEQ ID NO: 454637 - RNA, 64 nt, hsa; identical to SEQ ID NO: 307523

SEQ ID NO: 454638 - RNA, 64 nt, hsa; identical to SEQ ID NO: 326636

SEQ ID NO: 454639 - RNA, 64 nt, hsa; identical to SEQ ID NO: 326637

SEQ ID NO: 454640 - RNA, 64 nt, hsa; identical to SEQ ID NO: 326638

SEQ ID NO: 454641 - RNA, 64 nt, hsa; identical to SEQ ID NO: 326639

SEQ ID NO: 454642 - RNA, 64 nt, hsa; identical to SEQ ID NO: 326640

SEQ ID NO: 454643 - RNA, 64 nt, hsa
uggcaaagacuuacugguugguguucuugauaagggaagugagacaaaggagaagaaauuacuc

SEQ ID NO: 454644 - RNA, 64 nt, hsa
auguccagcugcuccaucgauauacucauagaauggaagugagcaaaggaaaauuuuaagccag

SEQ ID NO: 454645 - RNA, 64 nt, hsa
caaaugcuuaaauauauaauacauuuuuuuccauggaagugagggaauauuucaguuuccugaa

SEQ ID NO: 454646 - RNA, 64 nt, hsa
ugagcacaauggugggcccucucuagacacauacggaagugauggccucaguagaagagacgca

SEQ ID NO: 454647 - RNA, 64 nt, hsa
gagugcagccucugcccggccgccaccccgucugggaagugaggagcgucucugccuggcugcc

SEQ ID NO: 454648 - RNA, 64 nt, hsa
gaggagcgucucugcccggccgccaucccaucuaggaagugaggagcgccucuucccacccgcc

SEQ ID NO: 454649 - RNA, 64 nt, hsa
gaggagcgccucuucccacccgccaucccaucuaggaagugaggagcuucucugccuggccgcc

SEQ ID NO: 454650 - RNA, 64 nt, hsa
gaggagccccucugcccagcagccacccugucugggaagugaggagcgucuccgcccggcagcc

SEQ ID NO: 454651 - RNA, 64 nt, hsa
ggugaggggcgccucugcccagcugccccuacugggaagugaggagccccucugccccgccagc

SEQ ID NO: 454652 - RNA, 64 nt, hsa
ggcgaggggcgccucugcccggcugccccuacugggaagugaggagccccucugcccggccagc

SEQ ID NO: 454653 - RNA, 64 nt, hsa
gguuaggggcgccucugcccggccgccccuacugggaagugaggagccccucugcccggccacc

SEQ ID NO: 454654 - RNA, 64 nt, hsa
ggaggacaugcaccaaggcuugccagagccaacaggaagugagcccagagcauggcacaugagc

SEQ ID NO: 454655 - RNA, 64 nt, hsa
uguaucuguuuuuaauuuucauucuucacuuaggggaagugaaaucgcucagagaugagauccu

SEQ ID NO: 454656 - RNA, 64 nt, hsa
gcuauuaaaacuacuguucauuuugggggcugggggaagugagccuguuuggaugauggaugcc

SEQ ID NO: 454657 - RNA, 64 nt, hsa
aaauguagugccuuuaaaggaaaaaugaacacagggaagugacuuugcuacaaauaauguugcu

SEQ ID NO: 454658 - RNA, 64 nt, hsa
augcagaaguuggguagagagguuaagaagaggaggaagugagacggggaagggaggagcaccu

SEQ ID NO: 454659 - RNA, 64 nt, hsa
ccuucccagagcaagcaggcugcauuuuagcuauggaagugaccugcugugacacugugcucuc

SEQ ID NO: 454660 - RNA, 64 nt, hsa
augccaccaaggcucgguccagcccaguaccgcuggaagugaauaaacuccggagggucggacg

SEQ ID NO: 454661 - RNA, 64 nt, hsa
uccacauagggagggcuuagagcucacagccuugggaagugagacuagaagaggggagcagaaa

SEQ ID NO: 454662 - RNA, 64 nt, hsa
gaggagcgccucugcccggccgccaucccaucuaggaagugaggagcgccucuucccagccgcc

SEQ ID NO: 454663 - RNA, 64 nt, hsa
gaggagcgccucuucccagccgccaucccaucuaggaagugaggagcgucucugcccggccgcc

SEQ ID NO: 454664 - RNA, 64 nt, hsa
gaggagccccuccgcccggcagccaccccaucugggaagugaggagcgucuacgcccgggcagc

SEQ ID NO: 454665 - RNA, 64 nt, hsa
cugcccggccgccccugcccggccgccccuacugggaagugaggagccccucugccuggccacc

SEQ ID NO: 454666 - RNA, 64 nt, hsa
ugggagcuguuccuggacagccuucuacugccugggaagugauggaacaggaacucagggugcc

SEQ ID NO: 454667 - RNA, 64 nt, hsa
gugccucucagaaacgcggccagaagacaagcagggaagugaaaggucccaggcacacacccug

SEQ ID NO: 454668 - RNA, 64 nt, hsa
uaaagauguagcucuggcccagugggaaaaauuaggaagugauuauaaaucgagaggaguuaua

SEQ ID NO: 454669 - RNA, 64 nt, hsa
gucugaguaagaaacagaauccucuggaacuugaggaagugaacauuucggugacuuccgcauc

SEQ ID NO: 454670 - RNA, 64 nt, hsa; identical to SEQ ID NO: 168507

SEQ ID NO: 454671 - RNA, 64 nt, hsa; identical to SEQ ID NO: 168508

SEQ ID NO: 454672 - RNA, 64 nt, hsa; identical to SEQ ID NO: 168509

SEQ ID NO: 454673 - RNA, 64 nt, hsa; identical to SEQ ID NO: 168510

SEQ ID NO: 454674 - RNA, 64 nt, hsa; identical to SEQ ID NO: 168511

SEQ ID NO: 454675 - RNA, 64 nt, hsa; identical to SEQ ID NO: 168512

SEQ ID NO: 454676 - RNA, 64 nt, hsa; identical to SEQ ID NO: 168513

SEQ ID NO: 454677 - RNA, 64 nt, hsa; identical to SEQ ID NO: 168514

SEQ ID NO: 454678 - RNA, 64 nt, hsa; identical to SEQ ID NO: 168515

SEQ ID NO: 454679 - RNA, 64 nt, hsa; identical to SEQ ID NO: 168516

SEQ ID NO: 454680 - RNA, 64 nt, hsa; identical to SEQ ID NO: 168517

SEQ ID NO: 454681 - RNA, 64 nt, hsa; identical to SEQ ID NO: 168518

SEQ ID NO: 454682 - RNA, 64 nt, hsa; identical to SEQ ID NO: 168519

SEQ ID NO: 454683 - RNA, 64 nt, hsa; identical to SEQ ID NO: 168520

SEQ ID NO: 454684 - RNA, 64 nt, hsa; identical to SEQ ID NO: 168521

SEQ ID NO: 454685 - RNA, 64 nt, hsa; identical to SEQ ID NO: 168522

SEQ ID NO: 454686 - RNA, 64 nt, hsa; identical to SEQ ID NO: 168523

SEQ ID NO: 454687 - RNA, 64 nt, hsa; identical to SEQ ID NO: 168524

SEQ ID NO: 454688 - RNA, 64 nt, hsa; identical to SEQ ID NO: 168525

SEQ ID NO: 454689 - RNA, 64 nt, hsa; identical to SEQ ID NO: 168526

SEQ ID NO: 454690 - RNA, 64 nt, hsa; identical to SEQ ID NO: 168527

SEQ ID NO: 454691 - RNA, 64 nt, hsa; identical to SEQ ID NO: 168528

SEQ ID NO: 454692 - RNA, 64 nt, hsa; identical to SEQ ID NO: 168529

SEQ ID NO: 454693 - RNA, 64 nt, hsa; identical to SEQ ID NO: 168530

SEQ ID NO: 454694 - RNA, 64 nt, hsa; identical to SEQ ID NO: 168531

SEQ ID NO: 454695 - RNA, 64 nt, hsa; identical to SEQ ID NO: 168532

SEQ ID NO: 454696 - RNA, 64 nt, hsa; identical to SEQ ID NO: 168533

SEQ ID NO: 454697 - RNA, 64 nt, hsa; identical to SEQ ID NO: 307377

SEQ ID NO: 454698 - RNA, 64 nt, hsa; identical to SEQ ID NO: 307378

SEQ ID NO: 454699 - RNA, 64 nt, hsa; identical to SEQ ID NO: 307379

SEQ ID NO: 454700 - RNA, 64 nt, hsa; identical to SEQ ID NO: 307380

SEQ ID NO: 454701 - RNA, 64 nt, hsa; identical to SEQ ID NO: 307381

SEQ ID NO: 454702 - RNA, 64 nt, hsa; identical to SEQ ID NO: 307382

SEQ ID NO: 454703 - RNA, 64 nt, hsa; identical to SEQ ID NO: 254469

SEQ ID NO: 454704 - RNA, 64 nt, hsa; identical to SEQ ID NO: 254470

SEQ ID NO: 454705 - RNA, 64 nt, hsa; identical to SEQ ID NO: 254471

SEQ ID NO: 454706 - RNA, 64 nt, hsa; identical to SEQ ID NO: 254472

SEQ ID NO: 454707 - RNA, 64 nt, hsa; identical to SEQ ID NO: 254473

SEQ ID NO: 454708 - RNA, 64 nt, hsa; identical to SEQ ID NO: 254474

SEQ ID NO: 454709 - RNA, 64 nt, hsa; identical to SEQ ID NO: 254475

SEQ ID NO: 454710 - RNA, 64 nt, hsa; identical to SEQ ID NO: 254476

SEQ ID NO: 454711 - RNA, 64 nt, hsa; identical to SEQ ID NO: 254477

SEQ ID NO: 454712 - RNA, 64 nt, hsa; identical to SEQ ID NO: 254478

SEQ ID NO: 454713 - RNA, 64 nt, hsa; identical to SEQ ID NO: 254479

SEQ ID NO: 454714 - RNA, 64 nt, hsa; identical to SEQ ID NO: 254480

SEQ ID NO: 454715 - RNA, 64 nt, hsa; identical to SEQ ID NO: 254481

SEQ ID NO: 454716 - RNA, 64 nt, hsa; identical to SEQ ID NO: 254482

SEQ ID NO: 454717 - RNA, 64 nt, hsa; identical to SEQ ID NO: 254483

SEQ ID NO: 454718 - RNA, 64 nt, hsa; identical to SEQ ID NO: 254484

SEQ ID NO: 454719 - RNA, 64 nt, hsa; identical to SEQ ID NO: 254485

SEQ ID NO: 454720 - RNA, 64 nt, hsa; identical to SEQ ID NO: 254486

SEQ ID NO: 454721 - RNA, 64 nt, hsa; identical to SEQ ID NO: 254487

SEQ ID NO: 454722 - RNA, 64 nt, hsa; identical to SEQ ID NO: 254488

SEQ ID NO: 454723 - RNA, 64 nt, hsa; identical to SEQ ID NO: 254489

SEQ ID NO: 454724 - RNA, 51 nt, hsa; identical to SEQ ID NO: 254490

SEQ ID NO: 454725 - RNA, 64 nt, hsa; identical to SEQ ID NO: 254491

SEQ ID NO: 454726 - RNA, 64 nt, hsa; identical to SEQ ID NO: 254492

SEQ ID NO: 454727 - RNA, 64 nt, hsa; identical to SEQ ID NO: 254493

SEQ ID NO: 454728 - RNA, 64 nt, hsa; identical to SEQ ID NO: 254494

SEQ ID NO: 454729 - RNA, 64 nt, hsa; identical to SEQ ID NO: 254495

SEQ ID NO: 454730 - RNA, 64 nt, hsa; identical to SEQ ID NO: 254496

SEQ ID NO: 454731 - RNA, 64 nt, hsa; identical to SEQ ID NO: 254497

SEQ ID NO: 454732 - RNA, 64 nt, hsa; identical to SEQ ID NO: 254498

SEQ ID NO: 454733 - RNA, 64 nt, hsa; identical to SEQ ID NO: 254499

SEQ ID NO: 454734 - RNA, 64 nt, hsa; identical to SEQ ID NO: 254500

SEQ ID NO: 454735 - RNA, 64 nt, hsa; identical to SEQ ID NO: 254501

SEQ ID NO: 454736 - RNA, 64 nt, hsa; identical to SEQ ID NO: 254502

SEQ ID NO: 454737 - RNA, 64 nt, hsa; identical to SEQ ID NO: 254503

SEQ ID NO: 454738 - RNA, 64 nt, hsa; identical to SEQ ID NO: 254504

SEQ ID NO: 454739 - RNA, 64 nt, hsa; identical to SEQ ID NO: 254505

SEQ ID NO: 454740 - RNA, 64 nt, hsa; identical to SEQ ID NO: 254506

SEQ ID NO: 454741 - RNA, 64 nt, hsa; identical to SEQ ID NO: 254507

SEQ ID NO: 454742 - RNA, 64 nt, hsa; identical to SEQ ID NO: 254508

SEQ ID NO: 454743 - RNA, 64 nt, hsa; identical to SEQ ID NO: 254509

SEQ ID NO: 454744 - RNA, 64 nt, hsa; identical to SEQ ID NO: 254510

SEQ ID NO: 454745 - RNA, 64 nt, hsa; identical to SEQ ID NO: 254511

SEQ ID NO: 454746 - RNA, 64 nt, hsa; identical to SEQ ID NO: 254512

SEQ ID NO: 454747 - RNA, 64 nt, hsa; identical to SEQ ID NO: 254513

SEQ ID NO: 454748 - RNA, 64 nt, hsa; identical to SEQ ID NO: 254514

SEQ ID NO: 454749 - RNA, 64 nt, hsa; identical to SEQ ID NO: 254515

SEQ ID NO: 454750 - RNA, 64 nt, hsa; identical to SEQ ID NO: 254516

SEQ ID NO: 454751 - RNA, 64 nt, hsa; identical to SEQ ID NO: 254517

SEQ ID NO: 454752 - RNA, 64 nt, hsa; identical to SEQ ID NO: 254518

SEQ ID NO: 454753 - RNA, 64 nt, hsa; identical to SEQ ID NO: 254519

SEQ ID NO: 454754 - RNA, 64 nt, hsa; identical to SEQ ID NO: 254520

SEQ ID NO: 454755 - RNA, 64 nt, hsa; identical to SEQ ID NO: 254521

SEQ ID NO: 454756 - RNA, 64 nt, hsa; identical to SEQ ID NO: 254522

SEQ ID NO: 454757 - RNA, 64 nt, hsa
cccaccucucugcagaggcaaagucuacuuucugguaccucaaagaaaucauuguucaaucuuc

SEQ ID NO: 454758 - RNA, 64 nt, hsa
ggccuagucugcauuuguuugcauauaugagaggguaccucaaauacuucuguuauguaucugu

SEQ ID NO: 454759 - RNA, 64 nt, hsa
gucugucagacaaaaaggccuuaugucaccacugguaccucaguuuccucaucccauuuacagu

SEQ ID NO: 454760 - RNA, 64 nt, hsa
gauggagggcuuggcccagcgccaaguaaacaggguaccucaagccccauuuccucacacuaag

SEQ ID NO: 454761 - RNA, 64 nt, hsa
aauggauacacagagguugcagcagaugguguggguaccucacccagauaucauccaggcccaa

SEQ ID NO: 454762 - RNA, 64 nt, hsa
ggacauggaaaugagaauagguuaaauggugcagguaccucauagccagcucuacacagagguc

SEQ ID NO: 454763 - RNA, 64 nt, hsa
cacagcacagggagaaaaacugagguacacagagguaccucagaagcucuggaugucuuugggg

SEQ ID NO: 454764 - RNA, 64 nt, hsa
ucacagaugaagaaacagagccucagagagauuaguaccucacuugcaaaguuaggaaaugggg

SEQ ID NO: 454765 - RNA, 58 nt, hsa
auuauguuagcaccaugugauggggcccguaccucacagucucaugcucgguaccauc

SEQ ID NO: 454766 - RNA, 64 nt, hsa
gcaaccagccaauccugcugucucaaggguauccguaccucaaugucaguuacauucagcagaa

SEQ ID NO: 454767 - RNA, 64 nt, hsa
gaaugguccucugggagggcugugcugcuaguggguaccucagucacacacccccaaccccagg

SEQ ID NO: 454768 - RNA, 64 nt, hsa
aucaaggacaaccaaaauccuuuuguuaguuucaguaccucagcuaucaacauuucugagcuac

SEQ ID NO: 454769 - RNA, 64 nt, hsa
aaccuuucucucugggggcuguaccaaaggcaugguaccucagucugguauccagacugugaaa

SEQ ID NO: 454770 - RNA, 64 nt, hsa
cagaacucuuuuggcauaaauauuuguguucccaguaccucacuuguucggauuugacugccug

SEQ ID NO: 454771 - RNA, 64 nt, hsa
uuuaucuggagcuggaaagaaaaauucuuuuucuguaccucaugccuaucugguaauguuuaau

SEQ ID NO: 454772 - RNA, 64 nt, hsa
uaaauggguggguguuucugcacauaccucugcaguaccucaccagggagcauuccaguaucau

SEQ ID NO: 454773 - RNA, 64 nt, hsa
gggccugaggccucaguggggguagggcaaggagguaccucacaggugggugugaggcccccuc

SEQ ID NO: 454774 - RNA, 64 nt, hsa
uaauaauuauuagaaauacauuuaaaaacaucgaguaccucaagucaguuugccuugaaaaaua

SEQ ID NO: 454775 - RNA, 64 nt, hsa
ucgucugguuccucaacccucucaaguccaucaaguaccucaucugcacccgguacaaguggcu

SEQ ID NO: 454776 - RNA, 64 nt, hsa
ccuagaauccuucgaucucgcuucaggaagaaaaguaccucauccucggccaccgaaaccacgu

SEQ ID NO: 454777 - RNA, 64 nt, hsa
ggacuagagccgggauacuuucagaugcucgccuguaccucaccaggcagaguaaauaucuacu

SEQ ID NO: 454778 - RNA, 64 nt, hsa
guguguguuugugcgugcacccuacacaugugugguaccucacugcugcuguuuagggaacuug

SEQ ID NO: 454779 - RNA, 64 nt, hsa
aauuuuuaagagcauccggccaaaugcaaaauuaguaccucaaaguaaaaauugaacuguaaac

SEQ ID NO: 454780 - RNA, 64 nt, hsa
caaauucugauauacauugcuugaaaaugagugaguaccucagagaaauuugauagacucaaac

SEQ ID NO: 454781 - RNA, 64 nt, hsa
auucacauaucugcuuaucagugugcaauacuguguaccucauggaugcuuuggcaaugcccaa

SEQ ID NO: 454782 - RNA, 64 nt, hsa
ugauuuuccauauuaaaaaauuuucauuuauuuuguaccucauucacaugaauaguaaugugac

SEQ ID NO: 454783 - RNA, 64 nt, hsa
uuaagcuaagacauguaaaaaaucccaaauggcaguaccucauuguuuacuuagcuuuuguacu

SEQ ID NO: 454784 - RNA, 64 nt, hsa
aaaugugucuguguuucucuuuacauuccuuguuguaccucauuguucaauucacuuuuguaaa

SEQ ID NO: 454785 - RNA, 64 nt, hsa
caaaaagcacaacuaauaaauugaauguuuccauguaccucacuuuauuucaguuaacaagaua

SEQ ID NO: 454786 - RNA, 64 nt, hsa
gaucugcaugaccuauaaucuuugaaccacuuucguaccucauguuuuuauccagcacucuuau

SEQ ID NO: 454787 - RNA, 64 nt, hsa
auuggauuauuuauaugaaguccauaauguucgaguaccucagggacauuuaagaguuggaggu

SEQ ID NO: 454788 - RNA, 64 nt, hsa
aaauggugcaccugcuuugaaaaacaguuuggcaguaccucaaaaaguuaaacguagagugacc

SEQ ID NO: 454789 - RNA, 64 nt, hsa
ugggaaggacuuggagagaguuaagaaacaccugguaccucaaagaugacucaucuacagguug

SEQ ID NO: 454790 - RNA, 64 nt, hsa
cuucccacccagguaaccccgugggaacgugccaguaccucaccgcacgaccucacugaguccu

SEQ ID NO: 454791 - RNA, 64 nt, hsa
cauuacuuuuuaacuuauaugugaaaugauucauguaccucacaaaaucaugcaaucuugcagu

SEQ ID NO: 454792 - RNA, 64 nt, hsa
cuaccuuaguauggucugcauucuuuuucugagaguaccucauagggcuccugccugaucuuug

SEQ ID NO: 454793 - RNA, 64 nt, hsa
uugccacuuuuguccuuauguuucccuagaacacguaccucagagacuuugguaucagucacca

SEQ ID NO: 454794 - RNA, 64 nt, hsa
auuuugucuccauacaaaucugaaccccaaguguguaccucauucuucccuuaucacugaaggc

SEQ ID NO: 454795 - RNA, 64 nt, hsa
agucacucuguuccuugacugucuuuguguuucuguaccucaaggcacugaagcuggaggacuc

SEQ ID NO: 454796 - RNA, 64 nt, hsa
ccucauugcuacaguacaaguaacacaagucguuguaccucaguugugaccuucagcagauuuu

SEQ ID NO: 454797 - RNA, 64 nt, hsa
ucaaaaucuuggucaucuguuuggaugagggaaaguaccucaugaguugcacauuacuucuaca

SEQ ID NO: 454798 - RNA, 64 nt, hsa
gaguuagcugucuagcgccuagcaaggugccuuuguaccucagguguuuuaggugugagauguu

SEQ ID NO: 454799 - RNA, 64 nt, hsa
uuacacauugcaugccuguaucaaaacaucucacguaccucauaaacaaauacaccuauguacc

SEQ ID NO: 454800 - RNA, 64 nt, hsa
uucagcccccagccccucccccaucucccacccuguaccucaucccaugagacccuggugccug

SEQ ID NO: 454801 - RNA, 64 nt, hsa
ccugccccaggaacauggcagaagcacagguucuguaccucagauggacuccugcugggccuuc

SEQ ID NO: 454802 - RNA, 64 nt, hsa
uccugagccucccugugacgcucuggccuucucuguaccucagagugcagaaccacagacggcu

SEQ ID NO: 454803 - RNA, 64 nt, hsa
ugcaaccucugccucccagguucaagcacuucucguaccucagacucccgaauagcugggauua

SEQ ID NO: 454804 - RNA, 64 nt, hsa
gagccagugauggggcaggaccgaugccagccggguaccucaguuucuccuuuauugcucccgu

SEQ ID NO: 454805 - RNA, 64 nt, hsa
auuuuuaguauuuagauugugccucaaaguuguaguaccucacaauaccuccacugguuuccug

SEQ ID NO: 454806 - RNA, 64 nt, hsa
cucacauuuuuuguuuccauuaguaauauucuagguaccucacaaaauguauuauggugccaug

SEQ ID NO: 454807 - RNA, 64 nt, hsa
uucaugggaaauggcccuucauuuaaaaaaagauguaccucacuacccacuacaaauuuggaac

SEQ ID NO: 454808 - RNA, 64 nt, hsa
ugaaaugaagcaacagagaggaaauuguacauaaguaccucagcauuuaauccaaacagggguu

SEQ ID NO: 454809 - RNA, 64 nt, hsa
aguaaaagaauuccuuagcaugaugucuguuuugguaccucagcaaugaaccuuuucuagaaau

SEQ ID NO: 454810 - RNA, 64 nt, hsa
aggaccccggggggauggcccaggccugcgaggaguaccucagccagauccacaguugccaaac

SEQ ID NO: 454811 - RNA, 64 nt, hsa
cccuggaacuggagaaagaguuucuguucaacauguaccucaccagggaccgcagguacgaggu

SEQ ID NO: 454812 - RNA, 64 nt, hsa
uuuaaaauuuuuaagaacuugauccauuguaucaguaccucacaaucagaguuggcaaaugaug

SEQ ID NO: 454813 - RNA, 64 nt, hsa
uagaggcuccuccucugcuggcuuagggucagaaguaccucacagugguuguggacauggaaga

SEQ ID NO: 454814 - RNA, 64 nt, hsa
aagcuuuuuauuacuugcuauagguuuagggaguguaccucagauagauuuuaaaaaaaagaau

SEQ ID NO: 454815 - RNA, 64 nt, hsa
aaaauauuaagaccaagucaugcaauaauugaauguaccucaaauuuuuaggggaggguggguu

SEQ ID NO: 454816 - RNA, 64 nt, hsa
ggugagguggcaugggagaugucugugcuuggagguaccucagagagguaacccaggggucagc

SEQ ID NO: 454817 - RNA, 64 nt, hsa
ugcaaccucugccuccuaaguucaaacgauucuuguaccucagccugcugaguagcugguauac

SEQ ID NO: 454818 - RNA, 64 nt, hsa
uaccacuuaaugaaucucaaaauuuugaguaaauguaccucagucuaaucagacuuuuuaugac

SEQ ID NO: 454819 - RNA, 64 nt, hsa
uuguauuuauaccucagauauucuuuuggguuuuguaccucaaggcuuuuuucuucuuauugua

SEQ ID NO: 454820 - RNA, 64 nt, hsa
cgucucuuuuucauacauugcauguaaguuguuaguaccucacaagcuacagaaguucagccau

SEQ ID NO: 454821 - RNA, 64 nt, hsa
cucuuagaauaccuauaaaaagauguaaacuaauguaccucaguaauuaaauaugcugucacaa

SEQ ID NO: 454822 - RNA, 64 nt, hsa
uccagagaccuuggguuagguauauccaucuucaguaccucauuggaucacuuuucuuucauca

SEQ ID NO: 454823 - RNA, 64 nt, hsa
uugggggccauccugccccuccaacccgacauguguaccucagcuuuuucccucacuugcauca

SEQ ID NO: 454824 - RNA, 64 nt, hsa; identical to SEQ ID NO: 454823

SEQ ID NO: 454825 - RNA, 64 nt, hsa
uguuucuguuguuauuauuccuguaggauuuauuguaccucacaguauuuauuguuucccaaaa

SEQ ID NO: 454826 - RNA, 64 nt, hsa
gcuuggaugagucagcugggaauauuguucuuguguaccucauugcuuuagcuggucacuugga

SEQ ID NO: 454827 - RNA, 64 nt, hsa
accucugugcagcccggaaggcugauguacagguguaccucaauccacauuacagccaugcucc

SEQ ID NO: 454828 - RNA, 64 nt, hsa
gugcccaggaugccauccaccaugguccccuucaguaccucacgcaugguccccagcuucuccu

SEQ ID NO: 454829 - RNA, 64 nt, hsa
gaaaaaaaaaaaagaaaccaguucugugaaaacgguaccucauuucuggaaaauaacuuauacc

SEQ ID NO: 454830 - RNA, 64 nt, hsa
gugccguggccaaguacaugggugcagcggccauguaccucaucagcaagcgacucaagagcag

SEQ ID NO: 454831 - RNA, 64 nt, hsa
uacauacauucauacuguagaaaccagcucauguguaccucauaucccauccuuaagagaagaa

SEQ ID NO: 454832 - RNA, 64 nt, hsa
cugggccagagcuggguuaucaugguuggcuuagguaccucagguggcccaggagguccccccu

SEQ ID NO: 454833 - RNA, 64 nt, hsa
cugaaggcaaagccucuaugugugaaacacagggguaccucaaaaauagaacaagagcacucca

SEQ ID NO: 454834 - RNA, 64 nt, hsa
acacuuuacuguuucgaugcuaauaaugcacccgguaccucaauucaacugcuacaaauaaaug

SEQ ID NO: 454835 - RNA, 64 nt, hsa
uaucuuaaaaaucuuaugcagaaauuugcauuuuguaccucaauauuucuacgucaugugccuu

SEQ ID NO: 454836 - RNA, 64 nt, hsa
ucuacaccacacucagacuucuggaaaguuuucuguaccucauucuuuagucccugucaagguu

SEQ ID NO: 454837 - RNA, 64 nt, hsa
uuuuuauuuuuaaugucuugacucuucagaguucguaccucaaaagaacaaugagaacauuugc

SEQ ID NO: 454838 - RNA, 64 nt, hsa
cugggagaacuauggcagcuacuugcaucgacuuguaccucacuuagcccuugggggcgucgug

SEQ ID NO: 454839 - RNA, 64 nt, hsa
caggaggaggcugcccugaggggcuggggaggggguaccucaugaggaccaggguggagcugag

SEQ ID NO: 454840 - RNA, 64 nt, hsa
uggccugggagucccucccugguuuuuauucucaguaccucaggcuccccuguguacuuggagg

SEQ ID NO: 454841 - RNA, 64 nt, hsa
guccuuggaggaaacuuaagaugaauacaugcguguaccucacuuuacauaagaaauguauucc

SEQ ID NO: 454842 - RNA, 64 nt, hsa
cauaaccaggucagaaauuuuauucagauaaucuguaccucaucaaucagaugaugacaauuua

SEQ ID NO: 454843 - RNA, 64 nt, hsa
cgggagguacagcuggcagagggaaaggcacuggguaccucagggugagcagagggcacugggc

SEQ ID NO: 454844 - RNA, 64 nt, hsa
uuccccaccccccccaccacgugcucaaucaugaguaccucaaaggauuguugggcuuggggga

SEQ ID NO: 454845 - RNA, 64 nt, hsa
agggggcuugcuugguaugcuuaccugggcuuguguaccucagugguuuuuguguacuuuuuuc

SEQ ID NO: 454846 - RNA, 64 nt, hsa
cauggggggagccugggccuaauaggcacccccuguaccucaggcuguggcgggagcagagucc

SEQ ID NO: 454847 - RNA, 64 nt, hsa
uuuugauuagccuucugaccaugauuaaaaugguguaccucaaaguagcugcuaaccuuaugug

SEQ ID NO: 454848 - RNA, 64 nt, hsa
cagcccguggugaggcugcccgccgugcccugcaguaccucaagaucauggcaggcagcaagug

SEQ ID NO: 454849 - RNA, 64 nt, hsa
ugacuguaauauuuaaauauuacccuccaagucuguaccucaaaugaauucuuuaaggagaugg

SEQ ID NO: 454850 - RNA, 64 nt, hsa
gggccuugccaaggucuaccuuagagcaaacccaguaccucagacaggaaagucggggcuuuga

SEQ ID NO: 454851 - RNA, 64 nt, hsa
uaauucuuuuucaucuauuugcagagcuauuuggguaccucauuuugucccuugacuuuagugu

SEQ ID NO: 454852 - RNA, 64 nt, hsa
aagcauguuuaacuggaaguugagagucugcuuuguaccucaagaguuacaugagcauguugug

SEQ ID NO: 454853 - RNA, 64 nt, hsa
auuaaugccccucucuuacagaacacuccuauuuguaccucaacaaaugcaaauuuuccccguu

SEQ ID NO: 454854 - RNA, 64 nt, hsa
guuaacagcaacgaacccuagaaauauauccuguguaccucacuguccaauaugaaaaccguaa

SEQ ID NO: 454855 - RNA, 64 nt, hsa
gaagccacacuguuugcauggguguuacuugucuguaccucagagucugaggauguuaacuuug

SEQ ID NO: 454856 - RNA, 64 nt, hsa
uguuuguaaacaugaauguucaggaacuacugauguaccucaaaaguuuguuuuauuaauugua

SEQ ID NO: 454857 - RNA, 64 nt, hsa
gagugagcaagagcaagagcgcauggcuccugcuguaccucaaggugugggcuccugguggcug

SEQ ID NO: 454858 - RNA, 64 nt, hsa
uaaguuuuguuaacugugucaucaacuuauccuaguaccucaguguucauuccuguuaccugca

SEQ ID NO: 454859 - RNA, 64 nt, hsa
ugucaucagugacugccauagcaacagcagcucuguaccucaucuguugaucccaccuuugaag

SEQ ID NO: 454860 - RNA, 64 nt, hsa
gaguaaugaaugaggcauauucuccucccaccuuguaccucagccagcagaacaucgcugggac

SEQ ID NO: 454861 - RNA, 64 nt, hsa
gagagaguuuuaacaauccauucacaagccuccuguaccucaguggaucuucagaacugcccuu

SEQ ID NO: 454862 - RNA, 64 nt, hsa
ugucagagacucauguuuaauacauaggugauuuguaccucagaguauuuuuuaaaggauucuu

SEQ ID NO: 454863 - RNA, 64 nt, hsa
gcugccaacccucccgggucacuuuuguucccagguaccucaugggaagcauguggaugacaca

SEQ ID NO: 454864 - RNA, 64 nt, hsa
uggccaccucccgggcuguccgagggaccccaggguaccucacacucggagcucgccugcccug

SEQ ID NO: 454865 - RNA, 64 nt, hsa
gugaaucugccugauccccuggcauuuggucagaguaccucagagcaccccacugcucaggggc

SEQ ID NO: 454866 - RNA, 64 nt, hsa
cucuuaaguuuuuuguucagcuacuucacacugaguaccucaaaucugcucuggagucgauuau

SEQ ID NO: 454867 - RNA, 64 nt, hsa
uaaucuggaacuuacguucuuauaccaauaaaagguaccucaauacauguucuuucaauuucug

SEQ ID NO: 454868 - RNA, 64 nt, hsa
auuuugucuccauacauaucugaaccccaaguguguaccucauucuucccuuaucacugaagga

SEQ ID NO: 454869 - RNA, 64 nt, hsa
caucaccagcuccuguggccuuguagaugacucuguaccucagugaagagugcaggcaaguaga

SEQ ID NO: 454870 - RNA, 64 nt, hsa
auuccuaacaccucuuguaacuaaaagaaccauaguaccucacaucacagugcugguagaaaug

SEQ ID NO: 454871 - RNA, 64 nt, hsa
ggggggcaggcguaccagacugcaagaccccccaguaccucaccgugccaaauaggaagaggug

SEQ ID NO: 454872 - RNA, 64 nt, hsa
ugacacaggggcccuuuccuugccccuuuagcugguaccucaguggggaggcuuccuuaccaag

SEQ ID NO: 454873 - RNA, 64 nt, hsa
gugagcgcugggaacagaguggagucuccgguguguaccucagacugauggugcccauguguuc

SEQ ID NO: 454874 - RNA, 64 nt, hsa
aacaaaaacccagcacauacaagaaacauacaguguaccucaaaaggggcccuugaaaugucau

SEQ ID NO: 454875 - RNA, 64 nt, hsa
cccaccuaagugaaauggccauccucuaaacuggguaccucacugcacagcuucuagguagccu

SEQ ID NO: 454876 - RNA, 64 nt, hsa
gugcguggcugggggaggccuuuucuuugaggacguaccucauuuccuucuuucuucuggcuuu

SEQ ID NO: 454877 - RNA, 64 nt, hsa
uuagucuuaaccacaguucucacucucuuaaaugguaccucaaaaagcuggagccucucugcca

SEQ ID NO: 454878 - RNA, 64 nt, hsa
ugcuucaagaguuccacuuggcucucccaaauagguaccucaaaaacuguuagcaagcggcauu

SEQ ID NO: 454879 - RNA, 64 nt, hsa
ucugugugauauuagacaaaauauuugcuucuugguaccucagcuguaaaaugaaacacaccua

SEQ ID NO: 454880 - RNA, 64 nt, hsa
uaccaauagauaucuaugaauuugauauauauuuguaccucauauaaguggauucuacaguauu

SEQ ID NO: 454881 - RNA, 64 nt, hsa
caagcaccgcucuguaugaauuuuacuaguccggguaccucauauaagaaaacuuaaguuuugg

SEQ ID NO: 454882 - RNA, 64 nt, hsa
cccaacaccccaaccacaggagcacggauucccuguaccucaacacccagacccugccucccuc

SEQ ID NO: 454883 - RNA, 64 nt, hsa
acauuuuuaguuuuuuuguuuguuuuuaauugcaguaccucacuucucaguaccaauaucugcc

SEQ ID NO: 454884 - RNA, 64 nt, hsa
uaaaggcaaaccucccagcuucuuuagccucuugguaccucacacucucugucccucgcguuau

SEQ ID NO: 454885 - RNA, 64 nt, hsa
auuauuuaugaaggaaaaaauacauaaauaugaaguaccucauguugaauguuauuguacugua

SEQ ID NO: 454886 - RNA, 64 nt, hsa
cccugcucuuccucagcugugugggucauaccguguaccucaguucccucuugcucaguggggg

SEQ ID NO: 454887 - RNA, 64 nt, hsa
guagcauuugaggaaguaagagaaaagaaucaugguaccucaggguuucuuucccuuuacucgc

SEQ ID NO: 454888 - RNA, 64 nt, hsa
ugaggacacugcggggguuggggggggggcgucuguaccucaggggaugccccgcuguggucac

SEQ ID NO: 454889 - RNA, 64 nt, hsa
uuuggcuuacuugguagaagauggcuacuuggauguaccucacuuaaagauguuuuguaccaca

SEQ ID NO: 454890 - RNA, 64 nt, hsa
ggaaggugggacagccggcagguagggacauuguguaccucaguugugucacaugugagcaagc

SEQ ID NO: 454891 - RNA, 64 nt, hsa
ucaauucuuuacaccaaaguaugaacuggagaggguaccucaguuauaaggagucugagaauau

SEQ ID NO: 454892 - RNA, 64 nt, hsa
uguacaccaaaaggccauggggaacuuugugcaaguaccucaucgcugagcaaauggagcuugc

SEQ ID NO: 454893 - RNA, 64 nt, hsa
uaacaugcugacuaguaaccaugaagauucagauguaccucagcaaugcgccagagcaaagucu

SEQ ID NO: 454894 - RNA, 64 nt, hsa
gcaacacuggccccacaguaaaagaggaagucuuguaccucaggcaggcccaucuagagcuauu

SEQ ID NO: 454895 - RNA, 64 nt, hsa
auucaccuugucccuugccugccccucucuauuaguaccucauccuccacucaccguuccuuau

SEQ ID NO: 454896 - RNA, 64 nt, hsa
cucaagaaaucaaaagauaguugauucuugccuuguaccucaaucuauucuguaaaauuaaaca

SEQ ID NO: 454897 - RNA, 64 nt, hsa
aaaaggaacuaacuguugauacaagaacuugguuguaccucagggguauuauggugaacaaaaa

SEQ ID NO: 454898 - RNA, 64 nt, hsa
uuagugggggacugaguucagguuaccagaaccaguaccucaguauucuuuuucaacauguagg

SEQ ID NO: 454899 - RNA, 64 nt, hsa
uacauccaaacaaauucuuuuccacagcuuaagaguaccucaucagaauacagugguucaaguu

SEQ ID NO: 454900 - RNA, 64 nt, hsa; identical to SEQ ID NO: 454896

SEQ ID NO: 454901 - RNA, 64 nt, hsa; identical to SEQ ID NO: 336314

SEQ ID NO: 454902 - RNA, 64 nt, hsa; identical to SEQ ID NO: 336315

SEQ ID NO: 454903 - RNA, 64 nt, hsa; identical to SEQ ID NO: 336316

SEQ ID NO: 454904 - RNA, 64 nt, hsa; identical to SEQ ID NO: 336317

SEQ ID NO: 454905 - RNA, 64 nt, hsa; identical to SEQ ID NO: 336318

SEQ ID NO: 454906 - RNA, 64 nt, hsa; identical to SEQ ID NO: 336319

SEQ ID NO: 454907 - RNA, 64 nt, hsa; identical to SEQ ID NO: 336320

SEQ ID NO: 454908 - RNA, 64 nt, hsa; identical to SEQ ID NO: 336321

SEQ ID NO: 454909 - RNA, 64 nt, hsa; identical to SEQ ID NO: 336322

SEQ ID NO: 454910 - RNA, 64 nt, hsa; identical to SEQ ID NO: 336323

SEQ ID NO: 454911 - RNA, 64 nt, hsa; identical to SEQ ID NO: 336324

SEQ ID NO: 454912 - RNA, 64 nt, hsa; identical to SEQ ID NO: 336325

SEQ ID NO: 454913 - RNA, 64 nt, hsa; identical to SEQ ID NO: 336326

SEQ ID NO: 454914 - RNA, 64 nt, hsa; identical to SEQ ID NO: 336327

SEQ ID NO: 454915 - RNA, 64 nt, hsa; identical to SEQ ID NO: 336328

SEQ ID NO: 454916 - RNA, 64 nt, hsa; identical to SEQ ID NO: 336329

SEQ ID NO: 454917 - RNA, 64 nt, hsa; identical to SEQ ID NO: 336330

SEQ ID NO: 454918 - RNA, 64 nt, hsa; identical to SEQ ID NO: 336331

SEQ ID NO: 454919 - RNA, 64 nt, hsa; identical to SEQ ID NO: 336332

SEQ ID NO: 454920 - RNA, 64 nt, hsa; identical to SEQ ID NO: 336333

SEQ ID NO: 454921 - RNA, 64 nt, hsa
ggaaccucccugggccugucucagauugggauuaacauaaaagaguggaacuauccaaaagaga

SEQ ID NO: 454922 - RNA, 64 nt, hsa
ccccuguacccagccaccuuccugacugggaaggacauaaaagguuuaaugucagggucaaacu

SEQ ID NO: 454923 - RNA, 64 nt, hsa
ucugggaaacaaagcgagacccugucuccacuaaacauaaaaacaaaauuacuggggccccaug

SEQ ID NO: 454924 - RNA, 64 nt, hsa
uggaaaacaguuuggcaguuucucaaaggauuaaacauaaaauuaccauaggauucagcaguuc

SEQ ID NO: 454925 - RNA, 64 nt, hsa
auacauuuauucugcuuaacacaaauuaaaacugacauaaaauuuuaugauaauaacaugauuc

SEQ ID NO: 454926 - RNA, 64 nt, hsa
uacuguuuuaucugggcggugaggguauugauuuacauaaaaacuguagacaaacacaguacga

SEQ ID NO: 454927 - RNA, 64 nt, hsa
accagccugugcaacaucaugaaacaucaucucuacauaaaaaaauacauauauacaaaaauua

SEQ ID NO: 454928 - RNA, 64 nt, hsa
uuuuuuaguaucaaauagugaucuucuuuugcuaacauaaaaaugaguaaacuacagcagagaa

SEQ ID NO: 454929 - RNA, 64 nt, hsa
cagcuagcuuugaaauuggcugaugaaaaaauauacauaaaaggguaaaauucacacauacagc

SEQ ID NO: 454930 - RNA, 64 nt, hsa
auugugcauguuuuguaugucauaguaugucgucacauaaaagggagggagcgaaaaaccauua

SEQ ID NO: 454931 - RNA, 64 nt, hsa
ucagaagaccuaugaaaagaaaguuguaugugccacauaaaacucugaauauaaaaguugcugu

SEQ ID NO: 454932 - RNA, 64 nt, hsa
agcacauaucuaucguaauauauguaauauauugacauaaaagacacaaacuaauauaaaguua

SEQ ID NO: 454933 - RNA, 64 nt, hsa
uugggcaacacagggcgacccccaucucuacaaaacauaaaagauuuuuaaaaaauuagccagg

SEQ ID NO: 454934 - RNA, 64 nt, hsa
acauuguaaauacauuauucuuggauaauucuauacauaaaaguuccuacuuguuaaaaaagau

SEQ ID NO: 454935 - RNA, 64 nt, hsa
auaggaggcacuucuuuucauaaagagaagcuaaacauaaaaaggaauuuuaaauuuaacucuu

SEQ ID NO: 454936 - RNA, 64 nt, hsa
auacauauauacacauaugcauguguguguguaaacauaaaaguccuuuauuauuaaaaaaugu

SEQ ID NO: 454937 - RNA, 64 nt, hsa
aguuaaacuuuguuucucuaauagcuuuuuuuuuacauaaaaaaagacccaggaacuuaauagu

SEQ ID NO: 454938 - RNA, 64 nt, hsa
uauauauuuauguuaaaguaauauuuuauuaucuacauaaaacagaaaugcacaauaccuucau

SEQ ID NO: 454939 - RNA, 64 nt, hsa
gucacuuuaaauguucuaguagcaacuuuuaaaaacauaaaaagaagcaggugaaaauguuaau

SEQ ID NO: 454940 - RNA, 64 nt, hsa
uucaugaagguaaagcuuucuucacuauucuggaacauaaaacuuuauucaguguaauuuaagu

SEQ ID NO: 454941 - RNA, 64 nt, hsa
acuaguauaauuuagucuuuucaugaauguacauacauaaaauuauacauaaaaauauuaaauu

SEQ ID NO: 454942 - RNA, 64 nt, hsa
uagucuuuucaugaauguacauacauaaaauuauacauaaaaauauuaaauuauucauuucaaa

SEQ ID NO: 454943 - RNA, 64 nt, hsa
uuaucauggcuuucuacaguauuucuauuguuuaacauaaaauaguuugccaaagaaguuucug

SEQ ID NO: 454944 - RNA, 64 nt, hsa
gucagcucucauauucuuccagguuuugcacucuacauaaaauuauuucuacaaugucaagacu

SEQ ID NO: 454945 - RNA, 64 nt, hsa
uacaggagaggaccuguggauagacuuaguuuugacauaaaacaaugcccauucaccuccuccu

SEQ ID NO: 454946 - RNA, 64 nt, hsa
auaaagugacuauuaaccagaaaagaaacauuuuacauaaaaugcuaaaauuuauuauaggaaa

SEQ ID NO: 454947 - RNA, 64 nt, hsa
uuauucuacauacucauuugacuggauaaacuuuacauaaaauuaacuaauuuuuuaaauaaau

SEQ ID NO: 454948 - RNA, 64 nt, hsa
uugacuuuuuuuuuuuuuaaagaaaagcauuaagacauaaaauucuuucacuuuggcagaagca

SEQ ID NO: 454949 - RNA, 64 nt, hsa
agaagaugcuggauuaaaagaugucaccuguggaacauaaaaaggacaucagcaaacaggauca

SEQ ID NO: 454950 - RNA, 64 nt, hsa
gaaauugauauuuuuucuggaacugaauucuuaaacauaaaacagauaaaaugcaucuuguuac

SEQ ID NO: 454951 - RNA, 64 nt, hsa
uucuauaaacuguucuuuggaaaaauuaaguuauacauaaaauucauauuaaacuuuuuacaga

SEQ ID NO: 454952 - RNA, 64 nt, hsa
cuccuuuugacuuauuugguauguuguauauauuacauaaaauaacuuuucaaauauaguuuaa

SEQ ID NO: 454953 - RNA, 64 nt, hsa
aggauauuuguuuguauguuuauucaguauacuuacauaaaaauuauuucgccaucagccaaaa

SEQ ID NO: 454954 - RNA, 64 nt, hsa
guauuuaaaacauuucauguauuucuuuagaacaacauaaaauuaaaauuuaacaucugcagug

SEQ ID NO: 454955 - RNA, 64 nt, hsa
agucuuaugaauagacauaaauuguaauuugggaacauaaaaacuacugaauaaaucauguggc

SEQ ID NO: 454956 - RNA, 64 nt, hsa
aagaguaaaugggggaaaaggcaguguuuaauuaacauaaaaacucauuuuuguauuucuugga

SEQ ID NO: 454957 - RNA, 64 nt, hsa
auucuuguguucauguugucauuugaaacucuucacauaaaauuuucuaauauucauuuggaaa

SEQ ID NO: 454958 - RNA, 64 nt, hsa
uacuguuuagcugaguucaguuaauacaaaauguacauaaaacguuaguccuuugagacugaca

SEQ ID NO: 454959 - RNA, 64 nt, hsa
guucuaugcugccaaagauuaaaaauaaauaaaaacauaaaaaauuaagaggggccaagaggaa

SEQ ID NO: 454960 - RNA, 64 nt, hsa
gaugaaaauguugcacauucuauaguugcaaaacacauaaaaggggacuuaacauuucacguug

SEQ ID NO: 454961 - RNA, 64 nt, hsa
ucuuauauccccauauggaauuuauccaucaaccacauaaaaacaaacagugccuucugcccuc

SEQ ID NO: 454962 - RNA, 64 nt, hsa
uuucugcuuuuuaaauacaaaaauacauaaaaauacauaaaaucugaugaugaauauaaaaaag

SEQ ID NO: 454963 - RNA, 64 nt, hsa
auaggaaaguuuucugcuuuuuaaauacaaaaauacauaaaaauacauaaaaucugaugaugaa

SEQ ID NO: 454964 - RNA, 64 nt, hsa
gagacccugucucugcaaaaaaauaaaaacgaauacauaaaaauuagcuguguguggcgucugu

SEQ ID NO: 454965 - RNA, 64 nt, hsa
ugguggagggagaugccuggguccuguucuuccuacauaaaaugcaagaaaacagcauggccag

SEQ ID NO: 454966 - RNA, 64 nt, hsa
gcgguugucagccccuuccuuucccccgaccuaaacauaaaagacaaggcaaagcccgcauaau

SEQ ID NO: 454967 - RNA, 64 nt, hsa
ccugcaccuaggcuaggauaacuuuagagcacugacauaaaacgcaaaaacaggaaucaugccg

SEQ ID NO: 454968 - RNA, 64 nt, hsa
uuuucauccuuacaauccugucccaugguauuuaacauaaaaaaaaauaaaacuguuaacagau

SEQ ID NO: 454969 - RNA, 64 nt, hsa
auugucuuaguuugagagauggcugaaauaaugaacauaaaaugcuauuuauaauaacaaguau

SEQ ID NO: 454970 - RNA, 64 nt, hsa
gaaaagcauugaguucucucagguccuugcauagacauaaaaggacucacuggagagauacucu

SEQ ID NO: 454971 - RNA, 64 nt, hsa
gaaagugaucgauuuuuuuuuaacaccauugucaacauaaaacaacucacagagcagaaaaacu

SEQ ID NO: 454972 - RNA, 64 nt, hsa
acaguaauucugacaacaccucaaacuuuucuaaacauaaaauaaaucauacuggugaggaacu

SEQ ID NO: 454973 - RNA, 64 nt, hsa
gcaaagcauuuaacuggucccuaaaucuuacuaaacauaaaaaaacuuaaacuggagagaaacu

SEQ ID NO: 454974 - RNA, 64 nt, hsa
uuaaaaaaaaaauuagauucuuaaaguguggcaaacauaaaauuugcaagaaaauguagaaauu

SEQ ID NO: 454975 - RNA, 64 nt, hsa
gcaaagccuuuuaccaguccucaacucuuacuaaacauaaaaaaauucauacuggagggaacuc

SEQ ID NO: 454976 - RNA, 64 nt, hsa
cacuguugcaauaaaagcacccguaguagcaaaaacauaaaacaaauaaaacuucccccacauc

SEQ ID NO: 454977 - RNA, 64 nt, hsa
agaggacugaccucuacaguucauauuugcagugacauaaaaggcaaagaggagcuggcauggu

SEQ ID NO: 454978 - RNA, 64 nt, hsa
gugaugcaauaaccagcauaauaaaaaggcaaucacauaaaaaagaguuuagucgucuaaacau

SEQ ID NO: 454979 - RNA, 64 nt, hsa
aagagagaggcugagaaaugcagagaagaauaagacauaaaauagcuccgaccuccaugauccg

SEQ ID NO: 454980 - RNA, 64 nt, hsa
cagauuuaacauaaguaguaaauaacauaaaauaacauaaaacaguauuuuuaggauucaugaa

SEQ ID NO: 454981 - RNA, 64 nt, hsa
uguguuguuccagauuuaacauaaguaguaaauaacauaaaauaacauaaaacaguauuuuuag

SEQ ID NO: 454982 - RNA, 64 nt, hsa
uauucuaaaccuccuaagauauuuaggcuucuguacauaaaaguguuuuugcuaaauuuacagu

SEQ ID NO: 454983 - RNA, 64 nt, hsa
auguucuuuucauagucguauuuugccaccguaaacauaaaaaaaaaaaaaaagauuuccaaaa

SEQ ID NO: 454984 - RNA, 64 nt, hsa
agaauaaguauaaacauaaagcaacuaaaaugaaacauaaaaccuuuuauuuucuucugauuuu

SEQ ID NO: 454985 - RNA, 64 nt, hsa
aaguucuuaaauuaguuauggagacaaagugaaaacauaaaaugugaccauuuaacuuauggcu

SEQ ID NO: 454986 - RNA, 64 nt, hsa; identical to SEQ ID NO: 97018

SEQ ID NO: 454987 - RNA, 64 nt, hsa; identical to SEQ ID NO: 97019

SEQ ID NO: 454988 - RNA, 64 nt, hsa; identical to SEQ ID NO: 97020

SEQ ID NO: 454989 - RNA, 64 nt, hsa; identical to SEQ ID NO: 97021

SEQ ID NO: 454990 - RNA, 64 nt, hsa; identical to SEQ ID NO: 97022

SEQ ID NO: 454991 - RNA, 64 nt, hsa; identical to SEQ ID NO: 97023

SEQ ID NO: 454992 - RNA, 64 nt, hsa; identical to SEQ ID NO: 97024

SEQ ID NO: 454993 - RNA, 64 nt, hsa; identical to SEQ ID NO: 97025

SEQ ID NO: 454994 - RNA, 64 nt, hsa; identical to SEQ ID NO: 97026

SEQ ID NO: 454995 - RNA, 64 nt, hsa; identical to SEQ ID NO: 97027

SEQ ID NO: 454996 - RNA, 64 nt, hsa; identical to SEQ ID NO: 97028

SEQ ID NO: 454997 - RNA, 64 nt, hsa; identical to SEQ ID NO: 124517

SEQ ID NO: 454998 - RNA, 64 nt, hsa; identical to SEQ ID NO: 124518

SEQ ID NO: 454999 - RNA, 63 nt, hsa; identical to SEQ ID NO: 124519

SEQ ID NO: 455000 - RNA, 64 nt, hsa; identical to SEQ ID NO: 124520

SEQ ID NO: 455001 - RNA, 64 nt, hsa; identical to SEQ ID NO: 124521

SEQ ID NO: 455002 - RNA, 64 nt, hsa; identical to SEQ ID NO: 124522

SEQ ID NO: 455003 - RNA, 64 nt, hsa; identical to SEQ ID NO: 124523

SEQ ID NO: 455004 - RNA, 64 nt, hsa; identical to SEQ ID NO: 124524

SEQ ID NO: 455005 - RNA, 64 nt, hsa; identical to SEQ ID NO: 124525

SEQ ID NO: 455006 - RNA, 64 nt, hsa; identical to SEQ ID NO: 124526

SEQ ID NO: 455007 - RNA, 64 nt, hsa; identical to SEQ ID NO: 124527

SEQ ID NO: 455008 - RNA, 64 nt, hsa; identical to SEQ ID NO: 124528

SEQ ID NO: 455009 - RNA, 64 nt, hsa; identical to SEQ ID NO: 124529

SEQ ID NO: 455010 - RNA, 64 nt, hsa; identical to SEQ ID NO: 124530

SEQ ID NO: 455011 - RNA, 64 nt, hsa; identical to SEQ ID NO: 124531

SEQ ID NO: 455012 - RNA, 64 nt, hsa; identical to SEQ ID NO: 124532

SEQ ID NO: 455013 - RNA, 64 nt, hsa; identical to SEQ ID NO: 124533

SEQ ID NO: 455014 - RNA, 64 nt, hsa; identical to SEQ ID NO: 124534

SEQ ID NO: 455015 - RNA, 64 nt, hsa; identical to SEQ ID NO: 124535

SEQ ID NO: 455016 - RNA, 64 nt, hsa; identical to SEQ ID NO: 124536

SEQ ID NO: 455017 - RNA, 64 nt, hsa; identical to SEQ ID NO: 124537

SEQ ID NO: 455018 - RNA, 64 nt, hsa; identical to SEQ ID NO: 124538

SEQ ID NO: 455019 - RNA, 64 nt, hsa; identical to SEQ ID NO: 124539

SEQ ID NO: 455020 - RNA, 64 nt, hsa; identical to SEQ ID NO: 124540

SEQ ID NO: 455021 - RNA, 64 nt, hsa; identical to SEQ ID NO: 124541

SEQ ID NO: 455022 - RNA, 64 nt, hsa; identical to SEQ ID NO: 124542

SEQ ID NO: 455023 - RNA, 64 nt, hsa; identical to SEQ ID NO: 124543

SEQ ID NO: 455024 - RNA, 64 nt, hsa; identical to SEQ ID NO: 124544

SEQ ID NO: 455025 - RNA, 64 nt, hsa; identical to SEQ ID NO: 124545

SEQ ID NO: 455026 - RNA, 64 nt, hsa; identical to SEQ ID NO: 124546

SEQ ID NO: 455027 - RNA, 64 nt, hsa; identical to SEQ ID NO: 124547

SEQ ID NO: 455028 - RNA, 64 nt, hsa; identical to SEQ ID NO: 124548

SEQ ID NO: 455029 - RNA, 64 nt, hsa; identical to SEQ ID NO: 124549

SEQ ID NO: 455030 - RNA, 64 nt, hsa; identical to SEQ ID NO: 124550

SEQ ID NO: 455031 - RNA, 64 nt, hsa; identical to SEQ ID NO: 124551

SEQ ID NO: 455032 - RNA, 64 nt, hsa; identical to SEQ ID NO: 124552

SEQ ID NO: 455033 - RNA, 64 nt, hsa; identical to SEQ ID NO: 124553

SEQ ID NO: 455034 - RNA, 64 nt, hsa; identical to SEQ ID NO: 124554

SEQ ID NO: 455035 - RNA, 64 nt, hsa; identical to SEQ ID NO: 124555

SEQ ID NO: 455036 - RNA, 64 nt, hsa; identical to SEQ ID NO: 124556

SEQ ID NO: 455037 - RNA, 64 nt, hsa; identical to SEQ ID NO: 124557

SEQ ID NO: 455038 - RNA, 64 nt, hsa; identical to SEQ ID NO: 124558

SEQ ID NO: 455039 - RNA, 64 nt, hsa; identical to SEQ ID NO: 124559

SEQ ID NO: 455040 - RNA, 64 nt, hsa; identical to SEQ ID NO: 124560

SEQ ID NO: 455041 - RNA, 64 nt, hsa; identical to SEQ ID NO: 124561

SEQ ID NO: 455042 - RNA, 64 nt, hsa; identical to SEQ ID NO: 124562

SEQ ID NO: 455043 - RNA, 64 nt, hsa; identical to SEQ ID NO: 124563

SEQ ID NO: 455044 - RNA, 64 nt, hsa; identical to SEQ ID NO: 124564

SEQ ID NO: 455045 - RNA, 64 nt, hsa; identical to SEQ ID NO: 124565

SEQ ID NO: 455046 - RNA, 64 nt, hsa; identical to SEQ ID NO: 124566

SEQ ID NO: 455047 - RNA, 64 nt, hsa; identical to SEQ ID NO: 124567

SEQ ID NO: 455048 - RNA, 64 nt, hsa; identical to SEQ ID NO: 124568

SEQ ID NO: 455049 - RNA, 64 nt, hsa; identical to SEQ ID NO: 124569

SEQ ID NO: 455050 - RNA, 64 nt, hsa; identical to SEQ ID NO: 124570

SEQ ID NO: 455051 - RNA, 64 nt, hsa; identical to SEQ ID NO: 124571

SEQ ID NO: 455052 - RNA, 64 nt, hsa; identical to SEQ ID NO: 124572

SEQ ID NO: 455053 - RNA, 64 nt, hsa; identical to SEQ ID NO: 124573

SEQ ID NO: 455054 - RNA, 64 nt, hsa; identical to SEQ ID NO: 124574

SEQ ID NO: 455055 - RNA, 64 nt, hsa; identical to SEQ ID NO: 124575

SEQ ID NO: 455056 - RNA, 64 nt, hsa; identical to SEQ ID NO: 124576

SEQ ID NO: 455057 - RNA, 64 nt, hsa; identical to SEQ ID NO: 124577

SEQ ID NO: 455058 - RNA, 64 nt, hsa; identical to SEQ ID NO: 124578

SEQ ID NO: 455059 - RNA, 64 nt, hsa; identical to SEQ ID NO: 124579

SEQ ID NO: 455060 - RNA, 64 nt, hsa; identical to SEQ ID NO: 124580

SEQ ID NO: 455061 - RNA, 64 nt, hsa; identical to SEQ ID NO: 124581

SEQ ID NO: 455062 - RNA, 64 nt, hsa; identical to SEQ ID NO: 124582

SEQ ID NO: 455063 - RNA, 64 nt, hsa; identical to SEQ ID NO: 124583

SEQ ID NO: 455064 - RNA, 64 nt, hsa; identical to SEQ ID NO: 124584

SEQ ID NO: 455065 - RNA, 64 nt, hsa; identical to SEQ ID NO: 124585

SEQ ID NO: 455066 - RNA, 64 nt, hsa; identical to SEQ ID NO: 124586

SEQ ID NO: 455067 - RNA, 64 nt, hsa; identical to SEQ ID NO: 124587

SEQ ID NO: 455068 - RNA, 64 nt, hsa; identical to SEQ ID NO: 124588

SEQ ID NO: 455069 - RNA, 64 nt, hsa; identical to SEQ ID NO: 124589

SEQ ID NO: 455070 - RNA, 64 nt, hsa; identical to SEQ ID NO: 124590

SEQ ID NO: 455071 - RNA, 64 nt, hsa; identical to SEQ ID NO: 124591

SEQ ID NO: 455072 - RNA, 64 nt, hsa; identical to SEQ ID NO: 124592

SEQ ID NO: 455073 - RNA, 64 nt, hsa; identical to SEQ ID NO: 124593

SEQ ID NO: 455074 - RNA, 64 nt, hsa; identical to SEQ ID NO: 124594

SEQ ID NO: 455075 - RNA, 64 nt, hsa; identical to SEQ ID NO: 124595

SEQ ID NO: 455076 - RNA, 64 nt, hsa; identical to SEQ ID NO: 124596

SEQ ID NO: 455077 - RNA, 64 nt, hsa; identical to SEQ ID NO: 124597

SEQ ID NO: 455078 - RNA, 64 nt, hsa; identical to SEQ ID NO: 124598

SEQ ID NO: 455079 - RNA, 64 nt, hsa; identical to SEQ ID NO: 124599

SEQ ID NO: 455080 - RNA, 64 nt, hsa; identical to SEQ ID NO: 124600

SEQ ID NO: 455081 - RNA, 64 nt, hsa; identical to SEQ ID NO: 124601

SEQ ID NO: 455082 - RNA, 64 nt, hsa; identical to SEQ ID NO: 124602

SEQ ID NO: 455083 - RNA, 64 nt, hsa; identical to SEQ ID NO: 124603

SEQ ID NO: 455084 - RNA, 64 nt, hsa; identical to SEQ ID NO: 124604

SEQ ID NO: 455085 - RNA, 64 nt, hsa; identical to SEQ ID NO: 124605

SEQ ID NO: 455086 - RNA, 64 nt, hsa; identical to SEQ ID NO: 124606

SEQ ID NO: 455087 - RNA, 64 nt, hsa; identical to SEQ ID NO: 124607

SEQ ID NO: 455088 - RNA, 64 nt, hsa; identical to SEQ ID NO: 124608

SEQ ID NO: 455089 - RNA, 64 nt, hsa; identical to SEQ ID NO: 124609

SEQ ID NO: 455090 - RNA, 64 nt, hsa; identical to SEQ ID NO: 124610

SEQ ID NO: 455091 - RNA, 64 nt, hsa; identical to SEQ ID NO: 124611

SEQ ID NO: 455092 - RNA, 64 nt, hsa; identical to SEQ ID NO: 124612

SEQ ID NO: 455093 - RNA, 64 nt, hsa; identical to SEQ ID NO: 124613

SEQ ID NO: 455094 - RNA, 64 nt, hsa; identical to SEQ ID NO: 124614

SEQ ID NO: 455095 - RNA, 58 nt, hsa; identical to SEQ ID NO: 124615

SEQ ID NO: 455096 - RNA, 64 nt, hsa; identical to SEQ ID NO: 124616

SEQ ID NO: 455097 - RNA, 64 nt, hsa; identical to SEQ ID NO: 124617

SEQ ID NO: 455098 - RNA, 64 nt, hsa; identical to SEQ ID NO: 124618

SEQ ID NO: 455099 - RNA, 64 nt, hsa; identical to SEQ ID NO: 124619

SEQ ID NO: 455100 - RNA, 64 nt, hsa; identical to SEQ ID NO: 124620

SEQ ID NO: 455101 - RNA, 64 nt, hsa; identical to SEQ ID NO: 124621

SEQ ID NO: 455102 - RNA, 64 nt, hsa; identical to SEQ ID NO: 124622

SEQ ID NO: 455103 - RNA, 64 nt, hsa; identical to SEQ ID NO: 124623

SEQ ID NO: 455104 - RNA, 64 nt, hsa; identical to SEQ ID NO: 124624

SEQ ID NO: 455105 - RNA, 64 nt, hsa; identical to SEQ ID NO: 124625

SEQ ID NO: 455106 - RNA, 64 nt, hsa; identical to SEQ ID NO: 124626

SEQ ID NO: 455107 - RNA, 64 nt, hsa; identical to SEQ ID NO: 124627

SEQ ID NO: 455108 - RNA, 64 nt, hsa; identical to SEQ ID NO: 124628

SEQ ID NO: 455109 - RNA, 64 nt, hsa; identical to SEQ ID NO: 124629

SEQ ID NO: 455110 - RNA, 64 nt, hsa; identical to SEQ ID NO: 124630

SEQ ID NO: 455111 - RNA, 64 nt, hsa; identical to SEQ ID NO: 124631

SEQ ID NO: 455112 - RNA, 64 nt, hsa; identical to SEQ ID NO: 124632

SEQ ID NO: 455113 - RNA, 64 nt, hsa; identical to SEQ ID NO: 124633

SEQ ID NO: 455114 - RNA, 64 nt, hsa; identical to SEQ ID NO: 124634

SEQ ID NO: 455115 - RNA, 64 nt, hsa; identical to SEQ ID NO: 124635

SEQ ID NO: 455116 - RNA, 64 nt, hsa; identical to SEQ ID NO: 124636

SEQ ID NO: 455117 - RNA, 64 nt, hsa; identical to SEQ ID NO: 124637

SEQ ID NO: 455118 - RNA, 64 nt, hsa; identical to SEQ ID NO: 124638

SEQ ID NO: 455119 - RNA, 64 nt, hsa; identical to SEQ ID NO: 124639

SEQ ID NO: 455120 - RNA, 64 nt, hsa; identical to SEQ ID NO: 124640

SEQ ID NO: 455121 - RNA, 64 nt, hsa; identical to SEQ ID NO: 124641

SEQ ID NO: 455122 - RNA, 64 nt, hsa; identical to SEQ ID NO: 124642

SEQ ID NO: 455123 - RNA, 64 nt, hsa; identical to SEQ ID NO: 124643

SEQ ID NO: 455124 - RNA, 64 nt, hsa; identical to SEQ ID NO: 124644

SEQ ID NO: 455125 - RNA, 64 nt, hsa; identical to SEQ ID NO: 124645

SEQ ID NO: 455126 - RNA, 64 nt, hsa; identical to SEQ ID NO: 124646

SEQ ID NO: 455127 - RNA, 64 nt, hsa; identical to SEQ ID NO: 124647

SEQ ID NO: 455128 - RNA, 64 nt, hsa; identical to SEQ ID NO: 124648

SEQ ID NO: 455129 - RNA, 64 nt, hsa; identical to SEQ ID NO: 124649

SEQ ID NO: 455130 - RNA, 64 nt, hsa; identical to SEQ ID NO: 124650

SEQ ID NO: 455131 - RNA, 64 nt, hsa; identical to SEQ ID NO: 124651

SEQ ID NO: 455132 - RNA, 64 nt, hsa; identical to SEQ ID NO: 124652

SEQ ID NO: 455133 - RNA, 64 nt, hsa; identical to SEQ ID NO: 124653

SEQ ID NO: 455134 - RNA, 64 nt, hsa; identical to SEQ ID NO: 124654

SEQ ID NO: 455135 - RNA, 64 nt, hsa; identical to SEQ ID NO: 124655

SEQ ID NO: 455136 - RNA, 64 nt, hsa; identical to SEQ ID NO: 124656

SEQ ID NO: 455137 - RNA, 64 nt, hsa; identical to SEQ ID NO: 124657

SEQ ID NO: 455138 - RNA, 64 nt, hsa; identical to SEQ ID NO: 124658

SEQ ID NO: 455139 - RNA, 64 nt, hsa; identical to SEQ ID NO: 124659

SEQ ID NO: 455140 - RNA, 64 nt, hsa; identical to SEQ ID NO: 124660

SEQ ID NO: 455141 - RNA, 64 nt, hsa; identical to SEQ ID NO: 124661

SEQ ID NO: 455142 - RNA, 64 nt, hsa; identical to SEQ ID NO: 124662

SEQ ID NO: 455143 - RNA, 64 nt, hsa; identical to SEQ ID NO: 124663

SEQ ID NO: 455144 - RNA, 64 nt, hsa; identical to SEQ ID NO: 124664

SEQ ID NO: 455145 - RNA, 64 nt, hsa; identical to SEQ ID NO: 124665

SEQ ID NO: 455146 - RNA, 64 nt, hsa; identical to SEQ ID NO: 124666

SEQ ID NO: 455147 - RNA, 64 nt, hsa; identical to SEQ ID NO: 124667

SEQ ID NO: 455148 - RNA, 64 nt, hsa; identical to SEQ ID NO: 124668

SEQ ID NO: 455149 - RNA, 64 nt, hsa; identical to SEQ ID NO: 124669

SEQ ID NO: 455150 - RNA, 64 nt, hsa; identical to SEQ ID NO: 124670

SEQ ID NO: 455151 - RNA, 64 nt, hsa; identical to SEQ ID NO: 124671

SEQ ID NO: 455152 - RNA, 64 nt, hsa; identical to SEQ ID NO: 124672

SEQ ID NO: 455153 - RNA, 64 nt, hsa; identical to SEQ ID NO: 124673

SEQ ID NO: 455154 - RNA, 64 nt, hsa; identical to SEQ ID NO: 124674

SEQ ID NO: 455155 - RNA, 64 nt, hsa; identical to SEQ ID NO: 124675

SEQ ID NO: 455156 - RNA, 64 nt, hsa; identical to SEQ ID NO: 124676

SEQ ID NO: 455157 - RNA, 64 nt, hsa; identical to SEQ ID NO: 124677

SEQ ID NO: 455158 - RNA, 64 nt, hsa; identical to SEQ ID NO: 124678

SEQ ID NO: 455159 - RNA, 64 nt, hsa; identical to SEQ ID NO: 124679

SEQ ID NO: 455160 - RNA, 64 nt, hsa; identical to SEQ ID NO: 124680

SEQ ID NO: 455161 - RNA, 64 nt, hsa; identical to SEQ ID NO: 124681

SEQ ID NO: 455162 - RNA, 64 nt, hsa; identical to SEQ ID NO: 124682

SEQ ID NO: 455163 - RNA, 64 nt, hsa; identical to SEQ ID NO: 124683

SEQ ID NO: 455164 - RNA, 64 nt, hsa; identical to SEQ ID NO: 124684

SEQ ID NO: 455165 - RNA, 64 nt, hsa; identical to SEQ ID NO: 124685

SEQ ID NO: 455166 - RNA, 64 nt, hsa; identical to SEQ ID NO: 124686

SEQ ID NO: 455167 - RNA, 64 nt, hsa; identical to SEQ ID NO: 124687

SEQ ID NO: 455168 - RNA, 64 nt, hsa; identical to SEQ ID NO: 124688

SEQ ID NO: 455169 - RNA, 64 nt, hsa; identical to SEQ ID NO: 124689

SEQ ID NO: 455170 - RNA, 64 nt, hsa; identical to SEQ ID NO: 124690

SEQ ID NO: 455171 - RNA, 64 nt, hsa; identical to SEQ ID NO: 124691

SEQ ID NO: 455172 - RNA, 64 nt, hsa; identical to SEQ ID NO: 124692

SEQ ID NO: 455173 - RNA, 64 nt, hsa; identical to SEQ ID NO: 124693

SEQ ID NO: 455174 - RNA, 64 nt, hsa; identical to SEQ ID NO: 124694

SEQ ID NO: 455175 - RNA, 64 nt, hsa; identical to SEQ ID NO: 124695

SEQ ID NO: 455176 - RNA, 64 nt, hsa; identical to SEQ ID NO: 124696

SEQ ID NO: 455177 - RNA, 64 nt, hsa; identical to SEQ ID NO: 124697

SEQ ID NO: 455178 - RNA, 64 nt, hsa; identical to SEQ ID NO: 124698

SEQ ID NO: 455179 - RNA, 64 nt, hsa; identical to SEQ ID NO: 124699

SEQ ID NO: 455180 - RNA, 64 nt, hsa; identical to SEQ ID NO: 124700

SEQ ID NO: 455181 - RNA, 64 nt, hsa; identical to SEQ ID NO: 124701

SEQ ID NO: 455182 - RNA, 64 nt, hsa; identical to SEQ ID NO: 124702

SEQ ID NO: 455183 - RNA, 64 nt, hsa; identical to SEQ ID NO: 124703

SEQ ID NO: 455184 - RNA, 64 nt, hsa; identical to SEQ ID NO: 124704

SEQ ID NO: 455185 - RNA, 64 nt, hsa; identical to SEQ ID NO: 124705

SEQ ID NO: 455186 - RNA, 64 nt, hsa; identical to SEQ ID NO: 124706

SEQ ID NO: 455187 - RNA, 64 nt, hsa; identical to SEQ ID NO: 124707

SEQ ID NO: 455188 - RNA, 64 nt, hsa; identical to SEQ ID NO: 124708

SEQ ID NO: 455189 - RNA, 64 nt, hsa; identical to SEQ ID NO: 124709

SEQ ID NO: 455190 - RNA, 64 nt, hsa; identical to SEQ ID NO: 124710

SEQ ID NO: 455191 - RNA, 64 nt, hsa; identical to SEQ ID NO: 124711

SEQ ID NO: 455192 - RNA, 64 nt, hsa; identical to SEQ ID NO: 124712

SEQ ID NO: 455193 - RNA, 64 nt, hsa; identical to SEQ ID NO: 124713

SEQ ID NO: 455194 - RNA, 64 nt, hsa; identical to SEQ ID NO: 124714

SEQ ID NO: 455195 - RNA, 64 nt, hsa; identical to SEQ ID NO: 124715

SEQ ID NO: 455196 - RNA, 64 nt, hsa; identical to SEQ ID NO: 124716

SEQ ID NO: 455197 - RNA, 64 nt, hsa; identical to SEQ ID NO: 124717

SEQ ID NO: 455198 - RNA, 64 nt, hsa; identical to SEQ ID NO: 124718

SEQ ID NO: 455199 - RNA, 64 nt, hsa; identical to SEQ ID NO: 124719

SEQ ID NO: 455200 - RNA, 64 nt, hsa; identical to SEQ ID NO: 298977

SEQ ID NO: 455201 - RNA, 64 nt, hsa; identical to SEQ ID NO: 298978

SEQ ID NO: 455202 - RNA, 64 nt, hsa
ugaauuuguaaacaaaacaaaauuggacugucuggaaagcuaaaguucugaaauauggaaugua

SEQ ID NO: 455203 - RNA, 64 nt, hsa
gaucaugguagguuaagaaaauaugccuguugaugaaagcuaaaagcaaauuuaugaaacuaaa

SEQ ID NO: 455204 - RNA, 64 nt, hsa
uuuaaaaacaagacaucuccagguaggaaaaaaugaaagcuauuucaugcaaacauuaucuaau

SEQ ID NO: 455205 - RNA, 64 nt, hsa
guggcagugauuggucuguuuguggagaauguaugaaagcuauuaauauucuagaauagauuaa

SEQ ID NO: 455206 - RNA, 64 nt, hsa
cuaaaugaaucgcaaguuaacuuggaaaucaguagaaagcuaaagugauccuaaauaugacagu

SEQ ID NO: 455207 - RNA, 64 nt, hsa
gauaaccaguaaggaaauauuaagagcuauuuuagaaagcuaaaugaaucgcaaguuaacuugg

SEQ ID NO: 455208 - RNA, 64 nt, hsa
acgucaguggggcaagaaaucuggagugagugaagaaagcuaaguugugaacaagaguguuuuu

SEQ ID NO: 455209 - RNA, 64 nt, hsa
uaaaauuggaagagacuucaaagacugucaaguggaaagcuaucauuuccuaaauuaaggaacu

SEQ ID NO: 455210 - RNA, 64 nt, hsa
auucagccuucaaacuacuacugaucaacuaaaggaaagcuaauaagguauuucuuuuaaacaa

SEQ ID NO: 455211 - RNA, 64 nt, hsa
cguauuccgucugcacaggcaaccaaggccaguagaaagcuauggcugcaaaacccuggggugg

SEQ ID NO: 455212 - RNA, 63 nt, hsa
cagcccugcugcacauggcacaggcauugcacacggugugaggaguguacaccugcaagggcu

SEQ ID NO: 455213 - RNA, 63 nt, hsa
cagcccugcugcacagggugcaggcauugcacacggugugaagggucuacaccugcacaggcu

SEQ ID NO: 455214 - RNA, 57 nt, hsa
gggagucaccucgacacugagggcccucggugugaagaugaaccuuccaccgucuuc

SEQ ID NO: 455215 - RNA, 63 nt, hsa
ccauauaauuagagaauuuuaagugcuuuagagcggugugauucuacugugcucagccuaguc

SEQ ID NO: 455216 - RNA, 64 nt, hsa
uagcugucccacacaacucaguggccugaacacacaccuucagccaccaugccuuugaccaggg

SEQ ID NO: 455217 - RNA, 64 nt, hsa
cuuugagagggaacaagaugccaucugucaacugcaccuucagaaaagucuaccugggagacua

SEQ ID NO: 455218 - RNA, 64 nt, hsa
ugccccuagcucagguggcuggggagaacuaaaacaccuucacuggugguuggggguaaggagc

SEQ ID NO: 455219 - RNA, 64 nt, hsa
cugcccugggaaagcauccaguggaugaagaagucaccuucaccaaggaacucuauuggaaggg

SEQ ID NO: 455220 - RNA, 64 nt, hsa
uuagggaucaaugaaggagagaaggucuuggaaucaccuucagucuuuggagacccagcugccu

SEQ ID NO: 455221 - RNA, 64 nt, hsa
gcaagcaaaguggagagaaagaagaugcaucugucaccuucaucaggguccucagugcagagca

SEQ ID NO: 455222 - RNA, 64 nt, hsa
aaaagaaaacuugugaucuauauaauuuauguaucaccuucauuguaaauuuagcaggaaaugc

SEQ ID NO: 455223 - RNA, 64 nt, hsa
cugugauguguuuuacccagcaccuccggacacucaccuucaggaccuuaauaaaauuauucac

SEQ ID NO: 455224 - RNA, 64 nt, hsa
ugcugcgcacggcggccuaccuccacaccacaaccaccuucaccuggaugugcagccccuuccu

SEQ ID NO: 455225 - RNA, 64 nt, hsa
uccucucaggcuaugccaucaccauacacaguggcaccuucaccugggcccaggaccugccccc

SEQ ID NO: 455226 - RNA, 64 nt, hsa
uggacaacuuuucucauguugaagccacugccuucaccuucaccuucauccauguccaaccccc

SEQ ID NO: 455227 - RNA, 64 nt, hsa
acuuuucucauguugaagccacugccuucaccuucaccuucauccauguccaacccccgacuuc

SEQ ID NO: 455228 - RNA, 64 nt, hsa
cuuugggaccuguccaaggguaggcaaccaccuucaccuucacacagauugaggagacacugga

SEQ ID NO: 455229 - RNA, 64 nt, hsa
gucucccuuugggaccuguccaaggguaggcaaccaccuucaccuucacacagauugaggagac

SEQ ID NO: 455230 - RNA, 64 nt, hsa; identical to SEQ ID NO: 296934

SEQ ID NO: 455231 - RNA, 64 nt, hsa; identical to SEQ ID NO: 296935

SEQ ID NO: 455232 - RNA, 64 nt, hsa; identical to SEQ ID NO: 296936

SEQ ID NO: 455233 - RNA, 64 nt, hsa; identical to SEQ ID NO: 296937

SEQ ID NO: 455234 - RNA, 64 nt, hsa; identical to SEQ ID NO: 296938

SEQ ID NO: 455235 - RNA, 64 nt, hsa; identical to SEQ ID NO: 296939

SEQ ID NO: 455236 - RNA, 64 nt, hsa; identical to SEQ ID NO: 296940

SEQ ID NO: 455237 - RNA, 64 nt, hsa; identical to SEQ ID NO: 296941

SEQ ID NO: 455238 - RNA, 64 nt, hsa; identical to SEQ ID NO: 296942

SEQ ID NO: 455239 - RNA, 64 nt, hsa; identical to SEQ ID NO: 296943

SEQ ID NO: 455240 - RNA, 64 nt, hsa; identical to SEQ ID NO: 296944

SEQ ID NO: 455241 - RNA, 64 nt, hsa; identical to SEQ ID NO: 296945

SEQ ID NO: 455242 - RNA, 64 nt, hsa; identical to SEQ ID NO: 296946

SEQ ID NO: 455243 - RNA, 64 nt, hsa; identical to SEQ ID NO: 296947

SEQ ID NO: 455244 - RNA, 64 nt, hsa; identical to SEQ ID NO: 296948

SEQ ID NO: 455245 - RNA, 64 nt, hsa; identical to SEQ ID NO: 296949

SEQ ID NO: 455246 - RNA, 64 nt, hsa; identical to SEQ ID NO: 296950

SEQ ID NO: 455247 - RNA, 64 nt, hsa; identical to SEQ ID NO: 296951

SEQ ID NO: 455248 - RNA, 64 nt, hsa; identical to SEQ ID NO: 296952

SEQ ID NO: 455249 - RNA, 64 nt, hsa; identical to SEQ ID NO: 296953

SEQ ID NO: 455250 - RNA, 64 nt, hsa; identical to SEQ ID NO: 296954

SEQ ID NO: 455251 - RNA, 64 nt, hsa; identical to SEQ ID NO: 296955

SEQ ID NO: 455252 - RNA, 64 nt, hsa; identical to SEQ ID NO: 296956

SEQ ID NO: 455253 - RNA, 64 nt, hsa; identical to SEQ ID NO: 296957

SEQ ID NO: 455254 - RNA, 64 nt, hsa; identical to SEQ ID NO: 296958

SEQ ID NO: 455255 - RNA, 64 nt, hsa; identical to SEQ ID NO: 296959

SEQ ID NO: 455256 - RNA, 64 nt, hsa; identical to SEQ ID NO: 296960

SEQ ID NO: 455257 - RNA, 64 nt, hsa; identical to SEQ ID NO: 296961

SEQ ID NO: 455258 - RNA, 64 nt, hsa; identical to SEQ ID NO: 296962

SEQ ID NO: 455259 - RNA, 64 nt, hsa; identical to SEQ ID NO: 296963

SEQ ID NO: 455260 - RNA, 64 nt, hsa; identical to SEQ ID NO: 296964

SEQ ID NO: 455261 - RNA, 64 nt, hsa; identical to SEQ ID NO: 296965

SEQ ID NO: 455262 - RNA, 64 nt, hsa; identical to SEQ ID NO: 296966

SEQ ID NO: 455263 - RNA, 64 nt, hsa; identical to SEQ ID NO: 296967

SEQ ID NO: 455264 - RNA, 64 nt, hsa; identical to SEQ ID NO: 296968

SEQ ID NO: 455265 - RNA, 64 nt, hsa; identical to SEQ ID NO: 296969

SEQ ID NO: 455266 - RNA, 64 nt, hsa; identical to SEQ ID NO: 296970

SEQ ID NO: 455267 - RNA, 64 nt, hsa; identical to SEQ ID NO: 296971

SEQ ID NO: 455268 - RNA, 64 nt, hsa; identical to SEQ ID NO: 296972

SEQ ID NO: 455269 - RNA, 64 nt, hsa; identical to SEQ ID NO: 296973

SEQ ID NO: 455270 - RNA, 64 nt, hsa; identical to SEQ ID NO: 296974

SEQ ID NO: 455271 - RNA, 64 nt, hsa; identical to SEQ ID NO: 296975

SEQ ID NO: 455272 - RNA, 64 nt, hsa; identical to SEQ ID NO: 296976

SEQ ID NO: 455273 - RNA, 64 nt, hsa; identical to SEQ ID NO: 296977

SEQ ID NO: 455274 - RNA, 64 nt, hsa; identical to SEQ ID NO: 296978

SEQ ID NO: 455275 - RNA, 64 nt, hsa; identical to SEQ ID NO: 296979

SEQ ID NO: 455276 - RNA, 64 nt, hsa; identical to SEQ ID NO: 296980

SEQ ID NO: 455277 - RNA, 64 nt, hsa; identical to SEQ ID NO: 296981

SEQ ID NO: 455278 - RNA, 64 nt, hsa; identical to SEQ ID NO: 296982

SEQ ID NO: 455279 - RNA, 64 nt, hsa; identical to SEQ ID NO: 296983

SEQ ID NO: 455280 - RNA, 64 nt, hsa; identical to SEQ ID NO: 296984

SEQ ID NO: 455281 - RNA, 64 nt, hsa; identical to SEQ ID NO: 296985

SEQ ID NO: 455282 - RNA, 64 nt, hsa; identical to SEQ ID NO: 296986

SEQ ID NO: 455283 - RNA, 64 nt, hsa; identical to SEQ ID NO: 296987

SEQ ID NO: 455284 - RNA, 64 nt, hsa; identical to SEQ ID NO: 296988

SEQ ID NO: 455285 - RNA, 64 nt, hsa; identical to SEQ ID NO: 296989

SEQ ID NO: 455286 - RNA, 64 nt, hsa; identical to SEQ ID NO: 296990

SEQ ID NO: 455287 - RNA, 64 nt, hsa; identical to SEQ ID NO: 296991

SEQ ID NO: 455288 - RNA, 64 nt, hsa; identical to SEQ ID NO: 296992

SEQ ID NO: 455289 - RNA, 64 nt, hsa; identical to SEQ ID NO: 296993

SEQ ID NO: 455290 - RNA, 64 nt, hsa; identical to SEQ ID NO: 296994

SEQ ID NO: 455291 - RNA, 64 nt, hsa; identical to SEQ ID NO: 193898

SEQ ID NO: 455292 - RNA, 64 nt, hsa; identical to SEQ ID NO: 193899

SEQ ID NO: 455293 - RNA, 64 nt, hsa; identical to SEQ ID NO: 193900

SEQ ID NO: 455294 - RNA, 64 nt, hsa; identical to SEQ ID NO: 193901

SEQ ID NO: 455295 - RNA, 64 nt, hsa; identical to SEQ ID NO: 193902

SEQ ID NO: 455296 - RNA, 64 nt, hsa; identical to SEQ ID NO: 193903

SEQ ID NO: 455297 - RNA, 64 nt, hsa; identical to SEQ ID NO: 193904

SEQ ID NO: 455298 - RNA, 64 nt, hsa; identical to SEQ ID NO: 193905

SEQ ID NO: 455299 - RNA, 64 nt, hsa; identical to SEQ ID NO: 193906

SEQ ID NO: 455300 - RNA, 64 nt, hsa; identical to SEQ ID NO: 193907

SEQ ID NO: 455301 - RNA, 64 nt, hsa; identical to SEQ ID NO: 193908

SEQ ID NO: 455302 - RNA, 64 nt, hsa; identical to SEQ ID NO: 193909

SEQ ID NO: 455303 - RNA, 64 nt, hsa; identical to SEQ ID NO: 193910

SEQ ID NO: 455304 - RNA, 64 nt, hsa; identical to SEQ ID NO: 193911

SEQ ID NO: 455305 - RNA, 64 nt, hsa; identical to SEQ ID NO: 193912

SEQ ID NO: 455306 - RNA, 64 nt, hsa; identical to SEQ ID NO: 193913

SEQ ID NO: 455307 - RNA, 64 nt, hsa; identical to SEQ ID NO: 193914

SEQ ID NO: 455308 - RNA, 64 nt, hsa; identical to SEQ ID NO: 193915

SEQ ID NO: 455309 - RNA, 64 nt, hsa; identical to SEQ ID NO: 193916

SEQ ID NO: 455310 - RNA, 64 nt, hsa; identical to SEQ ID NO: 193917

SEQ ID NO: 455311 - RNA, 64 nt, hsa; identical to SEQ ID NO: 193918

SEQ ID NO: 455312 - RNA, 64 nt, hsa; identical to SEQ ID NO: 193919

SEQ ID NO: 455313 - RNA, 64 nt, hsa; identical to SEQ ID NO: 257499

SEQ ID NO: 455314 - RNA, 64 nt, hsa; identical to SEQ ID NO: 257500

SEQ ID NO: 455315 - RNA, 64 nt, hsa; identical to SEQ ID NO: 257501

SEQ ID NO: 455316 - RNA, 64 nt, hsa; identical to SEQ ID NO: 257502

SEQ ID NO: 455317 - RNA, 60 nt, hsa
agcagguuuccccacucaucuagguugucuugaaaggaggauagagccacuuacaguuuu

SEQ ID NO: 455318 - RNA, 60 nt, hsa
ugcaggaugcuuuuaacugauguaggaaacugaaaggaaauagauuuuuuccaaaaccca

SEQ ID NO: 455319 - RNA, 60 nt, hsa
uuauauaaauauuaaugaauucagauuagcugaaaggaaaaaaaguagaagccugacuac

SEQ ID NO: 455320 - RNA, 60 nt, hsa
uucugauuauugaagaggucagauuaugaaugaaaggauaaaauguuuuaauaguagagc

SEQ ID NO: 455321 - RNA, 60 nt, hsa
cuaguuuguuacuuuaaaaaucaguuuugaugaaaggagggaaaagcagauggacuugaa

SEQ ID NO: 455322 - RNA, 60 nt, hsa
auggacuccgauuuggagaguaguaagacgugaaaggaauacacuuguguuuaagcacca

SEQ ID NO: 455323 - RNA, 60 nt, hsa
gcggcgcucacccuccucagucccaguuucugaaaggacucagcugagaaaggacaacug

SEQ ID NO: 455324 - RNA, 60 nt, hsa
aauagaauuaccauauuguuuuuccugguuugaaaggaccagauggaaagaaacugggca

SEQ ID NO: 455325 - RNA, 60 nt, hsa
gcccauguuucagccucagcccacgccaggugaaaggaucagcaaugcucuguugccauc

SEQ ID NO: 455326 - RNA, 60 nt, hsa
ggccccacacugccucuguggccuggacuuugaaaggaacccacugaacacuaauuauga

SEQ ID NO: 455327 - RNA, 60 nt, hsa
ugugaacacugaugcaagaaacuuguuaaaugaaaggacucuuuacccuagaaggaagag

SEQ ID NO: 455328 - RNA, 60 nt, hsa
uauccucuucuguugaaugcaguccaaacaugaaaggaaauaauuguuuuauauuauaac

SEQ ID NO: 455329 - RNA, 60 nt, hsa
aaaaaaaaguaugcuagcacuauuguaccuugaaaggauuuccaccagacugucuugagu

SEQ ID NO: 455330 - RNA, 60 nt, hsa
acaaggaacuacauuccagauuuaaagaaaugaaaggauaccauuaguguguauaacaga

SEQ ID NO: 455331 - RNA, 60 nt, hsa
cucaaauuuucaucugcacaaugaggcuguugaaaggaaaaaaagugagccucuaggaau

SEQ ID NO: 455332 - RNA, 60 nt, hsa
auggcugcagauagaucccgcagucccuucugaaaggaacuguguagccagcagggaccu

SEQ ID NO: 455333 - RNA, 60 nt, hsa
gcuuggugugaacucgcuuaaaagcaauggugaaaggauaaccucgaugauguaaaucca

SEQ ID NO: 455334 - RNA, 60 nt, hsa
ggaagcuugagucaaaauguguuuccccuuugaaaggagaaggaauuggagcagcuuuuc

SEQ ID NO: 455335 - RNA, 60 nt, hsa
accucuuaagaaaaaauaaaaaguaaaaaaugaaaggaaucuuuuuuagaaauagagaug

SEQ ID NO: 455336 - RNA, 60 nt, hsa
uuauuucuucuccuuguggacaguuguuaaugaaaggaguaaggauuucccuuuuuuugu

SEQ ID NO: 455337 - RNA, 60 nt, hsa
ggagugugcccagaccagcugggggagcauugaaaggacagcuuggggauggaauuuuuu

SEQ ID NO: 455338 - RNA, 60 nt, hsa
cuauguuaacuaguuaaggauguuacauuuugaaaggauguauguuagauauauuauuug

SEQ ID NO: 455339 - RNA, 60 nt, hsa
aacuugauaaccccuagaaagaagaggacaugaaaggaugcuggcuauauauguuaauga

SEQ ID NO: 455340 - RNA, 60 nt, hsa
aagcacgugagagacccucgcaaaaugaugugaaaggaccaguuucuugaaguccagugu

SEQ ID NO: 455341 - RNA, 60 nt, hsa
caggagagaacacggggagguuuguuugugugaaaggaaaguaguccaggcugucccuga

SEQ ID NO: 455342 - RNA, 60 nt, hsa
cauggguguggcauucucuaacaaaugaugugaaaggaaaguaguuuucauaaaacucau

SEQ ID NO: 455343 - RNA, 60 nt, hsa
agccaaucuuuuauuguuccuuugcuacuuugaaaggaaaaaaaagguugucucuugauu

SEQ ID NO: 455344 - RNA, 60 nt, hsa
uguaccugucugaagagugacauuaaacuuugaaaggacuucacugcuccuuuacgauau

SEQ ID NO: 455345 - RNA, 60 nt, hsa
auguagaaaauaaugaauuaaugagauuggugaaaggaaaucaugcaaaacauuugaaug

SEQ ID NO: 455346 - RNA, 60 nt, hsa
ugcuuuguuggaauggaauuuaaauuuaaaugaaaggaaaaauauaucccugguaguuuu

SEQ ID NO: 455347 - RNA, 60 nt, hsa
uuacuugcacuuuauguauacuuccugauuugaaaggaggagguuugaaaagaaaaaaau

SEQ ID NO: 455348 - RNA, 60 nt, hsa
gcuguccuugaacaaguaucaauguguuuaugaaaggaagaucuaaaucagacaggaguu

SEQ ID NO: 455349 - RNA, 60 nt, hsa
aauggaacccuugcuauaguagugacaaagugaaaggaaauuuaggaggcauaggccauu

SEQ ID NO: 455350 - RNA, 53 nt, hsa
uugucccaguucuuucaugagcaugaaaggagucacauagagaaaccccauga

SEQ ID NO: 455351 - RNA, 60 nt, hsa
cuucaguccuuucuguuucuuucaacuacgugaaaggauucacaguggagaaagacccug

SEQ ID NO: 455352 - RNA, 60 nt, hsa
cuuuguuuccuucacuuccuuucgauaucaugaaaggacucacacuggagagaaccccua

SEQ ID NO: 455353 - RNA, 60 nt, hsa
auuccauaauuucucuucuuugcaaauacaugaaaggaugcacagaggagagaagcucug

SEQ ID NO: 455354 - RNA, 60 nt, hsa
cuuuauuucuuccacuucuuuucaauaucaugaaaggacucacaugggagagaaacccua

SEQ ID NO: 455355 - RNA, 60 nt, hsa
cuucauuucuucuaguucccuucaauaucaugaaaggacucacacuggagagaagcccua

SEQ ID NO: 455356 - RNA, 60 nt, hsa
cuucagaucugucaagaaccuuucaauuuaugaaaggacacacacuggagagaaacccua

SEQ ID NO: 455357 - RNA, 60 nt, hsa
auucaauuauuuuucuuccuugcauauacaugaaaggacucauacgagagagaauccgua

SEQ ID NO: 455358 - RNA, 60 nt, hsa
uuucacuucuuccaguucuuuucaauaucaugaaaggacucacacuggggagaaaccgua

SEQ ID NO: 455359 - RNA, 60 nt, hsa
cuucaaucuuuccaguuccuuucaguaucaugaaaggacucacacuggagagaaacccua

SEQ ID NO: 455360 - RNA, 60 nt, hsa
cuucagaucugccucacaccuucaaauucaugaaaggacacaaacacacauaagaauaca

SEQ ID NO: 455361 - RNA, 60 nt, hsa
cuucaguaguuccaguuccuuuugguaccaugaaaggacucacacuggagagaaacccua

SEQ ID NO: 455362 - RNA, 60 nt, hsa
cuucagaucugccaagaaccuucgaauucaugaaaggacacaaacacacguaagaaugca

SEQ ID NO: 455363 - RNA, 60 nt, hsa
cuuuauuucuuucacuucuuuucgauaacaugaaaggacucacacuggagagaaacccua

SEQ ID NO: 455364 - RNA, 60 nt, hsa
cuuuuauuguugcaguucugcccgaagacaugaaaggaugcacacugcaaagaaacagua

SEQ ID NO: 455365 - RNA, 60 nt, hsa
auuuagauacuacuacucagcucaaagacaugaaaggacucauacuggagagaaacccua

SEQ ID NO: 455366 - RNA, 60 nt, hsa
cuucauuuaccgccauucugcucgagcacaugaaaggaaucacacuguacagaaacgcua

SEQ ID NO: 455367 - RNA, 60 nt, hsa
cuucagucauuuuggucacuuaaagcaacaugaaaggauucacacuggagagaagccgua

SEQ ID NO: 455368 - RNA, 60 nt, hsa
cuuuguuuauuucauuggauuucaaagacaugaaaggacucacacuagggagaaaaucua

SEQ ID NO: 455369 - RNA, 64 nt, hsa; identical to SEQ ID NO: 91745

SEQ ID NO: 455370 - RNA, 64 nt, hsa; identical to SEQ ID NO: 91746

SEQ ID NO: 455371 - RNA, 64 nt, hsa; identical to SEQ ID NO: 91747

SEQ ID NO: 455372 - RNA, 64 nt, hsa; identical to SEQ ID NO: 91748

SEQ ID NO: 455373 - RNA, 64 nt, hsa; identical to SEQ ID NO: 91749

SEQ ID NO: 455374 - RNA, 64 nt, hsa; identical to SEQ ID NO: 91750

SEQ ID NO: 455375 - RNA, 64 nt, hsa; identical to SEQ ID NO: 91751

SEQ ID NO: 455376 - RNA, 64 nt, hsa; identical to SEQ ID NO: 91752

SEQ ID NO: 455377 - RNA, 64 nt, hsa; identical to SEQ ID NO: 91753

SEQ ID NO: 455378 - RNA, 64 nt, hsa; identical to SEQ ID NO: 91754

SEQ ID NO: 455379 - RNA, 64 nt, hsa; identical to SEQ ID NO: 91755

SEQ ID NO: 455380 - RNA, 64 nt, hsa; identical to SEQ ID NO: 91756

SEQ ID NO: 455381 - RNA, 64 nt, hsa; identical to SEQ ID NO: 91757

SEQ ID NO: 455382 - RNA, 64 nt, hsa; identical to SEQ ID NO: 91758

SEQ ID NO: 455383 - RNA, 64 nt, hsa; identical to SEQ ID NO: 91759

SEQ ID NO: 455384 - RNA, 64 nt, hsa; identical to SEQ ID NO: 91760

SEQ ID NO: 455385 - RNA, 64 nt, hsa; identical to SEQ ID NO: 91761

SEQ ID NO: 455386 - RNA, 64 nt, hsa; identical to SEQ ID NO: 91762

SEQ ID NO: 455387 - RNA, 64 nt, hsa; identical to SEQ ID NO: 91763

SEQ ID NO: 455388 - RNA, 64 nt, hsa; identical to SEQ ID NO: 91764

SEQ ID NO: 455389 - RNA, 64 nt, hsa; identical to SEQ ID NO: 91765

SEQ ID NO: 455390 - RNA, 64 nt, hsa; identical to SEQ ID NO: 91766

SEQ ID NO: 455391 - RNA, 64 nt, hsa; identical to SEQ ID NO: 91767

SEQ ID NO: 455392 - RNA, 64 nt, hsa; identical to SEQ ID NO: 91768

SEQ ID NO: 455393 - RNA, 64 nt, hsa; identical to SEQ ID NO: 91769

SEQ ID NO: 455394 - RNA, 64 nt, hsa; identical to SEQ ID NO: 91770

SEQ ID NO: 455395 - RNA, 64 nt, hsa; identical to SEQ ID NO: 91771

SEQ ID NO: 455396 - RNA, 64 nt, hsa; identical to SEQ ID NO: 91772

SEQ ID NO: 455397 - RNA, 64 nt, hsa; identical to SEQ ID NO: 91773

SEQ ID NO: 455398 - RNA, 64 nt, hsa; identical to SEQ ID NO: 91774

SEQ ID NO: 455399 - RNA, 64 nt, hsa; identical to SEQ ID NO: 91775

SEQ ID NO: 455400 - RNA, 64 nt, hsa; identical to SEQ ID NO: 91776

SEQ ID NO: 455401 - RNA, 64 nt, hsa; identical to SEQ ID NO: 91777

SEQ ID NO: 455402 - RNA, 64 nt, hsa; identical to SEQ ID NO: 91778

SEQ ID NO: 455403 - RNA, 64 nt, hsa; identical to SEQ ID NO: 91779

SEQ ID NO: 455404 - RNA, 64 nt, hsa; identical to SEQ ID NO: 91780

SEQ ID NO: 455405 - RNA, 64 nt, hsa; identical to SEQ ID NO: 91781

SEQ ID NO: 455406 - RNA, 64 nt, hsa; identical to SEQ ID NO: 91782

SEQ ID NO: 455407 - RNA, 64 nt, hsa; identical to SEQ ID NO: 91783

SEQ ID NO: 455408 - RNA, 64 nt, hsa; identical to SEQ ID NO: 91784

SEQ ID NO: 455409 - RNA, 64 nt, hsa; identical to SEQ ID NO: 91785

SEQ ID NO: 455410 - RNA, 64 nt, hsa; identical to SEQ ID NO: 91786

SEQ ID NO: 455411 - RNA, 64 nt, hsa; identical to SEQ ID NO: 91787

SEQ ID NO: 455412 - RNA, 64 nt, hsa; identical to SEQ ID NO: 91788

SEQ ID NO: 455413 - RNA, 64 nt, hsa; identical to SEQ ID NO: 91789

SEQ ID NO: 455414 - RNA, 64 nt, hsa; identical to SEQ ID NO: 91790

SEQ ID NO: 455415 - RNA, 64 nt, hsa; identical to SEQ ID NO: 91791

SEQ ID NO: 455416 - RNA, 64 nt, hsa; identical to SEQ ID NO: 91792

SEQ ID NO: 455417 - RNA, 64 nt, hsa; identical to SEQ ID NO: 91793

SEQ ID NO: 455418 - RNA, 64 nt, hsa; identical to SEQ ID NO: 91794

SEQ ID NO: 455419 - RNA, 64 nt, hsa; identical to SEQ ID NO: 91795

SEQ ID NO: 455420 - RNA, 64 nt, hsa; identical to SEQ ID NO: 91796

SEQ ID NO: 455421 - RNA, 64 nt, hsa; identical to SEQ ID NO: 91797

SEQ ID NO: 455422 - RNA, 64 nt, hsa; identical to SEQ ID NO: 91798

SEQ ID NO: 455423 - RNA, 64 nt, hsa; identical to SEQ ID NO: 91799

SEQ ID NO: 455424 - RNA, 64 nt, hsa; identical to SEQ ID NO: 91800

SEQ ID NO: 455425 - RNA, 54 nt, hsa; identical to SEQ ID NO: 91801

SEQ ID NO: 455426 - RNA, 64 nt, hsa; identical to SEQ ID NO: 158094

SEQ ID NO: 455427 - RNA, 64 nt, hsa; identical to SEQ ID NO: 158095

SEQ ID NO: 455428 - RNA, 64 nt, hsa; identical to SEQ ID NO: 158096

SEQ ID NO: 455429 - RNA, 64 nt, hsa; identical to SEQ ID NO: 158097

SEQ ID NO: 455430 - RNA, 64 nt, hsa; identical to SEQ ID NO: 158098

SEQ ID NO: 455431 - RNA, 64 nt, hsa; identical to SEQ ID NO: 158099

SEQ ID NO: 455432 - RNA, 64 nt, hsa; identical to SEQ ID NO: 158100

SEQ ID NO: 455433 - RNA, 64 nt, hsa; identical to SEQ ID NO: 158101

SEQ ID NO: 455434 - RNA, 64 nt, hsa; identical to SEQ ID NO: 158102

SEQ ID NO: 455435 - RNA, 64 nt, hsa; identical to SEQ ID NO: 158103

SEQ ID NO: 455436 - RNA, 64 nt, hsa; identical to SEQ ID NO: 158104

SEQ ID NO: 455437 - RNA, 64 nt, hsa; identical to SEQ ID NO: 158105

SEQ ID NO: 455438 - RNA, 64 nt, hsa; identical to SEQ ID NO: 158106

SEQ ID NO: 455439 - RNA, 64 nt, hsa; identical to SEQ ID NO: 158107

SEQ ID NO: 455440 - RNA, 64 nt, hsa; identical to SEQ ID NO: 158108

SEQ ID NO: 455441 - RNA, 64 nt, hsa; identical to SEQ ID NO: 158109

SEQ ID NO: 455442 - RNA, 64 nt, hsa; identical to SEQ ID NO: 158110

SEQ ID NO: 455443 - RNA, 64 nt, hsa; identical to SEQ ID NO: 158111

SEQ ID NO: 455444 - RNA, 64 nt, hsa; identical to SEQ ID NO: 158112

SEQ ID NO: 455445 - RNA, 64 nt, hsa; identical to SEQ ID NO: 158113

SEQ ID NO: 455446 - RNA, 64 nt, hsa; identical to SEQ ID NO: 158114

SEQ ID NO: 455447 - RNA, 64 nt, hsa; identical to SEQ ID NO: 158115

SEQ ID NO: 455448 - RNA, 64 nt, hsa; identical to SEQ ID NO: 158116

SEQ ID NO: 455449 - RNA, 64 nt, hsa; identical to SEQ ID NO: 158117

SEQ ID NO: 455450 - RNA, 64 nt, hsa; identical to SEQ ID NO: 158118

SEQ ID NO: 455451 - RNA, 64 nt, hsa; identical to SEQ ID NO: 158119

SEQ ID NO: 455452 - RNA, 64 nt, hsa; identical to SEQ ID NO: 158120

SEQ ID NO: 455453 - RNA, 64 nt, hsa; identical to SEQ ID NO: 158121

SEQ ID NO: 455454 - RNA, 64 nt, hsa; identical to SEQ ID NO: 158122

SEQ ID NO: 455455 - RNA, 64 nt, hsa; identical to SEQ ID NO: 158123

SEQ ID NO: 455456 - RNA, 64 nt, hsa; identical to SEQ ID NO: 158124

SEQ ID NO: 455457 - RNA, 64 nt, hsa; identical to SEQ ID NO: 158125

SEQ ID NO: 455458 - RNA, 64 nt, hsa; identical to SEQ ID NO: 158126

SEQ ID NO: 455459 - RNA, 64 nt, hsa; identical to SEQ ID NO: 158127

SEQ ID NO: 455460 - RNA, 64 nt, hsa; identical to SEQ ID NO: 158128

SEQ ID NO: 455461 - RNA, 64 nt, hsa; identical to SEQ ID NO: 257525

SEQ ID NO: 455462 - RNA, 64 nt, hsa; identical to SEQ ID NO: 257526

SEQ ID NO: 455463 - RNA, 64 nt, hsa; identical to SEQ ID NO: 257527

SEQ ID NO: 455464 - RNA, 64 nt, hsa; identical to SEQ ID NO: 257528

SEQ ID NO: 455465 - RNA, 64 nt, hsa; identical to SEQ ID NO: 257529

SEQ ID NO: 455466 - RNA, 64 nt, hsa; identical to SEQ ID NO: 257530

SEQ ID NO: 455467 - RNA, 64 nt, hsa; identical to SEQ ID NO: 257531

SEQ ID NO: 455468 - RNA, 64 nt, hsa; identical to SEQ ID NO: 257532

SEQ ID NO: 455469 - RNA, 64 nt, hsa; identical to SEQ ID NO: 257533

SEQ ID NO: 455470 - RNA, 64 nt, hsa; identical to SEQ ID NO: 257534

SEQ ID NO: 455471 - RNA, 64 nt, hsa; identical to SEQ ID NO: 257535

SEQ ID NO: 455472 - RNA, 64 nt, hsa; identical to SEQ ID NO: 257536

SEQ ID NO: 455473 - RNA, 64 nt, hsa
ugacaagccagccaucagggcaaguguuuugaaucuuagcaaguguuuugaaucuuagcaacug

SEQ ID NO: 455474 - RNA, 64 nt, hsa
gcaaguguuuugaaucuuagcaaguguuuugaaucuuagcaacugaacaugacauugcacacug

SEQ ID NO: 455475 - RNA, 64 nt, hsa
aaaaaaaaaaaaaaaaaaaaagcuuacacagcuucuuagcaauuuuuuuuuuuuugccgaaaca

SEQ ID NO: 455476 - RNA, 64 nt, hsa
cuuguuuuagcgaacucuagcaaaacuuguuuagcuuagcaaaaacaaacacacaaaaaacuga

SEQ ID NO: 455477 - RNA, 64 nt, hsa
guuagaaggcuccauuguuuuguuggcucucaaacuuagcaaaauuagcaauauauuauccaau

SEQ ID NO: 455478 - RNA, 64 nt, hsa
uccaacauuauuugaauugagcaccucaagcaugcuuagcaauguucuaaucacuauggacaga

SEQ ID NO: 455479 - RNA, 64 nt, hsa
cuaauguuuuauauucauauauuaggaaagugaacuuagcaagcuuuuuggaauuuaaggauca

SEQ ID NO: 455480 - RNA, 64 nt, hsa
gccauaagagaugcucaaaaaagcauggucagggcuuagcaagaauccuuuuccagugcaaaua

SEQ ID NO: 455481 - RNA, 64 nt, hsa
caaagccucagagaaaggguguuucugguuuugccuuagcaaugcaucggucucugaggugaca

SEQ ID NO: 455482 - RNA, 64 nt, hsa
gcacccacauuuuuuugaaagacuggacuggaaucuuagcaaacaauuguaagucuccuccuua

SEQ ID NO: 455483 - RNA, 64 nt, hsa
uccaugcuuuuuaaagacagagauaauaucuucucuauucuauucuacuuccuccauuucacca

SEQ ID NO: 455484 - RNA, 64 nt, hsa
gcuuuuuaaagacagagauaauaucuucucuauucuauucuacuuccuccauuucaccauuuau

SEQ ID NO: 455485 - RNA, 64 nt, hsa
acuuuuaaauauuguaagaggauaucuaguuucucuauucuaccaucaaagaagcuuuugagua

SEQ ID NO: 455486 - RNA, 64 nt, hsa
gaagcuuuugaguaccaccuguuaaugagcuuuccuauucuaaauuguuuugggucacagaguu

SEQ ID NO: 455487 - RNA, 61 nt, hsa
aaaagaagaccuggguggaaagcgguuuggaugaaaagauuucaggcaaagacuugcagga

SEQ ID NO: 455488 - RNA, 61 nt, hsa
aaagacggguguuuuauuuggucuaauacccugaaaagaagugaugacuuguugcuuuuca

SEQ ID NO: 455489 - RNA, 61 nt, hsa
aguaaguagacaagaauaaagugguuugagaugaaaagaaccuaacauuauuuacaguaga

SEQ ID NO: 455490 - RNA, 61 nt, hsa
ggagcaagagaaagaagauaauuuaaccaugugaaaagaauuuuuuugugugugaauuauc

SEQ ID NO: 455491 - RNA, 61 nt, hsa
uuuucuuuuuaucuuauuuuuacucguccguugaaaagauaaucaaggccuacauuuuagc

SEQ ID NO: 455492 - RNA, 61 nt, hsa
aaagacucuuuuagggcauuuuucugacucaugaaaagagcacagaaaaggauguuuggca

SEQ ID NO: 455493 - RNA, 61 nt, hsa
uuuugugauugaaaagacccuaucaagaaggugaaaagauaaccugcagaaugggagaaaa

SEQ ID NO: 455494 - RNA, 61 nt, hsa
ggacuuaaucaagauuugaagcuuuugugauugaaaagacccuaucaagaaggugaaaaga

SEQ ID NO: 455495 - RNA, 61 nt, hsa
acuccaucucaaaaaaaaaaagagagagagaugaaaagaguaggaaaaugagaaaucaccu

SEQ ID NO: 455496 - RNA, 61 nt, hsa
aaaaaaagaaaagaaaaagauaaagggauugugaaaagagcauuuauauuggacuaaucag

SEQ ID NO: 455497 - RNA, 61 nt, hsa
ccgugccuucaguuaauaaagauuuguauugugaaaagauuuuuucuuuuuuuuuugggac

SEQ ID NO: 455498 - RNA, 61 nt, hsa
gauuacaggcgcgagccacggcgcccagccuugaaaagauguuuuuagaaccagaagaaac

SEQ ID NO: 455499 - RNA, 61 nt, hsa
uuaagcuaugauaggagaauaauaauaaagaugaaaagagaagguacccuaaggcugaggg

SEQ ID NO: 455500 - RNA, 61 nt, hsa
ccaagucuuacauagaaaaaaaagguagauaugaaaagaaaaaucacagaagagagaaugc

SEQ ID NO: 455501 - RNA, 61 nt, hsa
guuagagaaaagauggauuuaaugagauaaaugaaaagauauuuaaccuaauauaucaagg

SEQ ID NO: 455502 - RNA, 61 nt, hsa
caaaaacaagugcuuguuuagcggagaauuuugaaaagaggaauauauaacucaauuuuca

SEQ ID NO: 455503 - RNA, 61 nt, hsa
ugaguacccucugaaaaagggaauuugcuggugaaaagaggcuggaucuuguggaagacug

SEQ ID NO: 455504 - RNA, 61 nt, hsa
ugaauuacuguaucuuuuacuuuuuuuuuuuugaaaagauaaacuuguaaauagagugauu

SEQ ID NO: 455505 - RNA, 61 nt, hsa
ucauuagauucucugauucuauauaagaaugugaaaagauugauauauuguuguuagaaau

SEQ ID NO: 455506 - RNA, 61 nt, hsa
uauaccgccacacccagcuaauuuuauuuuuugaaaagacaagguucccuauguugcccag

SEQ ID NO: 455507 - RNA, 61 nt, hsa
ugacaaaugaaaagaauaacaaguugucaaaugaaaagaaugacauugaaacauuuguauu

SEQ ID NO: 455508 - RNA, 61 nt, hsa
aguuaugagaaaucuuugcuuauaugacaaaugaaaagaauaacaaguugucaaaugaaaa

SEQ ID NO: 455509 - RNA, 61 nt, hsa
ugaguugguugauugggguuugauuugcuuuugaaaagauuuuuauuuuuagaggcagggc

SEQ ID NO: 455510 - RNA, 61 nt, hsa
auauauuuccucauaaacauuugaguuuuguugaaaagauggaguuuacaaagauaccauu

SEQ ID NO: 455511 - RNA, 61 nt, hsa
gccuuuguggauuuggguuugugcuuuggguugaaaagaaguuuuuaguccuaggccagua

SEQ ID NO: 455512 - RNA, 61 nt, hsa
uugaggcuuuucuauauacuucucagagcacugaaaagaaaggaaggguuugcagaggaga

SEQ ID NO: 455513 - RNA, 61 nt, hsa
aaagaacuguaaccgaaagaaguaagagauuugaaaagacgauagaguuaaaacaauauuu

SEQ ID NO: 455514 - RNA, 61 nt, hsa
caaacuuuuuguguuaucuggcacaggccuuugaaaagacuauaauucuacuuuguuuaau

SEQ ID NO: 455515 - RNA, 61 nt, hsa
uaguuucaaaugaguuuaaaaaaauaacaucugaaaagaaaugcuaauguaaucauuuauc

SEQ ID NO: 455516 - RNA, 61 nt, hsa
uuguaauauacaguuuuuguaaccauaugauugaaaagaagaaagucuaugcuuaggccag

SEQ ID NO: 455517 - RNA, 61 nt, hsa
agacacagauguucgguuuuuuuccuguuucugaaaagaaauaauaauauccaggucaaca

SEQ ID NO: 455518 - RNA, 61 nt, hsa
ggauaacaaagauaucuuuucuuuagagaacugaaaagagagcagagaauauaacaugaaa

SEQ ID NO: 455519 - RNA, 61 nt, hsa
aaauacagcagacgaacauauuuauugguacugaaaagagacguaguaaauuaaauagaag

SEQ ID NO: 455520 - RNA, 61 nt, hsa
auguucuuuugcaaggcauagaacauuuguaugaaaagacauuuaguaugcuuugaaaaaa

SEQ ID NO: 455521 - RNA, 61 nt, hsa
auguacaguauaaagaggaauauugugcuuuugaaaagaguauacuuuuuacuuuuauuua

SEQ ID NO: 455522 - RNA, 61 nt, hsa
uccacuuuacuuaagaaaacuagcaaauauaugaaaagacccuuaguaccaaauacacuca

SEQ ID NO: 455523 - RNA, 61 nt, hsa
gauggagcuccguggguugacacuuuuucugugaaaagaacacugacacaccagucugggu

SEQ ID NO: 455524 - RNA, 61 nt, hsa
gugcaccugauuuggccaauaggaucaacagugaaaagacagaagaggcaauaccagcagu

SEQ ID NO: 455525 - RNA, 61 nt, hsa
aaagaaaccuguuuguuuuucuuuugaacuaugaaaagacccuguuugugaauauauuuua

SEQ ID NO: 455526 - RNA, 61 nt, hsa
uuaaaggcagagaaguaucugcaucuuuauuugaaaagacgucuuauuaacucuuagcucc

SEQ ID NO: 455527 - RNA, 61 nt, hsa
caagaucugucacccacaacaccacauaucuugaaaagaugcuuuucauaauuuucacuau

SEQ ID NO: 455528 - RNA, 61 nt, hsa
acuucucgggaaaggaucaucgccguugaaaugaaaagagagacagagagaaaaaaaaaaa

SEQ ID NO: 455529 - RNA, 61 nt, hsa
ucacauuggaugacaccauguucuuccucuuugaaaagaaaaggggaaugugucccacuag

SEQ ID NO: 455530 - RNA, 61 nt, hsa
aacuagaaauagcacucuugguuucuuuugaugaaaagagugagcuggucaaugcaacauu

SEQ ID NO: 455531 - RNA, 61 nt, hsa
gugccgagcagggauauaaccugcaguuaagugaaaagaaaauccagccucccccuccaaa

SEQ ID NO: 455532 - RNA, 61 nt, hsa
gaaaauaacugaaaagauuaaaagugagagcugaaaagagaaaugauaaugcuuccaaacu

SEQ ID NO: 455533 - RNA, 61 nt, hsa
uugguggcuaaguuuuacuaaggaaaauaacugaaaagauuaaaagugagagcugaaaaga

SEQ ID NO: 455534 - RNA, 61 nt, hsa
agauucaaaugcuuuuaugacuaauguaaaaugaaaagaggcuuacauuuuaaauguuauu

SEQ ID NO: 455535 - RNA, 61 nt, hsa
aacacauaguguaaaauaauuacaugccuaaugaaaagaagaugucauuuccuaauuuuga

SEQ ID NO: 455536 - RNA, 61 nt, hsa
guuaccaguuaggggaagacuuuuauuuucaugaaaagacaauaaaacaaaauggaaugug

SEQ ID NO: 455537 - RNA, 61 nt, hsa
acacauucacccuaaggauccaauggaauacugaaaagaaaucacuuccuugaaaauuuua

SEQ ID NO: 455538 - RNA, 61 nt, hsa
cugcauuugguuuuaugaauacaaagauaagugaaaagagagaaaggaaaagaaaaaggag

SEQ ID NO: 455539 - RNA, 61 nt, hsa
auuuuuauuuuuccuuugguauuugcuacagugaaaagaaguuuggaaaguagauacauaa

SEQ ID NO: 455540 - RNA, 61 nt, hsa
uaggcauuaccucagggaaaagccuugacagugaaaagaaacuacuuaaucgcuaauagcu

SEQ ID NO: 455541 - RNA, 61 nt, hsa
aacuuuuuuucuugcagcaccgaggcacauuugaaaagauggaauugaagucguuuuguuu

SEQ ID NO: 455542 - RNA, 61 nt, hsa
aagacuacagaaggaaagagaucuugccuuuugaaaagaugaaggaacaaagguugagaga

SEQ ID NO: 455543 - RNA, 61 nt, hsa
ccucuaagaaagaaaugaagaaagaaaaugaugaaaagaguaguucaagaaguucuggaga

SEQ ID NO: 455544 - RNA, 61 nt, hsa
uuaauuuuugacaacaagcauguauuacuuuugaaaagaugaaaaauaaagauuuauuuaa

SEQ ID NO: 455545 - RNA, 61 nt, hsa
guuuuguaccaacaggaauuagaaaauauaaugaaaagauuucguucccagcagcaucaag

SEQ ID NO: 455546 - RNA, 61 nt, hsa
acacacacauacacauauauuaugcauguggugaaaagaauuggcuagauaggggauuuuu

SEQ ID NO: 455547 - RNA, 61 nt, hsa
acuuuugggugucuguauccuaagaaguuucugaaaagaucuaaagccuuuuuaucccaua

SEQ ID NO: 455548 - RNA, 61 nt, hsa
uuguugaaaauauaauguaugcuauguuaaaugaaaagaucgauugggaauuuaaaaacga

SEQ ID NO: 455549 - RNA, 61 nt, hsa
agacugaagugugcagguucuucuauguuuuugaaaagaagguggggucuuggauaucacc

SEQ ID NO: 455550 - RNA, 61 nt, hsa
uguuagauuaaagcugcacccugugauuauuugaaaagaauuagcuugagaguaaugucac

SEQ ID NO: 455551 - RNA, 61 nt, hsa
auugucccccagaaaagauuaagaugcuacuugaaaagacugugaagauuuuuuacauugc

SEQ ID NO: 455552 - RNA, 61 nt, hsa
auagauaacauggcuuuuacuccuuacuguuugaaaagauaaguacuuuagcuucuuucug

SEQ ID NO: 455553 - RNA, 61 nt, hsa
cacaccugacuuaacaucucuaaacucagauugaaaagagaccgaaugugcagauuccaca

SEQ ID NO: 455554 - RNA, 61 nt, hsa
caacccaguucuguuugacuauguagcaucuugaaaagaaaaauuauaauaaagccccaaa

SEQ ID NO: 455555 - RNA, 61 nt, hsa
ccaugugucccccaguacuuauaaaagggagugaaaagaccgagcuguaaggcaugugccu

SEQ ID NO: 455556 - RNA, 61 nt, hsa
ugcauuguuuuuagcucagguuuugauaaggugaaaagaauagucaccaggguuacucaga

SEQ ID NO: 455557 - RNA, 61 nt, hsa
cauaacugguggggcacaucuaacucaacugugaaaagacacaucacacaaucaccuugcu

SEQ ID NO: 455558 - RNA, 61 nt, hsa
gcacaaggcagagcugggaugaaaacagggcugaaaagacucagggccaauuauuggcuga

SEQ ID NO: 455559 - RNA, 61 nt, hsa
gaaagaaggugauuuguauuugucuccccgcugaaaagaacaggauucaaguccagaguuu

SEQ ID NO: 455560 - RNA, 61 nt, hsa
ucuaccauuaaaaucuugaaagcgaaauacuugaaaagaggugaccauaaagaucacacca

SEQ ID NO: 455561 - RNA, 61 nt, hsa
auaagcagguuauuuuuauuuuuuuacuguuugaaaagaaauaaguagugucauucauaug

SEQ ID NO: 455562 - RNA, 61 nt, hsa
uuuuucuuccuauucagaaaagagcaaaaugugaaaagacacaagacucucagguauagaa

SEQ ID NO: 455563 - RNA, 61 nt, hsa
gcuaagggaagaggaaggaauaacaacucagugaaaagauggucuccaguuucugaaugaa

SEQ ID NO: 455564 - RNA, 61 nt, hsa
cuuuuacuauguguaagaaauaccccaaacaugaaaagauuguuuugaucauaugcaugua

SEQ ID NO: 455565 - RNA, 61 nt, hsa
caaugucuaugcuucucgauagcugugaacaugaaaagacaucuauugggaguccgaggca

SEQ ID NO: 455566 - RNA, 61 nt, hsa
uggaaauugaaaaacgaaaaucguguguguuugaaaagaagaaugcaacuuguauauuuug

SEQ ID NO: 455567 - RNA, 61 nt, hsa
gugggcaaacccuucuacaaaguuuuuguuuugaaaagagcaaaaguaaaaaguguucugu

SEQ ID NO: 455568 - RNA, 61 nt, hsa
aggccuguacauacuucucccaaagcgccacugaaaagauggcauagcuuaaaagaugaaa

SEQ ID NO: 455569 - RNA, 61 nt, hsa
acugcaauaaguggguuuuagaaaauaagugugaaaagaaucagguguuaauauaauacua

SEQ ID NO: 455570 - RNA, 61 nt, hsa
cacgugacagugacaacacagugacugccucugaaaagagcccugaggcaaacacucucuc

SEQ ID NO: 455571 - RNA, 64 nt, hsa; identical to SEQ ID NO: 173467

SEQ ID NO: 455572 - RNA, 64 nt, hsa; identical to SEQ ID NO: 173468

SEQ ID NO: 455573 - RNA, 64 nt, hsa; identical to SEQ ID NO: 173469

SEQ ID NO: 455574 - RNA, 64 nt, hsa; identical to SEQ ID NO: 173470

SEQ ID NO: 455575 - RNA, 64 nt, hsa; identical to SEQ ID NO: 173471

SEQ ID NO: 455576 - RNA, 64 nt, hsa; identical to SEQ ID NO: 173472

SEQ ID NO: 455577 - RNA, 64 nt, hsa; identical to SEQ ID NO: 173473

SEQ ID NO: 455578 - RNA, 64 nt, hsa; identical to SEQ ID NO: 173474

SEQ ID NO: 455579 - RNA, 64 nt, hsa; identical to SEQ ID NO: 173475

SEQ ID NO: 455580 - RNA, 64 nt, hsa; identical to SEQ ID NO: 173476

SEQ ID NO: 455581 - RNA, 64 nt, hsa; identical to SEQ ID NO: 173477

SEQ ID NO: 455582 - RNA, 64 nt, hsa; identical to SEQ ID NO: 173478

SEQ ID NO: 455583 - RNA, 64 nt, hsa; identical to SEQ ID NO: 173479

SEQ ID NO: 455584 - RNA, 64 nt, hsa; identical to SEQ ID NO: 173480

SEQ ID NO: 455585 - RNA, 64 nt, hsa; identical to SEQ ID NO: 173481

SEQ ID NO: 455586 - RNA, 64 nt, hsa; identical to SEQ ID NO: 173482

SEQ ID NO: 455587 - RNA, 64 nt, hsa; identical to SEQ ID NO: 173483

SEQ ID NO: 455588 - RNA, 64 nt, hsa; identical to SEQ ID NO: 173484

SEQ ID NO: 455589 - RNA, 64 nt, hsa; identical to SEQ ID NO: 173485

SEQ ID NO: 455590 - RNA, 64 nt, hsa; identical to SEQ ID NO: 173486

SEQ ID NO: 455591 - RNA, 64 nt, hsa; identical to SEQ ID NO: 173487

SEQ ID NO: 455592 - RNA, 64 nt, hsa; identical to SEQ ID NO: 173488

SEQ ID NO: 455593 - RNA, 64 nt, hsa
aaaaugccaaacauguuggcaucaauuuuauacagggauauaaaaaaguauauguggauaaauu

SEQ ID NO: 455594 - RNA, 64 nt, hsa
aaaguauauguggauaaauuuuuuguaaucuuuagggauauaaaaaaguguauguggauaaauu

SEQ ID NO: 455595 - RNA, 64 nt, hsa
auagauuaacuguagaauucuuccuguacgauuggggauauaaugggcuucacuaaccuucccu

SEQ ID NO: 455596 - RNA, 64 nt, hsa
ggaggucauccaacugacuuuaucaaguggaauugggauauauuugauauacuucugccuaaca

SEQ ID NO: 455597 - RNA, 64 nt, hsa
aacaaauggaaaaagaagaugucccuaaccuacacccauagauuaccaagguuucaguguacua

SEQ ID NO: 455598 - RNA, 64 nt, hsa
aaguuaaaacaaaacauggaugucugggucccgccccauagagaaugacuuaauuggcaugggg

SEQ ID NO: 455599 - RNA, 64 nt, hsa; identical to SEQ ID NO: 153609

SEQ ID NO: 455600 - RNA, 64 nt, hsa; identical to SEQ ID NO: 153610

SEQ ID NO: 455601 - RNA, 64 nt, hsa; identical to SEQ ID NO: 153611

SEQ ID NO: 455602 - RNA, 64 nt, hsa; identical to SEQ ID NO: 153612

SEQ ID NO: 455603 - RNA, 64 nt, hsa; identical to SEQ ID NO: 153613

SEQ ID NO: 455604 - RNA, 64 nt, hsa; identical to SEQ ID NO: 153614

SEQ ID NO: 455605 - RNA, 64 nt, hsa; identical to SEQ ID NO: 153615

SEQ ID NO: 455606 - RNA, 64 nt, hsa; identical to SEQ ID NO: 153616

SEQ ID NO: 455607 - RNA, 64 nt, hsa; identical to SEQ ID NO: 153617

SEQ ID NO: 455608 - RNA, 64 nt, hsa; identical to SEQ ID NO: 153618

SEQ ID NO: 455609 - RNA, 64 nt, hsa; identical to SEQ ID NO: 153619

SEQ ID NO: 455610 - RNA, 64 nt, hsa; identical to SEQ ID NO: 153620

SEQ ID NO: 455611 - RNA, 64 nt, hsa; identical to SEQ ID NO: 153621

SEQ ID NO: 455612 - RNA, 64 nt, hsa; identical to SEQ ID NO: 153622

SEQ ID NO: 455613 - RNA, 64 nt, hsa; identical to SEQ ID NO: 153623

SEQ ID NO: 455614 - RNA, 64 nt, hsa; identical to SEQ ID NO: 153624

SEQ ID NO: 455615 - RNA, 64 nt, hsa; identical to SEQ ID NO: 153625

SEQ ID NO: 455616 - RNA, 64 nt, hsa; identical to SEQ ID NO: 153626

SEQ ID NO: 455617 - RNA, 64 nt, hsa; identical to SEQ ID NO: 153627

SEQ ID NO: 455618 - RNA, 64 nt, hsa
aacacggcccuccugggaaccuccuuaccuggaguaaccggacaccuuagacggaggugccuga

SEQ ID NO: 455619 - RNA, 64 nt, hsa
gagcuuuaugucuuuuauucauucuaauucuuauuaaccggaauauguaggaccauuucaauac

SEQ ID NO: 455620 - RNA, 64 nt, hsa
gauaacacaaguaaaacugugguacugauggacuuaaccggaguucggaaaccguccuguguac

SEQ ID NO: 455621 - RNA, 64 nt, hsa
uaggaguguuaggggcagaaguuuugaaugcacuuaaccggaggagggcgcaggguggggggua

SEQ ID NO: 455622 - RNA, 64 nt, hsa
ggagguggagugaaaguucacccccaugucuguguaaccggagucaaggccaggcuggcagagu

SEQ ID NO: 455623 - RNA, 64 nt, hsa
aaucgggauuccauuuguguaaaaacuagggugguaaccggaaaaaaauauugucaguauuuca

SEQ ID NO: 455624 - RNA, 64 nt, hsa
ggguccacgggacgauggcuuugccagcuuaaaguaaccggauggcggacaccuggcccccgag

SEQ ID NO: 455625 - RNA, 64 nt, hsa
aggaauaaauagaaccuguugugcaaccacgguuuaaccggagauuuugaggcuaggguguguu

SEQ ID NO: 455626 - RNA, 64 nt, hsa
auaucacuguguuugaaucgagggggaggggugguaaccggaaauaaagaccuccgaucuuccg

SEQ ID NO: 455627 - RNA, 64 nt, hsa
aauugcagaacuaaacucauuuauaaagcuaaaauaaccggauauauacauagcaugacauuuc

SEQ ID NO: 455628 - RNA, 64 nt, hsa
uauagagaaaauaaaauuuuuuccuuuuuuuuuuuaaccggaaagugcauuugcuuggguguaa

SEQ ID NO: 455629 - RNA, 64 nt, hsa
cugcccaguggcucuuaaacaguuuagcaacuaauaaccggagaacuaacauguaguauuugug

SEQ ID NO: 455630 - RNA, 64 nt, hsa
cuuuaaccaguuauuuacaguuaccuuuuuccuuuaaccggauugugaaagcuucauguauuuu

SEQ ID NO: 455631 - RNA, 64 nt, hsa
uuguguguguguguguguguguuuuuaaucacuguaaccggaugcauuuuuuuaaggcaaaauu

SEQ ID NO: 455632 - RNA, 64 nt, hsa
uggcaccccagcucacugggagucucaggagggauaaccggauuucugcucuuuccccugucac

SEQ ID NO: 455633 - RNA, 64 nt, hsa
ucagaagugccucacuguucucgugaccuggaguuaaccggaacagcgucuucauucauuucug

SEQ ID NO: 455634 - RNA, 64 nt, hsa
caaacugcccgugacuuuuucugaauggacuucauaaccggaagacuuaaccgguggccucauc

SEQ ID NO: 455635 - RNA, 64 nt, hsa
uauaguguaaaugcuaauuaaccauauugguauauaaccggaauuuuauauuaaaaggggccuc

SEQ ID NO: 455636 - RNA, 64 nt, hsa
acuccucuaaccgguaccucugaauggggcuggauaaccggagaccccaugggaggucccugaa

SEQ ID NO: 455637 - RNA, 64 nt, hsa
auaaagcugaaaaucgcauggcgcucagacauuuuaaccggaacugauguauaaucacaaaucu

SEQ ID NO: 455638 - RNA, 64 nt, hsa
accaucaccaccaccauggacaacaagccuuggguaaccggaccaggccaagggucuacaauuc

SEQ ID NO: 455639 - RNA, 64 nt, hsa
gggcuagcugcaccucacauuucuuggacauauaccguuggacaugucuaucuucuggaaacua

SEQ ID NO: 455640 - RNA, 64 nt, hsa
ccgccacuuccagcgaacacacacagguguccugccguuggaccuucaccuccuagagauaaac

SEQ ID NO: 455641 - RNA, 64 nt, hsa
aagccuuaucucagccuuuccucaauaugggguuccguuggauuggggcuccuccaugacuagu

SEQ ID NO: 455642 - RNA, 64 nt, hsa
acacaugugagacccaguccuguuugguuuucuuccguuggaaccacccagacaucugcuucca

SEQ ID NO: 455643 - RNA, 64 nt, hsa
aaaaauggagguaguuccaaaaaaguggcaaaucccguuggagguuuugaaguccaacaaauuu

SEQ ID NO: 455644 - RNA, 64 nt, hsa
gucuuagaugauaucuguaaccaguuucugaaucccguuggauaaaacuguauugugauaucua

SEQ ID NO: 455645 - RNA, 64 nt, hsa
cacucagggugggggacagcaggaucaagacaacccguuggagccccuguguuccagaggaccu

SEQ ID NO: 455646 - RNA, 64 nt, hsa
gggcuaggugcacuacagccucuuuccccgugucccguuggaucugagcuguguagcacuuguu

SEQ ID NO: 455647 - RNA, 64 nt, hsa
gauguauuuuguauuuuaagagucucaugcucuaccguuggaacuagccagauggccauuauuu

SEQ ID NO: 455648 - RNA, 64 nt, hsa
gcauccuccgaaucccagggcuggguguagguagccguuggaggccaucgcuacagggcaccua

SEQ ID NO: 455649 - RNA, 64 nt, hsa
agugugaccggcgcuaggaaaugacccgagaaccccguuggaagcgcagcagcgggagcuaggg

SEQ ID NO: 455650 - RNA, 64 nt, hsa
cuauauccugggacccuguaaagguccaugacauccguuggaacuuugaaaaguuccugguggg

SEQ ID NO: 455651 - RNA, 64 nt, hsa
ugauuuuucauauguggaaauauaccuaccucuuccguuggaaagaacauuuaaaauuaaauaa

SEQ ID NO: 455652 - RNA, 64 nt, hsa
uggaagcccuggccugggaggaggucauaccccaccguuggagcccagcugccuguuuucuuuu

SEQ ID NO: 455653 - RNA, 64 nt, hsa
gugauggacccaggaggucucugcagagcaagugccguuggaccagcugauucacaaagugcug

SEQ ID NO: 455654 - RNA, 64 nt, hsa
gcugaaguucuuggaaggcucccacccaggugccccguuggaaagcagauauuucccggaccca

SEQ ID NO: 455655 - RNA, 64 nt, hsa
cuuuuauucacucuugagcuguaacaaacaagccccguuggaacuuccuagugggaaugauggg

SEQ ID NO: 455656 - RNA, 64 nt, hsa
acagagggcuauggcuguggagaagguucuuggcccguuggacucacacagacccuguacccuc

SEQ ID NO: 455657 - RNA, 64 nt, hsa
cuuccuccagggacucuggggcccuuugguggggccguuggacuucuggaugcuugucuauuuc

SEQ ID NO: 455658 - RNA, 64 nt, hsa
guaacaccuacaccauuaucuuggaaagaaacaaccguuggaaacauaaccauuacagggagcu

SEQ ID NO: 455659 - RNA, 64 nt, hsa
cgaccccccuuuucacgucccuucugccucugccccguuggaugcccugacugggggcagggga

SEQ ID NO: 455660 - RNA, 64 nt, hsa
gggaaccaggcugagcugaguggccucaaaccccccguuggaucagacccuccugugggcaggg

SEQ ID NO: 455661 - RNA, 64 nt, hsa
cucucccuuuccccaggcagcucgccuggccacaccguuggagugaacccucacugcccucaag

SEQ ID NO: 455662 - RNA, 64 nt, hsa
cagcacagugaggcauuuagguaucucucggugaccguuggauuccuggaagcaguagcuguuc

SEQ ID NO: 455663 - RNA, 64 nt, hsa
cuucuuuguagagcccaccgcuaccucccucuccccguuggauguccauuccauuccccaggug

SEQ ID NO: 455664 - RNA, 64 nt, hsa
ccagcccccugucgccuguccagggccugcccacccguuggaggccgguggagaagccccaccu

SEQ ID NO: 455665 - RNA, 64 nt, hsa
uggggccugugugcuucccagacucucccuccagccguuggaaucgcugaagauggcaaugaaa

SEQ ID NO: 455666 - RNA, 63 nt, hsa
auucgcugcuggugaauugauucgaccugacugccguuggaccguaggcccuggacugcagag

SEQ ID NO: 455667 - RNA, 64 nt, hsa
ccugaacccuagaacugucuucgacuccggggccccguuggaagacugagugcccggggcacgg

SEQ ID NO: 455668 - RNA, 64 nt, hsa
ccaagaaacaaagccuacaugccgcuuacagcccccguuggaugguugcucaguacaacagucu

SEQ ID NO: 455669 - RNA, 64 nt, hsa
uuguagguucuucacucacucacucaacaaauacccguuggaagagucuuaaacuggggcuuca

SEQ ID NO: 455670 - RNA, 64 nt, hsa
agcugggaaagcccaggccgcaggagugggaugcccguuggacuuugccccucacacuggccca

SEQ ID NO: 455671 - RNA, 64 nt, hsa
uuccaggcccugcucuccacggccucccucuggcccguuggaggggcaggcugaggcuguggag

SEQ ID NO: 455672 - RNA, 64 nt, hsa
agccugggggaguggggaaggcuugggcauggccccguuggagguugauuugcuguuuuguuuc

SEQ ID NO: 455673 - RNA, 64 nt, hsa
aaguuaaugagguuuuuaaaauaagguuuucuaguuuugagagugugcacuucacacaggggaa

SEQ ID NO: 455674 - RNA, 64 nt, hsa
uccugguaaggauuuggggcauaguuuuuuguuuuuuugagacggaguuucgcucuuguugccc

SEQ ID NO: 455675 - RNA, 64 nt, hsa
uucuuagaaucuaacguuacucaguuacuaauucuuuugagaacuccuaagagaccaauuugua

SEQ ID NO: 455676 - RNA, 64 nt, hsa
augacaaccagacauuuccaguugguuuuguaaguuuugagaaucuagauacuggguuuuauuu

SEQ ID NO: 455677 - RNA, 64 nt, hsa
aguuccauccaacuuucugaaauuucauuuuuuuuuuugagauggagucucucucugucaccca

SEQ ID NO: 455678 - RNA, 64 nt, hsa
aacuagugcucuuccuaaaguuccuuuaauguccuuuugagauuuugagccauggaacuuacuu

SEQ ID NO: 455679 - RNA, 64 nt, hsa
ccaccacgcccggccuuuuuuuuuuuuuuuucuuuuuugagauggaguuucacucuuguugccc

SEQ ID NO: 455680 - RNA, 64 nt, hsa
uaacacagauuuuuuuauuuuuuauuuuuuuuuauuuugagacggaguuuugcucugucgcgca

SEQ ID NO: 455681 - RNA, 64 nt, hsa
aaagaacauaaagguaaaacaaaacaaaacaacauuuugagaacaaagaugaccauaaccacug

SEQ ID NO: 455682 - RNA, 64 nt, hsa
gguguggacugaaugggaucaugaaaguagacaguuuugagaacguaaagaacuuuuucuuuuc

SEQ ID NO: 455683 - RNA, 64 nt, hsa
aaaaaacuuagaguuaguuuuagggcacuuuuuauuuugagagcaugaaguguggaauguguca

SEQ ID NO: 455684 - RNA, 64 nt, hsa
aauacuuaccauaaagucuuucaguguaauuuuuuuuugagacagagucuugcuuugucaccca

SEQ ID NO: 455685 - RNA, 64 nt, hsa
caauucucuguuuuguuuuguuuuuauuuuuguuuuuugagaugaagucucacugcacucaggc

SEQ ID NO: 455686 - RNA, 64 nt, hsa
uauaauuuuauaaacacaaauucaugauuaucuguuuugagaguuuuaaguuuuguuuuaaugu

SEQ ID NO: 455687 - RNA, 64 nt, hsa
uaaauagaauaauagcuuugaaauacaauuagguuuuugagauuuuuauaaccaaauacauuuc

SEQ ID NO: 455688 - RNA, 64 nt, hsa
acagucaagaccauuaauggucuucuccaaaauauuuugagauauaaaaguaggaaacagguau

SEQ ID NO: 455689 - RNA, 64 nt, hsa
aagcacuaccuuccccagagcuugccagguuggguuuugagauuagggucaggucauggguaug

SEQ ID NO: 455690 - RNA, 64 nt, hsa
cacagauggccugagauaagcaguacaaguagguuuuugagacaaucaccaagugcaguuucau

SEQ ID NO: 455691 - RNA, 64 nt, hsa
ccaccgcguccggccucuuuuuuucuuuucuuuuuuuugagacaaagucucacugugucaccca

SEQ ID NO: 455692 - RNA, 64 nt, hsa
ggaagagugaagcguuuuucuuuuucuuuuuuuuuuuugagacggagucucucacugucgccca

SEQ ID NO: 455693 - RNA, 64 nt, hsa
guagauucccccguugucacuaaucacacaacaauuuugagaaguaggcuauaaaacaaaaaaa

SEQ ID NO: 455694 - RNA, 64 nt, hsa
auaucauaaauugauaauuuugcaaaaugcacuuuuuugagaugcagauauagcaaaggauuag

SEQ ID NO: 455695 - RNA, 64 nt, hsa
gccagauuuucacauuuuuaaaauguucuagucauuuugagaaaucauauaucuuacacaguuc

SEQ ID NO: 455696 - RNA, 64 nt, hsa
ugccaccucuggcauuuucuuucuuuuuuuuucuuuuugagacggaguuucgcuuuuguccccc

SEQ ID NO: 455697 - RNA, 64 nt, hsa
uuuuuccuaaguaacuguaauaggaaaaaguuuauuuugagaguuucuucuucauaaaucuaca

SEQ ID NO: 455698 - RNA, 64 nt, hsa
auagaagaugcaugauuucuggguuuuuuuuuuuuuuugagacagaguuucgcucuuguugccc

SEQ ID NO: 455699 - RNA, 64 nt, hsa
uagcauucuguuuuuuugauccuaugucauaauuuuuugagaaaauguuugauacugcaagauc

SEQ ID NO: 455700 - RNA, 64 nt, hsa
gagcaaaaaguagaagugauaaaugcaaguuauguuuugagauugcuuacaccgugacaagaug

SEQ ID NO: 455701 - RNA, 64 nt, hsa
aauuuguucauaauggcucauguauuauuauuauuuuugagauggaguuuugcucuuaaugaua

SEQ ID NO: 455702 - RNA, 64 nt, hsa
caggggcuuugaccacgaccuuugaagagcuucauuuugagaucaagccccacgaugacugcac

SEQ ID NO: 455703 - RNA, 64 nt, hsa
ggugcuauuuuguuuguuuuguuuuguuuuguuuuuuugagacagaaucucgcucugucgccca

SEQ ID NO: 455704 - RNA, 64 nt, hsa
ugcgaauguucuccucuuaaagaauagcuucaaauuuugagaccagugguucccacuaaguaua

SEQ ID NO: 455705 - RNA, 64 nt, hsa
gucuuuuuuuuaauuuauuuauuuauuuauuuauuuuugagauggagucuugcucugucaccca

SEQ ID NO: 455706 - RNA, 64 nt, hsa
uuuucuuucuuucuuucuuuucuuuuuuuuuuuuuuuugagacggagucucacucuuguugccc

SEQ ID NO: 455707 - RNA, 64 nt, hsa
aaugaagaacaaaaaaaaagauugauuuuuuuuuuuuugagacaggaucucacucugucaucca

SEQ ID NO: 455708 - RNA, 64 nt, hsa
auaggaaaccaguuauuccuucuaccuuuaaaaauuuugagaacuugccaaccagggauuaaag

SEQ ID NO: 455709 - RNA, 64 nt, hsa
cugccaccugaauaaaaugaaaaaaaaaguguuuuuuugagacagagucuugcucuguugccca

SEQ ID NO: 455710 - RNA, 64 nt, hsa
uuagcccaagacaccaugacaaaauagcccagccuuuugagaguaauuugggaaaagaagcugu

SEQ ID NO: 455711 - RNA, 64 nt, hsa
uuuuuuuuuuaagaagaaagaaaaugcaagcuaguuuugagaaaggaaggccaaauugggucgg

SEQ ID NO: 455712 - RNA, 64 nt, hsa
guaguaaaggaaaaccaacccucuggaaaauacauuuugagaaucucaaacaucucacauauau

SEQ ID NO: 455713 - RNA, 64 nt, hsa
uuucuuuuucuaacggcaaggaagauaugugcccuuuugagaauucaagauggcacugacacgg

SEQ ID NO: 455714 - RNA, 64 nt, hsa
caaagucaagagucuuaaccuuguacucagggaauuuugagauaacaagucccuugggcaccuu

SEQ ID NO: 455715 - RNA, 64 nt, hsa
aggggugggaaggaagagcgucccuuccuucuccuuuugagaaaaccacagaacuaugacucuc

SEQ ID NO: 455716 - RNA, 64 nt, hsa
ugcuagucugucauuucuggagugauacuuuuuuuuuugagacggagucugcucugucgcucgc

SEQ ID NO: 455717 - RNA, 64 nt, hsa
uuuguuuuguuuugcuuuguuuuuguuguuguuguuuugagacagggucucacuguguccccca

SEQ ID NO: 455718 - RNA, 64 nt, hsa
ggagcuucucugaugugauauccacuuuuuuuuuuuuugagauggagucucacucugucaccca

SEQ ID NO: 455719 - RNA, 64 nt, hsa
uugugaucugcccgccuccauuuuuguuguuauuuuuugagaaagauagauaugagguuuagag

SEQ ID NO: 455720 - RNA, 64 nt, hsa
agcacaggucuagagaaaugauaccuuuuuuuuuuuuugagacagagucucacucuguugccca

SEQ ID NO: 455721 - RNA, 64 nt, hsa
augaguagugggguuuuuugguuuuguuuguuuguuuugagacagagucuugcucugucgccga

SEQ ID NO: 455722 - RNA, 64 nt, hsa
auacauuguuuuagauccccugauacagaacuacuuuugagaugguaagauuagaauaucauga

SEQ ID NO: 455723 - RNA, 64 nt, hsa
ugagaaagauuuugagauauacauuguuuuuuguuuuugagacagggucucacucuugccuagg

SEQ ID NO: 455724 - RNA, 64 nt, hsa
aaaagaaauaauuggcaccauguucugagaaagauuuugagauauacauuguuuuuuguuuuug

SEQ ID NO: 455725 - RNA, 64 nt, hsa
cugugccuuuacucugcaucuuugccaugauucuuuuugagacagagucucuggugcccaggcu

SEQ ID NO: 455726 - RNA, 64 nt, hsa
caguuugguauuuuaaaaauugucuauuguuaaauuuugagauucauacacuacauuuacaaaa

SEQ ID NO: 455727 - RNA, 64 nt, hsa
uacuugucuuaguauuauauguagauaugugauuuuuugagacuguauuuuuagagcugaauuu

SEQ ID NO: 455728 - RNA, 64 nt, hsa
auuuacuuguuuuguuuuuguguuuguuuuguuuuuuugagauggaguuucacucuugucaccu

SEQ ID NO: 455729 - RNA, 64 nt, hsa
uucuccuaccucuuccaacccuccauuagcucaauuuugagauaauggaaaauugacuggaaau

SEQ ID NO: 455730 - RNA, 64 nt, hsa
uggguacugcuuucauaaaacaguuuuuucaguauuuugagaauugccauauuaauuuuuauaa

SEQ ID NO: 455731 - RNA, 64 nt, hsa
cauuuucuuggcauguuaaaucaagcuuaaaaaguuuugagaaaauuuuacugcgcuguguugc

SEQ ID NO: 455732 - RNA, 64 nt, hsa
cauuauggugauacacauaugugaauucaguacauuuugagacaguauucuaccauucaguaau

SEQ ID NO: 455733 - RNA, 64 nt, hsa
uggcuuuucuaauuuuuaauuaauuaauuuauuuuuuugagacagagucuuguucugucgccag

SEQ ID NO: 455734 - RNA, 64 nt, hsa
auacuuguguuuuugauacaucuccaugaaguucuuuugagaggagaggcuauuuugauguuuu

SEQ ID NO: 455735 - RNA, 64 nt, hsa
auuauuauuauuauuauuauuauuauuuuuuuuuuuuugagacggagucuccugaccuaaucuu

SEQ ID NO: 455736 - RNA, 64 nt, hsa
ucugaaguuauuaaagcuaaaacugcacuaagccuuuugagacauccuuuauucuuaaaaagcu

SEQ ID NO: 455737 - RNA, 64 nt, hsa
aacuuagauguaacuuagcacuuuuuuuuuuuuuuuuugagauggagucucacucugucaccag

SEQ ID NO: 455738 - RNA, 64 nt, hsa
gcgcugccacacccagguaauuuauuuauuuuuuuuuugagacagagucucgcacuguugccca

SEQ ID NO: 455739 - RNA, 64 nt, hsa
agguacauggacuauaucgcacaacaggugcuaguuuugagaaggcccaacaggaguuugcaac

SEQ ID NO: 455740 - RNA, 64 nt, hsa
auacuugaaucccuaaaugcaccugucuuucacuuuuugagacagacugaauauaucuaaaauu

SEQ ID NO: 455741 - RNA, 64 nt, hsa
aaaauaucuaaaauaauguucauggugaaucuuauuuugagaaauacauguuaaaaaaggaaca

SEQ ID NO: 455742 - RNA, 64 nt, hsa
cgagccaccacaccuggccaaaaaaauuuauauuuuuugagacaaggucucacucugucaccca

SEQ ID NO: 455743 - RNA, 64 nt, hsa
gccuggcuggauaugaaauuuuuuuuuuuuuuuuuuuugagacaggguuucgcucuuguugcca

SEQ ID NO: 455744 - RNA, 64 nt, hsa
uuucuuuucuuuucuuucuuuuuuuuuuuuuccuuuuugagacagggucuuacucuugucaccc

SEQ ID NO: 455745 - RNA, 64 nt, hsa
caaugugcccauccaaaguuuuauuuauuuauuuuuuugagauggagucucguaaaguuaccuu

SEQ ID NO: 455746 - RNA, 64 nt, hsa
ugaaaaaggaaguaauauaaauuuugugggguuuuuuugagauggagucuuacucuuuugccag

SEQ ID NO: 455747 - RNA, 64 nt, hsa
agcucuuuagcuccaauuucccuuaagcaaaguuuuuugagaagggaaaugacccaaaggaaag

SEQ ID NO: 455748 - RNA, 64 nt, hsa
uuuucuuccuuuuucuuuuuucuuuuuuuuuuuuuuuugagauggagucucacucugucacaca

SEQ ID NO: 455749 - RNA, 64 nt, hsa
uauaguaaaaccuugggauauagaauauuacaucuuuugagaauguaugugucucuaaguaagu

SEQ ID NO: 455750 - RNA, 64 nt, hsa
ugcuuguuugucgguuuuguuuuguguuuuguuuuuuugagaugaagucucgcucuguugccca

SEQ ID NO: 455751 - RNA, 64 nt, hsa
aauuauauggaucucuuuuuuuuuuuuuuuuuuuuuuugagacggaguuucugucuuguugccc

SEQ ID NO: 455752 - RNA, 64 nt, hsa
ugcuuaaguauaccuaucacuuacauuuuugugguuuugagaaaguacagcaguagacuggggc

SEQ ID NO: 455753 - RNA, 64 nt, hsa
caccauuuuguaaguuauguuuuacaugccccguuuuugagacugaucucgaugcagguggauc

SEQ ID NO: 455754 - RNA, 64 nt, hsa
guucucugauuucugguggcuuuuagacacuaauuuuugagaacuacuuuuuuuuuuuuaccaa

SEQ ID NO: 455755 - RNA, 64 nt, hsa
cagguguugcugaugcuggugauuggguaccacauuuugagaaccauggggcauuggcaaucaa

SEQ ID NO: 455756 - RNA, 64 nt, hsa
augauagaagguuuuuuuuuuuuuuuuuuuuuuuuuuugagacggagucccacucuugucgccc

SEQ ID NO: 455757 - RNA, 64 nt, hsa
uuguguuauugauuauauacaaaggagacuuuuuuuuugagauaacacucaaauaguauucucu

SEQ ID NO: 455758 - RNA, 64 nt, hsa
agguaauaagcuucacuuuuuguguucuaauuguuuuugagauauaaagacccugaaaaagccc

SEQ ID NO: 455759 - RNA, 64 nt, hsa
ucuucuuauccaucaccaugcucccugaaagccuuuuugagauuaagaaauuuucuuaccagga

SEQ ID NO: 455760 - RNA, 64 nt, hsa
cugacugacaguucauccccacaaaacacauugguuuugagaggugaugcaaaaaguaucuguu

SEQ ID NO: 455761 - RNA, 64 nt, hsa
ccuaguucaguaucuuuuuuuuuuuuuuuuuuuuuuuugagacagugccucacucugucaccca

SEQ ID NO: 455762 - RNA, 64 nt, hsa
cuuuugugucuggcuucuuucacuuaguacaaguuuuugagauuuauuuacauaguagcaugua

SEQ ID NO: 455763 - RNA, 64 nt, hsa
aguuuuuaauugggcuguuaugaucaguaguugauuuugagaaagcucuaugagcucuaaguaa

SEQ ID NO: 455764 - RNA, 64 nt, hsa
acucacucaguuguguguagguuuuuuuguuuuguuuugagagagaauuuuucucuccuuaaua

SEQ ID NO: 455765 - RNA, 64 nt, hsa
gaaugaagaaggcaaaaaacuuuuuuuuuuuuuuuuuugagacggagucucgcucugucgccca

SEQ ID NO: 455766 - RNA, 64 nt, hsa
cuuauauaagggauaauuuuucuuuuuuuuuuuuuuuugagacggagucucacucuuccgccca

SEQ ID NO: 455767 - RNA, 64 nt, hsa
auauacauacacacauacauauaauuuuuuuuuuuuuugagauggaguuucacucugucgccca

SEQ ID NO: 455768 - RNA, 64 nt, hsa
guuuuacugagccuucugacuaugccuuguucucuuuugagauauauauuuucacagucuuuuc

SEQ ID NO: 455769 - RNA, 64 nt, hsa
aacuuaacauuuugcacagaauauaucaaauauauuuugagaaaaaaaguacggcaugaguucu

SEQ ID NO: 455770 - RNA, 64 nt, hsa
ucucacaaaaaaucuuauuucagaauggaaauauuuuugagaaaaguagcugaguauacugguu

SEQ ID NO: 455771 - RNA, 64 nt, hsa
acuuuaauaguguuacuuggauagcuuauaugaauuuugagaauuuuauaugaauuuugagaaa

SEQ ID NO: 455772 - RNA, 64 nt, hsa
auagcuuauaugaauuuugagaauuuuauaugaauuuugagaaagcaaguucaaaagaacucug

SEQ ID NO: 455773 - RNA, 64 nt, hsa
uauagauaauguucaaugaccucaagacauauauuuuugagaaauuaucauuuuaaaaaauuug

SEQ ID NO: 455774 - RNA, 64 nt, hsa
guagagcuauaucauugucuguuaauguauuauauuuugagauuuuuuuugaucuaagguuuua

SEQ ID NO: 455775 - RNA, 64 nt, hsa
aaguucaaaaaccaucccuuaaaggugauuguuuuuuugagacagagucuugcucugucaccca

SEQ ID NO: 455776 - RNA, 64 nt, hsa
aaaaugugauucuguaacuuuuuuauuuuuauuuuuuugagauaauuucacucuuguugcccag

SEQ ID NO: 455777 - RNA, 64 nt, hsa
uuccaucuuggcuaguuguggcguuuaguuuguuuuuugagacauggucacgcugugucgccaa

SEQ ID NO: 455778 - RNA, 64 nt, hsa
uuagaaacaaauuuuuuucuuguuuuuguuuuguuuuugagaccgaaucucacucuguugccca

SEQ ID NO: 455779 - RNA, 64 nt, hsa
uuuaacugggagugauaugauguguagggcuuuuuuuugagaauacacuaucaaaucagucuug

SEQ ID NO: 455780 - RNA, 64 nt, hsa
aaauaaaccuuugcuuuuuuuuuuuuuuuuuuuuuuuugagacggagucucgcucugucgccca

SEQ ID NO: 455781 - RNA, 64 nt, hsa
agagcaucuaugugccuucaucaagaagcccauguuuugagauuuugcucaugaaccaucugca

SEQ ID NO: 455782 - RNA, 64 nt, hsa
ggcuuuuucucaggucaggcuuuucaugaaaguauuuugagaacaaugaauugcaauaaccagc

SEQ ID NO: 455783 - RNA, 64 nt, hsa
cgccaggcaguuguauuuuuuuuuuuuuuuuuuuuuuugagacugaaucucacuccaucgucca

SEQ ID NO: 455784 - RNA, 64 nt, hsa
uggaaacuuacaggacuuaaauaucagugaaauauuuugagaucuuugaauaauuccuuuagag

SEQ ID NO: 455785 - RNA, 64 nt, hsa
auuaauauauaugaguccuuuguaauuuauuuuuuuuugagacaggaucucacuuuuaccgccc

SEQ ID NO: 455786 - RNA, 64 nt, hsa
cacuugcuagcaacucauacuacuaaugacagguuuuugagaauuguacugacaucacauguua

SEQ ID NO: 455787 - RNA, 64 nt, hsa
ucagcugaaaauuugguuggggugaauugaugguuuuugagaaguaggccagguauccucacaa

SEQ ID NO: 455788 - RNA, 64 nt, hsa
uugauucuccuuugguagguggaaucaguuaauguuuugagaaaccugccugggcucugcccuu

SEQ ID NO: 455789 - RNA, 64 nt, hsa
guagaccaaaaagaaccaaauccauagggugaaauuuugagaccuagacucuguaaaaauaauc

SEQ ID NO: 455790 - RNA, 64 nt, hsa
caaaagaaaaaaaauagacuuuuucaacucagcuuuuugagaccugaaaaaauuauuauguaaa

SEQ ID NO: 455791 - RNA, 64 nt, hsa
uucuaagacuacuaugaacaguuuucuuuuaaaauuuugagauuaagaaugccaggaauauugu

SEQ ID NO: 455792 - RNA, 64 nt, hsa
ggagguagauucagcaccuaacaauccuguaugcuuuugagaucacguuuagugcuauguccua

SEQ ID NO: 455793 - RNA, 64 nt, hsa
gauugauugauugauagaaagaaaguugcuuuucuuuugagaauuaaaaacuuuggcuugauuu

SEQ ID NO: 455794 - RNA, 64 nt, hsa
cauuguccccagacagggaucugggcccucagacuuuugagaauaugaagaggaggguugaggc

SEQ ID NO: 455795 - RNA, 64 nt, hsa
aaagugccaggaccagcuggguucacugauguguuuuugagauacuuaagguagaaaugauacc

SEQ ID NO: 455796 - RNA, 64 nt, hsa
uggucuccguuaaguauagggcuuuuugacagcuuuuugagaccucuuaagaaaaaauaaaaag

SEQ ID NO: 455797 - RNA, 64 nt, hsa
ccauuuucaaaaaccaucauguuuuguagauacauuuugagaaaaaccaucauguuuugaggau

SEQ ID NO: 455798 - RNA, 64 nt, hsa
auaaaauguuucagguauuuuuguuucauuuuguuuuugagauagggucuuuguugcucaggcu

SEQ ID NO: 455799 - RNA, 64 nt, hsa
ugcggguuggagaaaauacaauuuuuuuuuuuuuuuuugagacagucucgcucugucccccagg

SEQ ID NO: 455800 - RNA, 64 nt, hsa
acaacagaaaauuuggacagacuucaauuugccauuuugagauuugaccugugguagcaucugg

SEQ ID NO: 455801 - RNA, 64 nt, hsa
uugauuagucuuuaaaguaggcuuuuuuuuuuuuuuuugagaauacuggaccaucauuaaaugu

SEQ ID NO: 455802 - RNA, 64 nt, hsa
auuuuuuguuuguuuguuuguuuguuuguuuguuuuuugagauggagucuugcucugucgccca

SEQ ID NO: 455803 - RNA, 64 nt, hsa
ccuucuuuuucuuuuuuuuuuuuuuauuuuaauuuuuugagacggaguuucccucuugucaccc

SEQ ID NO: 455804 - RNA, 64 nt, hsa
augcaccaccacacccagcuaauuuuuuuuuuuuuuuugagaggagucucgcucugucgcccag

SEQ ID NO: 455805 - RNA, 64 nt, hsa
ucuugccuaaugcauauucucuuuuuuuuuuuuuuuuugagacggagucuuguucuguugccag

SEQ ID NO: 455806 - RNA, 64 nt, hsa
guaagcauugguacaguguccuguuuccugacuuuuuugagagaaaugucuacuuuuccuguuu

SEQ ID NO: 455807 - RNA, 64 nt, hsa
gaguuucuguauaacauaacugguuucuuucuuuuuuugagauggagucuugcucuguugccca

SEQ ID NO: 455808 - RNA, 64 nt, hsa
gguaaucgccaaauaguuccauuuuuuuuuuuuuuuuugagacagaguuucacucuuguugccc

SEQ ID NO: 455809 - RNA, 64 nt, hsa
ccaaauggucaacuuacuuaaaaaucuuuuccuguuuugagauagucacuggaucaagaaugca

SEQ ID NO: 455810 - RNA, 64 nt, hsa
ucuuagaggaccagccuccugggacugugacugcuuuugagagcucuucagagaucauaagaac

SEQ ID NO: 455811 - RNA, 64 nt, hsa
uaaaauccugucauuuagaacagugaaaaguaucuuuugagauuaaagugacucuuuacuguag

SEQ ID NO: 455812 - RNA, 64 nt, hsa
aaaccaucaucuguaaaaccaucuaugacaugaguuuugagaaacaauaauggggaaaauauuu

SEQ ID NO: 455813 - RNA, 64 nt, hsa
cccagguucaagcgauuccuuuuuuuuuuuuuuuuuuugagacagagucucacucuguccccca

SEQ ID NO: 455814 - RNA, 64 nt, hsa
guuccuacccuuuuuuuuuuuuaaucuuuuauuuuuuugagacagagucucacucugucaccca

SEQ ID NO: 455815 - RNA, 64 nt, hsa
uaugcccaucccaucuucaccccaagccuucuccuuuugagacuccucauccaguuucuuuagu

SEQ ID NO: 455816 - RNA, 64 nt, hsa
uuaggccuaacuccaaagcccuggcuuuuuuuuuuuuugagauggaaucuuacucugucaccgg

SEQ ID NO: 455817 - RNA, 64 nt, hsa
aaaggccaaaugauagcgggggcuaaguuggugcuuuugagaaccaaguaaaacaaaaccacug

SEQ ID NO: 455818 - RNA, 64 nt, hsa
cccauaggaguuagaaguuaggguuuaggcaucauuuugagaaugcugacacuuuuucagggcu

SEQ ID NO: 455819 - RNA, 64 nt, hsa
gagggaugggggaaaguaaaagauguuuuuuuuuuuuugagacucgcuuugucacccaggcugg

SEQ ID NO: 455820 - RNA, 64 nt, hsa
uaucuugguguaguuuuggcuuuuuuguuuguuuuuuugagacagcaucucacacugucgccca

SEQ ID NO: 455821 - RNA, 64 nt, hsa
ccagaaaaauguauggaugaauuuuuuuuuuuuuuuuugagacaaagucucacugugucaugca

SEQ ID NO: 455822 - RNA, 64 nt, hsa
ggccauguuuagcacugguugccagggauucucuuuuugagagagggaaagcaaaaugaaugga

SEQ ID NO: 455823 - RNA, 64 nt, hsa
ggugugagccacugugucuggccagaaaaggcauuuuugagaaagcaaaucguauaccuuauua

SEQ ID NO: 455824 - RNA, 64 nt, hsa
aaaggcuguuuuuuguuuuuuuuuuuuuuuuuuuuuuugagacggggucuggcuguguugcccu

SEQ ID NO: 455825 - RNA, 64 nt, hsa
auaucucuaauagaaucuuuuuuuuuuuuuuuuuuuuugagacagaguuucgcucuuguugccc

SEQ ID NO: 455826 - RNA, 64 nt, hsa
caagcuugaguuuuuauuuuuuauuuauuuauuuuuuugagauagggucucacuuuguuaccca

SEQ ID NO: 455827 - RNA, 64 nt, hsa
uaugauaaacuguauguaguuuuuagucuuucuguuuugagaagcagugguuggggcauuuuua

SEQ ID NO: 455828 - RNA, 64 nt, hsa
aaaaccacaaagcuacaaacugacccucuuuuuuuuuugagacggaguuuugcucuuguuaccc

SEQ ID NO: 455829 - RNA, 64 nt, hsa
aauuugacaaauggugcuguugcaaacacuuuuuuuuugagaugaagucucgcgguugucaccc

SEQ ID NO: 455830 - RNA, 64 nt, hsa
uucuucacuguugagaacaccuaaauguuuuuauuuuugagaaguggggacagagucucacuau

SEQ ID NO: 455831 - RNA, 64 nt, hsa
uauuuauauaacuuaaaaaguaaaaauaacuauguuuugagauauguauguguauauauaaaag

SEQ ID NO: 455832 - RNA, 64 nt, hsa
gcuggucuaaacuuauuuucacuuuuuguauuauuuuugagaugcaggaauuacuguaacaaaa

SEQ ID NO: 455833 - RNA, 64 nt, hsa
augcaguaaagaucacuuuuuuuuuuuuuuuuuuuuuugagauggagucuugcucugucgccca

SEQ ID NO: 455834 - RNA, 64 nt, hsa
agagauggugauuuguuuaguuucaucuuagauuuuuugagaacucaccagcuuuuauuaccca

SEQ ID NO: 455835 - RNA, 64 nt, hsa
gaaguacaggcaaacuugauguuugaaagauaaguuuugagaaaugucauuguauuuuggagua

SEQ ID NO: 455836 - RNA, 64 nt, hsa
cugcuugcaaaguguuggugauuuuacugaaaacuuuugagaucuucauuuuacaggcagaccu

SEQ ID NO: 455837 - RNA, 64 nt, hsa
cuuguguugcuaagugcuaaacagaauacugcuauuuugagagagucaagacucuuucuuaagg

SEQ ID NO: 455838 - RNA, 64 nt, hsa
gaaggaacaggcauuuuacacuaugaagacauucuuuugagauuuuuauuucaguugcuauauc

SEQ ID NO: 455839 - RNA, 64 nt, hsa
aacccucauggucaaaguuucucuuuaaaauuuauuuugagaagaagaguuaucccacagaaaa

SEQ ID NO: 455840 - RNA, 64 nt, hsa
cuuauguagcacuuaacacuguguagaaacuauuuuuugagaaaucauuuuauaaucauuauuu

SEQ ID NO: 455841 - RNA, 64 nt, hsa
acaauauauugauugcacuauauaaaugaguaaauuuugagaggaacaaugugggaauguauaa

SEQ ID NO: 455842 - RNA, 64 nt, hsa
uuccuaugaaacaaaaaccuugagaucucuuuuuuuuugagacagagucucgcuguugucagcc

SEQ ID NO: 455843 - RNA, 64 nt, hsa
cacaggaauaguuaaaugcauuuguuuguuuguuuuuugagacagaguuucacucuuguugccc

SEQ ID NO: 455844 - RNA, 64 nt, hsa
acgcccagccaucaaugcauuuuuuuuauuuuuuuuuugagacagaguuucgcacuucuugccc

SEQ ID NO: 455845 - RNA, 64 nt, hsa
ucuauauggucagcuucaucuuccuuuuuuuuuuuuuugagauggaguuucgcucuuguugccc

SEQ ID NO: 455846 - RNA, 64 nt, hsa
uuaggguagaaauuuauuuagcaaaugugaauucuuuugagaaaguaugaaguuuugcagaaau

SEQ ID NO: 455847 - RNA, 64 nt, hsa
aaaagagaggauguccgugcuuaauucuagauacuuuugagacaacaccuucagaaaacacaua

SEQ ID NO: 455848 - RNA, 64 nt, hsa
guguuugggccucucuugcugucauuaugauguauuuugagaugauuagucaagagucaagguu

SEQ ID NO: 455849 - RNA, 64 nt, hsa
aaugguuaagcccucuucuuuacucuuaauuuuuuuuugagacagagucacccaggcuggagug

SEQ ID NO: 455850 - RNA, 64 nt, hsa
cugauggguguuuuuuuuuguuuuguuuuuuguuuuuugagauggaguuuugcucuuguugccc

SEQ ID NO: 455851 - RNA, 64 nt, hsa
uguuagauguuagcacaucuugcuuuuuuuuuuuuuuugagauggagucucgcucuguugccca

SEQ ID NO: 455852 - RNA, 64 nt, hsa
uauauauaugcacacacaccucuuuuucagcauuuuuugagaaagucuugggucucaaacacau

SEQ ID NO: 455853 - RNA, 64 nt, hsa
cccaguccaaauuuuuuuuuuuuuuuuuuuuuuuuuuugagacagagucuugcucugucaccca

SEQ ID NO: 455854 - RNA, 64 nt, hsa
cuuagugucuugaaguuuugcacaaaauucuuuuuuuugagauggagucucacucugucaccca

SEQ ID NO: 455855 - RNA, 64 nt, hsa
uuuuguugguuuguuuguuugguuuuguguuuuuuuuugagauggggucuugcucugucgccca

SEQ ID NO: 455856 - RNA, 64 nt, hsa
ccgcucuaaaaaugaaauuguuaggugaaaguguuuuugagaauuuuuauauauauuacucacu

SEQ ID NO: 455857 - RNA, 64 nt, hsa
uuuuucauauucauuggccaugcuauauucauucuuuugagaauugcucauucauauuuuuucu

SEQ ID NO: 455858 - RNA, 64 nt, hsa
ccaucaccagaauuaauuuuauuauucuuauuauuuuugagacagagucuuacucuguugccag

SEQ ID NO: 455859 - RNA, 64 nt, hsa
gaaccaccgcgcccagccuuuuuguuuuuuuuuuuuuugagacagagucuuccucugucuccua

SEQ ID NO: 455860 - RNA, 64 nt, hsa
caaaaaguaacuaaaaaauugugucggacccuacuuuugagaaaucuacguuucccaaguuuua

SEQ ID NO: 455861 - RNA, 64 nt, hsa
uguuuauuuuagacccuucuaaauuuuuuuuuuuuuuugagacuccggagucucgcucuaucgc

SEQ ID NO: 455862 - RNA, 64 nt, hsa
acguagguuuuuuguuuguuuuguuuuguucuuuuuuugagacggagucucacucuguuaccca

SEQ ID NO: 455863 - RNA, 64 nt, hsa
cugaugaacaaaacuuuuuuaaaaaaauguuuucuuuugagacccuuugcuccaguccuauggc

SEQ ID NO: 455864 - RNA, 64 nt, hsa
caucuuggugggggcaccuuuuuaaacauuuuuuuuuugagagagagccuuguucugucaccua

SEQ ID NO: 455865 - RNA, 64 nt, hsa
ccaccacaccuggcuaacuuuuuuuuuuuuuuuuuuuugagauggcaucuugcucugucgccca

SEQ ID NO: 455866 - RNA, 64 nt, hsa
cugugcccggccuaugauucuuuuuuuuuuuuuuuuuugagacaaaguuuugcucuugucaccc

SEQ ID NO: 455867 - RNA, 64 nt, hsa
ccuggauuaaugaacuaugauuuuuuuuuuuuuuuuuugagaccaaaucuugcucuguggccca

SEQ ID NO: 455868 - RNA, 64 nt, hsa
uuagauuccugagagaugucucuggaagggaaaguuuugagaacuaauggcuauuuuugaggac

SEQ ID NO: 455869 - RNA, 64 nt, hsa
ucuuuguucuuguuugcugcuauuuucuguccuauuuugagaaauauaaauacauagaaauggu

SEQ ID NO: 455870 - RNA, 64 nt, hsa
aggaaaagucaacaucuucucucuuuuuuuuuuuuuuugagacagggucucacuauguugccca

SEQ ID NO: 455871 - RNA, 64 nt, hsa
acuccuccuugccugcuuuucuuuuuuuuucuuuuuuugagacggcgcaccuaucacccaggcu

SEQ ID NO: 455872 - RNA, 64 nt, hsa
auccagcuaaaggagagcguuuuuuucuuuuucuuuuugagacagagucucacucuggcgccug

SEQ ID NO: 455873 - RNA, 64 nt, hsa
guaggggagcaugguuuuuuuguuuuguuuuuguuuuugagacgaggucucacugucacccagg

SEQ ID NO: 455874 - RNA, 64 nt, hsa
aggcauuuuauaaaaugcauuaugccaugguugcuuuugagauagauuguagucuggguagcau

SEQ ID NO: 455875 - RNA, 64 nt, hsa
uuccgaucaaagaaaaguaauucuuucuuuuuuuuuuugagacagagucuugcuuuguugccca

SEQ ID NO: 455876 - RNA, 64 nt, hsa
guucucuuuuucuagcuuccacaucagcuuccuuuuuugagaacauauagaagaagaaggcuaa

SEQ ID NO: 455877 - RNA, 64 nt, hsa
uaauuauuuuuuaaaaaaaauuuuuaaaaagguuuuuugagacagauucuugcucugucaccca

SEQ ID NO: 455878 - RNA, 64 nt, hsa
guuugguuauguuuuguccuuuuaaaacauuuucuuuugagaugggggucuugcucuguugccc

SEQ ID NO: 455879 - RNA, 64 nt, hsa
aacaauaguacuguugagauaaaaguugagcacauuuugagacuucuuccaaauuggucccuag

SEQ ID NO: 455880 - RNA, 64 nt, hsa
uuuguaguaugacuccugucacucaguacaauuauuuugagauucauuuauguuauuguaugua

SEQ ID NO: 455881 - RNA, 64 nt, hsa
aacccucugcuauugaugacuacauuuaauuucuuuuugagaaagguguuagauguuacggugc

SEQ ID NO: 455882 - RNA, 64 nt, hsa
ggccccacccauguuauuuuuguuuuuguuuuuguuuugagacagggucucacucuguugccca

SEQ ID NO: 455883 - RNA, 64 nt, hsa
gucaugacaggaaacuugcaucaguuggauauccuuuugagaaacugaauuuugcaaagggcca

SEQ ID NO: 455884 - RNA, 64 nt, hsa
gaagauugauuauuuccucaucuuuuuuucuuuuuuuugagacagagucucucucuguccccca

SEQ ID NO: 455885 - RNA, 64 nt, hsa
aagacuuugacaggggugccuaauuuuuuuuuuuuuuugagauggagucucgcucuguugccca

SEQ ID NO: 455886 - RNA, 64 nt, hsa
uuuuccuucgguuguuugccuucuuauuguuggauuuugagaguucuauguacaaguccuuugu

SEQ ID NO: 455887 - RNA, 64 nt, hsa
uuuaaguuauuauuauuauuauuauuuuuuuuuuuuuugagauggagucucgcucugucgccca

SEQ ID NO: 455888 - RNA, 64 nt, hsa
ugagccacugcgccuggcuaaguuauuauuauuuuuuugagacagucuccuggugucacccagg

SEQ ID NO: 455889 - RNA, 64 nt, hsa
gaggucacuccuugcagaacaucagaaaauucauuuuugagauaacuguucccaaugcagugag

SEQ ID NO: 455890 - RNA, 64 nt, hsa
gugagccaguuuucccagccuguuuauuauuauuuuuugagauggaguguugcucuugcugccc

SEQ ID NO: 455891 - RNA, 64 nt, hsa
guaccucauauaaguggauucuacaguauuuaucuuuugagacuggcuuauuucacuuaggaua

SEQ ID NO: 455892 - RNA, 64 nt, hsa
ucauauaggauuucuauuuuuuuuuuuuguuuguuuuugagacagagucuugcucugucaccca

SEQ ID NO: 455893 - RNA, 64 nt, hsa
ccugagucacgugauagauuaaaguacaacucuuuuuugagacagagucucacucugucaccca

SEQ ID NO: 455894 - RNA, 64 nt, hsa
uugagucagugguuuauguuuugcauuuuuuuuguuuugagacaaagucucgcucugucuccca

SEQ ID NO: 455895 - RNA, 64 nt, hsa
uccagacuauuuugugccuaacugcaaggcugacuuuugagacugccucuuccacgaugccuuu

SEQ ID NO: 455896 - RNA, 64 nt, hsa
uucuuuuucuuuuucuuuucuuuucuuuuuuuuuuuuugagauggagucucgcucugucgccca

SEQ ID NO: 455897 - RNA, 64 nt, hsa
ccauugucauugauaacaucuuaucaggagacgguuuugagaucaacuggucugacuaaaauuu

SEQ ID NO: 455898 - RNA, 64 nt, hsa
aaacacaggauuuuuuuuuuuuuuuuuuuuuuuuuuuugagauggaguuuugcucuuguugccc

SEQ ID NO: 455899 - RNA, 64 nt, hsa
cgugcccagcuagacgucuuccuuuuuuuuuuuuuuuugagacggagucucacucugucgccca

SEQ ID NO: 455900 - RNA, 64 nt, hsa
ugaaauguggggacauagaucuuuuuuuuuuuuuuuuugagacagaguuucacucuuguugucc

SEQ ID NO: 455901 - RNA, 64 nt, hsa
cugccuggcugguuauuuuguuuguuuguuguuuuuuugagacacagucucgcucugucaccaa

SEQ ID NO: 455902 - RNA, 64 nt, hsa
uggaaugcuuuuagguuuuuuuuuuuuuuuuuuuuuuugagauggauucucacuguugccaggc

SEQ ID NO: 455903 - RNA, 64 nt, hsa
ccaccacacccggcccccaguucuuuuuuuuuuuuuuugagacggaguccuugcccaggcugga

SEQ ID NO: 455904 - RNA, 64 nt, hsa
cgagaaaguugguuguuuuuuuuuuuuuuuuuuuuuuugagacagagucucacucuuguugccc

SEQ ID NO: 455905 - RNA, 64 nt, hsa
uguagguuaaauuuuuguuuuuauuuuauuuuauuuuugagagguagucuugcucugucaccca

SEQ ID NO: 455906 - RNA, 64 nt, hsa
gaggccauggcagguggaucaccugaggucgggauuuugagaccagccugaccaacacugagaa

SEQ ID NO: 455907 - RNA, 64 nt, hsa
cuaugaaagaugcuagagcaccaauguauaauuuuuuugagacagggugucacuuuguccccca

SEQ ID NO: 455908 - RNA, 64 nt, hsa
uguauaugauguuacagaacaucagaaaauucauuuuugagaaaauguguuucaugcucaauuc

SEQ ID NO: 455909 - RNA, 64 nt, hsa
cugacagagaacgcuacuaaugauuuuuuuuuuuuuuugagacggaguuuuguucuuguugccc

SEQ ID NO: 455910 - RNA, 64 nt, hsa
accuaaacaguguucucuuauuugaagcaaaucuuuuugagaauuuguuuacuugauuucuuuc

SEQ ID NO: 455911 - RNA, 64 nt, hsa
gccuguuuuuugauucuuauuuucuauuuuucuuuuuugagauaguacuuuuuaaagagauagu

SEQ ID NO: 455912 - RNA, 64 nt, hsa; identical to SEQ ID NO: 455889

SEQ ID NO: 455913 - RNA, 64 nt, hsa
uaucaauuuuuaaaaccuuuucuuguuuauuuguuuuugagacagaauuuugcucuuguugccc

SEQ ID NO: 455914 - RNA, 64 nt, hsa
cucuuaagagcacaguuuucuuuucuuuuuucuuuuuugagacagggucucacacugucaccca

SEQ ID NO: 455915 - RNA, 64 nt, hsa
uaaacagacucgcuuuuuaaacuuuuuuuuuuuuuuuugagacggaguuucacgcuuauugccc

SEQ ID NO: 455916 - RNA, 64 nt, hsa
uggcaagaaugaaauacucuuuuuuuuuuuuuuuuuuugagauggagucucgcucugcugccca

SEQ ID NO: 455917 - RNA, 64 nt, hsa
auacauauuuucacuacgauacuuaguuguggccuuuugagaguugagcuuuaacagccauggc

SEQ ID NO: 455918 - RNA, 64 nt, hsa
ugucauguuucccuguauuugauaaaacacauaauuuugagaaaaauaaaguuuuaaauguauc

SEQ ID NO: 455919 - RNA, 64 nt, hsa
uuuuuuguuuuguuuuguuuguuuuguuuuguuuuuuugagacggugucucgcugcaucaccca

SEQ ID NO: 455920 - RNA, 64 nt, hsa
gcugugacuguggcccugucuggagguuccuagguuuugagauuuagagcaaugcauucuggag

SEQ ID NO: 455921 - RNA, 64 nt, hsa
gagagcagagguggucucuggcaauuccaucugguuuugagaaacuuagcagcucacagagcac

SEQ ID NO: 455922 - RNA, 64 nt, hsa
uuuuuuuuuuuuucuguuucuguuucuguuuuuuuuuugagauggagucucgcucugucgccca

SEQ ID NO: 455923 - RNA, 64 nt, hsa
aucuccccagcauaaccuaauauuuuuuuuuuuuuuuugagacggaauuucgcucugucaccca

SEQ ID NO: 455924 - RNA, 64 nt, hsa
aguugaaauggguauguaaguugaaaaccagaaguuuugagaaacauccuuuguuaacuuucau

SEQ ID NO: 455925 - RNA, 64 nt, hsa
uaugaaaauauuuaaguaaaaacaaaaugaugcauuuugagaagaacaaagugugcacucagcg

SEQ ID NO: 455926 - RNA, 64 nt, hsa
auaucuacuuuauacaaauacuuuauauggcuauuuuugagaaaacccucacauuuuaauguuu

SEQ ID NO: 455927 - RNA, 64 nt, hsa
ucuugggcuauuuguuugacaguagcaugauguuuuuugagaccaucaggggugguuacauaga

SEQ ID NO: 455928 - RNA, 64 nt, hsa
uuauuuuauuuuacuuuauuauuuauuuguuuauuuuugagauggaguuucgcuguugucaccc

SEQ ID NO: 455929 - RNA, 64 nt, hsa
acauugcaaauuuauuuuauuuauuuaauuuucuuuuugagauggagucuugcuugucacccag

SEQ ID NO: 455930 - RNA, 64 nt, hsa
aauuuagucugcugaucaaaagcauugucuuaauuuuugagaacugguuuuagcauuuacaaac

SEQ ID NO: 455931 - RNA, 64 nt, hsa
ucagauagguugaucuuugggguuuuuuuuuuuuuuuugagauggaguuucgcucuguugucca

SEQ ID NO: 455932 - RNA, 64 nt, hsa
guggguuuuuguuuuuguuuuuuguuuuuuguuuuuuugagauggagucuugcuccuguugugc

SEQ ID NO: 455933 - RNA, 64 nt, hsa
acuuaaaaauugggaauaagcucgcuuuuuuuuuuuuugagauggagucuugcuccuguugugc

SEQ ID NO: 455934 - RNA, 64 nt, hsa
uguuuagcaauuuguuuucuuugcuuaacgauguuuuugagaucugugcauguuacuuaaugua

SEQ ID NO: 455935 - RNA, 64 nt, hsa
ucuaauuacccaaauaugcaugaauucauucuccuuuugagaaguuagauuguuaaagauaguc

SEQ ID NO: 455936 - RNA, 64 nt, hsa
cauauuaaagucauauugggaaagauggcaaagcuuuugagaauauaaacacaccuguuuuguu

SEQ ID NO: 455937 - RNA, 64 nt, hsa
ucauuaauguugaguccuaauauggcaauucuguuuuugagacacuuuucugccuucuaucacu

SEQ ID NO: 455938 - RNA, 65 nt, hsa; identical to SEQ ID NO: 65698

SEQ ID NO: 455939 - RNA, 65 nt, hsa; identical to SEQ ID NO: 65699

SEQ ID NO: 455940 - RNA, 65 nt, hsa; identical to SEQ ID NO: 65706

SEQ ID NO: 455941 - RNA, 65 nt, hsa; identical to SEQ ID NO: 65707

SEQ ID NO: 455942 - RNA, 65 nt, hsa; identical to SEQ ID NO: 65720

SEQ ID NO: 455943 - RNA, 65 nt, hsa; identical to SEQ ID NO: 65721

SEQ ID NO: 455944 - RNA, 65 nt, hsa; identical to SEQ ID NO: 65744

SEQ ID NO: 455945 - RNA, 65 nt, hsa; identical to SEQ ID NO: 65745

SEQ ID NO: 455946 - RNA, 65 nt, hsa; identical to SEQ ID NO: 65788

SEQ ID NO: 455947 - RNA, 65 nt, hsa; identical to SEQ ID NO: 65789

SEQ ID NO: 455948 - RNA, 65 nt, hsa; identical to SEQ ID NO: 65808

SEQ ID NO: 455949 - RNA, 65 nt, hsa; identical to SEQ ID NO: 65809

SEQ ID NO: 455950 - RNA, 65 nt, hsa; identical to SEQ ID NO: 65810

SEQ ID NO: 455951 - RNA, 65 nt, hsa; identical to SEQ ID NO: 65811

SEQ ID NO: 455952 - RNA, 65 nt, hsa; identical to SEQ ID NO: 65827

SEQ ID NO: 455953 - RNA, 65 nt, hsa; identical to SEQ ID NO: 65828

SEQ ID NO: 455954 - RNA, 65 nt, hsa; identical to SEQ ID NO: 65831

SEQ ID NO: 455955 - RNA, 56 nt, hsa; identical to SEQ ID NO: 61369

SEQ ID NO: 455956 - RNA, 65 nt, hsa; identical to SEQ ID NO: 65853

SEQ ID NO: 455957 - RNA, 65 nt, hsa; identical to SEQ ID NO: 65854

SEQ ID NO: 455958 - RNA, 65 nt, hsa; identical to SEQ ID NO: 65891

SEQ ID NO: 455959 - RNA, 65 nt, hsa; identical to SEQ ID NO: 65892

SEQ ID NO: 455960 - RNA, 65 nt, hsa; identical to SEQ ID NO: 65896

SEQ ID NO: 455961 - RNA, 65 nt, hsa; identical to SEQ ID NO: 65897

SEQ ID NO: 455962 - RNA, 64 nt, hsa
auagcugcccaucuccugugauugcacaaccaagcacuuugacauuugcaccuuaggagaggca

SEQ ID NO: 455963 - RNA, 64 nt, hsa
uguuuuuugguuuuuuuuaaugacaaugaagugacacuuugacauuuccuaccuuuugaggacu

SEQ ID NO: 455964 - RNA, 64 nt, hsa
uguucaauuagcuuuggggaagaaaugccaaauccacuuugaggaugagucuuacgacacagau

SEQ ID NO: 455965 - RNA, 64 nt, hsa
uaaguuuauugcuuuaaaauggcaguguuucucccacuuugauaugcuaacauuuaguaagcac

SEQ ID NO: 455966 - RNA, 64 nt, hsa
aauugcauccucugggaucuucugagguggacagcacuuugaauguagcauuucacuggaacag

SEQ ID NO: 455967 - RNA, 64 nt, hsa
acuguuuugguggcauccaaagacgaucucagagcacuuugaaccucucuguugaguuuucuuu

SEQ ID NO: 455968 - RNA, 64 nt, hsa
gauaacacugucuaagcacccccaagccacuauccacuuugaauccugcuccauacauugggug

SEQ ID NO: 455969 - RNA, 64 nt, hsa
uguugugaggauuaaaugagauggcaugugaaagcacuuugaaaauuguaaagcgcuauguaaa

SEQ ID NO: 455970 - RNA, 64 nt, hsa
uagguuugcugagaaggcuucauuaaauuaaucucacuuugaauaucuccugagagauggacaa

SEQ ID NO: 455971 - RNA, 64 nt, hsa
aagcgggauccguuuuuuggaauuugguugaagucacuuugauuucuuuaaaaaacaucuuuuc

SEQ ID NO: 455972 - RNA, 64 nt, hsa
agugacuuugcugcuacauauuuacuaaauugaccacuuugauucuugcuuguuugucucaguu

SEQ ID NO: 455973 - RNA, 64 nt, hsa
gaaguaauugcggaggcuccuucagcugccucagcacuuugauuuuggacagggacaagguagg

SEQ ID NO: 455974 - RNA, 64 nt, hsa
aauuguuuacuuuaugauguuuacauacacguuucacuuugaaaaaaaaugcaaaucgacuuuu

SEQ ID NO: 455975 - RNA, 64 nt, hsa
aagucuggccuugugugcauuggagcuuccaaggcacuuugaaaucauuccaguauauuuggga

SEQ ID NO: 455976 - RNA, 64 nt, hsa
cuuccuuguacaccuaccuucagauuucugcuuacacuuugauuucagagcuuuauuccccagu

SEQ ID NO: 455977 - RNA, 64 nt, hsa
ugacaucuucaguaugagggggacaguuugacuucacuuugagggugugaugucuguagcuaug

SEQ ID NO: 455978 - RNA, 64 nt, hsa
cugggccucggaguuugccccguaaagcgaauugcacuuugauguucagaaacccacuuuguuc

SEQ ID NO: 455979 - RNA, 64 nt, hsa
ucugauaacauuauuauguugccuucuuguuucucacuuugauauuuaaaagauguucaauaca

SEQ ID NO: 455980 - RNA, 64 nt, hsa
ccaggucaugcugcuguugcuggacugaggaccacacuuugagaaccugugcucuaagugaaua

SEQ ID NO: 455981 - RNA, 64 nt, hsa
gaauguuuacuuuucuauuuggcauagcuaacuacacuuugauacuaacuccaguuuuacuauu

SEQ ID NO: 455982 - RNA, 64 nt, hsa
uaugagugccaaaaaucugucuugaaggcagcuacacuuugaaguggucuuugaauacuuuuaa

SEQ ID NO: 455983 - RNA, 64 nt, hsa
guaagucacuuuauaaguuggcagaagugaaugacacuuugagaguagucuuucaaucugaaga

SEQ ID NO: 455984 - RNA, 64 nt, hsa
gcucaggucacccgggccucugacccaggccugucacuuugagaggggcaaaacugagaggggc

SEQ ID NO: 455985 - RNA, 64 nt, hsa
uccgccaguagugugauuguuuuucaauuuuucccacuuugaaaacuuacaccuaaaggccugu

SEQ ID NO: 455986 - RNA, 64 nt, hsa
acaaccuucucaggacaagcccacugucuuaagccacuuugacccugggagacacaggacugug

SEQ ID NO: 455987 - RNA, 64 nt, hsa
aaaaaaaaagaguggcugacaccuguaaucucagcacuuugagaggccaaggcaguaggacuga

SEQ ID NO: 455988 - RNA, 64 nt, hsa
aacaguuauuggcaaaaagcaugaaaagagaaagcacuuugaaauuuauuacuagcuugcuacc

SEQ ID NO: 455989 - RNA, 64 nt, hsa
aguugggauaauuuuuauauaaaagaaguuuuuccacuuugaauugcuaaaaguggcauuuuuc

SEQ ID NO: 455990 - RNA, 64 nt, hsa
aacaaaaagaaauugacucaguacuauuucuuuucacuuugaaaauauaaagaacaaaauaaag

SEQ ID NO: 455991 - RNA, 64 nt, hsa
uacauuccuguuugaauuuuuccaaagcaaaacucacuuugaccccauuaagaggcaagccugg

SEQ ID NO: 455992 - RNA, 64 nt, hsa
agaaaaaggaaugaagacucgcaauuucacgacacacuuugaucccuucuguuggugucauguu

SEQ ID NO: 455993 - RNA, 64 nt, hsa
ggcugggcaugguggcucacaccuguaaucccagcacuuugagaggccgaggugagacgggaag

SEQ ID NO: 455994 - RNA, 64 nt, hsa
uuugcacaguguaacagcgcaguugcauucuggccacuuugaccuuauagcucccaaaugauga

SEQ ID NO: 455995 - RNA, 64 nt, hsa
uuuuguuuuguuuuuguuuuuugaaacagggucucacuuugacacccaggcuggagugcaguag

SEQ ID NO: 455996 - RNA, 64 nt, hsa
auguguaccauagaggggggaaaggugguauuuucacuuugaugagguugguaaauguuuuuag

SEQ ID NO: 455997 - RNA, 64 nt, hsa
cugaucucaaacuucugaccucaggugauccacccacuuugaccucccaaagugcugggauuac

SEQ ID NO: 455998 - RNA, 64 nt, hsa
ccauuagcauucugguuuugacaucagcauuagucacuuugaaauguaacgaaugguacuacaa

SEQ ID NO: 455999 - RNA, 64 nt, hsa
ugagcuuuguuaauaaacuauuaugcagcaucuacacuuugaaaaucaaguacuucaaaacgca

SEQ ID NO: 456000 - RNA, 64 nt, hsa
acucuuggaaaucuuuacacaugcgagugcuaaccacuuugagcaaggcugccuucuuguagau

SEQ ID NO: 456001 - RNA, 64 nt, hsa
uuuuucuaauuuguagauuucaguuuccgucguucacuuugagacuuugaaauuccuauuucuc

SEQ ID NO: 456002 - RNA, 64 nt, hsa
ugacgggguucaggacacccuacacaaaauacagcacuuugacauauugaauauuuuaagcuga

SEQ ID NO: 456003 - RNA, 64 nt, hsa
uaaccaagaggcugcagucaaauacugcuacugucacuuugaagauuuucuaagggcacaagug

SEQ ID NO: 456004 - RNA, 64 nt, hsa
cuccaccccacacucccaccucuuucuaggacuucacuuugauaccaaauucucauuauuuuca

SEQ ID NO: 456005 - RNA, 64 nt, hsa
auauugugacuuuaggcccauuuuucaugugcuucacuuugauagaguuaauccauaaaauugc

SEQ ID NO: 456006 - RNA, 64 nt, hsa
uucaucuuuauuauuguacuuuugguuaugcaaacacuuugauaauauaaacaguuaugucccc

SEQ ID NO: 456007 - RNA, 64 nt, hsa
guuuauuaacuugagcuucacugucaucuuuuuccacuuugacuacaaagauauuucagagagc

SEQ ID NO: 456008 - RNA, 64 nt, hsa
ucaaaauguauauauuuagugcugcaucuuauagcacuuugaaauaccucauguuuaugaaaau

SEQ ID NO: 456009 - RNA, 64 nt, hsa
acuuuuauuuuacacauaagggaaaaaauaagaccacuuugagcaguugccuggaaggcugggc

SEQ ID NO: 456010 - RNA, 64 nt, hsa
gugauucacugugcuucgagccaacucuaacaggcacuuugagauguguuccuccugcuguagu

SEQ ID NO: 456011 - RNA, 64 nt, hsa
aaaaccuggacucagggagcaaccacaggcucuccacuuugaaacuuuaguuugaauuuuaaaa

SEQ ID NO: 456012 - RNA, 64 nt, hsa
cagauucaagggaaauaccagcuuccacuugagucacuuugaaauaguuaauucaacagcacca

SEQ ID NO: 456013 - RNA, 64 nt, hsa
ccaaauguuaauacauuuacuuuagcauugaagccacuuugaaaccugagauaaaugaauguga

SEQ ID NO: 456014 - RNA, 64 nt, hsa
uggaagaacuuuuaacagaagccucaaugaugaucacuuugaauugcuugugauuucaaaaaua

SEQ ID NO: 456015 - RNA, 64 nt, hsa
aauaaaaaucccagaaggacaggaggauucucaacacuuugaauuuuuuuaacuucauuuuucu

SEQ ID NO: 456016 - RNA, 64 nt, hsa
gaaaacugaagauuucaucaguuggaaacaguagcacuuugaaaacuuuuuaggccagcuuuaa

SEQ ID NO: 456017 - RNA, 64 nt, hsa
cgaagccuggcuuauucacaagacaacgaagcuccacuuugaggcucugaugaacauuccagug

SEQ ID NO: 456018 - RNA, 64 nt, hsa
uccuggaguucugucuggucacuaucagaaggaacacuuugagggaaacccuggugcagccagc

SEQ ID NO: 456019 - RNA, 64 nt, hsa
aacucacaguccacuagcuucacuccuuuaaauucacuuugaaacaggccucaucccacuucca

SEQ ID NO: 456020 - RNA, 64 nt, hsa
caugcuuuccuagaaugucaaguagauauuuuuacacuuugaguuuuaaagcaauuacuaucag

SEQ ID NO: 456021 - RNA, 64 nt, hsa
ggcugggcgcgguggcucacgccuguaaucccagcacuuugagagaccgaggcgggcggaucac

SEQ ID NO: 456022 - RNA, 64 nt, hsa
uuuaaucaaucagaauuagagcaugggaggucaucacuuugaccuaaauuauuuacugcaaaaa

SEQ ID NO: 456023 - RNA, 64 nt, hsa
gcuggaaaugaauuauucuuuaccaguuuugaaacacuuugaaauauccuaagguaacuuggaa

SEQ ID NO: 456024 - RNA, 64 nt, hsa
caagugucugguuucacuuucacagugcggcugccacuuugaagagacccuugguaaaccccug

SEQ ID NO: 456025 - RNA, 64 nt, hsa
ugcuaauuucauuauaaauuguuuugcuaaaauacacuuugaaacuauuuuucuguauuccaag

SEQ ID NO: 456026 - RNA, 64 nt, hsa
augcauuguguguguaguaauagauguaaguuuacacuuugaaaggaaaucuuguuucaauguu

SEQ ID NO: 456027 - RNA, 64 nt, hsa
guuggauucauuucuuggaagagccagaaugagccacuuugaccacccucgggugcuaugggug

SEQ ID NO: 456028 - RNA, 64 nt, hsa
cauucacccuucaucagugaacuaucaggugagacacuuugacagccccuaccuguuguaccac

SEQ ID NO: 456029 - RNA, 64 nt, hsa
cugccccaggggcuugccuggcuuggcugcagugcacuuugaaaugaaguaucuguccuuuggc

SEQ ID NO: 456030 - RNA, 64 nt, hsa
gcugcauguuuuguaguuacgauuuuuggaaucccacuuugagugcugaaaguguaaggaagcu

SEQ ID NO: 456031 - RNA, 64 nt, hsa
cauuagauguaacuaaucauauuuaaauauauuucacuuugacuuuagaccuuuugaagucugu

SEQ ID NO: 456032 - RNA, 64 nt, hsa
uagauauuuuaccauauagucauaagaauuugcucacuuugaugccagaaguacuuaagaaguu

SEQ ID NO: 456033 - RNA, 64 nt, hsa
uuuuuuuuuuuguuauaaucuauucauggaucuccacuuugauuuaauuuuuaaauguuuuaau

SEQ ID NO: 456034 - RNA, 64 nt, hsa
uuauaauauacauaacucccuggaaauaacugagcacuuugaauuuuuuuuaugucuaaaauug

SEQ ID NO: 456035 - RNA, 64 nt, hsa
ugugggaauuagugagacaucagggaguaagugacacuuugaacuccucaagggcagagaacug

SEQ ID NO: 456036 - RNA, 64 nt, hsa
uucacaaaaccuugucaaagaccucaugcaauaucacuuugaaaguuauuuucuguuuacuaca

SEQ ID NO: 456037 - RNA, 64 nt, hsa
gauggggaggaaaaaaccccauagauugaauuagcacuuugacucucacuuaauucaacgauuu

SEQ ID NO: 456038 - RNA, 64 nt, hsa
uuaugaagcuuuaucaacuuggcuucaugauccucacuuugauugauuuuaagaggauggauaa

SEQ ID NO: 456039 - RNA, 64 nt, hsa
ucuuuauuuucuucacaugcgacaauuucuuaagcacuuugacauuuugguaguuccacacuau

SEQ ID NO: 456040 - RNA, 64 nt, hsa
guaauuggucaugugaugcaagccagcuuacuagcacuuugagaaugagucuccuguugagcug

SEQ ID NO: 456041 - RNA, 64 nt, hsa
aauugcuguaucguucagucucuuguggcaauagcacuuugaagaaaauagagaauuuaauaua

SEQ ID NO: 456042 - RNA, 64 nt, hsa
ccauuccacaaaguuggaccaucacuugugcacccacuuugacuaugaguauaccaccacauug

SEQ ID NO: 456043 - RNA, 64 nt, hsa
auucacaauuccauuuugauuagcaggacuuuuccacuuugaagauaaauagcaacuuuaucaa

SEQ ID NO: 456044 - RNA, 64 nt, hsa
cagcacuuuucccucaugcuguccuauaggacuccacuuugaagguugugccuacguugcaggg

SEQ ID NO: 456045 - RNA, 64 nt, hsa
uuuuggaguauuucaucagcugaaaagugauucucacuuugaguuuucuuccuauauuuguaua

SEQ ID NO: 456046 - RNA, 64 nt, hsa
uucuuuuggaaacuggacaggccauugccaccugcacuuugaagaagugagcaaagacguggcc

SEQ ID NO: 456047 - RNA, 64 nt, hsa
ggccgggcuugguggcucaugccuguaaucccagcacuuugagaggccgaagcgaguggaucac

SEQ ID NO: 456048 - RNA, 64 nt, hsa
ccaccccacucuaccuccuuagcuuucccugugccacuuugacucagaggcugggagcauagca

SEQ ID NO: 456049 - RNA, 64 nt, hsa
cacauauauacaagccaaauggauuucuuacuugcacuuugacuggcuaccagauaaucacagu

SEQ ID NO: 456050 - RNA, 64 nt, hsa
ccauuguuccuuauaucguuaaaucuuugugacacacuuugacaaaaauguagaaccuauaaca

SEQ ID NO: 456051 - RNA, 64 nt, hsa
uucacauuuucaguguuuguaauauuuaucuuuucacuuugauaaaccagaaauguuucuaaau

SEQ ID NO: 456052 - RNA, 64 nt, hsa
accuugguucuccuuacugaaguccucuugcuuucacuuugaucugguuuuugaagucucuuaa

SEQ ID NO: 456053 - RNA, 64 nt, hsa
ggcaggauugucacaccguuuuaggacucugugccacuuugagagacuguucccaggaggccca

SEQ ID NO: 456054 - RNA, 64 nt, hsa
uaaaaaauaggcuauacuacaauugcacuuccagcacuuugagaacgaguugaauaccaagaau

SEQ ID NO: 456055 - RNA, 64 nt, hsa
gcccaccuuagacuucuuuuggggccuucgaccucacuuugagaaauaccuucuucagguuauu

SEQ ID NO: 456056 - RNA, 64 nt, hsa
aaguauucugacugagugauugguugaccuaaaccacuuugaauguuucuauuuuaugaaauga

SEQ ID NO: 456057 - RNA, 64 nt, hsa
ggccgggcgcaguggcucaugccuguaaucccagcacuuugagaggccaaggcagguggaucac

SEQ ID NO: 456058 - RNA, 64 nt, hsa
aaagaaaauaacaaaugaaaauaaauguguacuacacuuugaaauauuuuaacuaaagccuuua

SEQ ID NO: 456059 - RNA, 64 nt, hsa
ugcuuucuaguugucaggaaugcugaagaauuaacacuuugacuccuaaaugugauacugguuu

SEQ ID NO: 456060 - RNA, 64 nt, hsa
gccugaagacuuaaguuuugugggcacuggaagucacuuugauagauggauugaaacuguuccu

SEQ ID NO: 456061 - RNA, 64 nt, hsa
agauuuguguauuguacuuauugccacuggccgccacuuugacuuauuuucucuaauaguuuau

SEQ ID NO: 456062 - RNA, 64 nt, hsa
ucauuucuagggaagaaauucuaaaucccuccuucacuuugagcaguguucuaauuggauaaau

SEQ ID NO: 456063 - RNA, 64 nt, hsa
ccgguuguacaaucucugaucagugucuuuucagcacuuugagcauuuacuuggcucauuuagu

SEQ ID NO: 456064 - RNA, 64 nt, hsa
uauacuuagcaagaaaauuuuuuuuuucugauagcacuuugaggauauuagauacaugcuaaau

SEQ ID NO: 456065 - RNA, 64 nt, hsa
uugacauuuuaaaagccugguuaugaucaguugacacuuugaguaccccccuaaauagcuggac

SEQ ID NO: 456066 - RNA, 64 nt, hsa
uggggggauauggggauucaggcaauuguuuacacacuuugaauaacugcaaaggauuuacggu

SEQ ID NO: 456067 - RNA, 64 nt, hsa
auucaucucccccucaaaucauagccuaacagaacacuuugaaagcucuuuuauuuaauauuuu

SEQ ID NO: 456068 - RNA, 64 nt, hsa
ccauggugaaggcuucuuuccccacugcaggacccacuuugagaaggaccgaggaggaggauuu

SEQ ID NO: 456069 - RNA, 64 nt, hsa
uucaguacaguacaucauuccuccucacuaggagcacuuugauguaaaccagaauagcuuuaaa

SEQ ID NO: 456070 - RNA, 64 nt, hsa
ggccaggugugguggcucaugccuguaaucccagcacuuugagaggccgaggugggcagaucac

SEQ ID NO: 456071 - RNA, 64 nt, hsa
aauucuauaggauucaauacuuaguuugcaaaagcacuuugaaauuauggcacagugaguuguu

SEQ ID NO: 456072 - RNA, 64 nt, hsa
cauauuguuuccugugcuggagcaaaagucauuacacuuugaaguauuauauuguucuuauccu

SEQ ID NO: 456073 - RNA, 64 nt, hsa
gaaugugcacuagcucuuuuuaaauuccaugcuacacuuugaggacugucaucauguucucguu

SEQ ID NO: 456074 - RNA, 64 nt, hsa
cugagaacaaucccuccccuugcacuugugaaaacacuuugagcgcuuuaagagauuagccuga

SEQ ID NO: 456075 - RNA, 64 nt, hsa
augaagccuaagaaacuaucuguaacauauuuugcacuuugagaaaccuuguauauuaaauuac

SEQ ID NO: 456076 - RNA, 64 nt, hsa
auuccaggucaaaauuugugaaaaauacacaaaacacuuugauuuuacaagagaggagcuuuaa

SEQ ID NO: 456077 - RNA, 64 nt, hsa
gauaguggauaacaaauauauuuguucacauaaccacuuugaugucaguacaacuucagcaauu

SEQ ID NO: 456078 - RNA, 64 nt, hsa
ccugcauucaaguguaacagcauucugucagggucacuuugaauugugcacauaagaaaaccaa

SEQ ID NO: 456079 - RNA, 64 nt, hsa
ugacagccguggugguucauaucuguaauccuaacacuuugacaggccaaggcaggggaauugc

SEQ ID NO: 456080 - RNA, 64 nt, hsa
ggccagguguaguggcucaugccuguaauccuagcacuuugagaggccgagauaggcggauugc

SEQ ID NO: 456081 - RNA, 64 nt, hsa
uuuuuccaguaguuagcuuucuuccuggauuccucacuuugaagagugugaggaaaaccuaugu

SEQ ID NO: 456082 - RNA, 64 nt, hsa
auucaguaugauuuauccucacauaaaaaagaagcacuuugauugaaguauucaaucaaguuuu

SEQ ID NO: 456083 - RNA, 64 nt, hsa
ggccaggcacaguggcucaugccuguaaucccagcacuuugagaggccaagguggguagaucau

SEQ ID NO: 456084 - RNA, 64 nt, hsa
caaaggguguuagcagaugcgaaguaaagaacgucacuuugaaacccauucaucacacagcaua

SEQ ID NO: 456085 - RNA, 64 nt, hsa
accccaauugucaaggguaguagcuguauacuaccacuuugaauuauugaaacgggucaauuua

SEQ ID NO: 456086 - RNA, 64 nt, hsa
ucuucccugggggcagauauuucccaauacauaccacuuugaauaggaugauaggaaauaaaug

SEQ ID NO: 456087 - RNA, 64 nt, hsa
caaacacucaugcuuuaauggauuauacccagagcacuuugaacaaaggucaguggggauuguu

SEQ ID NO: 456088 - RNA, 64 nt, hsa
ugaauggauguggaaaugaaagcuagcgcaccugcacuuugaauucuugcuucuuuuuuauuac

SEQ ID NO: 456089 - RNA, 64 nt, hsa
uagcauuuagauaauguaacaggauuuuagagagcacuuugaaagauaacauuuuauuaugaug

SEQ ID NO: 456090 - RNA, 64 nt, hsa
agucaacuuacggugcacaguaauaugaaagccacacuuugaagguaauaaauacacagcaugc

SEQ ID NO: 456091 - RNA, 64 nt, hsa
uuuauuacauuccagcagcuuacucccguggccgcacuuugaaugucaccaccuugaguuucuc

SEQ ID NO: 456092 - RNA, 64 nt, hsa
caagcaccccagucacuaggaugcagauggaccacacuuugagaaacaccacccauuucuacuu

SEQ ID NO: 456093 - RNA, 64 nt, hsa
aagugaaguugcuucuucuacuucagucuucucucacuuugauuugcuaguuguuaucaauuaa

SEQ ID NO: 456094 - RNA, 64 nt, hsa
aaguuaucaacuuuagcuaguaucuucaaacuuucacuuugaaaaaugagaauuuuauauucua

SEQ ID NO: 456095 - RNA, 64 nt, hsa
uuggacaaauaguuguuaccaaaauauucaaaaccacuuugaguuuacauacuaguuaccuuaa

SEQ ID NO: 456096 - RNA, 64 nt, hsa
gaugauaauuggugcucccuucauccaacuggaucacuuugagauucaguuuuacaucauuuua

SEQ ID NO: 456097 - RNA, 64 nt, hsa
uaggaaaaacuaaguugucacccaauaucuuagacacuuugagagcaaagggggugcuguaaau

SEQ ID NO: 456098 - RNA, 64 nt, hsa
ucucucucucucuuuucuaagaaacaauuaugugcacuuugauacacaaccuucucuaaccaac

SEQ ID NO: 456099 - RNA, 64 nt, hsa
accucuuugaaugcugaaaggucuucccucagcucacuuugaguuuuuaaaugacauuguuuuu

SEQ ID NO: 456100 - RNA, 64 nt, hsa
cguccccagaggaggacuugaaugaggaaaccaacacuuugagaaaccaaaguccuuuuuccca

SEQ ID NO: 456101 - RNA, 64 nt, hsa
ggaugaaacaggcccuugaguugggagccugcuucacuuugacuuucccacuguugcuggagac

SEQ ID NO: 456102 - RNA, 64 nt, hsa
cucaaccaaacaggaguuccguaggcagagugcucacuuugaauugcuaauagaaaauaaugca

SEQ ID NO: 456103 - RNA, 64 nt, hsa
uuauuucauuaaauauuucauucguaucuguuuucacuuugagaaaucuauuuuacgauuguag

SEQ ID NO: 456104 - RNA, 64 nt, hsa
cuacuugaccauucucacccugugaaacgucccacacuuugaagcaaauacaauucacagcaca

SEQ ID NO: 456105 - RNA, 64 nt, hsa
cuaaagaacaauuugcuaaacaugagaaaucacucacuuugauuauguauagauuacauaggaa

SEQ ID NO: 456106 - RNA, 64 nt, hsa
cuacaccaagaguguaucugugaaagagcuccuacacuuugaaaacuuaagaaucccuuaucau

SEQ ID NO: 456107 - RNA, 64 nt, hsa
cgauggagccacauuaauaauacuuuucaugccucacuuugacaugacagcauucgauuuuuuu

SEQ ID NO: 456108 - RNA, 64 nt, hsa
uuuuucuggugcuuuuuuggauugaugacugucucacuuugacuauacccauguuuugcaugca

SEQ ID NO: 456109 - RNA, 64 nt, hsa
gggucucaucauucccauacacagaaacacaaaacacuuugaucauaaacuuuuuucuucagaa

SEQ ID NO: 456110 - RNA, 64 nt, hsa
gaaaacugaagaucucaucaguuggaaacaguagcacuuugaaaacuuucaggccagcuuuaau

SEQ ID NO: 456111 - RNA, 64 nt, hsa
ggaggcgggaacgcgggcccgcgcgcggacuuugcacuuugaauccagaggaagaugaauuuuu

SEQ ID NO: 456112 - RNA, 64 nt, hsa
aaaaacaaaagccgcuaugaccggcguugccucucacuuugaaagaaagacuccguaaucuuaa

SEQ ID NO: 456113 - RNA, 64 nt, hsa
cccuauaacauuccuucucugccucucuauggcccacuuugaccacuaacaacaucagaauuau

SEQ ID NO: 456114 - RNA, 64 nt, hsa
uuguuaaucugucugauuuugucugaauuauaaacacuuugagguaccaaacauaaccaaucug

SEQ ID NO: 456115 - RNA, 64 nt, hsa
ugaauucuuuuucauuugagaaguaaacagauggcacuuugaaggggccucaccgagugggggc

SEQ ID NO: 456116 - RNA, 64 nt, hsa
uuccucauccaccccaucccuccccaguucauugcacuuugauuagcagcggaacaaggaguca

SEQ ID NO: 456117 - RNA, 64 nt, hsa
aaaacucaucacacaagaagagaaacaguaaccucacuuugaaaauuagcuccacucaagacua

SEQ ID NO: 456118 - RNA, 64 nt, hsa
uacccccaacaaaucuucuaagugcauuuuugaucacuuugauaacuucuuaggugauuugccu

SEQ ID NO: 456119 - RNA, 64 nt, hsa
auauuuccagaguuguccagcagaaagaaaguggcacuuugaagagaacuagggaaguacauau

SEQ ID NO: 456120 - RNA, 64 nt, hsa
acccucuuuuccuguaauuuauugcagaauacaccacuuugacuuggacagcuuucugcccccu

SEQ ID NO: 456121 - RNA, 64 nt, hsa
agucccugcuaaaacauuccauuguuaaaauuugcacuuugaagguaagcuuucuaggccugac

SEQ ID NO: 456122 - RNA, 64 nt, hsa
uguguauauuagauaauuguguugugaugcuacucacuuugauugcaaugaugauguccaaggu

SEQ ID NO: 456123 - RNA, 64 nt, hsa
gcgaaaaacauggacaauuccuauucauucuuagcacuuugacaugucuuggggaaaagcuuac

SEQ ID NO: 456124 - RNA, 64 nt, hsa
gaccaccaaguacuaccugacgggaggcacuuuucacuuugaugucugagaaucaguucaaggc

SEQ ID NO: 456125 - RNA, 64 nt, hsa
aggccaggcgccguggcucacgccuguaauccaacacuuugagaggcugaggcgggcggaucac

SEQ ID NO: 456126 - RNA, 64 nt, hsa
gggagagauuaagcgcucauuaagcagaggagcccacuuugaggagagcaaagcacaagcuugc

SEQ ID NO: 456127 - RNA, 64 nt, hsa
guuucaguucugauuucagcaaacaugagcaaaccacuuugacugaaagcagaaagagugaaaa

SEQ ID NO: 456128 - RNA, 64 nt, hsa
aguauagaacuguugauuucaacauacacuauagcacuuugacuaauuacagauauauuugaua

SEQ ID NO: 456129 - RNA, 64 nt, hsa
uugugagauaaaacucuccuuuuccuuaccauaccacuuugacacgcuucaaggauauacugca

SEQ ID NO: 456130 - RNA, 64 nt, hsa
uccuacacuugagaugauuuccaagccucucuggcacuuugaguuaagucuaucugguauuaaa

SEQ ID NO: 456131 - RNA, 64 nt, hsa
ccuucauuuaaaaagguuuaaaacuaguuagauucacuuugacacuuuucauaucauuucuuaa

SEQ ID NO: 456132 - RNA, 64 nt, hsa
ccauuugcaugaaauucacaugcaccuaaauccucacuuugacagaaacucaugcuucaguuua

SEQ ID NO: 456133 - RNA, 64 nt, hsa
cuggaugcuacuugaagagggaguacuuuguaaccacuuugauaugcuguuaucaccacccccu

SEQ ID NO: 456134 - RNA, 64 nt, hsa
cccucuugaucuucucuuuuauaaauaaaguaagcacuuugaagcaaaaacuuguauauuaaca

SEQ ID NO: 456135 - RNA, 64 nt, hsa
gauaaucauggguuagaaggaaguguuugaaagucacuuugaaaguuaguuuugggccagcacg

SEQ ID NO: 456136 - RNA, 64 nt, hsa
uuuugacugagugagacuucuagcaugaaagucccacuuugauuauugcuuauuugaaaacagu

SEQ ID NO: 456137 - RNA, 64 nt, hsa
uuacuuugugugcaacuaccugcuuuuaaugacucacuuugaucaaaugacagugaacaaagcc

SEQ ID NO: 456138 - RNA, 64 nt, hsa
aaaauguauuacaucaauauuaacucaucuauagcacuuugaguaucuuuguaguucaugauau

SEQ ID NO: 456139 - RNA, 64 nt, hsa
ggcugggcgcgguggcucacaccuguaaucccagcacuuugagaggaugagguaggcggaucac

SEQ ID NO: 456140 - RNA, 64 nt, hsa
aaauauuguaaagcagggucucaacuuuuaaauacacuuugaacuucuucucugaauuauuaaa

SEQ ID NO: 456141 - RNA, 64 nt, hsa
uaggaaguauuaaaacugugaagcuuucucagugcacuuugaaccuggaaaacaaucccaacag

SEQ ID NO: 456142 - RNA, 64 nt, hsa
uucuuaaacuuuuuuuuuuuuucaguuuuuuuuccacuuugaaucagaaauauaaucugcagua

SEQ ID NO: 456143 - RNA, 64 nt, hsa
cucagaaaccacugucauuaguuuacaaaguuagcacuuugaaguaaaacuaaaugaggaagga

SEQ ID NO: 456144 - RNA, 64 nt, hsa
uuuaaaucauuccauuagccauauauagcaaacucacuuugacauuuuggaaauaacauugugc

SEQ ID NO: 456145 - RNA, 64 nt, hsa
auuccaaccacuagaauacccuagucacuauucccacuuugagcauuaaccccuuugaaaagaa

SEQ ID NO: 456146 - RNA, 64 nt, hsa
aggaacaacauaguuaauuuuuuucuaaccuugccacuuugagggaaggaaggguugggggaag

SEQ ID NO: 456147 - RNA, 64 nt, hsa
guucagacuguauaguaaggagaaagucugguugcacuuugaagagcuugaagauuugaaagau

SEQ ID NO: 456148 - RNA, 64 nt, hsa
gcugucgucuuggcagcacuugucacguuggcagcacuuugagagcaagucugaguggacccac

SEQ ID NO: 456149 - RNA, 64 nt, hsa
gaaagauaguugcaaccucaccucccucacucaacacuuugaauacuuauuguuuggcagguca

SEQ ID NO: 456150 - RNA, 64 nt, hsa
ggcgugguggcucacaccugugaguggcucccagcacuuugagaggccgaggagggaggacugc

SEQ ID NO: 456151 - RNA, 64 nt, hsa
uauaaugauguaguaaaaagauuucuccagaaaacacuuugagauacuuaaagaaauucagagc

SEQ ID NO: 456152 - RNA, 64 nt, hsa
guucuuaaacuuuuuuuuuuuucaguuuuuuuuccacuuugaaucagaaauauaaucugcagua

SEQ ID NO: 456153 - RNA, 64 nt, hsa
ggccgggcacaguggcucacgccuguaaucccagcacuuugagaggcugaggugguaggaucac

SEQ ID NO: 456154 - RNA, 64 nt, hsa
cuuauuuuaaacccugucuccaugacuucauuugcacuuugacagagcagaggcagaguauuug

SEQ ID NO: 456155 - RNA, 64 nt, hsa
uuggaauuuguuccaacuuaauggcuugcaguaccacuuugauaaaaaucagcaucaaaacauu

SEQ ID NO: 456156 - RNA, 64 nt, hsa
acagaggcccccagcccugugccccgcuggauugcacuuugagcccguggggugaggaguuggc

SEQ ID NO: 456157 - RNA, 64 nt, hsa
agcagauuuugauuuuguuucaauuuauaacuuacacuuugaaccauggguuuacuuauaaugg

SEQ ID NO: 456158 - RNA, 64 nt, hsa
uccucaagugaaaaacaggaguaauguuucguugcacuuugaaagaucugcuucaaggcauaac

SEQ ID NO: 456159 - RNA, 64 nt, hsa
uuucaaugccgucauuuucaguuagaugauuuugcacuuugagauuaaaaugccaugucuauuu

SEQ ID NO: 456160 - RNA, 64 nt, hsa
uaugguaaaaacauauaaaauuuaccaucuuaaucacuuugaguguacaguucaucaguguuaa

SEQ ID NO: 456161 - RNA, 55 nt, hsa
cagcaaaaucugaaagcuaacaccccacuuugacccucgaccacaccugaaaaug

SEQ ID NO: 456162 - RNA, 64 nt, hsa
ucuucagcagaaaaucuuuguggaacacauuccacacuuugaaaucuucguggaacaaaagaua

SEQ ID NO: 456163 - RNA, 64 nt, hsa
gcucacaccuuaaucucaggccccuauauagucacacuuugauuuaagaaaaauggagcucuug

SEQ ID NO: 456164 - RNA, 64 nt, hsa
ggucggaugcaggggcucacaccgguaaucccagcacuuugagaggcugaggcgggaagaucac

SEQ ID NO: 456165 - RNA, 64 nt, hsa
aaaacagucaucuagaauucacugaguuuuguuucacuuugacauuuggggaucuggugggcag

SEQ ID NO: 456166 - RNA, 64 nt, hsa
uccgcaaguggcacaacuucagaacuaauaguaucacuuugauuuuucuuuuuccucccuuaga

SEQ ID NO: 456167 - RNA, 64 nt, hsa
ggccacaugcgguggcucaugccuguaaucccagcacuuugauaggcugaggcagguggauugc

SEQ ID NO: 456168 - RNA, 64 nt, hsa
cguaggaaauagacacgugcuuuuuaaugcaggacacuuugaguguuacaaaaucuguagaccu

SEQ ID NO: 456169 - RNA, 64 nt, hsa
cuucccccaaagccggauucuuaauucucugcaacacuuugaggacauuuaugauugucccucu

SEQ ID NO: 456170 - RNA, 64 nt, hsa
aaucacucaaauuguucucuaauauguaaaauuacacuuugaacuacuagaaaauugugcugga

SEQ ID NO: 456171 - RNA, 60 nt, hsa
uggaacuggaguaccuguaacagcgcucggcacuuugacagcgcacagcugcucugugac

SEQ ID NO: 456172 - RNA, 64 nt, hsa
ccacccuucuugcuguccccaacacaccugaugucacuuugagccauauaguugaaguacaaau

SEQ ID NO: 456173 - RNA, 64 nt, hsa
uccuagcagaagauaguccuacugagaaaaugagcacuuugaucauucagucuuugaacuuuaa

SEQ ID NO: 456174 - RNA, 64 nt, hsa
guggacuacugagcccugaagaaauaaguccuuccacuuugaccccauggaggauugccuguga

SEQ ID NO: 456175 - RNA, 64 nt, hsa
augcagcucauuugcuaccauuuggauacuuagacacuuugagcaagauuguggcaguuuuugc

SEQ ID NO: 456176 - RNA, 64 nt, hsa
cagauucacacuguuccagugucuauaaaagaaacacuuugaagucuauaaaaaauaaaauaau

SEQ ID NO: 456177 - RNA, 64 nt, hsa
uaucucuacaacauuuaaugaauuucuuguaaaccacuuugagauacauuguuuuggaaauuca

SEQ ID NO: 456178 - RNA, 64 nt, hsa
gcagacuguuaggagcaguauugaguggcugucacacuuugaggcaacuaaaaaggcuucaaac

SEQ ID NO: 456179 - RNA, 64 nt, hsa
ccuguuuuuacagugaucaccaaacagaucuugccacuuugauuguuaaaaaugaaccacauuc

SEQ ID NO: 456180 - RNA, 64 nt, hsa
ugguugaaaaaucuuucucauauaaguuuaaccacacuuugauuuggguucauuuuuuguuuug

SEQ ID NO: 456181 - RNA, 64 nt, hsa
guaaauaucccagagaacaaucacuauucuuaagcacuuugaaaauauuucuauguaaauuauu

SEQ ID NO: 456182 - RNA, 64 nt, hsa
uuauuucuaagaaacgccacugaggaacaggauccacuuugaacaguccgcuaaagcuaucaaa

SEQ ID NO: 456183 - RNA, 64 nt, hsa
agccagauccugggguggggucuuuagguuuucucacuuugacaacccccgaauguuuuuauag

SEQ ID NO: 456184 - RNA, 64 nt, hsa
caggcauuaucuauaccuggggccagauuuucugcacuuugaaauguugccuuugccuaaugua

SEQ ID NO: 456185 - RNA, 64 nt, hsa
uuccuuaauguuccaugguauuuucaacggaauacacuuugaaagguaaaaacaauucaaaagu

SEQ ID NO: 456186 - RNA, 64 nt, hsa
cuguccaggaaaugagcagagauucacaagacagcacuuugauucuauguugaguuuguuucua

SEQ ID NO: 456187 - RNA, 64 nt, hsa
cauuugcagugacuuuuaaggcaguacuguuuagcacuuugauauuaaaauuuugcuuauguuu

SEQ ID NO: 456188 - RNA, 64 nt, hsa
gauggcugaugcaucgacuugcauucccacuuaacacuuugauuagcaugaacuugccaaucaa

SEQ ID NO: 456189 - RNA, 64 nt, hsa
cuagagggccauuggagcuugcagcucagacccccacuuugaguuuuauuuauuuaaauaguag

SEQ ID NO: 456190 - RNA, 64 nt, hsa
cagggauggggucagugguuccaccuucacaggccacuuugaaggguggauucuuugaggcccc

SEQ ID NO: 456191 - RNA, 64 nt, hsa
gccuaauauauacuguuaaauuuguuaaggauuucacuuugaaggauacaugcaaaacauauag

SEQ ID NO: 456192 - RNA, 64 nt, hsa
uuugaauuugguguuuucuagaauuuuuaaaagccacuuugauuuaguuuuaaauauguuuaaa

SEQ ID NO: 456193 - RNA, 64 nt, hsa
uacuuucauacucuucuaaguccucuuccagccucacuuugaguccuccuugggguugauagga

SEQ ID NO: 456194 - RNA, 64 nt, hsa
uuuccaaagagccaugugucauguaauacugaaccacuuugauauugagacauuaauuuguacc

SEQ ID NO: 456195 - RNA, 64 nt, hsa
ugccuuguaagauuguuguaaaauuuuuugugagcacuuugagauuuuugcugggggaggggug

SEQ ID NO: 456196 - RNA, 64 nt, hsa
gaagaguggaauaaauauucuaagugauuuaaugcacuuugacuuguauaaaacuuucuguguu

SEQ ID NO: 456197 - RNA, 64 nt, hsa
ugucuccaucuucuauagugugccacaucagaagcacuuugaccacuauauccgcuucuguuuu

SEQ ID NO: 456198 - RNA, 64 nt, hsa
uugaucauuuagguuuuuuuuuaaaccaccaugucacuuugaguccuucauggguuuuugaaca

SEQ ID NO: 456199 - RNA, 64 nt, hsa
caaauauuucauuuugugcgugugaaagggaaaacacuuugacggaucguuuuugucagaugac

SEQ ID NO: 456200 - RNA, 64 nt, hsa
cuuuucugcagcuucgcuuuuuugcaaaugcauucacuuugacaccauauaauggaacagaagc

SEQ ID NO: 456201 - RNA, 64 nt, hsa
aauaccuaagggaguguaacagucucuggaggaccacuuugagccuuuggaaguuaagguuucc

SEQ ID NO: 456202 - RNA, 64 nt, hsa
auuacauuucuuuaaaccuguuuuacuacuauggcacuuugauaaaauggucaggaaccaacuu

SEQ ID NO: 456203 - RNA, 64 nt, hsa
aaauuagaagacauuuauacucuuuuuucauggacacuuugaaauguguuucuguauaaagccu

SEQ ID NO: 456204 - RNA, 64 nt, hsa
gugccuuuagccuuuucauguuucugucucaaaacacuuugacaaagcucaccaacuuuaaaau

SEQ ID NO: 456205 - RNA, 64 nt, hsa
ucuugguuuuauuuuguuccauguuuaaaucauucacuuugauuugagugggaaaagccugaag

SEQ ID NO: 456206 - RNA, 64 nt, hsa
auguuauuuucuucuaagugaaauuucuagccugcacuuugaugucauguguucccuuugucuu

SEQ ID NO: 456207 - RNA, 64 nt, hsa
gauccucaccagggugaaugacagaguugccaggcacuuugagucucagucugaugacccacac

SEQ ID NO: 456208 - RNA, 64 nt, hsa
acauuuauuuauuuaguugaagauucacugaucccacuuugaaauacaucuuuuuaccuaagca

SEQ ID NO: 456209 - RNA, 64 nt, hsa
guucaacacagcaagugcuucauugcauggaaaacacuuugaagacaaaaaagaaaucuuauuu

SEQ ID NO: 456210 - RNA, 64 nt, hsa
gguugggugugguggcucacacuuguaaucccagcacuuugaggugggcaauggcuugagccca

SEQ ID NO: 456211 - RNA, 64 nt, hsa
gcagaauugcagaguguagaaugguacugauuugcacuuugauucacaccuuugucugcuuggu

SEQ ID NO: 456212 - RNA, 64 nt, hsa
uugggcucuaagcuagauaucuuucccucuuuuucacuuugagcuuugggaaaacucuuuaucu

SEQ ID NO: 456213 - RNA, 64 nt, hsa
ccucuauaaaugaaaggguguugguucagaauggcacuuugaauaauguaaaccagugaaaagu

SEQ ID NO: 456214 - RNA, 64 nt, hsa
gaaacaaagaagacuauguaaaacucacccaucacacuuugagacuacucacugguuggaagaa

SEQ ID NO: 456215 - RNA, 64 nt, hsa
auugguguucaagacuauaucuaauuccucugaucacuuugagaaacaaacuuuuauuaaaugu

SEQ ID NO: 456216 - RNA, 64 nt, hsa
ccccauaccuacuauuuuuuuauaucccgauuugcacuuugagaauacaucuaaggucaucuuu

SEQ ID NO: 456217 - RNA, 64 nt, hsa
gccaugcaaucugggaagcacaggaauaaguagacacuuugaaaauggauuugaauguucucau

SEQ ID NO: 456218 - RNA, 64 nt, hsa
gacuguaauugguuucuuagaccaccuaagaugccacuuugaauucucuaagacccuggagaau

SEQ ID NO: 456219 - RNA, 64 nt, hsa
augagaaaagucccaggcuaauggcagaaauuugcacuuugaacauguguguuuuuguguugug

SEQ ID NO: 456220 - RNA, 64 nt, hsa
uugguuccugcuccauggucgggccucugacagccacuuugaauaaaccagacaccgcacaugu

SEQ ID NO: 456221 - RNA, 64 nt, hsa
aaggaaacgcagggagacugugugccuggguguccacuuugaucacaugugaguguccacuuuu

SEQ ID NO: 456222 - RNA, 64 nt, hsa
gauaaagauaguugaugguuuauuuuaaaagaugcacuuugaguugcaauauguuauuuuuaua

SEQ ID NO: 456223 - RNA, 64 nt, hsa
aggagugcuauucaguguuucuuuuccugauaaacacuuugaauauuuuuuuuguguuuuuguu

SEQ ID NO: 456224 - RNA, 64 nt, hsa
uuggacaguacaaaaacaaagcugcucuuguuagcacuuugaugaggggguaggaggggaagaa

SEQ ID NO: 456225 - RNA, 64 nt, hsa
ucgagagcaccaccuucucuuuuugcccauauugcacuuugauuucaaacuaugcacugugaag

SEQ ID NO: 456226 - RNA, 64 nt, hsa
uacaugggaagauguugugcuuacuauggccagucacuuugacaaagaaaagccaaauucuuuu

SEQ ID NO: 456227 - RNA, 64 nt, hsa
uuuuaccaucuccagcucagcagacccugaaggacacuuugagacaccaaucuggauugagcgg

SEQ ID NO: 456228 - RNA, 64 nt, hsa
ggcugggugcgguggcucaugccuguaaucccagcacuuugagaggcugcggcggguggaucac

SEQ ID NO: 456229 - RNA, 64 nt, hsa
caaaaaggagucagauuuaauuuguuuuuugaagcacuuugagaaauuaauuuuaauuaacuua

SEQ ID NO: 456230 - RNA, 64 nt, hsa
uugagcucugcaaagaucagagcaggugagcauccacuuugacaugaaggacaagaagacgcau

SEQ ID NO: 456231 - RNA, 64 nt, hsa
caacagucucagguucgaucagugggucuuuuggcacuuugaaccuugaccacagggaccaaga

SEQ ID NO: 456232 - RNA, 64 nt, hsa
uaacacacccacugagaaaacccuguuuguaguucacuuugacucuugaaugugucacuuuacu

SEQ ID NO: 456233 - RNA, 64 nt, hsa
ggcccgaugcaguggcucaugccuguaaucccagcacuuugagaggcugaggcagggcagauug

SEQ ID NO: 456234 - RNA, 64 nt, hsa
gaugaagagggaaagcugacaucugcagggaacccacuuugaggcugaggccauggcaggacag

SEQ ID NO: 456235 - RNA, 64 nt, hsa
ucuucuuuuauguucacaccaccacauucccauucacuuugauuuucuacauguaauuaccuuc

SEQ ID NO: 456236 - RNA, 64 nt, hsa
ccugaaguuucuuuuugaauacuuguuucuuuagcacuuugaagauagaaaaaccacuuuuuaa

SEQ ID NO: 456237 - RNA, 64 nt, hsa
auacagagaacaucagaaauuuucuaaaaugggucacuuugaaaagaauucuuuuucucacuau

SEQ ID NO: 456238 - RNA, 64 nt, hsa
auuuucacaugaaacuacaaaucauagacucugacacuuugauuuuuaaaguacucuguccaua

SEQ ID NO: 456239 - RNA, 64 nt, hsa
ucacccuacccaggcggugggucuccaccacagccacuuugagucuguggucccuggagggugg

SEQ ID NO: 456240 - RNA, 64 nt, hsa
uuuagcauuguuauaaaccauuccauucgaaaagcacuuugaaaaauuguucccgagcgauaga

SEQ ID NO: 456241 - RNA, 64 nt, hsa
cuucauaaugauccugucuucaucauaucauauucacuuugagaaucgguuugacuuugcuuuc

SEQ ID NO: 456242 - RNA, 64 nt, hsa
auaagaggugaugacauggauauacaacagaaaacacuuugaguugaaaguaaacacaagcugg

SEQ ID NO: 456243 - RNA, 64 nt, hsa
cuaaaguggagcacuuacaccaggcucuaagauucacuuugagguggaacuuaaaaccagugua

SEQ ID NO: 456244 - RNA, 64 nt, hsa
auuuggcagaugcaguuaagguuccuaaacaacucacuuugagacuguugaaagggccugaccu

SEQ ID NO: 456245 - RNA, 64 nt, hsa
aguccuccucaggagaaggggaagggaaggaggccacuuugagagggcugaagggagggccuug

SEQ ID NO: 456246 - RNA, 64 nt, hsa
aaaauguuuauaugauaaugucuguaaacagcaucacuuugauuacaauagauguaguguugua

SEQ ID NO: 456247 - RNA, 64 nt, hsa
auaaauauugcaaguggaugaguuggaaauuaugcacuuugaaaaacauucacuuuguuuaagc

SEQ ID NO: 456248 - RNA, 64 nt, hsa
agguucgaauucaaacccagccagguuaugccaacacuuugagggaugcagcucccaaaaugua

SEQ ID NO: 456249 - RNA, 64 nt, hsa
cacgguuccuucauaaaacuauaauaauauccgacacuuugauagaaaaaaauucaaagcugug

SEQ ID NO: 456250 - RNA, 64 nt, hsa
ggagggaagaggauuuuuauaagagaaauuucugcacuuugaaacuguccucuaagagaauaag

SEQ ID NO: 456251 - RNA, 64 nt, hsa
uuuccuccugaaguguucuguuggcaauaaaaugcacuuugacuguuuguugucacugaugccc

SEQ ID NO: 456252 - RNA, 64 nt, hsa
aaaaauacccaauucuaagugguugacagauguucacuuugaagugugaaguuuuaaaaauacg

SEQ ID NO: 456253 - RNA, 64 nt, hsa
cguggacuuccucagaggguuggucccuggaucacacuuugagaaccauacuuguccugaagua

SEQ ID NO: 456254 - RNA, 64 nt, hsa
uaguuaucaaucucuaguugucacuuuccucuuccacuuugauaccauugggucauugaauaua

SEQ ID NO: 456255 - RNA, 64 nt, hsa
cauguauagcagaaaaugaaacaugcaacaaaagcacuuugaaaaauauauaaggaauuguuga

SEQ ID NO: 456256 - RNA, 64 nt, hsa
gcacagauuucaccucugucuugaauaaaggucccacuuugaagucacuggcuguaauuuuuuu

SEQ ID NO: 456257 - RNA, 64 nt, hsa
aggcacugaggaguaucaaagaagcaaauauuuucacuuugaaagaaaacugccauuuuguauu

SEQ ID NO: 456258 - RNA, 64 nt, hsa
gagccugagauugugugauuaucucaaaucaaaucacuuugauggagauaaauaaucaaaacug

SEQ ID NO: 456259 - RNA, 64 nt, hsa
ggcgccuggagcaagugcucagcuacuucuccugcacuuugaaagaccccucccacuccuggcc

SEQ ID NO: 456260 - RNA, 64 nt, hsa
agcaaguuaaauuuuugucauuuaucucugauggcacuuugagggaaaagaauguccacauaca

SEQ ID NO: 456261 - RNA, 64 nt, hsa
agcacuguugaauauggguaucggcuuucuuuuucacuuugacucuuaacauuaucagucaacu

SEQ ID NO: 456262 - RNA, 64 nt, hsa
guaguaggugagaaauguguucucuugaaacaagcacuuugaaauuugaauaggaaguuguagu

SEQ ID NO: 456263 - RNA, 64 nt, hsa
uugccuuuuuugugguuguaaauagacuuacuugcacuuugaagaugaguuacuccuugucauc

SEQ ID NO: 456264 - RNA, 64 nt, hsa
uuuuccaauuaauuaucaagucuguuuugggaaacacuuugaggacauuuaugaugcagcagau

SEQ ID NO: 456265 - RNA, 64 nt, hsa
auuccagcacuuugggaggccaaggcaggcagaucacuuugaggucaggaguuugagaccagcc

SEQ ID NO: 456266 - RNA, 64 nt, hsa
cgaaauuuuuaugagauaucucucacuugucuuccacuuugaaccgguuaaagcucauagcugu

SEQ ID NO: 456267 - RNA, 64 nt, hsa
uucucaaaaugcuugccucauaaugcauaacuuucacuuugacucuggucuugaaauuccuagu

SEQ ID NO: 456268 - RNA, 64 nt, hsa
ggcugagcucgguggcucaugccuguaaucccaacacuuugagaagcugaggugggaggagugc

SEQ ID NO: 456269 - RNA, 64 nt, hsa
gaagugagggaagaaugaguagucaggaacuggucacuuugaaugugggagggaagauauucac

SEQ ID NO: 456270 - RNA, 64 nt, hsa
uccuggcccagugcuuuuucuuacuuuguagcuacacuuugaaguaagauucaaacuguuaucc

SEQ ID NO: 456271 - RNA, 64 nt, hsa
aacaagagacugcuugacaaaggagcauugcagucacuuugacagguuccuuuuaaguggacuc

SEQ ID NO: 456272 - RNA, 64 nt, hsa
uuuauacuguaaaguauauguuaaaugcuuuuaucacuuugagaauaaaaaguuacuaaugcug

SEQ ID NO: 456273 - RNA, 64 nt, hsa
cccuauaccuagcacugugacaccaccccuaaaucacuuugagccugggaaauaagcccccuca

SEQ ID NO: 456274 - RNA, 64 nt, hsa
ucgucggcauuuucguuuagaccuuuaauucuagcacuuugaauucgagcaggucagcgucuuc

SEQ ID NO: 456275 - RNA, 64 nt, hsa
cuaaaugucagcuguugucacacaguagcuccaacacuuugagcauuuuuaagggaguggccuc

SEQ ID NO: 456276 - RNA, 64 nt, hsa
aagagaggaacaagcagaagaugccugcagguaucacuuugauccuaugugggagcgacugaaa

SEQ ID NO: 456277 - RNA, 64 nt, hsa
auauuucuauugcaaaagucuauccgauuugaugcacuuugaauauugagauauuuugcacgga

SEQ ID NO: 456278 - RNA, 64 nt, hsa
uccucagccgcugguauuuucuaaggggucucuucacuuugaugagugacaugaacaccguguc

SEQ ID NO: 456279 - RNA, 64 nt, hsa
uugaugcuugcuuuaacuuuagucccaucucugccacuuugaugcuauuuggguuaugaugggg

SEQ ID NO: 456280 - RNA, 64 nt, hsa
cugagauccagcccuacuucuugcacugauaaugcacuuugaagauggaagggauggaaacagg

SEQ ID NO: 456281 - RNA, 64 nt, hsa
ccuucggccuggcucagcugggcugcaggaugcccacuuugaggagggaggcacagggcuuggg

SEQ ID NO: 456282 - RNA, 64 nt, hsa
gcguuuaugagcuaccggguaaaugaauuacaugcacuuugaaguaaauagguuuucuauuggg

SEQ ID NO: 456283 - RNA, 64 nt, hsa
cauaggaauugacuucuuuuccuugaauggaaaacacuuugaaauaauaauaaacauuguuaua

SEQ ID NO: 456284 - RNA, 64 nt, hsa
ucuaauccuuaggaguuguuuuaaaagacauaaucacuuugaacuuccaugaaaccugucuucc

SEQ ID NO: 456285 - RNA, 64 nt, hsa
ucugaggacgcaacaagccugguucccuagagcucacuuugacccucaauauguucauaauuuc

SEQ ID NO: 456286 - RNA, 64 nt, hsa
gacuuuuuuauuuuauguuaauguuuucaguucucacuuugaggcacauuuacaucaaugcuuu

SEQ ID NO: 456287 - RNA, 64 nt, hsa
gcugugucugccaaacacauuuacccuuuggccccacuuugaagggcaagaaauggcgucugcu

SEQ ID NO: 456288 - RNA, 64 nt, hsa
ccucuuuaaaaacucacuuacguuuguccuuuuucacuuugaaaaguuggaaggaucugcugag

SEQ ID NO: 456289 - RNA, 64 nt, hsa
agguuuguuuuuguuuuuccacuuaucuugaguucacuuugauguuaaaucuauugcuacuuca

SEQ ID NO: 456290 - RNA, 64 nt, hsa
ggggcaagcaugauauguuguuagaacaggagcccacuuugaagguauaacagguuccugccag

SEQ ID NO: 456291 - RNA, 64 nt, hsa
uuugcucaaaguauagaaacagcccaccugugcccacuuugaccauuggugaggauagauauaa

SEQ ID NO: 456292 - RNA, 64 nt, hsa
cgauccugugguacuugaauauccaaaaacccugcacuuugaacaaucagcuguugcuaucugg

SEQ ID NO: 456293 - RNA, 64 nt, hsa
caaccaugaacccaccucacggaagcuuuuuuugcacuuugaacagaagucauugcaguugggg

SEQ ID NO: 456294 - RNA, 64 nt, hsa; identical to SEQ ID NO: 456283

SEQ ID NO: 456295 - RNA, 64 nt, hsa
uuucuccagucaaagcucacagaaaaaaaccuggcacuuugauuuucaugggaugguccuaaca

SEQ ID NO: 456296 - RNA, 64 nt, hsa
ggccgggucugguggcucaugccuguaaucccagcacuuugagaggccugaggucggcggacug

SEQ ID NO: 456297 - RNA, 64 nt, hsa
cuguuacaaauggaacauuucauuauaacgugaucacuuugacuugagcaaaugguuuaauuuu

SEQ ID NO: 456298 - RNA, 64 nt, hsa
ccuaacuuucaaugagggaaccggaugcuguucacacuuugacuggauggagaugcauuuacaa

SEQ ID NO: 456299 - RNA, 64 nt, hsa
ccccucccuccauggagggacccauagggcuagacacuuugaggcaagcaggaggcucugccua

SEQ ID NO: 456300 - RNA, 64 nt, hsa
gcaagauauucauucauucauaaacuauugccuacacuuugaaauuuucauuuuuugaaguuga

SEQ ID NO: 456301 - RNA, 64 nt, hsa
uccaaggccuccccuauguacauuucagugagcucacuuugauuuuuaaucccaccacaagcac

SEQ ID NO: 456302 - RNA, 64 nt, hsa
aggaagcagacccuucacaagcaaaaucagccagcacuuugaucacggacuucccagccucuag

SEQ ID NO: 456303 - RNA, 64 nt, hsa
caccguuucuugaaacaaagaugguuguauuccucacuuugauguuguuuugcaagauguuugu

SEQ ID NO: 456304 - RNA, 64 nt, hsa
cuugcagcccaccugccacccaggacgggcccugcacuuugaauaggcuuuccauuuuguuuug

SEQ ID NO: 456305 - RNA, 64 nt, hsa
uugaauaggcuuuccauuuuguuuuggagguucucacuuugaaccuucuuguuuacagauuuuu

SEQ ID NO: 456306 - RNA, 64 nt, hsa
uauuaaauauacugaguugcccguuuugaaaaugcacuuugaauaaucucaaaaagauguacaa

SEQ ID NO: 456307 - RNA, 64 nt, hsa
cucucuucucucgucugagcccccaggccuuuuccacuuugagggaggugcuucgaagaauguu

SEQ ID NO: 456308 - RNA, 64 nt, hsa
agcagguucuacccucucugcuaagggccuagcacacuuugaugagguuccuggacgugagacc

SEQ ID NO: 456309 - RNA, 64 nt, hsa
aagguugggcuggugcucacagcuguaaucccagcacuuugagguuggcugggaguucaagacc

SEQ ID NO: 456310 - RNA, 64 nt, hsa
ugauaauguacaggucacagauccccuuucccaacacuuugaagaugaaucuggagucugcuua

SEQ ID NO: 456311 - RNA, 64 nt, hsa
auuagaucucuaauaaagucuguauauacauguacacuuugauccugcuggaaaauuuuaucag

SEQ ID NO: 456312 - RNA, 64 nt, hsa
guaucuauuuuuggcuaaauaaaugagcugcugccacuuugacuauaacccgccugucugcccc

SEQ ID NO: 456313 - RNA, 64 nt, hsa
cugaggauuccggauaccaagacgcaaacacuuucacuuugagcugggcaaaucuuacuuggca

SEQ ID NO: 456314 - RNA, 64 nt, hsa
uaaugagcacucuacagaugaagaaagcugggagcacuuugaacuugaaaaucauuucucuuag

SEQ ID NO: 456315 - RNA, 64 nt, hsa
ccgggcugggcucuacuaccuguacugucaggugcacuuugaugaggggaaggcugucuaccug

SEQ ID NO: 456316 - RNA, 64 nt, hsa
uuccaaauaaauuacucauccuuaaaguuuacuccacuuugacaaaagauacgcccuucucccu

SEQ ID NO: 456317 - RNA, 64 nt, hsa
gugaugacuuagggcuucccaucuguguacaucccacuuugaaucuugaucgugacaagaaaua

SEQ ID NO: 456318 - RNA, 64 nt, hsa
guuucuccguccucuccuaucacccccaaacacucacuuugaaugcugcaugaaucucgugggg

SEQ ID NO: 456319 - RNA, 64 nt, hsa
ccucagaucagacagagguaaguguauuguuucucacuuugauuagggcuuuuuguuacuguuu

SEQ ID NO: 456320 - RNA, 64 nt, hsa
gcugcagauaggcauggucucagguaugaacagacacuuugaaacgacuuuaggucuuucuuuu

SEQ ID NO: 456321 - RNA, 64 nt, hsa
cguccaccuacaaaucaggaacagaaagucuguccacuuugaaaauaccuuuccaggcagcucc

SEQ ID NO: 456322 - RNA, 64 nt, hsa
ccaaguguuucuugagcaucuggucuggggggaccacuuugaucggacccacccuuggaaagcu

SEQ ID NO: 456323 - RNA, 64 nt, hsa
auaugauuuuuuuguuguuguuaagacagagucucacuuugacacccaggcuggagugcagugg

SEQ ID NO: 456324 - RNA, 64 nt, hsa
cugcuuggccaauuaguucagccucagaccauggcacuuugagggggucucuaccuccccauca

SEQ ID NO: 456325 - RNA, 64 nt, hsa
ugcaaaaacaccaauggggucuagugcagguggacacuuugaaccacuccucaaaaaaagaacu

SEQ ID NO: 456326 - RNA, 64 nt, hsa
gagucucacuucuaaaugaaacaaugcaacauuucacuuugauuucuccacugaaauuuccuug

SEQ ID NO: 456327 - RNA, 64 nt, hsa
uuccagauaguuucauuucaccuguaaacuguaucacuuugacugauauuguaauuuucaaaug

SEQ ID NO: 456328 - RNA, 64 nt, hsa
agaaggagaaaugacuggaaaccagcacugucagcacuuugagcccuccucgguuuauggaggg

SEQ ID NO: 456329 - RNA, 64 nt, hsa
uaggaauuuauuuuuucuuuaacugcugugaacucacuuugaggggguaggaggagggagaaac

SEQ ID NO: 456330 - RNA, 64 nt, hsa
uuucuugcuucuccuuuuuaauuucuaaaaaagccacuuugaauggaaguugucauccguaaaa

SEQ ID NO: 456331 - RNA, 64 nt, hsa
gcugaaggacccuacgcucgguggccuggcaccucacuuugagaagagugagcacacuggcuuu

SEQ ID NO: 456332 - RNA, 64 nt, hsa
aauuacuuuugaacuguaaucuuucagauuacaccacuuugaaaacaaguuuuaacaguagggu

SEQ ID NO: 456333 - RNA, 64 nt, hsa
uuaucuugcccuuuucauucuaccaacagaucugcacuuugaagucaaugguaaauuacuccag

SEQ ID NO: 456334 - RNA, 64 nt, hsa
cugaacccauuuuccuccccugucccagccuucccacuuugacagacacuuuuaacuguguucc

SEQ ID NO: 456335 - RNA, 64 nt, hsa
ccacaaacuaaaucauaaaauaauugaauccuuacacuuugagaaaauggauagcuucuguguu

SEQ ID NO: 456336 - RNA, 64 nt, hsa
uagaggucgguaauuuaacauaaaacagggaugucacuuugaggggcagaugaaagucuagaga

SEQ ID NO: 456337 - RNA, 64 nt, hsa
uuaaagaggauugcacgaguguguuuuccucacacacuuugauuuggagaauuggugcuaguug

SEQ ID NO: 456338 - RNA, 64 nt, hsa
cacucuccauccccuuucccuuccacuuuggguucacuuugaauuuucuccguuuuuuggggca

SEQ ID NO: 456339 - RNA, 64 nt, hsa
gcacaggaccucuguaagcugcuuguguauuguccacuuugacgaucagucauucgguccguug

SEQ ID NO: 456340 - RNA, 64 nt, hsa
ggccauuugguuccugggagaauaggcagccccacacuuugaagaauacagaccccaguaucua

SEQ ID NO: 456341 - RNA, 64 nt, hsa
aucuccauggugaugcagucucuggguugucauucacuuugagagcccgaggggugggagggag

SEQ ID NO: 456342 - RNA, 64 nt, hsa
ggucgggugcgguggcucaugccuauaauccuagcacuuugagaggccaaggugggcugaucac

SEQ ID NO: 456343 - RNA, 64 nt, hsa
uagggggacccugaauuugcccauccaccugggucacuuugagaguugugcaggggggcuggga

SEQ ID NO: 456344 - RNA, 64 nt, hsa
ggugguccuguccaggcuccugcagcgccccccucacuuugacacuggacuaggaugcagccuc

SEQ ID NO: 456345 - RNA, 64 nt, hsa
ggcccggagcgguggcucacaccuguaaucccagcacuuugagaggccaaggagggaggaucgc

SEQ ID NO: 456346 - RNA, 64 nt, hsa
cauuuuuuaucuuucaucuuaccuguaauccuagcacuuugagaccacuaaggcagguggauca

SEQ ID NO: 456347 - RNA, 64 nt, hsa
auauauuguacagaaguaaaaauaaucauguauucacuuugaacuccucaaagccuuuuuuauu

SEQ ID NO: 456348 - RNA, 64 nt, hsa
cucaugaucucuuuaucagaugaucguucagccacacuuugaggauucucuucaguacaaguuu

SEQ ID NO: 456349 - RNA, 64 nt, hsa
cucaugaucucuuuaucaaaugauuguucagccacacuuugaggauucucuucaguacaaguuu

SEQ ID NO: 456350 - RNA, 64 nt, hsa
acacacaggcauggaugcauguguguguaacaaacacuuugacccugggaacuggguauaccuc

SEQ ID NO: 456351 - RNA, 64 nt, hsa
acacugugagugcacuaaaugcuauugaauuggacacuuugaaauggugaauuucgugguaugu

SEQ ID NO: 456352 - RNA, 64 nt, hsa
ggccaggugcagugucucaccccugucaucccagcacuuugagaggccaaggcgggcggaucac

SEQ ID NO: 456353 - RNA, 64 nt, hsa
gucuuugaguuuuagagucuguuaguaaaaauggcacuuugauucccauuugggaugagcccuc

SEQ ID NO: 456354 - RNA, 64 nt, hsa
uuauacuuucaauucagagcgaguuugaagaugacacuuugaggcaucgugucuaugguucauu

SEQ ID NO: 456355 - RNA, 64 nt, hsa
ggcugggcacuguggcucacgccugcaaugccagcacuuugagaggccaagacugguaggucac

SEQ ID NO: 456356 - RNA, 64 nt, hsa
cacugggggccauggcucaugccuguaauuccagcacuuugagaggcaaagacagguaggucac

SEQ ID NO: 456357 - RNA, 64 nt, hsa
auggcuuguaucucuuauuugcacauguuuuuaucacuuugaucaauguuuguagauuugaagg

SEQ ID NO: 456358 - RNA, 64 nt, hsa
ggccaggcguggugucucacaccuguaaucccagcacuuugagaggccaagacagguaggucac

SEQ ID NO: 456359 - RNA, 64 nt, hsa
aaaaagaaaucuuuuguaaaucauucuacuuuugcacuuugaaagaaaggcguuaaucauaaag

SEQ ID NO: 456360 - RNA, 64 nt, hsa
auuuuuuuaaauuugaaauauacuuuaccugauccacuuugauuguauacuauauucuuuguua

SEQ ID NO: 456361 - RNA, 64 nt, hsa
agcuuuucaaacaagaaugucccuuuuccuaagucacuuugaggugucucaaucugaucugagu

SEQ ID NO: 456362 - RNA, 64 nt, hsa
agauggggacaaggacuaagagucagaauguugacacuuugaugaaauggaguagagaaaugca

SEQ ID NO: 456363 - RNA, 64 nt, hsa
guuaguagugaaauucauucuucaauaaauaaaacacuuugaaacuccggaggaccacaucuuu

SEQ ID NO: 456364 - RNA, 64 nt, hsa
cuacauuuuuaauuuauuaaacuugcugugaaaacacuuugauuuucuaagaggaagguacuuu

SEQ ID NO: 456365 - RNA, 64 nt, hsa
aaguuuagauugcuccauuauuaacugauuaaugcacuuugaaguucucuggaauuaauuauuu

SEQ ID NO: 456366 - RNA, 64 nt, hsa
ugugauagccccagccaggucacaccuggccucacacuuugagcugagacuugaaaacgaugcu

SEQ ID NO: 456367 - RNA, 64 nt, hsa
ucucaccccucauccuuuuacuuuuugccccuuccacuuugaguaccaaauccacaagccauuu

SEQ ID NO: 456368 - RNA, 64 nt, hsa
aucaucaccacaccgugagcagaucugaaaggcacacuuugauuuuuuuaaggauaagaaccac

SEQ ID NO: 456369 - RNA, 64 nt, hsa
gaucccaucuggaaaucauaauaaagacauaugccacuuugacaaaccugacuaguccuuacua

SEQ ID NO: 456370 - RNA, 64 nt, hsa
uguagaauugucaacacgagagaucacaguggagcacuuugaaagaccgucgguugugugcacg

SEQ ID NO: 456371 - RNA, 64 nt, hsa
uuaugggcccagcuuuggggggccagucccgaugcacuuugagggguguuggagaggggacucc

SEQ ID NO: 456372 - RNA, 64 nt, hsa
gaaccuaggugucugggucuugugacaaccaaagcacuuugacacuacccccugccgagagaag

SEQ ID NO: 456373 - RNA, 64 nt, hsa
gccuccccacugcucugccccacccuccaaucugcacuuugauuugcuuccuaacagcucuguu

SEQ ID NO: 456374 - RNA, 64 nt, hsa
ucuuucuggagccugcaagaagacaguugcccaacacuuugacacuugcuaguagguccuuuga

SEQ ID NO: 456375 - RNA, 64 nt, hsa
auucaaucccaucccccuuccucccacccugccccacuuugauuuaauccuuuggcugugggcu

SEQ ID NO: 456376 - RNA, 64 nt, hsa
aggaaaggucuuuuuucacugcuuaaaguggggucacuuugauaccuuugcggucaugucugug

SEQ ID NO: 456377 - RNA, 64 nt, hsa
agguaagaguguguguguguguguguguguguaacacuuugacaauacuaaacucucauaagca

SEQ ID NO: 456378 - RNA, 64 nt, hsa
cauucagugcauuguuuacauauucaaaguggugcacuuugaaggaagcacaugugcaccuuuc

SEQ ID NO: 456379 - RNA, 64 nt, hsa
ugaucaacccacucuuguuauggguggucucugucacuuugaaugccaggcuggcuucucgucu

SEQ ID NO: 456380 - RNA, 64 nt, hsa
auagaugucuguaaccaauaauguagcaguucugcacuuugacacaagguguaacuagaccauu

SEQ ID NO: 456381 - RNA, 63 nt, hsa
ugaaagcugauagucgcguccugaauugcuccugcacuuugaccauuuccuggugucugcugu

SEQ ID NO: 456382 - RNA, 64 nt, hsa
cuacgguuguguuguuuucuagcagugacaaguucacuuugaaucagguuugaacuugacaauu

SEQ ID NO: 456383 - RNA, 64 nt, hsa
gggaaaauucuauacaacucaaucuaagucaguccacuuugacuucguacugucuuucaccuuu

SEQ ID NO: 456384 - RNA, 64 nt, hsa
uuugacguagaaauuuuuuuucucaauaaauuaucacuuugagaaaugaggccuguacaaggcu

SEQ ID NO: 456385 - RNA, 64 nt, hsa
uacuggcugaauaucagugcuguuuguaauuuuucacuuugagaaccaacauuaauuccauaug

SEQ ID NO: 456386 - RNA, 64 nt, hsa
cgugcaguggcccugccacagcccucccucggcacacuuugacccuuuguaggauuggaauuag

SEQ ID NO: 456387 - RNA, 62 nt, hsa
ucaucaguguuuuaaacagaauaaagauuccaaacacuuugaauagagaaccaagaguuauu

SEQ ID NO: 456388 - RNA, 64 nt, hsa
ucuucccacucgguagacaggcuggccucucccucacuuugagacuuuggcaacuccugggcca

SEQ ID NO: 456389 - RNA, 64 nt, hsa
aggaacucgccugacccugcugccaccuccugugcacuuugagcaaugcccccugggaucaccc

SEQ ID NO: 456390 - RNA, 64 nt, hsa
cuucauagcaaucuuugcccugaauuuaggcagucacuuugagauccaucagccuaaaacaaag

SEQ ID NO: 456391 - RNA, 64 nt, hsa
ucagcccaggguccucgcucacucccucacuccccacuuugaagccaucucuguucugcaggug

SEQ ID NO: 456392 - RNA, 62 nt, hsa
ucccuuagccuuuguucuagaaaauaaacuugugcacuuugaccucuguccccgagauguca

SEQ ID NO: 456393 - RNA, 64 nt, hsa
cccugguccugucuccagcccgucuuggcuuauccacuuugacuccuuugagccguuuggaggg

SEQ ID NO: 456394 - RNA, 64 nt, hsa
uuuuuguuaacgagcgugucuuacuaaaacgcuccacuuugagcucccccacccccuccagguc

SEQ ID NO: 456395 - RNA, 64 nt, hsa
ggucacaccaucugggccugagguagcagugggucacuuugauccacuuugcaggacuuauucu

SEQ ID NO: 456396 - RNA, 64 nt, hsa
ugcuuguaaauacacagugaaauugucuuuauaucacuuugacagaggagaagauugagggagg

SEQ ID NO: 456397 - RNA, 64 nt, hsa
uaauuugcuuaauucugagccauuaauccugcuacacuuugaaugauacauuaauucagacuaa

SEQ ID NO: 456398 - RNA, 64 nt, hsa
agaugagcauuguccaccacuaaaaugccucugccacuuugaauucugugcuaauuuuguggcc

SEQ ID NO: 456399 - RNA, 64 nt, hsa
gcgcaaugggcuggauuauaaugagcuggccaugcacuuugaccgccuugugcgaaaacaccac

SEQ ID NO: 456400 - RNA, 64 nt, hsa
ggguuucuacuucuuucaaggacucaggaaauuucacuuugaacugaggccaagugagcuguua

SEQ ID NO: 456401 - RNA, 64 nt, hsa
aagaggcugccuggggcugggccagcccgcugugcacuuugaccccaguuccuugccagcacgg

SEQ ID NO: 456402 - RNA, 64 nt, hsa
caaugcacaaggggaaauuuggcuugcaauucaucacuuugaaaagguuagucauuaaauuaau

SEQ ID NO: 456403 - RNA, 64 nt, hsa
gcauuaaaggugccaugaaagguagacucugaaccacuuugaucccucugaaguaggugacuga

SEQ ID NO: 456404 - RNA, 64 nt, hsa
agagccaguagugaauccccucauuuugugcauucacuuugaagaaaaagguuucucaaagaug

SEQ ID NO: 456405 - RNA, 64 nt, hsa
aucacuccuuugcacuccacuccccucguucugucacuuugaacgaagucugagugaggcuagu

SEQ ID NO: 456406 - RNA, 64 nt, hsa
caucgaugagagagaaucacaaucagaauggaagcacuuugaguaucugaagagugagagcauu

SEQ ID NO: 456407 - RNA, 64 nt, hsa
gacaaacaagaaaaaaagcuuuuauugguguuuucacuuugaaagagcuuuuagcaagguugug

SEQ ID NO: 456408 - RNA, 64 nt, hsa
ucccagguuuuuuacuuucugaguaguuguccaucacuuugaggacuuguguaugggcuuguac

SEQ ID NO: 456409 - RNA, 64 nt, hsa
uuuugguuauacauuuuaaauuacuuaccauuuucacuuugaauguguuguuccagauuuaaca

SEQ ID NO: 456410 - RNA, 64 nt, hsa
uuggagguuucauguuagccauuuuaaaaggcaacacuuugacaaaaugaucguucauacuuug

SEQ ID NO: 456411 - RNA, 64 nt, hsa
uaauuugcuuaguucugagccauuuauucugcuacacuuugaaagauauauuaguucugacuua

SEQ ID NO: 456412 - RNA, 64 nt, hsa
uaaggagaaaaaaaaaugaguaaaaggagcuccacacuuugacuuaauuucauacaaagcucug

SEQ ID NO: 456413 - RNA, 64 nt, hsa
ccugauauuauguuauuagcuacgauuucaaggucacuuugaagucagacuucacaguuuucua

SEQ ID NO: 456414 - RNA, 64 nt, hsa
ggugccgccaggugacccuacauguccggagcaacacuuugaaaaccaaagacgcuuggcagaa

SEQ ID NO: 456415 - RNA, 64 nt, hsa
aaguuacagauucagcuuuucaaauugucaaauucacuuugaauaauaauagaaccugggcuac

SEQ ID NO: 456416 - RNA, 64 nt, hsa
aacauuuguuauuuucucaccuuuuuuucuaauucacuuugauugcuaggggucauguaugcuu

SEQ ID NO: 456417 - RNA, 64 nt, hsa
cuuggaagauaggccuggaagagacuguugaugccacuuugaagaaaagaacacugagaacuag

SEQ ID NO: 456418 - RNA, 66 nt, hsa
aaauagcugcccaucuccugugauugcacaaccaagcacuuugacauuugcaccuuaggagaggca

SEQ ID NO: 456419 - RNA, 66 nt, hsa
uuuguuuuuugguuuuuuuuaaugacaaugaagugacacuuugacauuuccuaccuuuugaggacu

SEQ ID NO: 456420 - RNA, 66 nt, hsa
uuuguucaauuagcuuuggggaagaaaugccaaauccacuuugaggaugagucuuacgacacagau

SEQ ID NO: 456421 - RNA, 66 nt, hsa
uuuaaguuuauugcuuuaaaauggcaguguuucucccacuuugauaugcuaacauuuaguaagcac

SEQ ID NO: 456422 - RNA, 66 nt, hsa
agaauugcauccucugggaucuucugagguggacagcacuuugaauguagcauuucacuggaacag

SEQ ID NO: 456423 - RNA, 66 nt, hsa
ggacuguuuugguggcauccaaagacgaucucagagcacuuugaaccucucuguugaguuuucuuu

SEQ ID NO: 456424 - RNA, 66 nt, hsa
gcgauaacacugucuaagcacccccaagccacuauccacuuugaauccugcuccauacauugggug

SEQ ID NO: 456425 - RNA, 66 nt, hsa
gcuguugugaggauuaaaugagauggcaugugaaagcacuuugaaaauuguaaagcgcuauguaaa

SEQ ID NO: 456426 - RNA, 66 nt, hsa
ucuagguuugcugagaaggcuucauuaaauuaaucucacuuugaauaucuccugagagauggacaa

SEQ ID NO: 456427 - RNA, 66 nt, hsa
guaagcgggauccguuuuuuggaauuugguugaagucacuuugauuucuuuaaaaaacaucuuuuc

SEQ ID NO: 456428 - RNA, 66 nt, hsa
ccagugacuuugcugcuacauauuuacuaaauugaccacuuugauucuugcuuguuugucucaguu

SEQ ID NO: 456429 - RNA, 66 nt, hsa
cagaaguaauugcggaggcuccuucagcugccucagcacuuugauuuuggacagggacaagguagg

SEQ ID NO: 456430 - RNA, 66 nt, hsa
uaaauuguuuacuuuaugauguuuacauacacguuucacuuugaaaaaaaaugcaaaucgacuuuu

SEQ ID NO: 456431 - RNA, 66 nt, hsa
ugaagucuggccuugugugcauuggagcuuccaaggcacuuugaaaucauuccaguauauuuggga

SEQ ID NO: 456432 - RNA, 66 nt, hsa
uccuuccuuguacaccuaccuucagauuucugcuuacacuuugauuucagagcuuuauuccccagu

SEQ ID NO: 456433 - RNA, 66 nt, hsa
caugacaucuucaguaugagggggacaguuugacuucacuuugagggugugaugucuguagcuaug

SEQ ID NO: 456434 - RNA, 66 nt, hsa
ggcugggccucggaguuugccccguaaagcgaauugcacuuugauguucagaaacccacuuuguuc

SEQ ID NO: 456435 - RNA, 66 nt, hsa
uuucugauaacauuauuauguugccuucuuguuucucacuuugauauuuaaaagauguucaauaca

SEQ ID NO: 456436 - RNA, 66 nt, hsa
ccccaggucaugcugcuguugcuggacugaggaccacacuuugagaaccugugcucuaagugaaua

SEQ ID NO: 456437 - RNA, 66 nt, hsa
gagaauguuuacuuuucuauuuggcauagcuaacuacacuuugauacuaacuccaguuuuacuauu

SEQ ID NO: 456438 - RNA, 66 nt, hsa
guuaugagugccaaaaaucugucuugaaggcagcuacacuuugaaguggucuuugaauacuuuuaa

SEQ ID NO: 456439 - RNA, 66 nt, hsa
aaguaagucacuuuauaaguuggcagaagugaaugacacuuugagaguagucuuucaaucugaaga

SEQ ID NO: 456440 - RNA, 66 nt, hsa
cagcucaggucacccgggccucugacccaggccugucacuuugagaggggcaaaacugagaggggc

SEQ ID NO: 456441 - RNA, 66 nt, hsa
aauccgccaguagugugauuguuuuucaauuuuucccacuuugaaaacuuacaccuaaaggccugu

SEQ ID NO: 456442 - RNA, 66 nt, hsa
acacaaccuucucaggacaagcccacugucuuaagccacuuugacccugggagacacaggacugug

SEQ ID NO: 456443 - RNA, 66 nt, hsa
aaaaaaaaaaagaguggcugacaccuguaaucucagcacuuugagaggccaaggcaguaggacuga

SEQ ID NO: 456444 - RNA, 66 nt, hsa
guaacaguuauuggcaaaaagcaugaaaagagaaagcacuuugaaauuuauuacuagcuugcuacc

SEQ ID NO: 456445 - RNA, 66 nt, hsa
ggaguugggauaauuuuuauauaaaagaaguuuuuccacuuugaauugcuaaaaguggcauuuuuc

SEQ ID NO: 456446 - RNA, 66 nt, hsa
aaaacaaaaagaaauugacucaguacuauuucuuuucacuuugaaaauauaaagaacaaaauaaag

SEQ ID NO: 456447 - RNA, 66 nt, hsa
uuuacauuccuguuugaauuuuuccaaagcaaaacucacuuugaccccauuaagaggcaagccugg

SEQ ID NO: 456448 - RNA, 66 nt, hsa
caagaaaaaggaaugaagacucgcaauuucacgacacacuuugaucccuucuguuggugucauguu

SEQ ID NO: 456449 - RNA, 66 nt, hsa
uaggcugggcaugguggcucacaccuguaaucccagcacuuugagaggccgaggugagacgggaag

SEQ ID NO: 456450 - RNA, 66 nt, hsa
auuuugcacaguguaacagcgcaguugcauucuggccacuuugaccuuauagcucccaaaugauga

SEQ ID NO: 456451 - RNA, 66 nt, hsa
cauuuuguuuuguuuuuguuuuuugaaacagggucucacuuugacacccaggcuggagugcaguag

SEQ ID NO: 456452 - RNA, 66 nt, hsa
ccauguguaccauagaggggggaaaggugguauuuucacuuugaugagguugguaaauguuuuuag

SEQ ID NO: 456453 - RNA, 66 nt, hsa
ggcugaucucaaacuucugaccucaggugauccacccacuuugaccucccaaagugcugggauuac

SEQ ID NO: 456454 - RNA, 66 nt, hsa
uaccauuagcauucugguuuugacaucagcauuagucacuuugaaauguaacgaaugguacuacaa

SEQ ID NO: 456455 - RNA, 66 nt, hsa
uuugagcuuuguuaauaaacuauuaugcagcaucuacacuuugaaaaucaaguacuucaaaacgca

SEQ ID NO: 456456 - RNA, 66 nt, hsa
gaacucuuggaaaucuuuacacaugcgagugcuaaccacuuugagcaaggcugccuucuuguagau

SEQ ID NO: 456457 - RNA, 66 nt, hsa
ccuuuuucuaauuuguagauuucaguuuccgucguucacuuugagacuuugaaauuccuauuucuc

SEQ ID NO: 456458 - RNA, 66 nt, hsa
agugacgggguucaggacacccuacacaaaauacagcacuuugacauauugaauauuuuaagcuga

SEQ ID NO: 456459 - RNA, 66 nt, hsa
aauaaccaagaggcugcagucaaauacugcuacugucacuuugaagauuuucuaagggcacaagug

SEQ ID NO: 456460 - RNA, 66 nt, hsa
uccuccaccccacacucccaccucuuucuaggacuucacuuugauaccaaauucucauuauuuuca

SEQ ID NO: 456461 - RNA, 66 nt, hsa
auauauugugacuuuaggcccauuuuucaugugcuucacuuugauagaguuaauccauaaaauugc

SEQ ID NO: 456462 - RNA, 66 nt, hsa
uuuucaucuuuauuauuguacuuuugguuaugcaaacacuuugauaauauaaacaguuaugucccc

SEQ ID NO: 456463 - RNA, 66 nt, hsa
caguuuauuaacuugagcuucacugucaucuuuuuccacuuugacuacaaagauauuucagagagc

SEQ ID NO: 456464 - RNA, 66 nt, hsa
cuucaaaauguauauauuuagugcugcaucuuauagcacuuugaaauaccucauguuuaugaaaau

SEQ ID NO: 456465 - RNA, 66 nt, hsa
guacuuuuauuuuacacauaagggaaaaaauaagaccacuuugagcaguugccuggaaggcugggc

SEQ ID NO: 456466 - RNA, 66 nt, hsa
aagugauucacugugcuucgagccaacucuaacaggcacuuugagauguguuccuccugcuguagu

SEQ ID NO: 456467 - RNA, 66 nt, hsa
auaaaaccuggacucagggagcaaccacaggcucuccacuuugaaacuuuaguuugaauuuuaaaa

SEQ ID NO: 456468 - RNA, 66 nt, hsa
cucagauucaagggaaauaccagcuuccacuugagucacuuugaaauaguuaauucaacagcacca

SEQ ID NO: 456469 - RNA, 66 nt, hsa
uuccaaauguuaauacauuuacuuuagcauugaagccacuuugaaaccugagauaaaugaauguga

SEQ ID NO: 456470 - RNA, 66 nt, hsa
uuuggaagaacuuuuaacagaagccucaaugaugaucacuuugaauugcuugugauuucaaaaaua

SEQ ID NO: 456471 - RNA, 66 nt, hsa
aaaauaaaaaucccagaaggacaggaggauucucaacacuuugaauuuuuuuaacuucauuuuucu

SEQ ID NO: 456472 - RNA, 66 nt, hsa
cagaaaacugaagauuucaucaguuggaaacaguagcacuuugaaaacuuuuuaggccagcuuuaa

SEQ ID NO: 456473 - RNA, 66 nt, hsa
cacgaagccuggcuuauucacaagacaacgaagcuccacuuugaggcucugaugaacauuccagug

SEQ ID NO: 456474 - RNA, 66 nt, hsa
aauccuggaguucugucuggucacuaucagaaggaacacuuugagggaaacccuggugcagccagc

SEQ ID NO: 456475 - RNA, 66 nt, hsa
ccaacucacaguccacuagcuucacuccuuuaaauucacuuugaaacaggccucaucccacuucca

SEQ ID NO: 456476 - RNA, 66 nt, hsa
gccaugcuuuccuagaaugucaaguagauauuuuuacacuuugaguuuuaaagcaauuacuaucag

SEQ ID NO: 456477 - RNA, 66 nt, hsa
cuggcugggcgcgguggcucacgccuguaaucccagcacuuugagagaccgaggcgggcggaucac

SEQ ID NO: 456478 - RNA, 66 nt, hsa
gguuuaaucaaucagaauuagagcaugggaggucaucacuuugaccuaaauuauuuacugcaaaaa

SEQ ID NO: 456479 - RNA, 66 nt, hsa
aggcuggaaaugaauuauucuuuaccaguuuugaaacacuuugaaauauccuaagguaacuuggaa

SEQ ID NO: 456480 - RNA, 66 nt, hsa
uucaagugucugguuucacuuucacagugcggcugccacuuugaagagacccuugguaaaccccug

SEQ ID NO: 456481 - RNA, 66 nt, hsa
aaugcuaauuucauuauaaauuguuuugcuaaaauacacuuugaaacuauuuuucuguauuccaag

SEQ ID NO: 456482 - RNA, 66 nt, hsa
auaugcauuguguguguaguaauagauguaaguuuacacuuugaaaggaaaucuuguuucaauguu

SEQ ID NO: 456483 - RNA, 66 nt, hsa
caguuggauucauuucuuggaagagccagaaugagccacuuugaccacccucgggugcuaugggug

SEQ ID NO: 456484 - RNA, 66 nt, hsa
cacauucacccuucaucagugaacuaucaggugagacacuuugacagccccuaccuguuguaccac

SEQ ID NO: 456485 - RNA, 66 nt, hsa
uucugccccaggggcuugccuggcuuggcugcagugcacuuugaaaugaaguaucuguccuuuggc

SEQ ID NO: 456486 - RNA, 66 nt, hsa
uagcugcauguuuuguaguuacgauuuuuggaaucccacuuugagugcugaaaguguaaggaagcu

SEQ ID NO: 456487 - RNA, 66 nt, hsa
ugcauuagauguaacuaaucauauuuaaauauauuucacuuugacuuuagaccuuuugaagucugu

SEQ ID NO: 456488 - RNA, 66 nt, hsa
auuagauauuuuaccauauagucauaagaauuugcucacuuugaugccagaaguacuuaagaaguu

SEQ ID NO: 456489 - RNA, 66 nt, hsa
guuuuuuuuuuuuguuauaaucuauucauggaucuccacuuugauuuaauuuuuaaauguuuuaau

SEQ ID NO: 456490 - RNA, 66 nt, hsa
gcuuauaauauacauaacucccuggaaauaacugagcacuuugaauuuuuuuuaugucuaaaauug

SEQ ID NO: 456491 - RNA, 66 nt, hsa
uaugugggaauuagugagacaucagggaguaagugacacuuugaacuccucaagggcagagaacug

SEQ ID NO: 456492 - RNA, 66 nt, hsa
cuuucacaaaaccuugucaaagaccucaugcaauaucacuuugaaaguuauuuucuguuuacuaca

SEQ ID NO: 456493 - RNA, 66 nt, hsa
augauggggaggaaaaaaccccauagauugaauuagcacuuugacucucacuuaauucaacgauuu

SEQ ID NO: 456494 - RNA, 66 nt, hsa
uuuuaugaagcuuuaucaacuuggcuucaugauccucacuuugauugauuuuaagaggauggauaa

SEQ ID NO: 456495 - RNA, 66 nt, hsa
uuucuuuauuuucuucacaugcgacaauuucuuaagcacuuugacauuuugguaguuccacacuau

SEQ ID NO: 456496 - RNA, 66 nt, hsa
caguaauuggucaugugaugcaagccagcuuacuagcacuuugagaaugagucuccuguugagcug

SEQ ID NO: 456497 - RNA, 66 nt, hsa
uaaauugcuguaucguucagucucuuguggcaauagcacuuugaagaaaauagagaauuuaauaua

SEQ ID NO: 456498 - RNA, 66 nt, hsa
uaccauuccacaaaguuggaccaucacuugugcacccacuuugacuaugaguauaccaccacauug

SEQ ID NO: 456499 - RNA, 66 nt, hsa
uaauucacaauuccauuuugauuagcaggacuuuuccacuuugaagauaaauagcaacuuuaucaa

SEQ ID NO: 456500 - RNA, 66 nt, hsa
ggcagcacuuuucccucaugcuguccuauaggacuccacuuugaagguugugccuacguugcaggg

SEQ ID NO: 456501 - RNA, 66 nt, hsa
uauuuuggaguauuucaucagcugaaaagugauucucacuuugaguuuucuuccuauauuuguaua

SEQ ID NO: 456502 - RNA, 66 nt, hsa
gcuucuuuuggaaacuggacaggccauugccaccugcacuuugaagaagugagcaaagacguggcc

SEQ ID NO: 456503 - RNA, 66 nt, hsa
uaggccgggcuugguggcucaugccuguaaucccagcacuuugagaggccgaagcgaguggaucac

SEQ ID NO: 456504 - RNA, 66 nt, hsa
ggccaccccacucuaccuccuuagcuuucccugugccacuuugacucagaggcugggagcauagca

SEQ ID NO: 456505 - RNA, 66 nt, hsa
cucacauauauacaagccaaauggauuucuuacuugcacuuugacuggcuaccagauaaucacagu

SEQ ID NO: 456506 - RNA, 66 nt, hsa
uaccauuguuccuuauaucguuaaaucuuugugacacacuuugacaaaaauguagaaccuauaaca

SEQ ID NO: 456507 - RNA, 66 nt, hsa
uuuucacauuuucaguguuuguaauauuuaucuuuucacuuugauaaaccagaaauguuucuaaau

SEQ ID NO: 456508 - RNA, 66 nt, hsa
uuaccuugguucuccuuacugaaguccucuugcuuucacuuugaucugguuuuugaagucucuuaa

SEQ ID NO: 456509 - RNA, 66 nt, hsa
gcggcaggauugucacaccguuuuaggacucugugccacuuugagagacuguucccaggaggccca

SEQ ID NO: 456510 - RNA, 66 nt, hsa
ucuaaaaaauaggcuauacuacaauugcacuuccagcacuuugagaacgaguugaauaccaagaau

SEQ ID NO: 456511 - RNA, 66 nt, hsa
gagcccaccuuagacuucuuuuggggccuucgaccucacuuugagaaauaccuucuucagguuauu

SEQ ID NO: 456512 - RNA, 66 nt, hsa
ucaaguauucugacugagugauugguugaccuaaaccacuuugaauguuucuauuuuaugaaauga

SEQ ID NO: 456513 - RNA, 66 nt, hsa
caggccgggcgcaguggcucaugccuguaaucccagcacuuugagaggccaaggcagguggaucac

SEQ ID NO: 456514 - RNA, 66 nt, hsa
ugaaagaaaauaacaaaugaaaauaaauguguacuacacuuugaaauauuuuaacuaaagccuuua

SEQ ID NO: 456515 - RNA, 66 nt, hsa
ugugcuuucuaguugucaggaaugcugaagaauuaacacuuugacuccuaaaugugauacugguuu

SEQ ID NO: 456516 - RNA, 66 nt, hsa
cugccugaagacuuaaguuuugugggcacuggaagucacuuugauagauggauugaaacuguuccu

SEQ ID NO: 456517 - RNA, 66 nt, hsa
ccagauuuguguauuguacuuauugccacuggccgccacuuugacuuauuuucucuaauaguuuau

SEQ ID NO: 456518 - RNA, 66 nt, hsa
acucauuucuagggaagaaauucuaaaucccuccuucacuuugagcaguguucuaauuggauaaau

SEQ ID NO: 456519 - RNA, 66 nt, hsa
ugccgguuguacaaucucugaucagugucuuuucagcacuuugagcauuuacuuggcucauuuagu

SEQ ID NO: 456520 - RNA, 66 nt, hsa
uguauacuuagcaagaaaauuuuuuuuuucugauagcacuuugaggauauuagauacaugcuaaau

SEQ ID NO: 456521 - RNA, 66 nt, hsa
ucuugacauuuuaaaagccugguuaugaucaguugacacuuugaguaccccccuaaauagcuggac

SEQ ID NO: 456522 - RNA, 66 nt, hsa
gguggggggauauggggauucaggcaauuguuuacacacuuugaauaacugcaaaggauuuacggu

SEQ ID NO: 456523 - RNA, 66 nt, hsa
ccauucaucucccccucaaaucauagccuaacagaacacuuugaaagcucuuuuauuuaauauuuu

SEQ ID NO: 456524 - RNA, 66 nt, hsa
caccauggugaaggcuucuuuccccacugcaggacccacuuugagaaggaccgaggaggaggauuu

SEQ ID NO: 456525 - RNA, 66 nt, hsa
uuuucaguacaguacaucauuccuccucacuaggagcacuuugauguaaaccagaauagcuuuaaa

SEQ ID NO: 456526 - RNA, 66 nt, hsa
caggccaggugugguggcucaugccuguaaucccagcacuuugagaggccgaggugggcagaucac

SEQ ID NO: 456527 - RNA, 66 nt, hsa
uaaauucuauaggauucaauacuuaguuugcaaaagcacuuugaaauuauggcacagugaguuguu

SEQ ID NO: 456528 - RNA, 66 nt, hsa
gucauauuguuuccugugcuggagcaaaagucauuacacuuugaaguauuauauuguucuuauccu

SEQ ID NO: 456529 - RNA, 66 nt, hsa
aggaaugugcacuagcucuuuuuaaauuccaugcuacacuuugaggacugucaucauguucucguu

SEQ ID NO: 456530 - RNA, 66 nt, hsa
ggcugagaacaaucccuccccuugcacuugugaaaacacuuugagcgcuuuaagagauuagccuga

SEQ ID NO: 456531 - RNA, 66 nt, hsa
aaaugaagccuaagaaacuaucuguaacauauuuugcacuuugagaaaccuuguauauuaaauuac

SEQ ID NO: 456532 - RNA, 66 nt, hsa
auauuccaggucaaaauuugugaaaaauacacaaaacacuuugauuuuacaagagaggagcuuuaa

SEQ ID NO: 456533 - RNA, 66 nt, hsa
cugauaguggauaacaaauauauuuguucacauaaccacuuugaugucaguacaacuucagcaauu

SEQ ID NO: 456534 - RNA, 66 nt, hsa
acccugcauucaaguguaacagcauucugucagggucacuuugaauugugcacauaagaaaaccaa

SEQ ID NO: 456535 - RNA, 66 nt, hsa
uaugacagccguggugguucauaucuguaauccuaacacuuugacaggccaaggcaggggaauugc

SEQ ID NO: 456536 - RNA, 66 nt, hsa
gaggccagguguaguggcucaugccuguaauccuagcacuuugagaggccgagauaggcggauugc

SEQ ID NO: 456537 - RNA, 66 nt, hsa
uguuuuuccaguaguuagcuuucuuccuggauuccucacuuugaagagugugaggaaaaccuaugu

SEQ ID NO: 456538 - RNA, 66 nt, hsa
uaauucaguaugauuuauccucacauaaaaaagaagcacuuugauugaaguauucaaucaaguuuu

SEQ ID NO: 456539 - RNA, 66 nt, hsa
uuggccaggcacaguggcucaugccuguaaucccagcacuuugagaggccaagguggguagaucau

SEQ ID NO: 456540 - RNA, 66 nt, hsa
uacaaaggguguuagcagaugcgaaguaaagaacgucacuuugaaacccauucaucacacagcaua

SEQ ID NO: 456541 - RNA, 66 nt, hsa
uaaccccaauugucaaggguaguagcuguauacuaccacuuugaauuauugaaacgggucaauuua

SEQ ID NO: 456542 - RNA, 66 nt, hsa
ucucuucccugggggcagauauuucccaauacauaccacuuugaauaggaugauaggaaauaaaug

SEQ ID NO: 456543 - RNA, 66 nt, hsa
aacaaacacucaugcuuuaauggauuauacccagagcacuuugaacaaaggucaguggggauuguu

SEQ ID NO: 456544 - RNA, 66 nt, hsa
ccugaauggauguggaaaugaaagcuagcgcaccugcacuuugaauucuugcuucuuuuuuauuac

SEQ ID NO: 456545 - RNA, 66 nt, hsa
auuagcauuuagauaauguaacaggauuuuagagagcacuuugaaagauaacauuuuauuaugaug

SEQ ID NO: 456546 - RNA, 66 nt, hsa
acagucaacuuacggugcacaguaauaugaaagccacacuuugaagguaauaaauacacagcaugc

SEQ ID NO: 456547 - RNA, 66 nt, hsa
acuuuauuacauuccagcagcuuacucccguggccgcacuuugaaugucaccaccuugaguuucuc

SEQ ID NO: 456548 - RNA, 66 nt, hsa
aacaagcaccccagucacuaggaugcagauggaccacacuuugagaaacaccacccauuucuacuu

SEQ ID NO: 456549 - RNA, 66 nt, hsa
caaagugaaguugcuucuucuacuucagucuucucucacuuugauuugcuaguuguuaucaauuaa

SEQ ID NO: 456550 - RNA, 66 nt, hsa
uuaaguuaucaacuuuagcuaguaucuucaaacuuucacuuugaaaaaugagaauuuuauauucua

SEQ ID NO: 456551 - RNA, 66 nt, hsa
uuuuggacaaauaguuguuaccaaaauauucaaaaccacuuugaguuuacauacuaguuaccuuaa

SEQ ID NO: 456552 - RNA, 66 nt, hsa
ucgaugauaauuggugcucccuucauccaacuggaucacuuugagauucaguuuuacaucauuuua

SEQ ID NO: 456553 - RNA, 66 nt, hsa
uauaggaaaaacuaaguugucacccaauaucuuagacacuuugagagcaaagggggugcuguaaau

SEQ ID NO: 456554 - RNA, 66 nt, hsa
ucucucucucucucuuuucuaagaaacaauuaugugcacuuugauacacaaccuucucuaaccaac

SEQ ID NO: 456555 - RNA, 66 nt, hsa
aaaccucuuugaaugcugaaaggucuucccucagcucacuuugaguuuuuaaaugacauuguuuuu

SEQ ID NO: 456556 - RNA, 66 nt, hsa
cucguccccagaggaggacuugaaugaggaaaccaacacuuugagaaaccaaaguccuuuuuccca

SEQ ID NO: 456557 - RNA, 66 nt, hsa
auggaugaaacaggcccuugaguugggagccugcuucacuuugacuuucccacuguugcuggagac

SEQ ID NO: 456558 - RNA, 66 nt, hsa
cacucaaccaaacaggaguuccguaggcagagugcucacuuugaauugcuaauagaaaauaaugca

SEQ ID NO: 456559 - RNA, 66 nt, hsa
auuuauuucauuaaauauuucauucguaucuguuuucacuuugagaaaucuauuuuacgauuguag

SEQ ID NO: 456560 - RNA, 66 nt, hsa
cacuacuugaccauucucacccugugaaacgucccacacuuugaagcaaauacaauucacagcaca

SEQ ID NO: 456561 - RNA, 66 nt, hsa
accuaaagaacaauuugcuaaacaugagaaaucacucacuuugauuauguauagauuacauaggaa

SEQ ID NO: 456562 - RNA, 66 nt, hsa
cccuacaccaagaguguaucugugaaagagcuccuacacuuugaaaacuuaagaaucccuuaucau

SEQ ID NO: 456563 - RNA, 66 nt, hsa
aucgauggagccacauuaauaauacuuuucaugccucacuuugacaugacagcauucgauuuuuuu

SEQ ID NO: 456564 - RNA, 66 nt, hsa
uuuuuuucuggugcuuuuuuggauugaugacugucucacuuugacuauacccauguuuugcaugca

SEQ ID NO: 456565 - RNA, 66 nt, hsa
augggucucaucauucccauacacagaaacacaaaacacuuugaucauaaacuuuuuucuucagaa

SEQ ID NO: 456566 - RNA, 66 nt, hsa
cagaaaacugaagaucucaucaguuggaaacaguagcacuuugaaaacuuucaggccagcuuuaau

SEQ ID NO: 456567 - RNA, 66 nt, hsa
ggggaggcgggaacgcgggcccgcgcgcggacuuugcacuuugaauccagaggaagaugaauuuuu

SEQ ID NO: 456568 - RNA, 66 nt, hsa
caaaaaacaaaagccgcuaugaccggcguugccucucacuuugaaagaaagacuccguaaucuuaa

SEQ ID NO: 456569 - RNA, 66 nt, hsa
uucccuauaacauuccuucucugccucucuauggcccacuuugaccacuaacaacaucagaauuau

SEQ ID NO: 456570 - RNA, 66 nt, hsa
aauuguuaaucugucugauuuugucugaauuauaaacacuuugagguaccaaacauaaccaaucug

SEQ ID NO: 456571 - RNA, 66 nt, hsa
ccugaauucuuuuucauuugagaaguaaacagauggcacuuugaaggggccucaccgagugggggc

SEQ ID NO: 456572 - RNA, 66 nt, hsa
ccuuccucauccaccccaucccuccccaguucauugcacuuugauuagcagcggaacaaggaguca

SEQ ID NO: 456573 - RNA, 66 nt, hsa
aaaaaacucaucacacaagaagagaaacaguaaccucacuuugaaaauuagcuccacucaagacua

SEQ ID NO: 456574 - RNA, 66 nt, hsa
gguacccccaacaaaucuucuaagugcauuuuugaucacuuugauaacuucuuaggugauuugccu

SEQ ID NO: 456575 - RNA, 66 nt, hsa
auauauuuccagaguuguccagcagaaagaaaguggcacuuugaagagaacuagggaaguacauau

SEQ ID NO: 456576 - RNA, 66 nt, hsa
acacccucuuuuccuguaauuuauugcagaauacaccacuuugacuuggacagcuuucugcccccu

SEQ ID NO: 456577 - RNA, 66 nt, hsa
uaagucccugcuaaaacauuccauuguuaaaauuugcacuuugaagguaagcuuucuaggccugac

SEQ ID NO: 456578 - RNA, 66 nt, hsa
cauguguauauuagauaauuguguugugaugcuacucacuuugauugcaaugaugauguccaaggu

SEQ ID NO: 456579 - RNA, 66 nt, hsa
aagcgaaaaacauggacaauuccuauucauucuuagcacuuugacaugucuuggggaaaagcuuac

SEQ ID NO: 456580 - RNA, 66 nt, hsa
augaccaccaaguacuaccugacgggaggcacuuuucacuuugaugucugagaaucaguucaaggc

SEQ ID NO: 456581 - RNA, 66 nt, hsa
uuaggccaggcgccguggcucacgccuguaauccaacacuuugagaggcugaggcgggcggaucac

SEQ ID NO: 456582 - RNA, 66 nt, hsa
uggggagagauuaagcgcucauuaagcagaggagcccacuuugaggagagcaaagcacaagcuugc

SEQ ID NO: 456583 - RNA, 66 nt, hsa
uuguuucaguucugauuucagcaaacaugagcaaaccacuuugacugaaagcagaaagagugaaaa

SEQ ID NO: 456584 - RNA, 66 nt, hsa
ugaguauagaacuguugauuucaacauacacuauagcacuuugacuaauuacagauauauuugaua

SEQ ID NO: 456585 - RNA, 66 nt, hsa
cuuugugagauaaaacucuccuuuuccuuaccauaccacuuugacacgcuucaaggauauacugca

SEQ ID NO: 456586 - RNA, 66 nt, hsa
uguccuacacuugagaugauuuccaagccucucuggcacuuugaguuaagucuaucugguauuaaa

SEQ ID NO: 456587 - RNA, 66 nt, hsa
aaccuucauuuaaaaagguuuaaaacuaguuagauucacuuugacacuuuucauaucauuucuuaa

SEQ ID NO: 456588 - RNA, 66 nt, hsa
ggccauuugcaugaaauucacaugcaccuaaauccucacuuugacagaaacucaugcuucaguuua

SEQ ID NO: 456589 - RNA, 66 nt, hsa
cacuggaugcuacuugaagagggaguacuuuguaaccacuuugauaugcuguuaucaccacccccu

SEQ ID NO: 456590 - RNA, 66 nt, hsa
aacccucuugaucuucucuuuuauaaauaaaguaagcacuuugaagcaaaaacuuguauauuaaca

SEQ ID NO: 456591 - RNA, 66 nt, hsa
aggauaaucauggguuagaaggaaguguuugaaagucacuuugaaaguuaguuuugggccagcacg

SEQ ID NO: 456592 - RNA, 66 nt, hsa
gauuuugacugagugagacuucuagcaugaaagucccacuuugauuauugcuuauuugaaaacagu

SEQ ID NO: 456593 - RNA, 66 nt, hsa
guuuacuuugugugcaacuaccugcuuuuaaugacucacuuugaucaaaugacagugaacaaagcc

SEQ ID NO: 456594 - RNA, 66 nt, hsa
ugaaaauguauuacaucaauauuaacucaucuauagcacuuugaguaucuuuguaguucaugauau

SEQ ID NO: 456595 - RNA, 66 nt, hsa
aaggcugggcgcgguggcucacaccuguaaucccagcacuuugagaggaugagguaggcggaucac

SEQ ID NO: 456596 - RNA, 66 nt, hsa
uaaaauauuguaaagcagggucucaacuuuuaaauacacuuugaacuucuucucugaauuauuaaa

SEQ ID NO: 456597 - RNA, 66 nt, hsa
ucuaggaaguauuaaaacugugaagcuuucucagugcacuuugaaccuggaaaacaaucccaacag

SEQ ID NO: 456598 - RNA, 66 nt, hsa
aguucuuaaacuuuuuuuuuuuuucaguuuuuuuuccacuuugaaucagaaauauaaucugcagua

SEQ ID NO: 456599 - RNA, 66 nt, hsa
cccucagaaaccacugucauuaguuuacaaaguuagcacuuugaaguaaaacuaaaugaggaagga

SEQ ID NO: 456600 - RNA, 66 nt, hsa
cuuuuaaaucauuccauuagccauauauagcaaacucacuuugacauuuuggaaauaacauugugc

SEQ ID NO: 456601 - RNA, 66 nt, hsa
uuauuccaaccacuagaauacccuagucacuauucccacuuugagcauuaaccccuuugaaaagaa

SEQ ID NO: 456602 - RNA, 66 nt, hsa
ggaggaacaacauaguuaauuuuuuucuaaccuugccacuuugagggaaggaaggguugggggaag

SEQ ID NO: 456603 - RNA, 66 nt, hsa
uuguucagacuguauaguaaggagaaagucugguugcacuuugaagagcuugaagauuugaaagau

SEQ ID NO: 456604 - RNA, 66 nt, hsa
cagcugucgucuuggcagcacuugucacguuggcagcacuuugagagcaagucugaguggacccac

SEQ ID NO: 456605 - RNA, 66 nt, hsa
gagaaagauaguugcaaccucaccucccucacucaacacuuugaauacuuauuguuuggcagguca

SEQ ID NO: 456606 - RNA, 66 nt, hsa
ugggcgugguggcucacaccugugaguggcucccagcacuuugagaggccgaggagggaggacugc

SEQ ID NO: 456607 - RNA, 66 nt, hsa
aguauaaugauguaguaaaaagauuucuccagaaaacacuuugagauacuuaaagaaauucagagc

SEQ ID NO: 456608 - RNA, 66 nt, hsa
gaguucuuaaacuuuuuuuuuuuucaguuuuuuuuccacuuugaaucagaaauauaaucugcagua

SEQ ID NO: 456609 - RNA, 66 nt, hsa
guggccgggcacaguggcucacgccuguaaucccagcacuuugagaggcugaggugguaggaucac

SEQ ID NO: 456610 - RNA, 66 nt, hsa
gucuuauuuuaaacccugucuccaugacuucauuugcacuuugacagagcagaggcagaguauuug

SEQ ID NO: 456611 - RNA, 66 nt, hsa
auuuggaauuuguuccaacuuaauggcuugcaguaccacuuugauaaaaaucagcaucaaaacauu

SEQ ID NO: 456612 - RNA, 66 nt, hsa
ucacagaggcccccagcccugugccccgcuggauugcacuuugagcccguggggugaggaguuggc

SEQ ID NO: 456613 - RNA, 66 nt, hsa
cuagcagauuuugauuuuguuucaauuuauaacuuacacuuugaaccauggguuuacuuauaaugg

SEQ ID NO: 456614 - RNA, 66 nt, hsa
ucuccucaagugaaaaacaggaguaauguuucguugcacuuugaaagaucugcuucaaggcauaac

SEQ ID NO: 456615 - RNA, 66 nt, hsa
uuuuucaaugccgucauuuucaguuagaugauuuugcacuuugagauuaaaaugccaugucuauuu

SEQ ID NO: 456616 - RNA, 66 nt, hsa
auuaugguaaaaacauauaaaauuuaccaucuuaaucacuuugaguguacaguucaucaguguuaa

SEQ ID NO: 456617 - RNA, 55 nt, hsa; identical to SEQ ID NO: 456161

SEQ ID NO: 456618 - RNA, 66 nt, hsa
gcucuucagcagaaaaucuuuguggaacacauuccacacuuugaaaucuucguggaacaaaagaua

SEQ ID NO: 456619 - RNA, 66 nt, hsa
aggcucacaccuuaaucucaggccccuauauagucacacuuugauuuaagaaaaauggagcucuug

SEQ ID NO: 456620 - RNA, 66 nt, hsa
ugggucggaugcaggggcucacaccgguaaucccagcacuuugagaggcugaggcgggaagaucac

SEQ ID NO: 456621 - RNA, 66 nt, hsa
guaaaacagucaucuagaauucacugaguuuuguuucacuuugacauuuggggaucuggugggcag

SEQ ID NO: 456622 - RNA, 66 nt, hsa
ucuccgcaaguggcacaacuucagaacuaauaguaucacuuugauuuuucuuuuuccucccuuaga

SEQ ID NO: 456623 - RNA, 66 nt, hsa
uaggccacaugcgguggcucaugccuguaaucccagcacuuugauaggcugaggcagguggauugc

SEQ ID NO: 456624 - RNA, 66 nt, hsa
cacguaggaaauagacacgugcuuuuuaaugcaggacacuuugaguguuacaaaaucuguagaccu

SEQ ID NO: 456625 - RNA, 66 nt, hsa
uucuucccccaaagccggauucuuaauucucugcaacacuuugaggacauuuaugauugucccucu

SEQ ID NO: 456626 - RNA, 66 nt, hsa
uaaaucacucaaauuguucucuaauauguaaaauuacacuuugaacuacuagaaaauugugcugga

SEQ ID NO: 456627 - RNA, 60 nt, hsa; identical to SEQ ID NO: 456171

SEQ ID NO: 456628 - RNA, 66 nt, hsa
ccccacccuucuugcuguccccaacacaccugaugucacuuugagccauauaguugaaguacaaau

SEQ ID NO: 456629 - RNA, 66 nt, hsa
ccuccuagcagaagauaguccuacugagaaaaugagcacuuugaucauucagucuuugaacuuuaa

SEQ ID NO: 456630 - RNA, 66 nt, hsa
auguggacuacugagcccugaagaaauaaguccuuccacuuugaccccauggaggauugccuguga

SEQ ID NO: 456631 - RNA, 66 nt, hsa
uaaugcagcucauuugcuaccauuuggauacuuagacacuuugagcaagauuguggcaguuuuugc

SEQ ID NO: 456632 - RNA, 66 nt, hsa
accagauucacacuguuccagugucuauaaaagaaacacuuugaagucuauaaaaaauaaaauaau

SEQ ID NO: 456633 - RNA, 66 nt, hsa
ucuaucucuacaacauuuaaugaauuucuuguaaaccacuuugagauacauuguuuuggaaauuca

SEQ ID NO: 456634 - RNA, 66 nt, hsa
aagcagacuguuaggagcaguauugaguggcugucacacuuugaggcaacuaaaaaggcuucaaac

SEQ ID NO: 456635 - RNA, 66 nt, hsa
uuccuguuuuuacagugaucaccaaacagaucuugccacuuugauuguuaaaaaugaaccacauuc

SEQ ID NO: 456636 - RNA, 66 nt, hsa
ucugguugaaaaaucuuucucauauaaguuuaaccacacuuugauuuggguucauuuuuuguuuug

SEQ ID NO: 456637 - RNA, 66 nt, hsa
cuguaaauaucccagagaacaaucacuauucuuaagcacuuugaaaauauuucuauguaaauuauu

SEQ ID NO: 456638 - RNA, 66 nt, hsa
ccuuauuucuaagaaacgccacugaggaacaggauccacuuugaacaguccgcuaaagcuaucaaa

SEQ ID NO: 456639 - RNA, 66 nt, hsa
ucagccagauccugggguggggucuuuagguuuucucacuuugacaacccccgaauguuuuuauag

SEQ ID NO: 456640 - RNA, 66 nt, hsa
cacaggcauuaucuauaccuggggccagauuuucugcacuuugaaauguugccuuugccuaaugua

SEQ ID NO: 456641 - RNA, 66 nt, hsa
auuuccuuaauguuccaugguauuuucaacggaauacacuuugaaagguaaaaacaauucaaaagu

SEQ ID NO: 456642 - RNA, 66 nt, hsa
agcuguccaggaaaugagcagagauucacaagacagcacuuugauucuauguugaguuuguuucua

SEQ ID NO: 456643 - RNA, 66 nt, hsa
uucauuugcagugacuuuuaaggcaguacuguuuagcacuuugauauuaaaauuuugcuuauguuu

SEQ ID NO: 456644 - RNA, 66 nt, hsa
uggauggcugaugcaucgacuugcauucccacuuaacacuuugauuagcaugaacuugccaaucaa

SEQ ID NO: 456645 - RNA, 66 nt, hsa
uccuagagggccauuggagcuugcagcucagacccccacuuugaguuuuauuuauuuaaauaguag

SEQ ID NO: 456646 - RNA, 66 nt, hsa
ugcagggauggggucagugguuccaccuucacaggccacuuugaaggguggauucuuugaggcccc

SEQ ID NO: 456647 - RNA, 66 nt, hsa
cagccuaauauauacuguuaaauuuguuaaggauuucacuuugaaggauacaugcaaaacauauag

SEQ ID NO: 456648 - RNA, 66 nt, hsa
uuuuugaauuugguguuuucuagaauuuuuaaaagccacuuugauuuaguuuuaaauauguuuaaa

SEQ ID NO: 456649 - RNA, 66 nt, hsa
aguacuuucauacucuucuaaguccucuuccagccucacuuugaguccuccuugggguugauagga

SEQ ID NO: 456650 - RNA, 66 nt, hsa
auuuuccaaagagccaugugucauguaauacugaaccacuuugauauugagacauuaauuuguacc

SEQ ID NO: 456651 - RNA, 66 nt, hsa
ugugccuuguaagauuguuguaaaauuuuuugugagcacuuugagauuuuugcugggggaggggug

SEQ ID NO: 456652 - RNA, 66 nt, hsa
aggaagaguggaauaaauauucuaagugauuuaaugcacuuugacuuguauaaaacuuucuguguu

SEQ ID NO: 456653 - RNA, 66 nt, hsa
ccugucuccaucuucuauagugugccacaucagaagcacuuugaccacuauauccgcuucuguuuu

SEQ ID NO: 456654 - RNA, 66 nt, hsa
uguugaucauuuagguuuuuuuuuaaaccaccaugucacuuugaguccuucauggguuuuugaaca

SEQ ID NO: 456655 - RNA, 66 nt, hsa
uucaaauauuucauuuugugcgugugaaagggaaaacacuuugacggaucguuuuugucagaugac

SEQ ID NO: 456656 - RNA, 66 nt, hsa
uucuuuucugcagcuucgcuuuuuugcaaaugcauucacuuugacaccauauaauggaacagaagc

SEQ ID NO: 456657 - RNA, 66 nt, hsa
uaaauaccuaagggaguguaacagucucuggaggaccacuuugagccuuuggaaguuaagguuucc

SEQ ID NO: 456658 - RNA, 66 nt, hsa
aaauuacauuucuuuaaaccuguuuuacuacuauggcacuuugauaaaauggucaggaaccaacuu

SEQ ID NO: 456659 - RNA, 66 nt, hsa
ucaaauuagaagacauuuauacucuuuuuucauggacacuuugaaauguguuucuguauaaagccu

SEQ ID NO: 456660 - RNA, 66 nt, hsa
cugugccuuuagccuuuucauguuucugucucaaaacacuuugacaaagcucaccaacuuuaaaau

SEQ ID NO: 456661 - RNA, 66 nt, hsa
ugucuugguuuuauuuuguuccauguuuaaaucauucacuuugauuugagugggaaaagccugaag

SEQ ID NO: 456662 - RNA, 66 nt, hsa
uaauguuauuuucuucuaagugaaauuucuagccugcacuuugaugucauguguucccuuugucuu

SEQ ID NO: 456663 - RNA, 66 nt, hsa
cagauccucaccagggugaaugacagaguugccaggcacuuugagucucagucugaugacccacac

SEQ ID NO: 456664 - RNA, 66 nt, hsa
guacauuuauuuauuuaguugaagauucacugaucccacuuugaaauacaucuuuuuaccuaagca

SEQ ID NO: 456665 - RNA, 66 nt, hsa
caguucaacacagcaagugcuucauugcauggaaaacacuuugaagacaaaaaagaaaucuuauuu

SEQ ID NO: 456666 - RNA, 66 nt, hsa
cugguugggugugguggcucacacuuguaaucccagcacuuugaggugggcaauggcuugagccca

SEQ ID NO: 456667 - RNA, 66 nt, hsa
augcagaauugcagaguguagaaugguacugauuugcacuuugauucacaccuuugucugcuuggu

SEQ ID NO: 456668 - RNA, 66 nt, hsa
gguugggcucuaagcuagauaucuuucccucuuuuucacuuugagcuuugggaaaacucuuuaucu

SEQ ID NO: 456669 - RNA, 66 nt, hsa
uuccucuauaaaugaaaggguguugguucagaauggcacuuugaauaauguaaaccagugaaaagu

SEQ ID NO: 456670 - RNA, 66 nt, hsa
ucgaaacaaagaagacuauguaaaacucacccaucacacuuugagacuacucacugguuggaagaa

SEQ ID NO: 456671 - RNA, 66 nt, hsa
auauugguguucaagacuauaucuaauuccucugaucacuuugagaaacaaacuuuuauuaaaugu

SEQ ID NO: 456672 - RNA, 66 nt, hsa
ucccccauaccuacuauuuuuuuauaucccgauuugcacuuugagaauacaucuaaggucaucuuu

SEQ ID NO: 456673 - RNA, 66 nt, hsa
gagccaugcaaucugggaagcacaggaauaaguagacacuuugaaaauggauuugaauguucucau

SEQ ID NO: 456674 - RNA, 66 nt, hsa
gagacuguaauugguuucuuagaccaccuaagaugccacuuugaauucucuaagacccuggagaau

SEQ ID NO: 456675 - RNA, 66 nt, hsa
cgaugagaaaagucccaggcuaauggcagaaauuugcacuuugaacauguguguuuuuguguugug

SEQ ID NO: 456676 - RNA, 66 nt, hsa
auuugguuccugcuccauggucgggccucugacagccacuuugaauaaaccagacaccgcacaugu

SEQ ID NO: 456677 - RNA, 66 nt, hsa
gaaaggaaacgcagggagacugugugccuggguguccacuuugaucacaugugaguguccacuuuu

SEQ ID NO: 456678 - RNA, 66 nt, hsa
uugauaaagauaguugaugguuuauuuuaaaagaugcacuuugaguugcaauauguuauuuuuaua

SEQ ID NO: 456679 - RNA, 66 nt, hsa
cuaggagugcuauucaguguuucuuuuccugauaaacacuuugaauauuuuuuuuguguuuuuguu

SEQ ID NO: 456680 - RNA, 66 nt, hsa
uguuggacaguacaaaaacaaagcugcucuuguuagcacuuugaugaggggguaggaggggaagaa

SEQ ID NO: 456681 - RNA, 66 nt, hsa
uaucgagagcaccaccuucucuuuuugcccauauugcacuuugauuucaaacuaugcacugugaag

SEQ ID NO: 456682 - RNA, 66 nt, hsa
ucuacaugggaagauguugugcuuacuauggccagucacuuugacaaagaaaagccaaauucuuuu

SEQ ID NO: 456683 - RNA, 66 nt, hsa
gcuuuuaccaucuccagcucagcagacccugaaggacacuuugagacaccaaucuggauugagcgg

SEQ ID NO: 456684 - RNA, 66 nt, hsa
ugggcugggugcgguggcucaugccuguaaucccagcacuuugagaggcugcggcggguggaucac

SEQ ID NO: 456685 - RNA, 66 nt, hsa
aacaaaaaggagucagauuuaauuuguuuuuugaagcacuuugagaaauuaauuuuaauuaacuua

SEQ ID NO: 456686 - RNA, 66 nt, hsa
ucuugagcucugcaaagaucagagcaggugagcauccacuuugacaugaaggacaagaagacgcau

SEQ ID NO: 456687 - RNA, 66 nt, hsa
cucaacagucucagguucgaucagugggucuuuuggcacuuugaaccuugaccacagggaccaaga

SEQ ID NO: 456688 - RNA, 66 nt, hsa
cuuaacacacccacugagaaaacccuguuuguaguucacuuugacucuugaaugugucacuuuacu

SEQ ID NO: 456689 - RNA, 66 nt, hsa
cuggcccgaugcaguggcucaugccuguaaucccagcacuuugagaggcugaggcagggcagauug

SEQ ID NO: 456690 - RNA, 66 nt, hsa
cagaugaagagggaaagcugacaucugcagggaacccacuuugaggcugaggccauggcaggacag

SEQ ID NO: 456691 - RNA, 66 nt, hsa
uuucuucuuuuauguucacaccaccacauucccauucacuuugauuuucuacauguaauuaccuuc

SEQ ID NO: 456692 - RNA, 66 nt, hsa
gaccugaaguuucuuuuugaauacuuguuucuuuagcacuuugaagauagaaaaaccacuuuuuaa

SEQ ID NO: 456693 - RNA, 66 nt, hsa
caauacagagaacaucagaaauuuucuaaaaugggucacuuugaaaagaauucuuuuucucacuau

SEQ ID NO: 456694 - RNA, 66 nt, hsa
guauuuucacaugaaacuacaaaucauagacucugacacuuugauuuuuaaaguacucuguccaua

SEQ ID NO: 456695 - RNA, 66 nt, hsa
caucacccuacccaggcggugggucuccaccacagccacuuugagucuguggucccuggagggugg

SEQ ID NO: 456696 - RNA, 66 nt, hsa
aguuuagcauuguuauaaaccauuccauucgaaaagcacuuugaaaaauuguucccgagcgauaga

SEQ ID NO: 456697 - RNA, 66 nt, hsa
agcuucauaaugauccugucuucaucauaucauauucacuuugagaaucgguuugacuuugcuuuc

SEQ ID NO: 456698 - RNA, 66 nt, hsa
aaauaagaggugaugacauggauauacaacagaaaacacuuugaguugaaaguaaacacaagcugg

SEQ ID NO: 456699 - RNA, 66 nt, hsa
cucuaaaguggagcacuuacaccaggcucuaagauucacuuugagguggaacuuaaaaccagugua

SEQ ID NO: 456700 - RNA, 66 nt, hsa
gaauuuggcagaugcaguuaagguuccuaaacaacucacuuugagacuguugaaagggccugaccu

SEQ ID NO: 456701 - RNA, 66 nt, hsa
ccaguccuccucaggagaaggggaagggaaggaggccacuuugagagggcugaagggagggccuug

SEQ ID NO: 456702 - RNA, 66 nt, hsa
uaaaaauguuuauaugauaaugucuguaaacagcaucacuuugauuacaauagauguaguguugua

SEQ ID NO: 456703 - RNA, 66 nt, hsa
ggauaaauauugcaaguggaugaguuggaaauuaugcacuuugaaaaacauucacuuuguuuaagc

SEQ ID NO: 456704 - RNA, 66 nt, hsa
uaagguucgaauucaaacccagccagguuaugccaacacuuugagggaugcagcucccaaaaugua

SEQ ID NO: 456705 - RNA, 66 nt, hsa
uucacgguuccuucauaaaacuauaauaauauccgacacuuugauagaaaaaaauucaaagcugug

SEQ ID NO: 456706 - RNA, 66 nt, hsa
auggagggaagaggauuuuuauaagagaaauuucugcacuuugaaacuguccucuaagagaauaag

SEQ ID NO: 456707 - RNA, 66 nt, hsa
cauuuccuccugaaguguucuguuggcaauaaaaugcacuuugacuguuuguugucacugaugccc

SEQ ID NO: 456708 - RNA, 66 nt, hsa
ccaaaaauacccaauucuaagugguugacagauguucacuuugaagugugaaguuuuaaaaauacg

SEQ ID NO: 456709 - RNA, 66 nt, hsa
cucguggacuuccucagaggguuggucccuggaucacacuuugagaaccauacuuguccugaagua

SEQ ID NO: 456710 - RNA, 66 nt, hsa
uauaguuaucaaucucuaguugucacuuuccucuuccacuuugauaccauugggucauugaauaua

SEQ ID NO: 456711 - RNA, 66 nt, hsa
gccauguauagcagaaaaugaaacaugcaacaaaagcacuuugaaaaauauauaaggaauuguuga

SEQ ID NO: 456712 - RNA, 66 nt, hsa
cagcacagauuucaccucugucuugaauaaaggucccacuuugaagucacuggcuguaauuuuuuu

SEQ ID NO: 456713 - RNA, 66 nt, hsa
caaggcacugaggaguaucaaagaagcaaauauuuucacuuugaaagaaaacugccauuuuguauu

SEQ ID NO: 456714 - RNA, 66 nt, hsa
ccgagccugagauugugugauuaucucaaaucaaaucacuuugauggagauaaauaaucaaaacug

SEQ ID NO: 456715 - RNA, 66 nt, hsa
caggcgccuggagcaagugcucagcuacuucuccugcacuuugaaagaccccucccacuccuggcc

SEQ ID NO: 456716 - RNA, 66 nt, hsa
gcagcaaguuaaauuuuugucauuuaucucugauggcacuuugagggaaaagaauguccacauaca

SEQ ID NO: 456717 - RNA, 66 nt, hsa
aaagcacuguugaauauggguaucggcuuucuuuuucacuuugacucuuaacauuaucagucaacu

SEQ ID NO: 456718 - RNA, 66 nt, hsa
agguaguaggugagaaauguguucucuugaaacaagcacuuugaaauuugaauaggaaguuguagu

SEQ ID NO: 456719 - RNA, 66 nt, hsa
cauugccuuuuuugugguuguaaauagacuuacuugcacuuugaagaugaguuacuccuugucauc

SEQ ID NO: 456720 - RNA, 66 nt, hsa
cauuuuccaauuaauuaucaagucuguuuugggaaacacuuugaggacauuuaugaugcagcagau

SEQ ID NO: 456721 - RNA, 66 nt, hsa
uaauuccagcacuuugggaggccaaggcaggcagaucacuuugaggucaggaguuugagaccagcc

SEQ ID NO: 456722 - RNA, 66 nt, hsa
gccgaaauuuuuaugagauaucucucacuugucuuccacuuugaaccgguuaaagcucauagcugu

SEQ ID NO: 456723 - RNA, 66 nt, hsa
ccuucucaaaaugcuugccucauaaugcauaacuuucacuuugacucuggucuugaaauuccuagu

SEQ ID NO: 456724 - RNA, 66 nt, hsa
uuggcugagcucgguggcucaugccuguaaucccaacacuuugagaagcugaggugggaggagugc

SEQ ID NO: 456725 - RNA, 66 nt, hsa
uugaagugagggaagaaugaguagucaggaacuggucacuuugaaugugggagggaagauauucac

SEQ ID NO: 456726 - RNA, 66 nt, hsa
acuccuggcccagugcuuuuucuuacuuuguagcuacacuuugaaguaagauucaaacuguuaucc

SEQ ID NO: 456727 - RNA, 66 nt, hsa
aaaacaagagacugcuugacaaaggagcauugcagucacuuugacagguuccuuuuaaguggacuc

SEQ ID NO: 456728 - RNA, 66 nt, hsa
uguuuauacuguaaaguauauguuaaaugcuuuuaucacuuugagaauaaaaaguuacuaaugcug

SEQ ID NO: 456729 - RNA, 64 nt, hsa; identical to SEQ ID NO: 456273

SEQ ID NO: 456730 - RNA, 66 nt, hsa
caucgucggcauuuucguuuagaccuuuaauucuagcacuuugaauucgagcaggucagcgucuuc

SEQ ID NO: 456731 - RNA, 66 nt, hsa
uccuaaaugucagcuguugucacacaguagcuccaacacuuugagcauuuuuaagggaguggccuc

SEQ ID NO: 456732 - RNA, 66 nt, hsa
aaaagagaggaacaagcagaagaugccugcagguaucacuuugauccuaugugggagcgacugaaa

SEQ ID NO: 456733 - RNA, 66 nt, hsa
uaauauuucuauugcaaaagucuauccgauuugaugcacuuugaauauugagauauuuugcacgga

SEQ ID NO: 456734 - RNA, 66 nt, hsa
aauccucagccgcugguauuuucuaaggggucucuucacuuugaugagugacaugaacaccguguc

SEQ ID NO: 456735 - RNA, 66 nt, hsa
cuuugaugcuugcuuuaacuuuagucccaucucugccacuuugaugcuauuuggguuaugaugggg

SEQ ID NO: 456736 - RNA, 66 nt, hsa
cccugagauccagcccuacuucuugcacugauaaugcacuuugaagauggaagggauggaaacagg

SEQ ID NO: 456737 - RNA, 66 nt, hsa
guccuucggccuggcucagcugggcugcaggaugcccacuuugaggagggaggcacagggcuuggg

SEQ ID NO: 456738 - RNA, 66 nt, hsa
gagcguuuaugagcuaccggguaaaugaauuacaugcacuuugaaguaaauagguuuucuauuggg

SEQ ID NO: 456739 - RNA, 66 nt, hsa
gacauaggaauugacuucuuuuccuugaauggaaaacacuuugaaauaauaauaaacauuguuaua

SEQ ID NO: 456740 - RNA, 66 nt, hsa
ucucuaauccuuaggaguuguuuuaaaagacauaaucacuuugaacuuccaugaaaccugucuucc

SEQ ID NO: 456741 - RNA, 66 nt, hsa
cuucugaggacgcaacaagccugguucccuagagcucacuuugacccucaauauguucauaauuuc

SEQ ID NO: 456742 - RNA, 66 nt, hsa
uugacuuuuuuauuuuauguuaauguuuucaguucucacuuugaggcacauuuacaucaaugcuuu

SEQ ID NO: 456743 - RNA, 66 nt, hsa
cagcugugucugccaaacacauuuacccuuuggccccacuuugaagggcaagaaauggcgucugcu

SEQ ID NO: 456744 - RNA, 66 nt, hsa
caccucuuuaaaaacucacuuacguuuguccuuuuucacuuugaaaaguuggaaggaucugcugag

SEQ ID NO: 456745 - RNA, 66 nt, hsa
uuagguuuguuuuuguuuuuccacuuaucuugaguucacuuugauguuaaaucuauugcuacuuca

SEQ ID NO: 456746 - RNA, 66 nt, hsa
gaggggcaagcaugauauguuguuagaacaggagcccacuuugaagguauaacagguuccugccag

SEQ ID NO: 456747 - RNA, 66 nt, hsa
aauuugcucaaaguauagaaacagcccaccugugcccacuuugaccauuggugaggauagauauaa

SEQ ID NO: 456748 - RNA, 66 nt, hsa
uccgauccugugguacuugaauauccaaaaacccugcacuuugaacaaucagcuguugcuaucugg

SEQ ID NO: 456749 - RNA, 66 nt, hsa
aacaaccaugaacccaccucacggaagcuuuuuuugcacuuugaacagaagucauugcaguugggg

SEQ ID NO: 456750 - RNA, 66 nt, hsa; identical to SEQ ID NO: 456739

SEQ ID NO: 456751 - RNA, 66 nt, hsa
gauuucuccagucaaagcucacagaaaaaaaccuggcacuuugauuuucaugggaugguccuaaca

SEQ ID NO: 456752 - RNA, 66 nt, hsa
caggccgggucugguggcucaugccuguaaucccagcacuuugagaggccugaggucggcggacug

SEQ ID NO: 456753 - RNA, 66 nt, hsa
agcuguuacaaauggaacauuucauuauaacgugaucacuuugacuugagcaaaugguuuaauuuu

SEQ ID NO: 456754 - RNA, 66 nt, hsa
ggccuaacuuucaaugagggaaccggaugcuguucacacuuugacuggauggagaugcauuuacaa

SEQ ID NO: 456755 - RNA, 66 nt, hsa
agccccucccuccauggagggacccauagggcuagacacuuugaggcaagcaggaggcucugccua

SEQ ID NO: 456756 - RNA, 66 nt, hsa
aggcaagauauucauucauucauaaacuauugccuacacuuugaaauuuucauuuuuugaaguuga

SEQ ID NO: 456757 - RNA, 66 nt, hsa
ucuccaaggccuccccuauguacauuucagugagcucacuuugauuuuuaaucccaccacaagcac

SEQ ID NO: 456758 - RNA, 66 nt, hsa
ugaggaagcagacccuucacaagcaaaaucagccagcacuuugaucacggacuucccagccucuag

SEQ ID NO: 456759 - RNA, 66 nt, hsa
gacaccguuucuugaaacaaagaugguuguauuccucacuuugauguuguuuugcaagauguuugu

SEQ ID NO: 456760 - RNA, 66 nt, hsa
gacuugcagcccaccugccacccaggacgggcccugcacuuugaauaggcuuuccauuuuguuuug

SEQ ID NO: 456761 - RNA, 66 nt, hsa
cuuugaauaggcuuuccauuuuguuuuggagguucucacuuugaaccuucuuguuuacagauuuuu

SEQ ID NO: 456762 - RNA, 66 nt, hsa
uauauuaaauauacugaguugcccguuuugaaaaugcacuuugaauaaucucaaaaagauguacaa

SEQ ID NO: 456763 - RNA, 66 nt, hsa
uucucucuucucucgucugagcccccaggccuuuuccacuuugagggaggugcuucgaagaauguu

SEQ ID NO: 456764 - RNA, 66 nt, hsa
cgagcagguucuacccucucugcuaagggccuagcacacuuugaugagguuccuggacgugagacc

SEQ ID NO: 456765 - RNA, 66 nt, hsa
gcaagguugggcuggugcucacagcuguaaucccagcacuuugagguuggcugggaguucaagacc

SEQ ID NO: 456766 - RNA, 66 nt, hsa
uaugauaauguacaggucacagauccccuuucccaacacuuugaagaugaaucuggagucugcuua

SEQ ID NO: 456767 - RNA, 66 nt, hsa
gcauuagaucucuaauaaagucuguauauacauguacacuuugauccugcuggaaaauuuuaucag

SEQ ID NO: 456768 - RNA, 66 nt, hsa
aaguaucuauuuuuggcuaaauaaaugagcugcugccacuuugacuauaacccgccugucugcccc

SEQ ID NO: 456769 - RNA, 66 nt, hsa
ggcugaggauuccggauaccaagacgcaaacacuuucacuuugagcugggcaaaucuuacuuggca

SEQ ID NO: 456770 - RNA, 66 nt, hsa
uguaaugagcacucuacagaugaagaaagcugggagcacuuugaacuugaaaaucauuucucuuag

SEQ ID NO: 456771 - RNA, 66 nt, hsa
acccgggcugggcucuacuaccuguacugucaggugcacuuugaugaggggaaggcugucuaccug

SEQ ID NO: 456772 - RNA, 66 nt, hsa
uuuuccaaauaaauuacucauccuuaaaguuuacuccacuuugacaaaagauacgcccuucucccu

SEQ ID NO: 456773 - RNA, 66 nt, hsa
uggugaugacuuagggcuucccaucuguguacaucccacuuugaaucuugaucgugacaagaaaua

SEQ ID NO: 456774 - RNA, 66 nt, hsa
cuguuucuccguccucuccuaucacccccaaacacucacuuugaaugcugcaugaaucucgugggg

SEQ ID NO: 456775 - RNA, 66 nt, hsa
gaccucagaucagacagagguaaguguauuguuucucacuuugauuagggcuuuuuguuacuguuu

SEQ ID NO: 456776 - RNA, 66 nt, hsa
uagcugcagauaggcauggucucagguaugaacagacacuuugaaacgacuuuaggucuuucuuuu

SEQ ID NO: 456777 - RNA, 66 nt, hsa
cucguccaccuacaaaucaggaacagaaagucuguccacuuugaaaauaccuuuccaggcagcucc

SEQ ID NO: 456778 - RNA, 66 nt, hsa
ccccaaguguuucuugagcaucuggucuggggggaccacuuugaucggacccacccuuggaaagcu

SEQ ID NO: 456779 - RNA, 66 nt, hsa
aaauaugauuuuuuuguuguuguuaagacagagucucacuuugacacccaggcuggagugcagugg

SEQ ID NO: 456780 - RNA, 66 nt, hsa
aucugcuuggccaauuaguucagccucagaccauggcacuuugagggggucucuaccuccccauca

SEQ ID NO: 456781 - RNA, 66 nt, hsa
ccugcaaaaacaccaauggggucuagugcagguggacacuuugaaccacuccucaaaaaaagaacu

SEQ ID NO: 456782 - RNA, 66 nt, hsa
gagagucucacuucuaaaugaaacaaugcaacauuucacuuugauuucuccacugaaauuuccuug

SEQ ID NO: 456783 - RNA, 66 nt, hsa
aguuccagauaguuucauuucaccuguaaacuguaucacuuugacugauauuguaauuuucaaaug

SEQ ID NO: 456784 - RNA, 66 nt, hsa
ggagaaggagaaaugacuggaaaccagcacugucagcacuuugagcccuccucgguuuauggaggg

SEQ ID NO: 456785 - RNA, 66 nt, hsa
uguaggaauuuauuuuuucuuuaacugcugugaacucacuuugaggggguaggaggagggagaaac

SEQ ID NO: 456786 - RNA, 66 nt, hsa
aguuucuugcuucuccuuuuuaauuucuaaaaaagccacuuugaauggaaguugucauccguaaaa

SEQ ID NO: 456787 - RNA, 66 nt, hsa
cugcugaaggacccuacgcucgguggccuggcaccucacuuugagaagagugagcacacuggcuuu

SEQ ID NO: 456788 - RNA, 66 nt, hsa
ggaauuacuuuugaacuguaaucuuucagauuacaccacuuugaaaacaaguuuuaacaguagggu

SEQ ID NO: 456789 - RNA, 66 nt, hsa
cuuuaucuugcccuuuucauucuaccaacagaucugcacuuugaagucaaugguaaauuacuccag

SEQ ID NO: 456790 - RNA, 66 nt, hsa
cccugaacccauuuuccuccccugucccagccuucccacuuugacagacacuuuuaacuguguucc

SEQ ID NO: 456791 - RNA, 66 nt, hsa
gaccacaaacuaaaucauaaaauaauugaauccuuacacuuugagaaaauggauagcuucuguguu

SEQ ID NO: 456792 - RNA, 66 nt, hsa
cuuagaggucgguaauuuaacauaaaacagggaugucacuuugaggggcagaugaaagucuagaga

SEQ ID NO: 456793 - RNA, 66 nt, hsa
uguuaaagaggauugcacgaguguguuuuccucacacacuuugauuuggagaauuggugcuaguug

SEQ ID NO: 456794 - RNA, 66 nt, hsa
uccacucuccauccccuuucccuuccacuuuggguucacuuugaauuuucuccguuuuuuggggca

SEQ ID NO: 456795 - RNA, 66 nt, hsa
gagcacaggaccucuguaagcugcuuguguauuguccacuuugacgaucagucauucgguccguug

SEQ ID NO: 456796 - RNA, 66 nt, hsa
gaggccauuugguuccugggagaauaggcagccccacacuuugaagaauacagaccccaguaucua

SEQ ID NO: 456797 - RNA, 66 nt, hsa
ccaucuccauggugaugcagucucuggguugucauucacuuugagagcccgaggggugggagggag

SEQ ID NO: 456798 - RNA, 66 nt, hsa
agggucgggugcgguggcucaugccuauaauccuagcacuuugagaggccaaggugggcugaucac

SEQ ID NO: 456799 - RNA, 66 nt, hsa
aguagggggacccugaauuugcccauccaccugggucacuuugagaguugugcaggggggcuggga

SEQ ID NO: 456800 - RNA, 66 nt, hsa
uaggugguccuguccaggcuccugcagcgccccccucacuuugacacuggacuaggaugcagccuc

SEQ ID NO: 456801 - RNA, 66 nt, hsa
agggcccggagcgguggcucacaccuguaaucccagcacuuugagaggccaaggagggaggaucgc

SEQ ID NO: 456802 - RNA, 66 nt, hsa
accauuuuuuaucuuucaucuuaccuguaauccuagcacuuugagaccacuaaggcagguggauca

SEQ ID NO: 456803 - RNA, 66 nt, hsa
aaauauauuguacagaaguaaaaauaaucauguauucacuuugaacuccucaaagccuuuuuuauu

SEQ ID NO: 456804 - RNA, 66 nt, hsa
cacucaugaucucuuuaucagaugaucguucagccacacuuugaggauucucuucaguacaaguuu

SEQ ID NO: 456805 - RNA, 66 nt, hsa
cacucaugaucucuuuaucaaaugauuguucagccacacuuugaggauucucuucaguacaaguuu

SEQ ID NO: 456806 - RNA, 66 nt, hsa
ucacacacaggcauggaugcauguguguguaacaaacacuuugacccugggaacuggguauaccuc

SEQ ID NO: 456807 - RNA, 66 nt, hsa
cgacacugugagugcacuaaaugcuauugaauuggacacuuugaaauggugaauuucgugguaugu

SEQ ID NO: 456808 - RNA, 66 nt, hsa
aaggccaggugcagugucucaccccugucaucccagcacuuugagaggccaaggcgggcggaucac

SEQ ID NO: 456809 - RNA, 66 nt, hsa
aagucuuugaguuuuagagucuguuaguaaaaauggcacuuugauucccauuugggaugagcccuc

SEQ ID NO: 456810 - RNA, 66 nt, hsa
gauuauacuuucaauucagagcgaguuugaagaugacacuuugaggcaucgugucuaugguucauu

SEQ ID NO: 456811 - RNA, 66 nt, hsa
ugggcugggcacuguggcucacgccugcaaugccagcacuuugagaggccaagacugguaggucac

SEQ ID NO: 456812 - RNA, 66 nt, hsa
ugcacugggggccauggcucaugccuguaauuccagcacuuugagaggcaaagacagguaggucac

SEQ ID NO: 456813 - RNA, 66 nt, hsa
auauggcuuguaucucuuauuugcacauguuuuuaucacuuugaucaauguuuguagauuugaagg

SEQ ID NO: 456814 - RNA, 66 nt, hsa
ugggccaggcguggugucucacaccuguaaucccagcacuuugagaggccaagacagguaggucac

SEQ ID NO: 456815 - RNA, 66 nt, hsa
ugaaaaagaaaucuuuuguaaaucauucuacuuuugcacuuugaaagaaaggcguuaaucauaaag

SEQ ID NO: 456816 - RNA, 66 nt, hsa
ucauuuuuuuaaauuugaaauauacuuuaccugauccacuuugauuguauacuauauucuuuguua

SEQ ID NO: 456817 - RNA, 66 nt, hsa
cuagcuuuucaaacaagaaugucccuuuuccuaagucacuuugaggugucucaaucugaucugagu

SEQ ID NO: 456818 - RNA, 66 nt, hsa
aaagauggggacaaggacuaagagucagaauguugacacuuugaugaaauggaguagagaaaugca

SEQ ID NO: 456819 - RNA, 66 nt, hsa
agguuaguagugaaauucauucuucaauaaauaaaacacuuugaaacuccggaggaccacaucuuu

SEQ ID NO: 456820 - RNA, 66 nt, hsa
cucuacauuuuuaauuuauuaaacuugcugugaaaacacuuugauuuucuaagaggaagguacuuu

SEQ ID NO: 456821 - RNA, 66 nt, hsa
uuaaguuuagauugcuccauuauuaacugauuaaugcacuuugaaguucucuggaauuaauuauuu

SEQ ID NO: 456822 - RNA, 66 nt, hsa
ggugugauagccccagccaggucacaccuggccucacacuuugagcugagacuugaaaacgaugcu

SEQ ID NO: 456823 - RNA, 66 nt, hsa
ugucucaccccucauccuuuuacuuuuugccccuuccacuuugaguaccaaauccacaagccauuu

SEQ ID NO: 456824 - RNA, 66 nt, hsa
uaaucaucaccacaccgugagcagaucugaaaggcacacuuugauuuuuuuaaggauaagaaccac

SEQ ID NO: 456825 - RNA, 66 nt, hsa
cagaucccaucuggaaaucauaauaaagacauaugccacuuugacaaaccugacuaguccuuacua

SEQ ID NO: 456826 - RNA, 66 nt, hsa
cauguagaauugucaacacgagagaucacaguggagcacuuugaaagaccgucgguugugugcacg

SEQ ID NO: 456827 - RNA, 66 nt, hsa
uguuaugggcccagcuuuggggggccagucccgaugcacuuugagggguguuggagaggggacucc

SEQ ID NO: 456828 - RNA, 66 nt, hsa
gggaaccuaggugucugggucuugugacaaccaaagcacuuugacacuacccccugccgagagaag

SEQ ID NO: 456829 - RNA, 66 nt, hsa
cugccuccccacugcucugccccacccuccaaucugcacuuugauuugcuuccuaacagcucuguu

SEQ ID NO: 456830 - RNA, 66 nt, hsa
guucuuucuggagccugcaagaagacaguugcccaacacuuugacacuugcuaguagguccuuuga

SEQ ID NO: 456831 - RNA, 66 nt, hsa
auauucaaucccaucccccuuccucccacccugccccacuuugauuuaauccuuuggcugugggcu

SEQ ID NO: 456832 - RNA, 66 nt, hsa
aaaggaaaggucuuuuuucacugcuuaaaguggggucacuuugauaccuuugcggucaugucugug

SEQ ID NO: 456833 - RNA, 66 nt, hsa
acagguaagaguguguguguguguguguguguguaacacuuugacaauacuaaacucucauaagca

SEQ ID NO: 456834 - RNA, 66 nt, hsa
aucauucagugcauuguuuacauauucaaaguggugcacuuugaaggaagcacaugugcaccuuuc

SEQ ID NO: 456835 - RNA, 66 nt, hsa
agugaucaacccacucuuguuauggguggucucugucacuuugaaugccaggcuggcuucucgucu

SEQ ID NO: 456836 - RNA, 66 nt, hsa
acauagaugucuguaaccaauaauguagcaguucugcacuuugacacaagguguaacuagaccauu

SEQ ID NO: 456837 - RNA, 65 nt, hsa
ccugaaagcugauagucgcguccugaauugcuccugcacuuugaccauuuccuggugucugcugu

SEQ ID NO: 456838 - RNA, 66 nt, hsa
cacuacgguuguguuguuuucuagcagugacaaguucacuuugaaucagguuugaacuugacaauu

SEQ ID NO: 456839 - RNA, 66 nt, hsa
aagggaaaauucuauacaacucaaucuaagucaguccacuuugacuucguacugucuuucaccuuu

SEQ ID NO: 456840 - RNA, 66 nt, hsa
cuuuugacguagaaauuuuuuuucucaauaaauuaucacuuugagaaaugaggccuguacaaggcu

SEQ ID NO: 456841 - RNA, 66 nt, hsa
uauacuggcugaauaucagugcuguuuguaauuuuucacuuugagaaccaacauuaauuccauaug

SEQ ID NO: 456842 - RNA, 66 nt, hsa
uccgugcaguggcccugccacagcccucccucggcacacuuugacccuuuguaggauuggaauuag

SEQ ID NO: 456843 - RNA, 64 nt, hsa
ugucaucaguguuuuaaacagaauaaagauuccaaacacuuugaauagagaaccaagaguuauu

SEQ ID NO: 456844 - RNA, 66 nt, hsa
caucuucccacucgguagacaggcuggccucucccucacuuugagacuuuggcaacuccugggcca

SEQ ID NO: 456845 - RNA, 66 nt, hsa
acaggaacucgccugacccugcugccaccuccugugcacuuugagcaaugcccccugggaucaccc

SEQ ID NO: 456846 - RNA, 66 nt, hsa
uacuucauagcaaucuuugcccugaauuuaggcagucacuuugagauccaucagccuaaaacaaag

SEQ ID NO: 456847 - RNA, 66 nt, hsa
ucucagcccaggguccucgcucacucccucacuccccacuuugaagccaucucuguucugcaggug

SEQ ID NO: 456848 - RNA, 64 nt, hsa
cuucccuuagccuuuguucuagaaaauaaacuugugcacuuugaccucuguccccgagauguca

SEQ ID NO: 456849 - RNA, 66 nt, hsa
accccugguccugucuccagcccgucuuggcuuauccacuuugacuccuuugagccguuuggaggg

SEQ ID NO: 456850 - RNA, 66 nt, hsa
aguuuuuguuaacgagcgugucuuacuaaaacgcuccacuuugagcucccccacccccuccagguc

SEQ ID NO: 456851 - RNA, 66 nt, hsa
caggucacaccaucugggccugagguagcagugggucacuuugauccacuuugcaggacuuauucu

SEQ ID NO: 456852 - RNA, 66 nt, hsa
ugugcuuguaaauacacagugaaauugucuuuauaucacuuugacagaggagaagauugagggagg

SEQ ID NO: 456853 - RNA, 66 nt, hsa
auuaauuugcuuaauucugagccauuaauccugcuacacuuugaaugauacauuaauucagacuaa

SEQ ID NO: 456854 - RNA, 66 nt, hsa
aaagaugagcauuguccaccacuaaaaugccucugccacuuugaauucugugcuaauuuuguggcc

SEQ ID NO: 456855 - RNA, 66 nt, hsa
augcgcaaugggcuggauuauaaugagcuggccaugcacuuugaccgccuugugcgaaaacaccac

SEQ ID NO: 456856 - RNA, 66 nt, hsa
uuggguuucuacuucuuucaaggacucaggaaauuucacuuugaacugaggccaagugagcuguua

SEQ ID NO: 456857 - RNA, 66 nt, hsa
ggaagaggcugccuggggcugggccagcccgcugugcacuuugaccccaguuccuugccagcacgg

SEQ ID NO: 456858 - RNA, 66 nt, hsa
uucaaugcacaaggggaaauuuggcuugcaauucaucacuuugaaaagguuagucauuaaauuaau

SEQ ID NO: 456859 - RNA, 66 nt, hsa
gggcauuaaaggugccaugaaagguagacucugaaccacuuugaucccucugaaguaggugacuga

SEQ ID NO: 456860 - RNA, 66 nt, hsa
aaagagccaguagugaauccccucauuuugugcauucacuuugaagaaaaagguuucucaaagaug

SEQ ID NO: 456861 - RNA, 66 nt, hsa
ggaucacuccuuugcacuccacuccccucguucugucacuuugaacgaagucugagugaggcuagu

SEQ ID NO: 456862 - RNA, 66 nt, hsa
cucaucgaugagagagaaucacaaucagaauggaagcacuuugaguaucugaagagugagagcauu

SEQ ID NO: 456863 - RNA, 66 nt, hsa
cagacaaacaagaaaaaaagcuuuuauugguguuuucacuuugaaagagcuuuuagcaagguugug

SEQ ID NO: 456864 - RNA, 66 nt, hsa
gaucccagguuuuuuacuuucugaguaguuguccaucacuuugaggacuuguguaugggcuuguac

SEQ ID NO: 456865 - RNA, 66 nt, hsa
cauuuugguuauacauuuuaaauuacuuaccauuuucacuuugaauguguuguuccagauuuaaca

SEQ ID NO: 456866 - RNA, 66 nt, hsa
uauuggagguuucauguuagccauuuuaaaaggcaacacuuugacaaaaugaucguucauacuuug

SEQ ID NO: 456867 - RNA, 66 nt, hsa
auuaauuugcuuaguucugagccauuuauucugcuacacuuugaaagauauauuaguucugacuua

SEQ ID NO: 456868 - RNA, 66 nt, hsa
uuuaaggagaaaaaaaaaugaguaaaaggagcuccacacuuugacuuaauuucauacaaagcucug

SEQ ID NO: 456869 - RNA, 66 nt, hsa
auccugauauuauguuauuagcuacgauuucaaggucacuuugaagucagacuucacaguuuucua

SEQ ID NO: 456870 - RNA, 66 nt, hsa
acggugccgccaggugacccuacauguccggagcaacacuuugaaaaccaaagacgcuuggcagaa

SEQ ID NO: 456871 - RNA, 66 nt, hsa
uaaaguuacagauucagcuuuucaaauugucaaauucacuuugaauaauaauagaaccugggcuac

SEQ ID NO: 456872 - RNA, 66 nt, hsa
aaaacauuuguuauuuucucaccuuuuuuucuaauucacuuugauugcuaggggucauguaugcuu

SEQ ID NO: 456873 - RNA, 66 nt, hsa
accuuggaagauaggccuggaagagacuguugaugccacuuugaagaaaagaacacugagaacuag

SEQ ID NO: 456874 - RNA, 65 nt, hsa; identical to SEQ ID NO: 192258

SEQ ID NO: 456875 - RNA, 65 nt, hsa; identical to SEQ ID NO: 192259

SEQ ID NO: 456876 - RNA, 65 nt, hsa; identical to SEQ ID NO: 192260

SEQ ID NO: 456877 - RNA, 65 nt, hsa; identical to SEQ ID NO: 192261

SEQ ID NO: 456878 - RNA, 65 nt, hsa; identical to SEQ ID NO: 192262

SEQ ID NO: 456879 - RNA, 65 nt, hsa; identical to SEQ ID NO: 192263

SEQ ID NO: 456880 - RNA, 65 nt, hsa; identical to SEQ ID NO: 192264

SEQ ID NO: 456881 - RNA, 65 nt, hsa; identical to SEQ ID NO: 192265

SEQ ID NO: 456882 - RNA, 65 nt, hsa; identical to SEQ ID NO: 192266

SEQ ID NO: 456883 - RNA, 65 nt, hsa; identical to SEQ ID NO: 192267

SEQ ID NO: 456884 - RNA, 65 nt, hsa; identical to SEQ ID NO: 192268

SEQ ID NO: 456885 - RNA, 65 nt, hsa; identical to SEQ ID NO: 192269

SEQ ID NO: 456886 - RNA, 65 nt, hsa; identical to SEQ ID NO: 192270

SEQ ID NO: 456887 - RNA, 65 nt, hsa; identical to SEQ ID NO: 192271

SEQ ID NO: 456888 - RNA, 65 nt, hsa; identical to SEQ ID NO: 192272

SEQ ID NO: 456889 - RNA, 65 nt, hsa; identical to SEQ ID NO: 192273

SEQ ID NO: 456890 - RNA, 65 nt, hsa; identical to SEQ ID NO: 192274

SEQ ID NO: 456891 - RNA, 65 nt, hsa; identical to SEQ ID NO: 192275

SEQ ID NO: 456892 - RNA, 65 nt, hsa; identical to SEQ ID NO: 192276

SEQ ID NO: 456893 - RNA, 65 nt, hsa; identical to SEQ ID NO: 192277

SEQ ID NO: 456894 - RNA, 65 nt, hsa; identical to SEQ ID NO: 192278

SEQ ID NO: 456895 - RNA, 65 nt, hsa; identical to SEQ ID NO: 192279

SEQ ID NO: 456896 - RNA, 65 nt, hsa; identical to SEQ ID NO: 192280

SEQ ID NO: 456897 - RNA, 65 nt, hsa; identical to SEQ ID NO: 192281

SEQ ID NO: 456898 - RNA, 65 nt, hsa; identical to SEQ ID NO: 192282

SEQ ID NO: 456899 - RNA, 65 nt, hsa; identical to SEQ ID NO: 192283

SEQ ID NO: 456900 - RNA, 65 nt, hsa; identical to SEQ ID NO: 192284

SEQ ID NO: 456901 - RNA, 65 nt, hsa; identical to SEQ ID NO: 192285

SEQ ID NO: 456902 - RNA, 65 nt, hsa; identical to SEQ ID NO: 192286

SEQ ID NO: 456903 - RNA, 65 nt, hsa; identical to SEQ ID NO: 192287

SEQ ID NO: 456904 - RNA, 65 nt, hsa; identical to SEQ ID NO: 192288

SEQ ID NO: 456905 - RNA, 65 nt, hsa; identical to SEQ ID NO: 192289

SEQ ID NO: 456906 - RNA, 65 nt, hsa; identical to SEQ ID NO: 192290

SEQ ID NO: 456907 - RNA, 65 nt, hsa; identical to SEQ ID NO: 192291

SEQ ID NO: 456908 - RNA, 65 nt, hsa; identical to SEQ ID NO: 192292

SEQ ID NO: 456909 - RNA, 65 nt, hsa; identical to SEQ ID NO: 192293

SEQ ID NO: 456910 - RNA, 65 nt, hsa; identical to SEQ ID NO: 192294

SEQ ID NO: 456911 - RNA, 65 nt, hsa; identical to SEQ ID NO: 192295

SEQ ID NO: 456912 - RNA, 65 nt, hsa; identical to SEQ ID NO: 192296

SEQ ID NO: 456913 - RNA, 65 nt, hsa; identical to SEQ ID NO: 192297

SEQ ID NO: 456914 - RNA, 65 nt, hsa; identical to SEQ ID NO: 192298

SEQ ID NO: 456915 - RNA, 65 nt, hsa; identical to SEQ ID NO: 192299

SEQ ID NO: 456916 - RNA, 65 nt, hsa; identical to SEQ ID NO: 192300

SEQ ID NO: 456917 - RNA, 65 nt, hsa; identical to SEQ ID NO: 192301

SEQ ID NO: 456918 - RNA, 65 nt, hsa; identical to SEQ ID NO: 192302

SEQ ID NO: 456919 - RNA, 65 nt, hsa; identical to SEQ ID NO: 192303

SEQ ID NO: 456920 - RNA, 65 nt, hsa; identical to SEQ ID NO: 192304

SEQ ID NO: 456921 - RNA, 65 nt, hsa; identical to SEQ ID NO: 192305

SEQ ID NO: 456922 - RNA, 65 nt, hsa; identical to SEQ ID NO: 192306

SEQ ID NO: 456923 - RNA, 65 nt, hsa; identical to SEQ ID NO: 192307

SEQ ID NO: 456924 - RNA, 65 nt, hsa; identical to SEQ ID NO: 192308

SEQ ID NO: 456925 - RNA, 65 nt, hsa; identical to SEQ ID NO: 192309

SEQ ID NO: 456926 - RNA, 65 nt, hsa; identical to SEQ ID NO: 192310

SEQ ID NO: 456927 - RNA, 65 nt, hsa; identical to SEQ ID NO: 192311

SEQ ID NO: 456928 - RNA, 65 nt, hsa; identical to SEQ ID NO: 192312

SEQ ID NO: 456929 - RNA, 65 nt, hsa; identical to SEQ ID NO: 192313

SEQ ID NO: 456930 - RNA, 65 nt, hsa; identical to SEQ ID NO: 192314

SEQ ID NO: 456931 - RNA, 65 nt, hsa; identical to SEQ ID NO: 192315

SEQ ID NO: 456932 - RNA, 65 nt, hsa; identical to SEQ ID NO: 192316

SEQ ID NO: 456933 - RNA, 65 nt, hsa; identical to SEQ ID NO: 192317

SEQ ID NO: 456934 - RNA, 65 nt, hsa; identical to SEQ ID NO: 192318

SEQ ID NO: 456935 - RNA, 65 nt, hsa; identical to SEQ ID NO: 192319

SEQ ID NO: 456936 - RNA, 65 nt, hsa; identical to SEQ ID NO: 192320

SEQ ID NO: 456937 - RNA, 65 nt, hsa; identical to SEQ ID NO: 192321

SEQ ID NO: 456938 - RNA, 65 nt, hsa; identical to SEQ ID NO: 192322

SEQ ID NO: 456939 - RNA, 65 nt, hsa; identical to SEQ ID NO: 192323

SEQ ID NO: 456940 - RNA, 65 nt, hsa; identical to SEQ ID NO: 192324

SEQ ID NO: 456941 - RNA, 65 nt, hsa; identical to SEQ ID NO: 192325

SEQ ID NO: 456942 - RNA, 65 nt, hsa; identical to SEQ ID NO: 192326

SEQ ID NO: 456943 - RNA, 65 nt, hsa; identical to SEQ ID NO: 192327

SEQ ID NO: 456944 - RNA, 65 nt, hsa; identical to SEQ ID NO: 192328

SEQ ID NO: 456945 - RNA, 65 nt, hsa; identical to SEQ ID NO: 192329

SEQ ID NO: 456946 - RNA, 65 nt, hsa; identical to SEQ ID NO: 192330

SEQ ID NO: 456947 - RNA, 65 nt, hsa; identical to SEQ ID NO: 192331

SEQ ID NO: 456948 - RNA, 65 nt, hsa; identical to SEQ ID NO: 192332

SEQ ID NO: 456949 - RNA, 65 nt, hsa; identical to SEQ ID NO: 192333

SEQ ID NO: 456950 - RNA, 65 nt, hsa; identical to SEQ ID NO: 192334

SEQ ID NO: 456951 - RNA, 65 nt, hsa; identical to SEQ ID NO: 192335

SEQ ID NO: 456952 - RNA, 65 nt, hsa; identical to SEQ ID NO: 192336

SEQ ID NO: 456953 - RNA, 65 nt, hsa; identical to SEQ ID NO: 192337

SEQ ID NO: 456954 - RNA, 65 nt, hsa; identical to SEQ ID NO: 192338

SEQ ID NO: 456955 - RNA, 65 nt, hsa; identical to SEQ ID NO: 192339

SEQ ID NO: 456956 - RNA, 65 nt, hsa; identical to SEQ ID NO: 192340

SEQ ID NO: 456957 - RNA, 65 nt, hsa; identical to SEQ ID NO: 192341

SEQ ID NO: 456958 - RNA, 65 nt, hsa; identical to SEQ ID NO: 192342

SEQ ID NO: 456959 - RNA, 65 nt, hsa; identical to SEQ ID NO: 192343

SEQ ID NO: 456960 - RNA, 65 nt, hsa; identical to SEQ ID NO: 192344

SEQ ID NO: 456961 - RNA, 65 nt, hsa; identical to SEQ ID NO: 192345

SEQ ID NO: 456962 - RNA, 65 nt, hsa; identical to SEQ ID NO: 192346

SEQ ID NO: 456963 - RNA, 65 nt, hsa; identical to SEQ ID NO: 192347

SEQ ID NO: 456964 - RNA, 65 nt, hsa; identical to SEQ ID NO: 192348

SEQ ID NO: 456965 - RNA, 65 nt, hsa; identical to SEQ ID NO: 192349

SEQ ID NO: 456966 - RNA, 65 nt, hsa; identical to SEQ ID NO: 192350

SEQ ID NO: 456967 - RNA, 65 nt, hsa; identical to SEQ ID NO: 192351

SEQ ID NO: 456968 - RNA, 65 nt, hsa; identical to SEQ ID NO: 192352

SEQ ID NO: 456969 - RNA, 65 nt, hsa; identical to SEQ ID NO: 192353

SEQ ID NO: 456970 - RNA, 65 nt, hsa; identical to SEQ ID NO: 192354

SEQ ID NO: 456971 - RNA, 65 nt, hsa; identical to SEQ ID NO: 192355

SEQ ID NO: 456972 - RNA, 65 nt, hsa; identical to SEQ ID NO: 192356

SEQ ID NO: 456973 - RNA, 65 nt, hsa; identical to SEQ ID NO: 192357

SEQ ID NO: 456974 - RNA, 65 nt, hsa; identical to SEQ ID NO: 192358

SEQ ID NO: 456975 - RNA, 65 nt, hsa; identical to SEQ ID NO: 192359

SEQ ID NO: 456976 - RNA, 65 nt, hsa; identical to SEQ ID NO: 192360

SEQ ID NO: 456977 - RNA, 65 nt, hsa; identical to SEQ ID NO: 192361

SEQ ID NO: 456978 - RNA, 65 nt, hsa; identical to SEQ ID NO: 192362

SEQ ID NO: 456979 - RNA, 65 nt, hsa; identical to SEQ ID NO: 192363

SEQ ID NO: 456980 - RNA, 65 nt, hsa; identical to SEQ ID NO: 192364

SEQ ID NO: 456981 - RNA, 65 nt, hsa; identical to SEQ ID NO: 192365

SEQ ID NO: 456982 - RNA, 65 nt, hsa; identical to SEQ ID NO: 192366

SEQ ID NO: 456983 - RNA, 65 nt, hsa; identical to SEQ ID NO: 192367

SEQ ID NO: 456984 - RNA, 65 nt, hsa; identical to SEQ ID NO: 192368

SEQ ID NO: 456985 - RNA, 65 nt, hsa; identical to SEQ ID NO: 192369

SEQ ID NO: 456986 - RNA, 65 nt, hsa; identical to SEQ ID NO: 192370

SEQ ID NO: 456987 - RNA, 65 nt, hsa; identical to SEQ ID NO: 192371

SEQ ID NO: 456988 - RNA, 65 nt, hsa; identical to SEQ ID NO: 192372

SEQ ID NO: 456989 - RNA, 65 nt, hsa; identical to SEQ ID NO: 192373

SEQ ID NO: 456990 - RNA, 65 nt, hsa; identical to SEQ ID NO: 192374

SEQ ID NO: 456991 - RNA, 65 nt, hsa; identical to SEQ ID NO: 192375

SEQ ID NO: 456992 - RNA, 65 nt, hsa; identical to SEQ ID NO: 192376

SEQ ID NO: 456993 - RNA, 65 nt, hsa; identical to SEQ ID NO: 192377

SEQ ID NO: 456994 - RNA, 65 nt, hsa; identical to SEQ ID NO: 192378

SEQ ID NO: 456995 - RNA, 65 nt, hsa; identical to SEQ ID NO: 192379

SEQ ID NO: 456996 - RNA, 65 nt, hsa; identical to SEQ ID NO: 192380

SEQ ID NO: 456997 - RNA, 65 nt, hsa; identical to SEQ ID NO: 192381

SEQ ID NO: 456998 - RNA, 65 nt, hsa; identical to SEQ ID NO: 192382

SEQ ID NO: 456999 - RNA, 65 nt, hsa; identical to SEQ ID NO: 192383

SEQ ID NO: 457000 - RNA, 65 nt, hsa; identical to SEQ ID NO: 192384

SEQ ID NO: 457001 - RNA, 65 nt, hsa; identical to SEQ ID NO: 192385

SEQ ID NO: 457002 - RNA, 65 nt, hsa; identical to SEQ ID NO: 192386

SEQ ID NO: 457003 - RNA, 65 nt, hsa; identical to SEQ ID NO: 192387

SEQ ID NO: 457004 - RNA, 65 nt, hsa; identical to SEQ ID NO: 192388

SEQ ID NO: 457005 - RNA, 65 nt, hsa; identical to SEQ ID NO: 192389

SEQ ID NO: 457006 - RNA, 65 nt, hsa; identical to SEQ ID NO: 192390

SEQ ID NO: 457007 - RNA, 65 nt, hsa; identical to SEQ ID NO: 192391

SEQ ID NO: 457008 - RNA, 65 nt, hsa; identical to SEQ ID NO: 192392

SEQ ID NO: 457009 - RNA, 65 nt, hsa; identical to SEQ ID NO: 192393

SEQ ID NO: 457010 - RNA, 65 nt, hsa; identical to SEQ ID NO: 192394

SEQ ID NO: 457011 - RNA, 65 nt, hsa; identical to SEQ ID NO: 192395

SEQ ID NO: 457012 - RNA, 65 nt, hsa; identical to SEQ ID NO: 192396

SEQ ID NO: 457013 - RNA, 65 nt, hsa; identical to SEQ ID NO: 192397

SEQ ID NO: 457014 - RNA, 65 nt, hsa; identical to SEQ ID NO: 192398

SEQ ID NO: 457015 - RNA, 65 nt, hsa; identical to SEQ ID NO: 192399

SEQ ID NO: 457016 - RNA, 65 nt, hsa; identical to SEQ ID NO: 192400

SEQ ID NO: 457017 - RNA, 65 nt, hsa; identical to SEQ ID NO: 192401

SEQ ID NO: 457018 - RNA, 65 nt, hsa; identical to SEQ ID NO: 192402

SEQ ID NO: 457019 - RNA, 65 nt, hsa; identical to SEQ ID NO: 192403

SEQ ID NO: 457020 - RNA, 65 nt, hsa; identical to SEQ ID NO: 192404

SEQ ID NO: 457021 - RNA, 65 nt, hsa; identical to SEQ ID NO: 192405

SEQ ID NO: 457022 - RNA, 65 nt, hsa; identical to SEQ ID NO: 192406

SEQ ID NO: 457023 - RNA, 65 nt, hsa; identical to SEQ ID NO: 192407

SEQ ID NO: 457024 - RNA, 65 nt, hsa; identical to SEQ ID NO: 192408

SEQ ID NO: 457025 - RNA, 65 nt, hsa; identical to SEQ ID NO: 192409

SEQ ID NO: 457026 - RNA, 65 nt, hsa; identical to SEQ ID NO: 192410

SEQ ID NO: 457027 - RNA, 65 nt, hsa; identical to SEQ ID NO: 192411

SEQ ID NO: 457028 - RNA, 65 nt, hsa; identical to SEQ ID NO: 192412

SEQ ID NO: 457029 - RNA, 65 nt, hsa; identical to SEQ ID NO: 192413

SEQ ID NO: 457030 - RNA, 65 nt, hsa; identical to SEQ ID NO: 192414

SEQ ID NO: 457031 - RNA, 65 nt, hsa; identical to SEQ ID NO: 192415

SEQ ID NO: 457032 - RNA, 65 nt, hsa; identical to SEQ ID NO: 192416

SEQ ID NO: 457033 - RNA, 65 nt, hsa; identical to SEQ ID NO: 192417

SEQ ID NO: 457034 - RNA, 65 nt, hsa; identical to SEQ ID NO: 192418

SEQ ID NO: 457035 - RNA, 65 nt, hsa; identical to SEQ ID NO: 192419

SEQ ID NO: 457036 - RNA, 65 nt, hsa; identical to SEQ ID NO: 192420

SEQ ID NO: 457037 - RNA, 65 nt, hsa; identical to SEQ ID NO: 192421

SEQ ID NO: 457038 - RNA, 65 nt, hsa; identical to SEQ ID NO: 192422

SEQ ID NO: 457039 - RNA, 65 nt, hsa; identical to SEQ ID NO: 192423

SEQ ID NO: 457040 - RNA, 65 nt, hsa; identical to SEQ ID NO: 192424

SEQ ID NO: 457041 - RNA, 65 nt, hsa; identical to SEQ ID NO: 192425

SEQ ID NO: 457042 - RNA, 65 nt, hsa; identical to SEQ ID NO: 192426

SEQ ID NO: 457043 - RNA, 65 nt, hsa; identical to SEQ ID NO: 192427

SEQ ID NO: 457044 - RNA, 65 nt, hsa; identical to SEQ ID NO: 192428

SEQ ID NO: 457045 - RNA, 65 nt, hsa; identical to SEQ ID NO: 192429

SEQ ID NO: 457046 - RNA, 65 nt, hsa; identical to SEQ ID NO: 192430

SEQ ID NO: 457047 - RNA, 65 nt, hsa; identical to SEQ ID NO: 192431

SEQ ID NO: 457048 - RNA, 65 nt, hsa; identical to SEQ ID NO: 192432

SEQ ID NO: 457049 - RNA, 65 nt, hsa; identical to SEQ ID NO: 192433

SEQ ID NO: 457050 - RNA, 65 nt, hsa; identical to SEQ ID NO: 192434

SEQ ID NO: 457051 - RNA, 65 nt, hsa; identical to SEQ ID NO: 192435

SEQ ID NO: 457052 - RNA, 65 nt, hsa; identical to SEQ ID NO: 192436

SEQ ID NO: 457053 - RNA, 65 nt, hsa; identical to SEQ ID NO: 192437

SEQ ID NO: 457054 - RNA, 65 nt, hsa; identical to SEQ ID NO: 192438

SEQ ID NO: 457055 - RNA, 65 nt, hsa; identical to SEQ ID NO: 192439

SEQ ID NO: 457056 - RNA, 65 nt, hsa; identical to SEQ ID NO: 192440

SEQ ID NO: 457057 - RNA, 65 nt, hsa; identical to SEQ ID NO: 192441

SEQ ID NO: 457058 - RNA, 65 nt, hsa; identical to SEQ ID NO: 192442

SEQ ID NO: 457059 - RNA, 65 nt, hsa; identical to SEQ ID NO: 192443

SEQ ID NO: 457060 - RNA, 65 nt, hsa; identical to SEQ ID NO: 192444

SEQ ID NO: 457061 - RNA, 65 nt, hsa; identical to SEQ ID NO: 192445

SEQ ID NO: 457062 - RNA, 65 nt, hsa; identical to SEQ ID NO: 192446

SEQ ID NO: 457063 - RNA, 65 nt, hsa; identical to SEQ ID NO: 192447

SEQ ID NO: 457064 - RNA, 65 nt, hsa; identical to SEQ ID NO: 192448

SEQ ID NO: 457065 - RNA, 65 nt, hsa; identical to SEQ ID NO: 192449

SEQ ID NO: 457066 - RNA, 65 nt, hsa; identical to SEQ ID NO: 192450

SEQ ID NO: 457067 - RNA, 65 nt, hsa; identical to SEQ ID NO: 192451

SEQ ID NO: 457068 - RNA, 65 nt, hsa; identical to SEQ ID NO: 192452

SEQ ID NO: 457069 - RNA, 65 nt, hsa; identical to SEQ ID NO: 192453

SEQ ID NO: 457070 - RNA, 65 nt, hsa; identical to SEQ ID NO: 192454

SEQ ID NO: 457071 - RNA, 65 nt, hsa; identical to SEQ ID NO: 192455

SEQ ID NO: 457072 - RNA, 65 nt, hsa; identical to SEQ ID NO: 192456

SEQ ID NO: 457073 - RNA, 65 nt, hsa; identical to SEQ ID NO: 192457

SEQ ID NO: 457074 - RNA, 65 nt, hsa; identical to SEQ ID NO: 192458

SEQ ID NO: 457075 - RNA, 65 nt, hsa; identical to SEQ ID NO: 192459

SEQ ID NO: 457076 - RNA, 65 nt, hsa; identical to SEQ ID NO: 192460

SEQ ID NO: 457077 - RNA, 65 nt, hsa; identical to SEQ ID NO: 192461

SEQ ID NO: 457078 - RNA, 65 nt, hsa; identical to SEQ ID NO: 192462

SEQ ID NO: 457079 - RNA, 65 nt, hsa; identical to SEQ ID NO: 192463

SEQ ID NO: 457080 - RNA, 51 nt, hsa; identical to SEQ ID NO: 192464

SEQ ID NO: 457081 - RNA, 65 nt, hsa; identical to SEQ ID NO: 192465

SEQ ID NO: 457082 - RNA, 65 nt, hsa; identical to SEQ ID NO: 192466

SEQ ID NO: 457083 - RNA, 65 nt, hsa; identical to SEQ ID NO: 192467

SEQ ID NO: 457084 - RNA, 65 nt, hsa; identical to SEQ ID NO: 192468

SEQ ID NO: 457085 - RNA, 65 nt, hsa; identical to SEQ ID NO: 192469

SEQ ID NO: 457086 - RNA, 65 nt, hsa; identical to SEQ ID NO: 192470

SEQ ID NO: 457087 - RNA, 65 nt, hsa; identical to SEQ ID NO: 192471

SEQ ID NO: 457088 - RNA, 65 nt, hsa; identical to SEQ ID NO: 192472

SEQ ID NO: 457089 - RNA, 65 nt, hsa; identical to SEQ ID NO: 192473

SEQ ID NO: 457090 - RNA, 65 nt, hsa; identical to SEQ ID NO: 192474

SEQ ID NO: 457091 - RNA, 65 nt, hsa; identical to SEQ ID NO: 192475

SEQ ID NO: 457092 - RNA, 65 nt, hsa; identical to SEQ ID NO: 192476

SEQ ID NO: 457093 - RNA, 65 nt, hsa; identical to SEQ ID NO: 192477

SEQ ID NO: 457094 - RNA, 65 nt, hsa; identical to SEQ ID NO: 192478

SEQ ID NO: 457095 - RNA, 65 nt, hsa; identical to SEQ ID NO: 192479

SEQ ID NO: 457096 - RNA, 65 nt, hsa; identical to SEQ ID NO: 192480

SEQ ID NO: 457097 - RNA, 65 nt, hsa; identical to SEQ ID NO: 192481

SEQ ID NO: 457098 - RNA, 65 nt, hsa; identical to SEQ ID NO: 192482

SEQ ID NO: 457099 - RNA, 65 nt, hsa; identical to SEQ ID NO: 192483

SEQ ID NO: 457100 - RNA, 65 nt, hsa; identical to SEQ ID NO: 192484

SEQ ID NO: 457101 - RNA, 65 nt, hsa; identical to SEQ ID NO: 192485

SEQ ID NO: 457102 - RNA, 65 nt, hsa; identical to SEQ ID NO: 192486

SEQ ID NO: 457103 - RNA, 65 nt, hsa; identical to SEQ ID NO: 192487

SEQ ID NO: 457104 - RNA, 65 nt, hsa; identical to SEQ ID NO: 192488

SEQ ID NO: 457105 - RNA, 65 nt, hsa; identical to SEQ ID NO: 192489

SEQ ID NO: 457106 - RNA, 65 nt, hsa; identical to SEQ ID NO: 192490

SEQ ID NO: 457107 - RNA, 65 nt, hsa; identical to SEQ ID NO: 192491

SEQ ID NO: 457108 - RNA, 65 nt, hsa; identical to SEQ ID NO: 192492

SEQ ID NO: 457109 - RNA, 65 nt, hsa; identical to SEQ ID NO: 192493

SEQ ID NO: 457110 - RNA, 65 nt, hsa; identical to SEQ ID NO: 192494

SEQ ID NO: 457111 - RNA, 65 nt, hsa; identical to SEQ ID NO: 192495

SEQ ID NO: 457112 - RNA, 65 nt, hsa; identical to SEQ ID NO: 192496

SEQ ID NO: 457113 - RNA, 65 nt, hsa; identical to SEQ ID NO: 192497

SEQ ID NO: 457114 - RNA, 65 nt, hsa; identical to SEQ ID NO: 192498

SEQ ID NO: 457115 - RNA, 65 nt, hsa; identical to SEQ ID NO: 192499

SEQ ID NO: 457116 - RNA, 65 nt, hsa; identical to SEQ ID NO: 192500

SEQ ID NO: 457117 - RNA, 65 nt, hsa; identical to SEQ ID NO: 192501

SEQ ID NO: 457118 - RNA, 65 nt, hsa; identical to SEQ ID NO: 192502

SEQ ID NO: 457119 - RNA, 65 nt, hsa; identical to SEQ ID NO: 192503

SEQ ID NO: 457120 - RNA, 65 nt, hsa; identical to SEQ ID NO: 192504

SEQ ID NO: 457121 - RNA, 65 nt, hsa; identical to SEQ ID NO: 192505

SEQ ID NO: 457122 - RNA, 65 nt, hsa; identical to SEQ ID NO: 192506

SEQ ID NO: 457123 - RNA, 65 nt, hsa; identical to SEQ ID NO: 192507

SEQ ID NO: 457124 - RNA, 65 nt, hsa; identical to SEQ ID NO: 192508

SEQ ID NO: 457125 - RNA, 65 nt, hsa; identical to SEQ ID NO: 192509

SEQ ID NO: 457126 - RNA, 65 nt, hsa; identical to SEQ ID NO: 192510

SEQ ID NO: 457127 - RNA, 65 nt, hsa; identical to SEQ ID NO: 192511

SEQ ID NO: 457128 - RNA, 65 nt, hsa; identical to SEQ ID NO: 192512

SEQ ID NO: 457129 - RNA, 65 nt, hsa; identical to SEQ ID NO: 192513

SEQ ID NO: 457130 - RNA, 65 nt, hsa; identical to SEQ ID NO: 192514

SEQ ID NO: 457131 - RNA, 65 nt, hsa; identical to SEQ ID NO: 192515

SEQ ID NO: 457132 - RNA, 65 nt, hsa; identical to SEQ ID NO: 192516

SEQ ID NO: 457133 - RNA, 65 nt, hsa; identical to SEQ ID NO: 192517

SEQ ID NO: 457134 - RNA, 65 nt, hsa; identical to SEQ ID NO: 192518

SEQ ID NO: 457135 - RNA, 65 nt, hsa; identical to SEQ ID NO: 192519

SEQ ID NO: 457136 - RNA, 65 nt, hsa; identical to SEQ ID NO: 192520

SEQ ID NO: 457137 - RNA, 65 nt, hsa; identical to SEQ ID NO: 192521

SEQ ID NO: 457138 - RNA, 65 nt, hsa; identical to SEQ ID NO: 192522

SEQ ID NO: 457139 - RNA, 65 nt, hsa; identical to SEQ ID NO: 192523

SEQ ID NO: 457140 - RNA, 65 nt, hsa; identical to SEQ ID NO: 192524

SEQ ID NO: 457141 - RNA, 65 nt, hsa; identical to SEQ ID NO: 192525

SEQ ID NO: 457142 - RNA, 65 nt, hsa; identical to SEQ ID NO: 192526

SEQ ID NO: 457143 - RNA, 65 nt, hsa; identical to SEQ ID NO: 192527

SEQ ID NO: 457144 - RNA, 65 nt, hsa; identical to SEQ ID NO: 192528

SEQ ID NO: 457145 - RNA, 65 nt, hsa; identical to SEQ ID NO: 192529

SEQ ID NO: 457146 - RNA, 65 nt, hsa; identical to SEQ ID NO: 192530

SEQ ID NO: 457147 - RNA, 65 nt, hsa; identical to SEQ ID NO: 192531

SEQ ID NO: 457148 - RNA, 53 nt, hsa; identical to SEQ ID NO: 192532

SEQ ID NO: 457149 - RNA, 65 nt, hsa; identical to SEQ ID NO: 192533

SEQ ID NO: 457150 - RNA, 65 nt, hsa; identical to SEQ ID NO: 192534

SEQ ID NO: 457151 - RNA, 65 nt, hsa; identical to SEQ ID NO: 192535

SEQ ID NO: 457152 - RNA, 65 nt, hsa; identical to SEQ ID NO: 192536

SEQ ID NO: 457153 - RNA, 65 nt, hsa; identical to SEQ ID NO: 192537

SEQ ID NO: 457154 - RNA, 65 nt, hsa; identical to SEQ ID NO: 192538

SEQ ID NO: 457155 - RNA, 65 nt, hsa; identical to SEQ ID NO: 192539

SEQ ID NO: 457156 - RNA, 65 nt, hsa; identical to SEQ ID NO: 192540

SEQ ID NO: 457157 - RNA, 65 nt, hsa; identical to SEQ ID NO: 192541

SEQ ID NO: 457158 - RNA, 65 nt, hsa; identical to SEQ ID NO: 192542

SEQ ID NO: 457159 - RNA, 65 nt, hsa; identical to SEQ ID NO: 192543

SEQ ID NO: 457160 - RNA, 65 nt, hsa; identical to SEQ ID NO: 192544

SEQ ID NO: 457161 - RNA, 65 nt, hsa; identical to SEQ ID NO: 192545

SEQ ID NO: 457162 - RNA, 65 nt, hsa; identical to SEQ ID NO: 192546

SEQ ID NO: 457163 - RNA, 65 nt, hsa; identical to SEQ ID NO: 192547

SEQ ID NO: 457164 - RNA, 65 nt, hsa; identical to SEQ ID NO: 192548

SEQ ID NO: 457165 - RNA, 65 nt, hsa; identical to SEQ ID NO: 192549

SEQ ID NO: 457166 - RNA, 65 nt, hsa; identical to SEQ ID NO: 192550

SEQ ID NO: 457167 - RNA, 65 nt, hsa; identical to SEQ ID NO: 192551

SEQ ID NO: 457168 - RNA, 65 nt, hsa; identical to SEQ ID NO: 192552

SEQ ID NO: 457169 - RNA, 65 nt, hsa; identical to SEQ ID NO: 192553

SEQ ID NO: 457170 - RNA, 65 nt, hsa; identical to SEQ ID NO: 192554

SEQ ID NO: 457171 - RNA, 65 nt, hsa; identical to SEQ ID NO: 192555

SEQ ID NO: 457172 - RNA, 65 nt, hsa; identical to SEQ ID NO: 192556

SEQ ID NO: 457173 - RNA, 65 nt, hsa; identical to SEQ ID NO: 192557

SEQ ID NO: 457174 - RNA, 65 nt, hsa; identical to SEQ ID NO: 192558

SEQ ID NO: 457175 - RNA, 65 nt, hsa; identical to SEQ ID NO: 192559

SEQ ID NO: 457176 - RNA, 65 nt, hsa; identical to SEQ ID NO: 192560

SEQ ID NO: 457177 - RNA, 65 nt, hsa; identical to SEQ ID NO: 192561

SEQ ID NO: 457178 - RNA, 65 nt, hsa; identical to SEQ ID NO: 192562

SEQ ID NO: 457179 - RNA, 65 nt, hsa; identical to SEQ ID NO: 192563

SEQ ID NO: 457180 - RNA, 65 nt, hsa; identical to SEQ ID NO: 192564

SEQ ID NO: 457181 - RNA, 65 nt, hsa; identical to SEQ ID NO: 192565

SEQ ID NO: 457182 - RNA, 65 nt, hsa; identical to SEQ ID NO: 192566

SEQ ID NO: 457183 - RNA, 65 nt, hsa; identical to SEQ ID NO: 192567

SEQ ID NO: 457184 - RNA, 65 nt, hsa; identical to SEQ ID NO: 192568

SEQ ID NO: 457185 - RNA, 65 nt, hsa; identical to SEQ ID NO: 192569

SEQ ID NO: 457186 - RNA, 65 nt, hsa; identical to SEQ ID NO: 192570

SEQ ID NO: 457187 - RNA, 65 nt, hsa; identical to SEQ ID NO: 192571

SEQ ID NO: 457188 - RNA, 65 nt, hsa; identical to SEQ ID NO: 192572

SEQ ID NO: 457189 - RNA, 65 nt, hsa; identical to SEQ ID NO: 192573

SEQ ID NO: 457190 - RNA, 65 nt, hsa; identical to SEQ ID NO: 192574

SEQ ID NO: 457191 - RNA, 65 nt, hsa; identical to SEQ ID NO: 192575

SEQ ID NO: 457192 - RNA, 65 nt, hsa; identical to SEQ ID NO: 192296

SEQ ID NO: 457193 - RNA, 65 nt, hsa; identical to SEQ ID NO: 192577

SEQ ID NO: 457194 - RNA, 65 nt, hsa; identical to SEQ ID NO: 192578

SEQ ID NO: 457195 - RNA, 65 nt, hsa; identical to SEQ ID NO: 192579

SEQ ID NO: 457196 - RNA, 65 nt, hsa; identical to SEQ ID NO: 192580

SEQ ID NO: 457197 - RNA, 65 nt, hsa; identical to SEQ ID NO: 192581

SEQ ID NO: 457198 - RNA, 65 nt, hsa; identical to SEQ ID NO: 192582

SEQ ID NO: 457199 - RNA, 65 nt, hsa; identical to SEQ ID NO: 192583

SEQ ID NO: 457200 - RNA, 65 nt, hsa; identical to SEQ ID NO: 192584

SEQ ID NO: 457201 - RNA, 65 nt, hsa; identical to SEQ ID NO: 192585

SEQ ID NO: 457202 - RNA, 65 nt, hsa; identical to SEQ ID NO: 192586

SEQ ID NO: 457203 - RNA, 65 nt, hsa; identical to SEQ ID NO: 192587

SEQ ID NO: 457204 - RNA, 65 nt, hsa; identical to SEQ ID NO: 192588

SEQ ID NO: 457205 - RNA, 65 nt, hsa; identical to SEQ ID NO: 192589

SEQ ID NO: 457206 - RNA, 65 nt, hsa; identical to SEQ ID NO: 192590

SEQ ID NO: 457207 - RNA, 65 nt, hsa; identical to SEQ ID NO: 192591

SEQ ID NO: 457208 - RNA, 65 nt, hsa; identical to SEQ ID NO: 192592

SEQ ID NO: 457209 - RNA, 65 nt, hsa; identical to SEQ ID NO: 192593

SEQ ID NO: 457210 - RNA, 65 nt, hsa; identical to SEQ ID NO: 192594

SEQ ID NO: 457211 - RNA, 65 nt, hsa; identical to SEQ ID NO: 192595

SEQ ID NO: 457212 - RNA, 65 nt, hsa; identical to SEQ ID NO: 192596

SEQ ID NO: 457213 - RNA, 65 nt, hsa; identical to SEQ ID NO: 192597

SEQ ID NO: 457214 - RNA, 65 nt, hsa; identical to SEQ ID NO: 192598

SEQ ID NO: 457215 - RNA, 65 nt, hsa; identical to SEQ ID NO: 192599

SEQ ID NO: 457216 - RNA, 65 nt, hsa; identical to SEQ ID NO: 192600

SEQ ID NO: 457217 - RNA, 65 nt, hsa; identical to SEQ ID NO: 192601

SEQ ID NO: 457218 - RNA, 65 nt, hsa; identical to SEQ ID NO: 192602

SEQ ID NO: 457219 - RNA, 65 nt, hsa; identical to SEQ ID NO: 192603

SEQ ID NO: 457220 - RNA, 65 nt, hsa; identical to SEQ ID NO: 192604

SEQ ID NO: 457221 - RNA, 65 nt, hsa; identical to SEQ ID NO: 192605

SEQ ID NO: 457222 - RNA, 65 nt, hsa; identical to SEQ ID NO: 192606

SEQ ID NO: 457223 - RNA, 65 nt, hsa; identical to SEQ ID NO: 192607

SEQ ID NO: 457224 - RNA, 65 nt, hsa; identical to SEQ ID NO: 192608

SEQ ID NO: 457225 - RNA, 65 nt, hsa; identical to SEQ ID NO: 192609

SEQ ID NO: 457226 - RNA, 65 nt, hsa; identical to SEQ ID NO: 192610

SEQ ID NO: 457227 - RNA, 65 nt, hsa; identical to SEQ ID NO: 192611

SEQ ID NO: 457228 - RNA, 65 nt, hsa; identical to SEQ ID NO: 192612

SEQ ID NO: 457229 - RNA, 65 nt, hsa; identical to SEQ ID NO: 192613

SEQ ID NO: 457230 - RNA, 65 nt, hsa; identical to SEQ ID NO: 192614

SEQ ID NO: 457231 - RNA, 65 nt, hsa; identical to SEQ ID NO: 192615

SEQ ID NO: 457232 - RNA, 65 nt, hsa; identical to SEQ ID NO: 192616

SEQ ID NO: 457233 - RNA, 65 nt, hsa; identical to SEQ ID NO: 192617

SEQ ID NO: 457234 - RNA, 65 nt, hsa; identical to SEQ ID NO: 192618

SEQ ID NO: 457235 - RNA, 65 nt, hsa; identical to SEQ ID NO: 192619

SEQ ID NO: 457236 - RNA, 65 nt, hsa; identical to SEQ ID NO: 192620

SEQ ID NO: 457237 - RNA, 65 nt, hsa; identical to SEQ ID NO: 192621

SEQ ID NO: 457238 - RNA, 65 nt, hsa; identical to SEQ ID NO: 192622

SEQ ID NO: 457239 - RNA, 65 nt, hsa; identical to SEQ ID NO: 192623

SEQ ID NO: 457240 - RNA, 65 nt, hsa; identical to SEQ ID NO: 192624

SEQ ID NO: 457241 - RNA, 65 nt, hsa; identical to SEQ ID NO: 192625

SEQ ID NO: 457242 - RNA, 65 nt, hsa; identical to SEQ ID NO: 192626

SEQ ID NO: 457243 - RNA, 65 nt, hsa; identical to SEQ ID NO: 192627

SEQ ID NO: 457244 - RNA, 65 nt, hsa; identical to SEQ ID NO: 192628

SEQ ID NO: 457245 - RNA, 65 nt, hsa; identical to SEQ ID NO: 192629

SEQ ID NO: 457246 - RNA, 65 nt, hsa; identical to SEQ ID NO: 192630

SEQ ID NO: 457247 - RNA, 65 nt, hsa; identical to SEQ ID NO: 192631

SEQ ID NO: 457248 - RNA, 65 nt, hsa; identical to SEQ ID NO: 192632

SEQ ID NO: 457249 - RNA, 65 nt, hsa; identical to SEQ ID NO: 192633

SEQ ID NO: 457250 - RNA, 65 nt, hsa; identical to SEQ ID NO: 192634

SEQ ID NO: 457251 - RNA, 65 nt, hsa; identical to SEQ ID NO: 192635

SEQ ID NO: 457252 - RNA, 65 nt, hsa; identical to SEQ ID NO: 192636

SEQ ID NO: 457253 - RNA, 65 nt, hsa; identical to SEQ ID NO: 192637

SEQ ID NO: 457254 - RNA, 65 nt, hsa; identical to SEQ ID NO: 192638

SEQ ID NO: 457255 - RNA, 65 nt, hsa; identical to SEQ ID NO: 192639

SEQ ID NO: 457256 - RNA, 65 nt, hsa; identical to SEQ ID NO: 192640

SEQ ID NO: 457257 - RNA, 65 nt, hsa; identical to SEQ ID NO: 192641

SEQ ID NO: 457258 - RNA, 65 nt, hsa; identical to SEQ ID NO: 192642

SEQ ID NO: 457259 - RNA, 65 nt, hsa; identical to SEQ ID NO: 192643

SEQ ID NO: 457260 - RNA, 65 nt, hsa; identical to SEQ ID NO: 192644

SEQ ID NO: 457261 - RNA, 65 nt, hsa; identical to SEQ ID NO: 192645

SEQ ID NO: 457262 - RNA, 65 nt, hsa; identical to SEQ ID NO: 192646

SEQ ID NO: 457263 - RNA, 65 nt, hsa; identical to SEQ ID NO: 192647

SEQ ID NO: 457264 - RNA, 65 nt, hsa; identical to SEQ ID NO: 192648

SEQ ID NO: 457265 - RNA, 65 nt, hsa; identical to SEQ ID NO: 192649

SEQ ID NO: 457266 - RNA, 51 nt, hsa; identical to SEQ ID NO: 192650

SEQ ID NO: 457267 - RNA, 65 nt, hsa; identical to SEQ ID NO: 192651

SEQ ID NO: 457268 - RNA, 65 nt, hsa; identical to SEQ ID NO: 192652

SEQ ID NO: 457269 - RNA, 65 nt, hsa; identical to SEQ ID NO: 192653

SEQ ID NO: 457270 - RNA, 65 nt, hsa; identical to SEQ ID NO: 192654

SEQ ID NO: 457271 - RNA, 65 nt, hsa; identical to SEQ ID NO: 192655

SEQ ID NO: 457272 - RNA, 65 nt, hsa; identical to SEQ ID NO: 192656

SEQ ID NO: 457273 - RNA, 65 nt, hsa; identical to SEQ ID NO: 192657

SEQ ID NO: 457274 - RNA, 65 nt, hsa; identical to SEQ ID NO: 192658

SEQ ID NO: 457275 - RNA, 65 nt, hsa; identical to SEQ ID NO: 192659

SEQ ID NO: 457276 - RNA, 65 nt, hsa; identical to SEQ ID NO: 192660

SEQ ID NO: 457277 - RNA, 65 nt, hsa; identical to SEQ ID NO: 192661

SEQ ID NO: 457278 - RNA, 65 nt, hsa; identical to SEQ ID NO: 192662

SEQ ID NO: 457279 - RNA, 65 nt, hsa; identical to SEQ ID NO: 192663

SEQ ID NO: 457280 - RNA, 65 nt, hsa; identical to SEQ ID NO: 192664

SEQ ID NO: 457281 - RNA, 65 nt, hsa; identical to SEQ ID NO: 192665

SEQ ID NO: 457282 - RNA, 65 nt, hsa; identical to SEQ ID NO: 192666

SEQ ID NO: 457283 - RNA, 65 nt, hsa; identical to SEQ ID NO: 192667

SEQ ID NO: 457284 - RNA, 65 nt, hsa; identical to SEQ ID NO: 192668

SEQ ID NO: 457285 - RNA, 65 nt, hsa; identical to SEQ ID NO: 192669

SEQ ID NO: 457286 - RNA, 65 nt, hsa; identical to SEQ ID NO: 192670

SEQ ID NO: 457287 - RNA, 65 nt, hsa; identical to SEQ ID NO: 192671

SEQ ID NO: 457288 - RNA, 65 nt, hsa; identical to SEQ ID NO: 192672

SEQ ID NO: 457289 - RNA, 65 nt, hsa; identical to SEQ ID NO: 192673

SEQ ID NO: 457290 - RNA, 65 nt, hsa; identical to SEQ ID NO: 192674

SEQ ID NO: 457291 - RNA, 65 nt, hsa; identical to SEQ ID NO: 192675

SEQ ID NO: 457292 - RNA, 65 nt, hsa; identical to SEQ ID NO: 192676

SEQ ID NO: 457293 - RNA, 65 nt, hsa; identical to SEQ ID NO: 192677

SEQ ID NO: 457294 - RNA, 65 nt, hsa; identical to SEQ ID NO: 192678

SEQ ID NO: 457295 - RNA, 65 nt, hsa; identical to SEQ ID NO: 192679

SEQ ID NO: 457296 - RNA, 65 nt, hsa; identical to SEQ ID NO: 192680

SEQ ID NO: 457297 - RNA, 64 nt, hsa; identical to SEQ ID NO: 455962

SEQ ID NO: 457298 - RNA, 64 nt, hsa; identical to SEQ ID NO: 455963

SEQ ID NO: 457299 - RNA, 64 nt, hsa; identical to SEQ ID NO: 455964

SEQ ID NO: 457300 - RNA, 64 nt, hsa; identical to SEQ ID NO: 455965

SEQ ID NO: 457301 - RNA, 64 nt, hsa; identical to SEQ ID NO: 455966

SEQ ID NO: 457302 - RNA, 64 nt, hsa; identical to SEQ ID NO: 455967

SEQ ID NO: 457303 - RNA, 64 nt, hsa; identical to SEQ ID NO: 455968

SEQ ID NO: 457304 - RNA, 64 nt, hsa; identical to SEQ ID NO: 455969

SEQ ID NO: 457305 - RNA, 64 nt, hsa; identical to SEQ ID NO: 455970

SEQ ID NO: 457306 - RNA, 64 nt, hsa; identical to SEQ ID NO: 455971

SEQ ID NO: 457307 - RNA, 64 nt, hsa; identical to SEQ ID NO: 455972

SEQ ID NO: 457308 - RNA, 64 nt, hsa; identical to SEQ ID NO: 455973

SEQ ID NO: 457309 - RNA, 64 nt, hsa; identical to SEQ ID NO: 455974

SEQ ID NO: 457310 - RNA, 64 nt, hsa; identical to SEQ ID NO: 455975

SEQ ID NO: 457311 - RNA, 64 nt, hsa; identical to SEQ ID NO: 455976

SEQ ID NO: 457312 - RNA, 64 nt, hsa; identical to SEQ ID NO: 455977

SEQ ID NO: 457313 - RNA, 64 nt, hsa; identical to SEQ ID NO: 455978

SEQ ID NO: 457314 - RNA, 64 nt, hsa; identical to SEQ ID NO: 455979

SEQ ID NO: 457315 - RNA, 64 nt, hsa; identical to SEQ ID NO: 455980

SEQ ID NO: 457316 - RNA, 64 nt, hsa; identical to SEQ ID NO: 455981

SEQ ID NO: 457317 - RNA, 64 nt, hsa; identical to SEQ ID NO: 455982

SEQ ID NO: 457318 - RNA, 64 nt, hsa; identical to SEQ ID NO: 455983

SEQ ID NO: 457319 - RNA, 64 nt, hsa; identical to SEQ ID NO: 455984

SEQ ID NO: 457320 - RNA, 64 nt, hsa; identical to SEQ ID NO: 455985

SEQ ID NO: 457321 - RNA, 64 nt, hsa; identical to SEQ ID NO: 455986

SEQ ID NO: 457322 - RNA, 64 nt, hsa; identical to SEQ ID NO: 455987

SEQ ID NO: 457323 - RNA, 64 nt, hsa; identical to SEQ ID NO: 455988

SEQ ID NO: 457324 - RNA, 64 nt, hsa; identical to SEQ ID NO: 455989

SEQ ID NO: 457325 - RNA, 64 nt, hsa; identical to SEQ ID NO: 455990

SEQ ID NO: 457326 - RNA, 64 nt, hsa; identical to SEQ ID NO: 455991

SEQ ID NO: 457327 - RNA, 64 nt, hsa; identical to SEQ ID NO: 455992

SEQ ID NO: 457328 - RNA, 64 nt, hsa; identical to SEQ ID NO: 455993

SEQ ID NO: 457329 - RNA, 64 nt, hsa; identical to SEQ ID NO: 455994

SEQ ID NO: 457330 - RNA, 64 nt, hsa; identical to SEQ ID NO: 455995

SEQ ID NO: 457331 - RNA, 64 nt, hsa; identical to SEQ ID NO: 455996

SEQ ID NO: 457332 - RNA, 64 nt, hsa; identical to SEQ ID NO: 455997

SEQ ID NO: 457333 - RNA, 64 nt, hsa; identical to SEQ ID NO: 455998

SEQ ID NO: 457334 - RNA, 64 nt, hsa; identical to SEQ ID NO: 455999

SEQ ID NO: 457335 - RNA, 64 nt, hsa; identical to SEQ ID NO: 456000

SEQ ID NO: 457336 - RNA, 64 nt, hsa; identical to SEQ ID NO: 456001

SEQ ID NO: 457337 - RNA, 64 nt, hsa; identical to SEQ ID NO: 456002

SEQ ID NO: 457338 - RNA, 64 nt, hsa; identical to SEQ ID NO: 456003

SEQ ID NO: 457339 - RNA, 64 nt, hsa; identical to SEQ ID NO: 456004

SEQ ID NO: 457340 - RNA, 64 nt, hsa; identical to SEQ ID NO: 456005

SEQ ID NO: 457341 - RNA, 64 nt, hsa; identical to SEQ ID NO: 456006

SEQ ID NO: 457342 - RNA, 64 nt, hsa; identical to SEQ ID NO: 456007

SEQ ID NO: 457343 - RNA, 64 nt, hsa; identical to SEQ ID NO: 456008

SEQ ID NO: 457344 - RNA, 64 nt, hsa; identical to SEQ ID NO: 456009

SEQ ID NO: 457345 - RNA, 64 nt, hsa; identical to SEQ ID NO: 456010

SEQ ID NO: 457346 - RNA, 64 nt, hsa; identical to SEQ ID NO: 456011

SEQ ID NO: 457347 - RNA, 64 nt, hsa; identical to SEQ ID NO: 456012

SEQ ID NO: 457348 - RNA, 64 nt, hsa; identical to SEQ ID NO: 456013

SEQ ID NO: 457349 - RNA, 64 nt, hsa; identical to SEQ ID NO: 456014

SEQ ID NO: 457350 - RNA, 64 nt, hsa; identical to SEQ ID NO: 456015

SEQ ID NO: 457351 - RNA, 64 nt, hsa; identical to SEQ ID NO: 456016

SEQ ID NO: 457352 - RNA, 64 nt, hsa; identical to SEQ ID NO: 456017

SEQ ID NO: 457353 - RNA, 64 nt, hsa; identical to SEQ ID NO: 456018

SEQ ID NO: 457354 - RNA, 64 nt, hsa; identical to SEQ ID NO: 456019

SEQ ID NO: 457355 - RNA, 64 nt, hsa; identical to SEQ ID NO: 456020

SEQ ID NO: 457356 - RNA, 64 nt, hsa; identical to SEQ ID NO: 456021

SEQ ID NO: 457357 - RNA, 64 nt, hsa; identical to SEQ ID NO: 456022

SEQ ID NO: 457358 - RNA, 64 nt, hsa; identical to SEQ ID NO: 456023

SEQ ID NO: 457359 - RNA, 64 nt, hsa; identical to SEQ ID NO: 456024

SEQ ID NO: 457360 - RNA, 64 nt, hsa; identical to SEQ ID NO: 456025

SEQ ID NO: 457361 - RNA, 64 nt, hsa; identical to SEQ ID NO: 456026

SEQ ID NO: 457362 - RNA, 64 nt, hsa; identical to SEQ ID NO: 456027

SEQ ID NO: 457363 - RNA, 64 nt, hsa; identical to SEQ ID NO: 456028

SEQ ID NO: 457364 - RNA, 64 nt, hsa; identical to SEQ ID NO: 456029

SEQ ID NO: 457365 - RNA, 64 nt, hsa; identical to SEQ ID NO: 456030

SEQ ID NO: 457366 - RNA, 64 nt, hsa; identical to SEQ ID NO: 456031

SEQ ID NO: 457367 - RNA, 64 nt, hsa; identical to SEQ ID NO: 456032

SEQ ID NO: 457368 - RNA, 64 nt, hsa; identical to SEQ ID NO: 456033

SEQ ID NO: 457369 - RNA, 64 nt, hsa; identical to SEQ ID NO: 456034

SEQ ID NO: 457370 - RNA, 64 nt, hsa; identical to SEQ ID NO: 456035

SEQ ID NO: 457371 - RNA, 64 nt, hsa; identical to SEQ ID NO: 456036

SEQ ID NO: 457372 - RNA, 64 nt, hsa; identical to SEQ ID NO: 456037

SEQ ID NO: 457373 - RNA, 64 nt, hsa; identical to SEQ ID NO: 456038

SEQ ID NO: 457374 - RNA, 64 nt, hsa; identical to SEQ ID NO: 456039

SEQ ID NO: 457375 - RNA, 64 nt, hsa; identical to SEQ ID NO: 456040

SEQ ID NO: 457376 - RNA, 64 nt, hsa; identical to SEQ ID NO: 456041

SEQ ID NO: 457377 - RNA, 64 nt, hsa; identical to SEQ ID NO: 456042

SEQ ID NO: 457378 - RNA, 64 nt, hsa; identical to SEQ ID NO: 456043

SEQ ID NO: 457379 - RNA, 64 nt, hsa; identical to SEQ ID NO: 456044

SEQ ID NO: 457380 - RNA, 64 nt, hsa; identical to SEQ ID NO: 456045

SEQ ID NO: 457381 - RNA, 64 nt, hsa; identical to SEQ ID NO: 456046

SEQ ID NO: 457382 - RNA, 64 nt, hsa; identical to SEQ ID NO: 456047

SEQ ID NO: 457383 - RNA, 64 nt, hsa; identical to SEQ ID NO: 456048

SEQ ID NO: 457384 - RNA, 64 nt, hsa; identical to SEQ ID NO: 456049

SEQ ID NO: 457385 - RNA, 64 nt, hsa; identical to SEQ ID NO: 456050

SEQ ID NO: 457386 - RNA, 64 nt, hsa; identical to SEQ ID NO: 456051

SEQ ID NO: 457387 - RNA, 64 nt, hsa; identical to SEQ ID NO: 456052

SEQ ID NO: 457388 - RNA, 64 nt, hsa; identical to SEQ ID NO: 456053

SEQ ID NO: 457389 - RNA, 64 nt, hsa; identical to SEQ ID NO: 456054

SEQ ID NO: 457390 - RNA, 64 nt, hsa; identical to SEQ ID NO: 456055

SEQ ID NO: 457391 - RNA, 64 nt, hsa; identical to SEQ ID NO: 456056

SEQ ID NO: 457392 - RNA, 64 nt, hsa; identical to SEQ ID NO: 456057

SEQ ID NO: 457393 - RNA, 64 nt, hsa; identical to SEQ ID NO: 456058

SEQ ID NO: 457394 - RNA, 64 nt, hsa; identical to SEQ ID NO: 456059

SEQ ID NO: 457395 - RNA, 64 nt, hsa; identical to SEQ ID NO: 456060

SEQ ID NO: 457396 - RNA, 64 nt, hsa; identical to SEQ ID NO: 456061

SEQ ID NO: 457397 - RNA, 64 nt, hsa; identical to SEQ ID NO: 456062

SEQ ID NO: 457398 - RNA, 64 nt, hsa; identical to SEQ ID NO: 456063

SEQ ID NO: 457399 - RNA, 64 nt, hsa; identical to SEQ ID NO: 456064

SEQ ID NO: 457400 - RNA, 64 nt, hsa; identical to SEQ ID NO: 456065

SEQ ID NO: 457401 - RNA, 64 nt, hsa; identical to SEQ ID NO: 456066

SEQ ID NO: 457402 - RNA, 64 nt, hsa; identical to SEQ ID NO: 456067

SEQ ID NO: 457403 - RNA, 64 nt, hsa; identical to SEQ ID NO: 456068

SEQ ID NO: 457404 - RNA, 64 nt, hsa; identical to SEQ ID NO: 456069

SEQ ID NO: 457405 - RNA, 64 nt, hsa; identical to SEQ ID NO: 456070

SEQ ID NO: 457406 - RNA, 64 nt, hsa; identical to SEQ ID NO: 456071

SEQ ID NO: 457407 - RNA, 64 nt, hsa; identical to SEQ ID NO: 456072

SEQ ID NO: 457408 - RNA, 64 nt, hsa; identical to SEQ ID NO: 456073

SEQ ID NO: 457409 - RNA, 64 nt, hsa; identical to SEQ ID NO: 456074

SEQ ID NO: 457410 - RNA, 64 nt, hsa; identical to SEQ ID NO: 456075

SEQ ID NO: 457411 - RNA, 64 nt, hsa; identical to SEQ ID NO: 456076

SEQ ID NO: 457412 - RNA, 64 nt, hsa; identical to SEQ ID NO: 456077

SEQ ID NO: 457413 - RNA, 64 nt, hsa; identical to SEQ ID NO: 456078

SEQ ID NO: 457414 - RNA, 64 nt, hsa; identical to SEQ ID NO: 456079

SEQ ID NO: 457415 - RNA, 64 nt, hsa; identical to SEQ ID NO: 456080

SEQ ID NO: 457416 - RNA, 64 nt, hsa; identical to SEQ ID NO: 456081

SEQ ID NO: 457417 - RNA, 64 nt, hsa; identical to SEQ ID NO: 456082

SEQ ID NO: 457418 - RNA, 64 nt, hsa; identical to SEQ ID NO: 456083

SEQ ID NO: 457419 - RNA, 64 nt, hsa; identical to SEQ ID NO: 456084

SEQ ID NO: 457420 - RNA, 64 nt, hsa; identical to SEQ ID NO: 456085

SEQ ID NO: 457421 - RNA, 64 nt, hsa; identical to SEQ ID NO: 456086

SEQ ID NO: 457422 - RNA, 64 nt, hsa; identical to SEQ ID NO: 456087

SEQ ID NO: 457423 - RNA, 64 nt, hsa; identical to SEQ ID NO: 456088

SEQ ID NO: 457424 - RNA, 64 nt, hsa; identical to SEQ ID NO: 456089

SEQ ID NO: 457425 - RNA, 64 nt, hsa; identical to SEQ ID NO: 456090

SEQ ID NO: 457426 - RNA, 64 nt, hsa; identical to SEQ ID NO: 456091

SEQ ID NO: 457427 - RNA, 64 nt, hsa; identical to SEQ ID NO: 456092

SEQ ID NO: 457428 - RNA, 64 nt, hsa; identical to SEQ ID NO: 456093

SEQ ID NO: 457429 - RNA, 64 nt, hsa; identical to SEQ ID NO: 456094

SEQ ID NO: 457430 - RNA, 64 nt, hsa; identical to SEQ ID NO: 456095

SEQ ID NO: 457431 - RNA, 64 nt, hsa; identical to SEQ ID NO: 456096

SEQ ID NO: 457432 - RNA, 64 nt, hsa; identical to SEQ ID NO: 456097

SEQ ID NO: 457433 - RNA, 64 nt, hsa; identical to SEQ ID NO: 456098

SEQ ID NO: 457434 - RNA, 64 nt, hsa; identical to SEQ ID NO: 456099

SEQ ID NO: 457435 - RNA, 64 nt, hsa; identical to SEQ ID NO: 456100

SEQ ID NO: 457436 - RNA, 64 nt, hsa; identical to SEQ ID NO: 456101

SEQ ID NO: 457437 - RNA, 64 nt, hsa; identical to SEQ ID NO: 456102

SEQ ID NO: 457438 - RNA, 64 nt, hsa; identical to SEQ ID NO: 456103

SEQ ID NO: 457439 - RNA, 64 nt, hsa; identical to SEQ ID NO: 456104

SEQ ID NO: 457440 - RNA, 64 nt, hsa; identical to SEQ ID NO: 456105

SEQ ID NO: 457441 - RNA, 64 nt, hsa; identical to SEQ ID NO: 456106

SEQ ID NO: 457442 - RNA, 64 nt, hsa; identical to SEQ ID NO: 456107

SEQ ID NO: 457443 - RNA, 64 nt, hsa; identical to SEQ ID NO: 456108

SEQ ID NO: 457444 - RNA, 64 nt, hsa; identical to SEQ ID NO: 456109

SEQ ID NO: 457445 - RNA, 64 nt, hsa; identical to SEQ ID NO: 456110

SEQ ID NO: 457446 - RNA, 64 nt, hsa; identical to SEQ ID NO: 456111

SEQ ID NO: 457447 - RNA, 64 nt, hsa; identical to SEQ ID NO: 456112

SEQ ID NO: 457448 - RNA, 64 nt, hsa; identical to SEQ ID NO: 456113

SEQ ID NO: 457449 - RNA, 64 nt, hsa; identical to SEQ ID NO: 456114

SEQ ID NO: 457450 - RNA, 64 nt, hsa; identical to SEQ ID NO: 456115

SEQ ID NO: 457451 - RNA, 64 nt, hsa; identical to SEQ ID NO: 456116

SEQ ID NO: 457452 - RNA, 64 nt, hsa; identical to SEQ ID NO: 456117

SEQ ID NO: 457453 - RNA, 64 nt, hsa; identical to SEQ ID NO: 456118

SEQ ID NO: 457454 - RNA, 64 nt, hsa; identical to SEQ ID NO: 456119

SEQ ID NO: 457455 - RNA, 64 nt, hsa; identical to SEQ ID NO: 456120

SEQ ID NO: 457456 - RNA, 64 nt, hsa; identical to SEQ ID NO: 456121

SEQ ID NO: 457457 - RNA, 64 nt, hsa; identical to SEQ ID NO: 456122

SEQ ID NO: 457458 - RNA, 64 nt, hsa; identical to SEQ ID NO: 456123

SEQ ID NO: 457459 - RNA, 64 nt, hsa; identical to SEQ ID NO: 456124

SEQ ID NO: 457460 - RNA, 64 nt, hsa; identical to SEQ ID NO: 456125

SEQ ID NO: 457461 - RNA, 64 nt, hsa; identical to SEQ ID NO: 456126

SEQ ID NO: 457462 - RNA, 64 nt, hsa; identical to SEQ ID NO: 456127

SEQ ID NO: 457463 - RNA, 64 nt, hsa; identical to SEQ ID NO: 456128

SEQ ID NO: 457464 - RNA, 64 nt, hsa; identical to SEQ ID NO: 456129

SEQ ID NO: 457465 - RNA, 64 nt, hsa; identical to SEQ ID NO: 456130

SEQ ID NO: 457466 - RNA, 64 nt, hsa; identical to SEQ ID NO: 456131

SEQ ID NO: 457467 - RNA, 64 nt, hsa; identical to SEQ ID NO: 456132

SEQ ID NO: 457468 - RNA, 64 nt, hsa; identical to SEQ ID NO: 456133

SEQ ID NO: 457469 - RNA, 64 nt, hsa; identical to SEQ ID NO: 456134

SEQ ID NO: 457470 - RNA, 64 nt, hsa; identical to SEQ ID NO: 456135

SEQ ID NO: 457471 - RNA, 64 nt, hsa; identical to SEQ ID NO: 456136

SEQ ID NO: 457472 - RNA, 64 nt, hsa; identical to SEQ ID NO: 456137

SEQ ID NO: 457473 - RNA, 64 nt, hsa; identical to SEQ ID NO: 456138

SEQ ID NO: 457474 - RNA, 64 nt, hsa; identical to SEQ ID NO: 456139

SEQ ID NO: 457475 - RNA, 64 nt, hsa; identical to SEQ ID NO: 456140

SEQ ID NO: 457476 - RNA, 64 nt, hsa; identical to SEQ ID NO: 456141

SEQ ID NO: 457477 - RNA, 64 nt, hsa; identical to SEQ ID NO: 456142

SEQ ID NO: 457478 - RNA, 64 nt, hsa; identical to SEQ ID NO: 456143

SEQ ID NO: 457479 - RNA, 64 nt, hsa; identical to SEQ ID NO: 456144

SEQ ID NO: 457480 - RNA, 64 nt, hsa; identical to SEQ ID NO: 456145

SEQ ID NO: 457481 - RNA, 64 nt, hsa; identical to SEQ ID NO: 456146

SEQ ID NO: 457482 - RNA, 64 nt, hsa; identical to SEQ ID NO: 456147

SEQ ID NO: 457483 - RNA, 64 nt, hsa; identical to SEQ ID NO: 456148

SEQ ID NO: 457484 - RNA, 64 nt, hsa; identical to SEQ ID NO: 456149

SEQ ID NO: 457485 - RNA, 64 nt, hsa; identical to SEQ ID NO: 456150

SEQ ID NO: 457486 - RNA, 64 nt, hsa; identical to SEQ ID NO: 456151

SEQ ID NO: 457487 - RNA, 64 nt, hsa; identical to SEQ ID NO: 456152

SEQ ID NO: 457488 - RNA, 64 nt, hsa; identical to SEQ ID NO: 456153

SEQ ID NO: 457489 - RNA, 64 nt, hsa; identical to SEQ ID NO: 456154

SEQ ID NO: 457490 - RNA, 64 nt, hsa; identical to SEQ ID NO: 456155

SEQ ID NO: 457491 - RNA, 64 nt, hsa; identical to SEQ ID NO: 456156

SEQ ID NO: 457492 - RNA, 64 nt, hsa; identical to SEQ ID NO: 456157

SEQ ID NO: 457493 - RNA, 64 nt, hsa; identical to SEQ ID NO: 456158

SEQ ID NO: 457494 - RNA, 64 nt, hsa; identical to SEQ ID NO: 456159

SEQ ID NO: 457495 - RNA, 64 nt, hsa; identical to SEQ ID NO: 456160

SEQ ID NO: 457496 - RNA, 55 nt, hsa; identical to SEQ ID NO: 456161

SEQ ID NO: 457497 - RNA, 64 nt, hsa; identical to SEQ ID NO: 456162

SEQ ID NO: 457498 - RNA, 64 nt, hsa; identical to SEQ ID NO: 456163

SEQ ID NO: 457499 - RNA, 64 nt, hsa; identical to SEQ ID NO: 456164

SEQ ID NO: 457500 - RNA, 64 nt, hsa; identical to SEQ ID NO: 456165

SEQ ID NO: 457501 - RNA, 64 nt, hsa; identical to SEQ ID NO: 456166

SEQ ID NO: 457502 - RNA, 64 nt, hsa; identical to SEQ ID NO: 456167

SEQ ID NO: 457503 - RNA, 64 nt, hsa; identical to SEQ ID NO: 456168

SEQ ID NO: 457504 - RNA, 64 nt, hsa; identical to SEQ ID NO: 456169

SEQ ID NO: 457505 - RNA, 64 nt, hsa; identical to SEQ ID NO: 456170

SEQ ID NO: 457506 - RNA, 60 nt, hsa; identical to SEQ ID NO: 456171

SEQ ID NO: 457507 - RNA, 64 nt, hsa; identical to SEQ ID NO: 456172

SEQ ID NO: 457508 - RNA, 64 nt, hsa; identical to SEQ ID NO: 456173

SEQ ID NO: 457509 - RNA, 64 nt, hsa; identical to SEQ ID NO: 456174

SEQ ID NO: 457510 - RNA, 64 nt, hsa; identical to SEQ ID NO: 456175

SEQ ID NO: 457511 - RNA, 64 nt, hsa; identical to SEQ ID NO: 456176

SEQ ID NO: 457512 - RNA, 64 nt, hsa; identical to SEQ ID NO: 456177

SEQ ID NO: 457513 - RNA, 64 nt, hsa; identical to SEQ ID NO: 456178

SEQ ID NO: 457514 - RNA, 64 nt, hsa; identical to SEQ ID NO: 456179

SEQ ID NO: 457515 - RNA, 64 nt, hsa; identical to SEQ ID NO: 456180

SEQ ID NO: 457516 - RNA, 64 nt, hsa; identical to SEQ ID NO: 456181

SEQ ID NO: 457517 - RNA, 64 nt, hsa; identical to SEQ ID NO: 456182

SEQ ID NO: 457518 - RNA, 64 nt, hsa; identical to SEQ ID NO: 456183

SEQ ID NO: 457519 - RNA, 64 nt, hsa; identical to SEQ ID NO: 456184

SEQ ID NO: 457520 - RNA, 64 nt, hsa; identical to SEQ ID NO: 456185

SEQ ID NO: 457521 - RNA, 64 nt, hsa; identical to SEQ ID NO: 456186

SEQ ID NO: 457522 - RNA, 64 nt, hsa; identical to SEQ ID NO: 456187

SEQ ID NO: 457523 - RNA, 64 nt, hsa; identical to SEQ ID NO: 456188

SEQ ID NO: 457524 - RNA, 64 nt, hsa; identical to SEQ ID NO: 456189

SEQ ID NO: 457525 - RNA, 64 nt, hsa; identical to SEQ ID NO: 456190

SEQ ID NO: 457526 - RNA, 64 nt, hsa; identical to SEQ ID NO: 456191

SEQ ID NO: 457527 - RNA, 64 nt, hsa; identical to SEQ ID NO: 456192

SEQ ID NO: 457528 - RNA, 64 nt, hsa; identical to SEQ ID NO: 456193

SEQ ID NO: 457529 - RNA, 64 nt, hsa; identical to SEQ ID NO: 456194

SEQ ID NO: 457530 - RNA, 64 nt, hsa; identical to SEQ ID NO: 456195

SEQ ID NO: 457531 - RNA, 64 nt, hsa; identical to SEQ ID NO: 456196

SEQ ID NO: 457532 - RNA, 64 nt, hsa; identical to SEQ ID NO: 456197

SEQ ID NO: 457533 - RNA, 64 nt, hsa; identical to SEQ ID NO: 456198

SEQ ID NO: 457534 - RNA, 64 nt, hsa; identical to SEQ ID NO: 456199

SEQ ID NO: 457535 - RNA, 64 nt, hsa; identical to SEQ ID NO: 456200

SEQ ID NO: 457536 - RNA, 64 nt, hsa; identical to SEQ ID NO: 456201

SEQ ID NO: 457537 - RNA, 64 nt, hsa; identical to SEQ ID NO: 456202

SEQ ID NO: 457538 - RNA, 64 nt, hsa; identical to SEQ ID NO: 456203

SEQ ID NO: 457539 - RNA, 64 nt, hsa; identical to SEQ ID NO: 456204

SEQ ID NO: 457540 - RNA, 64 nt, hsa; identical to SEQ ID NO: 456205

SEQ ID NO: 457541 - RNA, 64 nt, hsa; identical to SEQ ID NO: 456206

SEQ ID NO: 457542 - RNA, 64 nt, hsa; identical to SEQ ID NO: 456207

SEQ ID NO: 457543 - RNA, 64 nt, hsa; identical to SEQ ID NO: 456208

SEQ ID NO: 457544 - RNA, 64 nt, hsa; identical to SEQ ID NO: 456209

SEQ ID NO: 457545 - RNA, 64 nt, hsa; identical to SEQ ID NO: 456210

SEQ ID NO: 457546 - RNA, 64 nt, hsa; identical to SEQ ID NO: 456211

SEQ ID NO: 457547 - RNA, 64 nt, hsa; identical to SEQ ID NO: 456212

SEQ ID NO: 457548 - RNA, 64 nt, hsa; identical to SEQ ID NO: 456213

SEQ ID NO: 457549 - RNA, 64 nt, hsa; identical to SEQ ID NO: 456214

SEQ ID NO: 457550 - RNA, 64 nt, hsa; identical to SEQ ID NO: 456215

SEQ ID NO: 457551 - RNA, 64 nt, hsa; identical to SEQ ID NO: 456216

SEQ ID NO: 457552 - RNA, 64 nt, hsa; identical to SEQ ID NO: 456217

SEQ ID NO: 457553 - RNA, 64 nt, hsa; identical to SEQ ID NO: 456218

SEQ ID NO: 457554 - RNA, 64 nt, hsa; identical to SEQ ID NO: 456219

SEQ ID NO: 457555 - RNA, 64 nt, hsa; identical to SEQ ID NO: 456220

SEQ ID NO: 457556 - RNA, 64 nt, hsa; identical to SEQ ID NO: 456221

SEQ ID NO: 457557 - RNA, 64 nt, hsa; identical to SEQ ID NO: 456222

SEQ ID NO: 457558 - RNA, 64 nt, hsa; identical to SEQ ID NO: 456223

SEQ ID NO: 457559 - RNA, 64 nt, hsa; identical to SEQ ID NO: 456224

SEQ ID NO: 457560 - RNA, 64 nt, hsa; identical to SEQ ID NO: 456225

SEQ ID NO: 457561 - RNA, 64 nt, hsa; identical to SEQ ID NO: 456226

SEQ ID NO: 457562 - RNA, 64 nt, hsa; identical to SEQ ID NO: 456227

SEQ ID NO: 457563 - RNA, 64 nt, hsa; identical to SEQ ID NO: 456228

SEQ ID NO: 457564 - RNA, 64 nt, hsa; identical to SEQ ID NO: 456229

SEQ ID NO: 457565 - RNA, 64 nt, hsa; identical to SEQ ID NO: 456230

SEQ ID NO: 457566 - RNA, 64 nt, hsa; identical to SEQ ID NO: 456231

SEQ ID NO: 457567 - RNA, 64 nt, hsa; identical to SEQ ID NO: 456232

SEQ ID NO: 457568 - RNA, 64 nt, hsa; identical to SEQ ID NO: 456233

SEQ ID NO: 457569 - RNA, 64 nt, hsa; identical to SEQ ID NO: 456234

SEQ ID NO: 457570 - RNA, 64 nt, hsa; identical to SEQ ID NO: 456235

SEQ ID NO: 457571 - RNA, 64 nt, hsa; identical to SEQ ID NO: 456236

SEQ ID NO: 457572 - RNA, 64 nt, hsa; identical to SEQ ID NO: 456237

SEQ ID NO: 457573 - RNA, 64 nt, hsa; identical to SEQ ID NO: 456238

SEQ ID NO: 457574 - RNA, 64 nt, hsa; identical to SEQ ID NO: 456239

SEQ ID NO: 457575 - RNA, 64 nt, hsa; identical to SEQ ID NO: 456240

SEQ ID NO: 457576 - RNA, 64 nt, hsa; identical to SEQ ID NO: 456241

SEQ ID NO: 457577 - RNA, 64 nt, hsa; identical to SEQ ID NO: 456242

SEQ ID NO: 457578 - RNA, 64 nt, hsa; identical to SEQ ID NO: 456243

SEQ ID NO: 457579 - RNA, 64 nt, hsa; identical to SEQ ID NO: 456244

SEQ ID NO: 457580 - RNA, 64 nt, hsa; identical to SEQ ID NO: 456245

SEQ ID NO: 457581 - RNA, 64 nt, hsa; identical to SEQ ID NO: 456246

SEQ ID NO: 457582 - RNA, 64 nt, hsa; identical to SEQ ID NO: 456247

SEQ ID NO: 457583 - RNA, 64 nt, hsa; identical to SEQ ID NO: 456248

SEQ ID NO: 457584 - RNA, 64 nt, hsa; identical to SEQ ID NO: 456249

SEQ ID NO: 457585 - RNA, 64 nt, hsa; identical to SEQ ID NO: 456250

SEQ ID NO: 457586 - RNA, 64 nt, hsa; identical to SEQ ID NO: 456251

SEQ ID NO: 457587 - RNA, 64 nt, hsa; identical to SEQ ID NO: 456252

SEQ ID NO: 457588 - RNA, 64 nt, hsa; identical to SEQ ID NO: 456253

SEQ ID NO: 457589 - RNA, 64 nt, hsa; identical to SEQ ID NO: 456254

SEQ ID NO: 457590 - RNA, 64 nt, hsa; identical to SEQ ID NO: 456255

SEQ ID NO: 457591 - RNA, 64 nt, hsa; identical to SEQ ID NO: 456256

SEQ ID NO: 457592 - RNA, 64 nt, hsa; identical to SEQ ID NO: 456257

SEQ ID NO: 457593 - RNA, 64 nt, hsa; identical to SEQ ID NO: 456258

SEQ ID NO: 457594 - RNA, 64 nt, hsa; identical to SEQ ID NO: 456259

SEQ ID NO: 457595 - RNA, 64 nt, hsa; identical to SEQ ID NO: 456260

SEQ ID NO: 457596 - RNA, 64 nt, hsa; identical to SEQ ID NO: 456261

SEQ ID NO: 457597 - RNA, 64 nt, hsa; identical to SEQ ID NO: 456262

SEQ ID NO: 457598 - RNA, 64 nt, hsa; identical to SEQ ID NO: 456263

SEQ ID NO: 457599 - RNA, 64 nt, hsa; identical to SEQ ID NO: 456264

SEQ ID NO: 457600 - RNA, 64 nt, hsa; identical to SEQ ID NO: 456265

SEQ ID NO: 457601 - RNA, 64 nt, hsa; identical to SEQ ID NO: 456266

SEQ ID NO: 457602 - RNA, 64 nt, hsa; identical to SEQ ID NO: 456267

SEQ ID NO: 457603 - RNA, 64 nt, hsa; identical to SEQ ID NO: 456268

SEQ ID NO: 457604 - RNA, 64 nt, hsa; identical to SEQ ID NO: 456269

SEQ ID NO: 457605 - RNA, 64 nt, hsa; identical to SEQ ID NO: 456270

SEQ ID NO: 457606 - RNA, 64 nt, hsa; identical to SEQ ID NO: 456271

SEQ ID NO: 457607 - RNA, 64 nt, hsa; identical to SEQ ID NO: 456272

SEQ ID NO: 457608 - RNA, 64 nt, hsa; identical to SEQ ID NO: 456273

SEQ ID NO: 457609 - RNA, 64 nt, hsa; identical to SEQ ID NO: 456274

SEQ ID NO: 457610 - RNA, 64 nt, hsa; identical to SEQ ID NO: 456275

SEQ ID NO: 457611 - RNA, 64 nt, hsa; identical to SEQ ID NO: 456276

SEQ ID NO: 457612 - RNA, 64 nt, hsa; identical to SEQ ID NO: 456277

SEQ ID NO: 457613 - RNA, 64 nt, hsa; identical to SEQ ID NO: 456278

SEQ ID NO: 457614 - RNA, 64 nt, hsa; identical to SEQ ID NO: 456279

SEQ ID NO: 457615 - RNA, 64 nt, hsa; identical to SEQ ID NO: 456280

SEQ ID NO: 457616 - RNA, 64 nt, hsa; identical to SEQ ID NO: 456281

SEQ ID NO: 457617 - RNA, 64 nt, hsa; identical to SEQ ID NO: 456282

SEQ ID NO: 457618 - RNA, 64 nt, hsa; identical to SEQ ID NO: 456283

SEQ ID NO: 457619 - RNA, 64 nt, hsa; identical to SEQ ID NO: 456284

SEQ ID NO: 457620 - RNA, 64 nt, hsa; identical to SEQ ID NO: 456285

SEQ ID NO: 457621 - RNA, 64 nt, hsa; identical to SEQ ID NO: 456286

SEQ ID NO: 457622 - RNA, 64 nt, hsa; identical to SEQ ID NO: 456287

SEQ ID NO: 457623 - RNA, 64 nt, hsa; identical to SEQ ID NO: 456288

SEQ ID NO: 457624 - RNA, 64 nt, hsa; identical to SEQ ID NO: 456289

SEQ ID NO: 457625 - RNA, 64 nt, hsa; identical to SEQ ID NO: 456290

SEQ ID NO: 457626 - RNA, 64 nt, hsa; identical to SEQ ID NO: 456291

SEQ ID NO: 457627 - RNA, 64 nt, hsa; identical to SEQ ID NO: 456292

SEQ ID NO: 457628 - RNA, 64 nt, hsa; identical to SEQ ID NO: 456293

SEQ ID NO: 457629 - RNA, 64 nt, hsa; identical to SEQ ID NO: 456283

SEQ ID NO: 457630 - RNA, 64 nt, hsa; identical to SEQ ID NO: 456295

SEQ ID NO: 457631 - RNA, 64 nt, hsa; identical to SEQ ID NO: 456296

SEQ ID NO: 457632 - RNA, 64 nt, hsa; identical to SEQ ID NO: 456297

SEQ ID NO: 457633 - RNA, 64 nt, hsa; identical to SEQ ID NO: 456298

SEQ ID NO: 457634 - RNA, 64 nt, hsa; identical to SEQ ID NO: 456299

SEQ ID NO: 457635 - RNA, 64 nt, hsa; identical to SEQ ID NO: 456300

SEQ ID NO: 457636 - RNA, 64 nt, hsa; identical to SEQ ID NO: 456301

SEQ ID NO: 457637 - RNA, 64 nt, hsa; identical to SEQ ID NO: 456302

SEQ ID NO: 457638 - RNA, 64 nt, hsa; identical to SEQ ID NO: 456303

SEQ ID NO: 457639 - RNA, 64 nt, hsa; identical to SEQ ID NO: 456304

SEQ ID NO: 457640 - RNA, 64 nt, hsa; identical to SEQ ID NO: 456305

SEQ ID NO: 457641 - RNA, 64 nt, hsa; identical to SEQ ID NO: 456306

SEQ ID NO: 457642 - RNA, 64 nt, hsa; identical to SEQ ID NO: 456307

SEQ ID NO: 457643 - RNA, 64 nt, hsa; identical to SEQ ID NO: 456308

SEQ ID NO: 457644 - RNA, 64 nt, hsa; identical to SEQ ID NO: 456309

SEQ ID NO: 457645 - RNA, 64 nt, hsa; identical to SEQ ID NO: 456310

SEQ ID NO: 457646 - RNA, 64 nt, hsa; identical to SEQ ID NO: 456311

SEQ ID NO: 457647 - RNA, 64 nt, hsa; identical to SEQ ID NO: 456312

SEQ ID NO: 457648 - RNA, 64 nt, hsa; identical to SEQ ID NO: 456313

SEQ ID NO: 457649 - RNA, 64 nt, hsa; identical to SEQ ID NO: 456314

SEQ ID NO: 457650 - RNA, 64 nt, hsa; identical to SEQ ID NO: 456315

SEQ ID NO: 457651 - RNA, 64 nt, hsa; identical to SEQ ID NO: 456316

SEQ ID NO: 457652 - RNA, 64 nt, hsa; identical to SEQ ID NO: 456317

SEQ ID NO: 457653 - RNA, 64 nt, hsa; identical to SEQ ID NO: 456318

SEQ ID NO: 457654 - RNA, 64 nt, hsa; identical to SEQ ID NO: 456319

SEQ ID NO: 457655 - RNA, 64 nt, hsa; identical to SEQ ID NO: 456320

SEQ ID NO: 457656 - RNA, 64 nt, hsa; identical to SEQ ID NO: 456321

SEQ ID NO: 457657 - RNA, 64 nt, hsa; identical to SEQ ID NO: 456322

SEQ ID NO: 457658 - RNA, 64 nt, hsa; identical to SEQ ID NO: 456323

SEQ ID NO: 457659 - RNA, 64 nt, hsa; identical to SEQ ID NO: 456324

SEQ ID NO: 457660 - RNA, 64 nt, hsa; identical to SEQ ID NO: 456325

SEQ ID NO: 457661 - RNA, 64 nt, hsa; identical to SEQ ID NO: 456326

SEQ ID NO: 457662 - RNA, 64 nt, hsa; identical to SEQ ID NO: 456327

SEQ ID NO: 457663 - RNA, 64 nt, hsa; identical to SEQ ID NO: 456328

SEQ ID NO: 457664 - RNA, 64 nt, hsa; identical to SEQ ID NO: 456329

SEQ ID NO: 457665 - RNA, 64 nt, hsa; identical to SEQ ID NO: 456330

SEQ ID NO: 457666 - RNA, 64 nt, hsa; identical to SEQ ID NO: 456331

SEQ ID NO: 457667 - RNA, 64 nt, hsa; identical to SEQ ID NO: 456332

SEQ ID NO: 457668 - RNA, 64 nt, hsa; identical to SEQ ID NO: 456333

SEQ ID NO: 457669 - RNA, 64 nt, hsa; identical to SEQ ID NO: 456334

SEQ ID NO: 457670 - RNA, 64 nt, hsa; identical to SEQ ID NO: 456335

SEQ ID NO: 457671 - RNA, 64 nt, hsa; identical to SEQ ID NO: 456336

SEQ ID NO: 457672 - RNA, 64 nt, hsa; identical to SEQ ID NO: 456337

SEQ ID NO: 457673 - RNA, 64 nt, hsa; identical to SEQ ID NO: 456338

SEQ ID NO: 457674 - RNA, 64 nt, hsa; identical to SEQ ID NO: 456339

SEQ ID NO: 457675 - RNA, 64 nt, hsa; identical to SEQ ID NO: 456340

SEQ ID NO: 457676 - RNA, 64 nt, hsa; identical to SEQ ID NO: 456341

SEQ ID NO: 457677 - RNA, 64 nt, hsa; identical to SEQ ID NO: 456342

SEQ ID NO: 457678 - RNA, 64 nt, hsa; identical to SEQ ID NO: 456343

SEQ ID NO: 457679 - RNA, 64 nt, hsa; identical to SEQ ID NO: 456344

SEQ ID NO: 457680 - RNA, 64 nt, hsa; identical to SEQ ID NO: 456345

SEQ ID NO: 457681 - RNA, 64 nt, hsa; identical to SEQ ID NO: 456346

SEQ ID NO: 457682 - RNA, 64 nt, hsa; identical to SEQ ID NO: 456347

SEQ ID NO: 457683 - RNA, 64 nt, hsa; identical to SEQ ID NO: 456348

SEQ ID NO: 457684 - RNA, 64 nt, hsa; identical to SEQ ID NO: 456349

SEQ ID NO: 457685 - RNA, 64 nt, hsa; identical to SEQ ID NO: 456350

SEQ ID NO: 457686 - RNA, 64 nt, hsa; identical to SEQ ID NO: 456351

SEQ ID NO: 457687 - RNA, 64 nt, hsa; identical to SEQ ID NO: 456352

SEQ ID NO: 457688 - RNA, 64 nt, hsa; identical to SEQ ID NO: 456353

SEQ ID NO: 457689 - RNA, 64 nt, hsa; identical to SEQ ID NO: 456354

SEQ ID NO: 457690 - RNA, 64 nt, hsa; identical to SEQ ID NO: 456355

SEQ ID NO: 457691 - RNA, 64 nt, hsa; identical to SEQ ID NO: 456356

SEQ ID NO: 457692 - RNA, 64 nt, hsa; identical to SEQ ID NO: 456357

SEQ ID NO: 457693 - RNA, 64 nt, hsa; identical to SEQ ID NO: 456358

SEQ ID NO: 457694 - RNA, 64 nt, hsa; identical to SEQ ID NO: 456359

SEQ ID NO: 457695 - RNA, 64 nt, hsa; identical to SEQ ID NO: 456360

SEQ ID NO: 457696 - RNA, 64 nt, hsa; identical to SEQ ID NO: 456361

SEQ ID NO: 457697 - RNA, 64 nt, hsa; identical to SEQ ID NO: 456362

SEQ ID NO: 457698 - RNA, 64 nt, hsa; identical to SEQ ID NO: 456363

SEQ ID NO: 457699 - RNA, 64 nt, hsa; identical to SEQ ID NO: 456364

SEQ ID NO: 457700 - RNA, 64 nt, hsa; identical to SEQ ID NO: 456365

SEQ ID NO: 457701 - RNA, 64 nt, hsa; identical to SEQ ID NO: 456366

SEQ ID NO: 457702 - RNA, 64 nt, hsa; identical to SEQ ID NO: 456367

SEQ ID NO: 457703 - RNA, 64 nt, hsa; identical to SEQ ID NO: 456368

SEQ ID NO: 457704 - RNA, 64 nt, hsa; identical to SEQ ID NO: 456369

SEQ ID NO: 457705 - RNA, 64 nt, hsa; identical to SEQ ID NO: 456370

SEQ ID NO: 457706 - RNA, 64 nt, hsa; identical to SEQ ID NO: 456371

SEQ ID NO: 457707 - RNA, 64 nt, hsa; identical to SEQ ID NO: 456372

SEQ ID NO: 457708 - RNA, 64 nt, hsa; identical to SEQ ID NO: 456373

SEQ ID NO: 457709 - RNA, 64 nt, hsa; identical to SEQ ID NO: 456374

SEQ ID NO: 457710 - RNA, 64 nt, hsa; identical to SEQ ID NO: 456375

SEQ ID NO: 457711 - RNA, 64 nt, hsa; identical to SEQ ID NO: 456376

SEQ ID NO: 457712 - RNA, 64 nt, hsa; identical to SEQ ID NO: 456377

SEQ ID NO: 457713 - RNA, 64 nt, hsa; identical to SEQ ID NO: 456378

SEQ ID NO: 457714 - RNA, 64 nt, hsa; identical to SEQ ID NO: 456379

SEQ ID NO: 457715 - RNA, 64 nt, hsa; identical to SEQ ID NO: 456380

SEQ ID NO: 457716 - RNA, 63 nt, hsa; identical to SEQ ID NO: 456381

SEQ ID NO: 457717 - RNA, 64 nt, hsa; identical to SEQ ID NO: 456382

SEQ ID NO: 457718 - RNA, 64 nt, hsa; identical to SEQ ID NO: 456383

SEQ ID NO: 457719 - RNA, 64 nt, hsa; identical to SEQ ID NO: 456384

SEQ ID NO: 457720 - RNA, 64 nt, hsa; identical to SEQ ID NO: 456385

SEQ ID NO: 457721 - RNA, 64 nt, hsa; identical to SEQ ID NO: 456386

SEQ ID NO: 457722 - RNA, 62 nt, hsa; identical to SEQ ID NO: 456387

SEQ ID NO: 457723 - RNA, 64 nt, hsa; identical to SEQ ID NO: 456388

SEQ ID NO: 457724 - RNA, 64 nt, hsa; identical to SEQ ID NO: 456389

SEQ ID NO: 457725 - RNA, 64 nt, hsa; identical to SEQ ID NO: 456390

SEQ ID NO: 457726 - RNA, 64 nt, hsa; identical to SEQ ID NO: 456391

SEQ ID NO: 457727 - RNA, 62 nt, hsa; identical to SEQ ID NO: 456392

SEQ ID NO: 457728 - RNA, 64 nt, hsa; identical to SEQ ID NO: 456393

SEQ ID NO: 457729 - RNA, 64 nt, hsa; identical to SEQ ID NO: 456394

SEQ ID NO: 457730 - RNA, 64 nt, hsa; identical to SEQ ID NO: 456395

SEQ ID NO: 457731 - RNA, 64 nt, hsa; identical to SEQ ID NO: 456396

SEQ ID NO: 457732 - RNA, 64 nt, hsa; identical to SEQ ID NO: 456397

SEQ ID NO: 457733 - RNA, 64 nt, hsa; identical to SEQ ID NO: 456398

SEQ ID NO: 457734 - RNA, 64 nt, hsa; identical to SEQ ID NO: 456399

SEQ ID NO: 457735 - RNA, 64 nt, hsa; identical to SEQ ID NO: 456400

SEQ ID NO: 457736 - RNA, 64 nt, hsa; identical to SEQ ID NO: 456401

SEQ ID NO: 457737 - RNA, 64 nt, hsa; identical to SEQ ID NO: 456402

SEQ ID NO: 457738 - RNA, 64 nt, hsa; identical to SEQ ID NO: 456403

SEQ ID NO: 457739 - RNA, 64 nt, hsa; identical to SEQ ID NO: 456404

SEQ ID NO: 457740 - RNA, 64 nt, hsa; identical to SEQ ID NO: 456405

SEQ ID NO: 457741 - RNA, 64 nt, hsa; identical to SEQ ID NO: 456406

SEQ ID NO: 457742 - RNA, 64 nt, hsa; identical to SEQ ID NO: 456407

SEQ ID NO: 457743 - RNA, 64 nt, hsa; identical to SEQ ID NO: 456408

SEQ ID NO: 457744 - RNA, 64 nt, hsa; identical to SEQ ID NO: 456409

SEQ ID NO: 457745 - RNA, 64 nt, hsa; identical to SEQ ID NO: 456410

SEQ ID NO: 457746 - RNA, 64 nt, hsa; identical to SEQ ID NO: 456411

SEQ ID NO: 457747 - RNA, 64 nt, hsa; identical to SEQ ID NO: 456412

SEQ ID NO: 457748 - RNA, 64 nt, hsa; identical to SEQ ID NO: 456413

SEQ ID NO: 457749 - RNA, 64 nt, hsa; identical to SEQ ID NO: 456414

SEQ ID NO: 457750 - RNA, 64 nt, hsa; identical to SEQ ID NO: 456415

SEQ ID NO: 457751 - RNA, 64 nt, hsa; identical to SEQ ID NO: 456416

SEQ ID NO: 457752 - RNA, 64 nt, hsa; identical to SEQ ID NO: 456417

SEQ ID NO: 457753 - RNA, 64 nt, hsa; identical to SEQ ID NO: 307734

SEQ ID NO: 457754 - RNA, 64 nt, hsa; identical to SEQ ID NO: 307735

SEQ ID NO: 457755 - RNA, 64 nt, hsa; identical to SEQ ID NO: 307736

SEQ ID NO: 457756 - RNA, 64 nt, hsa; identical to SEQ ID NO: 307737

SEQ ID NO: 457757 - RNA, 64 nt, hsa; identical to SEQ ID NO: 307738

SEQ ID NO: 457758 - RNA, 64 nt, hsa; identical to SEQ ID NO: 307739

SEQ ID NO: 457759 - RNA, 64 nt, hsa; identical to SEQ ID NO: 307740

SEQ ID NO: 457760 - RNA, 64 nt, hsa; identical to SEQ ID NO: 307741

SEQ ID NO: 457761 - RNA, 59 nt, hsa; identical to SEQ ID NO: 307742

SEQ ID NO: 457762 - RNA, 64 nt, hsa; identical to SEQ ID NO: 307743

SEQ ID NO: 457763 - RNA, 64 nt, hsa; identical to SEQ ID NO: 307744

SEQ ID NO: 457764 - RNA, 64 nt, hsa; identical to SEQ ID NO: 307745

SEQ ID NO: 457765 - RNA, 64 nt, hsa; identical to SEQ ID NO: 307746

SEQ ID NO: 457766 - RNA, 64 nt, hsa; identical to SEQ ID NO: 307747

SEQ ID NO: 457767 - RNA, 64 nt, hsa; identical to SEQ ID NO: 307748

SEQ ID NO: 457768 - RNA, 64 nt, hsa; identical to SEQ ID NO: 307749

SEQ ID NO: 457769 - RNA, 64 nt, hsa; identical to SEQ ID NO: 307750

SEQ ID NO: 457770 - RNA, 64 nt, hsa; identical to SEQ ID NO: 307751

SEQ ID NO: 457771 - RNA, 64 nt, hsa; identical to SEQ ID NO: 307752

SEQ ID NO: 457772 - RNA, 64 nt, hsa; identical to SEQ ID NO: 307753

SEQ ID NO: 457773 - RNA, 64 nt, hsa; identical to SEQ ID NO: 307754

SEQ ID NO: 457774 - RNA, 64 nt, hsa; identical to SEQ ID NO: 307755

SEQ ID NO: 457775 - RNA, 64 nt, hsa; identical to SEQ ID NO: 307756

SEQ ID NO: 457776 - RNA, 64 nt, hsa; identical to SEQ ID NO: 307757

SEQ ID NO: 457777 - RNA, 64 nt, hsa; identical to SEQ ID NO: 307758

SEQ ID NO: 457778 - RNA, 64 nt, hsa; identical to SEQ ID NO: 307759

SEQ ID NO: 457779 - RNA, 64 nt, hsa; identical to SEQ ID NO: 307760

SEQ ID NO: 457780 - RNA, 64 nt, hsa; identical to SEQ ID NO: 307761

SEQ ID NO: 457781 - RNA, 64 nt, hsa; identical to SEQ ID NO: 307762

SEQ ID NO: 457782 - RNA, 64 nt, hsa; identical to SEQ ID NO: 307763

SEQ ID NO: 457783 - RNA, 64 nt, hsa; identical to SEQ ID NO: 307764

SEQ ID NO: 457784 - RNA, 64 nt, hsa; identical to SEQ ID NO: 307765

SEQ ID NO: 457785 - RNA, 64 nt, hsa; identical to SEQ ID NO: 307766

SEQ ID NO: 457786 - RNA, 64 nt, hsa; identical to SEQ ID NO: 307767

SEQ ID NO: 457787 - RNA, 64 nt, hsa; identical to SEQ ID NO: 307768

SEQ ID NO: 457788 - RNA, 64 nt, hsa; identical to SEQ ID NO: 307769

SEQ ID NO: 457789 - RNA, 64 nt, hsa; identical to SEQ ID NO: 307770

SEQ ID NO: 457790 - RNA, 64 nt, hsa; identical to SEQ ID NO: 307771

SEQ ID NO: 457791 - RNA, 64 nt, hsa; identical to SEQ ID NO: 307772

SEQ ID NO: 457792 - RNA, 64 nt, hsa; identical to SEQ ID NO: 307773

SEQ ID NO: 457793 - RNA, 64 nt, hsa; identical to SEQ ID NO: 307774

SEQ ID NO: 457794 - RNA, 64 nt, hsa; identical to SEQ ID NO: 307775

SEQ ID NO: 457795 - RNA, 64 nt, hsa; identical to SEQ ID NO: 307776

SEQ ID NO: 457796 - RNA, 64 nt, hsa; identical to SEQ ID NO: 307777

SEQ ID NO: 457797 - RNA, 64 nt, hsa; identical to SEQ ID NO: 307778

SEQ ID NO: 457798 - RNA, 64 nt, hsa; identical to SEQ ID NO: 307779

SEQ ID NO: 457799 - RNA, 64 nt, hsa; identical to SEQ ID NO: 307780

SEQ ID NO: 457800 - RNA, 64 nt, hsa; identical to SEQ ID NO: 307781

SEQ ID NO: 457801 - RNA, 64 nt, hsa; identical to SEQ ID NO: 307782

SEQ ID NO: 457802 - RNA, 64 nt, hsa; identical to SEQ ID NO: 307783

SEQ ID NO: 457803 - RNA, 64 nt, hsa; identical to SEQ ID NO: 307784

SEQ ID NO: 457804 - RNA, 64 nt, hsa; identical to SEQ ID NO: 307785

SEQ ID NO: 457805 - RNA, 64 nt, hsa; identical to SEQ ID NO: 307786

SEQ ID NO: 457806 - RNA, 64 nt, hsa; identical to SEQ ID NO: 307787

SEQ ID NO: 457807 - RNA, 64 nt, hsa; identical to SEQ ID NO: 307788

SEQ ID NO: 457808 - RNA, 64 nt, hsa; identical to SEQ ID NO: 307789

SEQ ID NO: 457809 - RNA, 64 nt, hsa; identical to SEQ ID NO: 307790

SEQ ID NO: 457810 - RNA, 64 nt, hsa; identical to SEQ ID NO: 307791

SEQ ID NO: 457811 - RNA, 64 nt, hsa; identical to SEQ ID NO: 307792

SEQ ID NO: 457812 - RNA, 64 nt, hsa; identical to SEQ ID NO: 307793

SEQ ID NO: 457813 - RNA, 64 nt, hsa; identical to SEQ ID NO: 307794

SEQ ID NO: 457814 - RNA, 64 nt, hsa; identical to SEQ ID NO: 307795

SEQ ID NO: 457815 - RNA, 64 nt, hsa; identical to SEQ ID NO: 307796

SEQ ID NO: 457816 - RNA, 62 nt, hsa; identical to SEQ ID NO: 307797

SEQ ID NO: 457817 - RNA, 64 nt, hsa; identical to SEQ ID NO: 307798

SEQ ID NO: 457818 - RNA, 64 nt, hsa; identical to SEQ ID NO: 307799

SEQ ID NO: 457819 - RNA, 64 nt, hsa; identical to SEQ ID NO: 307800

SEQ ID NO: 457820 - RNA, 64 nt, hsa; identical to SEQ ID NO: 307801

SEQ ID NO: 457821 - RNA, 64 nt, hsa; identical to SEQ ID NO: 307802

SEQ ID NO: 457822 - RNA, 64 nt, hsa; identical to SEQ ID NO: 307803

SEQ ID NO: 457823 - RNA, 64 nt, hsa; identical to SEQ ID NO: 307804

SEQ ID NO: 457824 - RNA, 64 nt, hsa; identical to SEQ ID NO: 307805

SEQ ID NO: 457825 - RNA, 64 nt, hsa; identical to SEQ ID NO: 307806

SEQ ID NO: 457826 - RNA, 64 nt, hsa; identical to SEQ ID NO: 307807

SEQ ID NO: 457827 - RNA, 64 nt, hsa; identical to SEQ ID NO: 307808

SEQ ID NO: 457828 - RNA, 64 nt, hsa; identical to SEQ ID NO: 307809

SEQ ID NO: 457829 - RNA, 64 nt, hsa
caagugggcacguggaggaagggucugaaggaaggcuccggagcacaggcccugguguuccugu

SEQ ID NO: 457830 - RNA, 64 nt, hsa
ccgcuccccucuccuccgccacccccgccguggggcuccggaggggacccagcuccucugagcc

SEQ ID NO: 457831 - RNA, 64 nt, hsa
gguccagcguccucacaggaacaccagggccugugcuccggagccuuccuucagacccuuccuc

SEQ ID NO: 457832 - RNA, 64 nt, hsa
gaucauuuuagagagugggucauuggcagggagugcuccggagggaggcagaggggagacugug

SEQ ID NO: 457833 - RNA, 64 nt, hsa
gggagcucagacuuagcugggcuccagcagccuggcuccggacucucgucugccaccaucacca

SEQ ID NO: 457834 - RNA, 64 nt, hsa
uggggugagcugagcccgggacuccgccuugcaggcuccggaacccucgcuguggcucccccgc

SEQ ID NO: 457835 - RNA, 64 nt, hsa
gagggggcggggcgggggaggggagguaggacccgcuccggaaggcgcuguuugaagcuugucg

SEQ ID NO: 457836 - RNA, 64 nt, hsa
gcuggcucuguaacccagugcaccucccuccccagcuccggaggggguccuccucgcuccuccu

SEQ ID NO: 457837 - RNA, 64 nt, hsa
uggguuugaaucugaaugcuauacuggauacucugcuccggaaagaugagcuuuuuauucuacu

SEQ ID NO: 457838 - RNA, 64 nt, hsa
gcccucacaagagcaucagccuucuagaaucggagcuccggagugugaagauucaguauugaua

SEQ ID NO: 457839 - RNA, 64 nt, hsa
ggcggccggggccgagggggugcgggcgcugggggcuccggauacagccucugcugcgccgccu

SEQ ID NO: 457840 - RNA, 64 nt, hsa
uaggugucccccacccccaaagaccugccugugugcuccggagaugaauaugagcucauuagua

SEQ ID NO: 457841 - RNA, 64 nt, hsa
ucaguacuuccuaccacugcugcaugaguauaaugcuccggaauuaucagaaagcauaaugcag

SEQ ID NO: 457842 - RNA, 64 nt, hsa
uugggcugaggcagcgagugauucccgcgcuccggcuccggaccggcgcugacagcuguaggcu

SEQ ID NO: 457843 - RNA, 64 nt, hsa
uuguuaaggaaugcuagcagggcauggcacgugagcuccggaauagaugucuucaucacuucuu

SEQ ID NO: 457844 - RNA, 64 nt, hsa
ucccggccgcgcugcgcgccgcgcuccucggacggcuccggacgcugcugccgugggccugaga

SEQ ID NO: 457845 - RNA, 64 nt, hsa
gguacacgagcgugggguucggcggccuggugcagcuccggaggggcgagaggguguacgucaa

SEQ ID NO: 457846 - RNA, 64 nt, hsa
gugccaggaguacaugugagacuaugggaggaaagcuccggaagaaggagaaacauugcagugg

SEQ ID NO: 457847 - RNA, 64 nt, hsa
caccgccccgauuccuuuuugcuucugguuuggagcuccggaccaggaccuucguccuggucag

SEQ ID NO: 457848 - RNA, 64 nt, hsa
caccuuaaauuauuagaccccggggcagucaggugcuccggacacccgaaggcaauaaaacagg

SEQ ID NO: 457849 - RNA, 64 nt, hsa
ggagagccaugugaaggaggcagcuggcgccaucgcuccggauuaguugguuuccauaggaaag

SEQ ID NO: 457850 - RNA, 64 nt, hsa
cggggagggggauaggaagacgcagagcaaaugagcuccggagucccugcaggugaauaaacac

SEQ ID NO: 457851 - RNA, 64 nt, hsa
guguugcuaacagaaguggccuguaagcuccugugcuccggagggaagcauuuccugguaggcu

SEQ ID NO: 457852 - RNA, 64 nt, hsa
ccccaaagccagagaaagccagauggcaccagcugcuccggaugugccugcccacauuggggga

SEQ ID NO: 457853 - RNA, 64 nt, hsa
cacuuugggaggcggaggcaggcggguugcuugagcuccggagcuugagaccagccugagcaac

SEQ ID NO: 457854 - RNA, 64 nt, hsa
cggaugaagaaguacuucugugucucacccaagugcuccggagagugacagguagguacucacc

SEQ ID NO: 457855 - RNA, 64 nt, hsa
ugugggugguauuggagaaagaagaugaauuauagcuccggagaaucaagaucuuaagugaagc

SEQ ID NO: 457856 - RNA, 64 nt, hsa
aguggagggcuguugacugcagugacaccugggugcuccggagguaucuguucuguugaccugu

SEQ ID NO: 457857 - RNA, 64 nt, hsa
aguguggguggcggcuccggcggaugucaggaaugcuccggaauucauaccuaguggcugugua

SEQ ID NO: 457858 - RNA, 64 nt, hsa
ccgggcagcagccuaccggccacguggaacacuggcuccggaguuauucucugucaaaucuacu

SEQ ID NO: 457859 - RNA, 64 nt, hsa
cuauggcccccggcucaagugcugcuguggcaaagcuccggagccccagccccaaggcuuugac

SEQ ID NO: 457860 - RNA, 64 nt, hsa
agccugacugugccaucuuggagccucaggcggggcuccggagauagaagacaggucgccggag

SEQ ID NO: 457861 - RNA, 64 nt, hsa
agguugagcagugagagagggaagggacuaacgugcuccggaaggguggagguuucucuucuaa

SEQ ID NO: 457862 - RNA, 64 nt, hsa
gaggccaugccaugguccugggauugacugagaugcuccggagcugccugcucuaugcccugag

SEQ ID NO: 457863 - RNA, 64 nt, hsa
cgccugcucauguugaagugcgcuguucacacccgcuccggagagcaccccagcagcauccaga

SEQ ID NO: 457864 - RNA, 64 nt, hsa
ggccaugcauucaucccagcacaggcagcgcauggcuccggaagcagacacaggccaggccugg

SEQ ID NO: 457865 - RNA, 64 nt, hsa
uauuugccaaagacgacagggugggcuggggugcgcuccggaggaacccccggcacugaugggc

SEQ ID NO: 457866 - RNA, 64 nt, hsa
aacgcuccucucaauccugggcugguggccccuggcuccggagaaugcuggauggaacaggaaa

SEQ ID NO: 457867 - RNA, 64 nt, hsa
cauuucccaguagucugccuugcccuggcagacugcuccggacucuucuaggaaauuccucugu

SEQ ID NO: 457868 - RNA, 64 nt, hsa
agucugagccugaagagccccaaagcaggaagaagcuccggauggaggccagcuaagccacucg

SEQ ID NO: 457869 - RNA, 64 nt, hsa
caaaucaguggcaauuccaugccaagaggaaguggcuccggauuuaagccauuuaaggguggac

SEQ ID NO: 457870 - RNA, 64 nt, hsa
ggagcaggcugccgaguggagggugccaucgagggcuccggaucccuuauccuacuuagcagug

SEQ ID NO: 457871 - RNA, 64 nt, hsa
gagcccucggcuccccagacuuugccgaggggcugcuccggaccccguugugagccggccuccu

SEQ ID NO: 457872 - RNA, 64 nt, hsa
ugcucuguuugugguccuagguugguucauucuggcuccggaugucgaucccccucccuuggau

SEQ ID NO: 457873 - RNA, 64 nt, hsa
ggacccacccugccaacaucaaguuguuccuucugcuccggagaccccuggggugcggcccugg

SEQ ID NO: 457874 - RNA, 64 nt, hsa
aaaccauuuaccaacugaaaggacacgaagucuagcuccggacaaaagcuguuagaggcccagg

SEQ ID NO: 457875 - RNA, 64 nt, hsa
aggcuccucccucuaaggggcgccaugggaacaggcuccggagggagccggcgucugaaaggcc

SEQ ID NO: 457876 - RNA, 64 nt, hsa
ggcccgcgggcuccaccucagguuuucacuuuucgcuccggagcgagaacgaaacgacaaaaac

SEQ ID NO: 457877 - RNA, 64 nt, hsa
ugauuggcuuccccgagggccagcagggcugggggcuccggagagcagcaggaagcacucccag

SEQ ID NO: 457878 - RNA, 64 nt, hsa
cgcccgagccccgcuccucgcagccgccucucccgcuccggaucccuccacgcagcggccggag

SEQ ID NO: 457879 - RNA, 64 nt, hsa
gaggcgccacugaaccgagaagggacggucaucugcuccggaaggaaagagaacgggccaagac

SEQ ID NO: 457880 - RNA, 64 nt, hsa
accccaaguccucugcuuggggaguucuccaggagcuccggacccugagucaauguugggagga

SEQ ID NO: 457881 - RNA, 64 nt, hsa
cuuuaccccaggccuuccuggacuccucccuccagcuccggaaccugagcuccccuucccuucu

SEQ ID NO: 457882 - RNA, 64 nt, hsa
gccugccccugcugaggcgucuucaggacugcaggcuccggagaguggcucuggcagcaggcgg

SEQ ID NO: 457883 - RNA, 64 nt, hsa
guacauggagucugagggcggcgacggcuaccuggcuccggagaauggguauuugauggaggcu

SEQ ID NO: 457884 - RNA, 64 nt, hsa
ucuuccgaaggcaccagaggugaagcugcccagggcuccggaggugcagcuaaaggccaccaag

SEQ ID NO: 457885 - RNA, 64 nt, hsa
gcccguccccaucuuaauaaagaccaugcccugcgcuccggacugcgccuaguuccugcgcgac

SEQ ID NO: 457886 - RNA, 64 nt, hsa
ccuccucguggccggaggacccgcccccuccuuugcuccggaaucucuccucccucgcccggcc

SEQ ID NO: 457887 - RNA, 64 nt, hsa
ccugccacccgggcccgagcgcgcccggcccgcggcuccggagcccucgccgcgccccccgccg

SEQ ID NO: 457888 - RNA, 64 nt, hsa
cguacagcaagggacuccccaggugcggcccaaggcuccggaccacacuggcccccugcggcgg

SEQ ID NO: 457889 - RNA, 64 nt, hsa
gggacaagccaggcccucucugcaguccucggcagcuccggaaggacacagucaggggccgggc

SEQ ID NO: 457890 - RNA, 64 nt, hsa; identical to SEQ ID NO: 301795

SEQ ID NO: 457891 - RNA, 64 nt, hsa; identical to SEQ ID NO: 301796

SEQ ID NO: 457892 - RNA, 64 nt, hsa; identical to SEQ ID NO: 301797

SEQ ID NO: 457893 - RNA, 64 nt, hsa; identical to SEQ ID NO: 301798

SEQ ID NO: 457894 - RNA, 64 nt, hsa; identical to SEQ ID NO: 301799

SEQ ID NO: 457895 - RNA, 64 nt, hsa; identical to SEQ ID NO: 301800

SEQ ID NO: 457896 - RNA, 64 nt, hsa; identical to SEQ ID NO: 301801

SEQ ID NO: 457897 - RNA, 64 nt, hsa; identical to SEQ ID NO: 301802

SEQ ID NO: 457898 - RNA, 64 nt, hsa; identical to SEQ ID NO: 301803

SEQ ID NO: 457899 - RNA, 63 nt, hsa; identical to SEQ ID NO: 98265

SEQ ID NO: 457900 - RNA, 63 nt, hsa; identical to SEQ ID NO: 342995

SEQ ID NO: 457901 - RNA, 63 nt, hsa; identical to SEQ ID NO: 342996

SEQ ID NO: 457902 - RNA, 63 nt, hsa; identical to SEQ ID NO: 342997

SEQ ID NO: 457903 - RNA, 63 nt, hsa; identical to SEQ ID NO: 342998

SEQ ID NO: 457904 - RNA, 63 nt, hsa; identical to SEQ ID NO: 342999

SEQ ID NO: 457905 - RNA, 63 nt, hsa; identical to SEQ ID NO: 343000

SEQ ID NO: 457906 - RNA, 63 nt, hsa; identical to SEQ ID NO: 343001

SEQ ID NO: 457907 - RNA, 63 nt, hsa; identical to SEQ ID NO: 343002

SEQ ID NO: 457908 - RNA, 63 nt, hsa; identical to SEQ ID NO: 343003

SEQ ID NO: 457909 - RNA, 63 nt, hsa; identical to SEQ ID NO: 343004

SEQ ID NO: 457910 - RNA, 63 nt, hsa; identical to SEQ ID NO: 343005

SEQ ID NO: 457911 - RNA, 63 nt, hsa; identical to SEQ ID NO: 343006

SEQ ID NO: 457912 - RNA, 63 nt, hsa; identical to SEQ ID NO: 343007

SEQ ID NO: 457913 - RNA, 63 nt, hsa; identical to SEQ ID NO: 343008

SEQ ID NO: 457914 - RNA, 63 nt, hsa; identical to SEQ ID NO: 343009

SEQ ID NO: 457915 - RNA, 63 nt, hsa; identical to SEQ ID NO: 343010

SEQ ID NO: 457916 - RNA, 63 nt, hsa; identical to SEQ ID NO: 343011

SEQ ID NO: 457917 - RNA, 63 nt, hsa; identical to SEQ ID NO: 343012

SEQ ID NO: 457918 - RNA, 63 nt, hsa; identical to SEQ ID NO: 343013

SEQ ID NO: 457919 - RNA, 63 nt, hsa; identical to SEQ ID NO: 343014

SEQ ID NO: 457920 - RNA, 63 nt, hsa; identical to SEQ ID NO: 343015

SEQ ID NO: 457921 - RNA, 63 nt, hsa; identical to SEQ ID NO: 343016

SEQ ID NO: 457922 - RNA, 63 nt, hsa; identical to SEQ ID NO: 343017

SEQ ID NO: 457923 - RNA, 63 nt, hsa; identical to SEQ ID NO: 343018

SEQ ID NO: 457924 - RNA, 63 nt, hsa; identical to SEQ ID NO: 343019

SEQ ID NO: 457925 - RNA, 63 nt, hsa; identical to SEQ ID NO: 343020

SEQ ID NO: 457926 - RNA, 63 nt, hsa; identical to SEQ ID NO: 343021

SEQ ID NO: 457927 - RNA, 63 nt, hsa; identical to SEQ ID NO: 343022

SEQ ID NO: 457928 - RNA, 63 nt, hsa; identical to SEQ ID NO: 343023

SEQ ID NO: 457929 - RNA, 63 nt, hsa; identical to SEQ ID NO: 343024

SEQ ID NO: 457930 - RNA, 63 nt, hsa; identical to SEQ ID NO: 343025

SEQ ID NO: 457931 - RNA, 63 nt, hsa; identical to SEQ ID NO: 343026

SEQ ID NO: 457932 - RNA, 63 nt, hsa; identical to SEQ ID NO: 343027

SEQ ID NO: 457933 - RNA, 63 nt, hsa; identical to SEQ ID NO: 343028

SEQ ID NO: 457934 - RNA, 63 nt, hsa; identical to SEQ ID NO: 343029

SEQ ID NO: 457935 - RNA, 63 nt, hsa; identical to SEQ ID NO: 343030

SEQ ID NO: 457936 - RNA, 63 nt, hsa; identical to SEQ ID NO: 343031

SEQ ID NO: 457937 - RNA, 64 nt, hsa
uuguuuuugagauggagucucuacuaaaaauacaaaaaauuagccaggcauggugccgcauaac

SEQ ID NO: 457938 - RNA, 64 nt, hsa
aauauggugaaaccccaucucuacuaagaauacaaaaaauuagcugagcaugguggugggcucc

SEQ ID NO: 457939 - RNA, 64 nt, hsa
agaguucuuugcuuucauuaacuuggauucauuuaaaaauuaaucuucccuguuaggcugauuu

SEQ ID NO: 457940 - RNA, 64 nt, hsa
cuuaaaaaugauguuaacccaagaaguagacaucaaaaauuaaaaaaaaaaaaaggaauguguu

SEQ ID NO: 457941 - RNA, 64 nt, hsa
guuuguuaaauuaaccuucaguaacugcaguaccaaaaauuacacucaacugaugaaaaaaacg

SEQ ID NO: 457942 - RNA, 64 nt, hsa
uauaugugucauauguauguacauguauaugucuaaaaauuacuuuacacaugugccuacauag

SEQ ID NO: 457943 - RNA, 64 nt, hsa
gggcaacauagaaaccugugucuacaaaaaauuuaaaaauuagccaaguauggugacaggcacc

SEQ ID NO: 457944 - RNA, 64 nt, hsa
caacauggugacaccccgucucuacuaaaaauacaaaaauuacccaggcauaguggcacacgcc

SEQ ID NO: 457945 - RNA, 64 nt, hsa
ucucaaaaaaacaaaacaaacaaacaaaaauacaaaaaauuagccgggcgugguggcaccugcc

SEQ ID NO: 457946 - RNA, 64 nt, hsa
uacaugacgaaacuccaucucuaucaaaaauacaaaaaauuaacuagguguggugcugcacgcc

SEQ ID NO: 457947 - RNA, 64 nt, hsa
cucugggcuggguaacagagugagauccugucucaaaaauuaauuaauuaauuaauuaaaauaa

SEQ ID NO: 457948 - RNA, 64 nt, hsa
ugaauccuuauagaauuugucuuuuaauagacagaaaaauuaaugaaacuuuuuaaaauagaaa

SEQ ID NO: 457949 - RNA, 64 nt, hsa
uagacagaaaaauuaaugaaacuuuuuaaaauagaaaaauuacucuucuuuaaugcuaaguauu

SEQ ID NO: 457950 - RNA, 64 nt, hsa
aacccucauauuuuaaugguguuacagcauuugcaaaaauuauucugcuaaguauuuacaacuc

SEQ ID NO: 457951 - RNA, 64 nt, hsa
caagaagucuuuacauuauauuuauaacucauauaaaaauuauauuuagaauuuuuaaacaugu

SEQ ID NO: 457952 - RNA, 64 nt, hsa
uagucaaauacacguuuagauuaaaacuaguuuaaaaaauuauaaaugaaucuaaucaaaaugu

SEQ ID NO: 457953 - RNA, 64 nt, hsa
acauggugaaacccccgucucuacuaaaauacaaaaaaauuagccaggcauaguggcgcgcgcc

SEQ ID NO: 457954 - RNA, 64 nt, hsa
uugaagaauuucucgcaaacucacaacccucaugaaaaauuaauccucaguuccacgagacugc

SEQ ID NO: 457955 - RNA, 64 nt, hsa
ccuggccaacaugacccaucuuuacuaaaaauacaaaaauuagccaggcgugguggugugcccc

SEQ ID NO: 457956 - RNA, 64 nt, hsa
uuguaaacccugucucucauauuuguaaaacuacaaaaauuagcuuggcaugguggugugcgcc

SEQ ID NO: 457957 - RNA, 64 nt, hsa
cauggugaaacccugucucuacuaaaaauacaaaaaaaauuagccagccaugguggcgggcgcc

SEQ ID NO: 457958 - RNA, 64 nt, hsa
cggugaaaccccgucucuacuaaaaaaaauacaaaaaaauuagccaggcguggucgugggcacc

SEQ ID NO: 457959 - RNA, 64 nt, hsa
caacauggcgaaaccccaucucuacuaaaaauacaaaaauuagccuggcaugguggugggaggc

SEQ ID NO: 457960 - RNA, 64 nt, hsa
aaaaaaaaauuagcagaauugguguugggcccugaaaaauuaguccgauuuuguggugguaaug

SEQ ID NO: 457961 - RNA, 64 nt, hsa
gcggagguugugaugagccaagauugagccaaaaaaaaauuagcagaauugguguugggcccug

SEQ ID NO: 457962 - RNA, 64 nt, hsa
caacaugacgaaacccggucucuacuaaaaauacaaaaauuagccaggcaugguggcaggugcc

SEQ ID NO: 457963 - RNA, 64 nt, hsa
aagugaacuugauucaaccugagaaaacugauuaaaaaauuaguuuaaauuugccagcagggaa

SEQ ID NO: 457964 - RNA, 64 nt, hsa
caauguggcaaaaccgcguguuuacaaaaaauacaaaaauuagccaggcaugguggugcaugcc

SEQ ID NO: 457965 - RNA, 64 nt, hsa
acagggagacccccucucuacaaaaacauuuuuaaaaaauuagcuggguguggugaugcaugcc

SEQ ID NO: 457966 - RNA, 64 nt, hsa
guugcucagccucugagggcaauacaggcauuuaaaaaauuaaaaugaccaggcacaguggcuc

SEQ ID NO: 457967 - RNA, 64 nt, hsa
gggcuaauugaugagcaucuuauuucuuaucucuaaaaauuaucagcaaaggcuacuucagaug

SEQ ID NO: 457968 - RNA, 64 nt, hsa
caugagcuauacagcugcaugcuuugacugccggaaaaauuaaucuugcuucuucaucaggucu

SEQ ID NO: 457969 - RNA, 64 nt, hsa
uuuauaauguagcuucuuucaaaauauuuucaugaaaaauuacuuuuauuauaccauuaugugc

SEQ ID NO: 457970 - RNA, 64 nt, hsa
cagccacagguauguggaauacggugaggaaaaaaaaaauuaaaaaaaaaaugcaagcugucag

SEQ ID NO: 457971 - RNA, 64 nt, hsa
uucuuuguuuuuguuuuauuuuuuaaauuguuguaaaaauuauuauaggccagcuacaucuagu

SEQ ID NO: 457972 - RNA, 64 nt, hsa
ggcuaaugcuuccagaugugcacugcuucugucuaaaaauuacaagccacagucuaauaugucu

SEQ ID NO: 457973 - RNA, 64 nt, hsa
aaggacuaugauugauaaaguauuuaauucuuuuaaaaauuauauucaucucagcuuucuuaga

SEQ ID NO: 457974 - RNA, 64 nt, hsa
aguuagcuccauaaaguacaaaugaagaaagucaaaaaauuauuugcuauggcaggauaagaaa

SEQ ID NO: 457975 - RNA, 64 nt, hsa
caagaaaauguauccaaggaaacauuuuaucauuaaaaauuaccuuuaauuuuaaugcuguuuc

SEQ ID NO: 457976 - RNA, 64 nt, hsa
uuaauuggauguucacugccaguugucuuaugugaaaaauuaacuuuuuuguggcaauuagugu

SEQ ID NO: 457977 - RNA, 64 nt, hsa
ugaaaccccaucucuacaguuuuguaaaaauacaaaaaauuaccugggccugguggcacacgcc

SEQ ID NO: 457978 - RNA, 64 nt, hsa
caacauggugaaaccuggccucuacuaaaaauacaaaaauuagccggguguggugguggguacc

SEQ ID NO: 457979 - RNA, 64 nt, hsa
uacugugucuguagcuaaagaaaaauuauuuuacaaaaauuacuucaugaaauauaguuuguac

SEQ ID NO: 457980 - RNA, 64 nt, hsa
auacauggcuacuuuacugugucuguagcuaaagaaaaauuauuuuacaaaaauuacuucauga

SEQ ID NO: 457981 - RNA, 64 nt, hsa
cacauauuagaaacucuucuaauaaaugaaguaaaaaaauuaaaaagaauacaaauauuccagc

SEQ ID NO: 457982 - RNA, 64 nt, hsa
gacauuuaucuucaaaacaccaaauugucuuuagaaaaauuaaugugauuacagguagaggccu

SEQ ID NO: 457983 - RNA, 64 nt, hsa
caaaugagcagaauaaaugagguuuuuuucaauuaaaaauuacuauaaauccaggaggcaaacu

SEQ ID NO: 457984 - RNA, 64 nt, hsa
uuucuguauaauuagcccaggcugauguaacuauaaaaauuaguugaaaaaaaaaauauuguuu

SEQ ID NO: 457985 - RNA, 64 nt, hsa
cacauuuguugacuuaaauuuaauucaaggauugaaaaauuaacuggauaucuugaaauauaca

SEQ ID NO: 457986 - RNA, 64 nt, hsa
aucacaauggacacagaaugcugcugcuccucuuaaaaauuaaaugugucauauuauauucuuu

SEQ ID NO: 457987 - RNA, 64 nt, hsa
uuuauaauaauccaaacucuaugaaagcaauuuuaaaaauuauuaagguuuuaugaaguugaca

SEQ ID NO: 457988 - RNA, 64 nt, hsa
aacauacugaaaccccgucucuacuaaaaauaagaaaaauuagcugggcgugguggcgggcacc

SEQ ID NO: 457989 - RNA, 64 nt, hsa
cagcauggcaaaaccccgucucuacuaaaaguacaaaaauuagccaggcgugauggcacguguc

SEQ ID NO: 457990 - RNA, 64 nt, hsa
gauagauaaucugguaauaaaugauagguaaaucaaaaauuacuuuuauuuaggaguuugaauu

SEQ ID NO: 457991 - RNA, 64 nt, hsa
uugcagagaaaccuguaaguaauggaagguaaagaaaaauuacagaauggaaaauaauauuuug

SEQ ID NO: 457992 - RNA, 64 nt, hsa
acacaggaccugugggagggacuaucagagaugcaaaaauuacuucaagaugaguuuauuguuu

SEQ ID NO: 457993 - RNA, 64 nt, hsa
aaauuaaaaaaacauuuuuuucuugguagucuuuaaaaauuaggggauugaaaggauccaggau

SEQ ID NO: 457994 - RNA, 64 nt, hsa
ugacaaauuuuaccuuaaaaccaaaaugaaacacaaaaauuaauccuuaauaaugauagcaagu

SEQ ID NO: 457995 - RNA, 64 nt, hsa
aucugugugaaagccuuuuucuucuuugauuuaaaaaaauuaacuauacaguuaaugguuuaga

SEQ ID NO: 457996 - RNA, 64 nt, hsa
guaaaugcaaccaauuuaacauguaguguuauuaaaaaauuacaaaggccuagaccagccuggg

SEQ ID NO: 457997 - RNA, 64 nt, hsa
caacauggugaaacccugucuuuacuaaaaauacaaaaauuagccaggcaugguggcgugugcc

SEQ ID NO: 457998 - RNA, 64 nt, hsa
acuucaucucuacaaaaaaagcaacaacgacaaaaaaaauuagccaagcauaguggcacacccc

SEQ ID NO: 457999 - RNA, 64 nt, hsa
ucugggcaacauggggaaaccccagcucuacaaaaaaaauuagccuggugugguggcacaugcc

SEQ ID NO: 458000 - RNA, 64 nt, hsa
uugaggcauaacuaucaaucacaaaaguauauucaaaaauuauauuuugaacaacucgaaucac

SEQ ID NO: 458001 - RNA, 64 nt, hsa
agaccacaagcaggcucaacauaacauaagcuagaaaaauuagaugacugaauuucuauggcau

SEQ ID NO: 458002 - RNA, 64 nt, hsa
auuaauuuguaagaguaagcaccuuuagaauauuaaaaauuaauucuuuaucacauguugucau

SEQ ID NO: 458003 - RNA, 64 nt, hsa
uccuggugguaaauuaaauaguuuuuuucaucagaaaaauuauuuuuuagccauuuuuuuucuu

SEQ ID NO: 458004 - RNA, 64 nt, hsa
uuccauugagucaaaucccauuuuauauauacauaaaaauuaaguucugagugaguucuagcua

SEQ ID NO: 458005 - RNA, 64 nt, hsa
gucucauuuugauaaucauuugcuuccaguguuuaaaaauuaaaaaaagaauggggagaagguu

SEQ ID NO: 458006 - RNA, 64 nt, hsa
augagacuugccagucaaaugcuauuugguuuaaaaaaauuauugcaaucucaaguuaauggaa

SEQ ID NO: 458007 - RNA, 64 nt, hsa
gcaguuccuuucauaauaucucagcaccagaaacaaaaauuaagauuaucaaagcauuuugaau

SEQ ID NO: 458008 - RNA, 64 nt, hsa
cucagaaccauucacauuuaauucaauucuuggaaaaaauuaaagcuuuuugcccacaauuugc

SEQ ID NO: 458009 - RNA, 64 nt, hsa
cugaacauugggcgguuuucuuaauuugaaguauaaaaauuauaaagaguaauuccaaagguau

SEQ ID NO: 458010 - RNA, 64 nt, hsa
aguuugccguaucauccaggaaaaccugagggaaaaaaauuauagcaauuaacugggcauugua

SEQ ID NO: 458011 - RNA, 64 nt, hsa
cacuccuguccagucuauuuauuauucaaauaggaaaaauuacuuuacagguuguuuuacugua

SEQ ID NO: 458012 - RNA, 64 nt, hsa
uuuuaauauugggaaaauuaugauaaaaugcuuuaaaaauuaauaugccagauuaaaauaacug

SEQ ID NO: 458013 - RNA, 64 nt, hsa
uggugaaaccccgucucuauuaaaaauauuuuuuaaaaauuaacugagcgugguggugggcgcc

SEQ ID NO: 458014 - RNA, 64 nt, hsa
aauauaaauccuuagaaauugucuuuauaccuucaaaaauuauacuaugcauuuaucauagaaa

SEQ ID NO: 458015 - RNA, 64 nt, hsa
aagcguauacuauuuucuucuuugagaauuacaaaaaaauuauuucuacacugacaggauuuac

SEQ ID NO: 458016 - RNA, 64 nt, hsa
uauuuagauguccaaacaagaauacuuccaacauaaaaauuauaauaggaauaauuugagauga

SEQ ID NO: 458017 - RNA, 64 nt, hsa
cacugcaguggcauugucaucaucuugguaggguaaaaauuauccuucccagccgaagggauaa

SEQ ID NO: 458018 - RNA, 64 nt, hsa
uaacacggugaaaccccgucucuacuaaaagugcaaaaauuagccgggcgugguggcgcaugcc

SEQ ID NO: 458019 - RNA, 64 nt, hsa
uauuauuaaaaguaagucauuuauacaucuuagaaaaaauuacauaguuuuguuuuuacaauuc

SEQ ID NO: 458020 - RNA, 64 nt, hsa
uucuucccuaauccccuggcaaccacuuuaaaaaaaaaauuagguucaggggguacaugugcag

SEQ ID NO: 458021 - RNA, 64 nt, hsa
uauuacucuugauuucaucuucagaguguaguuaaaaaauuauuuuaaauaauuauuuuuuuaa

SEQ ID NO: 458022 - RNA, 64 nt, hsa
auaauaaacugauuuaaacuuuuucuauaagaagaaaaauuaagaccacuuauuugaaaacaaa

SEQ ID NO: 458023 - RNA, 64 nt, hsa
auaaaugaagugcuggacuuuaccugaaagcugcaaaaauuaaugguuuagauauauuuauaau

SEQ ID NO: 458024 - RNA, 64 nt, hsa
aacaucaucucuacauaaaaaaauacauauauacaaaaauuagcugggcaucauggcacacacc

SEQ ID NO: 458025 - RNA, 64 nt, hsa
aggugacugaccacaaagaagaaaauucugucucaaaaauuaaagaauuuuguuuguuauuguu

SEQ ID NO: 458026 - RNA, 64 nt, hsa
aaacauacaacuuccaaaaggcaucugauuuuuaaaaaauuaaaauuucugaaaaccaaugcga

SEQ ID NO: 458027 - RNA, 64 nt, hsa
aaacaagaugcuaaacaaauccuggacuguuaauaaaaauuaauuauguauuauuggauaagga

SEQ ID NO: 458028 - RNA, 64 nt, hsa
caaugaaauuucagaaguuuuuguucuguaaguaaaaaauuacuaaccacugauguucaagauu

SEQ ID NO: 458029 - RNA, 64 nt, hsa
caacauggugaaacccugucucuacuaaaaauacaaaaauuagccagguguggagguacaugcc

SEQ ID NO: 458030 - RNA, 64 nt, hsa
aacauggugaaaccccgucucuacuaaaaauacaaaaaauuagccaggcgugguggcacgugcc

SEQ ID NO: 458031 - RNA, 64 nt, hsa
ccaugaacuggucuucuauuaauacuuugauucuaaaaauuauuuguuuacuugcuauggucug

SEQ ID NO: 458032 - RNA, 64 nt, hsa
cuuuuacgugucuuugcauuugagaggcacuguuaaaaauuauugggaaagauuuaaagugcag

SEQ ID NO: 458033 - RNA, 64 nt, hsa
ggcgacagagcgagacuucgucucaaacaaacaaaaaaauuagccgggcaugguggcaggugcc

SEQ ID NO: 458034 - RNA, 64 nt, hsa
caacaaggugaaaccccaccucuauuaaaaauacaaaaauuagccgggagugguggugcgugcc

SEQ ID NO: 458035 - RNA, 64 nt, hsa
caauaugaugaaaccccaucucuacuaaaaauacaaaaauuaggccggguacaguggcucaugc

SEQ ID NO: 458036 - RNA, 64 nt, hsa
auauuuauaauuacuaugugucuguauuauuaaaaaaaauuaugugucuguguuauacuguaua

SEQ ID NO: 458037 - RNA, 64 nt, hsa
caacacagugacaccugacucuacuaaaaaauuaaaaaauuagcugggcagcguggugugugcc

SEQ ID NO: 458038 - RNA, 64 nt, hsa
agccugggcaacacagugacaccugacucuacuaaaaaauuaaaaaauuagcugggcagcgugg

SEQ ID NO: 458039 - RNA, 64 nt, hsa
acucuauuauuucuuucuaaaucuaauagucuauaaaaauuauguuuccucuguuuuuuauuuu

SEQ ID NO: 458040 - RNA, 64 nt, hsa
aguauuaccuccuuaauuuuuaacaacuaagaacaaaaauuaacgagaaaaacaacaaaguaca

SEQ ID NO: 458041 - RNA, 64 nt, hsa
agagaaaugaaauauuuuugaaugguugcacguuaaaaauuaaaagaaggaaugggggcagaau

SEQ ID NO: 458042 - RNA, 64 nt, hsa
caauauggagaaaccuugucucuacuaaaaacacaaaaauuaucugggcaugguggggcaugcc

SEQ ID NO: 458043 - RNA, 64 nt, hsa
aauaacuuaaaaaaugcuuuacuacuaaaauguaaaaaauuaaugugcucaccucggcagcaca

SEQ ID NO: 458044 - RNA, 64 nt, hsa
aaauuaaugugcucaccucggcagcacauauacuaaaaauuaauaagacccagcuugaaaauug

SEQ ID NO: 458045 - RNA, 64 nt, hsa
aaugaaaaauguaaaaguaccuagaaauucacaaaaaaauuaauaccucuguggagaaaacuuc

SEQ ID NO: 458046 - RNA, 64 nt, hsa
aaauccugccucuacuaaaaauacaaaaaaaaaaaaaaauuagcugggcaugguggcacacacc

SEQ ID NO: 458047 - RNA, 64 nt, hsa
gcaacauggcaaaacccugugucuacaaaaaauaaaaaauuagcugggcaugacggccagagcc

SEQ ID NO: 458048 - RNA, 64 nt, hsa
acauauaccaaaaauauaugaggcaaauuuuagcaaaaauuaaaauucuuaagaaaacuucacu

SEQ ID NO: 458049 - RNA, 64 nt, hsa
aaaugaaauagagaauagaaaagcaauacagaaaaaaaauuaugaaaucaaaagcugguucuuu

SEQ ID NO: 458050 - RNA, 64 nt, hsa
aaagucaagauuuuauuaccaaacuuauagaaauaaaaauuauuagaaagaaauacuaugaaca

SEQ ID NO: 458051 - RNA, 64 nt, hsa
ugaaucaauuauuacaucuguuuuacuaugaaaaaaaaauuaauacuacuagcuuccagacaau

SEQ ID NO: 458052 - RNA, 64 nt, hsa
caacauggugaaauccugucucuacuaaaaauacaaaaauuagcugggcaugguggcacauacc

SEQ ID NO: 458053 - RNA, 64 nt, hsa
aauaauauaauaaccagugaauuuucaggaauuuaaaaauuagcuuuuuuccacuuaaaggaga

SEQ ID NO: 458054 - RNA, 64 nt, hsa
uauuaauuuuaaaacauucagaacuuguugaaagaaaaauuauaucugaaucaagauucauguu

SEQ ID NO: 458055 - RNA, 64 nt, hsa
aacauagugaaacccugucucuauuaaaaaugcaaaaaauuagccgggcguggugggcacccgu

SEQ ID NO: 458056 - RNA, 64 nt, hsa
ucaugacgaaaccccaucuccacaaaaaaauucaaaaaauuagccaggugugguggcaugugcc

SEQ ID NO: 458057 - RNA, 64 nt, hsa
agcauggcgaaaccccaucucuacuaaaaauacaaaaaauuagcugggcaugguggcaguugcc

SEQ ID NO: 458058 - RNA, 64 nt, hsa
cauagggagacccuaucccuacaaaaaauuucugaaaaauuaccugggcauuguggggcacacc

SEQ ID NO: 458059 - RNA, 64 nt, hsa
aaaaccagagguuauauacaauuuaaauugggcuaaaaauuaaaaauuugaggauuuaacuuga

SEQ ID NO: 458060 - RNA, 64 nt, hsa
cuuaaacaucuaagacucaguuguaguugcagaaaaaaauuaaagucaccucuacugaaccuug

SEQ ID NO: 458061 - RNA, 64 nt, hsa
caacaugaugaagcccugucucuacuaaaaauacaaaaauuagccgggcgugauggcacaugcc

SEQ ID NO: 458062 - RNA, 64 nt, hsa
ucuaccuuuuuauaaauacauaucuaugucucauaaaaauuagaauguacuauuuuaaaauaau

SEQ ID NO: 458063 - RNA, 64 nt, hsa
aucccuguuuucauaaagcuaauacuucaguuggaaaaauuaaacaggagcacaaagucaggga

SEQ ID NO: 458064 - RNA, 64 nt, hsa
cauucaggucuucugcuacauuaucuucuuugagaaaaauuaauugauuauaaaauaugugcua

SEQ ID NO: 458065 - RNA, 64 nt, hsa
gccuuuagcuucuugaagauuuagaaguuauauaaaaaauuaauuuaaaagcaaaccaaaagag

SEQ ID NO: 458066 - RNA, 64 nt, hsa
cucagugcugguuuacggaacaacucuuacuuuuaaaaauuacuuguucccccaaauuguugag

SEQ ID NO: 458067 - RNA, 64 nt, hsa
guuuuauuauaaauaauauucaauuaugaaacaaaaaaauuaugauguuuuucaaaaugcaagu

SEQ ID NO: 458068 - RNA, 64 nt, hsa
caacauggugaauccccgucucuauuaaaaauacaaaaauuagcugggugugguggcgugugcc

SEQ ID NO: 458069 - RNA, 64 nt, hsa
aggaguuucuauaggugucuucagaguucugaagaaaaauuacuggacacagcuucagcuauac

SEQ ID NO: 458070 - RNA, 64 nt, hsa
acagaaguuauuuccaaguuuguguauauauuauaaaaauuacauauauaaaacuaaggcuuuu

SEQ ID NO: 458071 - RNA, 64 nt, hsa
caacauggugaaaccccaucucuacuaaaaauacaaaaauuagccggacgcaguggcacgcgcc

SEQ ID NO: 458072 - RNA, 64 nt, hsa
cuuuuuguuucguuuuguuucuucuucugcauuuaaaaauuaaaagauugguuugaggauguga

SEQ ID NO: 458073 - RNA, 64 nt, hsa
uuaaagaaguuucuuauuuaaacaucucagacgcaaaaauuacauuaaauuuuuguauauuuca

SEQ ID NO: 458074 - RNA, 64 nt, hsa
caacaugaugaaaccuugucuuuacuaaaaauacaaaaauuagcugggcaugguggcaggcgcc

SEQ ID NO: 458075 - RNA, 64 nt, hsa
cagcaugguaaaacccugucuccacuaaaaauacaaaaauuagccaggcaugguggcgggcacc

SEQ ID NO: 458076 - RNA, 64 nt, hsa
caacauggugaaacccugucucuacuaaaaauacaaaaauuagcuggguguggugguguguacc

SEQ ID NO: 458077 - RNA, 64 nt, hsa
ccagccugggcgacagagcaagaccaccaucuccaaaaauuauauauauaaaaauaauuaauau

SEQ ID NO: 458078 - RNA, 64 nt, hsa
gcauuuuuaaacauuuaaaaauuauuaaacauuuaaaaauuaguuuauuaucagauaucagcau

SEQ ID NO: 458079 - RNA, 64 nt, hsa
agaaauuaguuuuaucuggcauuuuuaaacauuuaaaaauuauuaaacauuuaaaaauuaguuu

SEQ ID NO: 458080 - RNA, 64 nt, hsa
ucacaguccggaagagaugauagaugcauagacaaaaaauuaugggauguaacuaaugcuucag

SEQ ID NO: 458081 - RNA, 64 nt, hsa
ccugagugaaaaagugaacuauguuuuuuuucagaaaaauuauuuuaaaagaacucagcauuca

SEQ ID NO: 458082 - RNA, 64 nt, hsa
agcagccauguggagaacaacauggacuuucuucaaaaauuacaaauagaacuaucauaugauc

SEQ ID NO: 458083 - RNA, 64 nt, hsa
gagacucugucucuacaaaaaaauuuuaaaaaguaaaaauuagcugggcgugguggcacaugcc

SEQ ID NO: 458084 - RNA, 64 nt, hsa
ccaagaagauuauguguccuacccugucucauggaaaaauuaauuauaugguugaaauguaaaa

SEQ ID NO: 458085 - RNA, 64 nt, hsa
uuucauuuggaggaaaucacaaguggccgaaaaaaaaaauuaugcucccaaaucauucuacuga

SEQ ID NO: 458086 - RNA, 64 nt, hsa
guuucugcaauauuuuucuuauguccacccuuuuaaaaauuauuauuugaaguaauuuauuuac

SEQ ID NO: 458087 - RNA, 64 nt, hsa
aagacuuacauuuucugcacaggucugcaaaaacaaaaauuauaaacuaguccauccaagaacc

SEQ ID NO: 458088 - RNA, 64 nt, hsa
agugugugcaaagcuuauuuucuuuuaucugggcaaaaauuaaaacacauuccuuggaacagag

SEQ ID NO: 458089 - RNA, 64 nt, hsa
caaaaagucauuuuucuggaguggaaaagcuuaaaaaaauuacugugaauuguuuuuguacagu

SEQ ID NO: 458090 - RNA, 64 nt, hsa
aagcaguguucuaaauaaaaauucuggguuccuuaaaaauuauuuuaaauuuaucuuugaaaua

SEQ ID NO: 458091 - RNA, 64 nt, hsa
uauuaauauuuaaaaacgagaaauacaacauuuaaaaaauuaagaguauuuugcauuagugauu

SEQ ID NO: 458092 - RNA, 64 nt, hsa
aaguauugauuuauauauuuugucucaaaaguggaaaaauuauauugucuaauuaugaugaauu

SEQ ID NO: 458093 - RNA, 64 nt, hsa
gaucauuuuuccauaugacacugguuccgauuuuaaaaauuauuuuuaaauaaccgauuauuga

SEQ ID NO: 458094 - RNA, 64 nt, hsa
aaaacggugaaaccccgucucuacuaaaaauacaaaaaauuagccgggcguaguggcgggcgcc

SEQ ID NO: 458095 - RNA, 64 nt, hsa
auacuaaaaauauaggcucuugggauuggagaggaaaaauuagaggugauuuucagauuucuug

SEQ ID NO: 458096 - RNA, 64 nt, hsa
aaauucuucugaccgaaaccaauguggguguuagaaaaauuaccauauagcuuaauauguuuau

SEQ ID NO: 458097 - RNA, 64 nt, hsa
cccucucaguuaagaaaugcuuagauuaaaaaaaaaaaauuacguaggauuaauacagaaauuu

SEQ ID NO: 458098 - RNA, 64 nt, hsa
aaaccccaucucaacuaaaaauacaaaaaauacaaaaaauuagccgggcgcgguggcucacacc

SEQ ID NO: 458099 - RNA, 64 nt, hsa
caacauggugaaacccugucucuauuaaaaauacaaaaauuagcugggcgugguggcgcaugcc

SEQ ID NO: 458100 - RNA, 64 nt, hsa
uuauuaaauuuauuugaaaaugcaucacaugaugaaaaauuauaguagcuuauaagagggcaua

SEQ ID NO: 458101 - RNA, 64 nt, hsa
caauauggugaaacccugucucuacaaaaaauacaaaaauuagcugggcaugguggugcgugcc

SEQ ID NO: 458102 - RNA, 64 nt, hsa
cuuauggcaugaucucuggaacaaauuuguaggaaaaaauuacuccaauugaaugacugaugua

SEQ ID NO: 458103 - RNA, 64 nt, hsa
aacacugugaaaccccgucucuacuaaaaauacaaaaaauuagcggggcaugguggcacgcgcc

SEQ ID NO: 458104 - RNA, 64 nt, hsa
gcagggaaguuuccuugagccuaaaauaaaaagaaaaaauuaaaaagaaucaguuuuuuuaauu

SEQ ID NO: 458105 - RNA, 64 nt, hsa
caacauggcaaaacccugucucuacuaaaaacauaaaaauuagcugggggugguagcacauacc

SEQ ID NO: 458106 - RNA, 64 nt, hsa
ggcuuuuccuccauuaauacauauaugaguacugaaaaauuaaguugcauagcugcuuugcagu

SEQ ID NO: 458107 - RNA, 64 nt, hsa
uucuaaguuuuggaaagcagguuuuuuccuuuaaaaaaauuauagacacgguucacuaaauuga

SEQ ID NO: 458108 - RNA, 64 nt, hsa
acacaaagcuaaauauucuagcagugauguaaugaaaaauuacaucuuacuguugauauaugua

SEQ ID NO: 458109 - RNA, 64 nt, hsa
uguuaacagugagguugauaaaguauuacugauaaaaaauuaucuaaggaaaaaaacagaaaau

SEQ ID NO: 458110 - RNA, 64 nt, hsa
ugucuuaccucuugcuaguggguuaaauguuuucaaaaauuauagcaguaguagaaguuuugua

SEQ ID NO: 458111 - RNA, 64 nt, hsa
uaagaaaggaaauuuaaaaacauuccacaagaagaaaaauuauuguuuauacuucuacuuaugg

SEQ ID NO: 458112 - RNA, 64 nt, hsa
cugagaucuagcugaugcuuagauccuuugaaauaaaaauuaugucuuuauaacucugaucuuu

SEQ ID NO: 458113 - RNA, 64 nt, hsa
uauuuauuauauugguaaaaauucugguuaaauaaaaaauuagagaucacucuuggcugauuuc

SEQ ID NO: 458114 - RNA, 64 nt, hsa
aaauuaauggcauuuuaaagguuaaaacauuuugaaaaauuauuagcauguaacaaagaaugcu

SEQ ID NO: 458115 - RNA, 64 nt, hsa
uuuuuugccacugcaaacauauaucuacagagagaaaaauuaauggcauuuuaaagguuaaaac

SEQ ID NO: 458116 - RNA, 64 nt, hsa
gauccccaacucuacaaaaaaauaaaaauuaaaaaaaaauuauuaggcugcagaggcaagagga

SEQ ID NO: 458117 - RNA, 64 nt, hsa
uagcaaggcaagauccccaacucuacaaaaaaauaaaaauuaaaaaaaaauuauuaggcugcag

SEQ ID NO: 458118 - RNA, 64 nt, hsa
caacauggugaaacccugucucuacuaaaaauacaaaaauuagccgggcauggugguaggggcc

SEQ ID NO: 458119 - RNA, 64 nt, hsa
guaagccaagaucaugcugugccucaaggaaaaaaaaaauuaauguuuacugauauuuguugaa

SEQ ID NO: 458120 - RNA, 64 nt, hsa
acuuaaaauugauuacauugagccuauucagaaaaaaaauuauauagguucugaugaaagcuuc

SEQ ID NO: 458121 - RNA, 64 nt, hsa
uguggcauaaauuuggagaaaauaauaugacuagaaaaauuaguguuauauugggugugagaaa

SEQ ID NO: 458122 - RNA, 64 nt, hsa
agagagaagauauuuuaaaaagaaauaccuuuuuaaaaauuauuuuauuauuuuuuaauagaga

SEQ ID NO: 458123 - RNA, 64 nt, hsa
aaagccugaauguacuauguuuaaaagacaaaccaaaaauuaacccaaacuugcauuauuuguc

SEQ ID NO: 458124 - RNA, 64 nt, hsa
gccaacauggcaaaaccaucucuacuaaaaauagaaaaauuagccaggcacguuccaggcaccu

SEQ ID NO: 458125 - RNA, 64 nt, hsa
uauggugaaaccccaucucuacuaaaauuacaaaaaaaauuauccaggcgugguggugcacgcc

SEQ ID NO: 458126 - RNA, 64 nt, hsa
ggcaaaacaccgucucuacaaaaaaaaaaaaaaaaaaaauuagccaaguacaguggggcacacc

SEQ ID NO: 458127 - RNA, 64 nt, hsa
agccuggacaacauagcaagaccucaucucuucuaaaaauuaaaaaaaaaaaaaauaggcaugg

SEQ ID NO: 458128 - RNA, 64 nt, hsa
uguauucuuacaguuaauguuuauaacuauaguaaaaaauuaauauauauccuauuacauaaau

SEQ ID NO: 458129 - RNA, 64 nt, hsa
aaucuucagaguauaaagacauccauucagaaacaaaaauuagcacuaaauuuuuuauaaaaua

SEQ ID NO: 458130 - RNA, 64 nt, hsa
uuguuuaacuuccuucuguuuuaagauuguaauuaaaaauuacuauuuuguuauauggaauggu

SEQ ID NO: 458131 - RNA, 64 nt, hsa
aaaccauuuuaugaguuuucuguuagcuugcuuuaaaaauuauuacuguaagaaauaguuuuau

SEQ ID NO: 458132 - RNA, 64 nt, hsa
uuuaaaaauuauuacuguaagaaauaguuuuauaaaaaauuauauuuuuauucaguaauuuaau

SEQ ID NO: 458133 - RNA, 64 nt, hsa
caguuccacaccaagaaugaacugcauuuccuuuaaaaauuauuuuaaaacaccuuuauugaaa

SEQ ID NO: 458134 - RNA, 64 nt, hsa
cuaauaucacagggcuugugcauucagauuuuuaaaaaauuaggauagauaaggaaacaacuua

SEQ ID NO: 458135 - RNA, 64 nt, hsa
aacauggugaaaccccaucucuacuaaaaauacaaaaaauuagcugggcaugcacuuguaauuc

SEQ ID NO: 458136 - RNA, 64 nt, hsa
cacucuuugcaggcacucuucaaauuuuuauuuuaaaaauuauaaugcaaacaucuggccauca

SEQ ID NO: 458137 - RNA, 64 nt, hsa
uuaaaaugggggaaaaaaagccaucuuuuuaaacaaaaauuauuuugccuacagaaagguugua

SEQ ID NO: 458138 - RNA, 64 nt, hsa
cuucggccagucuuaaacgggugucagcaagaagaaaaauuaacaaaagacagaaggccugacu

SEQ ID NO: 458139 - RNA, 64 nt, hsa
caacauagcgagacugcaucucuacaaaaaauuuaaaaauuauccagguguaauggugugcacc

SEQ ID NO: 458140 - RNA, 64 nt, hsa
acaugguuaaaccccgucucuacuaaaauaguacaaaaauuagccgggcgugguggugggcacu

SEQ ID NO: 458141 - RNA, 64 nt, hsa
auguucucuuugccauuuuagauggaaaaauaaaaaaaauuaaaaaguaaauuuuugcuuuuca

SEQ ID NO: 458142 - RNA, 64 nt, hsa
ugcuuuucagaauguagagugagaccucugguggaaaaauuauugcccuguggacuccuuuaau

SEQ ID NO: 458143 - RNA, 64 nt, hsa
cuucuucaagagaugccuaaaauguuuucuauuuaaaaauuacaaaaaugaacccaagucuguu

SEQ ID NO: 458144 - RNA, 64 nt, hsa
gccauaauuugucaauaaagcugaaaacuuuuguaaaaauuaaauuuggaauuacuuguuuucu

SEQ ID NO: 458145 - RNA, 64 nt, hsa
uuucauuugaauauuuaaauuuuaugguuuauuaaaaaauuaaauaaauguuguguccgucuuu

SEQ ID NO: 458146 - RNA, 64 nt, hsa
agaucccauaauaaaaaugaauguuuuucuuauaaaaaauuauacaaaugcugaagugagauuc

SEQ ID NO: 458147 - RNA, 64 nt, hsa
aauacuauuaaccuauauaaccauuuaaaauuuaaaaaauuauguuccaaguaccucuauuuuc

SEQ ID NO: 458148 - RNA, 64 nt, hsa
caacauagugaaacacugucucugcaaaaaauacaaaaauuagcuggguauggugguaagugcc

SEQ ID NO: 458149 - RNA, 64 nt, hsa
ucucaaguagaaaaguuuuugaaaacuaacauuuaaaaauuaaucaguuacaguaaagacuuug

SEQ ID NO: 458150 - RNA, 64 nt, hsa
aagacaauaaauugugagucaacuuuagaacaaaaaaaauuagaguuuuuucaauguuuauauu

SEQ ID NO: 458151 - RNA, 64 nt, hsa
aucagaaugaugcucuuauaguuguaccaucuauaaaaauuacuuuaagggcucucacauuuua

SEQ ID NO: 458152 - RNA, 64 nt, hsa
guucuaaagcuauccauugugucauauuuacucuaaaaauuaaagagacucucaacauacuguu

SEQ ID NO: 458153 - RNA, 64 nt, hsa
acuguugcucaaucuaaucuucgauggaaauucuaaaaauuaauacagagcugaucuucuuggg

SEQ ID NO: 458154 - RNA, 64 nt, hsa
uaauguuacaugcaccuucaauuucauccacuuuaaaaauuaucuucucauugaauuuuagugc

SEQ ID NO: 458155 - RNA, 64 nt, hsa
cauacuuuuaaaacaagugcuugaguugucacuuaaaaauuauagcauauugcuauaauaaaac

SEQ ID NO: 458156 - RNA, 64 nt, hsa
acauggcgaaaccucgccucuacuaaaaauacaaaaaaauuagcugcgcgugguggugcacgcc

SEQ ID NO: 458157 - RNA, 64 nt, hsa
gcaacagagacucugucucaaaaaaaaaaaaaaaaaaaauuaaccucaaccaaacgccuauuuu

SEQ ID NO: 458158 - RNA, 64 nt, hsa
cauagcaaaaccccaucucuauuaaaaauuuuacaaaaauuagcugcgugugguggcaggcccc

SEQ ID NO: 458159 - RNA, 64 nt, hsa
auguauaauuacauucaaauuauauuuuuucuugaaaaauuaguuuuugaaaagcaaaugaugu

SEQ ID NO: 458160 - RNA, 64 nt, hsa
guauauuuacauucagaguacacuuuucuuuggaaaaaauuacagguuuuuugaaaagugaaua

SEQ ID NO: 458161 - RNA, 64 nt, hsa
uuauggacuacaggguuauuuuuauggucauaauaaaaauuacaaaaguaugaauaaaauacau

SEQ ID NO: 458162 - RNA, 64 nt, hsa
ugcaauuuucuacagaauugaauaccuguuaaagaaaaauuacagaauaaacuugugacugguc

SEQ ID NO: 458163 - RNA, 64 nt, hsa
ccaacauggugaaaccuugucuacuaaaaauacaaaaaauuagcugggcauggcggcaugcgcc

SEQ ID NO: 458164 - RNA, 64 nt, hsa
guucuauugcauaguacaugaaucuauugucacuaaaaauuagguuacuaaucuuaauuuuuuu

SEQ ID NO: 458165 - RNA, 64 nt, hsa
gacagagcaagacuccgucucaaagaaacaaacaaaaaauuaaaagggauagaauauaaugaaa

SEQ ID NO: 458166 - RNA, 64 nt, hsa
caacaugaugaaacccugucucuacuaaauauacaaaaauuaguuggguguuauggugcaugcc

SEQ ID NO: 458167 - RNA, 64 nt, hsa
ugaaaucuucaagaacaccuuuacucuauaacucaaaaauuaguugaaaaauaauuacuucuca

SEQ ID NO: 458168 - RNA, 64 nt, hsa
cugggcaacacagugagacuccaucucuuaaaaaaaaaauuagcuggguauagugguaugugcc

SEQ ID NO: 458169 - RNA, 64 nt, hsa
uuucagaucaguaucuucuagauuccagacagaaaaaaauuacacuucagaaaagacaucaaag

SEQ ID NO: 458170 - RNA, 64 nt, hsa
aacaaggugaaaccccgucucuacuaaaaauacaaaaaauuagccaggcgcgguggcgggggcc

SEQ ID NO: 458171 - RNA, 64 nt, hsa
acugucauacugucauaggaugagagaguucuucaaaaauuauguuuucccaagaucaguugcu

SEQ ID NO: 458172 - RNA, 64 nt, hsa
agccugggcaaaacccugucucuacuaaaaauauaaaaauuagccaggcaugauggcacaugcu

SEQ ID NO: 458173 - RNA, 64 nt, hsa
agacuuuugacagugagacugucaaaaaaaaaaaaaaaauuaauagauaaaacaggccacuaga

SEQ ID NO: 458174 - RNA, 64 nt, hsa
caacauggcaaaaccccgucucuaugaaaaauauaaaaauuagcugggcaugguggcaggcacc

SEQ ID NO: 458175 - RNA, 64 nt, hsa
uggcucgugaucaagagcuuacaagacccuaugaaaaaauuaguugagaaagaagagaagaaga

SEQ ID NO: 458176 - RNA, 64 nt, hsa
gagacccccaucucuacaaaaaauaaaaacacuuaaaaauuauccggguaccgugcaugugcag

SEQ ID NO: 458177 - RNA, 64 nt, hsa
uauaaaaaucauuggcacaguuacacuuaauaaaaaaaauuaaacagaagagcacccugaaaaa

SEQ ID NO: 458178 - RNA, 64 nt, hsa
caguacagcuauaauaguaucuugaaaguuguaaaaaaauuaaagcauauuuguuacguaaagu

SEQ ID NO: 458179 - RNA, 64 nt, hsa
aucuuuucauaucugcaagauuuuuuucaucaauaaaaauuauccuugaaacaagugagcuuuu

SEQ ID NO: 458180 - RNA, 64 nt, hsa
aaaaucguaaaaacagaaaaugucauaggaauaaaaaaauuaucuuuucauaucugcaagauuu

SEQ ID NO: 458181 - RNA, 64 nt, hsa
uccagccugggcgacagagucuccaucuggggaaaaaaauuaaauaaauaaacucccgugacuu

SEQ ID NO: 458182 - RNA, 64 nt, hsa
caacauggggaaacccugucuuuacuaaaaauauaaaaauuagcugggugugguggcgggcacc

SEQ ID NO: 458183 - RNA, 64 nt, hsa
caacauggugaaaccccgucucuacuaaaaauacaaaaauuagccgggcaugguggcaggcgcc

SEQ ID NO: 458184 - RNA, 64 nt, hsa
acagagcgagacuccaucucuuuaaaaacaaacaaaaaauuaucugaaugauccugucucuaaa

SEQ ID NO: 458185 - RNA, 64 nt, hsa
gcaacaagagcaaaacuccgucucaaaaaaaaaaaaaaauuacaaauggggcaaacagucuagu

SEQ ID NO: 458186 - RNA, 64 nt, hsa
acauggugaaacccccaucucuacuaaaaauaccaaaaauuagccgagcguagugacgggugcc

SEQ ID NO: 458187 - RNA, 64 nt, hsa
uucuccaaauaaaaauuagauggaaaaaugugaaaaaaauuauucaugcucucauauauauuuu

SEQ ID NO: 458188 - RNA, 64 nt, hsa
gaauaauuucauacugaaauuauuuucuccaaauaaaaauuagauggaaaaaugugaaaaaaau

SEQ ID NO: 458189 - RNA, 64 nt, hsa
aacaaggugaaaccccgucucuacuaaaaauacaaaaaauuagccgggcgcgguggcgggcgcc

SEQ ID NO: 458190 - RNA, 64 nt, hsa
auucagaaucuguugugagaaaugcccaggcuuuaaaaauuaaaaauggauggaucuucucuga

SEQ ID NO: 458191 - RNA, 64 nt, hsa
cuguaaaagauuuuugcuucccucuugugguaaaaaaaauuauauucucacacauuucuuuuuu

SEQ ID NO: 458192 - RNA, 64 nt, hsa
ggugacacagcaagacuccaucucaaaaaaaaaaaaaaauuacuuucaacaaggcauauagucu

SEQ ID NO: 458193 - RNA, 64 nt, hsa
ccaacauggugaaacccugucucuacaaaaauacaaaaauuagcugggugugguggcgggcgcc

SEQ ID NO: 458194 - RNA, 64 nt, hsa
gugacagauaaagauguaugauuucuaaggcuuuaaaaauuauucauaaaacagugggcaauag

SEQ ID NO: 458195 - RNA, 64 nt, hsa
gcuuuugacucauuucuaggcagugcuuaugaagaaaaauuaaagcacaaacauucuggcauuc

SEQ ID NO: 458196 - RNA, 64 nt, hsa
caacacggugaaaccccaucucuauuaaaauacaaaaaauuagcugggcaugguggugcgugcc

SEQ ID NO: 458197 - RNA, 64 nt, hsa
gauugaaaauggacgccuuccuuaugccauauacaaaaauuaacucaagauggauuaaagacuu

SEQ ID NO: 458198 - RNA, 64 nt, hsa
guugcguacauggcaaauccugcaaauauagauuaaaaauuaaauuagcccauugaaauccuuu

SEQ ID NO: 458199 - RNA, 64 nt, hsa
uugucaguguuuccuucuauaaacuguucuuuggaaaaauuaaguuauacauaaaauucauauu

SEQ ID NO: 458200 - RNA, 64 nt, hsa
gcccacugugcucaauuugaagcagaauucagugaaaaauuauuuuuccacauugaaacacuuu

SEQ ID NO: 458201 - RNA, 64 nt, hsa
uagcauagcaagacccugucucuacaaaaaaaacaaaaauuagcugggcaugguggcaugcaca

SEQ ID NO: 458202 - RNA, 64 nt, hsa
uuucucuuaaaauuauuuagccuccauuauuacaaaaaauuauaaaaauaaguuuucagucagu

SEQ ID NO: 458203 - RNA, 64 nt, hsa
uauuuguuuguauguuuauucaguauacuuacauaaaaauuauuucgccaucagccaaaacuca

SEQ ID NO: 458204 - RNA, 64 nt, hsa
aggagccccaccccccgucucuacaaaaaaauuuaaaaauuaacugggcaugguggcugaggug

SEQ ID NO: 458205 - RNA, 64 nt, hsa
ccaacuuuuuuagagacagccugucucuuaaaaaaaaaauuaauuugguagugagagcuugugu

SEQ ID NO: 458206 - RNA, 64 nt, hsa
caacauggcgaaacccuaucucuacaaaaaauacaaaaauuagccagacaugguggcacaugcc

SEQ ID NO: 458207 - RNA, 64 nt, hsa
auuuuuuguacucauucauuccuguuaagcugccaaaaauuaaagugcaauauuguauauuuuu

SEQ ID NO: 458208 - RNA, 64 nt, hsa
gacuuuaacugcaguuccaaagcuucucuaacccaaaaauuacaguaccaaaugauugacucag

SEQ ID NO: 458209 - RNA, 64 nt, hsa
uguauacuugaaacuguuuaaguacaaguugaacaaaaauuaugaaaagguauauuugcuucuc

SEQ ID NO: 458210 - RNA, 64 nt, hsa
cacauuuuaauuuagcaaauugauuuaccuaggaaaaaauuaucaccuucaaagauaggcauag

SEQ ID NO: 458211 - RNA, 64 nt, hsa
augcuuaagcuuuuaacagcauuuuaaccgcucuaaaaauuaccagaguaagaaaaagcuaggu

SEQ ID NO: 458212 - RNA, 64 nt, hsa
ucuauaaugcuuauuaugguaaaauaaaauuggaaaaaauuaaaacugaccuauaagaguguua

SEQ ID NO: 458213 - RNA, 64 nt, hsa
uuuauguccauaaaauacaaauauauuguucauaaaaaauuaguaucccuuuuguuugguugcu

SEQ ID NO: 458214 - RNA, 64 nt, hsa
uagacuugugaguugaaugacaaagcaguugaacaaaaauuauggcauuuaagaauuuaacaug

SEQ ID NO: 458215 - RNA, 64 nt, hsa
uuuuucuagaacuacuaauuaucucucaaggcugaaaaauuaauugccuuagguggagaacuua

SEQ ID NO: 458216 - RNA, 64 nt, hsa
caacauggcgaaaccccaucucuacuaaaaauacaaaaauuagcuuggcaugguggugcgugcc

SEQ ID NO: 458217 - RNA, 64 nt, hsa
ugcacuugacugaguugggacaaggcuucacauaaaaaauuauuucuucacuuuuaacacaagu

SEQ ID NO: 458218 - RNA, 64 nt, hsa
cagcagcgaugcagaaggcaagaacggcagcuugaaaaauuaaaggagguuguucacuuccaga

SEQ ID NO: 458219 - RNA, 64 nt, hsa
aauauuaaugauuauucucuuguaaaagaaaaggaaaaauuaguaaagaaaaaaguuuuaguug

SEQ ID NO: 458220 - RNA, 64 nt, hsa
auuuuaauguuuguuccaaaauagcagaaauuguaaaaauuaugaauuauuggagaaaaugcca

SEQ ID NO: 458221 - RNA, 64 nt, hsa
uuuauauacugcuaguuaacaauuaccacuuuuaaaaaauuauaaccguuuuuguucuaucuug

SEQ ID NO: 458222 - RNA, 64 nt, hsa
aaaaauaugucugcuauagaaauaacuugaaaaaaaaaauuaaaaccguggccagccaccaaau

SEQ ID NO: 458223 - RNA, 64 nt, hsa
ugauuauugagaaaauguagcaguuugcauauuuaaaaauuaaucauuuugcauuuuacauuua

SEQ ID NO: 458224 - RNA, 64 nt, hsa
aaucuuuuaaaaauauuaucuugcagauaaagaaaaaaauuaagaguguguuuacaacuguuuu

SEQ ID NO: 458225 - RNA, 64 nt, hsa
uauuuuggucuagccacuaaacauaaugacugaaaaaaauuauuauuauaaaucaccaauauaa

SEQ ID NO: 458226 - RNA, 64 nt, hsa
cccaaaaaccauuuggcuggcagaaauuaucuagaaaaauuauuauuuugcaguuaucugagac

SEQ ID NO: 458227 - RNA, 64 nt, hsa
aacuuuuuuagcauguggucuguuacacaugcuaaaaaauuagucuuacuuguaacagcguaau

SEQ ID NO: 458228 - RNA, 64 nt, hsa
uuaauauuuugcuuuuuugcuacauagucuacucaaaaauuacaugaggagaaauccuuuuucc

SEQ ID NO: 458229 - RNA, 64 nt, hsa
ccaacauggugaaacccuucucuacugaaaauacaaaaauuagccaggugugguggcgcauacc

SEQ ID NO: 458230 - RNA, 64 nt, hsa
uaauauggugaaaccucgucucuacuaaaaauacaaaaauuagcugggcaugguggugcgugcc

SEQ ID NO: 458231 - RNA, 64 nt, hsa
uauguuauuagcaagguuaagacaucuuuuuuaaaaaaauuauagcuucuaccaagagaaacac

SEQ ID NO: 458232 - RNA, 64 nt, hsa
ucugaacuuggcaaaauuggaaauuaaaauuuuuaaaaauuacaaauauacaaaguuauuuauc

SEQ ID NO: 458233 - RNA, 64 nt, hsa
ugacgaaaccccaucucuacugaaaauagaaaaaaaaaauuagccaggcuugcaccuguaaucc

SEQ ID NO: 458234 - RNA, 64 nt, hsa
guguuaaaaaaaaaaagugcaacuaucaaaacuaaaaaauuauagaguaauauugccguucugc

SEQ ID NO: 458235 - RNA, 64 nt, hsa
auugaccucuguugcauuuauucuaaagccccccaaaaauuaucuagccguuucgaauaucaac

SEQ ID NO: 458236 - RNA, 64 nt, hsa
caacaugacgaaacuccgucucuauuuaaaauacaaaaauuagcugggcaugguggugcaugcc

SEQ ID NO: 458237 - RNA, 64 nt, hsa
caacauggcgaaaccccaucucuacuaaaaauauaaaaauuaguugcgugugguggcacauccc

SEQ ID NO: 458238 - RNA, 64 nt, hsa
caacauggggaaaccccgucucuacuaaaaauacaaaaauuagccgggcaugguggugggcgcc

SEQ ID NO: 458239 - RNA, 64 nt, hsa
acaacauagugagauccuaucucuauaaaaaaucaaaaauuagccaggcaugguggugcauacc

SEQ ID NO: 458240 - RNA, 64 nt, hsa
caauguggugaaaccccaucucuacuaaaaauacaaaaauuagcugggcgugguggugcaugcc

SEQ ID NO: 458241 - RNA, 64 nt, hsa
guuguauugaaauaguaacuuaucaaugccauguaaaaauuaauuccauuuucgaagccaccug

SEQ ID NO: 458242 - RNA, 64 nt, hsa
uuuaaauuugcuaguugcauuauacugggucaugaaaaauuaucccuugaaauagauaugaaac

SEQ ID NO: 458243 - RNA, 64 nt, hsa
auguagcacuugacuuuuugccaaggaaaaaaauaaaaauuauuccagugcacaauggugugag

SEQ ID NO: 458244 - RNA, 64 nt, hsa
ccucuucucuggguguaagaagggaaauuggaaaaaaaauuauauauauauucuccuuuuaaug

SEQ ID NO: 458245 - RNA, 64 nt, hsa
accaacacccccaagugacugacacagguggucuaaaaauuacuuuucuagaaacaccauucug

SEQ ID NO: 458246 - RNA, 64 nt, hsa
gagcagagcaccucccacugggggugggguauuuaaaaauuaacucauuaguaucauaaacguc

SEQ ID NO: 458247 - RNA, 64 nt, hsa
gggcgacagagugagacucugucucaaaaaaaaaaaaaauuaugaaaaaaguuaugggauuaaa

SEQ ID NO: 458248 - RNA, 64 nt, hsa
caacauggugaaacugugucucuacuaaaaauacaaaaauuagccaggcaugguggcacgugcc

SEQ ID NO: 458249 - RNA, 64 nt, hsa
cacugucaucuaaaagcuggccacuaaauuaaaaaaaaauuaaaaguuaugggauuaaaaaaag

SEQ ID NO: 458250 - RNA, 64 nt, hsa
augauaaagaaauuuaagguauaaaauuaaauguaaaaauuaauuucagcuucauuucguauuu

SEQ ID NO: 458251 - RNA, 64 nt, hsa
caucauggugaaacccugucucuacugaaaauacaaaaauuagccgggcgugguggcacacgcc

SEQ ID NO: 458252 - RNA, 64 nt, hsa
caacaugaugaaacccugucucuacuaaaaauacaaaaauuagccgggcaugguggugcacauc

SEQ ID NO: 458253 - RNA, 64 nt, hsa
ggcaacauggcacaauugucucuacaaaaaauacaaaaauuagccaggcaugguggcaugcacc

SEQ ID NO: 458254 - RNA, 64 nt, hsa
cgacauggugaaacucagucucuauugaaaauacaaaaauuagcucagugugguggcacacacu

SEQ ID NO: 458255 - RNA, 64 nt, hsa
cauggugaaaccuugucucuacuaaaacuacaaaaaaaauuagccaggcgugguggcgggcgcc

SEQ ID NO: 458256 - RNA, 64 nt, hsa
uauuagcaucaaccaucuugauaaucaccaagggaaaaauuaaaaauaccuagacugcaauaaa

SEQ ID NO: 458257 - RNA, 64 nt, hsa
cuuggugacuaaggugacuuuguauauucaucuuaaaaauuauguucuuuagacacugcuaccu

SEQ ID NO: 458258 - RNA, 64 nt, hsa
uuucuuuaaauaggaacaaccucuuuuaaaagagaaaaauuauuucagugauuugucaaaacga

SEQ ID NO: 458259 - RNA, 64 nt, hsa
gguagccaaaugaaaaagaaugaaagggaaagugaaaaauuaaggggacaaaagaugggaugug

SEQ ID NO: 458260 - RNA, 64 nt, hsa
cucaaaguguuucuuaagggugaguuggcaugcaaaaaauuacauugauuacaguguguuuugg

SEQ ID NO: 458261 - RNA, 64 nt, hsa
aucaggccuuggagcagucacugcuuuauuccgcaaaaauuauuugguaggaaauuuuugggag

SEQ ID NO: 458262 - RNA, 64 nt, hsa
acuuuucuuguaaauaugucacaucugaguucaaaaaaauuacuuugaauaccuuaauauuugc

SEQ ID NO: 458263 - RNA, 64 nt, hsa
caacauggugaaaccucgucucuacuaaaaauacaaaaauuagcugggcgugguggugcgugcc

SEQ ID NO: 458264 - RNA, 64 nt, hsa
aaaacauaaguaacaaaguugagcuuucauuuuuaaaaauuauauuuuacuuuagaaaaauauc

SEQ ID NO: 458265 - RNA, 64 nt, hsa
agacguuuuucuucugcugugguaucuugcccuuaaaaauuaguuuucauuaaaaagaaauuug

SEQ ID NO: 458266 - RNA, 64 nt, hsa
ugugugcagauaccaaaagaggaggaaagaagaaaaaaauuaaugugugggagcugcacguuua

SEQ ID NO: 458267 - RNA, 64 nt, hsa
augcugccaaagauuaaaaauaaauaaaaacauaaaaaauuaagaggggccaagaggaagacau

SEQ ID NO: 458268 - RNA, 64 nt, hsa
gucaaaaggaagcuuguuuguaauacgugugcauaaaaauuaaauagaggugaacacaauuauu

SEQ ID NO: 458269 - RNA, 64 nt, hsa
caacacggugaaaccccgucucuacuaaaauacaaaaaauuagccgggcgucgcagcaugcgcc

SEQ ID NO: 458270 - RNA, 64 nt, hsa
uauaggaucuacagaugaauauuuaacucaauagaaaaauuauuuuagaacacauuguauuggu

SEQ ID NO: 458271 - RNA, 64 nt, hsa
agccugggugacagagugagacucugucucaaaaaaaaauuaaauaaauuauuauaaccuuuca

SEQ ID NO: 458272 - RNA, 64 nt, hsa
agccugggcaacagagcaagacucugccucaaaaaaaaauuaaaauaaauuuaaauacaaaaaa

SEQ ID NO: 458273 - RNA, 64 nt, hsa
caacauggugaaaccccaucucuacuaaacaugcaaaaauuaccugggcaugguggcaggugcu

SEQ ID NO: 458274 - RNA, 64 nt, hsa
cauuguuauuuuuagaaagauuuuuugcuaagaaaaaaauuaaacauauuuacauauuuuucau

SEQ ID NO: 458275 - RNA, 64 nt, hsa
uguuaauguuauauuaaaagagaggguccuucaaaaaaauuauuuuuuaaaacacagagguguu

SEQ ID NO: 458276 - RNA, 64 nt, hsa
aucagucaaaauaauaaaacuaaaaacaaaaaguaaaaauuaguucccaaguaaauauaucagu

SEQ ID NO: 458277 - RNA, 64 nt, hsa
acauacauuuugaaauuaugaacauuuuuuucauaaaaauuaaaugcuuuaagaaauggagaag

SEQ ID NO: 458278 - RNA, 64 nt, hsa
ccuggugaaacccugucucuacuaaaaauacaaaaaaaauuagcugagcgugguggcgggcgcc

SEQ ID NO: 458279 - RNA, 64 nt, hsa
uauacugaguaguagaaagaagcuaauuugaaauaaaaauuauuuguauaauuaagaaagcaga

SEQ ID NO: 458280 - RNA, 64 nt, hsa
auuacauauuagggauuguaagaaaacuuuaauuaaaaauuaaagacuauauauaauuaaacua

SEQ ID NO: 458281 - RNA, 64 nt, hsa
aacaaggugaaacccugucucuacuaaaaauacaaaaaauuagccaggcaugguggugcgcacc

SEQ ID NO: 458282 - RNA, 64 nt, hsa
guuuugcccuuaagaagucaugauuaacuuaugaaaaaauuauuuggggacaggagugugauac

SEQ ID NO: 458283 - RNA, 64 nt, hsa
aaaguaguggaaggaaauugucuacgugucuuggaaaaauuaguuaggaauuuggauggguaaa

SEQ ID NO: 458284 - RNA, 64 nt, hsa
auuuuuuuuuuuuuuuaagaaaaaccuauagaugaaaaauuacuaaugaaacuguguguacgug

SEQ ID NO: 458285 - RNA, 64 nt, hsa
uguucuccuuagaugugagagaaagagaaaucagaaaaauuaauucucuugggggaagggcuug

SEQ ID NO: 458286 - RNA, 64 nt, hsa
aaaauaagaaagcccuaaaauacuauuggagagaaaaaauuaacuagguugcuacuuuauuugc

SEQ ID NO: 458287 - RNA, 64 nt, hsa
cauaagacaugcacacuaauacacauacacaccaaaaaauuacacauuuuaaaacugcuaagcu

SEQ ID NO: 458288 - RNA, 64 nt, hsa
augugaaagcuggagccgaagagucaaagagcuaaaaaauuaagucuagaacauucuaugagga

SEQ ID NO: 458289 - RNA, 64 nt, hsa
uuugcaauaucgaucagaugacuagaaagugaauaaaaauuaaggcaacugaacaaaaaaaugc

SEQ ID NO: 458290 - RNA, 64 nt, hsa
gauuuauguuguauagauuagauuauauugagacaaaaauuaucuauuuguauauauacauaac

SEQ ID NO: 458291 - RNA, 64 nt, hsa
ccaaauguccgaugugugcuaugacuaaaaauugaaaaauuaaacacaguguuagucaaccuuu

SEQ ID NO: 458292 - RNA, 64 nt, hsa
uuuacuaugauuuagggcuuuuuuuucaaagaacaaaaauuauaagcauaaaaacucagguauc

SEQ ID NO: 458293 - RNA, 64 nt, hsa
aucuuuuuuuuauuuuuaagggaauaaaaauuuuaaaaauuaagagauauacagaugacuuuuu

SEQ ID NO: 458294 - RNA, 64 nt, hsa
caauauggugaaacccugucucuacuaaaaauacaaaaauuagccgggugugguggugggcacc

SEQ ID NO: 458295 - RNA, 64 nt, hsa
uuaaguucugaaaauugaaaaaauuaaaauguaaaaaaauuaaagaauaaaaauacuucuauua

SEQ ID NO: 458296 - RNA, 64 nt, hsa
gcaauaguucaaaaaauuaaguucugaaaauugaaaaaauuaaaauguaaaaaaauuaaagaau

SEQ ID NO: 458297 - RNA, 64 nt, hsa
aaaauccuugcuuuuaaguguuagcaauaguucaaaaaauuaaguucugaaaauugaaaaaauu

SEQ ID NO: 458298 - RNA, 64 nt, hsa
gcaaaauagagcaauuauaacaauauauuguaauaaaaauuaugugaauguggucucucuuucu

SEQ ID NO: 458299 - RNA, 64 nt, hsa
gaaauccagcgagauauuagaaauaaaggccagaaaaaauuaauuaaccaugauggaugaaucu

SEQ ID NO: 458300 - RNA, 64 nt, hsa
uaguguuaauagucuugugcuaugcagcagguguaaaaauuaauaaauauauuuuuuaauaaac

SEQ ID NO: 458301 - RNA, 64 nt, hsa
cuuuuaauaagacggucaacuucacacuuagggaaaaaauuaaaaugugauggccacuucuaau

SEQ ID NO: 458302 - RNA, 64 nt, hsa
uucucugugaccugauuucagaagagacugauccaaaaauuauaacggcagggaaccuagugca

SEQ ID NO: 458303 - RNA, 64 nt, hsa
ucugcuagccaauauuaaaagagaccugcaauaaaaaaauuacccugaucugauagaaagcaag

SEQ ID NO: 458304 - RNA, 64 nt, hsa
ucgaauccauccgcuuguaggggaaaaaaaggaaaaaaauuaaccagagagggucuguaaucuc

SEQ ID NO: 458305 - RNA, 64 nt, hsa
aguaacaucucagaaauuucauccagaggaacaaaaaaauuaaaaauagaacauagcaaagcaa

SEQ ID NO: 458306 - RNA, 64 nt, hsa
auaacuuacuauauguuucaguugcucucugaacaaaaauuaucuucaauuuaauauguggaau

SEQ ID NO: 458307 - RNA, 64 nt, hsa
aacauggugaaacaccgucucuacuaaaaauacaaaaaauuaggugugguggugcgugccugua

SEQ ID NO: 458308 - RNA, 64 nt, hsa
uauuccuacuuucagaagaaaaauauaauacggaaaaaauuauagauuuacuuguagcuuauua

SEQ ID NO: 458309 - RNA, 64 nt, hsa
aaguugugcuguuuucuaaguaaaauaaaaaauaaaaaauuagcaauuuaugauagccaguguu

SEQ ID NO: 458310 - RNA, 64 nt, hsa
caguuuucucugcauaaguaauuaaaauauacuuaaaaauuaauaguuuuaucuggguacaaau

SEQ ID NO: 458311 - RNA, 64 nt, hsa
ugcuuuuguuucuuaagaaaacaaacucuuuuuuaaaaauuacuuuuaaauauuaacucaaaag

SEQ ID NO: 458312 - RNA, 64 nt, hsa
auuauauuuuuucuauaaaaagaaaaaaauggaaaaaaauuacaaggcaauggaaacuauuaua

SEQ ID NO: 458313 - RNA, 64 nt, hsa
aacaugacaagaccccaucucuacaaaaaaauuaaaaaauuagccaggcaugguggcacaugcc

SEQ ID NO: 458314 - RNA, 64 nt, hsa
acaugggcaacaugacaagaccccaucucuacaaaaaaauuaaaaaauuagccaggcauggugg

SEQ ID NO: 458315 - RNA, 64 nt, hsa
augaucaacuuauuccauuaaauagauacauuaaaaaaauuaaaaacugauucuucugcagagc

SEQ ID NO: 458316 - RNA, 64 nt, hsa
gaaaccccgucucuacuaaaaaaaaaaaauagacaaaaauuagcgggggggugguggcagggcc

SEQ ID NO: 458317 - RNA, 64 nt, hsa
aacaccgugaaaccccgucucuacuaaaaauacaaaaaauuagccgggcgugguggcgggugcc

SEQ ID NO: 458318 - RNA, 64 nt, hsa
acggugaaaccccaucucuacuaaaaaaaaauacaaaaauuagccgggcgugguggcaggcacc

SEQ ID NO: 458319 - RNA, 64 nt, hsa
cauggugaaaccccaucucuacuaaaaaaaaaaaaaaaauuagucgggcgugguggugcaugcc

SEQ ID NO: 458320 - RNA, 64 nt, hsa
caucauaccuagcagguaauaaaauuuaaaaaauaaaaauuaaauauuagaaugugagaaauuu

SEQ ID NO: 458321 - RNA, 64 nt, hsa
ucgguuaacuguaaaguuagggggaagaaagaaaaaaaauuaaaaggguagacacaguugagag

SEQ ID NO: 458322 - RNA, 64 nt, hsa
aacauggugaaaccucgucucuacuaaaaauacaaaaaauuagccagcugugguggcgggcgcc

SEQ ID NO: 458323 - RNA, 64 nt, hsa
ccaguugugaagcuggagaagagaaauggguuuuaaaaauuaagugaggggaggccgggugcgg

SEQ ID NO: 458324 - RNA, 64 nt, hsa
auuucuuucacuuaaguuggaaaaccagccucuaaaaaauuaggugcugguaaugagagcuuaa

SEQ ID NO: 458325 - RNA, 64 nt, hsa
ugauuguacagggagaaauuaagcauucuguuuuaaaaauuaggcuuauugcuagacuguaagu

SEQ ID NO: 458326 - RNA, 64 nt, hsa
ccaaggugauaaaacccgucucuacuaauacaaaaaaaauuagcuggguauguuggugcaggcu

SEQ ID NO: 458327 - RNA, 64 nt, hsa
caacauggcgaaaccccaucucuacuaaaaauacaaaaauuagccgggcgugguggcuuacgcc

SEQ ID NO: 458328 - RNA, 64 nt, hsa
ugaaaacuuaaauuguaaaacauguugaaauuuuaaaaauuaauguuaauauggaaaugcauuu

SEQ ID NO: 458329 - RNA, 64 nt, hsa
gcacaagagaauuagagcuucagugagaauuuagaaaaauuauacuaaagugagaugcauuuuu

SEQ ID NO: 458330 - RNA, 64 nt, hsa
ccccccaccaacccccuucuacugccuacuuuaaaaaaauuaauaguuuucuauggaacugauc

SEQ ID NO: 458331 - RNA, 64 nt, hsa
uuaauaguuuucuauggaacugaucuaagauuagaaaaauuaauuuucuuuaauuucauuauga

SEQ ID NO: 458332 - RNA, 64 nt, hsa
ucauaauugugccaaguuguuucaugcaguccucaaaaauuagauguaauugagcuuuguguaa

SEQ ID NO: 458333 - RNA, 64 nt, hsa
gauaauuauauguauuuuuaaaaacugugagaggaaaaauuagucauaacccuuuuggguuauc

SEQ ID NO: 458334 - RNA, 64 nt, hsa
uucaaguaaucugacagcauuaaauauugcauuuaaaaauuauacuguagcaaauacauuuaaa

SEQ ID NO: 458335 - RNA, 64 nt, hsa
ugcauuuaaaaauuauacuguagcaaauacauuuaaaaauuaaucacaacguuaagaugaaauu

SEQ ID NO: 458336 - RNA, 64 nt, hsa
aagugagaccucccugucucuacaaaaaaaaucaaaaaauuaucugauccuuguggcacacaac

SEQ ID NO: 458337 - RNA, 64 nt, hsa
auagugaaaauuuuauugaauauaauggccucuuaaaaauuaucuuuaaaacuuacuaugguau

SEQ ID NO: 458338 - RNA, 64 nt, hsa
caccuaucuggaaaaaaaaaaauaugagauuggaaaaaauuagacaagucuaguggaaccaacg

SEQ ID NO: 458339 - RNA, 64 nt, hsa
uaagaauucaaauuuguaauaaaacuauuuguauaaaaauuaagcuuuuauuaauuuguugcua

SEQ ID NO: 458340 - RNA, 64 nt, hsa
ugaaacauccguuuucauuguucacuucuaaaccaaaaauuauguguugccaaaaccaaaccca

SEQ ID NO: 458341 - RNA, 64 nt, hsa
uuuccuguggaauaaagaugguccaaaaauagucaaaaauuaaauauauauauauauuaguaau

SEQ ID NO: 458342 - RNA, 64 nt, hsa
auccucuuuagagguaauuuuuguuaacauaaccaaaaauuaaauugaaacaaaaugucccaac

SEQ ID NO: 458343 - RNA, 64 nt, hsa
uauuugucacuuuaaaaaauccauuucuuuuagaaaaaauuagggugauaggauauucauuagu

SEQ ID NO: 458344 - RNA, 64 nt, hsa
aaauugcaauacguaguucuagaauaaaaguacaaaaaauuagaauaagaauucuuuaacauuu

SEQ ID NO: 458345 - RNA, 64 nt, hsa
aacacagugaaaccccgucucuaauaaaaauacgaaaaauuagccaggcgugguggcgggcgcc

SEQ ID NO: 458346 - RNA, 64 nt, hsa
acaaucauuaauggaucauacacaauagguuuuuaaaaauuaauaacuuuuaguaauuacuuuu

SEQ ID NO: 458347 - RNA, 64 nt, hsa
ccaacacggugaaaccccaucucucuaaaaauacaaaaauuagcugggcgugguggcacacgcc

SEQ ID NO: 458348 - RNA, 64 nt, hsa
acuuaguuacuacugaagauaauuuuugaaauguaaaaauuagauuuaaauaguauauuuuaaa

SEQ ID NO: 458349 - RNA, 64 nt, hsa
gaucacugauuucaaagacuugguguauaguguuaaaaauuaaagcuuaaaaggugguuagaaa

SEQ ID NO: 458350 - RNA, 64 nt, hsa
acauggugaagccccaucucuacaaaaaauacaaaaaaauuagccggguaugauggugugugcc

SEQ ID NO: 458351 - RNA, 64 nt, hsa
uuuuguuauuagaaauuuucuuuuauugaaugagaaaaauuagucuaucauuuuaagagccaau

SEQ ID NO: 458352 - RNA, 64 nt, hsa
gacagagagagacuccaucucaaaacaaaacaaaaaaaauuagccuacuuaaaggcacaacuaa

SEQ ID NO: 458353 - RNA, 64 nt, hsa
aaaauggugaaacccugucucuacuaaaaaaaagaaaaauuagccagacgugguggcaugcgcc

SEQ ID NO: 458354 - RNA, 64 nt, hsa
agguaaauccugguaauuaaaaacgcauguuuuuaaaaauuagccugguaaggccgggugcagu

SEQ ID NO: 458355 - RNA, 64 nt, hsa
caguauucccaacucacaggcaagcaacuguuagaaaaauuagaaaauuuaaaauggaaauaac

SEQ ID NO: 458356 - RNA, 64 nt, hsa
gaaaauuuuaugacaucuauuauguaucaguuuuaaaaauuagaauuguaugaaauuaagaguu

SEQ ID NO: 458357 - RNA, 64 nt, hsa
uuaagcuauauguuuagaaauggucauuuuacggaaaaauuagaaaaauucugauaauagugca

SEQ ID NO: 458358 - RNA, 64 nt, hsa
aacaaacaaacaaaaaaaacaauucuucauucagaaaaauuaucuuagggacugauauugguaa

SEQ ID NO: 458359 - RNA, 64 nt, hsa
uagacuuuaaaaaguuagaauuuauucuguaacuaaaaauuauuugaaaaaauuaugccucugg

SEQ ID NO: 458360 - RNA, 64 nt, hsa
guuagaauuuauucuguaacuaaaaauuauuugaaaaaauuaugccucugguuuaauuauuggu

SEQ ID NO: 458361 - RNA, 64 nt, hsa
guuugauuauugugagucaaaacucuaagugguuaaaaauuaguaugaauuuuuuagcuucuua

SEQ ID NO: 458362 - RNA, 64 nt, hsa
caacauggugaaaccccgucucuacuagaaauacaaaaauuagcugggugugggggcgugcgcc

SEQ ID NO: 458363 - RNA, 64 nt, hsa
aauacccacuuuauagauaauuacagggauggugaaaaauuaguaaauagcuucacaaaagagg

SEQ ID NO: 458364 - RNA, 64 nt, hsa
uagcaaaucaguauauuuucuguauuuaauuauaaaaaauuaacuuaguuuuuaaaauuuauuu

SEQ ID NO: 458365 - RNA, 64 nt, hsa
uuguauuuuggaggugcuugaucuaucuacaaagaaaaauuaauuaggaauuacuuuauuauaa

SEQ ID NO: 458366 - RNA, 64 nt, hsa
ucguuauugauaaccagucuguauaguuaagguaaaaaauuaagcuuuucuucuauagucugug

SEQ ID NO: 458367 - RNA, 64 nt, hsa
auggaccagguccucuauaaaaugaagaacuaacaaaaauuagucuucagaaaugaaaaucaga

SEQ ID NO: 458368 - RNA, 64 nt, hsa
ggugacaaagcgagacuccgucucaaaaaaaaaaaaaaauuauauucauauguauugcauugca

SEQ ID NO: 458369 - RNA, 64 nt, hsa
ccacggugaaacccugucucuacuaaaaaauacaaaaaauuagccgggcgugguggcgggcgcc

SEQ ID NO: 458370 - RNA, 64 nt, hsa
aacauggcaaaacgcagucuguacaaaaaauacaaaaaauuagccagguguagggguaggcacc

SEQ ID NO: 458371 - RNA, 64 nt, hsa
ucacaggcugaggggguucagaaccagccuggccaaaaauuacaccagagagacagaguccucc

SEQ ID NO: 458372 - RNA, 64 nt, hsa
caacauggugaaaccccgucucuacaaaaaauacaaaaauuagcugggcaugguggcaugcucc

SEQ ID NO: 458373 - RNA, 64 nt, hsa
uagauagccaugugacguccuggugacuugggggaaaaauuagugaugaaacagccaccaccau

SEQ ID NO: 458374 - RNA, 64 nt, hsa
acacgguaaaacccugucucuacuaaaaauacaaaaaaauuagccaggcaugguggcaagcgcc

SEQ ID NO: 458375 - RNA, 64 nt, hsa
ggccaacacaguaaacccugucuccacaaaauuuaaaaauuagcggccgggcgcaguggcucac

SEQ ID NO: 458376 - RNA, 64 nt, hsa
uuuucuuaguaguauauaaaagguaagaguacugaaaaauuaauaaaauugcaaguuaagaaau

SEQ ID NO: 458377 - RNA, 64 nt, hsa
uuuuuauuugccugaaauauauuuuuuucugugaaaaaauuaaaacguacuuaagccaggagaa

SEQ ID NO: 458378 - RNA, 64 nt, hsa
agccuggacaacuaagugagacuccaucucuacaaaaaauuaaaaaauuagccagguguggagg

SEQ ID NO: 458379 - RNA, 64 nt, hsa
caacuaagugagacuccaucucuacaaaaaauuaaaaaauuagccagguguggaggggcaugcc

SEQ ID NO: 458380 - RNA, 64 nt, hsa
ugacauguugggcugcaugauaaaaguuaauuauaaaaauuaaaagauuuuuuuuuuugagaug

SEQ ID NO: 458381 - RNA, 64 nt, hsa
cugggauuauaggcguaagccaccaugccuggccaaaaauuaaaagauuuuaugaaacgaaaug

SEQ ID NO: 458382 - RNA, 64 nt, hsa
cugggcaacauagcgagaccucgucucuacaaaaaaaaauuaaaaagggggcuuugggaggcca

SEQ ID NO: 458383 - RNA, 64 nt, hsa
caacauggugaaaccccgucucuacuaaaauacaaaaaauuagcugggcaugguggcgcacacc

SEQ ID NO: 458384 - RNA, 64 nt, hsa
caacuuggugaaaucccaucucuacuaaaaauacaaaaauuagcugggugcaguggcgcaugcu

SEQ ID NO: 458385 - RNA, 64 nt, hsa
agcucgacuuuaaaaagcuccaaaugcagcuuuaaaaaauuaaucugggccagaauuucaaacg

SEQ ID NO: 458386 - RNA, 64 nt, hsa
gauguacaguuauggauugaaaguuuacaggaaaaaaaauuaggccguuccuucaaagcaaaug

SEQ ID NO: 458387 - RNA, 64 nt, hsa
aaacauggugaaaccccgucucuauuaaaaauacaaaaauuagcugggcgugguggcgugcacc

SEQ ID NO: 458388 - RNA, 64 nt, hsa
caauauggugaaaccccaucucuacuaaaaauagaaaaauuagccagguguaguggugugcacc

SEQ ID NO: 458389 - RNA, 64 nt, hsa
gcaacauagugaggccccaucuuuacaaaaauacaaaaauuagcuggacguguagucccagcua

SEQ ID NO: 458390 - RNA, 64 nt, hsa
caguauggugaaacccugucucuccuaaaaauacaaaaauuagccgggcaugguggaaugugcc

SEQ ID NO: 458391 - RNA, 64 nt, hsa
aguugggauuuugcaguuggauauuuauuuuaaaaaaaauuauaauauucagacuauucuuaaa

SEQ ID NO: 458392 - RNA, 64 nt, hsa
uguauuaggcuguguauugauaguuaauuccguuaaaaauuacuuggaaaacagugggaagugg

SEQ ID NO: 458393 - RNA, 64 nt, hsa
acacggugaaaccccaucucuacuaaaaauacaaaaaaauuagucggacaugguggcaggcacc

SEQ ID NO: 458394 - RNA, 64 nt, hsa
caacauggugaaaccccaucucuacuaaaaauacaaaaauuagcuaggcgggguagugcaugcc

SEQ ID NO: 458395 - RNA, 64 nt, hsa
caacauggugaaaccccgucucuacuaaagauaaaaaaauuagcugaguguguuggugggugcc

SEQ ID NO: 458396 - RNA, 64 nt, hsa
cacggugaaaccucgucuccacuaaaaauaccaaaaaaauuagcugggcaugguggcacacacc

SEQ ID NO: 458397 - RNA, 64 nt, hsa
ccagcuugggugacagagcaagacuccaucucaaaaaaauuauaaauaacucuuugcaaauagg

SEQ ID NO: 458398 - RNA, 64 nt, hsa
aacauggugaaaccccgucucugcuaaaaauacaaaaaauuagccagaugugguggugcacacc

SEQ ID NO: 458399 - RNA, 64 nt, hsa
ugaacuuuugagagagaugaaaggauggucuccaaaaaauuaaugaugguuauuucuguuuuag

SEQ ID NO: 458400 - RNA, 64 nt, hsa
cagugagaugaaacuuccccuucauggaucuggcaaaaauuaagagaucuuuugcuagcuauug

SEQ ID NO: 458401 - RNA, 64 nt, hsa
uccgucucaaaaaaaaaaaaaaaaaaaaaaauacaaaaauuagccgggcgugguggcccacgcc

SEQ ID NO: 458402 - RNA, 64 nt, hsa
aacaugaugaaaccccaucucuacuaaaaauacaaaaaauuagccgggcgugguagcgggcgcc

SEQ ID NO: 458403 - RNA, 64 nt, hsa
aaguuaauccuuuuuaaaaacuuuauuuaaaaagaaaaauuagcagccaggugcaguggcucac

SEQ ID NO: 458404 - RNA, 64 nt, hsa
ccaaauuaaacuagacuuacuauuuuagugaguuaaaaauuacauacuaaaaguuuauugguag

SEQ ID NO: 458405 - RNA, 64 nt, hsa
aggacagaagcagaccacucugugcaccaaccuaaaaaauuacagagaagagaaaauuaucuuu

SEQ ID NO: 458406 - RNA, 64 nt, hsa
ccacauggugaaacccugucucuacuaaagauauaaaaauuagcuggaugugguggugcacacc

SEQ ID NO: 458407 - RNA, 64 nt, hsa
cacagaauguuuuugguaauauuaauuuccacuaaaaaauuaaaugucuuuuaagaaacauucu

SEQ ID NO: 458408 - RNA, 64 nt, hsa
ugucuuuuaagaaacauucuuuuccacuuguuaaaaaaauuaaauauauuuuaaagcacuuuaa

SEQ ID NO: 458409 - RNA, 64 nt, hsa
acauccuugagauucuuacacaucuaacaacaaaaaaaauuaucuacaucagucauuguuacau

SEQ ID NO: 458410 - RNA, 64 nt, hsa
ggucucugugaaacuccgucucuacuaaaaauacaaaaauuagcuggacguguuggcgggcauc

SEQ ID NO: 458411 - RNA, 64 nt, hsa
gguguuuagcuggcucgaugauguuaacaguauuaaaaauuaaaccccauaaaccaacuaagcc

SEQ ID NO: 458412 - RNA, 64 nt, hsa
cagcauggugaaacccuguaucuacaaaaaauacaaaaauuagccaggcaugguggugggugcc

SEQ ID NO: 458413 - RNA, 64 nt, hsa
uaaaauaucuugauauuuucacaaauuuuaaacaaaaaauuaaauaucuauaaagugaauguuc

SEQ ID NO: 458414 - RNA, 64 nt, hsa
auaugugauauaaauuaaugugugcaaauuguuuaaaaauuagauguguugcaguuuugcaugu

SEQ ID NO: 458415 - RNA, 64 nt, hsa
caacauggugaaaugccgucucuacuaaaaauacaaaaauuagcugggcaugauggcgaguguc

SEQ ID NO: 458416 - RNA, 64 nt, hsa
caucauucuuaucaauguaaaauuuacguuauuaaaaaauuacaaaugauagaaucuuuacuca

SEQ ID NO: 458417 - RNA, 64 nt, hsa
caacauggugaaaccucaucucuacuaaaaauacaaaaauuagccaggcgugguggcaggugcc

SEQ ID NO: 458418 - RNA, 64 nt, hsa
gaacauggcgaaaccccgucucuaauaaaaauacaaaaauuagccgggcaugguggugcaugcc

SEQ ID NO: 458419 - RNA, 64 nt, hsa
aaucccccagcccagcccagccccaccgaaaagcaaaaauuacacgucgucagccacucagccc

SEQ ID NO: 458420 - RNA, 64 nt, hsa
accaacacaagaucaaaaaggaaaaggacgagagaaaaauuauuuuuaagauaauuaaacauaa

SEQ ID NO: 458421 - RNA, 64 nt, hsa
caacaugguaaaaccccaucucuaccaaaaauacaaaaauuagcugggcuugguggcuggcgcc

SEQ ID NO: 458422 - RNA, 64 nt, hsa
uaacauggugaaauccuaucucuaccaaaaauacaaaaauuagccaggcgugguggugggcacc

SEQ ID NO: 458423 - RNA, 64 nt, hsa
aaugaaaugaagugagaagggaaguuuagagaaaaaaaauuaaaaagaaacaaagucuccaaga

SEQ ID NO: 458424 - RNA, 64 nt, hsa
gaaguaaagcacuccucagcaaauguaaaggaacaaaaauuauaacaaacugucucucagacca

SEQ ID NO: 458425 - RNA, 64 nt, hsa
aacucaaggaaauagagacacaaaaaaaccuucaaaaaauuaauguauccaggagcugguuuuu

SEQ ID NO: 458426 - RNA, 64 nt, hsa
agcugaaacuggaucccuuccuuacaccuuauacaaaaauuaauucaagauggauuaaagacuu

SEQ ID NO: 458427 - RNA, 64 nt, hsa
caacauggugaaacccugucucuacuaaaaauacaaaaauuaucugggugugguggcacgugcc

SEQ ID NO: 458428 - RNA, 64 nt, hsa
uuauuuaccacaguguuauuuuuaucgucauaauaaaaauuauauacgaguauaaaugaaauuc

SEQ ID NO: 458429 - RNA, 64 nt, hsa
uucugaguauagaaaauaaaacuaaaguugguagaaaaauuauuuguauauaauguuaagagga

SEQ ID NO: 458430 - RNA, 64 nt, hsa
aauaacuauauucggauuauacuuuguuucuugaaaaaauuacagauuuuuugaaaagcaaaug

SEQ ID NO: 458431 - RNA, 64 nt, hsa
gcaacacggggagacccugucucuacaagaaauuaaaaauuagccaggcauaguuggcacgugc

SEQ ID NO: 458432 - RNA, 64 nt, hsa
aacugaauaagcauuuagcuuuuuaaaucauuuuaaaaauuaagucuaauuuugaagcuuuuuu

SEQ ID NO: 458433 - RNA, 64 nt, hsa
caccauagaucuggagaucuucgccaguaacaagaaaaauuaaguuguaaauauuggaaaggaa

SEQ ID NO: 458434 - RNA, 64 nt, hsa
uaggauauuuacuguggcuugauuuguaguagccaaaaauuagaaacaacugagaaagcccauc

SEQ ID NO: 458435 - RNA, 64 nt, hsa
aacacggugaaaccccgacucuacuaaaaauacaaaaaauuagccgggugugguggcacacacc

SEQ ID NO: 458436 - RNA, 64 nt, hsa
caacauagcaaaagcccuuaucugcaaaaaauucaaaaauuagccaggugugguggugcgugcc

SEQ ID NO: 458437 - RNA, 64 nt, hsa
aacaccuguaugcacacaaacuagaaaaccuagaaaaaauuaauaaauuccuugaaagauauaa

SEQ ID NO: 458438 - RNA, 64 nt, hsa
uucaaaaaaguuucaggauacaaaaucuguguacaaaaauuaguugcauuucuauacaccagua

SEQ ID NO: 458439 - RNA, 64 nt, hsa
gggagcuucuaaugaggacaaacaaaaaauagagaaaaauuaauaaagucaaaauguuuauucu

SEQ ID NO: 458440 - RNA, 64 nt, hsa
uaacagaaaauguagaugagauagaugaaauacgaaaaauuacaguuuacuuaaugaacauaag

SEQ ID NO: 458441 - RNA, 64 nt, hsa
aucaauguaauucaguauuuuaacaaaaggaaugaaaaauuaucaucucaauagacaaagcuuu

SEQ ID NO: 458442 - RNA, 64 nt, hsa
agccauaugguaaauuuuuauuuguuaaauuuuuaaaaauuacuuagcucaaaaugucaguggu

SEQ ID NO: 458443 - RNA, 64 nt, hsa
gccaacauggcaaaacccugucuacuaaaaauacaaaaauuagccaggcaugguggcgugugcc

SEQ ID NO: 458444 - RNA, 64 nt, hsa
uaacauggcaaaauccugucuuuacaaaaaauacaaaaauuagccuagcaugguggcgcauacc

SEQ ID NO: 458445 - RNA, 64 nt, hsa
auauggugaaacccugucucuacuaaaaauacaaaaaaauuagcuaggcaugguggcgggcucc

SEQ ID NO: 458446 - RNA, 64 nt, hsa
cucuagccugggcgacagagcaagacugucucaaaaaaauuaaaauuaaaauuaaaaacaaaua

SEQ ID NO: 458447 - RNA, 64 nt, hsa
aacauggugaaacccugucucuacuaaaaauauaaaaaauuagccaggcgugguggugggcacc

SEQ ID NO: 458448 - RNA, 64 nt, hsa
agagugagaaccaucucuacccaaaaaaaaaauuaaaaauuagccaagcauggugaugauauag

SEQ ID NO: 458449 - RNA, 64 nt, hsa
gggcaacagagugagaaccaucucuacccaaaaaaaaaauuaaaaauuagccaagcauggugau

SEQ ID NO: 458450 - RNA, 64 nt, hsa
uuauaguaagaacauuuaaguuuuguuaaaauuaaaaaauuaguacguuauuuuacuauuugua

SEQ ID NO: 458451 - RNA, 64 nt, hsa
caacaugguaaaacccugucucuacuaaaaauacaaaaauuagcugggcguggcggcacgugcc

SEQ ID NO: 458452 - RNA, 64 nt, hsa
agauuaaaucagaauaguuguucuuuguuaaaaaaaaaauuagauucuuaaaguguggcaaaca

SEQ ID NO: 458453 - RNA, 64 nt, hsa
aguuauugcauucaaaguaugcuuaacuuuuugaaaaaauuagauuuuuugaaaagugaguaau

SEQ ID NO: 458454 - RNA, 64 nt, hsa
aaauuaagucuauauauuaacagaaauauuuuuaaaaaauuagagugaagaaaaaugaugaaca

SEQ ID NO: 458455 - RNA, 64 nt, hsa
uaucccagauugguggggaaaucauggauuacuuaaaaauuaauugacucuucauauggaaaaa

SEQ ID NO: 458456 - RNA, 64 nt, hsa
caucauggugaaaccucaucuccacuaaaaauacaaaaauuagccaggcguggucacaugcgcc

SEQ ID NO: 458457 - RNA, 64 nt, hsa
cucaucaucucaacuucacaaaaagcaagagaguaaaaauuacgugccuccuaaugugcuacag

SEQ ID NO: 458458 - RNA, 64 nt, hsa
aauaagaaauagcuacagugacagauuuuagagcaaaaauuaguaauaaaaauaagaaauaaaa

SEQ ID NO: 458459 - RNA, 64 nt, hsa
caacaugaugaaacccuaucucuacuaaaaauacaaaaauuagccgggcaugguggugcacgcc

SEQ ID NO: 458460 - RNA, 64 nt, hsa
aaaccccaucucuacuaaaaauacaaaaaccaaaaaaaauuagccaggcgcauuggcucauguc

SEQ ID NO: 458461 - RNA, 64 nt, hsa
acacggugaaaccccgucucuacuaaaaauacaaaaaaauuagccgggugcgguggcgggcacc

SEQ ID NO: 458462 - RNA, 64 nt, hsa
caacauggugagaccccaucucuacaaaaaauacaaaaauuagcugagugugguggcacaugcc

SEQ ID NO: 458463 - RNA, 64 nt, hsa
cauuauggcugucacaagcuugugaaaggaaaauaaaaauuacuaagccaaagagaaaagucaa

SEQ ID NO: 458464 - RNA, 64 nt, hsa
aacacggugaaaccccaucucuacuaaaaauacaaaaaauuagccaggcgugguugugggcgcc

SEQ ID NO: 458465 - RNA, 64 nt, hsa
agaaaccccgucucuacuaaaaaaaaaaauuacaaaaaauuagccgggcaugguagcaggugcc

SEQ ID NO: 458466 - RNA, 64 nt, hsa
gcuaacguggagaaaccccgucucuacuaaaaaaaaaaauuacaaaaaauuagccgggcauggu

SEQ ID NO: 458467 - RNA, 64 nt, hsa
acuuauaugaauuugauuuauauuuugcaagaucaaaaauuagauguuaaguaucagauuuuaa

SEQ ID NO: 458468 - RNA, 64 nt, hsa
uaaguaucagauuuuaagcuuguuuuaauggucaaaaaauuaggacagaaauaauauggacauu

SEQ ID NO: 458469 - RNA, 64 nt, hsa
caauauugaaauuaaacuuccaacuucucuaauaaaaaauuaaaacacgcauaacacucgucaa

SEQ ID NO: 458470 - RNA, 64 nt, hsa
uagacuacauaucuuuuggcacuaacaucucaugaaaaauuaugguuaauaaaauaucaccaca

SEQ ID NO: 458471 - RNA, 64 nt, hsa
aggagccaaccucccccuuugcagggcugcauuuaaaaauuagguuugggacaguucuuguacc

SEQ ID NO: 458472 - RNA, 64 nt, hsa
caaaaucccaucucuacaaaacaucaaaaaaaaaaaaaauuagucgggcaugguggugcacacc

SEQ ID NO: 458473 - RNA, 64 nt, hsa
ggauuuuuacaaguugguaaacacagccauuauaaaaaauuaaaugauuuaaauuuauaauuaa

SEQ ID NO: 458474 - RNA, 64 nt, hsa
uaaauuuauaauuaaguaaauuacauuaaaacaaaaaaauuauacucaaaauucauuacuuaau

SEQ ID NO: 458475 - RNA, 64 nt, hsa
acauacccuuuaucucuguaaaauuuauacacacaaaaauuaacaaaagauucuguaagaauua

SEQ ID NO: 458476 - RNA, 64 nt, hsa
auuuuuuuaaaacucucaggacugaacagaagagaaaaauuauuaauuagcugcuacuguaugu

SEQ ID NO: 458477 - RNA, 64 nt, hsa
guguaaguauugugaaaacccuuuucuuccagggaaaaauuauuggaaauuccuuaacugagcu

SEQ ID NO: 458478 - RNA, 64 nt, hsa
aacucgaacuuuucauaacucaggggauucccugaaaaauuaccugcagguggaauauuucaug

SEQ ID NO: 458479 - RNA, 64 nt, hsa
ugcuuguggauuuauaguaguucagucauaaaaaaaaaauuauaauaggcugauuuucuuuuuu

SEQ ID NO: 458480 - RNA, 64 nt, hsa
gagaggcauuuaauucuaauaaaccagcuguuauaaaaauuauaaaaugaucucuguuuuuccu

SEQ ID NO: 458481 - RNA, 64 nt, hsa
gguuuguuuugguuuguuauggcuuccuuuuuuaaaaaauuacccuguagugccaguuuauuau

SEQ ID NO: 458482 - RNA, 64 nt, hsa
uauaaacauaugaaggcauaaagauauacagaagaaaaauuauuaaacaacucauuuuaagauu

SEQ ID NO: 458483 - RNA, 64 nt, hsa
aaaaaauaaacaaaauaaacugcucacuuauuugaaaaauuaaggaaggauuucaggcauggcu

SEQ ID NO: 458484 - RNA, 64 nt, hsa
caacaaggcgaaacccugucucuaccaaaaauacaaaaauuagccaggcaggguggcaugugcc

SEQ ID NO: 458485 - RNA, 64 nt, hsa
caacguggugaaaccccaucucuacuaaaaauacaaaaauuagccgggugugguggcgcgcgcc

SEQ ID NO: 458486 - RNA, 64 nt, hsa
ggacuuaaaguacuuauucauauaccuuguaacuaaaaauuagaacagcucccuagaauuguga

SEQ ID NO: 458487 - RNA, 64 nt, hsa
auuuaugaauaacaaucugaagucuuuucauaaaaaaaauuaauaaacuuuaguuguacauuua

SEQ ID NO: 458488 - RNA, 64 nt, hsa
auuuuccuuaauagaggaaugcuucauauuauucaaaaauuauauccugaucaccuuuuuuugu

SEQ ID NO: 458489 - RNA, 64 nt, hsa
cuaacagugaaacccugucuccacuaaaaauacaaaaaauuagccgggcgugguggcgggcgcc

SEQ ID NO: 458490 - RNA, 64 nt, hsa
aauacagugaaaccccaugucugcuaaaauuacaaaaaauuagcugggcgugguggugcacgcc

SEQ ID NO: 458491 - RNA, 64 nt, hsa
uucaauuuaaaguugauuucuuaaugaugacuucaaaaauuaauaaaaagaaaagaaaaaaaug

SEQ ID NO: 458492 - RNA, 64 nt, hsa
cacggugaaaccccgucuuuacuaaaaauacaaaaaaaauuagcugggcgugguggcggaugcc

SEQ ID NO: 458493 - RNA, 64 nt, hsa
acacuagagacaccuuguaguauuuugggagcaaaaaaauuauuuucucuuaacaagacuuuuu

SEQ ID NO: 458494 - RNA, 64 nt, hsa
auuuuuuucguuauuuuuacaucuaacaaaguaaaaaaauuaaaaagaggguaagaaacgauuc

SEQ ID NO: 458495 - RNA, 64 nt, hsa
caacauggugaaacccugucucuacuaaaaauacaaaaauuagccgggugugguggcacaugcc

SEQ ID NO: 458496 - RNA, 64 nt, hsa
aaaagugaaaguuaggguuaggacauccuuuuuuaaaaauuacaaauuuaguccguuuugguuu

SEQ ID NO: 458497 - RNA, 64 nt, hsa
caacauagcaagacccugucuguacacaaaauuuaaaaauuaguucaucgggguggcacacauc

SEQ ID NO: 458498 - RNA, 64 nt, hsa
aauauagugaaacuccugucccuacaaaaaauacaaaaauuagccgggugugguagugcaugcc

SEQ ID NO: 458499 - RNA, 64 nt, hsa
ucuagacucgaaugcuuucauacaagugauuuucaaaaauuagucaauaaaaauugaugucagu

SEQ ID NO: 458500 - RNA, 64 nt, hsa
gaaguagaaacaaaauacaauuuuuuugguaaaaaaaaauuacuguuuauuaaaguacaaccau

SEQ ID NO: 458501 - RNA, 64 nt, hsa
ggugccuuuauuuccacugugcagguucccacuuaaaaauuaaauuggaaagcagguuucaagg

SEQ ID NO: 458502 - RNA, 64 nt, hsa
ucaacuuuggccaaauacaaaugcgaaauuagaaaaaaauuauaauaucugcuauuuuuaaaag

SEQ ID NO: 458503 - RNA, 64 nt, hsa
acccugucucuaaagaaaaacuauagaaaauuuaaaaaauuaaaaaacggguaacaugguaaau

SEQ ID NO: 458504 - RNA, 64 nt, hsa
uuugaugcauuauaacuuaaagguacuacaaauuaaaaauuaaaguauaaaguauuuuaaguua

SEQ ID NO: 458505 - RNA, 64 nt, hsa
caguauagugagaucuuuucucuacaaaaaauuuaaaaauuagccaagugugguggugugcacc

SEQ ID NO: 458506 - RNA, 64 nt, hsa
uaacuugauaauucuucaucuaccuuaaaaagaaaaaaauuacacauagucauucuugauguua

SEQ ID NO: 458507 - RNA, 64 nt, hsa
uggcacuuucugccuccuugcucuaaaugucacaaaaaauuauacuuccuuaaaguaaauguaa

SEQ ID NO: 458508 - RNA, 64 nt, hsa
auugguucuggcaaguuuggccagacugacuucaaaaaauuaauguguauccagggacauuuua

SEQ ID NO: 458509 - RNA, 64 nt, hsa
caacauggugaaaccccaucuguacuaaacauaaaaaaauuagccuggcauggugguguacgcc

SEQ ID NO: 458510 - RNA, 64 nt, hsa
caacauggugaaaccccaccucuacaaaaaauacaaaaauuagccgggcgugguggcaggcacc

SEQ ID NO: 458511 - RNA, 64 nt, hsa
guggaagacagugagacuccgucucaaaaaaaugaaaaauuagccaggcagguuggcgggggcc

SEQ ID NO: 458512 - RNA, 64 nt, hsa
accuguguuuuaacuaauauugugucaguguauuaaaaauuagcuuuuacauaugauaucuaca

SEQ ID NO: 458513 - RNA, 64 nt, hsa
aaucugcucagaaaaauguaugugcacaaauaaaaaaaauuaauggcaauuguuuagugauugu

SEQ ID NO: 458514 - RNA, 64 nt, hsa
uuauccaugagcaccaggcuuugcucacuuaaaaaaaaauuaagccacauuaaggagugagucu

SEQ ID NO: 458515 - RNA, 64 nt, hsa
auuaaggagugagucuucuuuuuuacaauaauguaaaaauuaaacuguuuacauuuuuuuaaag

SEQ ID NO: 458516 - RNA, 64 nt, hsa
acuguuuacauuuuuuuaaagcauuguaguuuuuaaaaauuaagcuguuuuguuuuguguuguu

SEQ ID NO: 458517 - RNA, 64 nt, hsa
uuacuacagaggaaaguuugagaguaaaacuguaaaaaauuauauuuuuguuguacuuucuaag

SEQ ID NO: 458518 - RNA, 64 nt, hsa
cggcuaaaacauugcaaauuuaaaugagaguuuuaaaaauuaaauaaugacugcccuguuucug

SEQ ID NO: 458519 - RNA, 64 nt, hsa
aagacucugaacacccaagguuggugucacauauaaaaauuaagcugaugacuuugcagugacu

SEQ ID NO: 458520 - RNA, 64 nt, hsa
ucaauucagcacccccaaauuuaauucuguggggaaaaauuauugagccaguugucaguguucu

SEQ ID NO: 458521 - RNA, 64 nt, hsa
caacauggcaaaacccccaucucuacuaaaauacaaaaauuaggugugguggcgggcaccugua

SEQ ID NO: 458522 - RNA, 64 nt, hsa
uaaaucauaguaauaauauugaacauucuacuuuaaaaauuauuaauaaaaccauaaaugaaac

SEQ ID NO: 458523 - RNA, 64 nt, hsa
aaacguggugagaccucaucucuacaaaauacaaaaaaauuagccgggcaugguggcacgugag

SEQ ID NO: 458524 - RNA, 64 nt, hsa
uuuugugaugcagcuaccaugauucaaaaaaauuaaaaauuaaaaaaaaaaaaucugccacuua

SEQ ID NO: 458525 - RNA, 64 nt, hsa
uuggagcuuuugugaugcagcuaccaugauucaaaaaaauuaaaaauuaaaaaaaaaaaaucug

SEQ ID NO: 458526 - RNA, 64 nt, hsa
aaacauagugagacccuuucucuacaaaaaguuaaaaaauuaucugagcaugguggugugcacc

SEQ ID NO: 458527 - RNA, 64 nt, hsa
cuaccauguugccucccaucuucugaaaaaacaaaaaaauuauaggcaugagccacugcacccg

SEQ ID NO: 458528 - RNA, 64 nt, hsa
uagcaugcugcuuuuuguacuuggaaguguuucaaaaaauuauaugaccauauuuacucuuucu

SEQ ID NO: 458529 - RNA, 64 nt, hsa
aaagucuauuuuauuaugagcuuucuuugcacuuaaaaauuagcaugcugcuuuuuguacuugg

SEQ ID NO: 458530 - RNA, 64 nt, hsa
caacauggugaaaccccaucucuacuaaaaauacaaaaauuagcugggcguaguggcgcgugcc

SEQ ID NO: 458531 - RNA, 64 nt, hsa
ccaacauagcaaaaccucaucucuacuaaaauacaaaaauuagccgggcgugguggugcgugcc

SEQ ID NO: 458532 - RNA, 64 nt, hsa
auuacuguuaacagauuuuccuccguauucuucuaaaaauuauaccccaugggcuugccaggua

SEQ ID NO: 458533 - RNA, 64 nt, hsa
cuaaccuugugauccgcccuccuuagcccccccaaaaaauuacaauaauuuugucaaccaauac

SEQ ID NO: 458534 - RNA, 64 nt, hsa
aucugcagcuggauacucuucuuuaaaaauguuuaaaaauuauuuagauugauucuccccaaau

SEQ ID NO: 458535 - RNA, 64 nt, hsa; identical to SEQ ID NO: 458512

SEQ ID NO: 458536 - RNA, 64 nt, hsa
aaucugcucagaaaaauguaugugcacaaauaaaaaaaauuaauggcaauuguuuagugacugu

SEQ ID NO: 458537 - RNA, 64 nt, hsa
gaaacccugucuguauggaauuuacacaaauuauaaaaauuagucgggugucauugugcauacc

SEQ ID NO: 458538 - RNA, 64 nt, hsa
aucauaguaauaauauuauugaacauucuacuuuaaaaauuauuaauaaaaccauaaaugaaac

SEQ ID NO: 458539 - RNA, 64 nt, hsa
aacaugaugaaacccuugucucuauuaaaaacacaaaaauuagccagaugugguggcacaugcc

SEQ ID NO: 458540 - RNA, 62 nt, hsa
uccuuccuuccuaaucucuaauccccugaagccuaacacaguuccuaauguguuuugccuua

SEQ ID NO: 458541 - RNA, 62 nt, hsa
cugugguuuacuccugucuaaaccccugaagccuaacacaguuccuggcacacaacaggugu

SEQ ID NO: 458542 - RNA, 62 nt, hsa
gccuuguuggagggggccaggcucuagaacgucuaacacaguggagaaccgaaacccccccc

SEQ ID NO: 458543 - RNA, 62 nt, hsa
ccucccccagucucucuucucaaucccccuuucuaacacacacacacacacacacacacaca

SEQ ID NO: 458544 - RNA, 64 nt, hsa
auagcacuuuucaauucucucuaaagaaauacuuauguacuacuaucacauguuguaaauuuuc

SEQ ID NO: 458545 - RNA, 64 nt, hsa
acauuaaaagaguacaauaaaaauguuuaaaaucauguacuaauaaauucauuguauguuagaa

SEQ ID NO: 458546 - RNA, 64 nt, hsa
ucuuuuagaccaguuuucuaauaagcuuuguaaaauguacuauccaaauuagaagcggauuugg

SEQ ID NO: 458547 - RNA, 64 nt, hsa
ggguggaggcugggcugaggauuaccauaaugaaauguacuaaaucuucauuuagguaugcaau

SEQ ID NO: 458548 - RNA, 64 nt, hsa
cuuaaacagaaauaaauauuuggaaugaaggggaauguacuagaacacccuuuuugccacgggu

SEQ ID NO: 458549 - RNA, 64 nt, hsa
cuaccucuuuuguuuuguuuuguuuuugcccuuuauguacuacauucuuauuuucuaacuuuua

SEQ ID NO: 458550 - RNA, 64 nt, hsa
guuuuauacggccugccuauaacguugaaaauccauguacuacauaauaauucagaagggcucu

SEQ ID NO: 458551 - RNA, 64 nt, hsa
ggagagguagagugaaaaucccagccauggaugaauguacuaauuugaaagccaaguguuaagu

SEQ ID NO: 458552 - RNA, 64 nt, hsa
aucaguuuuuuguuuuacaaugucauauacugccauguacuaguuuuaguuuucucuuagaaca

SEQ ID NO: 458553 - RNA, 64 nt, hsa
aauuuguucaaguuuuggguauguuuaaucuguuauguacuaguguucuguuuguuauuguuuu

SEQ ID NO: 458554 - RNA, 64 nt, hsa
uuuugaaaauguggguguacuauguacuauguggauguacuaccuuuucaaaaauaaaacauuu

SEQ ID NO: 458555 - RNA, 64 nt, hsa
auccuuucauagcuuuugaaaauguggguguacuauguacuauguggauguacuaccuuuucaa

SEQ ID NO: 458556 - RNA, 64 nt, hsa; identical to SEQ ID NO: 79909

SEQ ID NO: 458557 - RNA, 64 nt, hsa; identical to SEQ ID NO: 79910

SEQ ID NO: 458558 - RNA, 64 nt, hsa; identical to SEQ ID NO: 79911

SEQ ID NO: 458559 - RNA, 64 nt, hsa; identical to SEQ ID NO: 79912

SEQ ID NO: 458560 - RNA, 64 nt, hsa; identical to SEQ ID NO: 79913

SEQ ID NO: 458561 - RNA, 64 nt, hsa; identical to SEQ ID NO: 79914

SEQ ID NO: 458562 - RNA, 64 nt, hsa; identical to SEQ ID NO: 79915

SEQ ID NO: 458563 - RNA, 64 nt, hsa; identical to SEQ ID NO: 79916

SEQ ID NO: 458564 - RNA, 64 nt, hsa; identical to SEQ ID NO: 79917

SEQ ID NO: 458565 - RNA, 64 nt, hsa; identical to SEQ ID NO: 79918

SEQ ID NO: 458566 - RNA, 64 nt, hsa
aucugcaccaguacacaggcaggcauuaucauucuucaccuacuuuuuaaauaguggcaacuug

SEQ ID NO: 458567 - RNA, 64 nt, hsa
uugagaaauauuuuucuuucaaauucugguuccuuucaccuauguaaccgcaucccucaggcau

SEQ ID NO: 458568 - RNA, 64 nt, hsa
uuuauuaaaacuuguguggcacuuuaacauugcuuucaccuauauuuuguguacuuuguuacuu

SEQ ID NO: 458569 - RNA, 64 nt, hsa
aaggcagggccuuuccaguccucacaaccuguccuucaccuagucccuccugacccagggaugg

SEQ ID NO: 458570 - RNA, 64 nt, hsa
ugacacaaaaaaaguugaaggccuuauucuacauuucaccuacuuuguaagugagagagacaag

SEQ ID NO: 458571 - RNA, 64 nt, hsa
cucucagaagcgcuaccgggccgccagugccuucuucaccuacgugucgcugagccaggaaggc

SEQ ID NO: 458572 - RNA, 64 nt, hsa
gagccccacccaaggggacccuggucucuccgccuucaccuagcaaugggaacccugcuuccca

SEQ ID NO: 458573 - RNA, 64 nt, hsa
aacagaugcuauagaacucuuuuaauauguuuaauucaccuaucacacucuguuaaaaacacau

SEQ ID NO: 458574 - RNA, 64 nt, hsa
ugcuuggcucuuuaaacacaucagugcuuccacauucaccuauguauuuauuauucaaaagugu

SEQ ID NO: 458575 - RNA, 64 nt, hsa
ccaaaauaagacuuagaacuguacagguuggcccuucaccuaguugacucagcccucgauaguc

SEQ ID NO: 458576 - RNA, 64 nt, hsa
uuugugguuuaguuuauuuacucacuucauguuuuucaccuauaaaauugucaagcuagcaaaa

SEQ ID NO: 458577 - RNA, 64 nt, hsa
aagaauuguuccuuggggaaaaauuuuuuuaaaauucaccuagaaucauagggccucauuuugu

SEQ ID NO: 458578 - RNA, 64 nt, hsa
gcgauaucacuuuaacuuucugaaccucagagucuucaccuauaagacggggaaaauaauacca

SEQ ID NO: 458579 - RNA, 64 nt, hsa
ucaggggcaauuuggcacucagauucuacucuacuucaccuaaccaccccuagaucugaguuuu

SEQ ID NO: 458580 - RNA, 64 nt, hsa
caugaaggaaagagauuuugccucucuuuuacuuuucaccuaaguuucucugagaaauagagac

SEQ ID NO: 458581 - RNA, 64 nt, hsa
gagaaaacuccacuggggcuugcagaauccaggguucaccuaagcugcacaguuccugcagcuu

SEQ ID NO: 458582 - RNA, 64 nt, hsa
gucuucuagagccuuugauccagcaauaccccacuucaccuacaauauuguuaacuauuuguua

SEQ ID NO: 458583 - RNA, 64 nt, hsa
ugauugaaacucacugcaaaaucaccacgacucuuucaccuacugagaugauugaccgagguuu

SEQ ID NO: 458584 - RNA, 64 nt, hsa
auuauacacauuauuggaccauaaggacauuuguuucaccuagauuuuaagauuauggagacug

SEQ ID NO: 458585 - RNA, 64 nt, hsa
cugccuccuagaauauagacugucuguauuauuauucaccuauaauuagucauuaugaugcuuu

SEQ ID NO: 458586 - RNA, 64 nt, hsa
ucuuugcacuuacacacacucuuccuguucugccuucaccuaugccgggauaagcagagaucuc

SEQ ID NO: 458587 - RNA, 64 nt, hsa
gaaagcugugugacugccugagagaaccuguuucuucaccuaaaaaaugggacuuuuugucuca

SEQ ID NO: 458588 - RNA, 64 nt, hsa
uuauuaaguuuccaaauuuaauuugaauuccaaauucaccuagcaauaaaaucuaauuuuuaaa

SEQ ID NO: 458589 - RNA, 64 nt, hsa
cucucugcguccuauuucauuagugaagacauaguucaccuaaaauggcauccugcucugaauc

SEQ ID NO: 458590 - RNA, 64 nt, hsa
uuuaguucuagaaucaccuguugacuccucagacuucaccuaacuuuggaaacucucuuuugga

SEQ ID NO: 458591 - RNA, 64 nt, hsa
ucauguuuucaauaugcaguuuugaaaaugaggauucaccuagacuuuuuuagauuuacuacua

SEQ ID NO: 458592 - RNA, 64 nt, hsa
caacuauuuuuugacccucugaaaauuauuauacuucaccuaaauggaagacugcuguguuugu

SEQ ID NO: 458593 - RNA, 64 nt, hsa
uguuaaaaaagaacugcaaagagacggacuccuguucaccuaggugaggugugugcagcaguug

SEQ ID NO: 458594 - RNA, 64 nt, hsa
uaauacuccauugucuagaugaauaguuuauccauucaccuauugaaagacuucuuggugguuu

SEQ ID NO: 458595 - RNA, 64 nt, hsa
aguuuuccuaaauguauaccuguaacugcagcaguucaccuauuucaaaaauuuggaauucugu

SEQ ID NO: 458596 - RNA, 64 nt, hsa
aucaugcuuugaaaaaucacuugauucauaaagauucaccuaagagauucugauuugccacuga

SEQ ID NO: 458597 - RNA, 64 nt, hsa
caagaauucuuauuucuauaauaaauuaacaagauucaccuaaccuuugaaaauaaaguaguau

SEQ ID NO: 458598 - RNA, 64 nt, hsa
gagugaagacacuuggcagacuugagccagacacuucaccuaguaguuccugaaacugugagca

SEQ ID NO: 458599 - RNA, 64 nt, hsa
cuucaggcccuuacacaaaagccaugaagagauguucaccuacccgguauuuuaaauguucugu

SEQ ID NO: 458600 - RNA, 64 nt, hsa
uuuuguuacucugagagcuguucacuucucugaauucaccuagagugguuggaccaucagaugu

SEQ ID NO: 458601 - RNA, 64 nt, hsa
ggccagcucuaugcaaagggaaaagcauguugcauucaccuaggccaagaaacaguguuguagg

SEQ ID NO: 458602 - RNA, 64 nt, hsa
uguacaguauauuacucuugacaguuugaauuucuucaccuaaagauaauucucugaaaguacu

SEQ ID NO: 458603 - RNA, 64 nt, hsa
ugcaaaaacauaauauauuucuguuaaacaguucuucaccuaacagcauauugcucuuauaacu

SEQ ID NO: 458604 - RNA, 64 nt, hsa
caguguuuuucuaagacuaaauaaauagcaaacuuucaccuauucaugaguuauuauugaaacc

SEQ ID NO: 458605 - RNA, 64 nt, hsa
gaugcagucaccuggaaagaacagagauuacccuuucaccuaccucagcaaaacaaacuuucaa

SEQ ID NO: 458606 - RNA, 64 nt, hsa
ggauauuauauguuucugggagaagagaaaauacuucaccuauugggaugccaauauuucuguu

SEQ ID NO: 458607 - RNA, 64 nt, hsa
caugaggcaagggaaggaaaagcagagcuuauuuuucaccuaagguggagaaggaucacuuuac

SEQ ID NO: 458608 - RNA, 64 nt, hsa
guagagaaaauaaauguuauauacccuauaaucuuucaccuaauuaguauuuaauuauauggau

SEQ ID NO: 458609 - RNA, 64 nt, hsa
aaaauugaucuuaauaacucucccuucauaucuuuucaccuauuuccaguccuuaucauaguug

SEQ ID NO: 458610 - RNA, 64 nt, hsa
gcccggccuuuuuaacuuuaaacauguuuuagaauucaccuaaagaucaaaauaucauggauug

SEQ ID NO: 458611 - RNA, 64 nt, hsa
ucauccagccggaaguuaaagcacacuuacuuuauucaccuauuuuuauaauaaacguucuugc

SEQ ID NO: 458612 - RNA, 64 nt, hsa
cuggcacauuuauuucuucuuuuguugaaauuuauucaccuagauaaaggcagcaguuugggac

SEQ ID NO: 458613 - RNA, 64 nt, hsa
cugaguuauaaggccacaggaguggauagcuguuuucaccuaaaggaaaagcccacccgaaucu

SEQ ID NO: 458614 - RNA, 64 nt, hsa
uguucggagcucuucugugcccuggcuccaugcuuucaccuacacaagcaucaccuuccuaauc

SEQ ID NO: 458615 - RNA, 64 nt, hsa
acauccugcuacacucauccgcaggucaccuuaguucaccuacccugagugaacacccccagcu

SEQ ID NO: 458616 - RNA, 64 nt, hsa
uguaagugauaugucagaagagcuucuuacugauuucaccuaaaaugagaaggaaguccuguuu

SEQ ID NO: 458617 - RNA, 64 nt, hsa
ugguuuuccauguaauauuuugaauuauagcaucuucaccuagaagaucucaauugucuuaguc

SEQ ID NO: 458618 - RNA, 64 nt, hsa
ugggcaguauguaguuauuuauuacaaaauuauauucaccuaaaugccaaccaucuacaaaaac

SEQ ID NO: 458619 - RNA, 64 nt, hsa
acugaccaucagcucugaacuguggcuuuuuuuguucaccuaugaugccauguaccaaauucag

SEQ ID NO: 458620 - RNA, 64 nt, hsa
acagaauuuacuuuaaaugucacguaaaaacaaauucaccuaagauagucuugcuuauuuuguu

SEQ ID NO: 458621 - RNA, 64 nt, hsa
caauugaccuaugacaaacugugaaccugcagauuucaccuauuuugauuuacuauaagagcug

SEQ ID NO: 458622 - RNA, 64 nt, hsa
auuuuaaaauguucauguucuguucuauauuuucuucaccuacucuccaaauauuguaaugcaa

SEQ ID NO: 458623 - RNA, 64 nt, hsa
uguguguacaacacuggugacuccaggaaccauuuucaccuauuaccaguguucccuggggacu

SEQ ID NO: 458624 - RNA, 64 nt, hsa
ggucgagaugcaauaacacuucguaagcaacgaguucaccuaaguaaggcucagauccuaguuu

SEQ ID NO: 458625 - RNA, 64 nt, hsa
guaggguacccugcguccucgaaaagccagaggguucaccuagucagacgaaacuccagaacag

SEQ ID NO: 458626 - RNA, 64 nt, hsa
ccauaauuuauaaucauuauuuuuuacuuuuggguucaccuagaucauaugaguugaugugaua

SEQ ID NO: 458627 - RNA, 64 nt, hsa
ucucaccacagacgucuuugcuaauuuggccaccuucaccuacugacaugaccaggauuuuccu

SEQ ID NO: 458628 - RNA, 64 nt, hsa
ucuuuaauacuaagagauggguaccuuaguacccuucaccuaacaucucucgguaaaaagcaga

SEQ ID NO: 458629 - RNA, 62 nt, hsa
caaggcuaauaucaauaguuuauaagcaguauauuucaccuacacuaaauaugggcauuuua

SEQ ID NO: 458630 - RNA, 64 nt, hsa
acuuaggcuaaguuaauuuggauuuguuacuugauucaccuacugaccuuuucuuuuguuugaa

SEQ ID NO: 458631 - RNA, 64 nt, hsa
aaaccucaugcuuuuaggcauaucuauguugaauuucaccuagggaauguucuguucuuaguua

SEQ ID NO: 458632 - RNA, 64 nt, hsa
aucuugauuagauccaaagucaaagcaaccauacuucaccuagagaagacaguauuggcaauca

SEQ ID NO: 458633 - RNA, 64 nt, hsa
aguccauuuccccuuccuauuucagcuguuccuuuucaccuaacuguucagucauucugguuuu

SEQ ID NO: 458634 - RNA, 64 nt, hsa
aguaaauaugauuuagggguuuugugggaucuuuuucaccuaagaguuuccuagcucugucaca

SEQ ID NO: 458635 - RNA, 64 nt, hsa
ucaaccugcuggcgggcugucuauggauugggguuucaccuaaucaugcuguguuuccuuucuu

SEQ ID NO: 458636 - RNA, 64 nt, hsa
guuuugcaggccaccuagaaauacaaaaugccaauucaccuaauuuuuauacugaaauguagau

SEQ ID NO: 458637 - RNA, 56 nt, hsa
cuacagcaggagaaaguugaagguucuucaccuaccaacgaggggagagagcugug

SEQ ID NO: 458638 - RNA, 64 nt, hsa
acaaaugaaaaaggcaauugaaaaucccagcuauuucaccuagauggaauagccacccugagca

SEQ ID NO: 458639 - RNA, 64 nt, hsa
uccauaugauauucaacauuuuacaacugcaguauucaccuaaaguagaaauaaucuguuacuu

SEQ ID NO: 458640 - RNA, 64 nt, hsa
ggcugacuguacaaaugacuccuggaaaaaacucuucaccuagucuagaauagggagguggaga

SEQ ID NO: 458641 - RNA, 64 nt, hsa
gcuugcugcaggcggcccagccguguauuuauuuuucaccuaucuccuuccugucaaggcaggc

SEQ ID NO: 458642 - RNA, 64 nt, hsa
uaccuuucuaaaauaugaaauuuuguaagauguuuucaccuaaauaaaaauugaaagcaagugg

SEQ ID NO: 458643 - RNA, 64 nt, hsa
ccccaggugacuuacuaaaaauaguugaaaauuauucaccuaagaauagaaucucagcauugug

SEQ ID NO: 458644 - RNA, 64 nt, hsa
ggauuugggcaacauucugcagucuuugcaauaguucaccuauaauccuauuuuaaaucucaga

SEQ ID NO: 458645 - RNA, 64 nt, hsa
guguauugugcuuagaaagguugcagauuucaucuucaccuaccaagaggcggccgccuccuug

SEQ ID NO: 458646 - RNA, 64 nt, hsa
cuauguaaacuacuucucuuguuagguaauuuuuuucaccuagauuuuuuucccaauugagaaa

SEQ ID NO: 458647 - RNA, 64 nt, hsa
acuccaaagccugcguucucaucccagucugauauucaccuaaguuuccggacccuuuuccuua

SEQ ID NO: 458648 - RNA, 64 nt, hsa
cuuauuuugaagaaaauccuagacaucaaaucauuucaccuauaaaaaugucaucauauauaau

SEQ ID NO: 458649 - RNA, 64 nt, hsa
cuugaucaccacaacucaauuauuucggcaucuuuucaccuaugcugugauuuguuuuuuuuuu

SEQ ID NO: 458650 - RNA, 64 nt, hsa
cuuaaagaacgagagcaucuuguucauugccuuuuucaccuaagcauagggggaaaaacucuca

SEQ ID NO: 458651 - RNA, 64 nt, hsa
uguggacccacauacuuacugccuuuuguggaaauucaccuagagugaguacuuuccuugugca

SEQ ID NO: 458652 - RNA, 64 nt, hsa
caauuucaaaaaaauaaaauaaaauaaaaauaaauucaccuagucuaaggaugcuaaaccuuag

SEQ ID NO: 458653 - RNA, 55 nt, hsa
aacagacuggugaaaaguaaaccuuuucaccuacaaaauuucaccugcaaaccuu

SEQ ID NO: 458654 - RNA, 64 nt, hsa
aauucgcugaaaaaggaacuaccuauccuuacauuucaccuacuaaugucucuucuaacaucuu

SEQ ID NO: 458655 - RNA, 64 nt, hsa
ugggaaaacuuuaauauccguaccugaaggcugauucaccuaaaaauguguuaacugaaagaaa

SEQ ID NO: 458656 - RNA, 64 nt, hsa
ugaccuguguguguguguguggggggguggggccuucaccuaagaccucugcagcagaccugga

SEQ ID NO: 458657 - RNA, 64 nt, hsa
agguuuaagauagcuccuuucuggaccucaguccuucaccuagucaccuagucacaggguggau

SEQ ID NO: 458658 - RNA, 64 nt, hsa
gacauuuguaacauuuccucuuugagacucugaguucaccuagagaagucuaagcauaacagcu

SEQ ID NO: 458659 - RNA, 64 nt, hsa
ugucacuguuaacacuuuucacucuuucuguugauucaccuaacucauuauuuugcuuuauuaa

SEQ ID NO: 458660 - RNA, 62 nt, hsa
auuauuuaagcauaaaauaaauuguguuaaacucuucaccuaucugugcucuacagucuccu

SEQ ID NO: 458661 - RNA, 64 nt, hsa
ucugauauuuuugagccauucuauuguguucuacuucaccuaaaaaaauaaaauaaaaauguug

SEQ ID NO: 458662 - RNA, 64 nt, hsa
aauacuuggaccucagccaaccucucgaacaguauucaccuaguuacccugacacaagaaguuc

SEQ ID NO: 458663 - RNA, 63 nt, hsa
uaugcccaccaagcucuugaauuuucucauuucuucaccuacaacccuuugucuugacuuauc

SEQ ID NO: 458664 - RNA, 64 nt, hsa
gaaaacagccacuccuauucugagucuugguuucuucaccuagaaagugaggguuuggacuaga

SEQ ID NO: 458665 - RNA, 64 nt, hsa
cccuguaguuugaaagugaaguaaagauuuagaauucaccuaaguccaaaggaaaacacguggu

SEQ ID NO: 458666 - RNA, 64 nt, hsa
aaagaaaagaucacauuuguauauucaacaaucuuucaccuauuucauaagucauuuuuucacc

SEQ ID NO: 458667 - RNA, 64 nt, hsa
aaguuaauaauccuauauaauaauugcuuuggcuuucaccuaaaauucugggcaucacaauuuc

SEQ ID NO: 458668 - RNA, 64 nt, hsa
gcugcccccuccccccaggugggucccccugcuuuucaccuaucuacuccugagcuuccccaac

SEQ ID NO: 458669 - RNA, 64 nt, hsa
aaauuuaaaaccaaaaacuauucuguuguuuuucuucaccuacuagccuuaguuuuuaaccaag

SEQ ID NO: 458670 - RNA, 64 nt, hsa
agcaucgagggcgaggggaauaugaaaguuggucuucaccuaauuaccuguuugguuuggauuu

SEQ ID NO: 458671 - RNA, 64 nt, hsa
auucaugucucuacccacuaugcacagauuaaacuucaccuacaaacuccuuaauaugaucugu

SEQ ID NO: 458672 - RNA, 64 nt, hsa
ccuggagaagcuggguuauacccaggacaugauuuucaccuacuaacaccuccacgugcucagc

SEQ ID NO: 458673 - RNA, 64 nt, hsa
gguuuccccaucuguaaaaugaugguaauaauacuucaccuaccucauaggggagguugugagg

SEQ ID NO: 458674 - RNA, 64 nt, hsa
acaauaugggcacuuuaaaugaagcuaauaauucuucaccuaagucucugugaauugaaauguu

SEQ ID NO: 458675 - RNA, 64 nt, hsa
gggacuucuuugggcagaugcuaggucaguuguuuucaccuaauauccucuuuuagcugcaugu

SEQ ID NO: 458676 - RNA, 64 nt, hsa
gugaaacaauguguuuuaaaauugaugaaauucguucaccuacauuugagaauuauaaaauuaa

SEQ ID NO: 458677 - RNA, 64 nt, hsa
agcacuuaacuaugagccaggcaucauacuaaacuucaccuacauuaucucacuuaguccuuua

SEQ ID NO: 458678 - RNA, 64 nt, hsa
ggguccaagggcagagccugugcccuucagcccuuucaccuaacaggcccauauucgggccuuu

SEQ ID NO: 458679 - RNA, 64 nt, hsa
gagagaggugagcaaccaagggaagcuccucugauucaccuagaaccuguucucugccgucuuu

SEQ ID NO: 458680 - RNA, 64 nt, hsa
gcagacaggacagugagguugucaccacucagacuucaccuauucagcauucuuucugauuucu

SEQ ID NO: 458681 - RNA, 64 nt, hsa
ugucaacauuuuugauucuagcuaccuguauuauuucaccuagcuugucccaagcuucccugcc

SEQ ID NO: 458682 - RNA, 64 nt, hsa
aguaaaauuuaguguucaaaacauugagacacucuucaccuauuguaugaccaaauaaagguua

SEQ ID NO: 458683 - RNA, 64 nt, hsa
ugccaguguugaguaaacucaacuacuaugaaauuucaccuaauguuuucaguuucacuuccuu

SEQ ID NO: 458684 - RNA, 64 nt, hsa
guuuuuuaaagcauuaaugaacaucaucauuaauuucaccuauuauauuguacccacauauauu

SEQ ID NO: 458685 - RNA, 64 nt, hsa
aauaaauuaauuugcucucaucguauuguguauauucaccuaaugcccauuguguauugauauu

SEQ ID NO: 458686 - RNA, 64 nt, hsa
ggaaccaaguuuaguauagucugauuacauuccauucaccuaacuuuagacauucguuuagaca

SEQ ID NO: 458687 - RNA, 64 nt, hsa
uuucuuccuaaaaaaaguucuuucuuuuauuauuuucaccuauuggcugcugcauuuuacgaag

SEQ ID NO: 458688 - RNA, 64 nt, hsa
ucuagauuauuuuuuuccuccacaguccuuuuuuuucaccuaacgcaccuaaaucuugaaacua

SEQ ID NO: 458689 - RNA, 64 nt, hsa
aauguaaauauuccuuauuuaagacauguuuaaauucaccuacuagcacgacuuacauagcuca

SEQ ID NO: 458690 - RNA, 64 nt, hsa
ccguggcaacuguggaaggcacacugagcaaguuuucaccuaucuggaaaaaaaaaaauaugag

SEQ ID NO: 458691 - RNA, 64 nt, hsa
agcuauuauuaacaacuuuuguguacuuauaauguucaccuaaaaauguuguagcauaauucug

SEQ ID NO: 458692 - RNA, 64 nt, hsa
guguugaggauguaaucuccuuugccaucuuuaauucaccuaacuuacacuagguguucucuua

SEQ ID NO: 458693 - RNA, 64 nt, hsa
uaagccucaucugauggaagagaggaauaaauaauucaccuauauguguuugagguugugacag

SEQ ID NO: 458694 - RNA, 64 nt, hsa
agcauuccauuuuguccuguuaaaaccuuuuguuuucaccuaaacccuuucugcuuaguuguau

SEQ ID NO: 458695 - RNA, 64 nt, hsa
cugauuugauacuagucaguuugcuugaaacuaguucaccuaaagcuagaucucuuaaaaccaa

SEQ ID NO: 458696 - RNA, 64 nt, hsa
uuuaaugauacuucugauguuucggaacagucauuucaccuacuauuucugaauauauuuugca

SEQ ID NO: 458697 - RNA, 64 nt, hsa
acuugacauaggauauuuucccucuggcuacacauucaccuacccuuguucucuauuuagauua

SEQ ID NO: 458698 - RNA, 64 nt, hsa
ucuuacuauacuuuucauaauguugcaugcauauuucaccuaccaaagcugugcuguuaaugcc

SEQ ID NO: 458699 - RNA, 64 nt, hsa
ucggccgccuuggggguuccgcuuccuguuccaguucaccuaaaggcugauugugcaggcccag

SEQ ID NO: 458700 - RNA, 64 nt, hsa
uuguuguguucucaauaugauggcuauuugaaacuucaccuacuuuucauuagauugguuguac

SEQ ID NO: 458701 - RNA, 64 nt, hsa
agugcuggugacuggauagcaguuuuaaguggcguucaccuagucaacacgaccgcguguguug

SEQ ID NO: 458702 - RNA, 64 nt, hsa
aagauuuuucuucuuuccuuaaaaauauuuuuuuuucaccuaggucuaaauagcuaacuaacug

SEQ ID NO: 458703 - RNA, 64 nt, hsa
gucuuauagagccuuugauccagcaauaccccacuucaccuacaauaauuguugacgcuauuug

SEQ ID NO: 458704 - RNA, 64 nt, hsa
caaagacccuaaacaaaaaguuaaguuucuuucuuucaccuauuuguacaacuccaaguuacag

SEQ ID NO: 458705 - RNA, 64 nt, hsa
ucauuuuuauauucauuuauucaucauucauucauucaccuaacuuucauuaaauagcugcacc

SEQ ID NO: 458706 - RNA, 64 nt, hsa
cucacuaagccagaggccaaagugcccccucccguucaccuaccacccaaguccucaugcccuc

SEQ ID NO: 458707 - RNA, 64 nt, hsa
gggccacugcaggagaugagaccagccuucuguguucaccuaacgauuuauacuguguaucugu

SEQ ID NO: 458708 - RNA, 64 nt, hsa
cccacccccucaaucugucggggagccccugcccuucaccuagcucccuuggccaggagcgagc

SEQ ID NO: 458709 - RNA, 64 nt, hsa
cuggccacaggggcucaccugggccccauggcuuuucaccuaaguggguccugcccccuccccc

SEQ ID NO: 458710 - RNA, 64 nt, hsa
cagguaguggaggcucagacaaguuauuuagccauucaccuagagaguaaguguugaagccaga

SEQ ID NO: 458711 - RNA, 64 nt, hsa
aaacauugcaaccaaaaaggucagcacaaaggccuucaccuacgugaagaccuccugguaggau

SEQ ID NO: 458712 - RNA, 64 nt, hsa
gagaaacucaguuaauauaaagaacaauaagucauucaccuagaugucaacuccacaagaugaa

SEQ ID NO: 458713 - RNA, 64 nt, hsa
cucagggggaccuuaccaccccucagagugcugcuucaccuacacuaccuacaagaucccgcgu

SEQ ID NO: 458714 - RNA, 64 nt, hsa
ugagauugaaaaagucaacauagaagcuuuagcauucaccuaucucaguaccuacaacuaaugu

SEQ ID NO: 458715 - RNA, 64 nt, hsa
guaccccaucccaagcauagccagcucccccuccuucaccuaguggucaaggcccggagcugga

SEQ ID NO: 458716 - RNA, 64 nt, hsa
gaaaauucugaaauuguaaaugucuauuuuaauauucaccuaugaaagaaucugugaauauaug

SEQ ID NO: 458717 - RNA, 64 nt, hsa
uuuuuucugauuuaugaggguuugaaagaaagaauucaccuaaaagauuccauuuccaguuuua

SEQ ID NO: 458718 - RNA, 64 nt, hsa
gccaagaaaaauaauacucuuaaauacuuagauguucaccuaaaguugauauuauuugguaugg

SEQ ID NO: 458719 - RNA, 64 nt, hsa
cugauuuuaaaggcagagaaguucucaaaguuaauucaccuauguuauuuuguguacaaguugu

SEQ ID NO: 458720 - RNA, 64 nt, hsa
uggaguguuuggggugccugccauugccucugccuucaccuaagucugugcccauuguuucagg

SEQ ID NO: 458721 - RNA, 64 nt, hsa
cguuguaguggaaccucuacauguuuuaguuugcuucaccuaaaauaaugcugaucuagagaua

SEQ ID NO: 458722 - RNA, 64 nt, hsa
uuacaguuccuucaauaaccaugaugaccugaaguucaccuaucccauuuuagcaucuacuugu

SEQ ID NO: 458723 - RNA, 64 nt, hsa
gaugcaauuagucugucacuccauuuagaaaauguucaccuagagguguucugguaaacugauu

SEQ ID NO: 458724 - RNA, 64 nt, hsa
auuuggugugcuuuccuccgauugaucccaacccuucaccuauuuuacguauaccugcccuuuc

SEQ ID NO: 458725 - RNA, 64 nt, hsa
uuauuaacuuacggauuuauuauauaaauauauauucaccuagcaacauaucucugccgucucu

SEQ ID NO: 458726 - RNA, 64 nt, hsa
gagugcaguggugcaaucucgccucacugcaaccuucaccuaccgaguucaagugauuuuccug

SEQ ID NO: 458727 - RNA, 64 nt, hsa
acccucaggccugaggugugugccacucagagacuucaccuaacuagagacaggcaaacugcaa

SEQ ID NO: 458728 - RNA, 64 nt, hsa
acagcaucagauaucaagaguuuguaggucuggauucaccuaagauucaagggaguguugcuuc

SEQ ID NO: 458729 - RNA, 64 nt, hsa
acggucaccuguugcagcuucaccugccuggggauucaccuaccuggguccucacuuuccuggg

SEQ ID NO: 458730 - RNA, 64 nt, hsa
aaucuagaagaacuuggaugguuucguaauacaauucaccuauagccaaucuugcaugagauuu

SEQ ID NO: 458731 - RNA, 64 nt, hsa
gcacaugggggcuuccaugcaccugcgcacacccuucaccuaccgugugccugaggacaccugg

SEQ ID NO: 458732 - RNA, 64 nt, hsa
uuaccuacuacagacauugaaguuguuucuaauguucaccuagaacucuaauuuuaccuucuuu

SEQ ID NO: 458733 - RNA, 64 nt, hsa
ucuguggcuuucauuugaguaucuuuggccccuuuucaccuacugcgaccacccaccucauccu

SEQ ID NO: 458734 - RNA, 64 nt, hsa
aguaguauacauauuugauguaguaguuuauccauucaccuaugagauauauuugcacuguuuu

SEQ ID NO: 458735 - RNA, 64 nt, hsa
cuggcugagggcaugggguaaagguuagaaaaccuucaccuaggacuugacccuuaccaaacca

SEQ ID NO: 458736 - RNA, 64 nt, hsa
agggaaucauuuuguguucauuuuuguuuucuguuucaccuaaaccagcauaggauugauaggg

SEQ ID NO: 458737 - RNA, 64 nt, hsa
cauguauuuuuauuaaauauaacaaugucugaguuucaccuaagauguuuuugugccauaugcu

SEQ ID NO: 458738 - RNA, 64 nt, hsa
cccauuccuguguuaccaccuuccucccgauuuguucaccuauuuugugcuuuaaaucucaaua

SEQ ID NO: 458739 - RNA, 64 nt, hsa
cuuauuuauuuuauauuuuuaaaagaagacaguauucaccuauguauuuugcauaacgauuaua

SEQ ID NO: 458740 - RNA, 64 nt, hsa
guuaacaggagggcuggggucccugccaccaguuuucaccuagccagucuugagucuucuccgu

SEQ ID NO: 458741 - RNA, 64 nt, hsa
ucugcuuucuguuagcuuaggcagacauugggccuucaccuacaaguuuuuccuuaccccugug

SEQ ID NO: 458742 - RNA, 64 nt, hsa
gcuucuugcugcucagcagaccaugaccuguagguucaccuauaaaacagggaaauugaauaac

SEQ ID NO: 458743 - RNA, 64 nt, hsa
gaucaugggcaagaagccugaccccaagugugucuucaccuaugugcagucgcucuacaaccac

SEQ ID NO: 458744 - RNA, 64 nt, hsa
aagaugauaaucuacuuaauuuuagaacaccuuuuucaccuaacuaaaauaauguuuaaagagu

SEQ ID NO: 458745 - RNA, 64 nt, hsa
cuuuauaaggcaaaaagaucuguauuuacacuccuucaccuagggauguguuuguugcccuccu

SEQ ID NO: 458746 - RNA, 64 nt, hsa
gaugcuuugaaagagcccuaaacauugggaaccauucaccuaauuuggagacauuucucacugg

SEQ ID NO: 458747 - RNA, 64 nt, hsa
cacacuucucaaaagugacacaagagaaauccaguucaccuacagagguagagcacucacgccc

SEQ ID NO: 458748 - RNA, 64 nt, hsa
aauuuugucuaucagaauaaacacaagugaaauuuucaccuacauuaacauuaugucuuugcag

SEQ ID NO: 458749 - RNA, 64 nt, hsa
gcuacuuucuauccaaauaauuuaaaaaacacuuuucaccuacuccuuucaugguuauaacaca

SEQ ID NO: 458750 - RNA, 64 nt, hsa
ggguugaggugcagcaaaaccaccauggcacacguucaccuauguaacaaaccugcacauccug

SEQ ID NO: 458751 - RNA, 64 nt, hsa
gguuguuaucacacucacuucuuuuuagcugugugagcaugaauaauuuacuuagccucucugu

SEQ ID NO: 458752 - RNA, 64 nt, hsa
ccugaggugucccacauacuauugugaguucucagagcaugaacuguccucagaagagcagggc

SEQ ID NO: 458753 - RNA, 64 nt, hsa
uaauuucagcauuucuuugugauuuauaaguacugagcaugaaguacuugucugccccucauuu

SEQ ID NO: 458754 - RNA, 64 nt, hsa
aucuuuuagggcacaauagaaaccauggggcguggagcaugaguugugaauggcagggaucauu

SEQ ID NO: 458755 - RNA, 64 nt, hsa
ugaacaauauugugaaaaugauugcauucucauugagcaugaaagucaaaacuggaauuuucua

SEQ ID NO: 458756 - RNA, 64 nt, hsa
aauuauuuuauucuagccugucaugagucugucugagcaugauacuuaacaugaacuugaugua

SEQ ID NO: 458757 - RNA, 64 nt, hsa
caccgcugccacuguggcuccaggaggcccuugggagcaugaggagagcuggacucgcucaucu

SEQ ID NO: 458758 - RNA, 64 nt, hsa
uacugaauugccugucccugagcuuggccugcuggagcaugaugcuggaggcugugugcgggca

SEQ ID NO: 458759 - RNA, 57 nt, hsa
aucagaagaaaaucagcuagcuguauuccuaaacaaauuguuuccuaaacaaaugug

SEQ ID NO: 458760 - RNA, 64 nt, hsa
aaaucagcuagcuguauuccuaaacaaauuguuuccuaaacaaaugugaaaaugugaacagugc

SEQ ID NO: 458761 - RNA, 64 nt, hsa
acuagaauaauggcaaauacuucuaauuuuuuucccuaaacauuuuuaaaagugaaauauggga

SEQ ID NO: 458762 - RNA, 64 nt, hsa
uccaugcugccauaucccuucauuguaaaaaguaccuaaacauucgugaaaugauuuuuuuuag

SEQ ID NO: 458763 - RNA, 64 nt, hsa
cauuaauccauucaugagggcuucacccucaugaccuaaacaucuccauuaggcuccaccuucc

SEQ ID NO: 458764 - RNA, 64 nt, hsa
cuuuucccuuuauucaagcugucaauuuuugucuccuaaacaucuucuaguuauauucucauuu

SEQ ID NO: 458765 - RNA, 64 nt, hsa
aaauuauguggucaaauaauauagucauuagccaccuaaacauuuuaauuccagauauuauuua

SEQ ID NO: 458766 - RNA, 64 nt, hsa
guguugggaaagaagaaagggugagaaacccuggccuaaacaauccaucccacagauccucagg

SEQ ID NO: 458767 - RNA, 64 nt, hsa
guaauuuagaaaucauuuugcaaucccuuaauauccuaaacaucauucauuuuuguuguuguug

SEQ ID NO: 458768 - RNA, 64 nt, hsa
gcugggauuacagguguaagccaccgugcccagcccuaaacaucauucuugagagcauugggau

SEQ ID NO: 458769 - RNA, 64 nt, hsa
cgcccuguuucugucaaauaccuagugaaaaaggccuaaacaauuguaaugauauuauuuauug

SEQ ID NO: 458770 - RNA, 64 nt, hsa
uagucuaaaaccauuuuucuuucuuuuuuuucccccuaaacaaccucuuaaagggguaagaagu

SEQ ID NO: 458771 - RNA, 64 nt, hsa
gguagugcuucaccuugagaugcuuugaaagagcccuaaacauugggaaccauucaccuaauuu

SEQ ID NO: 458772 - RNA, 64 nt, hsa
acccccuuaugauccuucacauucauuuuaugucccuaaacaucacaauguaaauaucauuuuu

SEQ ID NO: 458773 - RNA, 64 nt, hsa
auuccuucgcaacagaagucuaaauccugcuuagccuaaacauaucuauagccagcgaugggca

SEQ ID NO: 458774 - RNA, 64 nt, hsa
uccuguugggauuaacaguugagggccaucgcugccuaaacauuuagcgugcgguuucccauca

SEQ ID NO: 458775 - RNA, 64 nt, hsa
uuuauucaugccuguguguuuuucuuaaguaugaauucuagauacagcuacuuauggauucauc

SEQ ID NO: 458776 - RNA, 64 nt, hsa
uauagaaccaacggaaauaugggcacuauuuugaauucuagagaugguuuuuguuaaaucuacu

SEQ ID NO: 458777 - RNA, 64 nt, hsa
uaaaacaacaaaauuaauaaugaaauggaggggaauucuagaauuauaugcuaaaugcauauuu

SEQ ID NO: 458778 - RNA, 64 nt, hsa
uggcaagcaguucaucaccaggacacuagcuaugauucuagaagucaaaaggugucuauagaac

SEQ ID NO: 458779 - RNA, 64 nt, hsa
ugcuuuguaauaacaccuggugaaaaaguuagauauucuagacuuguuuuaguaauggaaacuc

SEQ ID NO: 458780 - RNA, 64 nt, hsa
aagcaagguauuuuuucaccucagauucuaauauauucuagauuuguuucuguuuuauagauuu

SEQ ID NO: 458781 - RNA, 64 nt, hsa
agucaaaacuuguguucucaugagccuaaggaccauucuagauuuauuacguguuuuuugugug

SEQ ID NO: 458782 - RNA, 64 nt, hsa
uuccugaaaccauacauuucaagugaaauaaguaauucuagauaggacaauuuaaauuggauaa

SEQ ID NO: 458783 - RNA, 64 nt, hsa
caauuuaagaucucucuuaacuuguggccaagaaauucuagauuuuccagcugacuuugguaua

SEQ ID NO: 458784 - RNA, 64 nt, hsa
uuucuugcaagaguaauuuaagcacaugggaaagauucuagacuuuuuguuucuugcaacaaca

SEQ ID NO: 458785 - RNA, 64 nt, hsa
ccauucuguaucuuauauaacagaucuuugccaaauucuagauauuauaguguugccugucugu

SEQ ID NO: 458786 - RNA, 64 nt, hsa
uaauaaauugaucugcuuauuuauuaaaauuauuauucuagacuuacaaaaggcuuaaaaagaa

SEQ ID NO: 458787 - RNA, 64 nt, hsa
ccaaauuuuacagccaggacuacagaagugcaucauucuagaauguguagaccugaguagcuua

SEQ ID NO: 458788 - RNA, 64 nt, hsa
aggaauguaagaacacccauauuggcuacuggaaauucuagaagucagucagguuuuaauuuau

SEQ ID NO: 458789 - RNA, 64 nt, hsa
auaguucagaaacacuuuuuaucugcaaggcacuauucuagauccagaagaugcaauguugaac

SEQ ID NO: 458790 - RNA, 64 nt, hsa
aacaaauccuagagucuuugaaauuucuaagggcauucuagaccucuguugggauaugguauua

SEQ ID NO: 458791 - RNA, 64 nt, hsa
auauaucagguugaaucacauucaacagagauauauucuagaauacuuuuuuagaagaggcuaa

SEQ ID NO: 458792 - RNA, 64 nt, hsa
gcagggcguagaaaagagaggauguccgugcuuaauucuagauacuuuugagacaacaccuuca

SEQ ID NO: 458793 - RNA, 64 nt, hsa
aaagcaauuagagaccauaccuaauauuguuuaaauucuagauguaggcuaacaaugaaaagua

SEQ ID NO: 458794 - RNA, 64 nt, hsa
auuuuuguuaacuaaaaagugaaauaugggauggauucuagaaaugggguaucucuguccauac

SEQ ID NO: 458795 - RNA, 64 nt, hsa
cuuacucuaagaucuuagauucucugugucuaagauucuagaucagaugcuccaagauucuaga

SEQ ID NO: 458796 - RNA, 64 nt, hsa
ucugugucuaagauucuagaucagaugcuccaagauucuagaugauuaaauaagauucuaacgg

SEQ ID NO: 458797 - RNA, 64 nt, hsa
auccacuggguggguuguuuuuuuuuaaagugccauucuagaauguccaaagggaaucaggauu

SEQ ID NO: 458798 - RNA, 64 nt, hsa
guagacugaucacagagucaaggaagcaguggcaauucuagauaucugagauuuugcugguucc

SEQ ID NO: 458799 - RNA, 64 nt, hsa
uccaguuugcccaauggaguugagaaucucaaugauucuagaugacuucuugugguucuguaau

SEQ ID NO: 458800 - RNA, 64 nt, hsa
cauucaccaaguccccuucuguguuucuggagugauucuagagggagacuuguucuagagagga

SEQ ID NO: 458801 - RNA, 64 nt, hsa
gagagaagggggacguuucuggaacugucugaauauucuagaacuagcaaaacaucuuuuccug

SEQ ID NO: 458802 - RNA, 64 nt, hsa
uaguacuuucugaacauucuggaauccuccccacauucuagaauucucccaacauuuuuuuuuc

SEQ ID NO: 458803 - RNA, 64 nt, hsa
uuggaccuauuuuaagaagcuugcuaaccuaaauauucuagaacuuucccagccucguagccca

SEQ ID NO: 458804 - RNA, 64 nt, hsa; identical to SEQ ID NO: 73323

SEQ ID NO: 458805 - RNA, 64 nt, hsa; identical to SEQ ID NO: 73324

SEQ ID NO: 458806 - RNA, 64 nt, hsa; identical to SEQ ID NO: 73325

SEQ ID NO: 458807 - RNA, 64 nt, hsa; identical to SEQ ID NO: 73326

SEQ ID NO: 458808 - RNA, 64 nt, hsa; identical to SEQ ID NO: 73327

SEQ ID NO: 458809 - RNA, 64 nt, hsa; identical to SEQ ID NO: 73328

SEQ ID NO: 458810 - RNA, 64 nt, hsa; identical to SEQ ID NO: 73329

SEQ ID NO: 458811 - RNA, 64 nt, hsa; identical to SEQ ID NO: 73330

SEQ ID NO: 458812 - RNA, 64 nt, hsa; identical to SEQ ID NO: 73331

SEQ ID NO: 458813 - RNA, 64 nt, hsa; identical to SEQ ID NO: 73332

SEQ ID NO: 458814 - RNA, 64 nt, hsa; identical to SEQ ID NO: 73333

SEQ ID NO: 458815 - RNA, 64 nt, hsa; identical to SEQ ID NO: 73334

SEQ ID NO: 458816 - RNA, 64 nt, hsa; identical to SEQ ID NO: 73335

SEQ ID NO: 458817 - RNA, 64 nt, hsa; identical to SEQ ID NO: 73336

SEQ ID NO: 458818 - RNA, 64 nt, hsa; identical to SEQ ID NO: 73337

SEQ ID NO: 458819 - RNA, 64 nt, hsa; identical to SEQ ID NO: 73338

SEQ ID NO: 458820 - RNA, 64 nt, hsa; identical to SEQ ID NO: 73339

SEQ ID NO: 458821 - RNA, 64 nt, hsa; identical to SEQ ID NO: 73340

SEQ ID NO: 458822 - RNA, 64 nt, hsa; identical to SEQ ID NO: 73341

SEQ ID NO: 458823 - RNA, 64 nt, hsa; identical to SEQ ID NO: 73342

SEQ ID NO: 458824 - RNA, 64 nt, hsa; identical to SEQ ID NO: 73343

SEQ ID NO: 458825 - RNA, 64 nt, hsa; identical to SEQ ID NO: 73344

SEQ ID NO: 458826 - RNA, 64 nt, hsa
augucccauuucagacagaguaaccauuaacaaaaaagaagagaaaaaguuaaagucguuauau

SEQ ID NO: 458827 - RNA, 64 nt, hsa
uuaaaugaauuuaaaaugagccaaaggacccugaaaagaagacauguugauuucccacuccuag

SEQ ID NO: 458828 - RNA, 64 nt, hsa
acucuugcaggagccuguccccucaucacaggcuaaagaagagcaguagacagcccuggacacu

SEQ ID NO: 458829 - RNA, 64 nt, hsa
agaccuggggacaggucgauugcuggaccagggcaaagaagaagcccugccaucugugcccugu

SEQ ID NO: 458830 - RNA, 64 nt, hsa
gugccuuuguuuuuacuagugucugcuguugcaaaaagaagaaaacauucuuugccugaguuuu

SEQ ID NO: 458831 - RNA, 64 nt, hsa
gggaagaaaagaaggggaagaagaucaaagaagaaaagaagaaggggaagaaaagaaggggaag

SEQ ID NO: 458832 - RNA, 64 nt, hsa
aggggaaggggaagaaaagaaggggaagaagaucaaagaagaaaagaagaaggggaagaaaaga

SEQ ID NO: 458833 - RNA, 64 nt, hsa
agagcagggcauaugcugacccaugcagccgaagaaagaagaggcagcaacaggaggaggagga

SEQ ID NO: 458834 - RNA, 64 nt, hsa
agcaaaccaaucagucccucaggaaagggaagaaaaagaagagguggcaccaugaagaggagaa

SEQ ID NO: 458835 - RNA, 64 nt, hsa
acauggucaguagguggcagagcuacuaguagggaaagaagaaagcuagcauuaaugaaugcuu

SEQ ID NO: 458836 - RNA, 64 nt, hsa
auguauaugguauauuauacauuugguggcagaaaaagaagauacugcauuuucacauugaaaa

SEQ ID NO: 458837 - RNA, 64 nt, hsa
acaaauucacugagaauuccaaaaguauauuaaaaaagaagauagcuaugaguucagaucuauc

SEQ ID NO: 458838 - RNA, 64 nt, hsa
aggacguuuaaaguauauauauuuugucaagaggaaagaagauaaaacuaugccaguuuuauau

SEQ ID NO: 458839 - RNA, 64 nt, hsa
auaacuguuaauucucagccaucuuugaagcuugaaagaagagucuuugguauuuuguaaacgu

SEQ ID NO: 458840 - RNA, 64 nt, hsa
uuuuaaaacuuuuuuuuaacuaauaauagcuuugaaagaagaggcuuaauuugggggugguaac

SEQ ID NO: 458841 - RNA, 64 nt, hsa
acauuucuuuuuuguaaugugacgauauguggacaaagaagaagaugcagguuuaagaaguuaa

SEQ ID NO: 458842 - RNA, 64 nt, hsa
agacaagcugagaagcuuacuuuuuggggaaguaaaagaagauggaaauggauguuucauuugu

SEQ ID NO: 458843 - RNA, 64 nt, hsa
uuccagaguuucacaggcauuuuuggauccuucaaaagaagagaaggagacaaaugcugauugg

SEQ ID NO: 458844 - RNA, 64 nt, hsa
aaagugggugaaggacaugaacagacacuucucaaaagaagacauuuaugcagccaaaaaacac

SEQ ID NO: 458845 - RNA, 64 nt, hsa
gcaaagaggagaaugaagauccagaaaggaaaauaaagaagaagggcuucggcgccaugcugag

SEQ ID NO: 458846 - RNA, 64 nt, hsa
agaagaagggcuucggcgccaugcugagauuuggaaagaagaaagaggauaaggguggaaaggc

SEQ ID NO: 458847 - RNA, 64 nt, hsa
ugguggccugagagaagaagagcuggagaaaaugaaagaagagcgugaaaggugagcagaagug

SEQ ID NO: 458848 - RNA, 64 nt, hsa
ggaacucagcccuguugcaaugcuuagggcccuuaaagaagaaaaucuccccagaaggcaucca

SEQ ID NO: 458849 - RNA, 64 nt, hsa
gucuauuuuuucuauaaguuuuauugcaagagguaaagaagaaaacuauauauauauaucuuau

SEQ ID NO: 458850 - RNA, 64 nt, hsa
cauagacuggaggagguaauccauggagagagaaaaagaagagggcucaggacaaggcccugag

SEQ ID NO: 458851 - RNA, 64 nt, hsa
ccuaaaaguuugggcagagggaaccaggcacguuaaagaagacagaaagcggacuaugcagagu

SEQ ID NO: 458852 - RNA, 64 nt, hsa
aaaaggaaaaagaaaccacaaauuggggaaaaaaaaagaagaaaaaccuguuuccgugugcaaa

SEQ ID NO: 458853 - RNA, 64 nt, hsa
augacugugcuuguucguaacagaugcaaacaagaaagaagaacugggaagucuuugucccuag

SEQ ID NO: 458854 - RNA, 64 nt, hsa
aaagauuugaauuuuuuguucccauggaagaaguaaagaagaggucacuagauguugcagugaa

SEQ ID NO: 458855 - RNA, 64 nt, hsa
auuugugauuauuuagguacugauugacuuaucaaaagaagaucugauuaagggcuuuucacaa

SEQ ID NO: 458856 - RNA, 64 nt, hsa
uuugagguagaccaggauuucuaaucaaaagggaaaagaagauguugaagaauacaguuaggca

SEQ ID NO: 458857 - RNA, 64 nt, hsa
gagcucucaaacuaaaagacauuuguuauuuuggaaagaagaaagacucuauucucaaaguuuc

SEQ ID NO: 458858 - RNA, 64 nt, hsa
uaauagaagcuuccuccaucaauuggcagaaccuaaagaagauuuuaaggggcaaaaguaauua

SEQ ID NO: 458859 - RNA, 64 nt, hsa
uuuuucuaaaaaaagaaaaaaaagaaaaaaaggaaaagaagaacaaagaaacaugacugucuca

SEQ ID NO: 458860 - RNA, 64 nt, hsa
gguacuuuucuuguauuuuuuaccauaucacuguaaagaagaggggaaacccagccagcuacuu

SEQ ID NO: 458861 - RNA, 64 nt, hsa
aaaacauuccaucuuucauuuaauaucaauaucaaaagaagaagacaaacaucuaucuuucuca

SEQ ID NO: 458862 - RNA, 64 nt, hsa
accauucuuuguaaacaguuggauggauuaugauaaagaagaugcuaccaaugaaauagaaaac

SEQ ID NO: 458863 - RNA, 64 nt, hsa
gcaaagaugcugugguggaugagguuggaguucgaaagaagaagcaagcgcuggccuggccuug

SEQ ID NO: 458864 - RNA, 64 nt, hsa
aaaaugggcuaacgguuugaauagacauuucuccaaagaagauaugcaaauggcuacuaagcac

SEQ ID NO: 458865 - RNA, 64 nt, hsa
ggaaagaaaaagaaauaaauguauccagauaggaaaagaagaaguaaaacuauuugcagaugac

SEQ ID NO: 458866 - RNA, 64 nt, hsa
cacccuuuaaaucuuaggaugacaaguuauaaagaaagaagaucuuugucugggacccccaaag

SEQ ID NO: 458867 - RNA, 64 nt, hsa
aggagugcucagcccaucaacuuccugagugucuaaagaagaugaggaaggugugcaggaagaa

SEQ ID NO: 458868 - RNA, 64 nt, hsa
uuguuccucagaaggagccaucaccuuugcuggaaaagaagauccaguugcuagaagcuaaauu

SEQ ID NO: 458869 - RNA, 64 nt, hsa
ucgagcugaagacaauuuuaacuuggaaaaggaaaaagaagaugucccuguggaaauguccaau

SEQ ID NO: 458870 - RNA, 64 nt, hsa
cuguuggucaaaaucugcaaacucuaaaagaagaaaagaagaaaaaaccaagcuuaggguauuu

SEQ ID NO: 458871 - RNA, 64 nt, hsa
aaccaugucuguuggucaaaaucugcaaacucuaaaagaagaaaagaagaaaaaaccaagcuua

SEQ ID NO: 458872 - RNA, 64 nt, hsa
auuuuaauggccacaucuaaucucauuucacaugaaagaagaaguauauuuuagaaauuuguua

SEQ ID NO: 458873 - RNA, 64 nt, hsa
gcccuugcaguaauucuacuggugaaaaacaugcaaagaagaggaagucacagaaacaugucuc

SEQ ID NO: 458874 - RNA, 64 nt, hsa
caucucaaaaaaaaaaaaaaaaaaaaaaaaaaaaaaagaagaagaaacccugagccauuaaugu

SEQ ID NO: 458875 - RNA, 64 nt, hsa
uuuuucaugcuuauuuuauucuuugucacagaugaaagaagaauaggacuaauuggggcuaaga

SEQ ID NO: 458876 - RNA, 64 nt, hsa
aaauuacauuaucaacaugagagaaaucaccaacaaagaagauguucaaaauaauagucccaua

SEQ ID NO: 458877 - RNA, 64 nt, hsa
ugaacaaaggucaguggggauuguugaauacauuaaagaagaguuucuaggggcuacuguuuau

SEQ ID NO: 458878 - RNA, 64 nt, hsa
acuaaaucuuuuauaggauuuauuuaaaauagcaaaagaagaaguuucaucauuuuuuacuucc

SEQ ID NO: 458879 - RNA, 64 nt, hsa
gagcauugggauaucuccugaaaagguuuaugaaaaagaagaaucucaucucagugaagaauac

SEQ ID NO: 458880 - RNA, 64 nt, hsa
uuccuguuucuggaauuccuuguuagggaacuuuaaagaagaaaagaaaaacuugaauuguguu

SEQ ID NO: 458881 - RNA, 64 nt, hsa
cucuucccuuucaccuccaauucccgugaucccaaaagaagaggaagacuccaggagggguaua

SEQ ID NO: 458882 - RNA, 64 nt, hsa
caagaaugaauucaguuaaagguauuuaggguucaaagaagacaaacuguacaagcccauuuca

SEQ ID NO: 458883 - RNA, 64 nt, hsa
uugauuucuuauuucuugggcaggcaauuugaggaaagaagaaauggcauggggaauauauaug

SEQ ID NO: 458884 - RNA, 64 nt, hsa
uuucccucccuaucaacaagaggauuuuaacagcaaagaagagaggcagcaccucccauuggca

SEQ ID NO: 458885 - RNA, 64 nt, hsa
ggaggaauuguuaacugaguaccaggguaccuuuaaagaagacccuuggagucuucuauaccuu

SEQ ID NO: 458886 - RNA, 64 nt, hsa
gcuguaggauucaagcugucuuugcacuagcucuaaagaagauuuucuucugguuuuagagaac

SEQ ID NO: 458887 - RNA, 64 nt, hsa
cuccaccagcacaucacuaugcaucuguuccaggaaagaagaaaagcgagcgaggaagacggaa

SEQ ID NO: 458888 - RNA, 64 nt, hsa
gguacuguguuguaccuuuauuucuguauuucuaaaagaagaaaguucuuuccuagcaggguuu

SEQ ID NO: 458889 - RNA, 64 nt, hsa
uuuccauccccaaggcaaacaaggaaaggaaaggaaagaagaaaaggugccuuaguccuuuguu

SEQ ID NO: 458890 - RNA, 64 nt, hsa
ccugcuucauguggaggaaacaggaaauaaagcaaaagaagagggucaggcuugguggcucaug

SEQ ID NO: 458891 - RNA, 64 nt, hsa
gaggacuagaggcuggaggccaagcagcugagccaaagaagaucaccugggccagggccuacgu

SEQ ID NO: 458892 - RNA, 64 nt, hsa
ucuguucuugcucucaaggagguuaccuuuaauaaaagaagacaaacccagauagauauguaaa

SEQ ID NO: 458893 - RNA, 64 nt, hsa
uugugcaggacugauagcucuucuuuauugacuuaaagaagauucuugugaaguuuccccagca

SEQ ID NO: 458894 - RNA, 64 nt, hsa
aaacuucagcugaagauuuuauauaggacuuuaaaaagaagagaagagaaagaagaaacaaugc

SEQ ID NO: 458895 - RNA, 64 nt, hsa
gauuuuauauaggacuuuaaaaagaagagaagagaaagaagaaacaaugcauuuccaggcaacc

SEQ ID NO: 458896 - RNA, 64 nt, hsa
uaaggagaaauagaaaagaagaaauuuauaaugaaaagaagaugaauuucauuauguaaacgcu

SEQ ID NO: 458897 - RNA, 64 nt, hsa
uaaugcccuaacucucuuauuaaggagaaauagaaaagaagaaauuuauaaugaaaagaagaug

SEQ ID NO: 458898 - RNA, 64 nt, hsa
augugagugguaaguauaucucaguuuaaaugguaaagaagaaauguaguuuacauuuguauuu

SEQ ID NO: 458899 - RNA, 64 nt, hsa
augugcacacgcccugccugguccgccauguuccaaagaagaugauuuaaugguagaacggaua

SEQ ID NO: 458900 - RNA, 64 nt, hsa
ggaaagugugaagacccaaaacagcuuugucuccaaagaagauagcucucugacugcuuuggau

SEQ ID NO: 458901 - RNA, 64 nt, hsa
guaaaauuucaggauuaacuaaagaagaggagaaaaagaagaaaagauucuucuuaaaaguuuc

SEQ ID NO: 458902 - RNA, 64 nt, hsa
acgcucaaugcccaguaaaauuucaggauuaacuaaagaagaggagaaaaagaagaaaagauuc

SEQ ID NO: 458903 - RNA, 64 nt, hsa
gccauuagacugaauuuaacuacuaagaauaaauaaagaagaaaauaaccuuaaucucuuguau

SEQ ID NO: 458904 - RNA, 64 nt, hsa
uuguaauauacaguuuuuguaaccauaugauugaaaagaagaaagucuaugcuuaggccaguca

SEQ ID NO: 458905 - RNA, 64 nt, hsa
gcuauuuuuccauaggaagaaaaggaguuaggagaaagaagagcagcugaacuuacuugccuca

SEQ ID NO: 458906 - RNA, 64 nt, hsa
agugucagggacccuauggaggcaagccaguaauaaagaagacacuaauugucacaccuggaag

SEQ ID NO: 458907 - RNA, 64 nt, hsa
ccaagacauuaaaguagcauggcugcccaggagaaaagaagacauucuaauuccagucauuuug

SEQ ID NO: 458908 - RNA, 64 nt, hsa
augucauuuaagggaguuacaucuuuauucugcuaaagaagaggaucauugauuucuguacagu

SEQ ID NO: 458909 - RNA, 64 nt, hsa
uucacaaucucauaggaguuuuuaaaaagaagagaaagaagauauacuuugcuuuggagaaauc

SEQ ID NO: 458910 - RNA, 64 nt, hsa
uugaacauuuucacaaucucauaggaguuuuuaaaaagaagagaaagaagauauacuuugcuuu

SEQ ID NO: 458911 - RNA, 64 nt, hsa
cuugcuggggccauaauaugcuucaggguguguaaaagaagaaaucucuuuguggcuuucaugg

SEQ ID NO: 458912 - RNA, 64 nt, hsa
gaacccuaacuuagggcuugggcaggggaaagagaaagaagaugagagauuauacuucaugagu

SEQ ID NO: 458913 - RNA, 64 nt, hsa
aaacauuauacauugggccauuuuucuuucucccaaagaagauucauggauagucagacugaac

SEQ ID NO: 458914 - RNA, 64 nt, hsa
caccacauuugugugcagauaccaaaagaggaggaaagaagaaaaaaauuaaugugugggagcu

SEQ ID NO: 458915 - RNA, 64 nt, hsa
cuugcguuugaaacuacaacuugauaaccccuagaaagaagaggacaugaaaggaugcuggcua

SEQ ID NO: 458916 - RNA, 64 nt, hsa
uugcauuuaaauugcaauccagcacacgugugagaaagaagaggcacuagucuaaaaggcugca

SEQ ID NO: 458917 - RNA, 64 nt, hsa
gaggaaagaaaaaagaaaagaaggaaagaagaauaaagaagagaaacguguaagaaugguuugc

SEQ ID NO: 458918 - RNA, 64 nt, hsa
gaaagagcaagaggaaagaaaaaagaaaagaaggaaagaagaauaaagaagagaaacguguaag

SEQ ID NO: 458919 - RNA, 64 nt, hsa
aggagaaucaaagauugauuguccuggggcuaagaaagaagauaauuuuuaaagaaugggagug

SEQ ID NO: 458920 - RNA, 64 nt, hsa
cacuaguguccaauuucauuuuuaaaagauguagaaagaagaaucaagcaucaauuaauuauaa

SEQ ID NO: 458921 - RNA, 64 nt, hsa
gcucagugaucaaagucuucaaauaguuaaaccaaaagaagaauagggcugcuuuguguggcca

SEQ ID NO: 458922 - RNA, 64 nt, hsa
acauggaaaaacaacuuagaggauuuagcagcuaaaagaagaaugagucagcuggugaugugcu

SEQ ID NO: 458923 - RNA, 64 nt, hsa
ccuuaggggugaguccuauugcaauaugaccgacaaagaagacaaaauagcauugaaacuaacc

SEQ ID NO: 458924 - RNA, 64 nt, hsa
uuacugugaaacuggcacugaauuaaucaucuauaaagaagaacuugcauggagcaggacucua

SEQ ID NO: 458925 - RNA, 64 nt, hsa
aagccauuauaccaccauccuuguagacucagaaaaagaagauccaauaaaauacaaugauuac

SEQ ID NO: 458926 - RNA, 64 nt, hsa
ggcuuccccucugucaaaucuaguuuccuauggaaaagaagauggcagauacaggagagacgac

SEQ ID NO: 458927 - RNA, 64 nt, hsa
guuugccccuuuauaaauccaaguagauaggaagaaagaagacaaacuuugcaucucaguauga

SEQ ID NO: 458928 - RNA, 64 nt, hsa
uguaauggcaguuauauuuugcaguucccacauuaaagaagaccugagaauguauccccaaaag

SEQ ID NO: 458929 - RNA, 64 nt, hsa
acagguccauaauuucauuuuaauuaauuauaggaaagaagaaaagauaauacccauuuguucu

SEQ ID NO: 458930 - RNA, 64 nt, hsa
ugaaauaagacaggaauaaagaguauucugaaaaaaagaagauauggaugaagugaacccaugc

SEQ ID NO: 458931 - RNA, 64 nt, hsa
cauuccagccccuauguuauugauggaaaaagaaaaagaagaaaagcaaucucgcaguacaugu

SEQ ID NO: 458932 - RNA, 64 nt, hsa
ucaccaggaugucacaugucagagaguaucauuaaaagaagacgcucagcacuguuucagcccg

SEQ ID NO: 458933 - RNA, 64 nt, hsa
gcuccccucacugauggacaaggaggucugugccaaagaagaauccaauaagcacauauugagc

SEQ ID NO: 458934 - RNA, 64 nt, hsa
gccucaguaaguaucuggaggaagaaaacaggugaaagaagaaguaaaaaccauuuaguauuag

SEQ ID NO: 458935 - RNA, 64 nt, hsa
auucuaaaauauaaucaaccaguagaaauuuaagaaagaagauguaaaaaaaaaaaauauuaac

SEQ ID NO: 458936 - RNA, 64 nt, hsa
agaaaacaccaaaaaauuuugaaaaagaagauaaaaagaagaaacgaaaaagaaagcccaaggc

SEQ ID NO: 458937 - RNA, 64 nt, hsa
auguuccacugagaaaacaccaaaaaauuuugaaaaagaagauaaaaagaagaaacgaaaaaga

SEQ ID NO: 458938 - RNA, 64 nt, hsa
cucgugagucccuggccuuuccuuuuguaauaagaaagaagagagagaacuugaugcaaagucc

SEQ ID NO: 458939 - RNA, 64 nt, hsa
agauaggacucuaaaccuagucaucuuggaauaaaaagaagagcugguuuguuuuagagcaggg

SEQ ID NO: 458940 - RNA, 64 nt, hsa
agaaaaagaagagccuuaacauauauaaaaguuuaaagaagaguaacacuugaaaaguguguuu

SEQ ID NO: 458941 - RNA, 64 nt, hsa
uuuuaaaauucuaaguagaguauauugaaaagaaaaagaagagccuuaacauauauaaaaguuu

SEQ ID NO: 458942 - RNA, 64 nt, hsa
agcugcauguuaguuauuacguucaccuggaacuaaagaagagcguccaggugggacugggaua

SEQ ID NO: 458943 - RNA, 64 nt, hsa
cuugcagugugcucuacugaauauucugacucugaaagaagacagucccuugacuugaaguaau

SEQ ID NO: 458944 - RNA, 64 nt, hsa
ggcaaacgugagccagggccagcggagaaacacuaaagaagacucggugguucagagccugggu

SEQ ID NO: 458945 - RNA, 64 nt, hsa
cgccuccuaguugccaggcacuggagggcgcaucaaagaagaguccuacccaggagggagagcg

SEQ ID NO: 458946 - RNA, 64 nt, hsa
uguuauuuuuuuaaaggaaacaaacagacaacaaaaagaagaaaaaaaaaaagaaccuccuugg

SEQ ID NO: 458947 - RNA, 64 nt, hsa
auaaaaauaaaaaaaauaaaaaaggaaaaaaaaaaaagaagaaacaagacaugccaccuuuccc

SEQ ID NO: 458948 - RNA, 64 nt, hsa
cagacucaaagaacagguucuuugggcaacagacaaagaagaaucaaguucugugcugucccgu

SEQ ID NO: 458949 - RNA, 64 nt, hsa
uuuaguaacuauuaugaaauacaaugguguuccaaaagaagaaagcacuaaaaacucaacuagc

SEQ ID NO: 458950 - RNA, 64 nt, hsa
ccaccuagcgccuucccacuccuuaagcaagcacaaagaagaugaggcagagaauugucagagc

SEQ ID NO: 458951 - RNA, 64 nt, hsa
ucguccugagagcuucugugugucaggcugcuggaaagaagacuccauucccaggacagaggcc

SEQ ID NO: 458952 - RNA, 64 nt, hsa
ggcaccauguuuucuuugaguccaacucauuaaaaaagaagaaucucugucaccucagccaagu

SEQ ID NO: 458953 - RNA, 64 nt, hsa
caaaaaaaaaaacacacaaaacaaaaacagaacaaaagaagagagaaggaaauuuuaucaauua

SEQ ID NO: 458954 - RNA, 64 nt, hsa
gaaaggacauugaguuuuaacagaagggaaaaggaaagaagaaaagauuuuugcagaauuucuc

SEQ ID NO: 458955 - RNA, 64 nt, hsa
gggcucaggaugggaaaggaagaaggggauaggaaaagaagagguaauuuuacauuuccccuuu

SEQ ID NO: 458956 - RNA, 64 nt, hsa
gaggacaacugugaacucacagugagcccuguggaaagaagagacagacagaguguggguuugu

SEQ ID NO: 458957 - RNA, 64 nt, hsa
aggucuugcuacauugcccucugcaaauguauucaaagaagaaccuccuccaccacuuacuuuu

SEQ ID NO: 458958 - RNA, 64 nt, hsa
gagaaggccagauggaguauguggaguaauagggaaagaagaguuacagaaaaugaaaaagaaa

SEQ ID NO: 458959 - RNA, 64 nt, hsa
uugcugaaauugaaaaagaaaaagaagaaaacgaaaagaagaaacaaaagaaagcaucaugaug

SEQ ID NO: 458960 - RNA, 64 nt, hsa
aauugagaaguauguugcugaaauugaaaaagaaaaagaagaaaacgaaaagaagaaacaaaag

SEQ ID NO: 458961 - RNA, 64 nt, hsa
gcucagcuggggguguggacagguagggguggggaaagaagaggcucugcguucugggggcuuu

SEQ ID NO: 458962 - RNA, 64 nt, hsa
uuauccuuucuaauuuuuacugaacugaaagcacaaagaagacuacacagaaaaucuggaaaca

SEQ ID NO: 458963 - RNA, 64 nt, hsa
cugucuuuuucauuuguagaaacuggagacguguaaagaagauaaauaauuguguaauuaaacu

SEQ ID NO: 458964 - RNA, 64 nt, hsa
cuauguuacaugaaugcuucugccucuuuaagacaaagaagaaugucacccaaaauugucauuu

SEQ ID NO: 458965 - RNA, 64 nt, hsa
gguuauagaaaggcuacaaggagaaaaggaacagaaagaagauucugaacuuucuacuggauug

SEQ ID NO: 458966 - RNA, 64 nt, hsa
gcaguuguuagaggaaccuaaaacagugguauccaaagaagaaucaaggccuccaaaauuuguc

SEQ ID NO: 458967 - RNA, 64 nt, hsa
cucacuagccaaacugaaacucuaugcaacauuaaaagaagagauccaucauguagcuugugac

SEQ ID NO: 458968 - RNA, 64 nt, hsa
aagauuguccuacaauuuggauuuugaucaugacaaagaagauuaaaauuucauuagcaugaau

SEQ ID NO: 458969 - RNA, 64 nt, hsa
uuuucaagugauuuaaauaguuaaucauuuaaccaaagaagauguguagugccuuaacaagcaa

SEQ ID NO: 458970 - RNA, 64 nt, hsa
uggaaauugaaaaacgaaaaucguguguguuugaaaagaagaaugcaacuuguauauuuuguau

SEQ ID NO: 458971 - RNA, 64 nt, hsa
ggaaagcuauuuaaaaaaacuugaaauuuaauugaaagaagaaacaacaacaaaaaagccuaaa

SEQ ID NO: 458972 - RNA, 64 nt, hsa
aaaaaagaaaaaaagccaugauguacccuccgagaaagaagaacguaagcacaggaaagagaaa

SEQ ID NO: 458973 - RNA, 64 nt, hsa
uuucacaagcaauggaaaagcaguuaccucauucaaagaagacauaugacucuuuccaagauga

SEQ ID NO: 458974 - RNA, 64 nt, hsa
ccgcucagcagaggaggcuuacaaacagcaaaucaaagaagauaauauuggaaaucagcugcug

SEQ ID NO: 458975 - RNA, 64 nt, hsa
aaugccauacaggcucuucacccagaggaucuggaaagaagaaagauauaaaggaucuuguagu

SEQ ID NO: 458976 - RNA, 64 nt, hsa
gaagaguugcuuccuauuucaggacccugccaaaaaagaagaaagcuugccuuugguggggcua

SEQ ID NO: 458977 - RNA, 64 nt, hsa
gccacaacaugacagucuugugacaucuuaaggaaaagaagaguuccuguuaaaugaauagcuu

SEQ ID NO: 458978 - RNA, 64 nt, hsa
auuacagggcugcuauuuucauaauguacaugaacaaugucacagaacuuuuuuaauuuuuuug

SEQ ID NO: 458979 - RNA, 64 nt, hsa
agcacucuuauuguaauauguacuagucugugaacaaugucaaauaaaagagaacgaacaggua

SEQ ID NO: 458980 - RNA, 64 nt, hsa
cacucauucccucaaaauauuuauugagcaccaacaaugucacaagcacugugcuaaacacugu

SEQ ID NO: 458981 - RNA, 64 nt, hsa
aacacuaaaauguuuuaaguuuucuuauugcuaacaaugucacagugaacauuuauauauucau

SEQ ID NO: 458982 - RNA, 64 nt, hsa
uugaaaguaacaccuuuuccaaggacaauggcaacaaugucaaugucaacacugagucuaauuu

SEQ ID NO: 458983 - RNA, 64 nt, hsa
guaacaccuuuuccaaggacaauggcaacaaugucaaugucaacacugagucuaauuuugacca

SEQ ID NO: 458984 - RNA, 64 nt, hsa
ucguaaucuuuuuugcuggugaggagucuugccucaaugucauuggcugcuggcugauaagggu

SEQ ID NO: 458985 - RNA, 64 nt, hsa
acaaaaaguggguaagcugaaacuaauaauuaggcaaugucaagugaacacaaauucaggauga

SEQ ID NO: 458986 - RNA, 64 nt, hsa
uagaaauuaaccaggaagauguuuccaccaagccugcugugagucaauugagggaguguuuggg

SEQ ID NO: 458987 - RNA, 64 nt, hsa
cggcuggggugggcagggaagggaagccgggggcugcugugagggaucuuggagcuucccugua

SEQ ID NO: 458988 - RNA, 64 nt, hsa
aaauacgacaguguuccaaaucccaucaacaaaaugcugugaacaacaacaacaaaaaauaaau

SEQ ID NO: 458989 - RNA, 64 nt, hsa
ugaacacugcucgcuacaagcuggccguggcagaugcugugauugagaaguuugccccaauuaa

SEQ ID NO: 458990 - RNA, 64 nt, hsa
aaaagucagucuauguacauacugcuuauugaugugcugugauaugagggaaucugaaauguuu

SEQ ID NO: 458991 - RNA, 64 nt, hsa
auagcguuccuuauucuuugagggaaacugugcuugcugugauccauuuugucucuagcuucua

SEQ ID NO: 458992 - RNA, 64 nt, hsa
ccccacagaucaaucucugcagaugacagggaggugcugugagaagugcaccaggcagcuuucu

SEQ ID NO: 458993 - RNA, 64 nt, hsa
uggaaccugggcuguggcucucugucguuuguggugcugugauggugucuacuguuagaauagc

SEQ ID NO: 458994 - RNA, 64 nt, hsa
aaugugcauguucuuagccaccgccucccuccuuugcugugacaucaccacucuuuccugaugc

SEQ ID NO: 458995 - RNA, 64 nt, hsa
uuaauauuugguauuucuuuuaaaguauuuuuugugcugugaacauuuucugccaaagaccaug

SEQ ID NO: 458996 - RNA, 64 nt, hsa
cucaaacucccgaucucaagccacccucccaaaaugcugugauuauaggccagagccauuguuc

SEQ ID NO: 458997 - RNA, 64 nt, hsa
uucgcaguguugggcuuggugacuggagcaaagcugcugugagagaguguccuuucccaucugu

SEQ ID NO: 458998 - RNA, 64 nt, hsa
caacuacuccacguguuuuuccauccaaucacacugcugugauucagggaucuuucuucuaaga

SEQ ID NO: 458999 - RNA, 64 nt, hsa
uuuuuucagugagcguggugacugcagagguuagugcugugaaaagcugggcuaaauauucuuu

SEQ ID NO: 459000 - RNA, 64 nt, hsa
acucugaaaaggccugggagcagaauggcuggccugcugugagcaggagaggagauucuaagaa

SEQ ID NO: 459001 - RNA, 64 nt, hsa
aauuaccuuugcuccucuccugugauucccaccaugcugugacccucagcugucucccuuugcu

SEQ ID NO: 459002 - RNA, 64 nt, hsa
ccuuagccuccugagcaucugggacuacagccauugcugugaauuacgugagggaaagauauug

SEQ ID NO: 459003 - RNA, 64 nt, hsa
ccugcauucugcgagucugugcucauuaacaaugugcugugaccaugugacucagcaauccugc

SEQ ID NO: 459004 - RNA, 64 nt, hsa
caugucccacuuuuuuaaccacuccgcacaucagugcugugaaggcaaccucaccauguauuuu

SEQ ID NO: 459005 - RNA, 64 nt, hsa
auaaugucauacaaaaaauguauuuguuuuuuugugcugugagaauugauguuuguagauuaau

SEQ ID NO: 459006 - RNA, 64 nt, hsa
guucugccaggccucgagcauccaagcaugauuuugcugugacaaaucuaaaaucaaccaggcu

SEQ ID NO: 459007 - RNA, 64 nt, hsa
cugccaggccccaagcaucugagcaugaugauuuugcugugacaauucuaagaucaaccagguu

SEQ ID NO: 459008 - RNA, 64 nt, hsa
cuucuguuguacuuuaauuauuguuuugccuuguugcugugaccucccuaagacacugaagaua

SEQ ID NO: 459009 - RNA, 64 nt, hsa
uaaaaagucaucuguucauuaggagaacucaaguugcugugacuuuucucauccaaaagacuca

SEQ ID NO: 459010 - RNA, 64 nt, hsa
caaggauccucaccacccaaaggguggugggcacugcugugaccaccccagcugcagagucagu

SEQ ID NO: 459011 - RNA, 64 nt, hsa
agcuuuaggcaccaucuguucccaucgcgccugcugcugugacccguuuuggaaaacuggugug

SEQ ID NO: 459012 - RNA, 64 nt, hsa
uggagggucuugucugcugugauucgacucuggaugcugugagcuugaugcuggccagggaagc

SEQ ID NO: 459013 - RNA, 64 nt, hsa
cuuccccggguugguggccauggagggucuugucugcugugauucgacucuggaugcugugagc

SEQ ID NO: 459014 - RNA, 64 nt, hsa
ccgccccaccuugcagcuaaaugugauccugccuugcugugaaauuucuguaccuucaaccugg

SEQ ID NO: 459015 - RNA, 64 nt, hsa
ugcacuccccacccugcucccuucccagagggauugcugugaaauuuuuuugguggcaaauaaa

SEQ ID NO: 459016 - RNA, 64 nt, hsa
acacauuuuguguagacaauuuuaaugucagugcugcugugaacuaaaguaugucauuuaugcu

SEQ ID NO: 459017 - RNA, 64 nt, hsa
acauagauggagaguuugagggcuuucgcagaaaugcugugauucuguuuuaaguccauaccuu

SEQ ID NO: 459018 - RNA, 64 nt, hsa
uaaaugaccauuguuuauaaacaguuaugaaaaaugcugugacuugaaaucuuucccacaucuc

SEQ ID NO: 459019 - RNA, 64 nt, hsa
aagaguuguuuucaguuuuuugcccuaauaaagcugcugugaacauucauguacagguuuuuau

SEQ ID NO: 459020 - RNA, 64 nt, hsa
gcucuuagcauucaaacugcagauacuaaacagaugcugugauuuauuaaagaguuagccauau

SEQ ID NO: 459021 - RNA, 64 nt, hsa
cuggccuugcagagcucaagaagggggcuuccaaugcugugagaauuccgagcuguucccuggg

SEQ ID NO: 459022 - RNA, 64 nt, hsa
cuuugugcaaccagggcccacggcgccccuccugugcugugacgugugugucguggcuggcccc

SEQ ID NO: 459023 - RNA, 64 nt, hsa
gcgccuaccgcccuggccgugucugucuggugugugcugugaaccccugcacccaaccccacau

SEQ ID NO: 459024 - RNA, 64 nt, hsa
uccugcagacgucugguggcagcgucuacuccauugcugugacaaaucaccacauugucugugg

SEQ ID NO: 459025 - RNA, 64 nt, hsa
uguggccuugagguuggugugcacaggcacuggcugcugugagugggggggcauggggcaguuu

SEQ ID NO: 459026 - RNA, 64 nt, hsa
ggcagggugccugaccugugugccggcugcucacugcugugaccagcagccgagcccuuggccc

SEQ ID NO: 459027 - RNA, 64 nt, hsa
accggugccucggucacucugggggcaguuuagaugcugugaaauuaaaccuguucuaagugua

SEQ ID NO: 459028 - RNA, 64 nt, hsa
agaacuuagaugugaaaaucuacacacugggagaugcugugagccccaagguuuugauggaguu

SEQ ID NO: 459029 - RNA, 64 nt, hsa
cgucauuugcaaaacacacauaauaccgucagagugcugugaaaaaccuuaaggguguguggau

SEQ ID NO: 459030 - RNA, 64 nt, hsa
gaaaagaaguacagauuuuuuaaaaagcuaauauugcugugauucaacucucuaguuacuugau

SEQ ID NO: 459031 - RNA, 64 nt, hsa
gaccucaugcucugcccagcuuggcuucccaaagugcugugauuacaggcuuaagccacagcgc

SEQ ID NO: 459032 - RNA, 64 nt, hsa
uauacacuuucccacguugaggugguguguucugugcugugacuauagaaaucuuggucagggc

SEQ ID NO: 459033 - RNA, 64 nt, hsa
gccuguguauuguuuaagcucgccaagucuguguugcugugaaaugaaugaaggagaggcuccu

SEQ ID NO: 459034 - RNA, 64 nt, hsa
aaaaguagccaucuccuuguuccagcugaaaaccugcugugagaguuuugacagagcacuuuau

SEQ ID NO: 459035 - RNA, 64 nt, hsa
gcaggacauuccuucuaugagcgcuucagaauuuugcugugaacaguccucuuggacacagguu

SEQ ID NO: 459036 - RNA, 64 nt, hsa
ggauuaauacagaaauuuaaucaugucugauuaauugcucuauuaaaauaaggggcauuuaaag

SEQ ID NO: 459037 - RNA, 64 nt, hsa
uuguguugucuuagcuuuaaaacagucacaguucuugcucuaucauagaugaacaaauacuuuc

SEQ ID NO: 459038 - RNA, 64 nt, hsa
ucauuuugccucuugggaaauuagcagauagucuuugcucuaaaugauaucugaguaaauagac

SEQ ID NO: 459039 - RNA, 64 nt, hsa
augcuuucucuauagaaccacuaacauauggcuauugcucuaugauuuuuuuuuuuacauuagg

SEQ ID NO: 459040 - RNA, 64 nt, hsa
guuuacauuaaaauccuuuaagccaaaaggaagcuugcucuauggauuuaaaugcaaacuucau

SEQ ID NO: 459041 - RNA, 64 nt, hsa
gggacaacagggguuaaaaauaaacugauuuaauuugcucuauaguccuaaagagaauuauauc

SEQ ID NO: 459042 - RNA, 64 nt, hsa
uaguuuuuuaacaugguagucuaaacuucaaggcuugcucuaucuccuagagcaauuuagagcu

SEQ ID NO: 459043 - RNA, 64 nt, hsa
cucucggcguuccagcauccugucaauuucccuuuugcucuagaggaugcauguuuauuugagg

SEQ ID NO: 459044 - RNA, 64 nt, hsa
ucauucuagugcccgguguguuggcaucaucuuuuugcucuagcccuuccucuccaaaauaaaa

SEQ ID NO: 459045 - RNA, 64 nt, hsa; identical to SEQ ID NO: 368876

SEQ ID NO: 459046 - RNA, 64 nt, hsa; identical to SEQ ID NO: 368877

SEQ ID NO: 459047 - RNA, 64 nt, hsa; identical to SEQ ID NO: 368878

SEQ ID NO: 459048 - RNA, 64 nt, hsa; identical to SEQ ID NO: 368879

SEQ ID NO: 459049 - RNA, 64 nt, hsa; identical to SEQ ID NO: 368880

SEQ ID NO: 459050 - RNA, 64 nt, hsa; identical to SEQ ID NO: 368881

SEQ ID NO: 459051 - RNA, 64 nt, hsa; identical to SEQ ID NO: 368882

SEQ ID NO: 459052 - RNA, 64 nt, hsa; identical to SEQ ID NO: 368883

SEQ ID NO: 459053 - RNA, 64 nt, hsa; identical to SEQ ID NO: 368884

SEQ ID NO: 459054 - RNA, 64 nt, hsa; identical to SEQ ID NO: 368885

SEQ ID NO: 459055 - RNA, 64 nt, hsa; identical to SEQ ID NO: 368886

SEQ ID NO: 459056 - RNA, 64 nt, hsa; identical to SEQ ID NO: 368887

SEQ ID NO: 459057 - RNA, 64 nt, hsa; identical to SEQ ID NO: 368888

SEQ ID NO: 459058 - RNA, 64 nt, hsa; identical to SEQ ID NO: 368889

SEQ ID NO: 459059 - RNA, 64 nt, hsa; identical to SEQ ID NO: 368890

SEQ ID NO: 459060 - RNA, 51 nt, hsa; identical to SEQ ID NO: 368891

SEQ ID NO: 459061 - RNA, 64 nt, hsa; identical to SEQ ID NO: 368892

SEQ ID NO: 459062 - RNA, 64 nt, hsa; identical to SEQ ID NO: 368893

SEQ ID NO: 459063 - RNA, 64 nt, hsa; identical to SEQ ID NO: 368894

SEQ ID NO: 459064 - RNA, 64 nt, hsa; identical to SEQ ID NO: 368895

SEQ ID NO: 459065 - RNA, 64 nt, hsa; identical to SEQ ID NO: 368896

SEQ ID NO: 459066 - RNA, 64 nt, hsa; identical to SEQ ID NO: 368897

SEQ ID NO: 459067 - RNA, 64 nt, hsa; identical to SEQ ID NO: 368898

SEQ ID NO: 459068 - RNA, 64 nt, hsa; identical to SEQ ID NO: 368899

SEQ ID NO: 459069 - RNA, 64 nt, hsa; identical to SEQ ID NO: 368900

SEQ ID NO: 459070 - RNA, 64 nt, hsa; identical to SEQ ID NO: 368901

SEQ ID NO: 459071 - RNA, 64 nt, hsa; identical to SEQ ID NO: 104428

SEQ ID NO: 459072 - RNA, 64 nt, hsa; identical to SEQ ID NO: 104429

SEQ ID NO: 459073 - RNA, 64 nt, hsa; identical to SEQ ID NO: 104430

SEQ ID NO: 459074 - RNA, 64 nt, hsa; identical to SEQ ID NO: 104431

SEQ ID NO: 459075 - RNA, 64 nt, hsa; identical to SEQ ID NO: 104432

SEQ ID NO: 459076 - RNA, 64 nt, hsa; identical to SEQ ID NO: 104433

SEQ ID NO: 459077 - RNA, 64 nt, hsa; identical to SEQ ID NO: 104434

SEQ ID NO: 459078 - RNA, 64 nt, hsa; identical to SEQ ID NO: 104435

SEQ ID NO: 459079 - RNA, 64 nt, hsa; identical to SEQ ID NO: 104436

SEQ ID NO: 459080 - RNA, 64 nt, hsa; identical to SEQ ID NO: 104437

SEQ ID NO: 459081 - RNA, 64 nt, hsa; identical to SEQ ID NO: 104438

SEQ ID NO: 459082 - RNA, 64 nt, hsa; identical to SEQ ID NO: 104439

SEQ ID NO: 459083 - RNA, 64 nt, hsa; identical to SEQ ID NO: 104440

SEQ ID NO: 459084 - RNA, 64 nt, hsa; identical to SEQ ID NO: 104441

SEQ ID NO: 459085 - RNA, 64 nt, hsa; identical to SEQ ID NO: 104442

SEQ ID NO: 459086 - RNA, 64 nt, hsa; identical to SEQ ID NO: 104443

SEQ ID NO: 459087 - RNA, 64 nt, hsa; identical to SEQ ID NO: 104444

SEQ ID NO: 459088 - RNA, 64 nt, hsa; identical to SEQ ID NO: 104445

SEQ ID NO: 459089 - RNA, 64 nt, hsa; identical to SEQ ID NO: 104446

SEQ ID NO: 459090 - RNA, 64 nt, hsa; identical to SEQ ID NO: 104447

SEQ ID NO: 459091 - RNA, 64 nt, hsa; identical to SEQ ID NO: 104448

SEQ ID NO: 459092 - RNA, 64 nt, hsa; identical to SEQ ID NO: 104449

SEQ ID NO: 459093 - RNA, 64 nt, hsa; identical to SEQ ID NO: 104450

SEQ ID NO: 459094 - RNA, 64 nt, hsa; identical to SEQ ID NO: 104451

SEQ ID NO: 459095 - RNA, 64 nt, hsa; identical to SEQ ID NO: 189185

SEQ ID NO: 459096 - RNA, 64 nt, hsa; identical to SEQ ID NO: 189186

SEQ ID NO: 459097 - RNA, 64 nt, hsa; identical to SEQ ID NO: 189187

SEQ ID NO: 459098 - RNA, 64 nt, hsa; identical to SEQ ID NO: 189188

SEQ ID NO: 459099 - RNA, 64 nt, hsa; identical to SEQ ID NO: 189189

SEQ ID NO: 459100 - RNA, 64 nt, hsa; identical to SEQ ID NO: 189190

SEQ ID NO: 459101 - RNA, 64 nt, hsa; identical to SEQ ID NO: 189191

SEQ ID NO: 459102 - RNA, 64 nt, hsa; identical to SEQ ID NO: 189192

SEQ ID NO: 459103 - RNA, 64 nt, hsa; identical to SEQ ID NO: 189193

SEQ ID NO: 459104 - RNA, 64 nt, hsa; identical to SEQ ID NO: 189194

SEQ ID NO: 459105 - RNA, 64 nt, hsa; identical to SEQ ID NO: 189195

SEQ ID NO: 459106 - RNA, 64 nt, hsa; identical to SEQ ID NO: 189196

SEQ ID NO: 459107 - RNA, 64 nt, hsa; identical to SEQ ID NO: 189197

SEQ ID NO: 459108 - RNA, 64 nt, hsa; identical to SEQ ID NO: 189198

SEQ ID NO: 459109 - RNA, 64 nt, hsa; identical to SEQ ID NO: 189199

SEQ ID NO: 459110 - RNA, 64 nt, hsa; identical to SEQ ID NO: 189200

SEQ ID NO: 459111 - RNA, 64 nt, hsa; identical to SEQ ID NO: 189201

SEQ ID NO: 459112 - RNA, 64 nt, hsa; identical to SEQ ID NO: 189202

SEQ ID NO: 459113 - RNA, 64 nt, hsa; identical to SEQ ID NO: 189203

SEQ ID NO: 459114 - RNA, 64 nt, hsa; identical to SEQ ID NO: 189204

SEQ ID NO: 459115 - RNA, 64 nt, hsa; identical to SEQ ID NO: 189205

SEQ ID NO: 459116 - RNA, 64 nt, hsa; identical to SEQ ID NO: 189206

SEQ ID NO: 459117 - RNA, 64 nt, hsa; identical to SEQ ID NO: 189207

SEQ ID NO: 459118 - RNA, 64 nt, hsa; identical to SEQ ID NO: 189208

SEQ ID NO: 459119 - RNA, 64 nt, hsa; identical to SEQ ID NO: 189209

SEQ ID NO: 459120 - RNA, 64 nt, hsa; identical to SEQ ID NO: 189210

SEQ ID NO: 459121 - RNA, 64 nt, hsa; identical to SEQ ID NO: 189211

SEQ ID NO: 459122 - RNA, 64 nt, hsa; identical to SEQ ID NO: 189212

SEQ ID NO: 459123 - RNA, 64 nt, hsa; identical to SEQ ID NO: 189213

SEQ ID NO: 459124 - RNA, 50 nt, hsa; identical to SEQ ID NO: 189214

SEQ ID NO: 459125 - RNA, 64 nt, hsa; identical to SEQ ID NO: 189215

SEQ ID NO: 459126 - RNA, 64 nt, hsa; identical to SEQ ID NO: 189216

SEQ ID NO: 459127 - RNA, 64 nt, hsa; identical to SEQ ID NO: 189217

SEQ ID NO: 459128 - RNA, 64 nt, hsa; identical to SEQ ID NO: 189218

SEQ ID NO: 459129 - RNA, 64 nt, hsa; identical to SEQ ID NO: 189219

SEQ ID NO: 459130 - RNA, 64 nt, hsa; identical to SEQ ID NO: 189220

SEQ ID NO: 459131 - RNA, 64 nt, hsa; identical to SEQ ID NO: 189221

SEQ ID NO: 459132 - RNA, 64 nt, hsa; identical to SEQ ID NO: 189222

SEQ ID NO: 459133 - RNA, 64 nt, hsa; identical to SEQ ID NO: 189223

SEQ ID NO: 459134 - RNA, 64 nt, hsa; identical to SEQ ID NO: 189224

SEQ ID NO: 459135 - RNA, 64 nt, hsa; identical to SEQ ID NO: 189225

SEQ ID NO: 459136 - RNA, 64 nt, hsa; identical to SEQ ID NO: 189226

SEQ ID NO: 459137 - RNA, 64 nt, hsa; identical to SEQ ID NO: 189227

SEQ ID NO: 459138 - RNA, 64 nt, hsa; identical to SEQ ID NO: 189228

SEQ ID NO: 459139 - RNA, 64 nt, hsa; identical to SEQ ID NO: 189229

SEQ ID NO: 459140 - RNA, 64 nt, hsa; identical to SEQ ID NO: 189230

SEQ ID NO: 459141 - RNA, 64 nt, hsa; identical to SEQ ID NO: 189231

SEQ ID NO: 459142 - RNA, 64 nt, hsa; identical to SEQ ID NO: 189232

SEQ ID NO: 459143 - RNA, 64 nt, hsa; identical to SEQ ID NO: 189233

SEQ ID NO: 459144 - RNA, 64 nt, hsa; identical to SEQ ID NO: 189234

SEQ ID NO: 459145 - RNA, 64 nt, hsa; identical to SEQ ID NO: 189235

SEQ ID NO: 459146 - RNA, 64 nt, hsa; identical to SEQ ID NO: 189236

SEQ ID NO: 459147 - RNA, 64 nt, hsa; identical to SEQ ID NO: 189237

SEQ ID NO: 459148 - RNA, 64 nt, hsa; identical to SEQ ID NO: 189238

SEQ ID NO: 459149 - RNA, 64 nt, hsa; identical to SEQ ID NO: 189239

SEQ ID NO: 459150 - RNA, 64 nt, hsa; identical to SEQ ID NO: 189240

SEQ ID NO: 459151 - RNA, 64 nt, hsa; identical to SEQ ID NO: 189241

SEQ ID NO: 459152 - RNA, 64 nt, hsa; identical to SEQ ID NO: 189242

SEQ ID NO: 459153 - RNA, 64 nt, hsa; identical to SEQ ID NO: 189243

SEQ ID NO: 459154 - RNA, 64 nt, hsa; identical to SEQ ID NO: 189244

SEQ ID NO: 459155 - RNA, 64 nt, hsa; identical to SEQ ID NO: 189245

SEQ ID NO: 459156 - RNA, 64 nt, hsa; identical to SEQ ID NO: 189246

SEQ ID NO: 459157 - RNA, 64 nt, hsa; identical to SEQ ID NO: 189247

SEQ ID NO: 459158 - RNA, 64 nt, hsa; identical to SEQ ID NO: 189248

SEQ ID NO: 459159 - RNA, 64 nt, hsa; identical to SEQ ID NO: 189249

SEQ ID NO: 459160 - RNA, 64 nt, hsa; identical to SEQ ID NO: 189250

SEQ ID NO: 459161 - RNA, 64 nt, hsa; identical to SEQ ID NO: 189251

SEQ ID NO: 459162 - RNA, 64 nt, hsa; identical to SEQ ID NO: 189252

SEQ ID NO: 459163 - RNA, 64 nt, hsa; identical to SEQ ID NO: 189253

SEQ ID NO: 459164 - RNA, 64 nt, hsa; identical to SEQ ID NO: 189254

SEQ ID NO: 459165 - RNA, 64 nt, hsa; identical to SEQ ID NO: 189255

SEQ ID NO: 459166 - RNA, 64 nt, hsa; identical to SEQ ID NO: 189256

SEQ ID NO: 459167 - RNA, 64 nt, hsa; identical to SEQ ID NO: 189257

SEQ ID NO: 459168 - RNA, 64 nt, hsa; identical to SEQ ID NO: 189258

SEQ ID NO: 459169 - RNA, 64 nt, hsa; identical to SEQ ID NO: 181919

SEQ ID NO: 459170 - RNA, 64 nt, hsa; identical to SEQ ID NO: 181920

SEQ ID NO: 459171 - RNA, 64 nt, hsa; identical to SEQ ID NO: 181921

SEQ ID NO: 459172 - RNA, 64 nt, hsa; identical to SEQ ID NO: 181922

SEQ ID NO: 459173 - RNA, 64 nt, hsa; identical to SEQ ID NO: 181923

SEQ ID NO: 459174 - RNA, 64 nt, hsa; identical to SEQ ID NO: 181924

SEQ ID NO: 459175 - RNA, 64 nt, hsa; identical to SEQ ID NO: 181925

SEQ ID NO: 459176 - RNA, 64 nt, hsa; identical to SEQ ID NO: 181926

SEQ ID NO: 459177 - RNA, 64 nt, hsa; identical to SEQ ID NO: 181927

SEQ ID NO: 459178 - RNA, 64 nt, hsa; identical to SEQ ID NO: 181928

SEQ ID NO: 459179 - RNA, 64 nt, hsa; identical to SEQ ID NO: 181929

SEQ ID NO: 459180 - RNA, 64 nt, hsa; identical to SEQ ID NO: 181930

SEQ ID NO: 459181 - RNA, 64 nt, hsa; identical to SEQ ID NO: 181931

SEQ ID NO: 459182 - RNA, 64 nt, hsa; identical to SEQ ID NO: 181932

SEQ ID NO: 459183 - RNA, 64 nt, hsa; identical to SEQ ID NO: 181933

SEQ ID NO: 459184 - RNA, 64 nt, hsa; identical to SEQ ID NO: 181934

SEQ ID NO: 459185 - RNA, 64 nt, hsa; identical to SEQ ID NO: 181935

SEQ ID NO: 459186 - RNA, 64 nt, hsa; identical to SEQ ID NO: 181936

SEQ ID NO: 459187 - RNA, 64 nt, hsa; identical to SEQ ID NO: 181937

SEQ ID NO: 459188 - RNA, 64 nt, hsa; identical to SEQ ID NO: 181938

SEQ ID NO: 459189 - RNA, 64 nt, hsa; identical to SEQ ID NO: 181939

SEQ ID NO: 459190 - RNA, 64 nt, hsa; identical to SEQ ID NO: 181940

SEQ ID NO: 459191 - RNA, 64 nt, hsa; identical to SEQ ID NO: 181941

SEQ ID NO: 459192 - RNA, 64 nt, hsa; identical to SEQ ID NO: 181942

SEQ ID NO: 459193 - RNA, 64 nt, hsa; identical to SEQ ID NO: 181943

SEQ ID NO: 459194 - RNA, 64 nt, hsa; identical to SEQ ID NO: 181944

SEQ ID NO: 459195 - RNA, 64 nt, hsa; identical to SEQ ID NO: 181945

SEQ ID NO: 459196 - RNA, 64 nt, hsa; identical to SEQ ID NO: 181946

SEQ ID NO: 459197 - RNA, 64 nt, hsa; identical to SEQ ID NO: 181947

SEQ ID NO: 459198 - RNA, 64 nt, hsa; identical to SEQ ID NO: 181948

SEQ ID NO: 459199 - RNA, 64 nt, hsa; identical to SEQ ID NO: 181949

SEQ ID NO: 459200 - RNA, 64 nt, hsa; identical to SEQ ID NO: 181950

SEQ ID NO: 459201 - RNA, 64 nt, hsa; identical to SEQ ID NO: 181951

SEQ ID NO: 459202 - RNA, 64 nt, hsa; identical to SEQ ID NO: 181952

SEQ ID NO: 459203 - RNA, 64 nt, hsa; identical to SEQ ID NO: 97841

SEQ ID NO: 459204 - RNA, 64 nt, hsa; identical to SEQ ID NO: 97842

SEQ ID NO: 459205 - RNA, 64 nt, hsa; identical to SEQ ID NO: 97843

SEQ ID NO: 459206 - RNA, 64 nt, hsa; identical to SEQ ID NO: 97844

SEQ ID NO: 459207 - RNA, 64 nt, hsa; identical to SEQ ID NO: 97845

SEQ ID NO: 459208 - RNA, 64 nt, hsa; identical to SEQ ID NO: 97846

SEQ ID NO: 459209 - RNA, 64 nt, hsa; identical to SEQ ID NO: 97847

SEQ ID NO: 459210 - RNA, 64 nt, hsa; identical to SEQ ID NO: 97848

SEQ ID NO: 459211 - RNA, 64 nt, hsa; identical to SEQ ID NO: 115592

SEQ ID NO: 459212 - RNA, 64 nt, hsa; identical to SEQ ID NO: 115593

SEQ ID NO: 459213 - RNA, 64 nt, hsa; identical to SEQ ID NO: 115594

SEQ ID NO: 459214 - RNA, 64 nt, hsa; identical to SEQ ID NO: 115595

SEQ ID NO: 459215 - RNA, 64 nt, hsa; identical to SEQ ID NO: 115596

SEQ ID NO: 459216 - RNA, 64 nt, hsa; identical to SEQ ID NO: 115597

SEQ ID NO: 459217 - RNA, 64 nt, hsa; identical to SEQ ID NO: 115598

SEQ ID NO: 459218 - RNA, 64 nt, hsa; identical to SEQ ID NO: 115599

SEQ ID NO: 459219 - RNA, 64 nt, hsa; identical to SEQ ID NO: 115600

SEQ ID NO: 459220 - RNA, 64 nt, hsa; identical to SEQ ID NO: 115601

SEQ ID NO: 459221 - RNA, 64 nt, hsa; identical to SEQ ID NO: 115602

SEQ ID NO: 459222 - RNA, 64 nt, hsa; identical to SEQ ID NO: 115603

SEQ ID NO: 459223 - RNA, 64 nt, hsa; identical to SEQ ID NO: 115604

SEQ ID NO: 459224 - RNA, 64 nt, hsa; identical to SEQ ID NO: 115605

SEQ ID NO: 459225 - RNA, 64 nt, hsa; identical to SEQ ID NO: 115606

SEQ ID NO: 459226 - RNA, 64 nt, hsa; identical to SEQ ID NO: 115607

SEQ ID NO: 459227 - RNA, 64 nt, hsa; identical to SEQ ID NO: 115608

SEQ ID NO: 459228 - RNA, 64 nt, hsa; identical to SEQ ID NO: 115609

SEQ ID NO: 459229 - RNA, 64 nt, hsa; identical to SEQ ID NO: 115610

SEQ ID NO: 459230 - RNA, 64 nt, hsa; identical to SEQ ID NO: 115611

SEQ ID NO: 459231 - RNA, 64 nt, hsa; identical to SEQ ID NO: 115612

SEQ ID NO: 459232 - RNA, 64 nt, hsa; identical to SEQ ID NO: 115613

SEQ ID NO: 459233 - RNA, 64 nt, hsa; identical to SEQ ID NO: 115614

SEQ ID NO: 459234 - RNA, 64 nt, hsa; identical to SEQ ID NO: 115615

SEQ ID NO: 459235 - RNA, 52 nt, hsa; identical to SEQ ID NO: 115616

SEQ ID NO: 459236 - RNA, 64 nt, hsa; identical to SEQ ID NO: 115617

SEQ ID NO: 459237 - RNA, 64 nt, hsa; identical to SEQ ID NO: 115618

SEQ ID NO: 459238 - RNA, 64 nt, hsa; identical to SEQ ID NO: 115619

SEQ ID NO: 459239 - RNA, 64 nt, hsa; identical to SEQ ID NO: 115620

SEQ ID NO: 459240 - RNA, 64 nt, hsa; identical to SEQ ID NO: 115621

SEQ ID NO: 459241 - RNA, 64 nt, hsa; identical to SEQ ID NO: 115622

SEQ ID NO: 459242 - RNA, 64 nt, hsa; identical to SEQ ID NO: 115623

SEQ ID NO: 459243 - RNA, 64 nt, hsa; identical to SEQ ID NO: 115624

SEQ ID NO: 459244 - RNA, 64 nt, hsa; identical to SEQ ID NO: 115625

SEQ ID NO: 459245 - RNA, 64 nt, hsa; identical to SEQ ID NO: 115626

SEQ ID NO: 459246 - RNA, 64 nt, hsa; identical to SEQ ID NO: 115627

SEQ ID NO: 459247 - RNA, 64 nt, hsa; identical to SEQ ID NO: 115628

SEQ ID NO: 459248 - RNA, 64 nt, hsa; identical to SEQ ID NO: 115629

SEQ ID NO: 459249 - RNA, 64 nt, hsa; identical to SEQ ID NO: 115630

SEQ ID NO: 459250 - RNA, 64 nt, hsa; identical to SEQ ID NO: 115631

SEQ ID NO: 459251 - RNA, 64 nt, hsa; identical to SEQ ID NO: 115632

SEQ ID NO: 459252 - RNA, 64 nt, hsa; identical to SEQ ID NO: 115633

SEQ ID NO: 459253 - RNA, 64 nt, hsa; identical to SEQ ID NO: 115634

SEQ ID NO: 459254 - RNA, 64 nt, hsa; identical to SEQ ID NO: 115635

SEQ ID NO: 459255 - RNA, 64 nt, hsa; identical to SEQ ID NO: 115636

SEQ ID NO: 459256 - RNA, 64 nt, hsa; identical to SEQ ID NO: 115637

SEQ ID NO: 459257 - RNA, 64 nt, hsa; identical to SEQ ID NO: 115636

SEQ ID NO: 459258 - RNA, 64 nt, hsa; identical to SEQ ID NO: 115639

SEQ ID NO: 459259 - RNA, 64 nt, hsa; identical to SEQ ID NO: 115640

SEQ ID NO: 459260 - RNA, 64 nt, hsa; identical to SEQ ID NO: 115641

SEQ ID NO: 459261 - RNA, 64 nt, hsa; identical to SEQ ID NO: 115642

SEQ ID NO: 459262 - RNA, 64 nt, hsa; identical to SEQ ID NO: 115643

SEQ ID NO: 459263 - RNA, 64 nt, hsa; identical to SEQ ID NO: 115644

SEQ ID NO: 459264 - RNA, 64 nt, hsa; identical to SEQ ID NO: 115645

SEQ ID NO: 459265 - RNA, 64 nt, hsa; identical to SEQ ID NO: 115646

SEQ ID NO: 459266 - RNA, 64 nt, hsa; identical to SEQ ID NO: 115647

SEQ ID NO: 459267 - RNA, 64 nt, hsa; identical to SEQ ID NO: 115648

SEQ ID NO: 459268 - RNA, 64 nt, hsa; identical to SEQ ID NO: 115649

SEQ ID NO: 459269 - RNA, 64 nt, hsa; identical to SEQ ID NO: 115650

SEQ ID NO: 459270 - RNA, 64 nt, hsa; identical to SEQ ID NO: 115651

SEQ ID NO: 459271 - RNA, 64 nt, hsa; identical to SEQ ID NO: 115652

SEQ ID NO: 459272 - RNA, 64 nt, hsa; identical to SEQ ID NO: 115653

SEQ ID NO: 459273 - RNA, 64 nt, hsa; identical to SEQ ID NO: 115654

SEQ ID NO: 459274 - RNA, 64 nt, hsa; identical to SEQ ID NO: 115655

SEQ ID NO: 459275 - RNA, 64 nt, hsa; identical to SEQ ID NO: 115656

SEQ ID NO: 459276 - RNA, 64 nt, hsa; identical to SEQ ID NO: 115657

SEQ ID NO: 459277 - RNA, 64 nt, hsa; identical to SEQ ID NO: 115658

SEQ ID NO: 459278 - RNA, 64 nt, hsa; identical to SEQ ID NO: 115659

SEQ ID NO: 459279 - RNA, 64 nt, hsa; identical to SEQ ID NO: 70830

SEQ ID NO: 459280 - RNA, 64 nt, hsa; identical to SEQ ID NO: 70831

SEQ ID NO: 459281 - RNA, 64 nt, hsa; identical to SEQ ID NO: 70832

SEQ ID NO: 459282 - RNA, 64 nt, hsa; identical to SEQ ID NO: 70833

SEQ ID NO: 459283 - RNA, 64 nt, hsa; identical to SEQ ID NO: 70834

SEQ ID NO: 459284 - RNA, 64 nt, hsa; identical to SEQ ID NO: 70835

SEQ ID NO: 459285 - RNA, 64 nt, hsa; identical to SEQ ID NO: 294959

SEQ ID NO: 459286 - RNA, 64 nt, hsa; identical to SEQ ID NO: 294960

SEQ ID NO: 459287 - RNA, 64 nt, hsa; identical to SEQ ID NO: 294961

SEQ ID NO: 459288 - RNA, 64 nt, hsa; identical to SEQ ID NO: 294962

SEQ ID NO: 459289 - RNA, 64 nt, hsa; identical to SEQ ID NO: 294963

SEQ ID NO: 459290 - RNA, 64 nt, hsa; identical to SEQ ID NO: 294964

SEQ ID NO: 459291 - RNA, 64 nt, hsa; identical to SEQ ID NO: 294965

SEQ ID NO: 459292 - RNA, 64 nt, hsa; identical to SEQ ID NO: 294966

SEQ ID NO: 459293 - RNA, 64 nt, hsa; identical to SEQ ID NO: 294967

SEQ ID NO: 459294 - RNA, 64 nt, hsa; identical to SEQ ID NO: 294968

SEQ ID NO: 459295 - RNA, 64 nt, hsa; identical to SEQ ID NO: 294969

SEQ ID NO: 459296 - RNA, 64 nt, hsa; identical to SEQ ID NO: 294970

SEQ ID NO: 459297 - RNA, 64 nt, hsa; identical to SEQ ID NO: 294971

SEQ ID NO: 459298 - RNA, 64 nt, hsa; identical to SEQ ID NO: 294972

SEQ ID NO: 459299 - RNA, 64 nt, hsa; identical to SEQ ID NO: 294973

SEQ ID NO: 459300 - RNA, 64 nt, hsa; identical to SEQ ID NO: 294974

SEQ ID NO: 459301 - RNA, 64 nt, hsa; identical to SEQ ID NO: 294975

SEQ ID NO: 459302 - RNA, 64 nt, hsa; identical to SEQ ID NO: 294976

SEQ ID NO: 459303 - RNA, 64 nt, hsa; identical to SEQ ID NO: 294977

SEQ ID NO: 459304 - RNA, 64 nt, hsa; identical to SEQ ID NO: 294978

SEQ ID NO: 459305 - RNA, 64 nt, hsa; identical to SEQ ID NO: 294979

SEQ ID NO: 459306 - RNA, 64 nt, hsa; identical to SEQ ID NO: 294980

SEQ ID NO: 459307 - RNA, 64 nt, hsa; identical to SEQ ID NO: 294981

SEQ ID NO: 459308 - RNA, 64 nt, hsa; identical to SEQ ID NO: 294982

SEQ ID NO: 459309 - RNA, 64 nt, hsa; identical to SEQ ID NO: 294983

SEQ ID NO: 459310 - RNA, 64 nt, hsa; identical to SEQ ID NO: 294984

SEQ ID NO: 459311 - RNA, 64 nt, hsa; identical to SEQ ID NO: 294985

SEQ ID NO: 459312 - RNA, 64 nt, hsa; identical to SEQ ID NO: 294986

SEQ ID NO: 459313 - RNA, 64 nt, hsa; identical to SEQ ID NO: 294987

SEQ ID NO: 459314 - RNA, 64 nt, hsa; identical to SEQ ID NO: 294988

SEQ ID NO: 459315 - RNA, 64 nt, hsa; identical to SEQ ID NO: 294989

SEQ ID NO: 459316 - RNA, 64 nt, hsa
gguagguggauccagggaaaagcaguggggacggaaggcaaagagaccacucaacccccaccug

SEQ ID NO: 459317 - RNA, 64 nt, hsa
gguucuuuucagcagagucuaguaguuucucuguaaggcaaaauaaucuaaaaagacuaaccug

SEQ ID NO: 459318 - RNA, 64 nt, hsa
ccacaaaacuaaaaggccuggccccauucuggaaaaggcaaagcugcaugagacacagccuucu

SEQ ID NO: 459319 - RNA, 64 nt, hsa
auucaguugagugaggcugaaggcuggguuugaaaaggcaaaaagacaagacauccaggcaggg

SEQ ID NO: 459320 - RNA, 64 nt, hsa
uaggaaaauacuugaaaugcaugucucaagcugcaaggcaaacuccauuccucauauuaaacua

SEQ ID NO: 459321 - RNA, 64 nt, hsa
uacuuuguugauucucaguuacuguaggcaucaaaaggcaaaaaucaaaaaaaaaaaaaacaaa

SEQ ID NO: 459322 - RNA, 64 nt, hsa
uuuuauggaugagcauaaaccuagucuuaguuuaaaggcaaacuaaaguugaggggaaauaauu

SEQ ID NO: 459323 - RNA, 64 nt, hsa
aacacugucuacccuaaauaauuuuuauaugcucaaggcaaagcagggaauagaggcaauuagc

SEQ ID NO: 459324 - RNA, 64 nt, hsa
aaaucaguugacaauuagaauaauaaaguggauaaaggcaaauuaagauauaggaccaaaacag

SEQ ID NO: 459325 - RNA, 64 nt, hsa
aaacuaccaaaaaaaaaguggggguggaggaaaaaaggcaaaggcgccuucugagaucaaaagg

SEQ ID NO: 459326 - RNA, 64 nt, hsa
uuauuuccccgucccuuaaaaagacaaaaaaaauaaggcaaaaggaaagcaacuaagacacugg

SEQ ID NO: 459327 - RNA, 64 nt, hsa
cuuggacagcuuucugcccccucuuucacuaaggaaggcaaaugaagugaaaaaaaaaaaugcc

SEQ ID NO: 459328 - RNA, 64 nt, hsa
uagcaucuuuccccuuuuaauuuguaggcuuuuaaaggcaaaucauucccaccaucacuuaacg

SEQ ID NO: 459329 - RNA, 64 nt, hsa
ucuggcaugccaaaaacuaacagaaacuuaguugaaggcaaagagagcaaggagaacguuuaau

SEQ ID NO: 459330 - RNA, 64 nt, hsa
gggggaccaggucuucuugcugaccucgucuacaaaggcaaaggaaggcaaaggaagcugucuc

SEQ ID NO: 459331 - RNA, 64 nt, hsa
gucuucuugcugaccucgucuacaaaggcaaaggaaggcaaaggaagcugucucggguguuucu

SEQ ID NO: 459332 - RNA, 64 nt, hsa
ucacuuuucaacuuccauauucuucauauaguaaaaggcaaaguguugaagauacuacggugug

SEQ ID NO: 459333 - RNA, 64 nt, hsa
uccuggauucacagugggaacaaguuucuauuaaaaggcaaaugcuguuacaaauuuuuggcau

SEQ ID NO: 459334 - RNA, 64 nt, hsa
uguuaaaauaugcuugacuagaguuuccaguugaaaggcaaaaacuuccaucacaacaagaaau

SEQ ID NO: 459335 - RNA, 64 nt, hsa
gaaggguacugaaaacaccauccauuugggaaagaaggcaaaguccccccaguuaugccuucca

SEQ ID NO: 459336 - RNA, 64 nt, hsa
acggauugaucugaucaaucccuucaaggagcugaaggcaaaauguguaaaaccccuaaaucag

SEQ ID NO: 459337 - RNA, 64 nt, hsa
ugacuuaacauggaagcuauuucucucuuacuuaaaggcaaacugguuuuacagcucuggugug

SEQ ID NO: 459338 - RNA, 64 nt, hsa
ucaguaagaagugauuaaaauaaugacaugcuaaaaggcaaauuucaagggaagaaauguaaaa

SEQ ID NO: 459339 - RNA, 64 nt, hsa
uucuuuauagcaaugcaagaauggccuaaaacacaaggcaaaacaacuuugauaugguacaguc

SEQ ID NO: 459340 - RNA, 64 nt, hsa
guccuuguacaucugcauuaaggugccgaugcagaaggcaaauuggaaacacgcgccagcggca

SEQ ID NO: 459341 - RNA, 64 nt, hsa
acccguggcuccuaaggaaaaaacagcaucaugaaaggcaaaaaguauuugaaacguaauuguu

SEQ ID NO: 459342 - RNA, 64 nt, hsa
cagaccuuuggcaaugggguggucacuaccucacaaggcaaaguguuguaugauuagaaauuac

SEQ ID NO: 459343 - RNA, 64 nt, hsa
acuuugaagaugaaucuggagucugcuuacuuggaaggcaaagagugacuugugucuauugaaa

SEQ ID NO: 459344 - RNA, 64 nt, hsa
gugguaaauacugugaaauaccuuuucucacaaaaaggcaaauauugaaguuguuuaucaacuu

SEQ ID NO: 459345 - RNA, 64 nt, hsa
cuccagucauuguaguauuguuugugacccugagaaggcaaaagaaagaaccacucauugucuu

SEQ ID NO: 459346 - RNA, 64 nt, hsa
uuuuuuucaaaguaggcaauucuuuguauauuuuaaggcaaauaaucacuucaccucuggugcc

SEQ ID NO: 459347 - RNA, 64 nt, hsa
ucaagauucuguuccccucuucgcagaagugaggaaggcaaauacucaggguuugaagggagac

SEQ ID NO: 459348 - RNA, 64 nt, hsa
cagagcaaaacucugucucaaaaaaaaaaaaaaaaaggcaaaauuaaagaauuucaagucccua

SEQ ID NO: 459349 - RNA, 64 nt, hsa
cugaccucuacaguucauauuugcagugacauaaaaggcaaagaggagcuggcauggugguaca

SEQ ID NO: 459350 - RNA, 64 nt, hsa
uaauaugaaagaaaaauggaucccaaucugagaaaaggcaaaagaauggcuacuuuuuucuaug

SEQ ID NO: 459351 - RNA, 64 nt, hsa
uuucaggaucagaucaauacaaucuuggagucaaaaggcaaaucauuuggacaaucugcaaaau

SEQ ID NO: 459352 - RNA, 64 nt, hsa
uuuugaaggcaaaauugcaaaucuugaaauuaagaaggcaaaaauguaaaggagucaaaacuac

SEQ ID NO: 459353 - RNA, 64 nt, hsa
uacuuuuuacaauuaaaaaaaaagaucuguuuugaaggcaaaauugcaaaucuugaaauuaaga

SEQ ID NO: 459354 - RNA, 64 nt, hsa; identical to SEQ ID NO: 82704

SEQ ID NO: 459355 - RNA, 64 nt, hsa; identical to SEQ ID NO: 82705

SEQ ID NO: 459356 - RNA, 64 nt, hsa; identical to SEQ ID NO: 82706

SEQ ID NO: 459357 - RNA, 64 nt, hsa; identical to SEQ ID NO: 82707

SEQ ID NO: 459358 - RNA, 64 nt, hsa; identical to SEQ ID NO: 82708

SEQ ID NO: 459359 - RNA, 64 nt, hsa; identical to SEQ ID NO: 82709

SEQ ID NO: 459360 - RNA, 64 nt, hsa; identical to SEQ ID NO: 82710

SEQ ID NO: 459361 - RNA, 64 nt, hsa; identical to SEQ ID NO: 82711

SEQ ID NO: 459362 - RNA, 64 nt, hsa; identical to SEQ ID NO: 82712

SEQ ID NO: 459363 - RNA, 64 nt, hsa; identical to SEQ ID NO: 82713

SEQ ID NO: 459364 - RNA, 64 nt, hsa; identical to SEQ ID NO: 82714

SEQ ID NO: 459365 - RNA, 64 nt, hsa; identical to SEQ ID NO: 82715

SEQ ID NO: 459366 - RNA, 64 nt, hsa; identical to SEQ ID NO: 82716

SEQ ID NO: 459367 - RNA, 64 nt, hsa; identical to SEQ ID NO: 82717

SEQ ID NO: 459368 - RNA, 64 nt, hsa; identical to SEQ ID NO: 82718

SEQ ID NO: 459369 - RNA, 64 nt, hsa; identical to SEQ ID NO: 82719

SEQ ID NO: 459370 - RNA, 64 nt, hsa; identical to SEQ ID NO: 82720

SEQ ID NO: 459371 - RNA, 64 nt, hsa; identical to SEQ ID NO: 82721

SEQ ID NO: 459372 - RNA, 64 nt, hsa; identical to SEQ ID NO: 82722

SEQ ID NO: 459373 - RNA, 64 nt, hsa; identical to SEQ ID NO: 82723

SEQ ID NO: 459374 - RNA, 64 nt, hsa; identical to SEQ ID NO: 82724

SEQ ID NO: 459375 - RNA, 64 nt, hsa; identical to SEQ ID NO: 82725

SEQ ID NO: 459376 - RNA, 64 nt, hsa; identical to SEQ ID NO: 82726

SEQ ID NO: 459377 - RNA, 64 nt, hsa; identical to SEQ ID NO: 82727

SEQ ID NO: 459378 - RNA, 64 nt, hsa; identical to SEQ ID NO: 82728

SEQ ID NO: 459379 - RNA, 64 nt, hsa; identical to SEQ ID NO: 82729

SEQ ID NO: 459380 - RNA, 64 nt, hsa; identical to SEQ ID NO: 82730

SEQ ID NO: 459381 - RNA, 64 nt, hsa; identical to SEQ ID NO: 82731

SEQ ID NO: 459382 - RNA, 64 nt, hsa; identical to SEQ ID NO: 82732

SEQ ID NO: 459383 - RNA, 64 nt, hsa; identical to SEQ ID NO: 82733

SEQ ID NO: 459384 - RNA, 64 nt, hsa; identical to SEQ ID NO: 82734

SEQ ID NO: 459385 - RNA, 64 nt, hsa; identical to SEQ ID NO: 82735

SEQ ID NO: 459386 - RNA, 64 nt, hsa; identical to SEQ ID NO: 82736

SEQ ID NO: 459387 - RNA, 64 nt, hsa; identical to SEQ ID NO: 82737

SEQ ID NO: 459388 - RNA, 64 nt, hsa; identical to SEQ ID NO: 82738

SEQ ID NO: 459389 - RNA, 64 nt, hsa; identical to SEQ ID NO: 82739

SEQ ID NO: 459390 - RNA, 64 nt, hsa; identical to SEQ ID NO: 82740

SEQ ID NO: 459391 - RNA, 64 nt, hsa; identical to SEQ ID NO: 82741

SEQ ID NO: 459392 - RNA, 64 nt, hsa; identical to SEQ ID NO: 82742

SEQ ID NO: 459393 - RNA, 64 nt, hsa; identical to SEQ ID NO: 82743

SEQ ID NO: 459394 - RNA, 64 nt, hsa; identical to SEQ ID NO: 82744

SEQ ID NO: 459395 - RNA, 64 nt, hsa; identical to SEQ ID NO: 82745

SEQ ID NO: 459396 - RNA, 64 nt, hsa; identical to SEQ ID NO: 82746

SEQ ID NO: 459397 - RNA, 64 nt, hsa; identical to SEQ ID NO: 82747

SEQ ID NO: 459398 - RNA, 64 nt, hsa; identical to SEQ ID NO: 82748

SEQ ID NO: 459399 - RNA, 64 nt, hsa; identical to SEQ ID NO: 82749

SEQ ID NO: 459400 - RNA, 64 nt, hsa; identical to SEQ ID NO: 82750

SEQ ID NO: 459401 - RNA, 64 nt, hsa; identical to SEQ ID NO: 82751

SEQ ID NO: 459402 - RNA, 64 nt, hsa; identical to SEQ ID NO: 82752

SEQ ID NO: 459403 - RNA, 64 nt, hsa; identical to SEQ ID NO: 82753

SEQ ID NO: 459404 - RNA, 64 nt, hsa; identical to SEQ ID NO: 82754

SEQ ID NO: 459405 - RNA, 64 nt, hsa; identical to SEQ ID NO: 82755

SEQ ID NO: 459406 - RNA, 64 nt, hsa; identical to SEQ ID NO: 82756

SEQ ID NO: 459407 - RNA, 64 nt, hsa; identical to SEQ ID NO: 82757

SEQ ID NO: 459408 - RNA, 64 nt, hsa; identical to SEQ ID NO: 82758

SEQ ID NO: 459409 - RNA, 64 nt, hsa; identical to SEQ ID NO: 82759

SEQ ID NO: 459410 - RNA, 64 nt, hsa; identical to SEQ ID NO: 82760

SEQ ID NO: 459411 - RNA, 64 nt, hsa; identical to SEQ ID NO: 82761

SEQ ID NO: 459412 - RNA, 64 nt, hsa; identical to SEQ ID NO: 82762

SEQ ID NO: 459413 - RNA, 64 nt, hsa; identical to SEQ ID NO: 82763

SEQ ID NO: 459414 - RNA, 64 nt, hsa; identical to SEQ ID NO: 82764

SEQ ID NO: 459415 - RNA, 64 nt, hsa; identical to SEQ ID NO: 82765

SEQ ID NO: 459416 - RNA, 64 nt, hsa; identical to SEQ ID NO: 82766

SEQ ID NO: 459417 - RNA, 64 nt, hsa; identical to SEQ ID NO: 82767

SEQ ID NO: 459418 - RNA, 64 nt, hsa; identical to SEQ ID NO: 82768

SEQ ID NO: 459419 - RNA, 64 nt, hsa; identical to SEQ ID NO: 82769

SEQ ID NO: 459420 - RNA, 64 nt, hsa; identical to SEQ ID NO: 82770

SEQ ID NO: 459421 - RNA, 64 nt, hsa; identical to SEQ ID NO: 82771

SEQ ID NO: 459422 - RNA, 64 nt, hsa; identical to SEQ ID NO: 82772

SEQ ID NO: 459423 - RNA, 64 nt, hsa; identical to SEQ ID NO: 82773

SEQ ID NO: 459424 - RNA, 64 nt, hsa; identical to SEQ ID NO: 82774

SEQ ID NO: 459425 - RNA, 64 nt, hsa; identical to SEQ ID NO: 82775

SEQ ID NO: 459426 - RNA, 64 nt, hsa; identical to SEQ ID NO: 82776

SEQ ID NO: 459427 - RNA, 64 nt, hsa; identical to SEQ ID NO: 82777

SEQ ID NO: 459428 - RNA, 64 nt, hsa; identical to SEQ ID NO: 82778

SEQ ID NO: 459429 - RNA, 64 nt, hsa; identical to SEQ ID NO: 82779

SEQ ID NO: 459430 - RNA, 64 nt, hsa; identical to SEQ ID NO: 82780

SEQ ID NO: 459431 - RNA, 64 nt, hsa; identical to SEQ ID NO: 82781

SEQ ID NO: 459432 - RNA, 64 nt, hsa; identical to SEQ ID NO: 82782

SEQ ID NO: 459433 - RNA, 64 nt, hsa; identical to SEQ ID NO: 82783

SEQ ID NO: 459434 - RNA, 64 nt, hsa; identical to SEQ ID NO: 82784

SEQ ID NO: 459435 - RNA, 64 nt, hsa; identical to SEQ ID NO: 82785

SEQ ID NO: 459436 - RNA, 64 nt, hsa; identical to SEQ ID NO: 82786

SEQ ID NO: 459437 - RNA, 64 nt, hsa; identical to SEQ ID NO: 82787

SEQ ID NO: 459438 - RNA, 64 nt, hsa; identical to SEQ ID NO: 82788

SEQ ID NO: 459439 - RNA, 64 nt, hsa; identical to SEQ ID NO: 82789

SEQ ID NO: 459440 - RNA, 64 nt, hsa; identical to SEQ ID NO: 82790

SEQ ID NO: 459441 - RNA, 64 nt, hsa; identical to SEQ ID NO: 107827

SEQ ID NO: 459442 - RNA, 64 nt, hsa; identical to SEQ ID NO: 107828

SEQ ID NO: 459443 - RNA, 64 nt, hsa; identical to SEQ ID NO: 107829

SEQ ID NO: 459444 - RNA, 64 nt, hsa; identical to SEQ ID NO: 107830

SEQ ID NO: 459445 - RNA, 64 nt, hsa; identical to SEQ ID NO: 107831

SEQ ID NO: 459446 - RNA, 64 nt, hsa; identical to SEQ ID NO: 107832

SEQ ID NO: 459447 - RNA, 64 nt, hsa; identical to SEQ ID NO: 107833

SEQ ID NO: 459448 - RNA, 64 nt, hsa; identical to SEQ ID NO: 107834

SEQ ID NO: 459449 - RNA, 64 nt, hsa; identical to SEQ ID NO: 107835

SEQ ID NO: 459450 - RNA, 64 nt, hsa; identical to SEQ ID NO: 107836

SEQ ID NO: 459451 - RNA, 64 nt, hsa; identical to SEQ ID NO: 107837

SEQ ID NO: 459452 - RNA, 64 nt, hsa; identical to SEQ ID NO: 107838

SEQ ID NO: 459453 - RNA, 64 nt, hsa; identical to SEQ ID NO: 107839

SEQ ID NO: 459454 - RNA, 64 nt, hsa; identical to SEQ ID NO: 107840

SEQ ID NO: 459455 - RNA, 64 nt, hsa
uuacgaauccugaaaauuaugcuagcaugauuuuuuuauauauagaaguuuaaaaauaaaccag

SEQ ID NO: 459456 - RNA, 64 nt, hsa
uuuuuagugcuaaauucuuguuaaauaauguaguuuuauauagcugauagaccaaccuauaucc

SEQ ID NO: 459457 - RNA, 64 nt, hsa
aacaucaaaauguauccaagccauuuaaaaaauauuuauauauacauaguagcaaauaguuuua

SEQ ID NO: 459458 - RNA, 64 nt, hsa
uaucgcauuuuuuauuacaaaugaauauuucauguuuauauaagcuguaaucaaaaaggacuag

SEQ ID NO: 459459 - RNA, 64 nt, hsa
agugagaugcacacuuauauauauacuguauauauuuauauauuuauauauauauuucauauau

SEQ ID NO: 459460 - RNA, 64 nt, hsa
gcacacuuauauauauacuguauauauuuauauauuuauauauauauuucauauauauauauaa

SEQ ID NO: 459461 - RNA, 64 nt, hsa
ugcuugguugauggccaugcaucuucagucagaauuuauauauaaauguaugcacccauuuuuu

SEQ ID NO: 459462 - RNA, 64 nt, hsa
ugcuauugaugcauaacauacugcuauuggucuuuuuauauaaauauauauauauauauacaua

SEQ ID NO: 459463 - RNA, 64 nt, hsa
ucaucucucuccagacucuagguauauuuccaacuuuauauaucacaguauuuaaaaagacaug

SEQ ID NO: 459464 - RNA, 64 nt, hsa
ugaaauuugaaaaccaccaaaaaucaagggaacuuuuauauauucaauuccuuuucugguguaa

SEQ ID NO: 459465 - RNA, 51 nt, hsa
cucaagaacuuuggaaauaauuuuauauauauauaaauaauauauauauau

SEQ ID NO: 459466 - RNA, 64 nt, hsa
augaagaacguaaaugcacuguuuuuauuuuuauuuuauauaauuuaaauugacuuucccacug

SEQ ID NO: 459467 - RNA, 64 nt, hsa
cucuuuuauauauucuuuuuccacuuuugaucuauuuauauauauguauguguuuuuaaaauau

SEQ ID NO: 459468 - RNA, 64 nt, hsa
ugaaauaauucucagcugccaaauguugcacucuuuuauauauucuuuuuccacuuuugaucua

SEQ ID NO: 459469 - RNA, 64 nt, hsa
agucuuuuucaggguuuuuuugugucucuguugcuuuauauaaugcaauauuuuguagugaaaa

SEQ ID NO: 459470 - RNA, 64 nt, hsa
caaauuucccacuucucccuguuucuaaacauauuuuauauauuaagauguuuguucuugaaag

SEQ ID NO: 459471 - RNA, 64 nt, hsa
uaauaucugauuacuuuugcaggcgaagugccccuuuauauauccaaaaacaucuauuugugac

SEQ ID NO: 459472 - RNA, 64 nt, hsa
acauaguguguauguuuggguuuuaauuacacauuuuauauaugagccauuuagauaugcagug

SEQ ID NO: 459473 - RNA, 64 nt, hsa
gguguuugaaaauuugccauuucaggcuaauauuuuuauauauuuuugacuuuuuaaaaguuca

SEQ ID NO: 459474 - RNA, 64 nt, hsa
aacauuucuguaaauuaucacaagcucuguuaccuuuauauacacugccucuucaauuuggaaa

SEQ ID NO: 459475 - RNA, 64 nt, hsa
aggaccaguagaauuuaaauugguugguugauuguuuauauaaaacacacuaaaauuauauuuu

SEQ ID NO: 459476 - RNA, 64 nt, hsa
gcaauuuuucuauuuuauauuaagacuucauacauuuauauauguaaauauggcuuauuaaugg

SEQ ID NO: 459477 - RNA, 64 nt, hsa
uggauuauuaaauaucuaguuuggaagaaaauaauuuauauaaauuauuguaaauuuuuaugua

SEQ ID NO: 459478 - RNA, 64 nt, hsa
uuuuaaaugcccuuucugcaguuggaagguuuucuuuauauacuauucccaccauggggagcga

SEQ ID NO: 459479 - RNA, 64 nt, hsa
uuuugacacaagccuacugaaugcuguguauauauuuauauauaaauauaucuauuugagugaa

SEQ ID NO: 459480 - RNA, 64 nt, hsa
aauuaucuuauuuaauuuuugcaauuauucuaauuuuauauauagagaaagugaccuauuuuuu

SEQ ID NO: 459481 - RNA, 64 nt, hsa
uguacuaguugaugaaggaguuuuuuuuaaccuguuuauauaauuuugcagcagaagccaaauu

SEQ ID NO: 459482 - RNA, 64 nt, hsa
auguauauaagacagguagugccugauuuacuacuuuauauaaaauaguaccuccuucaguuac

SEQ ID NO: 459483 - RNA, 64 nt, hsa
auaauagcauagauuuuccuucaaaaaaugaacauuuauauaucuacaaaaauauggagaagag

SEQ ID NO: 459484 - RNA, 64 nt, hsa
acauugguaagaaauauugauacugauauugauuuuuauauagguauuuauuucagaauugaua

SEQ ID NO: 459485 - RNA, 64 nt, hsa
aacauaaaacauccuuacuuuuauuucacacaguuuuauauauagauagaagacuguacaauuu

SEQ ID NO: 459486 - RNA, 64 nt, hsa
aacaagaaaguaucuauauauacauauguaaauauuuauauauagauauauguagcuuucuaua

SEQ ID NO: 459487 - RNA, 64 nt, hsa
augauaaaguuguaaauaauuuucuaagacaguuuuuauauagucuacaguuguccugauuucu

SEQ ID NO: 459488 - RNA, 64 nt, hsa
ggcaugagccaccgcgccuggccucugcuuacuuuuuauauagcaaaaugauuccucuuggcaa

SEQ ID NO: 459489 - RNA, 64 nt, hsa
auaaagcuuuauuggaacuagcuauacucaucuguuuauauauuaucuguggcugcuuugaaau

SEQ ID NO: 459490 - RNA, 64 nt, hsa
cagcaugugggccaaauccagccugcugccuguuuuuauauacccuguaagcuaagaaugguuu

SEQ ID NO: 459491 - RNA, 64 nt, hsa
cacugcauacaaucugaggccuccucucucaguuuuuauauagauggcgagaaccuaaguuuca

SEQ ID NO: 459492 - RNA, 64 nt, hsa
cauugguuuaccugugaaauaguucaaagccaaguuuauauacaauuauaucaguccucuuuca

SEQ ID NO: 459493 - RNA, 64 nt, hsa
aaccauuuuuuuccuaugugaaaguugaggacaauuuauauaacucacuuuuugucauguaaaa

SEQ ID NO: 459494 - RNA, 64 nt, hsa
cauacaaaccugugugccaagugacagcuauuuuuuuauauacaugguaauucauuaaaauugc

SEQ ID NO: 459495 - RNA, 64 nt, hsa
agaagcauaauaaaguucacaauaaggauaauacuuuauauaauguauaaaguauauauaauau

SEQ ID NO: 459496 - RNA, 64 nt, hsa
auucugauugguaaaauuaaagaggaaauuaaucuuuauauauuauuucuugcagaaacauuca

SEQ ID NO: 459497 - RNA, 64 nt, hsa
cggaaacaaaggcuuaaugaauuuauggcagguuuuuauauaauaacaaauaaauuaaaggaaa

SEQ ID NO: 459498 - RNA, 64 nt, hsa
gcccuugauuuuaaaaauguguccauuguugcauuuuauauauauguaaguaaucauuuuggga

SEQ ID NO: 459499 - RNA, 64 nt, hsa
ucccucaaaaugcagagaaaauauaaguugucucuuuauauaaauacccauuugcuaaaaauaa

SEQ ID NO: 459500 - RNA, 64 nt, hsa
auuuuuaggagguuuuuagaauguuuccauugcuuuuauauagugugcuuguauuuugauugug

SEQ ID NO: 459501 - RNA, 64 nt, hsa
guuuaaauaaauaaaaauugaauuuuauuguucauuuauauaaaaucugauaccuugauguaau

SEQ ID NO: 459502 - RNA, 64 nt, hsa
cuuuuuaaagucuaacaaaucuuuuuagucaucuuuuauauacuuuuaguuccacaugaaauaa

SEQ ID NO: 459503 - RNA, 64 nt, hsa
uaauaaaacggcuauauuugaagagagaauacauuuuauauaaacaggaaaauacauuugacac

SEQ ID NO: 459504 - RNA, 64 nt, hsa
uucuuagccauggagagcauuugugauuaauuaauuuauauaugaaauaaugguuuccauuuua

SEQ ID NO: 459505 - RNA, 64 nt, hsa
gccauuuuuccaacagaugcuguacaccguucauuuuauauagacuagggagauucaaauacag

SEQ ID NO: 459506 - RNA, 64 nt, hsa
cacccucuguggauauggauaugaauucccagauuuuauauacucuugaauaaaagguuuauuu

SEQ ID NO: 459507 - RNA, 64 nt, hsa
aaaauuauauuugucucuuagaguuaaaauuuucuuuauauaauauugucauaugucauaguuu

SEQ ID NO: 459508 - RNA, 64 nt, hsa
uuauuacaaaauaaaacauuuuuuaauguuaaaguuuauauauuccaugcuuguuuucucauuc

SEQ ID NO: 459509 - RNA, 64 nt, hsa
agucucuuaucaggaaauagagaugauguggauauuuauauauuacauauauaaccaccagacu

SEQ ID NO: 459510 - RNA, 64 nt, hsa
uuuauauauuacauauauaaccaccagacuccauuuuauauauuagcauuuuccuugcuuaugg

SEQ ID NO: 459511 - RNA, 64 nt, hsa
auagaauugcagucauuuggugcucugcuaaccauuuauauaaaacuuaaaaacaagagaaaag

SEQ ID NO: 459512 - RNA, 64 nt, hsa
gaugugaauagguuauaugcaagcacuaugcccuuuuauauaagugacuugaacaucugugccc

SEQ ID NO: 459513 - RNA, 64 nt, hsa
ucuucauuuaauuccucauagaaucccagucaccuuuauauaucauauuauuggaagagauuca

SEQ ID NO: 459514 - RNA, 64 nt, hsa
auuuuuauucacucuucauagaaucacaauuaccuuuauauaucauauguuauuggaagagauu

SEQ ID NO: 459515 - RNA, 64 nt, hsa
cuugguaaaaacguauguauuuauauauuauauauuuauauauaauauauauuauauauuuagc

SEQ ID NO: 459516 - RNA, 64 nt, hsa
aaaaauaaaacauuucuugguaaaaacguauguauuuauauauuauauauuuauauauaauaua

SEQ ID NO: 459517 - RNA, 64 nt, hsa
gaagcuagaaaacaggcaaauuccugacugcuaguuuauauagaaauguauucuuuuaguuuuu

SEQ ID NO: 459518 - RNA, 64 nt, hsa
uauuaguuaugugcaagcuuuguauauucuuauauuuauauauaaauauaaaaauuuguuaaag

SEQ ID NO: 459519 - RNA, 64 nt, hsa
cauguagaccgcuuuauaggcuucaaaauguauuuuuauauauuaccuuauuugaucuucacaa

SEQ ID NO: 459520 - RNA, 64 nt, hsa
uuuauguggcacacaauccuauaaaugugauuuuuuuauauaaguuaaagagacaaauaguagg

SEQ ID NO: 459521 - RNA, 64 nt, hsa
gacauagauccucugauauacaauuagagauauuuuuauauagaccccaagcauucugugcaua

SEQ ID NO: 459522 - RNA, 64 nt, hsa
uuugguuuaccuggggauccaauugauguauauguuuauauacuggguucuuguuuuauauacc

SEQ ID NO: 459523 - RNA, 64 nt, hsa
aauugauguauauguuuauauacuggguucuuguuuuauauaccuggcuuuuacuuuauuaaua

SEQ ID NO: 459524 - RNA, 64 nt, hsa
uaguagaagugauaaauuguguuauauaugauaauuuauauaaaaccacuaauuguuccguuaa

SEQ ID NO: 459525 - RNA, 64 nt, hsa
acucuuuagcaauauauaacacaguauaugcuuuuuuauauauucaauguuagcccaagucuga

SEQ ID NO: 459526 - RNA, 64 nt, hsa
gacguaaaaauucaaauuauuuuaaaaggcaaaauuuauauacauaugugcuuuuuuucuauau

SEQ ID NO: 459527 - RNA, 64 nt, hsa
auuucugcauuuuacuugcauuaaaagaaaccucuuuauauacuacaguuguuccuaucucucc

SEQ ID NO: 459528 - RNA, 64 nt, hsa
guaccuguuguauguccuaaacuuauuagaaaauuuuauauacuuuuuuacauguuggggggca

SEQ ID NO: 459529 - RNA, 64 nt, hsa
cuagucuucccugggaaacuaagaagagagcuuuuuuauauacaguauauuagaauuuuccuag

SEQ ID NO: 459530 - RNA, 64 nt, hsa
augcuaagaacuauaagguacagaaaauuaauacuuuauauaguguuuuauuaacuuucuccua

SEQ ID NO: 459531 - RNA, 64 nt, hsa
aaauaauuuugguccuuaaaaggagucaggagcuuuuauauauaagguacauauuuuaaaagaa

SEQ ID NO: 459532 - RNA, 64 nt, hsa
uaaagauucuuagcuaucaagggcugcauuguauuuuauauacucaguuuuauaaggugauacu

SEQ ID NO: 459533 - RNA, 64 nt, hsa
gcuuucuccuagguuaauuuuccacaagcauuguuuuauauacacuguaaucaggauaacacaa

SEQ ID NO: 459534 - RNA, 64 nt, hsa
auuuuuuugccauaaugcuuccuguaaagccaauuuuauauacuaauaaaacaugaacugccca

SEQ ID NO: 459535 - RNA, 64 nt, hsa
uucgauaaagugauauguaauaguugcagaaggcuuuauauaugcuuauaaugaaaagauauuu

SEQ ID NO: 459536 - RNA, 64 nt, hsa
uuagugcuucucaguguucucaguguaaauucuauuuauauacagcauauucacauacuacuuu

SEQ ID NO: 459537 - RNA, 64 nt, hsa
uauacagcauauucacauacuacuuuccuuauauuuuauauaguucuaugacuguugaaacauc

SEQ ID NO: 459538 - RNA, 64 nt, hsa
uaccaaaauuuaguaggcauguuuuucuaauaaauuuauauauuuguaaagaaaacaacagaaa

SEQ ID NO: 459539 - RNA, 64 nt, hsa
aaaucuauacuuggcauccaacucaugaguggauuuuauauaggauggaacaggaagguauguc

SEQ ID NO: 459540 - RNA, 64 nt, hsa
auauagguguaacaguuucccaguuaacuuugaauuuauauauuuagauuuaaaggauuaaaaa

SEQ ID NO: 459541 - RNA, 64 nt, hsa
auuugcauaaaauuauuuuucauaacaguccuuuuuuauauauugguguaaacauaauauucuu

SEQ ID NO: 459542 - RNA, 64 nt, hsa
uuuuuuuuuuggauggcucaaaauauggugcugcuuuauauaaaccuuacauuuauauagugca

SEQ ID NO: 459543 - RNA, 64 nt, hsa
ucaaaauauggugcugcuuuauauaaaccuuacauuuauauagugcaccuaugagcaguugccu

SEQ ID NO: 459544 - RNA, 64 nt, hsa
uugguuuaauuuauucaguuucauuaggacuauuuuuauauauuuauccucuucauuuucuccu

SEQ ID NO: 459545 - RNA, 64 nt, hsa
uacuguauaaagaccucaaucuauccagaguauuuuuauauaauguuggaugaguuaggauuug

SEQ ID NO: 459546 - RNA, 64 nt, hsa
uaaagagagucugagaaaugcaauugcuauucuuuuuauauacuuuuucagauuuuuuauaugc

SEQ ID NO: 459547 - RNA, 64 nt, hsa
augcuucuuuacuacuuacaucauaaugcacaauuuuauauacugauuuuuucaaucaauguau

SEQ ID NO: 459548 - RNA, 64 nt, hsa
uaaaguuauuguuuucuaaguuaaauaacuauaauuuauauaucuauuaaaaagguacuucucu

SEQ ID NO: 459549 - RNA, 64 nt, hsa
uauauacacguauguauagaugugugaauauuuguuuauauacauauaugcacguaucuauaug

SEQ ID NO: 459550 - RNA, 64 nt, hsa
gaagaugaagcucaauaauuguucacauuguucuuuuauauauauuuauauauauauauaaaaa

SEQ ID NO: 459551 - RNA, 64 nt, hsa
cucaauaauuguucacauuguucuuuuauauauauuuauauauauauauaaaaauugggucuua

SEQ ID NO: 459552 - RNA, 64 nt, hsa
aaccuuaaugggcuguuacagaaacuaguucguguuuauauacuauuuccuuugauguccuaua

SEQ ID NO: 459553 - RNA, 64 nt, hsa
agauuuuuuccuguuuuaucugaaacauacuggauuuauauauguauaagcgccucaaugggga

SEQ ID NO: 459554 - RNA, 64 nt, hsa
agggagaggauauaagauuaauggaauguauauuuuuauauaagacguauacggcaccuucuug

SEQ ID NO: 459555 - RNA, 64 nt, hsa
guuuauaugaauguagaacaccuugacauuucuuuuuauauauaaacuauuuaauaaaaaugaa

SEQ ID NO: 459556 - RNA, 64 nt, hsa
cugugcuugccuucugaaguggcacaaaccuguguuuauauauuuaaaagauacucuaggauga

SEQ ID NO: 459557 - RNA, 64 nt, hsa
gcuaauuuuuuucaaaggugauuguaagucauauuuuauauagcauuuugcuugauuauuugcu

SEQ ID NO: 459558 - RNA, 64 nt, hsa
agaaauuugauuuuagggauugugaguaaacaaguuuauauagagagacauugugaaguuaaag

SEQ ID NO: 459559 - RNA, 64 nt, hsa
gacauaaugcuauuuaaaggcuugaauuuuucccuuuauauaauuuucaccuuuacuuucaaag

SEQ ID NO: 459560 - RNA, 64 nt, hsa
guaugcauauuuuuuucuccucuagauucauacauuuauauagcauugaaacacuuucaaacuc

SEQ ID NO: 459561 - RNA, 64 nt, hsa
cuagaguacuguuaaugccccuuucccacagucuuuuauauaauuaaauauaugucaauacaca

SEQ ID NO: 459562 - RNA, 64 nt, hsa
agugcuaaauaaauagaucuacauuuuguacauauuuauauaaaauuuaccuuuaaguauuuac

SEQ ID NO: 459563 - RNA, 64 nt, hsa
acaugcaaccaauguauaucugaguuugaagauguuuauauaggguauuuuuuccaacugcccc

SEQ ID NO: 459564 - RNA, 64 nt, hsa
auaacuauggucagggaauuuauaauauuauauuuuuauauacugaacugccauagaugcugga

SEQ ID NO: 459565 - RNA, 64 nt, hsa
uauuuucaaaauauugauaagggaaguuauuacuuuuauauaguauucaacuuuuuucagguaa

SEQ ID NO: 459566 - RNA, 64 nt, hsa
gaaaaaugugacuagacaugcuaaccuccagguuuuuauauaugacuugagucugcuguaauug

SEQ ID NO: 459567 - RNA, 64 nt, hsa
gucuuugcacaaauguaccaaucgacaaguauauuuuauauauuccauaaaaauacaaaguaac

SEQ ID NO: 459568 - RNA, 64 nt, hsa
uuugaacuguauucagguaauauguuuaaagauauuuauauauugccauacaaaaacuuaacau

SEQ ID NO: 459569 - RNA, 64 nt, hsa
aaggaaauccaaaaccuauucuaaacaauuugcauuuauauaauuuuccuguuuaacaacaaga

SEQ ID NO: 459570 - RNA, 64 nt, hsa
uauauauugacaagaguuuauauauugacaagaguuuauauauuugucaaaacuccucaaauag

SEQ ID NO: 459571 - RNA, 64 nt, hsa
uggggugguggaauacucuauauauugacaagaguuuauauauugacaagaguuuauauauuug

SEQ ID NO: 459572 - RNA, 64 nt, hsa
guggcaccucgguacccagcggguagggcgauaauuuauauauuuuccacagucagggaaggac

SEQ ID NO: 459573 - RNA, 64 nt, hsa
uugagaaagaauucuuaugaauuguuaugcgaauuuuauauauuuaaagagggagaucuggggc

SEQ ID NO: 459574 - RNA, 64 nt, hsa
gcuuuuuauauuuguacauuucuuaugagcuuuguuuauauacccauuaccuggauguuuuugu

SEQ ID NO: 459575 - RNA, 64 nt, hsa
uuuaaaguuuccuuuacccugcccuuguugaacauuuauauaaucuaaccuggacaucaagcug

SEQ ID NO: 459576 - RNA, 64 nt, hsa
uguaaacuuuuaaggacuugagauaacuaauuuguuuauauacaaaaauuaauguuacuguguu

SEQ ID NO: 459577 - RNA, 64 nt, hsa
uaauguuacuguguuacuuaacccauguuuucucuuuauauaaucacuuaucgcuuacaaauga

SEQ ID NO: 459578 - RNA, 64 nt, hsa
cauaucaucaaauguuuuuuucuuaugcgggucuuuuauauauuagggauccugagauacccga

SEQ ID NO: 459579 - RNA, 64 nt, hsa
uugcuuuguuuuucguaucaaguuauaggaucucuuuauauaauaaauguaauuuaacuugcau

SEQ ID NO: 459580 - RNA, 64 nt, hsa
uuccuggaauaauugucuaccugaagaaaaaaaauuuauauauacauuguguguguguguaaua

SEQ ID NO: 459581 - RNA, 64 nt, hsa
gcaaaaucuggaaaaugugaaagcauauuuagauuuuauauacuaucugaaaugugauuuguua

SEQ ID NO: 459582 - RNA, 64 nt, hsa
auguuuaaaauggcaaaagcccaucuuauacacuuuuauauagcugcaaaaaauuuauaucugu

SEQ ID NO: 459583 - RNA, 64 nt, hsa
uuauauauauaaaauacauauggaauauauauauuuuauauauauauauauauauuuuuauuuu

SEQ ID NO: 459584 - RNA, 64 nt, hsa
auaauauauauggaauauguauauuauauauauuuuuauauauauaauauauauggaauauaua

SEQ ID NO: 459585 - RNA, 64 nt, hsa
gagacuguuaaggaaaaaaauuuuaaaccccugauuuauauagauaucuucaugccauuacagc

SEQ ID NO: 459586 - RNA, 64 nt, hsa
uuccauuagaagcaauuggcacaucuuucuauacuuuauauacuuuucuccaguaauacauguu

SEQ ID NO: 459587 - RNA, 64 nt, hsa
ggauacaagcugggaacuucuaaacacuucauucuuuauauauggacagcuuuauuuuaaaugu

SEQ ID NO: 459588 - RNA, 64 nt, hsa
uauuugcaaaucacccacuccuuuacaaccauacuuuauauauguacauacauucauacuguag

SEQ ID NO: 459589 - RNA, 64 nt, hsa
gacaaugaauuuaaucgggcccuugguggaaacauuuauauauuuaaugcagaugcauaguguu

SEQ ID NO: 459590 - RNA, 64 nt, hsa
gcauggcugaagcauaaaagggagagagaauuucuuuauauacacaaacauacaugaauaugca

SEQ ID NO: 459591 - RNA, 64 nt, hsa
ccaaaaauguauagugccuuguuuuuauguacaguuuauauacagaaaaguuugcucugcauuu

SEQ ID NO: 459592 - RNA, 64 nt, hsa
uuugauaguuuguggauucuaaaauauauauauauuuauauaaacaccauauaagucaaauaug

SEQ ID NO: 459593 - RNA, 64 nt, hsa
aauuuacucagucuuauaaauuaaaaaugugcauuuuauauaaagaugcauuuuauauaaaaau

SEQ ID NO: 459594 - RNA, 64 nt, hsa
aaauuaaaaaugugcauuuuauauaaagaugcauuuuauauaaaaaugcacaccuuuaaucucu

SEQ ID NO: 459595 - RNA, 64 nt, hsa
gggaagacaccuggguuuuuaauucagaacccuauuuauauacuguuaaaauuugagguacugu

SEQ ID NO: 459596 - RNA, 64 nt, hsa
uauuuauauacuguuaaaauuugagguacuguaguuuauauaaaagucggauguuaagauauua

SEQ ID NO: 459597 - RNA, 64 nt, hsa
uaaacauauuguguguuuacuaacacacuuaauguuuauauaccuaauauuuauuaugccauau

SEQ ID NO: 459598 - RNA, 64 nt, hsa
agcaguaaacuugccaaauauauguacauauauauuuauauauuuuaaaaauaaacauuuuuua

SEQ ID NO: 459599 - RNA, 64 nt, hsa
ccaucaagcaccaucaaccagucagccauuauuauuuauauauguauuaccaaaagcagucuau

SEQ ID NO: 459600 - RNA, 64 nt, hsa
uacucuuuggagcucugagaugacaucuuguuguuuuauauagauguaucuuuuaaaaauaguu

SEQ ID NO: 459601 - RNA, 64 nt, hsa
gucuguuacuauuugauaaugcauaaauguuauauuuauauacaguuacagcaggccagaaaca

SEQ ID NO: 459602 - RNA, 64 nt, hsa
uucuuucuaaauuugauaauugauuaggaaguauuuuauauauaaccacuguagauauugacaa

SEQ ID NO: 459603 - RNA, 64 nt, hsa
ugucucuuccuuugucucaaaaaguaaugucaauuuuauauacuauuucaauauuacuaucugc

SEQ ID NO: 459604 - RNA, 64 nt, hsa
ugcucuaaaaugagaaagccugugguuucacuuauuuauauaacucacugggacauugccaaau

SEQ ID NO: 459605 - RNA, 64 nt, hsa
uugggguggcacuucucaauuccucuuuauauauuuuauauauauaaauauauauguauauaua

SEQ ID NO: 459606 - RNA, 64 nt, hsa
gcuuuuucuuugggguggcacuucucaauuccucuuuauauauuuuauauauauaaauauauau

SEQ ID NO: 459607 - RNA, 64 nt, hsa
uauauauaccuuguucacauacccugaagguaauuuuauauaauauuuuuaauaauuugugcau

SEQ ID NO: 459608 - RNA, 64 nt, hsa
gagauccaagucuaaacacaaaauucauuuauauuuuauauauaccuuguucacauacccugaa

SEQ ID NO: 459609 - RNA, 64 nt, hsa
agacugcaccaaguggacuaguucucccgguggcuuuauauauguagauggauauagcaguacu

SEQ ID NO: 459610 - RNA, 64 nt, hsa
gcugaugcuggcacaucauuuugcuggagaguuuuuuauauacuguagccugauuucauauugu

SEQ ID NO: 459611 - RNA, 64 nt, hsa
cggcugaggauucugucacaaugaaagaaaacuguuuauauagaccccauuggaaaagcaaaac

SEQ ID NO: 459612 - RNA, 64 nt, hsa
ucuuauucuugcaccuuuuuuucuugguaguaauuuuauauagcagguugagaaagcuacucua

SEQ ID NO: 459613 - RNA, 64 nt, hsa
cuuuguuauuuuuacaguuuucaguacaaaaguguuuauauagaaacaauaaaguugacauuug

SEQ ID NO: 459614 - RNA, 64 nt, hsa
uuugcuuucuuaugguucaauguacacaaacuguuuuauauagaaaaugauuucaaauaucaua

SEQ ID NO: 459615 - RNA, 64 nt, hsa
uuuagacuuuguguccauccccaagaucucucauuuuauauauauauauauauauauauauaua

SEQ ID NO: 459616 - RNA, 64 nt, hsa
uuccagauuucgauguuucuuaagucuaggugaauuuauauauauauuuuuuugcuuuucauuu

SEQ ID NO: 459617 - RNA, 64 nt, hsa
cagugcuuuuguuucacacuugauuuguaaaaauuuuauauauauguauuuaaaaugugccauu

SEQ ID NO: 459618 - RNA, 64 nt, hsa
augcagaugauaaaacuaauuuugaacuuuuuaauuuauauaaauuauuuuauaucacuuacuu

SEQ ID NO: 459619 - RNA, 64 nt, hsa
uuuuaagcuccuccuuuucuuugaaauacaauaauuuauauagaaauguguagcagcaaauuau

SEQ ID NO: 459620 - RNA, 64 nt, hsa
uacaaauagaugaugguaugauucuauuauauauuuuauauaaaauccauccaaauuaaguuuu

SEQ ID NO: 459621 - RNA, 64 nt, hsa
uggaagcugcagaucuuugcuaggacgcaauaaauuuauauacuuuuugagggguucuucuggg

SEQ ID NO: 459622 - RNA, 64 nt, hsa
aaauauguauuuuucauaauguuuaauauuaagcuuuauauaauacuauuuuuccacacuaaag

SEQ ID NO: 459623 - RNA, 64 nt, hsa
uguauaauuuauuaaucuggagaauguuuaaaauuuuauauaauuuaaagguaacagauauuau

SEQ ID NO: 459624 - RNA, 64 nt, hsa
ucuucccauuuuccuauauugaaaauguauauuauuuauauaacuuaaaaaguaaaaauaacua

SEQ ID NO: 459625 - RNA, 64 nt, hsa
uuuguaagucaaaauugaaaugaaugcacauagauuuauauauaaauuagcaccugagcuaagg

SEQ ID NO: 459626 - RNA, 64 nt, hsa
cuuuuuuccuucaagcauuuugcagugagcuucuuuuauauauagcaaacaauuugaaagaaua

SEQ ID NO: 459627 - RNA, 64 nt, hsa
acucagagccauggaggcaaguaccuuaauuaguuuuauauagucacaacggaaauauauuuuc

SEQ ID NO: 459628 - RNA, 64 nt, hsa
gucuuccuugaugaugcaucuauauuuauauauguuuauauauguucuucauaaaucuauuaaa

SEQ ID NO: 459629 - RNA, 64 nt, hsa
uguguccuaagucuuccuugaugaugcaucuauauuuauauauguuuauauauguucuucauaa

SEQ ID NO: 459630 - RNA, 64 nt, hsa
uauaggcuuggauguuuuuaguucugacuuugaauuuauauaaaguauuuuuauaaugacuggu

SEQ ID NO: 459631 - RNA, 64 nt, hsa
uggacucucugacaaaguggguacuuucugaaaauuuauauaacuguuguugauaaggaacauu

SEQ ID NO: 459632 - RNA, 64 nt, hsa
ucuuuugcagaauguaaaagguaaugauaauuaguuuauauaaguguacuggcuguaaaugaug

SEQ ID NO: 459633 - RNA, 64 nt, hsa
guuuguguguacauauuuuccacaaauguuauaauuuauauagugugguugaacaggaugcaau

SEQ ID NO: 459634 - RNA, 64 nt, hsa
ugaaugauugggaugauacaucauugaacugcacuuuauauaaccaaagcuuagcaguuuguua

SEQ ID NO: 459635 - RNA, 64 nt, hsa
aaaacaaaacgaaaaccuuuaagagaauguagaguuuauauaaacacaaaguaugcauugaaga

SEQ ID NO: 459636 - RNA, 64 nt, hsa
uuucgugugcuuuuuuaaacuuguuaaaaagaaauuuauauaaaauuuaaaauacaaauguuaa

SEQ ID NO: 459637 - RNA, 64 nt, hsa
cuccaucuuuacuguauauauguaaaauaccaauuuuauauagaauuguguguuuugaaaauga

SEQ ID NO: 459638 - RNA, 64 nt, hsa
uacaucccuacuaauauaauuuuaaaaugagaacuuuauauauauuacuuaaaauuaaauggac

SEQ ID NO: 459639 - RNA, 64 nt, hsa
uaaucauuauuuuaaaagcuuugcaaccuauauauuuauauaacuuuguaauauaacaugggca

SEQ ID NO: 459640 - RNA, 64 nt, hsa
ggacaaauauuguuuccuauauauauguauauguuuuauauauguauguauacucauauagaua

SEQ ID NO: 459641 - RNA, 64 nt, hsa
uuaaaaguguccaucaacagugugucagauggucuuuauauauuuuuucuguaugaaggaauag

SEQ ID NO: 459642 - RNA, 64 nt, hsa
aauaaauucagucaucuucuuaucagguugcuuauuuauauaauuuguuuauuuuauuaaaaau

SEQ ID NO: 459643 - RNA, 64 nt, hsa
accaaaaggacuuaauucuuguuuuuuucccaguuuuauauagaggaaacacuaugauaggauu

SEQ ID NO: 459644 - RNA, 64 nt, hsa
caccaaaaggacuuacuucuuguuuuuucccaguuuuauauagaggaaacacugucuaugauag

SEQ ID NO: 459645 - RNA, 64 nt, hsa
acugaagaaauguugacaauguuaaguguuugauuuuauauaacaagcuuauuaaauauauuuu

SEQ ID NO: 459646 - RNA, 64 nt, hsa
uaaaauaggauuuggaaccuuauugugauaaauauuuauauaugauguauguuugucuccccuc

SEQ ID NO: 459647 - RNA, 64 nt, hsa
uugaaaugucacauuaguaguaaagugggguuuauuuauauagugguuaagaaaugucaguuua

SEQ ID NO: 459648 - RNA, 64 nt, hsa
aauacuaaauaaaauuuggggaacacuuuuuauuuuuauauaauuuccaauuuacagaaaaguu

SEQ ID NO: 459649 - RNA, 64 nt, hsa
ggcauaauagcaaugacagucuuaagccaaacauuuuauauaaaguugcuuuuguaaaggagaa

SEQ ID NO: 459650 - RNA, 64 nt, hsa
uuuguucuuuuuacuauugaguuuugagagguuuuuuauauauccuagauaaaauuccucuguu

SEQ ID NO: 459651 - RNA, 64 nt, hsa
gaauaguuucuuccuuuuuuucuuuuaaaaauguuuuauauauuuaggggguauaaguacagau

SEQ ID NO: 459652 - RNA, 64 nt, hsa
ugucuaauguucugaugggaacguaacacuuauuuuuauauaaaaagagacugaguaaacaaac

SEQ ID NO: 459653 - RNA, 64 nt, hsa
gcagguuuuuaaacgucauuuauguaucauucuuuuuauauaucacacuuaagcuuguguuagc

SEQ ID NO: 459654 - RNA, 64 nt, hsa
cuguaggcagcaguuuuaagucuuauuuuuacuguuuauauauuugaaugcugcuacaacagau

SEQ ID NO: 459655 - RNA, 64 nt, hsa
augaaauuguuaggugaaaguguuuuugagaauuuuuauauauauuacucacugcagagaucau

SEQ ID NO: 459656 - RNA, 64 nt, hsa
uuuacaccuaucuuuaaaaggaauuuaaauuuuguuuauauacauuaacuaaaucaguacaagu

SEQ ID NO: 459657 - RNA, 64 nt, hsa
cccagauaucaucuaccuagauuuaauauaaaguuuuauauauuauauggaaauauauauuaua

SEQ ID NO: 459658 - RNA, 64 nt, hsa
uuuucuuucucuuccuccuuccucuuccuuacuuuuuauauauauauauaaagaaaaugauaca

SEQ ID NO: 459659 - RNA, 64 nt, hsa
uauauggaagcauaggugucuauauccuuacucuuuuauauaacacaauaauggcguuuuccuu

SEQ ID NO: 459660 - RNA, 64 nt, hsa
auuuugauuuuuaugaaaguugcaauucauguaauuuauauaaacuuuuuaaauguagaaacuu

SEQ ID NO: 459661 - RNA, 64 nt, hsa
ucuucuuaacccagucuuaggcugguauucccuuuuuauauauaucuauauuacuuuucaccuc

SEQ ID NO: 459662 - RNA, 64 nt, hsa
guacugagugaguacauuggcauaaauauagaaauuuauauauauacauauauauaaacuauuc

SEQ ID NO: 459663 - RNA, 64 nt, hsa
agaugcugcuucauuuacccaggaggucauauucuuuauauauauuuuuuguugcaaagugucu

SEQ ID NO: 459664 - RNA, 64 nt, hsa
acucuauauauuauucgaauuuuuaaauuauuuguuuauauauaaaagaaaagcucaauuggcu

SEQ ID NO: 459665 - RNA, 64 nt, hsa
ccaaguggccacuggcaucgcagcuuccugucuguuuauauauugaaaguugcuuuuauugcac

SEQ ID NO: 459666 - RNA, 64 nt, hsa
uucuguaauguaggcacuuuuauuuucauugugauuuauauauaagguaauguaggguuauauu

SEQ ID NO: 459667 - RNA, 64 nt, hsa
cuuuagccagaauagccuaguauuuuauuucuauuuuauauauugagauuucuucuaacauuuc

SEQ ID NO: 459668 - RNA, 64 nt, hsa
uguaucaagauuaugagguuaaaaauaaugugguuuuauauagcauagugguuuuauuuuguua

SEQ ID NO: 459669 - RNA, 64 nt, hsa
aacuaugcauauuauguauuaaaguuuucuugguuuuauauaucagagaauaaaaacuuuuuug

SEQ ID NO: 459670 - RNA, 64 nt, hsa
uaauuuuaaaaauuccuauuugauacaauuaaauuuuauauaauguguuuugcuugaauaaaau

SEQ ID NO: 459671 - RNA, 64 nt, hsa
uucauccucacuuuauguugaucuuccagcaacguuuauauauuuaguaauuuuaaaaauuccu

SEQ ID NO: 459672 - RNA, 64 nt, hsa
ccccugaggucaagagaggauggggcuauucacuuuuauauauuuauauaaaauuaguagugag

SEQ ID NO: 459673 - RNA, 64 nt, hsa
gucaagagaggauggggcuauucacuuuuauauauuuauauaaaauuaguagugagauguaaca

SEQ ID NO: 459674 - RNA, 64 nt, hsa
cccacuguauauuaauugagguuacagaaaguucuuuauauaaaacuuauuuaaauuuuucaua

SEQ ID NO: 459675 - RNA, 64 nt, hsa
uuuauguucucguuuuucuacagauauaaguaaauuuauauauaaaaauaccaaaaagaggcug

SEQ ID NO: 459676 - RNA, 64 nt, hsa
uauauacucaaauguauauaauucuaucuauagauuuauauauguauacauucuguacaguagu

SEQ ID NO: 459677 - RNA, 64 nt, hsa
uuuuuucuuuuuuucccucauuugaaucagaacuuuuauauaaaacccaaacacugauguuuac

SEQ ID NO: 459678 - RNA, 64 nt, hsa
uucuccuuuuaguguuuauauacgugcagauuaauuuauauauauauauauacacacacacaua

SEQ ID NO: 459679 - RNA, 64 nt, hsa
agagaacagacacuuggaauuucuccuuuuaguguuuauauacgugcagauuaauuuauauaua

SEQ ID NO: 459680 - RNA, 64 nt, hsa
uacuuucagaaaugaaguuuuuaauugcuauuguuuuauauaggauugaaagaaaauuaacucc

SEQ ID NO: 459681 - RNA, 64 nt, hsa
uccuuaagugacacaggaggacgccuggggacuuuuuauauauuugcagauuacgccuuuuugu

SEQ ID NO: 459682 - RNA, 64 nt, hsa
cacauuuguaauuucagauuuauuagaaagcuaauuuauauauuuuucuuccccuucauuuaca

SEQ ID NO: 459683 - RNA, 64 nt, hsa
uguuccuugaaguauuuauuuauguuuauauauguuuauauauguucuucauaaaucuauuaca

SEQ ID NO: 459684 - RNA, 64 nt, hsa
cuauccuaaauguuccuugaaguauuuauuuauguuuauauauguuuauauauguucuucauaa

SEQ ID NO: 459685 - RNA, 64 nt, hsa
uugagaauuuacuuuauggagcguauguaaguuauuuauauacaaggaaaucuauuuuaugucg

SEQ ID NO: 459686 - RNA, 64 nt, hsa
caagugccuaaguuuuuaauauuggacuugaguauuuauauauugugcaucaacucuguuggau

SEQ ID NO: 459687 - RNA, 64 nt, hsa
auuugcauuugggugguuuuuauuuuuauauacguuuauauaaauauauauaaauugagcuugc

SEQ ID NO: 459688 - RNA, 64 nt, hsa
caaaaugcguauuugcauuugggugguuuuuauuuuuauauacguuuauauaaauauauauaaa

SEQ ID NO: 459689 - RNA, 64 nt, hsa
aucucaguguccccugaacucuuuauuugccuaauuuauauauauauauaugagauauauaaau

SEQ ID NO: 459690 - RNA, 64 nt, hsa
gggucuuucuuucuacuccaggacugguuuuguuuuuauauauauaaaaaaaaaaagugaaaac

SEQ ID NO: 459691 - RNA, 64 nt, hsa
auagucauaaaauaguauguuaauauguuuuuacuuuauauauuuauauauuaaaauauauuua

SEQ ID NO: 459692 - RNA, 64 nt, hsa
aaaauaguauguuaauauguuuuuacuuuauauauuuauauauuaaaauauauuuaauauguuu

SEQ ID NO: 459693 - RNA, 64 nt, hsa
agcagacaucugaucauuuuauccauaaauauucuuuauauaucucugaaagcuaugggaugau

SEQ ID NO: 459694 - RNA, 64 nt, hsa
ccauuccaacuaggcuuuggcuaaaucugacaauuuuauauauagcuuaaaacaaagaauauac

SEQ ID NO: 459695 - RNA, 64 nt, hsa
cauuucuuccuggaacucacuuuuuauauaauguuuuauauauauauuuuuuccuuucaaauca

SEQ ID NO: 459696 - RNA, 64 nt, hsa
aaaaaagaaaaacauuucuuccuggaacucacuuuuuauauaauguuuuauauauauauuuuuu

SEQ ID NO: 459697 - RNA, 64 nt, hsa; identical to SEQ ID NO: 387427

SEQ ID NO: 459698 - RNA, 64 nt, hsa; identical to SEQ ID NO: 387428

SEQ ID NO: 459699 - RNA, 64 nt, hsa; identical to SEQ ID NO: 387429

SEQ ID NO: 459700 - RNA, 64 nt, hsa; identical to SEQ ID NO: 387430

SEQ ID NO: 459701 - RNA, 64 nt, hsa; identical to SEQ ID NO: 387431

SEQ ID NO: 459702 - RNA, 64 nt, hsa; identical to SEQ ID NO: 387432

SEQ ID NO: 459703 - RNA, 64 nt, hsa; identical to SEQ ID NO: 387433

SEQ ID NO: 459704 - RNA, 64 nt, hsa; identical to SEQ ID NO: 387434

SEQ ID NO: 459705 - RNA, 64 nt, hsa; identical to SEQ ID NO: 387435

SEQ ID NO: 459706 - RNA, 64 nt, hsa; identical to SEQ ID NO: 387436

SEQ ID NO: 459707 - RNA, 64 nt, hsa; identical to SEQ ID NO: 387437

SEQ ID NO: 459708 - RNA, 64 nt, hsa; identical to SEQ ID NO: 387438

SEQ ID NO: 459709 - RNA, 64 nt, hsa; identical to SEQ ID NO: 387439

SEQ ID NO: 459710 - RNA, 64 nt, hsa; identical to SEQ ID NO: 387440

SEQ ID NO: 459711 - RNA, 64 nt, hsa; identical to SEQ ID NO: 387441

SEQ ID NO: 459712 - RNA, 64 nt, hsa; identical to SEQ ID NO: 387442

SEQ ID NO: 459713 - RNA, 64 nt, hsa; identical to SEQ ID NO: 387443

SEQ ID NO: 459714 - RNA, 64 nt, hsa; identical to SEQ ID NO: 387444

SEQ ID NO: 459715 - RNA, 64 nt, hsa; identical to SEQ ID NO: 387445

SEQ ID NO: 459716 - RNA, 64 nt, hsa; identical to SEQ ID NO: 387446

SEQ ID NO: 459717 - RNA, 64 nt, hsa; identical to SEQ ID NO: 387447

SEQ ID NO: 459718 - RNA, 64 nt, hsa; identical to SEQ ID NO: 387448

SEQ ID NO: 459719 - RNA, 64 nt, hsa; identical to SEQ ID NO: 387449

SEQ ID NO: 459720 - RNA, 64 nt, hsa; identical to SEQ ID NO: 387450

SEQ ID NO: 459721 - RNA, 64 nt, hsa; identical to SEQ ID NO: 387451

SEQ ID NO: 459722 - RNA, 64 nt, hsa; identical to SEQ ID NO: 387452

SEQ ID NO: 459723 - RNA, 64 nt, hsa; identical to SEQ ID NO: 387453

SEQ ID NO: 459724 - RNA, 64 nt, hsa; identical to SEQ ID NO: 387454

SEQ ID NO: 459725 - RNA, 64 nt, hsa; identical to SEQ ID NO: 387455

SEQ ID NO: 459726 - RNA, 64 nt, hsa; identical to SEQ ID NO: 387456

SEQ ID NO: 459727 - RNA, 64 nt, hsa; identical to SEQ ID NO: 387457

SEQ ID NO: 459728 - RNA, 64 nt, hsa; identical to SEQ ID NO: 387458

SEQ ID NO: 459729 - RNA, 64 nt, hsa; identical to SEQ ID NO: 387459

SEQ ID NO: 459730 - RNA, 64 nt, hsa; identical to SEQ ID NO: 387460

SEQ ID NO: 459731 - RNA, 64 nt, hsa; identical to SEQ ID NO: 387461

SEQ ID NO: 459732 - RNA, 64 nt, hsa; identical to SEQ ID NO: 387462

SEQ ID NO: 459733 - RNA, 64 nt, hsa; identical to SEQ ID NO: 387463

SEQ ID NO: 459734 - RNA, 64 nt, hsa; identical to SEQ ID NO: 387464

SEQ ID NO: 459735 - RNA, 64 nt, hsa; identical to SEQ ID NO: 387465

SEQ ID NO: 459736 - RNA, 64 nt, hsa; identical to SEQ ID NO: 387466

SEQ ID NO: 459737 - RNA, 64 nt, hsa; identical to SEQ ID NO: 387467

SEQ ID NO: 459738 - RNA, 64 nt, hsa; identical to SEQ ID NO: 387468

SEQ ID NO: 459739 - RNA, 64 nt, hsa; identical to SEQ ID NO: 387469

SEQ ID NO: 459740 - RNA, 64 nt, hsa; identical to SEQ ID NO: 387470

SEQ ID NO: 459741 - RNA, 64 nt, hsa; identical to SEQ ID NO: 387471

SEQ ID NO: 459742 - RNA, 64 nt, hsa; identical to SEQ ID NO: 387472

SEQ ID NO: 459743 - RNA, 64 nt, hsa; identical to SEQ ID NO: 387473

SEQ ID NO: 459744 - RNA, 64 nt, hsa; identical to SEQ ID NO: 387474

SEQ ID NO: 459745 - RNA, 64 nt, hsa; identical to SEQ ID NO: 387475

SEQ ID NO: 459746 - RNA, 64 nt, hsa; identical to SEQ ID NO: 387476

SEQ ID NO: 459747 - RNA, 64 nt, hsa; identical to SEQ ID NO: 387477

SEQ ID NO: 459748 - RNA, 64 nt, hsa; identical to SEQ ID NO: 387478

SEQ ID NO: 459749 - RNA, 64 nt, hsa; identical to SEQ ID NO: 387479

SEQ ID NO: 459750 - RNA, 64 nt, hsa; identical to SEQ ID NO: 387480

SEQ ID NO: 459751 - RNA, 64 nt, hsa; identical to SEQ ID NO: 387481

SEQ ID NO: 459752 - RNA, 64 nt, hsa; identical to SEQ ID NO: 387482

SEQ ID NO: 459753 - RNA, 64 nt, hsa; identical to SEQ ID NO: 387483

SEQ ID NO: 459754 - RNA, 64 nt, hsa; identical to SEQ ID NO: 387484

SEQ ID NO: 459755 - RNA, 64 nt, hsa; identical to SEQ ID NO: 387485

SEQ ID NO: 459756 - RNA, 64 nt, hsa; identical to SEQ ID NO: 387486

SEQ ID NO: 459757 - RNA, 64 nt, hsa; identical to SEQ ID NO: 387487

SEQ ID NO: 459758 - RNA, 64 nt, hsa; identical to SEQ ID NO: 387488

SEQ ID NO: 459759 - RNA, 64 nt, hsa; identical to SEQ ID NO: 387487

SEQ ID NO: 459760 - RNA, 64 nt, hsa; identical to SEQ ID NO: 387488

SEQ ID NO: 459761 - RNA, 64 nt, hsa; identical to SEQ ID NO: 72274

SEQ ID NO: 459762 - RNA, 64 nt, hsa; identical to SEQ ID NO: 72275

SEQ ID NO: 459763 - RNA, 64 nt, hsa; identical to SEQ ID NO: 72276

SEQ ID NO: 459764 - RNA, 64 nt, hsa; identical to SEQ ID NO: 72277

SEQ ID NO: 459765 - RNA, 64 nt, hsa; identical to SEQ ID NO: 72278

SEQ ID NO: 459766 - RNA, 64 nt, hsa; identical to SEQ ID NO: 72279

SEQ ID NO: 459767 - RNA, 64 nt, hsa; identical to SEQ ID NO: 72280

SEQ ID NO: 459768 - RNA, 64 nt, hsa; identical to SEQ ID NO: 72281

SEQ ID NO: 459769 - RNA, 64 nt, hsa; identical to SEQ ID NO: 72282

SEQ ID NO: 459770 - RNA, 64 nt, hsa; identical to SEQ ID NO: 72283

SEQ ID NO: 459771 - RNA, 64 nt, hsa; identical to SEQ ID NO: 72284

SEQ ID NO: 459772 - RNA, 64 nt, hsa; identical to SEQ ID NO: 72285

SEQ ID NO: 459773 - RNA, 64 nt, hsa; identical to SEQ ID NO: 72286

SEQ ID NO: 459774 - RNA, 64 nt, hsa; identical to SEQ ID NO: 72287

SEQ ID NO: 459775 - RNA, 64 nt, hsa; identical to SEQ ID NO: 72288

SEQ ID NO: 459776 - RNA, 64 nt, hsa; identical to SEQ ID NO: 72289

SEQ ID NO: 459777 - RNA, 64 nt, hsa; identical to SEQ ID NO: 72290

SEQ ID NO: 459778 - RNA, 64 nt, hsa; identical to SEQ ID NO: 72291

SEQ ID NO: 459779 - RNA, 64 nt, hsa; identical to SEQ ID NO: 72292

SEQ ID NO: 459780 - RNA, 64 nt, hsa; identical to SEQ ID NO: 72293

SEQ ID NO: 459781 - RNA, 64 nt, hsa; identical to SEQ ID NO: 72294

SEQ ID NO: 459782 - RNA, 64 nt, hsa; identical to SEQ ID NO: 72295

SEQ ID NO: 459783 - RNA, 64 nt, hsa; identical to SEQ ID NO: 72296

SEQ ID NO: 459784 - RNA, 64 nt, hsa; identical to SEQ ID NO: 72297

SEQ ID NO: 459785 - RNA, 64 nt, hsa; identical to SEQ ID NO: 72298

SEQ ID NO: 459786 - RNA, 64 nt, hsa; identical to SEQ ID NO: 72299

SEQ ID NO: 459787 - RNA, 64 nt, hsa; identical to SEQ ID NO: 72300

SEQ ID NO: 459788 - RNA, 64 nt, hsa; identical to SEQ ID NO: 72301

SEQ ID NO: 459789 - RNA, 64 nt, hsa; identical to SEQ ID NO: 72302

SEQ ID NO: 459790 - RNA, 64 nt, hsa; identical to SEQ ID NO: 72303

SEQ ID NO: 459791 - RNA, 64 nt, hsa; identical to SEQ ID NO: 72304

SEQ ID NO: 459792 - RNA, 64 nt, hsa; identical to SEQ ID NO: 72305

SEQ ID NO: 459793 - RNA, 64 nt, hsa; identical to SEQ ID NO: 72306

SEQ ID NO: 459794 - RNA, 64 nt, hsa; identical to SEQ ID NO: 72307

SEQ ID NO: 459795 - RNA, 64 nt, hsa; identical to SEQ ID NO: 72308

SEQ ID NO: 459796 - RNA, 64 nt, hsa; identical to SEQ ID NO: 72309

SEQ ID NO: 459797 - RNA, 64 nt, hsa; identical to SEQ ID NO: 72310

SEQ ID NO: 459798 - RNA, 64 nt, hsa; identical to SEQ ID NO: 72311

SEQ ID NO: 459799 - RNA, 64 nt, hsa; identical to SEQ ID NO: 72312

SEQ ID NO: 459800 - RNA, 64 nt, hsa; identical to SEQ ID NO: 72313

SEQ ID NO: 459801 - RNA, 64 nt, hsa; identical to SEQ ID NO: 72314

SEQ ID NO: 459802 - RNA, 64 nt, hsa; identical to SEQ ID NO: 72315

SEQ ID NO: 459803 - RNA, 64 nt, hsa; identical to SEQ ID NO: 72316

SEQ ID NO: 459804 - RNA, 64 nt, hsa; identical to SEQ ID NO: 72317

SEQ ID NO: 459805 - RNA, 64 nt, hsa; identical to SEQ ID NO: 72318

SEQ ID NO: 459806 - RNA, 64 nt, hsa; identical to SEQ ID NO: 72319

SEQ ID NO: 459807 - RNA, 64 nt, hsa; identical to SEQ ID NO: 72320

SEQ ID NO: 459808 - RNA, 64 nt, hsa; identical to SEQ ID NO: 72321

SEQ ID NO: 459809 - RNA, 64 nt, hsa; identical to SEQ ID NO: 72322

SEQ ID NO: 459810 - RNA, 64 nt, hsa; identical to SEQ ID NO: 72323

SEQ ID NO: 459811 - RNA, 64 nt, hsa; identical to SEQ ID NO: 72324

SEQ ID NO: 459812 - RNA, 64 nt, hsa; identical to SEQ ID NO: 72325

SEQ ID NO: 459813 - RNA, 64 nt, hsa; identical to SEQ ID NO: 72326

SEQ ID NO: 459814 - RNA, 64 nt, hsa; identical to SEQ ID NO: 72327

SEQ ID NO: 459815 - RNA, 64 nt, hsa; identical to SEQ ID NO: 72328

SEQ ID NO: 459816 - RNA, 64 nt, hsa; identical to SEQ ID NO: 72329

SEQ ID NO: 459817 - RNA, 64 nt, hsa; identical to SEQ ID NO: 72330

SEQ ID NO: 459818 - RNA, 64 nt, hsa; identical to SEQ ID NO: 72331

SEQ ID NO: 459819 - RNA, 64 nt, hsa; identical to SEQ ID NO: 72332

SEQ ID NO: 459820 - RNA, 64 nt, hsa; identical to SEQ ID NO: 72333

SEQ ID NO: 459821 - RNA, 64 nt, hsa; identical to SEQ ID NO: 72334

SEQ ID NO: 459822 - RNA, 64 nt, hsa; identical to SEQ ID NO: 72335

SEQ ID NO: 459823 - RNA, 64 nt, hsa; identical to SEQ ID NO: 72336

SEQ ID NO: 459824 - RNA, 64 nt, hsa; identical to SEQ ID NO: 72337

SEQ ID NO: 459825 - RNA, 64 nt, hsa; identical to SEQ ID NO: 72338

SEQ ID NO: 459826 - RNA, 64 nt, hsa; identical to SEQ ID NO: 72339

SEQ ID NO: 459827 - RNA, 64 nt, hsa; identical to SEQ ID NO: 72340

SEQ ID NO: 459828 - RNA, 64 nt, hsa; identical to SEQ ID NO: 72341

SEQ ID NO: 459829 - RNA, 64 nt, hsa; identical to SEQ ID NO: 72342

SEQ ID NO: 459830 - RNA, 64 nt, hsa; identical to SEQ ID NO: 72343

SEQ ID NO: 459831 - RNA, 64 nt, hsa; identical to SEQ ID NO: 72344

SEQ ID NO: 459832 - RNA, 64 nt, hsa; identical to SEQ ID NO: 72345

SEQ ID NO: 459833 - RNA, 64 nt, hsa; identical to SEQ ID NO: 72346

SEQ ID NO: 459834 - RNA, 64 nt, hsa; identical to SEQ ID NO: 72347

SEQ ID NO: 459835 - RNA, 64 nt, hsa; identical to SEQ ID NO: 72348

SEQ ID NO: 459836 - RNA, 64 nt, hsa; identical to SEQ ID NO: 72349

SEQ ID NO: 459837 - RNA, 64 nt, hsa; identical to SEQ ID NO: 72350

SEQ ID NO: 459838 - RNA, 64 nt, hsa; identical to SEQ ID NO: 72351

SEQ ID NO: 459839 - RNA, 64 nt, hsa; identical to SEQ ID NO: 72352

SEQ ID NO: 459840 - RNA, 64 nt, hsa; identical to SEQ ID NO: 72353

SEQ ID NO: 459841 - RNA, 64 nt, hsa; identical to SEQ ID NO: 72354

SEQ ID NO: 459842 - RNA, 64 nt, hsa; identical to SEQ ID NO: 72355

SEQ ID NO: 459843 - RNA, 64 nt, hsa; identical to SEQ ID NO: 72356

SEQ ID NO: 459844 - RNA, 64 nt, hsa; identical to SEQ ID NO: 72357

SEQ ID NO: 459845 - RNA, 64 nt, hsa; identical to SEQ ID NO: 72358

SEQ ID NO: 459846 - RNA, 64 nt, hsa; identical to SEQ ID NO: 72359

SEQ ID NO: 459847 - RNA, 64 nt, hsa; identical to SEQ ID NO: 72360

SEQ ID NO: 459848 - RNA, 64 nt, hsa; identical to SEQ ID NO: 72361

SEQ ID NO: 459849 - RNA, 64 nt, hsa; identical to SEQ ID NO: 72362

SEQ ID NO: 459850 - RNA, 64 nt, hsa; identical to SEQ ID NO: 72363

SEQ ID NO: 459851 - RNA, 64 nt, hsa; identical to SEQ ID NO: 72364

SEQ ID NO: 459852 - RNA, 64 nt, hsa; identical to SEQ ID NO: 72365

SEQ ID NO: 459853 - RNA, 64 nt, hsa; identical to SEQ ID NO: 72366

SEQ ID NO: 459854 - RNA, 64 nt, hsa; identical to SEQ ID NO: 72367

SEQ ID NO: 459855 - RNA, 64 nt, hsa; identical to SEQ ID NO: 72368

SEQ ID NO: 459856 - RNA, 64 nt, hsa; identical to SEQ ID NO: 72369

SEQ ID NO: 459857 - RNA, 64 nt, hsa; identical to SEQ ID NO: 72370

SEQ ID NO: 459858 - RNA, 64 nt, hsa; identical to SEQ ID NO: 72371

SEQ ID NO: 459859 - RNA, 64 nt, hsa; identical to SEQ ID NO: 72372

SEQ ID NO: 459860 - RNA, 64 nt, hsa; identical to SEQ ID NO: 72373

SEQ ID NO: 459861 - RNA, 64 nt, hsa; identical to SEQ ID NO: 72374

SEQ ID NO: 459862 - RNA, 64 nt, hsa; identical to SEQ ID NO: 72375

SEQ ID NO: 459863 - RNA, 64 nt, hsa; identical to SEQ ID NO: 72376

SEQ ID NO: 459864 - RNA, 64 nt, hsa; identical to SEQ ID NO: 72377

SEQ ID NO: 459865 - RNA, 64 nt, hsa; identical to SEQ ID NO: 72378

SEQ ID NO: 459866 - RNA, 64 nt, hsa; identical to SEQ ID NO: 72379

SEQ ID NO: 459867 - RNA, 64 nt, hsa; identical to SEQ ID NO: 72380

SEQ ID NO: 459868 - RNA, 64 nt, hsa; identical to SEQ ID NO: 72381

SEQ ID NO: 459869 - RNA, 64 nt, hsa; identical to SEQ ID NO: 72382

SEQ ID NO: 459870 - RNA, 64 nt, hsa; identical to SEQ ID NO: 72383

SEQ ID NO: 459871 - RNA, 64 nt, hsa; identical to SEQ ID NO: 72384

SEQ ID NO: 459872 - RNA, 64 nt, hsa; identical to SEQ ID NO: 72385

SEQ ID NO: 459873 - RNA, 64 nt, hsa; identical to SEQ ID NO: 72386

SEQ ID NO: 459874 - RNA, 64 nt, hsa; identical to SEQ ID NO: 72387

SEQ ID NO: 459875 - RNA, 64 nt, hsa; identical to SEQ ID NO: 72388

SEQ ID NO: 459876 - RNA, 64 nt, hsa; identical to SEQ ID NO: 72389

SEQ ID NO: 459877 - RNA, 64 nt, hsa; identical to SEQ ID NO: 72390

SEQ ID NO: 459878 - RNA, 64 nt, hsa; identical to SEQ ID NO: 72391

SEQ ID NO: 459879 - RNA, 64 nt, hsa; identical to SEQ ID NO: 72392

SEQ ID NO: 459880 - RNA, 64 nt, hsa; identical to SEQ ID NO: 72393

SEQ ID NO: 459881 - RNA, 64 nt, hsa; identical to SEQ ID NO: 72394

SEQ ID NO: 459882 - RNA, 64 nt, hsa; identical to SEQ ID NO: 72395

SEQ ID NO: 459883 - RNA, 64 nt, hsa; identical to SEQ ID NO: 72396

SEQ ID NO: 459884 - RNA, 64 nt, hsa; identical to SEQ ID NO: 72397

SEQ ID NO: 459885 - RNA, 64 nt, hsa; identical to SEQ ID NO: 72398

SEQ ID NO: 459886 - RNA, 64 nt, hsa; identical to SEQ ID NO: 72399

SEQ ID NO: 459887 - RNA, 64 nt, hsa; identical to SEQ ID NO: 72400

SEQ ID NO: 459888 - RNA, 64 nt, hsa; identical to SEQ ID NO: 72401

SEQ ID NO: 459889 - RNA, 64 nt, hsa; identical to SEQ ID NO: 72402

SEQ ID NO: 459890 - RNA, 64 nt, hsa; identical to SEQ ID NO: 72403

SEQ ID NO: 459891 - RNA, 64 nt, hsa; identical to SEQ ID NO: 72404

SEQ ID NO: 459892 - RNA, 64 nt, hsa; identical to SEQ ID NO: 72405

SEQ ID NO: 459893 - RNA, 64 nt, hsa; identical to SEQ ID NO: 72406

SEQ ID NO: 459894 - RNA, 64 nt, hsa; identical to SEQ ID NO: 72407

SEQ ID NO: 459895 - RNA, 64 nt, hsa; identical to SEQ ID NO: 72408

SEQ ID NO: 459896 - RNA, 64 nt, hsa; identical to SEQ ID NO: 72409

SEQ ID NO: 459897 - RNA, 64 nt, hsa; identical to SEQ ID NO: 72410

SEQ ID NO: 459898 - RNA, 64 nt, hsa; identical to SEQ ID NO: 72411

SEQ ID NO: 459899 - RNA, 64 nt, hsa; identical to SEQ ID NO: 72412

SEQ ID NO: 459900 - RNA, 64 nt, hsa; identical to SEQ ID NO: 72413

SEQ ID NO: 459901 - RNA, 64 nt, hsa; identical to SEQ ID NO: 72414

SEQ ID NO: 459902 - RNA, 64 nt, hsa; identical to SEQ ID NO: 72415

SEQ ID NO: 459903 - RNA, 64 nt, hsa; identical to SEQ ID NO: 72416

SEQ ID NO: 459904 - RNA, 64 nt, hsa; identical to SEQ ID NO: 72417

SEQ ID NO: 459905 - RNA, 64 nt, hsa; identical to SEQ ID NO: 72418

SEQ ID NO: 459906 - RNA, 64 nt, hsa; identical to SEQ ID NO: 72419

SEQ ID NO: 459907 - RNA, 64 nt, hsa; identical to SEQ ID NO: 72420

SEQ ID NO: 459908 - RNA, 64 nt, hsa; identical to SEQ ID NO: 72421

SEQ ID NO: 459909 - RNA, 64 nt, hsa; identical to SEQ ID NO: 72422

SEQ ID NO: 459910 - RNA, 64 nt, hsa; identical to SEQ ID NO: 72423

SEQ ID NO: 459911 - RNA, 64 nt, hsa; identical to SEQ ID NO: 72424

SEQ ID NO: 459912 - RNA, 64 nt, hsa; identical to SEQ ID NO: 72425

SEQ ID NO: 459913 - RNA, 64 nt, hsa; identical to SEQ ID NO: 72426

SEQ ID NO: 459914 - RNA, 64 nt, hsa; identical to SEQ ID NO: 72427

SEQ ID NO: 459915 - RNA, 64 nt, hsa; identical to SEQ ID NO: 72428

SEQ ID NO: 459916 - RNA, 64 nt, hsa; identical to SEQ ID NO: 72429

SEQ ID NO: 459917 - RNA, 64 nt, hsa; identical to SEQ ID NO: 72430

SEQ ID NO: 459918 - RNA, 64 nt, hsa; identical to SEQ ID NO: 72431

SEQ ID NO: 459919 - RNA, 64 nt, hsa; identical to SEQ ID NO: 72432

SEQ ID NO: 459920 - RNA, 64 nt, hsa; identical to SEQ ID NO: 72433

SEQ ID NO: 459921 - RNA, 64 nt, hsa; identical to SEQ ID NO: 72434

SEQ ID NO: 459922 - RNA, 64 nt, hsa
aggccuauucuuuucaguugaccuuuuguaauauuugauuuagaguauuuuggacaaaugcucu

SEQ ID NO: 459923 - RNA, 64 nt, hsa
uaguagaguugcuugaagauuagacuagacaggguugauuuauuauuagcaugucauuuguaca

SEQ ID NO: 459924 - RNA, 64 nt, hsa
uacagauaacuuuucaaaaauucaucauucacccuugauuuaauuauuucucuggcaaugauuu

SEQ ID NO: 459925 - RNA, 64 nt, hsa
aauggaaauaggaaaaauuagucgaaaauaaagguugauuuagaaaugaagaaaaugaauauau

SEQ ID NO: 459926 - RNA, 64 nt, hsa
uccuuuaaaaaaauuauagacacgguucacuaaauugauuuagucagaauuccuagacugaaag

SEQ ID NO: 459927 - RNA, 64 nt, hsa
uuuuuuuuguuuuguuuugguaaugaaagaggccuugauuuaaagguuucgugucaauucucua

SEQ ID NO: 459928 - RNA, 64 nt, hsa
caaaucauucuugguaaauguaaaucaaacaugauugauuuaaaacuucauggaauuuguagaa

SEQ ID NO: 459929 - RNA, 64 nt, hsa
aggagcaaaaauaaaaccaaaguguuaguaaauuuugauuuauuagauauuuuagaaaaauaau

SEQ ID NO: 459930 - RNA, 64 nt, hsa
cuuuugugagagacuaaacuuauuuuuaagccaguugauuuaggaugcucuauuacuaauaacu

SEQ ID NO: 459931 - RNA, 64 nt, hsa
uaaccagugacacuccccuucucguugccagcaguugauuuacaguggucacagggcccaauuc

SEQ ID NO: 459932 - RNA, 64 nt, hsa
aucuaauauucuggcugcuuuggauacaauacucuugauuuaugauaauuaguuaaaauauauu

SEQ ID NO: 459933 - RNA, 64 nt, hsa
uggccacugggguuaaauuuaguguacuacaacauugauuuacugaagggcacuaauguuuccc

SEQ ID NO: 459934 - RNA, 64 nt, hsa
uuuucucuggcccucuaccuugcuuccugggaguuugauuuaggauugcuguugaaggcuuccu

SEQ ID NO: 459935 - RNA, 64 nt, hsa
ucucacugguaaggugacuugguggcguucccacuugauuuagccauuuucuuccauugugaga

SEQ ID NO: 459936 - RNA, 64 nt, hsa
ucuagcaaauauaaugcuaguccuagauuacuuauugauuuaaaaacaaaaaaaagauuacuua

SEQ ID NO: 459937 - RNA, 64 nt, hsa
auugauuuaaaaacaaaaaaaagauuacuuaauuuugauuuaaaaacaaaaaaucguaaaauac

SEQ ID NO: 459938 - RNA, 64 nt, hsa
uccagaucgagcgcaguucaugcacaaggccccguugauuuaaaauauuggaucuugcucuguu

SEQ ID NO: 459939 - RNA, 64 nt, hsa
gaggaaaaaaaugugguuuggccuugcugcuguuuugauuuauggaauuugaaaaagauaauua

SEQ ID NO: 459940 - RNA, 64 nt, hsa
uuaguccaaguuccaguucuuuuaggccuucucuuugauuuauuuuccccugcaugugagaagc

SEQ ID NO: 459941 - RNA, 64 nt, hsa
ccuccuaggccugcagacaugagggagugaaugauugauuuaccugcuucucacuaagagucca

SEQ ID NO: 459942 - RNA, 64 nt, hsa
gucauuaucucccuuucuccacuugauuaccaguuugauuuauuggacaagauacuaagcuucu

SEQ ID NO: 459943 - RNA, 64 nt, hsa
agcauaauaaauuuuauauuagagaaagaauauguugauuuaaaagccuuccaacaccauuuaa

SEQ ID NO: 459944 - RNA, 64 nt, hsa
agcaucuaaccuuuuacuuuugcauaggaaauacuugauuuaauuacagguccagggaugagcu

SEQ ID NO: 459945 - RNA, 64 nt, hsa
aggcauuuuaccuuccagugcaaauccugcuccuuugauuuaaugggguguacuggggccaggg

SEQ ID NO: 459946 - RNA, 64 nt, hsa
agugauguuucugcaauaauugugaaaugcauuauugauuuaaauaaugcugacacguacucuu

SEQ ID NO: 459947 - RNA, 64 nt, hsa
uccaaaauaggaagaaguggaguaguuugcaguauugauuuauaucuuagacuacuuuagcaau

SEQ ID NO: 459948 - RNA, 64 nt, hsa
uagccaaaguacagguguauauaguucagggcacuugauuuagauuuggaggggcugggguggg

SEQ ID NO: 459949 - RNA, 64 nt, hsa
guagcauugccuuaaaucuuauccaguuagaacauugauuuauuuacaugauguucagauuuuc

SEQ ID NO: 459950 - RNA, 64 nt, hsa; identical to SEQ ID NO: 59936

SEQ ID NO: 459951 - RNA, 64 nt, hsa; identical to SEQ ID NO: 59937

SEQ ID NO: 459952 - RNA, 64 nt, hsa; identical to SEQ ID NO: 59938

SEQ ID NO: 459953 - RNA, 64 nt, hsa; identical to SEQ ID NO: 59939

SEQ ID NO: 459954 - RNA, 64 nt, hsa; identical to SEQ ID NO: 59940

SEQ ID NO: 459955 - RNA, 64 nt, hsa; identical to SEQ ID NO: 59941

SEQ ID NO: 459956 - RNA, 64 nt, hsa; identical to SEQ ID NO: 59942

SEQ ID NO: 459957 - RNA, 64 nt, hsa; identical to SEQ ID NO: 59943

SEQ ID NO: 459958 - RNA, 64 nt, hsa; identical to SEQ ID NO: 59944

SEQ ID NO: 459959 - RNA, 64 nt, hsa; identical to SEQ ID NO: 59945

SEQ ID NO: 459960 - RNA, 64 nt, hsa; identical to SEQ ID NO: 59946

SEQ ID NO: 459961 - RNA, 64 nt, hsa; identical to SEQ ID NO: 59947

SEQ ID NO: 459962 - RNA, 64 nt, hsa; identical to SEQ ID NO: 59948

SEQ ID NO: 459963 - RNA, 64 nt, hsa; identical to SEQ ID NO: 59949

SEQ ID NO: 459964 - RNA, 64 nt, hsa; identical to SEQ ID NO: 59950

SEQ ID NO: 459965 - RNA, 64 nt, hsa; identical to SEQ ID NO: 59951

SEQ ID NO: 459966 - RNA, 64 nt, hsa; identical to SEQ ID NO: 59952

SEQ ID NO: 459967 - RNA, 64 nt, hsa; identical to SEQ ID NO: 59953

SEQ ID NO: 459968 - RNA, 64 nt, hsa; identical to SEQ ID NO: 59954

SEQ ID NO: 459969 - RNA, 64 nt, hsa; identical to SEQ ID NO: 59955

SEQ ID NO: 459970 - RNA, 64 nt, hsa; identical to SEQ ID NO: 71880

SEQ ID NO: 459971 - RNA, 64 nt, hsa; identical to SEQ ID NO: 71881

SEQ ID NO: 459972 - RNA, 64 nt, hsa; identical to SEQ ID NO: 71882

SEQ ID NO: 459973 - RNA, 64 nt, hsa; identical to SEQ ID NO: 71883

SEQ ID NO: 459974 - RNA, 64 nt, hsa; identical to SEQ ID NO: 71884

SEQ ID NO: 459975 - RNA, 64 nt, hsa; identical to SEQ ID NO: 71885

SEQ ID NO: 459976 - RNA, 64 nt, hsa; identical to SEQ ID NO: 71886

SEQ ID NO: 459977 - RNA, 64 nt, hsa; identical to SEQ ID NO: 71887

SEQ ID NO: 459978 - RNA, 64 nt, hsa; identical to SEQ ID NO: 71888

SEQ ID NO: 459979 - RNA, 64 nt, hsa; identical to SEQ ID NO: 71889

SEQ ID NO: 459980 - RNA, 64 nt, hsa; identical to SEQ ID NO: 71890

SEQ ID NO: 459981 - RNA, 64 nt, hsa; identical to SEQ ID NO: 71891

SEQ ID NO: 459982 - RNA, 64 nt, hsa; identical to SEQ ID NO: 71892

SEQ ID NO: 459983 - RNA, 64 nt, hsa; identical to SEQ ID NO: 71893

SEQ ID NO: 459984 - RNA, 64 nt, hsa; identical to SEQ ID NO: 71894

SEQ ID NO: 459985 - RNA, 64 nt, hsa; identical to SEQ ID NO: 71895

SEQ ID NO: 459986 - RNA, 64 nt, hsa; identical to SEQ ID NO: 71896

SEQ ID NO: 459987 - RNA, 64 nt, hsa; identical to SEQ ID NO: 71897

SEQ ID NO: 459988 - RNA, 64 nt, hsa; identical to SEQ ID NO: 71898

SEQ ID NO: 459989 - RNA, 64 nt, hsa; identical to SEQ ID NO: 71899

SEQ ID NO: 459990 - RNA, 64 nt, hsa; identical to SEQ ID NO: 71900

SEQ ID NO: 459991 - RNA, 65 nt, hsa; identical to SEQ ID NO: 242081

SEQ ID NO: 459992 - RNA, 65 nt, hsa; identical to SEQ ID NO: 242082

SEQ ID NO: 459993 - RNA, 65 nt, hsa; identical to SEQ ID NO: 242083

SEQ ID NO: 459994 - RNA, 65 nt, hsa; identical to SEQ ID NO: 242084

SEQ ID NO: 459995 - RNA, 65 nt, hsa; identical to SEQ ID NO: 242085

SEQ ID NO: 459996 - RNA, 65 nt, hsa; identical to SEQ ID NO: 242086

SEQ ID NO: 459997 - RNA, 65 nt, hsa; identical to SEQ ID NO: 242087

SEQ ID NO: 459998 - RNA, 65 nt, hsa; identical to SEQ ID NO: 242088

SEQ ID NO: 459999 - RNA, 65 nt, hsa; identical to SEQ ID NO: 242089

SEQ ID NO: 460000 - RNA, 65 nt, hsa; identical to SEQ ID NO: 242090

SEQ ID NO: 460001 - RNA, 65 nt, hsa; identical to SEQ ID NO: 242091

SEQ ID NO: 460002 - RNA, 65 nt, hsa; identical to SEQ ID NO: 242092

SEQ ID NO: 460003 - RNA, 65 nt, hsa; identical to SEQ ID NO: 242093

SEQ ID NO: 460004 - RNA, 65 nt, hsa; identical to SEQ ID NO: 242094

SEQ ID NO: 460005 - RNA, 65 nt, hsa; identical to SEQ ID NO: 242095

SEQ ID NO: 460006 - RNA, 65 nt, hsa; identical to SEQ ID NO: 242096

SEQ ID NO: 460007 - RNA, 65 nt, hsa; identical to SEQ ID NO: 242097

SEQ ID NO: 460008 - RNA, 65 nt, hsa; identical to SEQ ID NO: 242098

SEQ ID NO: 460009 - RNA, 65 nt, hsa; identical to SEQ ID NO: 242099

SEQ ID NO: 460010 - RNA, 65 nt, hsa; identical to SEQ ID NO: 242100

SEQ ID NO: 460011 - RNA, 65 nt, hsa; identical to SEQ ID NO: 242101

SEQ ID NO: 460012 - RNA, 65 nt, hsa; identical to SEQ ID NO: 242102

SEQ ID NO: 460013 - RNA, 65 nt, hsa; identical to SEQ ID NO: 242103

SEQ ID NO: 460014 - RNA, 65 nt, hsa; identical to SEQ ID NO: 242104

SEQ ID NO: 460015 - RNA, 65 nt, hsa; identical to SEQ ID NO: 242105

SEQ ID NO: 460016 - RNA, 65 nt, hsa; identical to SEQ ID NO: 242106

SEQ ID NO: 460017 - RNA, 65 nt, hsa; identical to SEQ ID NO: 242107

SEQ ID NO: 460018 - RNA, 65 nt, hsa; identical to SEQ ID NO: 242108

SEQ ID NO: 460019 - RNA, 65 nt, hsa; identical to SEQ ID NO: 242109

SEQ ID NO: 460020 - RNA, 65 nt, hsa; identical to SEQ ID NO: 242110

SEQ ID NO: 460021 - RNA, 65 nt, hsa; identical to SEQ ID NO: 242111

SEQ ID NO: 460022 - RNA, 65 nt, hsa; identical to SEQ ID NO: 242112

SEQ ID NO: 460023 - RNA, 65 nt, hsa; identical to SEQ ID NO: 242113

SEQ ID NO: 460024 - RNA, 65 nt, hsa; identical to SEQ ID NO: 242114

SEQ ID NO: 460025 - RNA, 65 nt, hsa; identical to SEQ ID NO: 242115

SEQ ID NO: 460026 - RNA, 65 nt, hsa; identical to SEQ ID NO: 242116

SEQ ID NO: 460027 - RNA, 65 nt, hsa; identical to SEQ ID NO: 242117

SEQ ID NO: 460028 - RNA, 65 nt, hsa; identical to SEQ ID NO: 242118

SEQ ID NO: 460029 - RNA, 65 nt, hsa; identical to SEQ ID NO: 242119

SEQ ID NO: 460030 - RNA, 65 nt, hsa; identical to SEQ ID NO: 242120

SEQ ID NO: 460031 - RNA, 65 nt, hsa; identical to SEQ ID NO: 242121

SEQ ID NO: 460032 - RNA, 65 nt, hsa; identical to SEQ ID NO: 242122

SEQ ID NO: 460033 - RNA, 65 nt, hsa; identical to SEQ ID NO: 242123

SEQ ID NO: 460034 - RNA, 65 nt, hsa; identical to SEQ ID NO: 242124

SEQ ID NO: 460035 - RNA, 65 nt, hsa; identical to SEQ ID NO: 242125

SEQ ID NO: 460036 - RNA, 65 nt, hsa; identical to SEQ ID NO: 242126

SEQ ID NO: 460037 - RNA, 65 nt, hsa; identical to SEQ ID NO: 242127

SEQ ID NO: 460038 - RNA, 65 nt, hsa; identical to SEQ ID NO: 242128

SEQ ID NO: 460039 - RNA, 65 nt, hsa; identical to SEQ ID NO: 242129

SEQ ID NO: 460040 - RNA, 65 nt, hsa; identical to SEQ ID NO: 242130

SEQ ID NO: 460041 - RNA, 65 nt, hsa; identical to SEQ ID NO: 242131

SEQ ID NO: 460042 - RNA, 65 nt, hsa; identical to SEQ ID NO: 242132

SEQ ID NO: 460043 - RNA, 65 nt, hsa; identical to SEQ ID NO: 242133

SEQ ID NO: 460044 - RNA, 65 nt, hsa; identical to SEQ ID NO: 242134

SEQ ID NO: 460045 - RNA, 65 nt, hsa; identical to SEQ ID NO: 242135

SEQ ID NO: 460046 - RNA, 65 nt, hsa; identical to SEQ ID NO: 242136

SEQ ID NO: 460047 - RNA, 65 nt, hsa; identical to SEQ ID NO: 242137

SEQ ID NO: 460048 - RNA, 65 nt, hsa; identical to SEQ ID NO: 242138

SEQ ID NO: 460049 - RNA, 65 nt, hsa; identical to SEQ ID NO: 242139

SEQ ID NO: 460050 - RNA, 65 nt, hsa; identical to SEQ ID NO: 242140

SEQ ID NO: 460051 - RNA, 65 nt, hsa; identical to SEQ ID NO: 242141

SEQ ID NO: 460052 - RNA, 62 nt, hsa; identical to SEQ ID NO: 242142

SEQ ID NO: 460053 - RNA, 65 nt, hsa; identical to SEQ ID NO: 242143

SEQ ID NO: 460054 - RNA, 65 nt, hsa; identical to SEQ ID NO: 242144

SEQ ID NO: 460055 - RNA, 65 nt, hsa; identical to SEQ ID NO: 242145

SEQ ID NO: 460056 - RNA, 65 nt, hsa; identical to SEQ ID NO: 242146

SEQ ID NO: 460057 - RNA, 65 nt, hsa; identical to SEQ ID NO: 242147

SEQ ID NO: 460058 - RNA, 65 nt, hsa; identical to SEQ ID NO: 242148

SEQ ID NO: 460059 - RNA, 65 nt, hsa; identical to SEQ ID NO: 242149

SEQ ID NO: 460060 - RNA, 65 nt, hsa; identical to SEQ ID NO: 242150

SEQ ID NO: 460061 - RNA, 65 nt, hsa; identical to SEQ ID NO: 242151

SEQ ID NO: 460062 - RNA, 65 nt, hsa; identical to SEQ ID NO: 242152

SEQ ID NO: 460063 - RNA, 65 nt, hsa; identical to SEQ ID NO: 242153

SEQ ID NO: 460064 - RNA, 65 nt, hsa; identical to SEQ ID NO: 242154

SEQ ID NO: 460065 - RNA, 65 nt, hsa; identical to SEQ ID NO: 242155

SEQ ID NO: 460066 - RNA, 65 nt, hsa; identical to SEQ ID NO: 242156

SEQ ID NO: 460067 - RNA, 65 nt, hsa; identical to SEQ ID NO: 242157

SEQ ID NO: 460068 - RNA, 65 nt, hsa; identical to SEQ ID NO: 242158

SEQ ID NO: 460069 - RNA, 65 nt, hsa; identical to SEQ ID NO: 242159

SEQ ID NO: 460070 - RNA, 65 nt, hsa; identical to SEQ ID NO: 242160

SEQ ID NO: 460071 - RNA, 65 nt, hsa; identical to SEQ ID NO: 242161

SEQ ID NO: 460072 - RNA, 65 nt, hsa; identical to SEQ ID NO: 242162

SEQ ID NO: 460073 - RNA, 65 nt, hsa; identical to SEQ ID NO: 242163

SEQ ID NO: 460074 - RNA, 65 nt, hsa; identical to SEQ ID NO: 242164

SEQ ID NO: 460075 - RNA, 65 nt, hsa; identical to SEQ ID NO: 242165

SEQ ID NO: 460076 - RNA, 65 nt, hsa; identical to SEQ ID NO: 242166

SEQ ID NO: 460077 - RNA, 65 nt, hsa; identical to SEQ ID NO: 242167

SEQ ID NO: 460078 - RNA, 65 nt, hsa; identical to SEQ ID NO: 242168

SEQ ID NO: 460079 - RNA, 60 nt, hsa; identical to SEQ ID NO: 242169

SEQ ID NO: 460080 - RNA, 65 nt, hsa; identical to SEQ ID NO: 242170

SEQ ID NO: 460081 - RNA, 65 nt, hsa; identical to SEQ ID NO: 242171

SEQ ID NO: 460082 - RNA, 65 nt, hsa; identical to SEQ ID NO: 242172

SEQ ID NO: 460083 - RNA, 65 nt, hsa; identical to SEQ ID NO: 242173

SEQ ID NO: 460084 - RNA, 65 nt, hsa; identical to SEQ ID NO: 242174

SEQ ID NO: 460085 - RNA, 65 nt, hsa; identical to SEQ ID NO: 242175

SEQ ID NO: 460086 - RNA, 65 nt, hsa; identical to SEQ ID NO: 242176

SEQ ID NO: 460087 - RNA, 65 nt, hsa; identical to SEQ ID NO: 242177

SEQ ID NO: 460088 - RNA, 65 nt, hsa; identical to SEQ ID NO: 242178

SEQ ID NO: 460089 - RNA, 65 nt, hsa; identical to SEQ ID NO: 242179

SEQ ID NO: 460090 - RNA, 65 nt, hsa; identical to SEQ ID NO: 242180

SEQ ID NO: 460091 - RNA, 65 nt, hsa; identical to SEQ ID NO: 242181

SEQ ID NO: 460092 - RNA, 65 nt, hsa; identical to SEQ ID NO: 242182

SEQ ID NO: 460093 - RNA, 65 nt, hsa; identical to SEQ ID NO: 242183

SEQ ID NO: 460094 - RNA, 65 nt, hsa; identical to SEQ ID NO: 242184

SEQ ID NO: 460095 - RNA, 65 nt, hsa; identical to SEQ ID NO: 242185

SEQ ID NO: 460096 - RNA, 65 nt, hsa; identical to SEQ ID NO: 242186

SEQ ID NO: 460097 - RNA, 65 nt, hsa; identical to SEQ ID NO: 242187

SEQ ID NO: 460098 - RNA, 65 nt, hsa; identical to SEQ ID NO: 242188

SEQ ID NO: 460099 - RNA, 65 nt, hsa; identical to SEQ ID NO: 242189

SEQ ID NO: 460100 - RNA, 65 nt, hsa; identical to SEQ ID NO: 242190

SEQ ID NO: 460101 - RNA, 65 nt, hsa; identical to SEQ ID NO: 242191

SEQ ID NO: 460102 - RNA, 65 nt, hsa; identical to SEQ ID NO: 242192

SEQ ID NO: 460103 - RNA, 65 nt, hsa; identical to SEQ ID NO: 242193

SEQ ID NO: 460104 - RNA, 65 nt, hsa; identical to SEQ ID NO: 242194

SEQ ID NO: 460105 - RNA, 65 nt, hsa; identical to SEQ ID NO: 242195

SEQ ID NO: 460106 - RNA, 65 nt, hsa; identical to SEQ ID NO: 242196

SEQ ID NO: 460107 - RNA, 65 nt, hsa; identical to SEQ ID NO: 242197

SEQ ID NO: 460108 - RNA, 65 nt, hsa; identical to SEQ ID NO: 242198

SEQ ID NO: 460109 - RNA, 65 nt, hsa; identical to SEQ ID NO: 242199

SEQ ID NO: 460110 - RNA, 65 nt, hsa; identical to SEQ ID NO: 242200

SEQ ID NO: 460111 - RNA, 65 nt, hsa; identical to SEQ ID NO: 242201

SEQ ID NO: 460112 - RNA, 65 nt, hsa; identical to SEQ ID NO: 242202

SEQ ID NO: 460113 - RNA, 65 nt, hsa; identical to SEQ ID NO: 242203

SEQ ID NO: 460114 - RNA, 65 nt, hsa; identical to SEQ ID NO: 242204

SEQ ID NO: 460115 - RNA, 65 nt, hsa; identical to SEQ ID NO: 242205

SEQ ID NO: 460116 - RNA, 65 nt, hsa; identical to SEQ ID NO: 242206

SEQ ID NO: 460117 - RNA, 65 nt, hsa; identical to SEQ ID NO: 242207

SEQ ID NO: 460118 - RNA, 65 nt, hsa; identical to SEQ ID NO: 242208

SEQ ID NO: 460119 - RNA, 65 nt, hsa; identical to SEQ ID NO: 242209

SEQ ID NO: 460120 - RNA, 65 nt, hsa; identical to SEQ ID NO: 242210

SEQ ID NO: 460121 - RNA, 65 nt, hsa; identical to SEQ ID NO: 242211

SEQ ID NO: 460122 - RNA, 65 nt, hsa; identical to SEQ ID NO: 242212

SEQ ID NO: 460123 - RNA, 65 nt, hsa; identical to SEQ ID NO: 242213

SEQ ID NO: 460124 - RNA, 65 nt, hsa; identical to SEQ ID NO: 242214

SEQ ID NO: 460125 - RNA, 65 nt, hsa; identical to SEQ ID NO: 242215

SEQ ID NO: 460126 - RNA, 65 nt, hsa; identical to SEQ ID NO: 242216

SEQ ID NO: 460127 - RNA, 65 nt, hsa; identical to SEQ ID NO: 242217

SEQ ID NO: 460128 - RNA, 50 nt, hsa; identical to SEQ ID NO: 242218

SEQ ID NO: 460129 - RNA, 65 nt, hsa; identical to SEQ ID NO: 242219

SEQ ID NO: 460130 - RNA, 65 nt, hsa; identical to SEQ ID NO: 242220

SEQ ID NO: 460131 - RNA, 65 nt, hsa; identical to SEQ ID NO: 242221

SEQ ID NO: 460132 - RNA, 65 nt, hsa; identical to SEQ ID NO: 242222

SEQ ID NO: 460133 - RNA, 65 nt, hsa; identical to SEQ ID NO: 242223

SEQ ID NO: 460134 - RNA, 65 nt, hsa; identical to SEQ ID NO: 242224

SEQ ID NO: 460135 - RNA, 65 nt, hsa; identical to SEQ ID NO: 242225

SEQ ID NO: 460136 - RNA, 65 nt, hsa; identical to SEQ ID NO: 242226

SEQ ID NO: 460137 - RNA, 65 nt, hsa; identical to SEQ ID NO: 242227

SEQ ID NO: 460138 - RNA, 65 nt, hsa; identical to SEQ ID NO: 242228

SEQ ID NO: 460139 - RNA, 65 nt, hsa; identical to SEQ ID NO: 242229

SEQ ID NO: 460140 - RNA, 65 nt, hsa; identical to SEQ ID NO: 242230

SEQ ID NO: 460141 - RNA, 65 nt, hsa; identical to SEQ ID NO: 242231

SEQ ID NO: 460142 - RNA, 65 nt, hsa; identical to SEQ ID NO: 242232

SEQ ID NO: 460143 - RNA, 65 nt, hsa; identical to SEQ ID NO: 242233

SEQ ID NO: 460144 - RNA, 65 nt, hsa; identical to SEQ ID NO: 242234

SEQ ID NO: 460145 - RNA, 65 nt, hsa; identical to SEQ ID NO: 242235

SEQ ID NO: 460146 - RNA, 65 nt, hsa; identical to SEQ ID NO: 242236

SEQ ID NO: 460147 - RNA, 65 nt, hsa; identical to SEQ ID NO: 242237

SEQ ID NO: 460148 - RNA, 65 nt, hsa; identical to SEQ ID NO: 242238

SEQ ID NO: 460149 - RNA, 65 nt, hsa; identical to SEQ ID NO: 242239

SEQ ID NO: 460150 - RNA, 65 nt, hsa; identical to SEQ ID NO: 242240

SEQ ID NO: 460151 - RNA, 65 nt, hsa; identical to SEQ ID NO: 242241

SEQ ID NO: 460152 - RNA, 65 nt, hsa; identical to SEQ ID NO: 242242

SEQ ID NO: 460153 - RNA, 65 nt, hsa; identical to SEQ ID NO: 242243

SEQ ID NO: 460154 - RNA, 65 nt, hsa; identical to SEQ ID NO: 242244

SEQ ID NO: 460155 - RNA, 65 nt, hsa; identical to SEQ ID NO: 242245

SEQ ID NO: 460156 - RNA, 65 nt, hsa; identical to SEQ ID NO: 242246

SEQ ID NO: 460157 - RNA, 65 nt, hsa; identical to SEQ ID NO: 242247

SEQ ID NO: 460158 - RNA, 65 nt, hsa; identical to SEQ ID NO: 242248

SEQ ID NO: 460159 - RNA, 65 nt, hsa; identical to SEQ ID NO: 242249

SEQ ID NO: 460160 - RNA, 65 nt, hsa; identical to SEQ ID NO: 242250

SEQ ID NO: 460161 - RNA, 65 nt, hsa; identical to SEQ ID NO: 242251

SEQ ID NO: 460162 - RNA, 65 nt, hsa; identical to SEQ ID NO: 242252

SEQ ID NO: 460163 - RNA, 65 nt, hsa; identical to SEQ ID NO: 242253

SEQ ID NO: 460164 - RNA, 65 nt, hsa; identical to SEQ ID NO: 242254

SEQ ID NO: 460165 - RNA, 65 nt, hsa; identical to SEQ ID NO: 242255

SEQ ID NO: 460166 - RNA, 65 nt, hsa; identical to SEQ ID NO: 242256

SEQ ID NO: 460167 - RNA, 65 nt, hsa; identical to SEQ ID NO: 242257

SEQ ID NO: 460168 - RNA, 65 nt, hsa; identical to SEQ ID NO: 242258

SEQ ID NO: 460169 - RNA, 65 nt, hsa; identical to SEQ ID NO: 242259

SEQ ID NO: 460170 - RNA, 65 nt, hsa; identical to SEQ ID NO: 242260

SEQ ID NO: 460171 - RNA, 65 nt, hsa; identical to SEQ ID NO: 242261

SEQ ID NO: 460172 - RNA, 65 nt, hsa; identical to SEQ ID NO: 242262

SEQ ID NO: 460173 - RNA, 65 nt, hsa; identical to SEQ ID NO: 242263

SEQ ID NO: 460174 - RNA, 65 nt, hsa; identical to SEQ ID NO: 242264

SEQ ID NO: 460175 - RNA, 65 nt, hsa; identical to SEQ ID NO: 242261

SEQ ID NO: 460176 - RNA, 65 nt, hsa; identical to SEQ ID NO: 242266

SEQ ID NO: 460177 - RNA, 65 nt, hsa; identical to SEQ ID NO: 242267

SEQ ID NO: 460178 - RNA, 65 nt, hsa; identical to SEQ ID NO: 242268

SEQ ID NO: 460179 - RNA, 65 nt, hsa; identical to SEQ ID NO: 242269

SEQ ID NO: 460180 - RNA, 65 nt, hsa; identical to SEQ ID NO: 242270

SEQ ID NO: 460181 - RNA, 65 nt, hsa; identical to SEQ ID NO: 242271

SEQ ID NO: 460182 - RNA, 65 nt, hsa; identical to SEQ ID NO: 242272

SEQ ID NO: 460183 - RNA, 65 nt, hsa; identical to SEQ ID NO: 242273

SEQ ID NO: 460184 - RNA, 65 nt, hsa; identical to SEQ ID NO: 242274

SEQ ID NO: 460185 - RNA, 65 nt, hsa; identical to SEQ ID NO: 242275

SEQ ID NO: 460186 - RNA, 65 nt, hsa; identical to SEQ ID NO: 242276

SEQ ID NO: 460187 - RNA, 65 nt, hsa; identical to SEQ ID NO: 242277

SEQ ID NO: 460188 - RNA, 65 nt, hsa; identical to SEQ ID NO: 242278

SEQ ID NO: 460189 - RNA, 65 nt, hsa; identical to SEQ ID NO: 242279

SEQ ID NO: 460190 - RNA, 65 nt, hsa; identical to SEQ ID NO: 242280

SEQ ID NO: 460191 - RNA, 65 nt, hsa; identical to SEQ ID NO: 242281

SEQ ID NO: 460192 - RNA, 65 nt, hsa; identical to SEQ ID NO: 242282

SEQ ID NO: 460193 - RNA, 65 nt, hsa; identical to SEQ ID NO: 242283

SEQ ID NO: 460194 - RNA, 65 nt, hsa; identical to SEQ ID NO: 242284

SEQ ID NO: 460195 - RNA, 65 nt, hsa; identical to SEQ ID NO: 242285

SEQ ID NO: 460196 - RNA, 65 nt, hsa; identical to SEQ ID NO: 242286

SEQ ID NO: 460197 - RNA, 65 nt, hsa; identical to SEQ ID NO: 242287

SEQ ID NO: 460198 - RNA, 65 nt, hsa; identical to SEQ ID NO: 242288

SEQ ID NO: 460199 - RNA, 65 nt, hsa; identical to SEQ ID NO: 242289

SEQ ID NO: 460200 - RNA, 65 nt, hsa; identical to SEQ ID NO: 242290

SEQ ID NO: 460201 - RNA, 65 nt, hsa; identical to SEQ ID NO: 242291

SEQ ID NO: 460202 - RNA, 65 nt, hsa; identical to SEQ ID NO: 242292

SEQ ID NO: 460203 - RNA, 65 nt, hsa; identical to SEQ ID NO: 242293

SEQ ID NO: 460204 - RNA, 65 nt, hsa; identical to SEQ ID NO: 242294

SEQ ID NO: 460205 - RNA, 65 nt, hsa; identical to SEQ ID NO: 242295

SEQ ID NO: 460206 - RNA, 65 nt, hsa; identical to SEQ ID NO: 242296

SEQ ID NO: 460207 - RNA, 65 nt, hsa; identical to SEQ ID NO: 242297

SEQ ID NO: 460208 - RNA, 65 nt, hsa; identical to SEQ ID NO: 242298

SEQ ID NO: 460209 - RNA, 65 nt, hsa; identical to SEQ ID NO: 242299

SEQ ID NO: 460210 - RNA, 65 nt, hsa; identical to SEQ ID NO: 242300

SEQ ID NO: 460211 - RNA, 65 nt, hsa; identical to SEQ ID NO: 242301

SEQ ID NO: 460212 - RNA, 65 nt, hsa; identical to SEQ ID NO: 242302

SEQ ID NO: 460213 - RNA, 65 nt, hsa; identical to SEQ ID NO: 242303

SEQ ID NO: 460214 - RNA, 65 nt, hsa; identical to SEQ ID NO: 242304

SEQ ID NO: 460215 - RNA, 65 nt, hsa; identical to SEQ ID NO: 242305

SEQ ID NO: 460216 - RNA, 65 nt, hsa; identical to SEQ ID NO: 242306

SEQ ID NO: 460217 - RNA, 65 nt, hsa; identical to SEQ ID NO: 242307

SEQ ID NO: 460218 - RNA, 60 nt, hsa; identical to SEQ ID NO: 37632

SEQ ID NO: 460219 - RNA, 60 nt, hsa; identical to SEQ ID NO: 37633

SEQ ID NO: 460220 - RNA, 60 nt, hsa; identical to SEQ ID NO: 37634

SEQ ID NO: 460221 - RNA, 60 nt, hsa; identical to SEQ ID NO: 37635

SEQ ID NO: 460222 - RNA, 60 nt, hsa; identical to SEQ ID NO: 37636

SEQ ID NO: 460223 - RNA, 60 nt, hsa; identical to SEQ ID NO: 37637

SEQ ID NO: 460224 - RNA, 60 nt, hsa; identical to SEQ ID NO: 37638

SEQ ID NO: 460225 - RNA, 60 nt, hsa; identical to SEQ ID NO: 37639

SEQ ID NO: 460226 - RNA, 60 nt, hsa; identical to SEQ ID NO: 37640

SEQ ID NO: 460227 - RNA, 60 nt, hsa; identical to SEQ ID NO: 37641

SEQ ID NO: 460228 - RNA, 60 nt, hsa; identical to SEQ ID NO: 37642

SEQ ID NO: 460229 - RNA, 60 nt, hsa; identical to SEQ ID NO: 37643

SEQ ID NO: 460230 - RNA, 60 nt, hsa; identical to SEQ ID NO: 37644

SEQ ID NO: 460231 - RNA, 60 nt, hsa; identical to SEQ ID NO: 37645

SEQ ID NO: 460232 - RNA, 60 nt, hsa; identical to SEQ ID NO: 37646

SEQ ID NO: 460233 - RNA, 60 nt, hsa; identical to SEQ ID NO: 37647

SEQ ID NO: 460234 - RNA, 60 nt, hsa; identical to SEQ ID NO: 37648

SEQ ID NO: 460235 - RNA, 60 nt, hsa; identical to SEQ ID NO: 37649

SEQ ID NO: 460236 - RNA, 60 nt, hsa; identical to SEQ ID NO: 37650

SEQ ID NO: 460237 - RNA, 60 nt, hsa; identical to SEQ ID NO: 37651

SEQ ID NO: 460238 - RNA, 60 nt, hsa; identical to SEQ ID NO: 37652

SEQ ID NO: 460239 - RNA, 60 nt, hsa; identical to SEQ ID NO: 37653

SEQ ID NO: 460240 - RNA, 60 nt, hsa; identical to SEQ ID NO: 37654

SEQ ID NO: 460241 - RNA, 60 nt, hsa; identical to SEQ ID NO: 37655

SEQ ID NO: 460242 - RNA, 60 nt, hsa; identical to SEQ ID NO: 37656

SEQ ID NO: 460243 - RNA, 60 nt, hsa; identical to SEQ ID NO: 37657

SEQ ID NO: 460244 - RNA, 60 nt, hsa; identical to SEQ ID NO: 37658

SEQ ID NO: 460245 - RNA, 60 nt, hsa; identical to SEQ ID NO: 37659

SEQ ID NO: 460246 - RNA, 60 nt, hsa; identical to SEQ ID NO: 37660

SEQ ID NO: 460247 - RNA, 60 nt, hsa; identical to SEQ ID NO: 37661

SEQ ID NO: 460248 - RNA, 60 nt, hsa; identical to SEQ ID NO: 37662

SEQ ID NO: 460249 - RNA, 60 nt, hsa; identical to SEQ ID NO: 37663

SEQ ID NO: 460250 - RNA, 60 nt, hsa; identical to SEQ ID NO: 37664

SEQ ID NO: 460251 - RNA, 60 nt, hsa; identical to SEQ ID NO: 37665

SEQ ID NO: 460252 - RNA, 60 nt, hsa; identical to SEQ ID NO: 37666

SEQ ID NO: 460253 - RNA, 60 nt, hsa; identical to SEQ ID NO: 37667

SEQ ID NO: 460254 - RNA, 60 nt, hsa; identical to SEQ ID NO: 37668

SEQ ID NO: 460255 - RNA, 60 nt, hsa; identical to SEQ ID NO: 37669

SEQ ID NO: 460256 - RNA, 60 nt, hsa; identical to SEQ ID NO: 37670

SEQ ID NO: 460257 - RNA, 60 nt, hsa; identical to SEQ ID NO: 37671

SEQ ID NO: 460258 - RNA, 60 nt, hsa; identical to SEQ ID NO: 37672

SEQ ID NO: 460259 - RNA, 50 nt, hsa; identical to SEQ ID NO: 37673

SEQ ID NO: 460260 - RNA, 60 nt, hsa; identical to SEQ ID NO: 37674

SEQ ID NO: 460261 - RNA, 60 nt, hsa; identical to SEQ ID NO: 37675

SEQ ID NO: 460262 - RNA, 60 nt, hsa; identical to SEQ ID NO: 37676

SEQ ID NO: 460263 - RNA, 60 nt, hsa; identical to SEQ ID NO: 37677

SEQ ID NO: 460264 - RNA, 60 nt, hsa; identical to SEQ ID NO: 37678

SEQ ID NO: 460265 - RNA, 60 nt, hsa; identical to SEQ ID NO: 37679

SEQ ID NO: 460266 - RNA, 60 nt, hsa; identical to SEQ ID NO: 37680

SEQ ID NO: 460267 - RNA, 60 nt, hsa; identical to SEQ ID NO: 37681

SEQ ID NO: 460268 - RNA, 60 nt, hsa; identical to SEQ ID NO: 37682

SEQ ID NO: 460269 - RNA, 60 nt, hsa; identical to SEQ ID NO: 37683

SEQ ID NO: 460270 - RNA, 60 nt, hsa; identical to SEQ ID NO: 37684

SEQ ID NO: 460271 - RNA, 60 nt, hsa; identical to SEQ ID NO: 37685

SEQ ID NO: 460272 - RNA, 60 nt, hsa; identical to SEQ ID NO: 37686

SEQ ID NO: 460273 - RNA, 60 nt, hsa; identical to SEQ ID NO: 37687

SEQ ID NO: 460274 - RNA, 60 nt, hsa; identical to SEQ ID NO: 37688

SEQ ID NO: 460275 - RNA, 60 nt, hsa; identical to SEQ ID NO: 37689

SEQ ID NO: 460276 - RNA, 60 nt, hsa; identical to SEQ ID NO: 37690

SEQ ID NO: 460277 - RNA, 60 nt, hsa; identical to SEQ ID NO: 37691

SEQ ID NO: 460278 - RNA, 60 nt, hsa; identical to SEQ ID NO: 37692

SEQ ID NO: 460279 - RNA, 60 nt, hsa; identical to SEQ ID NO: 37693

SEQ ID NO: 460280 - RNA, 60 nt, hsa; identical to SEQ ID NO: 37694

SEQ ID NO: 460281 - RNA, 60 nt, hsa; identical to SEQ ID NO: 37695

SEQ ID NO: 460282 - RNA, 60 nt, hsa; identical to SEQ ID NO: 37696

SEQ ID NO: 460283 - RNA, 60 nt, hsa; identical to SEQ ID NO: 37697

SEQ ID NO: 460284 - RNA, 60 nt, hsa; identical to SEQ ID NO: 37698

SEQ ID NO: 460285 - RNA, 60 nt, hsa; identical to SEQ ID NO: 37699

SEQ ID NO: 460286 - RNA, 60 nt, hsa; identical to SEQ ID NO: 37700

SEQ ID NO: 460287 - RNA, 60 nt, hsa; identical to SEQ ID NO: 37701

SEQ ID NO: 460288 - RNA, 60 nt, hsa; identical to SEQ ID NO: 37702

SEQ ID NO: 460289 - RNA, 60 nt, hsa; identical to SEQ ID NO: 37703

SEQ ID NO: 460290 - RNA, 60 nt, hsa; identical to SEQ ID NO: 37704

SEQ ID NO: 460291 - RNA, 60 nt, hsa; identical to SEQ ID NO: 37705

SEQ ID NO: 460292 - RNA, 60 nt, hsa; identical to SEQ ID NO: 37706

SEQ ID NO: 460293 - RNA, 60 nt, hsa; identical to SEQ ID NO: 37707

SEQ ID NO: 460294 - RNA, 60 nt, hsa; identical to SEQ ID NO: 37708

SEQ ID NO: 460295 - RNA, 60 nt, hsa; identical to SEQ ID NO: 37709

SEQ ID NO: 460296 - RNA, 60 nt, hsa; identical to SEQ ID NO: 37710

SEQ ID NO: 460297 - RNA, 60 nt, hsa; identical to SEQ ID NO: 37711

SEQ ID NO: 460298 - RNA, 60 nt, hsa; identical to SEQ ID NO: 37712

SEQ ID NO: 460299 - RNA, 60 nt, hsa; identical to SEQ ID NO: 37713

SEQ ID NO: 460300 - RNA, 60 nt, hsa; identical to SEQ ID NO: 37714

SEQ ID NO: 460301 - RNA, 60 nt, hsa; identical to SEQ ID NO: 37715

SEQ ID NO: 460302 - RNA, 60 nt, hsa; identical to SEQ ID NO: 37716

SEQ ID NO: 460303 - RNA, 60 nt, hsa; identical to SEQ ID NO: 37717

SEQ ID NO: 460304 - RNA, 60 nt, hsa; identical to SEQ ID NO: 37718

SEQ ID NO: 460305 - RNA, 60 nt, hsa; identical to SEQ ID NO: 37719

SEQ ID NO: 460306 - RNA, 60 nt, hsa; identical to SEQ ID NO: 37720

SEQ ID NO: 460307 - RNA, 60 nt, hsa; identical to SEQ ID NO: 37721

SEQ ID NO: 460308 - RNA, 60 nt, hsa; identical to SEQ ID NO: 37722

SEQ ID NO: 460309 - RNA, 60 nt, hsa; identical to SEQ ID NO: 37723

SEQ ID NO: 460310 - RNA, 60 nt, hsa; identical to SEQ ID NO: 37724

SEQ ID NO: 460311 - RNA, 60 nt, hsa; identical to SEQ ID NO: 37725

SEQ ID NO: 460312 - RNA, 60 nt, hsa; identical to SEQ ID NO: 37726

SEQ ID NO: 460313 - RNA, 60 nt, hsa; identical to SEQ ID NO: 37727

SEQ ID NO: 460314 - RNA, 60 nt, hsa; identical to SEQ ID NO: 37728

SEQ ID NO: 460315 - RNA, 60 nt, hsa; identical to SEQ ID NO: 37729

SEQ ID NO: 460316 - RNA, 60 nt, hsa; identical to SEQ ID NO: 37730

SEQ ID NO: 460317 - RNA, 60 nt, hsa; identical to SEQ ID NO: 37731

SEQ ID NO: 460318 - RNA, 60 nt, hsa; identical to SEQ ID NO: 37732

SEQ ID NO: 460319 - RNA, 60 nt, hsa; identical to SEQ ID NO: 37733

SEQ ID NO: 460320 - RNA, 60 nt, hsa; identical to SEQ ID NO: 37734

SEQ ID NO: 460321 - RNA, 60 nt, hsa; identical to SEQ ID NO: 37735

SEQ ID NO: 460322 - RNA, 60 nt, hsa; identical to SEQ ID NO: 37736

SEQ ID NO: 460323 - RNA, 60 nt, hsa; identical to SEQ ID NO: 37737

SEQ ID NO: 460324 - RNA, 60 nt, hsa; identical to SEQ ID NO: 37738

SEQ ID NO: 460325 - RNA, 60 nt, hsa; identical to SEQ ID NO: 37739

SEQ ID NO: 460326 - RNA, 60 nt, hsa; identical to SEQ ID NO: 37740

SEQ ID NO: 460327 - RNA, 60 nt, hsa; identical to SEQ ID NO: 37741

SEQ ID NO: 460328 - RNA, 60 nt, hsa; identical to SEQ ID NO: 37742

SEQ ID NO: 460329 - RNA, 60 nt, hsa; identical to SEQ ID NO: 37743

SEQ ID NO: 460330 - RNA, 60 nt, hsa; identical to SEQ ID NO: 37744

SEQ ID NO: 460331 - RNA, 60 nt, hsa; identical to SEQ ID NO: 37745

SEQ ID NO: 460332 - RNA, 60 nt, hsa; identical to SEQ ID NO: 37746

SEQ ID NO: 460333 - RNA, 60 nt, hsa; identical to SEQ ID NO: 37747

SEQ ID NO: 460334 - RNA, 60 nt, hsa; identical to SEQ ID NO: 37748

SEQ ID NO: 460335 - RNA, 60 nt, hsa; identical to SEQ ID NO: 37749

SEQ ID NO: 460336 - RNA, 60 nt, hsa; identical to SEQ ID NO: 37750

SEQ ID NO: 460337 - RNA, 60 nt, hsa; identical to SEQ ID NO: 37751

SEQ ID NO: 460338 - RNA, 60 nt, hsa; identical to SEQ ID NO: 37752

SEQ ID NO: 460339 - RNA, 51 nt, hsa; identical to SEQ ID NO: 37753

SEQ ID NO: 460340 - RNA, 60 nt, hsa; identical to SEQ ID NO: 37754

SEQ ID NO: 460341 - RNA, 60 nt, hsa; identical to SEQ ID NO: 37755

SEQ ID NO: 460342 - RNA, 60 nt, hsa; identical to SEQ ID NO: 37756

SEQ ID NO: 460343 - RNA, 60 nt, hsa; identical to SEQ ID NO: 37757

SEQ ID NO: 460344 - RNA, 60 nt, hsa; identical to SEQ ID NO: 37758

SEQ ID NO: 460345 - RNA, 60 nt, hsa; identical to SEQ ID NO: 37759

SEQ ID NO: 460346 - RNA, 60 nt, hsa; identical to SEQ ID NO: 37760

SEQ ID NO: 460347 - RNA, 60 nt, hsa; identical to SEQ ID NO: 37761

SEQ ID NO: 460348 - RNA, 60 nt, hsa; identical to SEQ ID NO: 37762

SEQ ID NO: 460349 - RNA, 60 nt, hsa; identical to SEQ ID NO: 37763

SEQ ID NO: 460350 - RNA, 60 nt, hsa; identical to SEQ ID NO: 37764

SEQ ID NO: 460351 - RNA, 60 nt, hsa; identical to SEQ ID NO: 37765

SEQ ID NO: 460352 - RNA, 54 nt, hsa; identical to SEQ ID NO: 37766

SEQ ID NO: 460353 - RNA, 60 nt, hsa; identical to SEQ ID NO: 37767

SEQ ID NO: 460354 - RNA, 60 nt, hsa; identical to SEQ ID NO: 37768

SEQ ID NO: 460355 - RNA, 60 nt, hsa; identical to SEQ ID NO: 37769

SEQ ID NO: 460356 - RNA, 60 nt, hsa; identical to SEQ ID NO: 37770

SEQ ID NO: 460357 - RNA, 60 nt, hsa; identical to SEQ ID NO: 37771

SEQ ID NO: 460358 - RNA, 60 nt, hsa; identical to SEQ ID NO: 37772

SEQ ID NO: 460359 - RNA, 60 nt, hsa; identical to SEQ ID NO: 37773

SEQ ID NO: 460360 - RNA, 60 nt, hsa; identical to SEQ ID NO: 37774

SEQ ID NO: 460361 - RNA, 60 nt, hsa; identical to SEQ ID NO: 37775

SEQ ID NO: 460362 - RNA, 60 nt, hsa; identical to SEQ ID NO: 37776

SEQ ID NO: 460363 - RNA, 60 nt, hsa; identical to SEQ ID NO: 37777

SEQ ID NO: 460364 - RNA, 60 nt, hsa; identical to SEQ ID NO: 37778

SEQ ID NO: 460365 - RNA, 60 nt, hsa; identical to SEQ ID NO: 37779

SEQ ID NO: 460366 - RNA, 60 nt, hsa; identical to SEQ ID NO: 37780

SEQ ID NO: 460367 - RNA, 60 nt, hsa; identical to SEQ ID NO: 37781

SEQ ID NO: 460368 - RNA, 60 nt, hsa; identical to SEQ ID NO: 37782

SEQ ID NO: 460369 - RNA, 60 nt, hsa; identical to SEQ ID NO: 37783

SEQ ID NO: 460370 - RNA, 60 nt, hsa; identical to SEQ ID NO: 37784

SEQ ID NO: 460371 - RNA, 60 nt, hsa; identical to SEQ ID NO: 37785

SEQ ID NO: 460372 - RNA, 60 nt, hsa; identical to SEQ ID NO: 37786

SEQ ID NO: 460373 - RNA, 60 nt, hsa; identical to SEQ ID NO: 37787

SEQ ID NO: 460374 - RNA, 60 nt, hsa; identical to SEQ ID NO: 37788

SEQ ID NO: 460375 - RNA, 60 nt, hsa; identical to SEQ ID NO: 37789

SEQ ID NO: 460376 - RNA, 60 nt, hsa; identical to SEQ ID NO: 37790

SEQ ID NO: 460377 - RNA, 60 nt, hsa; identical to SEQ ID NO: 37791

SEQ ID NO: 460378 - RNA, 60 nt, hsa; identical to SEQ ID NO: 37792

SEQ ID NO: 460379 - RNA, 60 nt, hsa; identical to SEQ ID NO: 37793

SEQ ID NO: 460380 - RNA, 60 nt, hsa; identical to SEQ ID NO: 37794

SEQ ID NO: 460381 - RNA, 60 nt, hsa; identical to SEQ ID NO: 37795

SEQ ID NO: 460382 - RNA, 60 nt, hsa; identical to SEQ ID NO: 37796

SEQ ID NO: 460383 - RNA, 60 nt, hsa; identical to SEQ ID NO: 37797

SEQ ID NO: 460384 - RNA, 60 nt, hsa; identical to SEQ ID NO: 37798

SEQ ID NO: 460385 - RNA, 60 nt, hsa; identical to SEQ ID NO: 37799

SEQ ID NO: 460386 - RNA, 60 nt, hsa; identical to SEQ ID NO: 37800

SEQ ID NO: 460387 - RNA, 60 nt, hsa; identical to SEQ ID NO: 37801

SEQ ID NO: 460388 - RNA, 60 nt, hsa; identical to SEQ ID NO: 37802

SEQ ID NO: 460389 - RNA, 60 nt, hsa; identical to SEQ ID NO: 37803

SEQ ID NO: 460390 - RNA, 60 nt, hsa; identical to SEQ ID NO: 37804

SEQ ID NO: 460391 - RNA, 60 nt, hsa; identical to SEQ ID NO: 37805

SEQ ID NO: 460392 - RNA, 60 nt, hsa; identical to SEQ ID NO: 37806

SEQ ID NO: 460393 - RNA, 60 nt, hsa; identical to SEQ ID NO: 37807

SEQ ID NO: 460394 - RNA, 60 nt, hsa; identical to SEQ ID NO: 37808

SEQ ID NO: 460395 - RNA, 60 nt, hsa; identical to SEQ ID NO: 37809

SEQ ID NO: 460396 - RNA, 60 nt, hsa; identical to SEQ ID NO: 37810

SEQ ID NO: 460397 - RNA, 60 nt, hsa; identical to SEQ ID NO: 37811

SEQ ID NO: 460398 - RNA, 60 nt, hsa; identical to SEQ ID NO: 37812

SEQ ID NO: 460399 - RNA, 60 nt, hsa; identical to SEQ ID NO: 37813

SEQ ID NO: 460400 - RNA, 60 nt, hsa; identical to SEQ ID NO: 37814

SEQ ID NO: 460401 - RNA, 60 nt, hsa; identical to SEQ ID NO: 37815

SEQ ID NO: 460402 - RNA, 60 nt, hsa; identical to SEQ ID NO: 37816

SEQ ID NO: 460403 - RNA, 60 nt, hsa; identical to SEQ ID NO: 37817

SEQ ID NO: 460404 - RNA, 60 nt, hsa; identical to SEQ ID NO: 37818

SEQ ID NO: 460405 - RNA, 60 nt, hsa; identical to SEQ ID NO: 37819

SEQ ID NO: 460406 - RNA, 60 nt, hsa; identical to SEQ ID NO: 37820

SEQ ID NO: 460407 - RNA, 60 nt, hsa; identical to SEQ ID NO: 37821

SEQ ID NO: 460408 - RNA, 60 nt, hsa; identical to SEQ ID NO: 37822

SEQ ID NO: 460409 - RNA, 60 nt, hsa; identical to SEQ ID NO: 37823

SEQ ID NO: 460410 - RNA, 60 nt, hsa; identical to SEQ ID NO: 37824

SEQ ID NO: 460411 - RNA, 60 nt, hsa; identical to SEQ ID NO: 37825

SEQ ID NO: 460412 - RNA, 60 nt, hsa; identical to SEQ ID NO: 37826

SEQ ID NO: 460413 - RNA, 60 nt, hsa; identical to SEQ ID NO: 37827

SEQ ID NO: 460414 - RNA, 60 nt, hsa; identical to SEQ ID NO: 37828

SEQ ID NO: 460415 - RNA, 60 nt, hsa; identical to SEQ ID NO: 37829

SEQ ID NO: 460416 - RNA, 60 nt, hsa; identical to SEQ ID NO: 37830

SEQ ID NO: 460417 - RNA, 60 nt, hsa; identical to SEQ ID NO: 37831

SEQ ID NO: 460418 - RNA, 60 nt, hsa; identical to SEQ ID NO: 37832

SEQ ID NO: 460419 - RNA, 60 nt, hsa; identical to SEQ ID NO: 37833

SEQ ID NO: 460420 - RNA, 60 nt, hsa; identical to SEQ ID NO: 37834

SEQ ID NO: 460421 - RNA, 60 nt, hsa; identical to SEQ ID NO: 37835

SEQ ID NO: 460422 - RNA, 60 nt, hsa; identical to SEQ ID NO: 37836

SEQ ID NO: 460423 - RNA, 60 nt, hsa; identical to SEQ ID NO: 37837

SEQ ID NO: 460424 - RNA, 60 nt, hsa; identical to SEQ ID NO: 37838

SEQ ID NO: 460425 - RNA, 60 nt, hsa; identical to SEQ ID NO: 37839

SEQ ID NO: 460426 - RNA, 60 nt, hsa; identical to SEQ ID NO: 37840

SEQ ID NO: 460427 - RNA, 60 nt, hsa; identical to SEQ ID NO: 37841

SEQ ID NO: 460428 - RNA, 60 nt, hsa; identical to SEQ ID NO: 37842

SEQ ID NO: 460429 - RNA, 60 nt, hsa; identical to SEQ ID NO: 37843

SEQ ID NO: 460430 - RNA, 60 nt, hsa; identical to SEQ ID NO: 37844

SEQ ID NO: 460431 - RNA, 60 nt, hsa; identical to SEQ ID NO: 37845

SEQ ID NO: 460432 - RNA, 60 nt, hsa; identical to SEQ ID NO: 37846

SEQ ID NO: 460433 - RNA, 60 nt, hsa; identical to SEQ ID NO: 37847

SEQ ID NO: 460434 - RNA, 60 nt, hsa; identical to SEQ ID NO: 37848

SEQ ID NO: 460435 - RNA, 60 nt, hsa; identical to SEQ ID NO: 37849

SEQ ID NO: 460436 - RNA, 60 nt, hsa; identical to SEQ ID NO: 37850

SEQ ID NO: 460437 - RNA, 60 nt, hsa; identical to SEQ ID NO: 37851

SEQ ID NO: 460438 - RNA, 60 nt, hsa; identical to SEQ ID NO: 37852

SEQ ID NO: 460439 - RNA, 60 nt, hsa; identical to SEQ ID NO: 37853

SEQ ID NO: 460440 - RNA, 60 nt, hsa; identical to SEQ ID NO: 37854

SEQ ID NO: 460441 - RNA, 60 nt, hsa; identical to SEQ ID NO: 37855

SEQ ID NO: 460442 - RNA, 60 nt, hsa; identical to SEQ ID NO: 37856

SEQ ID NO: 460443 - RNA, 60 nt, hsa; identical to SEQ ID NO: 37857

SEQ ID NO: 460444 - RNA, 60 nt, hsa; identical to SEQ ID NO: 37858

SEQ ID NO: 460445 - RNA, 60 nt, hsa; identical to SEQ ID NO: 37859

SEQ ID NO: 460446 - RNA, 60 nt, hsa; identical to SEQ ID NO: 37860

SEQ ID NO: 460447 - RNA, 60 nt, hsa; identical to SEQ ID NO: 37861

SEQ ID NO: 460448 - RNA, 60 nt, hsa; identical to SEQ ID NO: 37862

SEQ ID NO: 460449 - RNA, 60 nt, hsa; identical to SEQ ID NO: 37863

SEQ ID NO: 460450 - RNA, 60 nt, hsa; identical to SEQ ID NO: 37864

SEQ ID NO: 460451 - RNA, 60 nt, hsa; identical to SEQ ID NO: 37865

SEQ ID NO: 460452 - RNA, 60 nt, hsa; identical to SEQ ID NO: 37866

SEQ ID NO: 460453 - RNA, 60 nt, hsa; identical to SEQ ID NO: 37867

SEQ ID NO: 460454 - RNA, 60 nt, hsa; identical to SEQ ID NO: 37868

SEQ ID NO: 460455 - RNA, 60 nt, hsa; identical to SEQ ID NO: 37869

SEQ ID NO: 460456 - RNA, 60 nt, hsa; identical to SEQ ID NO: 37870

SEQ ID NO: 460457 - RNA, 60 nt, hsa; identical to SEQ ID NO: 37871

SEQ ID NO: 460458 - RNA, 60 nt, hsa; identical to SEQ ID NO: 37872

SEQ ID NO: 460459 - RNA, 60 nt, hsa; identical to SEQ ID NO: 37873

SEQ ID NO: 460460 - RNA, 60 nt, hsa; identical to SEQ ID NO: 37874

SEQ ID NO: 460461 - RNA, 60 nt, hsa; identical to SEQ ID NO: 37875

SEQ ID NO: 460462 - RNA, 60 nt, hsa; identical to SEQ ID NO: 37876

SEQ ID NO: 460463 - RNA, 60 nt, hsa; identical to SEQ ID NO: 37877

SEQ ID NO: 460464 - RNA, 60 nt, hsa; identical to SEQ ID NO: 37878

SEQ ID NO: 460465 - RNA, 60 nt, hsa; identical to SEQ ID NO: 37879

SEQ ID NO: 460466 - RNA, 60 nt, hsa; identical to SEQ ID NO: 37880

SEQ ID NO: 460467 - RNA, 60 nt, hsa; identical to SEQ ID NO: 37881

SEQ ID NO: 460468 - RNA, 60 nt, hsa; identical to SEQ ID NO: 37882

SEQ ID NO: 460469 - RNA, 60 nt, hsa; identical to SEQ ID NO: 37883

SEQ ID NO: 460470 - RNA, 60 nt, hsa; identical to SEQ ID NO: 37884

SEQ ID NO: 460471 - RNA, 60 nt, hsa; identical to SEQ ID NO: 37885

SEQ ID NO: 460472 - RNA, 60 nt, hsa; identical to SEQ ID NO: 37886

SEQ ID NO: 460473 - RNA, 60 nt, hsa; identical to SEQ ID NO: 37887

SEQ ID NO: 460474 - RNA, 60 nt, hsa; identical to SEQ ID NO: 37888

SEQ ID NO: 460475 - RNA, 60 nt, hsa; identical to SEQ ID NO: 37889

SEQ ID NO: 460476 - RNA, 60 nt, hsa; identical to SEQ ID NO: 37890

SEQ ID NO: 460477 - RNA, 60 nt, hsa; identical to SEQ ID NO: 37891

SEQ ID NO: 460478 - RNA, 60 nt, hsa; identical to SEQ ID NO: 37892

SEQ ID NO: 460479 - RNA, 60 nt, hsa; identical to SEQ ID NO: 37893

SEQ ID NO: 460480 - RNA, 60 nt, hsa; identical to SEQ ID NO: 37894

SEQ ID NO: 460481 - RNA, 60 nt, hsa; identical to SEQ ID NO: 37895

SEQ ID NO: 460482 - RNA, 60 nt, hsa; identical to SEQ ID NO: 37896

SEQ ID NO: 460483 - RNA, 60 nt, hsa; identical to SEQ ID NO: 37897

SEQ ID NO: 460484 - RNA, 60 nt, hsa; identical to SEQ ID NO: 37898

SEQ ID NO: 460485 - RNA, 60 nt, hsa; identical to SEQ ID NO: 37899

SEQ ID NO: 460486 - RNA, 60 nt, hsa; identical to SEQ ID NO: 37900

SEQ ID NO: 460487 - RNA, 60 nt, hsa; identical to SEQ ID NO: 37901

SEQ ID NO: 460488 - RNA, 60 nt, hsa; identical to SEQ ID NO: 37902

SEQ ID NO: 460489 - RNA, 60 nt, hsa; identical to SEQ ID NO: 37903

SEQ ID NO: 460490 - RNA, 60 nt, hsa; identical to SEQ ID NO: 37904

SEQ ID NO: 460491 - RNA, 60 nt, hsa; identical to SEQ ID NO: 37905

SEQ ID NO: 460492 - RNA, 60 nt, hsa; identical to SEQ ID NO: 37906

SEQ ID NO: 460493 - RNA, 60 nt, hsa; identical to SEQ ID NO: 37907

SEQ ID NO: 460494 - RNA, 60 nt, hsa; identical to SEQ ID NO: 37908

SEQ ID NO: 460495 - RNA, 60 nt, hsa; identical to SEQ ID NO: 37909

SEQ ID NO: 460496 - RNA, 60 nt, hsa; identical to SEQ ID NO: 37910

SEQ ID NO: 460497 - RNA, 60 nt, hsa; identical to SEQ ID NO: 37911

SEQ ID NO: 460498 - RNA, 60 nt, hsa; identical to SEQ ID NO: 37912

SEQ ID NO: 460499 - RNA, 60 nt, hsa; identical to SEQ ID NO: 37913

SEQ ID NO: 460500 - RNA, 60 nt, hsa; identical to SEQ ID NO: 37914

SEQ ID NO: 460501 - RNA, 60 nt, hsa; identical to SEQ ID NO: 37915

SEQ ID NO: 460502 - RNA, 60 nt, hsa; identical to SEQ ID NO: 37916

SEQ ID NO: 460503 - RNA, 60 nt, hsa; identical to SEQ ID NO: 37917

SEQ ID NO: 460504 - RNA, 60 nt, hsa; identical to SEQ ID NO: 37918

SEQ ID NO: 460505 - RNA, 60 nt, hsa; identical to SEQ ID NO: 37919

SEQ ID NO: 460506 - RNA, 60 nt, hsa; identical to SEQ ID NO: 37920

SEQ ID NO: 460507 - RNA, 60 nt, hsa; identical to SEQ ID NO: 37921

SEQ ID NO: 460508 - RNA, 60 nt, hsa; identical to SEQ ID NO: 37922

SEQ ID NO: 460509 - RNA, 60 nt, hsa; identical to SEQ ID NO: 37923

SEQ ID NO: 460510 - RNA, 60 nt, hsa; identical to SEQ ID NO: 37924

SEQ ID NO: 460511 - RNA, 60 nt, hsa; identical to SEQ ID NO: 37925

SEQ ID NO: 460512 - RNA, 60 nt, hsa; identical to SEQ ID NO: 37926

SEQ ID NO: 460513 - RNA, 60 nt, hsa; identical to SEQ ID NO: 37927

SEQ ID NO: 460514 - RNA, 60 nt, hsa; identical to SEQ ID NO: 37928

SEQ ID NO: 460515 - RNA, 60 nt, hsa; identical to SEQ ID NO: 37929

SEQ ID NO: 460516 - RNA, 60 nt, hsa; identical to SEQ ID NO: 37930

SEQ ID NO: 460517 - RNA, 60 nt, hsa; identical to SEQ ID NO: 37931

SEQ ID NO: 460518 - RNA, 60 nt, hsa; identical to SEQ ID NO: 37932

SEQ ID NO: 460519 - RNA, 60 nt, hsa; identical to SEQ ID NO: 37933

SEQ ID NO: 460520 - RNA, 60 nt, hsa; identical to SEQ ID NO: 37934

SEQ ID NO: 460521 - RNA, 60 nt, hsa; identical to SEQ ID NO: 37935

SEQ ID NO: 460522 - RNA, 60 nt, hsa; identical to SEQ ID NO: 37936

SEQ ID NO: 460523 - RNA, 60 nt, hsa; identical to SEQ ID NO: 37937

SEQ ID NO: 460524 - RNA, 60 nt, hsa; identical to SEQ ID NO: 37938

SEQ ID NO: 460525 - RNA, 60 nt, hsa; identical to SEQ ID NO: 37939

SEQ ID NO: 460526 - RNA, 60 nt, hsa; identical to SEQ ID NO: 37940

SEQ ID NO: 460527 - RNA, 60 nt, hsa; identical to SEQ ID NO: 37941

SEQ ID NO: 460528 - RNA, 60 nt, hsa; identical to SEQ ID NO: 37942

SEQ ID NO: 460529 - RNA, 60 nt, hsa; identical to SEQ ID NO: 37943

SEQ ID NO: 460530 - RNA, 60 nt, hsa; identical to SEQ ID NO: 37944

SEQ ID NO: 460531 - RNA, 60 nt, hsa; identical to SEQ ID NO: 37945

SEQ ID NO: 460532 - RNA, 60 nt, hsa; identical to SEQ ID NO: 37946

SEQ ID NO: 460533 - RNA, 60 nt, hsa; identical to SEQ ID NO: 37947

SEQ ID NO: 460534 - RNA, 60 nt, hsa; identical to SEQ ID NO: 37948

SEQ ID NO: 460535 - RNA, 60 nt, hsa; identical to SEQ ID NO: 37949

SEQ ID NO: 460536 - RNA, 60 nt, hsa; identical to SEQ ID NO: 37950

SEQ ID NO: 460537 - RNA, 60 nt, hsa; identical to SEQ ID NO: 37951

SEQ ID NO: 460538 - RNA, 60 nt, hsa; identical to SEQ ID NO: 37952

SEQ ID NO: 460539 - RNA, 60 nt, hsa; identical to SEQ ID NO: 37953

SEQ ID NO: 460540 - RNA, 60 nt, hsa; identical to SEQ ID NO: 37954

SEQ ID NO: 460541 - RNA, 60 nt, hsa; identical to SEQ ID NO: 37955

SEQ ID NO: 460542 - RNA, 60 nt, hsa; identical to SEQ ID NO: 37956

SEQ ID NO: 460543 - RNA, 60 nt, hsa; identical to SEQ ID NO: 37957

SEQ ID NO: 460544 - RNA, 60 nt, hsa; identical to SEQ ID NO: 37958

SEQ ID NO: 460545 - RNA, 60 nt, hsa; identical to SEQ ID NO: 37959

SEQ ID NO: 460546 - RNA, 60 nt, hsa; identical to SEQ ID NO: 37960

SEQ ID NO: 460547 - RNA, 54 nt, hsa; identical to SEQ ID NO: 37961

SEQ ID NO: 460548 - RNA, 60 nt, hsa; identical to SEQ ID NO: 37962

SEQ ID NO: 460549 - RNA, 60 nt, hsa; identical to SEQ ID NO: 37963

SEQ ID NO: 460550 - RNA, 60 nt, hsa; identical to SEQ ID NO: 37964

SEQ ID NO: 460551 - RNA, 60 nt, hsa; identical to SEQ ID NO: 37965

SEQ ID NO: 460552 - RNA, 60 nt, hsa; identical to SEQ ID NO: 37966

SEQ ID NO: 460553 - RNA, 60 nt, hsa; identical to SEQ ID NO: 37967

SEQ ID NO: 460554 - RNA, 60 nt, hsa; identical to SEQ ID NO: 37968

SEQ ID NO: 460555 - RNA, 60 nt, hsa; identical to SEQ ID NO: 37969

SEQ ID NO: 460556 - RNA, 60 nt, hsa; identical to SEQ ID NO: 37970

SEQ ID NO: 460557 - RNA, 60 nt, hsa; identical to SEQ ID NO: 37971

SEQ ID NO: 460558 - RNA, 60 nt, hsa; identical to SEQ ID NO: 37972

SEQ ID NO: 460559 - RNA, 60 nt, hsa; identical to SEQ ID NO: 37973

SEQ ID NO: 460560 - RNA, 60 nt, hsa; identical to SEQ ID NO: 37974

SEQ ID NO: 460561 - RNA, 60 nt, hsa; identical to SEQ ID NO: 37975

SEQ ID NO: 460562 - RNA, 60 nt, hsa; identical to SEQ ID NO: 37976

SEQ ID NO: 460563 - RNA, 60 nt, hsa; identical to SEQ ID NO: 37977

SEQ ID NO: 460564 - RNA, 60 nt, hsa; identical to SEQ ID NO: 37978

SEQ ID NO: 460565 - RNA, 60 nt, hsa; identical to SEQ ID NO: 37979

SEQ ID NO: 460566 - RNA, 60 nt, hsa; identical to SEQ ID NO: 37980

SEQ ID NO: 460567 - RNA, 60 nt, hsa; identical to SEQ ID NO: 37981

SEQ ID NO: 460568 - RNA, 60 nt, hsa; identical to SEQ ID NO: 37982

SEQ ID NO: 460569 - RNA, 60 nt, hsa; identical to SEQ ID NO: 37983

SEQ ID NO: 460570 - RNA, 60 nt, hsa; identical to SEQ ID NO: 37984

SEQ ID NO: 460571 - RNA, 60 nt, hsa; identical to SEQ ID NO: 37985

SEQ ID NO: 460572 - RNA, 60 nt, hsa; identical to SEQ ID NO: 37986

SEQ ID NO: 460573 - RNA, 60 nt, hsa; identical to SEQ ID NO: 37987

SEQ ID NO: 460574 - RNA, 60 nt, hsa; identical to SEQ ID NO: 37988

SEQ ID NO: 460575 - RNA, 60 nt, hsa; identical to SEQ ID NO: 37989

SEQ ID NO: 460576 - RNA, 60 nt, hsa; identical to SEQ ID NO: 37990

SEQ ID NO: 460577 - RNA, 60 nt, hsa; identical to SEQ ID NO: 37991

SEQ ID NO: 460578 - RNA, 60 nt, hsa; identical to SEQ ID NO: 37992

SEQ ID NO: 460579 - RNA, 60 nt, hsa; identical to SEQ ID NO: 37993

SEQ ID NO: 460580 - RNA, 60 nt, hsa; identical to SEQ ID NO: 37994

SEQ ID NO: 460581 - RNA, 52 nt, hsa; identical to SEQ ID NO: 37995

SEQ ID NO: 460582 - RNA, 60 nt, hsa; identical to SEQ ID NO: 37996

SEQ ID NO: 460583 - RNA, 60 nt, hsa; identical to SEQ ID NO: 37997

SEQ ID NO: 460584 - RNA, 60 nt, hsa; identical to SEQ ID NO: 37998

SEQ ID NO: 460585 - RNA, 60 nt, hsa; identical to SEQ ID NO: 37999

SEQ ID NO: 460586 - RNA, 60 nt, hsa; identical to SEQ ID NO: 38000

SEQ ID NO: 460587 - RNA, 60 nt, hsa; identical to SEQ ID NO: 38001

SEQ ID NO: 460588 - RNA, 60 nt, hsa; identical to SEQ ID NO: 38002

SEQ ID NO: 460589 - RNA, 60 nt, hsa; identical to SEQ ID NO: 38003

SEQ ID NO: 460590 - RNA, 60 nt, hsa; identical to SEQ ID NO: 38004

SEQ ID NO: 460591 - RNA, 60 nt, hsa; identical to SEQ ID NO: 38005

SEQ ID NO: 460592 - RNA, 60 nt, hsa; identical to SEQ ID NO: 38006

SEQ ID NO: 460593 - RNA, 60 nt, hsa; identical to SEQ ID NO: 38007

SEQ ID NO: 460594 - RNA, 60 nt, hsa; identical to SEQ ID NO: 38008

SEQ ID NO: 460595 - RNA, 60 nt, hsa; identical to SEQ ID NO: 38009

SEQ ID NO: 460596 - RNA, 60 nt, hsa; identical to SEQ ID NO: 38010

SEQ ID NO: 460597 - RNA, 60 nt, hsa; identical to SEQ ID NO: 38011

SEQ ID NO: 460598 - RNA, 60 nt, hsa; identical to SEQ ID NO: 38012

SEQ ID NO: 460599 - RNA, 60 nt, hsa; identical to SEQ ID NO: 38013

SEQ ID NO: 460600 - RNA, 60 nt, hsa; identical to SEQ ID NO: 38014

SEQ ID NO: 460601 - RNA, 60 nt, hsa; identical to SEQ ID NO: 38015

SEQ ID NO: 460602 - RNA, 60 nt, hsa; identical to SEQ ID NO: 38016

SEQ ID NO: 460603 - RNA, 60 nt, hsa; identical to SEQ ID NO: 38017

SEQ ID NO: 460604 - RNA, 60 nt, hsa; identical to SEQ ID NO: 38018

SEQ ID NO: 460605 - RNA, 60 nt, hsa; identical to SEQ ID NO: 38019

SEQ ID NO: 460606 - RNA, 60 nt, hsa; identical to SEQ ID NO: 38020

SEQ ID NO: 460607 - RNA, 60 nt, hsa; identical to SEQ ID NO: 38021

SEQ ID NO: 460608 - RNA, 60 nt, hsa; identical to SEQ ID NO: 38022

SEQ ID NO: 460609 - RNA, 60 nt, hsa; identical to SEQ ID NO: 38023

SEQ ID NO: 460610 - RNA, 60 nt, hsa; identical to SEQ ID NO: 38024

SEQ ID NO: 460611 - RNA, 60 nt, hsa; identical to SEQ ID NO: 38025

SEQ ID NO: 460612 - RNA, 60 nt, hsa; identical to SEQ ID NO: 38026

SEQ ID NO: 460613 - RNA, 60 nt, hsa; identical to SEQ ID NO: 38027

SEQ ID NO: 460614 - RNA, 60 nt, hsa; identical to SEQ ID NO: 38028

SEQ ID NO: 460615 - RNA, 60 nt, hsa; identical to SEQ ID NO: 38029

SEQ ID NO: 460616 - RNA, 60 nt, hsa; identical to SEQ ID NO: 38030

SEQ ID NO: 460617 - RNA, 60 nt, hsa; identical to SEQ ID NO: 38031

SEQ ID NO: 460618 - RNA, 60 nt, hsa; identical to SEQ ID NO: 38032

SEQ ID NO: 460619 - RNA, 60 nt, hsa; identical to SEQ ID NO: 38033

SEQ ID NO: 460620 - RNA, 60 nt, hsa; identical to SEQ ID NO: 38034

SEQ ID NO: 460621 - RNA, 60 nt, hsa; identical to SEQ ID NO: 38035

SEQ ID NO: 460622 - RNA, 60 nt, hsa; identical to SEQ ID NO: 38036

SEQ ID NO: 460623 - RNA, 60 nt, hsa; identical to SEQ ID NO: 38037

SEQ ID NO: 460624 - RNA, 60 nt, hsa; identical to SEQ ID NO: 38038

SEQ ID NO: 460625 - RNA, 60 nt, hsa; identical to SEQ ID NO: 38039

SEQ ID NO: 460626 - RNA, 60 nt, hsa; identical to SEQ ID NO: 38040

SEQ ID NO: 460627 - RNA, 60 nt, hsa; identical to SEQ ID NO: 38041

SEQ ID NO: 460628 - RNA, 60 nt, hsa; identical to SEQ ID NO: 38042

SEQ ID NO: 460629 - RNA, 60 nt, hsa; identical to SEQ ID NO: 38043

SEQ ID NO: 460630 - RNA, 60 nt, hsa; identical to SEQ ID NO: 38044

SEQ ID NO: 460631 - RNA, 60 nt, hsa; identical to SEQ ID NO: 38045

SEQ ID NO: 460632 - RNA, 60 nt, hsa; identical to SEQ ID NO: 38046

SEQ ID NO: 460633 - RNA, 60 nt, hsa; identical to SEQ ID NO: 38047

SEQ ID NO: 460634 - RNA, 60 nt, hsa; identical to SEQ ID NO: 38048

SEQ ID NO: 460635 - RNA, 60 nt, hsa; identical to SEQ ID NO: 38049

SEQ ID NO: 460636 - RNA, 60 nt, hsa; identical to SEQ ID NO: 38050

SEQ ID NO: 460637 - RNA, 60 nt, hsa; identical to SEQ ID NO: 38051

SEQ ID NO: 460638 - RNA, 60 nt, hsa; identical to SEQ ID NO: 38052

SEQ ID NO: 460639 - RNA, 60 nt, hsa; identical to SEQ ID NO: 38053

SEQ ID NO: 460640 - RNA, 60 nt, hsa; identical to SEQ ID NO: 38054

SEQ ID NO: 460641 - RNA, 60 nt, hsa; identical to SEQ ID NO: 38055

SEQ ID NO: 460642 - RNA, 60 nt, hsa; identical to SEQ ID NO: 38056

SEQ ID NO: 460643 - RNA, 60 nt, hsa; identical to SEQ ID NO: 38057

SEQ ID NO: 460644 - RNA, 60 nt, hsa; identical to SEQ ID NO: 38058

SEQ ID NO: 460645 - RNA, 60 nt, hsa; identical to SEQ ID NO: 38059

SEQ ID NO: 460646 - RNA, 60 nt, hsa; identical to SEQ ID NO: 38060

SEQ ID NO: 460647 - RNA, 60 nt, hsa; identical to SEQ ID NO: 38061

SEQ ID NO: 460648 - RNA, 60 nt, hsa; identical to SEQ ID NO: 38062

SEQ ID NO: 460649 - RNA, 60 nt, hsa; identical to SEQ ID NO: 38063

SEQ ID NO: 460650 - RNA, 60 nt, hsa; identical to SEQ ID NO: 38064

SEQ ID NO: 460651 - RNA, 60 nt, hsa; identical to SEQ ID NO: 38065

SEQ ID NO: 460652 - RNA, 60 nt, hsa; identical to SEQ ID NO: 38066

SEQ ID NO: 460653 - RNA, 60 nt, hsa; identical to SEQ ID NO: 38067

SEQ ID NO: 460654 - RNA, 60 nt, hsa; identical to SEQ ID NO: 38068

SEQ ID NO: 460655 - RNA, 60 nt, hsa; identical to SEQ ID NO: 38069

SEQ ID NO: 460656 - RNA, 60 nt, hsa; identical to SEQ ID NO: 38070

SEQ ID NO: 460657 - RNA, 60 nt, hsa; identical to SEQ ID NO: 38071

SEQ ID NO: 460658 - RNA, 60 nt, hsa; identical to SEQ ID NO: 38072

SEQ ID NO: 460659 - RNA, 60 nt, hsa; identical to SEQ ID NO: 38073

SEQ ID NO: 460660 - RNA, 60 nt, hsa; identical to SEQ ID NO: 38074

SEQ ID NO: 460661 - RNA, 60 nt, hsa; identical to SEQ ID NO: 38075

SEQ ID NO: 460662 - RNA, 60 nt, hsa; identical to SEQ ID NO: 38076

SEQ ID NO: 460663 - RNA, 60 nt, hsa; identical to SEQ ID NO: 38077

SEQ ID NO: 460664 - RNA, 60 nt, hsa; identical to SEQ ID NO: 38078

SEQ ID NO: 460665 - RNA, 60 nt, hsa; identical to SEQ ID NO: 38079

SEQ ID NO: 460666 - RNA, 60 nt, hsa; identical to SEQ ID NO: 38080

SEQ ID NO: 460667 - RNA, 60 nt, hsa; identical to SEQ ID NO: 38081

SEQ ID NO: 460668 - RNA, 60 nt, hsa; identical to SEQ ID NO: 38082

SEQ ID NO: 460669 - RNA, 60 nt, hsa; identical to SEQ ID NO: 38083

SEQ ID NO: 460670 - RNA, 60 nt, hsa; identical to SEQ ID NO: 38084

SEQ ID NO: 460671 - RNA, 60 nt, hsa; identical to SEQ ID NO: 38085

SEQ ID NO: 460672 - RNA, 60 nt, hsa; identical to SEQ ID NO: 38086

SEQ ID NO: 460673 - RNA, 60 nt, hsa; identical to SEQ ID NO: 38087

SEQ ID NO: 460674 - RNA, 60 nt, hsa; identical to SEQ ID NO: 38088

SEQ ID NO: 460675 - RNA, 60 nt, hsa; identical to SEQ ID NO: 38089

SEQ ID NO: 460676 - RNA, 60 nt, hsa; identical to SEQ ID NO: 38090

SEQ ID NO: 460677 - RNA, 60 nt, hsa; identical to SEQ ID NO: 38091

SEQ ID NO: 460678 - RNA, 60 nt, hsa; identical to SEQ ID NO: 38092

SEQ ID NO: 460679 - RNA, 60 nt, hsa; identical to SEQ ID NO: 38093

SEQ ID NO: 460680 - RNA, 60 nt, hsa; identical to SEQ ID NO: 38094

SEQ ID NO: 460681 - RNA, 60 nt, hsa; identical to SEQ ID NO: 38095

SEQ ID NO: 460682 - RNA, 60 nt, hsa; identical to SEQ ID NO: 38096

SEQ ID NO: 460683 - RNA, 60 nt, hsa; identical to SEQ ID NO: 38097

SEQ ID NO: 460684 - RNA, 60 nt, hsa; identical to SEQ ID NO: 38098

SEQ ID NO: 460685 - RNA, 60 nt, hsa; identical to SEQ ID NO: 38099

SEQ ID NO: 460686 - RNA, 60 nt, hsa; identical to SEQ ID NO: 38100

SEQ ID NO: 460687 - RNA, 60 nt, hsa; identical to SEQ ID NO: 38101

SEQ ID NO: 460688 - RNA, 60 nt, hsa; identical to SEQ ID NO: 38102

SEQ ID NO: 460689 - RNA, 60 nt, hsa; identical to SEQ ID NO: 38103

SEQ ID NO: 460690 - RNA, 60 nt, hsa; identical to SEQ ID NO: 38104

SEQ ID NO: 460691 - RNA, 60 nt, hsa; identical to SEQ ID NO: 38105

SEQ ID NO: 460692 - RNA, 60 nt, hsa; identical to SEQ ID NO: 38106

SEQ ID NO: 460693 - RNA, 60 nt, hsa; identical to SEQ ID NO: 38107

SEQ ID NO: 460694 - RNA, 60 nt, hsa; identical to SEQ ID NO: 38108

SEQ ID NO: 460695 - RNA, 60 nt, hsa; identical to SEQ ID NO: 38109

SEQ ID NO: 460696 - RNA, 60 nt, hsa; identical to SEQ ID NO: 38110

SEQ ID NO: 460697 - RNA, 60 nt, hsa; identical to SEQ ID NO: 38111

SEQ ID NO: 460698 - RNA, 60 nt, hsa; identical to SEQ ID NO: 38112

SEQ ID NO: 460699 - RNA, 60 nt, hsa; identical to SEQ ID NO: 38113

SEQ ID NO: 460700 - RNA, 60 nt, hsa; identical to SEQ ID NO: 38114

SEQ ID NO: 460701 - RNA, 60 nt, hsa; identical to SEQ ID NO: 38115

SEQ ID NO: 460702 - RNA, 60 nt, hsa; identical to SEQ ID NO: 38116

SEQ ID NO: 460703 - RNA, 60 nt, hsa; identical to SEQ ID NO: 38117

SEQ ID NO: 460704 - RNA, 60 nt, hsa; identical to SEQ ID NO: 38118

SEQ ID NO: 460705 - RNA, 60 nt, hsa; identical to SEQ ID NO: 38119

SEQ ID NO: 460706 - RNA, 60 nt, hsa; identical to SEQ ID NO: 38120

SEQ ID NO: 460707 - RNA, 60 nt, hsa; identical to SEQ ID NO: 38121

SEQ ID NO: 460708 - RNA, 60 nt, hsa; identical to SEQ ID NO: 38122

SEQ ID NO: 460709 - RNA, 60 nt, hsa; identical to SEQ ID NO: 38123

SEQ ID NO: 460710 - RNA, 60 nt, hsa; identical to SEQ ID NO: 38124

SEQ ID NO: 460711 - RNA, 60 nt, hsa; identical to SEQ ID NO: 38125

SEQ ID NO: 460712 - RNA, 60 nt, hsa; identical to SEQ ID NO: 38126

SEQ ID NO: 460713 - RNA, 60 nt, hsa; identical to SEQ ID NO: 38127

SEQ ID NO: 460714 - RNA, 60 nt, hsa; identical to SEQ ID NO: 38128

SEQ ID NO: 460715 - RNA, 60 nt, hsa; identical to SEQ ID NO: 38129

SEQ ID NO: 460716 - RNA, 60 nt, hsa; identical to SEQ ID NO: 38130

SEQ ID NO: 460717 - RNA, 60 nt, hsa; identical to SEQ ID NO: 38131

SEQ ID NO: 460718 - RNA, 60 nt, hsa; identical to SEQ ID NO: 38132

SEQ ID NO: 460719 - RNA, 60 nt, hsa; identical to SEQ ID NO: 38133

SEQ ID NO: 460720 - RNA, 60 nt, hsa; identical to SEQ ID NO: 38134

SEQ ID NO: 460721 - RNA, 60 nt, hsa; identical to SEQ ID NO: 38135

SEQ ID NO: 460722 - RNA, 60 nt, hsa; identical to SEQ ID NO: 38136

SEQ ID NO: 460723 - RNA, 60 nt, hsa; identical to SEQ ID NO: 38137

SEQ ID NO: 460724 - RNA, 60 nt, hsa; identical to SEQ ID NO: 38138

SEQ ID NO: 460725 - RNA, 60 nt, hsa; identical to SEQ ID NO: 38139

SEQ ID NO: 460726 - RNA, 64 nt, hsa
gcuuuccucacuguucucucccuugaaucucauuuguaggaaucaagagauuccuauacauggg

SEQ ID NO: 460727 - RNA, 64 nt, hsa
aggucaugaucaggagacuugaauuguuacuggauguaggaauuguuucacugcucuuaacuug

SEQ ID NO: 460728 - RNA, 64 nt, hsa
uguaagguguuaauguguguguaugugcuuugguuguaggaaaacuugaaaauuccaaaauccu

SEQ ID NO: 460729 - RNA, 64 nt, hsa
guauuaacaaacacugcaauuuauagauuacauuuguaggaaguuaugcuuuuuucugguuuuu

SEQ ID NO: 460730 - RNA, 64 nt, hsa
aaccaggcuuauggcaugaucucuggaacaaauuuguaggaaaaaauuacuccaauugaaugac

SEQ ID NO: 460731 - RNA, 64 nt, hsa
aauuuauucuagguaaaauuuagauuguagugaauguaggaaguucuucagcacuugagcugca

SEQ ID NO: 460732 - RNA, 64 nt, hsa
ucagcaaauuccuaugagagaauaauguaaugaauguaggaaaaucuuuagccuuaucugucau

SEQ ID NO: 460733 - RNA, 64 nt, hsa
aaaagaagcauuaacuuaguagaacugaaccaggagcauuaaguucugaaauuuugaaucaucu

SEQ ID NO: 460734 - RNA, 64 nt, hsa
agacugagagaguuacauguugggaaaaaaaagaagcauuaacuuaguagaacugaaccaggag

SEQ ID NO: 460735 - RNA, 64 nt, hsa
gggacaauaaaguuguuuaaagcuggcacaaauaagcauuaaccaaggcuguguccaccuucug

SEQ ID NO: 460736 - RNA, 64 nt, hsa
aaauuuuaaaaggaaaaauguaucuguuccuucuagcauuaacauauauacauguagagacaag

SEQ ID NO: 460737 - RNA, 64 nt, hsa
uuuucuucugguuuuagagaacuaauuuuguuuuagcauuaaacuguugaacuuuuuuuuguac

SEQ ID NO: 460738 - RNA, 64 nt, hsa
ucucaccgcuucuuguuugacaccuucacaagucagcauuaaucuuucuuuuaaaacuuguuuc

SEQ ID NO: 460739 - RNA, 64 nt, hsa
uauuuuacuuauucuauucaaggcauagggccaaagcauuaaguauaauuuaaucccauacauu

SEQ ID NO: 460740 - RNA, 64 nt, hsa
guuaucugggaaguaucagguucugggaggcaacagcauuaagugauaagaaaaggagacauuc

SEQ ID NO: 460741 - RNA, 64 nt, hsa
ugcugaagaaugugucugugguuaggauagcacaagcauuaacuuuuguuuuauaguuaugcuu

SEQ ID NO: 460742 - RNA, 64 nt, hsa
guuggaugaaguccuuaguacaguugaaaaacagagcauuaaagacuaaucaauuguuuugccu

SEQ ID NO: 460743 - RNA, 64 nt, hsa
acauuucaagcucugggauauaaauuacguagucagcauuaagauaguauuauuuuuaauugcu

SEQ ID NO: 460744 - RNA, 64 nt, hsa
guaccaggcagugaauaagcccuaggcagaauaaagcauuaaaauuucuuuuggggagagacug

SEQ ID NO: 460745 - RNA, 64 nt, hsa
uccucacuuuggagaugaacacucuggguuuuacagcauuaaccugccuaaccuucauggugag

SEQ ID NO: 460746 - RNA, 64 nt, hsa
auucucgggguuuggacuuaauguugagcuaagaagcauuaagucuuugaacugaauguauuuu

SEQ ID NO: 460747 - RNA, 64 nt, hsa
aucccaaacuuuuaagugcuaaauauuaacauuuagcauuaacugucuugucaagcgaaaggcc

SEQ ID NO: 460748 - RNA, 64 nt, hsa
uggggcucacccaucccauaggaggccuauguggagcauuaacuguggccaaaggaggcagcgg

SEQ ID NO: 460749 - RNA, 64 nt, hsa
aauaagccuggagaguucuguuauuaaggggcauagcauuaauuuuugcagucuuaaaauuaca

SEQ ID NO: 460750 - RNA, 64 nt, hsa
aaacaagauacuuaauauuuuuaauguuuuuuaaagcauuaaugaacaucaucauuaauuucac

SEQ ID NO: 460751 - RNA, 64 nt, hsa
gaccugaguuugaguugacuuaacauugaguuuaagcauuaauugacauuaaacuguuuauguu

SEQ ID NO: 460752 - RNA, 64 nt, hsa
uuguuucaaaugccauuaguauagcaagccaucaagcauuaauugacauuacaguuaaaugagc

SEQ ID NO: 460753 - RNA, 64 nt, hsa
uugaccugaguuuguugauuuaacauugauuucaagcauuaauugccauuaaacuguuuauguu

SEQ ID NO: 460754 - RNA, 64 nt, hsa
uuguuucaaaugcagugaguauagcaaaccaucaagcauuaauugacauuagagucaaaucagc

SEQ ID NO: 460755 - RNA, 64 nt, hsa; identical to SEQ ID NO: 323157

SEQ ID NO: 460756 - RNA, 64 nt, hsa; identical to SEQ ID NO: 323158

SEQ ID NO: 460757 - RNA, 64 nt, hsa; identical to SEQ ID NO: 323159

SEQ ID NO: 460758 - RNA, 64 nt, hsa; identical to SEQ ID NO: 323160

SEQ ID NO: 460759 - RNA, 64 nt, hsa; identical to SEQ ID NO: 323161

SEQ ID NO: 460760 - RNA, 64 nt, hsa; identical to SEQ ID NO: 323162

SEQ ID NO: 460761 - RNA, 64 nt, hsa; identical to SEQ ID NO: 323163

SEQ ID NO: 460762 - RNA, 64 nt, hsa; identical to SEQ ID NO: 323164

SEQ ID NO: 460763 - RNA, 64 nt, hsa; identical to SEQ ID NO: 323165

SEQ ID NO: 460764 - RNA, 64 nt, hsa; identical to SEQ ID NO: 323166

SEQ ID NO: 460765 - RNA, 64 nt, hsa; identical to SEQ ID NO: 323167

SEQ ID NO: 460766 - RNA, 64 nt, hsa; identical to SEQ ID NO: 323168

SEQ ID NO: 460767 - RNA, 64 nt, hsa; identical to SEQ ID NO: 323169

SEQ ID NO: 460768 - RNA, 64 nt, hsa; identical to SEQ ID NO: 323170

SEQ ID NO: 460769 - RNA, 64 nt, hsa; identical to SEQ ID NO: 323171

SEQ ID NO: 460770 - RNA, 64 nt, hsa; identical to SEQ ID NO: 323172

SEQ ID NO: 460771 - RNA, 64 nt, hsa; identical to SEQ ID NO: 323173

SEQ ID NO: 460772 - RNA, 64 nt, hsa; identical to SEQ ID NO: 323174

SEQ ID NO: 460773 - RNA, 64 nt, hsa; identical to SEQ ID NO: 323175

SEQ ID NO: 460774 - RNA, 64 nt, hsa; identical to SEQ ID NO: 323176

SEQ ID NO: 460775 - RNA, 64 nt, hsa; identical to SEQ ID NO: 323177

SEQ ID NO: 460776 - RNA, 64 nt, hsa; identical to SEQ ID NO: 323178

SEQ ID NO: 460777 - RNA, 64 nt, hsa; identical to SEQ ID NO: 323179

SEQ ID NO: 460778 - RNA, 64 nt, hsa; identical to SEQ ID NO: 323180

SEQ ID NO: 460779 - RNA, 64 nt, hsa; identical to SEQ ID NO: 323181

SEQ ID NO: 460780 - RNA, 64 nt, hsa; identical to SEQ ID NO: 323182

SEQ ID NO: 460781 - RNA, 64 nt, hsa; identical to SEQ ID NO: 323183

SEQ ID NO: 460782 - RNA, 64 nt, hsa; identical to SEQ ID NO: 323184

SEQ ID NO: 460783 - RNA, 64 nt, hsa; identical to SEQ ID NO: 323185

SEQ ID NO: 460784 - RNA, 64 nt, hsa; identical to SEQ ID NO: 323186

SEQ ID NO: 460785 - RNA, 64 nt, hsa; identical to SEQ ID NO: 323187

SEQ ID NO: 460786 - RNA, 64 nt, hsa; identical to SEQ ID NO: 323188

SEQ ID NO: 460787 - RNA, 64 nt, hsa; identical to SEQ ID NO: 323189

SEQ ID NO: 460788 - RNA, 64 nt, hsa; identical to SEQ ID NO: 323190

SEQ ID NO: 460789 - RNA, 64 nt, hsa; identical to SEQ ID NO: 323191

SEQ ID NO: 460790 - RNA, 64 nt, hsa; identical to SEQ ID NO: 323192

SEQ ID NO: 460791 - RNA, 64 nt, hsa; identical to SEQ ID NO: 323193

SEQ ID NO: 460792 - RNA, 64 nt, hsa; identical to SEQ ID NO: 323194

SEQ ID NO: 460793 - RNA, 64 nt, hsa; identical to SEQ ID NO: 323195

SEQ ID NO: 460794 - RNA, 64 nt, hsa; identical to SEQ ID NO: 323196

SEQ ID NO: 460795 - RNA, 64 nt, hsa; identical to SEQ ID NO: 323197

SEQ ID NO: 460796 - RNA, 64 nt, hsa; identical to SEQ ID NO: 323198

SEQ ID NO: 460797 - RNA, 64 nt, hsa; identical to SEQ ID NO: 323199

SEQ ID NO: 460798 - RNA, 64 nt, hsa; identical to SEQ ID NO: 323200

SEQ ID NO: 460799 - RNA, 64 nt, hsa; identical to SEQ ID NO: 323201

SEQ ID NO: 460800 - RNA, 64 nt, hsa; identical to SEQ ID NO: 323202

SEQ ID NO: 460801 - RNA, 64 nt, hsa; identical to SEQ ID NO: 323203

SEQ ID NO: 460802 - RNA, 64 nt, hsa; identical to SEQ ID NO: 323204

SEQ ID NO: 460803 - RNA, 64 nt, hsa; identical to SEQ ID NO: 323205

SEQ ID NO: 460804 - RNA, 64 nt, hsa; identical to SEQ ID NO: 323206

SEQ ID NO: 460805 - RNA, 64 nt, hsa; identical to SEQ ID NO: 323207

SEQ ID NO: 460806 - RNA, 64 nt, hsa; identical to SEQ ID NO: 323208

SEQ ID NO: 460807 - RNA, 64 nt, hsa; identical to SEQ ID NO: 323209

SEQ ID NO: 460808 - RNA, 64 nt, hsa; identical to SEQ ID NO: 323210

SEQ ID NO: 460809 - RNA, 64 nt, hsa; identical to SEQ ID NO: 323211

SEQ ID NO: 460810 - RNA, 64 nt, hsa; identical to SEQ ID NO: 323212

SEQ ID NO: 460811 - RNA, 64 nt, hsa; identical to SEQ ID NO: 323213

SEQ ID NO: 460812 - RNA, 64 nt, hsa; identical to SEQ ID NO: 323214

SEQ ID NO: 460813 - RNA, 64 nt, hsa; identical to SEQ ID NO: 323215

SEQ ID NO: 460814 - RNA, 64 nt, hsa; identical to SEQ ID NO: 323216

SEQ ID NO: 460815 - RNA, 64 nt, hsa; identical to SEQ ID NO: 323217

SEQ ID NO: 460816 - RNA, 64 nt, hsa; identical to SEQ ID NO: 323218

SEQ ID NO: 460817 - RNA, 64 nt, hsa; identical to SEQ ID NO: 323219

SEQ ID NO: 460818 - RNA, 64 nt, hsa; identical to SEQ ID NO: 323220

SEQ ID NO: 460819 - RNA, 64 nt, hsa; identical to SEQ ID NO: 323221

SEQ ID NO: 460820 - RNA, 64 nt, hsa; identical to SEQ ID NO: 323222

SEQ ID NO: 460821 - RNA, 64 nt, hsa; identical to SEQ ID NO: 323223

SEQ ID NO: 460822 - RNA, 64 nt, hsa; identical to SEQ ID NO: 323224

SEQ ID NO: 460823 - RNA, 64 nt, hsa; identical to SEQ ID NO: 323225

SEQ ID NO: 460824 - RNA, 64 nt, hsa; identical to SEQ ID NO: 323226

SEQ ID NO: 460825 - RNA, 64 nt, hsa; identical to SEQ ID NO: 323227

SEQ ID NO: 460826 - RNA, 64 nt, hsa; identical to SEQ ID NO: 323228

SEQ ID NO: 460827 - RNA, 64 nt, hsa; identical to SEQ ID NO: 323229

SEQ ID NO: 460828 - RNA, 64 nt, hsa; identical to SEQ ID NO: 323230

SEQ ID NO: 460829 - RNA, 64 nt, hsa; identical to SEQ ID NO: 323231

SEQ ID NO: 460830 - RNA, 64 nt, hsa; identical to SEQ ID NO: 323232

SEQ ID NO: 460831 - RNA, 64 nt, hsa; identical to SEQ ID NO: 323233

SEQ ID NO: 460832 - RNA, 64 nt, hsa; identical to SEQ ID NO: 323234

SEQ ID NO: 460833 - RNA, 64 nt, hsa; identical to SEQ ID NO: 323235

SEQ ID NO: 460834 - RNA, 64 nt, hsa; identical to SEQ ID NO: 323236

SEQ ID NO: 460835 - RNA, 64 nt, hsa; identical to SEQ ID NO: 323237

SEQ ID NO: 460836 - RNA, 64 nt, hsa; identical to SEQ ID NO: 323238

SEQ ID NO: 460837 - RNA, 64 nt, hsa; identical to SEQ ID NO: 323239

SEQ ID NO: 460838 - RNA, 64 nt, hsa; identical to SEQ ID NO: 323240

SEQ ID NO: 460839 - RNA, 64 nt, hsa; identical to SEQ ID NO: 323241

SEQ ID NO: 460840 - RNA, 64 nt, hsa; identical to SEQ ID NO: 323242

SEQ ID NO: 460841 - RNA, 64 nt, hsa; identical to SEQ ID NO: 323243

SEQ ID NO: 460842 - RNA, 64 nt, hsa; identical to SEQ ID NO: 323244

SEQ ID NO: 460843 - RNA, 64 nt, hsa; identical to SEQ ID NO: 323245

SEQ ID NO: 460844 - RNA, 64 nt, hsa; identical to SEQ ID NO: 323246

SEQ ID NO: 460845 - RNA, 64 nt, hsa; identical to SEQ ID NO: 323247

SEQ ID NO: 460846 - RNA, 64 nt, hsa; identical to SEQ ID NO: 323248

SEQ ID NO: 460847 - RNA, 64 nt, hsa; identical to SEQ ID NO: 323249

SEQ ID NO: 460848 - RNA, 64 nt, hsa; identical to SEQ ID NO: 323250

SEQ ID NO: 460849 - RNA, 64 nt, hsa; identical to SEQ ID NO: 323251

SEQ ID NO: 460850 - RNA, 64 nt, hsa; identical to SEQ ID NO: 323252

SEQ ID NO: 460851 - RNA, 64 nt, hsa; identical to SEQ ID NO: 323253

SEQ ID NO: 460852 - RNA, 64 nt, hsa; identical to SEQ ID NO: 323254

SEQ ID NO: 460853 - RNA, 64 nt, hsa; identical to SEQ ID NO: 323255

SEQ ID NO: 460854 - RNA, 64 nt, hsa; identical to SEQ ID NO: 323256

SEQ ID NO: 460855 - RNA, 64 nt, hsa; identical to SEQ ID NO: 323257

SEQ ID NO: 460856 - RNA, 64 nt, hsa; identical to SEQ ID NO: 323258

SEQ ID NO: 460857 - RNA, 64 nt, hsa; identical to SEQ ID NO: 323259

SEQ ID NO: 460858 - RNA, 64 nt, hsa; identical to SEQ ID NO: 323260

SEQ ID NO: 460859 - RNA, 64 nt, hsa; identical to SEQ ID NO: 323261

SEQ ID NO: 460860 - RNA, 64 nt, hsa; identical to SEQ ID NO: 323262

SEQ ID NO: 460861 - RNA, 64 nt, hsa; identical to SEQ ID NO: 323263

SEQ ID NO: 460862 - RNA, 64 nt, hsa; identical to SEQ ID NO: 323264

SEQ ID NO: 460863 - RNA, 64 nt, hsa; identical to SEQ ID NO: 323265

SEQ ID NO: 460864 - RNA, 64 nt, hsa; identical to SEQ ID NO: 323266

SEQ ID NO: 460865 - RNA, 64 nt, hsa; identical to SEQ ID NO: 323267

SEQ ID NO: 460866 - RNA, 64 nt, hsa; identical to SEQ ID NO: 323268

SEQ ID NO: 460867 - RNA, 64 nt, hsa; identical to SEQ ID NO: 323269

SEQ ID NO: 460868 - RNA, 64 nt, hsa; identical to SEQ ID NO: 323270

SEQ ID NO: 460869 - RNA, 64 nt, hsa; identical to SEQ ID NO: 323271

SEQ ID NO: 460870 - RNA, 64 nt, hsa; identical to SEQ ID NO: 323272

SEQ ID NO: 460871 - RNA, 64 nt, hsa; identical to SEQ ID NO: 323273

SEQ ID NO: 460872 - RNA, 64 nt, hsa; identical to SEQ ID NO: 323274

SEQ ID NO: 460873 - RNA, 64 nt, hsa; identical to SEQ ID NO: 323275

SEQ ID NO: 460874 - RNA, 64 nt, hsa; identical to SEQ ID NO: 323276

SEQ ID NO: 460875 - RNA, 64 nt, hsa; identical to SEQ ID NO: 323277

SEQ ID NO: 460876 - RNA, 64 nt, hsa; identical to SEQ ID NO: 323278

SEQ ID NO: 460877 - RNA, 64 nt, hsa; identical to SEQ ID NO: 323279

SEQ ID NO: 460878 - RNA, 64 nt, hsa; identical to SEQ ID NO: 323280

SEQ ID NO: 460879 - RNA, 64 nt, hsa; identical to SEQ ID NO: 323281

SEQ ID NO: 460880 - RNA, 64 nt, hsa; identical to SEQ ID NO: 323282

SEQ ID NO: 460881 - RNA, 64 nt, hsa; identical to SEQ ID NO: 323283

SEQ ID NO: 460882 - RNA, 64 nt, hsa; identical to SEQ ID NO: 323284

SEQ ID NO: 460883 - RNA, 64 nt, hsa; identical to SEQ ID NO: 323285

SEQ ID NO: 460884 - RNA, 64 nt, hsa; identical to SEQ ID NO: 323286

SEQ ID NO: 460885 - RNA, 64 nt, hsa; identical to SEQ ID NO: 323287

SEQ ID NO: 460886 - RNA, 64 nt, hsa; identical to SEQ ID NO: 323288

SEQ ID NO: 460887 - RNA, 64 nt, hsa; identical to SEQ ID NO: 323289

SEQ ID NO: 460888 - RNA, 64 nt, hsa; identical to SEQ ID NO: 323290

SEQ ID NO: 460889 - RNA, 64 nt, hsa; identical to SEQ ID NO: 323291

SEQ ID NO: 460890 - RNA, 64 nt, hsa; identical to SEQ ID NO: 323292

SEQ ID NO: 460891 - RNA, 64 nt, hsa; identical to SEQ ID NO: 323293

SEQ ID NO: 460892 - RNA, 64 nt, hsa; identical to SEQ ID NO: 323294

SEQ ID NO: 460893 - RNA, 64 nt, hsa; identical to SEQ ID NO: 323295

SEQ ID NO: 460894 - RNA, 64 nt, hsa; identical to SEQ ID NO: 323296

SEQ ID NO: 460895 - RNA, 64 nt, hsa; identical to SEQ ID NO: 323297

SEQ ID NO: 460896 - RNA, 64 nt, hsa; identical to SEQ ID NO: 323298

SEQ ID NO: 460897 - RNA, 64 nt, hsa; identical to SEQ ID NO: 323299

SEQ ID NO: 460898 - RNA, 64 nt, hsa; identical to SEQ ID NO: 323300

SEQ ID NO: 460899 - RNA, 64 nt, hsa; identical to SEQ ID NO: 323301

SEQ ID NO: 460900 - RNA, 64 nt, hsa; identical to SEQ ID NO: 323302

SEQ ID NO: 460901 - RNA, 64 nt, hsa; identical to SEQ ID NO: 323303

SEQ ID NO: 460902 - RNA, 64 nt, hsa; identical to SEQ ID NO: 323304

SEQ ID NO: 460903 - RNA, 64 nt, hsa; identical to SEQ ID NO: 323305

SEQ ID NO: 460904 - RNA, 64 nt, hsa; identical to SEQ ID NO: 323306

SEQ ID NO: 460905 - RNA, 64 nt, hsa; identical to SEQ ID NO: 323307

SEQ ID NO: 460906 - RNA, 64 nt, hsa; identical to SEQ ID NO: 323308

SEQ ID NO: 460907 - RNA, 64 nt, hsa; identical to SEQ ID NO: 323309

SEQ ID NO: 460908 - RNA, 64 nt, hsa; identical to SEQ ID NO: 323310

SEQ ID NO: 460909 - RNA, 64 nt, hsa; identical to SEQ ID NO: 323311

SEQ ID NO: 460910 - RNA, 64 nt, hsa; identical to SEQ ID NO: 323312

SEQ ID NO: 460911 - RNA, 64 nt, hsa; identical to SEQ ID NO: 323313

SEQ ID NO: 460912 - RNA, 64 nt, hsa; identical to SEQ ID NO: 323314

SEQ ID NO: 460913 - RNA, 64 nt, hsa; identical to SEQ ID NO: 323315

SEQ ID NO: 460914 - RNA, 64 nt, hsa; identical to SEQ ID NO: 323316

SEQ ID NO: 460915 - RNA, 64 nt, hsa; identical to SEQ ID NO: 323317

SEQ ID NO: 460916 - RNA, 64 nt, hsa; identical to SEQ ID NO: 323318

SEQ ID NO: 460917 - RNA, 64 nt, hsa; identical to SEQ ID NO: 323319

SEQ ID NO: 460918 - RNA, 64 nt, hsa; identical to SEQ ID NO: 323320

SEQ ID NO: 460919 - RNA, 64 nt, hsa; identical to SEQ ID NO: 323321

SEQ ID NO: 460920 - RNA, 64 nt, hsa; identical to SEQ ID NO: 323322

SEQ ID NO: 460921 - RNA, 64 nt, hsa; identical to SEQ ID NO: 323323

SEQ ID NO: 460922 - RNA, 64 nt, hsa; identical to SEQ ID NO: 323324

SEQ ID NO: 460923 - RNA, 64 nt, hsa; identical to SEQ ID NO: 323325

SEQ ID NO: 460924 - RNA, 64 nt, hsa; identical to SEQ ID NO: 323326

SEQ ID NO: 460925 - RNA, 64 nt, hsa; identical to SEQ ID NO: 323327

SEQ ID NO: 460926 - RNA, 64 nt, hsa; identical to SEQ ID NO: 323328

SEQ ID NO: 460927 - RNA, 64 nt, hsa; identical to SEQ ID NO: 323329

SEQ ID NO: 460928 - RNA, 64 nt, hsa; identical to SEQ ID NO: 323330

SEQ ID NO: 460929 - RNA, 64 nt, hsa; identical to SEQ ID NO: 323331

SEQ ID NO: 460930 - RNA, 64 nt, hsa; identical to SEQ ID NO: 323332

SEQ ID NO: 460931 - RNA, 64 nt, hsa; identical to SEQ ID NO: 323333

SEQ ID NO: 460932 - RNA, 64 nt, hsa; identical to SEQ ID NO: 323334

SEQ ID NO: 460933 - RNA, 64 nt, hsa; identical to SEQ ID NO: 323335

SEQ ID NO: 460934 - RNA, 64 nt, hsa; identical to SEQ ID NO: 323336

SEQ ID NO: 460935 - RNA, 64 nt, hsa; identical to SEQ ID NO: 323337

SEQ ID NO: 460936 - RNA, 64 nt, hsa; identical to SEQ ID NO: 323338

SEQ ID NO: 460937 - RNA, 64 nt, hsa; identical to SEQ ID NO: 323339

SEQ ID NO: 460938 - RNA, 64 nt, hsa; identical to SEQ ID NO: 323340

SEQ ID NO: 460939 - RNA, 64 nt, hsa; identical to SEQ ID NO: 323341

SEQ ID NO: 460940 - RNA, 64 nt, hsa; identical to SEQ ID NO: 323342

SEQ ID NO: 460941 - RNA, 64 nt, hsa; identical to SEQ ID NO: 323343

SEQ ID NO: 460942 - RNA, 64 nt, hsa; identical to SEQ ID NO: 323344

SEQ ID NO: 460943 - RNA, 64 nt, hsa; identical to SEQ ID NO: 323345

SEQ ID NO: 460944 - RNA, 64 nt, hsa; identical to SEQ ID NO: 323346

SEQ ID NO: 460945 - RNA, 64 nt, hsa; identical to SEQ ID NO: 323347

SEQ ID NO: 460946 - RNA, 64 nt, hsa; identical to SEQ ID NO: 323348

SEQ ID NO: 460947 - RNA, 64 nt, hsa; identical to SEQ ID NO: 323349

SEQ ID NO: 460948 - RNA, 64 nt, hsa; identical to SEQ ID NO: 323350

SEQ ID NO: 460949 - RNA, 64 nt, hsa; identical to SEQ ID NO: 323351

SEQ ID NO: 460950 - RNA, 64 nt, hsa; identical to SEQ ID NO: 323352

SEQ ID NO: 460951 - RNA, 64 nt, hsa; identical to SEQ ID NO: 323353

SEQ ID NO: 460952 - RNA, 64 nt, hsa; identical to SEQ ID NO: 323354

SEQ ID NO: 460953 - RNA, 64 nt, hsa; identical to SEQ ID NO: 323355

SEQ ID NO: 460954 - RNA, 64 nt, hsa; identical to SEQ ID NO: 323356

SEQ ID NO: 460955 - RNA, 64 nt, hsa; identical to SEQ ID NO: 323357

SEQ ID NO: 460956 - RNA, 64 nt, hsa; identical to SEQ ID NO: 323358

SEQ ID NO: 460957 - RNA, 64 nt, hsa; identical to SEQ ID NO: 323359

SEQ ID NO: 460958 - RNA, 64 nt, hsa; identical to SEQ ID NO: 323360

SEQ ID NO: 460959 - RNA, 64 nt, hsa; identical to SEQ ID NO: 323361

SEQ ID NO: 460960 - RNA, 64 nt, hsa; identical to SEQ ID NO: 323362

SEQ ID NO: 460961 - RNA, 64 nt, hsa; identical to SEQ ID NO: 323363

SEQ ID NO: 460962 - RNA, 64 nt, hsa; identical to SEQ ID NO: 323364

SEQ ID NO: 460963 - RNA, 64 nt, hsa; identical to SEQ ID NO: 323365

SEQ ID NO: 460964 - RNA, 64 nt, hsa; identical to SEQ ID NO: 323366

SEQ ID NO: 460965 - RNA, 64 nt, hsa; identical to SEQ ID NO: 323367

SEQ ID NO: 460966 - RNA, 64 nt, hsa; identical to SEQ ID NO: 323368

SEQ ID NO: 460967 - RNA, 64 nt, hsa; identical to SEQ ID NO: 323369

SEQ ID NO: 460968 - RNA, 64 nt, hsa
uauguaaaaguuguuuuuguggagucaguggauauauuucuaaugaagugcuagacuauccaau

SEQ ID NO: 460969 - RNA, 64 nt, hsa
ugaaaauucuuaacuaaacuauacauguaauauguauuucuagaagagaauaaaaacccaaguc

SEQ ID NO: 460970 - RNA, 64 nt, hsa
uagcuuacauuuucaaaauggaaauugucggucauauuucuagaacuuuaaagaaaaaagaaug

SEQ ID NO: 460971 - RNA, 64 nt, hsa
gauauuguguugcacuagaaaacuaagugguucauauuucuaaugaggaagauuaaugaaagaa

SEQ ID NO: 460972 - RNA, 64 nt, hsa
gaucaguuagcaaaacuuaauacaccaauuaaaauauuucuacauaugagaauguuuacaauuu

SEQ ID NO: 460973 - RNA, 64 nt, hsa
uacuaaaaaguggagggagauuuguuuaaacaaguauuucuaaaagaaauauguacauaguucu

SEQ ID NO: 460974 - RNA, 64 nt, hsa
cuaccucaguuuacaaucuaccuggucauuauuuuauuucuauccaguucuaagaacugccucc

SEQ ID NO: 460975 - RNA, 64 nt, hsa
aaugacuuggauugaaaauaugugguagccuuuuuauuucuacauuaaguucuaccuaggauau

SEQ ID NO: 460976 - RNA, 64 nt, hsa
acaaaaaaaugcaaacuguaaugaaacuacauuguauuucuaagugugaaaacgacaggcugcc

SEQ ID NO: 460977 - RNA, 64 nt, hsa
cacuuuauaaaagggaauagagaagagaugggacuauuucuauauuuaaaugcugcuggcuauu

SEQ ID NO: 460978 - RNA, 64 nt, hsa
uuucuuucacugguuauauuaaagggagagcuauuauuucuaaauacuuuacaccuuugacaaa

SEQ ID NO: 460979 - RNA, 64 nt, hsa
cauuauuuaaaaacacauggaaaaauaugagacauauuucuaacauacgaacuauagugccugg

SEQ ID NO: 460980 - RNA, 64 nt, hsa
uuauaaucuucuauguaaguuuuuuaauuaaaguuauuucuauaugccguguguugcuuguuau

SEQ ID NO: 460981 - RNA, 64 nt, hsa
auuagcaagaaauuaguuaauucuggcugauuucuauuucuagcuaauuuggucauucuuugcc

SEQ ID NO: 460982 - RNA, 64 nt, hsa
guauaaaauuugaaaaaaaaaaaaaagaugauuguauuucuagauuagcaagaaauuaguuaau

SEQ ID NO: 460983 - RNA, 64 nt, hsa
uuuuccaauauuaauaccuuauguuguccuuaaauauuucuaaaagcgccuuuauuucagcauu

SEQ ID NO: 460984 - RNA, 64 nt, hsa
aagguaucaguauuucagaauccugcgacgauuuuauuucuaaauucauguacuguauguccau

SEQ ID NO: 460985 - RNA, 64 nt, hsa
gccuuugucuccuaacugaaacauuauuucuaaauauuucuauucaauaaguuuuuucuuuuuu

SEQ ID NO: 460986 - RNA, 64 nt, hsa
aucuauuuaagccuuugucuccuaacugaaacauuauuucuaaauauuucuauucaauaaguuu

SEQ ID NO: 460987 - RNA, 64 nt, hsa
agucugcugcuauauagugggggaagcgugcacuuauuucuaaacauggguuuuuaacuucaag

SEQ ID NO: 460988 - RNA, 64 nt, hsa
uuuugcuaacaaaaggagagacuuuuuucaugcauauuucuauuuuguuuuuuuggguuuuauu

SEQ ID NO: 460989 - RNA, 64 nt, hsa
ugcuccaacauugcaaagacacauuaucagucccuauuucuagagggauuacuuugaauugagc

SEQ ID NO: 460990 - RNA, 64 nt, hsa
auggauaaugugaccgggucuuaugcaaauuuucuauuucuaaaacuacuacuaugauauacaa

SEQ ID NO: 460991 - RNA, 64 nt, hsa
ccauguaagguacuguguuguaccuuuauuucuguauuucuaaaagaagaaaguucuuuccuag

SEQ ID NO: 460992 - RNA, 64 nt, hsa
augucuuugcauucagaccaauauuucagguggauauuucuaaguauuacuagaaaauacguuu

SEQ ID NO: 460993 - RNA, 64 nt, hsa
uaacccccaaaaaagauucgguugucaagggauauauuucuaucccugccagcacagugcugga

SEQ ID NO: 460994 - RNA, 64 nt, hsa
ggaaaacguguugcaagucaaccagucacuaggauauuucuacccaugcaacggaagaaaaacc

SEQ ID NO: 460995 - RNA, 64 nt, hsa
auuuuagguuuuccuuuaucauggcuuucuacaguauuucuauuguuuaacauaaaauaguuug

SEQ ID NO: 460996 - RNA, 64 nt, hsa
cauauucuuccagguuuugcacucuacauaaaauuauuucuacaaugucaagacuagccaaagg

SEQ ID NO: 460997 - RNA, 64 nt, hsa
cucuauugauacaauauugugcaugcuaguguuguauuucuauacaguagcuugaaauugauua

SEQ ID NO: 460998 - RNA, 64 nt, hsa
guugacaguauuaacacuaaauugcaguuuacaguauuucuacauuacagccauauguaacauc

SEQ ID NO: 460999 - RNA, 64 nt, hsa
uauauuuuauaaaguuuuguaaaaucccaaacaauauuucuauuuuuguaaaacaauuguaugu

SEQ ID NO: 461000 - RNA, 64 nt, hsa
auuuugcaaucuauggaaauagaguagcaauugcuauuucuaaauugugaacuuuaagucaauc

SEQ ID NO: 461001 - RNA, 64 nt, hsa
uauuucauauugagaucagcauucaaaauaguucuauuucuaucugcaaauaguuucaaaugag

SEQ ID NO: 461002 - RNA, 64 nt, hsa
accauagaacugucccacaaaauauuucuaagcuuauuucuaacuauuaggaggaaugugcuuu

SEQ ID NO: 461003 - RNA, 64 nt, hsa
uuauuuuagacaaccauagaacugucccacaaaauauuucuaagcuuauuucuaacuauuagga

SEQ ID NO: 461004 - RNA, 64 nt, hsa
uuagcaaggucuguuuuuaauaccauauacuuuauauuucuauacauuuauauuucuaauaaua

SEQ ID NO: 461005 - RNA, 64 nt, hsa
uuaauaccauauacuuuauauuucuauacauuuauauuucuaauaauacaguuaucacugauau

SEQ ID NO: 461006 - RNA, 64 nt, hsa
guuuuguuucuguuuccuaaauacuccuaaauaauauuucuaaucagccauuaugcuggggcau

SEQ ID NO: 461007 - RNA, 64 nt, hsa
aauuugagccaaaaaaaaaauacgcaggcuuuccuauuucuacaacugauuguacuuaugcauu

SEQ ID NO: 461008 - RNA, 64 nt, hsa
uugauuaucauuaaaauuaucauuaaaauugccuuauuucuauggacucagaggaaugauguuu

SEQ ID NO: 461009 - RNA, 64 nt, hsa
gauaaacaugaaagcucuguccaaaugaaaaagguauuucuaacaacaaccacaauaacaauaa

SEQ ID NO: 461010 - RNA, 64 nt, hsa
agguccuuccaucucugggaguuuuuucaacccauauuucuagaaauuacagcugccaguuuau

SEQ ID NO: 461011 - RNA, 64 nt, hsa
cuuugaaaugcaaauaauguuuaucucagaagacuauuucuaggauuaacugagagauuaaagg

SEQ ID NO: 461012 - RNA, 64 nt, hsa
uuggguuucauuugggauuugcaauguaaauacguauuucuaguuuucauauaaaguaguucuu

SEQ ID NO: 461013 - RNA, 64 nt, hsa
uuaucuagaaaucuuuuaacaccuuuuuagugguuauuucuaaaaucacugucaacaauaaauc

SEQ ID NO: 461014 - RNA, 64 nt, hsa
ucuggcuggcuacaguguagaucaguauuaggaauauuucuaaagauccugcuuuuuuguuuca

SEQ ID NO: 461015 - RNA, 64 nt, hsa
auauacuguucuugguuuuauuguuccacuugaauauuucuacuguaaaaaaaagacagugguu

SEQ ID NO: 461016 - RNA, 64 nt, hsa
uagggaaauuuugaaguaguuuuugcuaaaaaauuauuucuagaguuguguuauucuuagcagu

SEQ ID NO: 461017 - RNA, 64 nt, hsa
aacuucauacuguuuauaaacugauuuucugguuuauuucuacuguaaucucucaauauucaua

SEQ ID NO: 461018 - RNA, 64 nt, hsa
gccuuacuuuuuggauaaauauuuuugaagcugguauuucuauuucuuuuggauuuuuuuuaau

SEQ ID NO: 461019 - RNA, 64 nt, hsa
ucccauccaagaacuuggccuaaaaauacuccccuauuucuaacccucaggacggaucugauau

SEQ ID NO: 461020 - RNA, 64 nt, hsa
uuccuucuucaaacauuaaagauccacaaagcaguauuucuaaauaugccuugaagaacuaaau

SEQ ID NO: 461021 - RNA, 64 nt, hsa
uuuugggaaaaaacuuuggaaaguguguuaccuauauuucuagccaacuaacucacagaaaaac

SEQ ID NO: 461022 - RNA, 64 nt, hsa
aaacuuaaguaauggugcuacuucauuuuuuaaguauuucuauauaaauaaaauauugaagaaa

SEQ ID NO: 461023 - RNA, 64 nt, hsa
uuacaaaaauucuguugcaccacucuaguuuuaguauuucuauuuuaauacauuuguuuaccac

SEQ ID NO: 461024 - RNA, 64 nt, hsa
guggcuccgagccucggcucuaugcagaccuuuuuauuucuauuaaacguuucugcacuggcuu

SEQ ID NO: 461025 - RNA, 64 nt, hsa
ccucgcucaccaggccagucucagggccucaccguauuucuacuacuacuuaaugaaaaagugu

SEQ ID NO: 461026 - RNA, 64 nt, hsa
aaugccuauaauaacauauuuauuuuuauacauuuauuucuaaugaaaaaaacuuuuaaauuau

SEQ ID NO: 461027 - RNA, 64 nt, hsa
auggcugcuaugguuucagagaauguuuauacauuauuucuaccgagaauuaaaacuucagauu

SEQ ID NO: 461028 - RNA, 64 nt, hsa
uucuugaugcugaccuuuuugcuugugggagaauuauuucuauauauuagugaaauuugaauug

SEQ ID NO: 461029 - RNA, 64 nt, hsa
uuuuacaaaagaauauuacauauuugagagaaaauauuucuauuaaugguuuaauuucuuugua

SEQ ID NO: 461030 - RNA, 64 nt, hsa
aaaauagauuuucuugacucugagcuuguaucaguauuucuagcuuuuguuuugucugacagua

SEQ ID NO: 461031 - RNA, 64 nt, hsa
acaucucuauuguaauguuuccaguugggccaacuauuucuagcccuuuaguucuuuuucaugu

SEQ ID NO: 461032 - RNA, 64 nt, hsa
agccaaagccuccuccagccgccaugcuccuggcccacugcaucguuucaucuuccaacucaaa

SEQ ID NO: 461033 - RNA, 64 nt, hsa
ugggaggucaaggcugcagugagccgagauugcaccacugcacuccagccugggugacagagca

SEQ ID NO: 461034 - RNA, 64 nt, hsa
ggggaggcggagguugcagugaggcgagauugugccacugcacuccagcuugggcgacagagug

SEQ ID NO: 461035 - RNA, 64 nt, hsa
cuggaggcagaaguugcagugagccgagaucgcaccacugcacuccagccuaggagacaaaacg

SEQ ID NO: 461036 - RNA, 64 nt, hsa
ugggaggcagagcuugcagugagcugagauugcgccacugcacuccagccugggcaacagagcg

SEQ ID NO: 461037 - RNA, 64 nt, hsa
ccaggagguggagguugcgugagcuaagaucgcgccacugcacuccagccugggcgacaagagu

SEQ ID NO: 461038 - RNA, 64 nt, hsa
caggaggucaaggcugcagugagccaagauugugccacugcacaccggccugggugacagcaug

SEQ ID NO: 461039 - RNA, 64 nt, hsa
caggaauuugagguuguaguaagcuacgaucaugccacugcacuccacucugggcaacagaaug

SEQ ID NO: 461040 - RNA, 64 nt, hsa
caggaauuugaagcugcagugagcuguguucuugccacugcacuccaaucugggugacugagca

SEQ ID NO: 461041 - RNA, 64 nt, hsa
ugggaggcagagguugcagugagccgagaucacgccacugcacuccagccuggcuacagggcga

SEQ ID NO: 461042 - RNA, 64 nt, hsa
cgggaggcggagguugcagugagccaagaucgcaccacugcacuccagccuggcaacagagcga

SEQ ID NO: 461043 - RNA, 64 nt, hsa
cuggagauggagguugcagugagcagagaucgcaccacugcacuccagccugggcaagagugag

SEQ ID NO: 461044 - RNA, 64 nt, hsa
uaggagagggagguugcagugagccgugauugcaccacugcacuccagccugggcaacagagca

SEQ ID NO: 461045 - RNA, 64 nt, hsa
cugggaagcugaggcugcaguagccaugacugcaccacugcauuccagccugguugacagagug

SEQ ID NO: 461046 - RNA, 64 nt, hsa
ggggagacggagguugcagugagccgaguuugggccacugcacucuagccuggcaacagagcaa

SEQ ID NO: 461047 - RNA, 64 nt, hsa
gacuuccucuccagccuucucucucuggucaggcccacugcagagaugguggugagcacaucug

SEQ ID NO: 461048 - RNA, 64 nt, hsa
aaauuucugaaagauagccagaguaaguaagcagccacugcaagcucugaaucaguuuuuuaaa

SEQ ID NO: 461049 - RNA, 64 nt, hsa
cuaagaagaaaagccacuuucuuccaauccaagcccacugcagccuuguggauuuuccacacag

SEQ ID NO: 461050 - RNA, 64 nt, hsa
ugggagguggagguugcagugagcugaggucgcaccacugcacuccagccuggacaacagagca

SEQ ID NO: 461051 - RNA, 64 nt, hsa
acagaggucgaggcugcagugagcugugacugugccacugcacuccagcuugagcaacacagug

SEQ ID NO: 461052 - RNA, 64 nt, hsa
ucuuauagacagagggcacagcuaagcacagcugccacugcaggagacaggccccaugucagga

SEQ ID NO: 461053 - RNA, 64 nt, hsa
ucuuggucccugugaugucaagcccauugcucucccacugcagaacauggccucuagauuaaug

SEQ ID NO: 461054 - RNA, 64 nt, hsa
ucaacuugcauccaacuccaggauagugggcaccccacugcaauccugucuuucugagcacacu

SEQ ID NO: 461055 - RNA, 64 nt, hsa
ccccaagugugaacaaaagaugcucuucuguggaccacugcaugagcuuuuauacuaccgaccu

SEQ ID NO: 461056 - RNA, 64 nt, hsa
cgggagggagagguugcagugagccaagaucguaccacugcacuccagccugggugacagagug

SEQ ID NO: 461057 - RNA, 64 nt, hsa
caggagacggaaguugcagugagcugagaucacaccacugcacuccagccuggugacagagcaa

SEQ ID NO: 461058 - RNA, 64 nt, hsa
agucuucuguuuuguuuuucauuguuugacguuuccacugcaugccuugacuucccccaccucc

SEQ ID NO: 461059 - RNA, 64 nt, hsa
ugacuucccccaccuccuccucaaacaagagacuccacugcauguuccaagacaguauggggug

SEQ ID NO: 461060 - RNA, 64 nt, hsa
uaggaggcagagguugcagugagccgagauugcgccacugcaccccagccuggacaacagagug

SEQ ID NO: 461061 - RNA, 64 nt, hsa
gccaccagguaugaaaaggagccugguggggagaccacugcacccaaaacaaauccuuucuucu

SEQ ID NO: 461062 - RNA, 64 nt, hsa
uaaagcagggaggaaaccucugcagcucauucugccacugcaaagcugguguagccaugcuggu

SEQ ID NO: 461063 - RNA, 64 nt, hsa
cuccuucacaccccuuccaaaagucagucacagaccacugcaacaugccuucccugcuggauca

SEQ ID NO: 461064 - RNA, 64 nt, hsa
uguucuguagcuagacuggugcaggcucguuguaccacugcaaccgacugacguuacuguaguu

SEQ ID NO: 461065 - RNA, 64 nt, hsa
ccacuguuuuugguagcaauuauaugguuacuauccacugcaguccucaguuguugggguaaau

SEQ ID NO: 461066 - RNA, 64 nt, hsa
agggagucagagguugcauugggccgagaucgagccacugcacgccagccugggugacagagcc

SEQ ID NO: 461067 - RNA, 64 nt, hsa
cggccucccaaagugcugggauuacaggcgugagccacugcaccuggccugacauucuuuauga

SEQ ID NO: 461068 - RNA, 64 nt, hsa
caggaguuugaaguugcaaugagcuaugauuucaccacugcauucuagccugggcaacagagug

SEQ ID NO: 461069 - RNA, 64 nt, hsa
ugggaggcagagguugcagugagccaagauuaugccacugcacuucagccugggugacagagca

SEQ ID NO: 461070 - RNA, 64 nt, hsa
ggaucccuagggacuaccuaaucugacuuucuguccacugcauggauucuucuaaaaaguaugu

SEQ ID NO: 461071 - RNA, 64 nt, hsa
cgggagguggagguugcaaugagccaagauuguaccacugcauuccaaccugggcgacagagcc

SEQ ID NO: 461072 - RNA, 64 nt, hsa
aaauauucaccauaauccaggagggucuccuuccccacugcagaggcagaacguccaagaaugg

SEQ ID NO: 461073 - RNA, 64 nt, hsa
uuaaucaccaguaagauuugauguuuaaagacuuccacugcaauauauaaauacugaaaaugug

SEQ ID NO: 461074 - RNA, 64 nt, hsa
caggaguucaagucugcagugagcuaugauugcaccacugcacuccagccugggugauagagca

SEQ ID NO: 461075 - RNA, 64 nt, hsa
cgcugagagaccccacuccccugcugagaucgcgccacugcacuccagccugggcgacagagca

SEQ ID NO: 461076 - RNA, 64 nt, hsa
cuggaggcggagguugccgugagccaagaucgcaccacugcacuccagccugggcgacaaagug

SEQ ID NO: 461077 - RNA, 64 nt, hsa
caggaggcggagguugcagugagcagagaucgugccacugcacuccagccuggguggacagagc

SEQ ID NO: 461078 - RNA, 64 nt, hsa
cgggagguggagauugcaguaagccgagaucgugccacugcacuccagccugggugauagagca

SEQ ID NO: 461079 - RNA, 64 nt, hsa
ugggaggcagagguugcagugagccaagauugugccacugcacuccagccugagcaacaaaagc

SEQ ID NO: 461080 - RNA, 64 nt, hsa
ccaagaugcuguccccccauccaaaacccgugcgccacugcagugaguguugagggcaccucuc

SEQ ID NO: 461081 - RNA, 64 nt, hsa
ucuuaucuugccuuauugcuauacuauuuacaucccacugcagaacagcagauuugaggcuuuu

SEQ ID NO: 461082 - RNA, 64 nt, hsa
agguaggcagagguugcagugagccaagaucgcgccacugcacuccagccugggcgacagagug

SEQ ID NO: 461083 - RNA, 64 nt, hsa
cgggggacagagguuguagugagccaagaucgcaccacugcacuccagccugggucacagagug

SEQ ID NO: 461084 - RNA, 64 nt, hsa
ccaggaguuugaggcugcaaugagccaugauuucccacugcacuccagccugagugacagagcg

SEQ ID NO: 461085 - RNA, 64 nt, hsa
guugccgcauuuauuccaccuccagcuggaccccccacugcaaauagagaacagcgguggggga

SEQ ID NO: 461086 - RNA, 64 nt, hsa
caggaggcggagguugcagugagccaagaucgcaccacugcacuccagccugggcaacagagug

SEQ ID NO: 461087 - RNA, 64 nt, hsa
acaagugccucccgagccuagauccuggcucggaccacugcaagggccgaggcagggccagacc

SEQ ID NO: 461088 - RNA, 64 nt, hsa
cauuugcugacagaggacggggcacccgggcuccccacugcagucggccuugccuccuccuccu

SEQ ID NO: 461089 - RNA, 64 nt, hsa
uggcccuaccccagccuccucagaacaggggugaccacugcaggggagacugccccuaaccugu

SEQ ID NO: 461090 - RNA, 64 nt, hsa
cccuaaccugugucuuuguguccccagaagacacccacugcagacccccagcccagccugcucu

SEQ ID NO: 461091 - RNA, 64 nt, hsa
ucaacuguuacacagagaugaccagaggauggggccacugcagugcaguucaagaggcucuggu

SEQ ID NO: 461092 - RNA, 64 nt, hsa
cgggagguggagguugcagugagccaagaucgcgccacugcacuccagccuggaugacagagca

SEQ ID NO: 461093 - RNA, 64 nt, hsa
agggaggucgaggcugcagugagccacgaucacaccacugcacuccagccuaggugacagagug

SEQ ID NO: 461094 - RNA, 64 nt, hsa
ucccagcugagucccaucgauguugaaucucaugccacugcaagugccauucaccacugcgucc

SEQ ID NO: 461095 - RNA, 64 nt, hsa
ugugcccaugggcaccccagagcacccacugugaccacugcaguucucucaugcccacaggcac

SEQ ID NO: 461096 - RNA, 64 nt, hsa
agguggagguugcagugagccaagaucacaggagccacugcacuccagccugggugacagagug

SEQ ID NO: 461097 - RNA, 64 nt, hsa
ugggagauggagguugcagugagcugagaucaugccacugcacuccagccugggcaacagagca

SEQ ID NO: 461098 - RNA, 61 nt, hsa
gcaagagggggaaguggugaccagacacugcccacugcagugccaagacggcagcaggacu

SEQ ID NO: 461099 - RNA, 64 nt, hsa
gcagcaggacuggggcugauagcccaccccgcccccacugcagcucccacaaagcacucuaagg

SEQ ID NO: 461100 - RNA, 64 nt, hsa
cugggagguugaggcugcagugagcuguguuucgccacugcacaccagccugggugacagugug

SEQ ID NO: 461101 - RNA, 64 nt, hsa
caggagguagagguugcagugagcugagauugcaccacugcaccagccuggcaacagagcaaga

SEQ ID NO: 461102 - RNA, 64 nt, hsa
ugggaggcagagguugcagugaucaggaauugugccacugcacuccaaccugagugacagagca

SEQ ID NO: 461103 - RNA, 64 nt, hsa
cggccucccaaagugcugggauuccaggcgugagccacugcacccggccagcccuguugucuuu

SEQ ID NO: 461104 - RNA, 64 nt, hsa
ccuaucugguaggcugcccugcuuugcagaagccccacugcaugaaggccugagugcaagcacc

SEQ ID NO: 461105 - RNA, 64 nt, hsa
cugagucaguuuuuuaucuggguucucuucauucccacugcacuuggugcugcuuuggcugacu

SEQ ID NO: 461106 - RNA, 64 nt, hsa
uguuagugggaagagcuggguuuuccuaguauacccacugcauccuacuccuaccuggucaacc

SEQ ID NO: 461107 - RNA, 64 nt, hsa
caccccccaucugucucuuccuccuaauuaagggccacugcaaagagagacgggcuggcuaacc

SEQ ID NO: 461108 - RNA, 64 nt, hsa
gcagagguugcagugaacugagauagugauagugccacugcaauucagccugggugacauagag

SEQ ID NO: 461109 - RNA, 64 nt, hsa
cggaaggcggagcuugcaguuagccgagaucaugccacugcacuccagccuacaugacaaugug

SEQ ID NO: 461110 - RNA, 64 nt, hsa
ugggaggcggagguugcagugagcugagcucauaccacugcacuccagccugaacagagugaga

SEQ ID NO: 461111 - RNA, 64 nt, hsa
ugggaggcggagguugcagugagcuaagaucacgccacugcacuccagccugcggacagaccaa

SEQ ID NO: 461112 - RNA, 64 nt, hsa
agggaaauccuauucacaucacuguugcaccaagccacugcaagagaaacccccacccggcaag

SEQ ID NO: 461113 - RNA, 64 nt, hsa
aggcuugcagaggcaucccagcggcaccagccucccacugcacagcuuccuucccuccuucacu

SEQ ID NO: 461114 - RNA, 64 nt, hsa
uaaggcggcuggaccccaggaaccccagggcacuccacugcagcaggagggacuuaagcuagac

SEQ ID NO: 461115 - RNA, 64 nt, hsa
cgggaggcagagcuugcagugagccaagaucacgccacugcauuccagccuggacgacagagcg

SEQ ID NO: 461116 - RNA, 64 nt, hsa
cucaagaaauccuuacagguaaguauugcuuccgccacugcagaggcgaaagccagugcuuugg

SEQ ID NO: 461117 - RNA, 64 nt, hsa
ugggaggcagagguugcagugagccaagaucgcgccacugcacuccagccugggugacagaaca

SEQ ID NO: 461118 - RNA, 64 nt, hsa
ugggaggcggaaguugcagugagccgagauugcaccacugcaguucagccuggaugaugagagu

SEQ ID NO: 461119 - RNA, 64 nt, hsa
cagccucccaaagugcuuggaugacaggugcgagccacugcaccuggcccacauuuuuuaaaga

SEQ ID NO: 461120 - RNA, 64 nt, hsa
cgggaggcaaagguugcagugagcugagaucacaccacugcacuccagccuggcgacagagaga

SEQ ID NO: 461121 - RNA, 64 nt, hsa
caugaggcccagguuacagugagccaagaucgugccacugcacuucagccugggugacagaaag

SEQ ID NO: 461122 - RNA, 64 nt, hsa
caggaggcagagcuugcagugagccgagaucacgccacugcacuugagccugggcgacacagcg

SEQ ID NO: 461123 - RNA, 64 nt, hsa
cagccucccaaagugcugggauuacaagcgugagccacugcaccgggccacagagaaaguacuu

SEQ ID NO: 461124 - RNA, 64 nt, hsa
agggaggcagagguugcagugagccgagaucacgccacugcacuauagccuaggugacagagug

SEQ ID NO: 461125 - RNA, 64 nt, hsa
caggaggcggagauugcagugagccaagguuccaccacugcacuccagccuggcgacagagcaa

SEQ ID NO: 461126 - RNA, 64 nt, hsa
cgggagguggaggcugcagugaacagagacagugccacugcacaucagccugagugacagagag

SEQ ID NO: 461127 - RNA, 64 nt, hsa
cgggaggaagagcuugcagugagccgagaucgcgccacugcacuccagccugggugacagagcc

SEQ ID NO: 461128 - RNA, 64 nt, hsa
caggaggcggagguugcagugagccgagaucgcuccacugcacuccagcccaggugacagugug

SEQ ID NO: 461129 - RNA, 64 nt, hsa
caggaguucaaggcugcagagagcuaugaucaucccacugcauuuguuuaaaaauaaauuuuua

SEQ ID NO: 461130 - RNA, 64 nt, hsa
ugggaggcagagguugcagugagcucagauagugccacugcacuccagccugggugacagagcg

SEQ ID NO: 461131 - RNA, 64 nt, hsa
uaccuauaaggugguuuauaagcugcuguccuggccacugcauucaaauuccaauguguacuuc

SEQ ID NO: 461132 - RNA, 64 nt, hsa
ugagaggcggagguugcagugagccaaaauugcaccacugcacacugcacuccauccugggcga

SEQ ID NO: 461133 - RNA, 64 nt, hsa
cugggaggcagagcuugcagugaguggagaugcgccacugcacuccagccugggcgacagagcg

SEQ ID NO: 461134 - RNA, 64 nt, hsa
uucuggaauuaacacucugugacucaaaguagugccacugcagugucuuuuuaaacuggaaaca

SEQ ID NO: 461135 - RNA, 64 nt, hsa
ugagaggcagagguuacagugagccaagaucgugccacugcauuccagccugggcgacagagca

SEQ ID NO: 461136 - RNA, 64 nt, hsa
caggaggcagagguugcagugauccaagaucaugccacugcacuccagccugggcaacaagagc

SEQ ID NO: 461137 - RNA, 64 nt, hsa
cgggaagcggagcuugcagugagccgagauugcgccacugcaguccgcagucuggccugggcga

SEQ ID NO: 461138 - RNA, 64 nt, hsa
caggagguggagguugcagugagccaugaucgagccacugcacuccagccugggcaacagauga

SEQ ID NO: 461139 - RNA, 64 nt, hsa
ugggagguugugguugcagugagcuaugauuguaccacugcacuccagccugggcaacagagca

SEQ ID NO: 461140 - RNA, 64 nt, hsa
ugggaggcggagguugcggucagcugagauggugccacugcacuccagccugggcgaaagagcg

SEQ ID NO: 461141 - RNA, 64 nt, hsa
cccugccucauggcuuuagugagccaugauugugccacugcacuccagcuuggugacagaguga

SEQ ID NO: 461142 - RNA, 64 nt, hsa
uaaguggcagagguugcagugagcugagaucgcaccacugcacucuagcuugggcaacagagca

SEQ ID NO: 461143 - RNA, 64 nt, hsa
cgggagguggagauugcagugagcccagaucgcaccacugcacuccagucuggcaacagagcaa

SEQ ID NO: 461144 - RNA, 64 nt, hsa
ucugaccuguacucuugaauacaaguuucugauaccacugcacugucugagaauuuccaaaacu

SEQ ID NO: 461145 - RNA, 64 nt, hsa
cgggaggcggagcuugcagugagccgagaucgcgccacugcacuccagccugggcgacagagug

SEQ ID NO: 461146 - RNA, 64 nt, hsa
agggagauugaggcugcagugagcuguguucacaccacugcacuccagucugggcaacagugca

SEQ ID NO: 461147 - RNA, 64 nt, hsa
ugggaggcagagguugcagugagcugagaucucaccacugcacuccagccugggcaacagagcg

SEQ ID NO: 461148 - RNA, 64 nt, hsa
cggccccccaaagugcugggguuacaggugugagccacugcacccggccacaagauguaauuuu

SEQ ID NO: 461149 - RNA, 64 nt, hsa
ugggagguggagguugcugugagcugacaccacgccacugcacuccagccugggugacagugag

SEQ ID NO: 461150 - RNA, 64 nt, hsa
gcccaguucaaggcugcagugaacuaugauggugccacugcauuccagccugggugacagaaug

SEQ ID NO: 461151 - RNA, 64 nt, hsa
caggaggcggaguuuguggugaguugagaucgcgccacugcacuccagccuggguaacagagca

SEQ ID NO: 461152 - RNA, 64 nt, hsa
caagaggcagaguuugcagugagcugagaucgugccacugcacuccagccugggugacagagug

SEQ ID NO: 461153 - RNA, 64 nt, hsa
gcccagguugaggcuauagugagccaugaucauaccacugcacuccagccugggugacagagcg

SEQ ID NO: 461154 - RNA, 64 nt, hsa
cgggaggcagaggcugcagugaaccaagaucaugccacugcacuccagccugggcaacacagcg

SEQ ID NO: 461155 - RNA, 64 nt, hsa
ugggaggcggagcuugcagugagccgagauugcgccacugcacuccagccugggcagcagagca

SEQ ID NO: 461156 - RNA, 64 nt, hsa
ugagagguagaggcugcauugagccaugauugcaccacugcacuccagccugggcaacagaggg

SEQ ID NO: 461157 - RNA, 64 nt, hsa
caggagguggagguugcagugagccgagauggcgccacugcacuccagccugggccacagaccc

SEQ ID NO: 461158 - RNA, 64 nt, hsa
cagccucccaaagugcugggauuacaggcgugagccacugcacccggcucaccacuaguuuuua

SEQ ID NO: 461159 - RNA, 64 nt, hsa
gguauuguucucacagucuuuuggugguugauggccacugcaaaccuggcaccaucagaucucu

SEQ ID NO: 461160 - RNA, 64 nt, hsa
ugggagguggagguugcagugagccgagauggugccacugcauuccagccugggcaacagagcg

SEQ ID NO: 461161 - RNA, 64 nt, hsa
cccuucacccucuguguccugguccuucugagggccacugcagaugacucuccuuugaaaugag

SEQ ID NO: 461162 - RNA, 64 nt, hsa
gcucagaaagugccccuugaugagggaaaaugucccacugcacugcgaauuucucaguuccauu

SEQ ID NO: 461163 - RNA, 64 nt, hsa
uggccuccaaaagugcugggauuacaggcaugagccacugcacucggcuguaccgugauuauua

SEQ ID NO: 461164 - RNA, 64 nt, hsa
ugggaggcagagguuucagugagcugaaauugugccacugcacuccagccugagugacagagug

SEQ ID NO: 461165 - RNA, 64 nt, hsa
caggagguggagguugcagugagccgagaucacgccacugcacuccagccuggugacagcguga

SEQ ID NO: 461166 - RNA, 64 nt, hsa
guuccagagcccaggguugagcauccugaaggagccacugcagccgucacuguccccagagccu

SEQ ID NO: 461167 - RNA, 64 nt, hsa
caggaggcggagcuugcagugagcugagaucacgccacugcacuccagccugggcaacagagug

SEQ ID NO: 461168 - RNA, 64 nt, hsa
cgggaggcagagguagcagugagcugaagucccgccacugcacuccagccugggcaacagagcg

SEQ ID NO: 461169 - RNA, 64 nt, hsa
agggaguuggagguugcagugagcuaagacugcaccacugcacuccagccuggugacagaacga

SEQ ID NO: 461170 - RNA, 64 nt, hsa
caggaggucgaggcugcagugagcugugaucucaccacugcauuccagccugggugacagaguu

SEQ ID NO: 461171 - RNA, 64 nt, hsa
cgggaggcagaggcugcaguaagccgagaucgugccacugcacuccagccugggccacagagca

SEQ ID NO: 461172 - RNA, 64 nt, hsa
ggggagguccaggccgcagugauccgagaucacaccacugcauuccagccugggugacagagug

SEQ ID NO: 461173 - RNA, 64 nt, hsa
caggaguuugagucugcagugagcuaugaucaugccacugcacuccagucugggugacagcaag

SEQ ID NO: 461174 - RNA, 64 nt, hsa
uggccucccaaagugcugggauuauaggcaugagccacugcacccggccgguggaaagcauuuu

SEQ ID NO: 461175 - RNA, 63 nt, hsa
ucaaacaugccauaaggaaaacgagugccugaacugcaugauuuauuaguuucucuccacucu

SEQ ID NO: 461176 - RNA, 63 nt, hsa
caagugugguaauauggcaagccuuguuccuuucugcaugagaaucuaggagagaauucauaa

SEQ ID NO: 461177 - RNA, 63 nt, hsa
cacagaccgucucagacacgcacagugggccugcugcaugauucacacccagucccugccaca

SEQ ID NO: 461178 - RNA, 63 nt, hsa; identical to SEQ ID NO: 461177

SEQ ID NO: 461179 - RNA, 63 nt, hsa
aguuucauucuuguuacccaggcuggagugcagcugcaugauuucagcucaccgcaaccucug

SEQ ID NO: 461180 - RNA, 63 nt, hsa
uucgucuaugaaaaguugccaagugugacuccccugcaugauguuagccauggguccuuucug

SEQ ID NO: 461181 - RNA, 63 nt, hsa
ucauagacuuugauuuuauuuauaagccacuugcugcaugacccuccaaguagaccuguggcu

SEQ ID NO: 461182 - RNA, 63 nt, hsa
uacucaaacacuuuuggaccaggauuugagucucugcaugacauauacuugauuaaaagguua

SEQ ID NO: 461183 - RNA, 64 nt, hsa; identical to SEQ ID NO: 85324

SEQ ID NO: 461184 - RNA, 64 nt, hsa; identical to SEQ ID NO: 85325

SEQ ID NO: 461185 - RNA, 64 nt, hsa; identical to SEQ ID NO: 85326

SEQ ID NO: 461186 - RNA, 64 nt, hsa; identical to SEQ ID NO: 85327

SEQ ID NO: 461187 - RNA, 64 nt, hsa; identical to SEQ ID NO: 85328

SEQ ID NO: 461188 - RNA, 64 nt, hsa; identical to SEQ ID NO: 85329

SEQ ID NO: 461189 - RNA, 64 nt, hsa; identical to SEQ ID NO: 85330

SEQ ID NO: 461190 - RNA, 64 nt, hsa; identical to SEQ ID NO: 85331

SEQ ID NO: 461191 - RNA, 64 nt, hsa; identical to SEQ ID NO: 85332

SEQ ID NO: 461192 - RNA, 64 nt, hsa; identical to SEQ ID NO: 85333

SEQ ID NO: 461193 - RNA, 64 nt, hsa; identical to SEQ ID NO: 85334

SEQ ID NO: 461194 - RNA, 64 nt, hsa; identical to SEQ ID NO: 85335

SEQ ID NO: 461195 - RNA, 64 nt, hsa; identical to SEQ ID NO: 85336

SEQ ID NO: 461196 - RNA, 64 nt, hsa; identical to SEQ ID NO: 85337

SEQ ID NO: 461197 - RNA, 64 nt, hsa; identical to SEQ ID NO: 85338

SEQ ID NO: 461198 - RNA, 64 nt, hsa; identical to SEQ ID NO: 85339

SEQ ID NO: 461199 - RNA, 64 nt, hsa; identical to SEQ ID NO: 85340

SEQ ID NO: 461200 - RNA, 64 nt, hsa; identical to SEQ ID NO: 85341

SEQ ID NO: 461201 - RNA, 64 nt, hsa; identical to SEQ ID NO: 85342

SEQ ID NO: 461202 - RNA, 64 nt, hsa; identical to SEQ ID NO: 85343

SEQ ID NO: 461203 - RNA, 64 nt, hsa; identical to SEQ ID NO: 85344

SEQ ID NO: 461204 - RNA, 64 nt, hsa; identical to SEQ ID NO: 85345

SEQ ID NO: 461205 - RNA, 64 nt, hsa; identical to SEQ ID NO: 85346

SEQ ID NO: 461206 - RNA, 64 nt, hsa; identical to SEQ ID NO: 85347

SEQ ID NO: 461207 - RNA, 64 nt, hsa; identical to SEQ ID NO: 85348

SEQ ID NO: 461208 - RNA, 64 nt, hsa; identical to SEQ ID NO: 85349

SEQ ID NO: 461209 - RNA, 64 nt, hsa; identical to SEQ ID NO: 85350

SEQ ID NO: 461210 - RNA, 64 nt, hsa; identical to SEQ ID NO: 85351

SEQ ID NO: 461211 - RNA, 64 nt, hsa; identical to SEQ ID NO: 85352

SEQ ID NO: 461212 - RNA, 64 nt, hsa; identical to SEQ ID NO: 85353

SEQ ID NO: 461213 - RNA, 64 nt, hsa; identical to SEQ ID NO: 85354

SEQ ID NO: 461214 - RNA, 64 nt, hsa; identical to SEQ ID NO: 85355

SEQ ID NO: 461215 - RNA, 64 nt, hsa; identical to SEQ ID NO: 85356

SEQ ID NO: 461216 - RNA, 64 nt, hsa; identical to SEQ ID NO: 85357

SEQ ID NO: 461217 - RNA, 64 nt, hsa; identical to SEQ ID NO: 85358

SEQ ID NO: 461218 - RNA, 64 nt, hsa; identical to SEQ ID NO: 85359

SEQ ID NO: 461219 - RNA, 64 nt, hsa; identical to SEQ ID NO: 85360

SEQ ID NO: 461220 - RNA, 64 nt, hsa; identical to SEQ ID NO: 85361

SEQ ID NO: 461221 - RNA, 64 nt, hsa; identical to SEQ ID NO: 85362

SEQ ID NO: 461222 - RNA, 64 nt, hsa; identical to SEQ ID NO: 85363

SEQ ID NO: 461223 - RNA, 64 nt, hsa; identical to SEQ ID NO: 85364

SEQ ID NO: 461224 - RNA, 64 nt, hsa; identical to SEQ ID NO: 85365

SEQ ID NO: 461225 - RNA, 64 nt, hsa; identical to SEQ ID NO: 85366

SEQ ID NO: 461226 - RNA, 64 nt, hsa; identical to SEQ ID NO: 85367

SEQ ID NO: 461227 - RNA, 64 nt, hsa; identical to SEQ ID NO: 85368

SEQ ID NO: 461228 - RNA, 64 nt, hsa; identical to SEQ ID NO: 85369

SEQ ID NO: 461229 - RNA, 64 nt, hsa; identical to SEQ ID NO: 290548

SEQ ID NO: 461230 - RNA, 64 nt, hsa; identical to SEQ ID NO: 290549

SEQ ID NO: 461231 - RNA, 64 nt, hsa; identical to SEQ ID NO: 290550

SEQ ID NO: 461232 - RNA, 64 nt, hsa; identical to SEQ ID NO: 290551

SEQ ID NO: 461233 - RNA, 64 nt, hsa; identical to SEQ ID NO: 290552

SEQ ID NO: 461234 - RNA, 64 nt, hsa; identical to SEQ ID NO: 290553

SEQ ID NO: 461235 - RNA, 57 nt, hsa; identical to SEQ ID NO: 50453

SEQ ID NO: 461236 - RNA, 64 nt, hsa; identical to SEQ ID NO: 290555

SEQ ID NO: 461237 - RNA, 64 nt, hsa; identical to SEQ ID NO: 290556

SEQ ID NO: 461238 - RNA, 64 nt, hsa; identical to SEQ ID NO: 290557

SEQ ID NO: 461239 - RNA, 64 nt, hsa; identical to SEQ ID NO: 290558

SEQ ID NO: 461240 - RNA, 64 nt, hsa; identical to SEQ ID NO: 290559

SEQ ID NO: 461241 - RNA, 64 nt, hsa; identical to SEQ ID NO: 290560

SEQ ID NO: 461242 - RNA, 64 nt, hsa; identical to SEQ ID NO: 290561

SEQ ID NO: 461243 - RNA, 64 nt, hsa; identical to SEQ ID NO: 290562

SEQ ID NO: 461244 - RNA, 64 nt, hsa; identical to SEQ ID NO: 290563

SEQ ID NO: 461245 - RNA, 64 nt, hsa; identical to SEQ ID NO: 290564

SEQ ID NO: 461246 - RNA, 64 nt, hsa; identical to SEQ ID NO: 290565

SEQ ID NO: 461247 - RNA, 64 nt, hsa; identical to SEQ ID NO: 290566

SEQ ID NO: 461248 - RNA, 64 nt, hsa; identical to SEQ ID NO: 290567

SEQ ID NO: 461249 - RNA, 64 nt, hsa; identical to SEQ ID NO: 290568

SEQ ID NO: 461250 - RNA, 64 nt, hsa; identical to SEQ ID NO: 290569

SEQ ID NO: 461251 - RNA, 64 nt, hsa; identical to SEQ ID NO: 290570

SEQ ID NO: 461252 - RNA, 64 nt, hsa; identical to SEQ ID NO: 290571

SEQ ID NO: 461253 - RNA, 64 nt, hsa; identical to SEQ ID NO: 290572

SEQ ID NO: 461254 - RNA, 64 nt, hsa; identical to SEQ ID NO: 290573

SEQ ID NO: 461255 - RNA, 64 nt, hsa; identical to SEQ ID NO: 290574

SEQ ID NO: 461256 - RNA, 64 nt, hsa; identical to SEQ ID NO: 290575

SEQ ID NO: 461257 - RNA, 64 nt, hsa; identical to SEQ ID NO: 290576

SEQ ID NO: 461258 - RNA, 64 nt, hsa; identical to SEQ ID NO: 290577

SEQ ID NO: 461259 - RNA, 64 nt, hsa; identical to SEQ ID NO: 290578

SEQ ID NO: 461260 - RNA, 64 nt, hsa; identical to SEQ ID NO: 290579

SEQ ID NO: 461261 - RNA, 64 nt, hsa; identical to SEQ ID NO: 290580

SEQ ID NO: 461262 - RNA, 64 nt, hsa; identical to SEQ ID NO: 290581

SEQ ID NO: 461263 - RNA, 64 nt, hsa; identical to SEQ ID NO: 290582

SEQ ID NO: 461264 - RNA, 64 nt, hsa; identical to SEQ ID NO: 290583

SEQ ID NO: 461265 - RNA, 64 nt, hsa; identical to SEQ ID NO: 290584

SEQ ID NO: 461266 - RNA, 64 nt, hsa; identical to SEQ ID NO: 290585

SEQ ID NO: 461267 - RNA, 64 nt, hsa; identical to SEQ ID NO: 290586

SEQ ID NO: 461268 - RNA, 64 nt, hsa; identical to SEQ ID NO: 290587

SEQ ID NO: 461269 - RNA, 64 nt, hsa; identical to SEQ ID NO: 290588

SEQ ID NO: 461270 - RNA, 64 nt, hsa; identical to SEQ ID NO: 290589

SEQ ID NO: 461271 - RNA, 64 nt, hsa; identical to SEQ ID NO: 290590

SEQ ID NO: 461272 - RNA, 64 nt, hsa; identical to SEQ ID NO: 290591

SEQ ID NO: 461273 - RNA, 64 nt, hsa; identical to SEQ ID NO: 290592

SEQ ID NO: 461274 - RNA, 64 nt, hsa; identical to SEQ ID NO: 290593

SEQ ID NO: 461275 - RNA, 64 nt, hsa; identical to SEQ ID NO: 290594

SEQ ID NO: 461276 - RNA, 64 nt, hsa; identical to SEQ ID NO: 290595

SEQ ID NO: 461277 - RNA, 64 nt, hsa; identical to SEQ ID NO: 290596

SEQ ID NO: 461278 - RNA, 64 nt, hsa; identical to SEQ ID NO: 290597

SEQ ID NO: 461279 - RNA, 64 nt, hsa; identical to SEQ ID NO: 290598

SEQ ID NO: 461280 - RNA, 64 nt, hsa; identical to SEQ ID NO: 290599

SEQ ID NO: 461281 - RNA, 64 nt, hsa; identical to SEQ ID NO: 290600

SEQ ID NO: 461282 - RNA, 64 nt, hsa; identical to SEQ ID NO: 290601

SEQ ID NO: 461283 - RNA, 64 nt, hsa; identical to SEQ ID NO: 290602

SEQ ID NO: 461284 - RNA, 64 nt, hsa; identical to SEQ ID NO: 290603

SEQ ID NO: 461285 - RNA, 64 nt, hsa; identical to SEQ ID NO: 290604

SEQ ID NO: 461286 - RNA, 64 nt, hsa; identical to SEQ ID NO: 290605

SEQ ID NO: 461287 - RNA, 64 nt, hsa; identical to SEQ ID NO: 290606

SEQ ID NO: 461288 - RNA, 64 nt, hsa; identical to SEQ ID NO: 290607

SEQ ID NO: 461289 - RNA, 64 nt, hsa; identical to SEQ ID NO: 290608

SEQ ID NO: 461290 - RNA, 64 nt, hsa; identical to SEQ ID NO: 290609

SEQ ID NO: 461291 - RNA, 64 nt, hsa; identical to SEQ ID NO: 290610

SEQ ID NO: 461292 - RNA, 64 nt, hsa; identical to SEQ ID NO: 290611

SEQ ID NO: 461293 - RNA, 64 nt, hsa; identical to SEQ ID NO: 290612

SEQ ID NO: 461294 - RNA, 64 nt, hsa; identical to SEQ ID NO: 290613

SEQ ID NO: 461295 - RNA, 64 nt, hsa; identical to SEQ ID NO: 290614

SEQ ID NO: 461296 - RNA, 64 nt, hsa; identical to SEQ ID NO: 290615

SEQ ID NO: 461297 - RNA, 64 nt, hsa; identical to SEQ ID NO: 290616

SEQ ID NO: 461298 - RNA, 64 nt, hsa; identical to SEQ ID NO: 290617

SEQ ID NO: 461299 - RNA, 64 nt, hsa; identical to SEQ ID NO: 290618

SEQ ID NO: 461300 - RNA, 64 nt, hsa; identical to SEQ ID NO: 290619

SEQ ID NO: 461301 - RNA, 64 nt, hsa; identical to SEQ ID NO: 290620

SEQ ID NO: 461302 - RNA, 64 nt, hsa; identical to SEQ ID NO: 290621

SEQ ID NO: 461303 - RNA, 64 nt, hsa; identical to SEQ ID NO: 290622

SEQ ID NO: 461304 - RNA, 64 nt, hsa; identical to SEQ ID NO: 290623

SEQ ID NO: 461305 - RNA, 64 nt, hsa; identical to SEQ ID NO: 290624

SEQ ID NO: 461306 - RNA, 64 nt, hsa; identical to SEQ ID NO: 290625

SEQ ID NO: 461307 - RNA, 64 nt, hsa; identical to SEQ ID NO: 290626

SEQ ID NO: 461308 - RNA, 64 nt, hsa; identical to SEQ ID NO: 290627

SEQ ID NO: 461309 - RNA, 64 nt, hsa; identical to SEQ ID NO: 290628

SEQ ID NO: 461310 - RNA, 64 nt, hsa; identical to SEQ ID NO: 290629

SEQ ID NO: 461311 - RNA, 64 nt, hsa; identical to SEQ ID NO: 290630

SEQ ID NO: 461312 - RNA, 64 nt, hsa; identical to SEQ ID NO: 290631

SEQ ID NO: 461313 - RNA, 64 nt, hsa; identical to SEQ ID NO: 290632

SEQ ID NO: 461314 - RNA, 64 nt, hsa; identical to SEQ ID NO: 290633

SEQ ID NO: 461315 - RNA, 64 nt, hsa; identical to SEQ ID NO: 290634

SEQ ID NO: 461316 - RNA, 64 nt, hsa; identical to SEQ ID NO: 290635

SEQ ID NO: 461317 - RNA, 64 nt, hsa; identical to SEQ ID NO: 290636

SEQ ID NO: 461318 - RNA, 64 nt, hsa
ugcagcagcacacccugcaggcggaguuuucagaggaugcaauuuuggaucccgaauuuugaug

SEQ ID NO: 461319 - RNA, 64 nt, hsa
uaaaaaucacuguaauacuucauuguguuguacuggaugcaaagcuagaaaauauugcaauaaa

SEQ ID NO: 461320 - RNA, 64 nt, hsa
uaugccaaauaucaagaugugaaggacuaauucaggaugcaaaaacguuauugggggguuguaa

SEQ ID NO: 461321 - RNA, 64 nt, hsa
gggggguuguaaauaucaacuauucaacaguuuaggaugcaauuacgaguguaaacugugugcc

SEQ ID NO: 461322 - RNA, 64 nt, hsa
cuuauccaccaugaucaagugggcuucaucccugggaugcaaggcugguucaacauacgcaaau

SEQ ID NO: 461323 - RNA, 64 nt, hsa
agaacuacaaaccacugcuuaacgaaauaaaagaggaugcaaagaaauggaagagcauuccaug

SEQ ID NO: 461324 - RNA, 64 nt, hsa; identical to SEQ ID NO: 286186

SEQ ID NO: 461325 - RNA, 64 nt, hsa; identical to SEQ ID NO: 286187

SEQ ID NO: 461326 - RNA, 64 nt, hsa; identical to SEQ ID NO: 286188

SEQ ID NO: 461327 - RNA, 64 nt, hsa; identical to SEQ ID NO: 286189

SEQ ID NO: 461328 - RNA, 64 nt, hsa; identical to SEQ ID NO: 286190

SEQ ID NO: 461329 - RNA, 64 nt, hsa; identical to SEQ ID NO: 286191

SEQ ID NO: 461330 - RNA, 64 nt, hsa; identical to SEQ ID NO: 286192

SEQ ID NO: 461331 - RNA, 64 nt, hsa; identical to SEQ ID NO: 286193

SEQ ID NO: 461332 - RNA, 64 nt, hsa; identical to SEQ ID NO: 286194

SEQ ID NO: 461333 - RNA, 64 nt, hsa; identical to SEQ ID NO: 286195

SEQ ID NO: 461334 - RNA, 64 nt, hsa; identical to SEQ ID NO: 286196

SEQ ID NO: 461335 - RNA, 64 nt, hsa; identical to SEQ ID NO: 286197

SEQ ID NO: 461336 - RNA, 64 nt, hsa; identical to SEQ ID NO: 286198

SEQ ID NO: 461337 - RNA, 64 nt, hsa; identical to SEQ ID NO: 286199

SEQ ID NO: 461338 - RNA, 64 nt, hsa; identical to SEQ ID NO: 286200

SEQ ID NO: 461339 - RNA, 64 nt, hsa; identical to SEQ ID NO: 286201

SEQ ID NO: 461340 - RNA, 64 nt, hsa; identical to SEQ ID NO: 286202

SEQ ID NO: 461341 - RNA, 64 nt, hsa; identical to SEQ ID NO: 286203

SEQ ID NO: 461342 - RNA, 64 nt, hsa; identical to SEQ ID NO: 286204

SEQ ID NO: 461343 - RNA, 64 nt, hsa; identical to SEQ ID NO: 286205

SEQ ID NO: 461344 - RNA, 64 nt, hsa; identical to SEQ ID NO: 286206

SEQ ID NO: 461345 - RNA, 64 nt, hsa; identical to SEQ ID NO: 286207

SEQ ID NO: 461346 - RNA, 64 nt, hsa; identical to SEQ ID NO: 286208

SEQ ID NO: 461347 - RNA, 64 nt, hsa; identical to SEQ ID NO: 286209

SEQ ID NO: 461348 - RNA, 64 nt, hsa; identical to SEQ ID NO: 286210

SEQ ID NO: 461349 - RNA, 64 nt, hsa
gaucugaaaauguguguggugguaugacagcauaccauuaaauacauuuacaucacagcucaaa

SEQ ID NO: 461350 - RNA, 64 nt, hsa
uauuagguuggugcaaaacuaguugcgguuuuucccauuaaaaguaauaaacuuacucuuauac

SEQ ID NO: 461351 - RNA, 64 nt, hsa
ugcucugagcuuguuuccucaucugucaggagugccauuaaaggagaaaaaucacguagaaagc

SEQ ID NO: 461352 - RNA, 64 nt, hsa
caggcaggaggacaucuuggcagugcuggcuuggccauuaaauggaaaccugaaggccauccuc

SEQ ID NO: 461353 - RNA, 64 nt, hsa
ccaucugaagaaacuucccaaguguaagacucugccauuaaaacauuaccgagaggggacucaa

SEQ ID NO: 461354 - RNA, 64 nt, hsa
uaucucaauuuaguuuguuauuuauccuagugggccauuaaaaacuaccacauguguuucuguc

SEQ ID NO: 461355 - RNA, 64 nt, hsa
uuuaccacccagaguuuuaucuuuagcaaaauaaccauuaaaguuguuugccuuuuacuuugcu

SEQ ID NO: 461356 - RNA, 64 nt, hsa
auaggcuucucagcuuguaaaauggaaacuguacccauuaaacaguaauucccacuccucccag

SEQ ID NO: 461357 - RNA, 64 nt, hsa
ucaguguuuucuacaauacuccuccugccccgccccauuaaaacaguucuuuuguuaagaaaua

SEQ ID NO: 461358 - RNA, 64 nt, hsa
ccuggaccugggaggacuucgaaugcuggauaagccauuaaacuuagcauuaucuucaucaugg

SEQ ID NO: 461359 - RNA, 62 nt, hsa
caucagggugaccacauuaagcccaguauuccaguuggcaccagaagauauggacuuggaau

SEQ ID NO: 461360 - RNA, 62 nt, hsa
acguggauguaguuuggcucaggugucccugcaguuggcaaggagucaguacucagucccug

SEQ ID NO: 461361 - RNA, 62 nt, hsa
uaauguggaaguuaacccuuaccaaaaaaggaaguuggcaaaaacagccuucuagcacacuu

SEQ ID NO: 461362 - RNA, 62 nt, hsa
cauuuuuaaaaugugaagauggacuucaugcaaguuggcagugguucugguacuaaaaauug

SEQ ID NO: 461363 - RNA, 62 nt, hsa
aaacaaggaagucagcucuuucacuuuuuacaaguuggcaaaaacagacuuccggggaauuu

SEQ ID NO: 461364 - RNA, 62 nt, hsa
gcaacuguggggccugcacacagcccuuccacaguuggcacugcaggugcaggccaacccuu

SEQ ID NO: 461365 - RNA, 62 nt, hsa
uuuuauuuugugaagugaaggauuuguguuuuaguuggcaguuguuaaguccuuggcuugcc

SEQ ID NO: 461366 - RNA, 62 nt, hsa
gguagguguuugaacagaggccacauuacuagaguuggcaugacucuugacucuugccugcc

SEQ ID NO: 461367 - RNA, 64 nt, hsa; identical to SEQ ID NO: 124720

SEQ ID NO: 461368 - RNA, 64 nt, hsa; identical to SEQ ID NO: 124721

SEQ ID NO: 461369 - RNA, 64 nt, hsa; identical to SEQ ID NO: 124722

SEQ ID NO: 461370 - RNA, 64 nt, hsa; identical to SEQ ID NO: 124723

SEQ ID NO: 461371 - RNA, 64 nt, hsa; identical to SEQ ID NO: 124724

SEQ ID NO: 461372 - RNA, 64 nt, hsa; identical to SEQ ID NO: 124725

SEQ ID NO: 461373 - RNA, 64 nt, hsa; identical to SEQ ID NO: 323157

SEQ ID NO: 461374 - RNA, 64 nt, hsa; identical to SEQ ID NO: 323158

SEQ ID NO: 461375 - RNA, 64 nt, hsa; identical to SEQ ID NO: 323159

SEQ ID NO: 461376 - RNA, 64 nt, hsa; identical to SEQ ID NO: 323160

SEQ ID NO: 461377 - RNA, 64 nt, hsa; identical to SEQ ID NO: 323161

SEQ ID NO: 461378 - RNA, 64 nt, hsa; identical to SEQ ID NO: 323162

SEQ ID NO: 461379 - RNA, 64 nt, hsa; identical to SEQ ID NO: 323163

SEQ ID NO: 461380 - RNA, 64 nt, hsa; identical to SEQ ID NO: 323164

SEQ ID NO: 461381 - RNA, 64 nt, hsa; identical to SEQ ID NO: 323165

SEQ ID NO: 461382 - RNA, 64 nt, hsa; identical to SEQ ID NO: 323166

SEQ ID NO: 461383 - RNA, 64 nt, hsa; identical to SEQ ID NO: 323167

SEQ ID NO: 461384 - RNA, 64 nt, hsa; identical to SEQ ID NO: 323168

SEQ ID NO: 461385 - RNA, 64 nt, hsa; identical to SEQ ID NO: 323169

SEQ ID NO: 461386 - RNA, 64 nt, hsa; identical to SEQ ID NO: 323170

SEQ ID NO: 461387 - RNA, 64 nt, hsa; identical to SEQ ID NO: 323171

SEQ ID NO: 461388 - RNA, 64 nt, hsa; identical to SEQ ID NO: 323172

SEQ ID NO: 461389 - RNA, 64 nt, hsa; identical to SEQ ID NO: 323173

SEQ ID NO: 461390 - RNA, 64 nt, hsa; identical to SEQ ID NO: 323174

SEQ ID NO: 461391 - RNA, 64 nt, hsa; identical to SEQ ID NO: 323175

SEQ ID NO: 461392 - RNA, 64 nt, hsa; identical to SEQ ID NO: 323176

SEQ ID NO: 461393 - RNA, 64 nt, hsa; identical to SEQ ID NO: 323177

SEQ ID NO: 461394 - RNA, 64 nt, hsa; identical to SEQ ID NO: 323178

SEQ ID NO: 461395 - RNA, 64 nt, hsa; identical to SEQ ID NO: 323179

SEQ ID NO: 461396 - RNA, 64 nt, hsa; identical to SEQ ID NO: 323180

SEQ ID NO: 461397 - RNA, 64 nt, hsa; identical to SEQ ID NO: 323181

SEQ ID NO: 461398 - RNA, 64 nt, hsa; identical to SEQ ID NO: 323182

SEQ ID NO: 461399 - RNA, 64 nt, hsa; identical to SEQ ID NO: 323183

SEQ ID NO: 461400 - RNA, 64 nt, hsa; identical to SEQ ID NO: 323184

SEQ ID NO: 461401 - RNA, 64 nt, hsa; identical to SEQ ID NO: 323185

SEQ ID NO: 461402 - RNA, 64 nt, hsa; identical to SEQ ID NO: 323186

SEQ ID NO: 461403 - RNA, 64 nt, hsa; identical to SEQ ID NO: 323187

SEQ ID NO: 461404 - RNA, 64 nt, hsa; identical to SEQ ID NO: 323188

SEQ ID NO: 461405 - RNA, 64 nt, hsa; identical to SEQ ID NO: 323189

SEQ ID NO: 461406 - RNA, 64 nt, hsa; identical to SEQ ID NO: 323190

SEQ ID NO: 461407 - RNA, 64 nt, hsa; identical to SEQ ID NO: 323191

SEQ ID NO: 461408 - RNA, 64 nt, hsa; identical to SEQ ID NO: 323192

SEQ ID NO: 461409 - RNA, 64 nt, hsa; identical to SEQ ID NO: 323193

SEQ ID NO: 461410 - RNA, 64 nt, hsa; identical to SEQ ID NO: 323194

SEQ ID NO: 461411 - RNA, 64 nt, hsa; identical to SEQ ID NO: 323195

SEQ ID NO: 461412 - RNA, 64 nt, hsa; identical to SEQ ID NO: 323196

SEQ ID NO: 461413 - RNA, 64 nt, hsa; identical to SEQ ID NO: 323197

SEQ ID NO: 461414 - RNA, 64 nt, hsa; identical to SEQ ID NO: 323198

SEQ ID NO: 461415 - RNA, 64 nt, hsa; identical to SEQ ID NO: 323199

SEQ ID NO: 461416 - RNA, 64 nt, hsa; identical to SEQ ID NO: 323200

SEQ ID NO: 461417 - RNA, 64 nt, hsa; identical to SEQ ID NO: 323201

SEQ ID NO: 461418 - RNA, 64 nt, hsa; identical to SEQ ID NO: 323202

SEQ ID NO: 461419 - RNA, 64 nt, hsa; identical to SEQ ID NO: 323203

SEQ ID NO: 461420 - RNA, 64 nt, hsa; identical to SEQ ID NO: 323204

SEQ ID NO: 461421 - RNA, 64 nt, hsa; identical to SEQ ID NO: 323205

SEQ ID NO: 461422 - RNA, 64 nt, hsa; identical to SEQ ID NO: 323206

SEQ ID NO: 461423 - RNA, 64 nt, hsa; identical to SEQ ID NO: 323207

SEQ ID NO: 461424 - RNA, 64 nt, hsa; identical to SEQ ID NO: 323208

SEQ ID NO: 461425 - RNA, 64 nt, hsa; identical to SEQ ID NO: 323209

SEQ ID NO: 461426 - RNA, 64 nt, hsa; identical to SEQ ID NO: 323210

SEQ ID NO: 461427 - RNA, 64 nt, hsa; identical to SEQ ID NO: 323211

SEQ ID NO: 461428 - RNA, 64 nt, hsa; identical to SEQ ID NO: 323212

SEQ ID NO: 461429 - RNA, 64 nt, hsa; identical to SEQ ID NO: 323213

SEQ ID NO: 461430 - RNA, 64 nt, hsa; identical to SEQ ID NO: 323214

SEQ ID NO: 461431 - RNA, 64 nt, hsa; identical to SEQ ID NO: 323215

SEQ ID NO: 461432 - RNA, 64 nt, hsa; identical to SEQ ID NO: 323216

SEQ ID NO: 461433 - RNA, 64 nt, hsa; identical to SEQ ID NO: 323217

SEQ ID NO: 461434 - RNA, 64 nt, hsa; identical to SEQ ID NO: 323218

SEQ ID NO: 461435 - RNA, 64 nt, hsa; identical to SEQ ID NO: 323219

SEQ ID NO: 461436 - RNA, 64 nt, hsa; identical to SEQ ID NO: 323220

SEQ ID NO: 461437 - RNA, 64 nt, hsa; identical to SEQ ID NO: 323221

SEQ ID NO: 461438 - RNA, 64 nt, hsa; identical to SEQ ID NO: 323222

SEQ ID NO: 461439 - RNA, 64 nt, hsa; identical to SEQ ID NO: 323223

SEQ ID NO: 461440 - RNA, 64 nt, hsa; identical to SEQ ID NO: 323224

SEQ ID NO: 461441 - RNA, 64 nt, hsa; identical to SEQ ID NO: 323225

SEQ ID NO: 461442 - RNA, 64 nt, hsa; identical to SEQ ID NO: 323226

SEQ ID NO: 461443 - RNA, 64 nt, hsa; identical to SEQ ID NO: 323227

SEQ ID NO: 461444 - RNA, 64 nt, hsa; identical to SEQ ID NO: 323228

SEQ ID NO: 461445 - RNA, 64 nt, hsa; identical to SEQ ID NO: 323229

SEQ ID NO: 461446 - RNA, 64 nt, hsa; identical to SEQ ID NO: 323230

SEQ ID NO: 461447 - RNA, 64 nt, hsa; identical to SEQ ID NO: 323231

SEQ ID NO: 461448 - RNA, 64 nt, hsa; identical to SEQ ID NO: 323232

SEQ ID NO: 461449 - RNA, 64 nt, hsa; identical to SEQ ID NO: 323233

SEQ ID NO: 461450 - RNA, 64 nt, hsa; identical to SEQ ID NO: 323234

SEQ ID NO: 461451 - RNA, 64 nt, hsa; identical to SEQ ID NO: 323235

SEQ ID NO: 461452 - RNA, 64 nt, hsa; identical to SEQ ID NO: 323236

SEQ ID NO: 461453 - RNA, 64 nt, hsa; identical to SEQ ID NO: 323237

SEQ ID NO: 461454 - RNA, 64 nt, hsa; identical to SEQ ID NO: 323238

SEQ ID NO: 461455 - RNA, 64 nt, hsa; identical to SEQ ID NO: 323239

SEQ ID NO: 461456 - RNA, 64 nt, hsa; identical to SEQ ID NO: 323240

SEQ ID NO: 461457 - RNA, 64 nt, hsa; identical to SEQ ID NO: 323241

SEQ ID NO: 461458 - RNA, 64 nt, hsa; identical to SEQ ID NO: 323242

SEQ ID NO: 461459 - RNA, 64 nt, hsa; identical to SEQ ID NO: 323243

SEQ ID NO: 461460 - RNA, 64 nt, hsa; identical to SEQ ID NO: 323244

SEQ ID NO: 461461 - RNA, 64 nt, hsa; identical to SEQ ID NO: 323245

SEQ ID NO: 461462 - RNA, 64 nt, hsa; identical to SEQ ID NO: 323246

SEQ ID NO: 461463 - RNA, 64 nt, hsa; identical to SEQ ID NO: 323247

SEQ ID NO: 461464 - RNA, 64 nt, hsa; identical to SEQ ID NO: 323248

SEQ ID NO: 461465 - RNA, 64 nt, hsa; identical to SEQ ID NO: 323249

SEQ ID NO: 461466 - RNA, 64 nt, hsa; identical to SEQ ID NO: 323250

SEQ ID NO: 461467 - RNA, 64 nt, hsa; identical to SEQ ID NO: 323251

SEQ ID NO: 461468 - RNA, 64 nt, hsa; identical to SEQ ID NO: 323252

SEQ ID NO: 461469 - RNA, 64 nt, hsa; identical to SEQ ID NO: 323253

SEQ ID NO: 461470 - RNA, 64 nt, hsa; identical to SEQ ID NO: 323254

SEQ ID NO: 461471 - RNA, 64 nt, hsa; identical to SEQ ID NO: 323255

SEQ ID NO: 461472 - RNA, 64 nt, hsa; identical to SEQ ID NO: 323256

SEQ ID NO: 461473 - RNA, 64 nt, hsa; identical to SEQ ID NO: 323257

SEQ ID NO: 461474 - RNA, 64 nt, hsa; identical to SEQ ID NO: 323258

SEQ ID NO: 461475 - RNA, 64 nt, hsa; identical to SEQ ID NO: 323259

SEQ ID NO: 461476 - RNA, 64 nt, hsa; identical to SEQ ID NO: 323260

SEQ ID NO: 461477 - RNA, 64 nt, hsa; identical to SEQ ID NO: 323261

SEQ ID NO: 461478 - RNA, 64 nt, hsa; identical to SEQ ID NO: 323262

SEQ ID NO: 461479 - RNA, 64 nt, hsa; identical to SEQ ID NO: 323263

SEQ ID NO: 461480 - RNA, 64 nt, hsa; identical to SEQ ID NO: 323264

SEQ ID NO: 461481 - RNA, 64 nt, hsa; identical to SEQ ID NO: 323265

SEQ ID NO: 461482 - RNA, 64 nt, hsa; identical to SEQ ID NO: 323266

SEQ ID NO: 461483 - RNA, 64 nt, hsa; identical to SEQ ID NO: 323267

SEQ ID NO: 461484 - RNA, 64 nt, hsa; identical to SEQ ID NO: 323268

SEQ ID NO: 461485 - RNA, 64 nt, hsa; identical to SEQ ID NO: 323269

SEQ ID NO: 461486 - RNA, 64 nt, hsa; identical to SEQ ID NO: 323270

SEQ ID NO: 461487 - RNA, 64 nt, hsa; identical to SEQ ID NO: 323271

SEQ ID NO: 461488 - RNA, 64 nt, hsa; identical to SEQ ID NO: 323272

SEQ ID NO: 461489 - RNA, 64 nt, hsa; identical to SEQ ID NO: 323273

SEQ ID NO: 461490 - RNA, 64 nt, hsa; identical to SEQ ID NO: 323274

SEQ ID NO: 461491 - RNA, 64 nt, hsa; identical to SEQ ID NO: 323275

SEQ ID NO: 461492 - RNA, 64 nt, hsa; identical to SEQ ID NO: 323276

SEQ ID NO: 461493 - RNA, 64 nt, hsa; identical to SEQ ID NO: 323277

SEQ ID NO: 461494 - RNA, 64 nt, hsa; identical to SEQ ID NO: 323278

SEQ ID NO: 461495 - RNA, 64 nt, hsa; identical to SEQ ID NO: 323279

SEQ ID NO: 461496 - RNA, 64 nt, hsa; identical to SEQ ID NO: 323280

SEQ ID NO: 461497 - RNA, 64 nt, hsa; identical to SEQ ID NO: 323281

SEQ ID NO: 461498 - RNA, 64 nt, hsa; identical to SEQ ID NO: 323282

SEQ ID NO: 461499 - RNA, 64 nt, hsa; identical to SEQ ID NO: 323283

SEQ ID NO: 461500 - RNA, 64 nt, hsa; identical to SEQ ID NO: 323284

SEQ ID NO: 461501 - RNA, 64 nt, hsa; identical to SEQ ID NO: 323285

SEQ ID NO: 461502 - RNA, 64 nt, hsa; identical to SEQ ID NO: 323286

SEQ ID NO: 461503 - RNA, 64 nt, hsa; identical to SEQ ID NO: 323287

SEQ ID NO: 461504 - RNA, 64 nt, hsa; identical to SEQ ID NO: 323288

SEQ ID NO: 461505 - RNA, 64 nt, hsa; identical to SEQ ID NO: 323289

SEQ ID NO: 461506 - RNA, 64 nt, hsa; identical to SEQ ID NO: 323290

SEQ ID NO: 461507 - RNA, 64 nt, hsa; identical to SEQ ID NO: 323291

SEQ ID NO: 461508 - RNA, 64 nt, hsa; identical to SEQ ID NO: 323292

SEQ ID NO: 461509 - RNA, 64 nt, hsa; identical to SEQ ID NO: 323293

SEQ ID NO: 461510 - RNA, 64 nt, hsa; identical to SEQ ID NO: 323294

SEQ ID NO: 461511 - RNA, 64 nt, hsa; identical to SEQ ID NO: 323295

SEQ ID NO: 461512 - RNA, 64 nt, hsa; identical to SEQ ID NO: 323296

SEQ ID NO: 461513 - RNA, 64 nt, hsa; identical to SEQ ID NO: 323297

SEQ ID NO: 461514 - RNA, 64 nt, hsa; identical to SEQ ID NO: 323298

SEQ ID NO: 461515 - RNA, 64 nt, hsa; identical to SEQ ID NO: 323299

SEQ ID NO: 461516 - RNA, 64 nt, hsa; identical to SEQ ID NO: 323300

SEQ ID NO: 461517 - RNA, 64 nt, hsa; identical to SEQ ID NO: 323301

SEQ ID NO: 461518 - RNA, 64 nt, hsa; identical to SEQ ID NO: 323302

SEQ ID NO: 461519 - RNA, 64 nt, hsa; identical to SEQ ID NO: 323303

SEQ ID NO: 461520 - RNA, 64 nt, hsa; identical to SEQ ID NO: 323304

SEQ ID NO: 461521 - RNA, 64 nt, hsa; identical to SEQ ID NO: 323305

SEQ ID NO: 461522 - RNA, 64 nt, hsa; identical to SEQ ID NO: 323306

SEQ ID NO: 461523 - RNA, 64 nt, hsa; identical to SEQ ID NO: 323307

SEQ ID NO: 461524 - RNA, 64 nt, hsa; identical to SEQ ID NO: 323308

SEQ ID NO: 461525 - RNA, 64 nt, hsa; identical to SEQ ID NO: 323309

SEQ ID NO: 461526 - RNA, 64 nt, hsa; identical to SEQ ID NO: 323310

SEQ ID NO: 461527 - RNA, 64 nt, hsa; identical to SEQ ID NO: 323311

SEQ ID NO: 461528 - RNA, 64 nt, hsa; identical to SEQ ID NO: 323312

SEQ ID NO: 461529 - RNA, 64 nt, hsa; identical to SEQ ID NO: 323313

SEQ ID NO: 461530 - RNA, 64 nt, hsa; identical to SEQ ID NO: 323314

SEQ ID NO: 461531 - RNA, 64 nt, hsa; identical to SEQ ID NO: 323315

SEQ ID NO: 461532 - RNA, 64 nt, hsa; identical to SEQ ID NO: 323316

SEQ ID NO: 461533 - RNA, 64 nt, hsa; identical to SEQ ID NO: 323317

SEQ ID NO: 461534 - RNA, 64 nt, hsa; identical to SEQ ID NO: 323318

SEQ ID NO: 461535 - RNA, 64 nt, hsa; identical to SEQ ID NO: 323319

SEQ ID NO: 461536 - RNA, 64 nt, hsa; identical to SEQ ID NO: 323320

SEQ ID NO: 461537 - RNA, 64 nt, hsa; identical to SEQ ID NO: 323321

SEQ ID NO: 461538 - RNA, 64 nt, hsa; identical to SEQ ID NO: 323322

SEQ ID NO: 461539 - RNA, 64 nt, hsa; identical to SEQ ID NO: 323323

SEQ ID NO: 461540 - RNA, 64 nt, hsa; identical to SEQ ID NO: 323324

SEQ ID NO: 461541 - RNA, 64 nt, hsa; identical to SEQ ID NO: 323325

SEQ ID NO: 461542 - RNA, 64 nt, hsa; identical to SEQ ID NO: 323326

SEQ ID NO: 461543 - RNA, 64 nt, hsa; identical to SEQ ID NO: 323327

SEQ ID NO: 461544 - RNA, 64 nt, hsa; identical to SEQ ID NO: 323328

SEQ ID NO: 461545 - RNA, 64 nt, hsa; identical to SEQ ID NO: 323329

SEQ ID NO: 461546 - RNA, 64 nt, hsa; identical to SEQ ID NO: 323330

SEQ ID NO: 461547 - RNA, 64 nt, hsa; identical to SEQ ID NO: 323331

SEQ ID NO: 461548 - RNA, 64 nt, hsa; identical to SEQ ID NO: 323332

SEQ ID NO: 461549 - RNA, 64 nt, hsa; identical to SEQ ID NO: 323333

SEQ ID NO: 461550 - RNA, 64 nt, hsa; identical to SEQ ID NO: 323334

SEQ ID NO: 461551 - RNA, 64 nt, hsa; identical to SEQ ID NO: 323335

SEQ ID NO: 461552 - RNA, 64 nt, hsa; identical to SEQ ID NO: 323336

SEQ ID NO: 461553 - RNA, 64 nt, hsa; identical to SEQ ID NO: 323337

SEQ ID NO: 461554 - RNA, 64 nt, hsa; identical to SEQ ID NO: 323338

SEQ ID NO: 461555 - RNA, 64 nt, hsa; identical to SEQ ID NO: 323339

SEQ ID NO: 461556 - RNA, 64 nt, hsa; identical to SEQ ID NO: 323340

SEQ ID NO: 461557 - RNA, 64 nt, hsa; identical to SEQ ID NO: 323341

SEQ ID NO: 461558 - RNA, 64 nt, hsa; identical to SEQ ID NO: 323342

SEQ ID NO: 461559 - RNA, 64 nt, hsa; identical to SEQ ID NO: 323343

SEQ ID NO: 461560 - RNA, 64 nt, hsa; identical to SEQ ID NO: 323344

SEQ ID NO: 461561 - RNA, 64 nt, hsa; identical to SEQ ID NO: 323345

SEQ ID NO: 461562 - RNA, 64 nt, hsa; identical to SEQ ID NO: 323346

SEQ ID NO: 461563 - RNA, 64 nt, hsa; identical to SEQ ID NO: 323347

SEQ ID NO: 461564 - RNA, 64 nt, hsa; identical to SEQ ID NO: 323348

SEQ ID NO: 461565 - RNA, 64 nt, hsa; identical to SEQ ID NO: 323349

SEQ ID NO: 461566 - RNA, 64 nt, hsa; identical to SEQ ID NO: 323350

SEQ ID NO: 461567 - RNA, 64 nt, hsa; identical to SEQ ID NO: 323351

SEQ ID NO: 461568 - RNA, 64 nt, hsa; identical to SEQ ID NO: 323352

SEQ ID NO: 461569 - RNA, 64 nt, hsa; identical to SEQ ID NO: 323353

SEQ ID NO: 461570 - RNA, 64 nt, hsa; identical to SEQ ID NO: 323354

SEQ ID NO: 461571 - RNA, 64 nt, hsa; identical to SEQ ID NO: 323355

SEQ ID NO: 461572 - RNA, 64 nt, hsa; identical to SEQ ID NO: 323356

SEQ ID NO: 461573 - RNA, 64 nt, hsa; identical to SEQ ID NO: 323357

SEQ ID NO: 461574 - RNA, 64 nt, hsa; identical to SEQ ID NO: 323358

SEQ ID NO: 461575 - RNA, 64 nt, hsa; identical to SEQ ID NO: 323359

SEQ ID NO: 461576 - RNA, 64 nt, hsa; identical to SEQ ID NO: 323360

SEQ ID NO: 461577 - RNA, 64 nt, hsa; identical to SEQ ID NO: 323361

SEQ ID NO: 461578 - RNA, 64 nt, hsa; identical to SEQ ID NO: 323362

SEQ ID NO: 461579 - RNA, 64 nt, hsa; identical to SEQ ID NO: 323363

SEQ ID NO: 461580 - RNA, 64 nt, hsa; identical to SEQ ID NO: 323364

SEQ ID NO: 461581 - RNA, 64 nt, hsa; identical to SEQ ID NO: 323365

SEQ ID NO: 461582 - RNA, 64 nt, hsa; identical to SEQ ID NO: 323366

SEQ ID NO: 461583 - RNA, 64 nt, hsa; identical to SEQ ID NO: 323367

SEQ ID NO: 461584 - RNA, 64 nt, hsa; identical to SEQ ID NO: 323368

SEQ ID NO: 461585 - RNA, 64 nt, hsa; identical to SEQ ID NO: 323369

SEQ ID NO: 461586 - RNA, 64 nt, hsa; identical to SEQ ID NO: 108616

SEQ ID NO: 461587 - RNA, 64 nt, hsa; identical to SEQ ID NO: 108617

SEQ ID NO: 461588 - RNA, 64 nt, hsa; identical to SEQ ID NO: 108618

SEQ ID NO: 461589 - RNA, 64 nt, hsa; identical to SEQ ID NO: 108619

SEQ ID NO: 461590 - RNA, 64 nt, hsa; identical to SEQ ID NO: 108620

SEQ ID NO: 461591 - RNA, 64 nt, hsa; identical to SEQ ID NO: 108621

SEQ ID NO: 461592 - RNA, 64 nt, hsa; identical to SEQ ID NO: 108622

SEQ ID NO: 461593 - RNA, 64 nt, hsa; identical to SEQ ID NO: 108623

SEQ ID NO: 461594 - RNA, 61 nt, hsa; identical to SEQ ID NO: 108624

SEQ ID NO: 461595 - RNA, 64 nt, hsa; identical to SEQ ID NO: 108625

SEQ ID NO: 461596 - RNA, 64 nt, hsa; identical to SEQ ID NO: 108626

SEQ ID NO: 461597 - RNA, 64 nt, hsa; identical to SEQ ID NO: 108627

SEQ ID NO: 461598 - RNA, 64 nt, hsa; identical to SEQ ID NO: 108628

SEQ ID NO: 461599 - RNA, 64 nt, hsa; identical to SEQ ID NO: 108629

SEQ ID NO: 461600 - RNA, 64 nt, hsa; identical to SEQ ID NO: 108630

SEQ ID NO: 461601 - RNA, 64 nt, hsa; identical to SEQ ID NO: 108631

SEQ ID NO: 461602 - RNA, 64 nt, hsa; identical to SEQ ID NO: 108632

SEQ ID NO: 461603 - RNA, 64 nt, hsa; identical to SEQ ID NO: 108633

SEQ ID NO: 461604 - RNA, 64 nt, hsa; identical to SEQ ID NO: 108634

SEQ ID NO: 461605 - RNA, 64 nt, hsa; identical to SEQ ID NO: 108635

SEQ ID NO: 461606 - RNA, 64 nt, hsa; identical to SEQ ID NO: 108636

SEQ ID NO: 461607 - RNA, 64 nt, hsa; identical to SEQ ID NO: 108637

SEQ ID NO: 461608 - RNA, 64 nt, hsa; identical to SEQ ID NO: 108638

SEQ ID NO: 461609 - RNA, 64 nt, hsa; identical to SEQ ID NO: 108639

SEQ ID NO: 461610 - RNA, 64 nt, hsa; identical to SEQ ID NO: 108640

SEQ ID NO: 461611 - RNA, 64 nt, hsa; identical to SEQ ID NO: 108641

SEQ ID NO: 461612 - RNA, 64 nt, hsa; identical to SEQ ID NO: 108642

SEQ ID NO: 461613 - RNA, 64 nt, hsa; identical to SEQ ID NO: 108643

SEQ ID NO: 461614 - RNA, 64 nt, hsa; identical to SEQ ID NO: 108644

SEQ ID NO: 461615 - RNA, 64 nt, hsa; identical to SEQ ID NO: 108645

SEQ ID NO: 461616 - RNA, 64 nt, hsa; identical to SEQ ID NO: 108646

SEQ ID NO: 461617 - RNA, 64 nt, hsa; identical to SEQ ID NO: 108647

SEQ ID NO: 461618 - RNA, 64 nt, hsa; identical to SEQ ID NO: 108648

SEQ ID NO: 461619 - RNA, 64 nt, hsa; identical to SEQ ID NO: 108649

SEQ ID NO: 461620 - RNA, 64 nt, hsa; identical to SEQ ID NO: 108650

SEQ ID NO: 461621 - RNA, 64 nt, hsa; identical to SEQ ID NO: 108651

SEQ ID NO: 461622 - RNA, 64 nt, hsa; identical to SEQ ID NO: 108652

SEQ ID NO: 461623 - RNA, 64 nt, hsa; identical to SEQ ID NO: 108653

SEQ ID NO: 461624 - RNA, 64 nt, hsa; identical to SEQ ID NO: 108654

SEQ ID NO: 461625 - RNA, 64 nt, hsa; identical to SEQ ID NO: 108655

SEQ ID NO: 461626 - RNA, 64 nt, hsa; identical to SEQ ID NO: 108656

SEQ ID NO: 461627 - RNA, 64 nt, hsa; identical to SEQ ID NO: 108657

SEQ ID NO: 461628 - RNA, 64 nt, hsa; identical to SEQ ID NO: 108658

SEQ ID NO: 461629 - RNA, 64 nt, hsa; identical to SEQ ID NO: 108659

SEQ ID NO: 461630 - RNA, 64 nt, hsa; identical to SEQ ID NO: 108660

SEQ ID NO: 461631 - RNA, 64 nt, hsa; identical to SEQ ID NO: 108661

SEQ ID NO: 461632 - RNA, 64 nt, hsa; identical to SEQ ID NO: 108662

SEQ ID NO: 461633 - RNA, 64 nt, hsa; identical to SEQ ID NO: 108663

SEQ ID NO: 461634 - RNA, 64 nt, hsa; identical to SEQ ID NO: 108664

SEQ ID NO: 461635 - RNA, 64 nt, hsa; identical to SEQ ID NO: 108665

SEQ ID NO: 461636 - RNA, 64 nt, hsa; identical to SEQ ID NO: 108666

SEQ ID NO: 461637 - RNA, 64 nt, hsa; identical to SEQ ID NO: 108667

SEQ ID NO: 461638 - RNA, 64 nt, hsa; identical to SEQ ID NO: 108668

SEQ ID NO: 461639 - RNA, 64 nt, hsa; identical to SEQ ID NO: 108669

SEQ ID NO: 461640 - RNA, 64 nt, hsa; identical to SEQ ID NO: 108670

SEQ ID NO: 461641 - RNA, 64 nt, hsa; identical to SEQ ID NO: 108671

SEQ ID NO: 461642 - RNA, 64 nt, hsa; identical to SEQ ID NO: 108672

SEQ ID NO: 461643 - RNA, 64 nt, hsa; identical to SEQ ID NO: 108673

SEQ ID NO: 461644 - RNA, 64 nt, hsa; identical to SEQ ID NO: 108674

SEQ ID NO: 461645 - RNA, 64 nt, hsa; identical to SEQ ID NO: 108675

SEQ ID NO: 461646 - RNA, 64 nt, hsa; identical to SEQ ID NO: 108676

SEQ ID NO: 461647 - RNA, 64 nt, hsa; identical to SEQ ID NO: 108677

SEQ ID NO: 461648 - RNA, 64 nt, hsa; identical to SEQ ID NO: 108678

SEQ ID NO: 461649 - RNA, 64 nt, hsa; identical to SEQ ID NO: 108679

SEQ ID NO: 461650 - RNA, 64 nt, hsa; identical to SEQ ID NO: 108680

SEQ ID NO: 461651 - RNA, 64 nt, hsa; identical to SEQ ID NO: 108681

SEQ ID NO: 461652 - RNA, 64 nt, hsa; identical to SEQ ID NO: 108682

SEQ ID NO: 461653 - RNA, 64 nt, hsa; identical to SEQ ID NO: 108683

SEQ ID NO: 461654 - RNA, 64 nt, hsa; identical to SEQ ID NO: 108684

SEQ ID NO: 461655 - RNA, 64 nt, hsa; identical to SEQ ID NO: 108685

SEQ ID NO: 461656 - RNA, 64 nt, hsa; identical to SEQ ID NO: 108686

SEQ ID NO: 461657 - RNA, 64 nt, hsa; identical to SEQ ID NO: 108687

SEQ ID NO: 461658 - RNA, 64 nt, hsa; identical to SEQ ID NO: 108688

SEQ ID NO: 461659 - RNA, 64 nt, hsa; identical to SEQ ID NO: 108689

SEQ ID NO: 461660 - RNA, 64 nt, hsa; identical to SEQ ID NO: 108690

SEQ ID NO: 461661 - RNA, 64 nt, hsa; identical to SEQ ID NO: 108691

SEQ ID NO: 461662 - RNA, 64 nt, hsa; identical to SEQ ID NO: 108692

SEQ ID NO: 461663 - RNA, 64 nt, hsa; identical to SEQ ID NO: 108693

SEQ ID NO: 461664 - RNA, 64 nt, hsa; identical to SEQ ID NO: 108694

SEQ ID NO: 461665 - RNA, 64 nt, hsa; identical to SEQ ID NO: 108695

SEQ ID NO: 461666 - RNA, 64 nt, hsa; identical to SEQ ID NO: 108696

SEQ ID NO: 461667 - RNA, 64 nt, hsa; identical to SEQ ID NO: 108697

SEQ ID NO: 461668 - RNA, 64 nt, hsa; identical to SEQ ID NO: 108698

SEQ ID NO: 461669 - RNA, 64 nt, hsa; identical to SEQ ID NO: 108699

SEQ ID NO: 461670 - RNA, 64 nt, hsa; identical to SEQ ID NO: 108700

SEQ ID NO: 461671 - RNA, 64 nt, hsa; identical to SEQ ID NO: 108701

SEQ ID NO: 461672 - RNA, 64 nt, hsa; identical to SEQ ID NO: 108702

SEQ ID NO: 461673 - RNA, 64 nt, hsa; identical to SEQ ID NO: 108703

SEQ ID NO: 461674 - RNA, 64 nt, hsa; identical to SEQ ID NO: 108704

SEQ ID NO: 461675 - RNA, 64 nt, hsa; identical to SEQ ID NO: 108705

SEQ ID NO: 461676 - RNA, 64 nt, hsa; identical to SEQ ID NO: 108706

SEQ ID NO: 461677 - RNA, 64 nt, hsa; identical to SEQ ID NO: 108707

SEQ ID NO: 461678 - RNA, 64 nt, hsa; identical to SEQ ID NO: 108708

SEQ ID NO: 461679 - RNA, 64 nt, hsa; identical to SEQ ID NO: 108709

SEQ ID NO: 461680 - RNA, 64 nt, hsa; identical to SEQ ID NO: 108710

SEQ ID NO: 461681 - RNA, 64 nt, hsa; identical to SEQ ID NO: 108711

SEQ ID NO: 461682 - RNA, 64 nt, hsa; identical to SEQ ID NO: 108712

SEQ ID NO: 461683 - RNA, 64 nt, hsa; identical to SEQ ID NO: 108713

SEQ ID NO: 461684 - RNA, 64 nt, hsa; identical to SEQ ID NO: 108714

SEQ ID NO: 461685 - RNA, 64 nt, hsa; identical to SEQ ID NO: 108715

SEQ ID NO: 461686 - RNA, 64 nt, hsa; identical to SEQ ID NO: 108716

SEQ ID NO: 461687 - RNA, 64 nt, hsa; identical to SEQ ID NO: 108717

SEQ ID NO: 461688 - RNA, 64 nt, hsa; identical to SEQ ID NO: 108718

SEQ ID NO: 461689 - RNA, 64 nt, hsa; identical to SEQ ID NO: 108719

SEQ ID NO: 461690 - RNA, 64 nt, hsa; identical to SEQ ID NO: 108720

SEQ ID NO: 461691 - RNA, 64 nt, hsa; identical to SEQ ID NO: 108721

SEQ ID NO: 461692 - RNA, 64 nt, hsa; identical to SEQ ID NO: 108722

SEQ ID NO: 461693 - RNA, 64 nt, hsa; identical to SEQ ID NO: 108723

SEQ ID NO: 461694 - RNA, 64 nt, hsa; identical to SEQ ID NO: 108724

SEQ ID NO: 461695 - RNA, 64 nt, hsa; identical to SEQ ID NO: 108725

SEQ ID NO: 461696 - RNA, 64 nt, hsa; identical to SEQ ID NO: 108726

SEQ ID NO: 461697 - RNA, 64 nt, hsa; identical to SEQ ID NO: 108727

SEQ ID NO: 461698 - RNA, 64 nt, hsa; identical to SEQ ID NO: 108728

SEQ ID NO: 461699 - RNA, 64 nt, hsa; identical to SEQ ID NO: 108729

SEQ ID NO: 461700 - RNA, 64 nt, hsa; identical to SEQ ID NO: 108730

SEQ ID NO: 461701 - RNA, 64 nt, hsa; identical to SEQ ID NO: 108731

SEQ ID NO: 461702 - RNA, 64 nt, hsa; identical to SEQ ID NO: 108732

SEQ ID NO: 461703 - RNA, 64 nt, hsa; identical to SEQ ID NO: 108733

SEQ ID NO: 461704 - RNA, 64 nt, hsa; identical to SEQ ID NO: 108734

SEQ ID NO: 461705 - RNA, 64 nt, hsa; identical to SEQ ID NO: 108735

SEQ ID NO: 461706 - RNA, 64 nt, hsa; identical to SEQ ID NO: 108736

SEQ ID NO: 461707 - RNA, 64 nt, hsa; identical to SEQ ID NO: 108737

SEQ ID NO: 461708 - RNA, 64 nt, hsa; identical to SEQ ID NO: 108738

SEQ ID NO: 461709 - RNA, 64 nt, hsa; identical to SEQ ID NO: 108739

SEQ ID NO: 461710 - RNA, 64 nt, hsa; identical to SEQ ID NO: 108740

SEQ ID NO: 461711 - RNA, 64 nt, hsa; identical to SEQ ID NO: 108741

SEQ ID NO: 461712 - RNA, 64 nt, hsa; identical to SEQ ID NO: 108742

SEQ ID NO: 461713 - RNA, 64 nt, hsa; identical to SEQ ID NO: 108743

SEQ ID NO: 461714 - RNA, 64 nt, hsa; identical to SEQ ID NO: 108744

SEQ ID NO: 461715 - RNA, 64 nt, hsa; identical to SEQ ID NO: 108745

SEQ ID NO: 461716 - RNA, 64 nt, hsa; identical to SEQ ID NO: 108746

SEQ ID NO: 461717 - RNA, 64 nt, hsa; identical to SEQ ID NO: 108747

SEQ ID NO: 461718 - RNA, 64 nt, hsa; identical to SEQ ID NO: 108748

SEQ ID NO: 461719 - RNA, 64 nt, hsa; identical to SEQ ID NO: 108749

SEQ ID NO: 461720 - RNA, 64 nt, hsa; identical to SEQ ID NO: 108750

SEQ ID NO: 461721 - RNA, 64 nt, hsa; identical to SEQ ID NO: 108751

SEQ ID NO: 461722 - RNA, 64 nt, hsa; identical to SEQ ID NO: 108752

SEQ ID NO: 461723 - RNA, 64 nt, hsa; identical to SEQ ID NO: 108753

SEQ ID NO: 461724 - RNA, 64 nt, hsa; identical to SEQ ID NO: 108754

SEQ ID NO: 461725 - RNA, 64 nt, hsa; identical to SEQ ID NO: 108755

SEQ ID NO: 461726 - RNA, 64 nt, hsa; identical to SEQ ID NO: 108756

SEQ ID NO: 461727 - RNA, 64 nt, hsa; identical to SEQ ID NO: 108757

SEQ ID NO: 461728 - RNA, 64 nt, hsa; identical to SEQ ID NO: 108758

SEQ ID NO: 461729 - RNA, 64 nt, hsa; identical to SEQ ID NO: 108759

SEQ ID NO: 461730 - RNA, 64 nt, hsa; identical to SEQ ID NO: 108760

SEQ ID NO: 461731 - RNA, 64 nt, hsa; identical to SEQ ID NO: 108761

SEQ ID NO: 461732 - RNA, 64 nt, hsa; identical to SEQ ID NO: 108762

SEQ ID NO: 461733 - RNA, 64 nt, hsa; identical to SEQ ID NO: 108763

SEQ ID NO: 461734 - RNA, 64 nt, hsa; identical to SEQ ID NO: 108764

SEQ ID NO: 461735 - RNA, 64 nt, hsa; identical to SEQ ID NO: 108765

SEQ ID NO: 461736 - RNA, 64 nt, hsa; identical to SEQ ID NO: 243136

SEQ ID NO: 461737 - RNA, 64 nt, hsa; identical to SEQ ID NO: 243137

SEQ ID NO: 461738 - RNA, 64 nt, hsa; identical to SEQ ID NO: 243138

SEQ ID NO: 461739 - RNA, 64 nt, hsa; identical to SEQ ID NO: 243139

SEQ ID NO: 461740 - RNA, 64 nt, hsa; identical to SEQ ID NO: 243140

SEQ ID NO: 461741 - RNA, 64 nt, hsa; identical to SEQ ID NO: 243141

SEQ ID NO: 461742 - RNA, 64 nt, hsa; identical to SEQ ID NO: 108616

SEQ ID NO: 461743 - RNA, 64 nt, hsa; identical to SEQ ID NO: 108617

SEQ ID NO: 461744 - RNA, 64 nt, hsa; identical to SEQ ID NO: 108618

SEQ ID NO: 461745 - RNA, 64 nt, hsa; identical to SEQ ID NO: 108619

SEQ ID NO: 461746 - RNA, 64 nt, hsa; identical to SEQ ID NO: 108620

SEQ ID NO: 461747 - RNA, 64 nt, hsa; identical to SEQ ID NO: 108621

SEQ ID NO: 461748 - RNA, 64 nt, hsa; identical to SEQ ID NO: 108622

SEQ ID NO: 461749 - RNA, 64 nt, hsa; identical to SEQ ID NO: 108623

SEQ ID NO: 461750 - RNA, 61 nt, hsa; identical to SEQ ID NO: 108624

SEQ ID NO: 461751 - RNA, 64 nt, hsa; identical to SEQ ID NO: 108625

SEQ ID NO: 461752 - RNA, 64 nt, hsa; identical to SEQ ID NO: 108626

SEQ ID NO: 461753 - RNA, 64 nt, hsa; identical to SEQ ID NO: 108627

SEQ ID NO: 461754 - RNA, 64 nt, hsa; identical to SEQ ID NO: 108628

SEQ ID NO: 461755 - RNA, 64 nt, hsa; identical to SEQ ID NO: 108629

SEQ ID NO: 461756 - RNA, 64 nt, hsa; identical to SEQ ID NO: 108630

SEQ ID NO: 461757 - RNA, 64 nt, hsa; identical to SEQ ID NO: 108631

SEQ ID NO: 461758 - RNA, 64 nt, hsa; identical to SEQ ID NO: 108632

SEQ ID NO: 461759 - RNA, 64 nt, hsa; identical to SEQ ID NO: 108633

SEQ ID NO: 461760 - RNA, 64 nt, hsa; identical to SEQ ID NO: 108634

SEQ ID NO: 461761 - RNA, 64 nt, hsa; identical to SEQ ID NO: 108635

SEQ ID NO: 461762 - RNA, 64 nt, hsa; identical to SEQ ID NO: 108636

SEQ ID NO: 461763 - RNA, 64 nt, hsa; identical to SEQ ID NO: 108637

SEQ ID NO: 461764 - RNA, 64 nt, hsa; identical to SEQ ID NO: 108638

SEQ ID NO: 461765 - RNA, 64 nt, hsa; identical to SEQ ID NO: 108639

SEQ ID NO: 461766 - RNA, 64 nt, hsa; identical to SEQ ID NO: 108640

SEQ ID NO: 461767 - RNA, 64 nt, hsa; identical to SEQ ID NO: 108641

SEQ ID NO: 461768 - RNA, 64 nt, hsa; identical to SEQ ID NO: 108642

SEQ ID NO: 461769 - RNA, 64 nt, hsa; identical to SEQ ID NO: 108643

SEQ ID NO: 461770 - RNA, 64 nt, hsa; identical to SEQ ID NO: 108644

SEQ ID NO: 461771 - RNA, 64 nt, hsa; identical to SEQ ID NO: 108645

SEQ ID NO: 461772 - RNA, 64 nt, hsa; identical to SEQ ID NO: 108646

SEQ ID NO: 461773 - RNA, 64 nt, hsa; identical to SEQ ID NO: 108647

SEQ ID NO: 461774 - RNA, 64 nt, hsa; identical to SEQ ID NO: 108648

SEQ ID NO: 461775 - RNA, 64 nt, hsa; identical to SEQ ID NO: 108649

SEQ ID NO: 461776 - RNA, 64 nt, hsa; identical to SEQ ID NO: 108650

SEQ ID NO: 461777 - RNA, 64 nt, hsa; identical to SEQ ID NO: 108651

SEQ ID NO: 461778 - RNA, 64 nt, hsa; identical to SEQ ID NO: 108652

SEQ ID NO: 461779 - RNA, 64 nt, hsa; identical to SEQ ID NO: 108653

SEQ ID NO: 461780 - RNA, 64 nt, hsa; identical to SEQ ID NO: 108654

SEQ ID NO: 461781 - RNA, 64 nt, hsa; identical to SEQ ID NO: 108655

SEQ ID NO: 461782 - RNA, 64 nt, hsa; identical to SEQ ID NO: 108656

SEQ ID NO: 461783 - RNA, 64 nt, hsa; identical to SEQ ID NO: 108657

SEQ ID NO: 461784 - RNA, 64 nt, hsa; identical to SEQ ID NO: 108658

SEQ ID NO: 461785 - RNA, 64 nt, hsa; identical to SEQ ID NO: 108659

SEQ ID NO: 461786 - RNA, 64 nt, hsa; identical to SEQ ID NO: 108660

SEQ ID NO: 461787 - RNA, 64 nt, hsa; identical to SEQ ID NO: 108661

SEQ ID NO: 461788 - RNA, 64 nt, hsa; identical to SEQ ID NO: 108662

SEQ ID NO: 461789 - RNA, 64 nt, hsa; identical to SEQ ID NO: 108663

SEQ ID NO: 461790 - RNA, 64 nt, hsa; identical to SEQ ID NO: 108664

SEQ ID NO: 461791 - RNA, 64 nt, hsa; identical to SEQ ID NO: 108665

SEQ ID NO: 461792 - RNA, 64 nt, hsa; identical to SEQ ID NO: 108666

SEQ ID NO: 461793 - RNA, 64 nt, hsa; identical to SEQ ID NO: 108667

SEQ ID NO: 461794 - RNA, 64 nt, hsa; identical to SEQ ID NO: 108668

SEQ ID NO: 461795 - RNA, 64 nt, hsa; identical to SEQ ID NO: 108669

SEQ ID NO: 461796 - RNA, 64 nt, hsa; identical to SEQ ID NO: 108670

SEQ ID NO: 461797 - RNA, 64 nt, hsa; identical to SEQ ID NO: 108671

SEQ ID NO: 461798 - RNA, 64 nt, hsa; identical to SEQ ID NO: 108672

SEQ ID NO: 461799 - RNA, 64 nt, hsa; identical to SEQ ID NO: 108673

SEQ ID NO: 461800 - RNA, 64 nt, hsa; identical to SEQ ID NO: 108674

SEQ ID NO: 461801 - RNA, 64 nt, hsa; identical to SEQ ID NO: 108675

SEQ ID NO: 461802 - RNA, 64 nt, hsa; identical to SEQ ID NO: 108676

SEQ ID NO: 461803 - RNA, 64 nt, hsa; identical to SEQ ID NO: 108677

SEQ ID NO: 461804 - RNA, 64 nt, hsa; identical to SEQ ID NO: 108678

SEQ ID NO: 461805 - RNA, 64 nt, hsa; identical to SEQ ID NO: 108679

SEQ ID NO: 461806 - RNA, 64 nt, hsa; identical to SEQ ID NO: 108680

SEQ ID NO: 461807 - RNA, 64 nt, hsa; identical to SEQ ID NO: 108681

SEQ ID NO: 461808 - RNA, 64 nt, hsa; identical to SEQ ID NO: 108682

SEQ ID NO: 461809 - RNA, 64 nt, hsa; identical to SEQ ID NO: 108683

SEQ ID NO: 461810 - RNA, 64 nt, hsa; identical to SEQ ID NO: 108684

SEQ ID NO: 461811 - RNA, 64 nt, hsa; identical to SEQ ID NO: 108685

SEQ ID NO: 461812 - RNA, 64 nt, hsa; identical to SEQ ID NO: 108686

SEQ ID NO: 461813 - RNA, 64 nt, hsa; identical to SEQ ID NO: 108687

SEQ ID NO: 461814 - RNA, 64 nt, hsa; identical to SEQ ID NO: 108688

SEQ ID NO: 461815 - RNA, 64 nt, hsa; identical to SEQ ID NO: 108689

SEQ ID NO: 461816 - RNA, 64 nt, hsa; identical to SEQ ID NO: 108690

SEQ ID NO: 461817 - RNA, 64 nt, hsa; identical to SEQ ID NO: 108691

SEQ ID NO: 461818 - RNA, 64 nt, hsa; identical to SEQ ID NO: 108692

SEQ ID NO: 461819 - RNA, 64 nt, hsa; identical to SEQ ID NO: 108693

SEQ ID NO: 461820 - RNA, 64 nt, hsa; identical to SEQ ID NO: 108694

SEQ ID NO: 461821 - RNA, 64 nt, hsa; identical to SEQ ID NO: 108695

SEQ ID NO: 461822 - RNA, 64 nt, hsa; identical to SEQ ID NO: 108696

SEQ ID NO: 461823 - RNA, 64 nt, hsa; identical to SEQ ID NO: 108697

SEQ ID NO: 461824 - RNA, 64 nt, hsa; identical to SEQ ID NO: 108698

SEQ ID NO: 461825 - RNA, 64 nt, hsa; identical to SEQ ID NO: 108699

SEQ ID NO: 461826 - RNA, 64 nt, hsa; identical to SEQ ID NO: 108700

SEQ ID NO: 461827 - RNA, 64 nt, hsa; identical to SEQ ID NO: 108701

SEQ ID NO: 461828 - RNA, 64 nt, hsa; identical to SEQ ID NO: 108702

SEQ ID NO: 461829 - RNA, 64 nt, hsa; identical to SEQ ID NO: 108703

SEQ ID NO: 461830 - RNA, 64 nt, hsa; identical to SEQ ID NO: 108704

SEQ ID NO: 461831 - RNA, 64 nt, hsa; identical to SEQ ID NO: 108705

SEQ ID NO: 461832 - RNA, 64 nt, hsa; identical to SEQ ID NO: 108706

SEQ ID NO: 461833 - RNA, 64 nt, hsa; identical to SEQ ID NO: 108707

SEQ ID NO: 461834 - RNA, 64 nt, hsa; identical to SEQ ID NO: 108708

SEQ ID NO: 461835 - RNA, 64 nt, hsa; identical to SEQ ID NO: 108709

SEQ ID NO: 461836 - RNA, 64 nt, hsa; identical to SEQ ID NO: 108710

SEQ ID NO: 461837 - RNA, 64 nt, hsa; identical to SEQ ID NO: 108711

SEQ ID NO: 461838 - RNA, 64 nt, hsa; identical to SEQ ID NO: 108712

SEQ ID NO: 461839 - RNA, 64 nt, hsa; identical to SEQ ID NO: 108713

SEQ ID NO: 461840 - RNA, 64 nt, hsa; identical to SEQ ID NO: 108714

SEQ ID NO: 461841 - RNA, 64 nt, hsa; identical to SEQ ID NO: 108715

SEQ ID NO: 461842 - RNA, 64 nt, hsa; identical to SEQ ID NO: 108716

SEQ ID NO: 461843 - RNA, 64 nt, hsa; identical to SEQ ID NO: 108717

SEQ ID NO: 461844 - RNA, 64 nt, hsa; identical to SEQ ID NO: 108718

SEQ ID NO: 461845 - RNA, 64 nt, hsa; identical to SEQ ID NO: 108719

SEQ ID NO: 461846 - RNA, 64 nt, hsa; identical to SEQ ID NO: 108720

SEQ ID NO: 461847 - RNA, 64 nt, hsa; identical to SEQ ID NO: 108721

SEQ ID NO: 461848 - RNA, 64 nt, hsa; identical to SEQ ID NO: 108722

SEQ ID NO: 461849 - RNA, 64 nt, hsa; identical to SEQ ID NO: 108723

SEQ ID NO: 461850 - RNA, 64 nt, hsa; identical to SEQ ID NO: 108724

SEQ ID NO: 461851 - RNA, 64 nt, hsa; identical to SEQ ID NO: 108725

SEQ ID NO: 461852 - RNA, 64 nt, hsa; identical to SEQ ID NO: 108726

SEQ ID NO: 461853 - RNA, 64 nt, hsa; identical to SEQ ID NO: 108727

SEQ ID NO: 461854 - RNA, 64 nt, hsa; identical to SEQ ID NO: 108728

SEQ ID NO: 461855 - RNA, 64 nt, hsa; identical to SEQ ID NO: 108729

SEQ ID NO: 461856 - RNA, 64 nt, hsa; identical to SEQ ID NO: 108730

SEQ ID NO: 461857 - RNA, 64 nt, hsa; identical to SEQ ID NO: 108731

SEQ ID NO: 461858 - RNA, 64 nt, hsa; identical to SEQ ID NO: 108732

SEQ ID NO: 461859 - RNA, 64 nt, hsa; identical to SEQ ID NO: 108733

SEQ ID NO: 461860 - RNA, 64 nt, hsa; identical to SEQ ID NO: 108734

SEQ ID NO: 461861 - RNA, 64 nt, hsa; identical to SEQ ID NO: 108735

SEQ ID NO: 461862 - RNA, 64 nt, hsa; identical to SEQ ID NO: 108736

SEQ ID NO: 461863 - RNA, 64 nt, hsa; identical to SEQ ID NO: 108737

SEQ ID NO: 461864 - RNA, 64 nt, hsa; identical to SEQ ID NO: 108738

SEQ ID NO: 461865 - RNA, 64 nt, hsa; identical to SEQ ID NO: 108739

SEQ ID NO: 461866 - RNA, 64 nt, hsa; identical to SEQ ID NO: 108740

SEQ ID NO: 461867 - RNA, 64 nt, hsa; identical to SEQ ID NO: 108741

SEQ ID NO: 461868 - RNA, 64 nt, hsa; identical to SEQ ID NO: 108742

SEQ ID NO: 461869 - RNA, 64 nt, hsa; identical to SEQ ID NO: 108743

SEQ ID NO: 461870 - RNA, 64 nt, hsa; identical to SEQ ID NO: 108744

SEQ ID NO: 461871 - RNA, 64 nt, hsa; identical to SEQ ID NO: 108745

SEQ ID NO: 461872 - RNA, 64 nt, hsa; identical to SEQ ID NO: 108746

SEQ ID NO: 461873 - RNA, 64 nt, hsa; identical to SEQ ID NO: 108747

SEQ ID NO: 461874 - RNA, 64 nt, hsa; identical to SEQ ID NO: 108748

SEQ ID NO: 461875 - RNA, 64 nt, hsa; identical to SEQ ID NO: 108749

SEQ ID NO: 461876 - RNA, 64 nt, hsa; identical to SEQ ID NO: 108750

SEQ ID NO: 461877 - RNA, 64 nt, hsa; identical to SEQ ID NO: 108751

SEQ ID NO: 461878 - RNA, 64 nt, hsa; identical to SEQ ID NO: 108752

SEQ ID NO: 461879 - RNA, 64 nt, hsa; identical to SEQ ID NO: 108753

SEQ ID NO: 461880 - RNA, 64 nt, hsa; identical to SEQ ID NO: 108754

SEQ ID NO: 461881 - RNA, 64 nt, hsa; identical to SEQ ID NO: 108755

SEQ ID NO: 461882 - RNA, 64 nt, hsa; identical to SEQ ID NO: 108756

SEQ ID NO: 461883 - RNA, 64 nt, hsa; identical to SEQ ID NO: 108757

SEQ ID NO: 461884 - RNA, 64 nt, hsa; identical to SEQ ID NO: 108758

SEQ ID NO: 461885 - RNA, 64 nt, hsa; identical to SEQ ID NO: 108759

SEQ ID NO: 461886 - RNA, 64 nt, hsa; identical to SEQ ID NO: 108760

SEQ ID NO: 461887 - RNA, 64 nt, hsa; identical to SEQ ID NO: 108761

SEQ ID NO: 461888 - RNA, 64 nt, hsa; identical to SEQ ID NO: 108762

SEQ ID NO: 461889 - RNA, 64 nt, hsa; identical to SEQ ID NO: 108763

SEQ ID NO: 461890 - RNA, 64 nt, hsa; identical to SEQ ID NO: 108764

SEQ ID NO: 461891 - RNA, 64 nt, hsa; identical to SEQ ID NO: 108765

SEQ ID NO: 461892 - RNA, 64 nt, hsa; identical to SEQ ID NO: 243136

SEQ ID NO: 461893 - RNA, 64 nt, hsa; identical to SEQ ID NO: 243137

SEQ ID NO: 461894 - RNA, 64 nt, hsa; identical to SEQ ID NO: 243138

SEQ ID NO: 461895 - RNA, 64 nt, hsa; identical to SEQ ID NO: 243139

SEQ ID NO: 461896 - RNA, 64 nt, hsa; identical to SEQ ID NO: 243140

SEQ ID NO: 461897 - RNA, 64 nt, hsa; identical to SEQ ID NO: 243141

SEQ ID NO: 461898 - RNA, 64 nt, hsa; identical to SEQ ID NO: 108616

SEQ ID NO: 461899 - RNA, 64 nt, hsa; identical to SEQ ID NO: 108617

SEQ ID NO: 461900 - RNA, 64 nt, hsa; identical to SEQ ID NO: 108618

SEQ ID NO: 461901 - RNA, 64 nt, hsa; identical to SEQ ID NO: 108619

SEQ ID NO: 461902 - RNA, 64 nt, hsa; identical to SEQ ID NO: 108620

SEQ ID NO: 461903 - RNA, 64 nt, hsa; identical to SEQ ID NO: 108621

SEQ ID NO: 461904 - RNA, 64 nt, hsa; identical to SEQ ID NO: 108622

SEQ ID NO: 461905 - RNA, 64 nt, hsa; identical to SEQ ID NO: 108623

SEQ ID NO: 461906 - RNA, 61 nt, hsa; identical to SEQ ID NO: 108624

SEQ ID NO: 461907 - RNA, 64 nt, hsa; identical to SEQ ID NO: 108625

SEQ ID NO: 461908 - RNA, 64 nt, hsa; identical to SEQ ID NO: 108626

SEQ ID NO: 461909 - RNA, 64 nt, hsa; identical to SEQ ID NO: 108627

SEQ ID NO: 461910 - RNA, 64 nt, hsa; identical to SEQ ID NO: 108628

SEQ ID NO: 461911 - RNA, 64 nt, hsa; identical to SEQ ID NO: 108629

SEQ ID NO: 461912 - RNA, 64 nt, hsa; identical to SEQ ID NO: 108630

SEQ ID NO: 461913 - RNA, 64 nt, hsa; identical to SEQ ID NO: 108631

SEQ ID NO: 461914 - RNA, 64 nt, hsa; identical to SEQ ID NO: 108632

SEQ ID NO: 461915 - RNA, 64 nt, hsa; identical to SEQ ID NO: 108633

SEQ ID NO: 461916 - RNA, 64 nt, hsa; identical to SEQ ID NO: 108634

SEQ ID NO: 461917 - RNA, 64 nt, hsa; identical to SEQ ID NO: 108635

SEQ ID NO: 461918 - RNA, 64 nt, hsa; identical to SEQ ID NO: 108636

SEQ ID NO: 461919 - RNA, 64 nt, hsa; identical to SEQ ID NO: 108637

SEQ ID NO: 461920 - RNA, 64 nt, hsa; identical to SEQ ID NO: 108638

SEQ ID NO: 461921 - RNA, 64 nt, hsa; identical to SEQ ID NO: 108639

SEQ ID NO: 461922 - RNA, 64 nt, hsa; identical to SEQ ID NO: 108640

SEQ ID NO: 461923 - RNA, 64 nt, hsa; identical to SEQ ID NO: 108641

SEQ ID NO: 461924 - RNA, 64 nt, hsa; identical to SEQ ID NO: 108642

SEQ ID NO: 461925 - RNA, 64 nt, hsa; identical to SEQ ID NO: 108643

SEQ ID NO: 461926 - RNA, 64 nt, hsa; identical to SEQ ID NO: 108644

SEQ ID NO: 461927 - RNA, 64 nt, hsa; identical to SEQ ID NO: 108645

SEQ ID NO: 461928 - RNA, 64 nt, hsa; identical to SEQ ID NO: 108646

SEQ ID NO: 461929 - RNA, 64 nt, hsa; identical to SEQ ID NO: 108647

SEQ ID NO: 461930 - RNA, 64 nt, hsa; identical to SEQ ID NO: 108648

SEQ ID NO: 461931 - RNA, 64 nt, hsa; identical to SEQ ID NO: 108649

SEQ ID NO: 461932 - RNA, 64 nt, hsa; identical to SEQ ID NO: 108650

SEQ ID NO: 461933 - RNA, 64 nt, hsa; identical to SEQ ID NO: 108651

SEQ ID NO: 461934 - RNA, 64 nt, hsa; identical to SEQ ID NO: 108652

SEQ ID NO: 461935 - RNA, 64 nt, hsa; identical to SEQ ID NO: 108653

SEQ ID NO: 461936 - RNA, 64 nt, hsa; identical to SEQ ID NO: 108654

SEQ ID NO: 461937 - RNA, 64 nt, hsa; identical to SEQ ID NO: 108655

SEQ ID NO: 461938 - RNA, 64 nt, hsa; identical to SEQ ID NO: 108656

SEQ ID NO: 461939 - RNA, 64 nt, hsa; identical to SEQ ID NO: 108657

SEQ ID NO: 461940 - RNA, 64 nt, hsa; identical to SEQ ID NO: 108658

SEQ ID NO: 461941 - RNA, 64 nt, hsa; identical to SEQ ID NO: 108659

SEQ ID NO: 461942 - RNA, 64 nt, hsa; identical to SEQ ID NO: 108660

SEQ ID NO: 461943 - RNA, 64 nt, hsa; identical to SEQ ID NO: 108661

SEQ ID NO: 461944 - RNA, 64 nt, hsa; identical to SEQ ID NO: 108662

SEQ ID NO: 461945 - RNA, 64 nt, hsa; identical to SEQ ID NO: 108663

SEQ ID NO: 461946 - RNA, 64 nt, hsa; identical to SEQ ID NO: 108664

SEQ ID NO: 461947 - RNA, 64 nt, hsa; identical to SEQ ID NO: 108665

SEQ ID NO: 461948 - RNA, 64 nt, hsa; identical to SEQ ID NO: 108666

SEQ ID NO: 461949 - RNA, 64 nt, hsa; identical to SEQ ID NO: 108667

SEQ ID NO: 461950 - RNA, 64 nt, hsa; identical to SEQ ID NO: 108668

SEQ ID NO: 461951 - RNA, 64 nt, hsa; identical to SEQ ID NO: 108669

SEQ ID NO: 461952 - RNA, 64 nt, hsa; identical to SEQ ID NO: 108670

SEQ ID NO: 461953 - RNA, 64 nt, hsa; identical to SEQ ID NO: 108671

SEQ ID NO: 461954 - RNA, 64 nt, hsa; identical to SEQ ID NO: 108672

SEQ ID NO: 461955 - RNA, 64 nt, hsa; identical to SEQ ID NO: 108673

SEQ ID NO: 461956 - RNA, 64 nt, hsa; identical to SEQ ID NO: 108674

SEQ ID NO: 461957 - RNA, 64 nt, hsa; identical to SEQ ID NO: 108675

SEQ ID NO: 461958 - RNA, 64 nt, hsa; identical to SEQ ID NO: 108676

SEQ ID NO: 461959 - RNA, 64 nt, hsa; identical to SEQ ID NO: 108677

SEQ ID NO: 461960 - RNA, 64 nt, hsa; identical to SEQ ID NO: 108678

SEQ ID NO: 461961 - RNA, 64 nt, hsa; identical to SEQ ID NO: 108679

SEQ ID NO: 461962 - RNA, 64 nt, hsa; identical to SEQ ID NO: 108680

SEQ ID NO: 461963 - RNA, 64 nt, hsa; identical to SEQ ID NO: 108681

SEQ ID NO: 461964 - RNA, 64 nt, hsa; identical to SEQ ID NO: 108682

SEQ ID NO: 461965 - RNA, 64 nt, hsa; identical to SEQ ID NO: 108683

SEQ ID NO: 461966 - RNA, 64 nt, hsa; identical to SEQ ID NO: 108684

SEQ ID NO: 461967 - RNA, 64 nt, hsa; identical to SEQ ID NO: 108685

SEQ ID NO: 461968 - RNA, 64 nt, hsa; identical to SEQ ID NO: 108686

SEQ ID NO: 461969 - RNA, 64 nt, hsa; identical to SEQ ID NO: 108687

SEQ ID NO: 461970 - RNA, 64 nt, hsa; identical to SEQ ID NO: 108688

SEQ ID NO: 461971 - RNA, 64 nt, hsa; identical to SEQ ID NO: 108689

SEQ ID NO: 461972 - RNA, 64 nt, hsa; identical to SEQ ID NO: 108690

SEQ ID NO: 461973 - RNA, 64 nt, hsa; identical to SEQ ID NO: 108691

SEQ ID NO: 461974 - RNA, 64 nt, hsa; identical to SEQ ID NO: 108692

SEQ ID NO: 461975 - RNA, 64 nt, hsa; identical to SEQ ID NO: 108693

SEQ ID NO: 461976 - RNA, 64 nt, hsa; identical to SEQ ID NO: 108694

SEQ ID NO: 461977 - RNA, 64 nt, hsa; identical to SEQ ID NO: 108695

SEQ ID NO: 461978 - RNA, 64 nt, hsa; identical to SEQ ID NO: 108696

SEQ ID NO: 461979 - RNA, 64 nt, hsa; identical to SEQ ID NO: 108697

SEQ ID NO: 461980 - RNA, 64 nt, hsa; identical to SEQ ID NO: 108698

SEQ ID NO: 461981 - RNA, 64 nt, hsa; identical to SEQ ID NO: 108699

SEQ ID NO: 461982 - RNA, 64 nt, hsa; identical to SEQ ID NO: 108700

SEQ ID NO: 461983 - RNA, 64 nt, hsa; identical to SEQ ID NO: 108701

SEQ ID NO: 461984 - RNA, 64 nt, hsa; identical to SEQ ID NO: 108702

SEQ ID NO: 461985 - RNA, 64 nt, hsa; identical to SEQ ID NO: 108703

SEQ ID NO: 461986 - RNA, 64 nt, hsa; identical to SEQ ID NO: 108704

SEQ ID NO: 461987 - RNA, 64 nt, hsa; identical to SEQ ID NO: 108705

SEQ ID NO: 461988 - RNA, 64 nt, hsa; identical to SEQ ID NO: 108706

SEQ ID NO: 461989 - RNA, 64 nt, hsa; identical to SEQ ID NO: 108707

SEQ ID NO: 461990 - RNA, 64 nt, hsa; identical to SEQ ID NO: 108708

SEQ ID NO: 461991 - RNA, 64 nt, hsa; identical to SEQ ID NO: 108709

SEQ ID NO: 461992 - RNA, 64 nt, hsa; identical to SEQ ID NO: 108710

SEQ ID NO: 461993 - RNA, 64 nt, hsa; identical to SEQ ID NO: 108711

SEQ ID NO: 461994 - RNA, 64 nt, hsa; identical to SEQ ID NO: 108712

SEQ ID NO: 461995 - RNA, 64 nt, hsa; identical to SEQ ID NO: 108713

SEQ ID NO: 461996 - RNA, 64 nt, hsa; identical to SEQ ID NO: 108714

SEQ ID NO: 461997 - RNA, 64 nt, hsa; identical to SEQ ID NO: 108715

SEQ ID NO: 461998 - RNA, 64 nt, hsa; identical to SEQ ID NO: 108716

SEQ ID NO: 461999 - RNA, 64 nt, hsa; identical to SEQ ID NO: 108717

SEQ ID NO: 462000 - RNA, 64 nt, hsa; identical to SEQ ID NO: 108718

SEQ ID NO: 462001 - RNA, 64 nt, hsa; identical to SEQ ID NO: 108719

SEQ ID NO: 462002 - RNA, 64 nt, hsa; identical to SEQ ID NO: 108720

SEQ ID NO: 462003 - RNA, 64 nt, hsa; identical to SEQ ID NO: 108721

SEQ ID NO: 462004 - RNA, 64 nt, hsa; identical to SEQ ID NO: 108722

SEQ ID NO: 462005 - RNA, 64 nt, hsa; identical to SEQ ID NO: 108723

SEQ ID NO: 462006 - RNA, 64 nt, hsa; identical to SEQ ID NO: 108724

SEQ ID NO: 462007 - RNA, 64 nt, hsa; identical to SEQ ID NO: 108725

SEQ ID NO: 462008 - RNA, 64 nt, hsa; identical to SEQ ID NO: 108726

SEQ ID NO: 462009 - RNA, 64 nt, hsa; identical to SEQ ID NO: 108727

SEQ ID NO: 462010 - RNA, 64 nt, hsa; identical to SEQ ID NO: 108728

SEQ ID NO: 462011 - RNA, 64 nt, hsa; identical to SEQ ID NO: 108729

SEQ ID NO: 462012 - RNA, 64 nt, hsa; identical to SEQ ID NO: 108730

SEQ ID NO: 462013 - RNA, 64 nt, hsa; identical to SEQ ID NO: 108731

SEQ ID NO: 462014 - RNA, 64 nt, hsa; identical to SEQ ID NO: 108732

SEQ ID NO: 462015 - RNA, 64 nt, hsa; identical to SEQ ID NO: 108733

SEQ ID NO: 462016 - RNA, 64 nt, hsa; identical to SEQ ID NO: 108734

SEQ ID NO: 462017 - RNA, 64 nt, hsa; identical to SEQ ID NO: 108735

SEQ ID NO: 462018 - RNA, 64 nt, hsa; identical to SEQ ID NO: 108736

SEQ ID NO: 462019 - RNA, 64 nt, hsa; identical to SEQ ID NO: 108737

SEQ ID NO: 462020 - RNA, 64 nt, hsa; identical to SEQ ID NO: 108738

SEQ ID NO: 462021 - RNA, 64 nt, hsa; identical to SEQ ID NO: 108739

SEQ ID NO: 462022 - RNA, 64 nt, hsa; identical to SEQ ID NO: 108740

SEQ ID NO: 462023 - RNA, 64 nt, hsa; identical to SEQ ID NO: 108741

SEQ ID NO: 462024 - RNA, 64 nt, hsa; identical to SEQ ID NO: 108742

SEQ ID NO: 462025 - RNA, 64 nt, hsa; identical to SEQ ID NO: 108743

SEQ ID NO: 462026 - RNA, 64 nt, hsa; identical to SEQ ID NO: 108744

SEQ ID NO: 462027 - RNA, 64 nt, hsa; identical to SEQ ID NO: 108745

SEQ ID NO: 462028 - RNA, 64 nt, hsa; identical to SEQ ID NO: 108746

SEQ ID NO: 462029 - RNA, 64 nt, hsa; identical to SEQ ID NO: 108747

SEQ ID NO: 462030 - RNA, 64 nt, hsa; identical to SEQ ID NO: 108748

SEQ ID NO: 462031 - RNA, 64 nt, hsa; identical to SEQ ID NO: 108749

SEQ ID NO: 462032 - RNA, 64 nt, hsa; identical to SEQ ID NO: 108750

SEQ ID NO: 462033 - RNA, 64 nt, hsa; identical to SEQ ID NO: 108751

SEQ ID NO: 462034 - RNA, 64 nt, hsa; identical to SEQ ID NO: 108752

SEQ ID NO: 462035 - RNA, 64 nt, hsa; identical to SEQ ID NO: 108753

SEQ ID NO: 462036 - RNA, 64 nt, hsa; identical to SEQ ID NO: 108754

SEQ ID NO: 462037 - RNA, 64 nt, hsa; identical to SEQ ID NO: 108755

SEQ ID NO: 462038 - RNA, 64 nt, hsa; identical to SEQ ID NO: 108756

SEQ ID NO: 462039 - RNA, 64 nt, hsa; identical to SEQ ID NO: 108757

SEQ ID NO: 462040 - RNA, 64 nt, hsa; identical to SEQ ID NO: 108758

SEQ ID NO: 462041 - RNA, 64 nt, hsa; identical to SEQ ID NO: 108759

SEQ ID NO: 462042 - RNA, 64 nt, hsa; identical to SEQ ID NO: 108760

SEQ ID NO: 462043 - RNA, 64 nt, hsa; identical to SEQ ID NO: 108761

SEQ ID NO: 462044 - RNA, 64 nt, hsa; identical to SEQ ID NO: 108762

SEQ ID NO: 462045 - RNA, 64 nt, hsa; identical to SEQ ID NO: 108763

SEQ ID NO: 462046 - RNA, 64 nt, hsa; identical to SEQ ID NO: 108764

SEQ ID NO: 462047 - RNA, 64 nt, hsa; identical to SEQ ID NO: 108765

SEQ ID NO: 462048 - RNA, 64 nt, hsa; identical to SEQ ID NO: 243136

SEQ ID NO: 462049 - RNA, 64 nt, hsa; identical to SEQ ID NO: 243137

SEQ ID NO: 462050 - RNA, 64 nt, hsa; identical to SEQ ID NO: 243138

SEQ ID NO: 462051 - RNA, 64 nt, hsa; identical to SEQ ID NO: 243139

SEQ ID NO: 462052 - RNA, 64 nt, hsa; identical to SEQ ID NO: 243140

SEQ ID NO: 462053 - RNA, 64 nt, hsa; identical to SEQ ID NO: 243141

SEQ ID NO: 462054 - RNA, 64 nt, hsa; identical to SEQ ID NO: 108616

SEQ ID NO: 462055 - RNA, 64 nt, hsa; identical to SEQ ID NO: 108617

SEQ ID NO: 462056 - RNA, 64 nt, hsa; identical to SEQ ID NO: 108618

SEQ ID NO: 462057 - RNA, 64 nt, hsa; identical to SEQ ID NO: 108619

SEQ ID NO: 462058 - RNA, 64 nt, hsa; identical to SEQ ID NO: 108620

SEQ ID NO: 462059 - RNA, 64 nt, hsa; identical to SEQ ID NO: 108621

SEQ ID NO: 462060 - RNA, 64 nt, hsa; identical to SEQ ID NO: 108622

SEQ ID NO: 462061 - RNA, 64 nt, hsa; identical to SEQ ID NO: 108623

SEQ ID NO: 462062 - RNA, 61 nt, hsa; identical to SEQ ID NO: 108624

SEQ ID NO: 462063 - RNA, 64 nt, hsa; identical to SEQ ID NO: 108625

SEQ ID NO: 462064 - RNA, 64 nt, hsa; identical to SEQ ID NO: 108626

SEQ ID NO: 462065 - RNA, 64 nt, hsa; identical to SEQ ID NO: 108627

SEQ ID NO: 462066 - RNA, 64 nt, hsa; identical to SEQ ID NO: 108628

SEQ ID NO: 462067 - RNA, 64 nt, hsa; identical to SEQ ID NO: 108629

SEQ ID NO: 462068 - RNA, 64 nt, hsa; identical to SEQ ID NO: 108630

SEQ ID NO: 462069 - RNA, 64 nt, hsa; identical to SEQ ID NO: 108631

SEQ ID NO: 462070 - RNA, 64 nt, hsa; identical to SEQ ID NO: 108632

SEQ ID NO: 462071 - RNA, 64 nt, hsa; identical to SEQ ID NO: 108633

SEQ ID NO: 462072 - RNA, 64 nt, hsa; identical to SEQ ID NO: 108634

SEQ ID NO: 462073 - RNA, 64 nt, hsa; identical to SEQ ID NO: 108635

SEQ ID NO: 462074 - RNA, 64 nt, hsa; identical to SEQ ID NO: 108636

SEQ ID NO: 462075 - RNA, 64 nt, hsa; identical to SEQ ID NO: 108637

SEQ ID NO: 462076 - RNA, 64 nt, hsa; identical to SEQ ID NO: 108638

SEQ ID NO: 462077 - RNA, 64 nt, hsa; identical to SEQ ID NO: 108639

SEQ ID NO: 462078 - RNA, 64 nt, hsa; identical to SEQ ID NO: 108640

SEQ ID NO: 462079 - RNA, 64 nt, hsa; identical to SEQ ID NO: 108641

SEQ ID NO: 462080 - RNA, 64 nt, hsa; identical to SEQ ID NO: 108642

SEQ ID NO: 462081 - RNA, 64 nt, hsa; identical to SEQ ID NO: 108643

SEQ ID NO: 462082 - RNA, 64 nt, hsa; identical to SEQ ID NO: 108644

SEQ ID NO: 462083 - RNA, 64 nt, hsa; identical to SEQ ID NO: 108645

SEQ ID NO: 462084 - RNA, 64 nt, hsa; identical to SEQ ID NO: 108646

SEQ ID NO: 462085 - RNA, 64 nt, hsa; identical to SEQ ID NO: 108647

SEQ ID NO: 462086 - RNA, 64 nt, hsa; identical to SEQ ID NO: 108648

SEQ ID NO: 462087 - RNA, 64 nt, hsa; identical to SEQ ID NO: 108649

SEQ ID NO: 462088 - RNA, 64 nt, hsa; identical to SEQ ID NO: 108650

SEQ ID NO: 462089 - RNA, 64 nt, hsa; identical to SEQ ID NO: 108651

SEQ ID NO: 462090 - RNA, 64 nt, hsa; identical to SEQ ID NO: 108652

SEQ ID NO: 462091 - RNA, 64 nt, hsa; identical to SEQ ID NO: 108653

SEQ ID NO: 462092 - RNA, 64 nt, hsa; identical to SEQ ID NO: 108654

SEQ ID NO: 462093 - RNA, 64 nt, hsa; identical to SEQ ID NO: 108655

SEQ ID NO: 462094 - RNA, 64 nt, hsa; identical to SEQ ID NO: 108656

SEQ ID NO: 462095 - RNA, 64 nt, hsa; identical to SEQ ID NO: 108657

SEQ ID NO: 462096 - RNA, 64 nt, hsa; identical to SEQ ID NO: 108658

SEQ ID NO: 462097 - RNA, 64 nt, hsa; identical to SEQ ID NO: 108659

SEQ ID NO: 462098 - RNA, 64 nt, hsa; identical to SEQ ID NO: 108660

SEQ ID NO: 462099 - RNA, 64 nt, hsa; identical to SEQ ID NO: 108661

SEQ ID NO: 462100 - RNA, 64 nt, hsa; identical to SEQ ID NO: 108662

SEQ ID NO: 462101 - RNA, 64 nt, hsa; identical to SEQ ID NO: 108663

SEQ ID NO: 462102 - RNA, 64 nt, hsa; identical to SEQ ID NO: 108664

SEQ ID NO: 462103 - RNA, 64 nt, hsa; identical to SEQ ID NO: 108665

SEQ ID NO: 462104 - RNA, 64 nt, hsa; identical to SEQ ID NO: 108666

SEQ ID NO: 462105 - RNA, 64 nt, hsa; identical to SEQ ID NO: 108667

SEQ ID NO: 462106 - RNA, 64 nt, hsa; identical to SEQ ID NO: 108668

SEQ ID NO: 462107 - RNA, 64 nt, hsa; identical to SEQ ID NO: 108669

SEQ ID NO: 462108 - RNA, 64 nt, hsa; identical to SEQ ID NO: 108670

SEQ ID NO: 462109 - RNA, 64 nt, hsa; identical to SEQ ID NO: 108671

SEQ ID NO: 462110 - RNA, 64 nt, hsa; identical to SEQ ID NO: 108672

SEQ ID NO: 462111 - RNA, 64 nt, hsa; identical to SEQ ID NO: 108673

SEQ ID NO: 462112 - RNA, 64 nt, hsa; identical to SEQ ID NO: 108674

SEQ ID NO: 462113 - RNA, 64 nt, hsa; identical to SEQ ID NO: 108675

SEQ ID NO: 462114 - RNA, 64 nt, hsa; identical to SEQ ID NO: 108676

SEQ ID NO: 462115 - RNA, 64 nt, hsa; identical to SEQ ID NO: 108677

SEQ ID NO: 462116 - RNA, 64 nt, hsa; identical to SEQ ID NO: 108678

SEQ ID NO: 462117 - RNA, 64 nt, hsa; identical to SEQ ID NO: 108679

SEQ ID NO: 462118 - RNA, 64 nt, hsa; identical to SEQ ID NO: 108680

SEQ ID NO: 462119 - RNA, 64 nt, hsa; identical to SEQ ID NO: 108681

SEQ ID NO: 462120 - RNA, 64 nt, hsa; identical to SEQ ID NO: 108682

SEQ ID NO: 462121 - RNA, 64 nt, hsa; identical to SEQ ID NO: 108683

SEQ ID NO: 462122 - RNA, 64 nt, hsa; identical to SEQ ID NO: 108684

SEQ ID NO: 462123 - RNA, 64 nt, hsa; identical to SEQ ID NO: 108685

SEQ ID NO: 462124 - RNA, 64 nt, hsa; identical to SEQ ID NO: 108686

SEQ ID NO: 462125 - RNA, 64 nt, hsa; identical to SEQ ID NO: 108687

SEQ ID NO: 462126 - RNA, 64 nt, hsa; identical to SEQ ID NO: 108688

SEQ ID NO: 462127 - RNA, 64 nt, hsa; identical to SEQ ID NO: 108689

SEQ ID NO: 462128 - RNA, 64 nt, hsa; identical to SEQ ID NO: 108690

SEQ ID NO: 462129 - RNA, 64 nt, hsa; identical to SEQ ID NO: 108691

SEQ ID NO: 462130 - RNA, 64 nt, hsa; identical to SEQ ID NO: 108692

SEQ ID NO: 462131 - RNA, 64 nt, hsa; identical to SEQ ID NO: 108693

SEQ ID NO: 462132 - RNA, 64 nt, hsa; identical to SEQ ID NO: 108694

SEQ ID NO: 462133 - RNA, 64 nt, hsa; identical to SEQ ID NO: 108695

SEQ ID NO: 462134 - RNA, 64 nt, hsa; identical to SEQ ID NO: 108696

SEQ ID NO: 462135 - RNA, 64 nt, hsa; identical to SEQ ID NO: 108697

SEQ ID NO: 462136 - RNA, 64 nt, hsa; identical to SEQ ID NO: 108698

SEQ ID NO: 462137 - RNA, 64 nt, hsa; identical to SEQ ID NO: 108699

SEQ ID NO: 462138 - RNA, 64 nt, hsa; identical to SEQ ID NO: 108700

SEQ ID NO: 462139 - RNA, 64 nt, hsa; identical to SEQ ID NO: 108701

SEQ ID NO: 462140 - RNA, 64 nt, hsa; identical to SEQ ID NO: 108702

SEQ ID NO: 462141 - RNA, 64 nt, hsa; identical to SEQ ID NO: 108703

SEQ ID NO: 462142 - RNA, 64 nt, hsa; identical to SEQ ID NO: 108704

SEQ ID NO: 462143 - RNA, 64 nt, hsa; identical to SEQ ID NO: 108705

SEQ ID NO: 462144 - RNA, 64 nt, hsa; identical to SEQ ID NO: 108706

SEQ ID NO: 462145 - RNA, 64 nt, hsa; identical to SEQ ID NO: 108707

SEQ ID NO: 462146 - RNA, 64 nt, hsa; identical to SEQ ID NO: 108708

SEQ ID NO: 462147 - RNA, 64 nt, hsa; identical to SEQ ID NO: 108709

SEQ ID NO: 462148 - RNA, 64 nt, hsa; identical to SEQ ID NO: 108710

SEQ ID NO: 462149 - RNA, 64 nt, hsa; identical to SEQ ID NO: 108711

SEQ ID NO: 462150 - RNA, 64 nt, hsa; identical to SEQ ID NO: 108712

SEQ ID NO: 462151 - RNA, 64 nt, hsa; identical to SEQ ID NO: 108713

SEQ ID NO: 462152 - RNA, 64 nt, hsa; identical to SEQ ID NO: 108714

SEQ ID NO: 462153 - RNA, 64 nt, hsa; identical to SEQ ID NO: 108715

SEQ ID NO: 462154 - RNA, 64 nt, hsa; identical to SEQ ID NO: 108716

SEQ ID NO: 462155 - RNA, 64 nt, hsa; identical to SEQ ID NO: 108717

SEQ ID NO: 462156 - RNA, 64 nt, hsa; identical to SEQ ID NO: 108718

SEQ ID NO: 462157 - RNA, 64 nt, hsa; identical to SEQ ID NO: 108719

SEQ ID NO: 462158 - RNA, 64 nt, hsa; identical to SEQ ID NO: 108720

SEQ ID NO: 462159 - RNA, 64 nt, hsa; identical to SEQ ID NO: 108721

SEQ ID NO: 462160 - RNA, 64 nt, hsa; identical to SEQ ID NO: 108722

SEQ ID NO: 462161 - RNA, 64 nt, hsa; identical to SEQ ID NO: 108723

SEQ ID NO: 462162 - RNA, 64 nt, hsa; identical to SEQ ID NO: 108724

SEQ ID NO: 462163 - RNA, 64 nt, hsa; identical to SEQ ID NO: 108725

SEQ ID NO: 462164 - RNA, 64 nt, hsa; identical to SEQ ID NO: 108726

SEQ ID NO: 462165 - RNA, 64 nt, hsa; identical to SEQ ID NO: 108727

SEQ ID NO: 462166 - RNA, 64 nt, hsa; identical to SEQ ID NO: 108728

SEQ ID NO: 462167 - RNA, 64 nt, hsa; identical to SEQ ID NO: 108729

SEQ ID NO: 462168 - RNA, 64 nt, hsa; identical to SEQ ID NO: 108730

SEQ ID NO: 462169 - RNA, 64 nt, hsa; identical to SEQ ID NO: 108731

SEQ ID NO: 462170 - RNA, 64 nt, hsa; identical to SEQ ID NO: 108732

SEQ ID NO: 462171 - RNA, 64 nt, hsa; identical to SEQ ID NO: 108733

SEQ ID NO: 462172 - RNA, 64 nt, hsa; identical to SEQ ID NO: 108734

SEQ ID NO: 462173 - RNA, 64 nt, hsa; identical to SEQ ID NO: 108735

SEQ ID NO: 462174 - RNA, 64 nt, hsa; identical to SEQ ID NO: 108736

SEQ ID NO: 462175 - RNA, 64 nt, hsa; identical to SEQ ID NO: 108737

SEQ ID NO: 462176 - RNA, 64 nt, hsa; identical to SEQ ID NO: 108738

SEQ ID NO: 462177 - RNA, 64 nt, hsa; identical to SEQ ID NO: 108739

SEQ ID NO: 462178 - RNA, 64 nt, hsa; identical to SEQ ID NO: 108740

SEQ ID NO: 462179 - RNA, 64 nt, hsa; identical to SEQ ID NO: 108741

SEQ ID NO: 462180 - RNA, 64 nt, hsa; identical to SEQ ID NO: 108742

SEQ ID NO: 462181 - RNA, 64 nt, hsa; identical to SEQ ID NO: 108743

SEQ ID NO: 462182 - RNA, 64 nt, hsa; identical to SEQ ID NO: 108744

SEQ ID NO: 462183 - RNA, 64 nt, hsa; identical to SEQ ID NO: 108745

SEQ ID NO: 462184 - RNA, 64 nt, hsa; identical to SEQ ID NO: 108746

SEQ ID NO: 462185 - RNA, 64 nt, hsa; identical to SEQ ID NO: 108747

SEQ ID NO: 462186 - RNA, 64 nt, hsa; identical to SEQ ID NO: 108748

SEQ ID NO: 462187 - RNA, 64 nt, hsa; identical to SEQ ID NO: 108749

SEQ ID NO: 462188 - RNA, 64 nt, hsa; identical to SEQ ID NO: 108750

SEQ ID NO: 462189 - RNA, 64 nt, hsa; identical to SEQ ID NO: 108751

SEQ ID NO: 462190 - RNA, 64 nt, hsa; identical to SEQ ID NO: 108752

SEQ ID NO: 462191 - RNA, 64 nt, hsa; identical to SEQ ID NO: 108753

SEQ ID NO: 462192 - RNA, 64 nt, hsa; identical to SEQ ID NO: 108754

SEQ ID NO: 462193 - RNA, 64 nt, hsa; identical to SEQ ID NO: 108755

SEQ ID NO: 462194 - RNA, 64 nt, hsa; identical to SEQ ID NO: 108756

SEQ ID NO: 462195 - RNA, 64 nt, hsa; identical to SEQ ID NO: 108757

SEQ ID NO: 462196 - RNA, 64 nt, hsa; identical to SEQ ID NO: 108758

SEQ ID NO: 462197 - RNA, 64 nt, hsa; identical to SEQ ID NO: 108759

SEQ ID NO: 462198 - RNA, 64 nt, hsa; identical to SEQ ID NO: 108760

SEQ ID NO: 462199 - RNA, 64 nt, hsa; identical to SEQ ID NO: 108761

SEQ ID NO: 462200 - RNA, 64 nt, hsa; identical to SEQ ID NO: 108762

SEQ ID NO: 462201 - RNA, 64 nt, hsa; identical to SEQ ID NO: 108763

SEQ ID NO: 462202 - RNA, 64 nt, hsa; identical to SEQ ID NO: 108764

SEQ ID NO: 462203 - RNA, 64 nt, hsa; identical to SEQ ID NO: 108765

SEQ ID NO: 462204 - RNA, 64 nt, hsa; identical to SEQ ID NO: 243136

SEQ ID NO: 462205 - RNA, 64 nt, hsa; identical to SEQ ID NO: 243137

SEQ ID NO: 462206 - RNA, 64 nt, hsa; identical to SEQ ID NO: 243138

SEQ ID NO: 462207 - RNA, 64 nt, hsa; identical to SEQ ID NO: 243139

SEQ ID NO: 462208 - RNA, 64 nt, hsa; identical to SEQ ID NO: 243140

SEQ ID NO: 462209 - RNA, 64 nt, hsa; identical to SEQ ID NO: 243141

SEQ ID NO: 462210 - RNA, 64 nt, hsa; identical to SEQ ID NO: 108616

SEQ ID NO: 462211 - RNA, 64 nt, hsa; identical to SEQ ID NO: 108617

SEQ ID NO: 462212 - RNA, 64 nt, hsa; identical to SEQ ID NO: 108618

SEQ ID NO: 462213 - RNA, 64 nt, hsa; identical to SEQ ID NO: 108619

SEQ ID NO: 462214 - RNA, 64 nt, hsa; identical to SEQ ID NO: 108620

SEQ ID NO: 462215 - RNA, 64 nt, hsa; identical to SEQ ID NO: 108621

SEQ ID NO: 462216 - RNA, 64 nt, hsa; identical to SEQ ID NO: 108622

SEQ ID NO: 462217 - RNA, 64 nt, hsa; identical to SEQ ID NO: 108623

SEQ ID NO: 462218 - RNA, 61 nt, hsa; identical to SEQ ID NO: 108624

SEQ ID NO: 462219 - RNA, 64 nt, hsa; identical to SEQ ID NO: 108625

SEQ ID NO: 462220 - RNA, 64 nt, hsa; identical to SEQ ID NO: 108626

SEQ ID NO: 462221 - RNA, 64 nt, hsa; identical to SEQ ID NO: 108627

SEQ ID NO: 462222 - RNA, 64 nt, hsa; identical to SEQ ID NO: 108628

SEQ ID NO: 462223 - RNA, 64 nt, hsa; identical to SEQ ID NO: 108629

SEQ ID NO: 462224 - RNA, 64 nt, hsa; identical to SEQ ID NO: 108630

SEQ ID NO: 462225 - RNA, 64 nt, hsa; identical to SEQ ID NO: 108631

SEQ ID NO: 462226 - RNA, 64 nt, hsa; identical to SEQ ID NO: 108632

SEQ ID NO: 462227 - RNA, 64 nt, hsa; identical to SEQ ID NO: 108633

SEQ ID NO: 462228 - RNA, 64 nt, hsa; identical to SEQ ID NO: 108634

SEQ ID NO: 462229 - RNA, 64 nt, hsa; identical to SEQ ID NO: 108635

SEQ ID NO: 462230 - RNA, 64 nt, hsa; identical to SEQ ID NO: 108636

SEQ ID NO: 462231 - RNA, 64 nt, hsa; identical to SEQ ID NO: 108637

SEQ ID NO: 462232 - RNA, 64 nt, hsa; identical to SEQ ID NO: 108638

SEQ ID NO: 462233 - RNA, 64 nt, hsa; identical to SEQ ID NO: 108639

SEQ ID NO: 462234 - RNA, 64 nt, hsa; identical to SEQ ID NO: 108640

SEQ ID NO: 462235 - RNA, 64 nt, hsa; identical to SEQ ID NO: 108641

SEQ ID NO: 462236 - RNA, 64 nt, hsa; identical to SEQ ID NO: 108642

SEQ ID NO: 462237 - RNA, 64 nt, hsa; identical to SEQ ID NO: 108643

SEQ ID NO: 462238 - RNA, 64 nt, hsa; identical to SEQ ID NO: 108644

SEQ ID NO: 462239 - RNA, 64 nt, hsa; identical to SEQ ID NO: 108645

SEQ ID NO: 462240 - RNA, 64 nt, hsa; identical to SEQ ID NO: 108646

SEQ ID NO: 462241 - RNA, 64 nt, hsa; identical to SEQ ID NO: 108647

SEQ ID NO: 462242 - RNA, 64 nt, hsa; identical to SEQ ID NO: 108648

SEQ ID NO: 462243 - RNA, 64 nt, hsa; identical to SEQ ID NO: 108649

SEQ ID NO: 462244 - RNA, 64 nt, hsa; identical to SEQ ID NO: 108650

SEQ ID NO: 462245 - RNA, 64 nt, hsa; identical to SEQ ID NO: 108651

SEQ ID NO: 462246 - RNA, 64 nt, hsa; identical to SEQ ID NO: 108652

SEQ ID NO: 462247 - RNA, 64 nt, hsa; identical to SEQ ID NO: 108653

SEQ ID NO: 462248 - RNA, 64 nt, hsa; identical to SEQ ID NO: 108654

SEQ ID NO: 462249 - RNA, 64 nt, hsa; identical to SEQ ID NO: 108655

SEQ ID NO: 462250 - RNA, 64 nt, hsa; identical to SEQ ID NO: 108656

SEQ ID NO: 462251 - RNA, 64 nt, hsa; identical to SEQ ID NO: 108657

SEQ ID NO: 462252 - RNA, 64 nt, hsa; identical to SEQ ID NO: 108658

SEQ ID NO: 462253 - RNA, 64 nt, hsa; identical to SEQ ID NO: 108659

SEQ ID NO: 462254 - RNA, 64 nt, hsa; identical to SEQ ID NO: 108660

SEQ ID NO: 462255 - RNA, 64 nt, hsa; identical to SEQ ID NO: 108661

SEQ ID NO: 462256 - RNA, 64 nt, hsa; identical to SEQ ID NO: 108662

SEQ ID NO: 462257 - RNA, 64 nt, hsa; identical to SEQ ID NO: 108663

SEQ ID NO: 462258 - RNA, 64 nt, hsa; identical to SEQ ID NO: 108664

SEQ ID NO: 462259 - RNA, 64 nt, hsa; identical to SEQ ID NO: 108665

SEQ ID NO: 462260 - RNA, 64 nt, hsa; identical to SEQ ID NO: 108666

SEQ ID NO: 462261 - RNA, 64 nt, hsa; identical to SEQ ID NO: 108667

SEQ ID NO: 462262 - RNA, 64 nt, hsa; identical to SEQ ID NO: 108668

SEQ ID NO: 462263 - RNA, 64 nt, hsa; identical to SEQ ID NO: 108669

SEQ ID NO: 462264 - RNA, 64 nt, hsa; identical to SEQ ID NO: 108670

SEQ ID NO: 462265 - RNA, 64 nt, hsa; identical to SEQ ID NO: 108671

SEQ ID NO: 462266 - RNA, 64 nt, hsa; identical to SEQ ID NO: 108672

SEQ ID NO: 462267 - RNA, 64 nt, hsa; identical to SEQ ID NO: 108673

SEQ ID NO: 462268 - RNA, 64 nt, hsa; identical to SEQ ID NO: 108674

SEQ ID NO: 462269 - RNA, 64 nt, hsa; identical to SEQ ID NO: 108675

SEQ ID NO: 462270 - RNA, 64 nt, hsa; identical to SEQ ID NO: 108676

SEQ ID NO: 462271 - RNA, 64 nt, hsa; identical to SEQ ID NO: 108677

SEQ ID NO: 462272 - RNA, 64 nt, hsa; identical to SEQ ID NO: 108678

SEQ ID NO: 462273 - RNA, 64 nt, hsa; identical to SEQ ID NO: 108679

SEQ ID NO: 462274 - RNA, 64 nt, hsa; identical to SEQ ID NO: 108680

SEQ ID NO: 462275 - RNA, 64 nt, hsa; identical to SEQ ID NO: 108681

SEQ ID NO: 462276 - RNA, 64 nt, hsa; identical to SEQ ID NO: 108682

SEQ ID NO: 462277 - RNA, 64 nt, hsa; identical to SEQ ID NO: 108683

SEQ ID NO: 462278 - RNA, 64 nt, hsa; identical to SEQ ID NO: 108684

SEQ ID NO: 462279 - RNA, 64 nt, hsa; identical to SEQ ID NO: 108685

SEQ ID NO: 462280 - RNA, 64 nt, hsa; identical to SEQ ID NO: 108686

SEQ ID NO: 462281 - RNA, 64 nt, hsa; identical to SEQ ID NO: 108687

SEQ ID NO: 462282 - RNA, 64 nt, hsa; identical to SEQ ID NO: 108688

SEQ ID NO: 462283 - RNA, 64 nt, hsa; identical to SEQ ID NO: 108689

SEQ ID NO: 462284 - RNA, 64 nt, hsa; identical to SEQ ID NO: 108690

SEQ ID NO: 462285 - RNA, 64 nt, hsa; identical to SEQ ID NO: 108691

SEQ ID NO: 462286 - RNA, 64 nt, hsa; identical to SEQ ID NO: 108692

SEQ ID NO: 462287 - RNA, 64 nt, hsa; identical to SEQ ID NO: 108693

SEQ ID NO: 462288 - RNA, 64 nt, hsa; identical to SEQ ID NO: 108694

SEQ ID NO: 462289 - RNA, 64 nt, hsa; identical to SEQ ID NO: 108695

SEQ ID NO: 462290 - RNA, 64 nt, hsa; identical to SEQ ID NO: 108696

SEQ ID NO: 462291 - RNA, 64 nt, hsa; identical to SEQ ID NO: 108697

SEQ ID NO: 462292 - RNA, 64 nt, hsa; identical to SEQ ID NO: 108698

SEQ ID NO: 462293 - RNA, 64 nt, hsa; identical to SEQ ID NO: 108699

SEQ ID NO: 462294 - RNA, 64 nt, hsa; identical to SEQ ID NO: 108700

SEQ ID NO: 462295 - RNA, 64 nt, hsa; identical to SEQ ID NO: 108701

SEQ ID NO: 462296 - RNA, 64 nt, hsa; identical to SEQ ID NO: 108702

SEQ ID NO: 462297 - RNA, 64 nt, hsa; identical to SEQ ID NO: 108703

SEQ ID NO: 462298 - RNA, 64 nt, hsa; identical to SEQ ID NO: 108704

SEQ ID NO: 462299 - RNA, 64 nt, hsa; identical to SEQ ID NO: 108705

SEQ ID NO: 462300 - RNA, 64 nt, hsa; identical to SEQ ID NO: 108706

SEQ ID NO: 462301 - RNA, 64 nt, hsa; identical to SEQ ID NO: 108707

SEQ ID NO: 462302 - RNA, 64 nt, hsa; identical to SEQ ID NO: 108708

SEQ ID NO: 462303 - RNA, 64 nt, hsa; identical to SEQ ID NO: 108709

SEQ ID NO: 462304 - RNA, 64 nt, hsa; identical to SEQ ID NO: 108710

SEQ ID NO: 462305 - RNA, 64 nt, hsa; identical to SEQ ID NO: 108711

SEQ ID NO: 462306 - RNA, 64 nt, hsa; identical to SEQ ID NO: 108712

SEQ ID NO: 462307 - RNA, 64 nt, hsa; identical to SEQ ID NO: 108713

SEQ ID NO: 462308 - RNA, 64 nt, hsa; identical to SEQ ID NO: 108714

SEQ ID NO: 462309 - RNA, 64 nt, hsa; identical to SEQ ID NO: 108715

SEQ ID NO: 462310 - RNA, 64 nt, hsa; identical to SEQ ID NO: 108716

SEQ ID NO: 462311 - RNA, 64 nt, hsa; identical to SEQ ID NO: 108717

SEQ ID NO: 462312 - RNA, 64 nt, hsa; identical to SEQ ID NO: 108718

SEQ ID NO: 462313 - RNA, 64 nt, hsa; identical to SEQ ID NO: 108719

SEQ ID NO: 462314 - RNA, 64 nt, hsa; identical to SEQ ID NO: 108720

SEQ ID NO: 462315 - RNA, 64 nt, hsa; identical to SEQ ID NO: 108721

SEQ ID NO: 462316 - RNA, 64 nt, hsa; identical to SEQ ID NO: 108722

SEQ ID NO: 462317 - RNA, 64 nt, hsa; identical to SEQ ID NO: 108723

SEQ ID NO: 462318 - RNA, 64 nt, hsa; identical to SEQ ID NO: 108724

SEQ ID NO: 462319 - RNA, 64 nt, hsa; identical to SEQ ID NO: 108725

SEQ ID NO: 462320 - RNA, 64 nt, hsa; identical to SEQ ID NO: 108726

SEQ ID NO: 462321 - RNA, 64 nt, hsa; identical to SEQ ID NO: 108727

SEQ ID NO: 462322 - RNA, 64 nt, hsa; identical to SEQ ID NO: 108728

SEQ ID NO: 462323 - RNA, 64 nt, hsa; identical to SEQ ID NO: 108729

SEQ ID NO: 462324 - RNA, 64 nt, hsa; identical to SEQ ID NO: 108730

SEQ ID NO: 462325 - RNA, 64 nt, hsa; identical to SEQ ID NO: 108731

SEQ ID NO: 462326 - RNA, 64 nt, hsa; identical to SEQ ID NO: 108732

SEQ ID NO: 462327 - RNA, 64 nt, hsa; identical to SEQ ID NO: 108733

SEQ ID NO: 462328 - RNA, 64 nt, hsa; identical to SEQ ID NO: 108734

SEQ ID NO: 462329 - RNA, 64 nt, hsa; identical to SEQ ID NO: 108735

SEQ ID NO: 462330 - RNA, 64 nt, hsa; identical to SEQ ID NO: 108736

SEQ ID NO: 462331 - RNA, 64 nt, hsa; identical to SEQ ID NO: 108737

SEQ ID NO: 462332 - RNA, 64 nt, hsa; identical to SEQ ID NO: 108738

SEQ ID NO: 462333 - RNA, 64 nt, hsa; identical to SEQ ID NO: 108739

SEQ ID NO: 462334 - RNA, 64 nt, hsa; identical to SEQ ID NO: 108740

SEQ ID NO: 462335 - RNA, 64 nt, hsa; identical to SEQ ID NO: 108741

SEQ ID NO: 462336 - RNA, 64 nt, hsa; identical to SEQ ID NO: 108742

SEQ ID NO: 462337 - RNA, 64 nt, hsa; identical to SEQ ID NO: 108743

SEQ ID NO: 462338 - RNA, 64 nt, hsa; identical to SEQ ID NO: 108744

SEQ ID NO: 462339 - RNA, 64 nt, hsa; identical to SEQ ID NO: 108745

SEQ ID NO: 462340 - RNA, 64 nt, hsa; identical to SEQ ID NO: 108746

SEQ ID NO: 462341 - RNA, 64 nt, hsa; identical to SEQ ID NO: 108747

SEQ ID NO: 462342 - RNA, 64 nt, hsa; identical to SEQ ID NO: 108748

SEQ ID NO: 462343 - RNA, 64 nt, hsa; identical to SEQ ID NO: 108749

SEQ ID NO: 462344 - RNA, 64 nt, hsa; identical to SEQ ID NO: 108750

SEQ ID NO: 462345 - RNA, 64 nt, hsa; identical to SEQ ID NO: 108751

SEQ ID NO: 462346 - RNA, 64 nt, hsa; identical to SEQ ID NO: 108752

SEQ ID NO: 462347 - RNA, 64 nt, hsa; identical to SEQ ID NO: 108753

SEQ ID NO: 462348 - RNA, 64 nt, hsa; identical to SEQ ID NO: 108754

SEQ ID NO: 462349 - RNA, 64 nt, hsa; identical to SEQ ID NO: 108755

SEQ ID NO: 462350 - RNA, 64 nt, hsa; identical to SEQ ID NO: 108756

SEQ ID NO: 462351 - RNA, 64 nt, hsa; identical to SEQ ID NO: 108757

SEQ ID NO: 462352 - RNA, 64 nt, hsa; identical to SEQ ID NO: 108758

SEQ ID NO: 462353 - RNA, 64 nt, hsa; identical to SEQ ID NO: 108759

SEQ ID NO: 462354 - RNA, 64 nt, hsa; identical to SEQ ID NO: 108760

SEQ ID NO: 462355 - RNA, 64 nt, hsa; identical to SEQ ID NO: 108761

SEQ ID NO: 462356 - RNA, 64 nt, hsa; identical to SEQ ID NO: 108762

SEQ ID NO: 462357 - RNA, 64 nt, hsa; identical to SEQ ID NO: 108763

SEQ ID NO: 462358 - RNA, 64 nt, hsa; identical to SEQ ID NO: 108764

SEQ ID NO: 462359 - RNA, 64 nt, hsa; identical to SEQ ID NO: 108765

SEQ ID NO: 462360 - RNA, 64 nt, hsa; identical to SEQ ID NO: 243136

SEQ ID NO: 462361 - RNA, 64 nt, hsa; identical to SEQ ID NO: 243137

SEQ ID NO: 462362 - RNA, 64 nt, hsa; identical to SEQ ID NO: 243138

SEQ ID NO: 462363 - RNA, 64 nt, hsa; identical to SEQ ID NO: 243139

SEQ ID NO: 462364 - RNA, 64 nt, hsa; identical to SEQ ID NO: 243140

SEQ ID NO: 462365 - RNA, 64 nt, hsa; identical to SEQ ID NO: 243141

SEQ ID NO: 462366 - RNA, 64 nt, hsa; identical to SEQ ID NO: 454757

SEQ ID NO: 462367 - RNA, 64 nt, hsa; identical to SEQ ID NO: 454758

SEQ ID NO: 462368 - RNA, 64 nt, hsa; identical to SEQ ID NO: 454759

SEQ ID NO: 462369 - RNA, 64 nt, hsa; identical to SEQ ID NO: 454760

SEQ ID NO: 462370 - RNA, 64 nt, hsa; identical to SEQ ID NO: 454761

SEQ ID NO: 462371 - RNA, 64 nt, hsa; identical to SEQ ID NO: 454762

SEQ ID NO: 462372 - RNA, 64 nt, hsa; identical to SEQ ID NO: 454763

SEQ ID NO: 462373 - RNA, 64 nt, hsa; identical to SEQ ID NO: 454764

SEQ ID NO: 462374 - RNA, 58 nt, hsa; identical to SEQ ID NO: 454765

SEQ ID NO: 462375 - RNA, 64 nt, hsa; identical to SEQ ID NO: 454766

SEQ ID NO: 462376 - RNA, 64 nt, hsa; identical to SEQ ID NO: 454767

SEQ ID NO: 462377 - RNA, 64 nt, hsa; identical to SEQ ID NO: 454768

SEQ ID NO: 462378 - RNA, 64 nt, hsa; identical to SEQ ID NO: 454769

SEQ ID NO: 462379 - RNA, 64 nt, hsa; identical to SEQ ID NO: 454770

SEQ ID NO: 462380 - RNA, 64 nt, hsa; identical to SEQ ID NO: 454771

SEQ ID NO: 462381 - RNA, 64 nt, hsa; identical to SEQ ID NO: 454772

SEQ ID NO: 462382 - RNA, 64 nt, hsa; identical to SEQ ID NO: 454773

SEQ ID NO: 462383 - RNA, 64 nt, hsa; identical to SEQ ID NO: 454774

SEQ ID NO: 462384 - RNA, 64 nt, hsa; identical to SEQ ID NO: 454775

SEQ ID NO: 462385 - RNA, 64 nt, hsa; identical to SEQ ID NO: 454776

SEQ ID NO: 462386 - RNA, 64 nt, hsa; identical to SEQ ID NO: 454777

SEQ ID NO: 462387 - RNA, 64 nt, hsa; identical to SEQ ID NO: 454778

SEQ ID NO: 462388 - RNA, 64 nt, hsa; identical to SEQ ID NO: 454779

SEQ ID NO: 462389 - RNA, 64 nt, hsa; identical to SEQ ID NO: 454780

SEQ ID NO: 462390 - RNA, 64 nt, hsa; identical to SEQ ID NO: 454781

SEQ ID NO: 462391 - RNA, 64 nt, hsa; identical to SEQ ID NO: 454782

SEQ ID NO: 462392 - RNA, 64 nt, hsa; identical to SEQ ID NO: 454783

SEQ ID NO: 462393 - RNA, 64 nt, hsa; identical to SEQ ID NO: 454784

SEQ ID NO: 462394 - RNA, 64 nt, hsa; identical to SEQ ID NO: 454785

SEQ ID NO: 462395 - RNA, 64 nt, hsa; identical to SEQ ID NO: 454786

SEQ ID NO: 462396 - RNA, 64 nt, hsa; identical to SEQ ID NO: 454787

SEQ ID NO: 462397 - RNA, 64 nt, hsa; identical to SEQ ID NO: 454788

SEQ ID NO: 462398 - RNA, 64 nt, hsa; identical to SEQ ID NO: 454789

SEQ ID NO: 462399 - RNA, 64 nt, hsa; identical to SEQ ID NO: 454790

SEQ ID NO: 462400 - RNA, 64 nt, hsa; identical to SEQ ID NO: 454791

SEQ ID NO: 462401 - RNA, 64 nt, hsa; identical to SEQ ID NO: 454792

SEQ ID NO: 462402 - RNA, 64 nt, hsa; identical to SEQ ID NO: 454793

SEQ ID NO: 462403 - RNA, 64 nt, hsa; identical to SEQ ID NO: 454794

SEQ ID NO: 462404 - RNA, 64 nt, hsa; identical to SEQ ID NO: 454795

SEQ ID NO: 462405 - RNA, 64 nt, hsa; identical to SEQ ID NO: 454796

SEQ ID NO: 462406 - RNA, 64 nt, hsa; identical to SEQ ID NO: 454797

SEQ ID NO: 462407 - RNA, 64 nt, hsa; identical to SEQ ID NO: 454798

SEQ ID NO: 462408 - RNA, 64 nt, hsa; identical to SEQ ID NO: 454799

SEQ ID NO: 462409 - RNA, 64 nt, hsa; identical to SEQ ID NO: 454800

SEQ ID NO: 462410 - RNA, 64 nt, hsa; identical to SEQ ID NO: 454801

SEQ ID NO: 462411 - RNA, 64 nt, hsa; identical to SEQ ID NO: 454802

SEQ ID NO: 462412 - RNA, 64 nt, hsa; identical to SEQ ID NO: 454803

SEQ ID NO: 462413 - RNA, 64 nt, hsa; identical to SEQ ID NO: 454804

SEQ ID NO: 462414 - RNA, 64 nt, hsa; identical to SEQ ID NO: 454805

SEQ ID NO: 462415 - RNA, 64 nt, hsa; identical to SEQ ID NO: 454806

SEQ ID NO: 462416 - RNA, 64 nt, hsa; identical to SEQ ID NO: 454807

SEQ ID NO: 462417 - RNA, 64 nt, hsa; identical to SEQ ID NO: 454808

SEQ ID NO: 462418 - RNA, 64 nt, hsa; identical to SEQ ID NO: 454809

SEQ ID NO: 462419 - RNA, 64 nt, hsa; identical to SEQ ID NO: 454810

SEQ ID NO: 462420 - RNA, 64 nt, hsa; identical to SEQ ID NO: 454811

SEQ ID NO: 462421 - RNA, 64 nt, hsa; identical to SEQ ID NO: 454812

SEQ ID NO: 462422 - RNA, 64 nt, hsa; identical to SEQ ID NO: 454813

SEQ ID NO: 462423 - RNA, 64 nt, hsa; identical to SEQ ID NO: 454814

SEQ ID NO: 462424 - RNA, 64 nt, hsa; identical to SEQ ID NO: 454815

SEQ ID NO: 462425 - RNA, 64 nt, hsa; identical to SEQ ID NO: 454816

SEQ ID NO: 462426 - RNA, 64 nt, hsa; identical to SEQ ID NO: 454817

SEQ ID NO: 462427 - RNA, 64 nt, hsa; identical to SEQ ID NO: 454818

SEQ ID NO: 462428 - RNA, 64 nt, hsa; identical to SEQ ID NO: 454819

SEQ ID NO: 462429 - RNA, 64 nt, hsa; identical to SEQ ID NO: 454820

SEQ ID NO: 462430 - RNA, 64 nt, hsa; identical to SEQ ID NO: 454821

SEQ ID NO: 462431 - RNA, 64 nt, hsa; identical to SEQ ID NO: 454822

SEQ ID NO: 462432 - RNA, 64 nt, hsa; identical to SEQ ID NO: 454823

SEQ ID NO: 462433 - RNA, 64 nt, hsa; identical to SEQ ID NO: 454823

SEQ ID NO: 462434 - RNA, 64 nt, hsa; identical to SEQ ID NO: 454825

SEQ ID NO: 462435 - RNA, 64 nt, hsa; identical to SEQ ID NO: 454826

SEQ ID NO: 462436 - RNA, 64 nt, hsa; identical to SEQ ID NO: 454827

SEQ ID NO: 462437 - RNA, 64 nt, hsa; identical to SEQ ID NO: 454828

SEQ ID NO: 462438 - RNA, 64 nt, hsa; identical to SEQ ID NO: 454829

SEQ ID NO: 462439 - RNA, 64 nt, hsa; identical to SEQ ID NO: 454830

SEQ ID NO: 462440 - RNA, 64 nt, hsa; identical to SEQ ID NO: 454831

SEQ ID NO: 462441 - RNA, 64 nt, hsa; identical to SEQ ID NO: 454832

SEQ ID NO: 462442 - RNA, 64 nt, hsa; identical to SEQ ID NO: 454833

SEQ ID NO: 462443 - RNA, 64 nt, hsa; identical to SEQ ID NO: 454834

SEQ ID NO: 462444 - RNA, 64 nt, hsa; identical to SEQ ID NO: 454835

SEQ ID NO: 462445 - RNA, 64 nt, hsa; identical to SEQ ID NO: 454836

SEQ ID NO: 462446 - RNA, 64 nt, hsa; identical to SEQ ID NO: 454837

SEQ ID NO: 462447 - RNA, 64 nt, hsa; identical to SEQ ID NO: 454838

SEQ ID NO: 462448 - RNA, 64 nt, hsa; identical to SEQ ID NO: 454839

SEQ ID NO: 462449 - RNA, 64 nt, hsa; identical to SEQ ID NO: 454840

SEQ ID NO: 462450 - RNA, 64 nt, hsa; identical to SEQ ID NO: 454841

SEQ ID NO: 462451 - RNA, 64 nt, hsa; identical to SEQ ID NO: 454842

SEQ ID NO: 462452 - RNA, 64 nt, hsa; identical to SEQ ID NO: 454843

SEQ ID NO: 462453 - RNA, 64 nt, hsa; identical to SEQ ID NO: 454844

SEQ ID NO: 462454 - RNA, 64 nt, hsa; identical to SEQ ID NO: 454845

SEQ ID NO: 462455 - RNA, 64 nt, hsa; identical to SEQ ID NO: 454846

SEQ ID NO: 462456 - RNA, 64 nt, hsa; identical to SEQ ID NO: 454847

SEQ ID NO: 462457 - RNA, 64 nt, hsa; identical to SEQ ID NO: 454848

SEQ ID NO: 462458 - RNA, 64 nt, hsa; identical to SEQ ID NO: 454849

SEQ ID NO: 462459 - RNA, 64 nt, hsa; identical to SEQ ID NO: 454850

SEQ ID NO: 462460 - RNA, 64 nt, hsa; identical to SEQ ID NO: 454851

SEQ ID NO: 462461 - RNA, 64 nt, hsa; identical to SEQ ID NO: 454852

SEQ ID NO: 462462 - RNA, 64 nt, hsa; identical to SEQ ID NO: 454853

SEQ ID NO: 462463 - RNA, 64 nt, hsa; identical to SEQ ID NO: 454854

SEQ ID NO: 462464 - RNA, 64 nt, hsa; identical to SEQ ID NO: 454855

SEQ ID NO: 462465 - RNA, 64 nt, hsa; identical to SEQ ID NO: 454856

SEQ ID NO: 462466 - RNA, 64 nt, hsa; identical to SEQ ID NO: 454857

SEQ ID NO: 462467 - RNA, 64 nt, hsa; identical to SEQ ID NO: 454858

SEQ ID NO: 462468 - RNA, 64 nt, hsa; identical to SEQ ID NO: 454859

SEQ ID NO: 462469 - RNA, 64 nt, hsa; identical to SEQ ID NO: 454860

SEQ ID NO: 462470 - RNA, 64 nt, hsa; identical to SEQ ID NO: 454861

SEQ ID NO: 462471 - RNA, 64 nt, hsa; identical to SEQ ID NO: 454862

SEQ ID NO: 462472 - RNA, 64 nt, hsa; identical to SEQ ID NO: 454863

SEQ ID NO: 462473 - RNA, 64 nt, hsa; identical to SEQ ID NO: 454864

SEQ ID NO: 462474 - RNA, 64 nt, hsa; identical to SEQ ID NO: 454865

SEQ ID NO: 462475 - RNA, 64 nt, hsa; identical to SEQ ID NO: 454866

SEQ ID NO: 462476 - RNA, 64 nt, hsa; identical to SEQ ID NO: 454867

SEQ ID NO: 462477 - RNA, 64 nt, hsa; identical to SEQ ID NO: 454868

SEQ ID NO: 462478 - RNA, 64 nt, hsa; identical to SEQ ID NO: 454869

SEQ ID NO: 462479 - RNA, 64 nt, hsa; identical to SEQ ID NO: 454870

SEQ ID NO: 462480 - RNA, 64 nt, hsa; identical to SEQ ID NO: 454871

SEQ ID NO: 462481 - RNA, 64 nt, hsa; identical to SEQ ID NO: 454872

SEQ ID NO: 462482 - RNA, 64 nt, hsa; identical to SEQ ID NO: 454873

SEQ ID NO: 462483 - RNA, 64 nt, hsa; identical to SEQ ID NO: 454874

SEQ ID NO: 462484 - RNA, 64 nt, hsa; identical to SEQ ID NO: 454875

SEQ ID NO: 462485 - RNA, 64 nt, hsa; identical to SEQ ID NO: 454876

SEQ ID NO: 462486 - RNA, 64 nt, hsa; identical to SEQ ID NO: 454877

SEQ ID NO: 462487 - RNA, 64 nt, hsa; identical to SEQ ID NO: 454878

SEQ ID NO: 462488 - RNA, 64 nt, hsa; identical to SEQ ID NO: 454879

SEQ ID NO: 462489 - RNA, 64 nt, hsa; identical to SEQ ID NO: 454880

SEQ ID NO: 462490 - RNA, 64 nt, hsa; identical to SEQ ID NO: 454881

SEQ ID NO: 462491 - RNA, 64 nt, hsa; identical to SEQ ID NO: 454882

SEQ ID NO: 462492 - RNA, 64 nt, hsa; identical to SEQ ID NO: 454883

SEQ ID NO: 462493 - RNA, 64 nt, hsa; identical to SEQ ID NO: 454884

SEQ ID NO: 462494 - RNA, 64 nt, hsa; identical to SEQ ID NO: 454885

SEQ ID NO: 462495 - RNA, 64 nt, hsa; identical to SEQ ID NO: 454886

SEQ ID NO: 462496 - RNA, 64 nt, hsa; identical to SEQ ID NO: 454887

SEQ ID NO: 462497 - RNA, 64 nt, hsa; identical to SEQ ID NO: 454888

SEQ ID NO: 462498 - RNA, 64 nt, hsa; identical to SEQ ID NO: 454889

SEQ ID NO: 462499 - RNA, 64 nt, hsa; identical to SEQ ID NO: 454890

SEQ ID NO: 462500 - RNA, 64 nt, hsa; identical to SEQ ID NO: 454891

SEQ ID NO: 462501 - RNA, 64 nt, hsa; identical to SEQ ID NO: 454892

SEQ ID NO: 462502 - RNA, 64 nt, hsa; identical to SEQ ID NO: 454893

SEQ ID NO: 462503 - RNA, 64 nt, hsa; identical to SEQ ID NO: 454894

SEQ ID NO: 462504 - RNA, 64 nt, hsa; identical to SEQ ID NO: 454895

SEQ ID NO: 462505 - RNA, 64 nt, hsa; identical to SEQ ID NO: 454896

SEQ ID NO: 462506 - RNA, 64 nt, hsa; identical to SEQ ID NO: 454897

SEQ ID NO: 462507 - RNA, 64 nt, hsa; identical to SEQ ID NO: 454898

SEQ ID NO: 462508 - RNA, 64 nt, hsa; identical to SEQ ID NO: 454899

SEQ ID NO: 462509 - RNA, 64 nt, hsa; identical to SEQ ID NO: 454896

SEQ ID NO: 462510 - RNA, 63 nt, hsa
uugcucccccuucauucugaugccucccuggggaacaaggauaaugacuuugcaucugcaccu

SEQ ID NO: 462511 - RNA, 63 nt, hsa
ccccauccagcacccuucagcuguguguggacaaacaaggacagaaaaacccaguguccaagg

SEQ ID NO: 462512 - RNA, 63 nt, hsa
gaggaagguucuguuuugaguauagccagagaaaacaaggauggagaaaaaucuaggacaggu

SEQ ID NO: 462513 - RNA, 63 nt, hsa
gaggaagauucuguuuuggguauagccagagaaaacaaggauggagaaaaaucuaggacaggu

SEQ ID NO: 462514 - RNA, 63 nt, hsa
agcugcccgcauacugagagacagcuucuuauaaacaaggagaguuuuugugugugcgagauc

SEQ ID NO: 462515 - RNA, 63 nt, hsa
uuuucuuuuugacaauucuuggacuugagguaaaacaaggaggauuguggccggauuucagau

SEQ ID NO: 462516 - RNA, 63 nt, hsa
gcauuccacacaggcacugccccaggacaacacaacaaggacagucacaacaaggacaacaag

SEQ ID NO: 462517 - RNA, 63 nt, hsa
acugccccaggacaacacaacaaggacagucacaacaaggacaacaaggacacaacacaacac

SEQ ID NO: 462518 - RNA, 63 nt, hsa
ggacaacacaacaaggacagucacaacaaggacaacaaggacacaacacaacacacaacaagg

SEQ ID NO: 462519 - RNA, 63 nt, hsa
caacaaggacaacaaggacacaacacaacacacaacaaggacagucacaacaagccuagagcc

SEQ ID NO: 462520 - RNA, 63 nt, hsa
aaaaacaagguauauacuuuauuauuuuuugaaaacaaggauauugugaucaauuuuacccug

SEQ ID NO: 462521 - RNA, 63 nt, hsa
ggccuacucauuauuuuagagaaugaaugaagcaacaaggaagagagaccaugacucuaucga

SEQ ID NO: 462522 - RNA, 63 nt, hsa
uaggcaaaaauaauuuauuuugcucuuguuucuaacaaggacuuggagacuugguggucugag

SEQ ID NO: 462523 - RNA, 63 nt, hsa
gggguuuccugcauggacaguuguuuggagaacaacaaggacaacuuuauguagagaaaagga

SEQ ID NO: 462524 - RNA, 63 nt, hsa
agagaugggccuuagaaauguguuuuaagaauuaacaaggagucucaaaaagaaaugagaggg

SEQ ID NO: 462525 - RNA, 63 nt, hsa
ggguugcugucagccccaguuggcuuccuggucaacaaggaccucaagaacugccuguggacc

SEQ ID NO: 462526 - RNA, 63 nt, hsa
guaggcacaaaguaaaaaauggaaccaucuacuaacaaggauccuuuaaaacugccaagggag

SEQ ID NO: 462527 - RNA, 63 nt, hsa
auauacacacacacauauauauauauaaaguguaacaaggaacacuaaaacaguguugauucu

SEQ ID NO: 462528 - RNA, 63 nt, hsa
cacguggagagcuucuuccagaagauggacagaaacaaggaugguguggugaccauugaggaa

SEQ ID NO: 462529 - RNA, 63 nt, hsa
aggcuuaauugggccuucaaccuguaugaccuuaacaaggacggcugcaucaccaaggaggug

SEQ ID NO: 462530 - RNA, 63 nt, hsa
uucuggcugcugaaaccacuuugggccaggaagaacaaggaugaagagguuccugucauuucu

SEQ ID NO: 462531 - RNA, 63 nt, hsa
ugucuuugcuuauagcauuuuucucuaaccuauaacaaggagacauuacauuuuacuuuagaa

SEQ ID NO: 462532 - RNA, 63 nt, hsa
acacuguuguacuuccgugggcccuccuuccagaacaaggacaacaaggacaagguugaaggg

SEQ ID NO: 462533 - RNA, 63 nt, hsa
uacuuccgugggcccuccuuccagaacaaggacaacaaggacaagguugaagggucuucucau

SEQ ID NO: 462534 - RNA, 64 nt, hsa; identical to SEQ ID NO: 163262

SEQ ID NO: 462535 - RNA, 64 nt, hsa; identical to SEQ ID NO: 163263

SEQ ID NO: 462536 - RNA, 64 nt, hsa; identical to SEQ ID NO: 163264

SEQ ID NO: 462537 - RNA, 64 nt, hsa; identical to SEQ ID NO: 163265

SEQ ID NO: 462538 - RNA, 64 nt, hsa; identical to SEQ ID NO: 163266

SEQ ID NO: 462539 - RNA, 64 nt, hsa; identical to SEQ ID NO: 163267

SEQ ID NO: 462540 - RNA, 64 nt, hsa; identical to SEQ ID NO: 163268

SEQ ID NO: 462541 - RNA, 64 nt, hsa; identical to SEQ ID NO: 163269

SEQ ID NO: 462542 - RNA, 61 nt, hsa
uuuugcuuacaguuuuaaauucugaacaauucucucuuauauguguauugcuaaucauuaa

SEQ ID NO: 462543 - RNA, 61 nt, hsa
uguuuaguauuaugucuuauuggugcauuuacucucuuaucauuauguaauguccuucuuu

SEQ ID NO: 462544 - RNA, 61 nt, hsa
cugcgggccaggcacugcccuuuucaggaagcucucuuaaaauacccauugccccagaccu

SEQ ID NO: 462545 - RNA, 61 nt, hsa
uggaaggaugggauggguuccagagguauuccucucuuaaaugcaagugccuagauuaggu

SEQ ID NO: 462546 - RNA, 61 nt, hsa
cgguacagaacaguuccuucacucccaauagcucucuuaugcugucccuuuguagucagcu

SEQ ID NO: 462547 - RNA, 61 nt, hsa
ucucaguaguaucccuagagaaauaguguuccucucuuauauauucuugauucuagugaca

SEQ ID NO: 462548 - RNA, 61 nt, hsa
ucuuucucucuccuaucucucugucuuuuuucucucuuagaauuggaggauuugccauugu

SEQ ID NO: 462549 - RNA, 61 nt, hsa
ucuugacccuuuuguauaaagcuacaauauucucucuuauuguucuuucauauggaaugua

SEQ ID NO: 462550 - RNA, 61 nt, hsa
uaacuaaucucauuuaacuccaaaaucaucucucucuuaggacugcugacuugguuaugca

SEQ ID NO: 462551 - RNA, 61 nt, hsa
uaauagguaaucaaggcaauucaguaucucccucucuuaaagucuguuuuuagacuucaug

SEQ ID NO: 462552 - RNA, 61 nt, hsa
augaacaaagcaaaggauacagagguauguucucucuuagaagcuaacuucccugagacug

SEQ ID NO: 462553 - RNA, 61 nt, hsa
augaaagauguauaauguagagaacugacuucucucuuaaaaaguacagagagccugugcu

SEQ ID NO: 462554 - RNA, 64 nt, hsa
cauauauauuaaauauauccacaaagcagaugggcaaaaagauuuucaugcuaaucuucaaagg

SEQ ID NO: 462555 - RNA, 64 nt, hsa
acaugauuuugauuaugcuacaugauauauguuucaaaaagaauuagcauagaaauccuggucu

SEQ ID NO: 462556 - RNA, 64 nt, hsa
gaugugacauaucugcagucccagcacagugggacaaaaagaauuuagaccccaaaaguguccu

SEQ ID NO: 462557 - RNA, 64 nt, hsa
cagaaaggccuuaaugaccucauaggcacucuuccaaaaagacaacagaacuggaaugagaggc

SEQ ID NO: 462558 - RNA, 55 nt, hsa
caacaucaacaaauaaauaagaaagcaaaaagaucugggauauguguuggaaaac

SEQ ID NO: 462559 - RNA, 64 nt, hsa
ucaucaucucuguuauacaccuguaucaugaaagcaaaaagaaguaaacaucaggagucagcuc

SEQ ID NO: 462560 - RNA, 64 nt, hsa
uuugacucuauaagcaaauugcuuuuuuccaaaacaaaaagaugucucagguuuguuuugugaa

SEQ ID NO: 462561 - RNA, 64 nt, hsa
uuacuuuuaaggauaaaucauaaagucaguugcucaaaaagaaaucaauaguugaauuagugag

SEQ ID NO: 462562 - RNA, 64 nt, hsa
aagagaacugacugaacuugggaaauaauuugaacaaaaagauaaaucuucacagauaugaaua

SEQ ID NO: 462563 - RNA, 64 nt, hsa
agcaaaacaaacaaagcaauauuaaaggaagagccaaaaagacccagaaauaaaaugacagaua

SEQ ID NO: 462564 - RNA, 64 nt, hsa
cuaaagcaguuuacucaucaauugaaaaguccuccaaaaagagaacuauugggaaaccauggug

SEQ ID NO: 462565 - RNA, 64 nt, hsa
gcagagccuacaaaacauuguauauuucaaaagacaaaaagaagcagcagcaguaucuuguucu

SEQ ID NO: 462566 - RNA, 64 nt, hsa
cucagguugucuaaguguuuuuauguaaaaccaacaaaaagaacaaaucagcuuauauuuuuua

SEQ ID NO: 462567 - RNA, 64 nt, hsa
auugcgcccggccuuaaauguuuuuuuuaaucaucaaaaagaacaacauaucucagguugucua

SEQ ID NO: 462568 - RNA, 64 nt, hsa
guuucaaauagcuaaaaggagauuuuguccccaacaaaaagaaaugauaaauauuugaaaccau

SEQ ID NO: 462569 - RNA, 64 nt, hsa
gauaucaucucauccuaauuaaggugacuauuuucaaaaagacaaaaaauaugacagccguggu

SEQ ID NO: 462570 - RNA, 64 nt, hsa
acacacugcagcagagcuuguagcuggacagagucaaaaagaagaaaauacgguuucaggcuuu

SEQ ID NO: 462571 - RNA, 64 nt, hsa
cagugaugccuuauuugaaacugggcuuaaacugcaaaaagaaugaaguuggauuuaggaagcu

SEQ ID NO: 462572 - RNA, 64 nt, hsa
agaucaaggucacagcacugccuacaccuguuuacaaaaagaaucaaauaccacuaugaauaag

SEQ ID NO: 462573 - RNA, 64 nt, hsa
uaauuccaggaaagcacagaggacaaaguuaauucaaaaagaggcgcuagaucaaggucacagc

SEQ ID NO: 462574 - RNA, 64 nt, hsa
ccaaucccgacaguagcagaauggcauucuacaacaaaaagaagcuaguuaugggaguuaaguu

SEQ ID NO: 462575 - RNA, 64 nt, hsa
caaaaagacaaaaaaaaaaaaaaaaaaaaaaaagcaaaaagacgucggagaaaagugccgcgaa

SEQ ID NO: 462576 - RNA, 64 nt, hsa
uuguguuugcuuuuccggaccccacucugcccuccaaaaagacaaaaaaaaaaaaaaaaaaaaa

SEQ ID NO: 462577 - RNA, 64 nt, hsa
ggaugacacagaaacaccguaagugucuggaaggcaaaaagaucuuaagauucaagagagagga

SEQ ID NO: 462578 - RNA, 64 nt, hsa
aagcaaaauguuuaaagacacaacggaauagacccaaaaagauaauuucuaucugauuugcuuu

SEQ ID NO: 462579 - RNA, 64 nt, hsa
aaucaguaaucuaccugguggauuuguuuuuaaccaaaaagaugaauuaucaaugauuuguaau

SEQ ID NO: 462580 - RNA, 64 nt, hsa
ugccauuuguaaaauaaaauagagcagaaaaacacaaaaagagaacacugguucagacauucag

SEQ ID NO: 462581 - RNA, 64 nt, hsa
cgggauauacccacaggaaaagaauucauuuuaucaaaaagacaccugcaccaauauguucauu

SEQ ID NO: 462582 - RNA, 64 nt, hsa
gagagaacucugcacuaugaacccaaacccagcucaaaaagauaaaaucuagucauuuaagaua

SEQ ID NO: 462583 - RNA, 64 nt, hsa
ugauagaaaagucacauuucuacaagguaauuuucaaaaagaaauaaaacauuucuguaaacuu

SEQ ID NO: 462584 - RNA, 64 nt, hsa
guaaagaaaagaucgcaggaauguggagagcuuccaaaaagagauugcucucagauuuuccuga

SEQ ID NO: 462585 - RNA, 64 nt, hsa
ucaggcauaggcagccuauagggcccaaagaaggcaaaaagauaagauuuacucaaguagcauu

SEQ ID NO: 462586 - RNA, 64 nt, hsa
gugggacaagcaggcuuguuuccaccaauagugccaaaaagauauugccuaaugugcaccugug

SEQ ID NO: 462587 - RNA, 64 nt, hsa
acauagucaguaauaauaaaacucagcauaguagcaaaaagaacgacaucaguuuaaaggcaca

SEQ ID NO: 462588 - RNA, 64 nt, hsa
uacaaagauauucucuauguuuuguaaguaaaaacaaaaagaaaaccuuucuuuuguuuuuuac

SEQ ID NO: 462589 - RNA, 64 nt, hsa
uuuuuaaagucccaccuuucaauguuuaauaaaacaaaaagagaaauccuuaaucuaaaagcua

SEQ ID NO: 462590 - RNA, 64 nt, hsa
ccauuagguaccuagcagaugugcacaauauaaacaaaaagauaucuggccuaccuuacuacua

SEQ ID NO: 462591 - RNA, 64 nt, hsa
auaccucuuaggaaccaaagaaugccucuacaagcaaaaagauaguugaaaauaguuaagaucc

SEQ ID NO: 462592 - RNA, 64 nt, hsa
guaauauggcaagagcccaacucuacuaaaaauacaaaaagaaaagaaaacagccaagcuuggu

SEQ ID NO: 462593 - RNA, 64 nt, hsa
uaauaacauggaagguuuguuuuauaugaauuuucaaaaagaugucucuuuacacuuuuuguua

SEQ ID NO: 462594 - RNA, 64 nt, hsa
uuauguaacuugauggaagaaaauggaauuacuccaaaaagacaagugcucaagcagcaaaauc

SEQ ID NO: 462595 - RNA, 64 nt, hsa
ggaguguuugaaguuugcagaugagaagguuugacaaaaagacagagagauguagagacaguga

SEQ ID NO: 462596 - RNA, 64 nt, hsa
gagagauguagagacagugauagagacagaggaacaaaaagagcagcagugagaaggcaaagag

SEQ ID NO: 462597 - RNA, 64 nt, hsa
uuugagcacuggguucuuuuagccaaauuccauacaaaaagaauuuggauguuuuccagcauuu

SEQ ID NO: 462598 - RNA, 64 nt, hsa
uagaaaaagaaaaaagugaaaaggaaacaacuagcaaaaagaauagccauaagaaaaccaggua

SEQ ID NO: 462599 - RNA, 64 nt, hsa
agaaaaagcacagcucucacuggccaguagcugccaaaaagaacacccaucguauaaggaaauc

SEQ ID NO: 462600 - RNA, 64 nt, hsa
ccgcucucucauguggggauguuugugcugcagacaaaaagaacaaaaaaaaauuuuuaaauac

SEQ ID NO: 462601 - RNA, 64 nt, hsa
agcaaucaggcaagagaaagaaauaaaaggcaaccaaaaagaaaggaagucgaaguaucucugu

SEQ ID NO: 462602 - RNA, 64 nt, hsa
caaaucaagaaugcaauccuauucacaauugccacaaaaagaauaaaauaccuaggaauacagc

SEQ ID NO: 462603 - RNA, 64 nt, hsa
aaaaaagagcccaaaaagccaaagcaauccuaagcaaaaagaacaaagcuggaggcaucgcauu

SEQ ID NO: 462604 - RNA, 64 nt, hsa
cauuggggucuaguuuggaaucugacaacuggaacaaaaagaaccuugaauccggugcaugccu

SEQ ID NO: 462605 - RNA, 51 nt, hsa
gacaguguuacagcaauuaaucaaaaagaaaaaccacaggcccuuccccuu

SEQ ID NO: 462606 - RNA, 64 nt, hsa
ugguguguuuagagauuuuaguuuaaaaacaaaacaaaaagauugaucaaaucuguacaguuuc

SEQ ID NO: 462607 - RNA, 64 nt, hsa
gaaaggccaaaaaaaagaggaaaagaaaaauguacaaaaagauuuucgaucuucucacucuuac

SEQ ID NO: 462608 - RNA, 64 nt, hsa
uauuuugguguuuuuguguuuucucuuuauaaggcaaaaagaucuguauuuacacuccuucacc

SEQ ID NO: 462609 - RNA, 64 nt, hsa
gguuugucaucuccgcaaggccagaaagugaucacaaaaagaggcagaugauagacacuggggu

SEQ ID NO: 462610 - RNA, 64 nt, hsa
aauuaaucacuaaugaauuaugcgaaagcaacauauuugauaaccguugcaguaaaucaugagu

SEQ ID NO: 462611 - RNA, 64 nt, hsa
uuuuaggauuugggaaaauaaacuguaaauguuuauuugauagguaaauauaguuuuauuguca

SEQ ID NO: 462612 - RNA, 64 nt, hsa
uaagaucaacucuuccuauccugcuaacucuaagauuugauaagggccacaucccaguguuuau

SEQ ID NO: 462613 - RNA, 64 nt, hsa
ggcugagaaaugauucauuugaagauacaauuuuauuugauaucaaugaacgcccucaagacug

SEQ ID NO: 462614 - RNA, 64 nt, hsa
uaaguuccagcagaugccacauaagggguuugccauuugauaccccuggggaacauuucuguaa

SEQ ID NO: 462615 - RNA, 64 nt, hsa
uguauacuuuaguaugacgcugauacauaacuaaauuugauacuuauauuuucguaugaaaaug

SEQ ID NO: 462616 - RNA, 64 nt, hsa
uuucuauggagcugauuuaaaguauuccauuuagauuugauagauaugcuuaagcaaucuauaa

SEQ ID NO: 462617 - RNA, 64 nt, hsa
ccacagaauaggauaaaauauuuguaaaucauauauuugauaaaagucuuguaaccagauacau

SEQ ID NO: 462618 - RNA, 64 nt, hsa
guaaagcuguaucgauuugcuauugaaauauaguauuugauacaggagccauguguacgaauug

SEQ ID NO: 462619 - RNA, 64 nt, hsa
uauauagugcauauaauaaauccaauuaaacauuauuugauacauauuuaacuuuuuuggcugu

SEQ ID NO: 462620 - RNA, 64 nt, hsa
agguuaaauuuucuauacuuugguccauaauuugauuugauaugauuguuucauuuauaauuug

SEQ ID NO: 462621 - RNA, 64 nt, hsa
uagaggagacuaauucucuuucuagcccauccaaauuugauaaauggaaccagagguuauauac

SEQ ID NO: 462622 - RNA, 64 nt, hsa
cugcaagaaaagaagucaaucagcagaggagagcauuugauaacuaagaggaagacuugcaaag

SEQ ID NO: 462623 - RNA, 64 nt, hsa
gagugauuugaaauacuauauggcaaaguuuuauauuugauauucuuuaaguuaguugcucaca

SEQ ID NO: 462624 - RNA, 64 nt, hsa
caagggaaguuuugugauaggagagaaauaaaagauuugauauuuuuugagaugacacucaagc

SEQ ID NO: 462625 - RNA, 64 nt, hsa
aagugaccacaguauacaaaguaauaagcaggaaauuugauauggguuaaauuaugcauuuugu

SEQ ID NO: 462626 - RNA, 64 nt, hsa
aacugauuuccaaauauguucaacauuuacuucuauuugauaucugcucaagaagucauagaag

SEQ ID NO: 462627 - RNA, 64 nt, hsa
gagaugaagugggguuuccauuaggugcuuugaaauuugauaacaaaucaucaacuuccacugg

SEQ ID NO: 462628 - RNA, 64 nt, hsa
guccuuauuuguuaauuguauauaaauguuaauuauuugauacgaauguuaugcauuuaguaug

SEQ ID NO: 462629 - RNA, 64 nt, hsa
aaaauauauauuugauauacccuucaauugccaaauuugauauguugcacugaagacagacccu

SEQ ID NO: 462630 - RNA, 64 nt, hsa
aguuuguuccacauuuugaaagcaaaaaauauauauuugauauacccuucaauugccaaauuug

SEQ ID NO: 462631 - RNA, 64 nt, hsa
uaagggaauauggacaaauuguuaaauaguauuuauuugauaaaugggaguuuguaugcagaaa

SEQ ID NO: 462632 - RNA, 64 nt, hsa
cauguacaaaucaaucacuauaauaaacugcaucauuugauagagucaccguuuuugcauguag

SEQ ID NO: 462633 - RNA, 64 nt, hsa
uuuguuaagccuuggcucuggauguggccuagauauuugauauucuaauuggaaauuacagauu

SEQ ID NO: 462634 - RNA, 64 nt, hsa
aacuagaaaauccuuuugacaaaaggaauaccccauuugauaucagagauacacaaaaaaccaa

SEQ ID NO: 462635 - RNA, 64 nt, hsa
cugccccucuccuuaaaacugaauggugccaauaauuugauacuaaugacuacaaaaaaaggua

SEQ ID NO: 462636 - RNA, 64 nt, hsa
gaguuuuucuauuacucuauguaguugagacaggauuugauaagucuaggaaaagaaagauggg

SEQ ID NO: 462637 - RNA, 64 nt, hsa
gauuagaaagaaacauggacaacucuguccauaaauuugauaacuuagcuaaaauggaccaauu

SEQ ID NO: 462638 - RNA, 64 nt, hsa
uauuagcaaaucaggaaugcaaggcuuguucaacauuugauauucaguguaauccauugcaugc

SEQ ID NO: 462639 - RNA, 64 nt, hsa
cucaacacagaaggaauacaggagaacuuacucaauuugauaaagaacuacuacaaaaaacccu

SEQ ID NO: 462640 - RNA, 64 nt, hsa
uguuagcaaaucaggaaugcaagccuuguucaacauuugauauucagugcaauccauugcaugc

SEQ ID NO: 462641 - RNA, 64 nt, hsa
gauuagaaagaaauauggacaacucuguccauaaauuugauaacuuagcuaaaauggaucaauu

SEQ ID NO: 462642 - RNA, 64 nt, hsa
acauauauaugaaugcuuguaauagucuguuacuauuugauaaugcauaaauguuauauuuaua

SEQ ID NO: 462643 - RNA, 64 nt, hsa
gaaauuucaaaguauguuucauuauucuuucuaaauuugauaauugauuaggaaguauuuuaua

SEQ ID NO: 462644 - RNA, 64 nt, hsa
ucuuuugcacuucuaacauguagccaauaaaucuauuugauagccaucaaaggaauaaaaagcu

SEQ ID NO: 462645 - RNA, 64 nt, hsa
ugaaacaucgacguaacuggaaauuaggugggauauuugauaggauccauaucuaauaauggau

SEQ ID NO: 462646 - RNA, 64 nt, hsa
ggugaaucugcuaaauccuuuugaaaugcugcagauuugauaaauauuuauuuuagacuaauug

SEQ ID NO: 462647 - RNA, 64 nt, hsa
agaguuggggggaacuggagggagcaaaacacugauuugauacuagucaguuugcuugaaacua

SEQ ID NO: 462648 - RNA, 64 nt, hsa
uauagaauuggcuugggcuuguguagccccagucauuugauaaagauguuguuaaacuguguca

SEQ ID NO: 462649 - RNA, 64 nt, hsa
ggagcuucuuaggucuugccacaaaaaucugcaaauuugauaauucuccugaauucacaaucau

SEQ ID NO: 462650 - RNA, 64 nt, hsa
ggaaugcaauuugacuuggcauaauugugaguuaauuugauaaagaucuccaguuguauccucu

SEQ ID NO: 462651 - RNA, 64 nt, hsa
uuuaaguaauuucaugcacacaggagaaaaugcaauuugauaaucaguuuccacuacauucgga

SEQ ID NO: 462652 - RNA, 64 nt, hsa
ugguauuaagccuuucccaacuugugaauauagaauuugauaauacacuuuuguguauuagcaa

SEQ ID NO: 462653 - RNA, 64 nt, hsa
uacuuuguaaauugaauuuuuuaaagaaauaggcauuugauaaccagcuuggcaaguaacucua

SEQ ID NO: 462654 - RNA, 64 nt, hsa
ucauaugaaaaauuugcuaauuuaauauuaacucauuugauaauaauacuugucuuuucuaccu

SEQ ID NO: 462655 - RNA, 64 nt, hsa
gugaaguaaauauuuuaaaggaaacauuauauagauuugauaaauguuguuuauaauuaagagu

SEQ ID NO: 462656 - RNA, 64 nt, hsa; identical to SEQ ID NO: 291173

SEQ ID NO: 462657 - RNA, 64 nt, hsa; identical to SEQ ID NO: 291174

SEQ ID NO: 462658 - RNA, 64 nt, hsa; identical to SEQ ID NO: 291175

SEQ ID NO: 462659 - RNA, 64 nt, hsa; identical to SEQ ID NO: 291176

SEQ ID NO: 462660 - RNA, 64 nt, hsa; identical to SEQ ID NO: 291177

SEQ ID NO: 462661 - RNA, 64 nt, hsa; identical to SEQ ID NO: 291178

SEQ ID NO: 462662 - RNA, 64 nt, hsa; identical to SEQ ID NO: 291179

SEQ ID NO: 462663 - RNA, 64 nt, hsa; identical to SEQ ID NO: 291180

SEQ ID NO: 462664 - RNA, 64 nt, hsa; identical to SEQ ID NO: 291181

SEQ ID NO: 462665 - RNA, 64 nt, hsa; identical to SEQ ID NO: 291182

SEQ ID NO: 462666 - RNA, 64 nt, hsa; identical to SEQ ID NO: 291183

SEQ ID NO: 462667 - RNA, 64 nt, hsa; identical to SEQ ID NO: 291184

SEQ ID NO: 462668 - RNA, 64 nt, hsa; identical to SEQ ID NO: 291185

SEQ ID NO: 462669 - RNA, 64 nt, hsa; identical to SEQ ID NO: 291186

SEQ ID NO: 462670 - RNA, 64 nt, hsa; identical to SEQ ID NO: 291187

SEQ ID NO: 462671 - RNA, 64 nt, hsa; identical to SEQ ID NO: 291188

SEQ ID NO: 462672 - RNA, 64 nt, hsa; identical to SEQ ID NO: 291189

SEQ ID NO: 462673 - RNA, 64 nt, hsa; identical to SEQ ID NO: 291190

SEQ ID NO: 462674 - RNA, 64 nt, hsa; identical to SEQ ID NO: 291191

SEQ ID NO: 462675 - RNA, 64 nt, hsa; identical to SEQ ID NO: 291192

SEQ ID NO: 462676 - RNA, 64 nt, hsa; identical to SEQ ID NO: 291193

SEQ ID NO: 462677 - RNA, 64 nt, hsa; identical to SEQ ID NO: 291194

SEQ ID NO: 462678 - RNA, 64 nt, hsa; identical to SEQ ID NO: 291195

SEQ ID NO: 462679 - RNA, 64 nt, hsa; identical to SEQ ID NO: 291196

SEQ ID NO: 462680 - RNA, 64 nt, hsa; identical to SEQ ID NO: 291197

SEQ ID NO: 462681 - RNA, 64 nt, hsa; identical to SEQ ID NO: 291198

SEQ ID NO: 462682 - RNA, 64 nt, hsa; identical to SEQ ID NO: 291199

SEQ ID NO: 462683 - RNA, 64 nt, hsa; identical to SEQ ID NO: 291200

SEQ ID NO: 462684 - RNA, 64 nt, hsa; identical to SEQ ID NO: 291201

SEQ ID NO: 462685 - RNA, 64 nt, hsa; identical to SEQ ID NO: 291202

SEQ ID NO: 462686 - RNA, 64 nt, hsa; identical to SEQ ID NO: 291203

SEQ ID NO: 462687 - RNA, 64 nt, hsa; identical to SEQ ID NO: 291204

SEQ ID NO: 462688 - RNA, 64 nt, hsa; identical to SEQ ID NO: 291205

SEQ ID NO: 462689 - RNA, 64 nt, hsa; identical to SEQ ID NO: 291206

SEQ ID NO: 462690 - RNA, 61 nt, hsa; identical to SEQ ID NO: 316476

SEQ ID NO: 462691 - RNA, 61 nt, hsa; identical to SEQ ID NO: 316477

SEQ ID NO: 462692 - RNA, 61 nt, hsa; identical to SEQ ID NO: 316567

SEQ ID NO: 462693 - RNA, 61 nt, hsa; identical to SEQ ID NO: 316568

SEQ ID NO: 462694 - RNA, 61 nt, hsa; identical to SEQ ID NO: 316585

SEQ ID NO: 462695 - RNA, 61 nt, hsa; identical to SEQ ID NO: 316586

SEQ ID NO: 462696 - RNA, 61 nt, hsa; identical to SEQ ID NO: 316623

SEQ ID NO: 462697 - RNA, 61 nt, hsa; identical to SEQ ID NO: 316624

SEQ ID NO: 462698 - RNA, 61 nt, hsa; identical to SEQ ID NO: 316679

SEQ ID NO: 462699 - RNA, 61 nt, hsa; identical to SEQ ID NO: 316680

SEQ ID NO: 462700 - RNA, 61 nt, hsa; identical to SEQ ID NO: 316734

SEQ ID NO: 462701 - RNA, 61 nt, hsa; identical to SEQ ID NO: 316735

SEQ ID NO: 462702 - RNA, 61 nt, hsa; identical to SEQ ID NO: 316748

SEQ ID NO: 462703 - RNA, 61 nt, hsa; identical to SEQ ID NO: 316749

SEQ ID NO: 462704 - RNA, 61 nt, hsa; identical to SEQ ID NO: 316751

SEQ ID NO: 462705 - RNA, 61 nt, hsa; identical to SEQ ID NO: 316752

SEQ ID NO: 462706 - RNA, 61 nt, hsa; identical to SEQ ID NO: 316776

SEQ ID NO: 462707 - RNA, 61 nt, hsa; identical to SEQ ID NO: 316777

SEQ ID NO: 462708 - RNA, 61 nt, hsa; identical to SEQ ID NO: 316788

SEQ ID NO: 462709 - RNA, 61 nt, hsa; identical to SEQ ID NO: 316789

SEQ ID NO: 462710 - RNA, 61 nt, hsa; identical to SEQ ID NO: 316796

SEQ ID NO: 462711 - RNA, 61 nt, hsa; identical to SEQ ID NO: 316797

SEQ ID NO: 462712 - RNA, 61 nt, hsa; identical to SEQ ID NO: 316804

SEQ ID NO: 462713 - RNA, 61 nt, hsa; identical to SEQ ID NO: 316805

SEQ ID NO: 462714 - RNA, 61 nt, hsa; identical to SEQ ID NO: 316842

SEQ ID NO: 462715 - RNA, 61 nt, hsa; identical to SEQ ID NO: 316843

SEQ ID NO: 462716 - RNA, 61 nt, hsa; identical to SEQ ID NO: 316851

SEQ ID NO: 462717 - RNA, 61 nt, hsa; identical to SEQ ID NO: 316852

SEQ ID NO: 462718 - RNA, 61 nt, hsa; identical to SEQ ID NO: 316866

SEQ ID NO: 462719 - RNA, 61 nt, hsa; identical to SEQ ID NO: 316867

SEQ ID NO: 462720 - RNA, 64 nt, hsa; identical to SEQ ID NO: 336218

SEQ ID NO: 462721 - RNA, 64 nt, hsa; identical to SEQ ID NO: 336219

SEQ ID NO: 462722 - RNA, 64 nt, hsa; identical to SEQ ID NO: 336220

SEQ ID NO: 462723 - RNA, 64 nt, hsa; identical to SEQ ID NO: 336221

SEQ ID NO: 462724 - RNA, 64 nt, hsa; identical to SEQ ID NO: 336222

SEQ ID NO: 462725 - RNA, 64 nt, hsa; identical to SEQ ID NO: 336223

SEQ ID NO: 462726 - RNA, 64 nt, hsa; identical to SEQ ID NO: 336224

SEQ ID NO: 462727 - RNA, 64 nt, hsa; identical to SEQ ID NO: 336225

SEQ ID NO: 462728 - RNA, 64 nt, hsa; identical to SEQ ID NO: 336226

SEQ ID NO: 462729 - RNA, 64 nt, hsa; identical to SEQ ID NO: 336227

SEQ ID NO: 462730 - RNA, 64 nt, hsa; identical to SEQ ID NO: 336228

SEQ ID NO: 462731 - RNA, 64 nt, hsa; identical to SEQ ID NO: 336229

SEQ ID NO: 462732 - RNA, 64 nt, hsa; identical to SEQ ID NO: 336230

SEQ ID NO: 462733 - RNA, 64 nt, hsa; identical to SEQ ID NO: 336231

SEQ ID NO: 462734 - RNA, 64 nt, hsa; identical to SEQ ID NO: 336232

SEQ ID NO: 462735 - RNA, 64 nt, hsa; identical to SEQ ID NO: 336233

SEQ ID NO: 462736 - RNA, 64 nt, hsa; identical to SEQ ID NO: 336234

SEQ ID NO: 462737 - RNA, 64 nt, hsa; identical to SEQ ID NO: 336235

SEQ ID NO: 462738 - RNA, 64 nt, hsa; identical to SEQ ID NO: 336236

SEQ ID NO: 462739 - RNA, 64 nt, hsa; identical to SEQ ID NO: 336237

SEQ ID NO: 462740 - RNA, 64 nt, hsa; identical to SEQ ID NO: 336238

SEQ ID NO: 462741 - RNA, 64 nt, hsa; identical to SEQ ID NO: 336239

SEQ ID NO: 462742 - RNA, 64 nt, hsa; identical to SEQ ID NO: 336240

SEQ ID NO: 462743 - RNA, 64 nt, hsa; identical to SEQ ID NO: 336241

SEQ ID NO: 462744 - RNA, 64 nt, hsa; identical to SEQ ID NO: 336242

SEQ ID NO: 462745 - RNA, 64 nt, hsa; identical to SEQ ID NO: 336243

SEQ ID NO: 462746 - RNA, 64 nt, hsa; identical to SEQ ID NO: 336244

SEQ ID NO: 462747 - RNA, 64 nt, hsa; identical to SEQ ID NO: 336245

SEQ ID NO: 462748 - RNA, 64 nt, hsa; identical to SEQ ID NO: 336246

SEQ ID NO: 462749 - RNA, 64 nt, hsa; identical to SEQ ID NO: 336247

SEQ ID NO: 462750 - RNA, 64 nt, hsa; identical to SEQ ID NO: 336248

SEQ ID NO: 462751 - RNA, 64 nt, hsa; identical to SEQ ID NO: 336249

SEQ ID NO: 462752 - RNA, 64 nt, hsa; identical to SEQ ID NO: 336250

SEQ ID NO: 462753 - RNA, 64 nt, hsa; identical to SEQ ID NO: 336251

SEQ ID NO: 462754 - RNA, 64 nt, hsa; identical to SEQ ID NO: 336252

SEQ ID NO: 462755 - RNA, 64 nt, hsa; identical to SEQ ID NO: 336253

SEQ ID NO: 462756 - RNA, 64 nt, hsa; identical to SEQ ID NO: 336254

SEQ ID NO: 462757 - RNA, 64 nt, hsa; identical to SEQ ID NO: 336255

SEQ ID NO: 462758 - RNA, 64 nt, hsa; identical to SEQ ID NO: 336256

SEQ ID NO: 462759 - RNA, 64 nt, hsa; identical to SEQ ID NO: 336257

SEQ ID NO: 462760 - RNA, 64 nt, hsa; identical to SEQ ID NO: 336258

SEQ ID NO: 462761 - RNA, 64 nt, hsa; identical to SEQ ID NO: 336259

SEQ ID NO: 462762 - RNA, 64 nt, hsa; identical to SEQ ID NO: 336260

SEQ ID NO: 462763 - RNA, 64 nt, hsa; identical to SEQ ID NO: 336261

SEQ ID NO: 462764 - RNA, 64 nt, hsa; identical to SEQ ID NO: 336262

SEQ ID NO: 462765 - RNA, 64 nt, hsa; identical to SEQ ID NO: 336263

SEQ ID NO: 462766 - RNA, 64 nt, hsa; identical to SEQ ID NO: 336264

SEQ ID NO: 462767 - RNA, 64 nt, hsa; identical to SEQ ID NO: 336265

SEQ ID NO: 462768 - RNA, 64 nt, hsa; identical to SEQ ID NO: 336266

SEQ ID NO: 462769 - RNA, 64 nt, hsa; identical to SEQ ID NO: 336267

SEQ ID NO: 462770 - RNA, 64 nt, hsa; identical to SEQ ID NO: 336268

SEQ ID NO: 462771 - RNA, 64 nt, hsa; identical to SEQ ID NO: 336269

SEQ ID NO: 462772 - RNA, 64 nt, hsa; identical to SEQ ID NO: 336270

SEQ ID NO: 462773 - RNA, 64 nt, hsa; identical to SEQ ID NO: 336271

SEQ ID NO: 462774 - RNA, 64 nt, hsa; identical to SEQ ID NO: 336272

SEQ ID NO: 462775 - RNA, 64 nt, hsa; identical to SEQ ID NO: 336273

SEQ ID NO: 462776 - RNA, 64 nt, hsa; identical to SEQ ID NO: 336274

SEQ ID NO: 462777 - RNA, 64 nt, hsa; identical to SEQ ID NO: 336275

SEQ ID NO: 462778 - RNA, 64 nt, hsa; identical to SEQ ID NO: 336276

SEQ ID NO: 462779 - RNA, 64 nt, hsa; identical to SEQ ID NO: 336277

SEQ ID NO: 462780 - RNA, 64 nt, hsa; identical to SEQ ID NO: 336278

SEQ ID NO: 462781 - RNA, 64 nt, hsa; identical to SEQ ID NO: 336279

SEQ ID NO: 462782 - RNA, 64 nt, hsa; identical to SEQ ID NO: 336280

SEQ ID NO: 462783 - RNA, 64 nt, hsa; identical to SEQ ID NO: 336281

SEQ ID NO: 462784 - RNA, 64 nt, hsa; identical to SEQ ID NO: 336282

SEQ ID NO: 462785 - RNA, 64 nt, hsa; identical to SEQ ID NO: 336283

SEQ ID NO: 462786 - RNA, 64 nt, hsa; identical to SEQ ID NO: 336284

SEQ ID NO: 462787 - RNA, 64 nt, hsa; identical to SEQ ID NO: 336285

SEQ ID NO: 462788 - RNA, 64 nt, hsa; identical to SEQ ID NO: 336286

SEQ ID NO: 462789 - RNA, 64 nt, hsa; identical to SEQ ID NO: 336287

SEQ ID NO: 462790 - RNA, 64 nt, hsa; identical to SEQ ID NO: 336288

SEQ ID NO: 462791 - RNA, 64 nt, hsa; identical to SEQ ID NO: 336289

SEQ ID NO: 462792 - RNA, 64 nt, hsa; identical to SEQ ID NO: 336290

SEQ ID NO: 462793 - RNA, 64 nt, hsa; identical to SEQ ID NO: 336291

SEQ ID NO: 462794 - RNA, 64 nt, hsa; identical to SEQ ID NO: 336292

SEQ ID NO: 462795 - RNA, 64 nt, hsa; identical to SEQ ID NO: 336293

SEQ ID NO: 462796 - RNA, 64 nt, hsa; identical to SEQ ID NO: 336294

SEQ ID NO: 462797 - RNA, 64 nt, hsa; identical to SEQ ID NO: 336295

SEQ ID NO: 462798 - RNA, 64 nt, hsa; identical to SEQ ID NO: 336296

SEQ ID NO: 462799 - RNA, 64 nt, hsa; identical to SEQ ID NO: 336297

SEQ ID NO: 462800 - RNA, 64 nt, hsa; identical to SEQ ID NO: 336298

SEQ ID NO: 462801 - RNA, 64 nt, hsa; identical to SEQ ID NO: 336299

SEQ ID NO: 462802 - RNA, 64 nt, hsa; identical to SEQ ID NO: 336300

SEQ ID NO: 462803 - RNA, 64 nt, hsa; identical to SEQ ID NO: 336301

SEQ ID NO: 462804 - RNA, 64 nt, hsa; identical to SEQ ID NO: 336302

SEQ ID NO: 462805 - RNA, 64 nt, hsa; identical to SEQ ID NO: 336303

SEQ ID NO: 462806 - RNA, 64 nt, hsa; identical to SEQ ID NO: 336304

SEQ ID NO: 462807 - RNA, 64 nt, hsa; identical to SEQ ID NO: 336305

SEQ ID NO: 462808 - RNA, 64 nt, hsa; identical to SEQ ID NO: 336306

SEQ ID NO: 462809 - RNA, 64 nt, hsa; identical to SEQ ID NO: 336307

SEQ ID NO: 462810 - RNA, 64 nt, hsa; identical to SEQ ID NO: 336308

SEQ ID NO: 462811 - RNA, 64 nt, hsa; identical to SEQ ID NO: 336309

SEQ ID NO: 462812 - RNA, 63 nt, hsa; identical to SEQ ID NO: 336310

SEQ ID NO: 462813 - RNA, 64 nt, hsa; identical to SEQ ID NO: 336311

SEQ ID NO: 462814 - RNA, 64 nt, hsa; identical to SEQ ID NO: 336312

SEQ ID NO: 462815 - RNA, 64 nt, hsa; identical to SEQ ID NO: 336313

SEQ ID NO: 462816 - RNA, 64 nt, hsa
ucuuguuauugcuccaguacauaggaauuguguaaaguguuaacagcagcuguauuuguuuaaa

SEQ ID NO: 462817 - RNA, 64 nt, hsa
uaauguaagaauacuuuaaaucucuaagcuucugaaguguuagagguagagauggucuaguaaa

SEQ ID NO: 462818 - RNA, 64 nt, hsa
uaaaacuuaguaaugagaaacugugaaaagagccaaguguuacauugagcuuggggugggagau

SEQ ID NO: 462819 - RNA, 64 nt, hsa
gucauagcccaugucuugugcccucccacacagaaaguguuagauagggaaauuggcaaaaaga

SEQ ID NO: 462820 - RNA, 64 nt, hsa
ugcccugugauuuuuaugauacuucuucaauacaaaguguuaauaugugucaucaguauaauaa

SEQ ID NO: 462821 - RNA, 64 nt, hsa
gcucagcuuacuguaaccucugccuccuggauucaaguguuaguagcugggauuacaaaagcau

SEQ ID NO: 462822 - RNA, 64 nt, hsa
uaguguuaaagauuaagcauaguaacugacucuuaaguguuaaauaauguagaaguaaaaaaau

SEQ ID NO: 462823 - RNA, 64 nt, hsa
agauaaugcaguugguggaaaugauaaacguuuuaaguguuaacauccuuugaaugcguuggau

SEQ ID NO: 462824 - RNA, 64 nt, hsa
uagagccacacacaacuuuugaacuuuuaauuauaaguguuauggcuaaaguuauuuacugaaa

SEQ ID NO: 462825 - RNA, 64 nt, hsa
guuuucugggaauuuuguaacaaguuacacgcacaaguguuagaaacuuuggcauaacucaauu

SEQ ID NO: 462826 - RNA, 64 nt, hsa
acuacacaacugccuuccugacagguucugagauaaguguuauguuuguagauagagugaaaua

SEQ ID NO: 462827 - RNA, 64 nt, hsa
accuuauuuuacagaagugaaagugagguaucagaaguguuaagugacaugccugaggcacccc

SEQ ID NO: 462828 - RNA, 64 nt, hsa
agcaaagcacuuggaaucuccguuuuaaagcuucaaguguuaaaaaugcuacaauaguuuuuua

SEQ ID NO: 462829 - RNA, 64 nt, hsa
aagcguaagauugaggcaugaaguucagaaaaaaaaguguuacaacacacagggaaguuuuuuc

SEQ ID NO: 462830 - RNA, 64 nt, hsa
cuaucagugccaagggcuuccuguaguucuauucaaguguuacaauaaauauuuguagauaaua

SEQ ID NO: 462831 - RNA, 64 nt, hsa
uuuuguuccauaaauguuuuucuuaauuauuaagaaguguuaccuuauuaaaaugaccaccauu

SEQ ID NO: 462832 - RNA, 64 nt, hsa
agaccguaaauucacauauaugccaucuguccucaaguguuaucuacauaggaaauaaaaugga

SEQ ID NO: 462833 - RNA, 64 nt, hsa
uuugcuguauaugugugguguuugauuucaacuaaaguguuauuaguggggaacagaaguauau

SEQ ID NO: 462834 - RNA, 64 nt, hsa
cauucuugguggauaaauuguucaucuguuuuugaaguguuaccuuacuauuuuguuuacaaga

SEQ ID NO: 462835 - RNA, 64 nt, hsa; identical to SEQ ID NO: 169116

SEQ ID NO: 462836 - RNA, 64 nt, hsa; identical to SEQ ID NO: 169117

SEQ ID NO: 462837 - RNA, 64 nt, hsa; identical to SEQ ID NO: 169118

SEQ ID NO: 462838 - RNA, 64 nt, hsa; identical to SEQ ID NO: 169119

SEQ ID NO: 462839 - RNA, 64 nt, hsa; identical to SEQ ID NO: 169120

SEQ ID NO: 462840 - RNA, 64 nt, hsa; identical to SEQ ID NO: 169121

SEQ ID NO: 462841 - RNA, 64 nt, hsa; identical to SEQ ID NO: 169122

SEQ ID NO: 462842 - RNA, 64 nt, hsa; identical to SEQ ID NO: 169123

SEQ ID NO: 462843 - RNA, 64 nt, hsa; identical to SEQ ID NO: 169124

SEQ ID NO: 462844 - RNA, 64 nt, hsa; identical to SEQ ID NO: 169125

SEQ ID NO: 462845 - RNA, 64 nt, hsa; identical to SEQ ID NO: 169126

SEQ ID NO: 462846 - RNA, 64 nt, hsa; identical to SEQ ID NO: 169127

SEQ ID NO: 462847 - RNA, 64 nt, hsa; identical to SEQ ID NO: 169128

SEQ ID NO: 462848 - RNA, 64 nt, hsa; identical to SEQ ID NO: 169129

SEQ ID NO: 462849 - RNA, 64 nt, hsa; identical to SEQ ID NO: 169130

SEQ ID NO: 462850 - RNA, 64 nt, hsa; identical to SEQ ID NO: 169131

SEQ ID NO: 462851 - RNA, 64 nt, hsa; identical to SEQ ID NO: 169132

SEQ ID NO: 462852 - RNA, 64 nt, hsa; identical to SEQ ID NO: 169133

SEQ ID NO: 462853 - RNA, 64 nt, hsa; identical to SEQ ID NO: 169134

SEQ ID NO: 462854 - RNA, 64 nt, hsa; identical to SEQ ID NO: 169135

SEQ ID NO: 462855 - RNA, 64 nt, hsa; identical to SEQ ID NO: 169136

SEQ ID NO: 462856 - RNA, 64 nt, hsa; identical to SEQ ID NO: 169137

SEQ ID NO: 462857 - RNA, 64 nt, hsa; identical to SEQ ID NO: 169138

SEQ ID NO: 462858 - RNA, 64 nt, hsa; identical to SEQ ID NO: 169139

SEQ ID NO: 462859 - RNA, 64 nt, hsa; identical to SEQ ID NO: 169140

SEQ ID NO: 462860 - RNA, 64 nt, hsa; identical to SEQ ID NO: 169141

SEQ ID NO: 462861 - RNA, 64 nt, hsa; identical to SEQ ID NO: 169142

SEQ ID NO: 462862 - RNA, 64 nt, hsa; identical to SEQ ID NO: 169143

SEQ ID NO: 462863 - RNA, 64 nt, hsa; identical to SEQ ID NO: 169144

SEQ ID NO: 462864 - RNA, 64 nt, hsa; identical to SEQ ID NO: 169145

SEQ ID NO: 462865 - RNA, 64 nt, hsa; identical to SEQ ID NO: 169146

SEQ ID NO: 462866 - RNA, 64 nt, hsa; identical to SEQ ID NO: 169147

SEQ ID NO: 462867 - RNA, 64 nt, hsa; identical to SEQ ID NO: 169148

SEQ ID NO: 462868 - RNA, 64 nt, hsa; identical to SEQ ID NO: 169149

SEQ ID NO: 462869 - RNA, 64 nt, hsa; identical to SEQ ID NO: 169150

SEQ ID NO: 462870 - RNA, 64 nt, hsa; identical to SEQ ID NO: 169151

SEQ ID NO: 462871 - RNA, 64 nt, hsa; identical to SEQ ID NO: 169152

SEQ ID NO: 462872 - RNA, 64 nt, hsa; identical to SEQ ID NO: 169153

SEQ ID NO: 462873 - RNA, 64 nt, hsa; identical to SEQ ID NO: 169154

SEQ ID NO: 462874 - RNA, 64 nt, hsa; identical to SEQ ID NO: 169155

SEQ ID NO: 462875 - RNA, 64 nt, hsa; identical to SEQ ID NO: 169156

SEQ ID NO: 462876 - RNA, 64 nt, hsa
ucuuauuaagacuuauauaauaagugcauguaggaauugcaaaaaauauuuuaaaaauuuauua

SEQ ID NO: 462877 - RNA, 64 nt, hsa
aaugaacugauacuuguuggaauguaugugaacuaauugcaauuauauuagagcauauuacugu

SEQ ID NO: 462878 - RNA, 64 nt, hsa
uaauaaguaauuaucauugguugcuuuucaauauaauugcaaacaaauuaaaaacacaguuaaa

SEQ ID NO: 462879 - RNA, 64 nt, hsa
guagccuuuaagaaggaauuaagaguacacugauaauugcaacuguuucuuauccuaagauuca

SEQ ID NO: 462880 - RNA, 64 nt, hsa
cugucacauguuucuguuucuauaguaauuuagaaauugcaaauaguuaacuuuucaucaugua

SEQ ID NO: 462881 - RNA, 64 nt, hsa
aagucauugccaaggucugauuuuucacacaaaaaauugcaacccccagcauaaauggguuagc

SEQ ID NO: 462882 - RNA, 64 nt, hsa
uuucuuuuuuauuaccagguccauuuugccugacaauugcaaaucagagcauacaaaauaaaac

SEQ ID NO: 462883 - RNA, 64 nt, hsa
gaacugaaauaaaaaauuauggauacguguuuugaauugcaaacuauuccucaggaauuccaau

SEQ ID NO: 462884 - RNA, 64 nt, hsa
aacaaaacugagauaauuuagaaaacaggugcuuaauugcaauaaaauuacuaugaaguauauu

SEQ ID NO: 462885 - RNA, 64 nt, hsa
ugcccacaagaaagaggacacaaguuuugcacaaaauugcaagucacuuccuauuccugcauuu

SEQ ID NO: 462886 - RNA, 64 nt, hsa
uagagauagagaaacagacccaagaaaugugcucaauugcaaugggccacauaccuagaucucc

SEQ ID NO: 462887 - RNA, 64 nt, hsa
aggaauacauuagauaaugacacaaucaaauauaaauugcaagaugucacaggugugaugaagg

SEQ ID NO: 462888 - RNA, 64 nt, hsa
aauuuugucuauugucuuagaauugauugccagaaauugcaagauguaauauaucaaagucagg

SEQ ID NO: 462889 - RNA, 64 nt, hsa
uaagucaacaaaaugcaauaucagucaucagguaaauugcaagcugaggauaaauaauaaaacu

SEQ ID NO: 462890 - RNA, 64 nt, hsa
uaaugggaucuauuuuugcacuggaauaucugagaauugcaaaacuagacaaaaguuucacaac

SEQ ID NO: 462891 - RNA, 64 nt, hsa
aacaauacugggcagccuuuuuuuuuuuuuuuuuaauugcaacaaugcaaaagccaagaaagua

SEQ ID NO: 462892 - RNA, 64 nt, hsa
ccaaaaauagcauacaccuaauguuggguuagggaauugcaauuucuacuuucauagagucaua

SEQ ID NO: 462893 - RNA, 64 nt, hsa
uuuugcuugucauuucuuaauauaacucaacaagaauugcaacauuuguguaccaagcaauaag

SEQ ID NO: 462894 - RNA, 64 nt, hsa
caauaucucuuugaaugacugucuggacaaacacaauugcaaauaagggaagggaaaaaugcuu

SEQ ID NO: 462895 - RNA, 64 nt, hsa
uaagaguuuuaaauacugaauccuuugucuucuaaauugcaauagcuauaaucacaagagcaau

SEQ ID NO: 462896 - RNA, 64 nt, hsa
augcugcaaauuaaaaaccucaaagaagggaaauaauugcaacaaaugggaauugauguugaau

SEQ ID NO: 462897 - RNA, 64 nt, hsa
agaggagugcgcccuucagcagcauguauacaaaaauugcaacgauacagagauuagcauggcc

SEQ ID NO: 462898 - RNA, 64 nt, hsa
auacuaaaccucacaaaguagaggaauccauguaaauugcaaauaaaccacuuucuaauuuuuu

SEQ ID NO: 462899 - RNA, 64 nt, hsa
caccuaauaucaauuuguagguaauguuccugaaaauugcaauacauuucaauuauacuaaacc

SEQ ID NO: 462900 - RNA, 64 nt, hsa
guuucauggauuuuucaucuucuaccguaugugaaauugcaaguguuugaagauuuauaaguac

SEQ ID NO: 462901 - RNA, 64 nt, hsa
aggugccacucaguuuuagccaugucuucacugaaauugcaaaaguacuuuuagggagcaggag

SEQ ID NO: 462902 - RNA, 64 nt, hsa
aggcaagaggccauauauagggcuacaucuuguuaauugcaauuguccaggaagguuuugggca

SEQ ID NO: 462903 - RNA, 64 nt, hsa
cugcagcaguucugaaaugaugcuaugggaaaaaaauugcaaaauauguauuuuuaaaguucau

SEQ ID NO: 462904 - RNA, 64 nt, hsa
ugaaaugaggccuacucuaaagaauucuugaaaaacuuacaagucaagccuagccugauaaucc

SEQ ID NO: 462905 - RNA, 64 nt, hsa
agggaauaguauagacaauaaggaaggaaauaguacuuacaaaugacuccuaagggacugugag

SEQ ID NO: 462906 - RNA, 64 nt, hsa
cucugcaagcuucuugcugaucagaguuccuccuacuuacaacccagggugugaacauguucuc

SEQ ID NO: 462907 - RNA, 64 nt, hsa
gaggaagacaagcauuuuuaaaaaauaaauuuaaacuuacaaacuuuguuugucacaaguggug

SEQ ID NO: 462908 - RNA, 64 nt, hsa
ugucaagagaaaggccaaagauuuguacuuuuucacuuacaaagcacuccuuuuucccuuaaac

SEQ ID NO: 462909 - RNA, 64 nt, hsa
aguagugagcaguuuguauguacagagaaaauggacuuacaaaaacuugcagcaguaguuuguu

SEQ ID NO: 462910 - RNA, 64 nt, hsa
gagcauaugaguaagucacauuucuauuaggacuacuuacaaggacaagguuuccauuuuucca

SEQ ID NO: 462911 - RNA, 64 nt, hsa
aacauuaucuuauuuggaaaauggggaaauuaucacuuacaaguauuuguuuacuaugaaauuu

SEQ ID NO: 462912 - RNA, 64 nt, hsa
uaaaaggaaaggaaggaaggaaaaagcagcuuucacuuacaaaguuucguguaaaaauaucuuu

SEQ ID NO: 462913 - RNA, 64 nt, hsa
aaaaaaacuuuaaugaaagguggaaaauaauuuaacuuacaaugugaaaauacaaugugaaaug

SEQ ID NO: 462914 - RNA, 64 nt, hsa
ucuuccccccccgccccugcagaggaaugaaacuacuuacaacauuuaauuccuuucauaauau

SEQ ID NO: 462915 - RNA, 64 nt, hsa
auuugucucguaaaccuggucugcagaaagucaaacuuacaaaaacuguugugacaaauguuau

SEQ ID NO: 462916 - RNA, 64 nt, hsa; identical to SEQ ID NO: 284290

SEQ ID NO: 462917 - RNA, 64 nt, hsa; identical to SEQ ID NO: 284291

SEQ ID NO: 462918 - RNA, 64 nt, hsa; identical to SEQ ID NO: 284292

SEQ ID NO: 462919 - RNA, 64 nt, hsa; identical to SEQ ID NO: 284293

SEQ ID NO: 462920 - RNA, 64 nt, hsa; identical to SEQ ID NO: 284294

SEQ ID NO: 462921 - RNA, 64 nt, hsa; identical to SEQ ID NO: 284295

SEQ ID NO: 462922 - RNA, 64 nt, hsa; identical to SEQ ID NO: 284296

SEQ ID NO: 462923 - RNA, 64 nt, hsa; identical to SEQ ID NO: 284297

SEQ ID NO: 462924 - RNA, 64 nt, hsa; identical to SEQ ID NO: 284298

SEQ ID NO: 462925 - RNA, 64 nt, hsa; identical to SEQ ID NO: 284299

SEQ ID NO: 462926 - RNA, 64 nt, hsa; identical to SEQ ID NO: 284300

SEQ ID NO: 462927 - RNA, 64 nt, hsa; identical to SEQ ID NO: 284301

SEQ ID NO: 462928 - RNA, 64 nt, hsa; identical to SEQ ID NO: 284302

SEQ ID NO: 462929 - RNA, 64 nt, hsa; identical to SEQ ID NO: 284303

SEQ ID NO: 462930 - RNA, 64 nt, hsa; identical to SEQ ID NO: 284304

SEQ ID NO: 462931 - RNA, 64 nt, hsa; identical to SEQ ID NO: 284305

SEQ ID NO: 462932 - RNA, 64 nt, hsa; identical to SEQ ID NO: 284306

SEQ ID NO: 462933 - RNA, 64 nt, hsa; identical to SEQ ID NO: 284307

SEQ ID NO: 462934 - RNA, 64 nt, hsa; identical to SEQ ID NO: 284308

SEQ ID NO: 462935 - RNA, 64 nt, hsa; identical to SEQ ID NO: 284309

SEQ ID NO: 462936 - RNA, 64 nt, hsa; identical to SEQ ID NO: 284310

SEQ ID NO: 462937 - RNA, 64 nt, hsa; identical to SEQ ID NO: 284311

SEQ ID NO: 462938 - RNA, 64 nt, hsa; identical to SEQ ID NO: 284312

SEQ ID NO: 462939 - RNA, 64 nt, hsa; identical to SEQ ID NO: 284313

SEQ ID NO: 462940 - RNA, 64 nt, hsa; identical to SEQ ID NO: 284314

SEQ ID NO: 462941 - RNA, 64 nt, hsa; identical to SEQ ID NO: 284315

SEQ ID NO: 462942 - RNA, 64 nt, hsa; identical to SEQ ID NO: 284316

SEQ ID NO: 462943 - RNA, 64 nt, hsa; identical to SEQ ID NO: 284317

SEQ ID NO: 462944 - RNA, 64 nt, hsa; identical to SEQ ID NO: 284318

SEQ ID NO: 462945 - RNA, 64 nt, hsa; identical to SEQ ID NO: 284319

SEQ ID NO: 462946 - RNA, 64 nt, hsa; identical to SEQ ID NO: 284320

SEQ ID NO: 462947 - RNA, 64 nt, hsa; identical to SEQ ID NO: 284321

SEQ ID NO: 462948 - RNA, 64 nt, hsa; identical to SEQ ID NO: 284322

SEQ ID NO: 462949 - RNA, 64 nt, hsa; identical to SEQ ID NO: 284323

SEQ ID NO: 462950 - RNA, 64 nt, hsa; identical to SEQ ID NO: 284324

SEQ ID NO: 462951 - RNA, 64 nt, hsa; identical to SEQ ID NO: 284325

SEQ ID NO: 462952 - RNA, 64 nt, hsa; identical to SEQ ID NO: 284326

SEQ ID NO: 462953 - RNA, 64 nt, hsa; identical to SEQ ID NO: 284327

SEQ ID NO: 462954 - RNA, 64 nt, hsa; identical to SEQ ID NO: 284328

SEQ ID NO: 462955 - RNA, 64 nt, hsa; identical to SEQ ID NO: 284329

SEQ ID NO: 462956 - RNA, 64 nt, hsa; identical to SEQ ID NO: 284330

SEQ ID NO: 462957 - RNA, 64 nt, hsa; identical to SEQ ID NO: 284331

SEQ ID NO: 462958 - RNA, 64 nt, hsa; identical to SEQ ID NO: 284332

SEQ ID NO: 462959 - RNA, 64 nt, hsa; identical to SEQ ID NO: 284333

SEQ ID NO: 462960 - RNA, 50 nt, hsa; identical to SEQ ID NO: 284334

SEQ ID NO: 462961 - RNA, 64 nt, hsa; identical to SEQ ID NO: 284335

SEQ ID NO: 462962 - RNA, 64 nt, hsa; identical to SEQ ID NO: 284336

SEQ ID NO: 462963 - RNA, 64 nt, hsa; identical to SEQ ID NO: 284337

SEQ ID NO: 462964 - RNA, 64 nt, hsa; identical to SEQ ID NO: 284338

SEQ ID NO: 462965 - RNA, 64 nt, hsa; identical to SEQ ID NO: 284339

SEQ ID NO: 462966 - RNA, 64 nt, hsa; identical to SEQ ID NO: 284340

SEQ ID NO: 462967 - RNA, 64 nt, hsa; identical to SEQ ID NO: 284341

SEQ ID NO: 462968 - RNA, 64 nt, hsa; identical to SEQ ID NO: 284342

SEQ ID NO: 462969 - RNA, 64 nt, hsa; identical to SEQ ID NO: 284343

SEQ ID NO: 462970 - RNA, 64 nt, hsa; identical to SEQ ID NO: 284344

SEQ ID NO: 462971 - RNA, 64 nt, hsa; identical to SEQ ID NO: 284345

SEQ ID NO: 462972 - RNA, 64 nt, hsa; identical to SEQ ID NO: 284346

SEQ ID NO: 462973 - RNA, 64 nt, hsa; identical to SEQ ID NO: 284347

SEQ ID NO: 462974 - RNA, 64 nt, hsa; identical to SEQ ID NO: 284348

SEQ ID NO: 462975 - RNA, 64 nt, hsa; identical to SEQ ID NO: 284349

SEQ ID NO: 462976 - RNA, 64 nt, hsa; identical to SEQ ID NO: 284350

SEQ ID NO: 462977 - RNA, 64 nt, hsa; identical to SEQ ID NO: 284351

SEQ ID NO: 462978 - RNA, 64 nt, hsa; identical to SEQ ID NO: 284352

SEQ ID NO: 462979 - RNA, 64 nt, hsa; identical to SEQ ID NO: 284353

SEQ ID NO: 462980 - RNA, 64 nt, hsa
aacugagaaccuagucucguauauucugaguaaauggaaucaguccugggaauagagagugucc

SEQ ID NO: 462981 - RNA, 64 nt, hsa
ugaaucauuugucuaagagguacauucuuccagauggaaucaauaacuuuuuuuuuuccagguu

SEQ ID NO: 462982 - RNA, 64 nt, hsa
cauuugcccuguggauuccagcauuugccauuccuggaaucaaggaauccugagucugggcaau

SEQ ID NO: 462983 - RNA, 64 nt, hsa
uuuuaguuuguuuuacaaauuuuuccugcaaaaguggaaucacuguauuuucauuuuaauuuau

SEQ ID NO: 462984 - RNA, 64 nt, hsa
caucccuuacuggucucaaccaaaauauuccuguuggaaucaugaugauaaucauagcagcacu

SEQ ID NO: 462985 - RNA, 64 nt, hsa
uguacugcuuaugguuguaggauucagggguuaauggaaucacagaaaugauauucugcaagaa

SEQ ID NO: 462986 - RNA, 64 nt, hsa
cucuagacuagacugauugaaguagacagugugguggaaucaguuuaaucagaaaaagacauac

SEQ ID NO: 462987 - RNA, 64 nt, hsa
uucauuaaaugucauauucuuacaacagugacauuggaaucauuuccauaggagguaauuucca

SEQ ID NO: 462988 - RNA, 64 nt, hsa
cagggucaaaguguuuucucugaacacauugaguuggaaucacuguuuagaacacacacacuua

SEQ ID NO: 462989 - RNA, 64 nt, hsa
aaccaaagaagaaaguccacccuugguuccuaacuggaaucagcucaggacugccauuggacua

SEQ ID NO: 462990 - RNA, 64 nt, hsa
augaucugggagagucucacuuuggaaucagaauuggaaucacauucuguuuaucaagccauaa

SEQ ID NO: 462991 - RNA, 64 nt, hsa
gagaagacauggaugaucugggagagucucacuuuggaaucagaauuggaaucacauucuguuu

SEQ ID NO: 462992 - RNA, 64 nt, hsa
guaacugugugagauugugaaguggucugaauucuggaaucacaaaccaagccaugcugguggg

SEQ ID NO: 462993 - RNA, 64 nt, hsa
aggcgcuuucagggcacuguaauuucaacaauacuggaaucauuuuggcgcugcuucucauuca

SEQ ID NO: 462994 - RNA, 64 nt, hsa
aaauuauucaugauacacuguuaaaacccaaucuuggaaucaaauauuuuuuccaggggugaga

SEQ ID NO: 462995 - RNA, 64 nt, hsa; identical to SEQ ID NO: 133159

SEQ ID NO: 462996 - RNA, 64 nt, hsa; identical to SEQ ID NO: 133160

SEQ ID NO: 462997 - RNA, 64 nt, hsa; identical to SEQ ID NO: 133161

SEQ ID NO: 462998 - RNA, 64 nt, hsa; identical to SEQ ID NO: 133162

SEQ ID NO: 462999 - RNA, 64 nt, hsa; identical to SEQ ID NO: 133163

SEQ ID NO: 463000 - RNA, 64 nt, hsa; identical to SEQ ID NO: 133164

SEQ ID NO: 463001 - RNA, 64 nt, hsa; identical to SEQ ID NO: 133165

SEQ ID NO: 463002 - RNA, 64 nt, hsa; identical to SEQ ID NO: 133166

SEQ ID NO: 463003 - RNA, 64 nt, hsa; identical to SEQ ID NO: 133167

SEQ ID NO: 463004 - RNA, 64 nt, hsa; identical to SEQ ID NO: 133168

SEQ ID NO: 463005 - RNA, 64 nt, hsa; identical to SEQ ID NO: 133169

SEQ ID NO: 463006 - RNA, 64 nt, hsa; identical to SEQ ID NO: 133170

SEQ ID NO: 463007 - RNA, 64 nt, hsa; identical to SEQ ID NO: 133171

SEQ ID NO: 463008 - RNA, 64 nt, hsa; identical to SEQ ID NO: 133172

SEQ ID NO: 463009 - RNA, 64 nt, hsa; identical to SEQ ID NO: 133173

SEQ ID NO: 463010 - RNA, 64 nt, hsa; identical to SEQ ID NO: 133174

SEQ ID NO: 463011 - RNA, 64 nt, hsa; identical to SEQ ID NO: 133175

SEQ ID NO: 463012 - RNA, 64 nt, hsa; identical to SEQ ID NO: 133176

SEQ ID NO: 463013 - RNA, 64 nt, hsa; identical to SEQ ID NO: 133177

SEQ ID NO: 463014 - RNA, 64 nt, hsa; identical to SEQ ID NO: 133178

SEQ ID NO: 463015 - RNA, 64 nt, hsa; identical to SEQ ID NO: 133179

SEQ ID NO: 463016 - RNA, 64 nt, hsa; identical to SEQ ID NO: 133180

SEQ ID NO: 463017 - RNA, 64 nt, hsa; identical to SEQ ID NO: 133181

SEQ ID NO: 463018 - RNA, 64 nt, hsa; identical to SEQ ID NO: 133182

SEQ ID NO: 463019 - RNA, 64 nt, hsa; identical to SEQ ID NO: 133183

SEQ ID NO: 463020 - RNA, 64 nt, hsa; identical to SEQ ID NO: 133184

SEQ ID NO: 463021 - RNA, 64 nt, hsa; identical to SEQ ID NO: 133185

SEQ ID NO: 463022 - RNA, 64 nt, hsa; identical to SEQ ID NO: 133186

SEQ ID NO: 463023 - RNA, 64 nt, hsa; identical to SEQ ID NO: 133187

SEQ ID NO: 463024 - RNA, 64 nt, hsa; identical to SEQ ID NO: 133188

SEQ ID NO: 463025 - RNA, 64 nt, hsa; identical to SEQ ID NO: 133189

SEQ ID NO: 463026 - RNA, 64 nt, hsa; identical to SEQ ID NO: 133190

SEQ ID NO: 463027 - RNA, 64 nt, hsa; identical to SEQ ID NO: 133191

SEQ ID NO: 463028 - RNA, 64 nt, hsa; identical to SEQ ID NO: 133192

SEQ ID NO: 463029 - RNA, 64 nt, hsa; identical to SEQ ID NO: 133193

SEQ ID NO: 463030 - RNA, 64 nt, hsa; identical to SEQ ID NO: 133194

SEQ ID NO: 463031 - RNA, 64 nt, hsa; identical to SEQ ID NO: 133195

SEQ ID NO: 463032 - RNA, 64 nt, hsa; identical to SEQ ID NO: 133196

SEQ ID NO: 463033 - RNA, 64 nt, hsa; identical to SEQ ID NO: 133197

SEQ ID NO: 463034 - RNA, 64 nt, hsa; identical to SEQ ID NO: 133198

SEQ ID NO: 463035 - RNA, 64 nt, hsa; identical to SEQ ID NO: 133199

SEQ ID NO: 463036 - RNA, 64 nt, hsa; identical to SEQ ID NO: 133200

SEQ ID NO: 463037 - RNA, 64 nt, hsa; identical to SEQ ID NO: 133201

SEQ ID NO: 463038 - RNA, 64 nt, hsa; identical to SEQ ID NO: 133202

SEQ ID NO: 463039 - RNA, 64 nt, hsa; identical to SEQ ID NO: 133203

SEQ ID NO: 463040 - RNA, 64 nt, hsa
uuacugucgguuuauugggguauuaaaugcauucucagcuuacaauauuuuugacuuacaauug

SEQ ID NO: 463041 - RNA, 64 nt, hsa
auuuuguauccugagacuuugcugaaguugcuuaucagcuuaaggagauuuugggcugagacaa

SEQ ID NO: 463042 - RNA, 64 nt, hsa
uacacuauuggauuuuuuauuuccuuuuuuugauucagcuuauacccgggcugaaaaccucaau

SEQ ID NO: 463043 - RNA, 64 nt, hsa
uucauaacauagauacugacaugauaggaagcucucagcuuagggaaagagaauaaauuuuaga

SEQ ID NO: 463044 - RNA, 64 nt, hsa; identical to SEQ ID NO: 133159

SEQ ID NO: 463045 - RNA, 64 nt, hsa; identical to SEQ ID NO: 133160

SEQ ID NO: 463046 - RNA, 64 nt, hsa; identical to SEQ ID NO: 133161

SEQ ID NO: 463047 - RNA, 64 nt, hsa; identical to SEQ ID NO: 133162

SEQ ID NO: 463048 - RNA, 64 nt, hsa; identical to SEQ ID NO: 133163

SEQ ID NO: 463049 - RNA, 64 nt, hsa; identical to SEQ ID NO: 133164

SEQ ID NO: 463050 - RNA, 64 nt, hsa; identical to SEQ ID NO: 133165

SEQ ID NO: 463051 - RNA, 64 nt, hsa; identical to SEQ ID NO: 133166

SEQ ID NO: 463052 - RNA, 64 nt, hsa; identical to SEQ ID NO: 133167

SEQ ID NO: 463053 - RNA, 64 nt, hsa; identical to SEQ ID NO: 133168

SEQ ID NO: 463054 - RNA, 64 nt, hsa; identical to SEQ ID NO: 133169

SEQ ID NO: 463055 - RNA, 64 nt, hsa; identical to SEQ ID NO: 133170

SEQ ID NO: 463056 - RNA, 64 nt, hsa; identical to SEQ ID NO: 133171

SEQ ID NO: 463057 - RNA, 64 nt, hsa; identical to SEQ ID NO: 133172

SEQ ID NO: 463058 - RNA, 64 nt, hsa; identical to SEQ ID NO: 133173

SEQ ID NO: 463059 - RNA, 64 nt, hsa; identical to SEQ ID NO: 133174

SEQ ID NO: 463060 - RNA, 64 nt, hsa; identical to SEQ ID NO: 133175

SEQ ID NO: 463061 - RNA, 64 nt, hsa; identical to SEQ ID NO: 133176

SEQ ID NO: 463062 - RNA, 64 nt, hsa; identical to SEQ ID NO: 133177

SEQ ID NO: 463063 - RNA, 64 nt, hsa; identical to SEQ ID NO: 133178

SEQ ID NO: 463064 - RNA, 64 nt, hsa; identical to SEQ ID NO: 133179

SEQ ID NO: 463065 - RNA, 64 nt, hsa; identical to SEQ ID NO: 133180

SEQ ID NO: 463066 - RNA, 64 nt, hsa; identical to SEQ ID NO: 133181

SEQ ID NO: 463067 - RNA, 64 nt, hsa; identical to SEQ ID NO: 133182

SEQ ID NO: 463068 - RNA, 64 nt, hsa; identical to SEQ ID NO: 133183

SEQ ID NO: 463069 - RNA, 64 nt, hsa; identical to SEQ ID NO: 133184

SEQ ID NO: 463070 - RNA, 64 nt, hsa; identical to SEQ ID NO: 133185

SEQ ID NO: 463071 - RNA, 64 nt, hsa; identical to SEQ ID NO: 133186

SEQ ID NO: 463072 - RNA, 64 nt, hsa; identical to SEQ ID NO: 133187

SEQ ID NO: 463073 - RNA, 64 nt, hsa; identical to SEQ ID NO: 133188

SEQ ID NO: 463074 - RNA, 64 nt, hsa; identical to SEQ ID NO: 133189

SEQ ID NO: 463075 - RNA, 64 nt, hsa; identical to SEQ ID NO: 133190

SEQ ID NO: 463076 - RNA, 64 nt, hsa; identical to SEQ ID NO: 133191

SEQ ID NO: 463077 - RNA, 64 nt, hsa; identical to SEQ ID NO: 133192

SEQ ID NO: 463078 - RNA, 64 nt, hsa; identical to SEQ ID NO: 133193

SEQ ID NO: 463079 - RNA, 64 nt, hsa; identical to SEQ ID NO: 133194

SEQ ID NO: 463080 - RNA, 64 nt, hsa; identical to SEQ ID NO: 133195

SEQ ID NO: 463081 - RNA, 64 nt, hsa; identical to SEQ ID NO: 133196

SEQ ID NO: 463082 - RNA, 64 nt, hsa; identical to SEQ ID NO: 133197

SEQ ID NO: 463083 - RNA, 64 nt, hsa; identical to SEQ ID NO: 133198

SEQ ID NO: 463084 - RNA, 64 nt, hsa; identical to SEQ ID NO: 133199

SEQ ID NO: 463085 - RNA, 64 nt, hsa; identical to SEQ ID NO: 133200

SEQ ID NO: 463086 - RNA, 64 nt, hsa; identical to SEQ ID NO: 133201

SEQ ID NO: 463087 - RNA, 64 nt, hsa; identical to SEQ ID NO: 133202

SEQ ID NO: 463088 - RNA, 64 nt, hsa; identical to SEQ ID NO: 133203

SEQ ID NO: 463089 - RNA, 64 nt, hsa; identical to SEQ ID NO: 110824

SEQ ID NO: 463090 - RNA, 64 nt, hsa; identical to SEQ ID NO: 110825

SEQ ID NO: 463091 - RNA, 64 nt, hsa; identical to SEQ ID NO: 110826

SEQ ID NO: 463092 - RNA, 64 nt, hsa; identical to SEQ ID NO: 110827

SEQ ID NO: 463093 - RNA, 64 nt, hsa; identical to SEQ ID NO: 110828

SEQ ID NO: 463094 - RNA, 64 nt, hsa; identical to SEQ ID NO: 110829

SEQ ID NO: 463095 - RNA, 64 nt, hsa; identical to SEQ ID NO: 110830

SEQ ID NO: 463096 - RNA, 64 nt, hsa; identical to SEQ ID NO: 110831

SEQ ID NO: 463097 - RNA, 64 nt, hsa; identical to SEQ ID NO: 110832

SEQ ID NO: 463098 - RNA, 64 nt, hsa; identical to SEQ ID NO: 110833

SEQ ID NO: 463099 - RNA, 64 nt, hsa
acaaaccccacauuauuccaguuuggaauuacuuauuaaggagaauuggaaauacauaugccca

SEQ ID NO: 463100 - RNA, 64 nt, hsa
ucucaaauugaaacuuuucugcacaaagaauaaaauuaaggauuuuauaaacucaaauuggcac

SEQ ID NO: 463101 - RNA, 64 nt, hsa
uuucuauauuguauguauguauauaaauacauagauuaaggaaauaggaaacugaaacucugug

SEQ ID NO: 463102 - RNA, 64 nt, hsa
ggguugcugguaguuaauuggauuuaauauuuguauuaaggauuaacuggaaaaaaugugucuc

SEQ ID NO: 463103 - RNA, 64 nt, hsa
auauaagugaauuuugugcucuuguuuguauuuuauuaaggaaaaugaaaauaaucuggcauca

SEQ ID NO: 463104 - RNA, 64 nt, hsa
cuuucggagucaaggaaagccuuucuauaagcaaauuaaggaagaaaagguaggauuauaagau

SEQ ID NO: 463105 - RNA, 64 nt, hsa
uuguguuugaauauuguagguagaugcauuuguaauuaaggauaauaucguuuaacaacaugua

SEQ ID NO: 463106 - RNA, 64 nt, hsa
cuuaaaaaaaucaauuuaaugcccuaacucucuuauuaaggagaaauagaaaagaagaaauuua

SEQ ID NO: 463107 - RNA, 64 nt, hsa
auuuggaaaauuugggagaaaucuaaucaugccuauuaaggauguaagacauuacagccuuaga

SEQ ID NO: 463108 - RNA, 64 nt, hsa
agcuuuaaaauaauuuuuuaguaauuauuacaaaauuaaggaaaaucucuauuaccguuaucuu

SEQ ID NO: 463109 - RNA, 64 nt, hsa
gggaaaagaaaagaguaauaauuuuuuuuaaaacauuaaggaauuggaauucagaaagguuacc

SEQ ID NO: 463110 - RNA, 64 nt, hsa
uuuuuugacacuggaaauguucaacuguaguuuuauuaaggaagccaggcaugcaacagauuuu

SEQ ID NO: 463111 - RNA, 64 nt, hsa
ccagugaaguagugacggaagccugaucauagacauuaaggaaagcgguguagguguugugagc

SEQ ID NO: 463112 - RNA, 64 nt, hsa
aaaccucacugagcauguucagagaauuccucucauuaaggaaauauuuuuccccacaauuguc

SEQ ID NO: 463113 - RNA, 64 nt, hsa
guguggcugcaaauuucccucugaagcugacacaauuaaggaugaauuaccauaacaucuucau

SEQ ID NO: 463114 - RNA, 64 nt, hsa; identical to SEQ ID NO: 332815

SEQ ID NO: 463115 - RNA, 64 nt, hsa; identical to SEQ ID NO: 332816

SEQ ID NO: 463116 - RNA, 64 nt, hsa; identical to SEQ ID NO: 332817

SEQ ID NO: 463117 - RNA, 64 nt, hsa; identical to SEQ ID NO: 332818

SEQ ID NO: 463118 - RNA, 64 nt, hsa; identical to SEQ ID NO: 332819

SEQ ID NO: 463119 - RNA, 64 nt, hsa; identical to SEQ ID NO: 332820

SEQ ID NO: 463120 - RNA, 64 nt, hsa; identical to SEQ ID NO: 332821

SEQ ID NO: 463121 - RNA, 64 nt, hsa; identical to SEQ ID NO: 332822

SEQ ID NO: 463122 - RNA, 64 nt, hsa; identical to SEQ ID NO: 332823

SEQ ID NO: 463123 - RNA, 64 nt, hsa; identical to SEQ ID NO: 332824

SEQ ID NO: 463124 - RNA, 64 nt, hsa; identical to SEQ ID NO: 332825

SEQ ID NO: 463125 - RNA, 64 nt, hsa; identical to SEQ ID NO: 332826

SEQ ID NO: 463126 - RNA, 64 nt, hsa
cccgcgcacagcguaggcacccgguguacucuguaaacgggaggagguggggcgaggcagccag

SEQ ID NO: 463127 - RNA, 64 nt, hsa
cuggcacagggacccucgauggagcgaagcccucaaacgggaugcuuucugguauucuaucggg

SEQ ID NO: 463128 - RNA, 64 nt, hsa; identical to SEQ ID NO: 313172

SEQ ID NO: 463129 - RNA, 64 nt, hsa; identical to SEQ ID NO: 313173

SEQ ID NO: 463130 - RNA, 64 nt, hsa; identical to SEQ ID NO: 189516

SEQ ID NO: 463131 - RNA, 64 nt, hsa; identical to SEQ ID NO: 189517

SEQ ID NO: 463132 - RNA, 64 nt, hsa; identical to SEQ ID NO: 101929

SEQ ID NO: 463133 - RNA, 64 nt, hsa; identical to SEQ ID NO: 101930

SEQ ID NO: 463134 - RNA, 64 nt, hsa; identical to SEQ ID NO: 101931

SEQ ID NO: 463135 - RNA, 64 nt, hsa; identical to SEQ ID NO: 101932

SEQ ID NO: 463136 - RNA, 64 nt, hsa; identical to SEQ ID NO: 101933

SEQ ID NO: 463137 - RNA, 64 nt, hsa; identical to SEQ ID NO: 101934

SEQ ID NO: 463138 - RNA, 64 nt, hsa; identical to SEQ ID NO: 101935

SEQ ID NO: 463139 - RNA, 64 nt, hsa; identical to SEQ ID NO: 101936

SEQ ID NO: 463140 - RNA, 64 nt, hsa; identical to SEQ ID NO: 101937

SEQ ID NO: 463141 - RNA, 64 nt, hsa; identical to SEQ ID NO: 101938

SEQ ID NO: 463142 - RNA, 64 nt, hsa; identical to SEQ ID NO: 101939

SEQ ID NO: 463143 - RNA, 64 nt, hsa; identical to SEQ ID NO: 101940

SEQ ID NO: 463144 - RNA, 64 nt, hsa; identical to SEQ ID NO: 101941

SEQ ID NO: 463145 - RNA, 64 nt, hsa; identical to SEQ ID NO: 101942

SEQ ID NO: 463146 - RNA, 64 nt, hsa; identical to SEQ ID NO: 101943

SEQ ID NO: 463147 - RNA, 64 nt, hsa; identical to SEQ ID NO: 101944

SEQ ID NO: 463148 - RNA, 64 nt, hsa; identical to SEQ ID NO: 101945

SEQ ID NO: 463149 - RNA, 64 nt, hsa; identical to SEQ ID NO: 101946

SEQ ID NO: 463150 - RNA, 64 nt, hsa; identical to SEQ ID NO: 101947

SEQ ID NO: 463151 - RNA, 64 nt, hsa; identical to SEQ ID NO: 92469

SEQ ID NO: 463152 - RNA, 64 nt, hsa; identical to SEQ ID NO: 92470

SEQ ID NO: 463153 - RNA, 64 nt, hsa; identical to SEQ ID NO: 92471

SEQ ID NO: 463154 - RNA, 64 nt, hsa; identical to SEQ ID NO: 92472

SEQ ID NO: 463155 - RNA, 64 nt, hsa; identical to SEQ ID NO: 92473

SEQ ID NO: 463156 - RNA, 64 nt, hsa; identical to SEQ ID NO: 92474

SEQ ID NO: 463157 - RNA, 63 nt, hsa; identical to SEQ ID NO: 92475

SEQ ID NO: 463158 - RNA, 64 nt, hsa; identical to SEQ ID NO: 92476

SEQ ID NO: 463159 - RNA, 64 nt, hsa; identical to SEQ ID NO: 92477

SEQ ID NO: 463160 - RNA, 64 nt, hsa; identical to SEQ ID NO: 92478

SEQ ID NO: 463161 - RNA, 64 nt, hsa; identical to SEQ ID NO: 92479

SEQ ID NO: 463162 - RNA, 64 nt, hsa; identical to SEQ ID NO: 92480

SEQ ID NO: 463163 - RNA, 64 nt, hsa; identical to SEQ ID NO: 92481

SEQ ID NO: 463164 - RNA, 64 nt, hsa; identical to SEQ ID NO: 92482

SEQ ID NO: 463165 - RNA, 64 nt, hsa; identical to SEQ ID NO: 92483

SEQ ID NO: 463166 - RNA, 64 nt, hsa; identical to SEQ ID NO: 92484

SEQ ID NO: 463167 - RNA, 64 nt, hsa; identical to SEQ ID NO: 92485

SEQ ID NO: 463168 - RNA, 64 nt, hsa; identical to SEQ ID NO: 92486

SEQ ID NO: 463169 - RNA, 64 nt, hsa; identical to SEQ ID NO: 92487

SEQ ID NO: 463170 - RNA, 64 nt, hsa; identical to SEQ ID NO: 92488

SEQ ID NO: 463171 - RNA, 64 nt, hsa; identical to SEQ ID NO: 92489

SEQ ID NO: 463172 - RNA, 64 nt, hsa; identical to SEQ ID NO: 92490

SEQ ID NO: 463173 - RNA, 64 nt, hsa; identical to SEQ ID NO: 92491

SEQ ID NO: 463174 - RNA, 64 nt, hsa; identical to SEQ ID NO: 92492

SEQ ID NO: 463175 - RNA, 64 nt, hsa; identical to SEQ ID NO: 92493

SEQ ID NO: 463176 - RNA, 64 nt, hsa; identical to SEQ ID NO: 92494

SEQ ID NO: 463177 - RNA, 64 nt, hsa; identical to SEQ ID NO: 92495

SEQ ID NO: 463178 - RNA, 64 nt, hsa; identical to SEQ ID NO: 92496

SEQ ID NO: 463179 - RNA, 64 nt, hsa; identical to SEQ ID NO: 92497

SEQ ID NO: 463180 - RNA, 64 nt, hsa; identical to SEQ ID NO: 92498

SEQ ID NO: 463181 - RNA, 64 nt, hsa; identical to SEQ ID NO: 92499

SEQ ID NO: 463182 - RNA, 64 nt, hsa; identical to SEQ ID NO: 92500

SEQ ID NO: 463183 - RNA, 64 nt, hsa; identical to SEQ ID NO: 92501

SEQ ID NO: 463184 - RNA, 64 nt, hsa; identical to SEQ ID NO: 92502

SEQ ID NO: 463185 - RNA, 64 nt, hsa; identical to SEQ ID NO: 92503

SEQ ID NO: 463186 - RNA, 64 nt, hsa; identical to SEQ ID NO: 92504

SEQ ID NO: 463187 - RNA, 64 nt, hsa; identical to SEQ ID NO: 92505

SEQ ID NO: 463188 - RNA, 64 nt, hsa; identical to SEQ ID NO: 92506

SEQ ID NO: 463189 - RNA, 64 nt, hsa; identical to SEQ ID NO: 92507

SEQ ID NO: 463190 - RNA, 64 nt, hsa; identical to SEQ ID NO: 92508

SEQ ID NO: 463191 - RNA, 64 nt, hsa; identical to SEQ ID NO: 92509

SEQ ID NO: 463192 - RNA, 64 nt, hsa; identical to SEQ ID NO: 92510

SEQ ID NO: 463193 - RNA, 64 nt, hsa; identical to SEQ ID NO: 92511

SEQ ID NO: 463194 - RNA, 64 nt, hsa; identical to SEQ ID NO: 92512

SEQ ID NO: 463195 - RNA, 64 nt, hsa; identical to SEQ ID NO: 92513

SEQ ID NO: 463196 - RNA, 64 nt, hsa; identical to SEQ ID NO: 92514

SEQ ID NO: 463197 - RNA, 64 nt, hsa; identical to SEQ ID NO: 92515

SEQ ID NO: 463198 - RNA, 64 nt, hsa; identical to SEQ ID NO: 92516

SEQ ID NO: 463199 - RNA, 64 nt, hsa; identical to SEQ ID NO: 92517

SEQ ID NO: 463200 - RNA, 64 nt, hsa; identical to SEQ ID NO: 92518

SEQ ID NO: 463201 - RNA, 64 nt, hsa
gaucacuggagcccaggaguuugaggcugcagcgagcuaugaucgcgccacuacacuccagccu

SEQ ID NO: 463202 - RNA, 64 nt, hsa
ggcuauauugaaucucuguaugcacugagaacugagcuaugaagaggaucuuauuaaacugcug

SEQ ID NO: 463203 - RNA, 64 nt, hsa
uuaaaaaaaaaaaaaaacuacucuugaucacauuagcuaugaggcgaggucaaauucagguauc

SEQ ID NO: 463204 - RNA, 64 nt, hsa
cguucuccagacucuagauguuuagaugagguugagcuaugauaugugcuuguguguaugucua

SEQ ID NO: 463205 - RNA, 64 nt, hsa
aaacuuguaaccugguugggacugauauugucauagcuaugauaaacuuuggauauuagcagaa

SEQ ID NO: 463206 - RNA, 64 nt, hsa
gaucacuucagcccaggaguuuaaggcugcagugagcuaugaugaugccacuguacugcagcuu

SEQ ID NO: 463207 - RNA, 64 nt, hsa
gaucacgugagcccaggaguuugaggcugcagcgagcuaugaucacaucacuguacuccagccu

SEQ ID NO: 463208 - RNA, 54 nt, hsa
uucuucugauuuuuaugugaccauagcuaugauguaaagacaauacuguccuuc

SEQ ID NO: 463209 - RNA, 64 nt, hsa
gauugcuugagcccagguauucaagucuggagugagcuaugacugugccacugcacuccagccu

SEQ ID NO: 463210 - RNA, 64 nt, hsa
cucugccuaauugucaaggccuccuuggcucuggagcuaugaaaggccccacuuucaagucacc

SEQ ID NO: 463211 - RNA, 64 nt, hsa
acccaaggggccucuccaugccuucuuaggaagcagcuaugaauccauuguccuuguaguuucu

SEQ ID NO: 463212 - RNA, 64 nt, hsa
gguggggcauguccucauccuuuccugccauaaaagcuaugacacgagaaucagaauauuaaua

SEQ ID NO: 463213 - RNA, 64 nt, hsa
ggcaccugaggccuaucugugccuuagucacuucagcuaugagccaaauguucccuuuccugga

SEQ ID NO: 463214 - RNA, 64 nt, hsa
ugccaagggcaggugaccacuggcaucuaugcuuagcuaugaaagugaauaaagcagaauaaaa

SEQ ID NO: 463215 - RNA, 64 nt, hsa
ucucucucaggcagugaaucgaagcccaaggaugagcuaugacagcguccaggucagacggaug

SEQ ID NO: 463216 - RNA, 64 nt, hsa
uuuugcuuugguuauuguuuuuuucccuuuucuuagcuaugagcugaucauugcuccuucucac

SEQ ID NO: 463217 - RNA, 64 nt, hsa
uacagaauccguccuuucauuucaacuuauagcaagcuaugauuuuuauauauaaauauuauau

SEQ ID NO: 463218 - RNA, 64 nt, hsa
auuaguuuacgaaccacaaaauugcaaauaaauaagcuaugaacuuugauguacacuauaaauc

SEQ ID NO: 463219 - RNA, 64 nt, hsa
gauggcuugagcccaagaguuugaagcugcagugagcuaugaucagcugcaauccacccugggu

SEQ ID NO: 463220 - RNA, 64 nt, hsa
acuguagacucagaucccaauaaagugcuguugcagcuaugaugcuaggugguuucuaagcaca

SEQ ID NO: 463221 - RNA, 64 nt, hsa
guaccaguuauucuuucugcaucuuguagaauucagcuaugaauccaucuggucuagggcuuuu

SEQ ID NO: 463222 - RNA, 64 nt, hsa
uuucuugcucuagaagagcaguauucaaccuuuuagcuaugaugacacauaacaaaagaugcuu

SEQ ID NO: 463223 - RNA, 64 nt, hsa
cugagaauuccaaaaguauauuaaaaaagaagauagcuaugaguucagaucuaucuuauugguc

SEQ ID NO: 463224 - RNA, 64 nt, hsa
ucuuagccucuugacgcuggaaguguggauuuauagcuaugaaaccacugcuggcagugggugg

SEQ ID NO: 463225 - RNA, 64 nt, hsa
uaaaaccugcaaagcuaaaauugaacuacuugggagcuaugauccacaaaaacaacuuauuauu

SEQ ID NO: 463226 - RNA, 64 nt, hsa
uaaagauguuccccauggguuuugauugugucuaagcuaugaugaccuucauauaaucagcaua

SEQ ID NO: 463227 - RNA, 64 nt, hsa
caguagagacaagcgggaaggauaauuagcugaaagcuaugaugauauaaauaaaaacagcucu

SEQ ID NO: 463228 - RNA, 64 nt, hsa
ccccaacuuuccuggagcccgaggccucauccauagcuaugaucacuugcccucugaagcuuau

SEQ ID NO: 463229 - RNA, 64 nt, hsa
uuacuugagucuuguacauacauacuuuuuuaugagcuaugaaauaaaacauuuuaaacugaau

SEQ ID NO: 463230 - RNA, 64 nt, hsa
ggcccauuaguuuuggggauggggcacagggcauagcuaugacuuugcuuucugguuggagccu

SEQ ID NO: 463231 - RNA, 64 nt, hsa
augcacugaugagucuaguuucauuauagcacgaagcuaugagaauaacuucagucacucccuu

SEQ ID NO: 463232 - RNA, 64 nt, hsa
ugagcugaacuggguuguguuaacacauugguagagcuaugauuccuucccaguucuaagagau

SEQ ID NO: 463233 - RNA, 64 nt, hsa
gaugucagauuuagauucuuccuggggauuacacagcuaugaauguauuugcuucuaaaaccuc

SEQ ID NO: 463234 - RNA, 64 nt, hsa
ugguggcaauaaauaccagacacguacaaaauccagcuaugaauauagagggcuuaugauucag

SEQ ID NO: 463235 - RNA, 64 nt, hsa
aaauggagcugaauuugauaaaaacccaaaauacagcuaugaagugcugggcaaguuuacuuuu

SEQ ID NO: 463236 - RNA, 64 nt, hsa
aacuuaaguguggaaugcauuauaugggcaaagaagcuaugaagauacaugauacacuuuguac

SEQ ID NO: 463237 - RNA, 64 nt, hsa
gacaaguucagcauguugcagauugggaauagugagcuaugagaagagauuuagagccuagaug

SEQ ID NO: 463238 - RNA, 64 nt, hsa
acacaagaaaucuggcuuggccaggauuggcacuagcuaugaagggcugagcgagucacauuaa

SEQ ID NO: 463239 - RNA, 64 nt, hsa
ucccuuggccuggguccuccuggugagucauuggagcuaugaaggggaaggggucguaucacuu

SEQ ID NO: 463240 - RNA, 64 nt, hsa
uuaccguuuaugauacuaacaguuccugagacuuagcuaugaucaguauguucaugagguggag

SEQ ID NO: 463241 - RNA, 64 nt, hsa
cauugcuugagcuugggagaucgaggcuacagugagcuaugauuacaccacugcacuucagucu

SEQ ID NO: 463242 - RNA, 64 nt, hsa
ugccuuuuuaccuggaauuuuugcuuacagccguagcuaugaauauauauagggugguccccag

SEQ ID NO: 463243 - RNA, 64 nt, hsa
gccuucaucuucccccacccccauuugcugguucagcuaugauucagguaggcucugcccuggg

SEQ ID NO: 463244 - RNA, 64 nt, hsa
uuuauuccugguuggcuagaacugggugaccaacagcuaugaaacaaauuucagcuguuugaag

SEQ ID NO: 463245 - RNA, 64 nt, hsa
cagcucuaguucauugugauauuuauaauuugaaagcuaugagaauagaugugugggugaagcc

SEQ ID NO: 463246 - RNA, 64 nt, hsa
aaucgcuugagccccaggcuucgaggcugcagugagcuaugauuacgacacugcacuccagccu

SEQ ID NO: 463247 - RNA, 64 nt, hsa
uucaagguguguagagaaauaauauggaauuagcagcuaugacuccaacagacaggauugugug

SEQ ID NO: 463248 - RNA, 64 nt, hsa
gcauauuuggcaagcaguucaucaccaggacacuagcuaugauucuagaagucaaaaggugucu

SEQ ID NO: 463249 - RNA, 64 nt, hsa
guuacaacccaguauggugagugccaagacagagagcuaugaacacgauaucuaucugggaaca

SEQ ID NO: 463250 - RNA, 64 nt, hsa
ugaagagccugagaguaaaaagauuaugcugcaaagcuaugauauaaacugcucuugcagucca

SEQ ID NO: 463251 - RNA, 64 nt, hsa
guggugugaaaauguauggaugaauucugaccagagcuaugaaucugguugauggcggcucaca

SEQ ID NO: 463252 - RNA, 64 nt, hsa
gauuuaacuuuuaaaauguuguuuaaaagugugaagcuaugaaaagccugauaaugugacuaca

SEQ ID NO: 463253 - RNA, 64 nt, hsa
auuguuacucauauuuuaaucaguaagucauuuaagcuaugacagaguaggaauugagaaauua

SEQ ID NO: 463254 - RNA, 64 nt, hsa
aauucauauaaacugugauacucacauuccuugaagcuaugagcauuuaaaaacuguuuacagc

SEQ ID NO: 463255 - RNA, 64 nt, hsa
ugguacacauaagaaaaacuagagauuugaaaucagcuaugaauuacucuauauaguaucuaua

SEQ ID NO: 463256 - RNA, 64 nt, hsa
gaaaaagaauauauugccaaauauuaagaagcucagcuaugaaaugaccuccagggaaucagaa

SEQ ID NO: 463257 - RNA, 64 nt, hsa
uuuaguuggaauuauucuaugucaaugauuuuuaagcuaugaaaaauaauaauauaaaaccuua

SEQ ID NO: 463258 - RNA, 64 nt, hsa
cuuuagcugaauuauucuaugucaaugauuuuuaagcuaugaaaaauacaauggggggaaggau

SEQ ID NO: 463259 - RNA, 64 nt, hsa
uuaaacagggaaaguuuaauauaaauaauaauuaagcuaugauaggagaauaauaauaaagaug

SEQ ID NO: 463260 - RNA, 64 nt, hsa
acuuuuuaguuuuaauuuucuuguauauuuugcuagcuaugagcuuuuaaauaaaauugaaagu

SEQ ID NO: 463261 - RNA, 64 nt, hsa
uuaagauacuuauucgacuuaucuuaacuaagguagcuaugaauguuaaguagaugagguaacc

SEQ ID NO: 463262 - RNA, 64 nt, hsa
gagucuuucagaggcaggauccauuuuugcagauagcuaugacuuguggcaaucaggcuucgua

SEQ ID NO: 463263 - RNA, 64 nt, hsa
uucuuuuuuuuuaacuggucagucauucacaauaagcuaugaggguaaauaaauauguguuaua

SEQ ID NO: 463264 - RNA, 64 nt, hsa
agcauuauauaguggugcauuaguuuagaaagucagcuaugauuuugccuauaguucuaguuau

SEQ ID NO: 463265 - RNA, 64 nt, hsa
gcccuugcacagcuggagaaauggcaucauuauaagcuaugaguugaaauguucugucaaaugu

SEQ ID NO: 463266 - RNA, 64 nt, hsa
guucuauggauuccauaauguuacaauggauuuaagcuaugaagccucaaaacaucacgagaua

SEQ ID NO: 463267 - RNA, 64 nt, hsa
aaaacuaugauccuuuauauguguguuuugggggagcuaugauaaguuuuauggcaaacgguug

SEQ ID NO: 463268 - RNA, 64 nt, hsa
aaaucugcagcacauugauaagaugguuuccgugagcuaugauaagauugaaauuccaguugca

SEQ ID NO: 463269 - RNA, 64 nt, hsa
gaggugccuccgggaaggaggcagcgagguagguagcuaugauaggcaccuaaugcuucucaag

SEQ ID NO: 463270 - RNA, 64 nt, hsa
ugagugauccaggguaugaccuagggaaugaacuagcuaugaaauacucaggguuaggaauccu

SEQ ID NO: 463271 - RNA, 64 nt, hsa
gucuugauaguagaugcuucuucagcguaagaguagcuaugauauuccuuuuuaucuuuucagu

SEQ ID NO: 463272 - RNA, 64 nt, hsa
aggaauauuuaaauuacugucauaauucaguuuaagcuaugaacugugugucccaguaggaggu

SEQ ID NO: 463273 - RNA, 64 nt, hsa
ggauucuuccaucugauugugaugugaguugcacagcuaugaaggcuguacacugcacgaaugg

SEQ ID NO: 463274 - RNA, 64 nt, hsa
gauagcuugagcccaggaguucgaggcugcagugagcuaugaucucaccacuacacuccagccu

SEQ ID NO: 463275 - RNA, 64 nt, hsa
gccgcccucugggacugccccucagucccaggagagcuaugaggccucacugggggcagaacuu

SEQ ID NO: 463276 - RNA, 64 nt, hsa
uucugcuuuacagugcugaauuccauauuuuagaagcuaugaaaguccuuuuaugaaaaaguua

SEQ ID NO: 463277 - RNA, 64 nt, hsa
uuugcauuccugguuauauguaaugugauaaauuagcuaugaaugguaaaagaacaaaacugau

SEQ ID NO: 463278 - RNA, 64 nt, hsa
gaaaaaaaugccaauugacacaaagcauuccaguagcuaugaccugccgcccugaccaggauag

SEQ ID NO: 463279 - RNA, 64 nt, hsa
gucuauguuaaaguugcuuuccugcuguuaaauaagcuaugauauuaagauauucugacuugcu

SEQ ID NO: 463280 - RNA, 64 nt, hsa
aguacugagaguaacaugacucaguagccacagaagcuaugauuuguaaaauauauaauugaau

SEQ ID NO: 463281 - RNA, 64 nt, hsa
uuucugacugcuggauucuguaguaaggugacauagcuaugacauuuguuaaaaauaaacucug

SEQ ID NO: 463282 - RNA, 64 nt, hsa
cauccuuuaaauuauaagcauccuuuuugaaaagagcuaugaagguguaugagcccauccuuuu

SEQ ID NO: 463283 - RNA, 64 nt, hsa
ggguucacgagccauuugucucuucggaggagcuagcuaugagaugucugcgaucacaucacgg

SEQ ID NO: 463284 - RNA, 64 nt, hsa
aauugcucaagcccaggaguuugaaguugcaaugagcuaugauuucaccacugcauucuagccu

SEQ ID NO: 463285 - RNA, 64 nt, hsa
ggguuugacugugcuuaccaaugagugguuuuugagcuaugagaaaguggaugggagugggagg

SEQ ID NO: 463286 - RNA, 64 nt, hsa
cucauuuuguaucagagcaauuuugcuugcagaaagcuaugaaauaaaacacgucccuuaacug

SEQ ID NO: 463287 - RNA, 64 nt, hsa
agagcucaccaggcaguaccaaugcucuuuucacagcuaugaagagcuagagaaauucuuguua

SEQ ID NO: 463288 - RNA, 64 nt, hsa
auaaugguauuaacuuuuaagagggaugaaagagagcuaugauguccuaggacugagaguaccc

SEQ ID NO: 463289 - RNA, 64 nt, hsa
ggucugacugacaaauucuguauuaaggugucauagcuaugacauuuguuaaaaauaaacucug

SEQ ID NO: 463290 - RNA, 64 nt, hsa
cuacuggauggcaccugagaugaucaacggccgcagcuaugaugagaagguggauguguucucc

SEQ ID NO: 463291 - RNA, 64 nt, hsa
gaucgcuugaacccaggaguucaagucugcagugagcuaugauugcaccacugcacuccagccu

SEQ ID NO: 463292 - RNA, 64 nt, hsa
gaucccuugagccgaggaguuugagucugcagugagcuaugaucgcaccacugcauuccagacc

SEQ ID NO: 463293 - RNA, 64 nt, hsa
ugucaacacucuacuugcugaccacauuucccagagcuaugacgaugagaggaagacugcgcug

SEQ ID NO: 463294 - RNA, 64 nt, hsa
cguauaaauaguaaaugaguacaucuugauuaaaagcuaugaauucagaauugcuuuuaaauau

SEQ ID NO: 463295 - RNA, 64 nt, hsa
gaucuuccauaauuuuaugguauuacacagggaaagcuaugacugcaggaucagucuaacuaua

SEQ ID NO: 463296 - RNA, 64 nt, hsa
uuugguuaacaucauugaugacaaaauaauaaggagcuaugacuggagucaggagaaguuagug

SEQ ID NO: 463297 - RNA, 64 nt, hsa
cacaaccaggaagaacaaaucugggcauugagcaagcuaugaggguccccgggagcacacgaac

SEQ ID NO: 463298 - RNA, 64 nt, hsa
gaguccgcuugaugaauucuaaugcuuugcuuagagcuaugagaaauguuuguuuuaauaaaaa

SEQ ID NO: 463299 - RNA, 64 nt, hsa
gaucccuugagccuaggagguugaggcugcagugagcuaugaucgcaucaguccacuccagccu

SEQ ID NO: 463300 - RNA, 64 nt, hsa
aaagugagggcagaaguagcugugggaaaagaugagcuaugauaaugcugggaaggcagagauu

SEQ ID NO: 463301 - RNA, 64 nt, hsa
aaucacuugagcccaggaguuugaggcugcagugagcuaugauugcaccacuguacuccugccu

SEQ ID NO: 463302 - RNA, 64 nt, hsa
ucaauacauggacaaaaaguaaaucauugaccaaagcuaugaaauguuucacaaaguuuuccuc

SEQ ID NO: 463303 - RNA, 64 nt, hsa
aaauggugcaugucauugagaacuacuuuaaugcagcuaugaaaagggaaaaaagugcccaguu

SEQ ID NO: 463304 - RNA, 64 nt, hsa
cucuuggauuaaaagguaacuucauucacugauuagcuaugacaugaggguucaggccccuaaa

SEQ ID NO: 463305 - RNA, 64 nt, hsa
uggggcccagccccaaacugggggcucuguauauagcuaugaagaaaacacaaaguguauaaau

SEQ ID NO: 463306 - RNA, 64 nt, hsa
ggugauuuuagauuucuuugauugugaaacagggagcuaugagagauguguccaugugaaauuu

SEQ ID NO: 463307 - RNA, 64 nt, hsa
gauuacuugagcuugggaaaucaagguugcagugagcuaugauuguguggccacacuccauccu

SEQ ID NO: 463308 - RNA, 64 nt, hsa
guggaggaaacuaaacauucccuugauggucucaagcuaugaucagaagacuuuaauuauauau

SEQ ID NO: 463309 - RNA, 64 nt, hsa
aaagucaucuuugaaaugauaaucaagaaacagcagcuaugaagccuugaauuuugaaaaaaag

SEQ ID NO: 463310 - RNA, 64 nt, hsa
uauucuggaaauuugauacggagagaacuuggugagcuaugaauuacucucagucuccuuuuua

SEQ ID NO: 463311 - RNA, 64 nt, hsa
aguggcaccucccucucccugcugacaugaagagagcuaugauaugccacugcugccaacucau

SEQ ID NO: 463312 - RNA, 64 nt, hsa
gaggagcugccuuuuggaggcccccuucaccugcagcuaugaugcccuuccccuucuccccugu

SEQ ID NO: 463313 - RNA, 64 nt, hsa
auacauuuuaauguugaaauuaauauugaauguuagcuaugaaauuuuaguauugaauuuuaua

SEQ ID NO: 463314 - RNA, 64 nt, hsa
uaaggacccuaaaugaacgauaaacagagaugguagcuaugaguauacaaaagguaaauccacu

SEQ ID NO: 463315 - RNA, 64 nt, hsa
agagugaucuuccuaaaacuucacuuaaccccucagcuaugaaaaggcuuccaggaguuuccau

SEQ ID NO: 463316 - RNA, 64 nt, hsa
aaucccccauccucacacccacucaucucugaggagcuaugaacugguuuuggucccucuaaug

SEQ ID NO: 463317 - RNA, 64 nt, hsa
agcuuucucaaugaauacacacauauuuuuacauagcuaugaucguuguguacauucuccuuug

SEQ ID NO: 463318 - RNA, 64 nt, hsa
gggaguagggggcauuccacagggacaacgguuuagcuaugaaauuuggggcccaaaauuucac

SEQ ID NO: 463319 - RNA, 64 nt, hsa
guuugaccuuugaaauuugcaugugaccucaucuagcuaugaauucugggaagucaaugugaaa

SEQ ID NO: 463320 - RNA, 64 nt, hsa
cuucaucuggcugccuuugcaguccuuuuacuacagcuaugaagaaacgcaacaagaaacucaa

SEQ ID NO: 463321 - RNA, 64 nt, hsa
caagccacucucuuuuuaaacagcaacaauuuaaagcuaugaagucaccuggagaaaaggaacg

SEQ ID NO: 463322 - RNA, 64 nt, hsa
cuaauagcucaugcaacucuuucaugaagagcuuagcuaugaccuuagaagacaaagccuguuu

SEQ ID NO: 463323 - RNA, 64 nt, hsa
acaggcuaaccccacucuaugaaucaauagaagaagcuaugaccuuuugcugaaauaucaguua

SEQ ID NO: 463324 - RNA, 64 nt, hsa
uaauuuucuuuugguggaucagcucucauaaaaaagcuaugauuugcucaaauaugcuguugac

SEQ ID NO: 463325 - RNA, 64 nt, hsa
gaucccuugaggccaggaguucaagguuacagugagcuaugauagugccacugcacuccagccu

SEQ ID NO: 463326 - RNA, 64 nt, hsa
gcagaagacagcuccuauaguuuuguauuuuggcagcuaugagauauuuucaugguaaugucaa

SEQ ID NO: 463327 - RNA, 64 nt, hsa
ucucaguuacugagagaggccugugaacaguucuagcuaugaucaugaacauguguuuucuucu

SEQ ID NO: 463328 - RNA, 64 nt, hsa
aacgggguggcauucacuuagggucugacuucacagcuaugacaaaaccgaaaaagcaaaacug

SEQ ID NO: 463329 - RNA, 64 nt, hsa
aguuuugaaaaugaucacuuaccuaaaacuugaaagcuaugaauuaguuauccauacucucaug

SEQ ID NO: 463330 - RNA, 64 nt, hsa
aucacauucccauuugcuuagaaagucugauuguagcuaugauuguccguaggcccauacuaga

SEQ ID NO: 463331 - RNA, 64 nt, hsa
cccccuugaggauuguggaaaaccaggaaaagggagcuaugauuuuuuuuuccaaaacaauuuc

SEQ ID NO: 463332 - RNA, 64 nt, hsa
guaggaaugaacuugccagccuucaggcucguucagcuaugaccaucugugcggucaggguaca

SEQ ID NO: 463333 - RNA, 64 nt, hsa
gaacaaaacgagcaugaauuaacucuucaauauaagcuaugaaguaauaguugguugugaauua

SEQ ID NO: 463334 - RNA, 64 nt, hsa
auuaguuugugugugugugugguggagggaagggagcuaugaguguguguguuguguauggacu

SEQ ID NO: 463335 - RNA, 64 nt, hsa
uucccaaguguggacuccagaggggcuggaggcaagcuaugaacuugcucgcuggcccaccccu

SEQ ID NO: 463336 - RNA, 64 nt, hsa
auucaauuaagugggaauuuucuggaagauggucagcuaugaaguaauagaguuugcuuaauca

SEQ ID NO: 463337 - RNA, 64 nt, hsa
uagagacaggccacuggggucagcauuugagcucagcuaugaucagaaaaaagcaccguugagg

SEQ ID NO: 463338 - RNA, 64 nt, hsa
ucgccccuuccccaccccuuaccagauguuaagcagcuaugaaacauucucuguacuaguucug

SEQ ID NO: 463339 - RNA, 64 nt, hsa
ggucgcuugagcccaggaguuugaggcugcagugagcuaugauugugccacuguacuccagccu

SEQ ID NO: 463340 - RNA, 64 nt, hsa
cuugcucuagagguucaaaggcagcaaggcagugagcuaugagcccagcauggaugugucucag

SEQ ID NO: 463341 - RNA, 64 nt, hsa
uaauaauaauuuuuugucauuugucuuuauguccagcuaugaauguagauuuugugucccgaca

SEQ ID NO: 463342 - RNA, 64 nt, hsa
uagauguucagaagccgcuuccucuccacugaagagcuaugagauacgcacaauacuugcuguu

SEQ ID NO: 463343 - RNA, 64 nt, hsa
gaucacuugagccugggaauucgaagcugcagugagcuaugauugugccacacacuccagccug

SEQ ID NO: 463344 - RNA, 64 nt, hsa
gugaaucuacugaaaucacuauaaugcacauugaagcuaugaugguauuugaguagugagguua

SEQ ID NO: 463345 - RNA, 64 nt, hsa
auauuuuaaauauacuauguuugcgaaccuugguagcuaugaugagagcuauuaucaucugugg

SEQ ID NO: 463346 - RNA, 64 nt, hsa
cuucuggaauauuuuuauguagcucuuggaguacagcuaugaaaauuaacaacuguuaaaggaa

SEQ ID NO: 463347 - RNA, 64 nt, hsa
gauagcuuaagcccaggauuucaaggcugcauugagcuaugauuacaccacugcacuccagccu

SEQ ID NO: 463348 - RNA, 64 nt, hsa
uaaauuuaaagcacagaagaaaugauuuccuucuagcuaugagaauagucaaauugagcuugcc

SEQ ID NO: 463349 - RNA, 64 nt, hsa
uaguccaucgaucuacagggugaucucauuugaaagcuaugauggcauugucgcugaguugaca

SEQ ID NO: 463350 - RNA, 64 nt, hsa
gcuaucaucugcagcuauaaucauagcucacugcagcuaugaucaugucucagcacuccagcuu

SEQ ID NO: 463351 - RNA, 64 nt, hsa
auucaaacaaaccugcuucugccucauuuuccuaagcuaugagaacaauuagagaaacagauuc

SEQ ID NO: 463352 - RNA, 64 nt, hsa
aguaacuuuugugcauauauugaagugguuuuucagcuaugaauucuuuaggguagaaauuuau

SEQ ID NO: 463353 - RNA, 64 nt, hsa
gaggugguuuggcaucuggggccaacuccauuacagcuaugagcucacugcugucagugacguu

SEQ ID NO: 463354 - RNA, 64 nt, hsa
gaauugaaacugugcagucaguagagcugaacuuagcuaugaauuaauuuaaauuaauucuaaa

SEQ ID NO: 463355 - RNA, 64 nt, hsa
cuguguggugguuauaucaaguuugcuuaauaaaagcuaugagacaaauaguccucuaguucca

SEQ ID NO: 463356 - RNA, 64 nt, hsa
uugguuaguagauaucaccgcaaugcccuagaacagcuaugaagcagaauaccauauggccacc

SEQ ID NO: 463357 - RNA, 64 nt, hsa
uuacaauguauguaugauguauaauuuaagggaaagcuaugacuucucaguuucuuagaauccu

SEQ ID NO: 463358 - RNA, 64 nt, hsa
uucacuuccugaaagccagggucgguucaugaaaagcuaugaaacagcaugcuaaaugugaaau

SEQ ID NO: 463359 - RNA, 64 nt, hsa
caaggacauuuucugcagccccuuccucucagugagcuaugauuggagggcuuaggucuggagg

SEQ ID NO: 463360 - RNA, 55 nt, hsa
agaaagaguacuucuucugauuggcagcuaugauuuaacauaaaauuaugauagu

SEQ ID NO: 463361 - RNA, 64 nt, hsa
ccauuagugcucucucugccuggaucccggcagaagcuaugaaagggaauaaagagaaaagaag

SEQ ID NO: 463362 - RNA, 64 nt, hsa
ccccuggagggcauggugucgggggguggcacugagcuaugagucccggggauggugaggaacg

SEQ ID NO: 463363 - RNA, 64 nt, hsa
agcuugcugucucggccuucuuugugcuucucugagcuaugaggcugagaagaucuucaagugg

SEQ ID NO: 463364 - RNA, 64 nt, hsa
agcuugcugucuuggccuucuuugugcuucucugagcuaugaggcugagaagaucuucaagugg

SEQ ID NO: 463365 - RNA, 64 nt, hsa
gauugcuugaggcugagagauugagccugcagugagcuaugacgaugccacucgcugcauucaa

SEQ ID NO: 463366 - RNA, 64 nt, hsa
aauuucauaauccugggauauauguaccauugucagcuaugacuaaaaauuugaaaaagauaaa

SEQ ID NO: 463367 - RNA, 64 nt, hsa
agcacauccuagaagcagcggauggugaggacacagcuaugaucagggaauuuuggagaaacua

SEQ ID NO: 463368 - RNA, 64 nt, hsa
caccccugaagccucuuuccagcucugcuucaggagcuaugagagucgggacucuccugcaccu

SEQ ID NO: 463369 - RNA, 64 nt, hsa
gauaccuauuacggaugaguucuggaaaagacccagcuaugauucauaaaaacacuucuggaug

SEQ ID NO: 463370 - RNA, 64 nt, hsa
cccucacccaccccaaagguauuuuugauaacagagcuaugacuugucugagccucacauccuu

SEQ ID NO: 463371 - RNA, 64 nt, hsa
auaauuaugauaaugcuguuucucacaggagaauagcuaugagucaaaucuaaccugcuuaaau

SEQ ID NO: 463372 - RNA, 64 nt, hsa
ucuagcaccguccgaauccccgcaggacccauggagcuaugaccacaccaggccauucaaaugg

SEQ ID NO: 463373 - RNA, 64 nt, hsa
uuuucuuuucaaauugcuuuaguuuuucuuagggagcuaugagggggaaaaaucacuaacauga

SEQ ID NO: 463374 - RNA, 64 nt, hsa
gauugcuugagccugggaguuugaggcugcagugagcuaugauugcaccacugcacuccaaccu

SEQ ID NO: 463375 - RNA, 64 nt, hsa
uguguuaugcugauuagcagauauccacaaacauagcuaugaaguucugacugggauaaccuug

SEQ ID NO: 463376 - RNA, 64 nt, hsa
gauugcuugagcucaggaguucaaggcugcagagagcuaugaucaucccacugcauuuguuuaa

SEQ ID NO: 463377 - RNA, 64 nt, hsa
gaucgccagagcccaggaguuugaggcugcagugagcuaugagggugccucugugcuccauccu

SEQ ID NO: 463378 - RNA, 64 nt, hsa
ugucucaauaaacaaaauguagagaaaaauauguagcuaugacuuuguuacaacuguucuuauc

SEQ ID NO: 463379 - RNA, 64 nt, hsa
caucauuugagcccaggaguuugaggcugcagugagcuaugauuccaccauugcacuccagucu

SEQ ID NO: 463380 - RNA, 64 nt, hsa
cacuuuugguuccuguguuuuauaucgaagacuuagcuaugaauugcuaucuaaaucucagagc

SEQ ID NO: 463381 - RNA, 64 nt, hsa
ccuguuauacugggacaaaccuuauaaauguuauagcuaugauuguuuuuaucagugaguauuu

SEQ ID NO: 463382 - RNA, 64 nt, hsa
ucacugugggcgcugcguaccuaugcaagugccuagcuaugaagucccaggcguaaagggggau

SEQ ID NO: 463383 - RNA, 64 nt, hsa
gaugguuugagcucaggcauuugaggcugucgugagcuaugauuaugccacugcuuuccagccu

SEQ ID NO: 463384 - RNA, 64 nt, hsa
gaucacuugagccugggagguugugguugcagugagcuaugauuguaccacugcacuccagccu

SEQ ID NO: 463385 - RNA, 64 nt, hsa
aaaauaaguaugaucauuauuauugaacucuaucagcuaugaagcuaaauuuuaaagucaacug

SEQ ID NO: 463386 - RNA, 64 nt, hsa
cuuacagugaucauuauuuucauaaaagcuguaaagcuaugaaaaaugaauaaaauuacuaaaa

SEQ ID NO: 463387 - RNA, 64 nt, hsa
cgccaagucauccucccaccucagccuccugaguagcuaugacuacagguaugugccaccacgu

SEQ ID NO: 463388 - RNA, 64 nt, hsa
gauucuuguagaauuaacagcccucaacgugaugagcuaugauaacacuaugaauuaugugcag

SEQ ID NO: 463389 - RNA, 64 nt, hsa
aauuaguugcauuucuauacaccaguaauguccaagcuaugaaccaaaucaagaauggaauccc

SEQ ID NO: 463390 - RNA, 64 nt, hsa
gaucacuuaaggccaugaguuugaggcuacagagagcuaugauugcaccacugcacuccagccu

SEQ ID NO: 463391 - RNA, 64 nt, hsa
gggaggcugagcccuggaggucgaggcuacagugagcuaugaucacaccauugcacuucagccu

SEQ ID NO: 463392 - RNA, 64 nt, hsa
gaucgcuugagcccaggaguuggaggcugaagagagcuaugacugcaucacugcacuccagccu

SEQ ID NO: 463393 - RNA, 64 nt, hsa
ggcuggaggaucacuggaguucgaggcugcagugagcuaugacugugccacugcacuccagccu

SEQ ID NO: 463394 - RNA, 64 nt, hsa
augguuugaacacagggauggugaggcugcagugagcuaugaucgugcuacugcacuccagccu

SEQ ID NO: 463395 - RNA, 64 nt, hsa
gcccggccaaauacuugguuuucaguaccacaagagcuaugagcugguuauccacuucaugugg

SEQ ID NO: 463396 - RNA, 55 nt, hsa
cagaguggcucgaauuuuaauagagagcuaugaacuuuauugacauuuugcaaau

SEQ ID NO: 463397 - RNA, 64 nt, hsa
uuuaggaggcacucaggugucacggcuagacugcagcuaugagacagaucuggcuucaaaucca

SEQ ID NO: 463398 - RNA, 64 nt, hsa
ggucagggugaaucagaugggggacugagcaaguagcuaugacugcagaucauguaaggaaggg

SEQ ID NO: 463399 - RNA, 64 nt, hsa
gugaucugcugcagagcaguaagggaacaaguugagcuaugacuuaacauagccaaaaugugag

SEQ ID NO: 463400 - RNA, 64 nt, hsa
gauugcuugagcccaggaguuugagccuucagugagcuaugaucgcgccacuguacuccauccu

SEQ ID NO: 463401 - RNA, 64 nt, hsa
cagcaugcccccgugaccugccugcugugguaugagcuaugaccaagagcaggcuuccugcucc

SEQ ID NO: 463402 - RNA, 64 nt, hsa
gaggcugucaaaugugugccacccuuuauaauacagcuaugaaaaguuacuucuccauuaauuu

SEQ ID NO: 463403 - RNA, 64 nt, hsa
aguuacugucuuguuucuuaauauggacauuugcagcuaugaauuucccucugcacacuguugu

SEQ ID NO: 463404 - RNA, 64 nt, hsa
gcuuugcagaaacgcccuuguccccgcccuccugagcuaugaaugccguacagagcagaggcug

SEQ ID NO: 463405 - RNA, 64 nt, hsa
gcuuugaacucuuaggccauuugaggcugcagugagcuaugauuguaucacugcacuccagccu

SEQ ID NO: 463406 - RNA, 64 nt, hsa
augcuucauuucuuccacuucuccagaaaauggaagcuaugaagcaacauuucaaaugucucuc

SEQ ID NO: 463407 - RNA, 64 nt, hsa
gauugcuugagcccaggaggucgaggcugcagugagcuaugaucacaccaccacacuccagccu

SEQ ID NO: 463408 - RNA, 64 nt, hsa
gcuugcuugaggcaaggaguucaaggcuacagugagcuaugauugugccacuguacuccagacu

SEQ ID NO: 463409 - RNA, 64 nt, hsa
aucucuggccaccacuccaccagaugggcagagcagcuaugaccgccacccagcccucccgcuc

SEQ ID NO: 463410 - RNA, 64 nt, hsa
uguugccaaguccaagcuaccauacuccugccugagcuaugacaacagccuccucacugaucuc

SEQ ID NO: 463411 - RNA, 64 nt, hsa
agaaucgaguuacccaccagaacccuaaugguaaagcuaugauuuuaggcaugcugucaaaucc

SEQ ID NO: 463412 - RNA, 64 nt, hsa
gauugcuugagcccaggaguuugagguuguagggagcuaugaucuugccauugcacuccagcug

SEQ ID NO: 463413 - RNA, 64 nt, hsa
cgauggcugagaaaagcccggaggagaugcuccuagcuaugacuuccagcuuucaagugcucug

SEQ ID NO: 463414 - RNA, 64 nt, hsa
guuauuacauuguguaacaaauauaagguuuacgagcuaugagaauuggugcuaucaccauuag

SEQ ID NO: 463415 - RNA, 64 nt, hsa
uccuaguagucccccaucccuuccucccuuacccagcuaugauucaguugucucugcccucccu

SEQ ID NO: 463416 - RNA, 64 nt, hsa
ucauucaguggacaaguuccuuguuuaacuacacagcuaugauggaaugauauauccaaguucc

SEQ ID NO: 463417 - RNA, 64 nt, hsa
ugaccagcauggacucaggcaacugguaaugauaagcuaugagcuccagugcuuuugccaaaau

SEQ ID NO: 463418 - RNA, 64 nt, hsa
gguaagauuucauuccgaauucauuguuucauagagcuaugaucaggccauuucugcaagcaau

SEQ ID NO: 463419 - RNA, 64 nt, hsa
uauuacuuuguguaacuuugauguaauguuuauaagcuaugagaaucaguuauaaaaguauuag

SEQ ID NO: 463420 - RNA, 64 nt, hsa
gauugcuugaguccaggaguuugagucugcagugagcuaugaucaugccacugcacuccagucu

SEQ ID NO: 463421 - RNA, 64 nt, hsa
aaugaagagcuguugaugggaugauugaagaaacagcuaugagaggauuggcucccaucuuuug

SEQ ID NO: 463422 - RNA, 64 nt, hsa
cgacccugagcucuucagccagauccugagggccagcuaugaguuugacucuccuuucugggau

SEQ ID NO: 463423 - RNA, 64 nt, hsa
aagcucaagaagaacacagaagcacacaucccucagcuaugagagagaugacauaaccauaugu

SEQ ID NO: 463424 - RNA, 64 nt, hsa
ccgguuaaggaauguagacaauaucccguuucaaagcuaugaaaugugcuauuuauugaaaggg

SEQ ID NO: 463425 - RNA, 64 nt, hsa; identical to SEQ ID NO: 60172

SEQ ID NO: 463426 - RNA, 64 nt, hsa; identical to SEQ ID NO: 60173

SEQ ID NO: 463427 - RNA, 64 nt, hsa; identical to SEQ ID NO: 60174

SEQ ID NO: 463428 - RNA, 64 nt, hsa; identical to SEQ ID NO: 60175

SEQ ID NO: 463429 - RNA, 64 nt, hsa; identical to SEQ ID NO: 60176

SEQ ID NO: 463430 - RNA, 64 nt, hsa; identical to SEQ ID NO: 60177

SEQ ID NO: 463431 - RNA, 64 nt, hsa; identical to SEQ ID NO: 60178

SEQ ID NO: 463432 - RNA, 64 nt, hsa; identical to SEQ ID NO: 60179

SEQ ID NO: 463433 - RNA, 64 nt, hsa; identical to SEQ ID NO: 60180

SEQ ID NO: 463434 - RNA, 64 nt, hsa; identical to SEQ ID NO: 60181

SEQ ID NO: 463435 - RNA, 64 nt, hsa; identical to SEQ ID NO: 60182

SEQ ID NO: 463436 - RNA, 64 nt, hsa; identical to SEQ ID NO: 60183

SEQ ID NO: 463437 - RNA, 64 nt, hsa; identical to SEQ ID NO: 60184

SEQ ID NO: 463438 - RNA, 64 nt, hsa; identical to SEQ ID NO: 60185

SEQ ID NO: 463439 - RNA, 64 nt, hsa; identical to SEQ ID NO: 60186

SEQ ID NO: 463440 - RNA, 64 nt, hsa; identical to SEQ ID NO: 60187

SEQ ID NO: 463441 - RNA, 64 nt, hsa; identical to SEQ ID NO: 60188

SEQ ID NO: 463442 - RNA, 64 nt, hsa; identical to SEQ ID NO: 60189

SEQ ID NO: 463443 - RNA, 64 nt, hsa; identical to SEQ ID NO: 60190

SEQ ID NO: 463444 - RNA, 64 nt, hsa; identical to SEQ ID NO: 60191

SEQ ID NO: 463445 - RNA, 64 nt, hsa; identical to SEQ ID NO: 60192

SEQ ID NO: 463446 - RNA, 64 nt, hsa; identical to SEQ ID NO: 60193

SEQ ID NO: 463447 - RNA, 64 nt, hsa; identical to SEQ ID NO: 60194

SEQ ID NO: 463448 - RNA, 64 nt, hsa; identical to SEQ ID NO: 60195

SEQ ID NO: 463449 - RNA, 64 nt, hsa; identical to SEQ ID NO: 60196

SEQ ID NO: 463450 - RNA, 64 nt, hsa; identical to SEQ ID NO: 60197

SEQ ID NO: 463451 - RNA, 64 nt, hsa; identical to SEQ ID NO: 60198

SEQ ID NO: 463452 - RNA, 64 nt, hsa; identical to SEQ ID NO: 60199

SEQ ID NO: 463453 - RNA, 64 nt, hsa; identical to SEQ ID NO: 60200

SEQ ID NO: 463454 - RNA, 64 nt, hsa; identical to SEQ ID NO: 60201

SEQ ID NO: 463455 - RNA, 64 nt, hsa; identical to SEQ ID NO: 60202

SEQ ID NO: 463456 - RNA, 64 nt, hsa; identical to SEQ ID NO: 60203

SEQ ID NO: 463457 - RNA, 64 nt, hsa; identical to SEQ ID NO: 60204

SEQ ID NO: 463458 - RNA, 64 nt, hsa; identical to SEQ ID NO: 60205

SEQ ID NO: 463459 - RNA, 64 nt, hsa; identical to SEQ ID NO: 60206

SEQ ID NO: 463460 - RNA, 64 nt, hsa; identical to SEQ ID NO: 60207

SEQ ID NO: 463461 - RNA, 64 nt, hsa; identical to SEQ ID NO: 60208

SEQ ID NO: 463462 - RNA, 64 nt, hsa; identical to SEQ ID NO: 60209

SEQ ID NO: 463463 - RNA, 64 nt, hsa
gacaaggcugaagguucuauuuauuuacaauacauaggguuacucaccaaacuuuuugacaagg

SEQ ID NO: 463464 - RNA, 64 nt, hsa
aacuuuucugaagguucuauuuauuuaccauacauaggguuacuuaccaaacuuuuugacaagg

SEQ ID NO: 463465 - RNA, 64 nt, hsa
aagcgcgguaggguucguagguagggcuaguagguaggguuaguagguagggcuaguagguagg

SEQ ID NO: 463466 - RNA, 64 nt, hsa
uucguagguaggguucguagguagggcugguagguaggguuaguagguagggcuaguagguagg

SEQ ID NO: 463467 - RNA, 64 nt, hsa
cugguagguaggguuaguagguagggcuaguagguaggguuaguagguaggguucguagguagg

SEQ ID NO: 463468 - RNA, 64 nt, hsa
uucguagguaggguucguagguagggcuaguagguaggguuaguagguaggguucguagguagg

SEQ ID NO: 463469 - RNA, 64 nt, hsa
uucguagguaggguucguagguagggcuaguagguaggguuaguagguagggcuaguagguagg

SEQ ID NO: 463470 - RNA, 64 nt, hsa
uuaguagguagggcuaguagguagggcuaguagguaggguuaguagguagggcuaguagguagg

SEQ ID NO: 463471 - RNA, 64 nt, hsa
uuaguagguagggcuaguagguaggguucguagguaggguuaguagguagggcuaguagguagg

SEQ ID NO: 463472 - RNA, 64 nt, hsa; identical to SEQ ID NO: 463469

SEQ ID NO: 463473 - RNA, 64 nt, hsa
uucguagguaggguucguagguaggguucguagguaggguuaguagguaggguucguagguagg

SEQ ID NO: 463474 - RNA, 64 nt, hsa
cuaguagguagggcuaguagguagggcuaguagguaggguuaguagguagggcuaguagguagg

SEQ ID NO: 463475 - RNA, 64 nt, hsa
uucguagguaggguucguagguaggguucguagguaggguuaguagcgcgucugugcugcuucc

SEQ ID NO: 463476 - RNA, 64 nt, hsa
gaccucagcgccuccugcaggcuaggacacuggugcacuacaccccaugccugggggccgagau

SEQ ID NO: 463477 - RNA, 64 nt, hsa
caucccuacccuuggcaguguggcagugaccauggcacuacacggcugugacgagguggcaguc

SEQ ID NO: 463478 - RNA, 64 nt, hsa
ggagaggaccagagugaucaaggguguaugaugugcacuacaauggugggcaaaacaggcuccu

SEQ ID NO: 463479 - RNA, 64 nt, hsa
auuugguauuaaacuccaaaugagccauaggaaggcacuacaugaaauaaugcacugaguaugc

SEQ ID NO: 463480 - RNA, 64 nt, hsa
aauguaauguugauuccucaagaaugaaaugaaggcacuacauugaaauauguuuuguauaaau

SEQ ID NO: 463481 - RNA, 64 nt, hsa
cucuucuccuuguccuagucagaugaaggaggcugcacuacaaacccaaauucugcaaaaaaau

SEQ ID NO: 463482 - RNA, 64 nt, hsa
auguuuggggucuuugugguagcuuaucuuagaagcacuacaccuugccuugcuguuuguccug

SEQ ID NO: 463483 - RNA, 64 nt, hsa
cacccccuucgugccucauggaauucagucccaugcacuacacucuggaugguguaugacugga

SEQ ID NO: 463484 - RNA, 64 nt, hsa
ccacaaugaauuguccuuaauuaccaacagugaagcacuacaggaggcaacuguggcauugcuu

SEQ ID NO: 463485 - RNA, 64 nt, hsa
caucaauguacuuugaacuaccugacucauuccagcacuacagaaguguguuuuacucauuuga

SEQ ID NO: 463486 - RNA, 64 nt, hsa
augaacggaugccucaguguccaagauacaaaaggcacuacauagaaguuugcuuuuucccugc

SEQ ID NO: 463487 - RNA, 64 nt, hsa
aucagguuuuaggguccugcaaaaggcuagcucggcacuacacuagggaauuugcuccuguucu

SEQ ID NO: 463488 - RNA, 64 nt, hsa
uccuucacuuacaccugacugacccuccugaacugcacuacaagacacuuuguagaagaggaga

SEQ ID NO: 463489 - RNA, 64 nt, hsa
uaucuguaguuuuuuguuuuuguuuuuuuuuaaagcacuacaucuguuuucacuaauuguuaau

SEQ ID NO: 463490 - RNA, 64 nt, hsa
uuaagcagguaacuuuuuuuguaauggaagaaaugcacuacaaaguuaagacagauuuuugcua

SEQ ID NO: 463491 - RNA, 64 nt, hsa
ccuuuuuucaaaggcaccacaaguauagacaguugcacuacaucaaaucuuuuuuugacacuug

SEQ ID NO: 463492 - RNA, 64 nt, hsa
aaacaaaauugccugaauuguacuguauguagcugcacuacaacagauucuuaccgucuccaca

SEQ ID NO: 463493 - RNA, 64 nt, hsa
ugcagaauguaaacagcagacucauacucaaugggcacuacaggccuuaucagacguuuuauac

SEQ ID NO: 463494 - RNA, 64 nt, hsa
cuccucucaagagcugccauuuuaugugucucuugcacuacaccucuguugugaggacuaccau

SEQ ID NO: 463495 - RNA, 64 nt, hsa
ugcauuacucuuuggccugggaacccuguggucugcacuacaugugaauggccuuccacuucag

SEQ ID NO: 463496 - RNA, 64 nt, hsa
gaccauuuguaugguauuuuuaugaaaaagaacugcacuacaguacaauuuacaacaaugcugc

SEQ ID NO: 463497 - RNA, 64 nt, hsa
uauuauuguuauuccuuuuuaauuuaaugugcucgcacuacaaugcaucaguauuaugauuccu

SEQ ID NO: 463498 - RNA, 64 nt, hsa
aaagccuuugcaaucuugcaagauuuguagaccagcacuacaaagaucgcauagaucaaauagg

SEQ ID NO: 463499 - RNA, 64 nt, hsa
uacauuuuaacuggaaaucuacuugaagacuccagcacuacauguuaugaagcuguaaauaagc

SEQ ID NO: 463500 - RNA, 64 nt, hsa
ggcggagguuccagagagccaagaucgcaccacugcacuacagccugggcgacagaacgagacc

SEQ ID NO: 463501 - RNA, 64 nt, hsa
ucuaauugcuaacaaaugcucuuugcugucucaggcacuacaugucauugaucuugcccccaau

SEQ ID NO: 463502 - RNA, 64 nt, hsa
aaagcugcacccacuuacauucaguauuuuccuggcacuacaaagagugggaaggccugggauu

SEQ ID NO: 463503 - RNA, 64 nt, hsa
ccacacugguccauccugccacccccaaccauuugcacuacaagggcggaggcaccccgaagaa

SEQ ID NO: 463504 - RNA, 64 nt, hsa
ggcaaggcaagggucucccucagcagggcuaggugcacuacagccucuuuccccgugucccguu

SEQ ID NO: 463505 - RNA, 64 nt, hsa
gcauaauguuagauucuucuccugucuacauuaugcacuacauaauuggacuucauuaugcuuu

SEQ ID NO: 463506 - RNA, 64 nt, hsa
uuagacauucaggcuccacaauaaauuuuaaugagcacuacaaauuuagaauauauaaaaauau

SEQ ID NO: 463507 - RNA, 64 nt, hsa
aaggagugaaaauagaguguaaaucuugccuuuggcacuacaaggugugugugugugugugugu

SEQ ID NO: 463508 - RNA, 64 nt, hsa
auacuugguuucuuuucuuacuuaucaaaagacagcacuacagauaucauauugaggauuaauu

SEQ ID NO: 463509 - RNA, 64 nt, hsa
uucuagaaagaucacuaauggucaaguggaacaagcacuacacgacuaaccccuauugggguuu

SEQ ID NO: 463510 - RNA, 64 nt, hsa
ucuggagaacaccauuccugauuucccacaaacugcacuacaucaguauaacugcauuucuagu

SEQ ID NO: 463511 - RNA, 64 nt, hsa
uccuuuauuucuggcucacagaggcagccacgaggcacuacaccaaguauuauauaaaagccau

SEQ ID NO: 463512 - RNA, 56 nt, hsa
uagagaggaugaagcauuagcuugaagcacuacaggaggaaugcaccacggcagcu

SEQ ID NO: 463513 - RNA, 64 nt, hsa
auuccuaaagccacuauuguguuuucucuaagaagcacuacaugccaccagaauugugcacuga

SEQ ID NO: 463514 - RNA, 64 nt, hsa
cuuugggcugugagcauuuagaacgagccuggaagcacuacagagcaucccacaggaccacacg

SEQ ID NO: 463515 - RNA, 64 nt, hsa
ugcucugguacacagaugucauuuuguugucacagcacuacagugaaauacacaaaaaaugaaa

SEQ ID NO: 463516 - RNA, 64 nt, hsa
uuuccauuccagaauaucugggauucuacuuuaagcacuacauaaacugacuuuauccucagac

SEQ ID NO: 463517 - RNA, 64 nt, hsa
aggaaugcuuuauaaccaucagaagccauuauuugcacuacauauaugauaaguauagacagca

SEQ ID NO: 463518 - RNA, 64 nt, hsa
gcacaaacuuuacacauuuguacaauuuugaaaugcacuacaauaaacaaauuagagcaacaca

SEQ ID NO: 463519 - RNA, 64 nt, hsa
gcugagaaacauuauuagcacuucccgccccagggcacuacauaauugcuguucugcugaauca

SEQ ID NO: 463520 - RNA, 64 nt, hsa
auuuguagacuuguagguaaaauaaaaaucaagggcacuacauaaccucucugguaacuccuug

SEQ ID NO: 463521 - RNA, 64 nt, hsa
gagcuacauuaguuacauucaggcauaccccagagcacuacaauucucugagacauugucugga

SEQ ID NO: 463522 - RNA, 64 nt, hsa
uuauuguuuucaucuguuguuuuguuuuaaauacgcacuacaugugguuuauagagggccaaga

SEQ ID NO: 463523 - RNA, 64 nt, hsa
gagcucuuuuuuccuuucugcugauuugcuggaagcacuacaagacuucuguuuguucguucgu

SEQ ID NO: 463524 - RNA, 64 nt, hsa
ggcaacuuuaucaguaucaauggaaaaaugauaggcacuacaaugaaauggcaggaugccaaua

SEQ ID NO: 463525 - RNA, 64 nt, hsa
guaguuaagaguggggucaccccuuuaacuccaagcacuacauuuuggcggcugccggccucug

SEQ ID NO: 463526 - RNA, 64 nt, hsa
aagugaaagaauucaguguauccguuauuuuaaugcacuacaccacagaaauguuaaguugguc

SEQ ID NO: 463527 - RNA, 64 nt, hsa
uacagguaagucuacauccucucugacagccacagcacuacaucaaucccugacguuagggaua

SEQ ID NO: 463528 - RNA, 64 nt, hsa
uuguaauucuacaaauuucacauuuccauggcaugcacuacagaaauaacuguauaaugaaaaa

SEQ ID NO: 463529 - RNA, 64 nt, hsa
uugugaugucacuugaccccauuuauguguaggagcacuacaccauugguuuccaauacugcac

SEQ ID NO: 463530 - RNA, 64 nt, hsa
uugaaccacugaaguuauaaaggagcacacugucgcacuacauugucuaaauuauguaggaaga

SEQ ID NO: 463531 - RNA, 64 nt, hsa
ggacaggggucaggcaacuaucccaaaggggagggcacuacacuuccuugagagaaaccgcugu

SEQ ID NO: 463532 - RNA, 64 nt, hsa
agaagaaacaugcuaaauagacaccuuauucuuggcacuacaugugacuaaaggaagguaagau

SEQ ID NO: 463533 - RNA, 64 nt, hsa
uaauugggggaaauaagcacuauuaacagauucagcacuacaaguauuuugaauguuguugcug

SEQ ID NO: 463534 - RNA, 64 nt, hsa
uuuuguaauucauauaguaagaguauucuaaacagcacuacauuaauaucauuugauagguaua

SEQ ID NO: 463535 - RNA, 64 nt, hsa
ccacagcaugggaggaaagacagccaugcugcuggcacuacagagggugagccgcccaugucug

SEQ ID NO: 463536 - RNA, 64 nt, hsa
augugauguguugcucuccauucuuuuaaaucucgcacuacaucugauaucaggaaauaucugu

SEQ ID NO: 463537 - RNA, 64 nt, hsa
guaccuaaauuuucuuaaaaaaaaaucuaguauagcacuacauucuuuuuuaagugaugcagac

SEQ ID NO: 463538 - RNA, 64 nt, hsa
uuuucugccuccaucccacccaugagggcugcaggcacuacaaaagagcugacuacugagaauu

SEQ ID NO: 463539 - RNA, 64 nt, hsa
caaacuucagccaacaggggugucugcuucugcugcacuacacaggccaggaguggcauuccau

SEQ ID NO: 463540 - RNA, 64 nt, hsa
aaagcaauugugaaaauguguuuacuucagaacggcacuacauaaaugugaaaaguuguugauc

SEQ ID NO: 463541 - RNA, 64 nt, hsa
ugauccucccagcucucagccuccaaaguagcuggcacuacaaguguacacccccacacaaggc

SEQ ID NO: 463542 - RNA, 64 nt, hsa
gaaugcacagguguuggugagggcguguggcugagcacuacaugucaaguccagagucaguuuc

SEQ ID NO: 463543 - RNA, 64 nt, hsa
uaaaauagagaauguugucuuuugccgaccaggagcacuacagauugagcuuuaucgaaagcug

SEQ ID NO: 463544 - RNA, 64 nt, hsa
uguucccugaguccgaggcucaugugucauucuggcacuacauuugcuuaaauugcuauuuugg

SEQ ID NO: 463545 - RNA, 64 nt, hsa
agauacuuguagcugucugugauuuacgaguuaggcacuacaucuccauuuucagacugagggg

SEQ ID NO: 463546 - RNA, 64 nt, hsa
gucuucccgaugagggaaggagcccagccagaaagcacuacaaucauggucaaguucccaacug

SEQ ID NO: 463547 - RNA, 64 nt, hsa
gcugcugugcagcauggaauuccuuuaaaaaggugcacuacaguuuuagcggggagggggauag

SEQ ID NO: 463548 - RNA, 64 nt, hsa
auuuuauuauguuuuuuaaaaugugagaacuucugcacuacaaaauucccuucacagagaagua

SEQ ID NO: 463549 - RNA, 64 nt, hsa
caaagugaaaaagaaauuauauucagauaggacugcacuacauuauuugucacacauggaucug

SEQ ID NO: 463550 - RNA, 64 nt, hsa
uucaaaggaaacauaugaauuuguuuugcguugugcacuacaucauuucucuccugaggaagaa

SEQ ID NO: 463551 - RNA, 64 nt, hsa
uuaguuuguguacauauauacacauauauauuuugcacuacacaaacgauaacauuuuaaggac

SEQ ID NO: 463552 - RNA, 64 nt, hsa
gaaaaauacugaauagacuugcuaaauggcacaugcacuacaagaggaaccuuuuggguuauuu

SEQ ID NO: 463553 - RNA, 64 nt, hsa
uauaauaguguuuaccaaacauaccaauaauucagcacuacaauucagaccuuugaaaaucugg

SEQ ID NO: 463554 - RNA, 64 nt, hsa
gcuaaccagggugcuugcuuuggucacguucaacgcacuacagagcuacgacacagggaaaccu

SEQ ID NO: 463555 - RNA, 64 nt, hsa
uagugugauaaugugcugcaaaaaauauccaacagcacuacacauaaguacagaguauucacaa

SEQ ID NO: 463556 - RNA, 64 nt, hsa
uggcauuacccucugcagaacagugaaagguauugcacuacauuauggaaucaugcaaaaggaa

SEQ ID NO: 463557 - RNA, 64 nt, hsa
auaggcuuuuguucuuaugaacgaaaaagagguagcacuacaaacacaauauucaaucaaaauu

SEQ ID NO: 463558 - RNA, 64 nt, hsa
gcaucucagcuuccucagaucaguucuaucacuggcacuacagaauccuucucuuucuuaaggc

SEQ ID NO: 463559 - RNA, 64 nt, hsa
uauuaggcacuacugauuuuuuaguuaaauugaugcacuacacuuuugauguuugaaguuacaa

SEQ ID NO: 463560 - RNA, 64 nt, hsa
cucugcuuuauccccuucucuuccuucaccaucugcacuacauuucuggcugaucccaaucaga

SEQ ID NO: 463561 - RNA, 64 nt, hsa
gacagaagugcuggcuaggaggucucagccucgggcacuacaauguuuaucuuuuucuuuuuga

SEQ ID NO: 463562 - RNA, 64 nt, hsa
auuuugccagggaacaguucacugacuaggaaaagcacuacauuuuaaauucagcauuagugca

SEQ ID NO: 463563 - RNA, 64 nt, hsa
ugauccucccaccucagcuucucaaguagcucuggcacuacagacaugugccacuaugccugaa

SEQ ID NO: 463564 - RNA, 64 nt, hsa
gccugcucccccugagccagcaccugcgggagcugcacuacagcccuggccuccacccccaccc

SEQ ID NO: 463565 - RNA, 64 nt, hsa
ccuauuugaaugacaaaggugccaguagugccaggcacuacacagagaggaaguggauuuguuc

SEQ ID NO: 463566 - RNA, 64 nt, hsa
uggaacaaacucucccuucacuuguugcccuguagcacuacagaaacccugguucuugggcucc

SEQ ID NO: 463567 - RNA, 64 nt, hsa
guuugcccguaucaucaugauugguacccugacugcacuacagugguuuaucuaugacuccgug

SEQ ID NO: 463568 - RNA, 64 nt, hsa
cuuguggccucaagaaauuuagacgcccacgacagcacuacacagcaucuccaggugaugccca

SEQ ID NO: 463569 - RNA, 64 nt, hsa
ugaucuaucaacaucaccccauuaagaauacaaagcacuacauucuuuuaucuuuuuugcucca

SEQ ID NO: 463570 - RNA, 64 nt, hsa
ggugauucuccugccucagccucccaaguagcuggcacuacagacacgcgccaccaugcccggc

SEQ ID NO: 463571 - RNA, 64 nt, hsa
auugguaguaaagguauuauguuaccuccuaacagcacuacaaaguaccuuuuuuuaucagaaa

SEQ ID NO: 463572 - RNA, 64 nt, hsa
cuaugcaaagcauccaggcgguucugaaugugaagcacuacacccagcagagucccggugcccu

SEQ ID NO: 463573 - RNA, 64 nt, hsa
ggacauggcuaaagaccuuaaccaauagcaaauugcacuacagcugaacuuuucaucaucucau

SEQ ID NO: 463574 - RNA, 64 nt, hsa
uuuguuugcaguccucuguuaguuuugcauaguugcacuacaagaagaauguaguugugcaaau

SEQ ID NO: 463575 - RNA, 64 nt, hsa
ccugggagcgaaagcuggccuuuuuucuacgaaugcacuacauuaaagaugugcaaccuaugcg

SEQ ID NO: 463576 - RNA, 64 nt, hsa
uuuucauucugaagcuuguaaccuccccauuuuagcacuacagaauuuucaagauuucaauauc

SEQ ID NO: 463577 - RNA, 64 nt, hsa
caaaacaacugguuauaugccucccuugcagcaagcacuacaauguaugugaucgucaauguga

SEQ ID NO: 463578 - RNA, 64 nt, hsa
ggagaacuuaccaucccccaaauauauccugcuggcacuacaccuucguaacugcuguucccac

SEQ ID NO: 463579 - RNA, 64 nt, hsa
gaaugggcaugaauaugggcauggaugggcaauggcacuacauguaaccuucaucauguaaagc

SEQ ID NO: 463580 - RNA, 64 nt, hsa
gguagcguguccauaguacuugguugcgacauuugcacuacauccacuuuaguuacuugaugag

SEQ ID NO: 463581 - RNA, 64 nt, hsa
guucaaggcugcaaugagccaugauuacaccacggcacuacaaccuugguggcacagugagaac

SEQ ID NO: 463582 - RNA, 64 nt, hsa
ugauuagcacuaaucucugggauuuuuaaggauugcacuacagaagaauguacccugauguaaa

SEQ ID NO: 463583 - RNA, 64 nt, hsa
gggugguccaguaccuggcugagcugcugaagcugcacuacaugcaggaaucuccagggaccag

SEQ ID NO: 463584 - RNA, 64 nt, hsa
cucccauccuuuccucucuccccguucaugcccugcacuacauagcacagccgggaugcuugga

SEQ ID NO: 463585 - RNA, 64 nt, hsa
uaugaugcugcauggcagaggcagguauaacacagcacuacauauuggaaauuuuuuauuuuuc

SEQ ID NO: 463586 - RNA, 64 nt, hsa
gguggcguguaaggaaugcagcccccugaagacagcacuacaagucugggggagccaguuuuaa

SEQ ID NO: 463587 - RNA, 64 nt, hsa
gauuuaaaacuuuuuuggaagugagagaccaggagcacuacagagaauuuccagaggcaaauuu

SEQ ID NO: 463588 - RNA, 64 nt, hsa
gcaguaacuucugggcugugguuguaaacugugagcacuacaaaauguuuuuccuuauugauac

SEQ ID NO: 463589 - RNA, 64 nt, hsa
cauccauuuccauacaggaacaaaauaggaggcagcacuacagacccuacacacagcuuuacag

SEQ ID NO: 463590 - RNA, 64 nt, hsa
augugugugauguauacuauauaugcccacacaugcacuacauaacacacuauauauauauaua

SEQ ID NO: 463591 - RNA, 64 nt, hsa
ucuuuauacaaauggaguagcaacuaguuuuguagcacuacauuuaauguaaugagauaccuuu

SEQ ID NO: 463592 - RNA, 64 nt, hsa
aggaggaucugcgcacggugcacagcccaccagagcacuacagccuuuuauugaguggggcaag

SEQ ID NO: 463593 - RNA, 64 nt, hsa
aaugcugacaagcacacccucucccauuauuugugcacuacagaucuccuccugaucagucacc

SEQ ID NO: 463594 - RNA, 54 nt, hsa
ugcuuggccccacaggcugaccccgcacuacaucuacccaccagccaucgugca

SEQ ID NO: 463595 - RNA, 64 nt, hsa
ugccauaaauguuugcauaaugacauagcuuuaagcacuacaugauuuuaaucugcucacauua

SEQ ID NO: 463596 - RNA, 64 nt, hsa
caaugaaaauauaaugaaauaaauauuuauuugugcacuacaauucaaagcauuagaaacauug

SEQ ID NO: 463597 - RNA, 64 nt, hsa
uagagagagagagagaagcggggagaauaagagugcacuacagcccaggcuuaugccaccccca

SEQ ID NO: 463598 - RNA, 64 nt, hsa
guuaacugugcuuucuucuccuggcccugacagagcacuacagcaucaaaguaaaucuuugggg

SEQ ID NO: 463599 - RNA, 64 nt, hsa
ccugggcacccagcugcaggccccugcccuacgugcacuacaggaaggggugaggagagcagcc

SEQ ID NO: 463600 - RNA, 64 nt, hsa
agccacaccuuuuccaggaguucugaagcugacagcacuacaaaggagacgggggagcagcacg

SEQ ID NO: 463601 - RNA, 64 nt, hsa
ggaccugggguaccuuuaguuagggacucugguggcacuacacggggugcuggauucaaaucuc

SEQ ID NO: 463602 - RNA, 64 nt, hsa
uuuucuauuuuuaguacuguauggauguuacugagcacuacacaugauccuucugugcuugcuu

SEQ ID NO: 463603 - RNA, 64 nt, hsa
cagcccaguguagagauuggcacuucccuguccagcacuacaacuuaauugcucuaugccucag

SEQ ID NO: 463604 - RNA, 64 nt, hsa
aguguguugucucuuuccuacaaguuaaccaguugcacuacauaaucucuggaaauuaauuuuc

SEQ ID NO: 463605 - RNA, 64 nt, hsa
augagaucaggcccccccaggguccacccacagagcacuacagagccucugaaagaccauagca

SEQ ID NO: 463606 - RNA, 64 nt, hsa
acugugaauucaaaacaauaaggcacuugugggugcacuacauagauucugacaguguugugau

SEQ ID NO: 463607 - RNA, 64 nt, hsa
caagauucucagauccagguuaggaaaggauucagcacuacagcauaccccucuacaacauaca

SEQ ID NO: 463608 - RNA, 64 nt, hsa
gcauuauacuaagacaccauuaagaacaguugaggcacuacacuaaaucaaaccauaaaugagg

SEQ ID NO: 463609 - RNA, 64 nt, hsa
gugauuauuuauuuuuuuagauuucuuuucuuuugcacuacaauuuuuggaauccuuuuggaaa

SEQ ID NO: 463610 - RNA, 64 nt, hsa
ggcauuuccuaucaccuauuuccauucaacaagagcacuacauucauuuagcuaaacggauucc

SEQ ID NO: 463611 - RNA, 64 nt, hsa
cugggguauaaucauguuguagguacuuaaaugcauuccgcaaaucaaaauaucuugauggaua

SEQ ID NO: 463612 - RNA, 64 nt, hsa
aggagcaugcacagcggugcuauguccgugggcuauuccgcagcuugcagcaagcacagagugu

SEQ ID NO: 463613 - RNA, 64 nt, hsa
cauugccccauggaaaugucgacccugugcggacauuccgcauacugccaugaagacggucucu

SEQ ID NO: 463614 - RNA, 64 nt, hsa
gaaaaauacuuaagcucccuauguauccaugaaaauuccgcauugauuuugacauuccauacuu

SEQ ID NO: 463615 - RNA, 64 nt, hsa
uguacggguuagauagaggucgucagccggguugauuccgcagguuagauagaggucguuagcu

SEQ ID NO: 463616 - RNA, 64 nt, hsa
gcaccuuuugcacauaacaugcuuuagauuauauauuccgcacucaaggaguaaccaggucguc

SEQ ID NO: 463617 - RNA, 64 nt, hsa
uguaucccacugauaggagguguugggugguguuauuccgcagugcuuucagucuuccauguga

SEQ ID NO: 463618 - RNA, 64 nt, hsa
gaauaacagacagcccagaggagauagugcagaaauuccgcaaggcugugacagacuucaccuc

SEQ ID NO: 463619 - RNA, 64 nt, hsa
guauacauguggcuucacauuuauuaaacaauaaauuccgcacagaaaguuucauuucaccaau

SEQ ID NO: 463620 - RNA, 64 nt, hsa
uguuuuaauguacagaugugggaaaaccacacaaauuccgcaguuuauucuggaugauucucug

SEQ ID NO: 463621 - RNA, 64 nt, hsa
ucaaauuucucuccuuugguuauauaccuugcguauuccgcacauugauaaaguuucuuucuua

SEQ ID NO: 463622 - RNA, 64 nt, hsa
cuccuuaugugaauuucaaacacguauggaauucauuccgcauggacucugggaucaaaggcuc

SEQ ID NO: 463623 - RNA, 64 nt, hsa
gauugcucagggacucaucuuucccuccuuggugauuccgcagugagagaguggcuggggcaug

SEQ ID NO: 463624 - RNA, 64 nt, hsa
cuaucgucuccacugacagccgccucuggguugaauuccgcagcagcagcaauuggguuggaaa

SEQ ID NO: 463625 - RNA, 64 nt, hsa
cgccgcgucgccgauuagaggacgaggaggagagauuccgcacgcaaccgaaaggguccuucgg

SEQ ID NO: 463626 - RNA, 64 nt, hsa
aagcuucaucaggccuuggagcagucacugcuuuauuccgcaaaaauuauuugguaggaaauuu

SEQ ID NO: 463627 - RNA, 64 nt, hsa
gcagagccccacuuaacuccauaaacugcuucccauuccgcagcccaguucugauuguugaggu

SEQ ID NO: 463628 - RNA, 64 nt, hsa
caaggagucacugagaccaaggcuuucucuacugauuccgcagcucagacccuuucuucagcuc

SEQ ID NO: 463629 - RNA, 64 nt, hsa
gcacacuccuguagcucugucgccaaaacccugcauuccgcagugcccucgcuggcuuguuuuc

SEQ ID NO: 463630 - RNA, 64 nt, hsa
ucuauaaugggugccucaaaauauguauugugccauuccgcaaauuuaaaagcuaauugaggac

SEQ ID NO: 463631 - RNA, 64 nt, hsa
ccgggccccacagacaaaagcgcuuuuccuuggcauuccgcaucccuaccgacccaggguuccc

SEQ ID NO: 463632 - RNA, 64 nt, hsa
ggacucccugcuuccaugcuuucuccuucaguccauuccgcaaacucuugugaucuuccaaaau

SEQ ID NO: 463633 - RNA, 64 nt, hsa
ccaauagauuggagaaagccagagauuagcccucauuccgcaucugucaaccaggacagaaagc

SEQ ID NO: 463634 - RNA, 64 nt, hsa
gaccagcagacagagccaggagaagcucagcugcauuccgcagcccccacccccaagguucucc

SEQ ID NO: 463635 - RNA, 64 nt, hsa
gguaucucaggucugaaucuucaccaucuuucugauuccgcacccugccuacgccaggagaagu

SEQ ID NO: 463636 - RNA, 64 nt, hsa
agaaauacaauggauuuuuaaauguugaucuuguauuccgcaaucuugcugaaguuguuuaccg

SEQ ID NO: 463637 - RNA, 64 nt, hsa
gccucugccugacagcauccucucuaugggccauauuccgcacugggcacaggccgucacccug

SEQ ID NO: 463638 - RNA, 64 nt, hsa
ccuggcuggcccccuucccucugucuggggucgcauuccgcacaagccuuucaucaacaucuua

SEQ ID NO: 463639 - RNA, 64 nt, hsa
accaacauauacauuuuguugcaggaaauguuuaauuccgcaugauguuucccucuccuuccaa

SEQ ID NO: 463640 - RNA, 64 nt, hsa
uauucaugcuagcauuuuuccaacgagggaacuuauuccgcacgggccuacuguaggaccauug

SEQ ID NO: 463641 - RNA, 64 nt, hsa
ccuuguuucuugaagguuuccucgucccugggcaauuccgcauuuaauucaugguauucaggau

SEQ ID NO: 463642 - RNA, 64 nt, hsa
uccgcccacgcccccgacccuuugcucaauaaacauuccgcacuccauuuucaggcucuuccuu

SEQ ID NO: 463643 - RNA, 64 nt, hsa
aucaaaguuggcgggggcuuggcugugcccucagauuccgcaccaauaaagccuucaaacuccc

SEQ ID NO: 463644 - RNA, 64 nt, hsa
aggaagcauuucauguucaauaagaaacccagccauuccgcauggcugguuccugaguggcucu

SEQ ID NO: 463645 - RNA, 64 nt, hsa
ugaacuauaaaaagcaccggaucuuuuccaucuaauuccgcaaaaauugaucauuugcaaaguc

SEQ ID NO: 463646 - RNA, 64 nt, hsa
accccaccucuaguauuuugggagauagggaaagugaaccgacuuccccuucccauaccccuca

SEQ ID NO: 463647 - RNA, 64 nt, hsa
ggcggggccucugggugcgaguuccuccugcauaugaaccgaggggaggaggagaagcugagca

SEQ ID NO: 463648 - RNA, 64 nt, hsa
agaaucgcuugagacugggaggcagagguugcagugaaccgagaucaugccaccgcacuucagc

SEQ ID NO: 463649 - RNA, 64 nt, hsa
gggaccuccccugaggcucagggaaaggccagugugaaccgaggggcucaggaaaacgggaccg

SEQ ID NO: 463650 - RNA, 64 nt, hsa
uuauuugccuuuaccucauaugagucuuugaucuugaaccgauacuuuuggaucucauuguuga

SEQ ID NO: 463651 - RNA, 64 nt, hsa
gaggaggacuuggagggucugggggcagcuguccugaaccgacugacccugaggaggccgcuua

SEQ ID NO: 463652 - RNA, 64 nt, hsa
ugagaagagauaugccuguuguuacugcagaaccugaaccgaagauuccugauguugcacccau

SEQ ID NO: 463653 - RNA, 64 nt, hsa
uucagaauugaaggagaaaaugcauuauguggacugaaccgacuuuucuaaagcucugaacaaa

SEQ ID NO: 463654 - RNA, 64 nt, hsa
ucucagauaaaugcauuuuguggaauugauuuucugaaccgacccugcugucugcaaaccuucc

SEQ ID NO: 463655 - RNA, 64 nt, hsa
agggaggggagaagggagcagaggccacgcagaaugaaccgaugggguauucaguugcuggcag

SEQ ID NO: 463656 - RNA, 64 nt, hsa
cagcuacucaugagguugaggcaggagaauggcgugaaccgaggaggcggagcuugcagugagu

SEQ ID NO: 463657 - RNA, 64 nt, hsa
cacaaguccucuagugcucuuguugguuugaagaugaaccgacuuuuuaguuuggguccuacug

SEQ ID NO: 463658 - RNA, 64 nt, hsa
acgcaccaaaaacguggugugugcuggaguugucugaaccgauauuucuuuuuguuccuuggua

SEQ ID NO: 463659 - RNA, 64 nt, hsa
caaagauuuuuuauugcugcauuucacacaacugugaaccgaauaaauagcuccuauuuggucu

SEQ ID NO: 463660 - RNA, 64 nt, hsa
uugaccuugccagcugaccuucaaacccugcauuugaaccgaccaacauuaaguccagagagua

SEQ ID NO: 463661 - RNA, 64 nt, hsa
cuguuuuaaguugcucaggagccugauggaaccaugaaccgagacucuucucuguuuccugcca

SEQ ID NO: 463662 - RNA, 64 nt, hsa
agaauggcgggaaccugggaggcggagcuuacagugaaccgagaucacaccacugcauucccgc

SEQ ID NO: 463663 - RNA, 64 nt, hsa
aagaagaagggcaaguaggccuuggauaagaauuugaaccgaaagaauaauucaaaagcauauu

SEQ ID NO: 463664 - RNA, 64 nt, hsa
agaauggugugaaccugggagguggagcuugcagugaaccgagaucgcuccacugcacuccagc

SEQ ID NO: 463665 - RNA, 53 nt, hsa
ccaaaauggggaaaagcuaacucugaaccgaauguuuuggacuuaacuguugc

SEQ ID NO: 463666 - RNA, 64 nt, hsa
agauuauuuuuauuggaggaggaagcaucauucaugaaccgaucuuuuuaguugagucaguagg

SEQ ID NO: 463667 - RNA, 64 nt, hsa
gaagcccuaaagaaugcaaccuagucagguuagcugaaccgacacucaaaacgcuacugaguca

SEQ ID NO: 463668 - RNA, 64 nt, hsa
auccucugggcugcuucgucuucuuuggaccuccugaaccgagagaacccagaggaacccccac

SEQ ID NO: 463669 - RNA, 64 nt, hsa
agaaucacuugaaccugggagacagagguugcaaugaaccgagauagugccauugcacuccggc

SEQ ID NO: 463670 - RNA, 64 nt, hsa
gagaagaaaacugacccgcaggcuccucccagauugaaccgacccccgccccuccucaucgggg

SEQ ID NO: 463671 - RNA, 64 nt, hsa
aguuaaggcugagccagagcacugucucagcauuugaaccgaaugcuaauauagucacuuauua

SEQ ID NO: 463672 - RNA, 64 nt, hsa
cggcgauccgcccccagcacuggggaggcgccacugaaccgagaagggacggucaucugcuccg

SEQ ID NO: 463673 - RNA, 64 nt, hsa
caguuugagcaguauuuccgagacgagaguggccugaaccgaaagaacauccaagacaacaggg

SEQ ID NO: 463674 - RNA, 64 nt, hsa
uuugugcgucucuucucucccuuuuccccaggaaugaaccgaggccgucgccccugcacacgca

SEQ ID NO: 463675 - RNA, 64 nt, hsa
gcgcacagccagccgcguggaucccacgcagcgcugaaccgaaccgaguaggaagccuuucucc

SEQ ID NO: 463676 - RNA, 64 nt, hsa
augcuuaggguguccuccccacagagcagauacuugaaccgacucaauuccuguguaaagagca

SEQ ID NO: 463677 - RNA, 64 nt, hsa
gaugcgcaugggcaaggccagcgcccggggcuucugaaccgagcgggguguuucauuuuuuugc

SEQ ID NO: 463678 - RNA, 64 nt, hsa
cggcacugaacaaggaagccucggcagauguggcugaaccgagcuggagccaacagauguguca

SEQ ID NO: 463679 - RNA, 64 nt, hsa
cagcuacucaggaggcugaggcaggagaauggcaugaaccgaggagguggagcuugccaugagc

SEQ ID NO: 463680 - RNA, 64 nt, hsa
cuguguucucuagggauucaggacugugcucagcugaaccgaugcugguugaggggccuugagg

SEQ ID NO: 463681 - RNA, 64 nt, hsa
ucucuucuucaagucccccuuguggcggggacugugaaccgaggcagugaggugauugcugcug

SEQ ID NO: 463682 - RNA, 64 nt, hsa
ccccuggcuuccccaccucuccaggugucaaaggugaaccgaguccaguauuagcugaauguca

SEQ ID NO: 463683 - RNA, 64 nt, hsa
auaacuguaggacuucuguuuccugguaacaagaugaaccgagagagugggcuggguucuguuu

SEQ ID NO: 463684 - RNA, 64 nt, hsa
caggccuucuagcaggaggucuugaagugugcugugaaccgagggaucucaggaguugggucca

SEQ ID NO: 463685 - RNA, 64 nt, hsa
uggagaugccggggacccuucagcuauugcuuccugaaccgagggcaggaugaagauggugagg

SEQ ID NO: 463686 - RNA, 64 nt, hsa
cccuuccucuuuccaucuacccuccgauuguuccugaaccgaugagaaauaaaguuucuguuga

SEQ ID NO: 463687 - RNA, 64 nt, hsa
uuaagggcagccacagugguuucuacuguauguaugaaccgaauggaggaauguuuucaaagau

SEQ ID NO: 463688 - RNA, 64 nt, hsa
gaggagcaaggcuugccagcaagucagaaggauuugaaccgagcagccaaucuuuccagcccuc

SEQ ID NO: 463689 - RNA, 64 nt, hsa; identical to SEQ ID NO: 111305

SEQ ID NO: 463690 - RNA, 64 nt, hsa; identical to SEQ ID NO: 111306

SEQ ID NO: 463691 - RNA, 64 nt, hsa; identical to SEQ ID NO: 111307

SEQ ID NO: 463692 - RNA, 64 nt, hsa; identical to SEQ ID NO: 111308

SEQ ID NO: 463693 - RNA, 64 nt, hsa; identical to SEQ ID NO: 111309

SEQ ID NO: 463694 - RNA, 64 nt, hsa; identical to SEQ ID NO: 111310

SEQ ID NO: 463695 - RNA, 64 nt, hsa; identical to SEQ ID NO: 111311

SEQ ID NO: 463696 - RNA, 64 nt, hsa; identical to SEQ ID NO: 111312

SEQ ID NO: 463697 - RNA, 64 nt, hsa; identical to SEQ ID NO: 111313

SEQ ID NO: 463698 - RNA, 64 nt, hsa; identical to SEQ ID NO: 111314

SEQ ID NO: 463699 - RNA, 64 nt, hsa; identical to SEQ ID NO: 111315

SEQ ID NO: 463700 - RNA, 64 nt, hsa; identical to SEQ ID NO: 111316

SEQ ID NO: 463701 - RNA, 64 nt, hsa; identical to SEQ ID NO: 111317

SEQ ID NO: 463702 - RNA, 64 nt, hsa; identical to SEQ ID NO: 111318

SEQ ID NO: 463703 - RNA, 64 nt, hsa; identical to SEQ ID NO: 111319

SEQ ID NO: 463704 - RNA, 64 nt, hsa; identical to SEQ ID NO: 111320

SEQ ID NO: 463705 - RNA, 64 nt, hsa; identical to SEQ ID NO: 111321

SEQ ID NO: 463706 - RNA, 64 nt, hsa; identical to SEQ ID NO: 111322

SEQ ID NO: 463707 - RNA, 64 nt, hsa; identical to SEQ ID NO: 111323

SEQ ID NO: 463708 - RNA, 64 nt, hsa; identical to SEQ ID NO: 111324

SEQ ID NO: 463709 - RNA, 64 nt, hsa; identical to SEQ ID NO: 111325

SEQ ID NO: 463710 - RNA, 64 nt, hsa; identical to SEQ ID NO: 111326

SEQ ID NO: 463711 - RNA, 64 nt, hsa; identical to SEQ ID NO: 111327

SEQ ID NO: 463712 - RNA, 64 nt, hsa; identical to SEQ ID NO: 111328

SEQ ID NO: 463713 - RNA, 64 nt, hsa; identical to SEQ ID NO: 111329

SEQ ID NO: 463714 - RNA, 64 nt, hsa; identical to SEQ ID NO: 111330

SEQ ID NO: 463715 - RNA, 64 nt, hsa; identical to SEQ ID NO: 111331

SEQ ID NO: 463716 - RNA, 64 nt, hsa; identical to SEQ ID NO: 111332

SEQ ID NO: 463717 - RNA, 64 nt, hsa; identical to SEQ ID NO: 111333

SEQ ID NO: 463718 - RNA, 64 nt, hsa; identical to SEQ ID NO: 111334

SEQ ID NO: 463719 - RNA, 57 nt, hsa; identical to SEQ ID NO: 111335

SEQ ID NO: 463720 - RNA, 64 nt, hsa; identical to SEQ ID NO: 111336

SEQ ID NO: 463721 - RNA, 64 nt, hsa; identical to SEQ ID NO: 111337

SEQ ID NO: 463722 - RNA, 64 nt, hsa; identical to SEQ ID NO: 111338

SEQ ID NO: 463723 - RNA, 64 nt, hsa; identical to SEQ ID NO: 111339

SEQ ID NO: 463724 - RNA, 64 nt, hsa; identical to SEQ ID NO: 111340

SEQ ID NO: 463725 - RNA, 64 nt, hsa; identical to SEQ ID NO: 111341

SEQ ID NO: 463726 - RNA, 64 nt, hsa; identical to SEQ ID NO: 111342

SEQ ID NO: 463727 - RNA, 64 nt, hsa; identical to SEQ ID NO: 111343

SEQ ID NO: 463728 - RNA, 64 nt, hsa; identical to SEQ ID NO: 111344

SEQ ID NO: 463729 - RNA, 64 nt, hsa; identical to SEQ ID NO: 111345

SEQ ID NO: 463730 - RNA, 64 nt, hsa; identical to SEQ ID NO: 111346

SEQ ID NO: 463731 - RNA, 57 nt, hsa; identical to SEQ ID NO: 111347

SEQ ID NO: 463732 - RNA, 64 nt, hsa; identical to SEQ ID NO: 111348

SEQ ID NO: 463733 - RNA, 64 nt, hsa; identical to SEQ ID NO: 111349

SEQ ID NO: 463734 - RNA, 64 nt, hsa; identical to SEQ ID NO: 111350

SEQ ID NO: 463735 - RNA, 64 nt, hsa
uuacuugcccuucuauacuuucucacauguggcucccccugaauuuugcuuccuuugggagcuc

SEQ ID NO: 463736 - RNA, 64 nt, hsa
acccccagaacccucugggggccugcccaggggacccccugagccccccgaccggcuuagcugu

SEQ ID NO: 463737 - RNA, 64 nt, hsa
ccuggagcaggccucaugauguggggggacucgacccccugacauggggcagcccauagcaggc

SEQ ID NO: 463738 - RNA, 64 nt, hsa
cccauagcaggccuugugcaguggggggacucgacccccugacauggggcugccuggagcaggc

SEQ ID NO: 463739 - RNA, 64 nt, hsa
ggcacagagagcccaacccugagugucucagaggcccccugaguguuccccuuggccugagccc

SEQ ID NO: 463740 - RNA, 64 nt, hsa
ugugggaggacuagaaacagccgcggggcgaaggcccccugaggaccacuacuauacugauggu

SEQ ID NO: 463741 - RNA, 64 nt, hsa; identical to SEQ ID NO: 394214

SEQ ID NO: 463742 - RNA, 64 nt, hsa; identical to SEQ ID NO: 394215

SEQ ID NO: 463743 - RNA, 64 nt, hsa; identical to SEQ ID NO: 394216

SEQ ID NO: 463744 - RNA, 64 nt, hsa; identical to SEQ ID NO: 394217

SEQ ID NO: 463745 - RNA, 64 nt, hsa; identical to SEQ ID NO: 394218

SEQ ID NO: 463746 - RNA, 64 nt, hsa; identical to SEQ ID NO: 394219

SEQ ID NO: 463747 - RNA, 64 nt, hsa; identical to SEQ ID NO: 394220

SEQ ID NO: 463748 - RNA, 64 nt, hsa; identical to SEQ ID NO: 394221

SEQ ID NO: 463749 - RNA, 64 nt, hsa; identical to SEQ ID NO: 394222

SEQ ID NO: 463750 - RNA, 64 nt, hsa; identical to SEQ ID NO: 394223

SEQ ID NO: 463751 - RNA, 64 nt, hsa; identical to SEQ ID NO: 394224

SEQ ID NO: 463752 - RNA, 64 nt, hsa; identical to SEQ ID NO: 394225

SEQ ID NO: 463753 - RNA, 64 nt, hsa; identical to SEQ ID NO: 394226

SEQ ID NO: 463754 - RNA, 64 nt, hsa; identical to SEQ ID NO: 394227

SEQ ID NO: 463755 - RNA, 64 nt, hsa; identical to SEQ ID NO: 394228

SEQ ID NO: 463756 - RNA, 64 nt, hsa; identical to SEQ ID NO: 394229

SEQ ID NO: 463757 - RNA, 64 nt, hsa; identical to SEQ ID NO: 394230

SEQ ID NO: 463758 - RNA, 64 nt, hsa; identical to SEQ ID NO: 394231

SEQ ID NO: 463759 - RNA, 64 nt, hsa; identical to SEQ ID NO: 394232

SEQ ID NO: 463760 - RNA, 64 nt, hsa; identical to SEQ ID NO: 394233

SEQ ID NO: 463761 - RNA, 64 nt, hsa; identical to SEQ ID NO: 394234

SEQ ID NO: 463762 - RNA, 64 nt, hsa; identical to SEQ ID NO: 394235

SEQ ID NO: 463763 - RNA, 64 nt, hsa; identical to SEQ ID NO: 394236

SEQ ID NO: 463764 - RNA, 64 nt, hsa; identical to SEQ ID NO: 394237

SEQ ID NO: 463765 - RNA, 64 nt, hsa; identical to SEQ ID NO: 394238

SEQ ID NO: 463766 - RNA, 64 nt, hsa; identical to SEQ ID NO: 394239

SEQ ID NO: 463767 - RNA, 64 nt, hsa; identical to SEQ ID NO: 394240

SEQ ID NO: 463768 - RNA, 64 nt, hsa; identical to SEQ ID NO: 394241

SEQ ID NO: 463769 - RNA, 64 nt, hsa; identical to SEQ ID NO: 394242

SEQ ID NO: 463770 - RNA, 64 nt, hsa; identical to SEQ ID NO: 394243

SEQ ID NO: 463771 - RNA, 64 nt, hsa; identical to SEQ ID NO: 394244

SEQ ID NO: 463772 - RNA, 64 nt, hsa; identical to SEQ ID NO: 394245

SEQ ID NO: 463773 - RNA, 64 nt, hsa; identical to SEQ ID NO: 394246

SEQ ID NO: 463774 - RNA, 64 nt, hsa; identical to SEQ ID NO: 394247

SEQ ID NO: 463775 - RNA, 64 nt, hsa; identical to SEQ ID NO: 394248

SEQ ID NO: 463776 - RNA, 64 nt, hsa; identical to SEQ ID NO: 394249

SEQ ID NO: 463777 - RNA, 64 nt, hsa; identical to SEQ ID NO: 394250

SEQ ID NO: 463778 - RNA, 64 nt, hsa; identical to SEQ ID NO: 394251

SEQ ID NO: 463779 - RNA, 64 nt, hsa; identical to SEQ ID NO: 394252

SEQ ID NO: 463780 - RNA, 64 nt, hsa; identical to SEQ ID NO: 394253

SEQ ID NO: 463781 - RNA, 64 nt, hsa; identical to SEQ ID NO: 394254

SEQ ID NO: 463782 - RNA, 64 nt, hsa; identical to SEQ ID NO: 394255

SEQ ID NO: 463783 - RNA, 64 nt, hsa; identical to SEQ ID NO: 394256

SEQ ID NO: 463784 - RNA, 64 nt, hsa; identical to SEQ ID NO: 394257

SEQ ID NO: 463785 - RNA, 64 nt, hsa; identical to SEQ ID NO: 394258

SEQ ID NO: 463786 - RNA, 64 nt, hsa; identical to SEQ ID NO: 394259

SEQ ID NO: 463787 - RNA, 64 nt, hsa; identical to SEQ ID NO: 190207

SEQ ID NO: 463788 - RNA, 64 nt, hsa; identical to SEQ ID NO: 190208

SEQ ID NO: 463789 - RNA, 64 nt, hsa; identical to SEQ ID NO: 190211

SEQ ID NO: 463790 - RNA, 64 nt, hsa; identical to SEQ ID NO: 190212

SEQ ID NO: 463791 - RNA, 64 nt, hsa; identical to SEQ ID NO: 190223

SEQ ID NO: 463792 - RNA, 64 nt, hsa; identical to SEQ ID NO: 190224

SEQ ID NO: 463793 - RNA, 64 nt, hsa; identical to SEQ ID NO: 190242

SEQ ID NO: 463794 - RNA, 64 nt, hsa; identical to SEQ ID NO: 190243

SEQ ID NO: 463795 - RNA, 64 nt, hsa; identical to SEQ ID NO: 190289

SEQ ID NO: 463796 - RNA, 64 nt, hsa; identical to SEQ ID NO: 190290

SEQ ID NO: 463797 - RNA, 64 nt, hsa; identical to SEQ ID NO: 190311

SEQ ID NO: 463798 - RNA, 64 nt, hsa; identical to SEQ ID NO: 190312

SEQ ID NO: 463799 - RNA, 64 nt, hsa; identical to SEQ ID NO: 190388

SEQ ID NO: 463800 - RNA, 64 nt, hsa; identical to SEQ ID NO: 190389

SEQ ID NO: 463801 - RNA, 64 nt, hsa; identical to SEQ ID NO: 332827

SEQ ID NO: 463802 - RNA, 64 nt, hsa; identical to SEQ ID NO: 332828

SEQ ID NO: 463803 - RNA, 64 nt, hsa; identical to SEQ ID NO: 332829

SEQ ID NO: 463804 - RNA, 64 nt, hsa; identical to SEQ ID NO: 332830

SEQ ID NO: 463805 - RNA, 64 nt, hsa; identical to SEQ ID NO: 332831

SEQ ID NO: 463806 - RNA, 64 nt, hsa; identical to SEQ ID NO: 332832

SEQ ID NO: 463807 - RNA, 64 nt, hsa
uuggugagaccuggagcugccuguuucuucccuaggggaucaccacggcucuagggcauucuag

SEQ ID NO: 463808 - RNA, 64 nt, hsa
uaaacccagugagaggugagggggagugaugaaaggggaucagcuguauuugugugugugugug

SEQ ID NO: 463809 - RNA, 64 nt, hsa
uaagaaaauaauguauugaguuacugucaaguagccaaguuaaugggaaugcuccaucuaccug

SEQ ID NO: 463810 - RNA, 64 nt, hsa
agagcaaaguuaauuauaaaaauuagacauuuugccaaguuaguuuucuuaccacaauacccuc

SEQ ID NO: 463811 - RNA, 63 nt, hsa
uggaaaauuuucagaauacuuuaaaaauaaaguuccaaguuacacaguuuggccuuuuuuuug

SEQ ID NO: 463812 - RNA, 64 nt, hsa
uacauagaaaauuaauacaauguuuuagaaacagccaaguuaauuuuagaggcaagaacaugau

SEQ ID NO: 463813 - RNA, 64 nt, hsa
guaaauagaauccaagucaauugugacugcaauuccaaguuaguauuuaaaaauagagaaauug

SEQ ID NO: 463814 - RNA, 64 nt, hsa
cuugauauaacuccuaguuauaauuuugaugcaaccaaguuauuuuuuauauauuuuguuauuu

SEQ ID NO: 463815 - RNA, 64 nt, hsa; identical to SEQ ID NO: 195795

SEQ ID NO: 463816 - RNA, 64 nt, hsa; identical to SEQ ID NO: 195796

SEQ ID NO: 463817 - RNA, 64 nt, hsa; identical to SEQ ID NO: 195797

SEQ ID NO: 463818 - RNA, 64 nt, hsa; identical to SEQ ID NO: 195798

SEQ ID NO: 463819 - RNA, 64 nt, hsa; identical to SEQ ID NO: 195799

SEQ ID NO: 463820 - RNA, 64 nt, hsa; identical to SEQ ID NO: 195800

SEQ ID NO: 463821 - RNA, 64 nt, hsa; identical to SEQ ID NO: 195801

SEQ ID NO: 463822 - RNA, 64 nt, hsa; identical to SEQ ID NO: 195802

SEQ ID NO: 463823 - RNA, 64 nt, hsa; identical to SEQ ID NO: 195803

SEQ ID NO: 463824 - RNA, 64 nt, hsa; identical to SEQ ID NO: 195804

SEQ ID NO: 463825 - RNA, 64 nt, hsa; identical to SEQ ID NO: 195805

SEQ ID NO: 463826 - RNA, 64 nt, hsa; identical to SEQ ID NO: 195806

SEQ ID NO: 463827 - RNA, 64 nt, hsa; identical to SEQ ID NO: 195807

SEQ ID NO: 463828 - RNA, 64 nt, hsa; identical to SEQ ID NO: 195808

SEQ ID NO: 463829 - RNA, 64 nt, hsa; identical to SEQ ID NO: 195809

SEQ ID NO: 463830 - RNA, 64 nt, hsa; identical to SEQ ID NO: 195810

SEQ ID NO: 463831 - RNA, 64 nt, hsa; identical to SEQ ID NO: 195811

SEQ ID NO: 463832 - RNA, 64 nt, hsa; identical to SEQ ID NO: 195812

SEQ ID NO: 463833 - RNA, 64 nt, hsa; identical to SEQ ID NO: 195813

SEQ ID NO: 463834 - RNA, 64 nt, hsa; identical to SEQ ID NO: 195814

SEQ ID NO: 463835 - RNA, 64 nt, hsa; identical to SEQ ID NO: 195815

SEQ ID NO: 463836 - RNA, 64 nt, hsa; identical to SEQ ID NO: 195816

SEQ ID NO: 463837 - RNA, 64 nt, hsa; identical to SEQ ID NO: 195817

SEQ ID NO: 463838 - RNA, 64 nt, hsa; identical to SEQ ID NO: 195818

SEQ ID NO: 463839 - RNA, 64 nt, hsa; identical to SEQ ID NO: 195819

SEQ ID NO: 463840 - RNA, 64 nt, hsa; identical to SEQ ID NO: 195820

SEQ ID NO: 463841 - RNA, 64 nt, hsa; identical to SEQ ID NO: 195821

SEQ ID NO: 463842 - RNA, 64 nt, hsa; identical to SEQ ID NO: 195822

SEQ ID NO: 463843 - RNA, 64 nt, hsa; identical to SEQ ID NO: 195823

SEQ ID NO: 463844 - RNA, 64 nt, hsa; identical to SEQ ID NO: 195824

SEQ ID NO: 463845 - RNA, 64 nt, hsa; identical to SEQ ID NO: 195825

SEQ ID NO: 463846 - RNA, 64 nt, hsa; identical to SEQ ID NO: 195826

SEQ ID NO: 463847 - RNA, 64 nt, hsa; identical to SEQ ID NO: 195827

SEQ ID NO: 463848 - RNA, 64 nt, hsa; identical to SEQ ID NO: 195828

SEQ ID NO: 463849 - RNA, 64 nt, hsa; identical to SEQ ID NO: 195829

SEQ ID NO: 463850 - RNA, 64 nt, hsa; identical to SEQ ID NO: 195830

SEQ ID NO: 463851 - RNA, 64 nt, hsa; identical to SEQ ID NO: 195831

SEQ ID NO: 463852 - RNA, 64 nt, hsa; identical to SEQ ID NO: 195832

SEQ ID NO: 463853 - RNA, 64 nt, hsa; identical to SEQ ID NO: 195833

SEQ ID NO: 463854 - RNA, 64 nt, hsa; identical to SEQ ID NO: 195834

SEQ ID NO: 463855 - RNA, 64 nt, hsa; identical to SEQ ID NO: 195835

SEQ ID NO: 463856 - RNA, 64 nt, hsa; identical to SEQ ID NO: 195836

SEQ ID NO: 463857 - RNA, 64 nt, hsa
cuaaagcagguuuccccacucaucuagguugucuugaaaggaggauagagccacuuacaguuuu

SEQ ID NO: 463858 - RNA, 64 nt, hsa
uuucugcaggaugcuuuuaacugauguaggaaacugaaaggaaauagauuuuuuccaaaaccca

SEQ ID NO: 463859 - RNA, 64 nt, hsa
auaauuauauaaauauuaaugaauucagauuagcugaaaggaaaaaaaguagaagccugacuac

SEQ ID NO: 463860 - RNA, 64 nt, hsa
uugcuucugauuauugaagaggucagauuaugaaugaaaggauaaaauguuuuaauaguagagc

SEQ ID NO: 463861 - RNA, 64 nt, hsa
uaaccuaguuuguuacuuuaaaaaucaguuuugaugaaaggagggaaaagcagauggacuugaa

SEQ ID NO: 463862 - RNA, 64 nt, hsa
agugauggacuccgauuuggagaguaguaagacgugaaaggaauacacuuguguuuaagcacca

SEQ ID NO: 463863 - RNA, 64 nt, hsa
cuccgcggcgcucacccuccucagucccaguuucugaaaggacucagcugagaaaggacaacug

SEQ ID NO: 463864 - RNA, 64 nt, hsa
caacaauagaauuaccauauuguuuuuccugguuugaaaggaccagauggaaagaaacugggca

SEQ ID NO: 463865 - RNA, 64 nt, hsa
gcaggcccauguuucagccucagcccacgccaggugaaaggaucagcaaugcucuguugccauc

SEQ ID NO: 463866 - RNA, 64 nt, hsa
gcccggccccacacugccucuguggccuggacuuugaaaggaacccacugaacacuaauuauga

SEQ ID NO: 463867 - RNA, 64 nt, hsa
uguuugugaacacugaugcaagaaacuuguuaaaugaaaggacucuuuacccuagaaggaagag

SEQ ID NO: 463868 - RNA, 64 nt, hsa
uuuauauccucuucuguugaaugcaguccaaacaugaaaggaaauaauuguuuuauauuauaac

SEQ ID NO: 463869 - RNA, 64 nt, hsa
cuuuaaaaaaaaguaugcuagcacuauuguaccuugaaaggauuuccaccagacugucuugagu

SEQ ID NO: 463870 - RNA, 64 nt, hsa
ccacacaaggaacuacauuccagauuuaaagaaaugaaaggauaccauuaguguguauaacaga

SEQ ID NO: 463871 - RNA, 64 nt, hsa
ggaucucaaauuuucaucugcacaaugaggcuguugaaaggaaaaaaagugagccucuaggaau

SEQ ID NO: 463872 - RNA, 64 nt, hsa
ugaaauggcugcagauagaucccgcagucccuucugaaaggaacuguguagccagcagggaccu

SEQ ID NO: 463873 - RNA, 64 nt, hsa
gcuggcuuggugugaacucgcuuaaaagcaauggugaaaggauaaccucgaugauguaaaucca

SEQ ID NO: 463874 - RNA, 64 nt, hsa
agcaggaagcuugagucaaaauguguuuccccuuugaaaggagaaggaauuggagcagcuuuuc

SEQ ID NO: 463875 - RNA, 64 nt, hsa
ugagaccucuuaagaaaaaauaaaaaguaaaaaaugaaaggaaucuuuuuuagaaauagagaug

SEQ ID NO: 463876 - RNA, 64 nt, hsa
ucuuuuauuucuucuccuuguggacaguuguuaaugaaaggaguaaggauuucccuuuuuuugu

SEQ ID NO: 463877 - RNA, 64 nt, hsa
ggaaggagugugcccagaccagcugggggagcauugaaaggacagcuuggggauggaauuuuuu

SEQ ID NO: 463878 - RNA, 64 nt, hsa
uagacuauguuaacuaguuaaggauguuacauuuugaaaggauguauguuagauauauuauuug

SEQ ID NO: 463879 - RNA, 64 nt, hsa
cuacaacuugauaaccccuagaaagaagaggacaugaaaggaugcuggcuauauauguuaauga

SEQ ID NO: 463880 - RNA, 64 nt, hsa
acugaagcacgugagagacccucgcaaaaugaugugaaaggaccaguuucuugaaguccagugu

SEQ ID NO: 463881 - RNA, 64 nt, hsa
ggcccaggagagaacacggggagguuuguuugugugaaaggaaaguaguccaggcugucccuga

SEQ ID NO: 463882 - RNA, 64 nt, hsa
ugaucauggguguggcauucucuaacaaaugaugugaaaggaaaguaguuuucauaaaacucau

SEQ ID NO: 463883 - RNA, 64 nt, hsa
agucagccaaucuuuuauuguuccuuugcuacuuugaaaggaaaaaaaagguugucucuugauu

SEQ ID NO: 463884 - RNA, 64 nt, hsa
ugucuguaccugucugaagagugacauuaaacuuugaaaggacuucacugcuccuuuacgauau

SEQ ID NO: 463885 - RNA, 64 nt, hsa
uuagauguagaaaauaaugaauuaaugagauuggugaaaggaaaucaugcaaaacauuugaaug

SEQ ID NO: 463886 - RNA, 64 nt, hsa
ugguugcuuuguuggaauggaauuuaaauuuaaaugaaaggaaaaauauaucccugguaguuuu

SEQ ID NO: 463887 - RNA, 64 nt, hsa
aaccuuacuugcacuuuauguauacuuccugauuugaaaggaggagguuugaaaagaaaaaaau

SEQ ID NO: 463888 - RNA, 64 nt, hsa
uacagcuguccuugaacaaguaucaauguguuuaugaaaggaagaucuaaaucagacaggaguu

SEQ ID NO: 463889 - RNA, 64 nt, hsa
uuggaauggaacccuugcuauaguagugacaaagugaaaggaaauuuaggaggcauaggccauu

SEQ ID NO: 463890 - RNA, 53 nt, hsa; identical to SEQ ID NO: 455350

SEQ ID NO: 463891 - RNA, 64 nt, hsa
aagccuucaguccuuucuguuucuuucaacuacgugaaaggauucacaguggagaaagacccug

SEQ ID NO: 463892 - RNA, 64 nt, hsa
aagccuuuguuuccuucacuuccuuucgauaucaugaaaggacucacacuggagagaaccccua

SEQ ID NO: 463893 - RNA, 64 nt, hsa
aagcauuccauaauuucucuucuuugcaaauacaugaaaggaugcacagaggagagaagcucug

SEQ ID NO: 463894 - RNA, 64 nt, hsa
aagccuuuauuucuuccacuucuuuucaauaucaugaaaggacucacaugggagagaaacccua

SEQ ID NO: 463895 - RNA, 64 nt, hsa
aagccuucauuucuucuaguucccuucaauaucaugaaaggacucacacuggagagaagcccua

SEQ ID NO: 463896 - RNA, 64 nt, hsa
aagucuucagaucugucaagaaccuuucaauuuaugaaaggacacacacuggagagaaacccua

SEQ ID NO: 463897 - RNA, 64 nt, hsa
aagcauucaauuauuuuucuuccuugcauauacaugaaaggacucauacgagagagaauccgua

SEQ ID NO: 463898 - RNA, 64 nt, hsa
aagcuuucacuucuuccaguucuuuucaauaucaugaaaggacucacacuggggagaaaccgua

SEQ ID NO: 463899 - RNA, 64 nt, hsa
aagccuucaaucuuuccaguuccuuucaguaucaugaaaggacucacacuggagagaaacccua

SEQ ID NO: 463900 - RNA, 64 nt, hsa
aagccuucagaucugccucacaccuucaaauucaugaaaggacacaaacacacauaagaauaca

SEQ ID NO: 463901 - RNA, 64 nt, hsa
aagccuucaguaguuccaguuccuuuugguaccaugaaaggacucacacuggagagaaacccua

SEQ ID NO: 463902 - RNA, 64 nt, hsa
aagccuucagaucugccaagaaccuucgaauucaugaaaggacacaaacacacguaagaaugca

SEQ ID NO: 463903 - RNA, 64 nt, hsa
aagccuuuauuucuuucacuucuuuucgauaacaugaaaggacucacacuggagagaaacccua

SEQ ID NO: 463904 - RNA, 64 nt, hsa
aagccuuuuauuguugcaguucugcccgaagacaugaaaggaugcacacugcaaagaaacagua

SEQ ID NO: 463905 - RNA, 64 nt, hsa
aagcauuuagauacuacuacucagcucaaagacaugaaaggacucauacuggagagaaacccua

SEQ ID NO: 463906 - RNA, 64 nt, hsa
aacccuucauuuaccgccauucugcucgagcacaugaaaggaaucacacuguacagaaacgcua

SEQ ID NO: 463907 - RNA, 64 nt, hsa
aagccuucagucauuuuggucacuuaaagcaacaugaaaggauucacacuggagagaagccgua

SEQ ID NO: 463908 - RNA, 64 nt, hsa
aagccuuuguuuauuucauuggauuucaaagacaugaaaggacucacacuagggagaaaaucua

SEQ ID NO: 463909 - RNA, 64 nt, hsa
gcccagccuuuuuucugcaugauccaggagcacauaccacaaacuaccacaauaaaaaagcugu

SEQ ID NO: 463910 - RNA, 64 nt, hsa
uuuucugcaugauccaggagcacauaccacaaacuaccacaauaaaaaagcuguuuuugcuaau

SEQ ID NO: 463911 - RNA, 64 nt, hsa
uguuaagaggauagauuucauguuaugcauuuuuuaccacaauuuuuaaaaaguuugaauagaa

SEQ ID NO: 463912 - RNA, 64 nt, hsa
aagauacuauuuauaaguugaagaaaguuugcuguaccacaaugcgcauguaguuaacaauuuu

SEQ ID NO: 463913 - RNA, 64 nt, hsa
aucuuucugcuguuuguuguccugcuugguugaguaccacaauuaaagauuaugcuccccuuuu

SEQ ID NO: 463914 - RNA, 64 nt, hsa
cagacauuuuguuauugauaccuuaaaggucaccuaccacaaauugauggcuagagcaagaccu

SEQ ID NO: 463915 - RNA, 64 nt, hsa; identical to SEQ ID NO: 377221

SEQ ID NO: 463916 - RNA, 64 nt, hsa; identical to SEQ ID NO: 377222

SEQ ID NO: 463917 - RNA, 64 nt, hsa; identical to SEQ ID NO: 377223

SEQ ID NO: 463918 - RNA, 64 nt, hsa; identical to SEQ ID NO: 377224

SEQ ID NO: 463919 - RNA, 64 nt, hsa; identical to SEQ ID NO: 377225

SEQ ID NO: 463920 - RNA, 64 nt, hsa; identical to SEQ ID NO: 377226

SEQ ID NO: 463921 - RNA, 64 nt, hsa; identical to SEQ ID NO: 377227

SEQ ID NO: 463922 - RNA, 64 nt, hsa; identical to SEQ ID NO: 377228

SEQ ID NO: 463923 - RNA, 64 nt, hsa; identical to SEQ ID NO: 377229

SEQ ID NO: 463924 - RNA, 64 nt, hsa; identical to SEQ ID NO: 377230

SEQ ID NO: 463925 - RNA, 64 nt, hsa; identical to SEQ ID NO: 377231

SEQ ID NO: 463926 - RNA, 64 nt, hsa; identical to SEQ ID NO: 377232

SEQ ID NO: 463927 - RNA, 64 nt, hsa; identical to SEQ ID NO: 377233

SEQ ID NO: 463928 - RNA, 64 nt, hsa; identical to SEQ ID NO: 377234

SEQ ID NO: 463929 - RNA, 64 nt, hsa; identical to SEQ ID NO: 377235

SEQ ID NO: 463930 - RNA, 64 nt, hsa; identical to SEQ ID NO: 377236

SEQ ID NO: 463931 - RNA, 64 nt, hsa; identical to SEQ ID NO: 377237

SEQ ID NO: 463932 - RNA, 64 nt, hsa; identical to SEQ ID NO: 377238

SEQ ID NO: 463933 - RNA, 64 nt, hsa; identical to SEQ ID NO: 377239

SEQ ID NO: 463934 - RNA, 64 nt, hsa; identical to SEQ ID NO: 377240

SEQ ID NO: 463935 - RNA, 64 nt, hsa; identical to SEQ ID NO: 377241

SEQ ID NO: 463936 - RNA, 64 nt, hsa; identical to SEQ ID NO: 377242

SEQ ID NO: 463937 - RNA, 64 nt, hsa; identical to SEQ ID NO: 377243

SEQ ID NO: 463938 - RNA, 64 nt, hsa; identical to SEQ ID NO: 377244

SEQ ID NO: 463939 - RNA, 64 nt, hsa; identical to SEQ ID NO: 377245

SEQ ID NO: 463940 - RNA, 64 nt, hsa; identical to SEQ ID NO: 377246

SEQ ID NO: 463941 - RNA, 64 nt, hsa; identical to SEQ ID NO: 377247

SEQ ID NO: 463942 - RNA, 64 nt, hsa; identical to SEQ ID NO: 377248

SEQ ID NO: 463943 - RNA, 64 nt, hsa; identical to SEQ ID NO: 377249

SEQ ID NO: 463944 - RNA, 64 nt, hsa; identical to SEQ ID NO: 377250

SEQ ID NO: 463945 - RNA, 64 nt, hsa; identical to SEQ ID NO: 377251

SEQ ID NO: 463946 - RNA, 64 nt, hsa; identical to SEQ ID NO: 377252

SEQ ID NO: 463947 - RNA, 64 nt, hsa; identical to SEQ ID NO: 377253

SEQ ID NO: 463948 - RNA, 64 nt, hsa; identical to SEQ ID NO: 377254

SEQ ID NO: 463949 - RNA, 64 nt, hsa; identical to SEQ ID NO: 377255

SEQ ID NO: 463950 - RNA, 64 nt, hsa; identical to SEQ ID NO: 377256

SEQ ID NO: 463951 - RNA, 64 nt, hsa; identical to SEQ ID NO: 377257

SEQ ID NO: 463952 - RNA, 64 nt, hsa; identical to SEQ ID NO: 377258

SEQ ID NO: 463953 - RNA, 64 nt, hsa; identical to SEQ ID NO: 377259

SEQ ID NO: 463954 - RNA, 64 nt, hsa; identical to SEQ ID NO: 377260

SEQ ID NO: 463955 - RNA, 64 nt, hsa; identical to SEQ ID NO: 377261

SEQ ID NO: 463956 - RNA, 64 nt, hsa; identical to SEQ ID NO: 377262

SEQ ID NO: 463957 - RNA, 64 nt, hsa; identical to SEQ ID NO: 377263

SEQ ID NO: 463958 - RNA, 64 nt, hsa; identical to SEQ ID NO: 377260

SEQ ID NO: 463959 - RNA, 64 nt, hsa; identical to SEQ ID NO: 377259

SEQ ID NO: 463960 - RNA, 64 nt, hsa; identical to SEQ ID NO: 377266

SEQ ID NO: 463961 - RNA, 64 nt, hsa; identical to SEQ ID NO: 377267

SEQ ID NO: 463962 - RNA, 64 nt, hsa; identical to SEQ ID NO: 377268

SEQ ID NO: 463963 - RNA, 64 nt, hsa; identical to SEQ ID NO: 377269

SEQ ID NO: 463964 - RNA, 64 nt, hsa; identical to SEQ ID NO: 377270

SEQ ID NO: 463965 - RNA, 64 nt, hsa; identical to SEQ ID NO: 377271

SEQ ID NO: 463966 - RNA, 64 nt, hsa; identical to SEQ ID NO: 377272

SEQ ID NO: 463967 - RNA, 64 nt, hsa; identical to SEQ ID NO: 377273

SEQ ID NO: 463968 - RNA, 64 nt, hsa; identical to SEQ ID NO: 377274

SEQ ID NO: 463969 - RNA, 64 nt, hsa; identical to SEQ ID NO: 377275

SEQ ID NO: 463970 - RNA, 64 nt, hsa; identical to SEQ ID NO: 377276

SEQ ID NO: 463971 - RNA, 64 nt, hsa; identical to SEQ ID NO: 377277

SEQ ID NO: 463972 - RNA, 64 nt, hsa; identical to SEQ ID NO: 377278

SEQ ID NO: 463973 - RNA, 64 nt, hsa; identical to SEQ ID NO: 377279

SEQ ID NO: 463974 - RNA, 64 nt, hsa; identical to SEQ ID NO: 377280

SEQ ID NO: 463975 - RNA, 64 nt, hsa; identical to SEQ ID NO: 377281

SEQ ID NO: 463976 - RNA, 64 nt, hsa; identical to SEQ ID NO: 377282

SEQ ID NO: 463977 - RNA, 64 nt, hsa; identical to SEQ ID NO: 377283

SEQ ID NO: 463978 - RNA, 64 nt, hsa; identical to SEQ ID NO: 377284

SEQ ID NO: 463979 - RNA, 64 nt, hsa; identical to SEQ ID NO: 377285

SEQ ID NO: 463980 - RNA, 64 nt, hsa; identical to SEQ ID NO: 377286

SEQ ID NO: 463981 - RNA, 64 nt, hsa; identical to SEQ ID NO: 377287

SEQ ID NO: 463982 - RNA, 64 nt, hsa; identical to SEQ ID NO: 377288

SEQ ID NO: 463983 - RNA, 64 nt, hsa; identical to SEQ ID NO: 377289

SEQ ID NO: 463984 - RNA, 64 nt, hsa; identical to SEQ ID NO: 377290

SEQ ID NO: 463985 - RNA, 64 nt, hsa; identical to SEQ ID NO: 377291

SEQ ID NO: 463986 - RNA, 64 nt, hsa; identical to SEQ ID NO: 377292

SEQ ID NO: 463987 - RNA, 64 nt, hsa; identical to SEQ ID NO: 377293

SEQ ID NO: 463988 - RNA, 64 nt, hsa; identical to SEQ ID NO: 377294

SEQ ID NO: 463989 - RNA, 64 nt, hsa; identical to SEQ ID NO: 377295

SEQ ID NO: 463990 - RNA, 64 nt, hsa; identical to SEQ ID NO: 377296

SEQ ID NO: 463991 - RNA, 64 nt, hsa; identical to SEQ ID NO: 377297

SEQ ID NO: 463992 - RNA, 64 nt, hsa; identical to SEQ ID NO: 377298

SEQ ID NO: 463993 - RNA, 64 nt, hsa; identical to SEQ ID NO: 209365

SEQ ID NO: 463994 - RNA, 64 nt, hsa; identical to SEQ ID NO: 209366

SEQ ID NO: 463995 - RNA, 64 nt, hsa; identical to SEQ ID NO: 209367

SEQ ID NO: 463996 - RNA, 64 nt, hsa; identical to SEQ ID NO: 209368

SEQ ID NO: 463997 - RNA, 64 nt, hsa; identical to SEQ ID NO: 209369

SEQ ID NO: 463998 - RNA, 64 nt, hsa; identical to SEQ ID NO: 209370

SEQ ID NO: 463999 - RNA, 64 nt, hsa; identical to SEQ ID NO: 209371

SEQ ID NO: 464000 - RNA, 64 nt, hsa; identical to SEQ ID NO: 209372

SEQ ID NO: 464001 - RNA, 64 nt, hsa; identical to SEQ ID NO: 209373

SEQ ID NO: 464002 - RNA, 64 nt, hsa; identical to SEQ ID NO: 209374

SEQ ID NO: 464003 - RNA, 64 nt, hsa; identical to SEQ ID NO: 209375

SEQ ID NO: 464004 - RNA, 64 nt, hsa; identical to SEQ ID NO: 209376

SEQ ID NO: 464005 - RNA, 64 nt, hsa; identical to SEQ ID NO: 209377

SEQ ID NO: 464006 - RNA, 64 nt, hsa; identical to SEQ ID NO: 209378

SEQ ID NO: 464007 - RNA, 64 nt, hsa; identical to SEQ ID NO: 209379

SEQ ID NO: 464008 - RNA, 64 nt, hsa; identical to SEQ ID NO: 209380

SEQ ID NO: 464009 - RNA, 64 nt, hsa; identical to SEQ ID NO: 209381

SEQ ID NO: 464010 - RNA, 64 nt, hsa; identical to SEQ ID NO: 209382

SEQ ID NO: 464011 - RNA, 64 nt, hsa; identical to SEQ ID NO: 209383

SEQ ID NO: 464012 - RNA, 64 nt, hsa; identical to SEQ ID NO: 313174

SEQ ID NO: 464013 - RNA, 64 nt, hsa; identical to SEQ ID NO: 313175

SEQ ID NO: 464014 - RNA, 64 nt, hsa; identical to SEQ ID NO: 313176

SEQ ID NO: 464015 - RNA, 64 nt, hsa; identical to SEQ ID NO: 313177

SEQ ID NO: 464016 - RNA, 64 nt, hsa; identical to SEQ ID NO: 313178

SEQ ID NO: 464017 - RNA, 64 nt, hsa; identical to SEQ ID NO: 313179

SEQ ID NO: 464018 - RNA, 64 nt, hsa; identical to SEQ ID NO: 313180

SEQ ID NO: 464019 - RNA, 64 nt, hsa; identical to SEQ ID NO: 313181

SEQ ID NO: 464020 - RNA, 64 nt, hsa; identical to SEQ ID NO: 313182

SEQ ID NO: 464021 - RNA, 64 nt, hsa; identical to SEQ ID NO: 313183

SEQ ID NO: 464022 - RNA, 64 nt, hsa; identical to SEQ ID NO: 313184

SEQ ID NO: 464023 - RNA, 64 nt, hsa; identical to SEQ ID NO: 313185

SEQ ID NO: 464024 - RNA, 64 nt, hsa; identical to SEQ ID NO: 313186

SEQ ID NO: 464025 - RNA, 64 nt, hsa; identical to SEQ ID NO: 313187

SEQ ID NO: 464026 - RNA, 64 nt, hsa
caagaauuaaaaucaugugcuguauuuuuaaaaucuagccaaauuaaauaguacaugagaaauu

SEQ ID NO: 464027 - RNA, 64 nt, hsa
ucacaccuguaaucuucaggauuucaagaccagccuagccaacaugacgaaaccccaucucuac

SEQ ID NO: 464028 - RNA, 64 nt, hsa
gaauacucuuuuugccuuguaucuucucagccuccuagccaaguccuauguaauauggaaaaca

SEQ ID NO: 464029 - RNA, 64 nt, hsa
uaaucagcagcguaacuacccuaaaagcauaucacuagccaaagagggaaauaucuguucuucu

SEQ ID NO: 464030 - RNA, 64 nt, hsa
gcgaccuggagcagcucuugacccuggcuguguacuagccaaaaugcaacuggacaaccccagc

SEQ ID NO: 464031 - RNA, 64 nt, hsa
ugaaguuccuggaucucccauauuugugaugagacuagccaaacaaucucgucaucuggaggug

SEQ ID NO: 464032 - RNA, 64 nt, hsa
uaauucuaaaccugaaggcauccuugaaaucaugcuugaauauugcuuugauagcugcuaucau

SEQ ID NO: 464033 - RNA, 64 nt, hsa
aaucuaguuaaauuucccauuuguauuuuauuuucuugaauacuuuuuucauaguuauuuguuu

SEQ ID NO: 464034 - RNA, 64 nt, hsa
cuguauuuuggaagauauuugaaauuauguaauucuugaauaaaacauuuuucaaaacucaagu

SEQ ID NO: 464035 - RNA, 64 nt, hsa
cacagcuauaaauugaggcagcuaacgucaaauucuugaauacaaaacuuugccuguuguacau

SEQ ID NO: 464036 - RNA, 64 nt, hsa
caucucuaguaaauacuguuacaggauucaugaacuugaauaauucuacaguuugaaacucuga

SEQ ID NO: 464037 - RNA, 64 nt, hsa
uaaauuuuaaaaaagcacuugguugaaaauuguacuugaauacauacaugcaugcugcuaaacu

SEQ ID NO: 464038 - RNA, 64 nt, hsa
uuucuugcuucauuagaguaagucugucagaaagcuugaauauuuuugacauucauuuugauuc

SEQ ID NO: 464039 - RNA, 64 nt, hsa
auacauuuuaaagacaaaacuugaaaaauguauucuugaauagugaauaauuugaucaauguua

SEQ ID NO: 464040 - RNA, 64 nt, hsa
agagcaaaagaacccucuucugguugauugugaccuugaauacaaaauaaaaguagugauuagu

SEQ ID NO: 464041 - RNA, 64 nt, hsa
uguuuuucagccauugaaaauguuaugaaaaagccuugaauaugcaugcugcuuucauuuuuau

SEQ ID NO: 464042 - RNA, 64 nt, hsa
uugauuuggucuaaauuugaauauauaugaguuacuugaauauaacaaaaaugaauuuuguuug

SEQ ID NO: 464043 - RNA, 64 nt, hsa
uuugauagauuuauauuguaaccuuuuucuaguucuugaauaaauauagccugcuuucccuaga

SEQ ID NO: 464044 - RNA, 64 nt, hsa
uuuaccuggguguuccacagcugauagugauugccuugaauaaauucaagggcaauuuauucau

SEQ ID NO: 464045 - RNA, 64 nt, hsa
gccucaguucuguauaggcaaugcuguguuauuacuugaauauagaauauauaguuuacaaaau

SEQ ID NO: 464046 - RNA, 64 nt, hsa
auuacuugguuucuuuuacuuaccugcuugaauacuugaauaaaccauucaccaauuuuaaucc

SEQ ID NO: 464047 - RNA, 64 nt, hsa
cguuguguauuacuugguuucuuuuacuuaccugcuugaauacuugaauaaaccauucaccaau

SEQ ID NO: 464048 - RNA, 64 nt, hsa
acaugggugaacuuacuugcauaccaaguugauacuugaauaaccaucugaaagugguacuuga

SEQ ID NO: 464049 - RNA, 64 nt, hsa
auguucuagaaacauguaauccuaaauuuacccucuugaauauaaucccuggaugauauuuuuu

SEQ ID NO: 464050 - RNA, 64 nt, hsa
gaggcaguaauuacaguggaaugaguacuggacaaggagucaaaaaacuugauuucagguccua

SEQ ID NO: 464051 - RNA, 64 nt, hsa
guguauuuaauuccaucagguccaguacaguacuaggagucauaauacuuuauaaucaauuaaa

SEQ ID NO: 464052 - RNA, 64 nt, hsa
uuuuuaaacguuuguaaaaaccucuuugaggaugaggagucaguaaaauuccacuccccaagug

SEQ ID NO: 464053 - RNA, 64 nt, hsa
uuugguccauguaagugcuacccguugcugggggaggagucaugguuuauuuggaaaugucagu

SEQ ID NO: 464054 - RNA, 64 nt, hsa
ucccugcagcugccuagaccccguucacagugggaggagucaaugucauucuaccccucgcuaa

SEQ ID NO: 464055 - RNA, 64 nt, hsa
ccuccacuggauuccuuuguuucuguccccuccgaggagucauuuuggucgacaggcucucaag

SEQ ID NO: 464056 - RNA, 64 nt, hsa
cacagggaagggugaugcagggaagggugacaucaggagucagggcauggacugguaagaugaa

SEQ ID NO: 464057 - RNA, 61 nt, hsa
cacagaagaaaaagaauuaguuccaucagggaggagucagaggaauuugcccaauggcugg

SEQ ID NO: 464058 - RNA, 64 nt, hsa
ggguggccagugggacucaggagagagcaagcuaaggagucaccaaaaaaaaaaaaaaaaaaaa

SEQ ID NO: 464059 - RNA, 64 nt, hsa
uuacauucugccaggggcaaaagauacuaggcccaggagucaagaaaagcuuuugugaaaguga

SEQ ID NO: 464060 - RNA, 64 nt, hsa
gcuccaccaggagaucaagcaagggcugccuuucaggagucaccuccugagccacuucagaguu

SEQ ID NO: 464061 - RNA, 64 nt, hsa
aaagcaugcaucuuagaaauagccccucaauuccaggagucaacaugccaaagaaugaggcugg

SEQ ID NO: 464062 - RNA, 64 nt, hsa
uggcagaaaacaaaagugacgagaaaaaaaaaucaggagucagcucugacaaugaagaugauga

SEQ ID NO: 464063 - RNA, 64 nt, hsa
gcugcugcccgggaaaagcuggcccaggcgucuaaggagucaaaagagaaacagcuucaagcag

SEQ ID NO: 464064 - RNA, 64 nt, hsa
aaggaagugucguugcuguuagagccucacguggaggagucacuuaaacaccaguuuuuuacug

SEQ ID NO: 464065 - RNA, 64 nt, hsa
acauucuugguccuggugcuuggguuaugauggcaggagucaagaagaagauuacuuucauucu

SEQ ID NO: 464066 - RNA, 64 nt, hsa
gucacugugcccagcagggugggcugugcccagcaggagucaggcuaagaaacgccaggucugc

SEQ ID NO: 464067 - RNA, 64 nt, hsa
augcagcccgaaaccuccagucacugcgcccggcaggagucaggagccagggacugugcagccu

SEQ ID NO: 464068 - RNA, 64 nt, hsa
ggaaccaccagucuaguccguccuggcacagaagaggagucaaguaauggaggucccagcccug

SEQ ID NO: 464069 - RNA, 64 nt, hsa
gaucaggccccaccccuguaaucaggcaaggaggaggagucagaugaggcccugcaccuucccc

SEQ ID NO: 464070 - RNA, 64 nt, hsa; identical to SEQ ID NO: 115878

SEQ ID NO: 464071 - RNA, 64 nt, hsa; identical to SEQ ID NO: 115879

SEQ ID NO: 464072 - RNA, 64 nt, hsa; identical to SEQ ID NO: 115880

SEQ ID NO: 464073 - RNA, 64 nt, hsa; identical to SEQ ID NO: 115881

SEQ ID NO: 464074 - RNA, 64 nt, hsa; identical to SEQ ID NO: 115882

SEQ ID NO: 464075 - RNA, 64 nt, hsa; identical to SEQ ID NO: 115883

SEQ ID NO: 464076 - RNA, 64 nt, hsa; identical to SEQ ID NO: 115884

SEQ ID NO: 464077 - RNA, 64 nt, hsa; identical to SEQ ID NO: 115885

SEQ ID NO: 464078 - RNA, 64 nt, hsa; identical to SEQ ID NO: 115886

SEQ ID NO: 464079 - RNA, 64 nt, hsa; identical to SEQ ID NO: 115887

SEQ ID NO: 464080 - RNA, 64 nt, hsa; identical to SEQ ID NO: 115888

SEQ ID NO: 464081 - RNA, 64 nt, hsa; identical to SEQ ID NO: 115889

SEQ ID NO: 464082 - RNA, 53 nt, hsa; identical to SEQ ID NO: 115890

SEQ ID NO: 464083 - RNA, 64 nt, hsa; identical to SEQ ID NO: 115891

SEQ ID NO: 464084 - RNA, 64 nt, hsa; identical to SEQ ID NO: 115892

SEQ ID NO: 464085 - RNA, 64 nt, hsa; identical to SEQ ID NO: 115893

SEQ ID NO: 464086 - RNA, 64 nt, hsa; identical to SEQ ID NO: 115894

SEQ ID NO: 464087 - RNA, 64 nt, hsa; identical to SEQ ID NO: 115895

SEQ ID NO: 464088 - RNA, 64 nt, hsa; identical to SEQ ID NO: 115896

SEQ ID NO: 464089 - RNA, 64 nt, hsa; identical to SEQ ID NO: 115897

SEQ ID NO: 464090 - RNA, 64 nt, hsa; identical to SEQ ID NO: 115898

SEQ ID NO: 464091 - RNA, 64 nt, hsa; identical to SEQ ID NO: 115899

SEQ ID NO: 464092 - RNA, 64 nt, hsa; identical to SEQ ID NO: 115900

SEQ ID NO: 464093 - RNA, 64 nt, hsa; identical to SEQ ID NO: 115901

SEQ ID NO: 464094 - RNA, 64 nt, hsa; identical to SEQ ID NO: 115902

SEQ ID NO: 464095 - RNA, 64 nt, hsa; identical to SEQ ID NO: 115903

SEQ ID NO: 464096 - RNA, 64 nt, hsa; identical to SEQ ID NO: 115903

SEQ ID NO: 464097 - RNA, 64 nt, hsa; identical to SEQ ID NO: 115905

SEQ ID NO: 464098 - RNA, 64 nt, hsa; identical to SEQ ID NO: 115906

SEQ ID NO: 464099 - RNA, 64 nt, hsa; identical to SEQ ID NO: 115907

SEQ ID NO: 464100 - RNA, 64 nt, hsa; identical to SEQ ID NO: 115908

SEQ ID NO: 464101 - RNA, 64 nt, hsa; identical to SEQ ID NO: 115909

SEQ ID NO: 464102 - RNA, 64 nt, hsa; identical to SEQ ID NO: 115910

SEQ ID NO: 464103 - RNA, 64 nt, hsa; identical to SEQ ID NO: 432964

SEQ ID NO: 464104 - RNA, 64 nt, hsa; identical to SEQ ID NO: 432965

SEQ ID NO: 464105 - RNA, 64 nt, hsa; identical to SEQ ID NO: 432966

SEQ ID NO: 464106 - RNA, 64 nt, hsa; identical to SEQ ID NO: 432967

SEQ ID NO: 464107 - RNA, 64 nt, hsa; identical to SEQ ID NO: 432968

SEQ ID NO: 464108 - RNA, 64 nt, hsa; identical to SEQ ID NO: 301795

SEQ ID NO: 464109 - RNA, 64 nt, hsa; identical to SEQ ID NO: 301796

SEQ ID NO: 464110 - RNA, 64 nt, hsa; identical to SEQ ID NO: 301797

SEQ ID NO: 464111 - RNA, 64 nt, hsa; identical to SEQ ID NO: 301798

SEQ ID NO: 464112 - RNA, 64 nt, hsa; identical to SEQ ID NO: 301799

SEQ ID NO: 464113 - RNA, 64 nt, hsa; identical to SEQ ID NO: 301800

SEQ ID NO: 464114 - RNA, 64 nt, hsa; identical to SEQ ID NO: 301801

SEQ ID NO: 464115 - RNA, 64 nt, hsa; identical to SEQ ID NO: 301802

SEQ ID NO: 464116 - RNA, 64 nt, hsa; identical to SEQ ID NO: 301803

SEQ ID NO: 464117 - RNA, 64 nt, hsa; identical to SEQ ID NO: 301804

SEQ ID NO: 464118 - RNA, 64 nt, hsa; identical to SEQ ID NO: 301805

SEQ ID NO: 464119 - RNA, 55 nt, hsa; identical to SEQ ID NO: 301806

SEQ ID NO: 464120 - RNA, 64 nt, hsa; identical to SEQ ID NO: 301807

SEQ ID NO: 464121 - RNA, 64 nt, hsa; identical to SEQ ID NO: 301808

SEQ ID NO: 464122 - RNA, 64 nt, hsa; identical to SEQ ID NO: 301809

SEQ ID NO: 464123 - RNA, 64 nt, hsa; identical to SEQ ID NO: 301810

SEQ ID NO: 464124 - RNA, 64 nt, hsa; identical to SEQ ID NO: 301811

SEQ ID NO: 464125 - RNA, 64 nt, hsa; identical to SEQ ID NO: 301812

SEQ ID NO: 464126 - RNA, 64 nt, hsa; identical to SEQ ID NO: 301813

SEQ ID NO: 464127 - RNA, 64 nt, hsa; identical to SEQ ID NO: 301814

SEQ ID NO: 464128 - RNA, 64 nt, hsa; identical to SEQ ID NO: 301815

SEQ ID NO: 464129 - RNA, 64 nt, hsa; identical to SEQ ID NO: 301816

SEQ ID NO: 464130 - RNA, 64 nt, hsa; identical to SEQ ID NO: 301817

SEQ ID NO: 464131 - RNA, 64 nt, hsa; identical to SEQ ID NO: 301818

SEQ ID NO: 464132 - RNA, 64 nt, hsa; identical to SEQ ID NO: 301819

SEQ ID NO: 464133 - RNA, 64 nt, hsa; identical to SEQ ID NO: 301820

SEQ ID NO: 464134 - RNA, 64 nt, hsa; identical to SEQ ID NO: 301821

SEQ ID NO: 464135 - RNA, 64 nt, hsa; identical to SEQ ID NO: 301822

SEQ ID NO: 464136 - RNA, 64 nt, hsa; identical to SEQ ID NO: 301823

SEQ ID NO: 464137 - RNA, 64 nt, hsa; identical to SEQ ID NO: 301824

SEQ ID NO: 464138 - RNA, 64 nt, hsa; identical to SEQ ID NO: 301825

SEQ ID NO: 464139 - RNA, 64 nt, hsa; identical to SEQ ID NO: 301826

SEQ ID NO: 464140 - RNA, 51 nt, hsa; identical to SEQ ID NO: 301827

SEQ ID NO: 464141 - RNA, 64 nt, hsa; identical to SEQ ID NO: 301828

SEQ ID NO: 464142 - RNA, 64 nt, hsa; identical to SEQ ID NO: 301829

SEQ ID NO: 464143 - RNA, 64 nt, hsa; identical to SEQ ID NO: 301830

SEQ ID NO: 464144 - RNA, 64 nt, hsa; identical to SEQ ID NO: 301831

SEQ ID NO: 464145 - RNA, 64 nt, hsa; identical to SEQ ID NO: 301832

SEQ ID NO: 464146 - RNA, 64 nt, hsa; identical to SEQ ID NO: 301833

SEQ ID NO: 464147 - RNA, 64 nt, hsa; identical to SEQ ID NO: 301834

SEQ ID NO: 464148 - RNA, 64 nt, hsa; identical to SEQ ID NO: 301835

SEQ ID NO: 464149 - RNA, 64 nt, hsa; identical to SEQ ID NO: 301836

SEQ ID NO: 464150 - RNA, 64 nt, hsa; identical to SEQ ID NO: 301837

SEQ ID NO: 464151 - RNA, 64 nt, hsa; identical to SEQ ID NO: 301838

SEQ ID NO: 464152 - RNA, 64 nt, hsa; identical to SEQ ID NO: 301839

SEQ ID NO: 464153 - RNA, 64 nt, hsa; identical to SEQ ID NO: 301840

SEQ ID NO: 464154 - RNA, 64 nt, hsa; identical to SEQ ID NO: 301841

SEQ ID NO: 464155 - RNA, 64 nt, hsa; identical to SEQ ID NO: 301842

SEQ ID NO: 464156 - RNA, 64 nt, hsa; identical to SEQ ID NO: 301843

SEQ ID NO: 464157 - RNA, 64 nt, hsa; identical to SEQ ID NO: 301844

SEQ ID NO: 464158 - RNA, 64 nt, hsa; identical to SEQ ID NO: 301845

SEQ ID NO: 464159 - RNA, 64 nt, hsa; identical to SEQ ID NO: 301846

SEQ ID NO: 464160 - RNA, 64 nt, hsa; identical to SEQ ID NO: 301847

SEQ ID NO: 464161 - RNA, 64 nt, hsa; identical to SEQ ID NO: 301848

SEQ ID NO: 464162 - RNA, 64 nt, hsa; identical to SEQ ID NO: 301849

SEQ ID NO: 464163 - RNA, 64 nt, hsa; identical to SEQ ID NO: 301850

SEQ ID NO: 464164 - RNA, 64 nt, hsa; identical to SEQ ID NO: 301851

SEQ ID NO: 464165 - RNA, 64 nt, hsa; identical to SEQ ID NO: 301852

SEQ ID NO: 464166 - RNA, 64 nt, hsa; identical to SEQ ID NO: 301853

SEQ ID NO: 464167 - RNA, 64 nt, hsa; identical to SEQ ID NO: 301854

SEQ ID NO: 464168 - RNA, 64 nt, hsa; identical to SEQ ID NO: 301855

SEQ ID NO: 464169 - RNA, 64 nt, hsa; identical to SEQ ID NO: 301856

SEQ ID NO: 464170 - RNA, 64 nt, hsa; identical to SEQ ID NO: 301857

SEQ ID NO: 464171 - RNA, 64 nt, hsa; identical to SEQ ID NO: 301858

SEQ ID NO: 464172 - RNA, 64 nt, hsa; identical to SEQ ID NO: 301859

SEQ ID NO: 464173 - RNA, 64 nt, hsa; identical to SEQ ID NO: 301860

SEQ ID NO: 464174 - RNA, 64 nt, hsa; identical to SEQ ID NO: 301861

SEQ ID NO: 464175 - RNA, 64 nt, hsa; identical to SEQ ID NO: 288178

SEQ ID NO: 464176 - RNA, 64 nt, hsa; identical to SEQ ID NO: 288179

SEQ ID NO: 464177 - RNA, 64 nt, hsa; identical to SEQ ID NO: 288180

SEQ ID NO: 464178 - RNA, 64 nt, hsa; identical to SEQ ID NO: 288181

SEQ ID NO: 464179 - RNA, 64 nt, hsa; identical to SEQ ID NO: 288182

SEQ ID NO: 464180 - RNA, 64 nt, hsa; identical to SEQ ID NO: 288183

SEQ ID NO: 464181 - RNA, 64 nt, hsa; identical to SEQ ID NO: 288184

SEQ ID NO: 464182 - RNA, 64 nt, hsa; identical to SEQ ID NO: 288185

SEQ ID NO: 464183 - RNA, 64 nt, hsa; identical to SEQ ID NO: 288186

SEQ ID NO: 464184 - RNA, 64 nt, hsa; identical to SEQ ID NO: 288187

SEQ ID NO: 464185 - RNA, 64 nt, hsa; identical to SEQ ID NO: 288188

SEQ ID NO: 464186 - RNA, 64 nt, hsa; identical to SEQ ID NO: 288189

SEQ ID NO: 464187 - RNA, 64 nt, hsa; identical to SEQ ID NO: 288190

SEQ ID NO: 464188 - RNA, 64 nt, hsa; identical to SEQ ID NO: 288191

SEQ ID NO: 464189 - RNA, 64 nt, hsa; identical to SEQ ID NO: 288192

SEQ ID NO: 464190 - RNA, 64 nt, hsa; identical to SEQ ID NO: 288193

SEQ ID NO: 464191 - RNA, 64 nt, hsa; identical to SEQ ID NO: 288194

SEQ ID NO: 464192 - RNA, 64 nt, hsa; identical to SEQ ID NO: 288195

SEQ ID NO: 464193 - RNA, 64 nt, hsa
uuuuaaaagcuucaaaaugaugggauaugaucauagauuuuagucuuacuaaucugaaucacau

SEQ ID NO: 464194 - RNA, 64 nt, hsa
ucaagguauuguaaaugacaagauaccaaauacaagauuuuaaaagcaaccauggggagaaaaa

SEQ ID NO: 464195 - RNA, 64 nt, hsa
uuuaaagccacaaaguagauuacauaauuagcagagauuuuagucaguaaaauguuagaaauca

SEQ ID NO: 464196 - RNA, 64 nt, hsa
ucuauccugacaaaguucacuggaaauugcccucagauuuuauaaacugggggauuucuuaauu

SEQ ID NO: 464197 - RNA, 64 nt, hsa
ccaguuaaaagaugcagccucacugcuucaacgcagauuuuaauguuuacuuaaauauaaaccu

SEQ ID NO: 464198 - RNA, 64 nt, hsa
uaaaucagaaauuuuuuauuaucuauguucuucuagauuuuaccuguaguucauacuucaguca

SEQ ID NO: 464199 - RNA, 64 nt, hsa
gaacuugaaauuuuuaacacauccuucuuggugaagauuuuaauauauuacuuauaugcuucaa

SEQ ID NO: 464200 - RNA, 64 nt, hsa
aagauuaauauuugauucucuaucucuuaacuguagauuuuauuggccuguuuuuuuuuucuaa

SEQ ID NO: 464201 - RNA, 64 nt, hsa
gaaacguaugaaacagaugaagaaugacugacccagauuuuagauguauaauguuguuaaagua

SEQ ID NO: 464202 - RNA, 64 nt, hsa
uuucuuagaucaaauuuaugccaauuauaugaaaagauuuuaacuccgagacaggagucuuuca

SEQ ID NO: 464203 - RNA, 64 nt, hsa
agacuguagcaaaaaaaaaaaaaaaagaaaaauuagauuuuacauaucuuugcagguaucacag

SEQ ID NO: 464204 - RNA, 64 nt, hsa
accucuacagagaccaaaacucauucucuuaaagagauuuuauggggcuacugcagauaaaaau

SEQ ID NO: 464205 - RNA, 64 nt, hsa
cauugucuuugcuguacucuugcugauggcugcuagauuuuaauuuauuuguuucccuacuuga

SEQ ID NO: 464206 - RNA, 64 nt, hsa
uaauaguucaguagaauuaccauuaauuacauacagauuuuaccuauccacaauagucagaaaa

SEQ ID NO: 464207 - RNA, 64 nt, hsa
guuuuacuuucaggcucuuguuuugguucagaggagauuuuaaauauugaaugacacuucuaca

SEQ ID NO: 464208 - RNA, 64 nt, hsa
cuucagccuccucugacuuuucuuuuggggcuucagauuuuaugauuacaucuugucccccuag

SEQ ID NO: 464209 - RNA, 64 nt, hsa
uguuuacuuuucaauauuuucauauuucuuaaccagauuuuaaagaaauuuguuguuaguuacg

SEQ ID NO: 464210 - RNA, 64 nt, hsa
uguuuguauuauauugggggugcugcgagacuggagauuuuauaaaagcaagcauuuuuauuuc

SEQ ID NO: 464211 - RNA, 64 nt, hsa
auauauauuguuaaaggagaccuguagcagucaaagauuuuauugauuuaaugacaaaggaaau

SEQ ID NO: 464212 - RNA, 64 nt, hsa
uaaauauaaauguuacaacucaauguuugcuuuuagauuuuauacaguauuuguuuuguuuugg

SEQ ID NO: 464213 - RNA, 64 nt, hsa
aaacuaucucaugccagugccuuauuacccaggaagauuuuaaaggaccucauuaauaauuugc

SEQ ID NO: 464214 - RNA, 64 nt, hsa
aggaucagcugguucaguacugucuaucaaagguagauuuuacagagaacagaaaucggggaag

SEQ ID NO: 464215 - RNA, 64 nt, hsa
aauucaauggauauacauuuuuuucugaagauuaagauuuuaauuauucaacuuaaaaaguaga

SEQ ID NO: 464216 - RNA, 64 nt, hsa
augaaauacauacugauaauacauaccucaugaaagauuuuauucuuuauuguguuacagagca

SEQ ID NO: 464217 - RNA, 64 nt, hsa
uaaacuuaagauccgacauuuuuuguauucuuuaagauuuuacaccuaaaaaaucucuccuauc

SEQ ID NO: 464218 - RNA, 64 nt, hsa
gcucucuacaugaagaugacuuguuuuauauuucagauuuuauuuuaaaagccaugucuguuaa

SEQ ID NO: 464219 - RNA, 64 nt, hsa
ccuuuuguuugaugaagaaauaaacuucagcugaagauuuuauauaggacuuuaaaaagaagag

SEQ ID NO: 464220 - RNA, 64 nt, hsa
cuaugauuuagacuucaaggaauuccaaugaugaagauuuuaaggaaaguauuuuauauucaac

SEQ ID NO: 464221 - RNA, 64 nt, hsa
aauacacuuuuuuccaaaguguaaguuugugaauagauuuuagcaugaugaaacugucauaaug

SEQ ID NO: 464222 - RNA, 64 nt, hsa
cucauggugcauauaaauauauuuaacuuaacccagauuuuauuuauaucuuuauucaccuuuu

SEQ ID NO: 464223 - RNA, 64 nt, hsa
accuuaugauguacuuuguaaaaaaauugauugaagauuuuaaauaaacaggaaauuagaagug

SEQ ID NO: 464224 - RNA, 64 nt, hsa
uuaaaaaccaggaaauuucuacaaucauggagacagauuuuaauuugcaugcucuccuuuauuu

SEQ ID NO: 464225 - RNA, 64 nt, hsa
cacugucucaagacugagcacuucacuaaaugguagauuuuacuguuaaagacccuacaauaag

SEQ ID NO: 464226 - RNA, 64 nt, hsa
cagcaauugaaaugcuacaaaagacuuuguuuaaagauuuuauuuaaacuauuaagaaucaaca

SEQ ID NO: 464227 - RNA, 64 nt, hsa
uuauccagaguugugggaaucucaggauuggaagagauuuuaaaggccacauaggccagcuagu

SEQ ID NO: 464228 - RNA, 64 nt, hsa
augaucagaacuuagauauaaggauggguccuucagauuuuagcauuuaggaguuucaauaaua

SEQ ID NO: 464229 - RNA, 64 nt, hsa
uuugaaugguuuaacaaaagauuuguuuuuguagagauuuuaaagggggagaauucuagaaaua

SEQ ID NO: 464230 - RNA, 64 nt, hsa
uuuacaugcuacuaaauuuuuauaauaauugaaaagauuuuaacaaguauaaaaaauucucaua

SEQ ID NO: 464231 - RNA, 64 nt, hsa
gauggugcaguuaauguugaaguuacagcauuucagauuuuauugucagauauuuagauguuug

SEQ ID NO: 464232 - RNA, 64 nt, hsa
ugguauagauuuucuuguuucagugcuuugggacagauuuuauauuaugucaauugaucagguu

SEQ ID NO: 464233 - RNA, 64 nt, hsa
auugcuaggugugacccagcaaucuuuuaggaagagauuuuacaguggugcuuuauuuauauca

SEQ ID NO: 464234 - RNA, 64 nt, hsa
uuguauuucuuuuuuagccagcacauuaaauuuuagauuuuauuuuuuaaucuaauuuuuuucu

SEQ ID NO: 464235 - RNA, 64 nt, hsa
gacccaggguccuacagauagauauggugugcccagauuuuaaaaauaccuucaaaaauaaaaa

SEQ ID NO: 464236 - RNA, 64 nt, hsa
augugccaaacuuuccaggguuuuguagucaccuagauuuuaagcugauagcauagugcuucag

SEQ ID NO: 464237 - RNA, 64 nt, hsa
aacagguuacugugaagauuuugccacuaacucuagauuuuaccuuuuuguaaugcuguuuauc

SEQ ID NO: 464238 - RNA, 64 nt, hsa
uuguaagcuaaauggucuugcauccagaaaggccagauuuuaccuaccaagaaaaaaagauauu

SEQ ID NO: 464239 - RNA, 64 nt, hsa
ucagccguuucacuuuuuguuggagaaaaauaguagauuuuaauuugacucacaguuugaagca

SEQ ID NO: 464240 - RNA, 64 nt, hsa
aaaccuuagacauaucacaccuaaaauaugcugcagauuuuauaauugauugguuacuuauuua

SEQ ID NO: 464241 - RNA, 64 nt, hsa
auagcaacaacccagaacuuacaaacuucuccaaagauuuuauugauuguuauaucaaaucaga

SEQ ID NO: 464242 - RNA, 64 nt, hsa
uacaauaccauuaaccaaagguagguguccaugcagauuuuauuggcagcuguuuuauugccau

SEQ ID NO: 464243 - RNA, 64 nt, hsa
agggccagaucaucccuggagugcaccucuacuaagauuuuaugaaaagaugacauguugggcu

SEQ ID NO: 464244 - RNA, 64 nt, hsa
aggcguaagccaccaugccuggccaaaaauuaaaagauuuuaugaaacgaaauggcuucccauu

SEQ ID NO: 464245 - RNA, 64 nt, hsa
guguuaguguauggaccaauacugccuguaauaaagauuuuauauauagaugccuuucauuuuu

SEQ ID NO: 464246 - RNA, 64 nt, hsa
guauguagguugcuaaaaaggauuuucuuaacucagauuuuaagccaaauaaccauuuaacacu

SEQ ID NO: 464247 - RNA, 64 nt, hsa
caccaugccuggccaggacauauuugaaauggggagauuuuaaaaauucugaugauuagacuga

SEQ ID NO: 464248 - RNA, 64 nt, hsa
uuggggguggggcgaggguuucuguaguagacucagauuuuacauggcccugagcugcccuugc

SEQ ID NO: 464249 - RNA, 64 nt, hsa
gaccuuucuguucaaggugaguagcuuccaagguagauuuuacuauugugguuuuuuuccacug

SEQ ID NO: 464250 - RNA, 56 nt, hsa
ccuguuggggagcaggaugacuuugcagauuuuauggcuuucaguaauagcucuau

SEQ ID NO: 464251 - RNA, 64 nt, hsa
gggcaugugcccaggugagcuccuguguguguccagauuuuauauuccuaaucccaguaaggaa

SEQ ID NO: 464252 - RNA, 64 nt, hsa
cauuuuucucauaguuaauuucaucucuccgguaagauuuuauugguguuucuuuuauaacuuu

SEQ ID NO: 464253 - RNA, 64 nt, hsa
ugaguuauucuucaucaaaugacuuuuggaguagagauuuuauuuuuauagcaauagaugcaca

SEQ ID NO: 464254 - RNA, 64 nt, hsa
gccuuccuuauggguaugcuguggcauaucccugagauuuuaauucgcauuuuccagugacuaa

SEQ ID NO: 464255 - RNA, 64 nt, hsa
ucuuuuucuuuuuaacccuaaucuuucacuugaaagauuuuauuguauaaaaaguuucacaggu

SEQ ID NO: 464256 - RNA, 64 nt, hsa
ugaguauuugguccaaaaaaaggaaaaauaaucaagauuuuagggcuuuuauuuuuucuuuugu

SEQ ID NO: 464257 - RNA, 64 nt, hsa
gguaggauuaaguuguugaguaguuuuguaaucaagauuuuauguaacauuuguaaagggaaaa

SEQ ID NO: 464258 - RNA, 64 nt, hsa
ugguauuauuuugugccccccacuuaauauggauagauuuuaaugggaaaauuauaauucagau

SEQ ID NO: 464259 - RNA, 64 nt, hsa
gggcaccgcagugccagagaagaugcuugagguuagauuuuaaggaguggggaauugugaagcc

SEQ ID NO: 464260 - RNA, 64 nt, hsa
cuuguccacguuguuucacaucugguuagggggcagauuuuaaaauguaguuuuguaauguuac

SEQ ID NO: 464261 - RNA, 64 nt, hsa
aucaacaaaguuaauuguauuuauguauguaaauagauuuuaagcuucauuauaaaauauuguu

SEQ ID NO: 464262 - RNA, 64 nt, hsa
gcuucugauuuagcaaugcugugaauaaaaagaaagauuuuauacccuugacuuaacuuuuuaa

SEQ ID NO: 464263 - RNA, 64 nt, hsa
aguuguuugagaugcuaagcaggauaauaaauuuagauuuuaaaauguucccuguaaaagucag

SEQ ID NO: 464264 - RNA, 64 nt, hsa
guaaaauguugaguuucgauugagccauguuuggagauuuuauuacuauucugaaggguagugu

SEQ ID NO: 464265 - RNA, 64 nt, hsa
uuuccacugaaauuuguuauguuuaaggaaauuaagauuuuaagcuugaaauuauacaagcaga

SEQ ID NO: 464266 - RNA, 64 nt, hsa
guaaagaaauauaauucauggaucaggcucauaaagauuuuauaauauuuuuaguuaaacaaga

SEQ ID NO: 464267 - RNA, 64 nt, hsa
ccaagguauggccacaaggaagaauaguguacagagauuuuaauuaaugcaaguucugggaccu

SEQ ID NO: 464268 - RNA, 64 nt, hsa
gucugagucugaaaugaaccuguucacuuagacuagauuuuauaguaacaaaaugugcuuuuaa

SEQ ID NO: 464269 - RNA, 64 nt, hsa
cacuguaggaagguuuugaaaauuguuucguuauagauuuuaucuuaucuuuugguguugucuu

SEQ ID NO: 464270 - RNA, 64 nt, hsa
gaucagcucaucuauaaggcugaccuucaugcagagauuuuauuucaccuuuaguuuugggaaa

SEQ ID NO: 464271 - RNA, 64 nt, hsa
aaaaagaaauguagauucuugggccccaccaccccacgccuacugagccagaaucucugggggu

SEQ ID NO: 464272 - RNA, 64 nt, hsa
uggaaagcaucaccucaggccaggugcaguggcucacgccuaugaucccagcacuuugggaggc

SEQ ID NO: 464273 - RNA, 64 nt, hsa
cuaaaaauacaaaaauuagccaggcaugguggcacacgccuauagucccagcuacucaggaggc

SEQ ID NO: 464274 - RNA, 64 nt, hsa
uggcacgggcccucccucccagcgcucugggagccacgccuaugcccugcccuuccucagggcc

SEQ ID NO: 464275 - RNA, 64 nt, hsa
aagaaaagaaaacuggaggcugggcgcaguggcucacgccuauaaucccagaggcugaggcagg

SEQ ID NO: 464276 - RNA, 64 nt, hsa
cuuuuaaaaaggcaguaggcccggugugguggcucacgccuauaaucccagcacuuugggaggc

SEQ ID NO: 464277 - RNA, 64 nt, hsa
agaaauguuaagaaauaggccaagugcgguggcucacgccuauaauccuaucacuuugggaggc

SEQ ID NO: 464278 - RNA, 64 nt, hsa
agacggggcggucgggugccugcggccucgcccgcacgccuagagucucgcccgaucccaucgg

SEQ ID NO: 464279 - RNA, 61 nt, hsa
gcaagguccacugugacugagcccucaccuccacgccuaccucauagcuucacagccuugc

SEQ ID NO: 464280 - RNA, 64 nt, hsa
cuaagagaagacaagagggccgggcgcggugacucacgccuauaaucccagcacuuugggaggc

SEQ ID NO: 464281 - RNA, 64 nt, hsa
caagaagaagcuugccaggccgggcacgguggcucacgccuauaaucccagcacuuugggaggc

SEQ ID NO: 464282 - RNA, 64 nt, hsa
aaguagaggccuggugguuuaacagccgaagacacacgccuagggaugagcacccucuuuguga

SEQ ID NO: 464283 - RNA, 64 nt, hsa
uagcuaaagaaugccauggccgggugcaguggcucacgccuauaaucccagcacuuugggaggc

SEQ ID NO: 464284 - RNA, 64 nt, hsa
acugaggagauacugaacauuuugcaaaacuuaucacgccuacuuaagagugcuguguaacccc

SEQ ID NO: 464285 - RNA, 64 nt, hsa
gcuccuggacuggcccaccugccugccacaugcccacgccuagucccaucugggcccccauucc

SEQ ID NO: 464286 - RNA, 64 nt, hsa
gugcaauucaggagcccagcagugacacacuuaucacgccuaggcuccaguuugcaaaaauugc

SEQ ID NO: 464287 - RNA, 64 nt, hsa
acacguuagccauuccuuacggcucuucacguuccacgccuagaugugaagugggacauagucu

SEQ ID NO: 464288 - RNA, 64 nt, hsa
cuccuaaguagcugggaguacaggcgcgcaccaccacgccuagcugauuuuuguauuuuuuugu

SEQ ID NO: 464289 - RNA, 64 nt, hsa
auaaaguuaaccaagcaggccaggcacgguggcucacgccuauaaucccagcacuuagggaggc

SEQ ID NO: 464290 - RNA, 64 nt, hsa
ggcccucucccugccccagcuuuccccgaccaaucacgccuacagugcuuugaagguuuccucu

SEQ ID NO: 464291 - RNA, 64 nt, hsa
acagguaccuugcugucuugacaaauccuaaugucacgccuacagccccaacacaagcuccagu

SEQ ID NO: 464292 - RNA, 64 nt, hsa
uauuugugaauugugcugguuuccugggcauugccacgccuaccacagguggguacauuagaag

SEQ ID NO: 464293 - RNA, 64 nt, hsa
agggccccaccucaccccuuggugucacccccaccacgccuaggcagcucugggcccugggauc

SEQ ID NO: 464294 - RNA, 55 nt, hsa
ggugcuguucuucuggauaacuguucacgccuaagaaauuaaaagacagaacaaa

SEQ ID NO: 464295 - RNA, 64 nt, hsa
uauuuaaaaacccauggagccgggugcgguggcucacgccuaugaucccagcacuuugggaggc

SEQ ID NO: 464296 - RNA, 64 nt, hsa
ccucacgcagaggccuuaaagcuggacacagaagcacgccuaggcugggcagggaugggaccca

SEQ ID NO: 464297 - RNA, 64 nt, hsa
cacacaagcacauacagacauaugcauccccacacacgccuaugcacaaacguggauuaucgca

SEQ ID NO: 464298 - RNA, 64 nt, hsa
uagucguuccagggcugggggaggugggagggaucacgccuauaggugugggcacaugaaacga

SEQ ID NO: 464299 - RNA, 64 nt, hsa
ugcucacacgcgaguuuucacaguuauuucuauccacgccuaugaaucuuuggacggugagauc

SEQ ID NO: 464300 - RNA, 64 nt, hsa
ugagacaagaauggccugcgggcuggucagaggucacgccuacucugucacggggcuggaugag

SEQ ID NO: 464301 - RNA, 56 nt, hsa
cguacuccaaugagaugugaaccagccacgccuaccagguggcagagcuggggcca

SEQ ID NO: 464302 - RNA, 64 nt, hsa
cacacuacagccuacaacucuugggcucaagcaucacgccuagcaguuucugguuccuuuaaca

SEQ ID NO: 464303 - RNA, 64 nt, hsa
augugcuugggcagcuugagaaggcguucagcaccacgccuagcaggcagaccuugaagccuca

SEQ ID NO: 464304 - RNA, 64 nt, hsa
uaagggcaucacaaauuaacauuuacuccuaaugcacgccuagaauguauuuuaaauacuuacu

SEQ ID NO: 464305 - RNA, 64 nt, hsa
aagagaacccacccagagacugggagugguggcucacgccuauaaucccugcgcuuuggcaguc

SEQ ID NO: 464306 - RNA, 64 nt, hsa
guuggguaggagcuuccaggccugggauuuacaccacgccuagcccagcagaggccuuaguccc

SEQ ID NO: 464307 - RNA, 64 nt, hsa
guuuauuuuaaaacugaauccuuaaacuugcaaacacgccuacuguaagcaugcuuggaaugac

SEQ ID NO: 464308 - RNA, 64 nt, hsa
cuuaacaaguaguuauuggcugugcacaguggcucacgccuauaaucccagcauuuugggaggc

SEQ ID NO: 464309 - RNA, 64 nt, hsa
caaucaaucacuguccuggccaguugcaguggcucacgccuauaaucccaacacuucgggaggc

SEQ ID NO: 464310 - RNA, 64 nt, hsa
cuccugaguagcugagaccacaggcgugugccaccacgccuagcuaauuuuuuauaccaggguc

SEQ ID NO: 464311 - RNA, 64 nt, hsa
uuuuacaaguaacucuaggcugggugugguggcucacgccuauaaucccagcacuuugggaggc

SEQ ID NO: 464312 - RNA, 64 nt, hsa
uuagaugaggaaaugauccccaaguggugaaugacacgccuaaggucacagcuaguuugagcca

SEQ ID NO: 464313 - RNA, 64 nt, hsa
uagaagaaaacagcuguggucgggcacgguggcucacgccuauaaucccagcacuuugggaggc

SEQ ID NO: 464314 - RNA, 64 nt, hsa
ugcucucugcaaaaagaaugggcaucccggaggccacgccuaucuucucucucugcuccuccuu

SEQ ID NO: 464315 - RNA, 64 nt, hsa
gcagucuccagacuggaaacgcagagcggcuccucacgccuaauccuguugacaagucccccgc

SEQ ID NO: 464316 - RNA, 64 nt, hsa
aaaagacuuggccuuagggccgagugcgguggcucacgccuauaaucccagcacuuugggaggc

SEQ ID NO: 464317 - RNA, 64 nt, hsa
aaaagacgaaaagugacggccaggugcaguggcucacgccuauaaucucagcacucugggaggc

SEQ ID NO: 464318 - RNA, 64 nt, hsa
gugcggggcagagccccgggagggcgcgucuguccacgccuaccggacgcgccgaggucgcgcu

SEQ ID NO: 464319 - RNA, 64 nt, hsa
ggcaugcgaaauguucucaugaacuaccccacaacacgccuaaaacucaaaacacccaaaaaua

SEQ ID NO: 464320 - RNA, 64 nt, hsa
acuucaaaaggauuucaggcugagugugguggcucacgccuauacacccagcacuuuggaaggc

SEQ ID NO: 464321 - RNA, 64 nt, hsa
auuaaaccucugcuccuggccaggcacaguggcucacgccuauaaucccagcacuuugggaggc

SEQ ID NO: 464322 - RNA, 64 nt, hsa
ucucaaaaaugaaaugcugccgggugcggugacucacgccuauaaucccagcacuuugggaggc

SEQ ID NO: 464323 - RNA, 64 nt, hsa
cuaaaaauacaaaaauuagccgggcaugguggugcacgccuauagucccagcuacucgggaggc

SEQ ID NO: 464324 - RNA, 64 nt, hsa
cacccgaaacugccagugugcggugacaacggcacacgccuagacugagugugguuucgucgug

SEQ ID NO: 464325 - RNA, 64 nt, hsa
cucccacagugcugggauuacaggcaugggccaccacgccuagccucacgcuccuuucugaucu

SEQ ID NO: 464326 - RNA, 64 nt, hsa
caucuacaaccaaguccugauggagcaagaggcccacgccuaggggaugcaagaacaacccguu

SEQ ID NO: 464327 - RNA, 64 nt, hsa
auggaaaauuggaaauggacugggcgugguggcucacgccuauaaucccagcaguuugggaggc

SEQ ID NO: 464328 - RNA, 64 nt, hsa
guggagcucugcuuuggcacugccccgcagaggccacgccuauuuauucuguuucuguuguuuu

SEQ ID NO: 464329 - RNA, 64 nt, hsa; identical to SEQ ID NO: 443640

SEQ ID NO: 464330 - RNA, 64 nt, hsa; identical to SEQ ID NO: 443641

SEQ ID NO: 464331 - RNA, 64 nt, hsa; identical to SEQ ID NO: 443642

SEQ ID NO: 464332 - RNA, 64 nt, hsa; identical to SEQ ID NO: 443643

SEQ ID NO: 464333 - RNA, 64 nt, hsa; identical to SEQ ID NO: 443644

SEQ ID NO: 464334 - RNA, 64 nt, hsa; identical to SEQ ID NO: 443645

SEQ ID NO: 464335 - RNA, 64 nt, hsa; identical to SEQ ID NO: 443646

SEQ ID NO: 464336 - RNA, 64 nt, hsa; identical to SEQ ID NO: 443647

SEQ ID NO: 464337 - RNA, 56 nt, hsa; identical to SEQ ID NO: 443648

SEQ ID NO: 464338 - RNA, 64 nt, hsa; identical to SEQ ID NO: 443649

SEQ ID NO: 464339 - RNA, 64 nt, hsa; identical to SEQ ID NO: 443650

SEQ ID NO: 464340 - RNA, 64 nt, hsa; identical to SEQ ID NO: 443651

SEQ ID NO: 464341 - RNA, 64 nt, hsa; identical to SEQ ID NO: 443652

SEQ ID NO: 464342 - RNA, 64 nt, hsa; identical to SEQ ID NO: 443653

SEQ ID NO: 464343 - RNA, 64 nt, hsa; identical to SEQ ID NO: 443654

SEQ ID NO: 464344 - RNA, 64 nt, hsa; identical to SEQ ID NO: 443655

SEQ ID NO: 464345 - RNA, 64 nt, hsa; identical to SEQ ID NO: 443656

SEQ ID NO: 464346 - RNA, 64 nt, hsa; identical to SEQ ID NO: 443657

SEQ ID NO: 464347 - RNA, 64 nt, hsa; identical to SEQ ID NO: 443658

SEQ ID NO: 464348 - RNA, 64 nt, hsa; identical to SEQ ID NO: 443659

SEQ ID NO: 464349 - RNA, 64 nt, hsa; identical to SEQ ID NO: 443660

SEQ ID NO: 464350 - RNA, 64 nt, hsa; identical to SEQ ID NO: 443661

SEQ ID NO: 464351 - RNA, 64 nt, hsa; identical to SEQ ID NO: 443662

SEQ ID NO: 464352 - RNA, 64 nt, hsa; identical to SEQ ID NO: 443663

SEQ ID NO: 464353 - RNA, 64 nt, hsa; identical to SEQ ID NO: 443664

SEQ ID NO: 464354 - RNA, 64 nt, hsa; identical to SEQ ID NO: 443665

SEQ ID NO: 464355 - RNA, 64 nt, hsa; identical to SEQ ID NO: 443666

SEQ ID NO: 464356 - RNA, 64 nt, hsa; identical to SEQ ID NO: 443667

SEQ ID NO: 464357 - RNA, 64 nt, hsa; identical to SEQ ID NO: 443668

SEQ ID NO: 464358 - RNA, 64 nt, hsa; identical to SEQ ID NO: 443669

SEQ ID NO: 464359 - RNA, 64 nt, hsa; identical to SEQ ID NO: 443670

SEQ ID NO: 464360 - RNA, 64 nt, hsa; identical to SEQ ID NO: 443671

SEQ ID NO: 464361 - RNA, 64 nt, hsa; identical to SEQ ID NO: 443672

SEQ ID NO: 464362 - RNA, 64 nt, hsa; identical to SEQ ID NO: 443673

SEQ ID NO: 464363 - RNA, 64 nt, hsa; identical to SEQ ID NO: 443674

SEQ ID NO: 464364 - RNA, 64 nt, hsa; identical to SEQ ID NO: 443675

SEQ ID NO: 464365 - RNA, 64 nt, hsa; identical to SEQ ID NO: 443676

SEQ ID NO: 464366 - RNA, 64 nt, hsa; identical to SEQ ID NO: 443677

SEQ ID NO: 464367 - RNA, 64 nt, hsa; identical to SEQ ID NO: 443678

SEQ ID NO: 464368 - RNA, 64 nt, hsa; identical to SEQ ID NO: 443679

SEQ ID NO: 464369 - RNA, 64 nt, hsa; identical to SEQ ID NO: 443680

SEQ ID NO: 464370 - RNA, 64 nt, hsa; identical to SEQ ID NO: 443681

SEQ ID NO: 464371 - RNA, 64 nt, hsa; identical to SEQ ID NO: 443682

SEQ ID NO: 464372 - RNA, 64 nt, hsa; identical to SEQ ID NO: 443683

SEQ ID NO: 464373 - RNA, 64 nt, hsa; identical to SEQ ID NO: 443684

SEQ ID NO: 464374 - RNA, 64 nt, hsa; identical to SEQ ID NO: 443685

SEQ ID NO: 464375 - RNA, 64 nt, hsa; identical to SEQ ID NO: 443686

SEQ ID NO: 464376 - RNA, 64 nt, hsa; identical to SEQ ID NO: 443687

SEQ ID NO: 464377 - RNA, 64 nt, hsa; identical to SEQ ID NO: 443688

SEQ ID NO: 464378 - RNA, 64 nt, hsa; identical to SEQ ID NO: 443689

SEQ ID NO: 464379 - RNA, 64 nt, hsa; identical to SEQ ID NO: 443690

SEQ ID NO: 464380 - RNA, 64 nt, hsa; identical to SEQ ID NO: 443691

SEQ ID NO: 464381 - RNA, 64 nt, hsa; identical to SEQ ID NO: 443692

SEQ ID NO: 464382 - RNA, 64 nt, hsa; identical to SEQ ID NO: 443693

SEQ ID NO: 464383 - RNA, 64 nt, hsa; identical to SEQ ID NO: 443694

SEQ ID NO: 464384 - RNA, 64 nt, hsa; identical to SEQ ID NO: 443695

SEQ ID NO: 464385 - RNA, 64 nt, hsa; identical to SEQ ID NO: 443696

SEQ ID NO: 464386 - RNA, 64 nt, hsa; identical to SEQ ID NO: 443697

SEQ ID NO: 464387 - RNA, 64 nt, hsa; identical to SEQ ID NO: 443698

SEQ ID NO: 464388 - RNA, 64 nt, hsa; identical to SEQ ID NO: 443699

SEQ ID NO: 464389 - RNA, 64 nt, hsa; identical to SEQ ID NO: 443700

SEQ ID NO: 464390 - RNA, 64 nt, hsa; identical to SEQ ID NO: 443701

SEQ ID NO: 464391 - RNA, 64 nt, hsa; identical to SEQ ID NO: 443702

SEQ ID NO: 464392 - RNA, 64 nt, hsa; identical to SEQ ID NO: 443703

SEQ ID NO: 464393 - RNA, 64 nt, hsa; identical to SEQ ID NO: 443704

SEQ ID NO: 464394 - RNA, 64 nt, hsa; identical to SEQ ID NO: 443705

SEQ ID NO: 464395 - RNA, 64 nt, hsa; identical to SEQ ID NO: 443706

SEQ ID NO: 464396 - RNA, 64 nt, hsa; identical to SEQ ID NO: 443707

SEQ ID NO: 464397 - RNA, 64 nt, hsa; identical to SEQ ID NO: 443708

SEQ ID NO: 464398 - RNA, 64 nt, hsa; identical to SEQ ID NO: 443709

SEQ ID NO: 464399 - RNA, 64 nt, hsa; identical to SEQ ID NO: 443710

SEQ ID NO: 464400 - RNA, 64 nt, hsa; identical to SEQ ID NO: 443711

SEQ ID NO: 464401 - RNA, 64 nt, hsa; identical to SEQ ID NO: 443712

SEQ ID NO: 464402 - RNA, 64 nt, hsa; identical to SEQ ID NO: 443713

SEQ ID NO: 464403 - RNA, 64 nt, hsa; identical to SEQ ID NO: 443714

SEQ ID NO: 464404 - RNA, 64 nt, hsa; identical to SEQ ID NO: 443715

SEQ ID NO: 464405 - RNA, 64 nt, hsa; identical to SEQ ID NO: 443716

SEQ ID NO: 464406 - RNA, 64 nt, hsa; identical to SEQ ID NO: 443717

SEQ ID NO: 464407 - RNA, 64 nt, hsa; identical to SEQ ID NO: 443718

SEQ ID NO: 464408 - RNA, 64 nt, hsa; identical to SEQ ID NO: 443719

SEQ ID NO: 464409 - RNA, 64 nt, hsa; identical to SEQ ID NO: 443720

SEQ ID NO: 464410 - RNA, 64 nt, hsa; identical to SEQ ID NO: 443721

SEQ ID NO: 464411 - RNA, 64 nt, hsa; identical to SEQ ID NO: 443722

SEQ ID NO: 464412 - RNA, 64 nt, hsa; identical to SEQ ID NO: 443723

SEQ ID NO: 464413 - RNA, 64 nt, hsa; identical to SEQ ID NO: 443724

SEQ ID NO: 464414 - RNA, 64 nt, hsa; identical to SEQ ID NO: 443725

SEQ ID NO: 464415 - RNA, 64 nt, hsa; identical to SEQ ID NO: 443726

SEQ ID NO: 464416 - RNA, 64 nt, hsa; identical to SEQ ID NO: 443727

SEQ ID NO: 464417 - RNA, 64 nt, hsa; identical to SEQ ID NO: 443728

SEQ ID NO: 464418 - RNA, 64 nt, hsa; identical to SEQ ID NO: 443729

SEQ ID NO: 464419 - RNA, 64 nt, hsa; identical to SEQ ID NO: 443730

SEQ ID NO: 464420 - RNA, 64 nt, hsa; identical to SEQ ID NO: 443731

SEQ ID NO: 464421 - RNA, 64 nt, hsa; identical to SEQ ID NO: 443732

SEQ ID NO: 464422 - RNA, 64 nt, hsa; identical to SEQ ID NO: 443733

SEQ ID NO: 464423 - RNA, 64 nt, hsa; identical to SEQ ID NO: 443734

SEQ ID NO: 464424 - RNA, 64 nt, hsa; identical to SEQ ID NO: 443735

SEQ ID NO: 464425 - RNA, 64 nt, hsa; identical to SEQ ID NO: 443736

SEQ ID NO: 464426 - RNA, 64 nt, hsa; identical to SEQ ID NO: 443737

SEQ ID NO: 464427 - RNA, 64 nt, hsa; identical to SEQ ID NO: 443738

SEQ ID NO: 464428 - RNA, 64 nt, hsa; identical to SEQ ID NO: 443739

SEQ ID NO: 464429 - RNA, 64 nt, hsa; identical to SEQ ID NO: 69124

SEQ ID NO: 464430 - RNA, 64 nt, hsa; identical to SEQ ID NO: 69125

SEQ ID NO: 464431 - RNA, 64 nt, hsa; identical to SEQ ID NO: 69126

SEQ ID NO: 464432 - RNA, 64 nt, hsa; identical to SEQ ID NO: 69127

SEQ ID NO: 464433 - RNA, 64 nt, hsa; identical to SEQ ID NO: 69128

SEQ ID NO: 464434 - RNA, 64 nt, hsa; identical to SEQ ID NO: 69129

SEQ ID NO: 464435 - RNA, 64 nt, hsa
aagagggcaggucagggauugggcgguguaaauugacucagaaaccugcgguuucagcuuuucu

SEQ ID NO: 464436 - RNA, 64 nt, hsa
gacaaaaccucauggcaaucuuguccucacuggagacucagaaggggaagcauugggaaaccau

SEQ ID NO: 464437 - RNA, 64 nt, hsa
acuguggaguguguggaccaccccacagaggagggacucagauuuauuuacucuugcuggaucu

SEQ ID NO: 464438 - RNA, 64 nt, hsa
auuaucauccccauuuaagaacugaggaaccugagacucagagagugugagcuacuggcccaag

SEQ ID NO: 464439 - RNA, 64 nt, hsa
gaaggucuuuccugauucuuccaagcuuugaggugacucagagcuaagaaugaaauaggagacc

SEQ ID NO: 464440 - RNA, 64 nt, hsa
uacccaggaaagaaauggucugcuagagugauaagacucagaacaggaagccugcaugugacug

SEQ ID NO: 464441 - RNA, 64 nt, hsa
acuguaaaguaguuacaagagaacaguugcccaagacucagaauuuuuaaaaaaaaaaauggag

SEQ ID NO: 464442 - RNA, 64 nt, hsa
uuauuuacagguacaacagaauaucucgggaauggacucagaaguaugccaugugaugcuaccu

SEQ ID NO: 464443 - RNA, 64 nt, hsa
cuaacacaaagcucauguuaagaaaacaguugaggacucagaagucaguucgaaaaugcacuuu

SEQ ID NO: 464444 - RNA, 64 nt, hsa
gagcaccucacgcugggggaaucaaucccugagggacucagaaucuucuccgugcaaccuggaa

SEQ ID NO: 464445 - RNA, 64 nt, hsa
ugccagguuuaaacaucacuuguaccuuccacaagacucagaauccacagugucccauuuuccg

SEQ ID NO: 464446 - RNA, 64 nt, hsa
gaccugguuaaacaaaccagaaucccucuacauggacucagagaaaagagauugagauguaagu

SEQ ID NO: 464447 - RNA, 64 nt, hsa
aucauggauuuuguuuauuccugaaacauaguuacauaguuaaacuguacauaugacauggcuu

SEQ ID NO: 464448 - RNA, 64 nt, hsa
acuaaaauaucauggauuuuguuuauuccugaaacauaguuacauaguuaaacuguacauauga

SEQ ID NO: 464449 - RNA, 64 nt, hsa
caagugaaaguuuagccaugguuuugugcggcaucauaguuaugucaauaaaguuuauuuaggu

SEQ ID NO: 464450 - RNA, 64 nt, hsa
guuuauuuaggucauagaauauccuaaaguaucacauaguuaaauuuuucagucagugaagacc

SEQ ID NO: 464451 - RNA, 64 nt, hsa
cuauuuauggcaaacacaugcuuuuguaucuugucauaguuauccacaaauggcaaaacuggac

SEQ ID NO: 464452 - RNA, 64 nt, hsa
uuucaauaucugauuuguucucuggauaaauuagcauaguuauuuuuuuauucacauuuacauu

SEQ ID NO: 464453 - RNA, 64 nt, hsa; identical to SEQ ID NO: 113583

SEQ ID NO: 464454 - RNA, 64 nt, hsa; identical to SEQ ID NO: 113584

SEQ ID NO: 464455 - RNA, 64 nt, hsa; identical to SEQ ID NO: 113585

SEQ ID NO: 464456 - RNA, 64 nt, hsa; identical to SEQ ID NO: 113586

SEQ ID NO: 464457 - RNA, 64 nt, hsa; identical to SEQ ID NO: 113587

SEQ ID NO: 464458 - RNA, 64 nt, hsa; identical to SEQ ID NO: 113588

SEQ ID NO: 464459 - RNA, 64 nt, hsa; identical to SEQ ID NO: 113589

SEQ ID NO: 464460 - RNA, 64 nt, hsa; identical to SEQ ID NO: 113590

SEQ ID NO: 464461 - RNA, 64 nt, hsa; identical to SEQ ID NO: 113591

SEQ ID NO: 464462 - RNA, 64 nt, hsa; identical to SEQ ID NO: 113592

SEQ ID NO: 464463 - RNA, 64 nt, hsa; identical to SEQ ID NO: 113593

SEQ ID NO: 464464 - RNA, 64 nt, hsa; identical to SEQ ID NO: 113594

SEQ ID NO: 464465 - RNA, 64 nt, hsa; identical to SEQ ID NO: 113595

SEQ ID NO: 464466 - RNA, 64 nt, hsa; identical to SEQ ID NO: 113596

SEQ ID NO: 464467 - RNA, 64 nt, hsa; identical to SEQ ID NO: 113597

SEQ ID NO: 464468 - RNA, 64 nt, hsa; identical to SEQ ID NO: 113598

SEQ ID NO: 464469 - RNA, 64 nt, hsa; identical to SEQ ID NO: 113599

SEQ ID NO: 464470 - RNA, 64 nt, hsa; identical to SEQ ID NO: 113600

SEQ ID NO: 464471 - RNA, 64 nt, hsa; identical to SEQ ID NO: 113601

SEQ ID NO: 464472 - RNA, 64 nt, hsa; identical to SEQ ID NO: 113602

SEQ ID NO: 464473 - RNA, 64 nt, hsa; identical to SEQ ID NO: 113603

SEQ ID NO: 464474 - RNA, 64 nt, hsa; identical to SEQ ID NO: 113604

SEQ ID NO: 464475 - RNA, 64 nt, hsa; identical to SEQ ID NO: 113605

SEQ ID NO: 464476 - RNA, 64 nt, hsa; identical to SEQ ID NO: 113606

SEQ ID NO: 464477 - RNA, 64 nt, hsa; identical to SEQ ID NO: 113607

SEQ ID NO: 464478 - RNA, 64 nt, hsa; identical to SEQ ID NO: 113608

SEQ ID NO: 464479 - RNA, 64 nt, hsa; identical to SEQ ID NO: 113609

SEQ ID NO: 464480 - RNA, 64 nt, hsa; identical to SEQ ID NO: 113610

SEQ ID NO: 464481 - RNA, 64 nt, hsa; identical to SEQ ID NO: 113611

SEQ ID NO: 464482 - RNA, 64 nt, hsa; identical to SEQ ID NO: 113612

SEQ ID NO: 464483 - RNA, 64 nt, hsa; identical to SEQ ID NO: 113613

SEQ ID NO: 464484 - RNA, 64 nt, hsa; identical to SEQ ID NO: 113614

SEQ ID NO: 464485 - RNA, 64 nt, hsa; identical to SEQ ID NO: 113615

SEQ ID NO: 464486 - RNA, 64 nt, hsa; identical to SEQ ID NO: 113616

SEQ ID NO: 464487 - RNA, 64 nt, hsa; identical to SEQ ID NO: 113617

SEQ ID NO: 464488 - RNA, 64 nt, hsa; identical to SEQ ID NO: 113618

SEQ ID NO: 464489 - RNA, 64 nt, hsa; identical to SEQ ID NO: 113619

SEQ ID NO: 464490 - RNA, 64 nt, hsa; identical to SEQ ID NO: 113620

SEQ ID NO: 464491 - RNA, 64 nt, hsa; identical to SEQ ID NO: 113621

SEQ ID NO: 464492 - RNA, 64 nt, hsa; identical to SEQ ID NO: 113622

SEQ ID NO: 464493 - RNA, 64 nt, hsa; identical to SEQ ID NO: 113623

SEQ ID NO: 464494 - RNA, 64 nt, hsa; identical to SEQ ID NO: 113624

SEQ ID NO: 464495 - RNA, 64 nt, hsa; identical to SEQ ID NO: 113625

SEQ ID NO: 464496 - RNA, 64 nt, hsa; identical to SEQ ID NO: 113626

SEQ ID NO: 464497 - RNA, 64 nt, hsa; identical to SEQ ID NO: 113627

SEQ ID NO: 464498 - RNA, 64 nt, hsa; identical to SEQ ID NO: 113628

SEQ ID NO: 464499 - RNA, 64 nt, hsa; identical to SEQ ID NO: 113629

SEQ ID NO: 464500 - RNA, 64 nt, hsa; identical to SEQ ID NO: 113630

SEQ ID NO: 464501 - RNA, 64 nt, hsa; identical to SEQ ID NO: 113631

SEQ ID NO: 464502 - RNA, 64 nt, hsa; identical to SEQ ID NO: 113632

SEQ ID NO: 464503 - RNA, 64 nt, hsa; identical to SEQ ID NO: 113633

SEQ ID NO: 464504 - RNA, 64 nt, hsa; identical to SEQ ID NO: 113634

SEQ ID NO: 464505 - RNA, 64 nt, hsa; identical to SEQ ID NO: 113635

SEQ ID NO: 464506 - RNA, 64 nt, hsa; identical to SEQ ID NO: 113636

SEQ ID NO: 464507 - RNA, 64 nt, hsa; identical to SEQ ID NO: 113637

SEQ ID NO: 464508 - RNA, 64 nt, hsa; identical to SEQ ID NO: 113638

SEQ ID NO: 464509 - RNA, 64 nt, hsa; identical to SEQ ID NO: 457937

SEQ ID NO: 464510 - RNA, 64 nt, hsa; identical to SEQ ID NO: 457938

SEQ ID NO: 464511 - RNA, 64 nt, hsa; identical to SEQ ID NO: 457939

SEQ ID NO: 464512 - RNA, 64 nt, hsa; identical to SEQ ID NO: 457940

SEQ ID NO: 464513 - RNA, 64 nt, hsa; identical to SEQ ID NO: 457941

SEQ ID NO: 464514 - RNA, 64 nt, hsa; identical to SEQ ID NO: 457942

SEQ ID NO: 464515 - RNA, 64 nt, hsa; identical to SEQ ID NO: 457943

SEQ ID NO: 464516 - RNA, 64 nt, hsa; identical to SEQ ID NO: 457944

SEQ ID NO: 464517 - RNA, 64 nt, hsa; identical to SEQ ID NO: 457945

SEQ ID NO: 464518 - RNA, 64 nt, hsa; identical to SEQ ID NO: 457946

SEQ ID NO: 464519 - RNA, 64 nt, hsa; identical to SEQ ID NO: 457947

SEQ ID NO: 464520 - RNA, 64 nt, hsa; identical to SEQ ID NO: 457948

SEQ ID NO: 464521 - RNA, 64 nt, hsa; identical to SEQ ID NO: 457949

SEQ ID NO: 464522 - RNA, 64 nt, hsa; identical to SEQ ID NO: 457950

SEQ ID NO: 464523 - RNA, 64 nt, hsa; identical to SEQ ID NO: 457951

SEQ ID NO: 464524 - RNA, 64 nt, hsa; identical to SEQ ID NO: 457952

SEQ ID NO: 464525 - RNA, 64 nt, hsa; identical to SEQ ID NO: 457953

SEQ ID NO: 464526 - RNA, 64 nt, hsa; identical to SEQ ID NO: 457954

SEQ ID NO: 464527 - RNA, 64 nt, hsa; identical to SEQ ID NO: 457955

SEQ ID NO: 464528 - RNA, 64 nt, hsa; identical to SEQ ID NO: 457956

SEQ ID NO: 464529 - RNA, 64 nt, hsa; identical to SEQ ID NO: 457957

SEQ ID NO: 464530 - RNA, 64 nt, hsa; identical to SEQ ID NO: 457958

SEQ ID NO: 464531 - RNA, 64 nt, hsa; identical to SEQ ID NO: 457959

SEQ ID NO: 464532 - RNA, 64 nt, hsa; identical to SEQ ID NO: 457960

SEQ ID NO: 464533 - RNA, 64 nt, hsa; identical to SEQ ID NO: 457961

SEQ ID NO: 464534 - RNA, 64 nt, hsa; identical to SEQ ID NO: 457962

SEQ ID NO: 464535 - RNA, 64 nt, hsa; identical to SEQ ID NO: 457963

SEQ ID NO: 464536 - RNA, 64 nt, hsa; identical to SEQ ID NO: 457964

SEQ ID NO: 464537 - RNA, 64 nt, hsa; identical to SEQ ID NO: 457965

SEQ ID NO: 464538 - RNA, 64 nt, hsa; identical to SEQ ID NO: 457966

SEQ ID NO: 464539 - RNA, 64 nt, hsa; identical to SEQ ID NO: 457967

SEQ ID NO: 464540 - RNA, 64 nt, hsa; identical to SEQ ID NO: 457968

SEQ ID NO: 464541 - RNA, 64 nt, hsa; identical to SEQ ID NO: 457969

SEQ ID NO: 464542 - RNA, 64 nt, hsa; identical to SEQ ID NO: 457970

SEQ ID NO: 464543 - RNA, 64 nt, hsa; identical to SEQ ID NO: 457971

SEQ ID NO: 464544 - RNA, 64 nt, hsa; identical to SEQ ID NO: 457972

SEQ ID NO: 464545 - RNA, 64 nt, hsa; identical to SEQ ID NO: 457973

SEQ ID NO: 464546 - RNA, 64 nt, hsa; identical to SEQ ID NO: 457974

SEQ ID NO: 464547 - RNA, 64 nt, hsa; identical to SEQ ID NO: 457975

SEQ ID NO: 464548 - RNA, 64 nt, hsa; identical to SEQ ID NO: 457976

SEQ ID NO: 464549 - RNA, 64 nt, hsa; identical to SEQ ID NO: 457977

SEQ ID NO: 464550 - RNA, 64 nt, hsa; identical to SEQ ID NO: 457978

SEQ ID NO: 464551 - RNA, 64 nt, hsa; identical to SEQ ID NO: 457979

SEQ ID NO: 464552 - RNA, 64 nt, hsa; identical to SEQ ID NO: 457980

SEQ ID NO: 464553 - RNA, 64 nt, hsa; identical to SEQ ID NO: 457981

SEQ ID NO: 464554 - RNA, 64 nt, hsa; identical to SEQ ID NO: 457982

SEQ ID NO: 464555 - RNA, 64 nt, hsa; identical to SEQ ID NO: 457983

SEQ ID NO: 464556 - RNA, 64 nt, hsa; identical to SEQ ID NO: 457984

SEQ ID NO: 464557 - RNA, 64 nt, hsa; identical to SEQ ID NO: 457985

SEQ ID NO: 464558 - RNA, 64 nt, hsa; identical to SEQ ID NO: 457986

SEQ ID NO: 464559 - RNA, 64 nt, hsa; identical to SEQ ID NO: 457987

SEQ ID NO: 464560 - RNA, 64 nt, hsa; identical to SEQ ID NO: 457988

SEQ ID NO: 464561 - RNA, 64 nt, hsa; identical to SEQ ID NO: 457989

SEQ ID NO: 464562 - RNA, 64 nt, hsa; identical to SEQ ID NO: 457990

SEQ ID NO: 464563 - RNA, 64 nt, hsa; identical to SEQ ID NO: 457991

SEQ ID NO: 464564 - RNA, 64 nt, hsa; identical to SEQ ID NO: 457992

SEQ ID NO: 464565 - RNA, 64 nt, hsa; identical to SEQ ID NO: 457993

SEQ ID NO: 464566 - RNA, 64 nt, hsa; identical to SEQ ID NO: 457994

SEQ ID NO: 464567 - RNA, 64 nt, hsa; identical to SEQ ID NO: 457995

SEQ ID NO: 464568 - RNA, 64 nt, hsa; identical to SEQ ID NO: 457996

SEQ ID NO: 464569 - RNA, 64 nt, hsa; identical to SEQ ID NO: 457997

SEQ ID NO: 464570 - RNA, 64 nt, hsa; identical to SEQ ID NO: 457998

SEQ ID NO: 464571 - RNA, 64 nt, hsa; identical to SEQ ID NO: 457999

SEQ ID NO: 464572 - RNA, 64 nt, hsa; identical to SEQ ID NO: 458000

SEQ ID NO: 464573 - RNA, 64 nt, hsa; identical to SEQ ID NO: 458001

SEQ ID NO: 464574 - RNA, 64 nt, hsa; identical to SEQ ID NO: 458002

SEQ ID NO: 464575 - RNA, 64 nt, hsa; identical to SEQ ID NO: 458003

SEQ ID NO: 464576 - RNA, 64 nt, hsa; identical to SEQ ID NO: 458004

SEQ ID NO: 464577 - RNA, 64 nt, hsa; identical to SEQ ID NO: 458005

SEQ ID NO: 464578 - RNA, 64 nt, hsa; identical to SEQ ID NO: 458006

SEQ ID NO: 464579 - RNA, 64 nt, hsa; identical to SEQ ID NO: 458007

SEQ ID NO: 464580 - RNA, 64 nt, hsa; identical to SEQ ID NO: 458008

SEQ ID NO: 464581 - RNA, 64 nt, hsa; identical to SEQ ID NO: 458009

SEQ ID NO: 464582 - RNA, 64 nt, hsa; identical to SEQ ID NO: 458010

SEQ ID NO: 464583 - RNA, 64 nt, hsa; identical to SEQ ID NO: 458011

SEQ ID NO: 464584 - RNA, 64 nt, hsa; identical to SEQ ID NO: 458012

SEQ ID NO: 464585 - RNA, 64 nt, hsa; identical to SEQ ID NO: 458013

SEQ ID NO: 464586 - RNA, 64 nt, hsa; identical to SEQ ID NO: 458014

SEQ ID NO: 464587 - RNA, 64 nt, hsa; identical to SEQ ID NO: 458015

SEQ ID NO: 464588 - RNA, 64 nt, hsa; identical to SEQ ID NO: 458016

SEQ ID NO: 464589 - RNA, 64 nt, hsa; identical to SEQ ID NO: 458017

SEQ ID NO: 464590 - RNA, 64 nt, hsa; identical to SEQ ID NO: 458018

SEQ ID NO: 464591 - RNA, 64 nt, hsa; identical to SEQ ID NO: 458019

SEQ ID NO: 464592 - RNA, 64 nt, hsa; identical to SEQ ID NO: 458020

SEQ ID NO: 464593 - RNA, 64 nt, hsa; identical to SEQ ID NO: 458021

SEQ ID NO: 464594 - RNA, 64 nt, hsa; identical to SEQ ID NO: 458022

SEQ ID NO: 464595 - RNA, 64 nt, hsa; identical to SEQ ID NO: 458023

SEQ ID NO: 464596 - RNA, 64 nt, hsa; identical to SEQ ID NO: 458024

SEQ ID NO: 464597 - RNA, 64 nt, hsa; identical to SEQ ID NO: 458025

SEQ ID NO: 464598 - RNA, 64 nt, hsa; identical to SEQ ID NO: 458026

SEQ ID NO: 464599 - RNA, 64 nt, hsa; identical to SEQ ID NO: 458027

SEQ ID NO: 464600 - RNA, 64 nt, hsa; identical to SEQ ID NO: 458028

SEQ ID NO: 464601 - RNA, 64 nt, hsa; identical to SEQ ID NO: 458029

SEQ ID NO: 464602 - RNA, 64 nt, hsa; identical to SEQ ID NO: 458030

SEQ ID NO: 464603 - RNA, 64 nt, hsa; identical to SEQ ID NO: 458031

SEQ ID NO: 464604 - RNA, 64 nt, hsa; identical to SEQ ID NO: 458032

SEQ ID NO: 464605 - RNA, 64 nt, hsa; identical to SEQ ID NO: 458033

SEQ ID NO: 464606 - RNA, 64 nt, hsa; identical to SEQ ID NO: 458034

SEQ ID NO: 464607 - RNA, 64 nt, hsa; identical to SEQ ID NO: 458035

SEQ ID NO: 464608 - RNA, 64 nt, hsa; identical to SEQ ID NO: 458036

SEQ ID NO: 464609 - RNA, 64 nt, hsa; identical to SEQ ID NO: 458037

SEQ ID NO: 464610 - RNA, 64 nt, hsa; identical to SEQ ID NO: 458038

SEQ ID NO: 464611 - RNA, 64 nt, hsa; identical to SEQ ID NO: 458039

SEQ ID NO: 464612 - RNA, 64 nt, hsa; identical to SEQ ID NO: 458040

SEQ ID NO: 464613 - RNA, 64 nt, hsa; identical to SEQ ID NO: 458041

SEQ ID NO: 464614 - RNA, 64 nt, hsa; identical to SEQ ID NO: 458042

SEQ ID NO: 464615 - RNA, 64 nt, hsa; identical to SEQ ID NO: 458043

SEQ ID NO: 464616 - RNA, 64 nt, hsa; identical to SEQ ID NO: 458044

SEQ ID NO: 464617 - RNA, 64 nt, hsa; identical to SEQ ID NO: 458045

SEQ ID NO: 464618 - RNA, 64 nt, hsa; identical to SEQ ID NO: 458046

SEQ ID NO: 464619 - RNA, 64 nt, hsa; identical to SEQ ID NO: 458047

SEQ ID NO: 464620 - RNA, 64 nt, hsa; identical to SEQ ID NO: 458048

SEQ ID NO: 464621 - RNA, 64 nt, hsa; identical to SEQ ID NO: 458049

SEQ ID NO: 464622 - RNA, 64 nt, hsa; identical to SEQ ID NO: 458050

SEQ ID NO: 464623 - RNA, 64 nt, hsa; identical to SEQ ID NO: 458051

SEQ ID NO: 464624 - RNA, 64 nt, hsa; identical to SEQ ID NO: 458052

SEQ ID NO: 464625 - RNA, 64 nt, hsa; identical to SEQ ID NO: 458053

SEQ ID NO: 464626 - RNA, 64 nt, hsa; identical to SEQ ID NO: 458054

SEQ ID NO: 464627 - RNA, 64 nt, hsa; identical to SEQ ID NO: 458055

SEQ ID NO: 464628 - RNA, 64 nt, hsa; identical to SEQ ID NO: 458056

SEQ ID NO: 464629 - RNA, 64 nt, hsa; identical to SEQ ID NO: 458057

SEQ ID NO: 464630 - RNA, 64 nt, hsa; identical to SEQ ID NO: 458058

SEQ ID NO: 464631 - RNA, 64 nt, hsa; identical to SEQ ID NO: 458059

SEQ ID NO: 464632 - RNA, 64 nt, hsa; identical to SEQ ID NO: 458060

SEQ ID NO: 464633 - RNA, 64 nt, hsa; identical to SEQ ID NO: 458061

SEQ ID NO: 464634 - RNA, 64 nt, hsa; identical to SEQ ID NO: 458062

SEQ ID NO: 464635 - RNA, 64 nt, hsa; identical to SEQ ID NO: 458063

SEQ ID NO: 464636 - RNA, 64 nt, hsa; identical to SEQ ID NO: 458064

SEQ ID NO: 464637 - RNA, 64 nt, hsa; identical to SEQ ID NO: 458065

SEQ ID NO: 464638 - RNA, 64 nt, hsa; identical to SEQ ID NO: 458066

SEQ ID NO: 464639 - RNA, 64 nt, hsa; identical to SEQ ID NO: 458067

SEQ ID NO: 464640 - RNA, 64 nt, hsa; identical to SEQ ID NO: 458068

SEQ ID NO: 464641 - RNA, 64 nt, hsa; identical to SEQ ID NO: 458069

SEQ ID NO: 464642 - RNA, 64 nt, hsa; identical to SEQ ID NO: 458070

SEQ ID NO: 464643 - RNA, 64 nt, hsa; identical to SEQ ID NO: 458071

SEQ ID NO: 464644 - RNA, 64 nt, hsa; identical to SEQ ID NO: 458072

SEQ ID NO: 464645 - RNA, 64 nt, hsa; identical to SEQ ID NO: 458073

SEQ ID NO: 464646 - RNA, 64 nt, hsa; identical to SEQ ID NO: 458074

SEQ ID NO: 464647 - RNA, 64 nt, hsa; identical to SEQ ID NO: 458075

SEQ ID NO: 464648 - RNA, 64 nt, hsa; identical to SEQ ID NO: 458076

SEQ ID NO: 464649 - RNA, 64 nt, hsa; identical to SEQ ID NO: 458077

SEQ ID NO: 464650 - RNA, 64 nt, hsa; identical to SEQ ID NO: 458078

SEQ ID NO: 464651 - RNA, 64 nt, hsa; identical to SEQ ID NO: 458079

SEQ ID NO: 464652 - RNA, 64 nt, hsa; identical to SEQ ID NO: 458080

SEQ ID NO: 464653 - RNA, 64 nt, hsa; identical to SEQ ID NO: 458081

SEQ ID NO: 464654 - RNA, 64 nt, hsa; identical to SEQ ID NO: 458082

SEQ ID NO: 464655 - RNA, 64 nt, hsa; identical to SEQ ID NO: 458083

SEQ ID NO: 464656 - RNA, 64 nt, hsa; identical to SEQ ID NO: 458084

SEQ ID NO: 464657 - RNA, 64 nt, hsa; identical to SEQ ID NO: 458085

SEQ ID NO: 464658 - RNA, 64 nt, hsa; identical to SEQ ID NO: 458086

SEQ ID NO: 464659 - RNA, 64 nt, hsa; identical to SEQ ID NO: 458087

SEQ ID NO: 464660 - RNA, 64 nt, hsa; identical to SEQ ID NO: 458088

SEQ ID NO: 464661 - RNA, 64 nt, hsa; identical to SEQ ID NO: 458089

SEQ ID NO: 464662 - RNA, 64 nt, hsa; identical to SEQ ID NO: 458090

SEQ ID NO: 464663 - RNA, 64 nt, hsa; identical to SEQ ID NO: 458091

SEQ ID NO: 464664 - RNA, 64 nt, hsa; identical to SEQ ID NO: 458092

SEQ ID NO: 464665 - RNA, 64 nt, hsa; identical to SEQ ID NO: 458093

SEQ ID NO: 464666 - RNA, 64 nt, hsa; identical to SEQ ID NO: 458094

SEQ ID NO: 464667 - RNA, 64 nt, hsa; identical to SEQ ID NO: 458095

SEQ ID NO: 464668 - RNA, 64 nt, hsa; identical to SEQ ID NO: 458096

SEQ ID NO: 464669 - RNA, 64 nt, hsa; identical to SEQ ID NO: 458097

SEQ ID NO: 464670 - RNA, 64 nt, hsa; identical to SEQ ID NO: 458098

SEQ ID NO: 464671 - RNA, 64 nt, hsa; identical to SEQ ID NO: 458099

SEQ ID NO: 464672 - RNA, 64 nt, hsa; identical to SEQ ID NO: 458100

SEQ ID NO: 464673 - RNA, 64 nt, hsa; identical to SEQ ID NO: 458101

SEQ ID NO: 464674 - RNA, 64 nt, hsa; identical to SEQ ID NO: 458102

SEQ ID NO: 464675 - RNA, 64 nt, hsa; identical to SEQ ID NO: 458103

SEQ ID NO: 464676 - RNA, 64 nt, hsa; identical to SEQ ID NO: 458104

SEQ ID NO: 464677 - RNA, 64 nt, hsa; identical to SEQ ID NO: 458105

SEQ ID NO: 464678 - RNA, 64 nt, hsa; identical to SEQ ID NO: 458106

SEQ ID NO: 464679 - RNA, 64 nt, hsa; identical to SEQ ID NO: 458107

SEQ ID NO: 464680 - RNA, 64 nt, hsa; identical to SEQ ID NO: 458108

SEQ ID NO: 464681 - RNA, 64 nt, hsa; identical to SEQ ID NO: 458109

SEQ ID NO: 464682 - RNA, 64 nt, hsa; identical to SEQ ID NO: 458110

SEQ ID NO: 464683 - RNA, 64 nt, hsa; identical to SEQ ID NO: 458111

SEQ ID NO: 464684 - RNA, 64 nt, hsa; identical to SEQ ID NO: 458112

SEQ ID NO: 464685 - RNA, 64 nt, hsa; identical to SEQ ID NO: 458113

SEQ ID NO: 464686 - RNA, 64 nt, hsa; identical to SEQ ID NO: 458114

SEQ ID NO: 464687 - RNA, 64 nt, hsa; identical to SEQ ID NO: 458115

SEQ ID NO: 464688 - RNA, 64 nt, hsa; identical to SEQ ID NO: 458116

SEQ ID NO: 464689 - RNA, 64 nt, hsa; identical to SEQ ID NO: 458117

SEQ ID NO: 464690 - RNA, 64 nt, hsa; identical to SEQ ID NO: 458118

SEQ ID NO: 464691 - RNA, 64 nt, hsa; identical to SEQ ID NO: 458119

SEQ ID NO: 464692 - RNA, 64 nt, hsa; identical to SEQ ID NO: 458120

SEQ ID NO: 464693 - RNA, 64 nt, hsa; identical to SEQ ID NO: 458121

SEQ ID NO: 464694 - RNA, 64 nt, hsa; identical to SEQ ID NO: 458122

SEQ ID NO: 464695 - RNA, 64 nt, hsa; identical to SEQ ID NO: 458123

SEQ ID NO: 464696 - RNA, 64 nt, hsa; identical to SEQ ID NO: 458124

SEQ ID NO: 464697 - RNA, 64 nt, hsa; identical to SEQ ID NO: 458125

SEQ ID NO: 464698 - RNA, 64 nt, hsa; identical to SEQ ID NO: 458126

SEQ ID NO: 464699 - RNA, 64 nt, hsa; identical to SEQ ID NO: 458127

SEQ ID NO: 464700 - RNA, 64 nt, hsa; identical to SEQ ID NO: 458128

SEQ ID NO: 464701 - RNA, 64 nt, hsa; identical to SEQ ID NO: 458129

SEQ ID NO: 464702 - RNA, 64 nt, hsa; identical to SEQ ID NO: 458130

SEQ ID NO: 464703 - RNA, 64 nt, hsa; identical to SEQ ID NO: 458131

SEQ ID NO: 464704 - RNA, 64 nt, hsa; identical to SEQ ID NO: 458132

SEQ ID NO: 464705 - RNA, 64 nt, hsa; identical to SEQ ID NO: 458133

SEQ ID NO: 464706 - RNA, 64 nt, hsa; identical to SEQ ID NO: 458134

SEQ ID NO: 464707 - RNA, 64 nt, hsa; identical to SEQ ID NO: 458135

SEQ ID NO: 464708 - RNA, 64 nt, hsa; identical to SEQ ID NO: 458136

SEQ ID NO: 464709 - RNA, 64 nt, hsa; identical to SEQ ID NO: 458137

SEQ ID NO: 464710 - RNA, 64 nt, hsa; identical to SEQ ID NO: 458138

SEQ ID NO: 464711 - RNA, 64 nt, hsa; identical to SEQ ID NO: 458139

SEQ ID NO: 464712 - RNA, 64 nt, hsa; identical to SEQ ID NO: 458140

SEQ ID NO: 464713 - RNA, 64 nt, hsa; identical to SEQ ID NO: 458141

SEQ ID NO: 464714 - RNA, 64 nt, hsa; identical to SEQ ID NO: 458142

SEQ ID NO: 464715 - RNA, 64 nt, hsa; identical to SEQ ID NO: 458143

SEQ ID NO: 464716 - RNA, 64 nt, hsa; identical to SEQ ID NO: 458144

SEQ ID NO: 464717 - RNA, 64 nt, hsa; identical to SEQ ID NO: 458145

SEQ ID NO: 464718 - RNA, 64 nt, hsa; identical to SEQ ID NO: 458146

SEQ ID NO: 464719 - RNA, 64 nt, hsa; identical to SEQ ID NO: 458147

SEQ ID NO: 464720 - RNA, 64 nt, hsa; identical to SEQ ID NO: 458148

SEQ ID NO: 464721 - RNA, 64 nt, hsa; identical to SEQ ID NO: 458149

SEQ ID NO: 464722 - RNA, 64 nt, hsa; identical to SEQ ID NO: 458150

SEQ ID NO: 464723 - RNA, 64 nt, hsa; identical to SEQ ID NO: 458151

SEQ ID NO: 464724 - RNA, 64 nt, hsa; identical to SEQ ID NO: 458152

SEQ ID NO: 464725 - RNA, 64 nt, hsa; identical to SEQ ID NO: 458153

SEQ ID NO: 464726 - RNA, 64 nt, hsa; identical to SEQ ID NO: 458154

SEQ ID NO: 464727 - RNA, 64 nt, hsa; identical to SEQ ID NO: 458155

SEQ ID NO: 464728 - RNA, 64 nt, hsa; identical to SEQ ID NO: 458156

SEQ ID NO: 464729 - RNA, 64 nt, hsa; identical to SEQ ID NO: 458157

SEQ ID NO: 464730 - RNA, 64 nt, hsa; identical to SEQ ID NO: 458158

SEQ ID NO: 464731 - RNA, 64 nt, hsa; identical to SEQ ID NO: 458159

SEQ ID NO: 464732 - RNA, 64 nt, hsa; identical to SEQ ID NO: 458160

SEQ ID NO: 464733 - RNA, 64 nt, hsa; identical to SEQ ID NO: 458161

SEQ ID NO: 464734 - RNA, 64 nt, hsa; identical to SEQ ID NO: 458162

SEQ ID NO: 464735 - RNA, 64 nt, hsa; identical to SEQ ID NO: 458163

SEQ ID NO: 464736 - RNA, 64 nt, hsa; identical to SEQ ID NO: 458164

SEQ ID NO: 464737 - RNA, 64 nt, hsa; identical to SEQ ID NO: 458165

SEQ ID NO: 464738 - RNA, 64 nt, hsa; identical to SEQ ID NO: 458166

SEQ ID NO: 464739 - RNA, 64 nt, hsa; identical to SEQ ID NO: 458167

SEQ ID NO: 464740 - RNA, 64 nt, hsa; identical to SEQ ID NO: 458168

SEQ ID NO: 464741 - RNA, 64 nt, hsa; identical to SEQ ID NO: 458169

SEQ ID NO: 464742 - RNA, 64 nt, hsa; identical to SEQ ID NO: 458170

SEQ ID NO: 464743 - RNA, 64 nt, hsa; identical to SEQ ID NO: 458171

SEQ ID NO: 464744 - RNA, 64 nt, hsa; identical to SEQ ID NO: 458172

SEQ ID NO: 464745 - RNA, 64 nt, hsa; identical to SEQ ID NO: 458173

SEQ ID NO: 464746 - RNA, 64 nt, hsa; identical to SEQ ID NO: 458174

SEQ ID NO: 464747 - RNA, 64 nt, hsa; identical to SEQ ID NO: 458175

SEQ ID NO: 464748 - RNA, 64 nt, hsa; identical to SEQ ID NO: 458176

SEQ ID NO: 464749 - RNA, 64 nt, hsa; identical to SEQ ID NO: 458177

SEQ ID NO: 464750 - RNA, 64 nt, hsa; identical to SEQ ID NO: 458178

SEQ ID NO: 464751 - RNA, 64 nt, hsa; identical to SEQ ID NO: 458179

SEQ ID NO: 464752 - RNA, 64 nt, hsa; identical to SEQ ID NO: 458180

SEQ ID NO: 464753 - RNA, 64 nt, hsa; identical to SEQ ID NO: 458181

SEQ ID NO: 464754 - RNA, 64 nt, hsa; identical to SEQ ID NO: 458182

SEQ ID NO: 464755 - RNA, 64 nt, hsa; identical to SEQ ID NO: 458183

SEQ ID NO: 464756 - RNA, 64 nt, hsa; identical to SEQ ID NO: 458184

SEQ ID NO: 464757 - RNA, 64 nt, hsa; identical to SEQ ID NO: 458185

SEQ ID NO: 464758 - RNA, 64 nt, hsa; identical to SEQ ID NO: 458186

SEQ ID NO: 464759 - RNA, 64 nt, hsa; identical to SEQ ID NO: 458187

SEQ ID NO: 464760 - RNA, 64 nt, hsa; identical to SEQ ID NO: 458188

SEQ ID NO: 464761 - RNA, 64 nt, hsa; identical to SEQ ID NO: 458189

SEQ ID NO: 464762 - RNA, 64 nt, hsa; identical to SEQ ID NO: 458190

SEQ ID NO: 464763 - RNA, 64 nt, hsa; identical to SEQ ID NO: 458191

SEQ ID NO: 464764 - RNA, 64 nt, hsa; identical to SEQ ID NO: 458192

SEQ ID NO: 464765 - RNA, 64 nt, hsa; identical to SEQ ID NO: 458193

SEQ ID NO: 464766 - RNA, 64 nt, hsa; identical to SEQ ID NO: 458194

SEQ ID NO: 464767 - RNA, 64 nt, hsa; identical to SEQ ID NO: 458195

SEQ ID NO: 464768 - RNA, 64 nt, hsa; identical to SEQ ID NO: 458196

SEQ ID NO: 464769 - RNA, 64 nt, hsa; identical to SEQ ID NO: 458197

SEQ ID NO: 464770 - RNA, 64 nt, hsa; identical to SEQ ID NO: 458198

SEQ ID NO: 464771 - RNA, 64 nt, hsa; identical to SEQ ID NO: 458199

SEQ ID NO: 464772 - RNA, 64 nt, hsa; identical to SEQ ID NO: 458200

SEQ ID NO: 464773 - RNA, 64 nt, hsa; identical to SEQ ID NO: 458201

SEQ ID NO: 464774 - RNA, 64 nt, hsa; identical to SEQ ID NO: 458202

SEQ ID NO: 464775 - RNA, 64 nt, hsa; identical to SEQ ID NO: 458203

SEQ ID NO: 464776 - RNA, 64 nt, hsa; identical to SEQ ID NO: 458204

SEQ ID NO: 464777 - RNA, 64 nt, hsa; identical to SEQ ID NO: 458205

SEQ ID NO: 464778 - RNA, 64 nt, hsa; identical to SEQ ID NO: 458206

SEQ ID NO: 464779 - RNA, 64 nt, hsa; identical to SEQ ID NO: 458207

SEQ ID NO: 464780 - RNA, 64 nt, hsa; identical to SEQ ID NO: 458208

SEQ ID NO: 464781 - RNA, 64 nt, hsa; identical to SEQ ID NO: 458209

SEQ ID NO: 464782 - RNA, 64 nt, hsa; identical to SEQ ID NO: 458210

SEQ ID NO: 464783 - RNA, 64 nt, hsa; identical to SEQ ID NO: 458211

SEQ ID NO: 464784 - RNA, 64 nt, hsa; identical to SEQ ID NO: 458212

SEQ ID NO: 464785 - RNA, 64 nt, hsa; identical to SEQ ID NO: 458213

SEQ ID NO: 464786 - RNA, 64 nt, hsa; identical to SEQ ID NO: 458214

SEQ ID NO: 464787 - RNA, 64 nt, hsa; identical to SEQ ID NO: 458215

SEQ ID NO: 464788 - RNA, 64 nt, hsa; identical to SEQ ID NO: 458216

SEQ ID NO: 464789 - RNA, 64 nt, hsa; identical to SEQ ID NO: 458217

SEQ ID NO: 464790 - RNA, 64 nt, hsa; identical to SEQ ID NO: 458218

SEQ ID NO: 464791 - RNA, 64 nt, hsa; identical to SEQ ID NO: 458219

SEQ ID NO: 464792 - RNA, 64 nt, hsa; identical to SEQ ID NO: 458220

SEQ ID NO: 464793 - RNA, 64 nt, hsa; identical to SEQ ID NO: 458221

SEQ ID NO: 464794 - RNA, 64 nt, hsa; identical to SEQ ID NO: 458222

SEQ ID NO: 464795 - RNA, 64 nt, hsa; identical to SEQ ID NO: 458223

SEQ ID NO: 464796 - RNA, 64 nt, hsa; identical to SEQ ID NO: 458224

SEQ ID NO: 464797 - RNA, 64 nt, hsa; identical to SEQ ID NO: 458225

SEQ ID NO: 464798 - RNA, 64 nt, hsa; identical to SEQ ID NO: 458226

SEQ ID NO: 464799 - RNA, 64 nt, hsa; identical to SEQ ID NO: 458227

SEQ ID NO: 464800 - RNA, 64 nt, hsa; identical to SEQ ID NO: 458228

SEQ ID NO: 464801 - RNA, 64 nt, hsa; identical to SEQ ID NO: 458229

SEQ ID NO: 464802 - RNA, 64 nt, hsa; identical to SEQ ID NO: 458230

SEQ ID NO: 464803 - RNA, 64 nt, hsa; identical to SEQ ID NO: 458231

SEQ ID NO: 464804 - RNA, 64 nt, hsa; identical to SEQ ID NO: 458232

SEQ ID NO: 464805 - RNA, 64 nt, hsa; identical to SEQ ID NO: 458233

SEQ ID NO: 464806 - RNA, 64 nt, hsa; identical to SEQ ID NO: 458234

SEQ ID NO: 464807 - RNA, 64 nt, hsa; identical to SEQ ID NO: 458235

SEQ ID NO: 464808 - RNA, 64 nt, hsa; identical to SEQ ID NO: 458236

SEQ ID NO: 464809 - RNA, 64 nt, hsa; identical to SEQ ID NO: 458237

SEQ ID NO: 464810 - RNA, 64 nt, hsa; identical to SEQ ID NO: 458238

SEQ ID NO: 464811 - RNA, 64 nt, hsa; identical to SEQ ID NO: 458239

SEQ ID NO: 464812 - RNA, 64 nt, hsa; identical to SEQ ID NO: 458240

SEQ ID NO: 464813 - RNA, 64 nt, hsa; identical to SEQ ID NO: 458241

SEQ ID NO: 464814 - RNA, 64 nt, hsa; identical to SEQ ID NO: 458242

SEQ ID NO: 464815 - RNA, 64 nt, hsa; identical to SEQ ID NO: 458243

SEQ ID NO: 464816 - RNA, 64 nt, hsa; identical to SEQ ID NO: 458244

SEQ ID NO: 464817 - RNA, 64 nt, hsa; identical to SEQ ID NO: 458245

SEQ ID NO: 464818 - RNA, 64 nt, hsa; identical to SEQ ID NO: 458246

SEQ ID NO: 464819 - RNA, 64 nt, hsa; identical to SEQ ID NO: 458247

SEQ ID NO: 464820 - RNA, 64 nt, hsa; identical to SEQ ID NO: 458248

SEQ ID NO: 464821 - RNA, 64 nt, hsa; identical to SEQ ID NO: 458249

SEQ ID NO: 464822 - RNA, 64 nt, hsa; identical to SEQ ID NO: 458250

SEQ ID NO: 464823 - RNA, 64 nt, hsa; identical to SEQ ID NO: 458251

SEQ ID NO: 464824 - RNA, 64 nt, hsa; identical to SEQ ID NO: 458252

SEQ ID NO: 464825 - RNA, 64 nt, hsa; identical to SEQ ID NO: 458253

SEQ ID NO: 464826 - RNA, 64 nt, hsa; identical to SEQ ID NO: 458254

SEQ ID NO: 464827 - RNA, 64 nt, hsa; identical to SEQ ID NO: 458255

SEQ ID NO: 464828 - RNA, 64 nt, hsa; identical to SEQ ID NO: 458256

SEQ ID NO: 464829 - RNA, 64 nt, hsa; identical to SEQ ID NO: 458257

SEQ ID NO: 464830 - RNA, 64 nt, hsa; identical to SEQ ID NO: 458258

SEQ ID NO: 464831 - RNA, 64 nt, hsa; identical to SEQ ID NO: 458259

SEQ ID NO: 464832 - RNA, 64 nt, hsa; identical to SEQ ID NO: 458260

SEQ ID NO: 464833 - RNA, 64 nt, hsa; identical to SEQ ID NO: 458261

SEQ ID NO: 464834 - RNA, 64 nt, hsa; identical to SEQ ID NO: 458262

SEQ ID NO: 464835 - RNA, 64 nt, hsa; identical to SEQ ID NO: 458263

SEQ ID NO: 464836 - RNA, 64 nt, hsa; identical to SEQ ID NO: 458264

SEQ ID NO: 464837 - RNA, 64 nt, hsa; identical to SEQ ID NO: 458265

SEQ ID NO: 464838 - RNA, 64 nt, hsa; identical to SEQ ID NO: 458266

SEQ ID NO: 464839 - RNA, 64 nt, hsa; identical to SEQ ID NO: 458267

SEQ ID NO: 464840 - RNA, 64 nt, hsa; identical to SEQ ID NO: 458268

SEQ ID NO: 464841 - RNA, 64 nt, hsa; identical to SEQ ID NO: 458269

SEQ ID NO: 464842 - RNA, 64 nt, hsa; identical to SEQ ID NO: 458270

SEQ ID NO: 464843 - RNA, 64 nt, hsa; identical to SEQ ID NO: 458271

SEQ ID NO: 464844 - RNA, 64 nt, hsa; identical to SEQ ID NO: 458272

SEQ ID NO: 464845 - RNA, 64 nt, hsa; identical to SEQ ID NO: 458273

SEQ ID NO: 464846 - RNA, 64 nt, hsa; identical to SEQ ID NO: 458274

SEQ ID NO: 464847 - RNA, 64 nt, hsa; identical to SEQ ID NO: 458275

SEQ ID NO: 464848 - RNA, 64 nt, hsa; identical to SEQ ID NO: 458276

SEQ ID NO: 464849 - RNA, 64 nt, hsa; identical to SEQ ID NO: 458277

SEQ ID NO: 464850 - RNA, 64 nt, hsa; identical to SEQ ID NO: 458278

SEQ ID NO: 464851 - RNA, 64 nt, hsa; identical to SEQ ID NO: 458279

SEQ ID NO: 464852 - RNA, 64 nt, hsa; identical to SEQ ID NO: 458280

SEQ ID NO: 464853 - RNA, 64 nt, hsa; identical to SEQ ID NO: 458281

SEQ ID NO: 464854 - RNA, 64 nt, hsa; identical to SEQ ID NO: 458282

SEQ ID NO: 464855 - RNA, 64 nt, hsa; identical to SEQ ID NO: 458283

SEQ ID NO: 464856 - RNA, 64 nt, hsa; identical to SEQ ID NO: 458284

SEQ ID NO: 464857 - RNA, 64 nt, hsa; identical to SEQ ID NO: 458285

SEQ ID NO: 464858 - RNA, 64 nt, hsa; identical to SEQ ID NO: 458286

SEQ ID NO: 464859 - RNA, 64 nt, hsa; identical to SEQ ID NO: 458287

SEQ ID NO: 464860 - RNA, 64 nt, hsa; identical to SEQ ID NO: 458288

SEQ ID NO: 464861 - RNA, 64 nt, hsa; identical to SEQ ID NO: 458289

SEQ ID NO: 464862 - RNA, 64 nt, hsa; identical to SEQ ID NO: 458290

SEQ ID NO: 464863 - RNA, 64 nt, hsa; identical to SEQ ID NO: 458291

SEQ ID NO: 464864 - RNA, 64 nt, hsa; identical to SEQ ID NO: 458292

SEQ ID NO: 464865 - RNA, 64 nt, hsa; identical to SEQ ID NO: 458293

SEQ ID NO: 464866 - RNA, 64 nt, hsa; identical to SEQ ID NO: 458294

SEQ ID NO: 464867 - RNA, 64 nt, hsa; identical to SEQ ID NO: 458295

SEQ ID NO: 464868 - RNA, 64 nt, hsa; identical to SEQ ID NO: 458296

SEQ ID NO: 464869 - RNA, 64 nt, hsa; identical to SEQ ID NO: 458297

SEQ ID NO: 464870 - RNA, 64 nt, hsa; identical to SEQ ID NO: 458298

SEQ ID NO: 464871 - RNA, 64 nt, hsa; identical to SEQ ID NO: 458299

SEQ ID NO: 464872 - RNA, 64 nt, hsa; identical to SEQ ID NO: 458300

SEQ ID NO: 464873 - RNA, 64 nt, hsa; identical to SEQ ID NO: 458301

SEQ ID NO: 464874 - RNA, 64 nt, hsa; identical to SEQ ID NO: 458302

SEQ ID NO: 464875 - RNA, 64 nt, hsa; identical to SEQ ID NO: 458303

SEQ ID NO: 464876 - RNA, 64 nt, hsa; identical to SEQ ID NO: 458304

SEQ ID NO: 464877 - RNA, 64 nt, hsa; identical to SEQ ID NO: 458305

SEQ ID NO: 464878 - RNA, 64 nt, hsa; identical to SEQ ID NO: 458306

SEQ ID NO: 464879 - RNA, 64 nt, hsa; identical to SEQ ID NO: 458307

SEQ ID NO: 464880 - RNA, 64 nt, hsa; identical to SEQ ID NO: 458308

SEQ ID NO: 464881 - RNA, 64 nt, hsa; identical to SEQ ID NO: 458309

SEQ ID NO: 464882 - RNA, 64 nt, hsa; identical to SEQ ID NO: 458310

SEQ ID NO: 464883 - RNA, 64 nt, hsa; identical to SEQ ID NO: 458311

SEQ ID NO: 464884 - RNA, 64 nt, hsa; identical to SEQ ID NO: 458312

SEQ ID NO: 464885 - RNA, 64 nt, hsa; identical to SEQ ID NO: 458313

SEQ ID NO: 464886 - RNA, 64 nt, hsa; identical to SEQ ID NO: 458314

SEQ ID NO: 464887 - RNA, 64 nt, hsa; identical to SEQ ID NO: 458315

SEQ ID NO: 464888 - RNA, 64 nt, hsa; identical to SEQ ID NO: 458316

SEQ ID NO: 464889 - RNA, 64 nt, hsa; identical to SEQ ID NO: 458317

SEQ ID NO: 464890 - RNA, 64 nt, hsa; identical to SEQ ID NO: 458318

SEQ ID NO: 464891 - RNA, 64 nt, hsa; identical to SEQ ID NO: 458319

SEQ ID NO: 464892 - RNA, 64 nt, hsa; identical to SEQ ID NO: 458320

SEQ ID NO: 464893 - RNA, 64 nt, hsa; identical to SEQ ID NO: 458321

SEQ ID NO: 464894 - RNA, 64 nt, hsa; identical to SEQ ID NO: 458322

SEQ ID NO: 464895 - RNA, 64 nt, hsa; identical to SEQ ID NO: 458323

SEQ ID NO: 464896 - RNA, 64 nt, hsa; identical to SEQ ID NO: 458324

SEQ ID NO: 464897 - RNA, 64 nt, hsa; identical to SEQ ID NO: 458325

SEQ ID NO: 464898 - RNA, 64 nt, hsa; identical to SEQ ID NO: 458326

SEQ ID NO: 464899 - RNA, 64 nt, hsa; identical to SEQ ID NO: 458327

SEQ ID NO: 464900 - RNA, 64 nt, hsa; identical to SEQ ID NO: 458328

SEQ ID NO: 464901 - RNA, 64 nt, hsa; identical to SEQ ID NO: 458329

SEQ ID NO: 464902 - RNA, 64 nt, hsa; identical to SEQ ID NO: 458330

SEQ ID NO: 464903 - RNA, 64 nt, hsa; identical to SEQ ID NO: 458331

SEQ ID NO: 464904 - RNA, 64 nt, hsa; identical to SEQ ID NO: 458332

SEQ ID NO: 464905 - RNA, 64 nt, hsa; identical to SEQ ID NO: 458333

SEQ ID NO: 464906 - RNA, 64 nt, hsa; identical to SEQ ID NO: 458334

SEQ ID NO: 464907 - RNA, 64 nt, hsa; identical to SEQ ID NO: 458335

SEQ ID NO: 464908 - RNA, 64 nt, hsa; identical to SEQ ID NO: 458336

SEQ ID NO: 464909 - RNA, 64 nt, hsa; identical to SEQ ID NO: 458337

SEQ ID NO: 464910 - RNA, 64 nt, hsa; identical to SEQ ID NO: 458338

SEQ ID NO: 464911 - RNA, 64 nt, hsa; identical to SEQ ID NO: 458339

SEQ ID NO: 464912 - RNA, 64 nt, hsa; identical to SEQ ID NO: 458340

SEQ ID NO: 464913 - RNA, 64 nt, hsa; identical to SEQ ID NO: 458341

SEQ ID NO: 464914 - RNA, 64 nt, hsa; identical to SEQ ID NO: 458342

SEQ ID NO: 464915 - RNA, 64 nt, hsa; identical to SEQ ID NO: 458343

SEQ ID NO: 464916 - RNA, 64 nt, hsa; identical to SEQ ID NO: 458344

SEQ ID NO: 464917 - RNA, 64 nt, hsa; identical to SEQ ID NO: 458345

SEQ ID NO: 464918 - RNA, 64 nt, hsa; identical to SEQ ID NO: 458346

SEQ ID NO: 464919 - RNA, 64 nt, hsa; identical to SEQ ID NO: 458347

SEQ ID NO: 464920 - RNA, 64 nt, hsa; identical to SEQ ID NO: 458348

SEQ ID NO: 464921 - RNA, 64 nt, hsa; identical to SEQ ID NO: 458349

SEQ ID NO: 464922 - RNA, 64 nt, hsa; identical to SEQ ID NO: 458350

SEQ ID NO: 464923 - RNA, 64 nt, hsa; identical to SEQ ID NO: 458351

SEQ ID NO: 464924 - RNA, 64 nt, hsa; identical to SEQ ID NO: 458352

SEQ ID NO: 464925 - RNA, 64 nt, hsa; identical to SEQ ID NO: 458353

SEQ ID NO: 464926 - RNA, 64 nt, hsa; identical to SEQ ID NO: 458354

SEQ ID NO: 464927 - RNA, 64 nt, hsa; identical to SEQ ID NO: 458355

SEQ ID NO: 464928 - RNA, 64 nt, hsa; identical to SEQ ID NO: 458356

SEQ ID NO: 464929 - RNA, 64 nt, hsa; identical to SEQ ID NO: 458357

SEQ ID NO: 464930 - RNA, 64 nt, hsa; identical to SEQ ID NO: 458358

SEQ ID NO: 464931 - RNA, 64 nt, hsa; identical to SEQ ID NO: 458359

SEQ ID NO: 464932 - RNA, 64 nt, hsa; identical to SEQ ID NO: 458360

SEQ ID NO: 464933 - RNA, 64 nt, hsa; identical to SEQ ID NO: 458361

SEQ ID NO: 464934 - RNA, 64 nt, hsa; identical to SEQ ID NO: 458362

SEQ ID NO: 464935 - RNA, 64 nt, hsa; identical to SEQ ID NO: 458363

SEQ ID NO: 464936 - RNA, 64 nt, hsa; identical to SEQ ID NO: 458364

SEQ ID NO: 464937 - RNA, 64 nt, hsa; identical to SEQ ID NO: 458365

SEQ ID NO: 464938 - RNA, 64 nt, hsa; identical to SEQ ID NO: 458366

SEQ ID NO: 464939 - RNA, 64 nt, hsa; identical to SEQ ID NO: 458367

SEQ ID NO: 464940 - RNA, 64 nt, hsa; identical to SEQ ID NO: 458368

SEQ ID NO: 464941 - RNA, 64 nt, hsa; identical to SEQ ID NO: 458369

SEQ ID NO: 464942 - RNA, 64 nt, hsa; identical to SEQ ID NO: 458370

SEQ ID NO: 464943 - RNA, 64 nt, hsa; identical to SEQ ID NO: 458371

SEQ ID NO: 464944 - RNA, 64 nt, hsa; identical to SEQ ID NO: 458372

SEQ ID NO: 464945 - RNA, 64 nt, hsa; identical to SEQ ID NO: 458373

SEQ ID NO: 464946 - RNA, 64 nt, hsa; identical to SEQ ID NO: 458374

SEQ ID NO: 464947 - RNA, 64 nt, hsa; identical to SEQ ID NO: 458375

SEQ ID NO: 464948 - RNA, 64 nt, hsa; identical to SEQ ID NO: 458376

SEQ ID NO: 464949 - RNA, 64 nt, hsa; identical to SEQ ID NO: 458377

SEQ ID NO: 464950 - RNA, 64 nt, hsa; identical to SEQ ID NO: 458378

SEQ ID NO: 464951 - RNA, 64 nt, hsa; identical to SEQ ID NO: 458379

SEQ ID NO: 464952 - RNA, 64 nt, hsa; identical to SEQ ID NO: 458380

SEQ ID NO: 464953 - RNA, 64 nt, hsa; identical to SEQ ID NO: 458381

SEQ ID NO: 464954 - RNA, 64 nt, hsa; identical to SEQ ID NO: 458382

SEQ ID NO: 464955 - RNA, 64 nt, hsa; identical to SEQ ID NO: 458383

SEQ ID NO: 464956 - RNA, 64 nt, hsa; identical to SEQ ID NO: 458384

SEQ ID NO: 464957 - RNA, 64 nt, hsa; identical to SEQ ID NO: 458385

SEQ ID NO: 464958 - RNA, 64 nt, hsa; identical to SEQ ID NO: 458386

SEQ ID NO: 464959 - RNA, 64 nt, hsa; identical to SEQ ID NO: 458387

SEQ ID NO: 464960 - RNA, 64 nt, hsa; identical to SEQ ID NO: 458388

SEQ ID NO: 464961 - RNA, 64 nt, hsa; identical to SEQ ID NO: 458389

SEQ ID NO: 464962 - RNA, 64 nt, hsa; identical to SEQ ID NO: 458390

SEQ ID NO: 464963 - RNA, 64 nt, hsa; identical to SEQ ID NO: 458391

SEQ ID NO: 464964 - RNA, 64 nt, hsa; identical to SEQ ID NO: 458392

SEQ ID NO: 464965 - RNA, 64 nt, hsa; identical to SEQ ID NO: 458393

SEQ ID NO: 464966 - RNA, 64 nt, hsa; identical to SEQ ID NO: 458394

SEQ ID NO: 464967 - RNA, 64 nt, hsa; identical to SEQ ID NO: 458395

SEQ ID NO: 464968 - RNA, 64 nt, hsa; identical to SEQ ID NO: 458396

SEQ ID NO: 464969 - RNA, 64 nt, hsa; identical to SEQ ID NO: 458397

SEQ ID NO: 464970 - RNA, 64 nt, hsa; identical to SEQ ID NO: 458398

SEQ ID NO: 464971 - RNA, 64 nt, hsa; identical to SEQ ID NO: 458399

SEQ ID NO: 464972 - RNA, 64 nt, hsa; identical to SEQ ID NO: 458400

SEQ ID NO: 464973 - RNA, 64 nt, hsa; identical to SEQ ID NO: 458401

SEQ ID NO: 464974 - RNA, 64 nt, hsa; identical to SEQ ID NO: 458402

SEQ ID NO: 464975 - RNA, 64 nt, hsa; identical to SEQ ID NO: 458403

SEQ ID NO: 464976 - RNA, 64 nt, hsa; identical to SEQ ID NO: 458404

SEQ ID NO: 464977 - RNA, 64 nt, hsa; identical to SEQ ID NO: 458405

SEQ ID NO: 464978 - RNA, 64 nt, hsa; identical to SEQ ID NO: 458406

SEQ ID NO: 464979 - RNA, 64 nt, hsa; identical to SEQ ID NO: 458407

SEQ ID NO: 464980 - RNA, 64 nt, hsa; identical to SEQ ID NO: 458408

SEQ ID NO: 464981 - RNA, 64 nt, hsa; identical to SEQ ID NO: 458409

SEQ ID NO: 464982 - RNA, 64 nt, hsa; identical to SEQ ID NO: 458410

SEQ ID NO: 464983 - RNA, 64 nt, hsa; identical to SEQ ID NO: 458411

SEQ ID NO: 464984 - RNA, 64 nt, hsa; identical to SEQ ID NO: 458412

SEQ ID NO: 464985 - RNA, 64 nt, hsa; identical to SEQ ID NO: 458413

SEQ ID NO: 464986 - RNA, 64 nt, hsa; identical to SEQ ID NO: 458414

SEQ ID NO: 464987 - RNA, 64 nt, hsa; identical to SEQ ID NO: 458415

SEQ ID NO: 464988 - RNA, 64 nt, hsa; identical to SEQ ID NO: 458416

SEQ ID NO: 464989 - RNA, 64 nt, hsa; identical to SEQ ID NO: 458417

SEQ ID NO: 464990 - RNA, 64 nt, hsa; identical to SEQ ID NO: 458418

SEQ ID NO: 464991 - RNA, 64 nt, hsa; identical to SEQ ID NO: 458419

SEQ ID NO: 464992 - RNA, 64 nt, hsa; identical to SEQ ID NO: 458420

SEQ ID NO: 464993 - RNA, 64 nt, hsa; identical to SEQ ID NO: 458421

SEQ ID NO: 464994 - RNA, 64 nt, hsa; identical to SEQ ID NO: 458422

SEQ ID NO: 464995 - RNA, 64 nt, hsa; identical to SEQ ID NO: 458423

SEQ ID NO: 464996 - RNA, 64 nt, hsa; identical to SEQ ID NO: 458424

SEQ ID NO: 464997 - RNA, 64 nt, hsa; identical to SEQ ID NO: 458425

SEQ ID NO: 464998 - RNA, 64 nt, hsa; identical to SEQ ID NO: 458426

SEQ ID NO: 464999 - RNA, 64 nt, hsa; identical to SEQ ID NO: 458427

SEQ ID NO: 465000 - RNA, 64 nt, hsa; identical to SEQ ID NO: 458428

SEQ ID NO: 465001 - RNA, 64 nt, hsa; identical to SEQ ID NO: 458429

SEQ ID NO: 465002 - RNA, 64 nt, hsa; identical to SEQ ID NO: 458430

SEQ ID NO: 465003 - RNA, 64 nt, hsa; identical to SEQ ID NO: 458431

SEQ ID NO: 465004 - RNA, 64 nt, hsa; identical to SEQ ID NO: 458432

SEQ ID NO: 465005 - RNA, 64 nt, hsa; identical to SEQ ID NO: 458433

SEQ ID NO: 465006 - RNA, 64 nt, hsa; identical to SEQ ID NO: 458434

SEQ ID NO: 465007 - RNA, 64 nt, hsa; identical to SEQ ID NO: 458435

SEQ ID NO: 465008 - RNA, 64 nt, hsa; identical to SEQ ID NO: 458436

SEQ ID NO: 465009 - RNA, 64 nt, hsa; identical to SEQ ID NO: 458437

SEQ ID NO: 465010 - RNA, 64 nt, hsa; identical to SEQ ID NO: 458438

SEQ ID NO: 465011 - RNA, 64 nt, hsa; identical to SEQ ID NO: 458439

SEQ ID NO: 465012 - RNA, 64 nt, hsa; identical to SEQ ID NO: 458440

SEQ ID NO: 465013 - RNA, 64 nt, hsa; identical to SEQ ID NO: 458441

SEQ ID NO: 465014 - RNA, 64 nt, hsa; identical to SEQ ID NO: 458442

SEQ ID NO: 465015 - RNA, 64 nt, hsa; identical to SEQ ID NO: 458443

SEQ ID NO: 465016 - RNA, 64 nt, hsa; identical to SEQ ID NO: 458444

SEQ ID NO: 465017 - RNA, 64 nt, hsa; identical to SEQ ID NO: 458445

SEQ ID NO: 465018 - RNA, 64 nt, hsa; identical to SEQ ID NO: 458446

SEQ ID NO: 465019 - RNA, 64 nt, hsa; identical to SEQ ID NO: 458447

SEQ ID NO: 465020 - RNA, 64 nt, hsa; identical to SEQ ID NO: 458448

SEQ ID NO: 465021 - RNA, 64 nt, hsa; identical to SEQ ID NO: 458449

SEQ ID NO: 465022 - RNA, 64 nt, hsa; identical to SEQ ID NO: 458450

SEQ ID NO: 465023 - RNA, 64 nt, hsa; identical to SEQ ID NO: 458451

SEQ ID NO: 465024 - RNA, 64 nt, hsa; identical to SEQ ID NO: 458452

SEQ ID NO: 465025 - RNA, 64 nt, hsa; identical to SEQ ID NO: 458453

SEQ ID NO: 465026 - RNA, 64 nt, hsa; identical to SEQ ID NO: 458454

SEQ ID NO: 465027 - RNA, 64 nt, hsa; identical to SEQ ID NO: 458455

SEQ ID NO: 465028 - RNA, 64 nt, hsa; identical to SEQ ID NO: 458456

SEQ ID NO: 465029 - RNA, 64 nt, hsa; identical to SEQ ID NO: 458457

SEQ ID NO: 465030 - RNA, 64 nt, hsa; identical to SEQ ID NO: 458458

SEQ ID NO: 465031 - RNA, 64 nt, hsa; identical to SEQ ID NO: 458459

SEQ ID NO: 465032 - RNA, 64 nt, hsa; identical to SEQ ID NO: 458460

SEQ ID NO: 465033 - RNA, 64 nt, hsa; identical to SEQ ID NO: 458461

SEQ ID NO: 465034 - RNA, 64 nt, hsa; identical to SEQ ID NO: 458462

SEQ ID NO: 465035 - RNA, 64 nt, hsa; identical to SEQ ID NO: 458463

SEQ ID NO: 465036 - RNA, 64 nt, hsa; identical to SEQ ID NO: 458464

SEQ ID NO: 465037 - RNA, 64 nt, hsa; identical to SEQ ID NO: 458465

SEQ ID NO: 465038 - RNA, 64 nt, hsa; identical to SEQ ID NO: 458466

SEQ ID NO: 465039 - RNA, 64 nt, hsa; identical to SEQ ID NO: 458467

SEQ ID NO: 465040 - RNA, 64 nt, hsa; identical to SEQ ID NO: 458468

SEQ ID NO: 465041 - RNA, 64 nt, hsa; identical to SEQ ID NO: 458469

SEQ ID NO: 465042 - RNA, 64 nt, hsa; identical to SEQ ID NO: 458470

SEQ ID NO: 465043 - RNA, 64 nt, hsa; identical to SEQ ID NO: 458471

SEQ ID NO: 465044 - RNA, 64 nt, hsa; identical to SEQ ID NO: 458472

SEQ ID NO: 465045 - RNA, 64 nt, hsa; identical to SEQ ID NO: 458473

SEQ ID NO: 465046 - RNA, 64 nt, hsa; identical to SEQ ID NO: 458474

SEQ ID NO: 465047 - RNA, 64 nt, hsa; identical to SEQ ID NO: 458475

SEQ ID NO: 465048 - RNA, 64 nt, hsa; identical to SEQ ID NO: 458476

SEQ ID NO: 465049 - RNA, 64 nt, hsa; identical to SEQ ID NO: 458477

SEQ ID NO: 465050 - RNA, 64 nt, hsa; identical to SEQ ID NO: 458478

SEQ ID NO: 465051 - RNA, 64 nt, hsa; identical to SEQ ID NO: 458479

SEQ ID NO: 465052 - RNA, 64 nt, hsa; identical to SEQ ID NO: 458480

SEQ ID NO: 465053 - RNA, 64 nt, hsa; identical to SEQ ID NO: 458481

SEQ ID NO: 465054 - RNA, 64 nt, hsa; identical to SEQ ID NO: 458482

SEQ ID NO: 465055 - RNA, 64 nt, hsa; identical to SEQ ID NO: 458483

SEQ ID NO: 465056 - RNA, 64 nt, hsa; identical to SEQ ID NO: 458484

SEQ ID NO: 465057 - RNA, 64 nt, hsa; identical to SEQ ID NO: 458485

SEQ ID NO: 465058 - RNA, 64 nt, hsa; identical to SEQ ID NO: 458486

SEQ ID NO: 465059 - RNA, 64 nt, hsa; identical to SEQ ID NO: 458487

SEQ ID NO: 465060 - RNA, 64 nt, hsa; identical to SEQ ID NO: 458488

SEQ ID NO: 465061 - RNA, 64 nt, hsa; identical to SEQ ID NO: 458489

SEQ ID NO: 465062 - RNA, 64 nt, hsa; identical to SEQ ID NO: 458490

SEQ ID NO: 465063 - RNA, 64 nt, hsa; identical to SEQ ID NO: 458491

SEQ ID NO: 465064 - RNA, 64 nt, hsa; identical to SEQ ID NO: 458492

SEQ ID NO: 465065 - RNA, 64 nt, hsa; identical to SEQ ID NO: 458493

SEQ ID NO: 465066 - RNA, 64 nt, hsa; identical to SEQ ID NO: 458494

SEQ ID NO: 465067 - RNA, 64 nt, hsa; identical to SEQ ID NO: 458495

SEQ ID NO: 465068 - RNA, 64 nt, hsa; identical to SEQ ID NO: 458496

SEQ ID NO: 465069 - RNA, 64 nt, hsa; identical to SEQ ID NO: 458497

SEQ ID NO: 465070 - RNA, 64 nt, hsa; identical to SEQ ID NO: 458498

SEQ ID NO: 465071 - RNA, 64 nt, hsa; identical to SEQ ID NO: 458499

SEQ ID NO: 465072 - RNA, 64 nt, hsa; identical to SEQ ID NO: 458500

SEQ ID NO: 465073 - RNA, 64 nt, hsa; identical to SEQ ID NO: 458501

SEQ ID NO: 465074 - RNA, 64 nt, hsa; identical to SEQ ID NO: 458502

SEQ ID NO: 465075 - RNA, 64 nt, hsa; identical to SEQ ID NO: 458503

SEQ ID NO: 465076 - RNA, 64 nt, hsa; identical to SEQ ID NO: 458504

SEQ ID NO: 465077 - RNA, 64 nt, hsa; identical to SEQ ID NO: 458505

SEQ ID NO: 465078 - RNA, 64 nt, hsa; identical to SEQ ID NO: 458506

SEQ ID NO: 465079 - RNA, 64 nt, hsa; identical to SEQ ID NO: 458507

SEQ ID NO: 465080 - RNA, 64 nt, hsa; identical to SEQ ID NO: 458508

SEQ ID NO: 465081 - RNA, 64 nt, hsa; identical to SEQ ID NO: 458509

SEQ ID NO: 465082 - RNA, 64 nt, hsa; identical to SEQ ID NO: 458510

SEQ ID NO: 465083 - RNA, 64 nt, hsa; identical to SEQ ID NO: 458511

SEQ ID NO: 465084 - RNA, 64 nt, hsa; identical to SEQ ID NO: 458512

SEQ ID NO: 465085 - RNA, 64 nt, hsa; identical to SEQ ID NO: 458513

SEQ ID NO: 465086 - RNA, 64 nt, hsa; identical to SEQ ID NO: 458514

SEQ ID NO: 465087 - RNA, 64 nt, hsa; identical to SEQ ID NO: 458515

SEQ ID NO: 465088 - RNA, 64 nt, hsa; identical to SEQ ID NO: 458516

SEQ ID NO: 465089 - RNA, 64 nt, hsa; identical to SEQ ID NO: 458517

SEQ ID NO: 465090 - RNA, 64 nt, hsa; identical to SEQ ID NO: 458518

SEQ ID NO: 465091 - RNA, 64 nt, hsa; identical to SEQ ID NO: 458519

SEQ ID NO: 465092 - RNA, 64 nt, hsa; identical to SEQ ID NO: 458520

SEQ ID NO: 465093 - RNA, 64 nt, hsa; identical to SEQ ID NO: 458521

SEQ ID NO: 465094 - RNA, 64 nt, hsa; identical to SEQ ID NO: 458522

SEQ ID NO: 465095 - RNA, 64 nt, hsa; identical to SEQ ID NO: 458523

SEQ ID NO: 465096 - RNA, 64 nt, hsa; identical to SEQ ID NO: 458524

SEQ ID NO: 465097 - RNA, 64 nt, hsa; identical to SEQ ID NO: 458525

SEQ ID NO: 465098 - RNA, 64 nt, hsa; identical to SEQ ID NO: 458526

SEQ ID NO: 465099 - RNA, 64 nt, hsa; identical to SEQ ID NO: 458527

SEQ ID NO: 465100 - RNA, 64 nt, hsa; identical to SEQ ID NO: 458528

SEQ ID NO: 465101 - RNA, 64 nt, hsa; identical to SEQ ID NO: 458529

SEQ ID NO: 465102 - RNA, 64 nt, hsa; identical to SEQ ID NO: 458530

SEQ ID NO: 465103 - RNA, 64 nt, hsa; identical to SEQ ID NO: 458531

SEQ ID NO: 465104 - RNA, 64 nt, hsa; identical to SEQ ID NO: 458532

SEQ ID NO: 465105 - RNA, 64 nt, hsa; identical to SEQ ID NO: 458533

SEQ ID NO: 465106 - RNA, 64 nt, hsa; identical to SEQ ID NO: 458534

SEQ ID NO: 465107 - RNA, 64 nt, hsa; identical to SEQ ID NO: 458512

SEQ ID NO: 465108 - RNA, 64 nt, hsa; identical to SEQ ID NO: 458536

SEQ ID NO: 465109 - RNA, 64 nt, hsa; identical to SEQ ID NO: 458537

SEQ ID NO: 465110 - RNA, 64 nt, hsa; identical to SEQ ID NO: 458538

SEQ ID NO: 465111 - RNA, 64 nt, hsa; identical to SEQ ID NO: 458539

SEQ ID NO: 465112 - RNA, 64 nt, hsa; identical to SEQ ID NO: 422910

SEQ ID NO: 465113 - RNA, 64 nt, hsa; identical to SEQ ID NO: 422911

SEQ ID NO: 465114 - RNA, 64 nt, hsa; identical to SEQ ID NO: 422917

SEQ ID NO: 465115 - RNA, 64 nt, hsa; identical to SEQ ID NO: 422918

SEQ ID NO: 465116 - RNA, 64 nt, hsa; identical to SEQ ID NO: 422923

SEQ ID NO: 465117 - RNA, 64 nt, hsa; identical to SEQ ID NO: 422924

SEQ ID NO: 465118 - RNA, 64 nt, hsa; identical to SEQ ID NO: 422947

SEQ ID NO: 465119 - RNA, 64 nt, hsa; identical to SEQ ID NO: 422948

SEQ ID NO: 465120 - RNA, 64 nt, hsa; identical to SEQ ID NO: 422952

SEQ ID NO: 465121 - RNA, 64 nt, hsa; identical to SEQ ID NO: 422953

SEQ ID NO: 465122 - RNA, 64 nt, hsa; identical to SEQ ID NO: 423007

SEQ ID NO: 465123 - RNA, 64 nt, hsa; identical to SEQ ID NO: 423008

SEQ ID NO: 465124 - RNA, 64 nt, hsa; identical to SEQ ID NO: 423031

SEQ ID NO: 465125 - RNA, 64 nt, hsa; identical to SEQ ID NO: 423032

SEQ ID NO: 465126 - RNA, 64 nt, hsa; identical to SEQ ID NO: 423040

SEQ ID NO: 465127 - RNA, 64 nt, hsa; identical to SEQ ID NO: 423041

SEQ ID NO: 465128 - RNA, 64 nt, hsa; identical to SEQ ID NO: 423075

SEQ ID NO: 465129 - RNA, 64 nt, hsa; identical to SEQ ID NO: 423076

SEQ ID NO: 465130 - RNA, 64 nt, hsa; identical to SEQ ID NO: 423095

SEQ ID NO: 465131 - RNA, 64 nt, hsa; identical to SEQ ID NO: 423096

SEQ ID NO: 465132 - RNA, 64 nt, hsa; identical to SEQ ID NO: 423115

SEQ ID NO: 465133 - RNA, 64 nt, hsa; identical to SEQ ID NO: 423116

SEQ ID NO: 465134 - RNA, 64 nt, hsa; identical to SEQ ID NO: 423117

SEQ ID NO: 465135 - RNA, 64 nt, hsa; identical to SEQ ID NO: 423118

SEQ ID NO: 465136 - RNA, 64 nt, hsa; identical to SEQ ID NO: 423119

SEQ ID NO: 465137 - RNA, 64 nt, hsa; identical to SEQ ID NO: 423138

SEQ ID NO: 465138 - RNA, 64 nt, hsa; identical to SEQ ID NO: 423139

SEQ ID NO: 465139 - RNA, 64 nt, hsa; identical to SEQ ID NO: 423160

SEQ ID NO: 465140 - RNA, 64 nt, hsa; identical to SEQ ID NO: 423161

SEQ ID NO: 465141 - RNA, 64 nt, hsa; identical to SEQ ID NO: 423187

SEQ ID NO: 465142 - RNA, 64 nt, hsa; identical to SEQ ID NO: 423188

SEQ ID NO: 465143 - RNA, 64 nt, hsa
guccaauacuaauccaauccaauacuaauaauacuauugguacaauccaauacuaauaauacua

SEQ ID NO: 465144 - RNA, 64 nt, hsa
uaauacuauugguacaauccaauacuaauaauacuauugguacaauccaauacuaauaauacua

SEQ ID NO: 465145 - RNA, 64 nt, hsa
gcaccucuaucucgcagguaauggaguaguuuguuauugguagucuacuccaggccaggcagug

SEQ ID NO: 465146 - RNA, 64 nt, hsa
uugauuuggaauaauuaauagcuacuggacauuauauugguacuaaagagaaagaauacuugac

SEQ ID NO: 465147 - RNA, 64 nt, hsa
aaaaucgauaaugucaguuaucuguuuuguccaauauugguaguacuuuuuugccucuuaugau

SEQ ID NO: 465148 - RNA, 64 nt, hsa
gcagaaguuaaaacccuuuguaucaaaagaucuuuauugguagagcacugguuaucuucuggau

SEQ ID NO: 465149 - RNA, 64 nt, hsa
guugccauggggaagaaggaugauguggaaaccauauugguaaaguuguuaaucccucguuaug

SEQ ID NO: 465150 - RNA, 64 nt, hsa
ugucguuggauaccuguauucuugacaguuagaauauugguagggacuuuguuaaaauucacuu

SEQ ID NO: 465151 - RNA, 64 nt, hsa
aggaugucuguuaaguaaucauuuaauauuauuauauugguaaugguuguaugugugaugcuau

SEQ ID NO: 465152 - RNA, 64 nt, hsa
uguuauaaaccauugugacuauuguuggucaaaguauugguacuuauauuguuaguaauugcau

SEQ ID NO: 465153 - RNA, 64 nt, hsa
uugacaaaguauguauuugcuggugucguguaaauauugguauuuuaaaauaaaaacuguuaca

SEQ ID NO: 465154 - RNA, 64 nt, hsa
aucucaguccagaaccaauauuaucguaauuaauuauugguauauaaugaaaacgguauuaauu

SEQ ID NO: 465155 - RNA, 64 nt, hsa
gaguacauucuaacccuacauuucuaaucauuguuauugguaaucuuuucugugaauauuaggu

SEQ ID NO: 465156 - RNA, 64 nt, hsa
aacaauccuaauuauaucuaguaccauacugaguuauugguaugacccuguggaaacacacauu

SEQ ID NO: 465157 - RNA, 64 nt, hsa
uaucuaagaaaacaagaaaacaaaggcagcagacuauugguacacauuauaguccaaagugcuu

SEQ ID NO: 465158 - RNA, 64 nt, hsa
aaaaaaaaagcuuuuuaaaauuucuauuguugucuauugguaauguuuuugaucagaauaaaga

SEQ ID NO: 465159 - RNA, 64 nt, hsa; identical to SEQ ID NO: 250961

SEQ ID NO: 465160 - RNA, 64 nt, hsa; identical to SEQ ID NO: 250962

SEQ ID NO: 465161 - RNA, 64 nt, hsa; identical to SEQ ID NO: 250963

SEQ ID NO: 465162 - RNA, 64 nt, hsa; identical to SEQ ID NO: 250964

SEQ ID NO: 465163 - RNA, 64 nt, hsa; identical to SEQ ID NO: 250965

SEQ ID NO: 465164 - RNA, 64 nt, hsa; identical to SEQ ID NO: 250966

SEQ ID NO: 465165 - RNA, 64 nt, hsa; identical to SEQ ID NO: 250967

SEQ ID NO: 465166 - RNA, 64 nt, hsa; identical to SEQ ID NO: 250968

SEQ ID NO: 465167 - RNA, 64 nt, hsa; identical to SEQ ID NO: 250969

SEQ ID NO: 465168 - RNA, 64 nt, hsa; identical to SEQ ID NO: 250970

SEQ ID NO: 465169 - RNA, 64 nt, hsa; identical to SEQ ID NO: 250971

SEQ ID NO: 465170 - RNA, 64 nt, hsa; identical to SEQ ID NO: 250972

SEQ ID NO: 465171 - RNA, 64 nt, hsa; identical to SEQ ID NO: 250973

SEQ ID NO: 465172 - RNA, 64 nt, hsa; identical to SEQ ID NO: 250974

SEQ ID NO: 465173 - RNA, 64 nt, hsa; identical to SEQ ID NO: 250975

SEQ ID NO: 465174 - RNA, 64 nt, hsa; identical to SEQ ID NO: 250976

SEQ ID NO: 465175 - RNA, 64 nt, hsa; identical to SEQ ID NO: 250977

SEQ ID NO: 465176 - RNA, 64 nt, hsa; identical to SEQ ID NO: 250978

SEQ ID NO: 465177 - RNA, 64 nt, hsa; identical to SEQ ID NO: 250979

SEQ ID NO: 465178 - RNA, 64 nt, hsa; identical to SEQ ID NO: 250980

SEQ ID NO: 465179 - RNA, 64 nt, hsa; identical to SEQ ID NO: 250981

SEQ ID NO: 465180 - RNA, 64 nt, hsa; identical to SEQ ID NO: 250982

SEQ ID NO: 465181 - RNA, 64 nt, hsa; identical to SEQ ID NO: 250983

SEQ ID NO: 465182 - RNA, 64 nt, hsa; identical to SEQ ID NO: 250984

SEQ ID NO: 465183 - RNA, 64 nt, hsa; identical to SEQ ID NO: 250985

SEQ ID NO: 465184 - RNA, 64 nt, hsa; identical to SEQ ID NO: 250986

SEQ ID NO: 465185 - RNA, 64 nt, hsa
auagauggauggauggauggacggauggggugggggaaggaaggaaaggagggagaaaggaggg

SEQ ID NO: 465186 - RNA, 64 nt, hsa
auggauggauggauggacggauggggugggggaaggaaggaaaggagggagaaaggagggaaua

SEQ ID NO: 465187 - RNA, 64 nt, hsa
agacaggugggagauggagguagggcuggcuggaggaaggaaacaacaaaggaagugagguagu

SEQ ID NO: 465188 - RNA, 64 nt, hsa
acaucugaggaaaauggaagaccuaaggcagacaggaaggaagcacaaaagacaagcauugggu

SEQ ID NO: 465189 - RNA, 64 nt, hsa
gagcaucugcuguuugaggacgggggguggggaaggaaggaacaugaucccuccagaagucucc

SEQ ID NO: 465190 - RNA, 64 nt, hsa
gggggagcaucugcuguuugaggacgggggguggggaaggaaggaacaugaucccuccagaagu

SEQ ID NO: 465191 - RNA, 64 nt, hsa
ggccugcccacaggacaagaaguggguaagggcaggaaggaaaugaacggaguuagcucccagg

SEQ ID NO: 465192 - RNA, 64 nt, hsa
auauuuuaaagauuucugagcuagcaggcaugugggaaggaaggcucugucuucaacucuuuga

SEQ ID NO: 465193 - RNA, 64 nt, hsa
uccuccucaaaaacugauucagaaacugacuuggggaaggaauuuaauacuuugaagucaugag

SEQ ID NO: 465194 - RNA, 64 nt, hsa
ucaagacuacuggucacaaugagucugauuuuuaggaaggaauaggaggagcagggaaaucaga

SEQ ID NO: 465195 - RNA, 64 nt, hsa
cugucauucaaauuggauaggagaaaguuggugaggaaggaauggagagagcaggaucccugga

SEQ ID NO: 465196 - RNA, 64 nt, hsa
ccugacccccucccagcccucccuaccuuggacaggaaggaaguaaugcaccuucucuugcuga

SEQ ID NO: 465197 - RNA, 64 nt, hsa
ccagccucuugcaguauucccauacuugaugcagggaaggaaccagaagcagaggggccucuac

SEQ ID NO: 465198 - RNA, 64 nt, hsa
ccucuuggauuuuuugaaauaaucuucagaggaaggaaggaaaauccuauuuugggguaucagu

SEQ ID NO: 465199 - RNA, 64 nt, hsa
uauuccucuuggauuuuuugaaauaaucuucagaggaaggaaggaaaauccuauuuugggguau

SEQ ID NO: 465200 - RNA, 64 nt, hsa
ugccucuuguggugaggggugugggaagaccaaaggaaggaacgcuaacaauuucucauacuua

SEQ ID NO: 465201 - RNA, 64 nt, hsa
uucguuagaaugucugccuuacugguuuccccagggaaggaaaaauacacuuccacccuuuuuu

SEQ ID NO: 465202 - RNA, 64 nt, hsa
uccucagaacaaugaaaaaagucuccauaggacaggaaggaaugcaaaacucauuuacacagug

SEQ ID NO: 465203 - RNA, 64 nt, hsa
gcuccggaaagaugagcuuuuuauucuacuacuuggaaggaaaaggaauuccugguccaccuga

SEQ ID NO: 465204 - RNA, 64 nt, hsa
caguagcaaauauuuauugacaaauugaaaagcaggaaggaagaggguugugccaagguauuga

SEQ ID NO: 465205 - RNA, 64 nt, hsa
aagcacauacaaaagaagacagggaaugcaaucaggaaggaaagacuuuuuaaaaaauaaaaac

SEQ ID NO: 465206 - RNA, 64 nt, hsa
cacuuagaaagaaaagacagaaaaggaagaggaaggaaggaaauauuuugagaauauauugaga

SEQ ID NO: 465207 - RNA, 64 nt, hsa
uacacacuuagaaagaaaagacagaaaaggaagaggaaggaaggaaauauuuugagaauauauu

SEQ ID NO: 465208 - RNA, 64 nt, hsa
ggccagucccugcauccucccugggguggaggauggaaggaaagcugggacaagcagggaacgc

SEQ ID NO: 465209 - RNA, 64 nt, hsa
gaagggaagagaggaagaacgagaggaagagaagggaaggaaguguuuguguagaagagagaga

SEQ ID NO: 465210 - RNA, 64 nt, hsa
gcuuuacauuauuugcugauaccaacuuuugguaggaaggaaaacagggaaggugauugcugcu

SEQ ID NO: 465211 - RNA, 64 nt, hsa
uuuuauagaguauaugguauauugugucaaucuuggaaggaaagcuguugcauaucaauuguag

SEQ ID NO: 465212 - RNA, 64 nt, hsa
caaaaaaaaaccccacaaucuaggaugggaacaaggaaggaaagaugugaauaggcugaugggc

SEQ ID NO: 465213 - RNA, 64 nt, hsa
ucaacauagugagacacugucucuaccaaaaaaaggaaggaagggacacauaucaaacugaaac

SEQ ID NO: 465214 - RNA, 64 nt, hsa
ccuggaucccaggagaaaggaguggaccgaggaaggaaggaaggcaaggcugucuguccauccg

SEQ ID NO: 465215 - RNA, 64 nt, hsa
caacccuggaucccaggagaaaggaguggaccgaggaaggaaggaaggcaaggcugucugucca

SEQ ID NO: 465216 - RNA, 64 nt, hsa
ugaguaucccugccaccaagagagcaaugggcagggaaggaaggggucugccgaccccagcucg

SEQ ID NO: 465217 - RNA, 64 nt, hsa
guacuuguggaaagguguguuugcguagccuuagggaaggaaggcaauugcuccuuaacagcag

SEQ ID NO: 465218 - RNA, 64 nt, hsa
ucccaaguuucccaggcacuuuuggccaaaggaaggaaggaacuaauucuucauuuuaaaaauu

SEQ ID NO: 465219 - RNA, 64 nt, hsa
uucaucccaaguuucccaggcacuuuuggccaaaggaaggaaggaacuaauucuucauuuuaaa

SEQ ID NO: 465220 - RNA, 64 nt, hsa
auccaacugaccuagugaagguucagaugcaaauggaaggaaaaaggaaacuggaaggaaaacc

SEQ ID NO: 465221 - RNA, 64 nt, hsa
agguucagaugcaaauggaaggaaaaaggaaacuggaaggaaaaccauugcgguaaguucucca

SEQ ID NO: 465222 - RNA, 64 nt, hsa
uuugugguuauaaacuaagagcuugauaggaguuggaaggaaacucuuacuaaaauguuaacuu

SEQ ID NO: 465223 - RNA, 64 nt, hsa
guagcagcuguugaguaacuuucauuggagguugggaaggaagugaggagaaaguguucuuguu

SEQ ID NO: 465224 - RNA, 64 nt, hsa
ugcuugcagggaaccgacugaguaaugaagaagaggaaggaagcccuuggaaggaacguaaaau

SEQ ID NO: 465225 - RNA, 64 nt, hsa
cgacugaguaaugaagaagaggaaggaagcccuuggaaggaacguaaaauccauuucagccugc

SEQ ID NO: 465226 - RNA, 64 nt, hsa
uucaaguggauaacaauauuuauaagaaaugaauggaaggaaauaugauccuccugagacuaac

SEQ ID NO: 465227 - RNA, 64 nt, hsa
uucagugaauucuaagaaggaaggaaggaagaaaggaaggaaagaagggagggaaacagggaga

SEQ ID NO: 465228 - RNA, 64 nt, hsa
ccuaggaaauacuucagugaauucuaagaaggaaggaaggaagaaaggaaggaaagaagggagg

SEQ ID NO: 465229 - RNA, 64 nt, hsa
gcuaccuaggaaauacuucagugaauucuaagaaggaaggaaggaagaaaggaaggaaagaagg

SEQ ID NO: 465230 - RNA, 64 nt, hsa
gcuguggaaugagagagaaaaccauggcugcucaggaaggaaguggagaaucucucagcacacg

SEQ ID NO: 465231 - RNA, 64 nt, hsa
uuuauagcuucaaaguguggcuugacauucaaauggaaggaaccaccugaauuauaucugcaaa

SEQ ID NO: 465232 - RNA, 64 nt, hsa
cugagggccaugaaagccacagaggaugggcugaggaaggaaagaaaugggguuacugcuccca

SEQ ID NO: 465233 - RNA, 64 nt, hsa
guugcauuaagcuuuuucaauaaaggaaaauuacggaaggaaaauaggcaacaccagcaaauua

SEQ ID NO: 465234 - RNA, 64 nt, hsa
uuggggaaggucuucaguugagcucucagccuuaggaaggaagcacguggaggagggacggagg

SEQ ID NO: 465235 - RNA, 64 nt, hsa
cucuacaggugucuucuggggggcagaaccaauuggaaggaagaaagggaccccucuccagucc

SEQ ID NO: 465236 - RNA, 64 nt, hsa
uagagaagaagaaauggaaaaaugaaagaaggcaggaaggaaagaaaggauauaggaagagagg

SEQ ID NO: 465237 - RNA, 64 nt, hsa
gucaauguacauuuugaacauauuuaugugcuauggaaggaaaugcuggugacuaaaauaaggu

SEQ ID NO: 465238 - RNA, 64 nt, hsa
cuacuuucccuauucuuauggagguaaaaggaaaggaaggaaggaaaaagcagcuuucacuuac

SEQ ID NO: 465239 - RNA, 64 nt, hsa
uuucccuauucuuauggagguaaaaggaaaggaaggaaggaaaaagcagcuuucacuuacaaag

SEQ ID NO: 465240 - RNA, 64 nt, hsa
uucccacuccuuccggaguaagguuagaagggaaggaaggaaagaucaaggaaccaagcgccuc

SEQ ID NO: 465241 - RNA, 64 nt, hsa
ccccuucccacuccuuccggaguaagguuagaagggaaggaaggaaagaucaaggaaccaagcg

SEQ ID NO: 465242 - RNA, 64 nt, hsa
agaauauugcauggagcacagugcuuccaaaacuggaaggaauuggccuggauuaggagucuua

SEQ ID NO: 465243 - RNA, 64 nt, hsa
ccauuuucacuaaacaauaaaaucuaaauaaauuggaaggaauaacaaccacaaaggaaagaau

SEQ ID NO: 465244 - RNA, 64 nt, hsa
uuauaauuugauaaggugauuauaaaagauacauggaaggaaguggaaccagaugcagaagagg

SEQ ID NO: 465245 - RNA, 64 nt, hsa
gagaguaagguguccuuauguuggaaacucaaguggaaggaagauuugguuugguuuuauucuc

SEQ ID NO: 465246 - RNA, 64 nt, hsa
gggaggcagggauggcaaggcgugaagccacccuggaaggaacuggaccaaggucuucagaggu

SEQ ID NO: 465247 - RNA, 64 nt, hsa
uucgauuucggcaaagccugggcaggugccaccgggaaggaauggcauccgagaugcugggcgg

SEQ ID NO: 465248 - RNA, 64 nt, hsa
ggagacucugucucgaaagaaagaaagaaaaaaaggaaggaaggagaaggaaggaaggagaaga

SEQ ID NO: 465249 - RNA, 64 nt, hsa
gaaagaaagaaagaaaaaaaggaaggaaggagaaggaaggaaggagaagaaaagguaccuguuc

SEQ ID NO: 465250 - RNA, 64 nt, hsa
ggcuggagcuccaugcacguaguccagaugccugggaaggaacaucucccuuccagcaucugcu

SEQ ID NO: 465251 - RNA, 64 nt, hsa
acaguucugaccuuuuuuguccaguuucuuugggggaaggaagacaaagaagguaggaacggaa

SEQ ID NO: 465252 - RNA, 64 nt, hsa
auaauuggacaaagagagagaaagaaagaaggaaggaaggaaaaacuuguuacugaaagagacu

SEQ ID NO: 465253 - RNA, 64 nt, hsa
auugauaauuggacaaagagagagaaagaaagaaggaaggaaggaaaaacuuguuacugaaaga

SEQ ID NO: 465254 - RNA, 64 nt, hsa
cgguggcggucacucccucugccacuauccccagggaaggaaaggcuccgccauuugggaaagu

SEQ ID NO: 465255 - RNA, 64 nt, hsa
auggucccaaaguacggcagcugcaaaaaguaguggaaggaaauugucuacgugucuuggaaaa

SEQ ID NO: 465256 - RNA, 64 nt, hsa
ggaaggaggaggaaggaaggacggaagcaaggaaggaaggaagggcugcuggagcccagucacc

SEQ ID NO: 465257 - RNA, 64 nt, hsa
agacggaaggaggaggaaggaaggacggaagcaaggaaggaaggaagggcugcuggagcccagu

SEQ ID NO: 465258 - RNA, 64 nt, hsa
cggaugcaggaaggaggugcagacggaaggaggaggaaggaaggacggaagcaaggaaggaagg

SEQ ID NO: 465259 - RNA, 64 nt, hsa
caguuagggaagggagccauugagcacagacuuuggaaggaaccuuuuuuuuguuguuuguuug

SEQ ID NO: 465260 - RNA, 64 nt, hsa
uugggaguugugcagggacucuggcccaggcaggggaaggaagaccaggcgguaggggacuggu

SEQ ID NO: 465261 - RNA, 64 nt, hsa
uacuuuaauguuuuaagugugggggguuugggaaggaaggaauguaauauuauggauuuagccu

SEQ ID NO: 465262 - RNA, 64 nt, hsa
uuaauacuuuaauguuuuaagugugggggguuugggaaggaaggaauguaauauuauggauuua

SEQ ID NO: 465263 - RNA, 64 nt, hsa
cacaaaucaacugaucuacuacuugggagacaguggaaggaaagauagagggaaggaaguucac

SEQ ID NO: 465264 - RNA, 64 nt, hsa
uacuacuugggagacaguggaaggaaagauagagggaaggaaguucacucacuugaauuugaau

SEQ ID NO: 465265 - RNA, 64 nt, hsa
ugaaaaauaaaaauuuauaauuugcccuugaauuggaaggaauggagauuagggaaggaaaacu

SEQ ID NO: 465266 - RNA, 64 nt, hsa
aauuugcccuugaauuggaaggaauggagauuagggaaggaaaacuacucuagaggccauuuaa

SEQ ID NO: 465267 - RNA, 64 nt, hsa
auugcccacuguucucauagcuaaaaguuaagaaggaaggaaggaaagcaggagaaaggaagga

SEQ ID NO: 465268 - RNA, 64 nt, hsa
cccacuguucucauagcuaaaaguuaagaaggaaggaaggaaagcaggagaaaggaaggauuaa

SEQ ID NO: 465269 - RNA, 64 nt, hsa
gcaaaaucuugagaaucaaucaauaaagaaagauggaaggaagggagaaauuggaauguuuuaa

SEQ ID NO: 465270 - RNA, 64 nt, hsa
uaaaacaaaacaaaacaaaauaaaacaaaaaaaaggaaggaaaaaaaaagaaaaaauuuaaaaa

SEQ ID NO: 465271 - RNA, 64 nt, hsa
aguuuacauacaggagaaugauggaaggaagggaggaaggaaaggaggagaaaaaugugucuuc

SEQ ID NO: 465272 - RNA, 64 nt, hsa
cuagguaccgugaguuuacauacaggagaaugauggaaggaagggaggaaggaaaggaggagaa

SEQ ID NO: 465273 - RNA, 64 nt, hsa
agcggggagcacugaugaggugcuggggaugacaggaaggaaggaacacugggcagaaccagag

SEQ ID NO: 465274 - RNA, 64 nt, hsa
gggagcacugaugaggugcuggggaugacaggaaggaaggaacacugggcagaaccagagagau

SEQ ID NO: 465275 - RNA, 64 nt, hsa
uagaggagcuauguggagcaaaggccgacagaggggaaggaauggaccugugagaggaagggaa

SEQ ID NO: 465276 - RNA, 64 nt, hsa
gcagaaagucucauuucaggaaggagggauagaaggaaggaaggaaggaacccccccccccccg

SEQ ID NO: 465277 - RNA, 64 nt, hsa
aaagucucauuucaggaaggagggauagaaggaaggaaggaaggaacccccccccccccgaaaa

SEQ ID NO: 465278 - RNA, 64 nt, hsa
ucucauuucaggaaggagggauagaaggaaggaaggaaggaacccccccccccccgaaaaaaaa

SEQ ID NO: 465279 - RNA, 64 nt, hsa
uguaguucccaccaguugccuuccccucagggauggaaggaagaggguuucuugggcugguuga

SEQ ID NO: 465280 - RNA, 64 nt, hsa
uucuaaaaugagagauagggauuuggugggguauggaaggaacuaaccccuucccucuccaccu

SEQ ID NO: 465281 - RNA, 64 nt, hsa
gccuguggggagccgagggcgucagagagacccgggaaggaaggcucucgggugggggagccag

SEQ ID NO: 465282 - RNA, 64 nt, hsa
ggggugguagucagaggagggaggaggaauaaggggaaggaagagagagggagcaggcggagcg

SEQ ID NO: 465283 - RNA, 64 nt, hsa
ugaagugaauucucugagcuggugguguggugcuggaaggaagguuauuuuuggagccacucuc

SEQ ID NO: 465284 - RNA, 64 nt, hsa
cuccgauguggagaggguguuauuuagagaucaaggaaggaagucauccuuccuugauauauau

SEQ ID NO: 465285 - RNA, 64 nt, hsa
agagagaaagaaagaaagaaagaaagggaaagauggaaggaaggaaggaaaaagaaagagaaag

SEQ ID NO: 465286 - RNA, 64 nt, hsa
agaaagaaagaaagaaagaaagggaaagauggaaggaaggaaggaaaaagaaagagaaagagag

SEQ ID NO: 465287 - RNA, 64 nt, hsa
agaaagaaagaaagaaagggaaagauggaaggaaggaaggaaaaagaaagagaaagagagagag

SEQ ID NO: 465288 - RNA, 64 nt, hsa
ugcaucccgccucccuggggaccugccuguggcaggaaggaauggggggccccagccccaggcc

SEQ ID NO: 465289 - RNA, 64 nt, hsa
caaggccaacagggcaggggaggggaagaccuggggaaggaagaaugaggacagucccgucgua

SEQ ID NO: 465290 - RNA, 64 nt, hsa
aaauggugcucagugcuccaaggaaaggaaggaaggaaggaaaaggaggggagaggaggggaag

SEQ ID NO: 465291 - RNA, 64 nt, hsa
uuccaaauggugcucagugcuccaaggaaaggaaggaaggaaggaaaaggaggggagaggaggg

SEQ ID NO: 465292 - RNA, 64 nt, hsa
aagcuuccaaauggugcucagugcuccaaggaaaggaaggaaggaaggaaaaggaggggagagg

SEQ ID NO: 465293 - RNA, 64 nt, hsa
auguagcuucucaggggaggcaggaagaaaggaaggaaggaaagaaggaagggaggacccaauc

SEQ ID NO: 465294 - RNA, 64 nt, hsa
aaaaauguagcuucucaggggaggcaggaagaaaggaaggaaggaaagaaggaagggaggaccc

SEQ ID NO: 465295 - RNA, 64 nt, hsa
ugucugucugugucugcauguaagagugagggagggaaggaaggaacuacaagagagucggaga

SEQ ID NO: 465296 - RNA, 64 nt, hsa
ugucugugucugcauguaagagugagggagggaaggaaggaacuacaagagagucggagaugau

SEQ ID NO: 465297 - RNA, 64 nt, hsa
uacucuuuuagucaggauuucggucuuuucugcgggaaggaauuaagcuauguauuagguccac

SEQ ID NO: 465298 - RNA, 64 nt, hsa
gucacguggcucccccuagccgcacacuagugugggaaggaaaauauugagcuaggcacauuac

SEQ ID NO: 465299 - RNA, 64 nt, hsa
ucauuuuucaggaaaguuuugaguguuauaagguggaaggaaacauaguagcaauggauacuuu

SEQ ID NO: 465300 - RNA, 64 nt, hsa
cccucugcccuacccgcucagcaacauagaagagggaaggaaagagagaaggaaagagagagag

SEQ ID NO: 465301 - RNA, 62 nt, hsa
cccugcagucuggguucccagacugaguccucuccccaaaucagggcucuagacccgagccc

SEQ ID NO: 465302 - RNA, 62 nt, hsa
cugggcuccaggauugucuccccacuccagcauccccaaacugguacucccugacccagggc

SEQ ID NO: 465303 - RNA, 62 nt, hsa
ugucccccacagcucaugcguuggaaacuuaauccccaaagcaacagcuuugagaggugaga

SEQ ID NO: 465304 - RNA, 62 nt, hsa
uccugauaaaaggaugaguucggccuucuucuuccccaaaaucuuuauccccacccccaccu

SEQ ID NO: 465305 - RNA, 62 nt, hsa
gauugugcgcacacucguuuccgaacugccucuccccaaagaaugugaggcauugucaccuu

SEQ ID NO: 465306 - RNA, 62 nt, hsa
gaaauguucucaauugagcaauucagucccucuccccaaagacuagacgugaccuggcagau

SEQ ID NO: 465307 - RNA, 62 nt, hsa
ucuucuaagccuguguguuauaauuuaccaguuccccaaaaugccauuuuuaacgccgaacu

SEQ ID NO: 465308 - RNA, 62 nt, hsa
aaauaaaauaaaaaauauuugucuccaccuuuuccccaaaagcaacagcaagacauauuuug

SEQ ID NO: 465309 - RNA, 62 nt, hsa
cacacacacacacacauacauccugcuuucccuccccaaacccaucagacagguaaaugggc

SEQ ID NO: 465310 - RNA, 62 nt, hsa
gucucucucucccuuuuaaauggugggaacccuccccaaaaccuuuccccagacacauucuc

SEQ ID NO: 465311 - RNA, 62 nt, hsa
cauguggccuaagagcucuggggagcccacacuccccaaagcaguuagacuauggagagccg

SEQ ID NO: 465312 - RNA, 62 nt, hsa
uuauuaaagaucauauggggaaaaugaaacccuccccaaaauacaagaaguucugggaggag

SEQ ID NO: 465313 - RNA, 62 nt, hsa
aagcuuuuugagggcaaacuuuaccuuugugguccccaaaugauggcauuucucuuugaaau

SEQ ID NO: 465314 - RNA, 62 nt, hsa
guuuacuucuaaacccacuuggguaguuacuauccccaaaucuguucuguaaauaauauuau

SEQ ID NO: 465315 - RNA, 62 nt, hsa
cuuugggaacuguguuuauugccuauaauggguccccaaaauggguaaccuagacuucagag

SEQ ID NO: 465316 - RNA, 62 nt, hsa
aucuggucuuuuuuuuuuuuuuuuuuuccgucuccccaaagcuuuaucugucuugacuuuuu

SEQ ID NO: 465317 - RNA, 62 nt, hsa
uucuuauuuuggcauucgauaucagcagccucuccccaaaguacuugaagucaguuuuagau

SEQ ID NO: 465318 - RNA, 62 nt, hsa
uggcugcugcuuucugcccagcucgccaguccuccccaaagaguugcgcaucagcaccuggg

SEQ ID NO: 465319 - RNA, 62 nt, hsa
aauaaucguuuuuguuuucuuguacuuugaauuccccaaagucuuaauugcuuuauuuuggu

SEQ ID NO: 465320 - RNA, 62 nt, hsa
agccccaguuuugacagaauaauucuuggucuuccccaaagagacaauuuguuguacccaug

SEQ ID NO: 465321 - RNA, 62 nt, hsa
ucaucccuuaauguucucaaggaggcccaggauccccaaaauauuauaagcauugcagucag

SEQ ID NO: 465322 - RNA, 62 nt, hsa
auauaugauccauauucaaaauucuccaguuguccccaaaauauccuuuauagcuguuuauu

SEQ ID NO: 465323 - RNA, 62 nt, hsa
acuuuccacuuugcccccuguccucucuguguuccccaaaucagagaauagcccgccauccc

SEQ ID NO: 465324 - RNA, 62 nt, hsa
gaucugucuuuccaauggccgggggcauuugguccccaaauuaaggcuauuggacaucugca

SEQ ID NO: 465325 - RNA, 62 nt, hsa
ccagaauuuuuuaucuagagaccagcauguucuccccaaagaccaagauauucugccaaaau

SEQ ID NO: 465326 - RNA, 62 nt, hsa
ccagaauuuuuugucuagagaccagcauguucuccccaaagaccagaauauucuaccuaaau

SEQ ID NO: 465327 - RNA, 62 nt, hsa
ccaggacuuuuuaucuagagaccagcauguucuccccaaagacuggaauauucuacccaaau

SEQ ID NO: 465328 - RNA, 62 nt, hsa
uucaggaaauaucgacagggcuacacgugauguccccaaacugcugcuauugaagaacuucc

SEQ ID NO: 465329 - RNA, 62 nt, hsa
aggcaagaauaugccccaacuaaagcauagauuccccaaagugaggcucauggugggaggcc

SEQ ID NO: 465330 - RNA, 62 nt, hsa
cagucaccacacaaggcacuggguauaugguauccccaaacaagagacauaaucccgguccu

SEQ ID NO: 465331 - RNA, 62 nt, hsa
cuccuuuccacugcuauuagucauggucacucuccccaaaauauuauauuuuuucuauaaaa

SEQ ID NO: 465332 - RNA, 62 nt, hsa
ggggaagccaauggccugucuccccacuaccauccccaaacgcuccuuggggcgugguuccu

SEQ ID NO: 465333 - RNA, 62 nt, hsa
gaauguuuugaaaggccagaggguggccuuuuuccccaaacaguuugguuccuuuuauguuu

SEQ ID NO: 465334 - RNA, 62 nt, hsa
uggccuugugcagacccuggacugcauccgguuccccaaagcccugcugcauucgagugucc

SEQ ID NO: 465335 - RNA, 62 nt, hsa
ccagggccccuguucuagggguuaggguucuuuccccaaaggaacuuaaaaagacaagcgug

SEQ ID NO: 465336 - RNA, 62 nt, hsa
ccaagccccgugcuagcagcgcuccgugcucuuccccaaauacucacggcucuaauucccca

SEQ ID NO: 465337 - RNA, 62 nt, hsa
cgugcucuuccccaaauacucacggcucuaauuccccaaaccugaaacuucauacccuggga

SEQ ID NO: 465338 - RNA, 62 nt, hsa
gugcuacuucaacauagagauuggacaugcucuccccaaaugagccacuuuccucuccaggu

SEQ ID NO: 465339 - RNA, 62 nt, hsa
accucuugcacaagccuaaauuccaggaaucuuccccaaaucccagauccucugcaaucuac

SEQ ID NO: 465340 - RNA, 64 nt, hsa; identical to SEQ ID NO: 220740

SEQ ID NO: 465341 - RNA, 64 nt, hsa; identical to SEQ ID NO: 220741

SEQ ID NO: 465342 - RNA, 64 nt, hsa; identical to SEQ ID NO: 220742

SEQ ID NO: 465343 - RNA, 64 nt, hsa; identical to SEQ ID NO: 220743

SEQ ID NO: 465344 - RNA, 64 nt, hsa; identical to SEQ ID NO: 220744

SEQ ID NO: 465345 - RNA, 64 nt, hsa; identical to SEQ ID NO: 220745

SEQ ID NO: 465346 - RNA, 64 nt, hsa; identical to SEQ ID NO: 220746

SEQ ID NO: 465347 - RNA, 64 nt, hsa; identical to SEQ ID NO: 220747

SEQ ID NO: 465348 - RNA, 64 nt, hsa; identical to SEQ ID NO: 220748

SEQ ID NO: 465349 - RNA, 64 nt, hsa; identical to SEQ ID NO: 220749

SEQ ID NO: 465350 - RNA, 64 nt, hsa; identical to SEQ ID NO: 220750

SEQ ID NO: 465351 - RNA, 64 nt, hsa; identical to SEQ ID NO: 220751

SEQ ID NO: 465352 - RNA, 64 nt, hsa; identical to SEQ ID NO: 220752

SEQ ID NO: 465353 - RNA, 64 nt, hsa; identical to SEQ ID NO: 220753

SEQ ID NO: 465354 - RNA, 64 nt, hsa; identical to SEQ ID NO: 220754

SEQ ID NO: 465355 - RNA, 64 nt, hsa; identical to SEQ ID NO: 220755

SEQ ID NO: 465356 - RNA, 64 nt, hsa; identical to SEQ ID NO: 220756

SEQ ID NO: 465357 - RNA, 64 nt, hsa; identical to SEQ ID NO: 220757

SEQ ID NO: 465358 - RNA, 64 nt, hsa; identical to SEQ ID NO: 220758

SEQ ID NO: 465359 - RNA, 64 nt, hsa; identical to SEQ ID NO: 220759

SEQ ID NO: 465360 - RNA, 64 nt, hsa; identical to SEQ ID NO: 220760

SEQ ID NO: 465361 - RNA, 64 nt, hsa; identical to SEQ ID NO: 220761

SEQ ID NO: 465362 - RNA, 64 nt, hsa; identical to SEQ ID NO: 220762

SEQ ID NO: 465363 - RNA, 64 nt, hsa; identical to SEQ ID NO: 220763

SEQ ID NO: 465364 - RNA, 64 nt, hsa; identical to SEQ ID NO: 220764

SEQ ID NO: 465365 - RNA, 64 nt, hsa; identical to SEQ ID NO: 220765

SEQ ID NO: 465366 - RNA, 64 nt, hsa; identical to SEQ ID NO: 220766

SEQ ID NO: 465367 - RNA, 64 nt, hsa; identical to SEQ ID NO: 220767

SEQ ID NO: 465368 - RNA, 64 nt, hsa; identical to SEQ ID NO: 220768

SEQ ID NO: 465369 - RNA, 64 nt, hsa; identical to SEQ ID NO: 220769

SEQ ID NO: 465370 - RNA, 64 nt, hsa; identical to SEQ ID NO: 220770

SEQ ID NO: 465371 - RNA, 64 nt, hsa; identical to SEQ ID NO: 220771

SEQ ID NO: 465372 - RNA, 64 nt, hsa; identical to SEQ ID NO: 220772

SEQ ID NO: 465373 - RNA, 64 nt, hsa; identical to SEQ ID NO: 220773

SEQ ID NO: 465374 - RNA, 64 nt, hsa; identical to SEQ ID NO: 220774

SEQ ID NO: 465375 - RNA, 64 nt, hsa; identical to SEQ ID NO: 220775

SEQ ID NO: 465376 - RNA, 64 nt, hsa; identical to SEQ ID NO: 220776

SEQ ID NO: 465377 - RNA, 64 nt, hsa; identical to SEQ ID NO: 220777

SEQ ID NO: 465378 - RNA, 64 nt, hsa; identical to SEQ ID NO: 220778

SEQ ID NO: 465379 - RNA, 64 nt, hsa; identical to SEQ ID NO: 220779

SEQ ID NO: 465380 - RNA, 64 nt, hsa; identical to SEQ ID NO: 220780

SEQ ID NO: 465381 - RNA, 64 nt, hsa; identical to SEQ ID NO: 220781

SEQ ID NO: 465382 - RNA, 64 nt, hsa; identical to SEQ ID NO: 220782

SEQ ID NO: 465383 - RNA, 63 nt, hsa; identical to SEQ ID NO: 220783

SEQ ID NO: 465384 - RNA, 64 nt, hsa; identical to SEQ ID NO: 220784

SEQ ID NO: 465385 - RNA, 64 nt, hsa; identical to SEQ ID NO: 220785

SEQ ID NO: 465386 - RNA, 64 nt, hsa; identical to SEQ ID NO: 220786

SEQ ID NO: 465387 - RNA, 64 nt, hsa; identical to SEQ ID NO: 220787

SEQ ID NO: 465388 - RNA, 64 nt, hsa; identical to SEQ ID NO: 220788

SEQ ID NO: 465389 - RNA, 64 nt, hsa; identical to SEQ ID NO: 220789

SEQ ID NO: 465390 - RNA, 64 nt, hsa; identical to SEQ ID NO: 220790

SEQ ID NO: 465391 - RNA, 64 nt, hsa; identical to SEQ ID NO: 220791

SEQ ID NO: 465392 - RNA, 64 nt, hsa; identical to SEQ ID NO: 220792

SEQ ID NO: 465393 - RNA, 64 nt, hsa; identical to SEQ ID NO: 220793

SEQ ID NO: 465394 - RNA, 64 nt, hsa; identical to SEQ ID NO: 220794

SEQ ID NO: 465395 - RNA, 64 nt, hsa; identical to SEQ ID NO: 220795

SEQ ID NO: 465396 - RNA, 56 nt, hsa; identical to SEQ ID NO: 220796

SEQ ID NO: 465397 - RNA, 64 nt, hsa; identical to SEQ ID NO: 220797

SEQ ID NO: 465398 - RNA, 64 nt, hsa; identical to SEQ ID NO: 220798

SEQ ID NO: 465399 - RNA, 64 nt, hsa; identical to SEQ ID NO: 220799

SEQ ID NO: 465400 - RNA, 64 nt, hsa; identical to SEQ ID NO: 220800

SEQ ID NO: 465401 - RNA, 64 nt, hsa; identical to SEQ ID NO: 220801

SEQ ID NO: 465402 - RNA, 64 nt, hsa; identical to SEQ ID NO: 220802

SEQ ID NO: 465403 - RNA, 51 nt, hsa; identical to SEQ ID NO: 220803

SEQ ID NO: 465404 - RNA, 51 nt, hsa; identical to SEQ ID NO: 220804

SEQ ID NO: 465405 - RNA, 51 nt, hsa; identical to SEQ ID NO: 220805

SEQ ID NO: 465406 - RNA, 64 nt, hsa; identical to SEQ ID NO: 220806

SEQ ID NO: 465407 - RNA, 64 nt, hsa; identical to SEQ ID NO: 220807

SEQ ID NO: 465408 - RNA, 64 nt, hsa; identical to SEQ ID NO: 220808

SEQ ID NO: 465409 - RNA, 64 nt, hsa; identical to SEQ ID NO: 220809

SEQ ID NO: 465410 - RNA, 64 nt, hsa; identical to SEQ ID NO: 220810

SEQ ID NO: 465411 - RNA, 64 nt, hsa; identical to SEQ ID NO: 220811

SEQ ID NO: 465412 - RNA, 64 nt, hsa; identical to SEQ ID NO: 220812

SEQ ID NO: 465413 - RNA, 64 nt, hsa; identical to SEQ ID NO: 220813

SEQ ID NO: 465414 - RNA, 64 nt, hsa; identical to SEQ ID NO: 220814

SEQ ID NO: 465415 - RNA, 64 nt, hsa; identical to SEQ ID NO: 220815

SEQ ID NO: 465416 - RNA, 64 nt, hsa
uggaggaauggaaauaaaauugggaugagcccuaauggaggaagucgggcaaauugaaaguaua

SEQ ID NO: 465417 - RNA, 64 nt, hsa
auguugcacaaggguugugaaugugaaagggggaauggaggaauggaaauaaaauugggaugag

SEQ ID NO: 465418 - RNA, 64 nt, hsa
ccacugugugcauuagcagggagguuuguaggccauggaggaaaugaggagacaccaccuagug

SEQ ID NO: 465419 - RNA, 64 nt, hsa
cuugccugcuggggggccuagccaugggccagagauggaggagccccaguggcugacaggccag

SEQ ID NO: 465420 - RNA, 64 nt, hsa
ggccuagauccacacacagaggaagagcaggcacauggaggagcuugggggaugacuagaggca

SEQ ID NO: 465421 - RNA, 64 nt, hsa
auuuaugaaggcaaaaaaauuaaauuauuuauuuauggaggauggagagaggggaauaauagaa

SEQ ID NO: 465422 - RNA, 64 nt, hsa
aggccgcuucgcggguggagcccucugccuggccauggaggaaggaucccgcuaggcugguccc

SEQ ID NO: 465423 - RNA, 64 nt, hsa
acuucggugacuucauccaccugucuauuugcacauggaggacuuuucaagaugucaggauacc

SEQ ID NO: 465424 - RNA, 64 nt, hsa
gucucaccaacaagugaggauauagccuuaucucauggaggacgagcuccguauuuacucagga

SEQ ID NO: 465425 - RNA, 64 nt, hsa
acucaggagcagucaggguacauuacauaaaacaauggaggaugccucauuuuagcaaacuagg

SEQ ID NO: 465426 - RNA, 64 nt, hsa
ugcuggcugcugcugccucgcgcgcugggguuccauggaggaacugggccugccgccccggccu

SEQ ID NO: 465427 - RNA, 64 nt, hsa
ccggccucaccugcugcccgcaugcuggggucccauggaggaaccaggccuggcgccccggccu

SEQ ID NO: 465428 - RNA, 64 nt, hsa
uggccugcuggcaaugccacaggugcccaagaagauggaggaucccugugccaggagccaaccu

SEQ ID NO: 465429 - RNA, 64 nt, hsa
uugagaagagagcccgcucuccguggggcaccccauggaggacacaguaccagaguuuacagag

SEQ ID NO: 465430 - RNA, 64 nt, hsa
cugcaggucagcaguaagguuucaagguacaguuauggaggaaagaagaaaaugacacauugau

SEQ ID NO: 465431 - RNA, 64 nt, hsa
ucucaugagaccggcucacuaucacaggaacagcauggaggaaaccgcccccaugauccaguua

SEQ ID NO: 465432 - RNA, 64 nt, hsa
ccgggacugggcuaggaguuggacggaauggaggauggaggacagcgagaagaaaggaagagaa

SEQ ID NO: 465433 - RNA, 64 nt, hsa
ggcgcccccgggacugggcuaggaguuggacggaauggaggauggaggacagcgagaagaaagg

SEQ ID NO: 465434 - RNA, 64 nt, hsa
gugccugcuagaggagcucuguguucccaaggagauggaggaagaccuggggugggggugguac

SEQ ID NO: 465435 - RNA, 64 nt, hsa
cagaggcugugaacagggagaugggggaggggggauggaggacucaagggauguaagggauaug

SEQ ID NO: 465436 - RNA, 64 nt, hsa
acacauacacacauguauauauauauucuucauaauggaggacaauguuuugcaauauauaaau

SEQ ID NO: 465437 - RNA, 64 nt, hsa
guucuuuauuagugccucucacaaaagauccuggauggaggaguaagaugaaauauuaugcuau

SEQ ID NO: 465438 - RNA, 64 nt, hsa
ugccccucugagucaggagccugguggggacaagauggaggauguccacagaggcugaccugug

SEQ ID NO: 465439 - RNA, 64 nt, hsa
ugcaagaauauucauauuauaaaugucucaucugauggaggaacgugugcauuuagagagaggg

SEQ ID NO: 465440 - RNA, 64 nt, hsa; identical to SEQ ID NO: 285072

SEQ ID NO: 465441 - RNA, 64 nt, hsa; identical to SEQ ID NO: 285073

SEQ ID NO: 465442 - RNA, 64 nt, hsa; identical to SEQ ID NO: 285074

SEQ ID NO: 465443 - RNA, 64 nt, hsa; identical to SEQ ID NO: 285075

SEQ ID NO: 465444 - RNA, 64 nt, hsa; identical to SEQ ID NO: 285076

SEQ ID NO: 465445 - RNA, 64 nt, hsa; identical to SEQ ID NO: 285077

SEQ ID NO: 465446 - RNA, 64 nt, hsa; identical to SEQ ID NO: 285078

SEQ ID NO: 465447 - RNA, 64 nt, hsa; identical to SEQ ID NO: 285079

SEQ ID NO: 465448 - RNA, 64 nt, hsa; identical to SEQ ID NO: 285080

SEQ ID NO: 465449 - RNA, 64 nt, hsa; identical to SEQ ID NO: 285081

SEQ ID NO: 465450 - RNA, 64 nt, hsa; identical to SEQ ID NO: 285082

SEQ ID NO: 465451 - RNA, 64 nt, hsa; identical to SEQ ID NO: 285083

SEQ ID NO: 465452 - RNA, 64 nt, hsa; identical to SEQ ID NO: 285084

SEQ ID NO: 465453 - RNA, 64 nt, hsa; identical to SEQ ID NO: 285085

SEQ ID NO: 465454 - RNA, 64 nt, hsa; identical to SEQ ID NO: 285086

SEQ ID NO: 465455 - RNA, 64 nt, hsa; identical to SEQ ID NO: 285087

SEQ ID NO: 465456 - RNA, 64 nt, hsa; identical to SEQ ID NO: 285088

SEQ ID NO: 465457 - RNA, 64 nt, hsa; identical to SEQ ID NO: 285089

SEQ ID NO: 465458 - RNA, 64 nt, hsa; identical to SEQ ID NO: 285090

SEQ ID NO: 465459 - RNA, 64 nt, hsa; identical to SEQ ID NO: 285091

SEQ ID NO: 465460 - RNA, 62 nt, hsa; identical to SEQ ID NO: 285092

SEQ ID NO: 465461 - RNA, 64 nt, hsa; identical to SEQ ID NO: 285093

SEQ ID NO: 465462 - RNA, 64 nt, hsa; identical to SEQ ID NO: 285094

SEQ ID NO: 465463 - RNA, 64 nt, hsa; identical to SEQ ID NO: 285095

SEQ ID NO: 465464 - RNA, 64 nt, hsa; identical to SEQ ID NO: 285096

SEQ ID NO: 465465 - RNA, 64 nt, hsa; identical to SEQ ID NO: 285097

SEQ ID NO: 465466 - RNA, 64 nt, hsa; identical to SEQ ID NO: 285098

SEQ ID NO: 465467 - RNA, 64 nt, hsa; identical to SEQ ID NO: 285099

SEQ ID NO: 465468 - RNA, 64 nt, hsa; identical to SEQ ID NO: 285100

SEQ ID NO: 465469 - RNA, 64 nt, hsa; identical to SEQ ID NO: 285101

SEQ ID NO: 465470 - RNA, 64 nt, hsa; identical to SEQ ID NO: 93186

SEQ ID NO: 465471 - RNA, 64 nt, hsa; identical to SEQ ID NO: 93187

SEQ ID NO: 465472 - RNA, 64 nt, hsa; identical to SEQ ID NO: 93188

SEQ ID NO: 465473 - RNA, 64 nt, hsa; identical to SEQ ID NO: 93189

SEQ ID NO: 465474 - RNA, 64 nt, hsa; identical to SEQ ID NO: 93190

SEQ ID NO: 465475 - RNA, 64 nt, hsa; identical to SEQ ID NO: 93191

SEQ ID NO: 465476 - RNA, 64 nt, hsa; identical to SEQ ID NO: 93192

SEQ ID NO: 465477 - RNA, 64 nt, hsa; identical to SEQ ID NO: 93193

SEQ ID NO: 465478 - RNA, 64 nt, hsa; identical to SEQ ID NO: 93194

SEQ ID NO: 465479 - RNA, 64 nt, hsa; identical to SEQ ID NO: 93195

SEQ ID NO: 465480 - RNA, 64 nt, hsa; identical to SEQ ID NO: 93196

SEQ ID NO: 465481 - RNA, 64 nt, hsa; identical to SEQ ID NO: 93197

SEQ ID NO: 465482 - RNA, 64 nt, hsa; identical to SEQ ID NO: 93198

SEQ ID NO: 465483 - RNA, 64 nt, hsa; identical to SEQ ID NO: 93199

SEQ ID NO: 465484 - RNA, 64 nt, hsa; identical to SEQ ID NO: 209146

SEQ ID NO: 465485 - RNA, 63 nt, hsa; identical to SEQ ID NO: 209147

SEQ ID NO: 465486 - RNA, 64 nt, hsa; identical to SEQ ID NO: 209148

SEQ ID NO: 465487 - RNA, 64 nt, hsa; identical to SEQ ID NO: 209149

SEQ ID NO: 465488 - RNA, 64 nt, hsa; identical to SEQ ID NO: 380092

SEQ ID NO: 465489 - RNA, 64 nt, hsa; identical to SEQ ID NO: 380093

SEQ ID NO: 465490 - RNA, 64 nt, hsa; identical to SEQ ID NO: 380094

SEQ ID NO: 465491 - RNA, 64 nt, hsa; identical to SEQ ID NO: 380095

SEQ ID NO: 465492 - RNA, 64 nt, hsa
gaacagaaaauuguauuuuccugucuuucauggcugaaaacaaaaguaaugggaauuuuaaaua

SEQ ID NO: 465493 - RNA, 64 nt, hsa
aauuuguugacacgaaaauuuuggaggaaccaauugaaaacacacuuccagucuagaugaugcu

SEQ ID NO: 465494 - RNA, 64 nt, hsa
gggcucugcuggcgagacgaaacagcuguagagaugaaaacaggcugcagaggcuggcacagcc

SEQ ID NO: 465495 - RNA, 64 nt, hsa
uauauuucucgccaaguuuuuauacuuucugaaaugaaaacauaggauugacuaguuuacuggu

SEQ ID NO: 465496 - RNA, 64 nt, hsa
uuguaaaguaagggauagucuuacuuauucugccugaaaacaauguauuaccccagggcccaac

SEQ ID NO: 465497 - RNA, 64 nt, hsa
uuugauguuuuuuugccaguuggcuuuucuuaaaugaaaacacuguuccauuuaaaguacauuu

SEQ ID NO: 465498 - RNA, 64 nt, hsa
uugcauuuuaaugggaaauuuucaacccuuaaucugaaaacagaagacagucuuaauauaaaug

SEQ ID NO: 465499 - RNA, 64 nt, hsa
uacuucugauuaaugcaaggggaaauuuuuauacugaaaacaaacaaacaaacuagcagcuacu

SEQ ID NO: 465500 - RNA, 64 nt, hsa
uauuuuauaaaauguuuucuguauggcaauaaacugaaaacauggaucaacccuucuuuugaaa

SEQ ID NO: 465501 - RNA, 64 nt, hsa
aauuccaaauuugggaacuuuugauacgaucuugugaaaacacuguauuuucgacugaaaauuc

SEQ ID NO: 465502 - RNA, 64 nt, hsa
ccuauuuuuuuuuccaguaguauuguuaccugcuugaaaacacugcuguguuaagcuguucaug

SEQ ID NO: 465503 - RNA, 64 nt, hsa
ugcacaaauuguaaugugauacugugaaacaaauugaaaacauugccucuuugcaucacauacc

SEQ ID NO: 465504 - RNA, 64 nt, hsa
ugacaaucuuguguauuuagaaaaauguauuacuugaaaacaugacauagaacauugaguuagc

SEQ ID NO: 465505 - RNA, 64 nt, hsa
auucucagaucuuuauucuaacaauuacaugauuugaaaacaguacucaaugagacuggaaaua

SEQ ID NO: 465506 - RNA, 64 nt, hsa
uuuuuaauaauagauucauaauguuacauuuaauugaaaacaaaccuuuauauccaaugaaaau

SEQ ID NO: 465507 - RNA, 64 nt, hsa
agaauuuguauuuagaaaagguuuauauuauuagugaaaacaaaacuaaagggaaguucaaguu

SEQ ID NO: 465508 - RNA, 64 nt, hsa
agaggugaucuuuauuuucuaaauauuucaaacuugaaaacagaguaaaaaagugauagaaaag

SEQ ID NO: 465509 - RNA, 64 nt, hsa
ucuauacuuggaaguguuuaagguugccauugguugaaaacauaagugucucuggccaucaaag

SEQ ID NO: 465510 - RNA, 64 nt, hsa
aauauaaaaacaagguauauacuuuauuauuuuuugaaaacaaggauauugugaucaauuuuac

SEQ ID NO: 465511 - RNA, 64 nt, hsa
ugaacuugguuugaucuuacucaacuagaaagcuugaaaacaucccuggggauucugaaggcuu

SEQ ID NO: 465512 - RNA, 64 nt, hsa
gauaaauuguguucuguuaaagagguuaguaggaugaaaacagcaaaacaauaauuuuuucaac

SEQ ID NO: 465513 - RNA, 64 nt, hsa
ggagaauuuuuucuucugagcauuuuaauauacuugaaaacaacauugacuugaaaaauuucag

SEQ ID NO: 465514 - RNA, 64 nt, hsa
acauauuaaacuggaagaauuuucuuuauucaaaugaaaacauguuugaugacuggucaaaaaa

SEQ ID NO: 465515 - RNA, 64 nt, hsa
acauagcugugagguacccuaugaguuguugacuugaaaacauggaacugcacagggcauucag

SEQ ID NO: 465516 - RNA, 64 nt, hsa
gaggugugcaguucgcugcucccugcuuggcuuaugaaaacaccacugaacagaaauuucucca

SEQ ID NO: 465517 - RNA, 64 nt, hsa
aagugcacugcacuucuggaauacugaaaaagaaugaaaacaauauguuagauuagguguaaga

SEQ ID NO: 465518 - RNA, 64 nt, hsa
uaaauagauuucagcugaaaauaaucaguucuuaugaaaacaaauagagaaauaucaguaaguc

SEQ ID NO: 465519 - RNA, 64 nt, hsa
augcuguuuuuauuuaggcugaacuagaagcuuuugaaaacagacugaagggucgucggaagaa

SEQ ID NO: 465520 - RNA, 64 nt, hsa
uaaaauuaaccuuuaccauuuaaugucaucuaccugaaaacagugagauuuauacuguaucaau

SEQ ID NO: 465521 - RNA, 64 nt, hsa
cuucccgauucuccugucccagcuuggaaggcauugaaaacagucuccguuuacacaucucuuc

SEQ ID NO: 465522 - RNA, 64 nt, hsa
gcaauacuacaacaaacuucaaggcaaguuuggcugaaaacaguugacaacaaagggcccccau

SEQ ID NO: 465523 - RNA, 64 nt, hsa
gaccccaugagaaaagaugucuuaaucauccuuaugaaaacagauguaaacaacuauauuucaa

SEQ ID NO: 465524 - RNA, 64 nt, hsa
gcacccuucuccacucagcuccaaagcgaaucuuugaaaacacccacucggcucccaucucugu

SEQ ID NO: 465525 - RNA, 64 nt, hsa
cgugugaaaggcagaacuaacgugcggaaacauuugaaaacaacucugaaugugcgguucggaa

SEQ ID NO: 465526 - RNA, 64 nt, hsa
ggugacagaagagaccuugucucgaaaaggaaucugaaaacaauggaaccaugccuucauaauu

SEQ ID NO: 465527 - RNA, 64 nt, hsa
aaauguugccaccuuguuuguaacagugaaaaauugaaaacaaccuggaaguccagugauggga

SEQ ID NO: 465528 - RNA, 64 nt, hsa
auucagggcauauuuuuucuucccaggaucaaacugaaaacauguuaaggcuauaguuuagcca

SEQ ID NO: 465529 - RNA, 64 nt, hsa
uacacuaaggucuccauauacuauuuuuuucuacugaaaacaauuuagaaagaagcuauugggc

SEQ ID NO: 465530 - RNA, 64 nt, hsa
aauccaaacccaagucaaaaccuuggcuccagcaugaaaacacguuuacaggaaaguguucucc

SEQ ID NO: 465531 - RNA, 64 nt, hsa
uuucuuugcaugacuuuauacgcaguaaguauguugaaaacaaacaaaaagaagaaaacacuca

SEQ ID NO: 465532 - RNA, 64 nt, hsa
ugaagauggcauccugugaaguccuucaccucacugaaaacaucuggaaggggaucccacccca

SEQ ID NO: 465533 - RNA, 64 nt, hsa
ugggcuaaugaagaucauauacgugaaaauuauuugaaaacauauaaagcacuauacagauucg

SEQ ID NO: 465534 - RNA, 64 nt, hsa
gaaaaugauuuaaaguguuuuccuuaauguucucugaaaacaaguuucuuuuguaguuuuaacc

SEQ ID NO: 465535 - RNA, 64 nt, hsa
aagaaaaguuuuugggauauaauuugaaugacugugaaaacauaugaccuuugauaacgaacuc

SEQ ID NO: 465536 - RNA, 64 nt, hsa
uuggcagcgccauaacauucauuuaaaaaguuuaugaaaacauucauuugaaaguuccaugcag

SEQ ID NO: 465537 - RNA, 64 nt, hsa
uuagaagguuuaacacuucacugauuaauggugcugaaaacacguuacaauuaccacauauccu

SEQ ID NO: 465538 - RNA, 64 nt, hsa
uacaaauguuaaaauguguuguuccaaauacuaaugaaaacagaaugucucuuccugguagacc

SEQ ID NO: 465539 - RNA, 64 nt, hsa
caaucauguguguuaacccagugcuuuccauucgugaaaacacauuugcuuuuugugauaugca

SEQ ID NO: 465540 - RNA, 64 nt, hsa
gaggacuucagagccaggccugcagcauuuuguuugaaaacacaaucagcucugacaguuagac

SEQ ID NO: 465541 - RNA, 64 nt, hsa
uaucaaagaucaguugacaucuccuagggaaugaugaaaacagcaggcuauuagaaaauuauuu

SEQ ID NO: 465542 - RNA, 64 nt, hsa
aaaggcauuuaacagcagcaguacuuggaagcuuugaaaacaugugcuaaacuugaauggagca

SEQ ID NO: 465543 - RNA, 64 nt, hsa
uuuugggaaaggagugggaucuuugauuucagggugaaaacagaguaccccuuuaaacacacac

SEQ ID NO: 465544 - RNA, 64 nt, hsa
ggaaauccccgggaagaguuagccuggauagccuugaaaacaaacaaaucaaacacaacacaag

SEQ ID NO: 465545 - RNA, 64 nt, hsa
uuuugguugugauuuuuuguucuuguuguuuauaugaaaacacucaaaaugaugcaaccaaaag

SEQ ID NO: 465546 - RNA, 64 nt, hsa
guaguuuaccaaagcauuuuuuguuuucuuaccuugaaaacacagaaccguuaauuccuugguu

SEQ ID NO: 465547 - RNA, 64 nt, hsa
ugaaguaugagauguaacuauuauaaacuguugcugaaaacauaaaugucuguaacuuacaaac

SEQ ID NO: 465548 - RNA, 64 nt, hsa
acaaggaacaguuugauacacuuuuaaaagguucugaaaacaaagcuguauagggauccucucu

SEQ ID NO: 465549 - RNA, 64 nt, hsa
cacagguaccaggaagaaggaaugaccucugggcugaaaacagcagcauuuucaguaauuccua

SEQ ID NO: 465550 - RNA, 64 nt, hsa
gauauucaaauuucaguguccauaaauaaaguuuugaaaacaugaauacaaacaaaaaacaccu

SEQ ID NO: 465551 - RNA, 64 nt, hsa
cuaaaaacaguaguauuuauuacaaucuccacaaugaaaacaaauagugcaauguaagaaauau

SEQ ID NO: 465552 - RNA, 64 nt, hsa
uuucagcacaacucauucuucagugccucaugacugaaaacaaaaaacaaaaaaacgaaagcau

SEQ ID NO: 465553 - RNA, 64 nt, hsa
gcugucagauuuagaaauguuuuuaagagcuaugugaaaacagacaauauuaguuuaggucggg

SEQ ID NO: 465554 - RNA, 64 nt, hsa
cauaucagcaacauacguguuuuuugacagaaagugaaaacaaauuccguaaaacuguuaguau

SEQ ID NO: 465555 - RNA, 64 nt, hsa
acuccaucucuccaaauguauuuccauaauguguugaaaacaugcuaacauuuguaugauuuuu

SEQ ID NO: 465556 - RNA, 64 nt, hsa
uucuuggcuuauguuaguuuauguuaguuuauuaugaaaacaucaaagauuuuuuugacuauau

SEQ ID NO: 465557 - RNA, 64 nt, hsa
aaaaaguuugucuuugagauucaauguaaagaacugaaaacaauguauauguuguaaauauuug

SEQ ID NO: 465558 - RNA, 64 nt, hsa
uuguacagugauagcaacuuuccacacaggacguugaaaacaguaauguggcuacacaguuuuu

SEQ ID NO: 465559 - RNA, 64 nt, hsa
ccuuuaaagaguuaguguuaauggcuuucugguuugaaaacaaaaaugcaucuaugugguugaa

SEQ ID NO: 465560 - RNA, 64 nt, hsa
gcauucauuauuuuuaagcugaaaaggggauccuugaaaacacugaaaaccucuacaacaaucu

SEQ ID NO: 465561 - RNA, 64 nt, hsa
cagagaguucucccuccacgauugugaaaacaaaugaaaacaaaauuagagcaaagcugaccug

SEQ ID NO: 465562 - RNA, 64 nt, hsa
cccaagccuccagagaguucucccuccacgauugugaaaacaaaugaaaacaaaauuagagcaa

SEQ ID NO: 465563 - RNA, 64 nt, hsa
cugagguauuaggacgaccauacugccucugagcugaaaacauucaaaaguucacaucccuguu

SEQ ID NO: 465564 - RNA, 64 nt, hsa
ggucugugagggacugcaaagcuuacucaggaaaugaaaacaaaugauggucauguugcaguuu

SEQ ID NO: 465565 - RNA, 64 nt, hsa
uagugcgauuucacagucuacugccuguuuccacugaaaacauuuuugucauauucuuguauuc

SEQ ID NO: 465566 - RNA, 64 nt, hsa
guuuguuaccauccuuuaaucauaacuaaaacauugaaaacagaacaaaugagaaaagaaaaaa

SEQ ID NO: 465567 - RNA, 64 nt, hsa
auauguacaugagucuucaucacagcaucguuuaugaaaacaacuaaauauucacuaauggugc

SEQ ID NO: 465568 - RNA, 64 nt, hsa
cucuguuuucauuucuuuuucuguaaaugcaggaugaaaacaauauguaucuccuaggauggcu

SEQ ID NO: 465569 - RNA, 64 nt, hsa
guacuguauaggaaccaacaugaacaauuuuaauugaaaacaccagucauaaacuauuaccacc

SEQ ID NO: 465570 - RNA, 64 nt, hsa
uuuuuuuuuuuuaaacacaccuggagaggacauuugaaaacacuguucuuacccucgaacccug

SEQ ID NO: 465571 - RNA, 64 nt, hsa
uucccaaagauuauauaauguucauaauccaccaugaaaacagcauuggccaaagguacugagg

SEQ ID NO: 465572 - RNA, 64 nt, hsa
acaaauuuuuuuacaaguauuuacauacuguaucugaaaacagacuuuaaagucacaagauuau

SEQ ID NO: 465573 - RNA, 64 nt, hsa
auuuguuuaguauaaauugucauagcugguuuacugaaaacaaacacauuuaaaauugguuuac

SEQ ID NO: 465574 - RNA, 64 nt, hsa
ccccagcaccaaccucugagcccaagaccuugccugaaaacaagcagauaccgauugcuucauc

SEQ ID NO: 465575 - RNA, 64 nt, hsa
ugccuuuuugggaaagagacaggaaagauucacuugaaaacauaaaugaacgucaagacugaag

SEQ ID NO: 465576 - RNA, 64 nt, hsa
uugucgguucaaagaggaaagaugaauuucaaugugaaaacacguuuuguugagggcuguacuu

SEQ ID NO: 465577 - RNA, 64 nt, hsa
cauaaacacagaguguagagugaaaacacuagagugaaaacacaugcuacaaugaggcagcauc

SEQ ID NO: 465578 - RNA, 64 nt, hsa
ucaggcuauucauucauaaacacagaguguagagugaaaacacuagagugaaaacacaugcuac

SEQ ID NO: 465579 - RNA, 64 nt, hsa
aauuauucagaauuacauuuuaucguuuucacauugaaaacagcaaauguugacuuaguaauuu

SEQ ID NO: 465580 - RNA, 64 nt, hsa
agccuuccaugaggcagaaggggucgucguucucugaaaacagugacucugaaauguugggaca

SEQ ID NO: 465581 - RNA, 64 nt, hsa
acacgauuccucagaccagugagcaaaaggaauaugaaaacagagacuauaaagauuucacaaa

SEQ ID NO: 465582 - RNA, 64 nt, hsa
uucuucaaaagaaagagacuucauuuggcaguucugaaaacaucaccaugacaucucucuccaa

SEQ ID NO: 465583 - RNA, 64 nt, hsa
uugccugaacaugacuuuaaagaaauuaauauauugaaaacauguuugaacccuuauuuuaauu

SEQ ID NO: 465584 - RNA, 64 nt, hsa
aaucuugaauguuuuccugagacaggagcguaugugaaaacaucaaacacugcacaugacagga

SEQ ID NO: 465585 - RNA, 64 nt, hsa
aaugccuaugcauucaugucugucuccaugcaugugaaaacaggagaguguuuucauuuugugu

SEQ ID NO: 465586 - RNA, 64 nt, hsa
agugaaaaaucuguuauccaauagcuaccauagaugaaaacaaacuuggauuuuuuucuuuguc

SEQ ID NO: 465587 - RNA, 64 nt, hsa
uuacagacacugaacuugaacuuccauugugauaugaaaacagcuauagacaaucauaaaugaa

SEQ ID NO: 465588 - RNA, 64 nt, hsa
guauuuacagcaacucaauucuaccacugugguaugaaaacagcuauagacaaucauaaaugaa

SEQ ID NO: 465589 - RNA, 64 nt, hsa
gcuguccauuguuugaggauguuaccuacuaaacugaaaacauucauuccauaucuacuuacac

SEQ ID NO: 465590 - RNA, 64 nt, hsa
uguguucugguagcccguauuugagguaagcugcugaaaacaaaagucucuauauucuuugccu

SEQ ID NO: 465591 - RNA, 63 nt, hsa
ucccuugucuagaggguggacauuggcuacaggcucuuccaucucucaugacuucauggaccc

SEQ ID NO: 465592 - RNA, 63 nt, hsa
gaaggagggcaccccaaaggacagcgccuucuucucuuccacccaugcacggccuugggugau

SEQ ID NO: 465593 - RNA, 63 nt, hsa
aucgggaacaaaggguuuuaucuaauaaagugucucuuccauucacguugcuaccuuacccac

SEQ ID NO: 465594 - RNA, 63 nt, hsa
acacccagccacuguaaagagguaacuuggguccucuuccauugcaguccugaugauccuaac

SEQ ID NO: 465595 - RNA, 63 nt, hsa
ggaagugaagcuggcuuaguaccagcagcugaucucuuccacgugcugcugcuuuuuuugcca

SEQ ID NO: 465596 - RNA, 63 nt, hsa
gucuguugucugcccucugcuccugcuucucagcucuuccaccguccugccccacgaaggauc

SEQ ID NO: 465597 - RNA, 63 nt, hsa
aagagcccugcuucccugccuccuccuaccuuucucuuccacuccucagaguuuucuucucca

SEQ ID NO: 465598 - RNA, 63 nt, hsa
guuaccaggagcccugacaugcaaccagggucccucuuccaugcccugcugcccaggaguugc

SEQ ID NO: 465599 - RNA, 63 nt, hsa
cccagcacauugaggauguaguuggugaauggacucuuccaggcauggagauccuccauccua

SEQ ID NO: 465600 - RNA, 63 nt, hsa
auguugcucuacauucaaaccuuccaggcuacacucuuccaucagcaugaguccuggagagcu

SEQ ID NO: 465601 - RNA, 63 nt, hsa
agcacuggauaaauuguuugguuuugcuuuucucucuuccacaaaauuggaagcuuuuuuuaa

SEQ ID NO: 465602 - RNA, 63 nt, hsa
ggaggaaauagacuuagacgaaagaaaggauuucucuuccaacaguugagauucgcauauuug

SEQ ID NO: 465603 - RNA, 63 nt, hsa
ucccaaaggacuccacccauccuaucagccugucucuuccauaugaccucaugcaucuccacc

SEQ ID NO: 465604 - RNA, 63 nt, hsa
cccugauuacaccagccucgucuucauuaagcccucuuccaucauguccccaaaccugcaagg

SEQ ID NO: 465605 - RNA, 63 nt, hsa
gacagacuggacauuucccuguuucgagccaggcucuuccaaggggccagcuggguccccgga

SEQ ID NO: 465606 - RNA, 63 nt, hsa
ccgaggcucccgguuccaagucccaucgugcuccucuuccaaugccacacugccucugagccc

SEQ ID NO: 465607 - RNA, 63 nt, hsa
cacggugaucuuggaguaggcgcccagcccuggcucuuccaugcucugccccuuuccuggaug

SEQ ID NO: 465608 - RNA, 63 nt, hsa
cccugauuggugucucagcauuuauuuuccugucucuuccaccaaaagccagcuguagcuuua

SEQ ID NO: 465609 - RNA, 63 nt, hsa
uuuccaaagaacugcacucuggaauuaaagggacucuuccauuuugaagaaggcauccagaag

SEQ ID NO: 465610 - RNA, 63 nt, hsa
ccacuucugguuccuuucaucuggaaagaagaccucuuccaucuuccaugcagcuagcaguca

SEQ ID NO: 465611 - RNA, 63 nt, hsa
auugagaaccaccacccgagggguacagccccucucuuccaaccgagaaguuccugucccaga

SEQ ID NO: 465612 - RNA, 63 nt, hsa
guccuguuuguaaaacaacgguggcaacagcuccucuuccagagcugccucugccuuuauccu

SEQ ID NO: 465613 - RNA, 63 nt, hsa
caacuacuaaaacuucccgccacccugcuauuucucuuccaauuacuguucaaacauuuuugg

SEQ ID NO: 465614 - RNA, 63 nt, hsa
guuuaguguaaacugaguaccacuuuauauuuucucuuccauagugagauguaugcaguaugu

SEQ ID NO: 465615 - RNA, 63 nt, hsa
gugaauagugcucucuaccuguggguggccguucucuuccacuugcucgucuccccccagccc

SEQ ID NO: 465616 - RNA, 63 nt, hsa
uucccaguaagauugugcaauuuuuauucacagcucuuccauguagacuuaccuuuccucaua

SEQ ID NO: 465617 - RNA, 63 nt, hsa
acagggcuggagacugugucugcuuucugccuccucuuccacacauccugggucagccuuucc

SEQ ID NO: 465618 - RNA, 63 nt, hsa
ggcuuuugcugggcucuccagagcugggcuuggcucuuccagcuggagaaggacugagcccca

SEQ ID NO: 465619 - RNA, 63 nt, hsa
cccagccuacccuuccugcauuucucuucucagcucuuccaugauggauuccccccccuuucc

SEQ ID NO: 465620 - RNA, 63 nt, hsa
cuuuugucucccagcaguagugagccacucagucucuuccacaggaaguuuggagccuacauu

SEQ ID NO: 465621 - RNA, 63 nt, hsa
guauauuuauugagugccaacuacguucccagccucuuccaggcacuggcaaugcagugauga

SEQ ID NO: 465622 - RNA, 63 nt, hsa
caggaccuggcuggaugcuuccugucccuggaacucuuccagccuuucuacuugaucuccagc

SEQ ID NO: 465623 - RNA, 63 nt, hsa
agacaggugacugagagcugcaggccuccucugcucuuccaaacacguagcauuugcaccccu

SEQ ID NO: 465624 - RNA, 63 nt, hsa
gagaacugcacagugaccacuguauuuuucacgcucuuccagggaucccugucccccgacauu

SEQ ID NO: 465625 - RNA, 63 nt, hsa
ugucuugaucccccccucccugccccuggcuuccucuuccauguucugcccuuucccacaccu

SEQ ID NO: 465626 - RNA, 63 nt, hsa
ggagcuuggggaccccucccugccccuggcuuccucuuccauguucugcccuuucccacaugu

SEQ ID NO: 465627 - RNA, 63 nt, hsa
gucaucaaugccccaguucacauccaccugcuucucuuccaggcuuugcuguuccccagcagc

SEQ ID NO: 465628 - RNA, 63 nt, hsa
gugggauuucuaagaccgacuguaugagcucgccucuuccagauagcuggcagagggcagggc

SEQ ID NO: 465629 - RNA, 63 nt, hsa
aagaaauugaaaauacauacaugcuugucucaacucuuccacuuguaggaauuuauucuauaa

SEQ ID NO: 465630 - RNA, 63 nt, hsa
gugucuucagccuccaaccuccggggcgaccuucucuuccagccacagucccaugagggcccc

SEQ ID NO: 465631 - RNA, 63 nt, hsa
caccccugcacagcagcugggcacagaggagcgcucuuccaucuugaccaggacugcaccaag

SEQ ID NO: 465632 - RNA, 63 nt, hsa
gaggggaaggggaagcuugggguucagaggggacucuuccaggagaggggugcccagcggagg

SEQ ID NO: 465633 - RNA, 63 nt, hsa
ggcuucccugccagugaggagugacuucucccucucuuccaguccuguaggggagacaaaacc

SEQ ID NO: 465634 - RNA, 64 nt, hsa; identical to SEQ ID NO: 279530

SEQ ID NO: 465635 - RNA, 64 nt, hsa; identical to SEQ ID NO: 279531

SEQ ID NO: 465636 - RNA, 64 nt, hsa; identical to SEQ ID NO: 279532

SEQ ID NO: 465637 - RNA, 64 nt, hsa; identical to SEQ ID NO: 279533

SEQ ID NO: 465638 - RNA, 64 nt, hsa; identical to SEQ ID NO: 279534

SEQ ID NO: 465639 - RNA, 64 nt, hsa; identical to SEQ ID NO: 279535

SEQ ID NO: 465640 - RNA, 64 nt, hsa; identical to SEQ ID NO: 279536

SEQ ID NO: 465641 - RNA, 64 nt, hsa; identical to SEQ ID NO: 279537

SEQ ID NO: 465642 - RNA, 64 nt, hsa; identical to SEQ ID NO: 279538

SEQ ID NO: 465643 - RNA, 64 nt, hsa; identical to SEQ ID NO: 279539

SEQ ID NO: 465644 - RNA, 64 nt, hsa; identical to SEQ ID NO: 279540

SEQ ID NO: 465645 - RNA, 64 nt, hsa; identical to SEQ ID NO: 279541

SEQ ID NO: 465646 - RNA, 64 nt, hsa; identical to SEQ ID NO: 279542

SEQ ID NO: 465647 - RNA, 64 nt, hsa; identical to SEQ ID NO: 279543

SEQ ID NO: 465648 - RNA, 64 nt, hsa; identical to SEQ ID NO: 279544

SEQ ID NO: 465649 - RNA, 64 nt, hsa; identical to SEQ ID NO: 392288

SEQ ID NO: 465650 - RNA, 64 nt, hsa; identical to SEQ ID NO: 392289

SEQ ID NO: 465651 - RNA, 64 nt, hsa; identical to SEQ ID NO: 392290

SEQ ID NO: 465652 - RNA, 64 nt, hsa; identical to SEQ ID NO: 392291

SEQ ID NO: 465653 - RNA, 64 nt, hsa; identical to SEQ ID NO: 392292

SEQ ID NO: 465654 - RNA, 64 nt, hsa; identical to SEQ ID NO: 392293

SEQ ID NO: 465655 - RNA, 64 nt, hsa
uuuacaaccuccuuucccuccaugcuuccgcggaggagucuauacuaucucuauauacacauuu

SEQ ID NO: 465656 - RNA, 64 nt, hsa
ccccgggaaucuacugcuuccuaagagucuccauggagucuauuuuacaaccuccuuucccucc

SEQ ID NO: 465657 - RNA, 64 nt, hsa
auccaaaggccuuaacuuauuuuaagaggccgagggagucuaugaaaaucuccccuuuuuuacu

SEQ ID NO: 465658 - RNA, 64 nt, hsa
ccuccugucugaugacaggacagacugguggugaggagucuaagugggcucaguuugaugucag

SEQ ID NO: 465659 - RNA, 61 nt, hsa
aauuugguaaccuaugaaagaugcuagagcaccaauguauaauuuuuuugagacagggugu

SEQ ID NO: 465660 - RNA, 61 nt, hsa
ggauccacauccagacuaacauaguuguuacccaauguauuuccgugaggccuguugcauu

SEQ ID NO: 465661 - RNA, 64 nt, hsa
uaaaaagaccuccagauaggcagacagacagauggaccaccaaccuggacagacagccaaagcu

SEQ ID NO: 465662 - RNA, 64 nt, hsa
agccaacagcuugauagaccagugcagccagagagaccaccaaacagagcccccaaaagacaga

SEQ ID NO: 465663 - RNA, 64 nt, hsa
ggccaaggaccccugaugcagacucuggaaucccuggcccaaaggccugucugggcccaucugg

SEQ ID NO: 465664 - RNA, 64 nt, hsa
cucugaggacacuuagaauaugaggaagaggguguggcccaacccucacuucaccuggggaggg

SEQ ID NO: 465665 - RNA, 64 nt, hsa
aggggaggggcuguuugcuggcucaggcugaggauggcccaaaguccagggucugguggggagg

SEQ ID NO: 465666 - RNA, 64 nt, hsa
ccuugcuguggagauccauuccccaccuuuccuguggcccaaccuuuuauuuaaaugugcuacc

SEQ ID NO: 465667 - RNA, 64 nt, hsa
ggccccaagcugccuuccucgauguggcccaaaguggcccaaagcgucccaaaguaggccucgc

SEQ ID NO: 465668 - RNA, 64 nt, hsa
ggcgccucccggccccaagcugccuuccucgauguggcccaaaguggcccaaagcgucccaaag

SEQ ID NO: 465669 - RNA, 64 nt, hsa
agcaagaugcuuacuaccacaccguuuuccucgguggcccaauagcucguguaucuaaguugaa

SEQ ID NO: 465670 - RNA, 64 nt, hsa
aagugcugggauuacaggccugagcaacugugccuggcccaaaaccagaccguuaacacauuaa

SEQ ID NO: 465671 - RNA, 64 nt, hsa
gaauaggggaggguuaauaagacuccaacccuaauggcccaacagggaaauucucauuuugguc

SEQ ID NO: 465672 - RNA, 64 nt, hsa
uauguucauagagcuagaaaguagcaucucaugauggcccaacaaucucuguugccaguuaaag

SEQ ID NO: 465673 - RNA, 64 nt, hsa
uuuuccucuguuuuggucucuugggcaacauuuuuggcccaaguuugggcaacauuuggcccaa

SEQ ID NO: 465674 - RNA, 64 nt, hsa
gggcaacauuuuuggcccaaguuugggcaacauuuggcccaaguuugggcauuuuggcaguagc

SEQ ID NO: 465675 - RNA, 64 nt, hsa
acccugaucucucagccccaaacacccacccaauuggcccaacacugucugccccucggggugu

SEQ ID NO: 465676 - RNA, 64 nt, hsa
ccuaggacauucccuuguagcccccagaauugucuggcccaaauugaauagaagcagaaaaaca

SEQ ID NO: 465677 - RNA, 64 nt, hsa
cacggcugaccucauacaucaagccaauaccguguggcccaagacccccaccauaaaucacauc

SEQ ID NO: 465678 - RNA, 64 nt, hsa
cauaaaucacaucauuagcaugaaccacccagaguggcccaagacucccagaucagcuaccagg

SEQ ID NO: 465679 - RNA, 64 nt, hsa
agcaaucacuugugccugggaguucuagacuagccugggcgagacuucaucucuacaaaaaaag

SEQ ID NO: 465680 - RNA, 64 nt, hsa
gcagugagccaagauugugccaccacacuccagccugggcgacagaaugagacccugucucaaa

SEQ ID NO: 465681 - RNA, 64 nt, hsa
cuccccugcugagaucgcgccacugcacuccagccugggcgacagagcaagacuccaucucaaa

SEQ ID NO: 465682 - RNA, 64 nt, hsa
gccgugagccaagaucgcaccacugcacuccagccugggcgacaaagugagacucugucuccaa

SEQ ID NO: 465683 - RNA, 64 nt, hsa
gcucaccuguggugagcugggcgagcugggcgagcugggcgagcugggcuggggagagccugug

SEQ ID NO: 465684 - RNA, 64 nt, hsa
gugccuccugcucaccuguggugagcugggcgagcugggcgagcugggcgagcugggcugggga

SEQ ID NO: 465685 - RNA, 64 nt, hsa
gagugcucugugccuccugcucaccuguggugagcugggcgagcugggcgagcugggcgagcug

SEQ ID NO: 465686 - RNA, 64 nt, hsa
gcaguaagcugagaucacgccacugcauuccagccugggcgacagagcaagacuccaucucaaa

SEQ ID NO: 465687 - RNA, 64 nt, hsa
guagugaggcgagauugugccauugcacuccaaccugggcgacagagugagacuccaucucaaa

SEQ ID NO: 465688 - RNA, 64 nt, hsa
uggggaauggggucccggccgggaggcuuggccucugggcgaccucguccuguuuuuuuuguuu

SEQ ID NO: 465689 - RNA, 64 nt, hsa
ggcucacgguggcuccgagcaugagguccgccuccugggcgagacccagcaguggacagcaugg

SEQ ID NO: 465690 - RNA, 64 nt, hsa
agguuaggacuugaagagggaagguauuuaauaacugggcgaggaugggugugguggcucacac

SEQ ID NO: 465691 - RNA, 64 nt, hsa
gcagugagccaagaucgugccacugcacuccagccugggcgacagagcaagacuccgucucaaa

SEQ ID NO: 465692 - RNA, 64 nt, hsa
gcagugagccgagaucgugccacugcacuccagccugggcgacagagugagacuccaucucaaa

SEQ ID NO: 465693 - RNA, 64 nt, hsa
gcagugaacugagauugcgccaccgcacuccagccugggcgacagagcgagacuccaucuuuaa

SEQ ID NO: 465694 - RNA, 64 nt, hsa
aggcucacccagcgugaacugcccccagggaacacugggcgaugccuggggacauugugguugu

SEQ ID NO: 465695 - RNA, 64 nt, hsa
auggugucacccccgucacccucugacugcaggccugggcgacugcggggagcuugcucuuccc

SEQ ID NO: 465696 - RNA, 64 nt, hsa
uggaaggucuugcgcaggcugcaacccuggugugcugggcgaaaacccuuaugacuccccccuu

SEQ ID NO: 465697 - RNA, 64 nt, hsa
gcagugaacugagacugcgccacggcacuccagccugggcgacagagcaagacucugucucaau

SEQ ID NO: 465698 - RNA, 64 nt, hsa
cagucaucggacucacccgaucacagacgagcggucaccagaaucgcccgaucacagacgagca

SEQ ID NO: 465699 - RNA, 64 nt, hsa
cagucaucggacucacccgaucacagacgagcggucaccagacucgcccgaucacagacgagca

SEQ ID NO: 465700 - RNA, 64 nt, hsa
acaucuuaacucauguugaguuugugcuguggugucaccagaauuccagauaaacacacagccu

SEQ ID NO: 465701 - RNA, 64 nt, hsa
ucaauauuaagucuuuuaccuaaaggcccagccgucaccagacaacagaauaaucaaucugccu

SEQ ID NO: 465702 - RNA, 64 nt, hsa
gacucugcucaggccugugaggcugggcagcccuucaccagaguucggaggagcaguguguggc

SEQ ID NO: 465703 - RNA, 64 nt, hsa
cauguucccacagaggugccugcuccgucuucgcucaccagacacucaggcaggcuggcuuagu

SEQ ID NO: 465704 - RNA, 64 nt, hsa
agcggggcuuuagccggaagucaguccuccucauucaccagaggacacacaggggagacgcccc

SEQ ID NO: 465705 - RNA, 64 nt, hsa
gggagggcuuuagccggaagucagaccuccucagucaccagaggacacacacaggggagaagcc

SEQ ID NO: 465706 - RNA, 64 nt, hsa
ggaggugaugagaucgggccacacuugagcugagucaccagacccuauugcuucaacagugcuu

SEQ ID NO: 465707 - RNA, 64 nt, hsa
cucuacauccuacugcuuuggccucccucuccucucaccagauggcaugugguguggcaccugu

SEQ ID NO: 465708 - RNA, 64 nt, hsa; identical to SEQ ID NO: 214864

SEQ ID NO: 465709 - RNA, 64 nt, hsa; identical to SEQ ID NO: 214865

SEQ ID NO: 465710 - RNA, 64 nt, hsa; identical to SEQ ID NO: 214866

SEQ ID NO: 465711 - RNA, 64 nt, hsa; identical to SEQ ID NO: 214867

SEQ ID NO: 465712 - RNA, 64 nt, hsa; identical to SEQ ID NO: 214868

SEQ ID NO: 465713 - RNA, 64 nt, hsa; identical to SEQ ID NO: 214869

SEQ ID NO: 465714 - RNA, 64 nt, hsa; identical to SEQ ID NO: 214870

SEQ ID NO: 465715 - RNA, 64 nt, hsa; identical to SEQ ID NO: 214871

SEQ ID NO: 465716 - RNA, 64 nt, hsa; identical to SEQ ID NO: 214872

SEQ ID NO: 465717 - RNA, 64 nt, hsa; identical to SEQ ID NO: 214873

SEQ ID NO: 465718 - RNA, 64 nt, hsa; identical to SEQ ID NO: 214874

SEQ ID NO: 465719 - RNA, 64 nt, hsa; identical to SEQ ID NO: 214875

SEQ ID NO: 465720 - RNA, 64 nt, hsa; identical to SEQ ID NO: 214876

SEQ ID NO: 465721 - RNA, 64 nt, hsa; identical to SEQ ID NO: 214877

SEQ ID NO: 465722 - RNA, 64 nt, hsa; identical to SEQ ID NO: 214878

SEQ ID NO: 465723 - RNA, 64 nt, hsa; identical to SEQ ID NO: 214879

SEQ ID NO: 465724 - RNA, 64 nt, hsa; identical to SEQ ID NO: 214880

SEQ ID NO: 465725 - RNA, 64 nt, hsa; identical to SEQ ID NO: 214881

SEQ ID NO: 465726 - RNA, 64 nt, hsa; identical to SEQ ID NO: 214882

SEQ ID NO: 465727 - RNA, 64 nt, hsa; identical to SEQ ID NO: 214883

SEQ ID NO: 465728 - RNA, 64 nt, hsa; identical to SEQ ID NO: 214884

SEQ ID NO: 465729 - RNA, 64 nt, hsa; identical to SEQ ID NO: 214885

SEQ ID NO: 465730 - RNA, 64 nt, hsa; identical to SEQ ID NO: 214886

SEQ ID NO: 465731 - RNA, 64 nt, hsa; identical to SEQ ID NO: 214887

SEQ ID NO: 465732 - RNA, 64 nt, hsa; identical to SEQ ID NO: 214888

SEQ ID NO: 465733 - RNA, 64 nt, hsa; identical to SEQ ID NO: 214889

SEQ ID NO: 465734 - RNA, 64 nt, hsa; identical to SEQ ID NO: 214890

SEQ ID NO: 465735 - RNA, 64 nt, hsa; identical to SEQ ID NO: 214891

SEQ ID NO: 465736 - RNA, 64 nt, hsa; identical to SEQ ID NO: 214892

SEQ ID NO: 465737 - RNA, 64 nt, hsa; identical to SEQ ID NO: 214893

SEQ ID NO: 465738 - RNA, 64 nt, hsa; identical to SEQ ID NO: 214894

SEQ ID NO: 465739 - RNA, 64 nt, hsa; identical to SEQ ID NO: 214895

SEQ ID NO: 465740 - RNA, 64 nt, hsa; identical to SEQ ID NO: 214896

SEQ ID NO: 465741 - RNA, 64 nt, hsa; identical to SEQ ID NO: 214897

SEQ ID NO: 465742 - RNA, 64 nt, hsa; identical to SEQ ID NO: 106415

SEQ ID NO: 465743 - RNA, 64 nt, hsa; identical to SEQ ID NO: 106416

SEQ ID NO: 465744 - RNA, 64 nt, hsa; identical to SEQ ID NO: 106417

SEQ ID NO: 465745 - RNA, 64 nt, hsa; identical to SEQ ID NO: 106418

SEQ ID NO: 465746 - RNA, 64 nt, hsa; identical to SEQ ID NO: 106419

SEQ ID NO: 465747 - RNA, 64 nt, hsa; identical to SEQ ID NO: 106420

SEQ ID NO: 465748 - RNA, 64 nt, hsa; identical to SEQ ID NO: 106421

SEQ ID NO: 465749 - RNA, 64 nt, hsa; identical to SEQ ID NO: 106422

SEQ ID NO: 465750 - RNA, 64 nt, hsa; identical to SEQ ID NO: 106423

SEQ ID NO: 465751 - RNA, 64 nt, hsa; identical to SEQ ID NO: 106424

SEQ ID NO: 465752 - RNA, 64 nt, hsa; identical to SEQ ID NO: 106425

SEQ ID NO: 465753 - RNA, 64 nt, hsa; identical to SEQ ID NO: 106426

SEQ ID NO: 465754 - RNA, 64 nt, hsa; identical to SEQ ID NO: 106426

SEQ ID NO: 465755 - RNA, 64 nt, hsa; identical to SEQ ID NO: 106425

SEQ ID NO: 465756 - RNA, 64 nt, hsa; identical to SEQ ID NO: 106429

SEQ ID NO: 465757 - RNA, 64 nt, hsa; identical to SEQ ID NO: 106430

SEQ ID NO: 465758 - RNA, 64 nt, hsa; identical to SEQ ID NO: 106431

SEQ ID NO: 465759 - RNA, 64 nt, hsa; identical to SEQ ID NO: 106432

SEQ ID NO: 465760 - RNA, 64 nt, hsa; identical to SEQ ID NO: 106433

SEQ ID NO: 465761 - RNA, 64 nt, hsa; identical to SEQ ID NO: 106434

SEQ ID NO: 465762 - RNA, 64 nt, hsa; identical to SEQ ID NO: 106435

SEQ ID NO: 465763 - RNA, 64 nt, hsa; identical to SEQ ID NO: 106436

SEQ ID NO: 465764 - RNA, 64 nt, hsa; identical to SEQ ID NO: 106437

SEQ ID NO: 465765 - RNA, 64 nt, hsa; identical to SEQ ID NO: 106438

SEQ ID NO: 465766 - RNA, 64 nt, hsa; identical to SEQ ID NO: 106439

SEQ ID NO: 465767 - RNA, 64 nt, hsa; identical to SEQ ID NO: 106440

SEQ ID NO: 465768 - RNA, 64 nt, hsa; identical to SEQ ID NO: 106441

SEQ ID NO: 465769 - RNA, 64 nt, hsa; identical to SEQ ID NO: 106442

SEQ ID NO: 465770 - RNA, 64 nt, hsa; identical to SEQ ID NO: 106443

SEQ ID NO: 465771 - RNA, 64 nt, hsa; identical to SEQ ID NO: 106444

SEQ ID NO: 465772 - RNA, 64 nt, hsa; identical to SEQ ID NO: 106445

SEQ ID NO: 465773 - RNA, 64 nt, hsa; identical to SEQ ID NO: 106446

SEQ ID NO: 465774 - RNA, 64 nt, hsa; identical to SEQ ID NO: 106447

SEQ ID NO: 465775 - RNA, 64 nt, hsa; identical to SEQ ID NO: 106448

SEQ ID NO: 465776 - RNA, 64 nt, hsa; identical to SEQ ID NO: 111894

SEQ ID NO: 465777 - RNA, 64 nt, hsa; identical to SEQ ID NO: 111895

SEQ ID NO: 465778 - RNA, 64 nt, hsa; identical to SEQ ID NO: 111896

SEQ ID NO: 465779 - RNA, 64 nt, hsa; identical to SEQ ID NO: 111897

SEQ ID NO: 465780 - RNA, 64 nt, hsa; identical to SEQ ID NO: 111898

SEQ ID NO: 465781 - RNA, 64 nt, hsa; identical to SEQ ID NO: 111899

SEQ ID NO: 465782 - RNA, 64 nt, hsa; identical to SEQ ID NO: 111900

SEQ ID NO: 465783 - RNA, 64 nt, hsa; identical to SEQ ID NO: 111901

SEQ ID NO: 465784 - RNA, 64 nt, hsa; identical to SEQ ID NO: 111902

SEQ ID NO: 465785 - RNA, 64 nt, hsa; identical to SEQ ID NO: 111903

SEQ ID NO: 465786 - RNA, 64 nt, hsa; identical to SEQ ID NO: 111904

SEQ ID NO: 465787 - RNA, 64 nt, hsa; identical to SEQ ID NO: 111905

SEQ ID NO: 465788 - RNA, 64 nt, hsa; identical to SEQ ID NO: 111906

SEQ ID NO: 465789 - RNA, 64 nt, hsa; identical to SEQ ID NO: 111907

SEQ ID NO: 465790 - RNA, 64 nt, hsa; identical to SEQ ID NO: 111908

SEQ ID NO: 465791 - RNA, 64 nt, hsa; identical to SEQ ID NO: 111909

SEQ ID NO: 465792 - RNA, 64 nt, hsa; identical to SEQ ID NO: 111910

SEQ ID NO: 465793 - RNA, 64 nt, hsa; identical to SEQ ID NO: 111911

SEQ ID NO: 465794 - RNA, 64 nt, hsa; identical to SEQ ID NO: 111912

SEQ ID NO: 465795 - RNA, 64 nt, hsa; identical to SEQ ID NO: 111913

SEQ ID NO: 465796 - RNA, 64 nt, hsa; identical to SEQ ID NO: 111914

SEQ ID NO: 465797 - RNA, 64 nt, hsa; identical to SEQ ID NO: 111915

SEQ ID NO: 465798 - RNA, 64 nt, hsa; identical to SEQ ID NO: 111916

SEQ ID NO: 465799 - RNA, 64 nt, hsa; identical to SEQ ID NO: 111917

SEQ ID NO: 465800 - RNA, 64 nt, hsa; identical to SEQ ID NO: 111918

SEQ ID NO: 465801 - RNA, 64 nt, hsa; identical to SEQ ID NO: 111919

SEQ ID NO: 465802 - RNA, 64 nt, hsa; identical to SEQ ID NO: 111920

SEQ ID NO: 465803 - RNA, 64 nt, hsa; identical to SEQ ID NO: 111921

SEQ ID NO: 465804 - RNA, 64 nt, hsa; identical to SEQ ID NO: 111922

SEQ ID NO: 465805 - RNA, 64 nt, hsa; identical to SEQ ID NO: 111923

SEQ ID NO: 465806 - RNA, 64 nt, hsa; identical to SEQ ID NO: 111924

SEQ ID NO: 465807 - RNA, 64 nt, hsa; identical to SEQ ID NO: 111925

SEQ ID NO: 465808 - RNA, 64 nt, hsa; identical to SEQ ID NO: 111926

SEQ ID NO: 465809 - RNA, 64 nt, hsa; identical to SEQ ID NO: 111927

SEQ ID NO: 465810 - RNA, 62 nt, hsa
gcaggaaaagugcaacuuaaagcaguaccuucauucaugaagcuacuuuuuaauuugaugua

SEQ ID NO: 465811 - RNA, 62 nt, hsa
ccaaaugaaaauuucaaagucaauaccagcagauucaugaaaguaaauuuaguccuauaauu

SEQ ID NO: 465812 - RNA, 62 nt, hsa
gugaauaaggcaaaagccagaaaauagcccuuauucaugaugcuguuacugagaauaaugaa

SEQ ID NO: 465813 - RNA, 62 nt, hsa
uuuggacuucuucuccugacaauuguggcuuaauucaugacuuguuuuugaaugcaggcagu

SEQ ID NO: 465814 - RNA, 62 nt, hsa
agucacuuaucaccaaggggauggcccaggccauucaugagggauccaccuuugugcuccaa

SEQ ID NO: 465815 - RNA, 62 nt, hsa
aguagugguaaauauuccagaauccauaugaaauucaugaguuuauuuaugucuaaaacacu

SEQ ID NO: 465816 - RNA, 62 nt, hsa
auaaauuugaccuaaaauauuuucucaaacuaauucaugaaacagcaacuuuuaccaauacc

SEQ ID NO: 465817 - RNA, 62 nt, hsa
auucuaagccucuggagagacuguaaugauccauucaugagcugguaugaaaucagugggaa

SEQ ID NO: 465818 - RNA, 62 nt, hsa
agucuaggcguuguggugaauaugcaggaaucauucaugagacagaauguauuuuguuguau

SEQ ID NO: 465819 - RNA, 62 nt, hsa
aaaugcugacuacuguagaaaaaaaggucaugauucaugauugaaagcagaacaauggagau

SEQ ID NO: 465820 - RNA, 62 nt, hsa
uugaggaagauuggguaaugcugauguguuccauucaugaaacuguauuugauacauaaucc

SEQ ID NO: 465821 - RNA, 62 nt, hsa
uccauauuuuaaggaaggagcuaaaaauggaaauucaugaaacauaaaugguaucaagaacu

SEQ ID NO: 465822 - RNA, 62 nt, hsa
aucuuucuauaaccaugccauucacuuaaauaauucaugaagggaaugguuuaauuuaaagg

SEQ ID NO: 465823 - RNA, 62 nt, hsa
uuauaagaaaaacacauaaaccauuaucauuuauucaugagccaaagccauuaagaagauaa

SEQ ID NO: 465824 - RNA, 62 nt, hsa
uguucagguuugcaugguaugaaaccaaauagauucaugaaaccuuggccaugagguuuguu

SEQ ID NO: 465825 - RNA, 62 nt, hsa
gaggggagcgagacgaaaggagaacggugauuauucaugacaggccugauaucacucauccu

SEQ ID NO: 465826 - RNA, 62 nt, hsa
ggaaagccuucagaucugccucacaccuucaaauucaugaaaggacacaaacacacauaaga

SEQ ID NO: 465827 - RNA, 62 nt, hsa
ggaaagccuucagaucugccaagaaccuucgaauucaugaaaggacacaaacacacguaaga

SEQ ID NO: 465828 - RNA, 62 nt, hsa
cucuguugcacauguuuaauuggcaaaaagcaauucaugauaaauaaaauuacugcuuucca

SEQ ID NO: 465829 - RNA, 62 nt, hsa
gaauuugagagaaauaguaauuugauuauuucauucaugaagcggagugguaguuauccuuc

SEQ ID NO: 465830 - RNA, 62 nt, hsa
aaguaaguuacucuuuuccuuuaaucuguaagauucaugaaauucggggccagggaaacagu

SEQ ID NO: 465831 - RNA, 62 nt, hsa
ggacaagggugucuccuucauuacuuaaagauauucaugagggugggucacuacagauguug

SEQ ID NO: 465832 - RNA, 64 nt, hsa
cuacaguuuuuauuagacuacgaugagggcauucuuucuacauagacugcuuguuuugcacaag

SEQ ID NO: 465833 - RNA, 64 nt, hsa
ggaagugggaagagaggugguucucuggcauuuuuuucuacaguuuuuauuagacuacgaugag

SEQ ID NO: 465834 - RNA, 64 nt, hsa
uucuccugggaauaauugugggcuucuucccaaauuucuacagccucuuuccucuucucaugcu

SEQ ID NO: 465835 - RNA, 64 nt, hsa
ucaccuuaguggugaaaggagacuaguagcaucuuuucuacaacguuaaaauugcagaaguagc

SEQ ID NO: 465836 - RNA, 64 nt, hsa
aagaugcagcauuuuagaaauuuacauaucaauguuucuacaguauuguuugcuaauuuuuaaa

SEQ ID NO: 465837 - RNA, 64 nt, hsa
uuuuuuuuuuuuuuuuacaguuuaguguaucugguuucuacauggaagacuaaacucaugcuua

SEQ ID NO: 465838 - RNA, 64 nt, hsa
uucaaaagguuuguaagauuuggaucucaacuaauuucuacauugccagaauauacuauaaaaa

SEQ ID NO: 465839 - RNA, 64 nt, hsa
ucauuuuugccaguuauuuuuauuuucuuuuacuuuucuacauaaacauaaacuucaaaagguu

SEQ ID NO: 465840 - RNA, 64 nt, hsa
auuuuucacugccagcuucaaggaaagaaaauuuuuucuacaauuugcaugagggauuuuuuua

SEQ ID NO: 465841 - RNA, 64 nt, hsa
uccuuuucuuuccuucccucuccagagauguugguuucuacagcaacccuagauauaaaauugu

SEQ ID NO: 465842 - RNA, 64 nt, hsa
agcuaauauucccaguaaagauaccauguauaauuuucuacaaccuaagauguucugccuuauc

SEQ ID NO: 465843 - RNA, 64 nt, hsa
acugucacuuuacaacuuagguuuuacucuuuucuuucuacagaccauauuuuuaaagaaaugu

SEQ ID NO: 465844 - RNA, 64 nt, hsa
ucuuuauccuuggaguuuaauccuuugcuucaucuuucuacaguaugacauaaugauuugcuau

SEQ ID NO: 465845 - RNA, 64 nt, hsa
auuuuuauuuuuacuguuuuauacccagaaguuauuucuacauuguucuacagcaagaauauuc

SEQ ID NO: 465846 - RNA, 64 nt, hsa
cagaacaaaucauagggguuuuuaaucucuaaaauuucuacaguaguacaggaaauauuccucu

SEQ ID NO: 465847 - RNA, 64 nt, hsa
gguuuuuuaugugcuaaccuaacuguaaugaccuuuucuacaacauguuuuauccauuccauaa

SEQ ID NO: 465848 - RNA, 64 nt, hsa
caagucgugaggaaauggguaugcaaggcugagauuucuacagcaauaaaggagacacacacug

SEQ ID NO: 465849 - RNA, 64 nt, hsa
uuuagguuuuaugaguagacaguguucauuugauuuucuacagaaauaauauaaauuauucuuu

SEQ ID NO: 465850 - RNA, 64 nt, hsa
accuguaguucguuuuaagucauguucacaggaauuucuacaauaauaaacccaucaucuccau

SEQ ID NO: 465851 - RNA, 64 nt, hsa
aguuugguuuacucuucucccaugagauuuugucuuucuacauuaacuaguaagacauaaagau

SEQ ID NO: 465852 - RNA, 64 nt, hsa
uuggaagacacaaaucaaaugugaaggauuugauuuucuacauuuaaaaugaagaaccaaaacu

SEQ ID NO: 465853 - RNA, 64 nt, hsa
ugcuaacuuuuaaaaauguuuuugaaaauugcaauuucuacaaauaaaugucauagugcaaaua

SEQ ID NO: 465854 - RNA, 64 nt, hsa
guuauaaugaaugcuucuauuuaaaagggaaauauuucuacaugugcauauaguuuuccaagag

SEQ ID NO: 465855 - RNA, 64 nt, hsa
aguugaauguugaggcuuuaacuuuuucggugucuuucuacaacuguguucugugacucaauug

SEQ ID NO: 465856 - RNA, 64 nt, hsa
gcuuacauugaaaacagauauuacagcuuauuuuuuucuacauaauugugaccaauacauuugu

SEQ ID NO: 465857 - RNA, 64 nt, hsa
aaaagcaagauauaagagauucauuugcuuaacauuucuacauaauauuuauggucuggucagu

SEQ ID NO: 465858 - RNA, 64 nt, hsa
aucauaugaauuguauaucaauuacuaaugggaauuucuacauauaugcuuacaaaagcaauuu

SEQ ID NO: 465859 - RNA, 64 nt, hsa
aaaaaaaucuuugguaccaaagauuacacuuguguuucuacacagcaaaccauuuuucuuucau

SEQ ID NO: 465860 - RNA, 64 nt, hsa
gaccugugaggacaggaauggugucuuacauucauuucuacacuuuauuaugcucaggauugca

SEQ ID NO: 465861 - RNA, 64 nt, hsa
cuaaaaggcuuagauuuuuaaaauuuaauaauuauuucuacaaauuuucuauuuuucuugaggu

SEQ ID NO: 465862 - RNA, 64 nt, hsa
cauuaacuaauuuuagguuuuccuuuaucauggcuuucuacaguauuucuauuguuuaacauaa

SEQ ID NO: 465863 - RNA, 64 nt, hsa
uauucuuccagguuuugcacucuacauaaaauuauuucuacaaugucaagacuagccaaaggac

SEQ ID NO: 465864 - RNA, 64 nt, hsa
uguaagcuguaauuuuuuauuaccacucauguucuuucuacacugacacuauucauuaagaaca

SEQ ID NO: 465865 - RNA, 64 nt, hsa
agcacuuuauucauacaaaauaaucaaaauagguuuucuacaccaaaugcuacccaggcagugc

SEQ ID NO: 465866 - RNA, 64 nt, hsa
gccugcugcuauuucacggcaaugagccuuuuucuuucuacacugaagauuuucuucuuauuua

SEQ ID NO: 465867 - RNA, 64 nt, hsa
uuguauauaccugcacugauauucuuaucaaaaauuucuacauuagcuuuaaguguucagauua

SEQ ID NO: 465868 - RNA, 64 nt, hsa
uauguacauauguuuguguguauauguaaauauauuucuacacacauacuuaaauauagugaug

SEQ ID NO: 465869 - RNA, 64 nt, hsa
uuaauugaguaacuacuaugguauuuguuaauauuuucuacacuaaauaccauuggugucuuua

SEQ ID NO: 465870 - RNA, 64 nt, hsa
cuucucacugaguuuuuguuuaaaaaccaggaaauuucuacaaucauggagacagauuuuaauu

SEQ ID NO: 465871 - RNA, 64 nt, hsa
guucauauuuuuaaagggaagaccuucugcugcuuuucuacaauuggcagaucagguuugucug

SEQ ID NO: 465872 - RNA, 64 nt, hsa
acaaugaucugucuggugcaggagaaggcaaaaguuucuacaagucuacaugaccuugcugaua

SEQ ID NO: 465873 - RNA, 64 nt, hsa
uuagggcucuaucggaaaugcuuccauuuugccuuuucuacaguuaggccaauuuugaaauaua

SEQ ID NO: 465874 - RNA, 64 nt, hsa
cucauauuucuacauaggugggaagauacucaucuuucuacauagacgggaacacgguguagca

SEQ ID NO: 465875 - RNA, 64 nt, hsa
agaugggauuuuaccugaauggagcauacucauauuucuacauaggugggaagauacucaucuu

SEQ ID NO: 465876 - RNA, 64 nt, hsa
uuaaaugaauauuuugauaauaauauuguuuuucuuucuacaaagcacuagagaaugcacagau

SEQ ID NO: 465877 - RNA, 64 nt, hsa
uucuuguuuauugaguuuguagguaaaauguauuuuucuacauuauugcuuauugcuuaguaaa

SEQ ID NO: 465878 - RNA, 64 nt, hsa
auugaacaucaucaauauuggagagcuuucuguuuuucuacauuuguuaggaaacuugugagca

SEQ ID NO: 465879 - RNA, 64 nt, hsa
uggcuucaaacacgaaauguuuauucucuaacaauuucuacagaucaggaauucaagaacagcu

SEQ ID NO: 465880 - RNA, 64 nt, hsa
ucuuugcuuuuaacagacacccuaaaagucuucuuuucuacauaguugaagacagcaacaucuu

SEQ ID NO: 465881 - RNA, 64 nt, hsa
cacuuuguggcagggguacuuuuaaacauaaauguuucuacaaaaguagguugaguucauugua

SEQ ID NO: 465882 - RNA, 64 nt, hsa
ccaagguuacuuucuuguuuuuggaaaaacaaaauuucuacaauuacaguucccaaagucaguu

SEQ ID NO: 465883 - RNA, 64 nt, hsa
ccaagguuacuuucuuguucuuggauaaagaaaauuucuacaauuacaguucccaaagacacag

SEQ ID NO: 465884 - RNA, 64 nt, hsa
aggagugaggcagccucacugugugcccucagggauacgagauucucuguugugaguugugggu

SEQ ID NO: 465885 - RNA, 64 nt, hsa
uuuuuucagggugaggugcuguguuucuuauuucauacgagauaaaacagagagaaguucucuc

SEQ ID NO: 465886 - RNA, 64 nt, hsa
aacugcauggaagcgguggucagaagguuguuuuauacgagaacaggcagaaagugcccauugu

SEQ ID NO: 465887 - RNA, 64 nt, hsa
auagcauuuuuguaacuugccauccgcacagaaaauacgagaaaaucugcauguuugauuauag

SEQ ID NO: 465888 - RNA, 64 nt, hsa
cauggauaaacugugaaccaaaauauggugcaacauacgagacaugaauauaguccaaccauca

SEQ ID NO: 465889 - RNA, 64 nt, hsa
uauaaaucuagcuuucuuuaugauguuucugauaauacgagaauugaaaacuuuaccuucucuu

SEQ ID NO: 465890 - RNA, 64 nt, hsa
uuaauuuugguaauuauuaaagucuauuucugagauacgagaggguagucacauuaauagaaga

SEQ ID NO: 465891 - RNA, 64 nt, hsa
ggucugggagucacacaguguuggagguuaaggcauacgagagcagaggucucccaaacgcccu

SEQ ID NO: 465892 - RNA, 64 nt, hsa
aggcagcucccacgacacacggagagacugacugauacgagauuuggaaagcuauguagacauc

SEQ ID NO: 465893 - RNA, 64 nt, hsa
auccaacuucugugcaaaauuuuaguaucagaaaauacgagauuugcaggggaaacaucaguaa

SEQ ID NO: 465894 - RNA, 64 nt, hsa
aagauguacaggaugcuuugguuucacuccugagauacgagaacguccucugaacacacaugca

SEQ ID NO: 465895 - RNA, 64 nt, hsa
uucugauaaaguucucuauggcaaagucuuucaaauacgagauaacugcaaaauauuuuccuuu

SEQ ID NO: 465896 - RNA, 64 nt, hsa
ggaagcugaagaaaaagcgccagugaagaaaucuauacgagauacuccagccaaaaaugcacaa

SEQ ID NO: 465897 - RNA, 64 nt, hsa
aaauuauauuauuauuguauuuuuugaaaaauuuauacgagaaagugguauauaagucuuugua

SEQ ID NO: 465898 - RNA, 64 nt, hsa
agauucuggauucuugguguccacagccuagcugauacgagauagcccauaggacaccugguuu

SEQ ID NO: 465899 - RNA, 64 nt, hsa
aucaaugugaacugcuuagcauggugccugguauauacgagagcuccacaaaugugagcuauaa

SEQ ID NO: 465900 - RNA, 64 nt, hsa
acucuuugugauacacaugugacaugugaaagacauacgagacauagcuacaugugaugugcac

SEQ ID NO: 465901 - RNA, 64 nt, hsa
caagucaguggcuguuguucugucuugcugucugauacgagaguggggcuuuucagugaacuaa

SEQ ID NO: 465902 - RNA, 64 nt, hsa
uagaugaacagagaggaaaauguauuuaaaagaaauacgagaaaagaaagugaaaguuuuacaa

SEQ ID NO: 465903 - RNA, 64 nt, hsa
ccccacccuccuugagacuggagcuggcgucugcauacgagagacuugguugaacuugguuggu

SEQ ID NO: 465904 - RNA, 64 nt, hsa
gaaacgcuuaagcaguugccuuuuuuaaacaucgauacgagaccucugaauuuguauuuuuucu

SEQ ID NO: 465905 - RNA, 64 nt, hsa
uauuuuucuuccuugcauauacaugaaaggacucauacgagagagaauccguaugaauguaagg

SEQ ID NO: 465906 - RNA, 64 nt, hsa
ucuccuuuucuacugaccaucuugauacuuauuuauacgagaggcaguugcuggacgggguagu

SEQ ID NO: 465907 - RNA, 64 nt, hsa
aauuggugagaaacccaacaaaugccuuucauauauacgagaaccaaaugaagucagaauuugc

SEQ ID NO: 465908 - RNA, 64 nt, hsa
ucauuucaaaauccugagugagucugacugaaaaauacgagagaaaagagagugguuuccguuu

SEQ ID NO: 465909 - RNA, 64 nt, hsa
gcccacagaggcucagcuccuucuuuucugugcaauacgagacccggccgcaccccgagucaca

SEQ ID NO: 465910 - RNA, 64 nt, hsa
ugaguauuuauauauugugcaucaacucuguuggauacgagaacacuguagaaguggacgauuu

SEQ ID NO: 465911 - RNA, 64 nt, hsa
uucuuccccuccuacaccuaaguuagcguucaauauacgagacacaaaauaaaguuuguuugaa

SEQ ID NO: 465912 - RNA, 64 nt, hsa; identical to SEQ ID NO: 266463

SEQ ID NO: 465913 - RNA, 64 nt, hsa; identical to SEQ ID NO: 266464

SEQ ID NO: 465914 - RNA, 64 nt, hsa; identical to SEQ ID NO: 266465

SEQ ID NO: 465915 - RNA, 64 nt, hsa; identical to SEQ ID NO: 266466

SEQ ID NO: 465916 - RNA, 64 nt, hsa; identical to SEQ ID NO: 266467

SEQ ID NO: 465917 - RNA, 64 nt, hsa; identical to SEQ ID NO: 266468

SEQ ID NO: 465918 - RNA, 64 nt, hsa; identical to SEQ ID NO: 266469

SEQ ID NO: 465919 - RNA, 64 nt, hsa; identical to SEQ ID NO: 266470

SEQ ID NO: 465920 - RNA, 64 nt, hsa; identical to SEQ ID NO: 266471

SEQ ID NO: 465921 - RNA, 64 nt, hsa; identical to SEQ ID NO: 266472

SEQ ID NO: 465922 - RNA, 64 nt, hsa; identical to SEQ ID NO: 266473

SEQ ID NO: 465923 - RNA, 64 nt, hsa; identical to SEQ ID NO: 266474

SEQ ID NO: 465924 - RNA, 64 nt, hsa; identical to SEQ ID NO: 266475

SEQ ID NO: 465925 - RNA, 64 nt, hsa; identical to SEQ ID NO: 266476

SEQ ID NO: 465926 - RNA, 64 nt, hsa; identical to SEQ ID NO: 266477

SEQ ID NO: 465927 - RNA, 64 nt, hsa; identical to SEQ ID NO: 266478

SEQ ID NO: 465928 - RNA, 64 nt, hsa; identical to SEQ ID NO: 266479

SEQ ID NO: 465929 - RNA, 64 nt, hsa; identical to SEQ ID NO: 266480

SEQ ID NO: 465930 - RNA, 64 nt, hsa; identical to SEQ ID NO: 266481

SEQ ID NO: 465931 - RNA, 64 nt, hsa; identical to SEQ ID NO: 266482

SEQ ID NO: 465932 - RNA, 64 nt, hsa; identical to SEQ ID NO: 266483

SEQ ID NO: 465933 - RNA, 64 nt, hsa; identical to SEQ ID NO: 266484

SEQ ID NO: 465934 - RNA, 64 nt, hsa; identical to SEQ ID NO: 266485

SEQ ID NO: 465935 - RNA, 64 nt, hsa; identical to SEQ ID NO: 266486

SEQ ID NO: 465936 - RNA, 64 nt, hsa; identical to SEQ ID NO: 266487

SEQ ID NO: 465937 - RNA, 64 nt, hsa; identical to SEQ ID NO: 266488

SEQ ID NO: 465938 - RNA, 64 nt, hsa; identical to SEQ ID NO: 266489

SEQ ID NO: 465939 - RNA, 64 nt, hsa; identical to SEQ ID NO: 266490

SEQ ID NO: 465940 - RNA, 64 nt, hsa; identical to SEQ ID NO: 266491

SEQ ID NO: 465941 - RNA, 64 nt, hsa; identical to SEQ ID NO: 266492

SEQ ID NO: 465942 - RNA, 64 nt, hsa; identical to SEQ ID NO: 266493

SEQ ID NO: 465943 - RNA, 64 nt, hsa; identical to SEQ ID NO: 266494

SEQ ID NO: 465944 - RNA, 64 nt, hsa; identical to SEQ ID NO: 266495

SEQ ID NO: 465945 - RNA, 64 nt, hsa; identical to SEQ ID NO: 266496

SEQ ID NO: 465946 - RNA, 64 nt, hsa; identical to SEQ ID NO: 266497

SEQ ID NO: 465947 - RNA, 64 nt, hsa; identical to SEQ ID NO: 266498

SEQ ID NO: 465948 - RNA, 64 nt, hsa; identical to SEQ ID NO: 266499

SEQ ID NO: 465949 - RNA, 64 nt, hsa; identical to SEQ ID NO: 266500

SEQ ID NO: 465950 - RNA, 64 nt, hsa; identical to SEQ ID NO: 266501

SEQ ID NO: 465951 - RNA, 64 nt, hsa; identical to SEQ ID NO: 266502

SEQ ID NO: 465952 - RNA, 64 nt, hsa; identical to SEQ ID NO: 266503

SEQ ID NO: 465953 - RNA, 64 nt, hsa; identical to SEQ ID NO: 266504

SEQ ID NO: 465954 - RNA, 64 nt, hsa; identical to SEQ ID NO: 266505

SEQ ID NO: 465955 - RNA, 64 nt, hsa; identical to SEQ ID NO: 266506

SEQ ID NO: 465956 - RNA, 64 nt, hsa; identical to SEQ ID NO: 266507

SEQ ID NO: 465957 - RNA, 64 nt, hsa; identical to SEQ ID NO: 266508

SEQ ID NO: 465958 - RNA, 64 nt, hsa; identical to SEQ ID NO: 266509

SEQ ID NO: 465959 - RNA, 64 nt, hsa; identical to SEQ ID NO: 266510

SEQ ID NO: 465960 - RNA, 64 nt, hsa; identical to SEQ ID NO: 266511

SEQ ID NO: 465961 - RNA, 64 nt, hsa; identical to SEQ ID NO: 266512

SEQ ID NO: 465962 - RNA, 64 nt, hsa; identical to SEQ ID NO: 266513

SEQ ID NO: 465963 - RNA, 64 nt, hsa; identical to SEQ ID NO: 266514

SEQ ID NO: 465964 - RNA, 64 nt, hsa; identical to SEQ ID NO: 266515

SEQ ID NO: 465965 - RNA, 64 nt, hsa; identical to SEQ ID NO: 266516

SEQ ID NO: 465966 - RNA, 64 nt, hsa; identical to SEQ ID NO: 266517

SEQ ID NO: 465967 - RNA, 64 nt, hsa; identical to SEQ ID NO: 266518

SEQ ID NO: 465968 - RNA, 64 nt, hsa; identical to SEQ ID NO: 266519

SEQ ID NO: 465969 - RNA, 64 nt, hsa; identical to SEQ ID NO: 266520

SEQ ID NO: 465970 - RNA, 64 nt, hsa; identical to SEQ ID NO: 266521

SEQ ID NO: 465971 - RNA, 64 nt, hsa; identical to SEQ ID NO: 266522

SEQ ID NO: 465972 - RNA, 64 nt, hsa; identical to SEQ ID NO: 266523

SEQ ID NO: 465973 - RNA, 64 nt, hsa; identical to SEQ ID NO: 266524

SEQ ID NO: 465974 - RNA, 64 nt, hsa; identical to SEQ ID NO: 266525

SEQ ID NO: 465975 - RNA, 64 nt, hsa; identical to SEQ ID NO: 266526

SEQ ID NO: 465976 - RNA, 64 nt, hsa; identical to SEQ ID NO: 266527

SEQ ID NO: 465977 - RNA, 64 nt, hsa; identical to SEQ ID NO: 266528

SEQ ID NO: 465978 - RNA, 64 nt, hsa; identical to SEQ ID NO: 266529

SEQ ID NO: 465979 - RNA, 64 nt, hsa; identical to SEQ ID NO: 266530

SEQ ID NO: 465980 - RNA, 64 nt, hsa; identical to SEQ ID NO: 266531

SEQ ID NO: 465981 - RNA, 64 nt, hsa; identical to SEQ ID NO: 266532

SEQ ID NO: 465982 - RNA, 64 nt, hsa; identical to SEQ ID NO: 266533

SEQ ID NO: 465983 - RNA, 64 nt, hsa; identical to SEQ ID NO: 266534

SEQ ID NO: 465984 - RNA, 64 nt, hsa; identical to SEQ ID NO: 266535

SEQ ID NO: 465985 - RNA, 64 nt, hsa; identical to SEQ ID NO: 266536

SEQ ID NO: 465986 - RNA, 64 nt, hsa; identical to SEQ ID NO: 266537

SEQ ID NO: 465987 - RNA, 64 nt, hsa; identical to SEQ ID NO: 266538

SEQ ID NO: 465988 - RNA, 64 nt, hsa; identical to SEQ ID NO: 266539

SEQ ID NO: 465989 - RNA, 64 nt, hsa; identical to SEQ ID NO: 266540

SEQ ID NO: 465990 - RNA, 64 nt, hsa; identical to SEQ ID NO: 266541

SEQ ID NO: 465991 - RNA, 64 nt, hsa; identical to SEQ ID NO: 266542

SEQ ID NO: 465992 - RNA, 64 nt, hsa; identical to SEQ ID NO: 266543

SEQ ID NO: 465993 - RNA, 64 nt, hsa; identical to SEQ ID NO: 266544

SEQ ID NO: 465994 - RNA, 64 nt, hsa; identical to SEQ ID NO: 266545

SEQ ID NO: 465995 - RNA, 64 nt, hsa; identical to SEQ ID NO: 266546

SEQ ID NO: 465996 - RNA, 64 nt, hsa; identical to SEQ ID NO: 266547

SEQ ID NO: 465997 - RNA, 64 nt, hsa; identical to SEQ ID NO: 266548

SEQ ID NO: 465998 - RNA, 64 nt, hsa; identical to SEQ ID NO: 266549

SEQ ID NO: 465999 - RNA, 64 nt, hsa; identical to SEQ ID NO: 266550

SEQ ID NO: 466000 - RNA, 64 nt, hsa; identical to SEQ ID NO: 266551

SEQ ID NO: 466001 - RNA, 64 nt, hsa; identical to SEQ ID NO: 266552

SEQ ID NO: 466002 - RNA, 64 nt, hsa; identical to SEQ ID NO: 266553

SEQ ID NO: 466003 - RNA, 64 nt, hsa; identical to SEQ ID NO: 266554

SEQ ID NO: 466004 - RNA, 64 nt, hsa; identical to SEQ ID NO: 266555

SEQ ID NO: 466005 - RNA, 64 nt, hsa; identical to SEQ ID NO: 266556

SEQ ID NO: 466006 - RNA, 64 nt, hsa; identical to SEQ ID NO: 266557

SEQ ID NO: 466007 - RNA, 64 nt, hsa; identical to SEQ ID NO: 266558

SEQ ID NO: 466008 - RNA, 64 nt, hsa; identical to SEQ ID NO: 266559

SEQ ID NO: 466009 - RNA, 64 nt, hsa; identical to SEQ ID NO: 266560

SEQ ID NO: 466010 - RNA, 55 nt, hsa; identical to SEQ ID NO: 266561

SEQ ID NO: 466011 - RNA, 64 nt, hsa; identical to SEQ ID NO: 266562

SEQ ID NO: 466012 - RNA, 64 nt, hsa; identical to SEQ ID NO: 266563

SEQ ID NO: 466013 - RNA, 64 nt, hsa; identical to SEQ ID NO: 266564

SEQ ID NO: 466014 - RNA, 64 nt, hsa; identical to SEQ ID NO: 266565

SEQ ID NO: 466015 - RNA, 64 nt, hsa; identical to SEQ ID NO: 266566

SEQ ID NO: 466016 - RNA, 64 nt, hsa; identical to SEQ ID NO: 266567

SEQ ID NO: 466017 - RNA, 64 nt, hsa; identical to SEQ ID NO: 266568

SEQ ID NO: 466018 - RNA, 64 nt, hsa; identical to SEQ ID NO: 266569

SEQ ID NO: 466019 - RNA, 64 nt, hsa; identical to SEQ ID NO: 266570

SEQ ID NO: 466020 - RNA, 64 nt, hsa; identical to SEQ ID NO: 266571

SEQ ID NO: 466021 - RNA, 64 nt, hsa; identical to SEQ ID NO: 266572

SEQ ID NO: 466022 - RNA, 64 nt, hsa; identical to SEQ ID NO: 266573

SEQ ID NO: 466023 - RNA, 64 nt, hsa; identical to SEQ ID NO: 266574

SEQ ID NO: 466024 - RNA, 64 nt, hsa; identical to SEQ ID NO: 266575

SEQ ID NO: 466025 - RNA, 60 nt, hsa; identical to SEQ ID NO: 266576

SEQ ID NO: 466026 - RNA, 64 nt, hsa; identical to SEQ ID NO: 266577

SEQ ID NO: 466027 - RNA, 64 nt, hsa; identical to SEQ ID NO: 266578

SEQ ID NO: 466028 - RNA, 64 nt, hsa; identical to SEQ ID NO: 266579

SEQ ID NO: 466029 - RNA, 64 nt, hsa; identical to SEQ ID NO: 266580

SEQ ID NO: 466030 - RNA, 64 nt, hsa; identical to SEQ ID NO: 266581

SEQ ID NO: 466031 - RNA, 64 nt, hsa; identical to SEQ ID NO: 266582

SEQ ID NO: 466032 - RNA, 64 nt, hsa; identical to SEQ ID NO: 266583

SEQ ID NO: 466033 - RNA, 64 nt, hsa; identical to SEQ ID NO: 266584

SEQ ID NO: 466034 - RNA, 64 nt, hsa; identical to SEQ ID NO: 266585

SEQ ID NO: 466035 - RNA, 64 nt, hsa; identical to SEQ ID NO: 266586

SEQ ID NO: 466036 - RNA, 64 nt, hsa; identical to SEQ ID NO: 266587

SEQ ID NO: 466037 - RNA, 64 nt, hsa; identical to SEQ ID NO: 266588

SEQ ID NO: 466038 - RNA, 64 nt, hsa; identical to SEQ ID NO: 266589

SEQ ID NO: 466039 - RNA, 64 nt, hsa; identical to SEQ ID NO: 266590

SEQ ID NO: 466040 - RNA, 54 nt, hsa; identical to SEQ ID NO: 266591

SEQ ID NO: 466041 - RNA, 64 nt, hsa; identical to SEQ ID NO: 266592

SEQ ID NO: 466042 - RNA, 64 nt, hsa; identical to SEQ ID NO: 266593

SEQ ID NO: 466043 - RNA, 64 nt, hsa; identical to SEQ ID NO: 266594

SEQ ID NO: 466044 - RNA, 64 nt, hsa; identical to SEQ ID NO: 266595

SEQ ID NO: 466045 - RNA, 64 nt, hsa; identical to SEQ ID NO: 266596

SEQ ID NO: 466046 - RNA, 64 nt, hsa; identical to SEQ ID NO: 266597

SEQ ID NO: 466047 - RNA, 64 nt, hsa; identical to SEQ ID NO: 266598

SEQ ID NO: 466048 - RNA, 64 nt, hsa; identical to SEQ ID NO: 266599

SEQ ID NO: 466049 - RNA, 64 nt, hsa; identical to SEQ ID NO: 266600

SEQ ID NO: 466050 - RNA, 64 nt, hsa; identical to SEQ ID NO: 266601

SEQ ID NO: 466051 - RNA, 64 nt, hsa; identical to SEQ ID NO: 266602

SEQ ID NO: 466052 - RNA, 64 nt, hsa; identical to SEQ ID NO: 266603

SEQ ID NO: 466053 - RNA, 64 nt, hsa; identical to SEQ ID NO: 266604

SEQ ID NO: 466054 - RNA, 64 nt, hsa; identical to SEQ ID NO: 266605

SEQ ID NO: 466055 - RNA, 64 nt, hsa; identical to SEQ ID NO: 266606

SEQ ID NO: 466056 - RNA, 64 nt, hsa; identical to SEQ ID NO: 266607

SEQ ID NO: 466057 - RNA, 64 nt, hsa; identical to SEQ ID NO: 266608

SEQ ID NO: 466058 - RNA, 64 nt, hsa; identical to SEQ ID NO: 266609

SEQ ID NO: 466059 - RNA, 64 nt, hsa; identical to SEQ ID NO: 266610

SEQ ID NO: 466060 - RNA, 64 nt, hsa; identical to SEQ ID NO: 266611

SEQ ID NO: 466061 - RNA, 64 nt, hsa; identical to SEQ ID NO: 266612

SEQ ID NO: 466062 - RNA, 64 nt, hsa; identical to SEQ ID NO: 266613

SEQ ID NO: 466063 - RNA, 64 nt, hsa; identical to SEQ ID NO: 266614

SEQ ID NO: 466064 - RNA, 64 nt, hsa; identical to SEQ ID NO: 266615

SEQ ID NO: 466065 - RNA, 64 nt, hsa; identical to SEQ ID NO: 266616

SEQ ID NO: 466066 - RNA, 64 nt, hsa; identical to SEQ ID NO: 266617

SEQ ID NO: 466067 - RNA, 64 nt, hsa; identical to SEQ ID NO: 266618

SEQ ID NO: 466068 - RNA, 64 nt, hsa; identical to SEQ ID NO: 266619

SEQ ID NO: 466069 - RNA, 64 nt, hsa; identical to SEQ ID NO: 266620

SEQ ID NO: 466070 - RNA, 64 nt, hsa; identical to SEQ ID NO: 266621

SEQ ID NO: 466071 - RNA, 64 nt, hsa; identical to SEQ ID NO: 266622

SEQ ID NO: 466072 - RNA, 64 nt, hsa; identical to SEQ ID NO: 266623

SEQ ID NO: 466073 - RNA, 64 nt, hsa; identical to SEQ ID NO: 266624

SEQ ID NO: 466074 - RNA, 64 nt, hsa; identical to SEQ ID NO: 266625

SEQ ID NO: 466075 - RNA, 64 nt, hsa; identical to SEQ ID NO: 266626

SEQ ID NO: 466076 - RNA, 64 nt, hsa; identical to SEQ ID NO: 266627

SEQ ID NO: 466077 - RNA, 64 nt, hsa; identical to SEQ ID NO: 266628

SEQ ID NO: 466078 - RNA, 64 nt, hsa; identical to SEQ ID NO: 266629

SEQ ID NO: 466079 - RNA, 64 nt, hsa; identical to SEQ ID NO: 266630

SEQ ID NO: 466080 - RNA, 64 nt, hsa; identical to SEQ ID NO: 266631

SEQ ID NO: 466081 - RNA, 64 nt, hsa; identical to SEQ ID NO: 266632

SEQ ID NO: 466082 - RNA, 65 nt, hsa
ugaacauugcucuucauuuuggccuguacuucucccucagggacguagaacaauggaaugucagu

SEQ ID NO: 466083 - RNA, 65 nt, hsa
acuuuuucuuuaaaauucaauuaagguacuucucccucagggacguagaacaauggaaugucagu

SEQ ID NO: 466084 - RNA, 65 nt, hsa
aaaauauuagccacagaccaccuacaucacaauaacucagggagcuuauagaagugaagauuccu

SEQ ID NO: 466085 - RNA, 65 nt, hsa
ggucuuaucagacgcccgucuuaaaguccagcaugcucagggacccuguguaggaucucguuugu

SEQ ID NO: 466086 - RNA, 65 nt, hsa
cucagggguuggucugagaggccugccauccaccccucagggagcuagguuuucucagaggcuca

SEQ ID NO: 466087 - RNA, 65 nt, hsa
caggccccugugcuccaggccgaggcugggcuacccucagggagauccagagacucaugcccaug

SEQ ID NO: 466088 - RNA, 65 nt, hsa
uagaaguugucugugggugauguuacuguaguggucucagggaaaggauuguccaguuacuuuag

SEQ ID NO: 466089 - RNA, 65 nt, hsa
cagggcaggaggagggggccgugccucccacccuucucagggacccccacgccuuuguuguuuga

SEQ ID NO: 466090 - RNA, 65 nt, hsa
ucuaaugaguggucggaccguggggaagggccccacucagggaucucagaccuagugcucccuuc

SEQ ID NO: 466091 - RNA, 65 nt, hsa
agaggccgaugcauaaagucagccuguucaaagugcucagggacuuagcaaaaugagaagaugug

SEQ ID NO: 466092 - RNA, 65 nt, hsa
aauacuguacuguguagugugucuccguaugucaucucagggagcuuaaaaugggcuugauuuaa

SEQ ID NO: 466093 - RNA, 65 nt, hsa
gucuuuccucggccgagucaggcuuccuggugagccucagggagugcauggucucagaugccauc

SEQ ID NO: 466094 - RNA, 65 nt, hsa
ugcuccucuccagaguuuccggucaccuccguguucucagggagugcguggucuuggaugccauc

SEQ ID NO: 466095 - RNA, 65 nt, hsa
uaaggguagggguauaagucuguuccaugcagucacucagggacccagucuccuuuugucuggug

SEQ ID NO: 466096 - RNA, 65 nt, hsa
gugagcaggucagcaggaacccuuuucugcagucacucagggacccagacuuacagaguggguag

SEQ ID NO: 466097 - RNA, 65 nt, hsa
agaaaagagagaucuacuuuggugguuucucaggucucagggaaggucuuuuauaaacucaaugg

SEQ ID NO: 466098 - RNA, 65 nt, hsa
gcuuugggaagagcugcugagcucuuugccugccacucagggagugcaauuguucuuaaagagcc

SEQ ID NO: 466099 - RNA, 65 nt, hsa
agcuggccacccuggccucagcucccucaggacgccucagggaucucgcugcgcgguccuauacg

SEQ ID NO: 466100 - RNA, 65 nt, hsa
gccaauugauccucuacuuuccuucuuuagucccucucagggacgccuccauccccggcuccccu

SEQ ID NO: 466101 - RNA, 65 nt, hsa
ugggcugggccugagauucugcauuucuaaggagucucagggaugccuaugcugcuggccuaaaa

SEQ ID NO: 466102 - RNA, 65 nt, hsa
acuaaaaucugaguuuugcccagugugacaucaaacucagggaagaggaagcuaaagugacgagu

SEQ ID NO: 466103 - RNA, 65 nt, hsa
aaggaugacucagcacugccgcucaacagacaugacucagggauggcuuaguacugccccucagc

SEQ ID NO: 466104 - RNA, 65 nt, hsa
aaggaugacucagcacugccgcucaacagggaugacucagggauggcuuaguacugccccucaac

SEQ ID NO: 466105 - RNA, 65 nt, hsa; identical to SEQ ID NO: 466103

SEQ ID NO: 466106 - RNA, 65 nt, hsa; identical to SEQ ID NO: 466103

SEQ ID NO: 466107 - RNA, 65 nt, hsa
cagccccucagccauccagggcuacccacugcuuacucagggaccaggcagcccccauggcagua

SEQ ID NO: 466108 - RNA, 65 nt, hsa
uccucccccuacuucuccccaagggccaagaacugcucagggacauuaaaggucaaaaguccagc

SEQ ID NO: 466109 - RNA, 65 nt, hsa
acauaaggagcgugggauccgauggaaagguggagcucagggaaaauggggguccuugccucucg

SEQ ID NO: 466110 - RNA, 65 nt, hsa
gacucagaggggagggaagggcucaucagcacccgcucagggagccugucccuuuauguucccaa

SEQ ID NO: 466111 - RNA, 65 nt, hsa
gcacccccaggcuucaaaccaccuggaaugcacagcucagggaagcugguggaugccuagaggcu

SEQ ID NO: 466112 - RNA, 65 nt, hsa
ugaaggacagggaacucuccauuauuggggcaggacucagggaggacacuuggggccaugugucu

SEQ ID NO: 466113 - RNA, 65 nt, hsa
ggcccaucugucagcagcgucuucuagguccccagcucagggagccauccccagcuccaguuuuc

SEQ ID NO: 466114 - RNA, 65 nt, hsa
cacaucuuucuucuuaguuuacagugaaauauuaucucagggauauuuuuuuuuuuuuuuugaga

SEQ ID NO: 466115 - RNA, 65 nt, hsa
ugggauuacaggcgugagccaccgcgcccggccaucucagggauauuuaaacaaaggaagaggaa

SEQ ID NO: 466116 - RNA, 65 nt, hsa
cauauuugguaaguuuuguacauauauuauguacacucagggaaccaauaccauaaucaugauaa

SEQ ID NO: 466117 - RNA, 65 nt, hsa
agcucuccaaagaguguguccaccacuccacugugcucagggaaggcagaccucuccucucucuu

SEQ ID NO: 466118 - RNA, 65 nt, hsa
ucagacacccagaguuggagacagaacaacagagucucagggaaagagaaccacaauagaaaaag

SEQ ID NO: 466119 - RNA, 65 nt, hsa
agagagacagagacccaaagggagagaaacagagacucagggagagggagacaaugaccuggagg

SEQ ID NO: 466120 - RNA, 65 nt, hsa
aauuacauccucccauggaggaugagagacugaggcucagggagggcaaggaauaggcccaagau

SEQ ID NO: 466121 - RNA, 65 nt, hsa
cauggugguauggcugaacaaggagcggcagacaacucagggagaaacucaggagugcaguacca

SEQ ID NO: 466122 - RNA, 65 nt, hsa
agccaaucagaucaacucugucuugggcguuugaacucagggagggaggcccuugggagcaggug

SEQ ID NO: 466123 - RNA, 65 nt, hsa
cacugcccccuccacuggaggggucuccucugcagcucagggacuggcacacuggccuccagaag

SEQ ID NO: 466124 - RNA, 65 nt, hsa
cuccaaacauuguaagaauugcuugguagcauaagcucagggauaaggugggaauugaguucaaa

SEQ ID NO: 466125 - RNA, 65 nt, hsa
aaauaauuuuuaaucugcagacccacgaaaagggucucagggacuccuccaggggucuucagacc

SEQ ID NO: 466126 - RNA, 64 nt, hsa
uucuguaggacacugaggcucuuguuugacaugguguguggauggggacuugccccaagacuga

SEQ ID NO: 466127 - RNA, 64 nt, hsa
auccaaguugcgugagauaagaugcaaagggcucuguguggaugaggaacgcaccuuagaggag

SEQ ID NO: 466128 - RNA, 64 nt, hsa
ucugguaggggagaaagcagcaggacaguggagguguguggaaggcacucuuuccaccucucuc

SEQ ID NO: 466129 - RNA, 64 nt, hsa
uugugucuuguugaaaagaaacccaaaggaguguuguguggacaugacucacccugaggagucu

SEQ ID NO: 466130 - RNA, 64 nt, hsa
ggaguuugcaggaaggugagggugagcagagauguguguggacaucucugaccauccaucgcug

SEQ ID NO: 466131 - RNA, 64 nt, hsa
ggcuggacuaaggugugauuaauucuuuguuuuuuguguggaacagcucaccuugucagacagc

SEQ ID NO: 466132 - RNA, 64 nt, hsa
guugaagaaaaucugggggauugggauggggguauguguggauuuuuccuccacuaaaucugca

SEQ ID NO: 466133 - RNA, 64 nt, hsa
auggcuguugggagagagugaugaccucguggccuguguggagagcaugcaucaggugaucccg

SEQ ID NO: 466134 - RNA, 64 nt, hsa
ugcuuccaaagucauuucccaccacaugcagacauguguggagaacagggaauugauagcugcu

SEQ ID NO: 466135 - RNA, 64 nt, hsa
ucuguucccagaccuguccccacaacaaggacccuguguggagccagguguucuccuucuuugu

SEQ ID NO: 466136 - RNA, 64 nt, hsa
gaacaaccacuugaaauuauauacauacaauucuuguguggaauuuaacuccaugacugaauag

SEQ ID NO: 466137 - RNA, 64 nt, hsa
ggacauggccuugguaaagguuagcagacugguguguguggaucugcagugcuucacuggaaau

SEQ ID NO: 466138 - RNA, 64 nt, hsa
cuucccucacugaagagcccuuauuugaauucacuguguggagcccuagcccuccauucucgac

SEQ ID NO: 466139 - RNA, 64 nt, hsa
uuuucucucaauuauccuaggagugaccuuuauauguguggaagauuaaugguauaugcuccuu

SEQ ID NO: 466140 - RNA, 64 nt, hsa
ccuccuuguaggggauaaggggaugugcagcaucuguguggauuuucacggacaaguuccagua

SEQ ID NO: 466141 - RNA, 64 nt, hsa
uguagagauucuguagugaagaggucugacaccauguguggaggaggaggaacgaucagucaag

SEQ ID NO: 466142 - RNA, 64 nt, hsa
aagucaggcugaacauucagucuccagagacagcuguguggagcaaaucagaguucaugcccaa

SEQ ID NO: 466143 - RNA, 64 nt, hsa
aaugguguuggggggucuuggaacagcuucucuauguguggauucguguaaaugcgaagaguuc

SEQ ID NO: 466144 - RNA, 64 nt, hsa
ggugccagguuugugggauggggguuagcgucuauguguggaaggccaccaaucuagggacagg

SEQ ID NO: 466145 - RNA, 64 nt, hsa
cuuggaaucagcuacaaauccuaaagaugggguguguguggauguguguguguguguguguaca

SEQ ID NO: 466146 - RNA, 64 nt, hsa
guucuagagcuggggguucuugggccaugcuccguguguggauaaggaaagaaauacuguuucu

SEQ ID NO: 466147 - RNA, 64 nt, hsa
ggcagggaagagaaagggcaccccagcgggggcauguguggaggcagcacggaacauguagguu

SEQ ID NO: 466148 - RNA, 64 nt, hsa
agucuauuauagaaggaaagaaguggaggccugcuguguggaucccuucuucuuccuagcuuuc

SEQ ID NO: 466149 - RNA, 64 nt, hsa
gugucuuagguuggcauucaggucacaugaaagguguguggaaaguggccagcauucugccugc

SEQ ID NO: 466150 - RNA, 64 nt, hsa
uguagguacccgcaucagcccuuguuccuaaggauguguggagcccaggcuguacucuuugaca

SEQ ID NO: 466151 - RNA, 64 nt, hsa
ugagggaguggcaagcaccacagauuaccacguauguguggaagacauucguacucuuaucuuu

SEQ ID NO: 466152 - RNA, 64 nt, hsa
auucucuuaauuagcuucauuauucuugucuuuguguguggauuaccuaaacucuccuuccaga

SEQ ID NO: 466153 - RNA, 64 nt, hsa
ucugauuauguuuugccauauugagucugaaguuuguguggaagugagcucgcccgaguugucc

SEQ ID NO: 466154 - RNA, 64 nt, hsa
cgugguguuauguggucauuucagcccuaacuucuguguggaucacaguuauucaggguucauu

SEQ ID NO: 466155 - RNA, 64 nt, hsa
ugcucgccuugaugacuugcucuuuuuuggcagauguguggaguuggcuguuacgacaucccug

SEQ ID NO: 466156 - RNA, 64 nt, hsa
ucuguguccucacucuugucccugaaugggucccuguguggaucucagugugugugugguuucu

SEQ ID NO: 466157 - RNA, 64 nt, hsa
caaaaaugguuuguuuuuaauauguagagcauuauguguggacuacuggaaggacucguguagg

SEQ ID NO: 466158 - RNA, 64 nt, hsa
aagaaaagccucaacugacagaggagaagucaaguguguggacaggcaagcuccuaauaaacag

SEQ ID NO: 466159 - RNA, 64 nt, hsa
uccaggcaacaaaauaauuucuaaaauggauauauguguggauuaaugacaggcaguaaauacc

SEQ ID NO: 466160 - RNA, 64 nt, hsa
uucuuuauuuuuaaaugaaaauuaagacaccuuuuguguggacauguuuuugucuuuaauguca

SEQ ID NO: 466161 - RNA, 64 nt, hsa
ugggagaaaucucaauuagccaccuuuucacaguuguguggauauaacauuugggggaucuuuc

SEQ ID NO: 466162 - RNA, 64 nt, hsa
uauucuagaucauuuuuuauugaagagcacaguauguguggaagacaguguauaacacguaguu

SEQ ID NO: 466163 - RNA, 64 nt, hsa
auacaauauacaaacauaugcccauuccugugauagcauacaaauucaaacauacagaaacaca

SEQ ID NO: 466164 - RNA, 64 nt, hsa
ugaggaguguguauguaccugugguauaccaaauagcauacauguacacacaaaaaugugugua

SEQ ID NO: 466165 - RNA, 64 nt, hsa
aaauauaacacaguuuguacuuuuauuacuaguuagcauacacauuuuauaggcuuauggguua

SEQ ID NO: 466166 - RNA, 64 nt, hsa
cgaaaaguaaagauguauaggcaucugguguuucagcauacauaacugaagcaugugaaacagu

SEQ ID NO: 466167 - RNA, 64 nt, hsa
ggacaauuuaaauuguggguaaauauuuaaaacuccugaacaauguuucugauggucuucuauc

SEQ ID NO: 466168 - RNA, 64 nt, hsa
aggcucaucagucuauccuucugccuccauauauccugaacaucaaacuaucccaggaaaacca

SEQ ID NO: 466169 - RNA, 64 nt, hsa
ucugggcacaagcuaguuuuuauguugauacguuccugaacauauuaucuuguuggacaucuuu

SEQ ID NO: 466170 - RNA, 64 nt, hsa
caaaucaccaaauuucugauuuauguuuuuaucuccugaacaauauuuucucacucauauuccu

SEQ ID NO: 466171 - RNA, 64 nt, hsa
ccaauguguacacgacuacuuacuacccaagcccccugaacaaacacagcuuccggcccgaggc

SEQ ID NO: 466172 - RNA, 64 nt, hsa
agaaugaaaaguacacacccauggaauucaagacccugaacaagaauaacuugaucccugauga

SEQ ID NO: 466173 - RNA, 64 nt, hsa
uauugcaagacaaaguugaauguaaagugaucucccugaacauuuuuaagguuuuacuuuucug

SEQ ID NO: 466174 - RNA, 64 nt, hsa
aauaaaauguuauuaugucaaccagugaggcugcccugaacaaaaaaaacaaaaagaaaaaaaa

SEQ ID NO: 466175 - RNA, 64 nt, hsa; identical to SEQ ID NO: 97088

SEQ ID NO: 466176 - RNA, 64 nt, hsa; identical to SEQ ID NO: 97089

SEQ ID NO: 466177 - RNA, 64 nt, hsa; identical to SEQ ID NO: 97090

SEQ ID NO: 466178 - RNA, 52 nt, hsa; identical to SEQ ID NO: 97091

SEQ ID NO: 466179 - RNA, 64 nt, hsa; identical to SEQ ID NO: 97092

SEQ ID NO: 466180 - RNA, 64 nt, hsa; identical to SEQ ID NO: 97093

SEQ ID NO: 466181 - RNA, 64 nt, hsa; identical to SEQ ID NO: 97094

SEQ ID NO: 466182 - RNA, 64 nt, hsa; identical to SEQ ID NO: 97095

SEQ ID NO: 466183 - RNA, 64 nt, hsa; identical to SEQ ID NO: 97096

SEQ ID NO: 466184 - RNA, 64 nt, hsa; identical to SEQ ID NO: 97097

SEQ ID NO: 466185 - RNA, 64 nt, hsa; identical to SEQ ID NO: 97098

SEQ ID NO: 466186 - RNA, 64 nt, hsa; identical to SEQ ID NO: 97099

SEQ ID NO: 466187 - RNA, 64 nt, hsa; identical to SEQ ID NO: 97100

SEQ ID NO: 466188 - RNA, 64 nt, hsa; identical to SEQ ID NO: 97101

SEQ ID NO: 466189 - RNA, 64 nt, hsa; identical to SEQ ID NO: 97102

SEQ ID NO: 466190 - RNA, 64 nt, hsa; identical to SEQ ID NO: 97103

SEQ ID NO: 466191 - RNA, 64 nt, hsa; identical to SEQ ID NO: 97104

SEQ ID NO: 466192 - RNA, 64 nt, hsa; identical to SEQ ID NO: 97105

SEQ ID NO: 466193 - RNA, 64 nt, hsa; identical to SEQ ID NO: 97106

SEQ ID NO: 466194 - RNA, 64 nt, hsa; identical to SEQ ID NO: 97107

SEQ ID NO: 466195 - RNA, 64 nt, hsa; identical to SEQ ID NO: 97108

SEQ ID NO: 466196 - RNA, 64 nt, hsa; identical to SEQ ID NO: 97109

SEQ ID NO: 466197 - RNA, 64 nt, hsa; identical to SEQ ID NO: 97110

SEQ ID NO: 466198 - RNA, 64 nt, hsa; identical to SEQ ID NO: 97111

SEQ ID NO: 466199 - RNA, 64 nt, hsa; identical to SEQ ID NO: 97112

SEQ ID NO: 466200 - RNA, 64 nt, hsa; identical to SEQ ID NO: 97113

SEQ ID NO: 466201 - RNA, 64 nt, hsa; identical to SEQ ID NO: 97114

SEQ ID NO: 466202 - RNA, 64 nt, hsa; identical to SEQ ID NO: 97115

SEQ ID NO: 466203 - RNA, 64 nt, hsa; identical to SEQ ID NO: 97116

SEQ ID NO: 466204 - RNA, 64 nt, hsa; identical to SEQ ID NO: 97117

SEQ ID NO: 466205 - RNA, 64 nt, hsa; identical to SEQ ID NO: 97118

SEQ ID NO: 466206 - RNA, 64 nt, hsa; identical to SEQ ID NO: 97119

SEQ ID NO: 466207 - RNA, 64 nt, hsa; identical to SEQ ID NO: 97120

SEQ ID NO: 466208 - RNA, 64 nt, hsa; identical to SEQ ID NO: 97121

SEQ ID NO: 466209 - RNA, 64 nt, hsa; identical to SEQ ID NO: 97122

SEQ ID NO: 466210 - RNA, 64 nt, hsa; identical to SEQ ID NO: 97123

SEQ ID NO: 466211 - RNA, 64 nt, hsa; identical to SEQ ID NO: 97124

SEQ ID NO: 466212 - RNA, 64 nt, hsa; identical to SEQ ID NO: 97125

SEQ ID NO: 466213 - RNA, 64 nt, hsa; identical to SEQ ID NO: 97126

SEQ ID NO: 466214 - RNA, 64 nt, hsa; identical to SEQ ID NO: 97127

SEQ ID NO: 466215 - RNA, 64 nt, hsa; identical to SEQ ID NO: 97128

SEQ ID NO: 466216 - RNA, 64 nt, hsa; identical to SEQ ID NO: 97129

SEQ ID NO: 466217 - RNA, 64 nt, hsa; identical to SEQ ID NO: 97130

SEQ ID NO: 466218 - RNA, 64 nt, hsa; identical to SEQ ID NO: 97131

SEQ ID NO: 466219 - RNA, 64 nt, hsa; identical to SEQ ID NO: 97132

SEQ ID NO: 466220 - RNA, 64 nt, hsa; identical to SEQ ID NO: 97133

SEQ ID NO: 466221 - RNA, 65 nt, hsa; identical to SEQ ID NO: 46699

SEQ ID NO: 466222 - RNA, 65 nt, hsa; identical to SEQ ID NO: 46700

SEQ ID NO: 466223 - RNA, 65 nt, hsa; identical to SEQ ID NO: 46729

SEQ ID NO: 466224 - RNA, 65 nt, hsa; identical to SEQ ID NO: 46730

SEQ ID NO: 466225 - RNA, 65 nt, hsa; identical to SEQ ID NO: 46736

SEQ ID NO: 466226 - RNA, 65 nt, hsa; identical to SEQ ID NO: 46737

SEQ ID NO: 466227 - RNA, 65 nt, hsa; identical to SEQ ID NO: 46784

SEQ ID NO: 466228 - RNA, 65 nt, hsa; identical to SEQ ID NO: 46785

SEQ ID NO: 466229 - RNA, 65 nt, hsa; identical to SEQ ID NO: 46787

SEQ ID NO: 466230 - RNA, 65 nt, hsa; identical to SEQ ID NO: 46788

SEQ ID NO: 466231 - RNA, 65 nt, hsa; identical to SEQ ID NO: 46800

SEQ ID NO: 466232 - RNA, 65 nt, hsa; identical to SEQ ID NO: 46801

SEQ ID NO: 466233 - RNA, 65 nt, hsa; identical to SEQ ID NO: 46823

SEQ ID NO: 466234 - RNA, 65 nt, hsa; identical to SEQ ID NO: 46824

SEQ ID NO: 466235 - RNA, 65 nt, hsa; identical to SEQ ID NO: 46864

SEQ ID NO: 466236 - RNA, 65 nt, hsa; identical to SEQ ID NO: 46865

SEQ ID NO: 466237 - RNA, 64 nt, hsa
cacuccuuguccuccaugcuguggcuguaucagcucccuacaaguucguuuacaccuggcagca

SEQ ID NO: 466238 - RNA, 64 nt, hsa
cacauuaccuucuaauuauaguuugaaaauagauucccuacacauacauacauauguaugcaca

SEQ ID NO: 466239 - RNA, 64 nt, hsa
uaauguggguaaaucugaguuuaauucaacugcuucccuacauagacuagagggcuaaggauuc

SEQ ID NO: 466240 - RNA, 64 nt, hsa
uuuuuaaaaucaaccauguuagcugggauuagacucccuacaguccuucaauggaaaaguaaca

SEQ ID NO: 466241 - RNA, 64 nt, hsa
agaaugagaauucagguucuaaggacuagaggucucccuacaaaugaagacuuaucagggcccu

SEQ ID NO: 466242 - RNA, 64 nt, hsa
cccagaaauagauguuuuuuaaguuuucuuuuuuucccuacagggucacccucaggaucucucc

SEQ ID NO: 466243 - RNA, 64 nt, hsa
agcgguggcuucuugaugcugcgcggucccccacucccuacaucagaaugcaucccgcauccag

SEQ ID NO: 466244 - RNA, 64 nt, hsa
ucagugcaagucuugaugcugcgccgucccccacucccuacaucagaacgcaucccucaucugg

SEQ ID NO: 466245 - RNA, 64 nt, hsa
uuuagaaauaguuuuaacuagcuuaguuuucugguuuccaaaacuaaaauagauuaaauccuac

SEQ ID NO: 466246 - RNA, 64 nt, hsa
ucugaccacuaucuauaaauacauuggacauugguuuccaaaucucccuuucuucuucaguucc

SEQ ID NO: 466247 - RNA, 64 nt, hsa
auaucccuaaaauuuuuagaaaucucucaaaaucuuuccaaauguucugguaucuuugaaaaau

SEQ ID NO: 466248 - RNA, 64 nt, hsa
uacagaaacacaaaauggacuaagacaccacccuuuuccaaaaucucuccuugugauggcuccc

SEQ ID NO: 466249 - RNA, 64 nt, hsa
agagacgcauggcccgaagucaaagugcuggaauuuuccaaaacagccuguucucuccucucuc

SEQ ID NO: 466250 - RNA, 64 nt, hsa
cauuuuuuucuuuuuuuaaaaaaaguuuuuauuuuuuccaaacuagugcauguauaaauaaugg

SEQ ID NO: 466251 - RNA, 64 nt, hsa
ucaguguguuuagacuuuucaaguaucuaacucauuuccaaacauguaccauguuuuauaaacc

SEQ ID NO: 466252 - RNA, 64 nt, hsa
ugaauacuuuuguauugcugcuugcaaauaugcauuuccaaacuugaaauauaggugugaacag

SEQ ID NO: 466253 - RNA, 64 nt, hsa
aaaauuaacuuuuuuguggcaauuagugugacaguuuccaaauugcccuaugcugugcuccaua

SEQ ID NO: 466254 - RNA, 64 nt, hsa
gaucuuuuaaaaucaugauccuuguguucagcucuuuccaaauuaaaacaaauauacauuuucu

SEQ ID NO: 466255 - RNA, 64 nt, hsa
guauagauacaaaaccuuguguaagaggcugacuuuuccaaauaaacauuuuuuaagaaaacau

SEQ ID NO: 466256 - RNA, 64 nt, hsa
gauauuucaaacaucagcugaauucacuuaaguuuuuccaaaaccucaguuaaacugugaagcu

SEQ ID NO: 466257 - RNA, 64 nt, hsa
uguguguguguagguauuaaagauguguuguugguuuccaaaaaggaacacuggaaaauaaauu

SEQ ID NO: 466258 - RNA, 64 nt, hsa
ugugauguuaacuauuauuaauaaauuuuaacauuuuccaaaauaaucaaaugugauucaugag

SEQ ID NO: 466259 - RNA, 64 nt, hsa
ugagggagaaaaagaaaacauacauuaugaagccuuuccaaaauuaggugcuugguaaucacgu

SEQ ID NO: 466260 - RNA, 64 nt, hsa
aauacauggaaauagcuugcuauuuuuauauacauuuccaaaauauuaagauaacuuucuguaa

SEQ ID NO: 466261 - RNA, 64 nt, hsa
uugaagagaucuucucuggucagacuuggaagaauuuccaaaacugaaguuagccccaagacuu

SEQ ID NO: 466262 - RNA, 64 nt, hsa
gcaacacuguucucuucuucucuacuaaauucuauuuccaaaauugguaauagagccagaagga

SEQ ID NO: 466263 - RNA, 64 nt, hsa
cauaaugcuuaaagccauauggaguuggaaauuauuuccaaagcauauuuauuccauuguuuua

SEQ ID NO: 466264 - RNA, 64 nt, hsa
uuuauuuuccuccauucauguacuuuuccuuauauuuccaaaacuguuacugagaaugggucaa

SEQ ID NO: 466265 - RNA, 64 nt, hsa
cuuaauccaauggguuuuucccuguacaguagauuuuccaaauguaauaaacuuuaauauaaag

SEQ ID NO: 466266 - RNA, 64 nt, hsa
cccacccugggcccugggcuggaaucaggaauauuuuccaaagagugauagucuuuugcuuuug

SEQ ID NO: 466267 - RNA, 64 nt, hsa
guuuuucuuuucuauugcauagucaggcugcaaauuuccaaacuuuuaugcuuugcuucccuua

SEQ ID NO: 466268 - RNA, 64 nt, hsa
cauuuccauacaucuucugaaaacuaggcggagguuuccaaaucucaauucuugacuucugugc

SEQ ID NO: 466269 - RNA, 64 nt, hsa
cuuggaaaggagcucacucuuggaaagacugaucuuuccaaaauauuuucccuggucugaagcu

SEQ ID NO: 466270 - RNA, 64 nt, hsa
acaugaaggaggguuuugguuuuggucugcaguuuuuccaaagggcuuuuaugagauacauuuc

SEQ ID NO: 466271 - RNA, 64 nt, hsa
caugugacauauuucccuuucccauuguugcugauuuccaaaucgcugucagcaauuuuuuccu

SEQ ID NO: 466272 - RNA, 64 nt, hsa
gacaugcugggaaucuucaccccaccagggcaaauuuccaaauagcucauuuuauucuaggucu

SEQ ID NO: 466273 - RNA, 64 nt, hsa
aggauacuuuuuuaagggguugagaauugaagauuuuccaaaagcguucaugaauuuagagcau

SEQ ID NO: 466274 - RNA, 64 nt, hsa
uuucuuuuguuaagcagcacuuauguagacugcauuuccaaauguguugagcacucagagugua

SEQ ID NO: 466275 - RNA, 64 nt, hsa
gggaaaacugucuaguucccuucugugucuaaauuuuccaaaacguugauuugcauaauacagu

SEQ ID NO: 466276 - RNA, 64 nt, hsa
gcauuguagcuugcuuaacggagcacuucuccuuuuuccaaaggucuacauucuaggguguggg

SEQ ID NO: 466277 - RNA, 64 nt, hsa
aaaaaguagaaaauugaguuacaauuugauuuuuuuuccaaagaugucuguuaaaucuguugug

SEQ ID NO: 466278 - RNA, 64 nt, hsa
aggaaaaguuauaagguacagguugaguaucccuuuuccaaaaaugcuugggacaagaaguauu

SEQ ID NO: 466279 - RNA, 64 nt, hsa
uacuaagauaaucugcuuugugccaaaacaguaauuuccaaacuucuguucaccaugaaaaggc

SEQ ID NO: 466280 - RNA, 64 nt, hsa
caauuugcagaagcucacauagcaaguucauaaguuuccaaaaaggaagcccauacauaacagu

SEQ ID NO: 466281 - RNA, 64 nt, hsa
gcuuuuuuuuuuuuuuuuuuaauaaggacaccucuuuccaaacagugccaucaaauauguucuu

SEQ ID NO: 466282 - RNA, 64 nt, hsa
gauuccuccguguugugaugugaugcuggccacguuuccaaacggcagcuccacuggguccccu

SEQ ID NO: 466283 - RNA, 64 nt, hsa
uguuacagacaagcuuauuuccaaagccaccucauuuccaaacaucucacucaggaagggaggc

SEQ ID NO: 466284 - RNA, 64 nt, hsa
gucuuuguggaaaccacuguuacagacaagcuuauuuccaaagccaccucauuuccaaacaucu

SEQ ID NO: 466285 - RNA, 64 nt, hsa
ggaucccagcccacaagugaucagcagaguugcauuuccaaagaaaaaggcuaugagaugagcu

SEQ ID NO: 466286 - RNA, 64 nt, hsa
uuuuaacaaaaugaaaugauguguuaaguuuuuauuuccaaaguguuuaguuuauuggcugaug

SEQ ID NO: 466287 - RNA, 64 nt, hsa
uaacaccuacugauauucacauuaaauaguaugguuuccaaaauaugucugcacaacaagaccu

SEQ ID NO: 466288 - RNA, 64 nt, hsa
guuuguggcaauuaauugccauaaaauaacaauguuuccaaaugcaacuaagaaaauacucaua

SEQ ID NO: 466289 - RNA, 64 nt, hsa
auccuaugugauuccugcucugaaugcauuauauuuuccaaacuauacccauaaauugugacua

SEQ ID NO: 466290 - RNA, 64 nt, hsa
gagucuugguagauaagaaaaaaaucagucaauauuuccaaauaauugcaaaauaauggccagu

SEQ ID NO: 466291 - RNA, 64 nt, hsa
uggcuauuucuauguuuuauaaaccaaaacaaaauuuccaaaaacaaugaaggaaaccaaaaua

SEQ ID NO: 466292 - RNA, 64 nt, hsa
ucauguugcagaccauguuuaugguaauacacacuuuccaaaaugagccuuaaaaauuguaaag

SEQ ID NO: 466293 - RNA, 64 nt, hsa
cuaauuaaggcgagugcuccagagucgggucugcuuuccaaaguauaggacauuugaagaacug

SEQ ID NO: 466294 - RNA, 64 nt, hsa
cuguuuugucucuacuguguacucugaucguaucuuuccaaagugcagacucuugugaaguuuu

SEQ ID NO: 466295 - RNA, 64 nt, hsa
gcuugcaacgcuuacguguugaucccaguguccuuuuccaaaugagugcuguagcuuuagaagu

SEQ ID NO: 466296 - RNA, 64 nt, hsa
gaaaguaucgugaccauguggcccaccagcagccuuuccaaaggggaacuccagagacauuuca

SEQ ID NO: 466297 - RNA, 64 nt, hsa
auuguucagaagauuuuuacaaauuaaaaacugauuuccaaauauguucaacauuuacuucuau

SEQ ID NO: 466298 - RNA, 64 nt, hsa
gguaugcauuggauauagcaggaaagaaagcacauuuccaaacagcagggaguaagcuuacauu

SEQ ID NO: 466299 - RNA, 64 nt, hsa
uaacuaaaaccccuaggucauuuguagauauauauuuccaaauauucuaaaaaagauacuguau

SEQ ID NO: 466300 - RNA, 64 nt, hsa
gcuuuuuaaacugauguauagcuuuaacauuuuguuuccaaagcugaagauccccauucuuucu

SEQ ID NO: 466301 - RNA, 64 nt, hsa
gugugaaguccacuuauguagacaaaacuuauaauuuccaaacuguugucuaguauacagugau

SEQ ID NO: 466302 - RNA, 64 nt, hsa
cccugggcuuuccugaauugccaagccuggugccuuuccaaaggacuagcagggccuguggugg

SEQ ID NO: 466303 - RNA, 64 nt, hsa
uuuccacaucaccucugggauauuucagcuguuguuuccaaauggcaaaucaucaacuaaaagc

SEQ ID NO: 466304 - RNA, 64 nt, hsa
gaaagaaagguaaagagucuagaguuuauuccucuuuccaaaacauucucauuccucuccuccc

SEQ ID NO: 466305 - RNA, 64 nt, hsa
uucaugccuuuuuuuuuuuuaaguagaaaaauuguuuccaaagugcaugucacaugccacaacc

SEQ ID NO: 466306 - RNA, 64 nt, hsa
acccuaaugauuaaaccccgugagauacauaugauuuccaaauaguccauuucauuaggaacuu

SEQ ID NO: 466307 - RNA, 64 nt, hsa
cauauaucaugaucuaaugcagaugacuaggcuuuuuccaaaaggaagacagacccucagacac

SEQ ID NO: 466308 - RNA, 64 nt, hsa
auguaguguuuuaagauaauuuaaugauacuaucuuuccaaacuuuguuagauuuuaaauguau

SEQ ID NO: 466309 - RNA, 64 nt, hsa
aauaaaguagaauucuauauugauaagcaaacuauuuccaaacuaaaaaugugauagauaaaag

SEQ ID NO: 466310 - RNA, 64 nt, hsa
ccaggcaugaugcugagugacacucuuguguauauuuccaaauuuuuguacagucgcugcacau

SEQ ID NO: 466311 - RNA, 64 nt, hsa
gucgcugcacauauuugaaaucauauauuaagacuuuccaaagaugaggucccugguuuuucau

SEQ ID NO: 466312 - RNA, 64 nt, hsa
ggagaagggcacauuuaucuaggggcauuucagguuuccaaagaaaggaauguaugccugggaa

SEQ ID NO: 466313 - RNA, 64 nt, hsa
cuguuagaauguauuaggucaugggcuaacauuauuuccaaaauugauuggcugguugccaaga

SEQ ID NO: 466314 - RNA, 64 nt, hsa
uguguggguuaaaaaaagaagcuuuaacacuaauuuuccaaagguuagggaagauuccaauuaa

SEQ ID NO: 466315 - RNA, 64 nt, hsa
ggcaccuauuuggaacuuagaaaagaucuugguuuuuccaaacuggaccauccugucuuauggu

SEQ ID NO: 466316 - RNA, 64 nt, hsa
augaauugucuaauuaauuuauguagaguccuuuuuuccaaagagcucaaaacacuacauccac

SEQ ID NO: 466317 - RNA, 64 nt, hsa
caauuaagugggaacauuuuuaauuuaaaaaaaauuuccaaauauuuguggguccgacaguaau

SEQ ID NO: 466318 - RNA, 64 nt, hsa
aacuucgggccccaagccauccucccaccuuggcuuuccaaaguguugggauuacaagcgugag

SEQ ID NO: 466319 - RNA, 64 nt, hsa
acaacccccuuugguuagagaagggaaagugacuuuuccaaagcugcacagcuagacagucaua

SEQ ID NO: 466320 - RNA, 64 nt, hsa
aaaaagcauaucaaauauuuuggguacuaggcaguuuccaaaguagcaugguaguauuacuugu

SEQ ID NO: 466321 - RNA, 64 nt, hsa
cguuuuucaacuucaguuucauucacuaccauuguuuccaaauuaucaaucucugcuaguaauu

SEQ ID NO: 466322 - RNA, 64 nt, hsa
uguccaacucuccuccagguugcauuucaguuucuuuccaaaacuuauuaccuccccuaauccu

SEQ ID NO: 466323 - RNA, 64 nt, hsa
cagagccagcucaucuuccaggugcugaaaccacuuuccaaauaaacuaaagccuggauuugau

SEQ ID NO: 466324 - RNA, 64 nt, hsa
cuaauguagaaaaggcccgccuccagugcccuucuuuccaaaacagcuacacaaaugcuucuga

SEQ ID NO: 466325 - RNA, 64 nt, hsa
uugguugaguuuugguuuuuucuuuuucuuuuuuuuuccaaaaauaaagacagcccauuuuugu

SEQ ID NO: 466326 - RNA, 64 nt, hsa
gugugauuuucauacagguuauuuuuacgaucuguuuccaaaucccuuucaugucuuuccacuu

SEQ ID NO: 466327 - RNA, 64 nt, hsa
gaguggccuagagcacucucaccccaagcggccuuuuccaaaugcccaaggaugccuuagcaug

SEQ ID NO: 466328 - RNA, 64 nt, hsa
ucuuuugacauuuuggaaauaaucauaacuugucuuuccaaaauaaccauuuucuugauggaac

SEQ ID NO: 466329 - RNA, 64 nt, hsa
uugcuuguagaaaguagacuugcucuuugucagauuuccaaacaaccuugccagccuuggcugu

SEQ ID NO: 466330 - RNA, 64 nt, hsa
aaacuccugagcacuagcaauccacccaccucuguuuccaaaaaaaaaaaaaaaaugaaagguc

SEQ ID NO: 466331 - RNA, 64 nt, hsa
cauucaggagauucuuccaucugggcaaccugguuuuccaaauaucauuugaccuaagugaaug

SEQ ID NO: 466332 - RNA, 64 nt, hsa
acaugccacugucaccaaaacaaacaacuaccacuuuccaaauuucauucagaaccauuuuagu

SEQ ID NO: 466333 - RNA, 64 nt, hsa
ucuggcuucuuuuucaagguaucagggcaaacaauuuccaaacuuuucauuuuguacagaagga

SEQ ID NO: 466334 - RNA, 64 nt, hsa
acuuuuaaacuugggaaauaagcaccuguauuuuuuuccaaaacuguuuuuaaagcuguauacg

SEQ ID NO: 466335 - RNA, 64 nt, hsa
guuagugcaucaguaaauguguuauuuugucauuuuuccaaagagaguguuguagguuuucccu

SEQ ID NO: 466336 - RNA, 64 nt, hsa
ggcccuauuucauagaggcuggcccuauuagugauuuccaaaaacaauauggaagugccuuuug

SEQ ID NO: 466337 - RNA, 64 nt, hsa
caagccugguagaauuggcuuuucuagcagaaccuuuccaaaaguuuuauauugagauucauaa

SEQ ID NO: 466338 - RNA, 64 nt, hsa
uacuauuauguggaauuuaacuuuucagagaaaauuuccaaaguccucuaccuuauuuggcuuu

SEQ ID NO: 466339 - RNA, 64 nt, hsa
aaaaugaggauccuguuggugauccucauuccaguuuccaaagcgagaggagccuucugagcag

SEQ ID NO: 466340 - RNA, 64 nt, hsa
uauauauuuucaguuuuuuugccuuauugauuuuuuuccaaaaaaaaaaaacuacuaaauuaaa

SEQ ID NO: 466341 - RNA, 64 nt, hsa
uuuccucaaguuugucucucuugaccaaucauuuuuuccaaaucaaucaccagaaggagacacc

SEQ ID NO: 466342 - RNA, 64 nt, hsa
ccagauguuccacaggaccccaccaagaaggucauuuccaaacccauccuggaagggcccagga

SEQ ID NO: 466343 - RNA, 64 nt, hsa
ucuucuggcugcuggccggagacagcucuugcccuuuccaaagucacuguccacugccuugcaa

SEQ ID NO: 466344 - RNA, 64 nt, hsa
aaaaugguucugugaaaagugaaugauauguauuuuuccaaaugcuucaugguuaggagucuuc

SEQ ID NO: 466345 - RNA, 64 nt, hsa
gugaacuagugccuuuggguaucacguaaaauuuuuuccaaaggguuacuuuaaaaaucuguua

SEQ ID NO: 466346 - RNA, 64 nt, hsa
caacuaaagguauugaagguacuaauuaauuagauuuccaaaauuuucuacagagaguuaauua

SEQ ID NO: 466347 - RNA, 64 nt, hsa
ccaguggaguuggguagaaugaccaaauaauuauuuuccaaacugggauacuuuuuagagugaa

SEQ ID NO: 466348 - RNA, 64 nt, hsa
acccuuguccaaggcuuuaugcaucggauuuauuuuuccaaaucaagaggacagugauagaugc

SEQ ID NO: 466349 - RNA, 64 nt, hsa
ccagagggagcaucauaagagcccagagcuccgauuuccaaagagugauauugacauuuaugga

SEQ ID NO: 466350 - RNA, 64 nt, hsa
ggcuugucaaguuuugcaaaauaaugccagguauuuuccaaaaugaugauauucucuugaguau

SEQ ID NO: 466351 - RNA, 64 nt, hsa
uucaagaaauuauuuuaucauaucugcuucuguuuuuccaaaagguuaaaacuuguaaaaaaaa

SEQ ID NO: 466352 - RNA, 64 nt, hsa
uagugccucugaaaguugaugcagcauuuuugccuuuccaaaaaguauuuauccucacugcuuu

SEQ ID NO: 466353 - RNA, 64 nt, hsa
auucaguauaaggaaacguaauuaugauugauuuuuuccaaagaugacaagcuguguugaaaua

SEQ ID NO: 466354 - RNA, 64 nt, hsa
ucccuuaaagucuuauuugcacccuuacaaaaucuuuccaaaggucacucuuaugaauggaugu

SEQ ID NO: 466355 - RNA, 64 nt, hsa
uagucuuucaaacuguuccucagaggccuaggauuuuccaaaaguaccuuaggaaccuuguagg

SEQ ID NO: 466356 - RNA, 64 nt, hsa
uuuaacauaggugguucugugauaacaucaguguuuuccaaaucaaaggaacgcuuuaaaaaau

SEQ ID NO: 466357 - RNA, 64 nt, hsa
ucuucauaaaguucugcguuuggcaucuucacucuuuccaaaauguaucuguacaucagaaaug

SEQ ID NO: 466358 - RNA, 64 nt, hsa
guugugcuuugagucagugcaauaaacuagacuuuuuccaaaccuggccgaguguggugccuga

SEQ ID NO: 466359 - RNA, 64 nt, hsa
ggaggacuacacacauuauggaaagaccucauucuuuccaaaggaauuuauagguguagcuuga

SEQ ID NO: 466360 - RNA, 64 nt, hsa
cauuucaagugaauuauuuuaaucuuuuucucucuuuccaaaaauuuaggaauguuuaguguaa

SEQ ID NO: 466361 - RNA, 64 nt, hsa
aauaauuaaccaucuaccucuguuuuuaauuuucuuuccaaaaggcagcuugaaauguuggucc

SEQ ID NO: 466362 - RNA, 64 nt, hsa
caugggagcaacugaguagcaauaguaaauuuacuuuccaaaaaagccuuauuaaaauauaaau

SEQ ID NO: 466363 - RNA, 64 nt, hsa
gauagguuuaaacacacagagacacacacacacguuuccaaagugcagcagugucucuuucagu

SEQ ID NO: 466364 - RNA, 64 nt, hsa
cuaugauucuuucugcauuuucgguuaacuaucauuuccaaagacuugucauucaguaauauua

SEQ ID NO: 466365 - RNA, 64 nt, hsa
ugucaugaaaucauuccagauaccucuuuucuucuuuccaaaugguuuucacauguguuugaaa

SEQ ID NO: 466366 - RNA, 64 nt, hsa
ggacguggucuccagcuucuucauccugccagaguuuccaaauggagcccggggcucugcagca

SEQ ID NO: 466367 - RNA, 64 nt, hsa
cucaucuuaacuaauuauaucaucaaaacccguguuuccaaauaaggucacauucugaggucug

SEQ ID NO: 466368 - RNA, 64 nt, hsa
auaaguuauggguuuuuauguuuuguuuuguguuuuuccaaaacuugaacuugcaggcaagccu

SEQ ID NO: 466369 - RNA, 64 nt, hsa
acauuuuaaggaugucacuauggcacuguugucauuuccaaauuccuagaaaaguuuguuuuac

SEQ ID NO: 466370 - RNA, 64 nt, hsa
ugcuuuguggcuuaguaaacuacucuguggaugauuuccaaacauucaaagccaauagccuugu

SEQ ID NO: 466371 - RNA, 64 nt, hsa
ccugccagcccuucccagucucauuagaggaagcuuuccaaaguucucaguuaucaagaccuca

SEQ ID NO: 466372 - RNA, 64 nt, hsa
gaaaaucccucccauguagacauguugcacauuuuuuccaaauuuauacauggaacugcaguag

SEQ ID NO: 466373 - RNA, 64 nt, hsa
auuguuaaaguugucacuuguguaacugacugcuuuuccaaaacugguacuuaugugaacuguu

SEQ ID NO: 466374 - RNA, 64 nt, hsa
aauuuauauuuuuaaagcaaguuguugcuuaucuuuuccaaaaagugaaaaauguuaaaacaga

SEQ ID NO: 466375 - RNA, 64 nt, hsa
gcuacaauuaggucuuugucagacauucuggagguuuccaaaaauaauauuguaaaguucaauu

SEQ ID NO: 466376 - RNA, 64 nt, hsa
cguaaacacuugacuauaaaaacugccccccuccuuuccaaauaagugcauuuauugccucuau

SEQ ID NO: 466377 - RNA, 64 nt, hsa
gagaugucuuaaccuauucccaaaugccuucuguuuuccaaaggaguggucaagcccuugccca

SEQ ID NO: 466378 - RNA, 64 nt, hsa
uccccuccccguccacagggcagccugagcgugcuuuccaaaacccaaauauggccacgcuccc

SEQ ID NO: 466379 - RNA, 64 nt, hsa
gcccccacccaguccugcacacuugguccauccauuuccaaaccuccacugcugcucccggguc

SEQ ID NO: 466380 - RNA, 64 nt, hsa
acucauagugagcuuauucuuauuuuggauugauuuuccaaaaccacagcuucagcagcaacaa

SEQ ID NO: 466381 - RNA, 64 nt, hsa
uuguuguguuuuaagacuuguauauaaacugcuuuuuccaaacucuguauaacuuuuaaauggc

SEQ ID NO: 466382 - RNA, 64 nt, hsa
uucgggacgcggcggcugcaguuucacccccgaauuuccaaacggaguuucgcucucguugccg

SEQ ID NO: 466383 - RNA, 64 nt, hsa
ugcaauagguucucuuugggaccuaaugacucauuuuccaaaaauccgcuucuacuuuugguac

SEQ ID NO: 466384 - RNA, 64 nt, hsa; identical to SEQ ID NO: 349054

SEQ ID NO: 466385 - RNA, 64 nt, hsa; identical to SEQ ID NO: 349055

SEQ ID NO: 466386 - RNA, 64 nt, hsa; identical to SEQ ID NO: 349056

SEQ ID NO: 466387 - RNA, 64 nt, hsa; identical to SEQ ID NO: 349057

SEQ ID NO: 466388 - RNA, 64 nt, hsa; identical to SEQ ID NO: 349058

SEQ ID NO: 466389 - RNA, 64 nt, hsa; identical to SEQ ID NO: 349059

SEQ ID NO: 466390 - RNA, 64 nt, hsa; identical to SEQ ID NO: 349060

SEQ ID NO: 466391 - RNA, 64 nt, hsa; identical to SEQ ID NO: 349061

SEQ ID NO: 466392 - RNA, 64 nt, hsa; identical to SEQ ID NO: 349062

SEQ ID NO: 466393 - RNA, 64 nt, hsa; identical to SEQ ID NO: 349063

SEQ ID NO: 466394 - RNA, 64 nt, hsa; identical to SEQ ID NO: 349064

SEQ ID NO: 466395 - RNA, 64 nt, hsa; identical to SEQ ID NO: 349065

SEQ ID NO: 466396 - RNA, 64 nt, hsa; identical to SEQ ID NO: 349066

SEQ ID NO: 466397 - RNA, 64 nt, hsa; identical to SEQ ID NO: 349067

SEQ ID NO: 466398 - RNA, 64 nt, hsa; identical to SEQ ID NO: 349068

SEQ ID NO: 466399 - RNA, 64 nt, hsa; identical to SEQ ID NO: 349069

SEQ ID NO: 466400 - RNA, 64 nt, hsa
aaucgcucagagaugagauccuuuaauugaaaacgaaguguaacggaaucuagugucuuucuaa

SEQ ID NO: 466401 - RNA, 64 nt, hsa
agaguuuguuuuaaaauuuuuaauugaagcaugugaaguguaccugcagaaaagugggaacaug

SEQ ID NO: 466402 - RNA, 64 nt, hsa
cauggauguguguugcaggguggagaaguggggagaaguguauaguaguacacggggggaagag

SEQ ID NO: 466403 - RNA, 64 nt, hsa
ugccacucacuuuuuguugguucugaaucuuccugaaguguacugacauuugggcugcacagag

SEQ ID NO: 466404 - RNA, 64 nt, hsa; identical to SEQ ID NO: 114045

SEQ ID NO: 466405 - RNA, 64 nt, hsa; identical to SEQ ID NO: 114046

SEQ ID NO: 466406 - RNA, 64 nt, hsa; identical to SEQ ID NO: 114047

SEQ ID NO: 466407 - RNA, 64 nt, hsa; identical to SEQ ID NO: 114048

SEQ ID NO: 466408 - RNA, 64 nt, hsa; identical to SEQ ID NO: 114049

SEQ ID NO: 466409 - RNA, 64 nt, hsa; identical to SEQ ID NO: 114050

SEQ ID NO: 466410 - RNA, 64 nt, hsa; identical to SEQ ID NO: 114051

SEQ ID NO: 466411 - RNA, 64 nt, hsa; identical to SEQ ID NO: 114052

SEQ ID NO: 466412 - RNA, 64 nt, hsa; identical to SEQ ID NO: 114053

SEQ ID NO: 466413 - RNA, 64 nt, hsa; identical to SEQ ID NO: 114054

SEQ ID NO: 466414 - RNA, 64 nt, hsa; identical to SEQ ID NO: 114055

SEQ ID NO: 466415 - RNA, 64 nt, hsa; identical to SEQ ID NO: 114056

SEQ ID NO: 466416 - RNA, 64 nt, hsa; identical to SEQ ID NO: 114057

SEQ ID NO: 466417 - RNA, 64 nt, hsa
ugauuugcuauuuugccuagagcuuuguccuucuagaucugauuggcuguaaguaucucuacug

SEQ ID NO: 466418 - RNA, 64 nt, hsa
gauuagagggggauuuuugaugggagaaagcuggagaucugaacccagcccauuugcacacuau

SEQ ID NO: 466419 - RNA, 64 nt, hsa
gggcugcugaaaucgcagagacuuuugcagcaucagaucugaggaguaaaacggcaccucuggc

SEQ ID NO: 466420 - RNA, 64 nt, hsa
aauaucuuuauuagaccuggggcuaaccaggugaagaucugagcccagaaaugacccuuccucc

SEQ ID NO: 466421 - RNA, 64 nt, hsa
uaggguucuuccaugggcuuacugacaguugcccagaucugaaggggaaagggucuugagaaag

SEQ ID NO: 466422 - RNA, 64 nt, hsa
accucuacguuauuuugcugcuaugugcauuuccagaucugauuuucugcuaacuugugugcua

SEQ ID NO: 466423 - RNA, 64 nt, hsa
accagaauagcuuuaaaaagacaaaaaggaucguagaucugauuuuuaaaugguugguugcucu

SEQ ID NO: 466424 - RNA, 64 nt, hsa
uagaucugauuuuuaaaugguugguugcucugacagaucugaacacuuugcuucaugacuauuu

SEQ ID NO: 466425 - RNA, 64 nt, hsa
aguugcauagcugcuuugcagugguuucagaggcagaucugagaagauuaaaaaaaaaucucaa

SEQ ID NO: 466426 - RNA, 64 nt, hsa
gguugaaugauagcauuucacucugcguucuccuagaucugagcaagcugucaguucucacccc

SEQ ID NO: 466427 - RNA, 64 nt, hsa
acugagaaauaagauugacuuugaaucugcaacaagaucugaaauaaaugagaagccaagcucu

SEQ ID NO: 466428 - RNA, 64 nt, hsa
uauguuuggaucauuaaauaccuauaugaauaugagaucugaagcacgucaaguugaaauuagg

SEQ ID NO: 466429 - RNA, 64 nt, hsa
gauuucuuuguauacuuguauuaguauuucuguaagaucugagaaguggaauuuguagggucau

SEQ ID NO: 466430 - RNA, 64 nt, hsa
uauucaccaguggauuuacccuuagaguauuuuuagaucugagcugaugacuugugagagaaaa

SEQ ID NO: 466431 - RNA, 64 nt, hsa
uuaggcaauggucuauauaagcaaaaggagauagagaucugaaauaauuuuccgaauaauucag

SEQ ID NO: 466432 - RNA, 64 nt, hsa
cauuauuucaaauugcuugucaaaauggcccaaaagaucugaauucacauuaaguuccccuugc

SEQ ID NO: 466433 - RNA, 64 nt, hsa
ccuguaaggauucauggauaaaaugaacaggaauagaucugaauaaagcaaaucugcauaaaug

SEQ ID NO: 466434 - RNA, 64 nt, hsa
acuuaaaauucuugagcacguuaauauguuuuuaagaucugauuaucuuugagagaucuucugu

SEQ ID NO: 466435 - RNA, 51 nt, hsa
cuaaaccuguggagaagugagagaucugaauuuggagaggacauggggaag

SEQ ID NO: 466436 - RNA, 64 nt, hsa
acagauaaucuuuaaguacagacccaggaauaucagaucugaaguggcaccaucuuuucugucu

SEQ ID NO: 466437 - RNA, 64 nt, hsa
ccucaugcuguucuugugauggugaguucucaugagaucugauggguguuuuuuuuuguuuugu

SEQ ID NO: 466438 - RNA, 64 nt, hsa
gggauuacaggcgugagccacugcuccuggcccaagaucugaugguuuuguaagggaauuuucc

SEQ ID NO: 466439 - RNA, 64 nt, hsa
aaugauaacagugaggaaauuaugacagugaaagagaucugaccuaacuaucuaucuugccucg

SEQ ID NO: 466440 - RNA, 63 nt, hsa
ugauuagguuacggaaaugaacuggcuggaugaagaucugauuuagaaagacugcgugagucu

SEQ ID NO: 466441 - RNA, 64 nt, hsa
gagcacaguaauuaugaccuuuuuguuuuggcuacaacuugauugaaacaaguucaaaauuuaa

SEQ ID NO: 466442 - RNA, 64 nt, hsa
uaaaugauggguuuguugguauuuaaaaugaauacaacuugaauguaauuaaagugcuguuuuu

SEQ ID NO: 466443 - RNA, 64 nt, hsa
ucuccugcucuguccauuuccuaugaacuaaugacaacuugagaaggcugggaggauuguguau

SEQ ID NO: 466444 - RNA, 64 nt, hsa
guauuucacuuuuucuguuauuuucaauuuauuacaacuugacagcuccaagcucuuauuacua

SEQ ID NO: 466445 - RNA, 64 nt, hsa
ugucugguucuugguauuuacuguauguaagcaacaacuugaaagguggcaauauggugucgau

SEQ ID NO: 466446 - RNA, 64 nt, hsa
gcuaaaaaaaaaaacggguggaguuuggacugaucaacuugagauuuaaaaacugcuauuccuu

SEQ ID NO: 466447 - RNA, 64 nt, hsa
ugaaugaacugcuggggcagugguaugugccuuucaacuugauaauuugggggacauuuucaua

SEQ ID NO: 466448 - RNA, 64 nt, hsa
cuaaaagcacaacuaaaauuucacaugcuaacgacaacuugaaugaacugcuggggcaguggua

SEQ ID NO: 466449 - RNA, 64 nt, hsa
auucuaaaucacuuuaauuuagaagauaggugagcaacuugagugaucccaaaccaaacuaaca

SEQ ID NO: 466450 - RNA, 64 nt, hsa
ggauauagcaacaucuuuugauaauugugcuuuacaacuugaaugcugauucaaggcauuauuu

SEQ ID NO: 466451 - RNA, 64 nt, hsa
uggagguaauacauacauaguaucaauauuguuucaacuugauguccucuaagcuaucauccag

SEQ ID NO: 466452 - RNA, 64 nt, hsa
uuuugacuuaguguccugucccccuuggacguuccaacuugacuuaguguccagugccccuugg

SEQ ID NO: 466453 - RNA, 64 nt, hsa
ccccaagcuucccucggagaagugagaggcucucccuggcuagauccucaucucaauagcaccu

SEQ ID NO: 466454 - RNA, 64 nt, hsa
aggcaaucaccugaggucaggaguucaagaccagccuggcuaacaugugaaacuaauaauaaua

SEQ ID NO: 466455 - RNA, 64 nt, hsa
cggguggaucacgaggucaggagaucgagaccauccuggcuaacacagugaaacguguuuuuac

SEQ ID NO: 466456 - RNA, 64 nt, hsa
ggggcggaucgugaagucaggagaucgagaccauccuggcuaacauggugaaacccugucucua

SEQ ID NO: 466457 - RNA, 64 nt, hsa
cgaguagggaggaccacaggugugagccaccacaccuggcuaauuuuuacuuuuuuuuuuuuuu

SEQ ID NO: 466458 - RNA, 64 nt, hsa
ucuaggguaugggaaauccaaucagagaccaggcccuggcuaagacccaaacauaugcacauuc

SEQ ID NO: 466459 - RNA, 64 nt, hsa
caaguagccaggacuauaggcaccugccaccaugccuggcuaauuuuuguauuuuuuuucuuuc

SEQ ID NO: 466460 - RNA, 64 nt, hsa
caaguagcuaggacuacaggagcacaccaccacaccuggcuaauuuuuguauuuuuuguggaga

SEQ ID NO: 466461 - RNA, 64 nt, hsa
agagcuccaccguauuagcuccauuagcuuggagccuggcuagcaacacucacugucaguuagg

SEQ ID NO: 466462 - RNA, 64 nt, hsa
cugaguaacuggaacuacaggugugcacuccucgccuggcuaauuuuuuauuuuuuguacaggc

SEQ ID NO: 466463 - RNA, 64 nt, hsa
ugaguagcuaggacuacagaugcucgccaccacaccuggcuaauuuuuuuuuuuugagacugag

SEQ ID NO: 466464 - RNA, 64 nt, hsa
ugaguagcugggauuacaggcgugugccaccaugccuggcuaacuuuuguauuuuuaguagaga

SEQ ID NO: 466465 - RNA, 64 nt, hsa
ugagacuuaagggaacugaaucacuuaaaugucaccuggcuaacugauggcagagccagagcuu

SEQ ID NO: 466466 - RNA, 64 nt, hsa
cgaguagcugggauuacaggcacacacuaccacgccuggcuaauuuuuguauuuuuauuauaga

SEQ ID NO: 466467 - RNA, 64 nt, hsa
gacccaggaagggcagcuccagccagaggaccuuccuggcuaugcaggugcacagcucuuaggc

SEQ ID NO: 466468 - RNA, 64 nt, hsa
guccagcugcuaagaucccuucaucugcacaagcccuggcuagauaugugugaauguguggcau

SEQ ID NO: 466469 - RNA, 64 nt, hsa
caaguagcuaggauuacaagugccugccacuaugccuggcuaauuuuuguuuuucguagagaug

SEQ ID NO: 466470 - RNA, 64 nt, hsa
cgaguaguugggauuagaggcauaguccagcacgccuggcuaauuuuguauuuuuaguagagac

SEQ ID NO: 466471 - RNA, 64 nt, hsa
ggaaagcccugcuuugcuccaggcuccaagaucuccuggcuaagucagcaagugagaaaaugug

SEQ ID NO: 466472 - RNA, 64 nt, hsa
gcugauuuuuuccaaagucuaaagacugagcucaccuggcuagauuguuguguguuuuguugaa

SEQ ID NO: 466473 - RNA, 64 nt, hsa
gcgugccaggcaacagugggcagacaaagggcucccuggcuacugggaagauacagaaccaucc

SEQ ID NO: 466474 - RNA, 64 nt, hsa
cagguagaucaugaggucaggagaucaaaaccauccuggcuaacauggugaaaccccaucucua

SEQ ID NO: 466475 - RNA, 64 nt, hsa
ugggaugggcugggaucuucucugugaauccaccccuggcuacccccacccuggcuaccccaac

SEQ ID NO: 466476 - RNA, 64 nt, hsa
ucuucucugugaauccaccccuggcuacccccacccuggcuaccccaacggcaucccaaggcca

SEQ ID NO: 466477 - RNA, 64 nt, hsa
gggcuccacugggccccuggccucgggagcggccccuggcuaugcacccccaccauuccuacac

SEQ ID NO: 466478 - RNA, 64 nt, hsa
agcccagcagcccuucgugaauccugcacugccaccuggcuauagcuacacuggucuucccuac

SEQ ID NO: 466479 - RNA, 64 nt, hsa
cgaguagcugggauuaccggcacccaccaccacgccuggcuaauuuuucaauuuucuuuuucag

SEQ ID NO: 466480 - RNA, 64 nt, hsa
gcaguuuugccucaggugcugaacauuucucagcccuggcuaaaagggagcagcacagggagag

SEQ ID NO: 466481 - RNA, 64 nt, hsa
agcuuaagguagaggugcaggauuagcaagcccaccuggcuaccaggccgacagcuacauccuc

SEQ ID NO: 466482 - RNA, 64 nt, hsa
uccuguugggaaagaauaaaauuagcuugagcaaccuggcuaagauagaggggcucugggagac

SEQ ID NO: 466483 - RNA, 64 nt, hsa
aaugagagaaugguacuuagggauggaaaacgggccuggcuagagcuucgggugugugugucug

SEQ ID NO: 466484 - RNA, 64 nt, hsa
aggcgggcggaucacaaagucaggacgagaccauccuggcuaacacggugaaacccugucucua

SEQ ID NO: 466485 - RNA, 64 nt, hsa
cagguaacugggacuacaggcaugcaccaccaugccuggcuaauuuuuguauuuuauguagaga

SEQ ID NO: 466486 - RNA, 64 nt, hsa
ccaguagcugggauuacaggugugcaccaccacgccuggcuaaauuuuguauuuuuaguacaga

SEQ ID NO: 466487 - RNA, 64 nt, hsa
caaguaggugggacuccaggcaugcaccaccaugccuggcuaauuuuugcauuuuuaguagaga

SEQ ID NO: 466488 - RNA, 64 nt, hsa
caagcagcugggacuacagguaccugccaccacgccuggcuaauuuuguuuuuguauuuuuagu

SEQ ID NO: 466489 - RNA, 64 nt, hsa
ccuugacgacaagaccaccaacguguccuuguacccuggcuacaacuucagguaacuccaaggc

SEQ ID NO: 466490 - RNA, 64 nt, hsa
ggcagaucaccugaggucgggaguuggagacccgccuggcuaacaaggcgaaauccugucugua

SEQ ID NO: 466491 - RNA, 64 nt, hsa
ccagauagcugggccacaggcgugugccaccacaccuggcuaacuuuuuuuuuuuuuuuuuuuu

SEQ ID NO: 466492 - RNA, 64 nt, hsa
ccaguagcugggacuacaggcgccugccaacaugccuggcuaauuuuuuuuuuuuguauuuuua

SEQ ID NO: 466493 - RNA, 64 nt, hsa
cuuccucccuucagucaguguccccaggguccagccuggcuagaguuagaaggcagaccuagcc

SEQ ID NO: 466494 - RNA, 64 nt, hsa
cgggcggaucacgaggucaggagaucgagaccauccuggcuaacguggugaaaccccaucucua

SEQ ID NO: 466495 - RNA, 64 nt, hsa
ggaggagcugguaucacaggcgucccccaccacgccuggcuaaauuuuguauuuuuaggugguc

SEQ ID NO: 466496 - RNA, 64 nt, hsa
caaguagcugggauuacaggcauguacuaccaugccuggcuaauuuucuuguaguuuuaguagg

SEQ ID NO: 466497 - RNA, 64 nt, hsa
aguggaucaccuaaggucagaaguucaagagcacccuggcuaacauggugaaaccccaucucua

SEQ ID NO: 466498 - RNA, 64 nt, hsa
cgggcccaugacaaggucaggagaucgagaccguccuggcuaacacggugaaaccccaucucua

SEQ ID NO: 466499 - RNA, 64 nt, hsa
ggcagaucaccugagaucaaguauuugagaacagccuggcuaacauggcgaauccucguuuuga

SEQ ID NO: 466500 - RNA, 64 nt, hsa
caagagcaucacgaggucaggagaucgagaaaauccuggcuaacacggugaaaccccaucucua

SEQ ID NO: 466501 - RNA, 64 nt, hsa
cgggcggaucaugaggucaggagaucgcgaccauccuggcuaacagugaaacccugucuccacu

SEQ ID NO: 466502 - RNA, 64 nt, hsa
cagguagaucacaaggucaggaaauugagaccauccuggcuaauacagugaaaccccaugucug

SEQ ID NO: 466503 - RNA, 64 nt, hsa
aguuaggagggacagacagcucuuccuuucggagccuggcuagucuaggacaucaccuugcugu

SEQ ID NO: 466504 - RNA, 64 nt, hsa
gucuacugugccucaggauaaggacccgccaugcccuggcuagacagugugugguuaguaggaa

SEQ ID NO: 466505 - RNA, 64 nt, hsa
uaugaaccagccccacagccccaggccccugucaccuggcuaugcccacucaucccacccgucu

SEQ ID NO: 466506 - RNA, 64 nt, hsa
caaguagcugggauuacaggcaugcaccaccaugccuggcuaauuuuguauuuuuaguagagau

SEQ ID NO: 466507 - RNA, 64 nt, hsa
aaaugagcugggugugaugauacaugccuguaauccuggcuacuugggaggcugaggcaugaga

SEQ ID NO: 466508 - RNA, 64 nt, hsa
gugggcggaucacgaggucaggagauugagaccuccuggcuaacacggugaaaccccgucuuua

SEQ ID NO: 466509 - RNA, 64 nt, hsa
cgaguagcugggauuacaggcaugcaccaccacaccuggcuaauuuuuguguuuuuaguagaga

SEQ ID NO: 466510 - RNA, 64 nt, hsa
cgaguagcugagauuauaggcgugcaccaccacaccuggcuaauuuuuguauuuuuaguagaga

SEQ ID NO: 466511 - RNA, 64 nt, hsa
cagggcugggaggaccccagugcccuccucagaagaagcacaugggcuccugcagcccuguccu

SEQ ID NO: 466512 - RNA, 64 nt, hsa
cccuuggugcuuuagugcaagaagccuaggcucagaagcacagcagcgccaucuuuccguuuca

SEQ ID NO: 466513 - RNA, 64 nt, hsa
ccugcaggguaguaacccagugauguuucuuacagaagcacaauauguugaaaauccugggugu

SEQ ID NO: 466514 - RNA, 64 nt, hsa
gagugcuuuguggcuuugggguccucugggagcugaagcacacggccauguuggagagcaaaac

SEQ ID NO: 466515 - RNA, 64 nt, hsa
aucacagccuagaguuaaguaaagucaauucacagaagcacaauuuugcccuuugcgagacauu

SEQ ID NO: 466516 - RNA, 59 nt, hsa; identical to SEQ ID NO: 214912

SEQ ID NO: 466517 - RNA, 64 nt, hsa
agcugggaaggccgcaagaggcauagagggagaggaagcacacugcagggcugcuguggcccag

SEQ ID NO: 466518 - RNA, 64 nt, hsa
ugagacggagaccccgguggcaguggaaaaaucagaagcacaaaggaaaacucuuggccucugc

SEQ ID NO: 466519 - RNA, 64 nt, hsa
aaugugccuuaaaaaucaagacacuaguucagaggaagcacauaauguccagaucuauggcgaa

SEQ ID NO: 466520 - RNA, 64 nt, hsa
ggaggcugcagcgcccggugcucugugucaaggugaagcacauacggcagaccucuuagagucc

SEQ ID NO: 466521 - RNA, 64 nt, hsa
aggguuugagagcccgcgugcuggagaauugacugaagcacagcaccgggggagagggacacuc

SEQ ID NO: 466522 - RNA, 64 nt, hsa
cacgcagaccugcagcgggcaaagagcucccgaggaagcacagcuugggucagguucuugccuu

SEQ ID NO: 466523 - RNA, 64 nt, hsa
aagcaagaaagagggucccagggcugcaaaacuggaagcacagccucggggauggggagggaaa

SEQ ID NO: 466524 - RNA, 64 nt, hsa
ucaaccagaagagugcgcugcaggugcacaugaagaagcacacgggggagcggcccuacaagug

SEQ ID NO: 466525 - RNA, 64 nt, hsa
aaucuguguucagguccaggguuacauaauugcagaagcacaagccauacaucgcagguaggaa

SEQ ID NO: 466526 - RNA, 64 nt, hsa
cuggcugaacucugggagugugucccagcugagggaagcacaaguagcaaagcucauuggucug

SEQ ID NO: 466527 - RNA, 64 nt, hsa
agggucauuagcuuugggaauagaaggcuacacagaagcacacuguuuuugaacuugacaacag

SEQ ID NO: 466528 - RNA, 64 nt, hsa; identical to SEQ ID NO: 71314

SEQ ID NO: 466529 - RNA, 64 nt, hsa; identical to SEQ ID NO: 71315

SEQ ID NO: 466530 - RNA, 64 nt, hsa; identical to SEQ ID NO: 71316

SEQ ID NO: 466531 - RNA, 64 nt, hsa; identical to SEQ ID NO: 71317

SEQ ID NO: 466532 - RNA, 64 nt, hsa
caccccuucccacggcgugucccacggccagacacaugcacacacaucacacccucaaacaccc

SEQ ID NO: 466533 - RNA, 64 nt, hsa
guguaugcguaugcauacacaccacacacacacacaugcacaagucaugugcgaacagcccucc

SEQ ID NO: 466534 - RNA, 64 nt, hsa
agucggccaagauguacuucucugugugcacacccaugcacacucaugcacacagauacauagg

SEQ ID NO: 466535 - RNA, 64 nt, hsa
gauguacuucucugugugcacacccaugcacacucaugcacacagauacauaggucuguauggc

SEQ ID NO: 466536 - RNA, 64 nt, hsa
aaucauuuugacugcauacaaacuaugucucugacaugcacauacacugcuuuauaaugaaaau

SEQ ID NO: 466537 - RNA, 64 nt, hsa
uacacguccacaccacucaccacacauacauacacaugcacacacacacacaugcaauucuacc

SEQ ID NO: 466538 - RNA, 64 nt, hsa
uuugcaggaguuccuuucccuccgaacgcugcuccaugcacaggaaaagggcauuuuguacaau

SEQ ID NO: 466539 - RNA, 64 nt, hsa
aaaaaaaaauauguguacacauaugaacgcacaacaugcacauucauccucacauguggcacgu

SEQ ID NO: 466540 - RNA, 64 nt, hsa
cuuuagaaguuaaauacaugcaugcacaugaaaacaugcacaaccacagccucaaucuuguauu

SEQ ID NO: 466541 - RNA, 64 nt, hsa
gugaugaaaaagggcuuuagaaguuaaauacaugcaugcacaugaaaacaugcacaaccacagc

SEQ ID NO: 466542 - RNA, 64 nt, hsa
gugcucccugaaggcacacguacgcacacacgcacaugcacagauaugccgccugggcacacag

SEQ ID NO: 466543 - RNA, 64 nt, hsa
acacacgcagacaugcuguccggacacacacacgcaugcacagauaugcuguccggacacacac

SEQ ID NO: 466544 - RNA, 64 nt, hsa
ggacacacacaugugcacagauaugcugucuggacaugcacacacgugcagauaugcuguccgg

SEQ ID NO: 466545 - RNA, 64 nt, hsa
agauaugcugccugggcacacacuuccggacacacaugcacacacaggugcagauaugcugccu

SEQ ID NO: 466546 - RNA, 64 nt, hsa
uuauuguaauaccucacagacguuguaccauauccaugcacauuuaguugccugccuguggcug

SEQ ID NO: 466547 - RNA, 64 nt, hsa
uuuuaacacucuacauuucccuuguuuuuuaacucaugcacaugugcucuuuguacaguuuuaa

SEQ ID NO: 466548 - RNA, 64 nt, hsa
aggaaagcagccccuccucacacauacaugugcacaugcacacacaugcaugcacacacaugca

SEQ ID NO: 466549 - RNA, 64 nt, hsa
uccucacacauacaugugcacaugcacacacaugcaugcacacacaugcacacauacacgcaca

SEQ ID NO: 466550 - RNA, 64 nt, hsa
uacaugugcacaugcacacacaugcaugcacacacaugcacacauacacgcacaugcacacaua

SEQ ID NO: 466551 - RNA, 64 nt, hsa
cacaugcaugcacacacaugcacacauacacgcacaugcacacauacacaugcaugcacacaua

SEQ ID NO: 466552 - RNA, 64 nt, hsa
ugcacacauacacgcacaugcacacauacacaugcaugcacacauacacaggcauacaugcaug

SEQ ID NO: 466553 - RNA, 64 nt, hsa
uacacaugcaugcacacauacacaggcauacaugcaugcacacacacaugcacgcacacacaca

SEQ ID NO: 466554 - RNA, 64 nt, hsa
uacaugcaugcacacacacaugcacgcacacacacaugcacacauacacgugcacacauacaca

SEQ ID NO: 466555 - RNA, 64 nt, hsa
cacauacacgugcacacauacacaggcacacaugcaugcacacauacacaugcacacacacaug

SEQ ID NO: 466556 - RNA, 64 nt, hsa
cacauacacaggcacacaugcaugcacacauacacaugcacacacacaugcacacauauaugca

SEQ ID NO: 466557 - RNA, 64 nt, hsa
cacacaugcaugcacacauacacaugcacacacacaugcacacauauaugcacaggcacacaca

SEQ ID NO: 466558 - RNA, 64 nt, hsa
auguacgcacacacacaugcacugcacacauauccaugcacacaaacacauauauacacaugca

SEQ ID NO: 466559 - RNA, 64 nt, hsa
cacacauauccaugcacacaaacacauauauacacaugcacauacacagauuuuucugcuggcc

SEQ ID NO: 466560 - RNA, 64 nt, hsa
ggcuuauuuauauauauguguguguauauaaauacaugcacacacuugcauacauauauauuuu

SEQ ID NO: 466561 - RNA, 64 nt, hsa
uagcaacugaacaaaagcucagguuuguccuggucaugcacaugccuuaagccaguuccgucuu

SEQ ID NO: 466562 - RNA, 64 nt, hsa
uuguccuguguccuuagugaugugugugugucuccaugcacaugcacgccgggauuccucugcu

SEQ ID NO: 466563 - RNA, 64 nt, hsa
cugccauuugaauuagaagaaaauaauuuauaugcaugcacaggaagauauugguggccggugg

SEQ ID NO: 466564 - RNA, 64 nt, hsa
ccucugccagccaccuaagcccugcguacauucacaugcacacauggaagaauguuuaucggcu

SEQ ID NO: 466565 - RNA, 64 nt, hsa
uaugagagacagagcuccaggcaugucccauccccaugcacaugugguaacacacaccuguauc

SEQ ID NO: 466566 - RNA, 64 nt, hsa
acccuucauacacacacgcacgcacgcacacaaacaugcacacacgcaugcacacacacaaagc

SEQ ID NO: 466567 - RNA, 64 nt, hsa
cacacgcacgcacgcacacaaacaugcacacacgcaugcacacacacaaagccuuaagcagaag

SEQ ID NO: 466568 - RNA, 64 nt, hsa
aucuuacucccucguacaugcacaaauacacacucaugcacacacacacucacacacaugcaua

SEQ ID NO: 466569 - RNA, 64 nt, hsa
ccccuucaccuuugagugaucuuacucccucguacaugcacaaauacacacucaugcacacaca

SEQ ID NO: 466570 - RNA, 64 nt, hsa
acccaccacaaacgugcaagcuccugcacacaugcaugcacacaaacguguacacaagugugag

SEQ ID NO: 466571 - RNA, 64 nt, hsa
cacagcagagagacguaugagcuucuacugcacacaugcacacacacacgcacacguacauuca

SEQ ID NO: 466572 - RNA, 64 nt, hsa
ggacacaccccaaacacgcacaggcuccuacacacaugcacacacguguacaccacaaacgagc

SEQ ID NO: 466573 - RNA, 64 nt, hsa
acacgucucccacacgugagcucccacacguacacaugcacauguacgcaccacaaacacaugc

SEQ ID NO: 466574 - RNA, 64 nt, hsa
cacaugcgcaggcuccugcaggcgugaauacacacaugcacacacauauacacacaugugccac

SEQ ID NO: 466575 - RNA, 64 nt, hsa
uggguauggaccaggggcuuguugagagcugagccaugcacacaggugcagacaccccccaacu

SEQ ID NO: 466576 - RNA, 64 nt, hsa
gccaugcacacaggugcagacaccccccaacucccaugcacacggcuaguccaggcgccuccac

SEQ ID NO: 466577 - RNA, 64 nt, hsa
gcuccuucaguuguuuuuauaaugggcguuuucacaugcacauauguguaugcauguauacgcc

SEQ ID NO: 466578 - RNA, 64 nt, hsa
cacauauguguaugcauguauacgcccauacagacaugcacacacagacuccuacuccauuagc

SEQ ID NO: 466579 - RNA, 64 nt, hsa
ggggaaagcaaucauugguguguauguguaugugcaugcacacacgugcauauacacauuugug

SEQ ID NO: 466580 - RNA, 64 nt, hsa
acuuagguucuggugaagggagacaaucagugcacaugcacacaccccacacgcauacacacau

SEQ ID NO: 466581 - RNA, 64 nt, hsa
augcacacaccccacacgcauacacacaugaacacaugcacaugugcacacacaaguaagaugg

SEQ ID NO: 466582 - RNA, 56 nt, hsa
uugggaagauugccuuguagagguagcaugcacaggaugguaaauuggauuggugg

SEQ ID NO: 466583 - RNA, 64 nt, hsa
ggagcacgcguggcuccuggaggacuuggagaugcaugcacauuuaggguguuuucccuagaau

SEQ ID NO: 466584 - RNA, 64 nt, hsa
gagcacacugcacacaugcacacacacacgcgugcaugcacacuccucgcacuuccagccuugg

SEQ ID NO: 466585 - RNA, 64 nt, hsa
acagcacacacaagugcacagagcacacugcacacaugcacacacacacgcgugcaugcacacu

SEQ ID NO: 466586 - RNA, 64 nt, hsa
acaugcacacacaaagugcauaggccacacagcacaugcacacaggugcacagaccacacagca

SEQ ID NO: 466587 - RNA, 64 nt, hsa
uacacaagugcacagaccacacacagcacuaacacaugcacacacaaagugcauaggccacaca

SEQ ID NO: 466588 - RNA, 64 nt, hsa
gcacgcuuacauguacacgugcacagaucacacacaugcacacacguguagcucacacacagua

SEQ ID NO: 466589 - RNA, 64 nt, hsa
agcacacaugugcacugaccacaccuguauagaccaugcacaguacacauacgugcauacacau

SEQ ID NO: 466590 - RNA, 64 nt, hsa
uccgcauacaggcguacacaugcacgcuugcacacaugcacacagaccacauagcacacaugug

SEQ ID NO: 466591 - RNA, 64 nt, hsa
augcaguucuguggugcugcucggggauggacuccaugcacaguccacuucuugacacauucuc

SEQ ID NO: 466592 - RNA, 64 nt, hsa
accgccacuacugcagcucagugcccagcggccgcaugcacaccucccggccccuccucagcag

SEQ ID NO: 466593 - RNA, 64 nt, hsa; identical to SEQ ID NO: 415214

SEQ ID NO: 466594 - RNA, 64 nt, hsa; identical to SEQ ID NO: 415215

SEQ ID NO: 466595 - RNA, 64 nt, hsa; identical to SEQ ID NO: 415216

SEQ ID NO: 466596 - RNA, 64 nt, hsa; identical to SEQ ID NO: 415217

SEQ ID NO: 466597 - RNA, 64 nt, hsa; identical to SEQ ID NO: 415218

SEQ ID NO: 466598 - RNA, 64 nt, hsa; identical to SEQ ID NO: 415219

SEQ ID NO: 466599 - RNA, 64 nt, hsa; identical to SEQ ID NO: 415220

SEQ ID NO: 466600 - RNA, 64 nt, hsa; identical to SEQ ID NO: 415221

SEQ ID NO: 466601 - RNA, 55 nt, hsa; identical to SEQ ID NO: 415222

SEQ ID NO: 466602 - RNA, 64 nt, hsa; identical to SEQ ID NO: 415223

SEQ ID NO: 466603 - RNA, 64 nt, hsa; identical to SEQ ID NO: 415224

SEQ ID NO: 466604 - RNA, 64 nt, hsa; identical to SEQ ID NO: 415225

SEQ ID NO: 466605 - RNA, 64 nt, hsa; identical to SEQ ID NO: 415226

SEQ ID NO: 466606 - RNA, 64 nt, hsa; identical to SEQ ID NO: 415227

SEQ ID NO: 466607 - RNA, 64 nt, hsa; identical to SEQ ID NO: 415228

SEQ ID NO: 466608 - RNA, 50 nt, hsa; identical to SEQ ID NO: 415229

SEQ ID NO: 466609 - RNA, 64 nt, hsa; identical to SEQ ID NO: 415230

SEQ ID NO: 466610 - RNA, 64 nt, hsa; identical to SEQ ID NO: 415231

SEQ ID NO: 466611 - RNA, 64 nt, hsa; identical to SEQ ID NO: 415232

SEQ ID NO: 466612 - RNA, 64 nt, hsa; identical to SEQ ID NO: 415233

SEQ ID NO: 466613 - RNA, 64 nt, hsa; identical to SEQ ID NO: 415234

SEQ ID NO: 466614 - RNA, 64 nt, hsa; identical to SEQ ID NO: 415235

SEQ ID NO: 466615 - RNA, 64 nt, hsa; identical to SEQ ID NO: 415236

SEQ ID NO: 466616 - RNA, 64 nt, hsa; identical to SEQ ID NO: 415237

SEQ ID NO: 466617 - RNA, 64 nt, hsa; identical to SEQ ID NO: 415238

SEQ ID NO: 466618 - RNA, 64 nt, hsa; identical to SEQ ID NO: 415239

SEQ ID NO: 466619 - RNA, 64 nt, hsa; identical to SEQ ID NO: 415240

SEQ ID NO: 466620 - RNA, 64 nt, hsa; identical to SEQ ID NO: 415241

SEQ ID NO: 466621 - RNA, 64 nt, hsa; identical to SEQ ID NO: 415242

SEQ ID NO: 466622 - RNA, 64 nt, hsa; identical to SEQ ID NO: 415243

SEQ ID NO: 466623 - RNA, 64 nt, hsa; identical to SEQ ID NO: 415244

SEQ ID NO: 466624 - RNA, 64 nt, hsa; identical to SEQ ID NO: 415245

SEQ ID NO: 466625 - RNA, 64 nt, hsa; identical to SEQ ID NO: 415246

SEQ ID NO: 466626 - RNA, 64 nt, hsa; identical to SEQ ID NO: 415247

SEQ ID NO: 466627 - RNA, 64 nt, hsa; identical to SEQ ID NO: 415248

SEQ ID NO: 466628 - RNA, 64 nt, hsa; identical to SEQ ID NO: 415249

SEQ ID NO: 466629 - RNA, 64 nt, hsa; identical to SEQ ID NO: 415250

SEQ ID NO: 466630 - RNA, 64 nt, hsa; identical to SEQ ID NO: 415251

SEQ ID NO: 466631 - RNA, 64 nt, hsa; identical to SEQ ID NO: 415252

SEQ ID NO: 466632 - RNA, 64 nt, hsa; identical to SEQ ID NO: 415253

SEQ ID NO: 466633 - RNA, 64 nt, hsa; identical to SEQ ID NO: 415254

SEQ ID NO: 466634 - RNA, 64 nt, hsa; identical to SEQ ID NO: 415255

SEQ ID NO: 466635 - RNA, 64 nt, hsa; identical to SEQ ID NO: 415256

SEQ ID NO: 466636 - RNA, 64 nt, hsa
auaucccacucaagguugaagaagaaaugaagaagcaugaaaguaauaaugugggauuacuaga

SEQ ID NO: 466637 - RNA, 64 nt, hsa
uuucucuuaguuguaagaaagaaaaagacgucuugcaugaaaauaguacguugcgggaagaaau

SEQ ID NO: 466638 - RNA, 64 nt, hsa
cucuuccauacugguagaugcgaaauuuaucugugcaugaaagggucacuucuguaauagugca

SEQ ID NO: 466639 - RNA, 64 nt, hsa
guuauuuccucugcaggauacaguucaauaugaugcaugaaaaaugcuccacauuuaaaggaca

SEQ ID NO: 466640 - RNA, 64 nt, hsa
agauggagaaacagguacuggacuuuucccuccugcaugaaacaagcaaacaauggacaaaaua

SEQ ID NO: 466641 - RNA, 64 nt, hsa
guaaaauguacaaugucuagcauccaguagagaggcaugaaaagcaggaaaauacauugcauaa

SEQ ID NO: 466642 - RNA, 64 nt, hsa
uuucauauauuugugacaauuuuugaguaauauugcaugaaaaugucccuauguuacauccauu

SEQ ID NO: 466643 - RNA, 64 nt, hsa
auucgcuuucuccuguuuuuuuuuuaaaaaaaaagcaugaaaaaggaagagaaaaaguuugaua

SEQ ID NO: 466644 - RNA, 64 nt, hsa
gcuggguguuuuuuuccauuacuuuuaaugaucuucguugcaaguuauaguuguggauaaaggg

SEQ ID NO: 466645 - RNA, 64 nt, hsa
ccaagugugaacuggggucauucggucugugaucucguugcacugcuccaagucuggcuguguc

SEQ ID NO: 466646 - RNA, 64 nt, hsa
auauaguguuugcugcaaggccuguggaauuaauucguugcauauagagguaucaacugcugca

SEQ ID NO: 466647 - RNA, 64 nt, hsa
cccuggucucucuaggaggaguggacugaauggaucguugcagagaagacucacccagaccugg

SEQ ID NO: 466648 - RNA, 64 nt, hsa
acauuuugugugcauauuguuucauagcaagaauucguugcaaaaaugcuuuauuuuugaacaa

SEQ ID NO: 466649 - RNA, 64 nt, hsa
aaaauaaaaccccaccuuguugcaaaagcugaccucguugcauggaauuaaaagagaaggaaaa

SEQ ID NO: 466650 - RNA, 64 nt, hsa
gaccuuuuaaaagaugugcagagcagcuuagcauucguugcagcugagccuaauuuuuucuugc

SEQ ID NO: 466651 - RNA, 64 nt, hsa
auuguauuguuagauguuuguugagcugguaacaucguugcaaccacugcaauaucuucguuag

SEQ ID NO: 466652 - RNA, 64 nt, hsa
uugaacaagagaaugccauguucacauaagcaaaucguugcaagugauaauaacgaaguguuuc

SEQ ID NO: 466653 - RNA, 64 nt, hsa
aaucauuguuauaaagacacaugcacgcguauguucguugcagcacugcccaucagugacagac

SEQ ID NO: 466654 - RNA, 64 nt, hsa
uuagucuccucaagugaaaaacaggaguaauguuucguugcacuuugaaagaucugcuucaagg

SEQ ID NO: 466655 - RNA, 64 nt, hsa
gcaccucagaaugugaccuuguuuggaaacacagucguugcagauuaauuagucaccaugaggu

SEQ ID NO: 466656 - RNA, 64 nt, hsa
ccacuuuccaccaacuuuuuccaaguccuuuaacucguugcagucuguauuuuccaccuuuugu

SEQ ID NO: 466657 - RNA, 64 nt, hsa
ugaaggcauauuuccaauaacuagugauauggcaucguugcauuuuacaguaucuucaaaaaua

SEQ ID NO: 466658 - RNA, 64 nt, hsa
uuggagaggaauagcagaacauuucuccugccccucguugcaaaacgagcuuguuucccugaac

SEQ ID NO: 466659 - RNA, 64 nt, hsa
cacacgcuaaauguauucuuacauagugcuuguaucguugcauuuguuuuaauuuguggaaaag

SEQ ID NO: 466660 - RNA, 64 nt, hsa
gcucgcgguccucccagggagcugcgggugauguucguugcacugcuagacacgaaauucccau

SEQ ID NO: 466661 - RNA, 64 nt, hsa
gagcagucuuaguaccagaaacaguguugcacuuucguugcaugugcugugugaccccaagggg

SEQ ID NO: 466662 - RNA, 64 nt, hsa
acacaccauggauuucagaggaggaaguacggagucguugcauaauccgccccugguggguggc

SEQ ID NO: 466663 - RNA, 64 nt, hsa
auagcugaaccuguucaaaauguuaauaaagguuucguugcaugguagcauacuugguguuuug

SEQ ID NO: 466664 - RNA, 64 nt, hsa
cuggaaaugugcauuuugcagaaacuuuugagggucguugcaagacuguguagcaggccuacca

SEQ ID NO: 466665 - RNA, 64 nt, hsa
caccaaguggggucggcugaccguguggcagggaucguugcacuggacucuuggcgugugggaa

SEQ ID NO: 466666 - RNA, 64 nt, hsa
cucacccgggccccgggcaggggcgcgcuccacuucguugcacgcggguccggcgcacaguucc

SEQ ID NO: 466667 - RNA, 64 nt, hsa
ugcagagggccccaugccagacagcccuuggggcucguugcacuuuaagaaauaggaucugugg

SEQ ID NO: 466668 - RNA, 62 nt, hsa
acuuucucacagggauaauaaaguuagagcacucucguugcagcugcguuuauugacaugcu

SEQ ID NO: 466669 - RNA, 64 nt, hsa
gucugcauuauacuccugcaauaaugcugaggacucguugcaggagggcaaacuaggugaauaa

SEQ ID NO: 466670 - RNA, 64 nt, hsa
uuccagccuggauccccucacacugaacccuucuucguugcaccauccugcuucugacauugaa

SEQ ID NO: 466671 - RNA, 64 nt, hsa
uggacugcuauucuagagcuuuuauuugguguguucguugcacagcuguuugaaauguuuaaua

SEQ ID NO: 466672 - RNA, 64 nt, hsa
uguguguguguauguguguggguuagggcuuuuuucguugcaugugaugguucuguggacauau

SEQ ID NO: 466673 - RNA, 64 nt, hsa
cuccgcugagaauccuggaggaauacacaauucaucguugcacccccaccucagaguguaaucg

SEQ ID NO: 466674 - RNA, 64 nt, hsa
ugcgcuucccccuucaggaagggugugugccaccucguugcacuggaucccaguggcugcuugg

SEQ ID NO: 466675 - RNA, 64 nt, hsa
ucacugggguuucccauguugcagcacuucugggucguugcaauuuugcaucuaggaguuaguu

SEQ ID NO: 466676 - RNA, 64 nt, hsa; identical to SEQ ID NO: 161467

SEQ ID NO: 466677 - RNA, 64 nt, hsa; identical to SEQ ID NO: 161468

SEQ ID NO: 466678 - RNA, 64 nt, hsa; identical to SEQ ID NO: 161469

SEQ ID NO: 466679 - RNA, 64 nt, hsa; identical to SEQ ID NO: 161470

SEQ ID NO: 466680 - RNA, 64 nt, hsa; identical to SEQ ID NO: 161471

SEQ ID NO: 466681 - RNA, 64 nt, hsa; identical to SEQ ID NO: 161472

SEQ ID NO: 466682 - RNA, 64 nt, hsa; identical to SEQ ID NO: 161473

SEQ ID NO: 466683 - RNA, 64 nt, hsa; identical to SEQ ID NO: 161474

SEQ ID NO: 466684 - RNA, 64 nt, hsa; identical to SEQ ID NO: 161475

SEQ ID NO: 466685 - RNA, 64 nt, hsa; identical to SEQ ID NO: 161476

SEQ ID NO: 466686 - RNA, 64 nt, hsa; identical to SEQ ID NO: 161477

SEQ ID NO: 466687 - RNA, 64 nt, hsa; identical to SEQ ID NO: 161478

SEQ ID NO: 466688 - RNA, 64 nt, hsa; identical to SEQ ID NO: 161479

SEQ ID NO: 466689 - RNA, 64 nt, hsa; identical to SEQ ID NO: 161480

SEQ ID NO: 466690 - RNA, 64 nt, hsa; identical to SEQ ID NO: 161481

SEQ ID NO: 466691 - RNA, 64 nt, hsa; identical to SEQ ID NO: 161482

SEQ ID NO: 466692 - RNA, 64 nt, hsa; identical to SEQ ID NO: 161483

SEQ ID NO: 466693 - RNA, 64 nt, hsa; identical to SEQ ID NO: 161484

SEQ ID NO: 466694 - RNA, 64 nt, hsa; identical to SEQ ID NO: 161485

SEQ ID NO: 466695 - RNA, 64 nt, hsa; identical to SEQ ID NO: 161486

SEQ ID NO: 466696 - RNA, 64 nt, hsa; identical to SEQ ID NO: 161487

SEQ ID NO: 466697 - RNA, 64 nt, hsa; identical to SEQ ID NO: 161488

SEQ ID NO: 466698 - RNA, 64 nt, hsa; identical to SEQ ID NO: 161489

SEQ ID NO: 466699 - RNA, 64 nt, hsa; identical to SEQ ID NO: 161490

SEQ ID NO: 466700 - RNA, 64 nt, hsa; identical to SEQ ID NO: 161491

SEQ ID NO: 466701 - RNA, 64 nt, hsa; identical to SEQ ID NO: 161492

SEQ ID NO: 466702 - RNA, 64 nt, hsa; identical to SEQ ID NO: 161493

SEQ ID NO: 466703 - RNA, 64 nt, hsa; identical to SEQ ID NO: 161494

SEQ ID NO: 466704 - RNA, 64 nt, hsa; identical to SEQ ID NO: 161495

SEQ ID NO: 466705 - RNA, 64 nt, hsa; identical to SEQ ID NO: 161496

SEQ ID NO: 466706 - RNA, 64 nt, hsa; identical to SEQ ID NO: 161497

SEQ ID NO: 466707 - RNA, 64 nt, hsa; identical to SEQ ID NO: 87425

SEQ ID NO: 466708 - RNA, 64 nt, hsa; identical to SEQ ID NO: 87426

SEQ ID NO: 466709 - RNA, 64 nt, hsa; identical to SEQ ID NO: 87427

SEQ ID NO: 466710 - RNA, 64 nt, hsa; identical to SEQ ID NO: 87428

SEQ ID NO: 466711 - RNA, 64 nt, hsa; identical to SEQ ID NO: 87429

SEQ ID NO: 466712 - RNA, 64 nt, hsa; identical to SEQ ID NO: 87430

SEQ ID NO: 466713 - RNA, 60 nt, hsa
aggggugggccugugaaucaauccugggcaaucagacacccucuccuuaaaaacuggccc

SEQ ID NO: 466714 - RNA, 60 nt, hsa
cuggagggacuuuuaaucagugaagaugcaaucagacaaguguuuuggaaagagcacccu

SEQ ID NO: 466715 - RNA, 60 nt, hsa
ucaggcucugugcuuggaauacagaguugaaucagacaugaucucuacccuccuaguaag

SEQ ID NO: 466716 - RNA, 60 nt, hsa
ucauuuguguauucauucauuuauguauucaucagacacauaccgaacacccucuauuug

SEQ ID NO: 466717 - RNA, 64 nt, hsa; identical to SEQ ID NO: 141176

SEQ ID NO: 466718 - RNA, 64 nt, hsa; identical to SEQ ID NO: 141177

SEQ ID NO: 466719 - RNA, 64 nt, hsa; identical to SEQ ID NO: 141178

SEQ ID NO: 466720 - RNA, 64 nt, hsa; identical to SEQ ID NO: 141179

SEQ ID NO: 466721 - RNA, 64 nt, hsa; identical to SEQ ID NO: 141180

SEQ ID NO: 466722 - RNA, 64 nt, hsa; identical to SEQ ID NO: 141181

SEQ ID NO: 466723 - RNA, 64 nt, hsa; identical to SEQ ID NO: 141182

SEQ ID NO: 466724 - RNA, 64 nt, hsa; identical to SEQ ID NO: 141183

SEQ ID NO: 466725 - RNA, 64 nt, hsa; identical to SEQ ID NO: 141184

SEQ ID NO: 466726 - RNA, 64 nt, hsa; identical to SEQ ID NO: 141185

SEQ ID NO: 466727 - RNA, 64 nt, hsa; identical to SEQ ID NO: 141186

SEQ ID NO: 466728 - RNA, 64 nt, hsa; identical to SEQ ID NO: 141187

SEQ ID NO: 466729 - RNA, 64 nt, hsa; identical to SEQ ID NO: 141188

SEQ ID NO: 466730 - RNA, 64 nt, hsa; identical to SEQ ID NO: 141189

SEQ ID NO: 466731 - RNA, 64 nt, hsa; identical to SEQ ID NO: 141190

SEQ ID NO: 466732 - RNA, 64 nt, hsa; identical to SEQ ID NO: 141191

SEQ ID NO: 466733 - RNA, 64 nt, hsa; identical to SEQ ID NO: 141192

SEQ ID NO: 466734 - RNA, 64 nt, hsa; identical to SEQ ID NO: 141193

SEQ ID NO: 466735 - RNA, 64 nt, hsa; identical to SEQ ID NO: 141194

SEQ ID NO: 466736 - RNA, 64 nt, hsa; identical to SEQ ID NO: 141195

SEQ ID NO: 466737 - RNA, 64 nt, hsa; identical to SEQ ID NO: 141196

SEQ ID NO: 466738 - RNA, 64 nt, hsa; identical to SEQ ID NO: 141197

SEQ ID NO: 466739 - RNA, 64 nt, hsa; identical to SEQ ID NO: 141198

SEQ ID NO: 466740 - RNA, 64 nt, hsa; identical to SEQ ID NO: 141199

SEQ ID NO: 466741 - RNA, 64 nt, hsa; identical to SEQ ID NO: 141200

SEQ ID NO: 466742 - RNA, 64 nt, hsa; identical to SEQ ID NO: 141201

SEQ ID NO: 466743 - RNA, 64 nt, hsa; identical to SEQ ID NO: 141202

SEQ ID NO: 466744 - RNA, 64 nt, hsa; identical to SEQ ID NO: 141203

SEQ ID NO: 466745 - RNA, 64 nt, hsa; identical to SEQ ID NO: 141204

SEQ ID NO: 466746 - RNA, 64 nt, hsa; identical to SEQ ID NO: 141205

SEQ ID NO: 466747 - RNA, 64 nt, hsa; identical to SEQ ID NO: 141206

SEQ ID NO: 466748 - RNA, 64 nt, hsa; identical to SEQ ID NO: 141207

SEQ ID NO: 466749 - RNA, 64 nt, hsa; identical to SEQ ID NO: 141208

SEQ ID NO: 466750 - RNA, 64 nt, hsa; identical to SEQ ID NO: 141209

SEQ ID NO: 466751 - RNA, 64 nt, hsa; identical to SEQ ID NO: 141210

SEQ ID NO: 466752 - RNA, 64 nt, hsa; identical to SEQ ID NO: 141211

SEQ ID NO: 466753 - RNA, 64 nt, hsa; identical to SEQ ID NO: 141212

SEQ ID NO: 466754 - RNA, 64 nt, hsa; identical to SEQ ID NO: 141213

SEQ ID NO: 466755 - RNA, 64 nt, hsa; identical to SEQ ID NO: 141214

SEQ ID NO: 466756 - RNA, 64 nt, hsa; identical to SEQ ID NO: 141215

SEQ ID NO: 466757 - RNA, 64 nt, hsa; identical to SEQ ID NO: 141216

SEQ ID NO: 466758 - RNA, 64 nt, hsa; identical to SEQ ID NO: 141217

SEQ ID NO: 466759 - RNA, 64 nt, hsa; identical to SEQ ID NO: 141218

SEQ ID NO: 466760 - RNA, 64 nt, hsa; identical to SEQ ID NO: 141219

SEQ ID NO: 466761 - RNA, 64 nt, hsa; identical to SEQ ID NO: 141220

SEQ ID NO: 466762 - RNA, 64 nt, hsa; identical to SEQ ID NO: 141221

SEQ ID NO: 466763 - RNA, 64 nt, hsa
cuuaacugcaguuucaaugaggcagagggcaaagagagaccaagaucagagggguucauuauac

SEQ ID NO: 466764 - RNA, 64 nt, hsa
cuccuuguugggcagacaccagcggugugcagggagagaccaaguaccaucuuuaucuacacuu

SEQ ID NO: 466765 - RNA, 64 nt, hsa
uauagcgggugggguuguauuuggaagccucugaagagaccaugucuuuuuaaaaucuaacucu

SEQ ID NO: 466766 - RNA, 64 nt, hsa
acagguggacaaagggauccccagccagagagagagagaccagccaacagcuugauagaccagu

SEQ ID NO: 466767 - RNA, 64 nt, hsa
accagccaacagcuugauagaccagugcagccagagagaccaccaaacagagcccccaaaagac

SEQ ID NO: 466768 - RNA, 64 nt, hsa
cuuguauauuucaguggaaauacaaaaccacuucagagaccaggguaucuccucuggaaggauc

SEQ ID NO: 466769 - RNA, 64 nt, hsa
ucuuagaggaggaaauauccuuuguccuguucagagagaccagggcccuaccauuaggcauacu

SEQ ID NO: 466770 - RNA, 64 nt, hsa
cugguuuaauguugcuucacuuaucccacccuacagagaccagcaagguucugccaggccucga

SEQ ID NO: 466771 - RNA, 64 nt, hsa
cugauuuacuguugcuucauuuaucccauccuucagagaccagcaagguucugccaggccccaa

SEQ ID NO: 466772 - RNA, 64 nt, hsa
ugugugugugugugagagagagagagagagagagagagaccagcaucuucaagagaaguauucu

SEQ ID NO: 466773 - RNA, 64 nt, hsa
uccaggugauggggcaugcugagaaauagagaaaagagaccauguuuauuuggguaggaggaag

SEQ ID NO: 466774 - RNA, 64 nt, hsa
ggauacaaggaagggccuuucucggggccggagaagagaccaagagaccaggcccgggcagcag

SEQ ID NO: 466775 - RNA, 64 nt, hsa
ggaagggccuuucucggggccggagaagagaccaagagaccaggcccgggcagcagccuaccgg

SEQ ID NO: 466776 - RNA, 64 nt, hsa
gaauuuucuaccuaaggaccagaauuuuuuaucuagagaccagcauguucuccccaaagaccaa

SEQ ID NO: 466777 - RNA, 64 nt, hsa
gaauuuucuaccuaaggaccagaauuuuuugucuagagaccagcauguucuccccaaagaccag

SEQ ID NO: 466778 - RNA, 64 nt, hsa
ggauuuucuaccuaaagaccaggacuuuuuaucuagagaccagcauguucuccccaaagacugg

SEQ ID NO: 466779 - RNA, 64 nt, hsa
ucuacccaaaugucaggaccaggauuuucuacccagagaccaagguguucuucccaaagaccaa

SEQ ID NO: 466780 - RNA, 64 nt, hsa
ucuacccauaugucaggaccaggauuuucuacccagagaccaagguuaucuuccuaaagaccaa

SEQ ID NO: 466781 - RNA, 64 nt, hsa
ugaauauagagaccaaguuuaccacuucugaugaagagaccaauuaagauucauuccucauucu

SEQ ID NO: 466782 - RNA, 64 nt, hsa
gucugcuuaaaaaacugucugacuucgugaauauagagaccaaguuuaccacuucugaugaaga

SEQ ID NO: 466783 - RNA, 64 nt, hsa; identical to SEQ ID NO: 433201

SEQ ID NO: 466784 - RNA, 64 nt, hsa; identical to SEQ ID NO: 433202

SEQ ID NO: 466785 - RNA, 64 nt, hsa
acuauggauauaaauguaggcaaaaugaaagauuaugacuaauauucagauuccauuuucaaua

SEQ ID NO: 466786 - RNA, 64 nt, hsa
cugagaauaauugaugcugauuaaggugcaaaucaugacuaaagacuuuucuuucuucuuuugc

SEQ ID NO: 466787 - RNA, 64 nt, hsa
gccagccagguuguuucucagccaucaaaugauaaugacuaaaauuucugaggcuucaggagua

SEQ ID NO: 466788 - RNA, 64 nt, hsa
ccucauaccaacuugacuauguuucacccgcuucaugacuaaaucacagguggcagaauuuuuc

SEQ ID NO: 466789 - RNA, 64 nt, hsa
cagguauuccaggucacugacaugaauuugaagauauaucuaucuguauggauauauaucuaua

SEQ ID NO: 466790 - RNA, 64 nt, hsa
caugaauuugaagauauaucuaucuguauggauauauaucuauauguauauagauauauaaaua

SEQ ID NO: 466791 - RNA, 64 nt, hsa
aagcaaugggcuaagguccaagaaacauagcaauuauaucuacaaauaaucuauuaacaugauc

SEQ ID NO: 466792 - RNA, 64 nt, hsa
ugaauauuaauguuucuuguuuagaaaaugcaacuauaucuauaugugggaaccauucugaagu

SEQ ID NO: 466793 - RNA, 64 nt, hsa
auuauaucuauauaucuacauauaucuaucuaucuauaucuacaucuauauaaucuuacauuua

SEQ ID NO: 466794 - RNA, 64 nt, hsa
agugauauugugacauuauaucuauauaucuacauauaucuaucuaucuauaucuacaucuaua

SEQ ID NO: 466795 - RNA, 64 nt, hsa
aaugccuuauagugauauugugacauuauaucuauauaucuacauauaucuaucuaucuauauc

SEQ ID NO: 466796 - RNA, 64 nt, hsa
gaagaaggaaugccuuauagugauauugugacauuauaucuauauaucuacauauaucuaucua

SEQ ID NO: 466797 - RNA, 64 nt, hsa
uccaagaacuguuacauauaaucauauauaugccuauaucuaaacguuuucccuccuuuaauau

SEQ ID NO: 466798 - RNA, 64 nt, hsa
auagcugaccaaguuugcugugaaaaauccuuguuauaucuauuucuguauuggaguaaugugu

SEQ ID NO: 466799 - RNA, 64 nt, hsa
gccuaaaucuaaucagguuguuaauguugggauuuauaucuauaguagucaauuaguacaguag

SEQ ID NO: 466800 - RNA, 64 nt, hsa
ucaucaauuuuuauacauaucagaaaaguagaauuauaucuaauuuauacaaaauaauuuaacu

SEQ ID NO: 466801 - RNA, 64 nt, hsa
cugggauuacaggugugagccaccaggcccagccuauaucuaggagucucuugaugagcauugg

SEQ ID NO: 466802 - RNA, 64 nt, hsa
cucugaacuggucuuacccccuuaaaccugccuuuauaucuaggaguuucuuuauuuuauuuua

SEQ ID NO: 466803 - RNA, 64 nt, hsa
cuugaaucugcuuuauguacauaaucaaaauaucuauaucuauaucuauaucuauaucuauaua

SEQ ID NO: 466804 - RNA, 64 nt, hsa
ucugcuuuauguacauaaucaaaauaucuauaucuauaucuauaucuauaucuauauauuuuua

SEQ ID NO: 466805 - RNA, 64 nt, hsa
uuauguacauaaucaaaauaucuauaucuauaucuauaucuauaucuauauauuuuuaaucauc

SEQ ID NO: 466806 - RNA, 64 nt, hsa
acauaaucaaaauaucuauaucuauaucuauaucuauaucuauauauuuuuaaucaucuacaug

SEQ ID NO: 466807 - RNA, 64 nt, hsa
auuaugaaaaauuuuuaaaagauauauauaucuauauaucuauauauauguacuguuuuguuuc

SEQ ID NO: 466808 - RNA, 64 nt, hsa
gaacuucaauuaugaaaaauuuuuaaaagauauauauaucuauauaucuauauauauguacugu

SEQ ID NO: 466809 - RNA, 64 nt, hsa
guuuaaaaaacuuuacuucugaaaggaacauaauuauaucuaggucacuagaacgucauugugu

SEQ ID NO: 466810 - RNA, 64 nt, hsa
aacuguguauguacuuuaauuucaaaugcuuuuuuauaucuaaaaauauuugagauauaauggc

SEQ ID NO: 466811 - RNA, 64 nt, hsa
gaucuguaucuacaucuauaucuguaugugcaucuauaucuaugccuauaucuauaucuauauc

SEQ ID NO: 466812 - RNA, 64 nt, hsa
caucuauaucuguaugugcaucuauaucuaugccuauaucuauaucuauaucauauugauuuug

SEQ ID NO: 466813 - RNA, 64 nt, hsa
uaucuguaugugcaucuauaucuaugccuauaucuauaucuauaucauauugauuuugucucuc

SEQ ID NO: 466814 - RNA, 64 nt, hsa
cagguucuaaacucuauauauacauauauauauauauaucuauauaucuauauacguaaucauc

SEQ ID NO: 466815 - RNA, 64 nt, hsa
aaacucuauauauacauauauauauauauaucuauauaucuauauacguaaucaucuaguucug

SEQ ID NO: 466816 - RNA, 64 nt, hsa
uuuaguuucuccuacaauggguauguuaaauaacuauaucuauacuuagauauagugcauuguc

SEQ ID NO: 466817 - RNA, 64 nt, hsa
ugaccugcacuuucauuguacugaaacuucacuuuauaucuaaaucaugcuguuucugaaacag

SEQ ID NO: 466818 - RNA, 64 nt, hsa
cuggucauauacugauguauaugguuaucuggguuauaucuauuuuuauguaaacucuauuuug

SEQ ID NO: 466819 - RNA, 64 nt, hsa
uucucaccuuugauuuuaaaucccaguaccuaguuauaucuaaccuaucaaaggcaagauauca

SEQ ID NO: 466820 - RNA, 64 nt, hsa
auauguauaauauauaucuacaauauauauuauauauaucuauaucauauuucuguggaggguu

SEQ ID NO: 466821 - RNA, 64 nt, hsa
ugcgugguauacauguguacauauauguauaauauauaucuacaauauauauuauauauaucua

SEQ ID NO: 466822 - RNA, 64 nt, hsa
aaaacuauuuuauauauaaauauaaaucuauaucuauaucuauuaaaaaaaaugaaguccaguc

SEQ ID NO: 466823 - RNA, 64 nt, hsa
uuguaaaaaacuauuuuauauauaaauauaaaucuauaucuauaucuauuaaaaaaaaugaagu

SEQ ID NO: 466824 - RNA, 64 nt, hsa
uaacccagucuuaggcugguauucccuuuuuauauauaucuauauuacuuuucaccucuuuuuc

SEQ ID NO: 466825 - RNA, 64 nt, hsa
auacaguuuucaaucguucaaguuuuggaugguuuauaucuaauguguguuucauuuuuuugga

SEQ ID NO: 466826 - RNA, 64 nt, hsa
aagaauacauauauauauaucuacacacaaauuauauaucuaucuaucuauacagcggaaccac

SEQ ID NO: 466827 - RNA, 64 nt, hsa
ugcaaaaaaauacguaauaaagaauacauauauauauaucuacacacaaauuauauaucuaucu

SEQ ID NO: 466828 - RNA, 64 nt, hsa
agcgucugcuugcguugugucuguuuuauguuuuuauaucuacaucuauauaucuauaauuuua

SEQ ID NO: 466829 - RNA, 64 nt, hsa
uugugucuguuuuauguuuuuauaucuacaucuauauaucuauaauuuuauuaaaaaaaagaaa

SEQ ID NO: 466830 - RNA, 64 nt, hsa
gauacucugugguguucuguucauguucuaucaguauaucuagaaagggaauagccauauaaau

SEQ ID NO: 466831 - RNA, 64 nt, hsa
uaacagagaaaaaccuuugauuuugguuaaccuuuauaucuagaaccaaaacagcuaaauccca

SEQ ID NO: 466832 - RNA, 64 nt, hsa; identical to SEQ ID NO: 142221

SEQ ID NO: 466833 - RNA, 64 nt, hsa; identical to SEQ ID NO: 142222

SEQ ID NO: 466834 - RNA, 64 nt, hsa; identical to SEQ ID NO: 142223

SEQ ID NO: 466835 - RNA, 64 nt, hsa; identical to SEQ ID NO: 142224

SEQ ID NO: 466836 - RNA, 64 nt, hsa; identical to SEQ ID NO: 142225

SEQ ID NO: 466837 - RNA, 64 nt, hsa; identical to SEQ ID NO: 142226

SEQ ID NO: 466838 - RNA, 64 nt, hsa; identical to SEQ ID NO: 142227

SEQ ID NO: 466839 - RNA, 64 nt, hsa; identical to SEQ ID NO: 142228

SEQ ID NO: 466840 - RNA, 64 nt, hsa; identical to SEQ ID NO: 142229

SEQ ID NO: 466841 - RNA, 64 nt, hsa; identical to SEQ ID NO: 142230

SEQ ID NO: 466842 - RNA, 64 nt, hsa; identical to SEQ ID NO: 142231

SEQ ID NO: 466843 - RNA, 64 nt, hsa; identical to SEQ ID NO: 142232

SEQ ID NO: 466844 - RNA, 64 nt, hsa; identical to SEQ ID NO: 142233

SEQ ID NO: 466845 - RNA, 64 nt, hsa; identical to SEQ ID NO: 142234

SEQ ID NO: 466846 - RNA, 64 nt, hsa; identical to SEQ ID NO: 142235

SEQ ID NO: 466847 - RNA, 64 nt, hsa; identical to SEQ ID NO: 142236

SEQ ID NO: 466848 - RNA, 64 nt, hsa; identical to SEQ ID NO: 142237

SEQ ID NO: 466849 - RNA, 64 nt, hsa; identical to SEQ ID NO: 142238

SEQ ID NO: 466850 - RNA, 64 nt, hsa; identical to SEQ ID NO: 142239

SEQ ID NO: 466851 - RNA, 64 nt, hsa; identical to SEQ ID NO: 142240

SEQ ID NO: 466852 - RNA, 64 nt, hsa; identical to SEQ ID NO: 142241

SEQ ID NO: 466853 - RNA, 64 nt, hsa; identical to SEQ ID NO: 142242

SEQ ID NO: 466854 - RNA, 64 nt, hsa; identical to SEQ ID NO: 142243

SEQ ID NO: 466855 - RNA, 64 nt, hsa; identical to SEQ ID NO: 142244

SEQ ID NO: 466856 - RNA, 64 nt, hsa; identical to SEQ ID NO: 142245

SEQ ID NO: 466857 - RNA, 64 nt, hsa; identical to SEQ ID NO: 142246

SEQ ID NO: 466858 - RNA, 64 nt, hsa; identical to SEQ ID NO: 142247

SEQ ID NO: 466859 - RNA, 64 nt, hsa; identical to SEQ ID NO: 142248

SEQ ID NO: 466860 - RNA, 64 nt, hsa; identical to SEQ ID NO: 142249

SEQ ID NO: 466861 - RNA, 64 nt, hsa; identical to SEQ ID NO: 142250

SEQ ID NO: 466862 - RNA, 64 nt, hsa; identical to SEQ ID NO: 142251

SEQ ID NO: 466863 - RNA, 64 nt, hsa; identical to SEQ ID NO: 142252

SEQ ID NO: 466864 - RNA, 64 nt, hsa; identical to SEQ ID NO: 142253

SEQ ID NO: 466865 - RNA, 64 nt, hsa; identical to SEQ ID NO: 142254

SEQ ID NO: 466866 - RNA, 64 nt, hsa; identical to SEQ ID NO: 142255

SEQ ID NO: 466867 - RNA, 64 nt, hsa; identical to SEQ ID NO: 142256

SEQ ID NO: 466868 - RNA, 64 nt, hsa; identical to SEQ ID NO: 142257

SEQ ID NO: 466869 - RNA, 64 nt, hsa; identical to SEQ ID NO: 142258

SEQ ID NO: 466870 - RNA, 64 nt, hsa; identical to SEQ ID NO: 142259

SEQ ID NO: 466871 - RNA, 64 nt, hsa; identical to SEQ ID NO: 142260

SEQ ID NO: 466872 - RNA, 64 nt, hsa; identical to SEQ ID NO: 142261

SEQ ID NO: 466873 - RNA, 64 nt, hsa; identical to SEQ ID NO: 142262

SEQ ID NO: 466874 - RNA, 64 nt, hsa; identical to SEQ ID NO: 142263

SEQ ID NO: 466875 - RNA, 64 nt, hsa; identical to SEQ ID NO: 142264

SEQ ID NO: 466876 - RNA, 64 nt, hsa; identical to SEQ ID NO: 142265

SEQ ID NO: 466877 - RNA, 64 nt, hsa; identical to SEQ ID NO: 142266

SEQ ID NO: 466878 - RNA, 64 nt, hsa; identical to SEQ ID NO: 142267

SEQ ID NO: 466879 - RNA, 64 nt, hsa; identical to SEQ ID NO: 142268

SEQ ID NO: 466880 - RNA, 64 nt, hsa
cagccccaggcugcugaggagcagaggccagaccagggccgaucuggguguccugacccucagc

SEQ ID NO: 466881 - RNA, 64 nt, hsa
uccgguccuuccugggcaaaucuaagccuuggccagggccgaaguuuaggccccugucuuguuc

SEQ ID NO: 466882 - RNA, 64 nt, hsa
ccccauguucugcaagacuacuugguauucuuguagggccgacacuaaauaaaagccaaaccuu

SEQ ID NO: 466883 - RNA, 64 nt, hsa
agaaaccugcgguuucagcuuuucuguggcaaacagggccgagggcuggugaagcuguuaaggc

SEQ ID NO: 466884 - RNA, 64 nt, hsa
gccagaaaggggaugaaaaaaaaauccuuaauucagggccgacauuaucuacuuaaacaacuuu

SEQ ID NO: 466885 - RNA, 64 nt, hsa
aagcagagagacugccaccuggaguuaggauggcagggccgagcugcuagcuucgacagugaga

SEQ ID NO: 466886 - RNA, 64 nt, hsa
caaaguaggcagaauaagaaaauaguucuucaggagggccgaccuuuaaagaacuucaacauag

SEQ ID NO: 466887 - RNA, 64 nt, hsa
agcuuugcacguuucgaucccaaaggcccuuuuuagggccgaccacuugcucaucugaggaguu

SEQ ID NO: 466888 - RNA, 64 nt, hsa
ugcgauccgagucgcggucuccggggugccugggagggccgaaccacuggugagggcgugggga

SEQ ID NO: 466889 - RNA, 64 nt, hsa
aggagcgaacuggugagcccagcgcccugggaagagggccgagggcggggcgguggugccggga

SEQ ID NO: 466890 - RNA, 64 nt, hsa
gucuguccuucaggccccacagugcagcuucuccagggccgacagcugagggcugcucccugca

SEQ ID NO: 466891 - RNA, 64 nt, hsa
ucccugcccuaccccuuaacuccaccuuagugccagggccgagggcuggucugcaugcuggaag

SEQ ID NO: 466892 - RNA, 64 nt, hsa
gauggaauccagcuucaagagcauacucuguacuagggccgaaguaaaaaaccaucaccuccca

SEQ ID NO: 466893 - RNA, 64 nt, hsa
acagagcuaucauuaugcacuugggagaaaauuaagggccgauuuaauuaaacuuagguaagaa

SEQ ID NO: 466894 - RNA, 64 nt, hsa
uccaugcugcaggccacuacggcugcucggcaggagggccgagaguuuggacccacauagcugc

SEQ ID NO: 466895 - RNA, 64 nt, hsa
agggacggggaagccgagcuccagagcaacgaccagggccgaggaggugccuggagugcccacc

SEQ ID NO: 466896 - RNA, 64 nt, hsa
uuccucccgucccagacuucguggcgcugcugacagggccgaggucgcaggcgguggcacgagc

SEQ ID NO: 466897 - RNA, 64 nt, hsa
gggugacagagccaaaugagggcugcaguugcugagggccgaccacccaugccaagggaaucca

SEQ ID NO: 466898 - RNA, 64 nt, hsa
cugcaccugccggcgacacuccugccgguaguuuagggccgagacggcuagcuucacgccaccc

SEQ ID NO: 466899 - RNA, 64 nt, hsa
ggcuuggccugauggugggcggggccccgcccacagggccgaccccaauacaccagcgacucaa

SEQ ID NO: 466900 - RNA, 64 nt, hsa
ugcagcgggccaggcaggcugggugggagggaggagggccgagacaggagcagcccacccagca

SEQ ID NO: 466901 - RNA, 64 nt, hsa
ccuaagucaagugggugaacgcagugcccuugggagggccgaggcacccgguggcagcuggcag

SEQ ID NO: 466902 - RNA, 51 nt, hsa
gcguccagcccuaccuauagaagggccgagcacagcaaugcaaguaagugg

SEQ ID NO: 466903 - RNA, 64 nt, hsa
accaaaguauaaaacaaaaucuagccccuucuucagggccgagagaauuuugagcacuagccgu

SEQ ID NO: 466904 - RNA, 64 nt, hsa
auuggagauguacacauacauacccuauaccaagagggccgaaacucuucaccuugauguaugu

SEQ ID NO: 466905 - RNA, 64 nt, hsa
ugagccuucugcaggggauguccacagagagggaagggccgaggggagagggugaccaugggga

SEQ ID NO: 466906 - RNA, 64 nt, hsa
ucacaaacccccugacauagucucagagaucuguagggccgagguuacauuuggagaacccgua

SEQ ID NO: 466907 - RNA, 64 nt, hsa
ucaggacagugucccucccugggaaugugacaugagggccgacuggggccaggcucaggggcag

SEQ ID NO: 466908 - RNA, 64 nt, hsa
cagccaggguuugugugucaucguacuggaguagagggccgacucuucccaugaaggugagcac

SEQ ID NO: 466909 - RNA, 64 nt, hsa
cucccgagccuagauccuggcucggaccacugcaagggccgaggcagggccagaccagagcauc

SEQ ID NO: 466910 - RNA, 64 nt, hsa
ccuccgccccugcaccagucacaugcacuggacgagggccgaaacuccugucugcuaucgagcc

SEQ ID NO: 466911 - RNA, 64 nt, hsa
ccaguuccuaggcaacuuguucaccagguacgcaagggccgaauaguugagaaauggacauucu

SEQ ID NO: 466912 - RNA, 64 nt, hsa
aaggaaaaccugaagacugaggacaaaguggaggagggccgaggugggcuucaguaaguccccg

SEQ ID NO: 466913 - RNA, 64 nt, hsa
cucugaauugaacuggaaucacauauuucacaacagggccgaagagaugacuauaaaauguuca

SEQ ID NO: 466914 - RNA, 64 nt, hsa
aacgccacguuugugaagagcugaggguaucaggagggccgacgcuguguuggcaugcgcagua

SEQ ID NO: 466915 - RNA, 64 nt, hsa
gccuucgggcgucugugugcgcucuguggaugccagggccgaccagaggagccuuuuuaaaaca

SEQ ID NO: 466916 - RNA, 64 nt, hsa
acccaagccugucuaagguuacuguguauuagacagggccgaacuagugugcugagcaaaaaga

SEQ ID NO: 466917 - RNA, 64 nt, hsa
ccccuccugggguuguaaguuuuguucauucaugagggccgacugcauuuccugguuacucuau

SEQ ID NO: 466918 - RNA, 64 nt, hsa
ggaaagugggggaacgacacacacuucaccugcaagggccgacaacgcaggggacaccgugccg

SEQ ID NO: 466919 - RNA, 64 nt, hsa
cacaucaggguggggugggggucacuuggcaaaaagggccgaggucuggugaugugguucccag

SEQ ID NO: 466920 - RNA, 64 nt, hsa
accuucuggaagacuuggccuuccgcucugacgcagggccgaggugggcaguccaggccgagag

SEQ ID NO: 466921 - RNA, 64 nt, hsa
agcccaagggcaucauccucagcagcaucgaggaagggccgaggaaugugaagccagaucucgg

SEQ ID NO: 466922 - RNA, 64 nt, hsa
cccaccacuguccacugaccagaaaccuggcugcagggccgaggacugguuuggggacuggagg

SEQ ID NO: 466923 - RNA, 64 nt, hsa
ggaguggaagaagagggagagguggagcaaagugagggccgagugagagcgugcuccagccugg

SEQ ID NO: 466924 - RNA, 64 nt, hsa
uucuaguuuaguaaaagaugugcaaaggccagagagggccgaaaaugaagcuuucuugcuacac

SEQ ID NO: 466925 - RNA, 64 nt, hsa
gacaacuaggagcccagcugggauugguguagggagggccgaacgcugacuaguguggccucac

SEQ ID NO: 466926 - RNA, 64 nt, hsa
aguuacagcccuccuucuuuuuuguuuucuguugagggccgacugcugcucugccuuccuucua

SEQ ID NO: 466927 - RNA, 64 nt, hsa
aggacuaggacccauaugggaauuauuaccucucagggccgagaggacagaauggauauaaucu

SEQ ID NO: 466928 - RNA, 64 nt, hsa
auccagauggguucagcagucuggucagugagaaagggccgaggguagacaggcagcuucugug

SEQ ID NO: 466929 - RNA, 64 nt, hsa
uggaccuggaacuguagggccaggggauugucucagggccgacguuccaccuggggcuucccuc

SEQ ID NO: 466930 - RNA, 64 nt, hsa
gaauccugaccccuugagagagagugaucuggcgagggccgaugaaggggcugggccuggucuu

SEQ ID NO: 466931 - RNA, 64 nt, hsa
cuuuguugcuuccguucauggaagcgcacaggauagggccgacgcugugccggucguggggaaa

SEQ ID NO: 466932 - RNA, 64 nt, hsa
gacaccugaggaugcggcugcacacacucagccaagggccgagucucaccugcggugggguguc

SEQ ID NO: 466933 - RNA, 64 nt, hsa
aggcuggucuggcuuagcugggccgagaggccggagggccgaguuagagcggccggccugacuc

SEQ ID NO: 466934 - RNA, 64 nt, hsa
ugggaccagaccuggccaaggucagccagcggggagggccgaggucugagcucucguccugccg

SEQ ID NO: 466935 - RNA, 64 nt, hsa
ccucugagcgcccugcugccacccagugacuggcagggccgagccagcauuccaccccaccuuu

SEQ ID NO: 466936 - RNA, 64 nt, hsa
cuuaccccaucacccgacucuggccacugaccucagggccgaaggggaggugguguacauagga

SEQ ID NO: 466937 - RNA, 64 nt, hsa
agguccagcaugucuggcuugcaccuaguaaagcagggccgagacagaaagaaaauagauucuc

SEQ ID NO: 466938 - RNA, 64 nt, hsa
gggaccacaugccugggucucacccucagcuccgagggccgagggcuuuccccaccccacccuc

SEQ ID NO: 466939 - RNA, 64 nt, hsa
uuccucaccccuccucugacccacccauggugccagggccgaagcugaccuuuagcucccuccu

SEQ ID NO: 466940 - RNA, 64 nt, hsa
gagaccaggugagcacagccuggagccugugcccagggccgacaggcgcgacacccagcaaggc

SEQ ID NO: 466941 - RNA, 64 nt, hsa
cuucggguacaacccugagcaggucgggggacacagggccgaggcaggccuucggggccccuuu

SEQ ID NO: 466942 - RNA, 64 nt, hsa
ccccguguccccccaggugcuggaggcagacucgagggccgaauuguuucuaguuaggccacgc

SEQ ID NO: 466943 - RNA, 64 nt, hsa
cugucuuaaaaaacacaaaaaaagacuuggccuuagggccgagugcgguggcucacgccuauaa

SEQ ID NO: 466944 - RNA, 64 nt, hsa
gcuauaggagucaccuggagccucggucucucccagggccgauccugucugcagucacaucuuu

SEQ ID NO: 466945 - RNA, 64 nt, hsa
uuguuuuucucuuugggccgggccgggccggggaagggccgagcaggcuccaggaggccuccag

SEQ ID NO: 466946 - RNA, 64 nt, hsa
gcccccaugugguugcgacacucccaaagccguaagggccgacccaggcaucuuggcccccagc

SEQ ID NO: 466947 - RNA, 64 nt, hsa
gggcaaguggguggagucuggcagcugcccacagagggccgagggucacccgucggccgccgcc

SEQ ID NO: 466948 - RNA, 64 nt, hsa
ggccccagacagacuaaagcugcccuccuggugcagggccgaggggacacaaggaccuaccugg

SEQ ID NO: 466949 - RNA, 64 nt, hsa
ggacacgccuggggcagcgugucugugcucagugagggccgaugaagaaagugcguuuucuguu

SEQ ID NO: 466950 - RNA, 64 nt, hsa
acuaaaauaagaucauguuuuaauugugagaaacagggccgagcacaguggcucacgccuguaa

SEQ ID NO: 466951 - RNA, 64 nt, hsa
auuuccaccgcggaggccccgcgcgccggugccgagggccgaggagcgcccggguccgggcagg

SEQ ID NO: 466952 - RNA, 64 nt, hsa
cacauauggaauuuugcaaagauuuaaucugccaagggccgacuaagagaaguuguaaaguaug

SEQ ID NO: 466953 - RNA, 64 nt, hsa
cguccaccgagcacucagauggaugcugaucaccagggccgagggggcucccagaaggacccca

SEQ ID NO: 466954 - RNA, 64 nt, hsa
aagggcaagaagaggaggcuccaggguuggggcgagggccgaccuguccacccuucccuggaau

SEQ ID NO: 466955 - RNA, 64 nt, hsa
cugggccccgggagccgugcuccuuggaacgcaaagggccgaggagcaucugguuuucauggca

SEQ ID NO: 466956 - RNA, 56 nt, hsa
agaucuucuugaguuggugagaaugcagggccgaguagccagcugcauugcuuaga

SEQ ID NO: 466957 - RNA, 64 nt, hsa
ccaaaaaugugugaaauggaaaguugauggcagcagggccgacgaugucaccuggugccucgcg

SEQ ID NO: 466958 - RNA, 64 nt, hsa
accaggccccccugucacccaugacaguucauucagggccgauggggcagucgugguugggaac

SEQ ID NO: 466959 - RNA, 64 nt, hsa
ucuccgucccccaucccuggggaggcucccaccaucucgccacuggacagaagcguccccuuug

SEQ ID NO: 466960 - RNA, 64 nt, hsa
cgcgcgaagaagcuugggagucguggcgggggucucucgccaccccuuuccggagagccucccc

SEQ ID NO: 466961 - RNA, 64 nt, hsa
ucccugccauugggcccuccaccuguggcucacaucucgccagccccacagagcauccucaggc

SEQ ID NO: 466962 - RNA, 64 nt, hsa
accucugggccaaugcauuuccaaaggaugccuuucucgccauaugccuccccuggcccccagc

SEQ ID NO: 466963 - RNA, 64 nt, hsa
aggaagcugcguuagccgaucaggcuuuguaagaucucgccaacagcuagcugcuuaggaguac

SEQ ID NO: 466964 - RNA, 64 nt, hsa
ggcccugccccaggccccgcugcugcgcccacacucucgccagaguccccagccggcucgccag

SEQ ID NO: 466965 - RNA, 64 nt, hsa
gaaacagaagggcgccaagccaugccuaaaaagaucucgccaauaauucuugucuuugaguguu

SEQ ID NO: 466966 - RNA, 64 nt, hsa
ucuuuuuuuuuuuuuuugagacggagucuugcccucucgccaggcuggaguguaguggcacaau

SEQ ID NO: 466967 - RNA, 64 nt, hsa
uggcagugacuguagaaaauacgaaauauauauuucucgccaaguuuuuauacuuucugaaaug

SEQ ID NO: 466968 - RNA, 58 nt, hsa
uccgcggggagcgggccuaggagggcuaucucgccaccugagagguugcgcaacguuc

SEQ ID NO: 466969 - RNA, 64 nt, hsa
ggcuucgugcaggagggcacggugggugagccauucucgccauucucaugucagacugaaagga

SEQ ID NO: 466970 - RNA, 64 nt, hsa
ccaguuucuuccggcgcagcucuuagguguucacucucgccagcucaguuggcuuugugaagug

SEQ ID NO: 466971 - RNA, 64 nt, hsa
ggccugcuggggcuuuccauggccuucugcuguuucucgccaacacuacccaggacucuugcua

SEQ ID NO: 466972 - RNA, 64 nt, hsa
guuuuuuaaaaaaauaaauauucuaauguagcuaucucgccauucccuuuaaauaccugucuua

SEQ ID NO: 466973 - RNA, 64 nt, hsa
uggcuuguaugaccuguucaggggucacaugaggucucgccaguuuccuggguccucuucagag

SEQ ID NO: 466974 - RNA, 64 nt, hsa
cccccgcagcaucuacugaaaauacuacucaaauucucgccaaccguccucacacaguauugcu

SEQ ID NO: 466975 - RNA, 64 nt, hsa
uuucuuauggaaagguccuguggggagcccauccucucgccaagccaucacaggcucugcauac

SEQ ID NO: 466976 - RNA, 64 nt, hsa
aggcuuccaguucagccucaguuauuuuagacaaucucgccaucuuuaauuucuuagcuuccug

SEQ ID NO: 466977 - RNA, 64 nt, hsa
uucugucuccagcuucccgaguaccagugacacgucucgccaagcaggacagugcuugauacag

SEQ ID NO: 466978 - RNA, 64 nt, hsa
cagugggccugcuggugggcauggauguccucacucucgccaucuggcagaucguggacccucu

SEQ ID NO: 466979 - RNA, 64 nt, hsa
cuacgggguaagauuugccuuaacaguacuauuuucucgccaccaaaaaaaaaaaaaaaaaaaa

SEQ ID NO: 466980 - RNA, 64 nt, hsa
uuguggcaugcccaugggcugccgaguccugcccucucgccacauuucccccaaguuacauucc

SEQ ID NO: 466981 - RNA, 64 nt, hsa
agcagaaacuaaagcagcaaaugcaggaaggcugucucgccauccucaagacucagcagcucuc

SEQ ID NO: 466982 - RNA, 64 nt, hsa
cccgcccagcccgggccaccucgugggggacaagucucgccagcgcccacccccauggcucggg

SEQ ID NO: 466983 - RNA, 64 nt, hsa
uuugugacuccuguggacuccacugcgccugggaucucgccaaccccucucucauuugggguga

SEQ ID NO: 466984 - RNA, 64 nt, hsa
uaaaaauguuaggcucuaaauggacgaaaaauucucucgccaucuuaauaacaaaauaaacuac

SEQ ID NO: 466985 - RNA, 64 nt, hsa
auguaaggaugagggaagcgaagcaagaggaaccucucgccaugaucagacauacagcugccua

SEQ ID NO: 466986 - RNA, 64 nt, hsa
caagguuuuauuuucuucugacuuagaauauaagucucgccaucgucaaagagaaacuuugaag

SEQ ID NO: 466987 - RNA, 64 nt, hsa
gggagacagcagccuuaaucuacauaauucuucaucucgccaauucagccgcagccuuuaaaga

SEQ ID NO: 466988 - RNA, 64 nt, hsa
cugggcuuuggcaccaaguaccugaaagagaacuucucgccauggauccagcagcacgguggau

SEQ ID NO: 466989 - RNA, 64 nt, hsa
guagauucaucaaacuagagaccccagcuccccuucucgccaucuucuuucucaaguugaccgu

SEQ ID NO: 466990 - RNA, 64 nt, hsa
uuaucuauuuauuuauuugaugacugucucucuuucucgccauuagcaguauugaauuauuuau

SEQ ID NO: 466991 - RNA, 64 nt, hsa
cuacagaagaggcaagacacagucaccaaugauaucucgccaaagaaaccacgcccacaccaau

SEQ ID NO: 466992 - RNA, 64 nt, hsa
ugaaugaucagaacugacauuuaauucauguuugucucgccaugcuucuuuacuuuaacauauu

SEQ ID NO: 466993 - RNA, 64 nt, hsa
cuagcacuuugaauucgagcaggucagcgucuucucucgccacgacgguccccauuccaccccc

SEQ ID NO: 466994 - RNA, 64 nt, hsa
uacuggggaagccgguccguacguaggccuugcaucucgccaccuccacuucuguccucaagaa

SEQ ID NO: 466995 - RNA, 64 nt, hsa
ucccgguggucuccccaagaaguccccaagacaaucucgccaaaggcaccuccuauccugcugc

SEQ ID NO: 466996 - RNA, 64 nt, hsa
cagugaaccaaccaaaccaaccccgaaucaucgcucucgccaugugcguuucucuuguuuuuuu

SEQ ID NO: 466997 - RNA, 64 nt, hsa
uacagaugcacgauuuggccauggauccgacuacucucgccaacagaacagauuuaaugacuuu

SEQ ID NO: 466998 - RNA, 64 nt, hsa
gaaccugggaggcggagguugcagugagccaagaucucgccacugcacuccagcuugggcaaua

SEQ ID NO: 466999 - RNA, 64 nt, hsa
ucacccagacagcucccucugccugaaccuuccaucucgccaccccuccuuccuugaccagcag

SEQ ID NO: 467000 - RNA, 63 nt, hsa
ccgcagaggaggggcgaugagggguggcggcugucucgccaucaggcagggacaggacgggca

SEQ ID NO: 467001 - RNA, 64 nt, hsa
aauagaaacuuccaaggcucuuccagcuccccuuucucgccauucuuuagcuguagucaugaau

SEQ ID NO: 467002 - RNA, 64 nt, hsa
cgccucagacucggggugagggaggcgggcagccucucgccagccuucccguccuucaguucaa

SEQ ID NO: 467003 - RNA, 64 nt, hsa
cgggcagauggcagaagggaccccuuggacuuuuucucgccaucccuccccccagcgcaggggc

SEQ ID NO: 467004 - RNA, 64 nt, hsa
caccgagcccuagcuggccggccaccuccuuuccucucgccaccuuccaccccugcgcugugcu

SEQ ID NO: 467005 - RNA, 64 nt, hsa
ccaggccugacccugguaccgaagcuguggacguucucgccacacucaaccccaugagcuucca

SEQ ID NO: 467006 - RNA, 64 nt, hsa
gcugcccgccucagggaugggcaccucaugccugucucgccaccuccugugccaaugucccacc

SEQ ID NO: 467007 - RNA, 64 nt, hsa
agcugagcaccuggggccucggggcgggcuccccucucgccaacccgccaaccgcgagagaccc

SEQ ID NO: 467008 - RNA, 64 nt, hsa
aaucagaucuacagcuccuggauaauugcuugauucucgccagagacugucaauguuucauuca

SEQ ID NO: 467009 - RNA, 64 nt, hsa
gguaaccuaauggccacuggcuagcagcacacaaucucgccagggaaaaucugaggccacacag

SEQ ID NO: 467010 - RNA, 64 nt, hsa
cugguaauuccaggugcugcgcuuggcagaggggucucgccaaagcgcaugugugugcaugugu

SEQ ID NO: 467011 - RNA, 64 nt, hsa
caaggcccagcuccuugacaauuuggcaauaaguucucgccaagguuagugauccaagagagga

SEQ ID NO: 467012 - RNA, 64 nt, hsa
ucccuggcugcagccuccgggguucagccuccugucucgccagaagacuccuaggcccuugggg

SEQ ID NO: 467013 - RNA, 64 nt, hsa
cccccgagaggacaacaggcaucuggaagugcucucucgccacucugggugcuuuacugucucu

SEQ ID NO: 467014 - RNA, 64 nt, hsa
agauguuuuugugccauaugcuggauauccagguucucgccaggccccgauacaugaauaacaa

SEQ ID NO: 467015 - RNA, 64 nt, hsa
accauggcuggcccaucugagagcaucuccccacucucgccaaccuaucggggcauagcccagg

SEQ ID NO: 467016 - RNA, 64 nt, hsa
ccccauauuuaugugacuagaagcgcaacagacuucucgccauagucgagcucucccgcugggg

SEQ ID NO: 467017 - RNA, 64 nt, hsa
gauggccacuuccagagcuugcccauugccugucucucgccaauuccguuuauccaaaaaggua

SEQ ID NO: 467018 - RNA, 58 nt, hsa
cuucagucccccaguccugaguggggguucucgccaauucccuaaugagauuccaccc

SEQ ID NO: 467019 - RNA, 64 nt, hsa
aacaggaccucgguucaugucccugcggcuggccucucgccagccacuccugcagugugcgucc

SEQ ID NO: 467020 - RNA, 64 nt, hsa
ucaggaggaugcugugcacacugugugugaugaaucucgccagaaaggcuccugaggucccagg

SEQ ID NO: 467021 - RNA, 64 nt, hsa
caccucucugcccugaacacccaaucucggccccucucgccacccuccugcauuucuguucagu

SEQ ID NO: 467022 - RNA, 64 nt, hsa
gaacccgggaggcagagcuugcagugagccgagaucucgccacugcacuccagccugggcaaca

SEQ ID NO: 467023 - RNA, 64 nt, hsa
ucucucucucucucucucucucucucucucucucucucgccauaccucucugaguauuuagcua

SEQ ID NO: 467024 - RNA, 64 nt, hsa; identical to SEQ ID NO: 51723

SEQ ID NO: 467025 - RNA, 64 nt, hsa; identical to SEQ ID NO: 51724

SEQ ID NO: 467026 - RNA, 64 nt, hsa; identical to SEQ ID NO: 51725

SEQ ID NO: 467027 - RNA, 64 nt, hsa; identical to SEQ ID NO: 51726

SEQ ID NO: 467028 - RNA, 64 nt, hsa; identical to SEQ ID NO: 51727

SEQ ID NO: 467029 - RNA, 64 nt, hsa; identical to SEQ ID NO: 51728

SEQ ID NO: 467030 - RNA, 64 nt, hsa; identical to SEQ ID NO: 51729

SEQ ID NO: 467031 - RNA, 64 nt, hsa; identical to SEQ ID NO: 51730

SEQ ID NO: 467032 - RNA, 64 nt, hsa; identical to SEQ ID NO: 51731

SEQ ID NO: 467033 - RNA, 64 nt, hsa; identical to SEQ ID NO: 51732

SEQ ID NO: 467034 - RNA, 64 nt, hsa; identical to SEQ ID NO: 51733

SEQ ID NO: 467035 - RNA, 64 nt, hsa; identical to SEQ ID NO: 51734

SEQ ID NO: 467036 - RNA, 64 nt, hsa; identical to SEQ ID NO: 51735

SEQ ID NO: 467037 - RNA, 64 nt, hsa; identical to SEQ ID NO: 51736

SEQ ID NO: 467038 - RNA, 64 nt, hsa; identical to SEQ ID NO: 51737

SEQ ID NO: 467039 - RNA, 64 nt, hsa; identical to SEQ ID NO: 51738

SEQ ID NO: 467040 - RNA, 64 nt, hsa; identical to SEQ ID NO: 51739

SEQ ID NO: 467041 - RNA, 64 nt, hsa; identical to SEQ ID NO: 51740

SEQ ID NO: 467042 - RNA, 64 nt, hsa; identical to SEQ ID NO: 51741

SEQ ID NO: 467043 - RNA, 64 nt, hsa; identical to SEQ ID NO: 51742

SEQ ID NO: 467044 - RNA, 64 nt, hsa; identical to SEQ ID NO: 51743

SEQ ID NO: 467045 - RNA, 64 nt, hsa; identical to SEQ ID NO: 51744

SEQ ID NO: 467046 - RNA, 64 nt, hsa; identical to SEQ ID NO: 51745

SEQ ID NO: 467047 - RNA, 64 nt, hsa; identical to SEQ ID NO: 51746

SEQ ID NO: 467048 - RNA, 64 nt, hsa; identical to SEQ ID NO: 51747

SEQ ID NO: 467049 - RNA, 64 nt, hsa; identical to SEQ ID NO: 51748

SEQ ID NO: 467050 - RNA, 64 nt, hsa; identical to SEQ ID NO: 236779

SEQ ID NO: 467051 - RNA, 64 nt, hsa; identical to SEQ ID NO: 236780

SEQ ID NO: 467052 - RNA, 64 nt, hsa; identical to SEQ ID NO: 236781

SEQ ID NO: 467053 - RNA, 64 nt, hsa; identical to SEQ ID NO: 236782

SEQ ID NO: 467054 - RNA, 64 nt, hsa; identical to SEQ ID NO: 236783

SEQ ID NO: 467055 - RNA, 64 nt, hsa; identical to SEQ ID NO: 236784

SEQ ID NO: 467056 - RNA, 64 nt, hsa; identical to SEQ ID NO: 236785

SEQ ID NO: 467057 - RNA, 64 nt, hsa; identical to SEQ ID NO: 236786

SEQ ID NO: 467058 - RNA, 64 nt, hsa; identical to SEQ ID NO: 236787

SEQ ID NO: 467059 - RNA, 64 nt, hsa; identical to SEQ ID NO: 236788

SEQ ID NO: 467060 - RNA, 64 nt, hsa; identical to SEQ ID NO: 236789

SEQ ID NO: 467061 - RNA, 64 nt, hsa; identical to SEQ ID NO: 236790

SEQ ID NO: 467062 - RNA, 64 nt, hsa; identical to SEQ ID NO: 223465

SEQ ID NO: 467063 - RNA, 64 nt, hsa; identical to SEQ ID NO: 223466

SEQ ID NO: 467064 - RNA, 64 nt, hsa; identical to SEQ ID NO: 223467

SEQ ID NO: 467065 - RNA, 64 nt, hsa; identical to SEQ ID NO: 223468

SEQ ID NO: 467066 - RNA, 64 nt, hsa; identical to SEQ ID NO: 223469

SEQ ID NO: 467067 - RNA, 64 nt, hsa; identical to SEQ ID NO: 223470

SEQ ID NO: 467068 - RNA, 64 nt, hsa; identical to SEQ ID NO: 223471

SEQ ID NO: 467069 - RNA, 64 nt, hsa; identical to SEQ ID NO: 223472

SEQ ID NO: 467070 - RNA, 64 nt, hsa; identical to SEQ ID NO: 223473

SEQ ID NO: 467071 - RNA, 64 nt, hsa; identical to SEQ ID NO: 223474

SEQ ID NO: 467072 - RNA, 64 nt, hsa; identical to SEQ ID NO: 223475

SEQ ID NO: 467073 - RNA, 64 nt, hsa; identical to SEQ ID NO: 223476

SEQ ID NO: 467074 - RNA, 64 nt, hsa; identical to SEQ ID NO: 223477

SEQ ID NO: 467075 - RNA, 64 nt, hsa; identical to SEQ ID NO: 223478

SEQ ID NO: 467076 - RNA, 64 nt, hsa; identical to SEQ ID NO: 223479

SEQ ID NO: 467077 - RNA, 64 nt, hsa; identical to SEQ ID NO: 223480

SEQ ID NO: 467078 - RNA, 64 nt, hsa; identical to SEQ ID NO: 223481

SEQ ID NO: 467079 - RNA, 64 nt, hsa; identical to SEQ ID NO: 223482

SEQ ID NO: 467080 - RNA, 64 nt, hsa; identical to SEQ ID NO: 223483

SEQ ID NO: 467081 - RNA, 64 nt, hsa; identical to SEQ ID NO: 223484

SEQ ID NO: 467082 - RNA, 64 nt, hsa; identical to SEQ ID NO: 223485

SEQ ID NO: 467083 - RNA, 64 nt, hsa; identical to SEQ ID NO: 223486

SEQ ID NO: 467084 - RNA, 64 nt, hsa; identical to SEQ ID NO: 223487

SEQ ID NO: 467085 - RNA, 64 nt, hsa; identical to SEQ ID NO: 223488

SEQ ID NO: 467086 - RNA, 64 nt, hsa; identical to SEQ ID NO: 223489

SEQ ID NO: 467087 - RNA, 64 nt, hsa; identical to SEQ ID NO: 223490

SEQ ID NO: 467088 - RNA, 64 nt, hsa; identical to SEQ ID NO: 223491

SEQ ID NO: 467089 - RNA, 64 nt, hsa; identical to SEQ ID NO: 223492

SEQ ID NO: 467090 - RNA, 64 nt, hsa; identical to SEQ ID NO: 223493

SEQ ID NO: 467091 - RNA, 64 nt, hsa; identical to SEQ ID NO: 223494

SEQ ID NO: 467092 - RNA, 64 nt, hsa; identical to SEQ ID NO: 223495

SEQ ID NO: 467093 - RNA, 64 nt, hsa; identical to SEQ ID NO: 223496

SEQ ID NO: 467094 - RNA, 64 nt, hsa; identical to SEQ ID NO: 223497

SEQ ID NO: 467095 - RNA, 64 nt, hsa; identical to SEQ ID NO: 223498

SEQ ID NO: 467096 - RNA, 64 nt, hsa; identical to SEQ ID NO: 223499

SEQ ID NO: 467097 - RNA, 64 nt, hsa; identical to SEQ ID NO: 223500

SEQ ID NO: 467098 - RNA, 64 nt, hsa; identical to SEQ ID NO: 223501

SEQ ID NO: 467099 - RNA, 64 nt, hsa; identical to SEQ ID NO: 223502

SEQ ID NO: 467100 - RNA, 64 nt, hsa; identical to SEQ ID NO: 223503

SEQ ID NO: 467101 - RNA, 64 nt, hsa; identical to SEQ ID NO: 223504

SEQ ID NO: 467102 - RNA, 64 nt, hsa; identical to SEQ ID NO: 223505

SEQ ID NO: 467103 - RNA, 64 nt, hsa; identical to SEQ ID NO: 223506

SEQ ID NO: 467104 - RNA, 64 nt, hsa; identical to SEQ ID NO: 223507

SEQ ID NO: 467105 - RNA, 64 nt, hsa; identical to SEQ ID NO: 223508

SEQ ID NO: 467106 - RNA, 64 nt, hsa; identical to SEQ ID NO: 223509

SEQ ID NO: 467107 - RNA, 64 nt, hsa; identical to SEQ ID NO: 223510

SEQ ID NO: 467108 - RNA, 64 nt, hsa; identical to SEQ ID NO: 223511

SEQ ID NO: 467109 - RNA, 64 nt, hsa; identical to SEQ ID NO: 223512

SEQ ID NO: 467110 - RNA, 64 nt, hsa; identical to SEQ ID NO: 223513

SEQ ID NO: 467111 - RNA, 64 nt, hsa; identical to SEQ ID NO: 223514

SEQ ID NO: 467112 - RNA, 64 nt, hsa; identical to SEQ ID NO: 223515

SEQ ID NO: 467113 - RNA, 64 nt, hsa; identical to SEQ ID NO: 223516

SEQ ID NO: 467114 - RNA, 64 nt, hsa; identical to SEQ ID NO: 223517

SEQ ID NO: 467115 - RNA, 64 nt, hsa; identical to SEQ ID NO: 223518

SEQ ID NO: 467116 - RNA, 64 nt, hsa; identical to SEQ ID NO: 223519

SEQ ID NO: 467117 - RNA, 64 nt, hsa; identical to SEQ ID NO: 223520

SEQ ID NO: 467118 - RNA, 64 nt, hsa; identical to SEQ ID NO: 223521

SEQ ID NO: 467119 - RNA, 64 nt, hsa; identical to SEQ ID NO: 223522

SEQ ID NO: 467120 - RNA, 64 nt, hsa; identical to SEQ ID NO: 223523

SEQ ID NO: 467121 - RNA, 64 nt, hsa; identical to SEQ ID NO: 223524

SEQ ID NO: 467122 - RNA, 64 nt, hsa; identical to SEQ ID NO: 223525

SEQ ID NO: 467123 - RNA, 64 nt, hsa; identical to SEQ ID NO: 223526

SEQ ID NO: 467124 - RNA, 64 nt, hsa; identical to SEQ ID NO: 223527

SEQ ID NO: 467125 - RNA, 64 nt, hsa; identical to SEQ ID NO: 223528

SEQ ID NO: 467126 - RNA, 64 nt, hsa; identical to SEQ ID NO: 223529

SEQ ID NO: 467127 - RNA, 64 nt, hsa; identical to SEQ ID NO: 223530

SEQ ID NO: 467128 - RNA, 64 nt, hsa; identical to SEQ ID NO: 223531

SEQ ID NO: 467129 - RNA, 64 nt, hsa; identical to SEQ ID NO: 223532

SEQ ID NO: 467130 - RNA, 64 nt, hsa; identical to SEQ ID NO: 223533

SEQ ID NO: 467131 - RNA, 64 nt, hsa; identical to SEQ ID NO: 223534

SEQ ID NO: 467132 - RNA, 64 nt, hsa; identical to SEQ ID NO: 223535

SEQ ID NO: 467133 - RNA, 64 nt, hsa; identical to SEQ ID NO: 223536

SEQ ID NO: 467134 - RNA, 64 nt, hsa; identical to SEQ ID NO: 223537

SEQ ID NO: 467135 - RNA, 64 nt, hsa; identical to SEQ ID NO: 223538

SEQ ID NO: 467136 - RNA, 64 nt, hsa; identical to SEQ ID NO: 223539

SEQ ID NO: 467137 - RNA, 64 nt, hsa; identical to SEQ ID NO: 223540

SEQ ID NO: 467138 - RNA, 64 nt, hsa; identical to SEQ ID NO: 223541

SEQ ID NO: 467139 - RNA, 64 nt, hsa; identical to SEQ ID NO: 223542

SEQ ID NO: 467140 - RNA, 64 nt, hsa; identical to SEQ ID NO: 223543

SEQ ID NO: 467141 - RNA, 64 nt, hsa; identical to SEQ ID NO: 223544

SEQ ID NO: 467142 - RNA, 64 nt, hsa; identical to SEQ ID NO: 223545

SEQ ID NO: 467143 - RNA, 64 nt, hsa; identical to SEQ ID NO: 223546

SEQ ID NO: 467144 - RNA, 64 nt, hsa; identical to SEQ ID NO: 223547

SEQ ID NO: 467145 - RNA, 64 nt, hsa; identical to SEQ ID NO: 223548

SEQ ID NO: 467146 - RNA, 64 nt, hsa; identical to SEQ ID NO: 223549

SEQ ID NO: 467147 - RNA, 64 nt, hsa; identical to SEQ ID NO: 223550

SEQ ID NO: 467148 - RNA, 64 nt, hsa; identical to SEQ ID NO: 223551

SEQ ID NO: 467149 - RNA, 64 nt, hsa; identical to SEQ ID NO: 223552

SEQ ID NO: 467150 - RNA, 64 nt, hsa; identical to SEQ ID NO: 223553

SEQ ID NO: 467151 - RNA, 64 nt, hsa; identical to SEQ ID NO: 223554

SEQ ID NO: 467152 - RNA, 64 nt, hsa; identical to SEQ ID NO: 223555

SEQ ID NO: 467153 - RNA, 64 nt, hsa; identical to SEQ ID NO: 223556

SEQ ID NO: 467154 - RNA, 64 nt, hsa; identical to SEQ ID NO: 223557

SEQ ID NO: 467155 - RNA, 64 nt, hsa; identical to SEQ ID NO: 223558

SEQ ID NO: 467156 - RNA, 64 nt, hsa; identical to SEQ ID NO: 223559

SEQ ID NO: 467157 - RNA, 64 nt, hsa; identical to SEQ ID NO: 223560

SEQ ID NO: 467158 - RNA, 64 nt, hsa; identical to SEQ ID NO: 223561

SEQ ID NO: 467159 - RNA, 64 nt, hsa; identical to SEQ ID NO: 223562

SEQ ID NO: 467160 - RNA, 64 nt, hsa; identical to SEQ ID NO: 223563

SEQ ID NO: 467161 - RNA, 64 nt, hsa; identical to SEQ ID NO: 223564

SEQ ID NO: 467162 - RNA, 64 nt, hsa; identical to SEQ ID NO: 223565

SEQ ID NO: 467163 - RNA, 64 nt, hsa; identical to SEQ ID NO: 223566

SEQ ID NO: 467164 - RNA, 64 nt, hsa; identical to SEQ ID NO: 223567

SEQ ID NO: 467165 - RNA, 64 nt, hsa; identical to SEQ ID NO: 223568

SEQ ID NO: 467166 - RNA, 64 nt, hsa; identical to SEQ ID NO: 223569

SEQ ID NO: 467167 - RNA, 64 nt, hsa; identical to SEQ ID NO: 223570

SEQ ID NO: 467168 - RNA, 64 nt, hsa; identical to SEQ ID NO: 223571

SEQ ID NO: 467169 - RNA, 64 nt, hsa
ucguuuuacaguugcccaagagaaaucaggugacuugcccaaggucacacagcuaguuagcggc

SEQ ID NO: 467170 - RNA, 64 nt, hsa
uuagagaucacccgaccaacccuucguuuuacaguugcccaagagaaaucaggugacuugccca

SEQ ID NO: 467171 - RNA, 64 nt, hsa
uuuuauuuuuuuguacagauggggucuugcuauguugcccaagcuggucuuaaacuccuggccu

SEQ ID NO: 467172 - RNA, 64 nt, hsa
uuaauaucaacucucacuccugaauucaguugcuuugcccaagauaggaguucucugaugcaga

SEQ ID NO: 467173 - RNA, 64 nt, hsa
ugucuacagaaaaugcuggcugagcugaacacauuugcccaauuccaggugugcacagaaaacc

SEQ ID NO: 467174 - RNA, 64 nt, hsa
uuuagagaucugagcugucucuuaaaggggacaguugcccaaaauguuccuugcuauguguucu

SEQ ID NO: 467175 - RNA, 64 nt, hsa
uuuuuuuuuuuucccgagaccaaguuucacucuguugcccaagguagagugcaguggcgugauc

SEQ ID NO: 467176 - RNA, 64 nt, hsa
ccaguauauucaguaguugaagaaagagcucucccugagucaguugcaaaacgucuauauuuuu

SEQ ID NO: 467177 - RNA, 64 nt, hsa
uaguacaugccuguaaucccagcuacacuggaggcugagucaggagaaucacuugaacguggga

SEQ ID NO: 467178 - RNA, 64 nt, hsa
agagauaaaagucagguuaauacuaucuuaaacacugagucagaaaaucauuacuguauagaag

SEQ ID NO: 467179 - RNA, 64 nt, hsa
guaaaaugaaccauuuacaguucgguuuuggacucugagucaaaggauuuuccuuuaaaugcuu

SEQ ID NO: 467180 - RNA, 64 nt, hsa
cgcuaucacacaccuccaagaucaagauccuguucugagucagaugaugaugacagcagugaaa

SEQ ID NO: 467181 - RNA, 64 nt, hsa
aaaaggaagaauuaugcugguaguaaaugggacucugagucaaauucagaacgagaugucacua

SEQ ID NO: 467182 - RNA, 64 nt, hsa
gucuacauaggcaaaguuuuccauuuuugucagucugagucaucaaaaagagucuuaauuuucu

SEQ ID NO: 467183 - RNA, 64 nt, hsa
uagaagcugaucugauugguccaacaguuugaugcugagucaugcguguugaaucccacuucag

SEQ ID NO: 467184 - RNA, 64 nt, hsa
uauuuuguuuuccccucuaaugagagggcauggccugagucagaagagcuaccccaggugaaac

SEQ ID NO: 467185 - RNA, 64 nt, hsa
guguucugcucaccacaccguccuucgguucuuacugagucacagacucgccugcccacuacgu

SEQ ID NO: 467186 - RNA, 64 nt, hsa
ccucuguccccuggccuagccucucuguccuucccugagucacagagagcaagccaagacaucc

SEQ ID NO: 467187 - RNA, 64 nt, hsa
aaccucccuagggcucccaacugaccucaggccucugagucacugaaugucaccaggagaggug

SEQ ID NO: 467188 - RNA, 64 nt, hsa
uuaguuacauuauuaaaagucauaaggcauuuaucugagucauugcucuacagagagcaauuaa

SEQ ID NO: 467189 - RNA, 64 nt, hsa
ccggugacauuuauucaccaaaggaauuaauauacugagucaaagauuaacaaugcuauacuau

SEQ ID NO: 467190 - RNA, 64 nt, hsa
aaaauuguaguccaaagugugauuuaaauguuaucugagucaaacauggguaagacucaaggua

SEQ ID NO: 467191 - RNA, 64 nt, hsa
ggccaccccucuucucucccacaugcacagcuuccugagucaccccucugucuaaccagcccca

SEQ ID NO: 467192 - RNA, 64 nt, hsa
cuuccuauuucucaauagucuuuaaacccuaaaucugagucaguaauucucuuacauccuuccc

SEQ ID NO: 467193 - RNA, 64 nt, hsa
cuuccuauuucucaauagucuuuaagcccuaaaucugagucaguaauucucuaaaaauccuucc

SEQ ID NO: 467194 - RNA, 64 nt, hsa
auguucccaaguaggcauucuaggcucuauuuaacugagucacacugcauaggaauuuagaacc

SEQ ID NO: 467195 - RNA, 64 nt, hsa
cugcugcuguggauaucuccaugaaguuuucccacugagucacaucagaaaugcccuacaucuu

SEQ ID NO: 467196 - RNA, 64 nt, hsa
cagugcuugaguuuggggaaugcggccgcauucccugagucaccaggaauguuaaagucagugg

SEQ ID NO: 467197 - RNA, 64 nt, hsa
gggauggaggagaagaauuuucagaccccagcggcugagucaugaucucccugccgccucaaug

SEQ ID NO: 467198 - RNA, 64 nt, hsa
cuggccuggguucuagaucucugggaaccagugccugagucacagcugucagugcagccauuug

SEQ ID NO: 467199 - RNA, 64 nt, hsa
cuggccuggguucuagaccucugggaaccagcaccugagucacagcugucuaggccucggugcu

SEQ ID NO: 467200 - RNA, 64 nt, hsa
acacucuacuuccuuugcagccuuagucacacaacugagucaucucaaguacucuuuaaggaca

SEQ ID NO: 467201 - RNA, 64 nt, hsa
aaguacucuuuaaggacacacagcccaggcuguucugagucagaauaggccccuacagguauau

SEQ ID NO: 467202 - RNA, 64 nt, hsa
aguaauuugccuaaggucacagcuaauaaguggcacagcuaauauucccaguaaagauaccaug

SEQ ID NO: 467203 - RNA, 64 nt, hsa
caggccagauaagugaaguaauuugccuaaggucacagcuaauaaguggcacagcuaauauucc

SEQ ID NO: 467204 - RNA, 64 nt, hsa
ccuugaccuuuucucagauaaucuguguauguacacagcuaacacagcucuuuagauucccugu

SEQ ID NO: 467205 - RNA, 64 nt, hsa
ucugccaaggguacauuauggccauuuuuaauuuacagcuaaaauauuuuuuaaaaugcauugc

SEQ ID NO: 467206 - RNA, 64 nt, hsa
uauucucuagaaugagcacaaaacaaaucgaauaacagcuaaacaaaucgaauaacagcuaaac

SEQ ID NO: 467207 - RNA, 64 nt, hsa
aaacaaaucgaauaacagcuaaacaaaucgaauaacagcuaaacgaaucgaauaacagcuuuug

SEQ ID NO: 467208 - RNA, 64 nt, hsa
aaugcuuuaugccaaacauguuuauuuuuaucacacagcuaaagucuguaguuaaguugcugcu

SEQ ID NO: 467209 - RNA, 64 nt, hsa
guacaaggcaggaaaagggauggaauugauggugacagcuaagucugucuuuuuucuuaggaaa

SEQ ID NO: 467210 - RNA, 64 nt, hsa
aauauugcuaauaccaaaaaugaaagaggccaucacagcuaauccuauggucaccaaaaggauu

SEQ ID NO: 467211 - RNA, 64 nt, hsa
ucaaguugguaaagaacauacuacaaaaaacccuacagcuaacauuauccuugauguuuccaac

SEQ ID NO: 467212 - RNA, 64 nt, hsa
aggcaggacaugcugaagccaaagccaauaacacacagcuaacacacagcucccauaaccgcug

SEQ ID NO: 467213 - RNA, 64 nt, hsa
gaaggcaaugccauccucaaacacugcaggcaucacagcuaacaauugugaagucgucuuaacu

SEQ ID NO: 467214 - RNA, 64 nt, hsa
ccugugagugcaucucuucuuuccuuuagucuucacagcuaacucuggagagcuucaaaacuag

SEQ ID NO: 467215 - RNA, 64 nt, hsa
ugggaugaguugccccgggcugcaaauuaagaguacagcuaagugcggggguggcgguggaggg

SEQ ID NO: 467216 - RNA, 64 nt, hsa
aaucuucagugauuccuuuuacuauagauucaugacagcuaauuaguacuaacugauuuagagg

SEQ ID NO: 467217 - RNA, 64 nt, hsa
acagacuuaacaacaaccgguauugacuggauugacagcuaaaguaucagaaugaaagcaaggu

SEQ ID NO: 467218 - RNA, 64 nt, hsa; identical to SEQ ID NO: 182508

SEQ ID NO: 467219 - RNA, 64 nt, hsa; identical to SEQ ID NO: 182509

SEQ ID NO: 467220 - RNA, 64 nt, hsa; identical to SEQ ID NO: 182510

SEQ ID NO: 467221 - RNA, 64 nt, hsa; identical to SEQ ID NO: 182511

SEQ ID NO: 467222 - RNA, 64 nt, hsa; identical to SEQ ID NO: 182512

SEQ ID NO: 467223 - RNA, 64 nt, hsa; identical to SEQ ID NO: 182513

SEQ ID NO: 467224 - RNA, 64 nt, hsa; identical to SEQ ID NO: 182514

SEQ ID NO: 467225 - RNA, 64 nt, hsa; identical to SEQ ID NO: 182515

SEQ ID NO: 467226 - RNA, 64 nt, hsa; identical to SEQ ID NO: 182516

SEQ ID NO: 467227 - RNA, 64 nt, hsa; identical to SEQ ID NO: 182517

SEQ ID NO: 467228 - RNA, 64 nt, hsa; identical to SEQ ID NO: 182518

SEQ ID NO: 467229 - RNA, 64 nt, hsa; identical to SEQ ID NO: 182519

SEQ ID NO: 467230 - RNA, 64 nt, hsa; identical to SEQ ID NO: 182520

SEQ ID NO: 467231 - RNA, 64 nt, hsa; identical to SEQ ID NO: 182521

SEQ ID NO: 467232 - RNA, 64 nt, hsa; identical to SEQ ID NO: 182522

SEQ ID NO: 467233 - RNA, 64 nt, hsa; identical to SEQ ID NO: 182523

SEQ ID NO: 467234 - RNA, 64 nt, hsa; identical to SEQ ID NO: 182524

SEQ ID NO: 467235 - RNA, 64 nt, hsa; identical to SEQ ID NO: 182525

SEQ ID NO: 467236 - RNA, 64 nt, hsa; identical to SEQ ID NO: 182526

SEQ ID NO: 467237 - RNA, 64 nt, hsa; identical to SEQ ID NO: 182527

SEQ ID NO: 467238 - RNA, 64 nt, hsa; identical to SEQ ID NO: 182528

SEQ ID NO: 467239 - RNA, 64 nt, hsa; identical to SEQ ID NO: 182529

SEQ ID NO: 467240 - RNA, 64 nt, hsa; identical to SEQ ID NO: 182530

SEQ ID NO: 467241 - RNA, 64 nt, hsa; identical to SEQ ID NO: 182531

SEQ ID NO: 467242 - RNA, 64 nt, hsa; identical to SEQ ID NO: 182532

SEQ ID NO: 467243 - RNA, 64 nt, hsa; identical to SEQ ID NO: 182533

SEQ ID NO: 467244 - RNA, 64 nt, hsa; identical to SEQ ID NO: 182534

SEQ ID NO: 467245 - RNA, 64 nt, hsa; identical to SEQ ID NO: 182535

SEQ ID NO: 467246 - RNA, 64 nt, hsa; identical to SEQ ID NO: 298158

SEQ ID NO: 467247 - RNA, 64 nt, hsa; identical to SEQ ID NO: 298159

SEQ ID NO: 467248 - RNA, 64 nt, hsa; identical to SEQ ID NO: 298160

SEQ ID NO: 467249 - RNA, 64 nt, hsa; identical to SEQ ID NO: 298161

SEQ ID NO: 467250 - RNA, 64 nt, hsa; identical to SEQ ID NO: 298162

SEQ ID NO: 467251 - RNA, 64 nt, hsa; identical to SEQ ID NO: 298163

SEQ ID NO: 467252 - RNA, 64 nt, hsa; identical to SEQ ID NO: 298164

SEQ ID NO: 467253 - RNA, 64 nt, hsa; identical to SEQ ID NO: 298165

SEQ ID NO: 467254 - RNA, 64 nt, hsa; identical to SEQ ID NO: 298166

SEQ ID NO: 467255 - RNA, 64 nt, hsa; identical to SEQ ID NO: 298167

SEQ ID NO: 467256 - RNA, 64 nt, hsa; identical to SEQ ID NO: 298168

SEQ ID NO: 467257 - RNA, 64 nt, hsa; identical to SEQ ID NO: 298169

SEQ ID NO: 467258 - RNA, 64 nt, hsa; identical to SEQ ID NO: 298170

SEQ ID NO: 467259 - RNA, 64 nt, hsa; identical to SEQ ID NO: 298171

SEQ ID NO: 467260 - RNA, 64 nt, hsa; identical to SEQ ID NO: 298172

SEQ ID NO: 467261 - RNA, 64 nt, hsa; identical to SEQ ID NO: 298173

SEQ ID NO: 467262 - RNA, 64 nt, hsa; identical to SEQ ID NO: 298174

SEQ ID NO: 467263 - RNA, 64 nt, hsa; identical to SEQ ID NO: 298175

SEQ ID NO: 467264 - RNA, 64 nt, hsa; identical to SEQ ID NO: 298176

SEQ ID NO: 467265 - RNA, 64 nt, hsa; identical to SEQ ID NO: 298177

SEQ ID NO: 467266 - RNA, 64 nt, hsa; identical to SEQ ID NO: 298178

SEQ ID NO: 467267 - RNA, 64 nt, hsa; identical to SEQ ID NO: 298179

SEQ ID NO: 467268 - RNA, 64 nt, hsa; identical to SEQ ID NO: 298180

SEQ ID NO: 467269 - RNA, 64 nt, hsa; identical to SEQ ID NO: 298181

SEQ ID NO: 467270 - RNA, 64 nt, hsa; identical to SEQ ID NO: 298182

SEQ ID NO: 467271 - RNA, 64 nt, hsa; identical to SEQ ID NO: 298183

SEQ ID NO: 467272 - RNA, 64 nt, hsa; identical to SEQ ID NO: 298184

SEQ ID NO: 467273 - RNA, 64 nt, hsa; identical to SEQ ID NO: 298185

SEQ ID NO: 467274 - RNA, 64 nt, hsa; identical to SEQ ID NO: 298186

SEQ ID NO: 467275 - RNA, 64 nt, hsa; identical to SEQ ID NO: 298187

SEQ ID NO: 467276 - RNA, 64 nt, hsa; identical to SEQ ID NO: 298188

SEQ ID NO: 467277 - RNA, 64 nt, hsa; identical to SEQ ID NO: 298189

SEQ ID NO: 467278 - RNA, 64 nt, hsa; identical to SEQ ID NO: 298190

SEQ ID NO: 467279 - RNA, 64 nt, hsa; identical to SEQ ID NO: 298191

SEQ ID NO: 467280 - RNA, 64 nt, hsa; identical to SEQ ID NO: 298192

SEQ ID NO: 467281 - RNA, 64 nt, hsa; identical to SEQ ID NO: 298193

SEQ ID NO: 467282 - RNA, 64 nt, hsa; identical to SEQ ID NO: 298194

SEQ ID NO: 467283 - RNA, 64 nt, hsa; identical to SEQ ID NO: 298195

SEQ ID NO: 467284 - RNA, 64 nt, hsa; identical to SEQ ID NO: 298196

SEQ ID NO: 467285 - RNA, 64 nt, hsa; identical to SEQ ID NO: 298197

SEQ ID NO: 467286 - RNA, 64 nt, hsa; identical to SEQ ID NO: 298198

SEQ ID NO: 467287 - RNA, 64 nt, hsa; identical to SEQ ID NO: 298199

SEQ ID NO: 467288 - RNA, 64 nt, hsa; identical to SEQ ID NO: 298200

SEQ ID NO: 467289 - RNA, 64 nt, hsa; identical to SEQ ID NO: 298201

SEQ ID NO: 467290 - RNA, 64 nt, hsa; identical to SEQ ID NO: 298202

SEQ ID NO: 467291 - RNA, 64 nt, hsa; identical to SEQ ID NO: 298203

SEQ ID NO: 467292 - RNA, 64 nt, hsa; identical to SEQ ID NO: 298204

SEQ ID NO: 467293 - RNA, 64 nt, hsa; identical to SEQ ID NO: 298205

SEQ ID NO: 467294 - RNA, 64 nt, hsa; identical to SEQ ID NO: 298206

SEQ ID NO: 467295 - RNA, 64 nt, hsa; identical to SEQ ID NO: 298207

SEQ ID NO: 467296 - RNA, 64 nt, hsa; identical to SEQ ID NO: 298208

SEQ ID NO: 467297 - RNA, 64 nt, hsa; identical to SEQ ID NO: 298209

SEQ ID NO: 467298 - RNA, 64 nt, hsa; identical to SEQ ID NO: 298210

SEQ ID NO: 467299 - RNA, 64 nt, hsa; identical to SEQ ID NO: 298211

SEQ ID NO: 467300 - RNA, 64 nt, hsa; identical to SEQ ID NO: 298212

SEQ ID NO: 467301 - RNA, 64 nt, hsa; identical to SEQ ID NO: 298213

SEQ ID NO: 467302 - RNA, 64 nt, hsa; identical to SEQ ID NO: 298214

SEQ ID NO: 467303 - RNA, 64 nt, hsa; identical to SEQ ID NO: 298215

SEQ ID NO: 467304 - RNA, 64 nt, hsa; identical to SEQ ID NO: 298216

SEQ ID NO: 467305 - RNA, 64 nt, hsa; identical to SEQ ID NO: 298217

SEQ ID NO: 467306 - RNA, 64 nt, hsa; identical to SEQ ID NO: 298218

SEQ ID NO: 467307 - RNA, 64 nt, hsa; identical to SEQ ID NO: 298219

SEQ ID NO: 467308 - RNA, 64 nt, hsa; identical to SEQ ID NO: 298220

SEQ ID NO: 467309 - RNA, 64 nt, hsa; identical to SEQ ID NO: 298221

SEQ ID NO: 467310 - RNA, 64 nt, hsa; identical to SEQ ID NO: 298222

SEQ ID NO: 467311 - RNA, 64 nt, hsa; identical to SEQ ID NO: 298223

SEQ ID NO: 467312 - RNA, 64 nt, hsa; identical to SEQ ID NO: 298224

SEQ ID NO: 467313 - RNA, 64 nt, hsa; identical to SEQ ID NO: 298225

SEQ ID NO: 467314 - RNA, 64 nt, hsa; identical to SEQ ID NO: 298226

SEQ ID NO: 467315 - RNA, 64 nt, hsa; identical to SEQ ID NO: 298227

SEQ ID NO: 467316 - RNA, 64 nt, hsa; identical to SEQ ID NO: 298228

SEQ ID NO: 467317 - RNA, 64 nt, hsa; identical to SEQ ID NO: 298229

SEQ ID NO: 467318 - RNA, 56 nt, hsa; identical to SEQ ID NO: 298230

SEQ ID NO: 467319 - RNA, 64 nt, hsa; identical to SEQ ID NO: 298231

SEQ ID NO: 467320 - RNA, 64 nt, hsa; identical to SEQ ID NO: 298232

SEQ ID NO: 467321 - RNA, 64 nt, hsa; identical to SEQ ID NO: 298233

SEQ ID NO: 467322 - RNA, 64 nt, hsa; identical to SEQ ID NO: 298234

SEQ ID NO: 467323 - RNA, 64 nt, hsa; identical to SEQ ID NO: 298235

SEQ ID NO: 467324 - RNA, 64 nt, hsa; identical to SEQ ID NO: 298236

SEQ ID NO: 467325 - RNA, 64 nt, hsa; identical to SEQ ID NO: 298237

SEQ ID NO: 467326 - RNA, 64 nt, hsa; identical to SEQ ID NO: 298238

SEQ ID NO: 467327 - RNA, 63 nt, hsa; identical to SEQ ID NO: 298239

SEQ ID NO: 467328 - RNA, 64 nt, hsa; identical to SEQ ID NO: 298240

SEQ ID NO: 467329 - RNA, 64 nt, hsa; identical to SEQ ID NO: 298241

SEQ ID NO: 467330 - RNA, 64 nt, hsa; identical to SEQ ID NO: 298242

SEQ ID NO: 467331 - RNA, 64 nt, hsa; identical to SEQ ID NO: 298243

SEQ ID NO: 467332 - RNA, 64 nt, hsa; identical to SEQ ID NO: 298244

SEQ ID NO: 467333 - RNA, 64 nt, hsa; identical to SEQ ID NO: 298245

SEQ ID NO: 467334 - RNA, 64 nt, hsa; identical to SEQ ID NO: 298246

SEQ ID NO: 467335 - RNA, 64 nt, hsa; identical to SEQ ID NO: 298247

SEQ ID NO: 467336 - RNA, 64 nt, hsa; identical to SEQ ID NO: 298248

SEQ ID NO: 467337 - RNA, 64 nt, hsa; identical to SEQ ID NO: 298249

SEQ ID NO: 467338 - RNA, 64 nt, hsa; identical to SEQ ID NO: 182508

SEQ ID NO: 467339 - RNA, 64 nt, hsa; identical to SEQ ID NO: 182509

SEQ ID NO: 467340 - RNA, 64 nt, hsa; identical to SEQ ID NO: 182510

SEQ ID NO: 467341 - RNA, 64 nt, hsa; identical to SEQ ID NO: 182511

SEQ ID NO: 467342 - RNA, 64 nt, hsa; identical to SEQ ID NO: 182512

SEQ ID NO: 467343 - RNA, 64 nt, hsa; identical to SEQ ID NO: 182513

SEQ ID NO: 467344 - RNA, 64 nt, hsa; identical to SEQ ID NO: 182514

SEQ ID NO: 467345 - RNA, 64 nt, hsa; identical to SEQ ID NO: 182515

SEQ ID NO: 467346 - RNA, 64 nt, hsa; identical to SEQ ID NO: 182516

SEQ ID NO: 467347 - RNA, 64 nt, hsa; identical to SEQ ID NO: 182517

SEQ ID NO: 467348 - RNA, 64 nt, hsa; identical to SEQ ID NO: 182518

SEQ ID NO: 467349 - RNA, 64 nt, hsa; identical to SEQ ID NO: 182519

SEQ ID NO: 467350 - RNA, 64 nt, hsa; identical to SEQ ID NO: 182520

SEQ ID NO: 467351 - RNA, 64 nt, hsa; identical to SEQ ID NO: 182521

SEQ ID NO: 467352 - RNA, 64 nt, hsa; identical to SEQ ID NO: 182522

SEQ ID NO: 467353 - RNA, 64 nt, hsa; identical to SEQ ID NO: 182523

SEQ ID NO: 467354 - RNA, 64 nt, hsa; identical to SEQ ID NO: 182524

SEQ ID NO: 467355 - RNA, 64 nt, hsa; identical to SEQ ID NO: 182525

SEQ ID NO: 467356 - RNA, 64 nt, hsa; identical to SEQ ID NO: 182526

SEQ ID NO: 467357 - RNA, 64 nt, hsa; identical to SEQ ID NO: 182527

SEQ ID NO: 467358 - RNA, 64 nt, hsa; identical to SEQ ID NO: 182528

SEQ ID NO: 467359 - RNA, 64 nt, hsa; identical to SEQ ID NO: 182529

SEQ ID NO: 467360 - RNA, 64 nt, hsa; identical to SEQ ID NO: 182530

SEQ ID NO: 467361 - RNA, 64 nt, hsa; identical to SEQ ID NO: 182531

SEQ ID NO: 467362 - RNA, 64 nt, hsa; identical to SEQ ID NO: 182532

SEQ ID NO: 467363 - RNA, 64 nt, hsa; identical to SEQ ID NO: 182533

SEQ ID NO: 467364 - RNA, 64 nt, hsa; identical to SEQ ID NO: 182534

SEQ ID NO: 467365 - RNA, 64 nt, hsa; identical to SEQ ID NO: 182535

SEQ ID NO: 467366 - RNA, 64 nt, hsa; identical to SEQ ID NO: 298158

SEQ ID NO: 467367 - RNA, 64 nt, hsa; identical to SEQ ID NO: 298159

SEQ ID NO: 467368 - RNA, 64 nt, hsa; identical to SEQ ID NO: 298160

SEQ ID NO: 467369 - RNA, 64 nt, hsa; identical to SEQ ID NO: 298161

SEQ ID NO: 467370 - RNA, 64 nt, hsa; identical to SEQ ID NO: 298162

SEQ ID NO: 467371 - RNA, 64 nt, hsa; identical to SEQ ID NO: 298163

SEQ ID NO: 467372 - RNA, 64 nt, hsa; identical to SEQ ID NO: 298164

SEQ ID NO: 467373 - RNA, 64 nt, hsa; identical to SEQ ID NO: 298165

SEQ ID NO: 467374 - RNA, 64 nt, hsa; identical to SEQ ID NO: 298166

SEQ ID NO: 467375 - RNA, 64 nt, hsa; identical to SEQ ID NO: 298167

SEQ ID NO: 467376 - RNA, 64 nt, hsa; identical to SEQ ID NO: 298168

SEQ ID NO: 467377 - RNA, 64 nt, hsa; identical to SEQ ID NO: 298169

SEQ ID NO: 467378 - RNA, 64 nt, hsa; identical to SEQ ID NO: 298170

SEQ ID NO: 467379 - RNA, 64 nt, hsa; identical to SEQ ID NO: 298171

SEQ ID NO: 467380 - RNA, 64 nt, hsa; identical to SEQ ID NO: 298172

SEQ ID NO: 467381 - RNA, 64 nt, hsa; identical to SEQ ID NO: 298173

SEQ ID NO: 467382 - RNA, 64 nt, hsa; identical to SEQ ID NO: 298174

SEQ ID NO: 467383 - RNA, 64 nt, hsa; identical to SEQ ID NO: 298175

SEQ ID NO: 467384 - RNA, 64 nt, hsa; identical to SEQ ID NO: 298176

SEQ ID NO: 467385 - RNA, 64 nt, hsa; identical to SEQ ID NO: 298177

SEQ ID NO: 467386 - RNA, 64 nt, hsa; identical to SEQ ID NO: 298178

SEQ ID NO: 467387 - RNA, 64 nt, hsa; identical to SEQ ID NO: 298179

SEQ ID NO: 467388 - RNA, 64 nt, hsa; identical to SEQ ID NO: 298180

SEQ ID NO: 467389 - RNA, 64 nt, hsa; identical to SEQ ID NO: 298181

SEQ ID NO: 467390 - RNA, 64 nt, hsa; identical to SEQ ID NO: 298182

SEQ ID NO: 467391 - RNA, 64 nt, hsa; identical to SEQ ID NO: 298183

SEQ ID NO: 467392 - RNA, 64 nt, hsa; identical to SEQ ID NO: 298184

SEQ ID NO: 467393 - RNA, 64 nt, hsa; identical to SEQ ID NO: 298185

SEQ ID NO: 467394 - RNA, 64 nt, hsa; identical to SEQ ID NO: 298186

SEQ ID NO: 467395 - RNA, 64 nt, hsa; identical to SEQ ID NO: 298187

SEQ ID NO: 467396 - RNA, 64 nt, hsa; identical to SEQ ID NO: 298188

SEQ ID NO: 467397 - RNA, 64 nt, hsa; identical to SEQ ID NO: 298189

SEQ ID NO: 467398 - RNA, 64 nt, hsa; identical to SEQ ID NO: 298190

SEQ ID NO: 467399 - RNA, 64 nt, hsa; identical to SEQ ID NO: 298191

SEQ ID NO: 467400 - RNA, 64 nt, hsa; identical to SEQ ID NO: 298192

SEQ ID NO: 467401 - RNA, 64 nt, hsa; identical to SEQ ID NO: 298193

SEQ ID NO: 467402 - RNA, 64 nt, hsa; identical to SEQ ID NO: 298194

SEQ ID NO: 467403 - RNA, 64 nt, hsa; identical to SEQ ID NO: 298195

SEQ ID NO: 467404 - RNA, 64 nt, hsa; identical to SEQ ID NO: 298196

SEQ ID NO: 467405 - RNA, 64 nt, hsa; identical to SEQ ID NO: 298197

SEQ ID NO: 467406 - RNA, 64 nt, hsa; identical to SEQ ID NO: 298198

SEQ ID NO: 467407 - RNA, 64 nt, hsa; identical to SEQ ID NO: 298199

SEQ ID NO: 467408 - RNA, 64 nt, hsa; identical to SEQ ID NO: 298200

SEQ ID NO: 467409 - RNA, 64 nt, hsa; identical to SEQ ID NO: 298201

SEQ ID NO: 467410 - RNA, 64 nt, hsa; identical to SEQ ID NO: 298202

SEQ ID NO: 467411 - RNA, 64 nt, hsa; identical to SEQ ID NO: 298203

SEQ ID NO: 467412 - RNA, 64 nt, hsa; identical to SEQ ID NO: 298204

SEQ ID NO: 467413 - RNA, 64 nt, hsa; identical to SEQ ID NO: 298205

SEQ ID NO: 467414 - RNA, 64 nt, hsa; identical to SEQ ID NO: 298206

SEQ ID NO: 467415 - RNA, 64 nt, hsa; identical to SEQ ID NO: 298207

SEQ ID NO: 467416 - RNA, 64 nt, hsa; identical to SEQ ID NO: 298208

SEQ ID NO: 467417 - RNA, 64 nt, hsa; identical to SEQ ID NO: 298209

SEQ ID NO: 467418 - RNA, 64 nt, hsa; identical to SEQ ID NO: 298210

SEQ ID NO: 467419 - RNA, 64 nt, hsa; identical to SEQ ID NO: 298211

SEQ ID NO: 467420 - RNA, 64 nt, hsa; identical to SEQ ID NO: 298212

SEQ ID NO: 467421 - RNA, 64 nt, hsa; identical to SEQ ID NO: 298213

SEQ ID NO: 467422 - RNA, 64 nt, hsa; identical to SEQ ID NO: 298214

SEQ ID NO: 467423 - RNA, 64 nt, hsa; identical to SEQ ID NO: 298215

SEQ ID NO: 467424 - RNA, 64 nt, hsa; identical to SEQ ID NO: 298216

SEQ ID NO: 467425 - RNA, 64 nt, hsa; identical to SEQ ID NO: 298217

SEQ ID NO: 467426 - RNA, 64 nt, hsa; identical to SEQ ID NO: 298218

SEQ ID NO: 467427 - RNA, 64 nt, hsa; identical to SEQ ID NO: 298219

SEQ ID NO: 467428 - RNA, 64 nt, hsa; identical to SEQ ID NO: 298220

SEQ ID NO: 467429 - RNA, 64 nt, hsa; identical to SEQ ID NO: 298221

SEQ ID NO: 467430 - RNA, 64 nt, hsa; identical to SEQ ID NO: 298222

SEQ ID NO: 467431 - RNA, 64 nt, hsa; identical to SEQ ID NO: 298223

SEQ ID NO: 467432 - RNA, 64 nt, hsa; identical to SEQ ID NO: 298224

SEQ ID NO: 467433 - RNA, 64 nt, hsa; identical to SEQ ID NO: 298225

SEQ ID NO: 467434 - RNA, 64 nt, hsa; identical to SEQ ID NO: 298226

SEQ ID NO: 467435 - RNA, 64 nt, hsa; identical to SEQ ID NO: 298227

SEQ ID NO: 467436 - RNA, 64 nt, hsa; identical to SEQ ID NO: 298228

SEQ ID NO: 467437 - RNA, 64 nt, hsa; identical to SEQ ID NO: 298229

SEQ ID NO: 467438 - RNA, 56 nt, hsa; identical to SEQ ID NO: 298230

SEQ ID NO: 467439 - RNA, 64 nt, hsa; identical to SEQ ID NO: 298231

SEQ ID NO: 467440 - RNA, 64 nt, hsa; identical to SEQ ID NO: 298232

SEQ ID NO: 467441 - RNA, 64 nt, hsa; identical to SEQ ID NO: 298233

SEQ ID NO: 467442 - RNA, 64 nt, hsa; identical to SEQ ID NO: 298234

SEQ ID NO: 467443 - RNA, 64 nt, hsa; identical to SEQ ID NO: 298235

SEQ ID NO: 467444 - RNA, 64 nt, hsa; identical to SEQ ID NO: 298236

SEQ ID NO: 467445 - RNA, 64 nt, hsa; identical to SEQ ID NO: 298237

SEQ ID NO: 467446 - RNA, 64 nt, hsa; identical to SEQ ID NO: 298238

SEQ ID NO: 467447 - RNA, 63 nt, hsa; identical to SEQ ID NO: 298239

SEQ ID NO: 467448 - RNA, 64 nt, hsa; identical to SEQ ID NO: 298240

SEQ ID NO: 467449 - RNA, 64 nt, hsa; identical to SEQ ID NO: 298241

SEQ ID NO: 467450 - RNA, 64 nt, hsa; identical to SEQ ID NO: 298242

SEQ ID NO: 467451 - RNA, 64 nt, hsa; identical to SEQ ID NO: 298243

SEQ ID NO: 467452 - RNA, 64 nt, hsa; identical to SEQ ID NO: 298244

SEQ ID NO: 467453 - RNA, 64 nt, hsa; identical to SEQ ID NO: 298245

SEQ ID NO: 467454 - RNA, 64 nt, hsa; identical to SEQ ID NO: 298246

SEQ ID NO: 467455 - RNA, 64 nt, hsa; identical to SEQ ID NO: 298247

SEQ ID NO: 467456 - RNA, 64 nt, hsa; identical to SEQ ID NO: 298248

SEQ ID NO: 467457 - RNA, 64 nt, hsa; identical to SEQ ID NO: 298249

SEQ ID NO: 467458 - RNA, 64 nt, hsa; identical to SEQ ID NO: 182508

SEQ ID NO: 467459 - RNA, 64 nt, hsa; identical to SEQ ID NO: 182509

SEQ ID NO: 467460 - RNA, 64 nt, hsa; identical to SEQ ID NO: 182510

SEQ ID NO: 467461 - RNA, 64 nt, hsa; identical to SEQ ID NO: 182511

SEQ ID NO: 467462 - RNA, 64 nt, hsa; identical to SEQ ID NO: 182512

SEQ ID NO: 467463 - RNA, 64 nt, hsa; identical to SEQ ID NO: 182513

SEQ ID NO: 467464 - RNA, 64 nt, hsa; identical to SEQ ID NO: 182514

SEQ ID NO: 467465 - RNA, 64 nt, hsa; identical to SEQ ID NO: 182515

SEQ ID NO: 467466 - RNA, 64 nt, hsa; identical to SEQ ID NO: 182516

SEQ ID NO: 467467 - RNA, 64 nt, hsa; identical to SEQ ID NO: 182517

SEQ ID NO: 467468 - RNA, 64 nt, hsa; identical to SEQ ID NO: 182518

SEQ ID NO: 467469 - RNA, 64 nt, hsa; identical to SEQ ID NO: 182519

SEQ ID NO: 467470 - RNA, 64 nt, hsa; identical to SEQ ID NO: 182520

SEQ ID NO: 467471 - RNA, 64 nt, hsa; identical to SEQ ID NO: 182521

SEQ ID NO: 467472 - RNA, 64 nt, hsa; identical to SEQ ID NO: 182522

SEQ ID NO: 467473 - RNA, 64 nt, hsa; identical to SEQ ID NO: 182523

SEQ ID NO: 467474 - RNA, 64 nt, hsa; identical to SEQ ID NO: 182524

SEQ ID NO: 467475 - RNA, 64 nt, hsa; identical to SEQ ID NO: 182525

SEQ ID NO: 467476 - RNA, 64 nt, hsa; identical to SEQ ID NO: 182526

SEQ ID NO: 467477 - RNA, 64 nt, hsa; identical to SEQ ID NO: 182527

SEQ ID NO: 467478 - RNA, 64 nt, hsa; identical to SEQ ID NO: 182528

SEQ ID NO: 467479 - RNA, 64 nt, hsa; identical to SEQ ID NO: 182529

SEQ ID NO: 467480 - RNA, 64 nt, hsa; identical to SEQ ID NO: 182530

SEQ ID NO: 467481 - RNA, 64 nt, hsa; identical to SEQ ID NO: 182531

SEQ ID NO: 467482 - RNA, 64 nt, hsa; identical to SEQ ID NO: 182532

SEQ ID NO: 467483 - RNA, 64 nt, hsa; identical to SEQ ID NO: 182533

SEQ ID NO: 467484 - RNA, 64 nt, hsa; identical to SEQ ID NO: 182534

SEQ ID NO: 467485 - RNA, 64 nt, hsa; identical to SEQ ID NO: 182535

SEQ ID NO: 467486 - RNA, 64 nt, hsa; identical to SEQ ID NO: 298158

SEQ ID NO: 467487 - RNA, 64 nt, hsa; identical to SEQ ID NO: 298159

SEQ ID NO: 467488 - RNA, 64 nt, hsa; identical to SEQ ID NO: 298160

SEQ ID NO: 467489 - RNA, 64 nt, hsa; identical to SEQ ID NO: 298161

SEQ ID NO: 467490 - RNA, 64 nt, hsa; identical to SEQ ID NO: 298162

SEQ ID NO: 467491 - RNA, 64 nt, hsa; identical to SEQ ID NO: 298163

SEQ ID NO: 467492 - RNA, 64 nt, hsa; identical to SEQ ID NO: 298164

SEQ ID NO: 467493 - RNA, 64 nt, hsa; identical to SEQ ID NO: 298165

SEQ ID NO: 467494 - RNA, 64 nt, hsa; identical to SEQ ID NO: 298166

SEQ ID NO: 467495 - RNA, 64 nt, hsa; identical to SEQ ID NO: 298167

SEQ ID NO: 467496 - RNA, 64 nt, hsa; identical to SEQ ID NO: 298168

SEQ ID NO: 467497 - RNA, 64 nt, hsa; identical to SEQ ID NO: 298169

SEQ ID NO: 467498 - RNA, 64 nt, hsa; identical to SEQ ID NO: 298170

SEQ ID NO: 467499 - RNA, 64 nt, hsa; identical to SEQ ID NO: 298171

SEQ ID NO: 467500 - RNA, 64 nt, hsa; identical to SEQ ID NO: 298172

SEQ ID NO: 467501 - RNA, 64 nt, hsa; identical to SEQ ID NO: 298173

SEQ ID NO: 467502 - RNA, 64 nt, hsa; identical to SEQ ID NO: 298174

SEQ ID NO: 467503 - RNA, 64 nt, hsa; identical to SEQ ID NO: 298175

SEQ ID NO: 467504 - RNA, 64 nt, hsa; identical to SEQ ID NO: 298176

SEQ ID NO: 467505 - RNA, 64 nt, hsa; identical to SEQ ID NO: 298177

SEQ ID NO: 467506 - RNA, 64 nt, hsa; identical to SEQ ID NO: 298178

SEQ ID NO: 467507 - RNA, 64 nt, hsa; identical to SEQ ID NO: 298179

SEQ ID NO: 467508 - RNA, 64 nt, hsa; identical to SEQ ID NO: 298180

SEQ ID NO: 467509 - RNA, 64 nt, hsa; identical to SEQ ID NO: 298181

SEQ ID NO: 467510 - RNA, 64 nt, hsa; identical to SEQ ID NO: 298182

SEQ ID NO: 467511 - RNA, 64 nt, hsa; identical to SEQ ID NO: 298183

SEQ ID NO: 467512 - RNA, 64 nt, hsa; identical to SEQ ID NO: 298184

SEQ ID NO: 467513 - RNA, 64 nt, hsa; identical to SEQ ID NO: 298185

SEQ ID NO: 467514 - RNA, 64 nt, hsa; identical to SEQ ID NO: 298186

SEQ ID NO: 467515 - RNA, 64 nt, hsa; identical to SEQ ID NO: 298187

SEQ ID NO: 467516 - RNA, 64 nt, hsa; identical to SEQ ID NO: 298188

SEQ ID NO: 467517 - RNA, 64 nt, hsa; identical to SEQ ID NO: 298189

SEQ ID NO: 467518 - RNA, 64 nt, hsa; identical to SEQ ID NO: 298190

SEQ ID NO: 467519 - RNA, 64 nt, hsa; identical to SEQ ID NO: 298191

SEQ ID NO: 467520 - RNA, 64 nt, hsa; identical to SEQ ID NO: 298192

SEQ ID NO: 467521 - RNA, 64 nt, hsa; identical to SEQ ID NO: 298193

SEQ ID NO: 467522 - RNA, 64 nt, hsa; identical to SEQ ID NO: 298194

SEQ ID NO: 467523 - RNA, 64 nt, hsa; identical to SEQ ID NO: 298195

SEQ ID NO: 467524 - RNA, 64 nt, hsa; identical to SEQ ID NO: 298196

SEQ ID NO: 467525 - RNA, 64 nt, hsa; identical to SEQ ID NO: 298197

SEQ ID NO: 467526 - RNA, 64 nt, hsa; identical to SEQ ID NO: 298198

SEQ ID NO: 467527 - RNA, 64 nt, hsa; identical to SEQ ID NO: 298199

SEQ ID NO: 467528 - RNA, 64 nt, hsa; identical to SEQ ID NO: 298200

SEQ ID NO: 467529 - RNA, 64 nt, hsa; identical to SEQ ID NO: 298201

SEQ ID NO: 467530 - RNA, 64 nt, hsa; identical to SEQ ID NO: 298202

SEQ ID NO: 467531 - RNA, 64 nt, hsa; identical to SEQ ID NO: 298203

SEQ ID NO: 467532 - RNA, 64 nt, hsa; identical to SEQ ID NO: 298204

SEQ ID NO: 467533 - RNA, 64 nt, hsa; identical to SEQ ID NO: 298205

SEQ ID NO: 467534 - RNA, 64 nt, hsa; identical to SEQ ID NO: 298206

SEQ ID NO: 467535 - RNA, 64 nt, hsa; identical to SEQ ID NO: 298207

SEQ ID NO: 467536 - RNA, 64 nt, hsa; identical to SEQ ID NO: 298208

SEQ ID NO: 467537 - RNA, 64 nt, hsa; identical to SEQ ID NO: 298209

SEQ ID NO: 467538 - RNA, 64 nt, hsa; identical to SEQ ID NO: 298210

SEQ ID NO: 467539 - RNA, 64 nt, hsa; identical to SEQ ID NO: 298211

SEQ ID NO: 467540 - RNA, 64 nt, hsa; identical to SEQ ID NO: 298212

SEQ ID NO: 467541 - RNA, 64 nt, hsa; identical to SEQ ID NO: 298213

SEQ ID NO: 467542 - RNA, 64 nt, hsa; identical to SEQ ID NO: 298214

SEQ ID NO: 467543 - RNA, 64 nt, hsa; identical to SEQ ID NO: 298215

SEQ ID NO: 467544 - RNA, 64 nt, hsa; identical to SEQ ID NO: 298216

SEQ ID NO: 467545 - RNA, 64 nt, hsa; identical to SEQ ID NO: 298217

SEQ ID NO: 467546 - RNA, 64 nt, hsa; identical to SEQ ID NO: 298218

SEQ ID NO: 467547 - RNA, 64 nt, hsa; identical to SEQ ID NO: 298219

SEQ ID NO: 467548 - RNA, 64 nt, hsa; identical to SEQ ID NO: 298220

SEQ ID NO: 467549 - RNA, 64 nt, hsa; identical to SEQ ID NO: 298221

SEQ ID NO: 467550 - RNA, 64 nt, hsa; identical to SEQ ID NO: 298222

SEQ ID NO: 467551 - RNA, 64 nt, hsa; identical to SEQ ID NO: 298223

SEQ ID NO: 467552 - RNA, 64 nt, hsa; identical to SEQ ID NO: 298224

SEQ ID NO: 467553 - RNA, 64 nt, hsa; identical to SEQ ID NO: 298225

SEQ ID NO: 467554 - RNA, 64 nt, hsa; identical to SEQ ID NO: 298226

SEQ ID NO: 467555 - RNA, 64 nt, hsa; identical to SEQ ID NO: 298227

SEQ ID NO: 467556 - RNA, 64 nt, hsa; identical to SEQ ID NO: 298228

SEQ ID NO: 467557 - RNA, 64 nt, hsa; identical to SEQ ID NO: 298229

SEQ ID NO: 467558 - RNA, 56 nt, hsa; identical to SEQ ID NO: 298230

SEQ ID NO: 467559 - RNA, 64 nt, hsa; identical to SEQ ID NO: 298231

SEQ ID NO: 467560 - RNA, 64 nt, hsa; identical to SEQ ID NO: 298232

SEQ ID NO: 467561 - RNA, 64 nt, hsa; identical to SEQ ID NO: 298233

SEQ ID NO: 467562 - RNA, 64 nt, hsa; identical to SEQ ID NO: 298234

SEQ ID NO: 467563 - RNA, 64 nt, hsa; identical to SEQ ID NO: 298235

SEQ ID NO: 467564 - RNA, 64 nt, hsa; identical to SEQ ID NO: 298236

SEQ ID NO: 467565 - RNA, 64 nt, hsa; identical to SEQ ID NO: 298237

SEQ ID NO: 467566 - RNA, 64 nt, hsa; identical to SEQ ID NO: 298238

SEQ ID NO: 467567 - RNA, 63 nt, hsa; identical to SEQ ID NO: 298239

SEQ ID NO: 467568 - RNA, 64 nt, hsa; identical to SEQ ID NO: 298240

SEQ ID NO: 467569 - RNA, 64 nt, hsa; identical to SEQ ID NO: 298241

SEQ ID NO: 467570 - RNA, 64 nt, hsa; identical to SEQ ID NO: 298242

SEQ ID NO: 467571 - RNA, 64 nt, hsa; identical to SEQ ID NO: 298243

SEQ ID NO: 467572 - RNA, 64 nt, hsa; identical to SEQ ID NO: 298244

SEQ ID NO: 467573 - RNA, 64 nt, hsa; identical to SEQ ID NO: 298245

SEQ ID NO: 467574 - RNA, 64 nt, hsa; identical to SEQ ID NO: 298246

SEQ ID NO: 467575 - RNA, 64 nt, hsa; identical to SEQ ID NO: 298247

SEQ ID NO: 467576 - RNA, 64 nt, hsa; identical to SEQ ID NO: 298248

SEQ ID NO: 467577 - RNA, 64 nt, hsa; identical to SEQ ID NO: 298249

SEQ ID NO: 467578 - RNA, 64 nt, hsa; identical to SEQ ID NO: 133489

SEQ ID NO: 467579 - RNA, 64 nt, hsa; identical to SEQ ID NO: 133490

SEQ ID NO: 467580 - RNA, 64 nt, hsa; identical to SEQ ID NO: 133491

SEQ ID NO: 467581 - RNA, 64 nt, hsa; identical to SEQ ID NO: 133492

SEQ ID NO: 467582 - RNA, 64 nt, hsa; identical to SEQ ID NO: 133493

SEQ ID NO: 467583 - RNA, 64 nt, hsa; identical to SEQ ID NO: 133494

SEQ ID NO: 467584 - RNA, 64 nt, hsa; identical to SEQ ID NO: 133495

SEQ ID NO: 467585 - RNA, 64 nt, hsa; identical to SEQ ID NO: 133496

SEQ ID NO: 467586 - RNA, 64 nt, hsa; identical to SEQ ID NO: 133497

SEQ ID NO: 467587 - RNA, 64 nt, hsa; identical to SEQ ID NO: 133498

SEQ ID NO: 467588 - RNA, 64 nt, hsa; identical to SEQ ID NO: 133499

SEQ ID NO: 467589 - RNA, 64 nt, hsa; identical to SEQ ID NO: 133500

SEQ ID NO: 467590 - RNA, 64 nt, hsa; identical to SEQ ID NO: 133501

SEQ ID NO: 467591 - RNA, 64 nt, hsa; identical to SEQ ID NO: 133502

SEQ ID NO: 467592 - RNA, 64 nt, hsa; identical to SEQ ID NO: 133503

SEQ ID NO: 467593 - RNA, 64 nt, hsa; identical to SEQ ID NO: 133504

SEQ ID NO: 467594 - RNA, 64 nt, hsa; identical to SEQ ID NO: 133505

SEQ ID NO: 467595 - RNA, 64 nt, hsa; identical to SEQ ID NO: 133506

SEQ ID NO: 467596 - RNA, 64 nt, hsa; identical to SEQ ID NO: 133507

SEQ ID NO: 467597 - RNA, 64 nt, hsa; identical to SEQ ID NO: 133508

SEQ ID NO: 467598 - RNA, 64 nt, hsa; identical to SEQ ID NO: 133509

SEQ ID NO: 467599 - RNA, 64 nt, hsa; identical to SEQ ID NO: 133510

SEQ ID NO: 467600 - RNA, 64 nt, hsa; identical to SEQ ID NO: 439495

SEQ ID NO: 467601 - RNA, 64 nt, hsa; identical to SEQ ID NO: 439496

SEQ ID NO: 467602 - RNA, 64 nt, hsa; identical to SEQ ID NO: 439497

SEQ ID NO: 467603 - RNA, 64 nt, hsa; identical to SEQ ID NO: 439498

SEQ ID NO: 467604 - RNA, 64 nt, hsa; identical to SEQ ID NO: 439499

SEQ ID NO: 467605 - RNA, 64 nt, hsa; identical to SEQ ID NO: 439500

SEQ ID NO: 467606 - RNA, 64 nt, hsa; identical to SEQ ID NO: 439501

SEQ ID NO: 467607 - RNA, 64 nt, hsa; identical to SEQ ID NO: 439502

SEQ ID NO: 467608 - RNA, 64 nt, hsa; identical to SEQ ID NO: 439503

SEQ ID NO: 467609 - RNA, 64 nt, hsa; identical to SEQ ID NO: 439504

SEQ ID NO: 467610 - RNA, 64 nt, hsa; identical to SEQ ID NO: 439505

SEQ ID NO: 467611 - RNA, 64 nt, hsa; identical to SEQ ID NO: 439506

SEQ ID NO: 467612 - RNA, 64 nt, hsa; identical to SEQ ID NO: 439507

SEQ ID NO: 467613 - RNA, 64 nt, hsa; identical to SEQ ID NO: 439508

SEQ ID NO: 467614 - RNA, 64 nt, hsa; identical to SEQ ID NO: 439509

SEQ ID NO: 467615 - RNA, 64 nt, hsa; identical to SEQ ID NO: 439510

SEQ ID NO: 467616 - RNA, 64 nt, hsa; identical to SEQ ID NO: 439511

SEQ ID NO: 467617 - RNA, 64 nt, hsa; identical to SEQ ID NO: 439512

SEQ ID NO: 467618 - RNA, 64 nt, hsa; identical to SEQ ID NO: 439513

SEQ ID NO: 467619 - RNA, 64 nt, hsa; identical to SEQ ID NO: 439514

SEQ ID NO: 467620 - RNA, 64 nt, hsa; identical to SEQ ID NO: 439515

SEQ ID NO: 467621 - RNA, 64 nt, hsa; identical to SEQ ID NO: 439516

SEQ ID NO: 467622 - RNA, 64 nt, hsa; identical to SEQ ID NO: 439517

SEQ ID NO: 467623 - RNA, 64 nt, hsa; identical to SEQ ID NO: 439518

SEQ ID NO: 467624 - RNA, 64 nt, hsa; identical to SEQ ID NO: 439519

SEQ ID NO: 467625 - RNA, 64 nt, hsa; identical to SEQ ID NO: 439520

SEQ ID NO: 467626 - RNA, 64 nt, hsa; identical to SEQ ID NO: 439521

SEQ ID NO: 467627 - RNA, 64 nt, hsa; identical to SEQ ID NO: 439522

SEQ ID NO: 467628 - RNA, 64 nt, hsa; identical to SEQ ID NO: 439523

SEQ ID NO: 467629 - RNA, 56 nt, hsa; identical to SEQ ID NO: 439524

SEQ ID NO: 467630 - RNA, 64 nt, hsa; identical to SEQ ID NO: 439525

SEQ ID NO: 467631 - RNA, 64 nt, hsa; identical to SEQ ID NO: 439526

SEQ ID NO: 467632 - RNA, 64 nt, hsa; identical to SEQ ID NO: 439527

SEQ ID NO: 467633 - RNA, 64 nt, hsa; identical to SEQ ID NO: 439528

SEQ ID NO: 467634 - RNA, 64 nt, hsa; identical to SEQ ID NO: 439529

SEQ ID NO: 467635 - RNA, 64 nt, hsa; identical to SEQ ID NO: 439530

SEQ ID NO: 467636 - RNA, 64 nt, hsa; identical to SEQ ID NO: 439531

SEQ ID NO: 467637 - RNA, 64 nt, hsa
uguauguuaccuuuuccaccucucauuguuuuccccagaacauuguagauggggguuggcagag

SEQ ID NO: 467638 - RNA, 64 nt, hsa
cuggcgaugugggcauccugggguucuuagggucccagaacaagccccaggcaagcuggaacuu

SEQ ID NO: 467639 - RNA, 64 nt, hsa
ucagggucaacucccaggccucagaugcaggggcccagaacaccugcucucaccugagccccag

SEQ ID NO: 467640 - RNA, 64 nt, hsa
caccugcucucaccugaaccccaggugaaggggcccagaacaccugcucucaccugagccccag

SEQ ID NO: 467641 - RNA, 64 nt, hsa
caaugagggcgaaugacauuacagcuugaccucuccagaacacuaauauccuaaaauacagaac

SEQ ID NO: 467642 - RNA, 64 nt, hsa
agcuagcaucuaauuugcacaacuagaacacaucccagaacaauuacugaaaagcugaaauuua

SEQ ID NO: 467643 - RNA, 64 nt, hsa
uccugguucucagucccaccccaaaaccuggcacccagaacaguuggaaguguggaaaggaggu

SEQ ID NO: 467644 - RNA, 64 nt, hsa
uugccuguuuucggaucugugguuccuuugaaagccagaacaauggaucggcuuccuuacccag

SEQ ID NO: 467645 - RNA, 64 nt, hsa
uagcuucccuucccucccccuucacccacucccuccagaacauuuaguguagaugaaaaugugg

SEQ ID NO: 467646 - RNA, 64 nt, hsa
acagacucccacugucuccagaagucguggccuuccagaacagucugccccucaaggaagggug

SEQ ID NO: 467647 - RNA, 64 nt, hsa
aucaucagcaggagaugagacuaugaauuggcauccagaacaggagauuuagagcaaaaucuaa

SEQ ID NO: 467648 - RNA, 64 nt, hsa
uggcuggagagcugaucagccaggcacagaaucuccagaacaaccuagagagugaaugcuaauu

SEQ ID NO: 467649 - RNA, 64 nt, hsa
agcuggagggucagccaccaagcugggagcugagccagaacaggagugaugucucugcccuucc

SEQ ID NO: 467650 - RNA, 64 nt, hsa
ccaugcuuggagcauuggguaucugaugucugcaccagaacaagagaaccucugacgguggaga

SEQ ID NO: 467651 - RNA, 64 nt, hsa
acccaaauauaaccauuuaaagaaagaaugcauuccagaacaaauuguuuacauaaguuccuau

SEQ ID NO: 467652 - RNA, 64 nt, hsa
uuuaaccacuugccucuuucuccagcagcugauuccagaacaaaucauuauguuuccuaacugu

SEQ ID NO: 467653 - RNA, 64 nt, hsa
cuguuucuccuugguuaaaauuauacuugaaggcccagaacacucauggcacauuuguuuaaua

SEQ ID NO: 467654 - RNA, 64 nt, hsa
uuuucagaaugccaaaugaaggcuaaaauuuuggccagaacauuacaaaaguuuuaaaucguag

SEQ ID NO: 467655 - RNA, 64 nt, hsa
gccuaaaggaggaaaagucccaccaacuaccagaccagaacacgagccccucugggcagcagga

SEQ ID NO: 467656 - RNA, 64 nt, hsa
acauuccccaaucaauacacacacacugcagaacccagaacagaaggccacaggcuggcacuac

SEQ ID NO: 467657 - RNA, 64 nt, hsa
uaaggacucgguucuguguugggaccccaaaaaaccagaacaaguucugugugccuccuuucag

SEQ ID NO: 467658 - RNA, 64 nt, hsa
acacuacuugcacuggaucuuacgcaaaaaagaaccagaacacacaguguggacaacugcccau

SEQ ID NO: 467659 - RNA, 64 nt, hsa
uaauggccucaacaccuucugaacguggauagugccagaacacuuaggagggugucuuuggacc

SEQ ID NO: 467660 - RNA, 64 nt, hsa
ggaaagggaagcacaugaucaugggaaugauagcccagaacaaaaagaaaucuugucuuaccac

SEQ ID NO: 467661 - RNA, 64 nt, hsa
cauuuacaugucauuugacugucucacuuuuuacccagaacaguaacaacccacaccgucuucc

SEQ ID NO: 467662 - RNA, 64 nt, hsa
ugggaacauugaaguuuauuuggauaucaaggucccagaacaaggaagucacuuuucaguggau

SEQ ID NO: 467663 - RNA, 64 nt, hsa
guuacauaaaccagagaugauaaaacagauacuuccagaacauagugugcuucaaaacauuaau

SEQ ID NO: 467664 - RNA, 64 nt, hsa
aacuuuccucccucaauagugaagugucaaccauccagaacacaagguaggaugugacaaaugg

SEQ ID NO: 467665 - RNA, 64 nt, hsa
ggaaucgaaaguucuagaaacugccuugaaagauccagaacaaaaaguccugaaaauccaaaac

SEQ ID NO: 467666 - RNA, 63 nt, hsa
guucucacaaggucaugggaucucaugugaacagugugugaucaaguguguccaccccuucgg

SEQ ID NO: 467667 - RNA, 63 nt, hsa
ggugaugguggaugaugugucaugaaugaggaggugugugagcagggaacucagugugacacc

SEQ ID NO: 467668 - RNA, 63 nt, hsa
ccaugcccacccuccccacgcugcagugggcuugugugugaugugcagucccgaagccacacc

SEQ ID NO: 467669 - RNA, 63 nt, hsa
ccuuuaugcuugagguuccaaccuggagccacagugugugagaggaggaggagagggagaauu

SEQ ID NO: 467670 - RNA, 63 nt, hsa
gaccuuuguacagcccagaggccaacacugugggugugugacucuuuagcaaaaaaaacccau

SEQ ID NO: 467671 - RNA, 63 nt, hsa
cuccagauuaucuauuugugugugugugugugugugugugagagacggugucuuguucuguca

SEQ ID NO: 467672 - RNA, 63 nt, hsa
ucuguguguguauguguguguuuauauguguaugugugugacagaaaaaucuguagagaagag

SEQ ID NO: 467673 - RNA, 63 nt, hsa
uuucuauauaugggucugugugaguguaugugugugugugauuuuuuuuuuaaauuuauguug

SEQ ID NO: 467674 - RNA, 63 nt, hsa
cccuucucccugcaugccugugggucugcucuggugugugaaggucgguggguuaacugugug

SEQ ID NO: 467675 - RNA, 63 nt, hsa
ucacgggagagcagucucgucuccuguguguaugugugugaguggugggcaggccaguggcag

SEQ ID NO: 467676 - RNA, 63 nt, hsa
gugaaguuuccauuuuucauccauugcugcccugugugugaacaaaugugacuccauauuuau

SEQ ID NO: 467677 - RNA, 63 nt, hsa
guacacaugccugggccaagucuaagaaacucagugugugauguugggcagugugccauccug

SEQ ID NO: 467678 - RNA, 63 nt, hsa
aaccuuucaugucgugaaaggcagagggugacugugugugaugugcagaguccuuggacagga

SEQ ID NO: 467679 - RNA, 63 nt, hsa
ccuugcuugcccaugguguguguguccagaggugugugugaggcugccagaacaagugcuggg

SEQ ID NO: 467680 - RNA, 63 nt, hsa
agacuuaacagauacaugcugguucuccuugcugugugugacacagcagacagaggcacuauu

SEQ ID NO: 467681 - RNA, 63 nt, hsa
gaaaugacaagggcaagagugagauaggaaacugugugugaaaggaaagcccuugcaguauuu

SEQ ID NO: 467682 - RNA, 63 nt, hsa
uuuuucuagacugucucuguggaauauauuugugugugugauauaugcaugugugugauggua

SEQ ID NO: 467683 - RNA, 63 nt, hsa
uguggaauauauuugugugugugauauaugcaugugugugaugguauguauggauuuaaucua

SEQ ID NO: 467684 - RNA, 63 nt, hsa
uggggucuguucuugaauccucuauuaauuacugugugugagccagagggagcugugguaagg

SEQ ID NO: 467685 - RNA, 63 nt, hsa
acaaugccuacagcugucuucacauguauggacgugugugaaugguuguacguuuugcacauu

SEQ ID NO: 467686 - RNA, 63 nt, hsa
aaagauagauuugugccuguguuggauggggucgugugugauucagauggacauuggauggcu

SEQ ID NO: 467687 - RNA, 63 nt, hsa
uuucucuauguuucucuaaguuggggggugagcgugugugacagucuacuggauuucuuuacu

SEQ ID NO: 467688 - RNA, 63 nt, hsa
guguguguuuccguuuaacuuguggugaaggaagugugugacucagcuuggcugggaagugcu

SEQ ID NO: 467689 - RNA, 63 nt, hsa
gcuuaacagaacauggaaaguucccacuaaguugugugugaggaaauccucaucuuguauuuu

SEQ ID NO: 467690 - RNA, 63 nt, hsa
uguguuugugugugugugugugugugugugugugugugugaguggaguugaggugucagagaa

SEQ ID NO: 467691 - RNA, 63 nt, hsa
ccauucgaccuauaagaagccuuaauuugcacagugugugacuuacagaaacugcaugaaaaa

SEQ ID NO: 467692 - RNA, 63 nt, hsa
gcggccccgccuuguucugaucugugugugagugugugugaacuucugaaagacaauauuaaa

SEQ ID NO: 467693 - RNA, 63 nt, hsa
gcuccccucggcggccccgccuuguucugaucugugugugagugugugugaacuucugaaaga

SEQ ID NO: 467694 - RNA, 63 nt, hsa
uaugcguagcuucugugugcucuuguguagucugugugugaucaaagggcacggaaguggcug

SEQ ID NO: 467695 - RNA, 63 nt, hsa
cccaucaagggaaugcauagauggagauauauagugugugauguguaaaucaggucaaaccuc

SEQ ID NO: 467696 - RNA, 63 nt, hsa
ugugugugagagagagaucuugucugcgugugugugugugaucuugugugccuguagguacug

SEQ ID NO: 467697 - RNA, 63 nt, hsa
cugugaaaguuugggagcugugugugucugugugugugugagagagagaucuugucugcgugu

SEQ ID NO: 467698 - RNA, 63 nt, hsa
uggcucauuagaucugucccuuccccgagguccgugugugacuuugagcaaaaagugacuucu

SEQ ID NO: 467699 - RNA, 63 nt, hsa
ugcuguggcucuauuugcaacauuuuccuucgugugugugauugugugcaugugugcaugacc

SEQ ID NO: 467700 - RNA, 63 nt, hsa
acuggcaaaaggugugugugugaaugugugcaugugugugaauguugugugugugugugugug

SEQ ID NO: 467701 - RNA, 63 nt, hsa
augugauuuuuguugggcacuggcaaaaggugugugugugaaugugugcaugugugugaaugu

SEQ ID NO: 467702 - RNA, 63 nt, hsa
caauuaaugcugauuuggguacaggggaauuaugugugugaaugucaucuacaauuaaaaaaa

SEQ ID NO: 467703 - RNA, 63 nt, hsa
gcaugugugugagugaggcgugugugugagcgugugugugagugaggcgugugugugugucuu

SEQ ID NO: 467704 - RNA, 63 nt, hsa
aaaugugugugagcaugugugugagugaggcgugugugugagcgugugugugagugaggcgug

SEQ ID NO: 467705 - RNA, 63 nt, hsa
ccuggggucaagaaggaaaaugugugugagcaugugugugagugaggcgugugugugagcgug

SEQ ID NO: 467706 - RNA, 63 nt, hsa
uggggguccaggccuggggucaagaaggaaaaugugugugagcaugugugugagugaggcgug

SEQ ID NO: 467707 - RNA, 63 nt, hsa
ugggcagggugggugaggugcagaugaccaggagugugugaaugccuuccaggagguggcuuu

SEQ ID NO: 467708 - RNA, 63 nt, hsa
cgaggcucagaaacuccuggcuuagauugaagugugugugaugggggugcagcuuagaggacc

SEQ ID NO: 467709 - RNA, 63 nt, hsa
ugugugugugugugugugugugugugugugugugugugugagagagagcccucccacugccag

SEQ ID NO: 467710 - RNA, 63 nt, hsa
gagcauguaugucugcaggugucugacacgcaagugugugagugugagugugagagauggggc

SEQ ID NO: 467711 - RNA, 63 nt, hsa
cuguccaaacauuucauccguguguauguguaugugugugagugugugaagccgccaguucau

SEQ ID NO: 467712 - RNA, 63 nt, hsa
acauuucauccguguguauguguaugugugugagugugugaagccgccaguucaucuuuuuau

SEQ ID NO: 467713 - RNA, 63 nt, hsa
uugcacaaaccugaaucccccaccagagaggaugugugugaggagccagaaacgcugaaucca

SEQ ID NO: 467714 - RNA, 63 nt, hsa
cucagcugcugaauuuuuccuugaggcuguuuggugugugacccagcaagggcccuguguggg

SEQ ID NO: 467715 - RNA, 63 nt, hsa
uucuuguauauuaaaggucuugggguagauggugugugugaaacagugaagucucaacagcag

SEQ ID NO: 467716 - RNA, 63 nt, hsa
aagugagugcucgucacuggguucaucagagcagugugugaaauuccauguguuugcugaggu

SEQ ID NO: 467717 - RNA, 63 nt, hsa
aaccuucaaaacaagacauguaugugugcuugagugugugaacacgugugugugugugcacau

SEQ ID NO: 467718 - RNA, 63 nt, hsa
uguguguguguucaagugcgugacuguaugugugugugugaaccacuguguacuggagccugc

SEQ ID NO: 467719 - RNA, 63 nt, hsa
acuauauguguguauauagugugugauguauaugugugugauguauacuauauaugcccacac

SEQ ID NO: 467720 - RNA, 63 nt, hsa
auacauaucacauauacuauauguguguauauagugugugauguauaugugugugauguauac

SEQ ID NO: 467721 - RNA, 63 nt, hsa
ucuccuaaugauguauugugccguggaaguacugugugugaauagcaguagugggggcaaaag

SEQ ID NO: 467722 - RNA, 63 nt, hsa
aacaagcaggacugcgacuugauacuuggaaaugugugugacuuuuacaaagagcaauuuuga

SEQ ID NO: 467723 - RNA, 63 nt, hsa
aggagacaggauggguuuaaagcaggauggugugugugugaacgggcaugagcagaggugagc

SEQ ID NO: 467724 - RNA, 63 nt, hsa
ugcacagaggguguggugccagcuugagugggagugugugagugugagcaggcgggcgagugc

SEQ ID NO: 467725 - RNA, 64 nt, hsa; identical to SEQ ID NO: 115592

SEQ ID NO: 467726 - RNA, 64 nt, hsa; identical to SEQ ID NO: 115593

SEQ ID NO: 467727 - RNA, 64 nt, hsa; identical to SEQ ID NO: 115594

SEQ ID NO: 467728 - RNA, 64 nt, hsa; identical to SEQ ID NO: 115595

SEQ ID NO: 467729 - RNA, 64 nt, hsa; identical to SEQ ID NO: 115596

SEQ ID NO: 467730 - RNA, 64 nt, hsa; identical to SEQ ID NO: 115597

SEQ ID NO: 467731 - RNA, 64 nt, hsa; identical to SEQ ID NO: 115598

SEQ ID NO: 467732 - RNA, 64 nt, hsa; identical to SEQ ID NO: 115599

SEQ ID NO: 467733 - RNA, 64 nt, hsa; identical to SEQ ID NO: 115600

SEQ ID NO: 467734 - RNA, 64 nt, hsa; identical to SEQ ID NO: 115601

SEQ ID NO: 467735 - RNA, 64 nt, hsa; identical to SEQ ID NO: 115602

SEQ ID NO: 467736 - RNA, 64 nt, hsa; identical to SEQ ID NO: 115603

SEQ ID NO: 467737 - RNA, 64 nt, hsa; identical to SEQ ID NO: 115604

SEQ ID NO: 467738 - RNA, 64 nt, hsa; identical to SEQ ID NO: 115605

SEQ ID NO: 467739 - RNA, 64 nt, hsa; identical to SEQ ID NO: 115606

SEQ ID NO: 467740 - RNA, 64 nt, hsa; identical to SEQ ID NO: 115607

SEQ ID NO: 467741 - RNA, 64 nt, hsa; identical to SEQ ID NO: 115608

SEQ ID NO: 467742 - RNA, 64 nt, hsa; identical to SEQ ID NO: 115609

SEQ ID NO: 467743 - RNA, 64 nt, hsa; identical to SEQ ID NO: 115610

SEQ ID NO: 467744 - RNA, 64 nt, hsa; identical to SEQ ID NO: 115611

SEQ ID NO: 467745 - RNA, 64 nt, hsa; identical to SEQ ID NO: 115612

SEQ ID NO: 467746 - RNA, 64 nt, hsa; identical to SEQ ID NO: 115613

SEQ ID NO: 467747 - RNA, 64 nt, hsa; identical to SEQ ID NO: 115614

SEQ ID NO: 467748 - RNA, 64 nt, hsa; identical to SEQ ID NO: 115615

SEQ ID NO: 467749 - RNA, 52 nt, hsa; identical to SEQ ID NO: 115616

SEQ ID NO: 467750 - RNA, 64 nt, hsa; identical to SEQ ID NO: 115617

SEQ ID NO: 467751 - RNA, 64 nt, hsa; identical to SEQ ID NO: 115618

SEQ ID NO: 467752 - RNA, 64 nt, hsa; identical to SEQ ID NO: 115619

SEQ ID NO: 467753 - RNA, 64 nt, hsa; identical to SEQ ID NO: 115620

SEQ ID NO: 467754 - RNA, 64 nt, hsa; identical to SEQ ID NO: 115621

SEQ ID NO: 467755 - RNA, 64 nt, hsa; identical to SEQ ID NO: 115622

SEQ ID NO: 467756 - RNA, 64 nt, hsa; identical to SEQ ID NO: 115623

SEQ ID NO: 467757 - RNA, 64 nt, hsa; identical to SEQ ID NO: 115624

SEQ ID NO: 467758 - RNA, 64 nt, hsa; identical to SEQ ID NO: 115625

SEQ ID NO: 467759 - RNA, 64 nt, hsa; identical to SEQ ID NO: 115626

SEQ ID NO: 467760 - RNA, 64 nt, hsa; identical to SEQ ID NO: 115627

SEQ ID NO: 467761 - RNA, 64 nt, hsa; identical to SEQ ID NO: 115628

SEQ ID NO: 467762 - RNA, 64 nt, hsa; identical to SEQ ID NO: 115629

SEQ ID NO: 467763 - RNA, 64 nt, hsa; identical to SEQ ID NO: 115630

SEQ ID NO: 467764 - RNA, 64 nt, hsa; identical to SEQ ID NO: 115631

SEQ ID NO: 467765 - RNA, 64 nt, hsa; identical to SEQ ID NO: 115632

SEQ ID NO: 467766 - RNA, 64 nt, hsa; identical to SEQ ID NO: 115633

SEQ ID NO: 467767 - RNA, 64 nt, hsa; identical to SEQ ID NO: 115634

SEQ ID NO: 467768 - RNA, 64 nt, hsa; identical to SEQ ID NO: 115635

SEQ ID NO: 467769 - RNA, 64 nt, hsa; identical to SEQ ID NO: 115636

SEQ ID NO: 467770 - RNA, 64 nt, hsa; identical to SEQ ID NO: 115637

SEQ ID NO: 467771 - RNA, 64 nt, hsa; identical to SEQ ID NO: 115636

SEQ ID NO: 467772 - RNA, 64 nt, hsa; identical to SEQ ID NO: 115639

SEQ ID NO: 467773 - RNA, 64 nt, hsa; identical to SEQ ID NO: 115640

SEQ ID NO: 467774 - RNA, 64 nt, hsa; identical to SEQ ID NO: 115641

SEQ ID NO: 467775 - RNA, 64 nt, hsa; identical to SEQ ID NO: 115642

SEQ ID NO: 467776 - RNA, 64 nt, hsa; identical to SEQ ID NO: 115643

SEQ ID NO: 467777 - RNA, 64 nt, hsa; identical to SEQ ID NO: 115644

SEQ ID NO: 467778 - RNA, 64 nt, hsa; identical to SEQ ID NO: 115645

SEQ ID NO: 467779 - RNA, 64 nt, hsa; identical to SEQ ID NO: 115646

SEQ ID NO: 467780 - RNA, 64 nt, hsa; identical to SEQ ID NO: 115647

SEQ ID NO: 467781 - RNA, 64 nt, hsa; identical to SEQ ID NO: 115648

SEQ ID NO: 467782 - RNA, 64 nt, hsa; identical to SEQ ID NO: 115649

SEQ ID NO: 467783 - RNA, 64 nt, hsa; identical to SEQ ID NO: 115650

SEQ ID NO: 467784 - RNA, 64 nt, hsa; identical to SEQ ID NO: 115651

SEQ ID NO: 467785 - RNA, 64 nt, hsa; identical to SEQ ID NO: 115652

SEQ ID NO: 467786 - RNA, 64 nt, hsa; identical to SEQ ID NO: 115653

SEQ ID NO: 467787 - RNA, 64 nt, hsa; identical to SEQ ID NO: 115654

SEQ ID NO: 467788 - RNA, 64 nt, hsa; identical to SEQ ID NO: 115655

SEQ ID NO: 467789 - RNA, 64 nt, hsa; identical to SEQ ID NO: 115656

SEQ ID NO: 467790 - RNA, 64 nt, hsa; identical to SEQ ID NO: 115657

SEQ ID NO: 467791 - RNA, 64 nt, hsa; identical to SEQ ID NO: 115658

SEQ ID NO: 467792 - RNA, 64 nt, hsa; identical to SEQ ID NO: 115659

SEQ ID NO: 467793 - RNA, 64 nt, hsa; identical to SEQ ID NO: 72506

SEQ ID NO: 467794 - RNA, 64 nt, hsa; identical to SEQ ID NO: 72507

SEQ ID NO: 467795 - RNA, 64 nt, hsa; identical to SEQ ID NO: 72508

SEQ ID NO: 467796 - RNA, 64 nt, hsa; identical to SEQ ID NO: 72509

SEQ ID NO: 467797 - RNA, 64 nt, hsa; identical to SEQ ID NO: 72510

SEQ ID NO: 467798 - RNA, 64 nt, hsa; identical to SEQ ID NO: 72511

SEQ ID NO: 467799 - RNA, 64 nt, hsa; identical to SEQ ID NO: 72512

SEQ ID NO: 467800 - RNA, 64 nt, hsa; identical to SEQ ID NO: 72513

SEQ ID NO: 467801 - RNA, 64 nt, hsa; identical to SEQ ID NO: 72514

SEQ ID NO: 467802 - RNA, 64 nt, hsa; identical to SEQ ID NO: 72515

SEQ ID NO: 467803 - RNA, 64 nt, hsa; identical to SEQ ID NO: 72516

SEQ ID NO: 467804 - RNA, 64 nt, hsa; identical to SEQ ID NO: 72517

SEQ ID NO: 467805 - RNA, 64 nt, hsa; identical to SEQ ID NO: 72518

SEQ ID NO: 467806 - RNA, 64 nt, hsa; identical to SEQ ID NO: 72519

SEQ ID NO: 467807 - RNA, 64 nt, hsa; identical to SEQ ID NO: 72520

SEQ ID NO: 467808 - RNA, 64 nt, hsa; identical to SEQ ID NO: 72521

SEQ ID NO: 467809 - RNA, 64 nt, hsa; identical to SEQ ID NO: 72522

SEQ ID NO: 467810 - RNA, 64 nt, hsa; identical to SEQ ID NO: 72523

SEQ ID NO: 467811 - RNA, 64 nt, hsa; identical to SEQ ID NO: 72524

SEQ ID NO: 467812 - RNA, 64 nt, hsa; identical to SEQ ID NO: 72525

SEQ ID NO: 467813 - RNA, 64 nt, hsa; identical to SEQ ID NO: 72526

SEQ ID NO: 467814 - RNA, 64 nt, hsa; identical to SEQ ID NO: 72527

SEQ ID NO: 467815 - RNA, 64 nt, hsa; identical to SEQ ID NO: 72528

SEQ ID NO: 467816 - RNA, 64 nt, hsa; identical to SEQ ID NO: 72529

SEQ ID NO: 467817 - RNA, 64 nt, hsa; identical to SEQ ID NO: 72530

SEQ ID NO: 467818 - RNA, 64 nt, hsa; identical to SEQ ID NO: 72531

SEQ ID NO: 467819 - RNA, 64 nt, hsa; identical to SEQ ID NO: 72532

SEQ ID NO: 467820 - RNA, 64 nt, hsa; identical to SEQ ID NO: 72533

SEQ ID NO: 467821 - RNA, 64 nt, hsa; identical to SEQ ID NO: 72534

SEQ ID NO: 467822 - RNA, 64 nt, hsa; identical to SEQ ID NO: 72535

SEQ ID NO: 467823 - RNA, 64 nt, hsa; identical to SEQ ID NO: 72536

SEQ ID NO: 467824 - RNA, 64 nt, hsa; identical to SEQ ID NO: 72537

SEQ ID NO: 467825 - RNA, 64 nt, hsa; identical to SEQ ID NO: 72538

SEQ ID NO: 467826 - RNA, 64 nt, hsa; identical to SEQ ID NO: 72539

SEQ ID NO: 467827 - RNA, 64 nt, hsa; identical to SEQ ID NO: 72540

SEQ ID NO: 467828 - RNA, 64 nt, hsa; identical to SEQ ID NO: 72541

SEQ ID NO: 467829 - RNA, 64 nt, hsa; identical to SEQ ID NO: 72542

SEQ ID NO: 467830 - RNA, 64 nt, hsa; identical to SEQ ID NO: 72543

SEQ ID NO: 467831 - RNA, 64 nt, hsa; identical to SEQ ID NO: 72544

SEQ ID NO: 467832 - RNA, 64 nt, hsa; identical to SEQ ID NO: 72545

SEQ ID NO: 467833 - RNA, 64 nt, hsa; identical to SEQ ID NO: 72546

SEQ ID NO: 467834 - RNA, 64 nt, hsa; identical to SEQ ID NO: 72547

SEQ ID NO: 467835 - RNA, 64 nt, hsa; identical to SEQ ID NO: 72548

SEQ ID NO: 467836 - RNA, 64 nt, hsa; identical to SEQ ID NO: 72549

SEQ ID NO: 467837 - RNA, 64 nt, hsa; identical to SEQ ID NO: 72550

SEQ ID NO: 467838 - RNA, 64 nt, hsa; identical to SEQ ID NO: 72551

SEQ ID NO: 467839 - RNA, 64 nt, hsa; identical to SEQ ID NO: 72552

SEQ ID NO: 467840 - RNA, 64 nt, hsa; identical to SEQ ID NO: 72553

SEQ ID NO: 467841 - RNA, 64 nt, hsa; identical to SEQ ID NO: 72554

SEQ ID NO: 467842 - RNA, 64 nt, hsa; identical to SEQ ID NO: 72555

SEQ ID NO: 467843 - RNA, 64 nt, hsa; identical to SEQ ID NO: 72556

SEQ ID NO: 467844 - RNA, 64 nt, hsa; identical to SEQ ID NO: 72557

SEQ ID NO: 467845 - RNA, 64 nt, hsa; identical to SEQ ID NO: 72558

SEQ ID NO: 467846 - RNA, 64 nt, hsa; identical to SEQ ID NO: 72559

SEQ ID NO: 467847 - RNA, 64 nt, hsa; identical to SEQ ID NO: 72560

SEQ ID NO: 467848 - RNA, 64 nt, hsa; identical to SEQ ID NO: 72561

SEQ ID NO: 467849 - RNA, 64 nt, hsa; identical to SEQ ID NO: 72562

SEQ ID NO: 467850 - RNA, 64 nt, hsa; identical to SEQ ID NO: 72563

SEQ ID NO: 467851 - RNA, 64 nt, hsa; identical to SEQ ID NO: 72564

SEQ ID NO: 467852 - RNA, 64 nt, hsa; identical to SEQ ID NO: 72565

SEQ ID NO: 467853 - RNA, 64 nt, hsa; identical to SEQ ID NO: 72566

SEQ ID NO: 467854 - RNA, 64 nt, hsa; identical to SEQ ID NO: 72567

SEQ ID NO: 467855 - RNA, 64 nt, hsa; identical to SEQ ID NO: 72568

SEQ ID NO: 467856 - RNA, 64 nt, hsa; identical to SEQ ID NO: 72569

SEQ ID NO: 467857 - RNA, 64 nt, hsa; identical to SEQ ID NO: 72570

SEQ ID NO: 467858 - RNA, 64 nt, hsa; identical to SEQ ID NO: 72571

SEQ ID NO: 467859 - RNA, 64 nt, hsa; identical to SEQ ID NO: 72572

SEQ ID NO: 467860 - RNA, 64 nt, hsa; identical to SEQ ID NO: 72573

SEQ ID NO: 467861 - RNA, 64 nt, hsa; identical to SEQ ID NO: 72574

SEQ ID NO: 467862 - RNA, 64 nt, hsa; identical to SEQ ID NO: 72575

SEQ ID NO: 467863 - RNA, 64 nt, hsa; identical to SEQ ID NO: 72576

SEQ ID NO: 467864 - RNA, 64 nt, hsa; identical to SEQ ID NO: 72577

SEQ ID NO: 467865 - RNA, 64 nt, hsa; identical to SEQ ID NO: 72578

SEQ ID NO: 467866 - RNA, 64 nt, hsa; identical to SEQ ID NO: 72579

SEQ ID NO: 467867 - RNA, 64 nt, hsa; identical to SEQ ID NO: 72580

SEQ ID NO: 467868 - RNA, 64 nt, hsa; identical to SEQ ID NO: 72581

SEQ ID NO: 467869 - RNA, 64 nt, hsa; identical to SEQ ID NO: 72582

SEQ ID NO: 467870 - RNA, 64 nt, hsa; identical to SEQ ID NO: 72583

SEQ ID NO: 467871 - RNA, 64 nt, hsa; identical to SEQ ID NO: 72584

SEQ ID NO: 467872 - RNA, 64 nt, hsa; identical to SEQ ID NO: 72585

SEQ ID NO: 467873 - RNA, 64 nt, hsa; identical to SEQ ID NO: 72586

SEQ ID NO: 467874 - RNA, 64 nt, hsa; identical to SEQ ID NO: 72587

SEQ ID NO: 467875 - RNA, 64 nt, hsa; identical to SEQ ID NO: 72588

SEQ ID NO: 467876 - RNA, 64 nt, hsa; identical to SEQ ID NO: 72589

SEQ ID NO: 467877 - RNA, 64 nt, hsa; identical to SEQ ID NO: 72590

SEQ ID NO: 467878 - RNA, 64 nt, hsa; identical to SEQ ID NO: 72591

SEQ ID NO: 467879 - RNA, 64 nt, hsa; identical to SEQ ID NO: 72592

SEQ ID NO: 467880 - RNA, 64 nt, hsa; identical to SEQ ID NO: 72593

SEQ ID NO: 467881 - RNA, 64 nt, hsa; identical to SEQ ID NO: 72594

SEQ ID NO: 467882 - RNA, 64 nt, hsa; identical to SEQ ID NO: 72595

SEQ ID NO: 467883 - RNA, 64 nt, hsa; identical to SEQ ID NO: 72596

SEQ ID NO: 467884 - RNA, 64 nt, hsa; identical to SEQ ID NO: 72597

SEQ ID NO: 467885 - RNA, 64 nt, hsa; identical to SEQ ID NO: 72598

SEQ ID NO: 467886 - RNA, 64 nt, hsa; identical to SEQ ID NO: 72599

SEQ ID NO: 467887 - RNA, 64 nt, hsa; identical to SEQ ID NO: 72600

SEQ ID NO: 467888 - RNA, 64 nt, hsa; identical to SEQ ID NO: 72601

SEQ ID NO: 467889 - RNA, 64 nt, hsa
gguaaauucucuauuuuuuguaauguguucggugauuucagaaagcuagaaaguguaugugugg

SEQ ID NO: 467890 - RNA, 64 nt, hsa
uuaaaacaucccuaacugaucgaauauaucaguaauuucagaaucagaugcauccuuucauaag

SEQ ID NO: 467891 - RNA, 64 nt, hsa
uaacuuccacuuaauuuaaauuuaauaaacuuuuauuucagagauauuugauuaguuuacaauc

SEQ ID NO: 467892 - RNA, 64 nt, hsa
auauucuguauuacauacuguacaccagauuuugauuucagaaaacaauauuugauguauaacu

SEQ ID NO: 467893 - RNA, 64 nt, hsa
ucaugaugcuguuacugagaauaaugaaaaucauauuucagaaaauauuaccauguaaauaugu

SEQ ID NO: 467894 - RNA, 64 nt, hsa
gccaaaaagagaaaagaaaagaaaauuucuacuaauuucagaccucuagagcaauucaguccug

SEQ ID NO: 467895 - RNA, 64 nt, hsa
guaccuuuauaaauucaguugcaucuguggcaaaauuucagacuauuuuugcgucuuuccucau

SEQ ID NO: 467896 - RNA, 64 nt, hsa
agugcaguggaaggaagccacacacuggucagucauuucagaggcagcagaugcccagggagac

SEQ ID NO: 467897 - RNA, 64 nt, hsa
aauacuaugacaguacuaaaaauauaugaauaacauuucagauaccauuauauuaaaauauuug

SEQ ID NO: 467898 - RNA, 64 nt, hsa
gguuaaagugaauguuuuuguaacauuuaagcauauuucagauguaaauaaaagauuguaaaau

SEQ ID NO: 467899 - RNA, 64 nt, hsa
cgcuguauuaaaauagaaccaggaaaggcucaggauuucagacauuucaucagccuuuucacuu

SEQ ID NO: 467900 - RNA, 64 nt, hsa
agguucuugguggugucucccauuccccuggcuaauuucagacagcuguggucaagggauuuua

SEQ ID NO: 467901 - RNA, 64 nt, hsa
ugaguuuagugaucugaacagaaauaccaaaauuauuucagaaauguacaacuuuuuaccuagu

SEQ ID NO: 467902 - RNA, 64 nt, hsa
aaaacccacaaaaguacaauuuaccagccuccguauuucagacugaauggggguggggggggcg

SEQ ID NO: 467903 - RNA, 64 nt, hsa
cagaugcuuccagaguucuuaaugccucucuggcauuucagagccagcaucccccaacucccac

SEQ ID NO: 467904 - RNA, 64 nt, hsa
gauuugguuugguuugguuugguuugauaauuaaauuucagaauguccuuaggccauucuccuu

SEQ ID NO: 467905 - RNA, 64 nt, hsa
gcaugugaaaaugggauacuauagacuacugagaauuucagaaauugagaacaauuucauaaua

SEQ ID NO: 467906 - RNA, 64 nt, hsa
ugugugcaaaauacugaguaaccacugggaaaauauuucagaugaaagggaugacaaaagcaug

SEQ ID NO: 467907 - RNA, 64 nt, hsa
uuugcuuuacugcaugaaugaaacugaugguucaauuucagaaguaaugauuaacaguuaugug

SEQ ID NO: 467908 - RNA, 64 nt, hsa
acaugaauugugucucaacagaaacuaaaugaacauuucagaauaaauuauugcuguauguaaa

SEQ ID NO: 467909 - RNA, 64 nt, hsa
ugugcuccugcucccagcagcccucucuuagaauauuucagauggaugagcuucugacucuuuc

SEQ ID NO: 467910 - RNA, 64 nt, hsa
cuaacuaaaauggccaaaguuccaacuuccuuaaauuucagaccugacuguaauggccucaaga

SEQ ID NO: 467911 - RNA, 64 nt, hsa
ucucuuauuugacagaauagcaaguguuuagauaauuucagauauauucuaaguauuuuaccag

SEQ ID NO: 467912 - RNA, 64 nt, hsa
uuacccuuaucuuuguuucuaauuuaaagaaacaauuucagaaaguguuagaagaauucuaugu

SEQ ID NO: 467913 - RNA, 64 nt, hsa
auuuuucccccugcuucagguuaauuuuuuggauauuucagaaacccauagcaauucagugauu

SEQ ID NO: 467914 - RNA, 61 nt, hsa
auuuccuccaaacaaaauaaugcaggaauuuauuucagaaaauguaguuuacaagaauaaa

SEQ ID NO: 467915 - RNA, 64 nt, hsa
gcaagccuuugucuuacucuuucagucaggaccuauuucagacuguugaugacauugacauuuc

SEQ ID NO: 467916 - RNA, 64 nt, hsa
uuuagauguugaacccugagagaacuaagaugauauuucagaagaguuggcugccuucucugga

SEQ ID NO: 467917 - RNA, 64 nt, hsa
uucccauaauuuagaaaaggaugucgacuugcuaauuucagaaauaauuauucauuuuuaaaaa

SEQ ID NO: 467918 - RNA, 64 nt, hsa
aaagauaucuuagauaaacuauuuugaaguucagauuucagaugaggcaacauuuucuugagau

SEQ ID NO: 467919 - RNA, 64 nt, hsa
ugcaggguuaucuucucacagggcuggaaugcaaauuucagaggcuucuuuugaagauucccca

SEQ ID NO: 467920 - RNA, 64 nt, hsa
ucacuccuguauauuuugguuuacuuacuccucuauuucagaaauugaaaaagauccccaagga

SEQ ID NO: 467921 - RNA, 64 nt, hsa
aaagaugaaacuauuguaucucacaaaaaaucuuauuucagaauggaaauauuuuugagaaaag

SEQ ID NO: 467922 - RNA, 64 nt, hsa
guagaauacuaaaaggaaaaugucauguuaagcaauuucagaacauuaacugaacuauuuucaa

SEQ ID NO: 467923 - RNA, 64 nt, hsa
uugguuuuguuuuuucuuuuuugcuguuagaauaauuucagacccaauaaggaauuucgauuau

SEQ ID NO: 467924 - RNA, 64 nt, hsa
aucauaauuaccuagaugccucuuaaaaaugaagauuucagagacccauucuaaacaagggcau

SEQ ID NO: 467925 - RNA, 64 nt, hsa
auuaaacaacguguaugcaaauuguuauggauacauuucagaaucuaagaaaucaggcaagugc

SEQ ID NO: 467926 - RNA, 64 nt, hsa
aaaaacaaaucauccaaauuaaauuucaaacauuauuucagagaacacagggcaagacacauac

SEQ ID NO: 467927 - RNA, 64 nt, hsa
uuauuuggaggaaaccgcuauaauguaaaaucagauuucagaaggaaaaugcagcaaggacuga

SEQ ID NO: 467928 - RNA, 64 nt, hsa
gaaggaaaaugcagcaaggacugacuguaguccuauuucagaccccugggcacuagugucaacu

SEQ ID NO: 467929 - RNA, 64 nt, hsa
uguguuuuagaaauuugcacuuaauggaauuugcauuucagagauguguuaguguugugcuuug

SEQ ID NO: 467930 - RNA, 64 nt, hsa
uuuuuuuuuggacagcuucaaggagauguuagcaauuucagauauacuagccaguuuagguaug

SEQ ID NO: 467931 - RNA, 64 nt, hsa
aaauaaaauuaaaauuggaggguugguuagauugauuucagauggauacuaacaguuugagggg

SEQ ID NO: 467932 - RNA, 64 nt, hsa
uaaugcugcaguuuaagagaacuuguauugugucauuucagauuguaggcugagaguuguaaau

SEQ ID NO: 467933 - RNA, 64 nt, hsa
ugggaagacuauugacuauuucagaaacagacuuauuucagaggcuuauuguuuucucuguauu

SEQ ID NO: 467934 - RNA, 64 nt, hsa
uucucuuauaguuuggaugggaagacuauugacuauuucagaaacagacuuauuucagaggcuu

SEQ ID NO: 467935 - RNA, 64 nt, hsa
auuaagcgaaagugguaucauccuagguaagcuuauuucagaacaagucuaauauuucagauuc

SEQ ID NO: 467936 - RNA, 64 nt, hsa
auccuagguaagcuuauuucagaacaagucuaauauuucagauucuuucuuuucgacuuuauac

SEQ ID NO: 467937 - RNA, 64 nt, hsa
gguggaguuuuucuauauuuaaaaauacauauauauuucagaggauuuuuauuuugcuuuuugg

SEQ ID NO: 467938 - RNA, 64 nt, hsa
uauauuucagaggauuuuuauuuugcuuuuuggcauuucagacuuugaucaguguuaagugcac

SEQ ID NO: 467939 - RNA, 64 nt, hsa
uuauucucaauuuaucaauggauacgugcauguuauuucagaauuaugcaaaacgucaaaaucu

SEQ ID NO: 467940 - RNA, 64 nt, hsa
gauacucgaaugucagguuuuugguuuuauuauuauuucagaacuagcucagcccaucucuaau

SEQ ID NO: 467941 - RNA, 64 nt, hsa
caauaaacagaauuuuuugacuaagcauaaccaaauuucagaacagucuaaucaaugccaagua

SEQ ID NO: 467942 - RNA, 64 nt, hsa
gugucagcacucaaaaaguuuuggauuuugggguauuucagauuuuagauuuuuguaugaggaa

SEQ ID NO: 467943 - RNA, 64 nt, hsa
aaauccgagacccagaacacuucuggucccaagcauuucagauaagggauaucaaucuguacua

SEQ ID NO: 467944 - RNA, 64 nt, hsa
uggauacaguauuuacacccugcagacccuaaagauuucagauucaguuagcaaaccuugauga

SEQ ID NO: 467945 - RNA, 64 nt, hsa
uuucaucuuggaccucagugcauaggucaaauggauuucagagguuuaaacuucccugugauuc

SEQ ID NO: 467946 - RNA, 64 nt, hsa
gagcagucuagucaaaucauauaaauuguucuaaauuucagaauugaacauugaaguauuaacu

SEQ ID NO: 467947 - RNA, 64 nt, hsa
cguuuuaaguguuaacauccuuugaaugcguuggauuucagagaauaaacauuuuguaaaaauc

SEQ ID NO: 467948 - RNA, 64 nt, hsa
uuggcuuucuuccauuguuguuuuuguagcauuuauuucagaaauguguauuuccauaauccag

SEQ ID NO: 467949 - RNA, 64 nt, hsa
gcagacaagaauauccauauaagauuuguuaaccauuucagagaguuuggcaauuuuuaaaaga

SEQ ID NO: 467950 - RNA, 64 nt, hsa
cagauacuaagcuuguauaugauuauggugggugauuucagauauauaagcagauaagcacaga

SEQ ID NO: 467951 - RNA, 64 nt, hsa
auagacaauuagcuguuugaagugaguauuaaauauuucagaagugugaauuucauguauuuga

SEQ ID NO: 467952 - RNA, 64 nt, hsa
aauaucaaaguuaacuuuuaaaaauugcgaaacuauuucagaaucgcaauuuuaucgaagauua

SEQ ID NO: 467953 - RNA, 64 nt, hsa
gcgcgggcgagcaggccugugaauucgcaggaucauuucagacccgcacuucggcagccaacuc

SEQ ID NO: 467954 - RNA, 64 nt, hsa
uuucuuuuugucacugucuagaauuuuguauuuuauuucagacuauaccuuggaguuuuguaua

SEQ ID NO: 467955 - RNA, 64 nt, hsa
gguauacauauccuccuauaccgcacauaaauagauuucagagcccccauacaaugggcagugu

SEQ ID NO: 467956 - RNA, 64 nt, hsa
gaaaucacagagagguaaaauggaggccagugccauuucagaggggaggcucaggaaggcuucu

SEQ ID NO: 467957 - RNA, 64 nt, hsa
gacccuagaugugcucguacucccucggccugggauuucagagcuggaaauauagaaaauaucu

SEQ ID NO: 467958 - RNA, 64 nt, hsa
ccacgcagccuggugauggcaggccuggguuuggauuucagaauccuagcuccgggcuccacuc

SEQ ID NO: 467959 - RNA, 64 nt, hsa
uguaaaauguuaucugcccuuuggcugcauuggaauuucagagaaggcugcagaggccuggguu

SEQ ID NO: 467960 - RNA, 64 nt, hsa
cgagguaguagacaggaugcccaguuaaguuugaauuucagauagaaaauaauuuuagaauaaa

SEQ ID NO: 467961 - RNA, 64 nt, hsa
aggagccaggaaaugugcuucuacuuugccaguuauuucagacagcacuaccaagaggaggugg

SEQ ID NO: 467962 - RNA, 64 nt, hsa
agaauagugcuauauaucagguaugugaccauuuauuucagaaggcugaacauaagagguuucu

SEQ ID NO: 467963 - RNA, 64 nt, hsa
cagagagaaaacauguccacucugcagaacugugauuucagaccauauaaacaaauggaaggau

SEQ ID NO: 467964 - RNA, 64 nt, hsa
auguggaugauauuuguucaauaugucaagcugaauuucagaagccaauucuucucauuuguca

SEQ ID NO: 467965 - RNA, 64 nt, hsa
gaguuguucggaaccucaauuaauccuguuuuacauuucagaccuaaagcuggcaaucaggaga

SEQ ID NO: 467966 - RNA, 64 nt, hsa
ggugugaacgaauuuugcaaguuuaauuugauuuauuucagagaaaauagaaaaaacaauguua

SEQ ID NO: 467967 - RNA, 64 nt, hsa
uuauuuuuguuuuuguuggauagcuuuuaauuacauuucagagagguguaauuuuggguagaug

SEQ ID NO: 467968 - RNA, 64 nt, hsa
gauuuauaugacuggugauacuggcuuuacagaaauuucagagaacuaauuuuuaaaaucuuua

SEQ ID NO: 467969 - RNA, 64 nt, hsa
agcauuuaugagaauuauaaguaaagcuuucuguauuucagagagacauaaguuacuagaaagu

SEQ ID NO: 467970 - RNA, 64 nt, hsa
ucgcaccaaacuuccuguggugacagacucuuccauuucagacugguuuuaacuuaucccagcu

SEQ ID NO: 467971 - RNA, 64 nt, hsa
uuuauaccucauucaucaugcuggauuguaauaaauuucagauuuuggaaugggcuuauuuaac

SEQ ID NO: 467972 - RNA, 64 nt, hsa
uuauuacauaccaauggcuuugcaagaagaugacauuucagaaaaucaaacaaaucuauauuua

SEQ ID NO: 467973 - RNA, 64 nt, hsa
cucuuugucuaagagcuguggcaacagcaccugaauuucagaaacaaaaggccgggcgcggugg

SEQ ID NO: 467974 - RNA, 64 nt, hsa
gugcauguaaauauauacucucaacauuuaaaagauuucagaagguuccuggaaauuccaaugu

SEQ ID NO: 467975 - RNA, 64 nt, hsa
cuagccuuaaucagguccucagagaauuucuaccauuucagagaggccuuuuggaauguggccc

SEQ ID NO: 467976 - RNA, 64 nt, hsa
ugcuuuuucaccagauuugcuaauuuauccugaaauuucagauucccagagcaaaauaauuuua

SEQ ID NO: 467977 - RNA, 64 nt, hsa
ccuccucucauuuguggcuuagagagcuaucaccauuucagaacuaugaugcuuuucuucucag

SEQ ID NO: 467978 - RNA, 64 nt, hsa
ccuguaaguuauuuauuagcccuaauuguguuugauuucagacaaaauuaacccuuuucuccug

SEQ ID NO: 467979 - RNA, 64 nt, hsa
auaaacaucauguauaggcagucugcaucuucagauuucagagauuaaaugaguauucaguuuu

SEQ ID NO: 467980 - RNA, 64 nt, hsa
ucaucgcugagcaaauggagcuugcuauguuuuaauuucagaaaauuuccucauauacguagug

SEQ ID NO: 467981 - RNA, 64 nt, hsa
ugguaauauaaucuaaaucaagauuaccaaaauaauuucagagguugaugugguaaccuuuaag

SEQ ID NO: 467982 - RNA, 64 nt, hsa
auuuaauaacugggucaccaguguuucuugagccauuucagauguauguaaaacacaaaauaug

SEQ ID NO: 467983 - RNA, 64 nt, hsa
ccccacccaguucuucauuuggaggaaucaccccauuucagaguuaucaagagacacucccccc

SEQ ID NO: 467984 - RNA, 64 nt, hsa
ugcaccuuccccaaaggaaccgcccagugcagguauuucagaaggagaaggcuggagaaggaca

SEQ ID NO: 467985 - RNA, 64 nt, hsa
uguauucccauuuuuaaaauaaauacaaauguuuauuucagaagggcaguuuugauuauaugug

SEQ ID NO: 467986 - RNA, 64 nt, hsa
uuuauaaacacagccuuucuuuagcauugauuuaauuucagaacaucuucauauugauuauuag

SEQ ID NO: 467987 - RNA, 64 nt, hsa
uuuuuucucuagaguagagguauaauugugugauauuucagaaauacagauaaaugauucaaaa

SEQ ID NO: 467988 - RNA, 64 nt, hsa
cuguugcugauuuuauucuugaucaguaguuugcauuucagaaagccuuucauuuugcuuuaau

SEQ ID NO: 467989 - RNA, 64 nt, hsa
gaaauuugcagcuuccaaugccucuugucuuccuauuucagaaguuuaaauauuaagcaugaca

SEQ ID NO: 467990 - RNA, 64 nt, hsa
gaccacaacugcauguuggauuagauugucucauauuucagaauaaaauguacuguauacuuuu

SEQ ID NO: 467991 - RNA, 64 nt, hsa
uggaaaggaaggcaaucgacacaguuauuagcacauuucagaaaaugaacacccuugugauaga

SEQ ID NO: 467992 - RNA, 64 nt, hsa; identical to SEQ ID NO: 276789

SEQ ID NO: 467993 - RNA, 64 nt, hsa; identical to SEQ ID NO: 276790

SEQ ID NO: 467994 - RNA, 64 nt, hsa; identical to SEQ ID NO: 276791

SEQ ID NO: 467995 - RNA, 64 nt, hsa; identical to SEQ ID NO: 276792

SEQ ID NO: 467996 - RNA, 64 nt, hsa; identical to SEQ ID NO: 276793

SEQ ID NO: 467997 - RNA, 64 nt, hsa; identical to SEQ ID NO: 276794

SEQ ID NO: 467998 - RNA, 64 nt, hsa; identical to SEQ ID NO: 276795

SEQ ID NO: 467999 - RNA, 64 nt, hsa; identical to SEQ ID NO: 276796

SEQ ID NO: 468000 - RNA, 64 nt, hsa; identical to SEQ ID NO: 276797

SEQ ID NO: 468001 - RNA, 64 nt, hsa; identical to SEQ ID NO: 276798

SEQ ID NO: 468002 - RNA, 64 nt, hsa; identical to SEQ ID NO: 276799

SEQ ID NO: 468003 - RNA, 64 nt, hsa; identical to SEQ ID NO: 276800

SEQ ID NO: 468004 - RNA, 64 nt, hsa; identical to SEQ ID NO: 276801

SEQ ID NO: 468005 - RNA, 64 nt, hsa; identical to SEQ ID NO: 276802

SEQ ID NO: 468006 - RNA, 64 nt, hsa; identical to SEQ ID NO: 276803

SEQ ID NO: 468007 - RNA, 64 nt, hsa; identical to SEQ ID NO: 276804

SEQ ID NO: 468008 - RNA, 64 nt, hsa; identical to SEQ ID NO: 276805

SEQ ID NO: 468009 - RNA, 64 nt, hsa; identical to SEQ ID NO: 276806

SEQ ID NO: 468010 - RNA, 64 nt, hsa; identical to SEQ ID NO: 276807

SEQ ID NO: 468011 - RNA, 64 nt, hsa; identical to SEQ ID NO: 276808

SEQ ID NO: 468012 - RNA, 64 nt, hsa; identical to SEQ ID NO: 276809

SEQ ID NO: 468013 - RNA, 64 nt, hsa; identical to SEQ ID NO: 276810

SEQ ID NO: 468014 - RNA, 64 nt, hsa; identical to SEQ ID NO: 276811

SEQ ID NO: 468015 - RNA, 64 nt, hsa; identical to SEQ ID NO: 276812

SEQ ID NO: 468016 - RNA, 64 nt, hsa; identical to SEQ ID NO: 276813

SEQ ID NO: 468017 - RNA, 64 nt, hsa; identical to SEQ ID NO: 276814

SEQ ID NO: 468018 - RNA, 64 nt, hsa; identical to SEQ ID NO: 276815

SEQ ID NO: 468019 - RNA, 64 nt, hsa; identical to SEQ ID NO: 276816

SEQ ID NO: 468020 - RNA, 64 nt, hsa; identical to SEQ ID NO: 276817

SEQ ID NO: 468021 - RNA, 64 nt, hsa; identical to SEQ ID NO: 276818

SEQ ID NO: 468022 - RNA, 64 nt, hsa; identical to SEQ ID NO: 276819

SEQ ID NO: 468023 - RNA, 64 nt, hsa; identical to SEQ ID NO: 276820

SEQ ID NO: 468024 - RNA, 64 nt, hsa; identical to SEQ ID NO: 276821

SEQ ID NO: 468025 - RNA, 64 nt, hsa; identical to SEQ ID NO: 276822

SEQ ID NO: 468026 - RNA, 64 nt, hsa; identical to SEQ ID NO: 276823

SEQ ID NO: 468027 - RNA, 64 nt, hsa; identical to SEQ ID NO: 276824

SEQ ID NO: 468028 - RNA, 64 nt, hsa; identical to SEQ ID NO: 276825

SEQ ID NO: 468029 - RNA, 64 nt, hsa; identical to SEQ ID NO: 276826

SEQ ID NO: 468030 - RNA, 64 nt, hsa; identical to SEQ ID NO: 276827

SEQ ID NO: 468031 - RNA, 64 nt, hsa; identical to SEQ ID NO: 276828

SEQ ID NO: 468032 - RNA, 64 nt, hsa; identical to SEQ ID NO: 276829

SEQ ID NO: 468033 - RNA, 64 nt, hsa; identical to SEQ ID NO: 276830

SEQ ID NO: 468034 - RNA, 64 nt, hsa; identical to SEQ ID NO: 276831

SEQ ID NO: 468035 - RNA, 64 nt, hsa; identical to SEQ ID NO: 276832

SEQ ID NO: 468036 - RNA, 64 nt, hsa; identical to SEQ ID NO: 276833

SEQ ID NO: 468037 - RNA, 64 nt, hsa; identical to SEQ ID NO: 276834

SEQ ID NO: 468038 - RNA, 64 nt, hsa; identical to SEQ ID NO: 276835

SEQ ID NO: 468039 - RNA, 64 nt, hsa; identical to SEQ ID NO: 276836

SEQ ID NO: 468040 - RNA, 64 nt, hsa; identical to SEQ ID NO: 276837

SEQ ID NO: 468041 - RNA, 64 nt, hsa; identical to SEQ ID NO: 276838

SEQ ID NO: 468042 - RNA, 64 nt, hsa; identical to SEQ ID NO: 276839

SEQ ID NO: 468043 - RNA, 64 nt, hsa; identical to SEQ ID NO: 276840

SEQ ID NO: 468044 - RNA, 64 nt, hsa; identical to SEQ ID NO: 276841

SEQ ID NO: 468045 - RNA, 64 nt, hsa; identical to SEQ ID NO: 276842

SEQ ID NO: 468046 - RNA, 64 nt, hsa; identical to SEQ ID NO: 276843

SEQ ID NO: 468047 - RNA, 64 nt, hsa; identical to SEQ ID NO: 276844

SEQ ID NO: 468048 - RNA, 64 nt, hsa; identical to SEQ ID NO: 276845

SEQ ID NO: 468049 - RNA, 64 nt, hsa; identical to SEQ ID NO: 276846

SEQ ID NO: 468050 - RNA, 64 nt, hsa; identical to SEQ ID NO: 276847

SEQ ID NO: 468051 - RNA, 64 nt, hsa; identical to SEQ ID NO: 276848

SEQ ID NO: 468052 - RNA, 64 nt, hsa; identical to SEQ ID NO: 276849

SEQ ID NO: 468053 - RNA, 64 nt, hsa; identical to SEQ ID NO: 276850

SEQ ID NO: 468054 - RNA, 64 nt, hsa; identical to SEQ ID NO: 276851

SEQ ID NO: 468055 - RNA, 64 nt, hsa; identical to SEQ ID NO: 276852

SEQ ID NO: 468056 - RNA, 64 nt, hsa; identical to SEQ ID NO: 276853

SEQ ID NO: 468057 - RNA, 64 nt, hsa; identical to SEQ ID NO: 276854

SEQ ID NO: 468058 - RNA, 64 nt, hsa; identical to SEQ ID NO: 276855

SEQ ID NO: 468059 - RNA, 64 nt, hsa; identical to SEQ ID NO: 276856

SEQ ID NO: 468060 - RNA, 64 nt, hsa; identical to SEQ ID NO: 276857

SEQ ID NO: 468061 - RNA, 64 nt, hsa; identical to SEQ ID NO: 297128

SEQ ID NO: 468062 - RNA, 64 nt, hsa; identical to SEQ ID NO: 297129

SEQ ID NO: 468063 - RNA, 64 nt, hsa; identical to SEQ ID NO: 297130

SEQ ID NO: 468064 - RNA, 64 nt, hsa; identical to SEQ ID NO: 297131

SEQ ID NO: 468065 - RNA, 64 nt, hsa; identical to SEQ ID NO: 297132

SEQ ID NO: 468066 - RNA, 64 nt, hsa; identical to SEQ ID NO: 297133

SEQ ID NO: 468067 - RNA, 64 nt, hsa; identical to SEQ ID NO: 297134

SEQ ID NO: 468068 - RNA, 64 nt, hsa; identical to SEQ ID NO: 297135

SEQ ID NO: 468069 - RNA, 64 nt, hsa; identical to SEQ ID NO: 297136

SEQ ID NO: 468070 - RNA, 64 nt, hsa; identical to SEQ ID NO: 297137

SEQ ID NO: 468071 - RNA, 64 nt, hsa; identical to SEQ ID NO: 297138

SEQ ID NO: 468072 - RNA, 64 nt, hsa; identical to SEQ ID NO: 297139

SEQ ID NO: 468073 - RNA, 64 nt, hsa; identical to SEQ ID NO: 297140

SEQ ID NO: 468074 - RNA, 64 nt, hsa; identical to SEQ ID NO: 297141

SEQ ID NO: 468075 - RNA, 64 nt, hsa; identical to SEQ ID NO: 297142

SEQ ID NO: 468076 - RNA, 64 nt, hsa; identical to SEQ ID NO: 297143

SEQ ID NO: 468077 - RNA, 64 nt, hsa; identical to SEQ ID NO: 297144

SEQ ID NO: 468078 - RNA, 62 nt, hsa; identical to SEQ ID NO: 297145

SEQ ID NO: 468079 - RNA, 64 nt, hsa; identical to SEQ ID NO: 248259

SEQ ID NO: 468080 - RNA, 64 nt, hsa; identical to SEQ ID NO: 248260

SEQ ID NO: 468081 - RNA, 64 nt, hsa; identical to SEQ ID NO: 248261

SEQ ID NO: 468082 - RNA, 64 nt, hsa; identical to SEQ ID NO: 248262

SEQ ID NO: 468083 - RNA, 64 nt, hsa; identical to SEQ ID NO: 248263

SEQ ID NO: 468084 - RNA, 64 nt, hsa; identical to SEQ ID NO: 248264

SEQ ID NO: 468085 - RNA, 64 nt, hsa; identical to SEQ ID NO: 248265

SEQ ID NO: 468086 - RNA, 64 nt, hsa; identical to SEQ ID NO: 248266

SEQ ID NO: 468087 - RNA, 64 nt, hsa; identical to SEQ ID NO: 248267

SEQ ID NO: 468088 - RNA, 64 nt, hsa; identical to SEQ ID NO: 248268

SEQ ID NO: 468089 - RNA, 64 nt, hsa; identical to SEQ ID NO: 248269

SEQ ID NO: 468090 - RNA, 64 nt, hsa; identical to SEQ ID NO: 248270

SEQ ID NO: 468091 - RNA, 64 nt, hsa; identical to SEQ ID NO: 248271

SEQ ID NO: 468092 - RNA, 64 nt, hsa; identical to SEQ ID NO: 248272

SEQ ID NO: 468093 - RNA, 64 nt, hsa; identical to SEQ ID NO: 248273

SEQ ID NO: 468094 - RNA, 64 nt, hsa; identical to SEQ ID NO: 248274

SEQ ID NO: 468095 - RNA, 64 nt, hsa; identical to SEQ ID NO: 248275

SEQ ID NO: 468096 - RNA, 64 nt, hsa; identical to SEQ ID NO: 248276

SEQ ID NO: 468097 - RNA, 64 nt, hsa; identical to SEQ ID NO: 248277

SEQ ID NO: 468098 - RNA, 64 nt, hsa; identical to SEQ ID NO: 248278

SEQ ID NO: 468099 - RNA, 64 nt, hsa; identical to SEQ ID NO: 248279

SEQ ID NO: 468100 - RNA, 64 nt, hsa; identical to SEQ ID NO: 248280

SEQ ID NO: 468101 - RNA, 64 nt, hsa; identical to SEQ ID NO: 248281

SEQ ID NO: 468102 - RNA, 64 nt, hsa; identical to SEQ ID NO: 248282

SEQ ID NO: 468103 - RNA, 64 nt, hsa; identical to SEQ ID NO: 248283

SEQ ID NO: 468104 - RNA, 64 nt, hsa; identical to SEQ ID NO: 248284

SEQ ID NO: 468105 - RNA, 64 nt, hsa; identical to SEQ ID NO: 248285

SEQ ID NO: 468106 - RNA, 64 nt, hsa; identical to SEQ ID NO: 248286

SEQ ID NO: 468107 - RNA, 64 nt, hsa; identical to SEQ ID NO: 248287

SEQ ID NO: 468108 - RNA, 64 nt, hsa; identical to SEQ ID NO: 248288

SEQ ID NO: 468109 - RNA, 64 nt, hsa; identical to SEQ ID NO: 248289

SEQ ID NO: 468110 - RNA, 64 nt, hsa; identical to SEQ ID NO: 248290

SEQ ID NO: 468111 - RNA, 54 nt, hsa; identical to SEQ ID NO: 248291

SEQ ID NO: 468112 - RNA, 64 nt, hsa; identical to SEQ ID NO: 248292

SEQ ID NO: 468113 - RNA, 64 nt, hsa; identical to SEQ ID NO: 248293

SEQ ID NO: 468114 - RNA, 64 nt, hsa; identical to SEQ ID NO: 248294

SEQ ID NO: 468115 - RNA, 64 nt, hsa; identical to SEQ ID NO: 248295

SEQ ID NO: 468116 - RNA, 64 nt, hsa; identical to SEQ ID NO: 248296

SEQ ID NO: 468117 - RNA, 64 nt, hsa; identical to SEQ ID NO: 248297

SEQ ID NO: 468118 - RNA, 64 nt, hsa; identical to SEQ ID NO: 248298

SEQ ID NO: 468119 - RNA, 64 nt, hsa; identical to SEQ ID NO: 248299

SEQ ID NO: 468120 - RNA, 64 nt, hsa
aggcucaaagaaaaguaaucccucuucugaauccacaccccaucaauuaucuuacuuucuucug

SEQ ID NO: 468121 - RNA, 64 nt, hsa
uaugauuuagaugaagaaaauuuuacaacuuuuaacaccccacaccaauuuuaguuucauuacu

SEQ ID NO: 468122 - RNA, 64 nt, hsa
ggaaaaccagagcacacaguuuugucaccauggaacaccccaaaugccauucuucagcgugucu

SEQ ID NO: 468123 - RNA, 64 nt, hsa
cucuauggccuggcuagagcugcaaaaaagggacacaccccacuucgguaaaagaaaauaggga

SEQ ID NO: 468124 - RNA, 64 nt, hsa
aacuggcccaaggcagcgaggcuucuacagucccacaccccauagccgccugggcuggggcuua

SEQ ID NO: 468125 - RNA, 64 nt, hsa
aacaagggucagguagaagagaaaggcuuccccuacaccccagccuccugcuguccccugaagc

SEQ ID NO: 468126 - RNA, 64 nt, hsa
ccggucagagauggaccuggccagaugucugaccacaccccaaucucagagcuaacauccacac

SEQ ID NO: 468127 - RNA, 64 nt, hsa
uccugugaagaguugagugcugugcuugggggagacaccccaccucccuccuccauggggcaca

SEQ ID NO: 468128 - RNA, 64 nt, hsa
ccagggaggcccagguacacacaggccauggcagacaccccaugucuuuguuaccccaggggcu

SEQ ID NO: 468129 - RNA, 64 nt, hsa
augcaugccgccggcacaugcucgagacguguggacaccccagcgugcgugugcgugugaugug

SEQ ID NO: 468130 - RNA, 64 nt, hsa
gcagccucagaucaucucugucacucuggaagggacaccccagccagggacggaaugccugguc

SEQ ID NO: 468131 - RNA, 64 nt, hsa
cuucuggcacaccuuguacagaguuuugggguucacaccccaaaaugacccaacgauguccaca

SEQ ID NO: 468132 - RNA, 64 nt, hsa
gccacaccccagaggugacaggugagccccugccacaccccagccucugacuugcuguguuguc

SEQ ID NO: 468133 - RNA, 64 nt, hsa
ccaggggccucuggugcgguuccgggaagaagccacaccccagaggugacaggugagccccugc

SEQ ID NO: 468134 - RNA, 64 nt, hsa
acuggaucccacacaaaucagugaauggaucccaacaccccaaccacaggagcacggauucccu

SEQ ID NO: 468135 - RNA, 64 nt, hsa
ucugcuacccuaaccacaagauucaagauuauccacaccccagcccuuaauccccaucccccaa

SEQ ID NO: 468136 - RNA, 64 nt, hsa
guacaccccaacagcacccucuccagaugagaguacaccccaacagcacccucuccagaugcag

SEQ ID NO: 468137 - RNA, 64 nt, hsa
guacaccccaacagcacccucuccagaugagaguacaccccaacagcacccucuccagaugaga

SEQ ID NO: 468138 - RNA, 64 nt, hsa
agugcccccaacagcacccucuccagaugagaguacaccccaacagcacccucuccagaugaga

SEQ ID NO: 468139 - RNA, 64 nt, hsa
cccgcuccucuauggccccugccuucccaggaguacaccccaacagcacccucuccagauggga

SEQ ID NO: 468140 - RNA, 64 nt, hsa
cagaggcagagggcacaggaaagaagccgggccaagcucggaauuaaugugccacaaguguugu

SEQ ID NO: 468141 - RNA, 64 nt, hsa
gagccacguugacuucagguggucuucuaccagcagcucggaauaguugcacugaaucuauacu

SEQ ID NO: 468142 - RNA, 64 nt, hsa
uccauacuuuuaaccuccuaaagcuaaaaacaauagcucggaaaccauucuuucuaguuacuuu

SEQ ID NO: 468143 - RNA, 64 nt, hsa
ggagagaaaggaauguuuuugauggugguuucaaagcucggacaguaacuaucuugagcccauu

SEQ ID NO: 468144 - RNA, 64 nt, hsa
aagauccugagaacuuggaauuccuuguaacuggagcucggagcugcaccgagggcaaccagga

SEQ ID NO: 468145 - RNA, 64 nt, hsa
gucuaacgccaguuccugccuguugccucuugugagcucggacugcugaugccccggugcugcu

SEQ ID NO: 468146 - RNA, 64 nt, hsa
aggcuucuuucuccucgcccgcuccccugggcucagcucggacgcugcaguuauugaccucccg

SEQ ID NO: 468147 - RNA, 64 nt, hsa
gaaaggccacccuaaccucuguguucaggugaacagcucggagaagcugcagcugcaggagugc

SEQ ID NO: 468148 - RNA, 64 nt, hsa
gucauauacaccuccagggaccaaaaacaaaagcagcucggagucuguguugccugauuggaaa

SEQ ID NO: 468149 - RNA, 64 nt, hsa
gcuguugcuucagccuggccugggcagcccuggaagcucggaggagaggccaccuucuuaggug

SEQ ID NO: 468150 - RNA, 64 nt, hsa
cacaggcccguccucggaagagccuugagagugcagcucggacccaccggcggcccccguagca

SEQ ID NO: 468151 - RNA, 64 nt, hsa
cauaaugaaugcuauugaaaagguuaacagauacagcucggaguugugagcacucuacugcaag

SEQ ID NO: 468152 - RNA, 64 nt, hsa
gguuugaauacuauggcucaagguuuucauaugcagcucggauggacauuuuucuucuaagaug

SEQ ID NO: 468153 - RNA, 64 nt, hsa
cuccgccuccacggaacgucucgccuugcgagcaagcucggaauccaguuccucaggaaccccu

SEQ ID NO: 468154 - RNA, 64 nt, hsa
guucacgccauucuccugccucagccucccaaguagcucggacuacaggcguccuccaccaugc

SEQ ID NO: 468155 - RNA, 64 nt, hsa
cuggguccucccacccucucuccucccaccccacagcucggacugcucugggagggcccugagg

SEQ ID NO: 468156 - RNA, 64 nt, hsa
gccagcggcucgcaucccccucaucuccagcugcagcucggaugguggauuuucagugccaaca

SEQ ID NO: 468157 - RNA, 64 nt, hsa
acacgugaggggggggugggugagagagacaggcagcucggauucaacuaccuuagauaauauu

SEQ ID NO: 468158 - RNA, 64 nt, hsa
cuucccgcagugucugcguccgcacagcauacccagcucggaccuccuaggacagagacucagc

SEQ ID NO: 468159 - RNA, 64 nt, hsa
ugaagcguuuccagcaggagaaugaagaauugaaagcucggauggacaagcacauggcaaucuc

SEQ ID NO: 468160 - RNA, 64 nt, hsa
gucugcuuccacguccucucccaggaacauucuuagcucggacucuugaagaaucucuuuagau

SEQ ID NO: 468161 - RNA, 64 nt, hsa
gauggagacaguaacacuggcgagcaggugccccagcucggacuauacugcugaguucuggucu

SEQ ID NO: 468162 - RNA, 64 nt, hsa
caggaggauuucaagaaagcaccaaagaccagggagcucggauccauacucggggggccucagc

SEQ ID NO: 468163 - RNA, 64 nt, hsa
ggguccagugggaacugaagagggcccaagucggagcucggagggggcugccugcaaugcaggg

SEQ ID NO: 468164 - RNA, 64 nt, hsa
agucugacaggaagacuggagacuguccacuucuagcucggaacuuacuguguaaauaaacuuu

SEQ ID NO: 468165 - RNA, 52 nt, hsa
cuccuaccucagccuccugagaagcucggacuacaggcacgagccaccaugc

SEQ ID NO: 468166 - RNA, 64 nt, hsa
ccagcugagaauguauggaggucaucggggccucagcucggaggcagugacuuggggccaaggg

SEQ ID NO: 468167 - RNA, 64 nt, hsa
ccgauggucagggagagggcuagagcucacacccagcucggaauagaucuucccugaugacauu

SEQ ID NO: 468168 - RNA, 64 nt, hsa
caccaucucugccuucgaugggggcucggacuccagcucggagucugagccugaagagccccaa

SEQ ID NO: 468169 - RNA, 64 nt, hsa
caggcuugccccuggucagccugcgggcccaggcagcucggacaccaggcugagcccggcgcag

SEQ ID NO: 468170 - RNA, 64 nt, hsa
ggagggaagagugaucuaugucucuucccccagcagcucggaccacucccagccccccaucccc

SEQ ID NO: 468171 - RNA, 64 nt, hsa
ccgcacacuuggacuugagaguuugccagcagcgagcucggaugcaucucuccaaaagccacca

SEQ ID NO: 468172 - RNA, 64 nt, hsa
gccacuggcuaccccuacugcgcggcggcccaggagcucggacugcugguccuggagagcugcc

SEQ ID NO: 468173 - RNA, 55 nt, hsa
gcaccgugguucuggaguagccuccagcucggaggacuuguguucagggguccug

SEQ ID NO: 468174 - RNA, 64 nt, hsa
aaggcuugagcgccccccauggcugggagcccgaagcucggagccagggcucgcgagggcagca

SEQ ID NO: 468175 - RNA, 64 nt, hsa
ucugggaagaggugacgcgugucccuggaaccccagcucggagggucucagccuccccuggguu

SEQ ID NO: 468176 - RNA, 64 nt, hsa
ccucaccacugaggccacgacaaagcacagcuccagcucggacagcacccucagugccagccag

SEQ ID NO: 468177 - RNA, 64 nt, hsa
cuugaccuugggggaauauuucacauccauccagagcucggaaucuacagcguccagccauuuc

SEQ ID NO: 468178 - RNA, 64 nt, hsa
agcagcugugccagaggcuggaccacacaggagaagcucggacuuggcacuccuggacaaccug

SEQ ID NO: 468179 - RNA, 64 nt, hsa
guuucuccuccugggagucaaaguccauagccugagcucggaggaaggccucuguaucacccca

SEQ ID NO: 468180 - RNA, 64 nt, hsa
cccucaaagcagacgugagagggacgguucacaaagcucggaccugccguggagggugcccggc

SEQ ID NO: 468181 - RNA, 64 nt, hsa
gcccuggcuggagcugucaucacacacaccccucagcucggaggcugugggcuccucaaagcug

SEQ ID NO: 468182 - RNA, 64 nt, hsa
cuggaucgugaggacgcugcgggccagcggcuucagcucggaggcggacguccccacucugggu

SEQ ID NO: 468183 - RNA, 64 nt, hsa
cuguaaguugcaugccaacaaugccuccaauuccagcucggagucaaucccaggaaaauaugcg

SEQ ID NO: 468184 - RNA, 64 nt, hsa
gaagguugucuccucuggggccagcauuuggccaagcucggaggcuuggccagcacugcuggau

SEQ ID NO: 468185 - RNA, 64 nt, hsa
gcugccuccuuacuccuggcccucuacaugaagaagcucggauacuggguaaacacuugcgaga

SEQ ID NO: 468186 - RNA, 64 nt, hsa
gacacaaccguccccggccccugccccgcccccaagcucggaucacaugaaggagacagcagca

SEQ ID NO: 468187 - RNA, 64 nt, hsa
acucaugacuaauaccucauuauuucagcugucugcaccuaauuccccacuugcacggcagugu

SEQ ID NO: 468188 - RNA, 64 nt, hsa
gugaaagcaauggcagccuuccuuauuugauuaugcaccuaagaauaaaugguauuugggcaug

SEQ ID NO: 468189 - RNA, 62 nt, hsa
uggggccugggcugggggccuggccucuggagagcccugauucuacuccagucuucucucac

SEQ ID NO: 468190 - RNA, 62 nt, hsa
acacucaccacccaggaugcucagcucaccagagcccugaccuccgagaaaugaccccgucc

SEQ ID NO: 468191 - RNA, 62 nt, hsa
guuuccuggucauuucugcagcucugacugugagcccugagaagaaagggaagacuuggggc

SEQ ID NO: 468192 - RNA, 62 nt, hsa
caggagaggaaccucaacucaguccauuucauagcccugauaggggaagugggaguugacag

SEQ ID NO: 468193 - RNA, 62 nt, hsa
ucacagauauccuauggagauuuaaggaugaaagcccugaguuguucuuggguucuuggauc

SEQ ID NO: 468194 - RNA, 62 nt, hsa
ccaucuacaucuccuucaccccuauggugcucagcccugagauccugcacaagguggagugu

SEQ ID NO: 468195 - RNA, 62 nt, hsa
cuccuaugaugagagauacauguugccucaccagcccugaggcuccgccccagcccucagcc

SEQ ID NO: 468196 - RNA, 62 nt, hsa
cccaucuccggggaagacgugcgcgaugugacagcccugaacgugagcacgcugaaggcuua

SEQ ID NO: 468197 - RNA, 62 nt, hsa
ggaugcccaauggcuccaccauucccccagggagcccugaggagaugcuuuuccacuuugga

SEQ ID NO: 468198 - RNA, 62 nt, hsa
uuguaccacuuacauuuuaggcuggggcaagcagcccugaccuaagggagaaugaguuggac

SEQ ID NO: 468199 - RNA, 62 nt, hsa
guuacaucauaacaacuucugaaacacacaccagcccugaguucugggcucauuugaagccu

SEQ ID NO: 468200 - RNA, 62 nt, hsa
ggcuggggccacagcuccuaccccugcccagcagcccugagcucagcugcaggaaggacauc

SEQ ID NO: 468201 - RNA, 62 nt, hsa
ucggcugcagcagagggcaggagccccagcuuagcccugagcgccagcgcgaggaccagggc

SEQ ID NO: 468202 - RNA, 62 nt, hsa
gggcacaugaaacgaccuggaacuugcuucacagcccugaggaagguggacuuacauaagca

SEQ ID NO: 468203 - RNA, 62 nt, hsa
acuaggccagugguuuucaaacugcuuggcagagcccugaaguuuccuagggguugccucag

SEQ ID NO: 468204 - RNA, 62 nt, hsa
cugccagcagcugccugggaaggccguguuucagcccugaugggccaagggaaggcuaucag

SEQ ID NO: 468205 - RNA, 62 nt, hsa
uugugcugacagcaaagauccacuuuggcaggagcccugacccagcuaggagguagucugga

SEQ ID NO: 468206 - RNA, 62 nt, hsa
gccaccugccaucuccaagcauuuggacaacuagcccugaugcauuaggcugcaacucugau

SEQ ID NO: 468207 - RNA, 62 nt, hsa
auuacaugagaagauuuccaugaaagaauugcagcccugagguccauggguugacuuaugcu

SEQ ID NO: 468208 - RNA, 62 nt, hsa
auucuucaaaagcauucugagaaggugagauaagcccugagucucagcuaccuaagaaaaac

SEQ ID NO: 468209 - RNA, 62 nt, hsa
uagcaauuuauacaauaucauccaguaccuuaagcccugauuguguauauucauauauuuug

SEQ ID NO: 468210 - RNA, 62 nt, hsa
accguggagcgcuggcaagggcguccuggcccagcccugagcgcgcggcccuuccccugucg

SEQ ID NO: 468211 - RNA, 62 nt, hsa
accucacccggccccaucuguugccccgguccagcccugauggcgcgcgccuggucugucug

SEQ ID NO: 468212 - RNA, 62 nt, hsa
cugccugcuuugugcaggguccuccggggcucagcccugaguuggcaucaccugcgcagggc

SEQ ID NO: 468213 - RNA, 62 nt, hsa
uggcaucaccugcgcagggcccucuggggcucagcccugagcuagugucaccugcacagggc

SEQ ID NO: 468214 - RNA, 62 nt, hsa
uagugucaccugcacagggcccucugaggcucagcccugagcuggcgucaccugugcagggc

SEQ ID NO: 468215 - RNA, 62 nt, hsa
uggcgucaccugugcagggcccucuggggcucagcccugagcuggccucaccuggguucccc

SEQ ID NO: 468216 - RNA, 64 nt, hsa
uaugaagucccuccugauuuugugugugugugucuguguuuaagcaagcguucgguugguauag

SEQ ID NO: 468217 - RNA, 64 nt, hsa
uucucugugaaggcuguucauaguugcuauagccuguguuuaguuuugugauuucaucaauccc

SEQ ID NO: 468218 - RNA, 64 nt, hsa
cuccucuuuaucauguuuuuucccuuguagcaguuguguuuaaugucauuaaaaagaaauaaaa

SEQ ID NO: 468219 - RNA, 64 nt, hsa
gugugugagguucucgagaacugucuugucucuguguguuuauuugccugccagugcucuccag

SEQ ID NO: 468220 - RNA, 64 nt, hsa
uguguucuuuacaaaggcuagcucaguccaacacuguguuuacauacacucgugcuuuuccuua

SEQ ID NO: 468221 - RNA, 64 nt, hsa
uaaguguuugaacaacuauaugcacuuacgguuguguguuuaaaaugucucucucacccccuag

SEQ ID NO: 468222 - RNA, 64 nt, hsa
cacacacaugcacacaaauggacuucucugaagcuguguuuagugaaaugagcucaaguacaug

SEQ ID NO: 468223 - RNA, 64 nt, hsa
aauucaucuuuaugaagauuuagaacucauuccuuguguuuaaagggaauguuuaauugagaaa

SEQ ID NO: 468224 - RNA, 64 nt, hsa
acuugacuauaucuuauaauuuuauuguuuauuuuguguuuaaugcacagcuacuucacaccuu

SEQ ID NO: 468225 - RNA, 64 nt, hsa
aauaagcauuuucccacacaaugaacauuugaacuguguuuaugaaaauuuucugguuugcacc

SEQ ID NO: 468226 - RNA, 64 nt, hsa
uguggaccauaaauaacacggcccaauaacucuuuguguuuauggaguguuguuuucuuagaau

SEQ ID NO: 468227 - RNA, 64 nt, hsa
ccagauuuuuaguccaaaaaaauguauuuuuuuguguguuuaccacugcaacuauugcaccucu

SEQ ID NO: 468228 - RNA, 64 nt, hsa
acagagguguugcagcguaucacuguuaugauccuguguuuagauuauccacucaugcuucucc

SEQ ID NO: 468229 - RNA, 64 nt, hsa
ccagauuagccaccauuagcaucuauaucuacuuuguguuuaaaaaucaacugguaauucugaa

SEQ ID NO: 468230 - RNA, 64 nt, hsa
agaaaaaaguuucaguugugguagaauaccgugcuguguuuaaauguuacuuguuuucaaacuu

SEQ ID NO: 468231 - RNA, 64 nt, hsa
ugguggaggauaauaugauuaaagggaacaugcuuguguuuauuuuuguugguaguauaugauu

SEQ ID NO: 468232 - RNA, 64 nt, hsa
caacaaaacugcuaaugucuauuaggaagaaaaauguguuuaaaguuuuacaggaacguggagc

SEQ ID NO: 468233 - RNA, 64 nt, hsa
aaaacaauucaggaccaaauuuuuucucaguguguguguuuauuccuuauagguguaaaugaga

SEQ ID NO: 468234 - RNA, 64 nt, hsa
ugaugauagcauauguguucagguuuauagcuguuguguuuaaaaauugaaaaaaguggaaaac

SEQ ID NO: 468235 - RNA, 64 nt, hsa
aauaucugacuauaaaauauuuuuuugaguuuuuuguguuuaugagauuaugcuaauuuuaugg

SEQ ID NO: 468236 - RNA, 64 nt, hsa
cugcuauagagaacauucuuccaagauaaauauguguguuuacacauaugucugcaugcaugug

SEQ ID NO: 468237 - RNA, 64 nt, hsa
ggcugcguggcguuccauugagugucugucaucauguguuuagccgaguggauggauagucugc

SEQ ID NO: 468238 - RNA, 64 nt, hsa
uagcccuuggggaacacagguaguuccuuuucacuguguuuaauuugggaaaauccagauccac

SEQ ID NO: 468239 - RNA, 64 nt, hsa
cguguguguuuaagacucuugagcugaacugggcuguguuuaccccaaacucuuccccaccucg

SEQ ID NO: 468240 - RNA, 64 nt, hsa
ugugagugugugugugugcgcgcgcgcaagcguguguguuuaagacucuugagcugaacugggc

SEQ ID NO: 468241 - RNA, 64 nt, hsa
uuuaaauuguauaguugaugagucaauguaaauuuguguuuauuuuuauaugauugaaugaguu

SEQ ID NO: 468242 - RNA, 64 nt, hsa
ccacagagagagagcugcaagagcauggaauucauguguuuaaagauaauccuuuccaugugaa

SEQ ID NO: 468243 - RNA, 64 nt, hsa
aaucuaguguccauauuuaauacucucacagcuuuguguuuauucucuuugcucauggaauagc

SEQ ID NO: 468244 - RNA, 64 nt, hsa
cuuugugucuuugaucuaauuaaaccugcuuggcuguguuuauccgcagggcaggucacagaua

SEQ ID NO: 468245 - RNA, 64 nt, hsa
gaacuuaguugaauauaaaaaucuagauuaaaaguguguuuaccauacuguauaauuccauuua

SEQ ID NO: 468246 - RNA, 64 nt, hsa
uucaacaaagcuguuuuaauaaaaaaaggaaaaauguguuuacuauaucggcuuagaaacaugc

SEQ ID NO: 468247 - RNA, 64 nt, hsa; identical to SEQ ID NO: 468246

SEQ ID NO: 468248 - RNA, 64 nt, hsa; identical to SEQ ID NO: 468245

SEQ ID NO: 468249 - RNA, 64 nt, hsa
acaucacuaaguaauagacccacagcuuuauucuuguguuuacauuacccuugaaauguuuuca

SEQ ID NO: 468250 - RNA, 64 nt, hsa
agcguacuauagaaaaugcacucagcucaacugcuguguuuaaaauacacauuuuaaaucccuc

SEQ ID NO: 468251 - RNA, 64 nt, hsa
ugacaauguuaugagauucauuacuaucuuaagauguguuuauccucagcuuauaggaaucucu

SEQ ID NO: 468252 - RNA, 64 nt, hsa
uugaagauaguaauuagguuucuaagcuguauacuguguuuauugguggcagugacaccaaaga

SEQ ID NO: 468253 - RNA, 64 nt, hsa
aaaacccagauaaagguucaugcaaacuuuauuuuguguuuaggaacuacugaggaucagagua

SEQ ID NO: 468254 - RNA, 64 nt, hsa
gcugccugcuuuuuauggccugugagcuaggaauuguguuuauaauuuuaaauguuuuuuuuua

SEQ ID NO: 468255 - RNA, 64 nt, hsa
aaucuccacaugaaggccccuccccugggaucacuguguuuaagagagagugguuccugcuguu

SEQ ID NO: 468256 - RNA, 64 nt, hsa
gaugacuccaggaagacagcuggaguacugcauuuguguuuaggguuuguaugacccuuccgag

SEQ ID NO: 468257 - RNA, 64 nt, hsa
ugcagagccaaaauagcaaaacaaacauauuaaguguguuuacuaaacauauuguguguuuacu

SEQ ID NO: 468258 - RNA, 64 nt, hsa
acaaacauauuaaguguguuuacuaaacauauuguguguuuacuaacacacuuaauguuuauau

SEQ ID NO: 468259 - RNA, 64 nt, hsa
caguagggaauaaacugugucccaccuguuuacuuguguuuauuuguuguuaugaugaguaugc

SEQ ID NO: 468260 - RNA, 64 nt, hsa
aaaaaaaaagagagagagagagaaaaagaaaugcuguguuuaaucuucuuaaaauguaucuugu

SEQ ID NO: 468261 - RNA, 64 nt, hsa
ccuccgucuuuccccuccccuggcauggacaccuuguguuuaggaucaucucugcagguuuccu

SEQ ID NO: 468262 - RNA, 64 nt, hsa
ggugaaauuccagaugagucagucucuugggaaguguguuuagaaggguucaggacuuugugag

SEQ ID NO: 468263 - RNA, 64 nt, hsa
cuccaauuccagcauauccagugaguuuugacaguguguuuauguggaauguuuaaggauauac

SEQ ID NO: 468264 - RNA, 64 nt, hsa
gaacauagccaaaaguaugugccguugcacagacuguguuuaugacucaaccguugguuggaaa

SEQ ID NO: 468265 - RNA, 64 nt, hsa
uaauaaagagaacaggguaagaugugaggcugaguguguuuaaguacgugagagagugugagug

SEQ ID NO: 468266 - RNA, 64 nt, hsa
agaaaccacgcccacaccaaugccaacacaaaacuguguuuacugaaagccgaaaacaguauua

SEQ ID NO: 468267 - RNA, 64 nt, hsa
ucugagcacuuaggugaagggacaagcagguuuauguguuuaaacagaaagaagggaaaaggua

SEQ ID NO: 468268 - RNA, 64 nt, hsa
gcuuauuuuaaaaauauuuuuuaucuauuuacuguguguuuaagcaagcaacagugcacugauc

SEQ ID NO: 468269 - RNA, 64 nt, hsa
gcacacuaagauguauuuucuuacgaaauaguucuguguuuauuuuuuaauuauagaaauucca

SEQ ID NO: 468270 - RNA, 64 nt, hsa
uucacaugauuuuguucuaguuuuuguguauauauguguuuauuagacauggcaugcuaagaag

SEQ ID NO: 468271 - RNA, 64 nt, hsa
cugggaguucagguucucuccagggcuccagguguguguuuaucucgcccccuccagcucuccu

SEQ ID NO: 468272 - RNA, 64 nt, hsa
aauggaaguguccuccuguucucuggucaauauguguguuuacuuugcuugcuuugacucaugc

SEQ ID NO: 468273 - RNA, 64 nt, hsa
uuauuauuguuuguuguuauuucuuuguuauuguuguguuuacuguuuauuuauuuugaggcag

SEQ ID NO: 468274 - RNA, 64 nt, hsa
agagauuaaagaaaaauauguucacucccacuuauguguuuauuguuauuauuguuuguuguua

SEQ ID NO: 468275 - RNA, 64 nt, hsa
agcaucaaauauuuaaugcccucagugggaaauuuguguuuaaacucaauggaaucuaauauuu

SEQ ID NO: 468276 - RNA, 64 nt, hsa
auuugcaaugaaauauucauagauauugaaagcuuguguuuacaugaaauauguuuauuaucaa

SEQ ID NO: 468277 - RNA, 64 nt, hsa
aaaauguaaauacugauuugacuggucuuuaagauguguuuaacugugaggcuauuuaacgaau

SEQ ID NO: 468278 - RNA, 64 nt, hsa
gucauccaguauuaaguucuuagucauugauuuuuguguuuaaaaaaaaauaggaaagagggaa

SEQ ID NO: 468279 - RNA, 64 nt, hsa
cacuguguuugguuacugucaagaaaucaauaaauguguuuaacaaguuacccaguacccaugu

SEQ ID NO: 468280 - RNA, 64 nt, hsa
cauuguguuugguuauuguuaccagcucaauaaauguguuuaacgaguuaauuucauuuuucug

SEQ ID NO: 468281 - RNA, 64 nt, hsa
gugcccaacagccuggcaucuucuuguuucucuguguguuuacucauucauucauuuauucagc

SEQ ID NO: 468282 - RNA, 64 nt, hsa
gaggccucggcaucuugagauggaagagcagccuuguguuuagaccuggauugaauugggcccu

SEQ ID NO: 468283 - RNA, 64 nt, hsa
uaaguuucuuuuaaaaauaugacauagccagugauguguuuaauuauauaacuguucuuacuga

SEQ ID NO: 468284 - RNA, 64 nt, hsa
ccaaaucaaaugguaauuuaaauaaaaucuauucuguguuuauguagggugguauaaaaaagag

SEQ ID NO: 468285 - RNA, 64 nt, hsa
guuuugauuuugauuaacauugacaggauuacuguguguuuaauuuuuuaaaaacugaacacug

SEQ ID NO: 468286 - RNA, 64 nt, hsa
cucccaagugcacucauccaggucagugcucagauguguuuaaggagacccuauauucagggaa

SEQ ID NO: 468287 - RNA, 64 nt, hsa
auuuaguucacaagcauaauuuggagguguguucuguguuuacacaguaguuuggauguacaau

SEQ ID NO: 468288 - RNA, 64 nt, hsa
gaugguaucgaaaaccagaaaccacuuuuaauaauguguuuaagauacuugauuugaaguccuu

SEQ ID NO: 468289 - RNA, 64 nt, hsa
ucuugaacaucuuucccuguuuguauauacacuuuguguuuauuuuucaguagcugcaguauau

SEQ ID NO: 468290 - RNA, 64 nt, hsa
auacggauuuguuucuguccauaauccucaugcuuguguuuaugucucaagagguuggaaucaa

SEQ ID NO: 468291 - RNA, 64 nt, hsa
guuaaaaugcaugauugcagaauuguuuagauuuuguguuuauucuugaugaaaagcuuuguuu

SEQ ID NO: 468292 - RNA, 64 nt, hsa
aguacauuuuuugaaaugcugaaaauugccuuucuguguuuauucaaacugaaaagcugagacc

SEQ ID NO: 468293 - RNA, 64 nt, hsa
guucuucauuagauguuuauuuagaaccugguucuguguuuaauauauaguuuaaaguaacaaa

SEQ ID NO: 468294 - RNA, 64 nt, hsa
auuuguaucaguaucauuugaucugccauggacauguguuuaaaguggcuuucuggcccuucuu

SEQ ID NO: 468295 - RNA, 64 nt, hsa; identical to SEQ ID NO: 468293

SEQ ID NO: 468296 - RNA, 64 nt, hsa; identical to SEQ ID NO: 468294

SEQ ID NO: 468297 - RNA, 64 nt, hsa; identical to SEQ ID NO: 382152

SEQ ID NO: 468298 - RNA, 64 nt, hsa; identical to SEQ ID NO: 382153

SEQ ID NO: 468299 - RNA, 64 nt, hsa; identical to SEQ ID NO: 382154

SEQ ID NO: 468300 - RNA, 64 nt, hsa; identical to SEQ ID NO: 382155

SEQ ID NO: 468301 - RNA, 64 nt, hsa; identical to SEQ ID NO: 382156

SEQ ID NO: 468302 - RNA, 64 nt, hsa; identical to SEQ ID NO: 382157

SEQ ID NO: 468303 - RNA, 64 nt, hsa; identical to SEQ ID NO: 382158

SEQ ID NO: 468304 - RNA, 64 nt, hsa; identical to SEQ ID NO: 382159

SEQ ID NO: 468305 - RNA, 64 nt, hsa; identical to SEQ ID NO: 382160

SEQ ID NO: 468306 - RNA, 64 nt, hsa; identical to SEQ ID NO: 382161

SEQ ID NO: 468307 - RNA, 64 nt, hsa; identical to SEQ ID NO: 382162

SEQ ID NO: 468308 - RNA, 64 nt, hsa; identical to SEQ ID NO: 382163

SEQ ID NO: 468309 - RNA, 64 nt, hsa; identical to SEQ ID NO: 382164

SEQ ID NO: 468310 - RNA, 64 nt, hsa; identical to SEQ ID NO: 382165

SEQ ID NO: 468311 - RNA, 64 nt, hsa; identical to SEQ ID NO: 382166

SEQ ID NO: 468312 - RNA, 64 nt, hsa; identical to SEQ ID NO: 382167

SEQ ID NO: 468313 - RNA, 64 nt, hsa; identical to SEQ ID NO: 382168

SEQ ID NO: 468314 - RNA, 64 nt, hsa; identical to SEQ ID NO: 382169

SEQ ID NO: 468315 - RNA, 64 nt, hsa; identical to SEQ ID NO: 382170

SEQ ID NO: 468316 - RNA, 64 nt, hsa; identical to SEQ ID NO: 382171

SEQ ID NO: 468317 - RNA, 64 nt, hsa; identical to SEQ ID NO: 382172

SEQ ID NO: 468318 - RNA, 64 nt, hsa; identical to SEQ ID NO: 382173

SEQ ID NO: 468319 - RNA, 64 nt, hsa; identical to SEQ ID NO: 382174

SEQ ID NO: 468320 - RNA, 64 nt, hsa; identical to SEQ ID NO: 382175

SEQ ID NO: 468321 - RNA, 64 nt, hsa; identical to SEQ ID NO: 382176

SEQ ID NO: 468322 - RNA, 64 nt, hsa; identical to SEQ ID NO: 382177

SEQ ID NO: 468323 - RNA, 64 nt, hsa; identical to SEQ ID NO: 382178

SEQ ID NO: 468324 - RNA, 64 nt, hsa; identical to SEQ ID NO: 382179

SEQ ID NO: 468325 - RNA, 64 nt, hsa; identical to SEQ ID NO: 382180

SEQ ID NO: 468326 - RNA, 64 nt, hsa; identical to SEQ ID NO: 382181

SEQ ID NO: 468327 - RNA, 64 nt, hsa; identical to SEQ ID NO: 382182

SEQ ID NO: 468328 - RNA, 64 nt, hsa; identical to SEQ ID NO: 382183

SEQ ID NO: 468329 - RNA, 64 nt, hsa; identical to SEQ ID NO: 382184

SEQ ID NO: 468330 - RNA, 64 nt, hsa; identical to SEQ ID NO: 382185

SEQ ID NO: 468331 - RNA, 64 nt, hsa; identical to SEQ ID NO: 382186

SEQ ID NO: 468332 - RNA, 64 nt, hsa; identical to SEQ ID NO: 382187

SEQ ID NO: 468333 - RNA, 64 nt, hsa; identical to SEQ ID NO: 382188

SEQ ID NO: 468334 - RNA, 64 nt, hsa; identical to SEQ ID NO: 382189

SEQ ID NO: 468335 - RNA, 64 nt, hsa; identical to SEQ ID NO: 382190

SEQ ID NO: 468336 - RNA, 64 nt, hsa; identical to SEQ ID NO: 382191

SEQ ID NO: 468337 - RNA, 64 nt, hsa; identical to SEQ ID NO: 382192

SEQ ID NO: 468338 - RNA, 64 nt, hsa; identical to SEQ ID NO: 87431

SEQ ID NO: 468339 - RNA, 64 nt, hsa; identical to SEQ ID NO: 87432

SEQ ID NO: 468340 - RNA, 64 nt, hsa; identical to SEQ ID NO: 87433

SEQ ID NO: 468341 - RNA, 64 nt, hsa; identical to SEQ ID NO: 87434

SEQ ID NO: 468342 - RNA, 64 nt, hsa; identical to SEQ ID NO: 87435

SEQ ID NO: 468343 - RNA, 64 nt, hsa; identical to SEQ ID NO: 87436

SEQ ID NO: 468344 - RNA, 64 nt, hsa; identical to SEQ ID NO: 87437

SEQ ID NO: 468345 - RNA, 64 nt, hsa; identical to SEQ ID NO: 87438

SEQ ID NO: 468346 - RNA, 64 nt, hsa; identical to SEQ ID NO: 87439

SEQ ID NO: 468347 - RNA, 64 nt, hsa; identical to SEQ ID NO: 87440

SEQ ID NO: 468348 - RNA, 64 nt, hsa; identical to SEQ ID NO: 87441

SEQ ID NO: 468349 - RNA, 64 nt, hsa; identical to SEQ ID NO: 87442

SEQ ID NO: 468350 - RNA, 64 nt, hsa; identical to SEQ ID NO: 87443

SEQ ID NO: 468351 - RNA, 64 nt, hsa; identical to SEQ ID NO: 87444

SEQ ID NO: 468352 - RNA, 64 nt, hsa; identical to SEQ ID NO: 87445

SEQ ID NO: 468353 - RNA, 64 nt, hsa; identical to SEQ ID NO: 87446

SEQ ID NO: 468354 - RNA, 64 nt, hsa; identical to SEQ ID NO: 87447

SEQ ID NO: 468355 - RNA, 64 nt, hsa; identical to SEQ ID NO: 87448

SEQ ID NO: 468356 - RNA, 64 nt, hsa; identical to SEQ ID NO: 87449

SEQ ID NO: 468357 - RNA, 64 nt, hsa; identical to SEQ ID NO: 87450

SEQ ID NO: 468358 - RNA, 64 nt, hsa; identical to SEQ ID NO: 87451

SEQ ID NO: 468359 - RNA, 64 nt, hsa; identical to SEQ ID NO: 87452

SEQ ID NO: 468360 - RNA, 64 nt, hsa; identical to SEQ ID NO: 87453

SEQ ID NO: 468361 - RNA, 64 nt, hsa; identical to SEQ ID NO: 87454

SEQ ID NO: 468362 - RNA, 64 nt, hsa; identical to SEQ ID NO: 87455

SEQ ID NO: 468363 - RNA, 64 nt, hsa; identical to SEQ ID NO: 87456

SEQ ID NO: 468364 - RNA, 64 nt, hsa; identical to SEQ ID NO: 87457

SEQ ID NO: 468365 - RNA, 64 nt, hsa; identical to SEQ ID NO: 87458

SEQ ID NO: 468366 - RNA, 64 nt, hsa; identical to SEQ ID NO: 87459

SEQ ID NO: 468367 - RNA, 64 nt, hsa; identical to SEQ ID NO: 87460

SEQ ID NO: 468368 - RNA, 64 nt, hsa; identical to SEQ ID NO: 87461

SEQ ID NO: 468369 - RNA, 64 nt, hsa; identical to SEQ ID NO: 87462

SEQ ID NO: 468370 - RNA, 64 nt, hsa; identical to SEQ ID NO: 87463

SEQ ID NO: 468371 - RNA, 64 nt, hsa; identical to SEQ ID NO: 87464

SEQ ID NO: 468372 - RNA, 64 nt, hsa; identical to SEQ ID NO: 87465

SEQ ID NO: 468373 - RNA, 64 nt, hsa; identical to SEQ ID NO: 87466

SEQ ID NO: 468374 - RNA, 64 nt, hsa; identical to SEQ ID NO: 87467

SEQ ID NO: 468375 - RNA, 64 nt, hsa; identical to SEQ ID NO: 87468

SEQ ID NO: 468376 - RNA, 64 nt, hsa; identical to SEQ ID NO: 87469

SEQ ID NO: 468377 - RNA, 64 nt, hsa; identical to SEQ ID NO: 87470

SEQ ID NO: 468378 - RNA, 64 nt, hsa; identical to SEQ ID NO: 87471

SEQ ID NO: 468379 - RNA, 64 nt, hsa; identical to SEQ ID NO: 87472

SEQ ID NO: 468380 - RNA, 64 nt, hsa; identical to SEQ ID NO: 87473

SEQ ID NO: 468381 - RNA, 64 nt, hsa; identical to SEQ ID NO: 87474

SEQ ID NO: 468382 - RNA, 64 nt, hsa; identical to SEQ ID NO: 87475

SEQ ID NO: 468383 - RNA, 64 nt, hsa; identical to SEQ ID NO: 87476

SEQ ID NO: 468384 - RNA, 64 nt, hsa; identical to SEQ ID NO: 87477

SEQ ID NO: 468385 - RNA, 64 nt, hsa; identical to SEQ ID NO: 87478

SEQ ID NO: 468386 - RNA, 64 nt, hsa; identical to SEQ ID NO: 87479

SEQ ID NO: 468387 - RNA, 64 nt, hsa
cauuuuuguguuuguuuuguucuuuucugucacugauccguauuaccacuuuuggaaaaaaaua

SEQ ID NO: 468388 - RNA, 64 nt, hsa
uauaccacgaaucguuaauuuugacaguucuacugauccguaaaugauaaccacugcaaauuuu

SEQ ID NO: 468389 - RNA, 64 nt, hsa
gucuggcgccgcccuucccgcccguugcugcugugauccguaguaauaaauucucagaggacuc

SEQ ID NO: 468390 - RNA, 64 nt, hsa
accacuccuuuuggagacggcaggaggccugagcgauccguacucagaacguccaggagagacg

SEQ ID NO: 468391 - RNA, 64 nt, hsa
uagucacauauauaagcacugcacaugagauauagauccguagaauugucaggagugcaccucu

SEQ ID NO: 468392 - RNA, 64 nt, hsa
gcuggauuaucugggugugcccaauugaucaccggauccguaaaaguggaagagaggcagauca

SEQ ID NO: 468393 - RNA, 64 nt, hsa
gugucucuguugcacagaucuguuuuuucacacugauccguauuccccugggugugcacacagg

SEQ ID NO: 468394 - RNA, 64 nt, hsa
agcauaaaguuccucuuauuuucaguaucuuuaggauccguaauaauguccccucuuuuauucu

SEQ ID NO: 468395 - RNA, 64 nt, hsa
guuuccugagaagugucuaaaaacaccaaaaagggauccguacauucaauguuuaugcaaggaa

SEQ ID NO: 468396 - RNA, 64 nt, hsa
uuccuccaggcuucucuucacaagagacugggaggauccguaagggauguccuaagagcugcac

SEQ ID NO: 468397 - RNA, 64 nt, hsa
ucaccuggauccccaggaucuccaggcucuccuggauccguaccuaaaaauacaucucagacgg

SEQ ID NO: 468398 - RNA, 64 nt, hsa
uugccuccaggucguucucggagcuggaagagaagauccguagcaaccgggucaucgaggugug

SEQ ID NO: 468399 - RNA, 64 nt, hsa
aagagaaauacuuccauuaugccacauuguccuugauccguaagugauguguuaaggugcuuca

SEQ ID NO: 468400 - RNA, 64 nt, hsa
ccaccccccggccacacguguccuauuccccugugauccguaaggccggcggcucggggccccc

SEQ ID NO: 468401 - RNA, 64 nt, hsa
uuaucuuuguuagcaguaguaguauagaauaaaagauccguaugcugguucguagauugauacg

SEQ ID NO: 468402 - RNA, 64 nt, hsa
guuucuuggaaguuaugcuguagaggcagccugugauccguaguaugcuagggugugacagcag

SEQ ID NO: 468403 - RNA, 64 nt, hsa
uuuuaacauacagugcuugaauauacagccuuaacaauguuaaucaucuccuuggaucauuaua

SEQ ID NO: 468404 - RNA, 64 nt, hsa
cuuguuaauuuuuauuuguuauacaauggaagcacaauguuauaaggaaagguaauuuuaagcu

SEQ ID NO: 468405 - RNA, 64 nt, hsa
caugcgacuguaaagccucuuuauaaaccauuuccaauguuaguauauaggauuauuugggaag

SEQ ID NO: 468406 - RNA, 64 nt, hsa
cuuguacuuuuccucaacuguaagagcagacuuucaauguuagcaauuaagcuguugucaaaca

SEQ ID NO: 468407 - RNA, 64 nt, hsa
ccucuacccggaacacacccucucacagacguaccaauguuauuuuuauaauuucauggauuua

SEQ ID NO: 468408 - RNA, 64 nt, hsa
uccuguuagguugauuuuuuuuggaaucaauaugcaauguuaaacacuuuuuuaauguaaucau

SEQ ID NO: 468409 - RNA, 64 nt, hsa
auaaguuuucagucagucaggaugacaucacucccaauguuaugcagacauacagacgguuggc

SEQ ID NO: 468410 - RNA, 64 nt, hsa
cacaccuaugcugcuuguugcaguaacuaaccaccaauguuaacaucuucauauuuuauauucc

SEQ ID NO: 468411 - RNA, 64 nt, hsa
uuuacauuguuaaauguuccuuaccccuaaaggucaauguuaaguacaacauucugaaaauaca

SEQ ID NO: 468412 - RNA, 64 nt, hsa
uccauguguucucauuguuauacgaacauuuuaacaauguuaauucuugcagaccaugaacaua

SEQ ID NO: 468413 - RNA, 64 nt, hsa
cccauuuauaugcgucuuguucaauuucauucaucaauguuauaaagauuuuagugcagagaua

SEQ ID NO: 468414 - RNA, 64 nt, hsa
cacgucuaaagcaguuucacagcaugguccccuacaauguuauaccaaggcucugauguauuuc

SEQ ID NO: 468415 - RNA, 64 nt, hsa
ccuuaaauugguuauuucauguugucaaaaauaccaauguuaauaugauuaauuuaugcuauuu

SEQ ID NO: 468416 - RNA, 64 nt, hsa
ccgccugagagccagcuuccgcguuggaggcacguguucagagagcugcugagcgccacccucu

SEQ ID NO: 468417 - RNA, 64 nt, hsa
aucauaaaaauagccccagaaagagccuaagcuauguucagauagaagccucgaaauuccugua

SEQ ID NO: 468418 - RNA, 64 nt, hsa
agaccacuuuacaaauuguucuugucaccagauguguucagacauugcugugcaauuguugggg

SEQ ID NO: 468419 - RNA, 64 nt, hsa
caucucaccagccccucccucugaagaaguauuauguucagaagccaacaaaacaguuuguugc

SEQ ID NO: 468420 - RNA, 64 nt, hsa
uauuugggaggcagcaagaugugaagacuggauguguucagaacuaggaccaaacgaugccauc

SEQ ID NO: 468421 - RNA, 64 nt, hsa
aucuucucucaucuauggcaaagucucaggauccuguucagauaucggggcuuucauacuccug

SEQ ID NO: 468422 - RNA, 64 nt, hsa
accugcagccaguggucauuucaaaaucuuuuuauguucagauacugagccuucauaaggguug

SEQ ID NO: 468423 - RNA, 64 nt, hsa
acuuccuggaacacacugcugaaaagaacugauguguucagaucaucuguguagggcugugauu

SEQ ID NO: 468424 - RNA, 64 nt, hsa
aauuugucgacugucuguuuugguugaugaauuuuguucagaguuucauccuaauccagaugua

SEQ ID NO: 468425 - RNA, 64 nt, hsa
ugaucucaguuauaaucuaaauuaccacaaguuauguucagauuuucaagaggauauuguauuu

SEQ ID NO: 468426 - RNA, 64 nt, hsa
gcguuagaguuuuuguugggccuucaaaaagcuguguucagaguuaggagaauauauccaauaa

SEQ ID NO: 468427 - RNA, 64 nt, hsa
auacguguguuugcuccgcgaacccucuugaagcuguucagaagccgcuugccgcggggcccac

SEQ ID NO: 468428 - RNA, 64 nt, hsa
auuauuuucacugugaauucacuuuuuuauugcauguucagaugucccucuuuguuuuuuuuuu

SEQ ID NO: 468429 - RNA, 64 nt, hsa
uaaucuguuaucauuuuuccuauguuucccucuuuguucagaagcccagaugcauuuuuauaac

SEQ ID NO: 468430 - RNA, 64 nt, hsa
gcaggaaauuugauauggguuaaauuaugcauuuuguucagauuuuggaaauugguaugcauua

SEQ ID NO: 468431 - RNA, 64 nt, hsa
cuucaauauacuagaaguucuaguagguuaauauuguucagaagauuuuuacaaauuaaaaacu

SEQ ID NO: 468432 - RNA, 64 nt, hsa
auaaugcguggcagagacugcaacagggauuguguguucagagaucauaugcauauguguaggg

SEQ ID NO: 468433 - RNA, 64 nt, hsa
cagucccagugugcgagccccacuuggacacaaguguucagagaggucccccucugccacuuga

SEQ ID NO: 468434 - RNA, 64 nt, hsa
ucaagggaccuucugggagcaggugcuaacauaguguucagaaucaauaugugagaugaaaagg

SEQ ID NO: 468435 - RNA, 64 nt, hsa
gaugaaaaggauccccuccaggaggauccugagcuguucagaaaucauuuaaguuuacagcguu

SEQ ID NO: 468436 - RNA, 64 nt, hsa
gccugggcaggaaccucucccaacucuguccagguguucagaccucuuggcccaaccugcucac

SEQ ID NO: 468437 - RNA, 64 nt, hsa
ccuuggcucuaggauuccgccgcuggaagccuucuguucagacaccccuuaugcuccaaggccu

SEQ ID NO: 468438 - RNA, 64 nt, hsa
uaggauuaguuuguacuuauuuacaaaacagucuuguucagauuuuuacagaaauugaguuaag

SEQ ID NO: 468439 - RNA, 64 nt, hsa
aagcuucauucaaaguguuuuucauugucucuaguguucagaaguuuggcugugaugugcgugg

SEQ ID NO: 468440 - RNA, 64 nt, hsa
gcacuuguacauaacuauacaguaguguccagaauguucagacauucggaguguacauaaaaca

SEQ ID NO: 468441 - RNA, 64 nt, hsa
acaaacccaagaaacgcauccccauugugugauguguucagaugcaucuggcaccaauuaggua

SEQ ID NO: 468442 - RNA, 64 nt, hsa
ugaaagcacagauucauugacuacaguacacuguuguucagaaaagaaggcugcaaaugacuuc

SEQ ID NO: 468443 - RNA, 64 nt, hsa
cuuauccaguuagaacauugauuuauuuacaugauguucagauuuuccagugaaaaauacccuu

SEQ ID NO: 468444 - RNA, 64 nt, hsa
cgggccuaggagggcuaucucgccaccugagagguugcgcaacguucaccccaaaggcucuuuu

SEQ ID NO: 468445 - RNA, 64 nt, hsa
uuccaaaaaaguguuaaauaggcuugagggguuguugcgcaauggccgcuucagaugacagaug

SEQ ID NO: 468446 - RNA, 64 nt, hsa
uggccuccuuggauuuaucgcaaaaacugaagguuugcgcaagagacgaggacagcggaaagug

SEQ ID NO: 468447 - RNA, 64 nt, hsa
caacaaacacugugauguugggaagcuauuuccuuugcgcaaacuuuaacagguuuucuucuaa

SEQ ID NO: 468448 - RNA, 64 nt, hsa
ggggaguuuuuagcaccuaauaugcuuccugccauugcgcaaucugagccugagcaacuggaaa

SEQ ID NO: 468449 - RNA, 64 nt, hsa
auggugguuguuucuuccaagacuccagcccugauugcgcaaaacugaaaggcaugugaaggga

SEQ ID NO: 468450 - RNA, 64 nt, hsa
aaaagacccccccuuuuuuuacagaggacuuuuuuugcgcaacuguggacacuuucaauggugc

SEQ ID NO: 468451 - RNA, 64 nt, hsa
agcuuccccgaggacccccaggcuuggccugugauugcgcaaacccacauuuccuaagcacacu

SEQ ID NO: 468452 - RNA, 64 nt, hsa
uaaugugcaggccaugugccugugaacuugaaguuugcgcaaaauguggaaagaaagaagacau

SEQ ID NO: 468453 - RNA, 64 nt, hsa
accuccccaccuccuggaaaacuuuaggguauuuuugcgcaaacuccuucaggguugggggacu

SEQ ID NO: 468454 - RNA, 64 nt, hsa
uccuaaacaaaucaucuuugucaguuaaguauaguugcgcaaaaauuguuaaauccuuugucuu

SEQ ID NO: 468455 - RNA, 64 nt, hsa
uugagaaacaaaucaaucaugguuucuucuagcguugcgcaaacacugacccagcuucugggua

SEQ ID NO: 468456 - RNA, 64 nt, hsa
cucccccagucagguggcgguagugcccuggggguugcgcaaagugcugaacuggcugaaguuc

SEQ ID NO: 468457 - RNA, 64 nt, hsa
ucuuguugauuauaaauccugauuuuggaaucuauugcgcaaaagaaguuucauuuugguuacu

SEQ ID NO: 468458 - RNA, 64 nt, hsa
ugcucuaaauacaguguaccuucuacucuaccaguugcgcaagaaagaagucacuguuacagag

SEQ ID NO: 468459 - RNA, 64 nt, hsa
cuuauagguaaaccuugcaaauauguaaccuguguugcgcaaaugccgcauaaauuugagugau

SEQ ID NO: 468460 - RNA, 64 nt, hsa
auaaaauuuuggaacuaauuguaguuuuaguuuuuugcgcaaacacaaucuuaucuucuuuccu

SEQ ID NO: 468461 - RNA, 64 nt, hsa
gcugcgggaaauguugaagcgccaggagagacuuuugcgcaacgaguaagcuggggucccgcgg

SEQ ID NO: 468462 - RNA, 64 nt, hsa
uuagaacaaagcuaaggcaauuccuauugcuuccuugcgcaacuucucaaaacgaugaaaguca

SEQ ID NO: 468463 - RNA, 64 nt, hsa
ccaagaacucugggcacuuuugaacucacgagccuugcgcaaaacccagaagauguauucagag

SEQ ID NO: 468464 - RNA, 64 nt, hsa
gaaaauaauaaaauuuaucucacaauaaguuaacuugcgcaaacuuuuuacauauggugaggug

SEQ ID NO: 468465 - RNA, 64 nt, hsa
aaucuccccagcuggguccgccccggccucagaguugcgcaauaaauguuaccgaccaugaccc

SEQ ID NO: 468466 - RNA, 64 nt, hsa
gcccuaaaccuaaauucaaaucuccuccaugccuuugcgcaaaggaccucccucuugcacucua

SEQ ID NO: 468467 - RNA, 64 nt, hsa
uuuuccugcuuccuggucacuuucaaagaacuauuugcgcaaucugugggucuguggauucacg

SEQ ID NO: 468468 - RNA, 64 nt, hsa
guucgcagcgauugcgcagugcgaugcuguuagguugcgcaagcgauguuugcgcucgcauuac

SEQ ID NO: 468469 - RNA, 63 nt, hsa; identical to SEQ ID NO: 354303

SEQ ID NO: 468470 - RNA, 63 nt, hsa; identical to SEQ ID NO: 354304

SEQ ID NO: 468471 - RNA, 63 nt, hsa; identical to SEQ ID NO: 354305

SEQ ID NO: 468472 - RNA, 63 nt, hsa; identical to SEQ ID NO: 354306

SEQ ID NO: 468473 - RNA, 63 nt, hsa; identical to SEQ ID NO: 354307

SEQ ID NO: 468474 - RNA, 63 nt, hsa; identical to SEQ ID NO: 354308

SEQ ID NO: 468475 - RNA, 63 nt, hsa; identical to SEQ ID NO: 354309

SEQ ID NO: 468476 - RNA, 63 nt, hsa; identical to SEQ ID NO: 354310

SEQ ID NO: 468477 - RNA, 64 nt, hsa
ugcuacuuuguuagaaaauacugaguggaauaacuuguuagaaugaggguuaaacuuugaggaa

SEQ ID NO: 468478 - RNA, 64 nt, hsa
uuccuuccaaagacuguuaggcauuugugcuacuuuguuagaaaauacugaguggaauaacuug

SEQ ID NO: 468479 - RNA, 64 nt, hsa
aggugagcaccacuguaccuggcuagcuacuucuuuguuagaggauugagaaugaaauuucugc

SEQ ID NO: 468480 - RNA, 64 nt, hsa
cuauuuaauugcauugaaaaugucauccuuucuguuguuagauaauuggggucuuccccugaua

SEQ ID NO: 468481 - RNA, 64 nt, hsa
ucaaagcaaguuucaucagucaaugaggaagauuuuguuagacuuaaacagcagauuucagauc

SEQ ID NO: 468482 - RNA, 64 nt, hsa
ccaagucuucucaagauccgagucuacccagcccuuguuagauucagaggagcggccagaagau

SEQ ID NO: 468483 - RNA, 64 nt, hsa
uuaagauaauuuaaugauacuaucuuuccaaacuuuguuagauuuuaaauguauuauugaccug

SEQ ID NO: 468484 - RNA, 64 nt, hsa
uucagaauagguuuuugagcagaacucuuucagcuuguuagacccaacuuugcuuuuguuuagc

SEQ ID NO: 468485 - RNA, 64 nt, hsa
cugggcuagauacagcuuggagaaccugcuggccuuguuagacagcacuugggccuuugccagc

SEQ ID NO: 468486 - RNA, 64 nt, hsa
cuuccgcaccuccugaggcccuggaugauucuaauuguuagaaauucuaauuguuagaaauccu

SEQ ID NO: 468487 - RNA, 64 nt, hsa
ggcccuggaugauucuaauuguuagaaauucuaauuguuagaaauccuuccuuauaaugaauga

SEQ ID NO: 468488 - RNA, 64 nt, hsa
uggaauugcuacagaggagugcuuuucuucucaauuguuagaagaauuuauguuaaacuuuaag

SEQ ID NO: 468489 - RNA, 64 nt, hsa
auuuuugagauaagguuuuuauuuauguuuauuauuguuagagugaguugcaaugugggaagaa

SEQ ID NO: 468490 - RNA, 64 nt, hsa
uugaguuuuacauaaaauagaaauuuguuagaauuuguuagauuuuauugcaaugaugccuacc

SEQ ID NO: 468491 - RNA, 64 nt, hsa
aauccauaauuugaguuuuacauaaaauagaaauuuguuagaauuuguuagauuuuauugcaau

SEQ ID NO: 468492 - RNA, 64 nt, hsa
acuuauuuacucagcuuaccuuuuugagaaacgauuguuagaaauugacgauguguuuguucca

SEQ ID NO: 468493 - RNA, 64 nt, hsa
uuaaaaaguaaagaaaguugcauccagaaggguuuuguuagaaugaauacauuuauauuaggac

SEQ ID NO: 468494 - RNA, 64 nt, hsa
auuauaaaaucuguuucaaguaugcaguuuucuuuuguuagaaauuguuagagaauagagagug

SEQ ID NO: 468495 - RNA, 64 nt, hsa
cuguuucaaguaugcaguuuucuuuuguuagaaauuguuagagaauagagagugguaauucaga

SEQ ID NO: 468496 - RNA, 64 nt, hsa
auuagggauuaugcugaauuuguaugguuuauaguuguuagaguuugagguguuaauucuaauu

SEQ ID NO: 468497 - RNA, 64 nt, hsa
gauuuggcaguauaaauucuggcuauauuuuuuguuguuagauuuauuuggcuguuaaguauug

SEQ ID NO: 468498 - RNA, 64 nt, hsa
ugugugugaaaaagcuggguucaaauaaguugguuuguuagacauucauaugccuacccaucag

SEQ ID NO: 468499 - RNA, 64 nt, hsa
uaaauuaucuggcauaagcaguuaucuccagcuuuuguuagaaucuugcauguugauuacuaaa

SEQ ID NO: 468500 - RNA, 64 nt, hsa
cuugugaaaacaagguuguuuuugucuuuaucguuuguuagaguuauagauuuaugauuucaua

SEQ ID NO: 468501 - RNA, 64 nt, hsa
gcccccuuuaaugaguacaagaaaaacucuuggcuuguuagaagaaaguauauucuuucuagaa

SEQ ID NO: 468502 - RNA, 64 nt, hsa
guguucuuaagcauaauuuuuagccacaaacccauuguuagauagauaucuauggauauagauc

SEQ ID NO: 468503 - RNA, 64 nt, hsa
ccuacauuaacauuaugucuuugcagcuuuagguuuguuagauguguucuuaagcauaauuuuu

SEQ ID NO: 468504 - RNA, 64 nt, hsa; identical to SEQ ID NO: 282391

SEQ ID NO: 468505 - RNA, 64 nt, hsa; identical to SEQ ID NO: 282392

SEQ ID NO: 468506 - RNA, 64 nt, hsa; identical to SEQ ID NO: 216966

SEQ ID NO: 468507 - RNA, 64 nt, hsa; identical to SEQ ID NO: 216967

SEQ ID NO: 468508 - RNA, 64 nt, hsa; identical to SEQ ID NO: 216968

SEQ ID NO: 468509 - RNA, 64 nt, hsa; identical to SEQ ID NO: 216969

SEQ ID NO: 468510 - RNA, 64 nt, hsa; identical to SEQ ID NO: 216970

SEQ ID NO: 468511 - RNA, 64 nt, hsa; identical to SEQ ID NO: 216971

SEQ ID NO: 468512 - RNA, 64 nt, hsa; identical to SEQ ID NO: 216972

SEQ ID NO: 468513 - RNA, 64 nt, hsa; identical to SEQ ID NO: 216973

SEQ ID NO: 468514 - RNA, 64 nt, hsa; identical to SEQ ID NO: 216974

SEQ ID NO: 468515 - RNA, 64 nt, hsa; identical to SEQ ID NO: 216975

SEQ ID NO: 468516 - RNA, 64 nt, hsa; identical to SEQ ID NO: 216976

SEQ ID NO: 468517 - RNA, 64 nt, hsa; identical to SEQ ID NO: 216977

SEQ ID NO: 468518 - RNA, 64 nt, hsa; identical to SEQ ID NO: 216978

SEQ ID NO: 468519 - RNA, 64 nt, hsa; identical to SEQ ID NO: 216979

SEQ ID NO: 468520 - RNA, 56 nt, hsa; identical to SEQ ID NO: 216980

SEQ ID NO: 468521 - RNA, 64 nt, hsa; identical to SEQ ID NO: 216981

SEQ ID NO: 468522 - RNA, 64 nt, hsa; identical to SEQ ID NO: 216982

SEQ ID NO: 468523 - RNA, 64 nt, hsa; identical to SEQ ID NO: 216983

SEQ ID NO: 468524 - RNA, 64 nt, hsa; identical to SEQ ID NO: 216984

SEQ ID NO: 468525 - RNA, 64 nt, hsa; identical to SEQ ID NO: 216985

SEQ ID NO: 468526 - RNA, 64 nt, hsa; identical to SEQ ID NO: 216986

SEQ ID NO: 468527 - RNA, 64 nt, hsa; identical to SEQ ID NO: 216987

SEQ ID NO: 468528 - RNA, 64 nt, hsa; identical to SEQ ID NO: 216988

SEQ ID NO: 468529 - RNA, 64 nt, hsa; identical to SEQ ID NO: 216989

SEQ ID NO: 468530 - RNA, 64 nt, hsa; identical to SEQ ID NO: 216990

SEQ ID NO: 468531 - RNA, 64 nt, hsa; identical to SEQ ID NO: 216991

SEQ ID NO: 468532 - RNA, 64 nt, hsa; identical to SEQ ID NO: 216992

SEQ ID NO: 468533 - RNA, 64 nt, hsa; identical to SEQ ID NO: 216993

SEQ ID NO: 468534 - RNA, 64 nt, hsa; identical to SEQ ID NO: 216994

SEQ ID NO: 468535 - RNA, 64 nt, hsa; identical to SEQ ID NO: 216995

SEQ ID NO: 468536 - RNA, 64 nt, hsa; identical to SEQ ID NO: 216996

SEQ ID NO: 468537 - RNA, 64 nt, hsa; identical to SEQ ID NO: 216997

SEQ ID NO: 468538 - RNA, 64 nt, hsa; identical to SEQ ID NO: 216998

SEQ ID NO: 468539 - RNA, 64 nt, hsa; identical to SEQ ID NO: 216999

SEQ ID NO: 468540 - RNA, 64 nt, hsa; identical to SEQ ID NO: 217000

SEQ ID NO: 468541 - RNA, 64 nt, hsa; identical to SEQ ID NO: 217001

SEQ ID NO: 468542 - RNA, 64 nt, hsa; identical to SEQ ID NO: 217002

SEQ ID NO: 468543 - RNA, 64 nt, hsa; identical to SEQ ID NO: 217003

SEQ ID NO: 468544 - RNA, 64 nt, hsa; identical to SEQ ID NO: 217004

SEQ ID NO: 468545 - RNA, 64 nt, hsa; identical to SEQ ID NO: 217005

SEQ ID NO: 468546 - RNA, 64 nt, hsa; identical to SEQ ID NO: 217006

SEQ ID NO: 468547 - RNA, 64 nt, hsa; identical to SEQ ID NO: 217007

SEQ ID NO: 468548 - RNA, 64 nt, hsa; identical to SEQ ID NO: 217008

SEQ ID NO: 468549 - RNA, 64 nt, hsa; identical to SEQ ID NO: 217009

SEQ ID NO: 468550 - RNA, 64 nt, hsa; identical to SEQ ID NO: 217010

SEQ ID NO: 468551 - RNA, 64 nt, hsa; identical to SEQ ID NO: 217011

SEQ ID NO: 468552 - RNA, 64 nt, hsa; identical to SEQ ID NO: 217012

SEQ ID NO: 468553 - RNA, 64 nt, hsa; identical to SEQ ID NO: 217013

SEQ ID NO: 468554 - RNA, 64 nt, hsa; identical to SEQ ID NO: 217014

SEQ ID NO: 468555 - RNA, 64 nt, hsa; identical to SEQ ID NO: 217015

SEQ ID NO: 468556 - RNA, 64 nt, hsa; identical to SEQ ID NO: 217016

SEQ ID NO: 468557 - RNA, 64 nt, hsa; identical to SEQ ID NO: 217017

SEQ ID NO: 468558 - RNA, 64 nt, hsa; identical to SEQ ID NO: 217018

SEQ ID NO: 468559 - RNA, 64 nt, hsa; identical to SEQ ID NO: 217019

SEQ ID NO: 468560 - RNA, 64 nt, hsa; identical to SEQ ID NO: 217020

SEQ ID NO: 468561 - RNA, 64 nt, hsa; identical to SEQ ID NO: 217021

SEQ ID NO: 468562 - RNA, 64 nt, hsa; identical to SEQ ID NO: 217022

SEQ ID NO: 468563 - RNA, 64 nt, hsa; identical to SEQ ID NO: 217023

SEQ ID NO: 468564 - RNA, 64 nt, hsa; identical to SEQ ID NO: 217024

SEQ ID NO: 468565 - RNA, 64 nt, hsa; identical to SEQ ID NO: 217025

SEQ ID NO: 468566 - RNA, 64 nt, hsa; identical to SEQ ID NO: 217026

SEQ ID NO: 468567 - RNA, 64 nt, hsa; identical to SEQ ID NO: 217027

SEQ ID NO: 468568 - RNA, 64 nt, hsa; identical to SEQ ID NO: 217028

SEQ ID NO: 468569 - RNA, 64 nt, hsa; identical to SEQ ID NO: 217029

SEQ ID NO: 468570 - RNA, 64 nt, hsa
ccuaucccccuaucccaggcaucccagacgaggacuggcugaggcuaggcgcucucaugaucca

SEQ ID NO: 468571 - RNA, 64 nt, hsa
uauaccaugcgggucugagcucugacugcaagcccuggcugaggccaaugcugugaagcuccac

SEQ ID NO: 468572 - RNA, 64 nt, hsa
uggggauuuggggacccuugggguccacaugcaccuggcugaccuggcugaaagccgcugucuc

SEQ ID NO: 468573 - RNA, 64 nt, hsa
ggggacccuugggguccacaugcaccuggcugaccuggcugaaagccgcugucucggagccccc

SEQ ID NO: 468574 - RNA, 64 nt, hsa
gagagaagacccuagaugaaguuggaaaagagcucuggcugacuccacccacuguccccaagca

SEQ ID NO: 468575 - RNA, 64 nt, hsa
caggaaggcaggugguggugcagaaacaugaugccuggcugauuuucguggcuaaagggguagg

SEQ ID NO: 468576 - RNA, 64 nt, hsa
agaauaaucacauagcauguacaauauauuuaugcuggcugaaaagacagaaucugggaauaau

SEQ ID NO: 468577 - RNA, 64 nt, hsa
auggucuggucaguauuggucuggucaguauugccuggcugacgugaaauguaaacuaguaggc

SEQ ID NO: 468578 - RNA, 64 nt, hsa
ggagcuagggaagagacccuagccucccuggcugcuggcugagcuagggccuagccuugagcag

SEQ ID NO: 468579 - RNA, 64 nt, hsa
uaggcuugaugacccagaaucuaggauucucucccuggcugacagguggggagaccgaaucccu

SEQ ID NO: 468580 - RNA, 64 nt, hsa
cccuggagugcaguuuccaaucccauagaugggucuggcugagcugaacccauuuugagugacu

SEQ ID NO: 468581 - RNA, 64 nt, hsa
uggccaggcacccccuggagagaaguuucuggcccuggcugaccccaaagagccuggagaagcu

SEQ ID NO: 468582 - RNA, 64 nt, hsa
uguuuuaaaaucauauccagcacaaaaacuauuucuggcugaauagcacagaaaaguauuuuaa

SEQ ID NO: 468583 - RNA, 64 nt, hsa
uuuguauuguucuacuuuuucagcccuuuacuuucuggcugaagcauccccuuggagugccaug

SEQ ID NO: 468584 - RNA, 64 nt, hsa
gccauucugacguguaaccgcauauaggagcccacuggcugaguagcuaccaucaucgcuggug

SEQ ID NO: 468585 - RNA, 64 nt, hsa
gagauguuaccaaucccguucgcucugacccuugcuggcugaucaccuugagcaacuuacuuaa

SEQ ID NO: 468586 - RNA, 64 nt, hsa
auuccccgaggugcgaccucagacuaaugacauccuggcugagccucuguuuuucucucuagga

SEQ ID NO: 468587 - RNA, 64 nt, hsa
aagcaucgagcuccaagcccagaugccaagcucccuggcugagcugaaugaugucacucauggu

SEQ ID NO: 468588 - RNA, 64 nt, hsa
ggcugagagaguuuuggaauuugacauuggcuggcuggcugagcccauuuucggcucuggagau

SEQ ID NO: 468589 - RNA, 64 nt, hsa
ucggcucuggagauuauccaugggugaugagggacuggcugaaccaaagaaacaauuuucuucu

SEQ ID NO: 468590 - RNA, 64 nt, hsa
cgguagugcccuggggguugcgcaaagugcugaacuggcugaaguucaaguacggagaccuccc

SEQ ID NO: 468591 - RNA, 64 nt, hsa
ucuggccuucuggcucaugguucaguccagcagccuggcugacccacuauuucuccucugcuuc

SEQ ID NO: 468592 - RNA, 64 nt, hsa
aagauugugcugagcgcugagcuugcgcucagggcuggcugaucaaacucaagcucacaccugu

SEQ ID NO: 468593 - RNA, 64 nt, hsa
ugcugcugccccagcucuacacugcgcccuggugcuggcugaccacccccugcccuccugccgg

SEQ ID NO: 468594 - RNA, 64 nt, hsa
cccauacuccacggagaggagccccaugcccagccuggcugagcccgagauucgcuccuccccc

SEQ ID NO: 468595 - RNA, 64 nt, hsa
gaagucggagcccucacucugcccuguccuggggcuggcugagggcgaacgccccaccucacuu

SEQ ID NO: 468596 - RNA, 64 nt, hsa
gggcagcugugccgugggcagggcaugcgcuccccuggcugagcaccccagagauucuccugca

SEQ ID NO: 468597 - RNA, 64 nt, hsa
aagcaagggugcuggggccccauggccuucagcccuggcugagcaacugggcuguagggcaggg

SEQ ID NO: 468598 - RNA, 64 nt, hsa
caggucuugguaggugccugcaucugucugccuucuggcugacaauccuggaaaucuguucucc

SEQ ID NO: 468599 - RNA, 64 nt, hsa
cacucacugcgucaaagggcuggugcugucccugcuggcugaggagccgcugcugggagacagc

SEQ ID NO: 468600 - RNA, 64 nt, hsa
caggaguucgaggugcaguuuggcaaccuguguccuggcugaggaaugcacucacagcaccccu

SEQ ID NO: 468601 - RNA, 64 nt, hsa; identical to SEQ ID NO: 437656

SEQ ID NO: 468602 - RNA, 64 nt, hsa; identical to SEQ ID NO: 437657

SEQ ID NO: 468603 - RNA, 64 nt, hsa; identical to SEQ ID NO: 437658

SEQ ID NO: 468604 - RNA, 64 nt, hsa; identical to SEQ ID NO: 437659

SEQ ID NO: 468605 - RNA, 64 nt, hsa; identical to SEQ ID NO: 437660

SEQ ID NO: 468606 - RNA, 64 nt, hsa; identical to SEQ ID NO: 437661

SEQ ID NO: 468607 - RNA, 64 nt, hsa; identical to SEQ ID NO: 437662

SEQ ID NO: 468608 - RNA, 64 nt, hsa; identical to SEQ ID NO: 437663

SEQ ID NO: 468609 - RNA, 64 nt, hsa; identical to SEQ ID NO: 437664

SEQ ID NO: 468610 - RNA, 64 nt, hsa; identical to SEQ ID NO: 437665

SEQ ID NO: 468611 - RNA, 64 nt, hsa; identical to SEQ ID NO: 437666

SEQ ID NO: 468612 - RNA, 64 nt, hsa; identical to SEQ ID NO: 437667

SEQ ID NO: 468613 - RNA, 64 nt, hsa; identical to SEQ ID NO: 437668

SEQ ID NO: 468614 - RNA, 64 nt, hsa; identical to SEQ ID NO: 437669

SEQ ID NO: 468615 - RNA, 64 nt, hsa; identical to SEQ ID NO: 437670

SEQ ID NO: 468616 - RNA, 64 nt, hsa; identical to SEQ ID NO: 437671

SEQ ID NO: 468617 - RNA, 64 nt, hsa; identical to SEQ ID NO: 437672

SEQ ID NO: 468618 - RNA, 64 nt, hsa; identical to SEQ ID NO: 437673

SEQ ID NO: 468619 - RNA, 64 nt, hsa; identical to SEQ ID NO: 437674

SEQ ID NO: 468620 - RNA, 64 nt, hsa; identical to SEQ ID NO: 437675

SEQ ID NO: 468621 - RNA, 64 nt, hsa
aagcaugcauccgccguacucuuuggggcagcuggucccggagaggccucgacccaccccagug

SEQ ID NO: 468622 - RNA, 64 nt, hsa
ggcggccucgcgggugacuccgggcuccguggcugucccggaccccaccucuucccugccgccc

SEQ ID NO: 468623 - RNA, 64 nt, hsa
cucauccuacaguugguuugguaaugaucugcaagucccggagagcaacagcacagcucugccu

SEQ ID NO: 468624 - RNA, 64 nt, hsa
cucagugaagggggccugcuugcucuuuauuuuggucccggauccugggguggggcagaaauau

SEQ ID NO: 468625 - RNA, 64 nt, hsa
gacagagcgggccgcacugucugucuguccgucugucccggaaagaacuauaaagcgcuggaag

SEQ ID NO: 468626 - RNA, 64 nt, hsa
aucagcagugauagaugaaggguucgcagcgagagucccggacuugucuagaaaugagcagguu

SEQ ID NO: 468627 - RNA, 64 nt, hsa
gcccucuuucacuuuuuuucuucuaggucuccaggucccggaggggauuuguggaccucucuug

SEQ ID NO: 468628 - RNA, 64 nt, hsa
ugcccacgugcccacgccccaccagcaggcggcugucccggaggccguggcccgcugggacugg

SEQ ID NO: 468629 - RNA, 64 nt, hsa
gcuccccuggagccagcagggcugugaugggcgagucccggagccccacccagaccugaaugcu

SEQ ID NO: 468630 - RNA, 64 nt, hsa
uccagguaccugcacaagcaggaagcgccugggagucccggaaggaggagagcgcacacccagg

SEQ ID NO: 468631 - RNA, 64 nt, hsa
uaaugaaaaaaucugaaacuacuuauagccuauggucccggaugacaucuguuuaaaaacaagc

SEQ ID NO: 468632 - RNA, 64 nt, hsa
agugaggcuuuuuauuagaaaaauuacaaaaugagucccggaaggucaguaagugcaacaugaa

SEQ ID NO: 468633 - RNA, 64 nt, hsa
cccaccccaguuuuuguugcuugaaaauauuguugucccggauuuuuguuaauauucauuuuug

SEQ ID NO: 468634 - RNA, 64 nt, hsa
ggccaacgcgccguaauuaagacgccgcuccccggucccggaacccucccuucgccacccucca

SEQ ID NO: 468635 - RNA, 64 nt, hsa
cagggcccccacaggggaugguuucacgaguguagucccggaggccuucccuuuacagcucucc

SEQ ID NO: 468636 - RNA, 64 nt, hsa
ggauccggccccccagacaccgaccccacaggccgucccggaucucagcggacacaggcaggag

SEQ ID NO: 468637 - RNA, 64 nt, hsa
gacuugcauccccauugcgggcagugcuggacgugucccggagacccaccgggagggcgccgcc

SEQ ID NO: 468638 - RNA, 64 nt, hsa
ccagccuggcaggagugggaagcaacacgcaggggucccggaccucuccagccuugcccucacg

SEQ ID NO: 468639 - RNA, 64 nt, hsa
cggccagcacccucuccacgugcagaccccaugcgucccggagccuggugugugggcgucggcc

SEQ ID NO: 468640 - RNA, 64 nt, hsa
acccugccaggcccccgcuggcuccuccaggcacgucccggaccuguggggccccagagagggg

SEQ ID NO: 468641 - RNA, 64 nt, hsa
ugcaaaugagacucccgcacgaaaacccuuaagagucccggauuacuuucuuggcagcuuaagu

SEQ ID NO: 468642 - RNA, 64 nt, hsa
aggccuggggaugaggguggggggggacccccaggucccggaggggaagugaagcaacagccca

SEQ ID NO: 468643 - RNA, 64 nt, hsa
gaccccccugcauagccuaagugcuauaucgaucgucccggaugugccuuaagaaccgugaccu

SEQ ID NO: 468644 - RNA, 64 nt, hsa
gagaguaacuaggaacaugguagaaguggagagagucccggacaugccgacucaggacaggugg

SEQ ID NO: 468645 - RNA, 64 nt, hsa
aguguggggcugggcagaggcggucagccugggagucccggaggccaggcugcacaccuggugg

SEQ ID NO: 468646 - RNA, 64 nt, hsa
gugccuccccugcugcacaaccaguaccucguaggucccggaggacugcuuccugccuacccgg

SEQ ID NO: 468647 - RNA, 64 nt, hsa
cccuaccaauugggagaaauaucuucccuucccugucccggaggaaggcugggugguggagggg

SEQ ID NO: 468648 - RNA, 64 nt, hsa
gaggugggcccccacagagcccacaggcagcugcgucccggaugcuggaggcuuccugagcccu

SEQ ID NO: 468649 - RNA, 64 nt, hsa
uuuucagaaccugacauuguuaaagauacugcuugucccggaguuguguauuuuguaaauguuc

SEQ ID NO: 468650 - RNA, 64 nt, hsa
gaugagacucaggcugauacaccagcucccaaaggucccggaggcccuuuguccacuggagcug

SEQ ID NO: 468651 - RNA, 64 nt, hsa
gugcccgagaaucacucgcuaaccccuaugcccggucccggaccgacauccuggagccgccugu

SEQ ID NO: 468652 - RNA, 64 nt, hsa
ccagaaggucacguggaaaugucucgggacuugggucccggagugcccgugaagcguguuuuug

SEQ ID NO: 468653 - RNA, 64 nt, hsa
uuuuccacuuuucuauguccuccuuccaccccaagucccggaucacucgcuguuuucuggcuag

SEQ ID NO: 468654 - RNA, 64 nt, hsa
ccgccaucccugaagccaucuccccucguccugcgucccggacccaucuacgcugaggacggag

SEQ ID NO: 468655 - RNA, 64 nt, hsa
gagggcccuucccaaccuccccugguccugcacugucccggagcucaggcccuggugaggggcu

SEQ ID NO: 468656 - RNA, 64 nt, hsa
uucuaccuagcgggauggggcucccccaggggcugucccggaggcggugggccugguuaaauaa

SEQ ID NO: 468657 - RNA, 64 nt, hsa
aggcgggaagaaggaggcaucguccaguaagaccgucccggacgggaagcuggugaaagguaug

SEQ ID NO: 468658 - RNA, 64 nt, hsa
uugccaggugggggugggaucaaacgcccugagagucccggauguccgaggcgggaugcaaacc

SEQ ID NO: 468659 - RNA, 64 nt, hsa
ccuccuguccucgcggugccuugcucgccaagcggucccggagcaggcuuuccuucgcgccucc

SEQ ID NO: 468660 - RNA, 64 nt, hsa
cuccccuuuaccccuccagagaaggggcuucccugucccggagggagacacggggaacgggauu

SEQ ID NO: 468661 - RNA, 64 nt, hsa
caaggagggagaaauccugcugcacacuggcuuugucccggagucggauucccuccugccugca

SEQ ID NO: 468662 - RNA, 64 nt, hsa
ggcacccccaccacucgcugccucccaggucagggucccggagccggugcccucacaggccaau

SEQ ID NO: 468663 - RNA, 64 nt, hsa
ugcucugugacuuuaagagaagaaggggggaggggucccggauuuuauguuuguuuguuuuuuc

SEQ ID NO: 468664 - RNA, 64 nt, hsa
ccuaguagaagcucacuugccaccucucagaggggucccggauugcauccaucacaaucccaaa

SEQ ID NO: 468665 - RNA, 64 nt, hsa
cuggaggcugccaagggcgcuucgccuugagcaggucccggagaggcucagccugccccuccug

SEQ ID NO: 468666 - RNA, 64 nt, hsa
gaggcaagagaaagagaaagcgggcgguggaggggucccggaagagcugguccccgugguugag

SEQ ID NO: 468667 - RNA, 64 nt, hsa
aagguauguccgacauuuaacgcgggcugcgucggucccggacuuuucuaauuuauuaaaaaca

SEQ ID NO: 468668 - RNA, 64 nt, hsa
uucaggcagagcucuggccaggcugugccagugugucccggacgcaucacuaaggaagagagag

SEQ ID NO: 468669 - RNA, 64 nt, hsa
cccagcgcugguccagagccgauccuugauccgggucccggaucguggauccggccgccuaggg

SEQ ID NO: 468670 - RNA, 64 nt, hsa
cccaaccccugcuggcuccucugggagcauccaugucccggagaggggucccucaacagucagc

SEQ ID NO: 468671 - RNA, 64 nt, hsa
acguuccucacauacaggcaagaggcacugccgggucccggacggcuccgggugacaccagccc

SEQ ID NO: 468672 - RNA, 64 nt, hsa
uuggucauuaucuucuacagcaguggaaugaguggucccggagaugugcuauaugaaacauucu

SEQ ID NO: 468673 - RNA, 64 nt, hsa
cguaggagaguggaggccccacucccaguugggcgucccggagcucagggacugagccccaaga

SEQ ID NO: 468674 - RNA, 64 nt, hsa
ccgcgcucucggaggcugucuucugucgccaagggucccggaccgaguacacaguggcagcugg

SEQ ID NO: 468675 - RNA, 64 nt, hsa
uuuggaggugggggcuggggaaugaggggcugaggucccggaagggauuuuauuuuuuugaauu

SEQ ID NO: 468676 - RNA, 64 nt, hsa
gacccucugcccugcccaccgcaggucccccggggucccggaagccccuucuggcugcaccugc

SEQ ID NO: 468677 - RNA, 64 nt, hsa
aagguggcagacauuuauggacacccgccacguggucccggaguggaacggugccucccacugc

SEQ ID NO: 468678 - RNA, 64 nt, hsa
agugacucugaaggacucugggaggugagacguugucccggagaucaaaacguccgcucaaaac

SEQ ID NO: 468679 - RNA, 64 nt, hsa
cggacgcugcauaccaauuugcccugcaccgccugucccggagacggagcccgaaggccugcca

SEQ ID NO: 468680 - RNA, 64 nt, hsa
gucgagguggaggucacgugcagagcuccaugaggucccggagccccccucucaacccgcuccu

SEQ ID NO: 468681 - RNA, 64 nt, hsa
ggacuccuggguccccgaggaggaggggacuggggucccggauucuugggucuccaagaagucu

SEQ ID NO: 468682 - RNA, 64 nt, hsa
uuagugguggugucucacucuuucuucucucuuugucccggauaggcuaaucaauacccuuggc

SEQ ID NO: 468683 - RNA, 64 nt, hsa
uugaugucauuaauguguugggaaaaaggccucugucccggaagagucaugggaggugaaaggg

SEQ ID NO: 468684 - RNA, 64 nt, hsa
agugccacagccucgucuggaaaaaggaccaggggucccggaggaacccauuugugcucugcuu

SEQ ID NO: 468685 - RNA, 64 nt, hsa
agcagagccggagagagagacgagagggugggaggucccggaguaacuucucuccaggcugaag

SEQ ID NO: 468686 - RNA, 64 nt, hsa
ggugugugcuguggugcaccgccuggcuuugggggucccggaggcaggcugccuagacucacag

SEQ ID NO: 468687 - RNA, 64 nt, hsa
ggaacauccggaacagccaaagaaacucagaagagucccggagcucaaggaucagaguaacaca

SEQ ID NO: 468688 - RNA, 64 nt, hsa
cugggagaagcgugcggaggaccguggcgucggcgucccggaugugucggucgugcccggggag

SEQ ID NO: 468689 - RNA, 64 nt, hsa
cuggcacagcguggcccgaggggcuguggaacgggucccggaacugucagacauguuugauuuu

SEQ ID NO: 468690 - RNA, 64 nt, hsa
ugcccugcucaggccuugcccccaaaccuguacugucccggaggagguugggagguggaggccc

SEQ ID NO: 468691 - RNA, 64 nt, hsa
guuauguaagcuaaaaagcugugugaacccaggugucccggaaaggggcugcaggacacagcaa

SEQ ID NO: 468692 - RNA, 64 nt, hsa; identical to SEQ ID NO: 282498

SEQ ID NO: 468693 - RNA, 64 nt, hsa; identical to SEQ ID NO: 282499

SEQ ID NO: 468694 - RNA, 64 nt, hsa; identical to SEQ ID NO: 282500

SEQ ID NO: 468695 - RNA, 64 nt, hsa; identical to SEQ ID NO: 282501

SEQ ID NO: 468696 - RNA, 64 nt, hsa; identical to SEQ ID NO: 282502

SEQ ID NO: 468697 - RNA, 64 nt, hsa; identical to SEQ ID NO: 282503

SEQ ID NO: 468698 - RNA, 64 nt, hsa; identical to SEQ ID NO: 282504

SEQ ID NO: 468699 - RNA, 64 nt, hsa; identical to SEQ ID NO: 282505

SEQ ID NO: 468700 - RNA, 64 nt, hsa; identical to SEQ ID NO: 282506

SEQ ID NO: 468701 - RNA, 64 nt, hsa; identical to SEQ ID NO: 282507

SEQ ID NO: 468702 - RNA, 64 nt, hsa; identical to SEQ ID NO: 282508

SEQ ID NO: 468703 - RNA, 64 nt, hsa; identical to SEQ ID NO: 282509

SEQ ID NO: 468704 - RNA, 64 nt, hsa; identical to SEQ ID NO: 282510

SEQ ID NO: 468705 - RNA, 64 nt, hsa; identical to SEQ ID NO: 282511

SEQ ID NO: 468706 - RNA, 64 nt, hsa; identical to SEQ ID NO: 282512

SEQ ID NO: 468707 - RNA, 64 nt, hsa; identical to SEQ ID NO: 282513

SEQ ID NO: 468708 - RNA, 64 nt, hsa; identical to SEQ ID NO: 282514

SEQ ID NO: 468709 - RNA, 64 nt, hsa; identical to SEQ ID NO: 282515

SEQ ID NO: 468710 - RNA, 64 nt, hsa; identical to SEQ ID NO: 282516

SEQ ID NO: 468711 - RNA, 64 nt, hsa; identical to SEQ ID NO: 282517

SEQ ID NO: 468712 - RNA, 64 nt, hsa; identical to SEQ ID NO: 282518

SEQ ID NO: 468713 - RNA, 64 nt, hsa; identical to SEQ ID NO: 282519

SEQ ID NO: 468714 - RNA, 64 nt, hsa; identical to SEQ ID NO: 282520

SEQ ID NO: 468715 - RNA, 64 nt, hsa; identical to SEQ ID NO: 282521

SEQ ID NO: 468716 - RNA, 64 nt, hsa; identical to SEQ ID NO: 282522

SEQ ID NO: 468717 - RNA, 64 nt, hsa; identical to SEQ ID NO: 282523

SEQ ID NO: 468718 - RNA, 64 nt, hsa; identical to SEQ ID NO: 282524

SEQ ID NO: 468719 - RNA, 64 nt, hsa; identical to SEQ ID NO: 282525

SEQ ID NO: 468720 - RNA, 64 nt, hsa; identical to SEQ ID NO: 282526

SEQ ID NO: 468721 - RNA, 64 nt, hsa; identical to SEQ ID NO: 282527

SEQ ID NO: 468722 - RNA, 64 nt, hsa; identical to SEQ ID NO: 282528

SEQ ID NO: 468723 - RNA, 64 nt, hsa; identical to SEQ ID NO: 282529

SEQ ID NO: 468724 - RNA, 64 nt, hsa; identical to SEQ ID NO: 282530

SEQ ID NO: 468725 - RNA, 64 nt, hsa; identical to SEQ ID NO: 282531

SEQ ID NO: 468726 - RNA, 64 nt, hsa; identical to SEQ ID NO: 282532

SEQ ID NO: 468727 - RNA, 64 nt, hsa; identical to SEQ ID NO: 282533

SEQ ID NO: 468728 - RNA, 64 nt, hsa; identical to SEQ ID NO: 282534

SEQ ID NO: 468729 - RNA, 64 nt, hsa; identical to SEQ ID NO: 282535

SEQ ID NO: 468730 - RNA, 64 nt, hsa; identical to SEQ ID NO: 282536

SEQ ID NO: 468731 - RNA, 64 nt, hsa; identical to SEQ ID NO: 282537

SEQ ID NO: 468732 - RNA, 64 nt, hsa; identical to SEQ ID NO: 282538

SEQ ID NO: 468733 - RNA, 64 nt, hsa; identical to SEQ ID NO: 282539

SEQ ID NO: 468734 - RNA, 64 nt, hsa; identical to SEQ ID NO: 282540

SEQ ID NO: 468735 - RNA, 64 nt, hsa; identical to SEQ ID NO: 282541

SEQ ID NO: 468736 - RNA, 64 nt, hsa; identical to SEQ ID NO: 282542

SEQ ID NO: 468737 - RNA, 64 nt, hsa; identical to SEQ ID NO: 282543

SEQ ID NO: 468738 - RNA, 64 nt, hsa; identical to SEQ ID NO: 282544

SEQ ID NO: 468739 - RNA, 64 nt, hsa; identical to SEQ ID NO: 282545

SEQ ID NO: 468740 - RNA, 64 nt, hsa; identical to SEQ ID NO: 282546

SEQ ID NO: 468741 - RNA, 64 nt, hsa; identical to SEQ ID NO: 282547

SEQ ID NO: 468742 - RNA, 64 nt, hsa; identical to SEQ ID NO: 282548

SEQ ID NO: 468743 - RNA, 64 nt, hsa; identical to SEQ ID NO: 282549

SEQ ID NO: 468744 - RNA, 64 nt, hsa; identical to SEQ ID NO: 282550

SEQ ID NO: 468745 - RNA, 64 nt, hsa; identical to SEQ ID NO: 282551

SEQ ID NO: 468746 - RNA, 64 nt, hsa; identical to SEQ ID NO: 282552

SEQ ID NO: 468747 - RNA, 64 nt, hsa; identical to SEQ ID NO: 282553

SEQ ID NO: 468748 - RNA, 64 nt, hsa; identical to SEQ ID NO: 282554

SEQ ID NO: 468749 - RNA, 64 nt, hsa; identical to SEQ ID NO: 282555

SEQ ID NO: 468750 - RNA, 64 nt, hsa; identical to SEQ ID NO: 282556

SEQ ID NO: 468751 - RNA, 64 nt, hsa; identical to SEQ ID NO: 282557

SEQ ID NO: 468752 - RNA, 64 nt, hsa; identical to SEQ ID NO: 282558

SEQ ID NO: 468753 - RNA, 64 nt, hsa; identical to SEQ ID NO: 282559

SEQ ID NO: 468754 - RNA, 64 nt, hsa; identical to SEQ ID NO: 282560

SEQ ID NO: 468755 - RNA, 64 nt, hsa; identical to SEQ ID NO: 282561

SEQ ID NO: 468756 - RNA, 64 nt, hsa; identical to SEQ ID NO: 282562

SEQ ID NO: 468757 - RNA, 64 nt, hsa; identical to SEQ ID NO: 282563

SEQ ID NO: 468758 - RNA, 64 nt, hsa; identical to SEQ ID NO: 282564

SEQ ID NO: 468759 - RNA, 64 nt, hsa; identical to SEQ ID NO: 282565

SEQ ID NO: 468760 - RNA, 64 nt, hsa; identical to SEQ ID NO: 282566

SEQ ID NO: 468761 - RNA, 64 nt, hsa; identical to SEQ ID NO: 282567

SEQ ID NO: 468762 - RNA, 64 nt, hsa; identical to SEQ ID NO: 282568

SEQ ID NO: 468763 - RNA, 64 nt, hsa; identical to SEQ ID NO: 282569

SEQ ID NO: 468764 - RNA, 64 nt, hsa; identical to SEQ ID NO: 282570

SEQ ID NO: 468765 - RNA, 64 nt, hsa; identical to SEQ ID NO: 282571

SEQ ID NO: 468766 - RNA, 64 nt, hsa; identical to SEQ ID NO: 282572

SEQ ID NO: 468767 - RNA, 64 nt, hsa; identical to SEQ ID NO: 282573

SEQ ID NO: 468768 - RNA, 64 nt, hsa; identical to SEQ ID NO: 282574

SEQ ID NO: 468769 - RNA, 64 nt, hsa; identical to SEQ ID NO: 282575

SEQ ID NO: 468770 - RNA, 64 nt, hsa; identical to SEQ ID NO: 282576

SEQ ID NO: 468771 - RNA, 64 nt, hsa; identical to SEQ ID NO: 282577

SEQ ID NO: 468772 - RNA, 64 nt, hsa; identical to SEQ ID NO: 282578

SEQ ID NO: 468773 - RNA, 64 nt, hsa; identical to SEQ ID NO: 282579

SEQ ID NO: 468774 - RNA, 64 nt, hsa; identical to SEQ ID NO: 282580

SEQ ID NO: 468775 - RNA, 64 nt, hsa; identical to SEQ ID NO: 282581

SEQ ID NO: 468776 - RNA, 64 nt, hsa; identical to SEQ ID NO: 282582

SEQ ID NO: 468777 - RNA, 64 nt, hsa; identical to SEQ ID NO: 282583

SEQ ID NO: 468778 - RNA, 64 nt, hsa; identical to SEQ ID NO: 282584

SEQ ID NO: 468779 - RNA, 64 nt, hsa; identical to SEQ ID NO: 282585

SEQ ID NO: 468780 - RNA, 64 nt, hsa; identical to SEQ ID NO: 282586

SEQ ID NO: 468781 - RNA, 64 nt, hsa; identical to SEQ ID NO: 282587

SEQ ID NO: 468782 - RNA, 64 nt, hsa; identical to SEQ ID NO: 282588

SEQ ID NO: 468783 - RNA, 64 nt, hsa; identical to SEQ ID NO: 282589

SEQ ID NO: 468784 - RNA, 64 nt, hsa; identical to SEQ ID NO: 282590

SEQ ID NO: 468785 - RNA, 64 nt, hsa; identical to SEQ ID NO: 282591

SEQ ID NO: 468786 - RNA, 64 nt, hsa; identical to SEQ ID NO: 282592

SEQ ID NO: 468787 - RNA, 64 nt, hsa; identical to SEQ ID NO: 282593

SEQ ID NO: 468788 - RNA, 64 nt, hsa; identical to SEQ ID NO: 282594

SEQ ID NO: 468789 - RNA, 64 nt, hsa; identical to SEQ ID NO: 282595

SEQ ID NO: 468790 - RNA, 64 nt, hsa; identical to SEQ ID NO: 282596

SEQ ID NO: 468791 - RNA, 64 nt, hsa; identical to SEQ ID NO: 282597

SEQ ID NO: 468792 - RNA, 64 nt, hsa; identical to SEQ ID NO: 282598

SEQ ID NO: 468793 - RNA, 64 nt, hsa; identical to SEQ ID NO: 282599

SEQ ID NO: 468794 - RNA, 64 nt, hsa; identical to SEQ ID NO: 282600

SEQ ID NO: 468795 - RNA, 64 nt, hsa; identical to SEQ ID NO: 282601

SEQ ID NO: 468796 - RNA, 64 nt, hsa; identical to SEQ ID NO: 282602

SEQ ID NO: 468797 - RNA, 64 nt, hsa; identical to SEQ ID NO: 223465

SEQ ID NO: 468798 - RNA, 64 nt, hsa; identical to SEQ ID NO: 223466

SEQ ID NO: 468799 - RNA, 64 nt, hsa; identical to SEQ ID NO: 223467

SEQ ID NO: 468800 - RNA, 64 nt, hsa; identical to SEQ ID NO: 223468

SEQ ID NO: 468801 - RNA, 64 nt, hsa; identical to SEQ ID NO: 223469

SEQ ID NO: 468802 - RNA, 64 nt, hsa; identical to SEQ ID NO: 223470

SEQ ID NO: 468803 - RNA, 64 nt, hsa; identical to SEQ ID NO: 223471

SEQ ID NO: 468804 - RNA, 64 nt, hsa; identical to SEQ ID NO: 223472

SEQ ID NO: 468805 - RNA, 64 nt, hsa; identical to SEQ ID NO: 223473

SEQ ID NO: 468806 - RNA, 64 nt, hsa; identical to SEQ ID NO: 223474

SEQ ID NO: 468807 - RNA, 64 nt, hsa; identical to SEQ ID NO: 223475

SEQ ID NO: 468808 - RNA, 64 nt, hsa; identical to SEQ ID NO: 223476

SEQ ID NO: 468809 - RNA, 64 nt, hsa; identical to SEQ ID NO: 223477

SEQ ID NO: 468810 - RNA, 64 nt, hsa; identical to SEQ ID NO: 223478

SEQ ID NO: 468811 - RNA, 64 nt, hsa; identical to SEQ ID NO: 223479

SEQ ID NO: 468812 - RNA, 64 nt, hsa; identical to SEQ ID NO: 223480

SEQ ID NO: 468813 - RNA, 64 nt, hsa; identical to SEQ ID NO: 223481

SEQ ID NO: 468814 - RNA, 64 nt, hsa; identical to SEQ ID NO: 223482

SEQ ID NO: 468815 - RNA, 64 nt, hsa; identical to SEQ ID NO: 223483

SEQ ID NO: 468816 - RNA, 64 nt, hsa; identical to SEQ ID NO: 223484

SEQ ID NO: 468817 - RNA, 64 nt, hsa; identical to SEQ ID NO: 223485

SEQ ID NO: 468818 - RNA, 64 nt, hsa; identical to SEQ ID NO: 223486

SEQ ID NO: 468819 - RNA, 64 nt, hsa; identical to SEQ ID NO: 223487

SEQ ID NO: 468820 - RNA, 64 nt, hsa; identical to SEQ ID NO: 223488

SEQ ID NO: 468821 - RNA, 64 nt, hsa; identical to SEQ ID NO: 223489

SEQ ID NO: 468822 - RNA, 64 nt, hsa; identical to SEQ ID NO: 223490

SEQ ID NO: 468823 - RNA, 64 nt, hsa; identical to SEQ ID NO: 223491

SEQ ID NO: 468824 - RNA, 64 nt, hsa; identical to SEQ ID NO: 223492

SEQ ID NO: 468825 - RNA, 64 nt, hsa; identical to SEQ ID NO: 223493

SEQ ID NO: 468826 - RNA, 64 nt, hsa; identical to SEQ ID NO: 223494

SEQ ID NO: 468827 - RNA, 64 nt, hsa; identical to SEQ ID NO: 223495

SEQ ID NO: 468828 - RNA, 64 nt, hsa; identical to SEQ ID NO: 223496

SEQ ID NO: 468829 - RNA, 64 nt, hsa; identical to SEQ ID NO: 223497

SEQ ID NO: 468830 - RNA, 64 nt, hsa; identical to SEQ ID NO: 223498

SEQ ID NO: 468831 - RNA, 64 nt, hsa; identical to SEQ ID NO: 223499

SEQ ID NO: 468832 - RNA, 64 nt, hsa; identical to SEQ ID NO: 223500

SEQ ID NO: 468833 - RNA, 64 nt, hsa; identical to SEQ ID NO: 223501

SEQ ID NO: 468834 - RNA, 64 nt, hsa; identical to SEQ ID NO: 223502

SEQ ID NO: 468835 - RNA, 64 nt, hsa; identical to SEQ ID NO: 223503

SEQ ID NO: 468836 - RNA, 64 nt, hsa; identical to SEQ ID NO: 223504

SEQ ID NO: 468837 - RNA, 64 nt, hsa; identical to SEQ ID NO: 223505

SEQ ID NO: 468838 - RNA, 64 nt, hsa; identical to SEQ ID NO: 223506

SEQ ID NO: 468839 - RNA, 64 nt, hsa; identical to SEQ ID NO: 223507

SEQ ID NO: 468840 - RNA, 64 nt, hsa; identical to SEQ ID NO: 223508

SEQ ID NO: 468841 - RNA, 64 nt, hsa; identical to SEQ ID NO: 223509

SEQ ID NO: 468842 - RNA, 64 nt, hsa; identical to SEQ ID NO: 223510

SEQ ID NO: 468843 - RNA, 64 nt, hsa; identical to SEQ ID NO: 223511

SEQ ID NO: 468844 - RNA, 64 nt, hsa; identical to SEQ ID NO: 223512

SEQ ID NO: 468845 - RNA, 64 nt, hsa; identical to SEQ ID NO: 223513

SEQ ID NO: 468846 - RNA, 64 nt, hsa; identical to SEQ ID NO: 223514

SEQ ID NO: 468847 - RNA, 64 nt, hsa; identical to SEQ ID NO: 223515

SEQ ID NO: 468848 - RNA, 64 nt, hsa; identical to SEQ ID NO: 223516

SEQ ID NO: 468849 - RNA, 64 nt, hsa; identical to SEQ ID NO: 223517

SEQ ID NO: 468850 - RNA, 64 nt, hsa; identical to SEQ ID NO: 223518

SEQ ID NO: 468851 - RNA, 64 nt, hsa; identical to SEQ ID NO: 223519

SEQ ID NO: 468852 - RNA, 64 nt, hsa; identical to SEQ ID NO: 223520

SEQ ID NO: 468853 - RNA, 64 nt, hsa; identical to SEQ ID NO: 223521

SEQ ID NO: 468854 - RNA, 64 nt, hsa; identical to SEQ ID NO: 223522

SEQ ID NO: 468855 - RNA, 64 nt, hsa; identical to SEQ ID NO: 223523

SEQ ID NO: 468856 - RNA, 64 nt, hsa; identical to SEQ ID NO: 223524

SEQ ID NO: 468857 - RNA, 64 nt, hsa; identical to SEQ ID NO: 223525

SEQ ID NO: 468858 - RNA, 64 nt, hsa; identical to SEQ ID NO: 223526

SEQ ID NO: 468859 - RNA, 64 nt, hsa; identical to SEQ ID NO: 223527

SEQ ID NO: 468860 - RNA, 64 nt, hsa; identical to SEQ ID NO: 223528

SEQ ID NO: 468861 - RNA, 64 nt, hsa; identical to SEQ ID NO: 223529

SEQ ID NO: 468862 - RNA, 64 nt, hsa; identical to SEQ ID NO: 223530

SEQ ID NO: 468863 - RNA, 64 nt, hsa; identical to SEQ ID NO: 223531

SEQ ID NO: 468864 - RNA, 64 nt, hsa; identical to SEQ ID NO: 223532

SEQ ID NO: 468865 - RNA, 64 nt, hsa; identical to SEQ ID NO: 223533

SEQ ID NO: 468866 - RNA, 64 nt, hsa; identical to SEQ ID NO: 223534

SEQ ID NO: 468867 - RNA, 64 nt, hsa; identical to SEQ ID NO: 223535

SEQ ID NO: 468868 - RNA, 64 nt, hsa; identical to SEQ ID NO: 223536

SEQ ID NO: 468869 - RNA, 64 nt, hsa; identical to SEQ ID NO: 223537

SEQ ID NO: 468870 - RNA, 64 nt, hsa; identical to SEQ ID NO: 223538

SEQ ID NO: 468871 - RNA, 64 nt, hsa; identical to SEQ ID NO: 223539

SEQ ID NO: 468872 - RNA, 64 nt, hsa; identical to SEQ ID NO: 223540

SEQ ID NO: 468873 - RNA, 64 nt, hsa; identical to SEQ ID NO: 223541

SEQ ID NO: 468874 - RNA, 64 nt, hsa; identical to SEQ ID NO: 223542

SEQ ID NO: 468875 - RNA, 64 nt, hsa; identical to SEQ ID NO: 223543

SEQ ID NO: 468876 - RNA, 64 nt, hsa; identical to SEQ ID NO: 223544

SEQ ID NO: 468877 - RNA, 64 nt, hsa; identical to SEQ ID NO: 223545

SEQ ID NO: 468878 - RNA, 64 nt, hsa; identical to SEQ ID NO: 223546

SEQ ID NO: 468879 - RNA, 64 nt, hsa; identical to SEQ ID NO: 223547

SEQ ID NO: 468880 - RNA, 64 nt, hsa; identical to SEQ ID NO: 223548

SEQ ID NO: 468881 - RNA, 64 nt, hsa; identical to SEQ ID NO: 223549

SEQ ID NO: 468882 - RNA, 64 nt, hsa; identical to SEQ ID NO: 223550

SEQ ID NO: 468883 - RNA, 64 nt, hsa; identical to SEQ ID NO: 223551

SEQ ID NO: 468884 - RNA, 64 nt, hsa; identical to SEQ ID NO: 223552

SEQ ID NO: 468885 - RNA, 64 nt, hsa; identical to SEQ ID NO: 223553

SEQ ID NO: 468886 - RNA, 64 nt, hsa; identical to SEQ ID NO: 223554

SEQ ID NO: 468887 - RNA, 64 nt, hsa; identical to SEQ ID NO: 223555

SEQ ID NO: 468888 - RNA, 64 nt, hsa; identical to SEQ ID NO: 223556

SEQ ID NO: 468889 - RNA, 64 nt, hsa; identical to SEQ ID NO: 223557

SEQ ID NO: 468890 - RNA, 64 nt, hsa; identical to SEQ ID NO: 223558

SEQ ID NO: 468891 - RNA, 64 nt, hsa; identical to SEQ ID NO: 223559

SEQ ID NO: 468892 - RNA, 64 nt, hsa; identical to SEQ ID NO: 223560

SEQ ID NO: 468893 - RNA, 64 nt, hsa; identical to SEQ ID NO: 223561

SEQ ID NO: 468894 - RNA, 64 nt, hsa; identical to SEQ ID NO: 223562

SEQ ID NO: 468895 - RNA, 64 nt, hsa; identical to SEQ ID NO: 223563

SEQ ID NO: 468896 - RNA, 64 nt, hsa; identical to SEQ ID NO: 223564

SEQ ID NO: 468897 - RNA, 64 nt, hsa; identical to SEQ ID NO: 223565

SEQ ID NO: 468898 - RNA, 64 nt, hsa; identical to SEQ ID NO: 223566

SEQ ID NO: 468899 - RNA, 64 nt, hsa; identical to SEQ ID NO: 223567

SEQ ID NO: 468900 - RNA, 64 nt, hsa; identical to SEQ ID NO: 223568

SEQ ID NO: 468901 - RNA, 64 nt, hsa; identical to SEQ ID NO: 223569

SEQ ID NO: 468902 - RNA, 64 nt, hsa; identical to SEQ ID NO: 223570

SEQ ID NO: 468903 - RNA, 64 nt, hsa; identical to SEQ ID NO: 223571

SEQ ID NO: 468904 - RNA, 64 nt, hsa; identical to SEQ ID NO: 172960

SEQ ID NO: 468905 - RNA, 64 nt, hsa; identical to SEQ ID NO: 172961

SEQ ID NO: 468906 - RNA, 64 nt, hsa; identical to SEQ ID NO: 172962

SEQ ID NO: 468907 - RNA, 64 nt, hsa; identical to SEQ ID NO: 172963

SEQ ID NO: 468908 - RNA, 64 nt, hsa; identical to SEQ ID NO: 172964

SEQ ID NO: 468909 - RNA, 64 nt, hsa; identical to SEQ ID NO: 172965

SEQ ID NO: 468910 - RNA, 64 nt, hsa
cacaccaggcccaacccugugcuggucaagccagggcagucacagcugcuuggggcccacagca

SEQ ID NO: 468911 - RNA, 64 nt, hsa
uaaagucagagucucugaggaaggaaugugauuuggcagucaggguacuaagcaugggugggaa

SEQ ID NO: 468912 - RNA, 64 nt, hsa
gcuguuggauguauggggagcuggcagagcagguggcagucacugggacaaggagggacuugcc

SEQ ID NO: 468913 - RNA, 64 nt, hsa
cuguggaaauugggucuugggcuggguggcaucuggcagucauggguaacacuugcuuuuccag

SEQ ID NO: 468914 - RNA, 64 nt, hsa
ccucgguuucagacugccuacauuaggaaacaauggcagucaaacccauggcuuuggagaaagu

SEQ ID NO: 468915 - RNA, 64 nt, hsa
ccuggccuggcccacccugcuccuccaggugcugggcagucacucugcuaagagucccucccug

SEQ ID NO: 468916 - RNA, 64 nt, hsa
ggaguuggaagaggagggauuagaaacaggaggaggcagucauccucuccuugccaaaagauuu

SEQ ID NO: 468917 - RNA, 64 nt, hsa
cacugaggacaaugcggcuauagcagauggccauggcagucaguggcagcagaaagaggcagca

SEQ ID NO: 468918 - RNA, 64 nt, hsa
cugagugaggagaccgccagccccagaagcagagggcagucaaggucaagagccugugguccag

SEQ ID NO: 468919 - RNA, 64 nt, hsa
agggcugccucauaagcucccaaucucagacacuggcagucagggagaaucaaacugccugucu

SEQ ID NO: 468920 - RNA, 64 nt, hsa
ccagaaugaggauacgugagaaauagacccggcaggcagucagacugaaugggagcuggaauca

SEQ ID NO: 468921 - RNA, 64 nt, hsa
auugccuuuagaaacugaguccuguucuuguuacggcagucacacugcugggaaguggcuuaau

SEQ ID NO: 468922 - RNA, 64 nt, hsa
cagcugccacagggagggaggucuuggggagaugggcagucagguggcccguccuuggugagug

SEQ ID NO: 468923 - RNA, 64 nt, hsa
ccagcugcaacagcugcgugcacaggagcccccaggcagucagcagccccugcagagccuggaa

SEQ ID NO: 468924 - RNA, 64 nt, hsa
guuggaccccagcuucuugccaccuuccccuccgggcagucagcucuccauccaucccccucuu

SEQ ID NO: 468925 - RNA, 64 nt, hsa
aaaaaaugucccuuacaggaaccggcagcagcuaggcagucaccggcccgccuccauccaaaau

SEQ ID NO: 468926 - RNA, 64 nt, hsa
ucucccuaacccaccaccccugcgucucccugcaggcagucaccuucuuaggcccgggaaaaug

SEQ ID NO: 468927 - RNA, 64 nt, hsa
cauauguccucagagaggcugaguguccccuccaggcagucaugggcccugaggccccuccugc

SEQ ID NO: 468928 - RNA, 64 nt, hsa
uacauucuuccugggguccagaguccccauucaaggcagucaaguuaagacacuaacuuggccc

SEQ ID NO: 468929 - RNA, 64 nt, hsa
ugcccuuugggcaagguugggacaaagccaucugggcagucaggggcaaggacuguuggaggag

SEQ ID NO: 468930 - RNA, 64 nt, hsa
gauagggaccacagagauucuggggccagccaggggcagucaaauuggcaccuacuggcucuga

SEQ ID NO: 468931 - RNA, 64 nt, hsa
aauggacucauggcuuagaaaucuuuauucuuagggcagucaguaguauucuaaagcuuucuga

SEQ ID NO: 468932 - RNA, 64 nt, hsa
cuggcuccccuuuuacaaguucucccugaaagagggcagucacaagaggugugaagaguagcag

SEQ ID NO: 468933 - RNA, 64 nt, hsa
aacaccccauggacugugacucgaguauccaacaggcagucagagcucucccggucugaaaguu

SEQ ID NO: 468934 - RNA, 64 nt, hsa
ugguugaucagaggcaaguguggauccuuuggguggcagucaggggagaucucagggccucugu

SEQ ID NO: 468935 - RNA, 64 nt, hsa
cacaauuuuguggaugauuuagcaauaauaaaauggcagucauaacagggacuguuugucagua

SEQ ID NO: 468936 - RNA, 64 nt, hsa
ucaugccacucauuucagaacuugagcaaaacagggcagucaggaucugaugucuuucuggucu

SEQ ID NO: 468937 - RNA, 64 nt, hsa
uuugugcauagcccuucucuauguaagcagccauggcagucauuaaagagaaaggaguagcuuu

SEQ ID NO: 468938 - RNA, 64 nt, hsa
guagcauacuuggagaaacugcauuaucuuaaaaggcagucaaaugguguuuguuuuuaucaaa

SEQ ID NO: 468939 - RNA, 64 nt, hsa
uggaacccucccuguuuggaacccuccccaaagaggcagucaggcugaugcucagugcuuugug

SEQ ID NO: 468940 - RNA, 64 nt, hsa
cccggccacccugggaggcuugccagaugccgggggcagucagcauuaaugaaacucauguuua

SEQ ID NO: 468941 - RNA, 64 nt, hsa
gucuaaaugaaaccgaaacgugaccacgcacaaaggcagucacugccucgaggggugcagaccg

SEQ ID NO: 468942 - RNA, 64 nt, hsa
ucucuagcccaucauuaccugugaacugcaguggggcagucauggcaaauagaauugggcuggg

SEQ ID NO: 468943 - RNA, 64 nt, hsa
ccaaguuagaauucaugauacugguuuauggggaggcagucauaccuguucagagaaccaggaa

SEQ ID NO: 468944 - RNA, 60 nt, hsa
guuacggagccgauggcugacguauuucauggcagucaaguccaauggcagcgucuucgu

SEQ ID NO: 468945 - RNA, 64 nt, hsa
uuuaaggcacuucugaaagucaaucccuggacaaggcagucaucacauaagaacagcuaccuuc

SEQ ID NO: 468946 - RNA, 64 nt, hsa
acacacauccaucucaagaggaacauuuauaccaggcagucagagcuggaaguguauggagagc

SEQ ID NO: 468947 - RNA, 64 nt, hsa
aggaguuuaggguauaauuugccuugugauguuuggcagucacuguuuauacuuuaaagguuau

SEQ ID NO: 468948 - RNA, 64 nt, hsa
uauuucuugcagaaucaccacacgagaccaucccggcagucaugguuuugcuuuaguuuuccaa

SEQ ID NO: 468949 - RNA, 64 nt, hsa
ggaacaugugagggaaaaauauuuaaaaaaagauggcagucaucuagacauguaaaaugccaag

SEQ ID NO: 468950 - RNA, 64 nt, hsa
uaucuuuuaacauuaagugccuuugguucagaggggcagucauaagcucuguuucccccucucc

SEQ ID NO: 468951 - RNA, 64 nt, hsa
caaagagaugcugaggguaacaaggaacucacuuggcagucagagcaucaugcuuugagguuug

SEQ ID NO: 468952 - RNA, 64 nt, hsa
gucagcuagguaaagaugacaaacugcccugucuggcagucagcuucccagacagacuauagac

SEQ ID NO: 468953 - RNA, 64 nt, hsa
gccaagcaugcgauauucagagucuccccagaccggcagucaucauggcaguuucagcguucaa

SEQ ID NO: 468954 - RNA, 64 nt, hsa
uguaauaauauuuuuaaaaauuuacaucaagagaggcagucauucacgaugguuuugugccagc

SEQ ID NO: 468955 - RNA, 64 nt, hsa
aucugaaauauuaccccuugucuagaaaaaggggggcagucagaacagcuguuccccacuccgu

SEQ ID NO: 468956 - RNA, 64 nt, hsa
ucuagggaccagcaauacagugcucgccacagugggcagucacacaaagcuacccaucugccag

SEQ ID NO: 468957 - RNA, 64 nt, hsa
auuuggcuccucagccccagcaccaccagcugugggcagucaguagcagaggacgauccuccga

SEQ ID NO: 468958 - RNA, 64 nt, hsa
ccugugcugagccccaguggguugcaccuccaccggcagucagcgagcuggggcugcacugugc

SEQ ID NO: 468959 - RNA, 64 nt, hsa
uaggugauggcaguccauguggcugccaggccaaggcagucacaggggcccugaccccaggcca

SEQ ID NO: 468960 - RNA, 64 nt, hsa
caccccugcuucagcgaaagggacucucuaacagggcagucacuguugacucuauucugaauuu

SEQ ID NO: 468961 - RNA, 64 nt, hsa
agggcagccuucugccaccugugucgccuccacuggcagucacgccaccagagccacccuggcu

SEQ ID NO: 468962 - RNA, 64 nt, hsa
cugaaggggcuuggcuuccacucagcaucagcguggcagucaccaccccagugaggaccucgau

SEQ ID NO: 468963 - RNA, 64 nt, hsa
gccugaguccuggucccucugaggcaguugacggggcagucagauuuuuaaaguuuuguacaaa

SEQ ID NO: 468964 - RNA, 64 nt, hsa
ugaagaguuuuguguccguaguucuguaauucugggcagucaucauguugguuuuuuugggagu

SEQ ID NO: 468965 - RNA, 64 nt, hsa
gcuuuucaagguaucuuuccaauccugcugauguggcagucaauggcugcagggcuggcaaacc

SEQ ID NO: 468966 - RNA, 64 nt, hsa
cuuccaagagcuucuuagaguaguauauuuugggggcagucaaggaauaaacuacaguguaaac

SEQ ID NO: 468967 - RNA, 64 nt, hsa
cuuaaugaaugauacaucagucagauuuuaggaaggcagucaauuauggauauuuuaauguugg

SEQ ID NO: 468968 - RNA, 64 nt, hsa
gagucaccauggaagcagcauccugaccacagcuggcagucaagccacagcuggagggucagcc

SEQ ID NO: 468969 - RNA, 64 nt, hsa
cuugcacuagugaaauugucuaaagaaacuaaagggcagucaugcccuguuugcaguaauuuuu

SEQ ID NO: 468970 - RNA, 64 nt, hsa
gcugagguucuucugcccugagcccugcagcagcggcagucacagcuuccagaugaggggggau

SEQ ID NO: 468971 - RNA, 64 nt, hsa
cugcacagcaccuuggcugaugcuggaagaggagggcagucagugucacuucugggaugugccc

SEQ ID NO: 468972 - RNA, 64 nt, hsa
cccuccugggguaggagcauaaucuacaucacugggcagucacaggacacucuauagcaagguu

SEQ ID NO: 468973 - RNA, 64 nt, hsa
uccucccgcuggcuuccagacagaccugggacuuggcagucaugccgggugaugguguuccugc

SEQ ID NO: 468974 - RNA, 64 nt, hsa
auuucagagggccaggcaagagcacuucagaugaggcagucaaaaucauuuuuuuccagugagg

SEQ ID NO: 468975 - RNA, 64 nt, hsa
guggaggagaggagacuguuugaugugguacaggggcagucaguggagggcgagugguuucgga

SEQ ID NO: 468976 - RNA, 64 nt, hsa
gaaaaaaacuaauguuugaagacaaaaauauuuuggcagucacaauaccagaacuggauugcau

SEQ ID NO: 468977 - RNA, 64 nt, hsa
cuggcucuucucucggggcgaccccucagugcucggcagucauacuggggugcgagagaggugg

SEQ ID NO: 468978 - RNA, 64 nt, hsa
cacuacuuuuuccuccucugugagugaccauccaggcagucaccauaacugcuggagugucugg

SEQ ID NO: 468979 - RNA, 64 nt, hsa
gaagagggaccagcacaugaggcugaggcugaggggcagucaccagcaccaggaagaagguggu

SEQ ID NO: 468980 - RNA, 64 nt, hsa
acucccucucccaaauaguaaugcuuuagagggaggcagucauaucucugugugcagauaauaa

SEQ ID NO: 468981 - RNA, 64 nt, hsa
gaaagagaugcugggacauagaaccucuuaucugggcagucaugugcugaguuaaaacucaggg

SEQ ID NO: 468982 - RNA, 64 nt, hsa
auuacuuuuucauauauuuuuaccaucugcugaaggcagucauaucaaaggguaaagaaagaug

SEQ ID NO: 468983 - RNA, 64 nt, hsa
cccucugcuucuuuucucuucugcccuccuugugggcagucaugaaaaucaauucagacugugu

SEQ ID NO: 468984 - RNA, 64 nt, hsa
uuuuugaaucccagaaagggucugccauggaguuggcagucaucacgguagauggcguaugauu

SEQ ID NO: 468985 - RNA, 64 nt, hsa
acccuuuuaauauagcacucaucuuucaagagagggcagucaucuuuaaagaacauuuuauuuu

SEQ ID NO: 468986 - RNA, 64 nt, hsa
ccgacccgggccgcaucccugagcaagccacacgggcagucacagagggcacccuuggcaaacc

SEQ ID NO: 468987 - RNA, 64 nt, hsa
aauguaauuuuccccuaauaaaauuauggauaugggcagucaucaauggcugccaaaaccauua

SEQ ID NO: 468988 - RNA, 64 nt, hsa
cccucuacuccaugcacauaguaagucugacuauggcagucagacuuacuuacucccauuuucc

SEQ ID NO: 468989 - RNA, 64 nt, hsa
ggcacugguuguugauggucggugguugggugugggcagucaucagucaucaggugugcucagg

SEQ ID NO: 468990 - RNA, 64 nt, hsa
acaucgcaccaacaauucucuucaggucuaggauggcagucacuauucaugccggauaauagag

SEQ ID NO: 468991 - RNA, 64 nt, hsa
aauauacuguauuuugagaaauggcacaaaaacaggcagucaucuuuaagggcuaugccuaggc

SEQ ID NO: 468992 - RNA, 64 nt, hsa
ccuguucucggcaccuuaaauuauuagaccccggggcagucaggugcuccggacacccgaaggc

SEQ ID NO: 468993 - RNA, 64 nt, hsa
accagaauuggcccauaccauagaagaaagaauuggcagucaaaaaaaaaaauaccuuuuguaa

SEQ ID NO: 468994 - RNA, 64 nt, hsa
aguuucccugccccuguuaaagaaucagagguugggcagucaucaaauucaucauaaagacaug

SEQ ID NO: 468995 - RNA, 64 nt, hsa
gugugcaauauuggugcauguaauaauguugaguggcagucaaaagucaugauuuuuaucuuag

SEQ ID NO: 468996 - RNA, 63 nt, hsa
agcagcuggcugaggccuaagcccucccugaugggcagucaguccagagaugcuggcccucgc

SEQ ID NO: 468997 - RNA, 64 nt, hsa
auaggacucuccuaguccaacuuggggugggcaaggcagucagcaucaccagcaauaccacagg

SEQ ID NO: 468998 - RNA, 64 nt, hsa
ucccuauggggcccagaguuugccuuuucugccaggcagucaccaugcuucccuaccccagccu

SEQ ID NO: 468999 - RNA, 64 nt, hsa
cccaugcaaaaaggaaagagaaaaauuaaguuagggcagucaguaaagugagcuuuagaaagaa

SEQ ID NO: 469000 - RNA, 64 nt, hsa
aacucuccuuuauucuauauggaaauaaaaaggaggcagucauguuagcaaaugacacguuaau

SEQ ID NO: 469001 - RNA, 64 nt, hsa
ccucagaacuuuguguaaugccuggagcauaguaggcagucauauguuguaucgugaauaaauu

SEQ ID NO: 469002 - RNA, 64 nt, hsa
gccaguugagccagcgacaacagcaccagagccaggcagucacuguuccuccuccugguuugga

SEQ ID NO: 469003 - RNA, 64 nt, hsa
agugauagcugcuccccaucccaaagugggccugggcagucaggcuccagggcccuaugccaac

SEQ ID NO: 469004 - RNA, 64 nt, hsa
gcgcauuggcugggccgacucuuucuccccuccuggcagucaggcugcguccccuuuaaagaac

SEQ ID NO: 469005 - RNA, 64 nt, hsa
uccccuuguaggugacacaugcucugcccucugaggcagucagcgaaggcaaauggucugacuu

SEQ ID NO: 469006 - RNA, 64 nt, hsa
cuuauaggggagagggaacagagcccagugaaauggcagucagaauguuaacccuggauccauc

SEQ ID NO: 469007 - RNA, 64 nt, hsa
uuugcagggucagggaggaggaacggugggggugggcagucacugccuguuccccacugccugu

SEQ ID NO: 469008 - RNA, 64 nt, hsa
gagauuucagccaaggcugggccagccuuuuuugggcagucagguccacaccuauguccagggc

SEQ ID NO: 469009 - RNA, 64 nt, hsa
agaauccguuccugagcagcuccugugcccugggggcagucacagagccccccaacacccccgu

SEQ ID NO: 469010 - RNA, 61 nt, hsa
gccucguccagcaguccuaaccguucaacgaggcagucaccgccgucggaaggcgcuggag

SEQ ID NO: 469011 - RNA, 64 nt, hsa
agccugccuggcaggcugucuggccaggccucuuggcagucacaucucuuccuccgaggccagu

SEQ ID NO: 469012 - RNA, 64 nt, hsa
auuuguuuucauuguuuguauguacuacuuuuauggcagucauaugaaccauuaucuuagcaug

SEQ ID NO: 469013 - RNA, 64 nt, hsa
ugugugugggguaccugggaaaggguguggcugaggcagucauaaugcaguaucuuccccugac

SEQ ID NO: 469014 - RNA, 64 nt, hsa
uuaucagucugagaaaauauuuuuuucuaaagaaggcagucaguggaucuuaaaaugacaaucu

SEQ ID NO: 469015 - RNA, 64 nt, hsa
guaacagggcccaugcaaguccaaaauucagcagggcagucaaauuuuaaaccuccaaaaugau

SEQ ID NO: 469016 - RNA, 64 nt, hsa
caggaaccugugcaugccacccaccgccuggacaggcagucauccugccucugaugugaaucag

SEQ ID NO: 469017 - RNA, 64 nt, hsa
aaacaaugcugauagacucagaaaaggaguggggggcagucaccacugcugggcguggcauccg

SEQ ID NO: 469018 - RNA, 64 nt, hsa
gaaaucucgcgaggguuaaucuucucuugagaauggcagucaagaaaugagaugguucacuuga

SEQ ID NO: 469019 - RNA, 64 nt, hsa
ucucacuauaccaguauaauugaguuuucaguggggcagucauuauccagguaauccaagauau

SEQ ID NO: 469020 - RNA, 64 nt, hsa
cuuuuuaaggggugggccaaucauaaugaagaggggcagucaauaucugcaccuuuaaugcuau

SEQ ID NO: 469021 - RNA, 64 nt, hsa
acuaggaagugugacagcaggggagcuuucgugaggcagucagucauugcuucucuguaaauua

SEQ ID NO: 469022 - RNA, 64 nt, hsa
auuaguaguuuuacuuuaccauaggaugugagagggcagucauucuucucacugaguuuuuguu

SEQ ID NO: 469023 - RNA, 64 nt, hsa
uugggauaucugcucucugggauggcaucaguugggcagucaucuuuuuggaagagaagugugc

SEQ ID NO: 469024 - RNA, 64 nt, hsa
ccccauaugaaucugggaaaugggcuaggccugaggcagucaccuauuuguagaacucaauuga

SEQ ID NO: 469025 - RNA, 64 nt, hsa
gagcaugaguggaugccagaacuguagguuauaaggcagucacuuuuucucucuacucccaccc

SEQ ID NO: 469026 - RNA, 61 nt, hsa
agaaaaagaccacggagugacugagcuugcuggcagucacgucaguuauguagauacugca

SEQ ID NO: 469027 - RNA, 64 nt, hsa
uaaaaauacaaaaaaaaaauuagcugggugugguggcagucaccuguagucccagcuacuuggg

SEQ ID NO: 469028 - RNA, 64 nt, hsa
aggggcaggggcuccucugccagccugugggcauggcagucauuccuggaaggggcaggaccuc

SEQ ID NO: 469029 - RNA, 64 nt, hsa
ugugucuagccccaguggcucacugaacuuucagggcagucaggggguccugcuuagaagccag

SEQ ID NO: 469030 - RNA, 64 nt, hsa
uuggcacgugaccaaaauucacaucccuccucauggcagucauucaguauguguacuuguacaa

SEQ ID NO: 469031 - RNA, 64 nt, hsa
ccuuagccagcguucaaucaagcucaccaugcagggcagucacccggcaguucucaaacuuuag

SEQ ID NO: 469032 - RNA, 64 nt, hsa
ccuccacgcucccuacacaccugagauguaaacuggcagucaguguucacucaggaccuaggau

SEQ ID NO: 469033 - RNA, 64 nt, hsa
ugcuuuucuggugcaugaaacauuaauugcaaagggcagucacauccaacuuuaauaaaauaug

SEQ ID NO: 469034 - RNA, 64 nt, hsa
aaaaaauccuuguacuuaucaauuuugccccuuaggcagucaguuuuguugagaacuguguccu

SEQ ID NO: 469035 - RNA, 64 nt, hsa
uuuucucugacagucaaguaguccaucagaaauuggcagucacuucccagauuguaccagcaaa

SEQ ID NO: 469036 - RNA, 64 nt, hsa
ccuaaaaagauuugcuguuagaaauuuucuuuguggcagucauuuauuaaggauucaacucgug

SEQ ID NO: 469037 - RNA, 64 nt, hsa
ugucugcaugcagcacagaacuuugaaccuaggaggcagucaauaaauacaugagaaauucagc

SEQ ID NO: 469038 - RNA, 64 nt, hsa
aacaaagguguuaaguaccucuguucuggaucugggcagucagcacucuuuuuagaucuuugug

SEQ ID NO: 469039 - RNA, 64 nt, hsa
auugcacauauuaguaacccaguggaccauaauuggcagucacuggaagucugggaagaauccu

SEQ ID NO: 469040 - RNA, 64 nt, hsa
uuaaugggcuuugucaugaaguagcagaugagagggcagucaguuuagcacaaagcaauacuag

SEQ ID NO: 469041 - RNA, 57 nt, hsa
agaagaugacaguugaauagcaggaguggcagucaaaacugaaauuauagcucugga

SEQ ID NO: 469042 - RNA, 64 nt, hsa
agcauuucaugaaggauaacauuuuuauacagaaggcagucaagcucaacucagagccauggag

SEQ ID NO: 469043 - RNA, 64 nt, hsa
cuucacagcuggccacaacgagccuguagccaacggcagucacaaggccugauggggggccccu

SEQ ID NO: 469044 - RNA, 64 nt, hsa
gaaaaggggacagcaguuuucccaguuuuggccaggcagucaagccuuuaacagcucaugcaca

SEQ ID NO: 469045 - RNA, 64 nt, hsa
gcaccacauacaauagugugaaguagguaugaggggcagucauuguauucuauaguuuuuuuau

SEQ ID NO: 469046 - RNA, 64 nt, hsa
aaaaaaaaaaaagaggcuguguuuugucacacagggcagucauucagcaccagagcacgugaug

SEQ ID NO: 469047 - RNA, 64 nt, hsa
aacccagagggaccaggccuuccuagguuuucuaggcagucagcuguuaaccacucacuuagua

SEQ ID NO: 469048 - RNA, 64 nt, hsa
gccuagcuugaggggucugcaguccaguagggcaggcagucagguccaugugcacugcaaugcc

SEQ ID NO: 469049 - RNA, 64 nt, hsa
uuuaauuccugucaagagaccuaggucuacugauggcagucacugcauuguacauuauuccagu

SEQ ID NO: 469050 - RNA, 64 nt, hsa
guagccaaacuguaguccuucuaaaggaggacauggcagucaaaaagucugaguaaagcuguuu

SEQ ID NO: 469051 - RNA, 64 nt, hsa
aucugccauccauucugcagucuccagcagagcaggcagucaggccccagcgugccuccauccc

SEQ ID NO: 469052 - RNA, 64 nt, hsa
gaaaugaagaaaucacgcagccuuuugguuaaauggcagucaaaauuuuccucaguguauuuag

SEQ ID NO: 469053 - RNA, 64 nt, hsa
uaugcccggaugcccccgcgagccccagcgcccuggcagucagcagggauggccgccugcuggc

SEQ ID NO: 469054 - RNA, 64 nt, hsa
aaggguggaacaggagggguggggaggaagccggggcagucaccgagugaccaccaagaggaag

SEQ ID NO: 469055 - RNA, 64 nt, hsa
gccuuccucugccuggggcccacugcaucugauuggcagucacuucccaugagggccuggccca

SEQ ID NO: 469056 - RNA, 64 nt, hsa
cuacuggacaauguuacgcuagaauaaacaccaaggcagucaguuaaggcagcuaugguuugga

SEQ ID NO: 469057 - RNA, 64 nt, hsa
gggggaggagauggugucguuuagaucaggguaaggcagucaggcggguguucaccacugccuu

SEQ ID NO: 469058 - RNA, 64 nt, hsa
aaaauaaagcccuccuggggacuuggaaucagucggcagucaugcugggucuccacguggugug

SEQ ID NO: 469059 - RNA, 64 nt, hsa
ugacccacacgcugcagugacaagaagggcagagggcagucauggggcccaggaccaugccacu

SEQ ID NO: 469060 - RNA, 64 nt, hsa
aaggcugcaggcacugguugcagacgucuuuauaggcagucaccauguugucaaaccuuaauaa

SEQ ID NO: 469061 - RNA, 64 nt, hsa
caaaagcugggcuuccuggggccacagggccuauggcagucagaccagaggaagcgguccgggg

SEQ ID NO: 469062 - RNA, 64 nt, hsa
guuugugaacgcugugaugcugugugcccaagugggcagucaccacccagcccuuccuugggcg

SEQ ID NO: 469063 - RNA, 64 nt, hsa
gccuccauuucucuagaucugugcucuccgauguggcagucaguaaccauaggugacuaaauua

SEQ ID NO: 469064 - RNA, 64 nt, hsa
augcugcuggacaguaucacugucuuuccuagauggcagucacugaauuccauuuuuucaaggu

SEQ ID NO: 469065 - RNA, 64 nt, hsa
ggugacaaccgaguggcugucaucagccuguguaggcagucauggcaccaaagccaccagacug

SEQ ID NO: 469066 - RNA, 64 nt, hsa
ggugacaaccgaguggcugucaucggccuguguaggcagucauggcaccaaagccaccagacug

SEQ ID NO: 469067 - RNA, 64 nt, hsa
gggauuccuggguuucccuggguaccuuguuccaggcagucaguccauuugccuuccuaguacu

SEQ ID NO: 469068 - RNA, 64 nt, hsa
agucuaagauggguggggacguccugccaccuggggcagucaccugcccagaucccagaaggac

SEQ ID NO: 469069 - RNA, 64 nt, hsa
ucugccugcugggaucuguuaucucuggugggcuggcagucauaauucacaauucagacagccc

SEQ ID NO: 469070 - RNA, 64 nt, hsa
uauagagauuugaggaaaguuauauccacuagguggcagucauugaucauaauaagugaaauga

SEQ ID NO: 469071 - RNA, 64 nt, hsa
ccuuuuuaaccuguguuguccuagacccugucggggcagucaggggacacuagagauuugaucu

SEQ ID NO: 469072 - RNA, 64 nt, hsa
cucagccuaaauuuacaguuacuuuaagaaaaugggcagucagaauuagggacuagaauguaua

SEQ ID NO: 469073 - RNA, 64 nt, hsa
ugugugaccuuggggaaaggcagugcccucucugggcagucagauccacccagugcuuaauagc

SEQ ID NO: 469074 - RNA, 64 nt, hsa
agccauucuaggcggggcuggggccaggguggggggcagucacugugggaggucccagcuccag

SEQ ID NO: 469075 - RNA, 64 nt, hsa
guggaaacccggucagguaaugauaguggcaggaggcagucaaaugcccaggcagauaggggug

SEQ ID NO: 469076 - RNA, 64 nt, hsa
aucccaacuuagccacgucuggccuguguccuugggcagucacacuaccucucugauuuuguuu

SEQ ID NO: 469077 - RNA, 64 nt, hsa
uggcauuuucugggguugugagggaaacggggauggcagucagacucaaacccgugacacucca

SEQ ID NO: 469078 - RNA, 64 nt, hsa
cccuucuugguccacagucugcccucaucccucuggcagucacgcugucuucccugcaugcugu

SEQ ID NO: 469079 - RNA, 64 nt, hsa
uuauuuuuaaacagugcauucuugaaagcaguauggcagucauaaaaauuuuggaaccaaaaca

SEQ ID NO: 469080 - RNA, 64 nt, hsa
acaaacucugucugccgccagaaggaaugcugggggcagucaugucccaggucccgugcuccuu

SEQ ID NO: 469081 - RNA, 64 nt, hsa
gucucuuacaugaaugugacuggugcccccaggaggcagucaccgugcugucucugccccacau

SEQ ID NO: 469082 - RNA, 64 nt, hsa
ugcuccuguugcuuucacguagagucucggccugggcagucacgugguggucacuccuggaugu

SEQ ID NO: 469083 - RNA, 64 nt, hsa
ggcuccaccagcugcagaauuucaacacgcugauggcagucacagggggccugugucacagugc

SEQ ID NO: 469084 - RNA, 64 nt, hsa
ucgccgccaggacagagaagggacgggguggcugggcagucagggaaggagggucgcccggauc

SEQ ID NO: 469085 - RNA, 64 nt, hsa
uacaagugcaaugaguguggcaaagccuuuagugggcagucaccacuuauucaccaucaagcaa

SEQ ID NO: 469086 - RNA, 64 nt, hsa
uacaagugcaaugaguguggcaaacccuuuagugggcagucaccacuuauucaccaucaagcaa

SEQ ID NO: 469087 - RNA, 64 nt, hsa
aacucacauacgaaaagguugcaggauauuuguaggcagucaguuaccuucaccuuaugaaaug

SEQ ID NO: 469088 - RNA, 64 nt, hsa
ugcccaaguucuaguaguauucaaaacuucaaacggcagucauuuguucuccucggcucugugg

SEQ ID NO: 469089 - RNA, 64 nt, hsa
ccaguuaaacaaacuacccauccaugagcugccaggcagucaaaaacagaagcuuccccgacuu

SEQ ID NO: 469090 - RNA, 64 nt, hsa
uccuugaaagaugaucaaaagcgaugaugagggaggcagucaucacgcaggugcuuaaagggac

SEQ ID NO: 469091 - RNA, 64 nt, hsa
guguccguauguaaggccuugagaggacccugcaggcagucagcaccagccucagcaacugugc

SEQ ID NO: 469092 - RNA, 64 nt, hsa
uggagcuucuuugguaauucuggaagcuuuuccuggcagucaagagagggugacauccuggggc

SEQ ID NO: 469093 - RNA, 64 nt, hsa
gcacugcccauggacaggcuggcuccagaugcagggcagucauuggcugucuccuaggaaaccc

SEQ ID NO: 469094 - RNA, 64 nt, hsa
gaucaagcacccuaccccaguucuuucugguuuuggcagucacuggaucaggauccaggggagg

SEQ ID NO: 469095 - RNA, 64 nt, hsa
caaguacuucauagcaaucuuugcccugaauuuaggcagucacuuugagauccaucagccuaaa

SEQ ID NO: 469096 - RNA, 64 nt, hsa
ucaggucuucugccuucugaguuggcucauccugggcagucacagacuguccugccugcacggc

SEQ ID NO: 469097 - RNA, 64 nt, hsa
gacuuuggcauaugccagccuguuccugccacagggcagucacugccgccuacccugaaauaaa

SEQ ID NO: 469098 - RNA, 64 nt, hsa
gcaaagguggucagggugaugggccgcacagcgaggcagucaaggccagcucccugggagaagc

SEQ ID NO: 469099 - RNA, 64 nt, hsa
cuuaaaguacaguguuauuuaagaaucuuccagaggcagucaacagacuuauacacuaagggca

SEQ ID NO: 469100 - RNA, 64 nt, hsa
uagcuuauguuuuagggacuuuccuggaagcaaaggcagucacaucuggcauaaucauaauaaa

SEQ ID NO: 469101 - RNA, 64 nt, hsa
uccgugcuuagcuuauucuaucaaucacggaagaggcagucaaggaggaaggagagacauuagg

SEQ ID NO: 469102 - RNA, 64 nt, hsa
ugcccuccccuccaacucagccaacccaggugugggcagucagggagggagggagugucccacc

SEQ ID NO: 469103 - RNA, 64 nt, hsa
ucgacgcgaagugcuuaacacagccgggcuugggggcagucaggaggaagcuggccauccgugg

SEQ ID NO: 469104 - RNA, 64 nt, hsa
guugaagcaaauuuugcauuuugugguuaaagagggcagucacuguuccaaggagugaaggacu

SEQ ID NO: 469105 - RNA, 60 nt, hsa
uuguucacaacuucagguagaggaaugcauggcagucagaggggccuugcaaggaggggc

SEQ ID NO: 469106 - RNA, 64 nt, hsa
ccuccuuuaaggggcaaugcucuagguuuuugguggcagucaauuugguauuauauaugaucau

SEQ ID NO: 469107 - RNA, 64 nt, hsa
uuugucccacugacuuaagacaaaaaugcaaaaaggcagucaucccaucccggcagacccuuau

SEQ ID NO: 469108 - RNA, 64 nt, hsa
gaaugagacuggcuugcccuaggcuuaauggaugggcagucauuuugcagaggcuaugggaaga

SEQ ID NO: 469109 - RNA, 64 nt, hsa
ccuucuucccuauccaaauacuuuguucucagugggcagucagauuuuuuuggcuuccaaaccu

SEQ ID NO: 469110 - RNA, 64 nt, hsa
cacgcgcacaugggcgcgcacgaacuaccauucaggcagucagugggcaagaggaaagauaagu

SEQ ID NO: 469111 - RNA, 64 nt, hsa
auccucccaagcugcugcacgugcugaguccagaggcagucacagagaccucuggccaggggau

SEQ ID NO: 469112 - RNA, 64 nt, hsa
agauugugucuucuuuaugaggauagaucaaauuggcagucaggcccaugauagucagugcagu

SEQ ID NO: 469113 - RNA, 64 nt, hsa
uuugugccacugacuuuagauaaaaaugcaaaagggcagucauccugucccagcagacccuucu

SEQ ID NO: 469114 - RNA, 64 nt, hsa
auauaagugcaauauauuuuugaaggucuguaaauguguacauacaugucuuauauaaauauau

SEQ ID NO: 469115 - RNA, 64 nt, hsa
cuuauauaaauauauaauauauaaauauggugucuguguacauauagugaagauaugcaguaag

SEQ ID NO: 469116 - RNA, 64 nt, hsa
accugaggcugcuuucuguucccaaagcuugaccuguguacagagauaauuccuuggcaauguu

SEQ ID NO: 469117 - RNA, 64 nt, hsa
cugacggugguauugcuucucugcauguuaucaguguguacaucuggugcuuuucaugugucau

SEQ ID NO: 469118 - RNA, 64 nt, hsa
acacuccuccuccccuuuuuuccuuucuuuaagcuguguacagugaaaauugucuuuacuguau

SEQ ID NO: 469119 - RNA, 64 nt, hsa
augagggcauuuuaucugcuugcugugaccagcguguguacacauaaaccuuaacaagacuaca

SEQ ID NO: 469120 - RNA, 64 nt, hsa
uccucaaaauaagaucuguuccucauagcuauacuguguacacauaagacgcauauaggguuuu

SEQ ID NO: 469121 - RNA, 64 nt, hsa
gcaguuuaauugaggaccguguuguguguguauguguguacacacgcucugucuuuaaugacag

SEQ ID NO: 469122 - RNA, 64 nt, hsa
uccccacucccuggcucucagaagguauuccuuuuguguacaguguguaaaguguaaauccuuu

SEQ ID NO: 469123 - RNA, 64 nt, hsa
ggggccugggcuguggacagaaggaugucccggguguguacaccaagguuaccaacuaccuaga

SEQ ID NO: 469124 - RNA, 64 nt, hsa
ugauauauauguaggccuuugauauauaaugcuuuguguacaaaaaugguagaugguauuuuaa

SEQ ID NO: 469125 - RNA, 64 nt, hsa
caccaguguuaaaauuuuggagucuuaauuuucauguguacaccucuuugccuguucccacccc

SEQ ID NO: 469126 - RNA, 64 nt, hsa
ggguggaggaggccccagcacagccucaucuccauguguacacguguguacguguguaugcgug

SEQ ID NO: 469127 - RNA, 64 nt, hsa
uguguaugcguguguguacgcguguguacgcgcguguguacacaugcguggccgccuguggugu

SEQ ID NO: 469128 - RNA, 64 nt, hsa
uugaaguacugggcuuauauuucauuggaauacauguguacagcaauaagcagguuuccaaauc

SEQ ID NO: 469129 - RNA, 64 nt, hsa
gcaauaagcagguuuccaaauccgguacuuaguuuguguacaaauguaauuauguucauugugu

SEQ ID NO: 469130 - RNA, 64 nt, hsa
gaaaucauauuaaaagugaauucuucuagaggcuuguguacacuacugguuguuuuaguugggc

SEQ ID NO: 469131 - RNA, 64 nt, hsa
cagguuuuuaaauuuaaauucagagguuauaaaauguguacagcauuuuuaagugaaaauuagu

SEQ ID NO: 469132 - RNA, 64 nt, hsa
aaaacaagaaagaaauggcuuuucuuacccagauuguguacauagagcaauguugguuuuuuau

SEQ ID NO: 469133 - RNA, 64 nt, hsa
guguguguaugugugagugggugcgugguauacauguguacauauauguauaauauauaucuac

SEQ ID NO: 469134 - RNA, 64 nt, hsa
auugguaguauggcccacggugaccauuuuuuuguguguacagcgucauauaggcuuugccuuu

SEQ ID NO: 469135 - RNA, 64 nt, hsa
ugagaauagaaguuaugugauuucagugaguugauguguacagcauggcugugcuccaucugau

SEQ ID NO: 469136 - RNA, 64 nt, hsa
gauguggugcagugaaguauuuuaggcccaggucuguguacacauuuuauagaagaaugaagua

SEQ ID NO: 469137 - RNA, 64 nt, hsa
agagauagaaguuaugacauauguaauacacaucuguguacacagaaaccggcaccugccagac

SEQ ID NO: 469138 - RNA, 64 nt, hsa
ccugaggguaauuuuauacgauauuuuaaauaguuguguacaugaagcaugguuugugguaacu

SEQ ID NO: 469139 - RNA, 64 nt, hsa
gacaccuguaugaaaaugugaugauugaacucccuguguacagcgagugaauuaaaaugucugc

SEQ ID NO: 469140 - RNA, 64 nt, hsa
ccacuuaauagacucuaugugugcugaauguuccuguguacauauguguguuaaauaaaacaau

SEQ ID NO: 469141 - RNA, 64 nt, hsa
gugcccgaggggcgggcggcggugucuguauguauguguacauaugcacauagaccuuagagug

SEQ ID NO: 469142 - RNA, 64 nt, hsa
uagcauauauuuuuacauguacuauaucuagguguguguacaaguguguguaaaaauauauacc

SEQ ID NO: 469143 - RNA, 64 nt, hsa
ccgcccgugguguuauuuaaagaagaaacgucuauguguacagaugaaugauaaacucucugcu

SEQ ID NO: 469144 - RNA, 64 nt, hsa
guugaugcaaucgguuuaaacauggcugaacgcguguguacacgggacugacgcaacccacgug

SEQ ID NO: 469145 - RNA, 64 nt, hsa
aaaggcauugcuuuaaaggaaaaaaguauagguauguguacauauauaauacauacaaacacau

SEQ ID NO: 469146 - RNA, 64 nt, hsa
ugcacugauaucuucacaaaacaccacuauuugauguguacagaguuggacuauguguauauug

SEQ ID NO: 469147 - RNA, 63 nt, hsa
agugccaggcauggugcugagguuacauguguguguguacagugcgugugauucccaugucca

SEQ ID NO: 469148 - RNA, 64 nt, hsa
ccagugccauucuguguucaggugcccauuuccuuguguacauccugucccugccacauccaua

SEQ ID NO: 469149 - RNA, 64 nt, hsa
gagcaaugauagcaaauaauguacgaauguuuuuugcauucaaaggacauccacaucuguugga

SEQ ID NO: 469150 - RNA, 64 nt, hsa
auuuguuuuuaaaaaucuauuuggucaaucuaaaugcauucauucuaaaaaauuuuuugaacca

SEQ ID NO: 469151 - RNA, 64 nt, hsa
aaaacugguuuguagcaguuuugaaagaauagaaugcauucaaauguaaggcugcuucuggauc

SEQ ID NO: 469152 - RNA, 64 nt, hsa
gagaauuagaggauggugguaguaaugaaaaugaugcauucaguuuaacaaguuuaauuugaga

SEQ ID NO: 469153 - RNA, 64 nt, hsa
aacaacauugucuuucuuuucuagcacagaguuaugcauucaaagaugcauaccuaguuaguuu

SEQ ID NO: 469154 - RNA, 64 nt, hsa
aaagccuuuuacaaaauuaaaaaaaaaauagaugugcauucaguuuuuaagaauggaaucaucc

SEQ ID NO: 469155 - RNA, 64 nt, hsa
uucauuuauuugagaaaaaaacaauacaaagaaaugcauucauaucaaaauuggaauagaaagg

SEQ ID NO: 469156 - RNA, 64 nt, hsa
agugcuaucccaauauuuucaauaaaggacuuuaugcauucagugauuuucuuucccaaagauu

SEQ ID NO: 469157 - RNA, 64 nt, hsa
ucuccauuucugcucagauuccccccaucuccauugcauucauguacuacccucagucuacacu

SEQ ID NO: 469158 - RNA, 64 nt, hsa
cuucauguucagucacaugugcucucgggugcccugcauucacagcuacgugugccccucucau

SEQ ID NO: 469159 - RNA, 64 nt, hsa
uccucauuacauuccacauucuuagaauaagaagugcauucaauccuaggagaaugauaauccu

SEQ ID NO: 469160 - RNA, 64 nt, hsa
cacuuugucaugugguuacaaguaaaacaacuguugcauucacuguuucaacauguguacaugu

SEQ ID NO: 469161 - RNA, 64 nt, hsa
aaagaaugagucucuguauggaagaacaaaugugugcauucacccccagucacaauggucucca

SEQ ID NO: 469162 - RNA, 64 nt, hsa
guucccucuuggugccuaaccuggauuaguaaugugcauucaggugaauuuucagcugaggcuc

SEQ ID NO: 469163 - RNA, 64 nt, hsa
acuuuuuauaaagcucuuaauuguugugcaguauugcauucauuacaaaaguguuugugguugg

SEQ ID NO: 469164 - RNA, 64 nt, hsa
accuuguuguacuguugguaaaauucugucuugaugcauucaaaaugguugacauaauuaauga

SEQ ID NO: 469165 - RNA, 64 nt, hsa
accaucucaccauauccaucucccagcauccaucugcauucagcuaagggcgggaaacugaccu

SEQ ID NO: 469166 - RNA, 64 nt, hsa
cucucugcauuaucccgccagacacuguauuuuaugcauucaugucuaggauacagugugaaaa

SEQ ID NO: 469167 - RNA, 64 nt, hsa
ucuuuuuaaauuguuaauucuaauaauuucaaaaugcauucacugaagaaauggacauuaaaau

SEQ ID NO: 469168 - RNA, 64 nt, hsa
ccucucuauguaagcacacaugcgcacacacacuugcauucaugaaucugauauaaagugccag

SEQ ID NO: 469169 - RNA, 64 nt, hsa
auucuaucauguacaguuuccagaauugucacugugcauucaaaaguaaugaaucuaacagaca

SEQ ID NO: 469170 - RNA, 64 nt, hsa
ggucgcgaagaaaucacagccaaggaagauuugaugcauucagauucucguguaacacuuguug

SEQ ID NO: 469171 - RNA, 64 nt, hsa
ugagccugcagugagcuaugacgaugccacucgcugcauucaagucuagaugacagagcaagac

SEQ ID NO: 469172 - RNA, 64 nt, hsa
uugucgaacaggggggcgugguucucgucgagagugcauucacacucuuguucccuagaaagcc

SEQ ID NO: 469173 - RNA, 64 nt, hsa
cuuugaccaaccgaacaugaccaaaaaccaaaagugcauucaaccuuaccaaaaaaaaaaaaaa

SEQ ID NO: 469174 - RNA, 64 nt, hsa
uuucacauggacuuuggaaaauauuuuuuuccuuugcauucaucucucaaacuuaguuuuuauc

SEQ ID NO: 469175 - RNA, 64 nt, hsa
ucugucuccggcccgcagcaggagcagccagcagugcauucaccccacuuuuguaaacugcucu

SEQ ID NO: 469176 - RNA, 64 nt, hsa
aucuggaagauuggguguauuuuuuggugacugcugcauucaucagcaaugaacaguuuccacu

SEQ ID NO: 469177 - RNA, 64 nt, hsa
auauucaaccuuuuuaacauguuaaauacuauugugcauucagugaaguguuauuaugccacag

SEQ ID NO: 469178 - RNA, 64 nt, hsa
uauaacuuuaaaaguagaaauuuuuugcaguuauugcauucaaaguaugcuuaacuuuuugaaa

SEQ ID NO: 469179 - RNA, 64 nt, hsa
agcgaaagagccaguagugaauccccucauuuugugcauucacuuugaagaaaaagguuucuca

SEQ ID NO: 469180 - RNA, 64 nt, hsa
uguguuuguuuuuaaguuagagaguagucccucuugcauucaaaccuccuucaaaacuccuuac

SEQ ID NO: 469181 - RNA, 62 nt, hsa
cacccaccacugaaaaagccgcggagaugcgcagcgcguacacugacuuuggggccugggug

SEQ ID NO: 469182 - RNA, 62 nt, hsa
uugguguaagacaucacaaucccauuauucagagcgcguauggaguggaaacgcuuguaagg

SEQ ID NO: 469183 - RNA, 62 nt, hsa
uugguguaagacaucacaaucccauuauucagagcgcguauggaguggaaacgcuuguaggg

SEQ ID NO: 469184 - RNA, 62 nt, hsa; identical to SEQ ID NO: 469183

SEQ ID NO: 469185 - RNA, 62 nt, hsa; identical to SEQ ID NO: 469183

SEQ ID NO: 469186 - RNA, 63 nt, hsa
gcacccaccacugaaaaagccgcggagaugcgcagcgcguacacugacuuuggggccugggug

SEQ ID NO: 469187 - RNA, 63 nt, hsa
auugguguaagacaucacaaucccauuauucagagcgcguauggaguggaaacgcuuguaagg

SEQ ID NO: 469188 - RNA, 63 nt, hsa
auugguguaagacaucacaaucccauuauucagagcgcguauggaguggaaacgcuuguaggg

SEQ ID NO: 469189 - RNA, 63 nt, hsa; identical to SEQ ID NO: 469188

SEQ ID NO: 469190 - RNA, 63 nt, hsa; identical to SEQ ID NO: 469188

SEQ ID NO: 469191 - RNA, 62 nt, hsa; identical to SEQ ID NO: 253135

SEQ ID NO: 469192 - RNA, 62 nt, hsa; identical to SEQ ID NO: 253136

SEQ ID NO: 469193 - RNA, 62 nt, hsa; identical to SEQ ID NO: 253137

SEQ ID NO: 469194 - RNA, 62 nt, hsa; identical to SEQ ID NO: 253138

SEQ ID NO: 469195 - RNA, 62 nt, hsa; identical to SEQ ID NO: 253139

SEQ ID NO: 469196 - RNA, 62 nt, hsa; identical to SEQ ID NO: 253140

SEQ ID NO: 469197 - RNA, 62 nt, hsa; identical to SEQ ID NO: 253141

SEQ ID NO: 469198 - RNA, 62 nt, hsa; identical to SEQ ID NO: 253142

SEQ ID NO: 469199 - RNA, 62 nt, hsa; identical to SEQ ID NO: 253143

SEQ ID NO: 469200 - RNA, 62 nt, hsa; identical to SEQ ID NO: 253144

SEQ ID NO: 469201 - RNA, 62 nt, hsa; identical to SEQ ID NO: 253145

SEQ ID NO: 469202 - RNA, 58 nt, hsa; identical to SEQ ID NO: 102991

SEQ ID NO: 469203 - RNA, 62 nt, hsa; identical to SEQ ID NO: 253147

SEQ ID NO: 469204 - RNA, 62 nt, hsa; identical to SEQ ID NO: 253148

SEQ ID NO: 469205 - RNA, 62 nt, hsa; identical to SEQ ID NO: 253149

SEQ ID NO: 469206 - RNA, 62 nt, hsa; identical to SEQ ID NO: 253150

SEQ ID NO: 469207 - RNA, 62 nt, hsa; identical to SEQ ID NO: 253151

SEQ ID NO: 469208 - RNA, 62 nt, hsa; identical to SEQ ID NO: 253152

SEQ ID NO: 469209 - RNA, 62 nt, hsa; identical to SEQ ID NO: 253153

SEQ ID NO: 469210 - RNA, 62 nt, hsa; identical to SEQ ID NO: 253154

SEQ ID NO: 469211 - RNA, 62 nt, hsa; identical to SEQ ID NO: 253155

SEQ ID NO: 469212 - RNA, 62 nt, hsa; identical to SEQ ID NO: 253156

SEQ ID NO: 469213 - RNA, 62 nt, hsa; identical to SEQ ID NO: 253157

SEQ ID NO: 469214 - RNA, 62 nt, hsa; identical to SEQ ID NO: 253158

SEQ ID NO: 469215 - RNA, 62 nt, hsa; identical to SEQ ID NO: 253159

SEQ ID NO: 469216 - RNA, 62 nt, hsa; identical to SEQ ID NO: 253160

SEQ ID NO: 469217 - RNA, 62 nt, hsa; identical to SEQ ID NO: 253161

SEQ ID NO: 469218 - RNA, 62 nt, hsa; identical to SEQ ID NO: 253162

SEQ ID NO: 469219 - RNA, 62 nt, hsa; identical to SEQ ID NO: 253163

SEQ ID NO: 469220 - RNA, 62 nt, hsa; identical to SEQ ID NO: 253164

SEQ ID NO: 469221 - RNA, 62 nt, hsa; identical to SEQ ID NO: 253165

SEQ ID NO: 469222 - RNA, 62 nt, hsa; identical to SEQ ID NO: 253166

SEQ ID NO: 469223 - RNA, 62 nt, hsa; identical to SEQ ID NO: 253167

SEQ ID NO: 469224 - RNA, 62 nt, hsa; identical to SEQ ID NO: 253168

SEQ ID NO: 469225 - RNA, 53 nt, hsa; identical to SEQ ID NO: 103014

SEQ ID NO: 469226 - RNA, 62 nt, hsa; identical to SEQ ID NO: 253170

SEQ ID NO: 469227 - RNA, 62 nt, hsa; identical to SEQ ID NO: 253171

SEQ ID NO: 469228 - RNA, 62 nt, hsa; identical to SEQ ID NO: 253172

SEQ ID NO: 469229 - RNA, 62 nt, hsa; identical to SEQ ID NO: 253173

SEQ ID NO: 469230 - RNA, 62 nt, hsa; identical to SEQ ID NO: 253174

SEQ ID NO: 469231 - RNA, 62 nt, hsa; identical to SEQ ID NO: 253175

SEQ ID NO: 469232 - RNA, 62 nt, hsa; identical to SEQ ID NO: 253176

SEQ ID NO: 469233 - RNA, 62 nt, hsa; identical to SEQ ID NO: 253177

SEQ ID NO: 469234 - RNA, 62 nt, hsa; identical to SEQ ID NO: 253178

SEQ ID NO: 469235 - RNA, 62 nt, hsa; identical to SEQ ID NO: 253179

SEQ ID NO: 469236 - RNA, 62 nt, hsa; identical to SEQ ID NO: 253180

SEQ ID NO: 469237 - RNA, 62 nt, hsa; identical to SEQ ID NO: 253181

SEQ ID NO: 469238 - RNA, 62 nt, hsa; identical to SEQ ID NO: 253182

SEQ ID NO: 469239 - RNA, 62 nt, hsa; identical to SEQ ID NO: 253183

SEQ ID NO: 469240 - RNA, 62 nt, hsa; identical to SEQ ID NO: 253184

SEQ ID NO: 469241 - RNA, 62 nt, hsa; identical to SEQ ID NO: 253185

SEQ ID NO: 469242 - RNA, 62 nt, hsa; identical to SEQ ID NO: 253186

SEQ ID NO: 469243 - RNA, 62 nt, hsa; identical to SEQ ID NO: 253187

SEQ ID NO: 469244 - RNA, 62 nt, hsa; identical to SEQ ID NO: 253188

SEQ ID NO: 469245 - RNA, 62 nt, hsa; identical to SEQ ID NO: 253189

SEQ ID NO: 469246 - RNA, 62 nt, hsa; identical to SEQ ID NO: 253190

SEQ ID NO: 469247 - RNA, 62 nt, hsa; identical to SEQ ID NO: 253191

SEQ ID NO: 469248 - RNA, 62 nt, hsa; identical to SEQ ID NO: 253192

SEQ ID NO: 469249 - RNA, 62 nt, hsa; identical to SEQ ID NO: 253193

SEQ ID NO: 469250 - RNA, 62 nt, hsa; identical to SEQ ID NO: 253194

SEQ ID NO: 469251 - RNA, 62 nt, hsa; identical to SEQ ID NO: 253195

SEQ ID NO: 469252 - RNA, 62 nt, hsa; identical to SEQ ID NO: 253196

SEQ ID NO: 469253 - RNA, 62 nt, hsa; identical to SEQ ID NO: 253197

SEQ ID NO: 469254 - RNA, 62 nt, hsa; identical to SEQ ID NO: 253198

SEQ ID NO: 469255 - RNA, 62 nt, hsa; identical to SEQ ID NO: 253199

SEQ ID NO: 469256 - RNA, 62 nt, hsa; identical to SEQ ID NO: 253200

SEQ ID NO: 469257 - RNA, 62 nt, hsa; identical to SEQ ID NO: 253201

SEQ ID NO: 469258 - RNA, 62 nt, hsa; identical to SEQ ID NO: 253202

SEQ ID NO: 469259 - RNA, 62 nt, hsa; identical to SEQ ID NO: 253203

SEQ ID NO: 469260 - RNA, 62 nt, hsa; identical to SEQ ID NO: 253204

SEQ ID NO: 469261 - RNA, 62 nt, hsa; identical to SEQ ID NO: 253205

SEQ ID NO: 469262 - RNA, 62 nt, hsa; identical to SEQ ID NO: 253206

SEQ ID NO: 469263 - RNA, 62 nt, hsa; identical to SEQ ID NO: 253207

SEQ ID NO: 469264 - RNA, 62 nt, hsa; identical to SEQ ID NO: 253208

SEQ ID NO: 469265 - RNA, 62 nt, hsa; identical to SEQ ID NO: 253209

SEQ ID NO: 469266 - RNA, 62 nt, hsa; identical to SEQ ID NO: 253210

SEQ ID NO: 469267 - RNA, 62 nt, hsa; identical to SEQ ID NO: 253211

SEQ ID NO: 469268 - RNA, 62 nt, hsa; identical to SEQ ID NO: 253212

SEQ ID NO: 469269 - RNA, 62 nt, hsa; identical to SEQ ID NO: 253213

SEQ ID NO: 469270 - RNA, 62 nt, hsa; identical to SEQ ID NO: 253214

SEQ ID NO: 469271 - RNA, 62 nt, hsa; identical to SEQ ID NO: 253215

SEQ ID NO: 469272 - RNA, 62 nt, hsa; identical to SEQ ID NO: 253216

SEQ ID NO: 469273 - RNA, 62 nt, hsa; identical to SEQ ID NO: 253217

SEQ ID NO: 469274 - RNA, 62 nt, hsa; identical to SEQ ID NO: 253218

SEQ ID NO: 469275 - RNA, 62 nt, hsa; identical to SEQ ID NO: 253219

SEQ ID NO: 469276 - RNA, 62 nt, hsa; identical to SEQ ID NO: 253220

SEQ ID NO: 469277 - RNA, 62 nt, hsa; identical to SEQ ID NO: 253221

SEQ ID NO: 469278 - RNA, 62 nt, hsa; identical to SEQ ID NO: 253222

SEQ ID NO: 469279 - RNA, 62 nt, hsa; identical to SEQ ID NO: 253223

SEQ ID NO: 469280 - RNA, 62 nt, hsa; identical to SEQ ID NO: 253224

SEQ ID NO: 469281 - RNA, 62 nt, hsa; identical to SEQ ID NO: 253225

SEQ ID NO: 469282 - RNA, 62 nt, hsa; identical to SEQ ID NO: 253226

SEQ ID NO: 469283 - RNA, 62 nt, hsa; identical to SEQ ID NO: 253227

SEQ ID NO: 469284 - RNA, 62 nt, hsa; identical to SEQ ID NO: 253228

SEQ ID NO: 469285 - RNA, 62 nt, hsa; identical to SEQ ID NO: 253229

SEQ ID NO: 469286 - RNA, 62 nt, hsa; identical to SEQ ID NO: 253230

SEQ ID NO: 469287 - RNA, 62 nt, hsa; identical to SEQ ID NO: 253231

SEQ ID NO: 469288 - RNA, 62 nt, hsa; identical to SEQ ID NO: 253232

SEQ ID NO: 469289 - RNA, 62 nt, hsa; identical to SEQ ID NO: 253233

SEQ ID NO: 469290 - RNA, 62 nt, hsa; identical to SEQ ID NO: 253234

SEQ ID NO: 469291 - RNA, 62 nt, hsa; identical to SEQ ID NO: 253235

SEQ ID NO: 469292 - RNA, 62 nt, hsa; identical to SEQ ID NO: 253236

SEQ ID NO: 469293 - RNA, 62 nt, hsa; identical to SEQ ID NO: 253237

SEQ ID NO: 469294 - RNA, 62 nt, hsa; identical to SEQ ID NO: 253238

SEQ ID NO: 469295 - RNA, 62 nt, hsa; identical to SEQ ID NO: 253239

SEQ ID NO: 469296 - RNA, 62 nt, hsa; identical to SEQ ID NO: 253240

SEQ ID NO: 469297 - RNA, 62 nt, hsa; identical to SEQ ID NO: 253241

SEQ ID NO: 469298 - RNA, 62 nt, hsa; identical to SEQ ID NO: 253242

SEQ ID NO: 469299 - RNA, 62 nt, hsa; identical to SEQ ID NO: 253243

SEQ ID NO: 469300 - RNA, 62 nt, hsa; identical to SEQ ID NO: 253244

SEQ ID NO: 469301 - RNA, 62 nt, hsa; identical to SEQ ID NO: 253245

SEQ ID NO: 469302 - RNA, 62 nt, hsa; identical to SEQ ID NO: 253246

SEQ ID NO: 469303 - RNA, 62 nt, hsa; identical to SEQ ID NO: 253247

SEQ ID NO: 469304 - RNA, 62 nt, hsa; identical to SEQ ID NO: 253248

SEQ ID NO: 469305 - RNA, 62 nt, hsa; identical to SEQ ID NO: 253249

SEQ ID NO: 469306 - RNA, 62 nt, hsa; identical to SEQ ID NO: 253250

SEQ ID NO: 469307 - RNA, 62 nt, hsa; identical to SEQ ID NO: 253251

SEQ ID NO: 469308 - RNA, 62 nt, hsa; identical to SEQ ID NO: 253252

SEQ ID NO: 469309 - RNA, 60 nt, hsa; identical to SEQ ID NO: 103098

SEQ ID NO: 469310 - RNA, 62 nt, hsa; identical to SEQ ID NO: 253254

SEQ ID NO: 469311 - RNA, 62 nt, hsa; identical to SEQ ID NO: 253255

SEQ ID NO: 469312 - RNA, 62 nt, hsa; identical to SEQ ID NO: 253256

SEQ ID NO: 469313 - RNA, 62 nt, hsa; identical to SEQ ID NO: 253257

SEQ ID NO: 469314 - RNA, 62 nt, hsa; identical to SEQ ID NO: 253258

SEQ ID NO: 469315 - RNA, 62 nt, hsa; identical to SEQ ID NO: 253259

SEQ ID NO: 469316 - RNA, 62 nt, hsa; identical to SEQ ID NO: 253260

SEQ ID NO: 469317 - RNA, 62 nt, hsa; identical to SEQ ID NO: 253261

SEQ ID NO: 469318 - RNA, 62 nt, hsa; identical to SEQ ID NO: 253262

SEQ ID NO: 469319 - RNA, 62 nt, hsa; identical to SEQ ID NO: 253263

SEQ ID NO: 469320 - RNA, 62 nt, hsa; identical to SEQ ID NO: 253264

SEQ ID NO: 469321 - RNA, 62 nt, hsa; identical to SEQ ID NO: 253265

SEQ ID NO: 469322 - RNA, 62 nt, hsa; identical to SEQ ID NO: 253266

SEQ ID NO: 469323 - RNA, 62 nt, hsa; identical to SEQ ID NO: 253267

SEQ ID NO: 469324 - RNA, 62 nt, hsa; identical to SEQ ID NO: 253268

SEQ ID NO: 469325 - RNA, 62 nt, hsa; identical to SEQ ID NO: 253269

SEQ ID NO: 469326 - RNA, 62 nt, hsa; identical to SEQ ID NO: 253270

SEQ ID NO: 469327 - RNA, 62 nt, hsa; identical to SEQ ID NO: 253271

SEQ ID NO: 469328 - RNA, 62 nt, hsa; identical to SEQ ID NO: 253272

SEQ ID NO: 469329 - RNA, 62 nt, hsa; identical to SEQ ID NO: 253273

SEQ ID NO: 469330 - RNA, 62 nt, hsa; identical to SEQ ID NO: 253274

SEQ ID NO: 469331 - RNA, 62 nt, hsa; identical to SEQ ID NO: 253275

SEQ ID NO: 469332 - RNA, 62 nt, hsa; identical to SEQ ID NO: 253276

SEQ ID NO: 469333 - RNA, 62 nt, hsa; identical to SEQ ID NO: 253277

SEQ ID NO: 469334 - RNA, 62 nt, hsa; identical to SEQ ID NO: 253278

SEQ ID NO: 469335 - RNA, 62 nt, hsa; identical to SEQ ID NO: 253279

SEQ ID NO: 469336 - RNA, 62 nt, hsa; identical to SEQ ID NO: 253280

SEQ ID NO: 469337 - RNA, 62 nt, hsa; identical to SEQ ID NO: 253281

SEQ ID NO: 469338 - RNA, 62 nt, hsa; identical to SEQ ID NO: 253282

SEQ ID NO: 469339 - RNA, 62 nt, hsa; identical to SEQ ID NO: 253283

SEQ ID NO: 469340 - RNA, 62 nt, hsa; identical to SEQ ID NO: 253284

SEQ ID NO: 469341 - RNA, 62 nt, hsa; identical to SEQ ID NO: 253285

SEQ ID NO: 469342 - RNA, 62 nt, hsa; identical to SEQ ID NO: 253286

SEQ ID NO: 469343 - RNA, 62 nt, hsa; identical to SEQ ID NO: 253287

SEQ ID NO: 469344 - RNA, 62 nt, hsa; identical to SEQ ID NO: 253288

SEQ ID NO: 469345 - RNA, 62 nt, hsa; identical to SEQ ID NO: 253289

SEQ ID NO: 469346 - RNA, 62 nt, hsa; identical to SEQ ID NO: 253290

SEQ ID NO: 469347 - RNA, 62 nt, hsa; identical to SEQ ID NO: 253291

SEQ ID NO: 469348 - RNA, 62 nt, hsa; identical to SEQ ID NO: 253292

SEQ ID NO: 469349 - RNA, 62 nt, hsa; identical to SEQ ID NO: 253293

SEQ ID NO: 469350 - RNA, 62 nt, hsa; identical to SEQ ID NO: 253294

SEQ ID NO: 469351 - RNA, 62 nt, hsa; identical to SEQ ID NO: 253295

SEQ ID NO: 469352 - RNA, 62 nt, hsa; identical to SEQ ID NO: 253296

SEQ ID NO: 469353 - RNA, 62 nt, hsa; identical to SEQ ID NO: 253297

SEQ ID NO: 469354 - RNA, 62 nt, hsa; identical to SEQ ID NO: 253298

SEQ ID NO: 469355 - RNA, 62 nt, hsa; identical to SEQ ID NO: 253299

SEQ ID NO: 469356 - RNA, 62 nt, hsa; identical to SEQ ID NO: 253300

SEQ ID NO: 469357 - RNA, 62 nt, hsa; identical to SEQ ID NO: 253301

SEQ ID NO: 469358 - RNA, 62 nt, hsa; identical to SEQ ID NO: 253302

SEQ ID NO: 469359 - RNA, 62 nt, hsa; identical to SEQ ID NO: 253303

SEQ ID NO: 469360 - RNA, 62 nt, hsa; identical to SEQ ID NO: 253304

SEQ ID NO: 469361 - RNA, 62 nt, hsa; identical to SEQ ID NO: 253305

SEQ ID NO: 469362 - RNA, 62 nt, hsa; identical to SEQ ID NO: 253306

SEQ ID NO: 469363 - RNA, 62 nt, hsa; identical to SEQ ID NO: 253307

SEQ ID NO: 469364 - RNA, 62 nt, hsa; identical to SEQ ID NO: 253308

SEQ ID NO: 469365 - RNA, 62 nt, hsa; identical to SEQ ID NO: 253309

SEQ ID NO: 469366 - RNA, 62 nt, hsa; identical to SEQ ID NO: 253310

SEQ ID NO: 469367 - RNA, 62 nt, hsa; identical to SEQ ID NO: 253311

SEQ ID NO: 469368 - RNA, 62 nt, hsa; identical to SEQ ID NO: 253312

SEQ ID NO: 469369 - RNA, 62 nt, hsa; identical to SEQ ID NO: 253313

SEQ ID NO: 469370 - RNA, 62 nt, hsa; identical to SEQ ID NO: 253314

SEQ ID NO: 469371 - RNA, 62 nt, hsa; identical to SEQ ID NO: 253315

SEQ ID NO: 469372 - RNA, 62 nt, hsa; identical to SEQ ID NO: 253316

SEQ ID NO: 469373 - RNA, 62 nt, hsa; identical to SEQ ID NO: 253317

SEQ ID NO: 469374 - RNA, 62 nt, hsa; identical to SEQ ID NO: 253318

SEQ ID NO: 469375 - RNA, 62 nt, hsa; identical to SEQ ID NO: 253319

SEQ ID NO: 469376 - RNA, 62 nt, hsa; identical to SEQ ID NO: 253320

SEQ ID NO: 469377 - RNA, 62 nt, hsa; identical to SEQ ID NO: 253321

SEQ ID NO: 469378 - RNA, 62 nt, hsa; identical to SEQ ID NO: 253322

SEQ ID NO: 469379 - RNA, 62 nt, hsa; identical to SEQ ID NO: 253323

SEQ ID NO: 469380 - RNA, 62 nt, hsa; identical to SEQ ID NO: 253324

SEQ ID NO: 469381 - RNA, 62 nt, hsa; identical to SEQ ID NO: 253325

SEQ ID NO: 469382 - RNA, 62 nt, hsa; identical to SEQ ID NO: 253326

SEQ ID NO: 469383 - RNA, 62 nt, hsa; identical to SEQ ID NO: 253327

SEQ ID NO: 469384 - RNA, 62 nt, hsa; identical to SEQ ID NO: 253328

SEQ ID NO: 469385 - RNA, 62 nt, hsa; identical to SEQ ID NO: 253329

SEQ ID NO: 469386 - RNA, 62 nt, hsa; identical to SEQ ID NO: 253330

SEQ ID NO: 469387 - RNA, 62 nt, hsa; identical to SEQ ID NO: 253331

SEQ ID NO: 469388 - RNA, 62 nt, hsa; identical to SEQ ID NO: 253332

SEQ ID NO: 469389 - RNA, 62 nt, hsa; identical to SEQ ID NO: 253333

SEQ ID NO: 469390 - RNA, 62 nt, hsa; identical to SEQ ID NO: 253334

SEQ ID NO: 469391 - RNA, 62 nt, hsa; identical to SEQ ID NO: 253335

SEQ ID NO: 469392 - RNA, 62 nt, hsa; identical to SEQ ID NO: 253336

SEQ ID NO: 469393 - RNA, 62 nt, hsa; identical to SEQ ID NO: 253337

SEQ ID NO: 469394 - RNA, 62 nt, hsa; identical to SEQ ID NO: 253338

SEQ ID NO: 469395 - RNA, 62 nt, hsa; identical to SEQ ID NO: 253339

SEQ ID NO: 469396 - RNA, 62 nt, hsa; identical to SEQ ID NO: 253340

SEQ ID NO: 469397 - RNA, 62 nt, hsa; identical to SEQ ID NO: 253341

SEQ ID NO: 469398 - RNA, 62 nt, hsa; identical to SEQ ID NO: 253342

SEQ ID NO: 469399 - RNA, 62 nt, hsa; identical to SEQ ID NO: 253343

SEQ ID NO: 469400 - RNA, 62 nt, hsa; identical to SEQ ID NO: 253344

SEQ ID NO: 469401 - RNA, 62 nt, hsa; identical to SEQ ID NO: 253345

SEQ ID NO: 469402 - RNA, 62 nt, hsa; identical to SEQ ID NO: 253346

SEQ ID NO: 469403 - RNA, 62 nt, hsa; identical to SEQ ID NO: 253347

SEQ ID NO: 469404 - RNA, 62 nt, hsa; identical to SEQ ID NO: 253348

SEQ ID NO: 469405 - RNA, 62 nt, hsa; identical to SEQ ID NO: 253349

SEQ ID NO: 469406 - RNA, 62 nt, hsa; identical to SEQ ID NO: 253350

SEQ ID NO: 469407 - RNA, 51 nt, hsa; identical to SEQ ID NO: 103196

SEQ ID NO: 469408 - RNA, 62 nt, hsa; identical to SEQ ID NO: 253352

SEQ ID NO: 469409 - RNA, 62 nt, hsa; identical to SEQ ID NO: 253353

SEQ ID NO: 469410 - RNA, 62 nt, hsa; identical to SEQ ID NO: 253354

SEQ ID NO: 469411 - RNA, 62 nt, hsa; identical to SEQ ID NO: 253355

SEQ ID NO: 469412 - RNA, 62 nt, hsa; identical to SEQ ID NO: 253356

SEQ ID NO: 469413 - RNA, 62 nt, hsa; identical to SEQ ID NO: 253357

SEQ ID NO: 469414 - RNA, 62 nt, hsa; identical to SEQ ID NO: 253358

SEQ ID NO: 469415 - RNA, 62 nt, hsa; identical to SEQ ID NO: 253359

SEQ ID NO: 469416 - RNA, 62 nt, hsa; identical to SEQ ID NO: 253360

SEQ ID NO: 469417 - RNA, 62 nt, hsa; identical to SEQ ID NO: 253361

SEQ ID NO: 469418 - RNA, 62 nt, hsa; identical to SEQ ID NO: 253362

SEQ ID NO: 469419 - RNA, 62 nt, hsa; identical to SEQ ID NO: 253363

SEQ ID NO: 469420 - RNA, 62 nt, hsa; identical to SEQ ID NO: 253364

SEQ ID NO: 469421 - RNA, 62 nt, hsa; identical to SEQ ID NO: 253365

SEQ ID NO: 469422 - RNA, 62 nt, hsa; identical to SEQ ID NO: 253366

SEQ ID NO: 469423 - RNA, 62 nt, hsa; identical to SEQ ID NO: 253367

SEQ ID NO: 469424 - RNA, 62 nt, hsa; identical to SEQ ID NO: 253368

SEQ ID NO: 469425 - RNA, 62 nt, hsa; identical to SEQ ID NO: 253369

SEQ ID NO: 469426 - RNA, 62 nt, hsa; identical to SEQ ID NO: 253370

SEQ ID NO: 469427 - RNA, 62 nt, hsa; identical to SEQ ID NO: 253371

SEQ ID NO: 469428 - RNA, 62 nt, hsa; identical to SEQ ID NO: 253372

SEQ ID NO: 469429 - RNA, 62 nt, hsa; identical to SEQ ID NO: 253373

SEQ ID NO: 469430 - RNA, 62 nt, hsa; identical to SEQ ID NO: 253374

SEQ ID NO: 469431 - RNA, 62 nt, hsa; identical to SEQ ID NO: 253375

SEQ ID NO: 469432 - RNA, 62 nt, hsa; identical to SEQ ID NO: 253376

SEQ ID NO: 469433 - RNA, 62 nt, hsa; identical to SEQ ID NO: 253377

SEQ ID NO: 469434 - RNA, 62 nt, hsa; identical to SEQ ID NO: 253378

SEQ ID NO: 469435 - RNA, 62 nt, hsa; identical to SEQ ID NO: 253379

SEQ ID NO: 469436 - RNA, 62 nt, hsa; identical to SEQ ID NO: 253380

SEQ ID NO: 469437 - RNA, 62 nt, hsa; identical to SEQ ID NO: 253381

SEQ ID NO: 469438 - RNA, 62 nt, hsa; identical to SEQ ID NO: 253382

SEQ ID NO: 469439 - RNA, 62 nt, hsa; identical to SEQ ID NO: 253383

SEQ ID NO: 469440 - RNA, 62 nt, hsa; identical to SEQ ID NO: 253384

SEQ ID NO: 469441 - RNA, 62 nt, hsa; identical to SEQ ID NO: 253385

SEQ ID NO: 469442 - RNA, 62 nt, hsa; identical to SEQ ID NO: 253386

SEQ ID NO: 469443 - RNA, 62 nt, hsa; identical to SEQ ID NO: 253387

SEQ ID NO: 469444 - RNA, 62 nt, hsa; identical to SEQ ID NO: 253388

SEQ ID NO: 469445 - RNA, 62 nt, hsa; identical to SEQ ID NO: 253389

SEQ ID NO: 469446 - RNA, 62 nt, hsa; identical to SEQ ID NO: 253390

SEQ ID NO: 469447 - RNA, 62 nt, hsa; identical to SEQ ID NO: 253391

SEQ ID NO: 469448 - RNA, 62 nt, hsa; identical to SEQ ID NO: 253392

SEQ ID NO: 469449 - RNA, 62 nt, hsa; identical to SEQ ID NO: 253393

SEQ ID NO: 469450 - RNA, 62 nt, hsa; identical to SEQ ID NO: 253394

SEQ ID NO: 469451 - RNA, 62 nt, hsa; identical to SEQ ID NO: 253395

SEQ ID NO: 469452 - RNA, 62 nt, hsa; identical to SEQ ID NO: 253396

SEQ ID NO: 469453 - RNA, 62 nt, hsa; identical to SEQ ID NO: 253397

SEQ ID NO: 469454 - RNA, 62 nt, hsa; identical to SEQ ID NO: 253398

SEQ ID NO: 469455 - RNA, 62 nt, hsa; identical to SEQ ID NO: 253399

SEQ ID NO: 469456 - RNA, 62 nt, hsa; identical to SEQ ID NO: 253400

SEQ ID NO: 469457 - RNA, 62 nt, hsa; identical to SEQ ID NO: 253401

SEQ ID NO: 469458 - RNA, 62 nt, hsa; identical to SEQ ID NO: 253402

SEQ ID NO: 469459 - RNA, 62 nt, hsa; identical to SEQ ID NO: 253403

SEQ ID NO: 469460 - RNA, 62 nt, hsa; identical to SEQ ID NO: 253404

SEQ ID NO: 469461 - RNA, 62 nt, hsa; identical to SEQ ID NO: 253405

SEQ ID NO: 469462 - RNA, 62 nt, hsa; identical to SEQ ID NO: 253406

SEQ ID NO: 469463 - RNA, 62 nt, hsa; identical to SEQ ID NO: 253407

SEQ ID NO: 469464 - RNA, 62 nt, hsa; identical to SEQ ID NO: 253408

SEQ ID NO: 469465 - RNA, 62 nt, hsa; identical to SEQ ID NO: 253409

SEQ ID NO: 469466 - RNA, 62 nt, hsa; identical to SEQ ID NO: 253410

SEQ ID NO: 469467 - RNA, 62 nt, hsa; identical to SEQ ID NO: 253411

SEQ ID NO: 469468 - RNA, 62 nt, hsa; identical to SEQ ID NO: 253412

SEQ ID NO: 469469 - RNA, 62 nt, hsa; identical to SEQ ID NO: 253413

SEQ ID NO: 469470 - RNA, 62 nt, hsa; identical to SEQ ID NO: 253414

SEQ ID NO: 469471 - RNA, 62 nt, hsa; identical to SEQ ID NO: 253415

SEQ ID NO: 469472 - RNA, 62 nt, hsa; identical to SEQ ID NO: 253416

SEQ ID NO: 469473 - RNA, 62 nt, hsa; identical to SEQ ID NO: 253417

SEQ ID NO: 469474 - RNA, 62 nt, hsa; identical to SEQ ID NO: 253418

SEQ ID NO: 469475 - RNA, 62 nt, hsa; identical to SEQ ID NO: 253419

SEQ ID NO: 469476 - RNA, 62 nt, hsa; identical to SEQ ID NO: 253420

SEQ ID NO: 469477 - RNA, 62 nt, hsa; identical to SEQ ID NO: 253421

SEQ ID NO: 469478 - RNA, 62 nt, hsa; identical to SEQ ID NO: 253422

SEQ ID NO: 469479 - RNA, 62 nt, hsa; identical to SEQ ID NO: 253423

SEQ ID NO: 469480 - RNA, 62 nt, hsa; identical to SEQ ID NO: 253424

SEQ ID NO: 469481 - RNA, 62 nt, hsa; identical to SEQ ID NO: 253425

SEQ ID NO: 469482 - RNA, 62 nt, hsa; identical to SEQ ID NO: 253426

SEQ ID NO: 469483 - RNA, 62 nt, hsa; identical to SEQ ID NO: 253427

SEQ ID NO: 469484 - RNA, 62 nt, hsa; identical to SEQ ID NO: 253428

SEQ ID NO: 469485 - RNA, 62 nt, hsa; identical to SEQ ID NO: 253429

SEQ ID NO: 469486 - RNA, 62 nt, hsa; identical to SEQ ID NO: 253430

SEQ ID NO: 469487 - RNA, 62 nt, hsa; identical to SEQ ID NO: 253431

SEQ ID NO: 469488 - RNA, 62 nt, hsa; identical to SEQ ID NO: 253432

SEQ ID NO: 469489 - RNA, 62 nt, hsa; identical to SEQ ID NO: 253433

SEQ ID NO: 469490 - RNA, 62 nt, hsa; identical to SEQ ID NO: 253434

SEQ ID NO: 469491 - RNA, 62 nt, hsa; identical to SEQ ID NO: 253435

SEQ ID NO: 469492 - RNA, 62 nt, hsa; identical to SEQ ID NO: 253436

SEQ ID NO: 469493 - RNA, 62 nt, hsa; identical to SEQ ID NO: 253437

SEQ ID NO: 469494 - RNA, 62 nt, hsa; identical to SEQ ID NO: 253438

SEQ ID NO: 469495 - RNA, 62 nt, hsa; identical to SEQ ID NO: 253439

SEQ ID NO: 469496 - RNA, 62 nt, hsa; identical to SEQ ID NO: 253440

SEQ ID NO: 469497 - RNA, 62 nt, hsa; identical to SEQ ID NO: 253441

SEQ ID NO: 469498 - RNA, 62 nt, hsa; identical to SEQ ID NO: 253442

SEQ ID NO: 469499 - RNA, 62 nt, hsa; identical to SEQ ID NO: 253443

SEQ ID NO: 469500 - RNA, 66 nt, hsa; identical to SEQ ID NO: 253444

SEQ ID NO: 469501 - RNA, 66 nt, hsa; identical to SEQ ID NO: 253445

SEQ ID NO: 469502 - RNA, 66 nt, hsa; identical to SEQ ID NO: 253446

SEQ ID NO: 469503 - RNA, 66 nt, hsa; identical to SEQ ID NO: 253447

SEQ ID NO: 469504 - RNA, 66 nt, hsa; identical to SEQ ID NO: 253448

SEQ ID NO: 469505 - RNA, 66 nt, hsa; identical to SEQ ID NO: 253449

SEQ ID NO: 469506 - RNA, 66 nt, hsa; identical to SEQ ID NO: 253450

SEQ ID NO: 469507 - RNA, 66 nt, hsa; identical to SEQ ID NO: 253451

SEQ ID NO: 469508 - RNA, 66 nt, hsa; identical to SEQ ID NO: 253452

SEQ ID NO: 469509 - RNA, 66 nt, hsa; identical to SEQ ID NO: 253453

SEQ ID NO: 469510 - RNA, 66 nt, hsa; identical to SEQ ID NO: 253454

SEQ ID NO: 469511 - RNA, 58 nt, hsa; identical to SEQ ID NO: 102991

SEQ ID NO: 469512 - RNA, 66 nt, hsa; identical to SEQ ID NO: 253456

SEQ ID NO: 469513 - RNA, 66 nt, hsa; identical to SEQ ID NO: 253457

SEQ ID NO: 469514 - RNA, 66 nt, hsa; identical to SEQ ID NO: 253458

SEQ ID NO: 469515 - RNA, 66 nt, hsa; identical to SEQ ID NO: 253459

SEQ ID NO: 469516 - RNA, 66 nt, hsa; identical to SEQ ID NO: 253460

SEQ ID NO: 469517 - RNA, 66 nt, hsa; identical to SEQ ID NO: 253461

SEQ ID NO: 469518 - RNA, 66 nt, hsa; identical to SEQ ID NO: 253462

SEQ ID NO: 469519 - RNA, 66 nt, hsa; identical to SEQ ID NO: 253463

SEQ ID NO: 469520 - RNA, 66 nt, hsa; identical to SEQ ID NO: 253464

SEQ ID NO: 469521 - RNA, 66 nt, hsa; identical to SEQ ID NO: 253465

SEQ ID NO: 469522 - RNA, 66 nt, hsa; identical to SEQ ID NO: 253466

SEQ ID NO: 469523 - RNA, 66 nt, hsa; identical to SEQ ID NO: 253467

SEQ ID NO: 469524 - RNA, 66 nt, hsa; identical to SEQ ID NO: 253468

SEQ ID NO: 469525 - RNA, 66 nt, hsa; identical to SEQ ID NO: 253469

SEQ ID NO: 469526 - RNA, 66 nt, hsa; identical to SEQ ID NO: 253470

SEQ ID NO: 469527 - RNA, 66 nt, hsa; identical to SEQ ID NO: 253471

SEQ ID NO: 469528 - RNA, 66 nt, hsa; identical to SEQ ID NO: 253472

SEQ ID NO: 469529 - RNA, 66 nt, hsa; identical to SEQ ID NO: 253473

SEQ ID NO: 469530 - RNA, 66 nt, hsa; identical to SEQ ID NO: 253474

SEQ ID NO: 469531 - RNA, 66 nt, hsa; identical to SEQ ID NO: 253475

SEQ ID NO: 469532 - RNA, 66 nt, hsa; identical to SEQ ID NO: 253476

SEQ ID NO: 469533 - RNA, 66 nt, hsa; identical to SEQ ID NO: 253477

SEQ ID NO: 469534 - RNA, 53 nt, hsa; identical to SEQ ID NO: 103014

SEQ ID NO: 469535 - RNA, 66 nt, hsa; identical to SEQ ID NO: 253479

SEQ ID NO: 469536 - RNA, 66 nt, hsa; identical to SEQ ID NO: 253480

SEQ ID NO: 469537 - RNA, 66 nt, hsa; identical to SEQ ID NO: 253481

SEQ ID NO: 469538 - RNA, 66 nt, hsa; identical to SEQ ID NO: 253482

SEQ ID NO: 469539 - RNA, 66 nt, hsa; identical to SEQ ID NO: 253483

SEQ ID NO: 469540 - RNA, 66 nt, hsa; identical to SEQ ID NO: 253484

SEQ ID NO: 469541 - RNA, 66 nt, hsa; identical to SEQ ID NO: 253485

SEQ ID NO: 469542 - RNA, 66 nt, hsa; identical to SEQ ID NO: 253486

SEQ ID NO: 469543 - RNA, 66 nt, hsa; identical to SEQ ID NO: 253487

SEQ ID NO: 469544 - RNA, 66 nt, hsa; identical to SEQ ID NO: 253488

SEQ ID NO: 469545 - RNA, 66 nt, hsa; identical to SEQ ID NO: 253489

SEQ ID NO: 469546 - RNA, 66 nt, hsa; identical to SEQ ID NO: 253490

SEQ ID NO: 469547 - RNA, 66 nt, hsa; identical to SEQ ID NO: 253491

SEQ ID NO: 469548 - RNA, 66 nt, hsa; identical to SEQ ID NO: 253492

SEQ ID NO: 469549 - RNA, 66 nt, hsa; identical to SEQ ID NO: 253493

SEQ ID NO: 469550 - RNA, 66 nt, hsa; identical to SEQ ID NO: 253494

SEQ ID NO: 469551 - RNA, 66 nt, hsa; identical to SEQ ID NO: 253495

SEQ ID NO: 469552 - RNA, 66 nt, hsa; identical to SEQ ID NO: 253496

SEQ ID NO: 469553 - RNA, 66 nt, hsa; identical to SEQ ID NO: 253497

SEQ ID NO: 469554 - RNA, 66 nt, hsa; identical to SEQ ID NO: 253498

SEQ ID NO: 469555 - RNA, 66 nt, hsa; identical to SEQ ID NO: 253499

SEQ ID NO: 469556 - RNA, 66 nt, hsa; identical to SEQ ID NO: 253500

SEQ ID NO: 469557 - RNA, 66 nt, hsa; identical to SEQ ID NO: 253501

SEQ ID NO: 469558 - RNA, 66 nt, hsa; identical to SEQ ID NO: 253502

SEQ ID NO: 469559 - RNA, 66 nt, hsa; identical to SEQ ID NO: 253503

SEQ ID NO: 469560 - RNA, 66 nt, hsa; identical to SEQ ID NO: 253504

SEQ ID NO: 469561 - RNA, 66 nt, hsa; identical to SEQ ID NO: 253505

SEQ ID NO: 469562 - RNA, 66 nt, hsa; identical to SEQ ID NO: 253506

SEQ ID NO: 469563 - RNA, 66 nt, hsa; identical to SEQ ID NO: 253507

SEQ ID NO: 469564 - RNA, 66 nt, hsa; identical to SEQ ID NO: 253508

SEQ ID NO: 469565 - RNA, 66 nt, hsa; identical to SEQ ID NO: 253509

SEQ ID NO: 469566 - RNA, 66 nt, hsa; identical to SEQ ID NO: 253510

SEQ ID NO: 469567 - RNA, 66 nt, hsa; identical to SEQ ID NO: 253511

SEQ ID NO: 469568 - RNA, 66 nt, hsa; identical to SEQ ID NO: 253512

SEQ ID NO: 469569 - RNA, 66 nt, hsa; identical to SEQ ID NO: 253513

SEQ ID NO: 469570 - RNA, 66 nt, hsa; identical to SEQ ID NO: 253514

SEQ ID NO: 469571 - RNA, 66 nt, hsa; identical to SEQ ID NO: 253515

SEQ ID NO: 469572 - RNA, 66 nt, hsa; identical to SEQ ID NO: 253516

SEQ ID NO: 469573 - RNA, 66 nt, hsa; identical to SEQ ID NO: 253517

SEQ ID NO: 469574 - RNA, 66 nt, hsa; identical to SEQ ID NO: 253518

SEQ ID NO: 469575 - RNA, 66 nt, hsa; identical to SEQ ID NO: 253519

SEQ ID NO: 469576 - RNA, 66 nt, hsa; identical to SEQ ID NO: 253520

SEQ ID NO: 469577 - RNA, 66 nt, hsa; identical to SEQ ID NO: 253521

SEQ ID NO: 469578 - RNA, 66 nt, hsa; identical to SEQ ID NO: 253522

SEQ ID NO: 469579 - RNA, 66 nt, hsa; identical to SEQ ID NO: 253523

SEQ ID NO: 469580 - RNA, 66 nt, hsa; identical to SEQ ID NO: 253524

SEQ ID NO: 469581 - RNA, 66 nt, hsa; identical to SEQ ID NO: 253525

SEQ ID NO: 469582 - RNA, 66 nt, hsa; identical to SEQ ID NO: 253526

SEQ ID NO: 469583 - RNA, 66 nt, hsa; identical to SEQ ID NO: 253527

SEQ ID NO: 469584 - RNA, 66 nt, hsa; identical to SEQ ID NO: 253528

SEQ ID NO: 469585 - RNA, 66 nt, hsa; identical to SEQ ID NO: 253529

SEQ ID NO: 469586 - RNA, 66 nt, hsa; identical to SEQ ID NO: 253530

SEQ ID NO: 469587 - RNA, 66 nt, hsa; identical to SEQ ID NO: 253531

SEQ ID NO: 469588 - RNA, 66 nt, hsa; identical to SEQ ID NO: 253532

SEQ ID NO: 469589 - RNA, 66 nt, hsa; identical to SEQ ID NO: 253533

SEQ ID NO: 469590 - RNA, 66 nt, hsa; identical to SEQ ID NO: 253534

SEQ ID NO: 469591 - RNA, 66 nt, hsa; identical to SEQ ID NO: 253535

SEQ ID NO: 469592 - RNA, 66 nt, hsa; identical to SEQ ID NO: 253536

SEQ ID NO: 469593 - RNA, 66 nt, hsa; identical to SEQ ID NO: 253537

SEQ ID NO: 469594 - RNA, 66 nt, hsa; identical to SEQ ID NO: 253538

SEQ ID NO: 469595 - RNA, 66 nt, hsa; identical to SEQ ID NO: 253539

SEQ ID NO: 469596 - RNA, 66 nt, hsa; identical to SEQ ID NO: 253540

SEQ ID NO: 469597 - RNA, 66 nt, hsa; identical to SEQ ID NO: 253541

SEQ ID NO: 469598 - RNA, 66 nt, hsa; identical to SEQ ID NO: 253542

SEQ ID NO: 469599 - RNA, 66 nt, hsa; identical to SEQ ID NO: 253543

SEQ ID NO: 469600 - RNA, 66 nt, hsa; identical to SEQ ID NO: 253544

SEQ ID NO: 469601 - RNA, 66 nt, hsa; identical to SEQ ID NO: 253545

SEQ ID NO: 469602 - RNA, 66 nt, hsa; identical to SEQ ID NO: 253546

SEQ ID NO: 469603 - RNA, 66 nt, hsa; identical to SEQ ID NO: 253547

SEQ ID NO: 469604 - RNA, 66 nt, hsa; identical to SEQ ID NO: 253548

SEQ ID NO: 469605 - RNA, 66 nt, hsa; identical to SEQ ID NO: 253549

SEQ ID NO: 469606 - RNA, 66 nt, hsa; identical to SEQ ID NO: 253550

SEQ ID NO: 469607 - RNA, 66 nt, hsa; identical to SEQ ID NO: 253551

SEQ ID NO: 469608 - RNA, 66 nt, hsa; identical to SEQ ID NO: 253552

SEQ ID NO: 469609 - RNA, 66 nt, hsa; identical to SEQ ID NO: 253553

SEQ ID NO: 469610 - RNA, 66 nt, hsa; identical to SEQ ID NO: 253554

SEQ ID NO: 469611 - RNA, 66 nt, hsa; identical to SEQ ID NO: 253555

SEQ ID NO: 469612 - RNA, 66 nt, hsa; identical to SEQ ID NO: 253556

SEQ ID NO: 469613 - RNA, 66 nt, hsa; identical to SEQ ID NO: 253557

SEQ ID NO: 469614 - RNA, 66 nt, hsa; identical to SEQ ID NO: 253558

SEQ ID NO: 469615 - RNA, 66 nt, hsa; identical to SEQ ID NO: 253559

SEQ ID NO: 469616 - RNA, 66 nt, hsa; identical to SEQ ID NO: 253560

SEQ ID NO: 469617 - RNA, 66 nt, hsa; identical to SEQ ID NO: 253561

SEQ ID NO: 469618 - RNA, 60 nt, hsa; identical to SEQ ID NO: 103098

SEQ ID NO: 469619 - RNA, 66 nt, hsa; identical to SEQ ID NO: 253563

SEQ ID NO: 469620 - RNA, 66 nt, hsa; identical to SEQ ID NO: 253564

SEQ ID NO: 469621 - RNA, 66 nt, hsa; identical to SEQ ID NO: 253565

SEQ ID NO: 469622 - RNA, 66 nt, hsa; identical to SEQ ID NO: 253566

SEQ ID NO: 469623 - RNA, 66 nt, hsa; identical to SEQ ID NO: 253567

SEQ ID NO: 469624 - RNA, 66 nt, hsa; identical to SEQ ID NO: 253568

SEQ ID NO: 469625 - RNA, 66 nt, hsa; identical to SEQ ID NO: 253569

SEQ ID NO: 469626 - RNA, 66 nt, hsa; identical to SEQ ID NO: 253570

SEQ ID NO: 469627 - RNA, 66 nt, hsa; identical to SEQ ID NO: 253571

SEQ ID NO: 469628 - RNA, 66 nt, hsa; identical to SEQ ID NO: 253572

SEQ ID NO: 469629 - RNA, 66 nt, hsa; identical to SEQ ID NO: 253573

SEQ ID NO: 469630 - RNA, 66 nt, hsa; identical to SEQ ID NO: 253574

SEQ ID NO: 469631 - RNA, 66 nt, hsa; identical to SEQ ID NO: 253575

SEQ ID NO: 469632 - RNA, 66 nt, hsa; identical to SEQ ID NO: 253576

SEQ ID NO: 469633 - RNA, 66 nt, hsa; identical to SEQ ID NO: 253577

SEQ ID NO: 469634 - RNA, 66 nt, hsa; identical to SEQ ID NO: 253578

SEQ ID NO: 469635 - RNA, 66 nt, hsa; identical to SEQ ID NO: 253579

SEQ ID NO: 469636 - RNA, 66 nt, hsa; identical to SEQ ID NO: 253580

SEQ ID NO: 469637 - RNA, 66 nt, hsa; identical to SEQ ID NO: 253581

SEQ ID NO: 469638 - RNA, 66 nt, hsa; identical to SEQ ID NO: 253582

SEQ ID NO: 469639 - RNA, 66 nt, hsa; identical to SEQ ID NO: 253583

SEQ ID NO: 469640 - RNA, 66 nt, hsa; identical to SEQ ID NO: 253584

SEQ ID NO: 469641 - RNA, 66 nt, hsa; identical to SEQ ID NO: 253585

SEQ ID NO: 469642 - RNA, 66 nt, hsa; identical to SEQ ID NO: 253586

SEQ ID NO: 469643 - RNA, 66 nt, hsa; identical to SEQ ID NO: 253587

SEQ ID NO: 469644 - RNA, 66 nt, hsa; identical to SEQ ID NO: 253588

SEQ ID NO: 469645 - RNA, 66 nt, hsa; identical to SEQ ID NO: 253589

SEQ ID NO: 469646 - RNA, 66 nt, hsa; identical to SEQ ID NO: 253590

SEQ ID NO: 469647 - RNA, 66 nt, hsa; identical to SEQ ID NO: 253591

SEQ ID NO: 469648 - RNA, 66 nt, hsa; identical to SEQ ID NO: 253592

SEQ ID NO: 469649 - RNA, 66 nt, hsa; identical to SEQ ID NO: 253593

SEQ ID NO: 469650 - RNA, 66 nt, hsa; identical to SEQ ID NO: 253594

SEQ ID NO: 469651 - RNA, 66 nt, hsa; identical to SEQ ID NO: 253595

SEQ ID NO: 469652 - RNA, 66 nt, hsa; identical to SEQ ID NO: 253596

SEQ ID NO: 469653 - RNA, 66 nt, hsa; identical to SEQ ID NO: 253597

SEQ ID NO: 469654 - RNA, 66 nt, hsa; identical to SEQ ID NO: 253598

SEQ ID NO: 469655 - RNA, 66 nt, hsa; identical to SEQ ID NO: 253599

SEQ ID NO: 469656 - RNA, 66 nt, hsa; identical to SEQ ID NO: 253600

SEQ ID NO: 469657 - RNA, 66 nt, hsa; identical to SEQ ID NO: 253601

SEQ ID NO: 469658 - RNA, 66 nt, hsa; identical to SEQ ID NO: 253602

SEQ ID NO: 469659 - RNA, 66 nt, hsa; identical to SEQ ID NO: 253603

SEQ ID NO: 469660 - RNA, 66 nt, hsa; identical to SEQ ID NO: 253604

SEQ ID NO: 469661 - RNA, 66 nt, hsa; identical to SEQ ID NO: 253605

SEQ ID NO: 469662 - RNA, 66 nt, hsa; identical to SEQ ID NO: 253606

SEQ ID NO: 469663 - RNA, 66 nt, hsa; identical to SEQ ID NO: 253607

SEQ ID NO: 469664 - RNA, 66 nt, hsa; identical to SEQ ID NO: 253608

SEQ ID NO: 469665 - RNA, 66 nt, hsa; identical to SEQ ID NO: 253609

SEQ ID NO: 469666 - RNA, 66 nt, hsa; identical to SEQ ID NO: 253610

SEQ ID NO: 469667 - RNA, 66 nt, hsa; identical to SEQ ID NO: 253611

SEQ ID NO: 469668 - RNA, 66 nt, hsa; identical to SEQ ID NO: 253612

SEQ ID NO: 469669 - RNA, 66 nt, hsa; identical to SEQ ID NO: 253613

SEQ ID NO: 469670 - RNA, 66 nt, hsa; identical to SEQ ID NO: 253614

SEQ ID NO: 469671 - RNA, 66 nt, hsa; identical to SEQ ID NO: 253615

SEQ ID NO: 469672 - RNA, 66 nt, hsa; identical to SEQ ID NO: 253616

SEQ ID NO: 469673 - RNA, 66 nt, hsa; identical to SEQ ID NO: 253617

SEQ ID NO: 469674 - RNA, 66 nt, hsa; identical to SEQ ID NO: 253618

SEQ ID NO: 469675 - RNA, 66 nt, hsa; identical to SEQ ID NO: 253619

SEQ ID NO: 469676 - RNA, 66 nt, hsa; identical to SEQ ID NO: 253620

SEQ ID NO: 469677 - RNA, 66 nt, hsa; identical to SEQ ID NO: 253621

SEQ ID NO: 469678 - RNA, 66 nt, hsa; identical to SEQ ID NO: 253622

SEQ ID NO: 469679 - RNA, 66 nt, hsa; identical to SEQ ID NO: 253623

SEQ ID NO: 469680 - RNA, 66 nt, hsa; identical to SEQ ID NO: 253624

SEQ ID NO: 469681 - RNA, 66 nt, hsa; identical to SEQ ID NO: 253625

SEQ ID NO: 469682 - RNA, 66 nt, hsa; identical to SEQ ID NO: 253626

SEQ ID NO: 469683 - RNA, 66 nt, hsa; identical to SEQ ID NO: 253627

SEQ ID NO: 469684 - RNA, 66 nt, hsa; identical to SEQ ID NO: 253628

SEQ ID NO: 469685 - RNA, 66 nt, hsa; identical to SEQ ID NO: 253629

SEQ ID NO: 469686 - RNA, 66 nt, hsa; identical to SEQ ID NO: 253630

SEQ ID NO: 469687 - RNA, 66 nt, hsa; identical to SEQ ID NO: 253631

SEQ ID NO: 469688 - RNA, 66 nt, hsa; identical to SEQ ID NO: 253632

SEQ ID NO: 469689 - RNA, 66 nt, hsa; identical to SEQ ID NO: 253633

SEQ ID NO: 469690 - RNA, 66 nt, hsa; identical to SEQ ID NO: 253634

SEQ ID NO: 469691 - RNA, 66 nt, hsa; identical to SEQ ID NO: 253635

SEQ ID NO: 469692 - RNA, 66 nt, hsa; identical to SEQ ID NO: 253636

SEQ ID NO: 469693 - RNA, 66 nt, hsa; identical to SEQ ID NO: 253637

SEQ ID NO: 469694 - RNA, 66 nt, hsa; identical to SEQ ID NO: 253638

SEQ ID NO: 469695 - RNA, 66 nt, hsa; identical to SEQ ID NO: 253639

SEQ ID NO: 469696 - RNA, 66 nt, hsa; identical to SEQ ID NO: 253640

SEQ ID NO: 469697 - RNA, 66 nt, hsa; identical to SEQ ID NO: 253641

SEQ ID NO: 469698 - RNA, 66 nt, hsa; identical to SEQ ID NO: 253642

SEQ ID NO: 469699 - RNA, 66 nt, hsa; identical to SEQ ID NO: 253643

SEQ ID NO: 469700 - RNA, 66 nt, hsa; identical to SEQ ID NO: 253644

SEQ ID NO: 469701 - RNA, 66 nt, hsa; identical to SEQ ID NO: 253645

SEQ ID NO: 469702 - RNA, 66 nt, hsa; identical to SEQ ID NO: 253646

SEQ ID NO: 469703 - RNA, 66 nt, hsa; identical to SEQ ID NO: 253647

SEQ ID NO: 469704 - RNA, 66 nt, hsa; identical to SEQ ID NO: 253648

SEQ ID NO: 469705 - RNA, 66 nt, hsa; identical to SEQ ID NO: 253649

SEQ ID NO: 469706 - RNA, 66 nt, hsa; identical to SEQ ID NO: 253650

SEQ ID NO: 469707 - RNA, 66 nt, hsa; identical to SEQ ID NO: 253651

SEQ ID NO: 469708 - RNA, 66 nt, hsa; identical to SEQ ID NO: 253652

SEQ ID NO: 469709 - RNA, 66 nt, hsa; identical to SEQ ID NO: 253653

SEQ ID NO: 469710 - RNA, 66 nt, hsa; identical to SEQ ID NO: 253654

SEQ ID NO: 469711 - RNA, 66 nt, hsa; identical to SEQ ID NO: 253655

SEQ ID NO: 469712 - RNA, 66 nt, hsa; identical to SEQ ID NO: 253656

SEQ ID NO: 469713 - RNA, 66 nt, hsa; identical to SEQ ID NO: 253657

SEQ ID NO: 469714 - RNA, 66 nt, hsa; identical to SEQ ID NO: 253658

SEQ ID NO: 469715 - RNA, 63 nt, hsa; identical to SEQ ID NO: 103195

SEQ ID NO: 469716 - RNA, 51 nt, hsa; identical to SEQ ID NO: 103196

SEQ ID NO: 469717 - RNA, 66 nt, hsa; identical to SEQ ID NO: 253661

SEQ ID NO: 469718 - RNA, 66 nt, hsa; identical to SEQ ID NO: 253662

SEQ ID NO: 469719 - RNA, 66 nt, hsa; identical to SEQ ID NO: 253663

SEQ ID NO: 469720 - RNA, 66 nt, hsa; identical to SEQ ID NO: 253664

SEQ ID NO: 469721 - RNA, 66 nt, hsa; identical to SEQ ID NO: 253665

SEQ ID NO: 469722 - RNA, 66 nt, hsa; identical to SEQ ID NO: 253666

SEQ ID NO: 469723 - RNA, 66 nt, hsa; identical to SEQ ID NO: 253667

SEQ ID NO: 469724 - RNA, 66 nt, hsa; identical to SEQ ID NO: 253668

SEQ ID NO: 469725 - RNA, 66 nt, hsa; identical to SEQ ID NO: 253669

SEQ ID NO: 469726 - RNA, 66 nt, hsa; identical to SEQ ID NO: 253670

SEQ ID NO: 469727 - RNA, 66 nt, hsa; identical to SEQ ID NO: 253671

SEQ ID NO: 469728 - RNA, 66 nt, hsa; identical to SEQ ID NO: 253672

SEQ ID NO: 469729 - RNA, 66 nt, hsa; identical to SEQ ID NO: 253673

SEQ ID NO: 469730 - RNA, 66 nt, hsa; identical to SEQ ID NO: 253674

SEQ ID NO: 469731 - RNA, 66 nt, hsa; identical to SEQ ID NO: 253675

SEQ ID NO: 469732 - RNA, 66 nt, hsa; identical to SEQ ID NO: 253676

SEQ ID NO: 469733 - RNA, 66 nt, hsa; identical to SEQ ID NO: 253677

SEQ ID NO: 469734 - RNA, 66 nt, hsa; identical to SEQ ID NO: 253678

SEQ ID NO: 469735 - RNA, 66 nt, hsa; identical to SEQ ID NO: 253679

SEQ ID NO: 469736 - RNA, 66 nt, hsa; identical to SEQ ID NO: 253680

SEQ ID NO: 469737 - RNA, 66 nt, hsa; identical to SEQ ID NO: 253681

SEQ ID NO: 469738 - RNA, 66 nt, hsa; identical to SEQ ID NO: 253682

SEQ ID NO: 469739 - RNA, 66 nt, hsa; identical to SEQ ID NO: 253683

SEQ ID NO: 469740 - RNA, 66 nt, hsa; identical to SEQ ID NO: 253684

SEQ ID NO: 469741 - RNA, 66 nt, hsa; identical to SEQ ID NO: 253685

SEQ ID NO: 469742 - RNA, 66 nt, hsa; identical to SEQ ID NO: 253686

SEQ ID NO: 469743 - RNA, 66 nt, hsa; identical to SEQ ID NO: 253687

SEQ ID NO: 469744 - RNA, 66 nt, hsa; identical to SEQ ID NO: 253688

SEQ ID NO: 469745 - RNA, 66 nt, hsa; identical to SEQ ID NO: 253689

SEQ ID NO: 469746 - RNA, 66 nt, hsa; identical to SEQ ID NO: 253690

SEQ ID NO: 469747 - RNA, 66 nt, hsa; identical to SEQ ID NO: 253691

SEQ ID NO: 469748 - RNA, 66 nt, hsa; identical to SEQ ID NO: 253692

SEQ ID NO: 469749 - RNA, 66 nt, hsa; identical to SEQ ID NO: 253693

SEQ ID NO: 469750 - RNA, 66 nt, hsa; identical to SEQ ID NO: 253694

SEQ ID NO: 469751 - RNA, 66 nt, hsa; identical to SEQ ID NO: 253695

SEQ ID NO: 469752 - RNA, 66 nt, hsa; identical to SEQ ID NO: 253696

SEQ ID NO: 469753 - RNA, 66 nt, hsa; identical to SEQ ID NO: 253697

SEQ ID NO: 469754 - RNA, 66 nt, hsa; identical to SEQ ID NO: 253698

SEQ ID NO: 469755 - RNA, 66 nt, hsa; identical to SEQ ID NO: 253699

SEQ ID NO: 469756 - RNA, 66 nt, hsa; identical to SEQ ID NO: 253700

SEQ ID NO: 469757 - RNA, 66 nt, hsa; identical to SEQ ID NO: 253701

SEQ ID NO: 469758 - RNA, 66 nt, hsa; identical to SEQ ID NO: 253702

SEQ ID NO: 469759 - RNA, 66 nt, hsa; identical to SEQ ID NO: 253703

SEQ ID NO: 469760 - RNA, 66 nt, hsa; identical to SEQ ID NO: 253704

SEQ ID NO: 469761 - RNA, 66 nt, hsa; identical to SEQ ID NO: 253705

SEQ ID NO: 469762 - RNA, 66 nt, hsa; identical to SEQ ID NO: 253706

SEQ ID NO: 469763 - RNA, 66 nt, hsa; identical to SEQ ID NO: 253707

SEQ ID NO: 469764 - RNA, 66 nt, hsa; identical to SEQ ID NO: 253708

SEQ ID NO: 469765 - RNA, 66 nt, hsa; identical to SEQ ID NO: 253709

SEQ ID NO: 469766 - RNA, 66 nt, hsa; identical to SEQ ID NO: 253710

SEQ ID NO: 469767 - RNA, 66 nt, hsa; identical to SEQ ID NO: 253711

SEQ ID NO: 469768 - RNA, 66 nt, hsa; identical to SEQ ID NO: 253712

SEQ ID NO: 469769 - RNA, 66 nt, hsa; identical to SEQ ID NO: 253713

SEQ ID NO: 469770 - RNA, 66 nt, hsa; identical to SEQ ID NO: 253714

SEQ ID NO: 469771 - RNA, 66 nt, hsa; identical to SEQ ID NO: 253715

SEQ ID NO: 469772 - RNA, 66 nt, hsa; identical to SEQ ID NO: 253716

SEQ ID NO: 469773 - RNA, 66 nt, hsa; identical to SEQ ID NO: 253717

SEQ ID NO: 469774 - RNA, 66 nt, hsa; identical to SEQ ID NO: 253718

SEQ ID NO: 469775 - RNA, 66 nt, hsa; identical to SEQ ID NO: 253719

SEQ ID NO: 469776 - RNA, 66 nt, hsa; identical to SEQ ID NO: 253720

SEQ ID NO: 469777 - RNA, 66 nt, hsa; identical to SEQ ID NO: 253721

SEQ ID NO: 469778 - RNA, 66 nt, hsa; identical to SEQ ID NO: 253722

SEQ ID NO: 469779 - RNA, 66 nt, hsa; identical to SEQ ID NO: 253723

SEQ ID NO: 469780 - RNA, 66 nt, hsa; identical to SEQ ID NO: 253724

SEQ ID NO: 469781 - RNA, 66 nt, hsa; identical to SEQ ID NO: 253725

SEQ ID NO: 469782 - RNA, 66 nt, hsa; identical to SEQ ID NO: 253726

SEQ ID NO: 469783 - RNA, 66 nt, hsa; identical to SEQ ID NO: 253727

SEQ ID NO: 469784 - RNA, 66 nt, hsa; identical to SEQ ID NO: 253728

SEQ ID NO: 469785 - RNA, 66 nt, hsa; identical to SEQ ID NO: 253729

SEQ ID NO: 469786 - RNA, 66 nt, hsa; identical to SEQ ID NO: 253730

SEQ ID NO: 469787 - RNA, 66 nt, hsa; identical to SEQ ID NO: 253731

SEQ ID NO: 469788 - RNA, 66 nt, hsa; identical to SEQ ID NO: 253732

SEQ ID NO: 469789 - RNA, 66 nt, hsa; identical to SEQ ID NO: 253733

SEQ ID NO: 469790 - RNA, 66 nt, hsa; identical to SEQ ID NO: 253734

SEQ ID NO: 469791 - RNA, 66 nt, hsa; identical to SEQ ID NO: 253735

SEQ ID NO: 469792 - RNA, 66 nt, hsa; identical to SEQ ID NO: 253736

SEQ ID NO: 469793 - RNA, 66 nt, hsa; identical to SEQ ID NO: 253737

SEQ ID NO: 469794 - RNA, 66 nt, hsa; identical to SEQ ID NO: 253738

SEQ ID NO: 469795 - RNA, 66 nt, hsa; identical to SEQ ID NO: 253739

SEQ ID NO: 469796 - RNA, 66 nt, hsa; identical to SEQ ID NO: 253740

SEQ ID NO: 469797 - RNA, 66 nt, hsa; identical to SEQ ID NO: 253741

SEQ ID NO: 469798 - RNA, 66 nt, hsa; identical to SEQ ID NO: 253742

SEQ ID NO: 469799 - RNA, 66 nt, hsa; identical to SEQ ID NO: 253743

SEQ ID NO: 469800 - RNA, 66 nt, hsa; identical to SEQ ID NO: 253744

SEQ ID NO: 469801 - RNA, 66 nt, hsa; identical to SEQ ID NO: 253745

SEQ ID NO: 469802 - RNA, 66 nt, hsa; identical to SEQ ID NO: 253746

SEQ ID NO: 469803 - RNA, 66 nt, hsa; identical to SEQ ID NO: 253747

SEQ ID NO: 469804 - RNA, 66 nt, hsa; identical to SEQ ID NO: 253748

SEQ ID NO: 469805 - RNA, 66 nt, hsa; identical to SEQ ID NO: 253749

SEQ ID NO: 469806 - RNA, 66 nt, hsa; identical to SEQ ID NO: 253750

SEQ ID NO: 469807 - RNA, 66 nt, hsa; identical to SEQ ID NO: 253751

SEQ ID NO: 469808 - RNA, 66 nt, hsa; identical to SEQ ID NO: 253752

SEQ ID NO: 469809 - RNA, 65 nt, hsa
cgucugccuguuucgaaauggggaaagccgugcgugcgcguuauuuauuuaagugcgccugugug

SEQ ID NO: 469810 - RNA, 65 nt, hsa
ucccgucucaguggcuucucugaggugcuguacacgcgcguuaaccuguucccuucucuauccuu

SEQ ID NO: 469811 - RNA, 65 nt, hsa
ucuagggguggguaugaagaugcuucagagcucaugcgcguuacccacgauggcaugacuagcac

SEQ ID NO: 469812 - RNA, 65 nt, hsa
cccguguucccgaaguugcuaagugcccgagcgcagcgcguuaaguagagaagucuugguaguaa

SEQ ID NO: 469813 - RNA, 65 nt, hsa
uuuacucuugcuaaauaaaagugggaguggggcgugcgcguuauccauguauugccuuucagcuc

SEQ ID NO: 469814 - RNA, 65 nt, hsa
cuccggcuguuucacugcggacggcuggggcugcugcgcguuaccuugcugcaagcggggcgccu

SEQ ID NO: 469815 - RNA, 65 nt, hsa
aacaccaacacauccuacaaagccuucagcgcagcgcgcguuacagcccguguccgucugcucgu

SEQ ID NO: 469816 - RNA, 65 nt, hsa
uggaaggacgcuaaauaauaggauugcucauaccagcgcguuaugaacucacccuagcuuguaac

SEQ ID NO: 469817 - RNA, 65 nt, hsa
aaggccaucuggagacuccuggcuuucugaacuuugcgcguuaagccgggacagcugcuuugcug

SEQ ID NO: 469818 - RNA, 63 nt, hsa; identical to SEQ ID NO: 57615

SEQ ID NO: 469819 - RNA, 63 nt, hsa; identical to SEQ ID NO: 57616

SEQ ID NO: 469820 - RNA, 63 nt, hsa; identical to SEQ ID NO: 57617

SEQ ID NO: 469821 - RNA, 63 nt, hsa; identical to SEQ ID NO: 57618

SEQ ID NO: 469822 - RNA, 63 nt, hsa; identical to SEQ ID NO: 57619

SEQ ID NO: 469823 - RNA, 63 nt, hsa; identical to SEQ ID NO: 57620

SEQ ID NO: 469824 - RNA, 50 nt, hsa; identical to SEQ ID NO: 57621

SEQ ID NO: 469825 - RNA, 63 nt, hsa; identical to SEQ ID NO: 57622

SEQ ID NO: 469826 - RNA, 63 nt, hsa; identical to SEQ ID NO: 57623

SEQ ID NO: 469827 - RNA, 63 nt, hsa; identical to SEQ ID NO: 57624

SEQ ID NO: 469828 - RNA, 63 nt, hsa; identical to SEQ ID NO: 57625

SEQ ID NO: 469829 - RNA, 63 nt, hsa; identical to SEQ ID NO: 57626

SEQ ID NO: 469830 - RNA, 63 nt, hsa; identical to SEQ ID NO: 57627

SEQ ID NO: 469831 - RNA, 63 nt, hsa; identical to SEQ ID NO: 57628

SEQ ID NO: 469832 - RNA, 63 nt, hsa; identical to SEQ ID NO: 57629

SEQ ID NO: 469833 - RNA, 63 nt, hsa; identical to SEQ ID NO: 57630

SEQ ID NO: 469834 - RNA, 63 nt, hsa; identical to SEQ ID NO: 57631

SEQ ID NO: 469835 - RNA, 63 nt, hsa; identical to SEQ ID NO: 57632

SEQ ID NO: 469836 - RNA, 63 nt, hsa; identical to SEQ ID NO: 57633

SEQ ID NO: 469837 - RNA, 63 nt, hsa; identical to SEQ ID NO: 102980

SEQ ID NO: 469838 - RNA, 63 nt, hsa; identical to SEQ ID NO: 102981

SEQ ID NO: 469839 - RNA, 63 nt, hsa; identical to SEQ ID NO: 102982

SEQ ID NO: 469840 - RNA, 63 nt, hsa; identical to SEQ ID NO: 102983

SEQ ID NO: 469841 - RNA, 63 nt, hsa; identical to SEQ ID NO: 102984

SEQ ID NO: 469842 - RNA, 63 nt, hsa; identical to SEQ ID NO: 102985

SEQ ID NO: 469843 - RNA, 63 nt, hsa; identical to SEQ ID NO: 102986

SEQ ID NO: 469844 - RNA, 63 nt, hsa; identical to SEQ ID NO: 102987

SEQ ID NO: 469845 - RNA, 63 nt, hsa; identical to SEQ ID NO: 102988

SEQ ID NO: 469846 - RNA, 63 nt, hsa; identical to SEQ ID NO: 102989

SEQ ID NO: 469847 - RNA, 63 nt, hsa; identical to SEQ ID NO: 102990

SEQ ID NO: 469848 - RNA, 58 nt, hsa; identical to SEQ ID NO: 102991

SEQ ID NO: 469849 - RNA, 63 nt, hsa; identical to SEQ ID NO: 102992

SEQ ID NO: 469850 - RNA, 63 nt, hsa; identical to SEQ ID NO: 102993

SEQ ID NO: 469851 - RNA, 63 nt, hsa; identical to SEQ ID NO: 102994

SEQ ID NO: 469852 - RNA, 63 nt, hsa; identical to SEQ ID NO: 102995

SEQ ID NO: 469853 - RNA, 63 nt, hsa; identical to SEQ ID NO: 102996

SEQ ID NO: 469854 - RNA, 63 nt, hsa; identical to SEQ ID NO: 102997

SEQ ID NO: 469855 - RNA, 63 nt, hsa; identical to SEQ ID NO: 102998

SEQ ID NO: 469856 - RNA, 63 nt, hsa; identical to SEQ ID NO: 102999

SEQ ID NO: 469857 - RNA, 63 nt, hsa; identical to SEQ ID NO: 103000

SEQ ID NO: 469858 - RNA, 63 nt, hsa; identical to SEQ ID NO: 103001

SEQ ID NO: 469859 - RNA, 63 nt, hsa; identical to SEQ ID NO: 103002

SEQ ID NO: 469860 - RNA, 63 nt, hsa; identical to SEQ ID NO: 103003

SEQ ID NO: 469861 - RNA, 63 nt, hsa; identical to SEQ ID NO: 103004

SEQ ID NO: 469862 - RNA, 63 nt, hsa; identical to SEQ ID NO: 103005

SEQ ID NO: 469863 - RNA, 63 nt, hsa; identical to SEQ ID NO: 103006

SEQ ID NO: 469864 - RNA, 63 nt, hsa; identical to SEQ ID NO: 103007

SEQ ID NO: 469865 - RNA, 63 nt, hsa; identical to SEQ ID NO: 103008

SEQ ID NO: 469866 - RNA, 63 nt, hsa; identical to SEQ ID NO: 103009

SEQ ID NO: 469867 - RNA, 63 nt, hsa; identical to SEQ ID NO: 103010

SEQ ID NO: 469868 - RNA, 63 nt, hsa; identical to SEQ ID NO: 103011

SEQ ID NO: 469869 - RNA, 63 nt, hsa; identical to SEQ ID NO: 103012

SEQ ID NO: 469870 - RNA, 63 nt, hsa; identical to SEQ ID NO: 103013

SEQ ID NO: 469871 - RNA, 53 nt, hsa; identical to SEQ ID NO: 103014

SEQ ID NO: 469872 - RNA, 63 nt, hsa; identical to SEQ ID NO: 103015

SEQ ID NO: 469873 - RNA, 63 nt, hsa; identical to SEQ ID NO: 103016

SEQ ID NO: 469874 - RNA, 63 nt, hsa; identical to SEQ ID NO: 103017

SEQ ID NO: 469875 - RNA, 63 nt, hsa; identical to SEQ ID NO: 103018

SEQ ID NO: 469876 - RNA, 63 nt, hsa; identical to SEQ ID NO: 103019

SEQ ID NO: 469877 - RNA, 63 nt, hsa; identical to SEQ ID NO: 103020

SEQ ID NO: 469878 - RNA, 63 nt, hsa; identical to SEQ ID NO: 103021

SEQ ID NO: 469879 - RNA, 63 nt, hsa; identical to SEQ ID NO: 103022

SEQ ID NO: 469880 - RNA, 63 nt, hsa; identical to SEQ ID NO: 103023

SEQ ID NO: 469881 - RNA, 63 nt, hsa; identical to SEQ ID NO: 103024

SEQ ID NO: 469882 - RNA, 63 nt, hsa; identical to SEQ ID NO: 103025

SEQ ID NO: 469883 - RNA, 63 nt, hsa; identical to SEQ ID NO: 103026

SEQ ID NO: 469884 - RNA, 63 nt, hsa; identical to SEQ ID NO: 103027

SEQ ID NO: 469885 - RNA, 63 nt, hsa; identical to SEQ ID NO: 103028

SEQ ID NO: 469886 - RNA, 63 nt, hsa; identical to SEQ ID NO: 103029

SEQ ID NO: 469887 - RNA, 63 nt, hsa; identical to SEQ ID NO: 103030

SEQ ID NO: 469888 - RNA, 63 nt, hsa; identical to SEQ ID NO: 103031

SEQ ID NO: 469889 - RNA, 63 nt, hsa; identical to SEQ ID NO: 103032

SEQ ID NO: 469890 - RNA, 63 nt, hsa; identical to SEQ ID NO: 103033

SEQ ID NO: 469891 - RNA, 63 nt, hsa; identical to SEQ ID NO: 103034

SEQ ID NO: 469892 - RNA, 63 nt, hsa; identical to SEQ ID NO: 103035

SEQ ID NO: 469893 - RNA, 63 nt, hsa; identical to SEQ ID NO: 103036

SEQ ID NO: 469894 - RNA, 63 nt, hsa; identical to SEQ ID NO: 103037

SEQ ID NO: 469895 - RNA, 63 nt, hsa; identical to SEQ ID NO: 103038

SEQ ID NO: 469896 - RNA, 63 nt, hsa; identical to SEQ ID NO: 103039

SEQ ID NO: 469897 - RNA, 63 nt, hsa; identical to SEQ ID NO: 103040

SEQ ID NO: 469898 - RNA, 63 nt, hsa; identical to SEQ ID NO: 103041

SEQ ID NO: 469899 - RNA, 63 nt, hsa; identical to SEQ ID NO: 103042

SEQ ID NO: 469900 - RNA, 63 nt, hsa; identical to SEQ ID NO: 103043

SEQ ID NO: 469901 - RNA, 63 nt, hsa; identical to SEQ ID NO: 103044

SEQ ID NO: 469902 - RNA, 63 nt, hsa; identical to SEQ ID NO: 103045

SEQ ID NO: 469903 - RNA, 63 nt, hsa; identical to SEQ ID NO: 103046

SEQ ID NO: 469904 - RNA, 63 nt, hsa; identical to SEQ ID NO: 103047

SEQ ID NO: 469905 - RNA, 63 nt, hsa; identical to SEQ ID NO: 103048

SEQ ID NO: 469906 - RNA, 63 nt, hsa; identical to SEQ ID NO: 103049

SEQ ID NO: 469907 - RNA, 63 nt, hsa; identical to SEQ ID NO: 103050

SEQ ID NO: 469908 - RNA, 63 nt, hsa; identical to SEQ ID NO: 103051

SEQ ID NO: 469909 - RNA, 63 nt, hsa; identical to SEQ ID NO: 103052

SEQ ID NO: 469910 - RNA, 63 nt, hsa; identical to SEQ ID NO: 103053

SEQ ID NO: 469911 - RNA, 63 nt, hsa; identical to SEQ ID NO: 103054

SEQ ID NO: 469912 - RNA, 63 nt, hsa; identical to SEQ ID NO: 103055

SEQ ID NO: 469913 - RNA, 63 nt, hsa; identical to SEQ ID NO: 103056

SEQ ID NO: 469914 - RNA, 63 nt, hsa; identical to SEQ ID NO: 103057

SEQ ID NO: 469915 - RNA, 63 nt, hsa; identical to SEQ ID NO: 103058

SEQ ID NO: 469916 - RNA, 63 nt, hsa; identical to SEQ ID NO: 103059

SEQ ID NO: 469917 - RNA, 63 nt, hsa; identical to SEQ ID NO: 103060

SEQ ID NO: 469918 - RNA, 63 nt, hsa; identical to SEQ ID NO: 103061

SEQ ID NO: 469919 - RNA, 63 nt, hsa; identical to SEQ ID NO: 103062

SEQ ID NO: 469920 - RNA, 63 nt, hsa; identical to SEQ ID NO: 103063

SEQ ID NO: 469921 - RNA, 63 nt, hsa; identical to SEQ ID NO: 103064

SEQ ID NO: 469922 - RNA, 63 nt, hsa; identical to SEQ ID NO: 103065

SEQ ID NO: 469923 - RNA, 63 nt, hsa; identical to SEQ ID NO: 103066

SEQ ID NO: 469924 - RNA, 63 nt, hsa; identical to SEQ ID NO: 103067

SEQ ID NO: 469925 - RNA, 63 nt, hsa; identical to SEQ ID NO: 103068

SEQ ID NO: 469926 - RNA, 63 nt, hsa; identical to SEQ ID NO: 103069

SEQ ID NO: 469927 - RNA, 63 nt, hsa; identical to SEQ ID NO: 103070

SEQ ID NO: 469928 - RNA, 63 nt, hsa; identical to SEQ ID NO: 103071

SEQ ID NO: 469929 - RNA, 63 nt, hsa; identical to SEQ ID NO: 103072

SEQ ID NO: 469930 - RNA, 63 nt, hsa; identical to SEQ ID NO: 103073

SEQ ID NO: 469931 - RNA, 63 nt, hsa; identical to SEQ ID NO: 103074

SEQ ID NO: 469932 - RNA, 63 nt, hsa; identical to SEQ ID NO: 103075

SEQ ID NO: 469933 - RNA, 63 nt, hsa; identical to SEQ ID NO: 103076

SEQ ID NO: 469934 - RNA, 63 nt, hsa; identical to SEQ ID NO: 103077

SEQ ID NO: 469935 - RNA, 63 nt, hsa; identical to SEQ ID NO: 103078

SEQ ID NO: 469936 - RNA, 63 nt, hsa; identical to SEQ ID NO: 103079

SEQ ID NO: 469937 - RNA, 63 nt, hsa; identical to SEQ ID NO: 103080

SEQ ID NO: 469938 - RNA, 63 nt, hsa; identical to SEQ ID NO: 103081

SEQ ID NO: 469939 - RNA, 63 nt, hsa; identical to SEQ ID NO: 103082

SEQ ID NO: 469940 - RNA, 63 nt, hsa; identical to SEQ ID NO: 103083

SEQ ID NO: 469941 - RNA, 63 nt, hsa; identical to SEQ ID NO: 103084

SEQ ID NO: 469942 - RNA, 63 nt, hsa; identical to SEQ ID NO: 103085

SEQ ID NO: 469943 - RNA, 63 nt, hsa; identical to SEQ ID NO: 103086

SEQ ID NO: 469944 - RNA, 63 nt, hsa; identical to SEQ ID NO: 103087

SEQ ID NO: 469945 - RNA, 63 nt, hsa; identical to SEQ ID NO: 103088

SEQ ID NO: 469946 - RNA, 63 nt, hsa; identical to SEQ ID NO: 103089

SEQ ID NO: 469947 - RNA, 63 nt, hsa; identical to SEQ ID NO: 103090

SEQ ID NO: 469948 - RNA, 63 nt, hsa; identical to SEQ ID NO: 103091

SEQ ID NO: 469949 - RNA, 63 nt, hsa; identical to SEQ ID NO: 103092

SEQ ID NO: 469950 - RNA, 63 nt, hsa; identical to SEQ ID NO: 103093

SEQ ID NO: 469951 - RNA, 63 nt, hsa; identical to SEQ ID NO: 103094

SEQ ID NO: 469952 - RNA, 63 nt, hsa; identical to SEQ ID NO: 103095

SEQ ID NO: 469953 - RNA, 63 nt, hsa; identical to SEQ ID NO: 103096

SEQ ID NO: 469954 - RNA, 63 nt, hsa; identical to SEQ ID NO: 103097

SEQ ID NO: 469955 - RNA, 60 nt, hsa; identical to SEQ ID NO: 103098

SEQ ID NO: 469956 - RNA, 63 nt, hsa; identical to SEQ ID NO: 103099

SEQ ID NO: 469957 - RNA, 63 nt, hsa; identical to SEQ ID NO: 103100

SEQ ID NO: 469958 - RNA, 63 nt, hsa; identical to SEQ ID NO: 103101

SEQ ID NO: 469959 - RNA, 63 nt, hsa; identical to SEQ ID NO: 103102

SEQ ID NO: 469960 - RNA, 63 nt, hsa; identical to SEQ ID NO: 103103

SEQ ID NO: 469961 - RNA, 63 nt, hsa; identical to SEQ ID NO: 103104

SEQ ID NO: 469962 - RNA, 63 nt, hsa; identical to SEQ ID NO: 103105

SEQ ID NO: 469963 - RNA, 63 nt, hsa; identical to SEQ ID NO: 103106

SEQ ID NO: 469964 - RNA, 63 nt, hsa; identical to SEQ ID NO: 103107

SEQ ID NO: 469965 - RNA, 63 nt, hsa; identical to SEQ ID NO: 103108

SEQ ID NO: 469966 - RNA, 63 nt, hsa; identical to SEQ ID NO: 103109

SEQ ID NO: 469967 - RNA, 63 nt, hsa; identical to SEQ ID NO: 103110

SEQ ID NO: 469968 - RNA, 63 nt, hsa; identical to SEQ ID NO: 103111

SEQ ID NO: 469969 - RNA, 63 nt, hsa; identical to SEQ ID NO: 103112

SEQ ID NO: 469970 - RNA, 63 nt, hsa; identical to SEQ ID NO: 103113

SEQ ID NO: 469971 - RNA, 63 nt, hsa; identical to SEQ ID NO: 103114

SEQ ID NO: 469972 - RNA, 63 nt, hsa; identical to SEQ ID NO: 103115

SEQ ID NO: 469973 - RNA, 63 nt, hsa; identical to SEQ ID NO: 103116

SEQ ID NO: 469974 - RNA, 63 nt, hsa; identical to SEQ ID NO: 103117

SEQ ID NO: 469975 - RNA, 63 nt, hsa; identical to SEQ ID NO: 103118

SEQ ID NO: 469976 - RNA, 63 nt, hsa; identical to SEQ ID NO: 103119

SEQ ID NO: 469977 - RNA, 63 nt, hsa; identical to SEQ ID NO: 103120

SEQ ID NO: 469978 - RNA, 63 nt, hsa; identical to SEQ ID NO: 103121

SEQ ID NO: 469979 - RNA, 63 nt, hsa; identical to SEQ ID NO: 103122

SEQ ID NO: 469980 - RNA, 63 nt, hsa; identical to SEQ ID NO: 103123

SEQ ID NO: 469981 - RNA, 63 nt, hsa; identical to SEQ ID NO: 103124

SEQ ID NO: 469982 - RNA, 63 nt, hsa; identical to SEQ ID NO: 103125

SEQ ID NO: 469983 - RNA, 63 nt, hsa; identical to SEQ ID NO: 103126

SEQ ID NO: 469984 - RNA, 63 nt, hsa; identical to SEQ ID NO: 103127

SEQ ID NO: 469985 - RNA, 63 nt, hsa; identical to SEQ ID NO: 103128

SEQ ID NO: 469986 - RNA, 63 nt, hsa; identical to SEQ ID NO: 103129

SEQ ID NO: 469987 - RNA, 63 nt, hsa; identical to SEQ ID NO: 103130

SEQ ID NO: 469988 - RNA, 63 nt, hsa; identical to SEQ ID NO: 103131

SEQ ID NO: 469989 - RNA, 63 nt, hsa; identical to SEQ ID NO: 103132

SEQ ID NO: 469990 - RNA, 63 nt, hsa; identical to SEQ ID NO: 103133

SEQ ID NO: 469991 - RNA, 63 nt, hsa; identical to SEQ ID NO: 103134

SEQ ID NO: 469992 - RNA, 63 nt, hsa; identical to SEQ ID NO: 103135

SEQ ID NO: 469993 - RNA, 63 nt, hsa; identical to SEQ ID NO: 103136

SEQ ID NO: 469994 - RNA, 63 nt, hsa; identical to SEQ ID NO: 103137

SEQ ID NO: 469995 - RNA, 63 nt, hsa; identical to SEQ ID NO: 103138

SEQ ID NO: 469996 - RNA, 63 nt, hsa; identical to SEQ ID NO: 103139

SEQ ID NO: 469997 - RNA, 63 nt, hsa; identical to SEQ ID NO: 103140

SEQ ID NO: 469998 - RNA, 63 nt, hsa; identical to SEQ ID NO: 103141

SEQ ID NO: 469999 - RNA, 63 nt, hsa; identical to SEQ ID NO: 103142

SEQ ID NO: 470000 - RNA, 63 nt, hsa; identical to SEQ ID NO: 103143

SEQ ID NO: 470001 - RNA, 63 nt, hsa; identical to SEQ ID NO: 103144

SEQ ID NO: 470002 - RNA, 63 nt, hsa; identical to SEQ ID NO: 103145

SEQ ID NO: 470003 - RNA, 63 nt, hsa; identical to SEQ ID NO: 103146

SEQ ID NO: 470004 - RNA, 63 nt, hsa; identical to SEQ ID NO: 103147

SEQ ID NO: 470005 - RNA, 63 nt, hsa; identical to SEQ ID NO: 103148

SEQ ID NO: 470006 - RNA, 63 nt, hsa; identical to SEQ ID NO: 103149

SEQ ID NO: 470007 - RNA, 63 nt, hsa; identical to SEQ ID NO: 103150

SEQ ID NO: 470008 - RNA, 63 nt, hsa; identical to SEQ ID NO: 103151

SEQ ID NO: 470009 - RNA, 63 nt, hsa; identical to SEQ ID NO: 103152

SEQ ID NO: 470010 - RNA, 63 nt, hsa; identical to SEQ ID NO: 103153

SEQ ID NO: 470011 - RNA, 63 nt, hsa; identical to SEQ ID NO: 103154

SEQ ID NO: 470012 - RNA, 63 nt, hsa; identical to SEQ ID NO: 103155

SEQ ID NO: 470013 - RNA, 63 nt, hsa; identical to SEQ ID NO: 103156

SEQ ID NO: 470014 - RNA, 63 nt, hsa; identical to SEQ ID NO: 103157

SEQ ID NO: 470015 - RNA, 63 nt, hsa; identical to SEQ ID NO: 103158

SEQ ID NO: 470016 - RNA, 63 nt, hsa; identical to SEQ ID NO: 103159

SEQ ID NO: 470017 - RNA, 63 nt, hsa; identical to SEQ ID NO: 103160

SEQ ID NO: 470018 - RNA, 63 nt, hsa; identical to SEQ ID NO: 103161

SEQ ID NO: 470019 - RNA, 63 nt, hsa; identical to SEQ ID NO: 103162

SEQ ID NO: 470020 - RNA, 63 nt, hsa; identical to SEQ ID NO: 103163

SEQ ID NO: 470021 - RNA, 63 nt, hsa; identical to SEQ ID NO: 103164

SEQ ID NO: 470022 - RNA, 63 nt, hsa; identical to SEQ ID NO: 103165

SEQ ID NO: 470023 - RNA, 63 nt, hsa; identical to SEQ ID NO: 103166

SEQ ID NO: 470024 - RNA, 63 nt, hsa; identical to SEQ ID NO: 103167

SEQ ID NO: 470025 - RNA, 63 nt, hsa; identical to SEQ ID NO: 103168

SEQ ID NO: 470026 - RNA, 63 nt, hsa; identical to SEQ ID NO: 103169

SEQ ID NO: 470027 - RNA, 63 nt, hsa; identical to SEQ ID NO: 103170

SEQ ID NO: 470028 - RNA, 63 nt, hsa; identical to SEQ ID NO: 103171

SEQ ID NO: 470029 - RNA, 63 nt, hsa; identical to SEQ ID NO: 103172

SEQ ID NO: 470030 - RNA, 63 nt, hsa; identical to SEQ ID NO: 103173

SEQ ID NO: 470031 - RNA, 63 nt, hsa; identical to SEQ ID NO: 103174

SEQ ID NO: 470032 - RNA, 63 nt, hsa; identical to SEQ ID NO: 103175

SEQ ID NO: 470033 - RNA, 63 nt, hsa; identical to SEQ ID NO: 103176

SEQ ID NO: 470034 - RNA, 63 nt, hsa; identical to SEQ ID NO: 103177

SEQ ID NO: 470035 - RNA, 63 nt, hsa; identical to SEQ ID NO: 103178

SEQ ID NO: 470036 - RNA, 63 nt, hsa; identical to SEQ ID NO: 103179

SEQ ID NO: 470037 - RNA, 63 nt, hsa; identical to SEQ ID NO: 103180

SEQ ID NO: 470038 - RNA, 63 nt, hsa; identical to SEQ ID NO: 103181

SEQ ID NO: 470039 - RNA, 63 nt, hsa; identical to SEQ ID NO: 103182

SEQ ID NO: 470040 - RNA, 63 nt, hsa; identical to SEQ ID NO: 103183

SEQ ID NO: 470041 - RNA, 63 nt, hsa; identical to SEQ ID NO: 103184

SEQ ID NO: 470042 - RNA, 63 nt, hsa; identical to SEQ ID NO: 103185

SEQ ID NO: 470043 - RNA, 63 nt, hsa; identical to SEQ ID NO: 103186

SEQ ID NO: 470044 - RNA, 63 nt, hsa; identical to SEQ ID NO: 103187

SEQ ID NO: 470045 - RNA, 63 nt, hsa; identical to SEQ ID NO: 103188

SEQ ID NO: 470046 - RNA, 63 nt, hsa; identical to SEQ ID NO: 103189

SEQ ID NO: 470047 - RNA, 63 nt, hsa; identical to SEQ ID NO: 103190

SEQ ID NO: 470048 - RNA, 63 nt, hsa; identical to SEQ ID NO: 103191

SEQ ID NO: 470049 - RNA, 63 nt, hsa; identical to SEQ ID NO: 103192

SEQ ID NO: 470050 - RNA, 63 nt, hsa; identical to SEQ ID NO: 103193

SEQ ID NO: 470051 - RNA, 63 nt, hsa; identical to SEQ ID NO: 103194

SEQ ID NO: 470052 - RNA, 63 nt, hsa; identical to SEQ ID NO: 103195

SEQ ID NO: 470053 - RNA, 51 nt, hsa; identical to SEQ ID NO: 103196

SEQ ID NO: 470054 - RNA, 63 nt, hsa; identical to SEQ ID NO: 103197

SEQ ID NO: 470055 - RNA, 63 nt, hsa; identical to SEQ ID NO: 103198

SEQ ID NO: 470056 - RNA, 63 nt, hsa; identical to SEQ ID NO: 103199

SEQ ID NO: 470057 - RNA, 63 nt, hsa; identical to SEQ ID NO: 103200

SEQ ID NO: 470058 - RNA, 63 nt, hsa; identical to SEQ ID NO: 103201

SEQ ID NO: 470059 - RNA, 63 nt, hsa; identical to SEQ ID NO: 103202

SEQ ID NO: 470060 - RNA, 63 nt, hsa; identical to SEQ ID NO: 103203

SEQ ID NO: 470061 - RNA, 63 nt, hsa; identical to SEQ ID NO: 103204

SEQ ID NO: 470062 - RNA, 63 nt, hsa; identical to SEQ ID NO: 103205

SEQ ID NO: 470063 - RNA, 63 nt, hsa; identical to SEQ ID NO: 103206

SEQ ID NO: 470064 - RNA, 63 nt, hsa; identical to SEQ ID NO: 103207

SEQ ID NO: 470065 - RNA, 63 nt, hsa; identical to SEQ ID NO: 103208

SEQ ID NO: 470066 - RNA, 63 nt, hsa; identical to SEQ ID NO: 103209

SEQ ID NO: 470067 - RNA, 63 nt, hsa; identical to SEQ ID NO: 103210

SEQ ID NO: 470068 - RNA, 63 nt, hsa; identical to SEQ ID NO: 103211

SEQ ID NO: 470069 - RNA, 63 nt, hsa; identical to SEQ ID NO: 103212

SEQ ID NO: 470070 - RNA, 63 nt, hsa; identical to SEQ ID NO: 103213

SEQ ID NO: 470071 - RNA, 63 nt, hsa; identical to SEQ ID NO: 103214

SEQ ID NO: 470072 - RNA, 63 nt, hsa; identical to SEQ ID NO: 103215

SEQ ID NO: 470073 - RNA, 63 nt, hsa; identical to SEQ ID NO: 103216

SEQ ID NO: 470074 - RNA, 63 nt, hsa; identical to SEQ ID NO: 103217

SEQ ID NO: 470075 - RNA, 63 nt, hsa; identical to SEQ ID NO: 103218

SEQ ID NO: 470076 - RNA, 63 nt, hsa; identical to SEQ ID NO: 103219

SEQ ID NO: 470077 - RNA, 63 nt, hsa; identical to SEQ ID NO: 103220

SEQ ID NO: 470078 - RNA, 63 nt, hsa; identical to SEQ ID NO: 103221

SEQ ID NO: 470079 - RNA, 63 nt, hsa; identical to SEQ ID NO: 103222

SEQ ID NO: 470080 - RNA, 63 nt, hsa; identical to SEQ ID NO: 103223

SEQ ID NO: 470081 - RNA, 63 nt, hsa; identical to SEQ ID NO: 103224

SEQ ID NO: 470082 - RNA, 63 nt, hsa; identical to SEQ ID NO: 103225

SEQ ID NO: 470083 - RNA, 63 nt, hsa; identical to SEQ ID NO: 103226

SEQ ID NO: 470084 - RNA, 63 nt, hsa; identical to SEQ ID NO: 103227

SEQ ID NO: 470085 - RNA, 63 nt, hsa; identical to SEQ ID NO: 103228

SEQ ID NO: 470086 - RNA, 63 nt, hsa; identical to SEQ ID NO: 103229

SEQ ID NO: 470087 - RNA, 63 nt, hsa; identical to SEQ ID NO: 103230

SEQ ID NO: 470088 - RNA, 63 nt, hsa; identical to SEQ ID NO: 103231

SEQ ID NO: 470089 - RNA, 63 nt, hsa; identical to SEQ ID NO: 103232

SEQ ID NO: 470090 - RNA, 63 nt, hsa; identical to SEQ ID NO: 103233

SEQ ID NO: 470091 - RNA, 63 nt, hsa; identical to SEQ ID NO: 103234

SEQ ID NO: 470092 - RNA, 63 nt, hsa; identical to SEQ ID NO: 103235

SEQ ID NO: 470093 - RNA, 63 nt, hsa; identical to SEQ ID NO: 103236

SEQ ID NO: 470094 - RNA, 63 nt, hsa; identical to SEQ ID NO: 103237

SEQ ID NO: 470095 - RNA, 63 nt, hsa; identical to SEQ ID NO: 103238

SEQ ID NO: 470096 - RNA, 63 nt, hsa; identical to SEQ ID NO: 103239

SEQ ID NO: 470097 - RNA, 63 nt, hsa; identical to SEQ ID NO: 103240

SEQ ID NO: 470098 - RNA, 63 nt, hsa; identical to SEQ ID NO: 103241

SEQ ID NO: 470099 - RNA, 63 nt, hsa; identical to SEQ ID NO: 103242

SEQ ID NO: 470100 - RNA, 63 nt, hsa; identical to SEQ ID NO: 103243

SEQ ID NO: 470101 - RNA, 63 nt, hsa; identical to SEQ ID NO: 103244

SEQ ID NO: 470102 - RNA, 63 nt, hsa; identical to SEQ ID NO: 103245

SEQ ID NO: 470103 - RNA, 63 nt, hsa; identical to SEQ ID NO: 103246

SEQ ID NO: 470104 - RNA, 63 nt, hsa; identical to SEQ ID NO: 103247

SEQ ID NO: 470105 - RNA, 63 nt, hsa; identical to SEQ ID NO: 103248

SEQ ID NO: 470106 - RNA, 63 nt, hsa; identical to SEQ ID NO: 103249

SEQ ID NO: 470107 - RNA, 63 nt, hsa; identical to SEQ ID NO: 103250

SEQ ID NO: 470108 - RNA, 63 nt, hsa; identical to SEQ ID NO: 103251

SEQ ID NO: 470109 - RNA, 63 nt, hsa; identical to SEQ ID NO: 103252

SEQ ID NO: 470110 - RNA, 63 nt, hsa; identical to SEQ ID NO: 103253

SEQ ID NO: 470111 - RNA, 63 nt, hsa; identical to SEQ ID NO: 103254

SEQ ID NO: 470112 - RNA, 63 nt, hsa; identical to SEQ ID NO: 103255

SEQ ID NO: 470113 - RNA, 63 nt, hsa; identical to SEQ ID NO: 103256

SEQ ID NO: 470114 - RNA, 63 nt, hsa; identical to SEQ ID NO: 103257

SEQ ID NO: 470115 - RNA, 63 nt, hsa; identical to SEQ ID NO: 103258

SEQ ID NO: 470116 - RNA, 63 nt, hsa; identical to SEQ ID NO: 103259

SEQ ID NO: 470117 - RNA, 63 nt, hsa; identical to SEQ ID NO: 103260

SEQ ID NO: 470118 - RNA, 63 nt, hsa; identical to SEQ ID NO: 103261

SEQ ID NO: 470119 - RNA, 63 nt, hsa; identical to SEQ ID NO: 103262

SEQ ID NO: 470120 - RNA, 63 nt, hsa; identical to SEQ ID NO: 103263

SEQ ID NO: 470121 - RNA, 63 nt, hsa; identical to SEQ ID NO: 103264

SEQ ID NO: 470122 - RNA, 63 nt, hsa; identical to SEQ ID NO: 103265

SEQ ID NO: 470123 - RNA, 63 nt, hsa; identical to SEQ ID NO: 103266

SEQ ID NO: 470124 - RNA, 63 nt, hsa; identical to SEQ ID NO: 103267

SEQ ID NO: 470125 - RNA, 63 nt, hsa; identical to SEQ ID NO: 103268

SEQ ID NO: 470126 - RNA, 63 nt, hsa; identical to SEQ ID NO: 103269

SEQ ID NO: 470127 - RNA, 63 nt, hsa; identical to SEQ ID NO: 103270

SEQ ID NO: 470128 - RNA, 63 nt, hsa; identical to SEQ ID NO: 103271

SEQ ID NO: 470129 - RNA, 63 nt, hsa; identical to SEQ ID NO: 103272

SEQ ID NO: 470130 - RNA, 63 nt, hsa; identical to SEQ ID NO: 103273

SEQ ID NO: 470131 - RNA, 63 nt, hsa; identical to SEQ ID NO: 103274

SEQ ID NO: 470132 - RNA, 63 nt, hsa; identical to SEQ ID NO: 103275

SEQ ID NO: 470133 - RNA, 63 nt, hsa; identical to SEQ ID NO: 103276

SEQ ID NO: 470134 - RNA, 63 nt, hsa; identical to SEQ ID NO: 103277

SEQ ID NO: 470135 - RNA, 63 nt, hsa; identical to SEQ ID NO: 103278

SEQ ID NO: 470136 - RNA, 63 nt, hsa; identical to SEQ ID NO: 103279

SEQ ID NO: 470137 - RNA, 63 nt, hsa; identical to SEQ ID NO: 103280

SEQ ID NO: 470138 - RNA, 63 nt, hsa; identical to SEQ ID NO: 103281

SEQ ID NO: 470139 - RNA, 63 nt, hsa; identical to SEQ ID NO: 103282

SEQ ID NO: 470140 - RNA, 63 nt, hsa; identical to SEQ ID NO: 103283

SEQ ID NO: 470141 - RNA, 63 nt, hsa; identical to SEQ ID NO: 103284

SEQ ID NO: 470142 - RNA, 63 nt, hsa; identical to SEQ ID NO: 103285

SEQ ID NO: 470143 - RNA, 63 nt, hsa; identical to SEQ ID NO: 103286

SEQ ID NO: 470144 - RNA, 63 nt, hsa; identical to SEQ ID NO: 103287

SEQ ID NO: 470145 - RNA, 63 nt, hsa; identical to SEQ ID NO: 103288

SEQ ID NO: 470146 - RNA, 65 nt, hsa
gaagaccguacucaguaacaggccggaaaauugugcucuagaagaauaaaacugaaaaacucuag

SEQ ID NO: 470147 - RNA, 65 nt, hsa
gucauaagguaaacauucuauauauucuaugccugcucuagaauugaaagacuucagcaguauua

SEQ ID NO: 470148 - RNA, 65 nt, hsa
aacuccacaucugccuuaaaaccaaagagggcuuccucuagaagccaagggaaaggggugcuuuu

SEQ ID NO: 470149 - RNA, 65 nt, hsa
gaaggaacauuauggagagaaaggguacugaggcacucuagaaucugccacauucauuuucaaau

SEQ ID NO: 470150 - RNA, 65 nt, hsa
ugaggcagcuggaauuggaacucagauuuguugaacucuagaacuaaagaucauaauguugucuu

SEQ ID NO: 470151 - RNA, 65 nt, hsa
guuucagaguucaaggaagaagcaaaauaucacaucucuagaaguguugggaaaaauauaauuuc

SEQ ID NO: 470152 - RNA, 65 nt, hsa
uuacuccuaaguuauuucucauagaacccagccuacucuagaauuucagcagugacauuggagaa

SEQ ID NO: 470153 - RNA, 65 nt, hsa
caaaauacaccagcucauuuggcugcucagucuaacucuagaauggaugcuuuugaauucauuuc

SEQ ID NO: 470154 - RNA, 65 nt, hsa
guuagagaggaauuaacuuccuggucugugcccuucucuagaagaauauaagaugcuccuccucc

SEQ ID NO: 470155 - RNA, 65 nt, hsa
uggcugggaggaaagugcugggcaucuuacaguaacucuagaaguuccuuugacuaggcugcaau

SEQ ID NO: 470156 - RNA, 65 nt, hsa
cccugaagccauuggagagcugucuuccuguguaccucuagaaucccagcagcagagaaccauca

SEQ ID NO: 470157 - RNA, 58 nt, hsa; identical to SEQ ID NO: 102991

SEQ ID NO: 470158 - RNA, 65 nt, hsa
agagaaguauguggacaucucuucuuuuccugucccucuagaagaacauucucccuugcuugaug

SEQ ID NO: 470159 - RNA, 65 nt, hsa
ucuuaagauccucacagcacgggagcagggagaggcucuagaacaagguuucacaaccgagaugc

SEQ ID NO: 470160 - RNA, 65 nt, hsa
aucucauuacccuuuucuggguuugaagcugcugucucuagaagugccaucucaauugugcuuug

SEQ ID NO: 470161 - RNA, 65 nt, hsa
aguguccagaccauugucuuccaaccccagcuggccucuagaacacccacuggccaguccuagag

SEQ ID NO: 470162 - RNA, 65 nt, hsa
uguguuaucaaggaauuguacugugcuacaauuaucucuagaaucuccagaaagguggagggcug

SEQ ID NO: 470163 - RNA, 65 nt, hsa
ugaguccugauccuaacccugggcucccuggaggacucuagaagcucagguucccugccacacua

SEQ ID NO: 470164 - RNA, 65 nt, hsa
gcucuguuuugcccaggggcucccgcuuuuucuugcucuagaagagcaguauucaaccuuuuagc

SEQ ID NO: 470165 - RNA, 65 nt, hsa
uccagacuauggauguguucucuaggccuucaggacucuagaauguccauauuuauuuuuauguu

SEQ ID NO: 470166 - RNA, 65 nt, hsa
ugcaguaacaaacuccagucuguugcaguaacaaacucuagaauauugacauucucuguggggga

SEQ ID NO: 470167 - RNA, 65 nt, hsa
caucccucuuagcuguagucuauauuagggcaguucucuagaacgcccacauuuccaccaacuca

SEQ ID NO: 470168 - RNA, 65 nt, hsa
agcuaguagguucugcuguuaugcagagccauuuccucuagaauuuggauaauaaagaugcuuau

SEQ ID NO: 470169 - RNA, 65 nt, hsa
uaaugacaauguagcuugaaagcgaugaagaaugucucuagaagagaaugaaggauugaagaauu

SEQ ID NO: 470170 - RNA, 65 nt, hsa
auugaauauauugguugcucauuuuugaagagagucucuagaauauagauuuucacuucuuuuga

SEQ ID NO: 470171 - RNA, 65 nt, hsa
auaugauaugauaauccuaccaauuuucaagaagucucuagaaagagauaacacauggaaagacg

SEQ ID NO: 470172 - RNA, 65 nt, hsa
aagccagccauauuacucuagucccuaccaaacugcucuagaaggucauuuccauuuuguuugug

SEQ ID NO: 470173 - RNA, 65 nt, hsa
agauugaaaguaagaaaacggauuuaggaugaaaacucuagaacuacccuaugcuguuuauacug

SEQ ID NO: 470174 - RNA, 65 nt, hsa
aacuacagucagauuuauagccagccaucuaucaccucuagaagguuccagagacagugaaacug

SEQ ID NO: 470175 - RNA, 65 nt, hsa
gauccucuuuaaaaaaaaaaaaguuuuuguuauaucucuagaacauuucaagucuuuuccuuuuu

SEQ ID NO: 470176 - RNA, 65 nt, hsa
gccacagaacguauagaguuaaccaaagugcucuucucuagaaucuuuacaccuccugugugguu

SEQ ID NO: 470177 - RNA, 65 nt, hsa
cuaguccccuaaauuucuguucuaguuuuaaauuucucuagaacuugcaauaguuggggguuuua

SEQ ID NO: 470178 - RNA, 65 nt, hsa
aagucucggccuccacauuaaccauaggauguugacucuagaaccuggacccacccagcgcgucc

SEQ ID NO: 470179 - RNA, 65 nt, hsa
cuuuuaauuuucuugugagauaauauucuaagaggcucuagaaacaugaaauacucaguagugau

SEQ ID NO: 470180 - RNA, 53 nt, hsa; identical to SEQ ID NO: 103014

SEQ ID NO: 470181 - RNA, 65 nt, hsa
ugaggacaccauguacuauaaccaguuaaauggaacucuagaauaucaagggagcaagaggaagc

SEQ ID NO: 470182 - RNA, 65 nt, hsa
guaaucaaaaacaaagaagcccuauaagaccauuucucuagaacagauguucuuaauauuuuucu

SEQ ID NO: 470183 - RNA, 65 nt, hsa
uuuggagcauguggucuuuuuaaaaaauuguaacccucuagaaaauaucaaagaaaugaaccaga

SEQ ID NO: 470184 - RNA, 65 nt, hsa
acaguuacugagaauuguugugcuuugacaguuaacucuagaaagaaagaacacuaccacugcaa

SEQ ID NO: 470185 - RNA, 65 nt, hsa
gaagaaaaaaguacugugaccugagagacacccuccucuagaauuuaguggcgggucugggcugg

SEQ ID NO: 470186 - RNA, 65 nt, hsa
aucugaaacacauguguaacaaucaaaauggugggcucuagaaugguuuuggagcucgagaucuu

SEQ ID NO: 470187 - RNA, 65 nt, hsa
auggucuccauucaggcaaguguguuucagcaaaucucuagaaauuuacauugauuaaaauguua

SEQ ID NO: 470188 - RNA, 65 nt, hsa
ucuuugauaauuguuauuuuuuuggcagauaauuccucuagaauguguaucuuuuuaugauuuag

SEQ ID NO: 470189 - RNA, 65 nt, hsa
aaugacccaacauuucuuagcaugagcuaccucaucucuagaagcugggauggacuuacuauucu

SEQ ID NO: 470190 - RNA, 65 nt, hsa
cagaaacaccuuaaguguauacuguuguguaaugucucuagaaaggaauccugucuuaaaacugg

SEQ ID NO: 470191 - RNA, 65 nt, hsa
uccugcuaccuaaaggauauaaagaaauacuauugcucuagaauguauuacuuuguucucccaug

SEQ ID NO: 470192 - RNA, 65 nt, hsa
aaggccuagaaccaguuuuaagauuaugccuacaucucuagaagacuaguacacuggcaucaucu

SEQ ID NO: 470193 - RNA, 65 nt, hsa
cugccugggcccaaggggugaugaggcauccuuuccucuagaagaccugagucuuccugaccgac

SEQ ID NO: 470194 - RNA, 65 nt, hsa
uucuagacaaaaaccauuguugaugaggcagaugccucuagaagagacguuuaaaagccaucaaa

SEQ ID NO: 470195 - RNA, 65 nt, hsa
agaaguuccacaucaucuuaucgaucaagaagcuacucuagaagucggagcagaggaugguacag

SEQ ID NO: 470196 - RNA, 65 nt, hsa
auuguccuguugccaaacaaaagccagucauguaacucuagaagcagugacugguggggcuuucu

SEQ ID NO: 470197 - RNA, 65 nt, hsa
uugugaugcuucuggggcacguugaccauaugcaccucuagaaccuaaccagggcuuccuucuac

SEQ ID NO: 470198 - RNA, 65 nt, hsa
augagagcguuccuugaguccguacaccguccucccucuagaagcuggcaucacacucaugcugg

SEQ ID NO: 470199 - RNA, 65 nt, hsa
aauaugaaguuccccaaggaaacgaacaaaaugaacucuagaauaucuagcaaauaguuaaagaa

SEQ ID NO: 470200 - RNA, 65 nt, hsa
guugcauggaagagaacaccucuuuauggcuuacccucuagaauuucuaauuuauguguucuguu

SEQ ID NO: 470201 - RNA, 65 nt, hsa
cuagcaccugggucccagcaucuagagcauggagccucuagaagccaugcucacccgcccacauu

SEQ ID NO: 470202 - RNA, 65 nt, hsa
cacaucaggaaagagagcaccacgugauggaguuucucuagaagcuccagugauaagagauguug

SEQ ID NO: 470203 - RNA, 65 nt, hsa
ggaagugugacucaaucuugccugccuucugggagcucuagaauuguucccaacccaguccaugg

SEQ ID NO: 470204 - RNA, 65 nt, hsa
cgucccuuccccagagaccuucagugccauccugacucuagaaggccccccacagcagggcguag

SEQ ID NO: 470205 - RNA, 65 nt, hsa
ggccuugaaagaaccgaagucuuucccauucacuucucuagaaagcugccaagacagaggcagaa

SEQ ID NO: 470206 - RNA, 65 nt, hsa
uuggcaggcuccaggcaggguccucugggaaguuacucuagaaaacgaagggaggaggagcacaa

SEQ ID NO: 470207 - RNA, 65 nt, hsa
gcaaaacauaaccauauguguuuugcguuuacuuccucuagaaaagaauuugcaggcaaccaugu

SEQ ID NO: 470208 - RNA, 65 nt, hsa
uuggaagaaacaacuucuuuaaagagcuucuuuggcucuagaaaaauuucaaacaauuaaaauaa

SEQ ID NO: 470209 - RNA, 65 nt, hsa
aagaaauaauuuuuuucaaauaagaaaauuguguacucuagaaauggagaccgauuuacaauuua

SEQ ID NO: 470210 - RNA, 65 nt, hsa
auuacuccuccuccagauaccaacugcugauguugcucuagaaaaaccaccaaacaugacuguuc

SEQ ID NO: 470211 - RNA, 65 nt, hsa
cugauuaggauuugauuucuugaaacccucuaggucucuagaacacugaggacaguuucuuuuga

SEQ ID NO: 470212 - RNA, 65 nt, hsa
ugggacuuuauuuucacauaagucaauagauguuucucuagaacaaaauauuuaguaaagcuuua

SEQ ID NO: 470213 - RNA, 65 nt, hsa
acuuaaaaaauguccaugauggaauauuccccuaucucuagaauuuuaagugcuuuguaauggga

SEQ ID NO: 470214 - RNA, 65 nt, hsa
agguaauuuuacacaugcuggaaugacuguaauuacucuagaauuccaaguagaauacaauaacu

SEQ ID NO: 470215 - RNA, 65 nt, hsa
aagauaacucuuaaaaaaccgucgagauuacaaugcucuagaaucagcauauaagaaaauaaaug

SEQ ID NO: 470216 - RNA, 65 nt, hsa
auacaauauuacauuacagccuguauucauuuguucucuagaaguuuugucagaauuuugacuug

SEQ ID NO: 470217 - RNA, 65 nt, hsa
cuauuguaacuacacugggcaucagaauaaaaggccucuagaaauugcugaacaaugguuaauua

SEQ ID NO: 470218 - RNA, 65 nt, hsa
gcucucuccuucauuaauuuaaauauuuuuaucggcucuagaaaaugcauaagguuaguacaaga

SEQ ID NO: 470219 - RNA, 65 nt, hsa
uucacucucugcacugacuuuuuaauuauuuaaaacucuagaaagaugaacaaagguuaauuuaa

SEQ ID NO: 470220 - RNA, 65 nt, hsa
caacuauucuguugugacuaugagaacauuucugucucuagaagucaucugucuguauugaucuu

SEQ ID NO: 470221 - RNA, 65 nt, hsa
ccauucuccuauuuaccaguccuguccuauauacccucuagaaacagaaagcaauuuuuaggcag

SEQ ID NO: 470222 - RNA, 65 nt, hsa
uaagugucacauuucucuaagaugaaagauuuuuacucuagaaacugugcgagcacaacacacac

SEQ ID NO: 470223 - RNA, 65 nt, hsa
ugcagcuuugggaaagcugccucguuucccuuuuccucuagaagcagaaccagcucuacgagagu

SEQ ID NO: 470224 - RNA, 65 nt, hsa
ugaaugcccugacucuaccagcgcccauaaaugaucucuagaaggacuguuaguaccaaucuguu

SEQ ID NO: 470225 - RNA, 65 nt, hsa
acaaaauauaccauaggcuaaaacuaaggcuuucacucuagaaugcaaagcuguuuugcagcugu

SEQ ID NO: 470226 - RNA, 65 nt, hsa
gauucccaucugcugcucuuuguagaaaagguuuccucuagaacugaauuccucuggaauugagu

SEQ ID NO: 470227 - RNA, 65 nt, hsa
uguguaaacauugagcucaccuuuuauauauuaaccucuagaauuaaugggccuaugugguuuuu

SEQ ID NO: 470228 - RNA, 65 nt, hsa
aauaaaauauuuagcccuuccuugguagguagcuucucuagaauuuaauugugcuuuuuuuuuuu

SEQ ID NO: 470229 - RNA, 65 nt, hsa
uauacuuugccaaagcugucaucuuguaauauaugcucuagaaaugacauaaagguuuaugggga

SEQ ID NO: 470230 - RNA, 65 nt, hsa
uagaaccugaaauauuguuuucuuccuugaauuuucucuagaaaugcagaaauuaggaaggugau

SEQ ID NO: 470231 - RNA, 65 nt, hsa
gggugaaucuuguuuuuuuuaucuuuaaaauauaucucuagaacuuaaagcugaaaucugcaaau

SEQ ID NO: 470232 - RNA, 65 nt, hsa
caaaccucaagggauuuagugcccugucucccugucucuagaagccuuagccugggcaccuggcu

SEQ ID NO: 470233 - RNA, 65 nt, hsa
aaugaaaugggaaucaguggucuuacuauauacuucucuagaagagauuacuuaagacuguguca

SEQ ID NO: 470234 - RNA, 65 nt, hsa
cccauggugggaaacagccaccgagaagguucuagcucuagaaagggacuaaacuuauucucuca

SEQ ID NO: 470235 - RNA, 65 nt, hsa
caguucuuacccaguuaacaugaagaaaccacugucucuagaagaaagcuuguuuugcaguauua

SEQ ID NO: 470236 - RNA, 65 nt, hsa
gugaccaguugcacauguuuuccccuaaaagcuuacucuagaaaggauauuuuuuggagagggag

SEQ ID NO: 470237 - RNA, 65 nt, hsa
uuccuuaucucccucagacgcagaguuuuuaguuucucuagaaauuuuguuucauauuaggaaua

SEQ ID NO: 470238 - RNA, 65 nt, hsa
uggaucauuaagaugaagagaguaauucacauuuacucuagaaccuuuaacaagcacugaaagga

SEQ ID NO: 470239 - RNA, 65 nt, hsa
ucugucacaggauuaauuaauugccgguuuucauacucuagaaggcugaaacugauguuuaucuu

SEQ ID NO: 470240 - RNA, 65 nt, hsa
aauaauauauuucacaucuuuauuauugcaguuuucucuagaaagcucugagaagcuuucucugc

SEQ ID NO: 470241 - RNA, 65 nt, hsa
uucauugaggaacuguugauuggcaggcacugauucucuagaacacugggcaugaggauguugca

SEQ ID NO: 470242 - RNA, 65 nt, hsa
uuuacuuuucagguaauuauggaaaauauuuuaaacucuagaagcuucaauaaugaugugugauu

SEQ ID NO: 470243 - RNA, 65 nt, hsa
uuucucugugugcuuugugguugcugucauauuugcucuagaagaaaaaaaaaaaaggaggggaa

SEQ ID NO: 470244 - RNA, 65 nt, hsa
uacacauuuuauacuuuucauaaaccacaaagucucucuagaauuuuuucugccuucacuaaaau

SEQ ID NO: 470245 - RNA, 65 nt, hsa
cagcuccugggcucaagugauccucuagacucagccucuagaauagcugggacuacaggcacaug

SEQ ID NO: 470246 - RNA, 65 nt, hsa
cucagccuuuugggaauaauagcacaugauuugggcucuagaauuccaguccccuuucucggggu

SEQ ID NO: 470247 - RNA, 65 nt, hsa
ucuuguucuucaguauuuuguuuuucucaaaaaugcucuagaacuuuccuuggcacauauaaaag

SEQ ID NO: 470248 - RNA, 65 nt, hsa
ucuuccaauaauguuagaguucauguaaucacauucucuagaaccauuuaguuuguguuaacuau

SEQ ID NO: 470249 - RNA, 65 nt, hsa
ugaagaggucuugcagucuucagaugaaacuaaaucucuagaagaggcacaagaauggcuaaagc

SEQ ID NO: 470250 - RNA, 65 nt, hsa
agaaaggauccacuacuucuuguucuuaugaaugacucuagaaaaaucagaaucaaguugugggu

SEQ ID NO: 470251 - RNA, 65 nt, hsa
aacuucacuaaugaucacauucuuuccaaaaggaacucuagaagaccaaaugccccgaguuaaga

SEQ ID NO: 470252 - RNA, 65 nt, hsa
ucacgugaaauauuuaaguauauaguauauuuauacucuagaacaugcacauuuauauauauaug

SEQ ID NO: 470253 - RNA, 65 nt, hsa
aaaaaaccuaaacucuucaggcuaccuuugugugucucuagaagagaaaagcaucuaucuggaga

SEQ ID NO: 470254 - RNA, 65 nt, hsa
acugaauaaacaucagaguauuuuaaaaaacaguucucuagaaagaacuguuauaauuaaaauga

SEQ ID NO: 470255 - RNA, 65 nt, hsa
gaaaacuccugugcuuuugagcaaggacuuuugcccucuagaaagcaacugaggccaggugcggu

SEQ ID NO: 470256 - RNA, 65 nt, hsa
auacugugucaaaaugauaauuuuguuauguuagccucuagaaaauuuaaguucagaaaaaugca

SEQ ID NO: 470257 - RNA, 65 nt, hsa
cuugcuuauagaggcaaaccacaguaucauuuuaacucuagaauugggcuuguacagaaggauaa

SEQ ID NO: 470258 - RNA, 65 nt, hsa
ggauuuugagucauaggucuguaauuuauagagaucucuagaauucuuauuguaauuuuccuacu

SEQ ID NO: 470259 - RNA, 65 nt, hsa
uccuuucaacucuguugacccucugucuggucuuccucuagaagguaccgcagaaauugaugugu

SEQ ID NO: 470260 - RNA, 65 nt, hsa
uccacucagggcuucuccucugcuaggcuacccuccucuagaaggcugaguaccaugggcuacag

SEQ ID NO: 470261 - RNA, 65 nt, hsa
gagaagaccaaaccccacauccuccuuuccccucucucuagaaucaucucgcaccaccaguuaca

SEQ ID NO: 470262 - RNA, 65 nt, hsa
uuauugcauugcauucagaguaaccugugugcauacucuagaagaguagggaaaauaaugcuugu

SEQ ID NO: 470263 - RNA, 65 nt, hsa
cagggauuaaaaauaaggauaaacacuaauaagagcucuagaaaaaagggaacagaaagucugcc

SEQ ID NO: 470264 - RNA, 60 nt, hsa; identical to SEQ ID NO: 103098

SEQ ID NO: 470265 - RNA, 65 nt, hsa
gcaugagccaccgcaccuggccuucccugcuuccucucuagaauccaauuagggauguuuguuac

SEQ ID NO: 470266 - RNA, 65 nt, hsa
uccguuuucauugucaagaauguuacuguaguauucucuagaacuucaaugucuuuguggacauu

SEQ ID NO: 470267 - RNA, 65 nt, hsa
guuuaauuuuuaagcucuuugccaauauuccauuucucuagaauguuuauccuaagcacuuguuu

SEQ ID NO: 470268 - RNA, 65 nt, hsa
acccagcuugcuaaauuaggcuauaccuagguaaucucuagaagacaacucugacagacucuuua

SEQ ID NO: 470269 - RNA, 65 nt, hsa
uauuuuucaucaugcacgaauuaauaaucaucauacucuagaaucuugucugucacucacuacau

SEQ ID NO: 470270 - RNA, 65 nt, hsa
uauuucuagguuuguaagugcagcaguuuuauuuccucuagaacucauccuguuucaagggaagu

SEQ ID NO: 470271 - RNA, 65 nt, hsa
cucuaagaauuuuccacuucuucaaaaugaacuuacucuagaaagcuuacccuuggauaaccagu

SEQ ID NO: 470272 - RNA, 65 nt, hsa
ggugcuggugaguauuaccuuucaucugugccaugcucuagaaccuugaccuugauaguucacca

SEQ ID NO: 470273 - RNA, 65 nt, hsa
gugcuuaaugaucaaguguuacuuaucuaauaauccucuagaaagaacccuguuagaucuugguu

SEQ ID NO: 470274 - RNA, 65 nt, hsa
gcaggggaaacucuggugccggggagggcacgaggcucuagaaaugcccuucacuuucuccuggu

SEQ ID NO: 470275 - RNA, 65 nt, hsa
cuucuccaccugcccaccgggacacucccccugcucucuagaaaggaacucucuuucuucucuug

SEQ ID NO: 470276 - RNA, 65 nt, hsa
cucuucuaguuuugacauuuuaugauagauuugcucucuagaaggaaacgucuuuauuuaggagg

SEQ ID NO: 470277 - RNA, 65 nt, hsa
aaaugcagacucaaaccuucccaacaucuuuaugacucuagaauaaucauauugaugaaaucgua

SEQ ID NO: 470278 - RNA, 65 nt, hsa
uuuuuguuuuuugguuuuuuuuuuuacccagacaacucuagaaaugcggaccaaacuacuucauu

SEQ ID NO: 470279 - RNA, 65 nt, hsa
ccagugcgugaagaccaacaaagucacagucguaucucuagaaagcucuaaagaccauguuggaa

SEQ ID NO: 470280 - RNA, 65 nt, hsa
ugaauuccugcuuguuaauuacauaauaugugaugcucuagaaaauagucacaaguauuaauaau

SEQ ID NO: 470281 - RNA, 65 nt, hsa
cuuaagaccaaaaacuguaauauccuuuagaaaugcucuagaagaucuguauuguguagaaugau

SEQ ID NO: 470282 - RNA, 65 nt, hsa
aacaugauagccaauggugagggaaaaggagguuucucuagaagagucugaugaaaggccgggaa

SEQ ID NO: 470283 - RNA, 65 nt, hsa
uuaagcuuugucagguuaauguagcauguuaaggacucuagaaaaaaauaaacuaaggagacgag

SEQ ID NO: 470284 - RNA, 65 nt, hsa
uuauauucggggauaugaaggauucaaugaaugaucucuagaaagauuuaaagaagaauauucag

SEQ ID NO: 470285 - RNA, 65 nt, hsa
uggguuccacccuaacuuggggaaacaaaagccuucucuagaaucugaaggccaggcuuaccucu

SEQ ID NO: 470286 - RNA, 65 nt, hsa
aauaggaaucaauaguuaguagugacauuggugcucucuagaaaucucagcaugagcugcuauag

SEQ ID NO: 470287 - RNA, 65 nt, hsa
uaacaggccugcuagcucagccgacgcucuggacacucuagaaaucacuccucagugugaccucc

SEQ ID NO: 470288 - RNA, 65 nt, hsa
uccuaguccugaguauaaauccugugcauagauuccucuagaaaggcaucaaaaggcucaacaga

SEQ ID NO: 470289 - RNA, 65 nt, hsa
aaaaauggguucagggucuuguccuuagcuacuagcucuagaaaagucccaaaagcagcagaagg

SEQ ID NO: 470290 - RNA, 65 nt, hsa
aaacuggacuguuccugggaaaagggugaagccaccucuagaagggacuuuggccuccccccaag

SEQ ID NO: 470291 - RNA, 65 nt, hsa
uguuguguguaugguacuagcacaccacugcaugucucuagaaugcuguugccacuuacgggggc

SEQ ID NO: 470292 - RNA, 65 nt, hsa
acgugucuucuaagagcuguucaauacaguauucacucuagaaacaauuaucuuuuucucuuaau

SEQ ID NO: 470293 - RNA, 65 nt, hsa
auuaauaguaaagguaaaaucucucaguuuccuaccucuagaaagaggccaucucacuagaauag

SEQ ID NO: 470294 - RNA, 65 nt, hsa
aaccccaaacuuucaccaaaagcaauaaagaggaacucuagaacuggagccaggacuaagugaga

SEQ ID NO: 470295 - RNA, 65 nt, hsa
ucaauucaggagcuuugaaggaaguccaaggaaagcucuagaaaacaguauaaacuuucagaggc

SEQ ID NO: 470296 - RNA, 65 nt, hsa
uuaaucuucuagaagaaaaaucuccgaagagcucucucuagaaguccaaaauggcuagccauuau

SEQ ID NO: 470297 - RNA, 65 nt, hsa
gguagcugaugucagcuucauguggauuuuaagcacucuagaaacaaugaagcuucuuggcauau

SEQ ID NO: 470298 - RNA, 65 nt, hsa
acuccugccacuagguuucaccucccaaacccagccucuagaacagccagacccugcagaucccc

SEQ ID NO: 470299 - RNA, 65 nt, hsa
aagacagugucuaaauauaagacaauauugaucagcucuagaauaacuuuaaagaaagacguguu

SEQ ID NO: 470300 - RNA, 65 nt, hsa
aguucuuugcauuuggcucuacuuacuaacaaccccucuagaauacauuggugauuucauuuaaa

SEQ ID NO: 470301 - RNA, 65 nt, hsa
uuuuguaguacauguuuuuacuaauaauucuuguucucuagaaagcuuucuauuucuaaccuaug

SEQ ID NO: 470302 - RNA, 65 nt, hsa
ugugaaugguaguugaggucuucauacaguucagccucuagaaugguaacaaaucagccaauugg

SEQ ID NO: 470303 - RNA, 65 nt, hsa
guaggaauugagcgguuccccaccuccuaccccuacucuagaaacacacuagacagaugucuccu

SEQ ID NO: 470304 - RNA, 65 nt, hsa
cagcaggguucaguuucauguaucuuugucuuuuccucuagaaccugccuuuuucaaauaucccu

SEQ ID NO: 470305 - RNA, 65 nt, hsa
uccugccacugucccaacucuuucccucuacgucucucuagaaugacaucuuuaaaccccuuaca

SEQ ID NO: 470306 - RNA, 65 nt, hsa
aaggagauuuaguuuuacugcuuugacuggugggucucuagaagcaaaacugagugauaacucau

SEQ ID NO: 470307 - RNA, 65 nt, hsa
uuccauaguuuuguuuugguuuauuuuuaacaacgcucuagaaacaaagucaaauuaaucacaaa

SEQ ID NO: 470308 - RNA, 65 nt, hsa
ggucucuuuagaacuugauggcugggcacugccaucucuagaauugccacgagucucucucuucc

SEQ ID NO: 470309 - RNA, 65 nt, hsa
ugggguguacuaguuacacaucuucaacagacccccucuagaaauuuuucagaugcuucugggag

SEQ ID NO: 470310 - RNA, 65 nt, hsa
gcagcagcuguggucauuaaaccauuaguuuaccccucuagaacuggggucugcaaacucccacc

SEQ ID NO: 470311 - RNA, 65 nt, hsa
agcuacagcacuaagagaagccccugagaaaaacccucuagaaaaacagcuguuccucugugugg

SEQ ID NO: 470312 - RNA, 65 nt, hsa
uuuucccucuguggccuccuggcuugcacugcucccucuagaaagauuccuucaggucuggaggc

SEQ ID NO: 470313 - RNA, 65 nt, hsa
ucucaguggacaguaugcacucagcugaccacucucucuagaaauagucaagauaugaacuaaga

SEQ ID NO: 470314 - RNA, 65 nt, hsa
ucgccuuguuaugcacaagagauucuauuaaaagccucuagaaguaacuccccuuaaaaugucua

SEQ ID NO: 470315 - RNA, 65 nt, hsa
ccgccuugugcuagugcccucgagaagaguuauugcucuagaaaguugaguucucauuuuuuuaa

SEQ ID NO: 470316 - RNA, 65 nt, hsa
ggaucccggcggcaaggagaacagaacacugaagacucuagaaaagcaaagccggauuucuggaa

SEQ ID NO: 470317 - RNA, 65 nt, hsa
uacauacucugcuucucucugucagcguccugcugcucuagaagacuguccguggaugaguuuag

SEQ ID NO: 470318 - RNA, 65 nt, hsa
cuaagcugaagguguacuucaccagcaagagucaacucuagaauucaggauguuccuucuauugu

SEQ ID NO: 470319 - RNA, 65 nt, hsa
uuuuuuccuuuuuuucuugauuaggucuggaacagcucuagaaugaacacauaaaauuuagcaau

SEQ ID NO: 470320 - RNA, 65 nt, hsa
caagugauuuugauguauucuaauuuugagaccaucucuagaaaagaauugcuaccucuuguaug

SEQ ID NO: 470321 - RNA, 65 nt, hsa
cuuucacuucaagacuuuccuucuuuucacuaaaacucuagaagguguuacaagggggagggaag

SEQ ID NO: 470322 - RNA, 65 nt, hsa
uguccuaggcccuagggauccaacuggcugucugccucuagaacucuccacccucaucucucugc

SEQ ID NO: 470323 - RNA, 65 nt, hsa
cagcugguaaaggggugcuggaggccauggaggagcucuagaaacauuagcaugggcugaucuga

SEQ ID NO: 470324 - RNA, 65 nt, hsa
uuuuauggcauaugucuccgauuuagaugguuauucucuagaaaauaguauuuaaagacauuuua

SEQ ID NO: 470325 - RNA, 65 nt, hsa
accucauccccaccccaccucaccccaacaaacuccucuagaagaagccaagaauuucucucuau

SEQ ID NO: 470326 - RNA, 65 nt, hsa
uccugaugcuuggaccccuuuuauugaucagagugcucuagaauaauggauggucuuggaugaug

SEQ ID NO: 470327 - RNA, 65 nt, hsa
ugucauuauuuuaaugaaugugagcucuugacuuacucuagaauucuaauacagauacuuucugc

SEQ ID NO: 470328 - RNA, 65 nt, hsa
gucuauuguuugaucuaguuauuuuaauaaaggaacucuagaaguuucaaguggccagugaagug

SEQ ID NO: 470329 - RNA, 65 nt, hsa
ugaaauaaguaggacugaguauuuaugugaaaacucucuagaagguaaaaauaaagauaauucuu

SEQ ID NO: 470330 - RNA, 65 nt, hsa
ugguuuucuguguaauuccagaugagucacuguaacucuagaagauuaaccuuccagccaaccua

SEQ ID NO: 470331 - RNA, 65 nt, hsa
ccuccucgcccuuucuuaaagugcaguucuuagcccucuagaaacgaguuggugucuuucgucuc

SEQ ID NO: 470332 - RNA, 65 nt, hsa
aagccccaaagcauauaaucucuacuccuuacagucucuagaauuaaauguacucauuuagacaa

SEQ ID NO: 470333 - RNA, 65 nt, hsa
guacuaccuuacgugauagcauacaaagaagaaagcucuagaaagagaaauuauggagaaugauu

SEQ ID NO: 470334 - RNA, 65 nt, hsa
acacuuaccccacagcugguuacugacaacacaagcucuagaauucauguuuguuuguuuguuuu

SEQ ID NO: 470335 - RNA, 65 nt, hsa
uuagaaaaauguggauaaacagucaaaccuuuauccucuagaauuuuggcaauguugacuaagaa

SEQ ID NO: 470336 - RNA, 65 nt, hsa
gacauccugaagaaaugguaaggguggagccaaaucucuagaaauaaguagugaggccguuaauu

SEQ ID NO: 470337 - RNA, 65 nt, hsa
cuaacccugacugugggcuugagaacaaagaugaacucuagaacucuagcagccuaacugcugcu

SEQ ID NO: 470338 - RNA, 65 nt, hsa
acuaccauuugaauauuuucauuugguguuuuccccucuagaaaacagaguugcuguuguuuuuu

SEQ ID NO: 470339 - RNA, 65 nt, hsa
cuccccagaucucuucccccauuccuucuuuugggcucuagaaagucuugccucauugaguguuu

SEQ ID NO: 470340 - RNA, 65 nt, hsa
acuuuuaucaagaugaagacauuuuacccuaccuacucuagaaauauacaacaauguuauauuuu

SEQ ID NO: 470341 - RNA, 65 nt, hsa
uagggcuaaugcugcauuuuucuacaacaucaugccucuagaagguuuaagcuagguaggcuuuc

SEQ ID NO: 470342 - RNA, 65 nt, hsa
aaaucuauuaucaacugcugcuucaccagacuuuucucuagaagcugucugcguuuacucuuguu

SEQ ID NO: 470343 - RNA, 65 nt, hsa
ugaggaacacugaacuaguuggaaauuacugcuuucucuagaaauauaaagcaaagcacuauucc

SEQ ID NO: 470344 - RNA, 65 nt, hsa
uuuuuuucagccacuaagaaccccucugcuuuuaacucuagaauuugggcuuggaccagaucuaa

SEQ ID NO: 470345 - RNA, 65 nt, hsa
guuggguuuucccuugccuuaugggcugaaguguucucuagaauccagcaggucacacugggggc

SEQ ID NO: 470346 - RNA, 65 nt, hsa
agagucugaggauguuaacuuuggaacucgcaguccucuagaacagcuucagauuauggcuuuuu

SEQ ID NO: 470347 - RNA, 65 nt, hsa
uugcugcucuccaaugcuaacuuucugacacagugcucuagaacccugccugugguccugagcac

SEQ ID NO: 470348 - RNA, 65 nt, hsa
aaaguugaggaaaugguugggaaucgcuguuagaacucuagaaauucuaaucugacuuugccacu

SEQ ID NO: 470349 - RNA, 65 nt, hsa
aggccuggacagccaggggcuccucgggcccugugcucuagaaggcccauucuaugucugcuucg

SEQ ID NO: 470350 - RNA, 65 nt, hsa
uagaaaagaaucugaacauuuaagugcgaaguuuucucuagaaauauauucaagauauguuuauu

SEQ ID NO: 470351 - RNA, 65 nt, hsa
gauuuauuuugcucgugcuuagcuaaauaugucaucucuagaaaagaugugguuuguuuuggcac

SEQ ID NO: 470352 - RNA, 65 nt, hsa
caccguucaaaugagcguagcccccugagucaucacucuagaagaaucuguacaucaucaggacu

SEQ ID NO: 470353 - RNA, 65 nt, hsa
ucaugguguucacucuacauaucagguuauggugucucuagaaucuguuguuuguuuccuauaag

SEQ ID NO: 470354 - RNA, 65 nt, hsa
aaaaugaagaccuacuuucaacuccuuuuuccccccucuagaagaaucaaauugaaucuuuuacu

SEQ ID NO: 470355 - RNA, 65 nt, hsa
ugaaggugauugguuuucuuuacagacuccuuguucucuagaagggcuuuuuacuugaauaaaac

SEQ ID NO: 470356 - RNA, 65 nt, hsa
uuuuugugaaugagaguuggcaugucaaaugcauccucuagaaaaauaauuaguguuauagucuu

SEQ ID NO: 470357 - RNA, 65 nt, hsa
gccacauagagccucucucuuuuccuguuucuuggcucuagaagaucagcacugcacuguuagcu

SEQ ID NO: 470358 - RNA, 65 nt, hsa
ucuggagaauuaucacaaccuaaugacauuaauaccucuagaaagggcugcugucauagugaaca

SEQ ID NO: 470359 - RNA, 65 nt, hsa
ugaacuugcagguccagguugguauacauuccacccucuagaaguauuuucuuacaguagauaag

SEQ ID NO: 470360 - RNA, 65 nt, hsa
caaauuggugauacuucuaaacuauaacuauaaaucucuagaauucugugaauuucaacauuauu

SEQ ID NO: 470361 - RNA, 63 nt, hsa; identical to SEQ ID NO: 103195

SEQ ID NO: 470362 - RNA, 51 nt, hsa; identical to SEQ ID NO: 103196

SEQ ID NO: 470363 - RNA, 65 nt, hsa
acgauuuccuguagaaguagcuuuaaugguuuuugcucuagaauaccguaggucuauccuuagag

SEQ ID NO: 470364 - RNA, 65 nt, hsa
cuccugccuccugggguccagugacugggacccuacucuagaacuguguaccauccaauucgcca

SEQ ID NO: 470365 - RNA, 65 nt, hsa
auucccuguaguugacaauucugcauguacuaguccucuagaaauagguuaaacugaagcaacuu

SEQ ID NO: 470366 - RNA, 65 nt, hsa
uccacgcacaugcgaccccgaggaaacgaaacccacucuagaaaacgcgaccuuggccgcaccua

SEQ ID NO: 470367 - RNA, 65 nt, hsa
cuugucugcucccacagcaccaucuaagaccccuccucuagaaguggggaaggccagauguguag

SEQ ID NO: 470368 - RNA, 65 nt, hsa
aaacuauguauauuuaaauuuaguaauuuucuaaucucuagaaaucucugcuguucaaaaggugg

SEQ ID NO: 470369 - RNA, 65 nt, hsa
acauuucuaaaucccaucuugauauacuaugaauacucuagaaugauguaaagcagauaggaaug

SEQ ID NO: 470370 - RNA, 65 nt, hsa
aucaaucauguacuuuaguuuaauguauaaagauccucuagaaaaugauaauauuguguauuaag

SEQ ID NO: 470371 - RNA, 65 nt, hsa
uucucugguggucucaagacaagaacaagagcugacucuagaaucuucugccuggcugaccucug

SEQ ID NO: 470372 - RNA, 65 nt, hsa
ugggucagugauggcaacaggauggccaaggauggcucuagaacacucuguccaugcgucacucc

SEQ ID NO: 470373 - RNA, 65 nt, hsa
uccuguccuguccaaugcgggggcacugcagaacucucuagaaaugucaugauugagcuucagag

SEQ ID NO: 470374 - RNA, 65 nt, hsa
agaacugaauaaucuuugccuggagugacacuacacucuagaauuuccacuuuggagaauacuca

SEQ ID NO: 470375 - RNA, 65 nt, hsa
uauuuuauuuuguuuucaaccaucaauaaaguuuucucuagaauauuguuuugaacauccuugua

SEQ ID NO: 470376 - RNA, 65 nt, hsa
cuguauggaaaugcacccucccuccugccgcuccucucuagaaccuucuagaaccugggcugugc

SEQ ID NO: 470377 - RNA, 65 nt, hsa
auucuaagggugccaagagacugguuagucaaagccucuagaaggggauccucguugaaaggagc

SEQ ID NO: 470378 - RNA, 65 nt, hsa
accauaucuauaaaacaaacauaguaucugucaaucucuagaaaccacaagaugauggagagguc

SEQ ID NO: 470379 - RNA, 65 nt, hsa
agguguagggacccugccaaguggcaccugauuuacucuagaaaauaaaaguagaaaauacugag

SEQ ID NO: 470380 - RNA, 65 nt, hsa
gugucccugaaguauuuaauaagaagcauuuugcacucuagaaaguauguuuguguugguuuuuu

SEQ ID NO: 470381 - RNA, 65 nt, hsa
gugguagauuacuuaucagaaaacauauaugucaucucuagaacgaagaaaaagcauaguaguuc

SEQ ID NO: 470382 - RNA, 65 nt, hsa
uggguaggguauaguaucacuccugaguuccacugcucuagaaucuaaccagaaauagaaaccua

SEQ ID NO: 470383 - RNA, 65 nt, hsa
uccccugcucaccauuggagaaucagcucacugcucucuagaaacguggcguuggugaacggacc

SEQ ID NO: 470384 - RNA, 65 nt, hsa
gcucaggacgugaugagguacucgugguucuggagcucuagaaacacuucugaugcaugaaaaau

SEQ ID NO: 470385 - RNA, 65 nt, hsa
agaauguucagucggucguguuuuuaacacagagucucuagaagaggugcagacaucccgucuga

SEQ ID NO: 470386 - RNA, 65 nt, hsa
ucuggcaaguguccagaugccagaaccuucuuuuccucuagaagggauggugcuugguaaccuua

SEQ ID NO: 470387 - RNA, 65 nt, hsa
ccauguaugucgauugauaucgcugcuacaucagacucuagaaaaaagggcugagaggaagcaag

SEQ ID NO: 470388 - RNA, 65 nt, hsa
acgauaauuccucaagcaugagaccuugcuaagcacucuagaauaaguuuuauguucugcucaca

SEQ ID NO: 470389 - RNA, 65 nt, hsa
gcuacaaaagugcaaauuucucauuuccugugggucucuagaaacucucucaauauuuaaagcca

SEQ ID NO: 470390 - RNA, 65 nt, hsa
ccugggcuugguaagugaauuuaugagauuuacugcucuagaaaguauagauggccaaaggaccg

SEQ ID NO: 470391 - RNA, 65 nt, hsa
auccaucugagaugggguccuguuguuuauuaucacucuagaaguuauacauugauauuuauucu

SEQ ID NO: 470392 - RNA, 65 nt, hsa
ugauuuuuguaacuuuacgcaggacacuuagagcucucuagaaucccacugacuuuagugggucu

SEQ ID NO: 470393 - RNA, 65 nt, hsa
gauaugcccauuugauccuaaccuuuuagccugcucucuagaacccuacuuacaguugaccaagc

SEQ ID NO: 470394 - RNA, 65 nt, hsa
ccaguacggcccccucuuugcaggcuuuuccuccucucuagaaccuccuucuguuggaggcccuc

SEQ ID NO: 470395 - RNA, 65 nt, hsa
gccucaggcccccagcccuguggcuuccaccucagcucuagaagccugcucccucugcagggggu

SEQ ID NO: 470396 - RNA, 65 nt, hsa
aagaaaaaaagaaaaagaacaaaaaauauauaucacucuagaaaauaaaucucuccugugucuua

SEQ ID NO: 470397 - RNA, 65 nt, hsa
ugcaaacacuaacugggggauuuuauuuauaagggcucuagaaaaaacgaguuauucacaccagc

SEQ ID NO: 470398 - RNA, 65 nt, hsa
aaaaaaaaaaaguuuguuaaaaggcuacacgagcucucuagaaacugcugcuacuagaaaugucu

SEQ ID NO: 470399 - RNA, 65 nt, hsa
guuggggccauuagaaugaggcagacaccaggccacucuagaagccgagccgucacaccucaggc

SEQ ID NO: 470400 - RNA, 65 nt, hsa
cauuccccuggcaugaaacuuucagauuccccugccucuagaaauuguccugcccuccucaccac

SEQ ID NO: 470401 - RNA, 65 nt, hsa
uuaacccaugguucucagcuggggugacacugcuccucuagaagcagguuugaaauuauggguau

SEQ ID NO: 470402 - RNA, 65 nt, hsa
guccuggcuuuuuguugauuauuaagcuguguucacucuagaagguguaaaggcccugucccaau

SEQ ID NO: 470403 - RNA, 65 nt, hsa
ccuacauucuccuugucugguauaacuuccauguucucuagaaaucaagguuuuguuuguuaauu

SEQ ID NO: 470404 - RNA, 65 nt, hsa
auguuucuggugugugaacuuuaugguaacuucuacucuagaauacguacguaugcacccacaga

SEQ ID NO: 470405 - RNA, 65 nt, hsa
uccagaacccagcccagaucggaggacaaguuccucucuagaacccaauccaauuuggagcccca

SEQ ID NO: 470406 - RNA, 65 nt, hsa
uuggagccccagcccaacuccagaacccaacccuucucuagaauccagcccagaucugaggccaa

SEQ ID NO: 470407 - RNA, 65 nt, hsa
aaugugguccaaaugcggaucacuggucagauggacucuagaagcacugagcucccugucucugg

SEQ ID NO: 470408 - RNA, 65 nt, hsa
cuucaaaaagccucaugcauagcgggucauguagucucuagaaaauacauaaccugauggaaaug

SEQ ID NO: 470409 - RNA, 65 nt, hsa
ugguuauuuauauccuauuuuuucucaccccaucucucuagaaacaccuauaaaggcuauuauug

SEQ ID NO: 470410 - RNA, 65 nt, hsa
ucuuguauaagauccuagauccuaagggucgaaagcucuagaaucugcaauucaaaaguuccaag

SEQ ID NO: 470411 - RNA, 65 nt, hsa
gggcugccgugauggauucuguuugacguauuguucucuagaaggccuggcucugauccagugac

SEQ ID NO: 470412 - RNA, 65 nt, hsa
cgguccccacccucugccccccagcccucuggcgucucuagaaacugcugcugauggagaccagg

SEQ ID NO: 470413 - RNA, 65 nt, hsa
ugcugacggaggaauuaacacaaaagcagacaacacucuagaacuggagagagguccagauugcg

SEQ ID NO: 470414 - RNA, 65 nt, hsa
acccagccccuccccuacuuuuuggucagcuacgucucuagaauaagaugguaucugaaguccuu

SEQ ID NO: 470415 - RNA, 65 nt, hsa
aaguuguuucucucccugggccucaguuuccccaucucuagaaugaggauguuggggaaaauccc

SEQ ID NO: 470416 - RNA, 65 nt, hsa
uuugaaauucaguaauauuugacauuuuuauuuaucucuagaaguuucucuaaaauuguacucag

SEQ ID NO: 470417 - RNA, 65 nt, hsa
aaaaguacagugaugagcaugccuaaauccauguucucuagaauguaagcuuggugaaagaaggg

SEQ ID NO: 470418 - RNA, 65 nt, hsa
ucuagacuguucugggguagcagagucacagaucacucuagaaucuaauacuugguaauuauacu

SEQ ID NO: 470419 - RNA, 65 nt, hsa
ugcccccaggaauggggaacucucccucuggucuacucuagaagagggguuacuucuccccuggg

SEQ ID NO: 470420 - RNA, 65 nt, hsa
gcucccaucuccuuucagaaaaauucaagguccuccucuagaaguuucaaaucucucccaacucu

SEQ ID NO: 470421 - RNA, 65 nt, hsa
cuaaggcccuggguucaagagaguuggagaaaccccucuagaaacauauuggcugucaucaaagg

SEQ ID NO: 470422 - RNA, 65 nt, hsa
uggaaauuccuuaacugagcuauacuugguacuugcucuagaacauuugggaaaugacaaacuca

SEQ ID NO: 470423 - RNA, 65 nt, hsa
ccaucucuuccagcaccaucaggguuuuaauggcccucuagaauuaccacugagauacacuauuu

SEQ ID NO: 470424 - RNA, 65 nt, hsa
ggugaagaaucugggccaaccagggguccuugggccucuagaaggccacaguaggccucucuuug

SEQ ID NO: 470425 - RNA, 65 nt, hsa
gaaucugcuggugccuugaucuuggacuucccagccucuagaacuguaagaaauaaauauuugcu

SEQ ID NO: 470426 - RNA, 65 nt, hsa
ggcaagggcccaaggacagugccuuaguuuggauccucuagaaacuaacccugggaaaagggcau

SEQ ID NO: 470427 - RNA, 65 nt, hsa
acuguauaacuuauuuucuuauuaucuucuucucccucuagaauauaaauuuaugaaaauacaaa

SEQ ID NO: 470428 - RNA, 65 nt, hsa
cuugcguggaaggagcaaugcagacacagugaaaucucuagaaucugcuuuguuuuguaagaacu

SEQ ID NO: 470429 - RNA, 65 nt, hsa
guaguuaaaccaaacuacagucucagccugucauucucuagaacacauccaggugucggagcuaa

SEQ ID NO: 470430 - RNA, 65 nt, hsa
acagucagggacccccauaaaggacacccccuucucucuagaaagagcugggcucucagcuauuu

SEQ ID NO: 470431 - RNA, 65 nt, hsa
cuaagacgggggcugcuucuccucuucaguauggacucuagaaagucuggcuacaugaauagauu

SEQ ID NO: 470432 - RNA, 65 nt, hsa
ccagugcuaacuugggccagcgggguuugggguaucucuagaaaacagcaacugaacagagcucc

SEQ ID NO: 470433 - RNA, 65 nt, hsa
gaggcgugacccaggccccuguagcccucagccuccucuagaagcuucuguacuccuuguaggau

SEQ ID NO: 470434 - RNA, 65 nt, hsa
gcugccguggccacccccgcugcccagugucugcccucuagaaguaggcuguguuuccagguguu

SEQ ID NO: 470435 - RNA, 65 nt, hsa
acuaaacaggaaagucgcauuauuuucccauucuacucuagaaagcauggaaauuaaguguuucg

SEQ ID NO: 470436 - RNA, 65 nt, hsa
uaucaacuauuuuguaaaugcaaguuuuuuaguagcucuagaaacauuuuuaagaaggagggaau

SEQ ID NO: 470437 - RNA, 65 nt, hsa
ugugaccagcucagaggauggggcuguccccugggcucuagaaagaacauucugugucaccagca

SEQ ID NO: 470438 - RNA, 65 nt, hsa
aggaagaggcugggggacuagaaagaggcccugcccucuagaaagcucagaucuuggcuucuguu

SEQ ID NO: 470439 - RNA, 65 nt, hsa
ucucuuccaagaaugccucuguggugcuguuuggucucuagaaacagggucacuuuuuuaaugua

SEQ ID NO: 470440 - RNA, 65 nt, hsa
cucgacugcugcuguuaaaaaacaugcauuagaaucucuagaacacgaggaaaaacagggucuug

SEQ ID NO: 470441 - RNA, 65 nt, hsa
uauugugcaaugauuguuaaauuauacugaaguagcucuagaaagacacauguauacaaggcacu

SEQ ID NO: 470442 - RNA, 65 nt, hsa
cagccguaguagauguucuacuuuguucugcuguucucuagaaagaauauuugguuuuccuguau

SEQ ID NO: 470443 - RNA, 65 nt, hsa
aguacacaucagcauaugagaaucucugagagguccucuagaaaggagagaaaaagcaccucuuu

SEQ ID NO: 470444 - RNA, 65 nt, hsa
cuggauucauauauuacaucaacuucccuuuuuaacucuagaaauucucaguaugggguuucccu

SEQ ID NO: 470445 - RNA, 65 nt, hsa
ucuggguuccuauggccuuguuggagggggccaggcucuagaacgucuaacacaguggagaaccg

SEQ ID NO: 470446 - RNA, 65 nt, hsa
auuugaucacgaucauauuguagucucucaaagugcucuagaaauugucagugguuuacaugaag

SEQ ID NO: 470447 - RNA, 65 nt, hsa
caaacuauagugauauaucaguguuugagagugaccucuagaaaaaagaaaaguguuuuuagaaa

SEQ ID NO: 470448 - RNA, 65 nt, hsa
gugccacccaguagcccagagugagcuuuagcucucucuagaaugagcaagacugggccccacau

SEQ ID NO: 470449 - RNA, 65 nt, hsa
acaguugugcaggagguagccuggugguuuucaaccucuagaauuuuaagccuuuguugaacugu

SEQ ID NO: 470450 - RNA, 65 nt, hsa
auaguuuggaguaagggacuucauauaccugauuccucuagaaggcugucuaacauaccacauga

SEQ ID NO: 470451 - RNA, 65 nt, hsa
uaugauauauuacuacuuauaauacuguggcuagucucuagaauggauguugaaaucuuugccuc

SEQ ID NO: 470452 - RNA, 65 nt, hsa
ugagugaacugaggaaggugcuuagauggugagggcucuagaaaccaagccccaugagcagcagu

SEQ ID NO: 470453 - RNA, 65 nt, hsa
caaacuauagugauauaucaguguuugggagugaccucuagaaaaaagaaaacuguuuuuagaaa

SEQ ID NO: 470454 - RNA, 65 nt, hsa
ccagccgcauccugccuguagauggccggggaaggcucuagaaaaggggcgcauugcgauccaac

SEQ ID NO: 470455 - RNA, 61 nt, hsa
auccugcuuucucaaguacuauucuaacauugcgcuuuauaagggaugauauuucuaccac

SEQ ID NO: 470456 - RNA, 61 nt, hsa
aaagcccaggaacuucuagaauaacccagaugcgcuuuaauuuuuuuuaauauguuuugau

SEQ ID NO: 470457 - RNA, 61 nt, hsa
cuuaauauaucuauggcagacauuuaagaaugcgcuuuaucuagcucaugguaacuuugca

SEQ ID NO: 470458 - RNA, 61 nt, hsa
cgguaguuaggaugcucaguugcuaaacacugcgcuuuauuuucuuaaccaguuguggugu

SEQ ID NO: 470459 - RNA, 61 nt, hsa
augggauaaaaauaaucgauguauguuacgggcgcuuuaaccaucagcugccucucgaaug

SEQ ID NO: 470460 - RNA, 61 nt, hsa
guucaccuggguggcuggagccgccggcgcugcgcuuuauuucggagcgcaaugccaucua

SEQ ID NO: 470461 - RNA, 61 nt, hsa
guuucccuuaaugauacaagucucuguaccagcgcuuuauguuaauuaccaaaacucuccu

SEQ ID NO: 470462 - RNA, 61 nt, hsa
gaaguggcagaacacuggauuuguguguguggcgcuuuagggugcuggacuguauggcuga

SEQ ID NO: 470463 - RNA, 61 nt, hsa
cccuccccuugcacuugugaaaacacuuugagcgcuuuaagagauuagccugagaaauaau

SEQ ID NO: 470464 - RNA, 61 nt, hsa
agugacuguuuggcuuauaaacacauugaaugcgcuuuauugcccaugggauauguggugu

SEQ ID NO: 470465 - RNA, 61 nt, hsa
aauaacaaguugucccuagcaaaaccgcugagcgcuuuauaauuuugugguguauuuuugu

SEQ ID NO: 470466 - RNA, 61 nt, hsa
ucaguuuuauaaggugauacuuuuuaaauaagcgcuuuaaugaaaaugguuagacugaaaa

SEQ ID NO: 470467 - RNA, 61 nt, hsa
acauugucaugugacuggaucacauggggaagcgcuuuauacagacaucaguuccauggug

SEQ ID NO: 470468 - RNA, 61 nt, hsa
cucaccucacaggcacaucaggcugcagaaugcgcuuuagaaagcauuguuuuaguccagg

SEQ ID NO: 470469 - RNA, 61 nt, hsa
auugcaugagucaagucggccacagacuugagcgcuuuauuauuaguuaaucuuuugcagg

SEQ ID NO: 470470 - RNA, 61 nt, hsa
auuuuuaaacuucuaagugaaaguagucugagcgcuuuauaaaauucauauuauugugugu

SEQ ID NO: 470471 - RNA, 61 nt, hsa
ccccagcacacacacucccugccacuguucugcgcuuuaauugugggagaagagaggagag

SEQ ID NO: 470472 - RNA, 61 nt, hsa
caugaugacaacacugccucgcguuucaauagcgcuuuauacuuuuuuaaguguuuucuau

SEQ ID NO: 470473 - RNA, 61 nt, hsa
uuugcuauuguaaauauuagugguuuacaaugcgcuuuagacauauuucuuuaaaaugcaa

SEQ ID NO: 470474 - RNA, 61 nt, hsa
guagcuaucuucaccugcgccaauugugagggcgcuuuagcauuugagugauucaauaguu

SEQ ID NO: 470475 - RNA, 61 nt, hsa
ggccgaggugggcuucaguaaguccccggcggcgcuuuaguuugagcgcauggcaagucac

SEQ ID NO: 470476 - RNA, 61 nt, hsa
aagauugaacuuaaaugccccccucccaacagcgcuuuaaaagcgaccucucuugagguag

SEQ ID NO: 470477 - RNA, 61 nt, hsa
ugccgccaucucuuaguuuucuuuuucacaagcgcuuuauuuuuuuaauagacaaaucaca

SEQ ID NO: 470478 - RNA, 61 nt, hsa
cuuggauuuaauuuaaagucuucaacacuaugcgcuuuaucauauuauucacagaugcauu

SEQ ID NO: 470479 - RNA, 61 nt, hsa
caauccaacuugaagucaauugaauauuaaggcgcuuuacuuccgugugcuuucaguuuuu

SEQ ID NO: 470480 - RNA, 61 nt, hsa
cugccucagaaagcucugcgcuuuccagaaagcgcuuuacccugcaggguuuugcuaaccu

SEQ ID NO: 470481 - RNA, 61 nt, hsa
uugagaaccuucacccuuucacuuaaaggaggcgcuuuauagcuucucuuuggcauaucca

SEQ ID NO: 470482 - RNA, 61 nt, hsa
ucauucucccccucucucccuccugugucuugcgcuuuauguuuucuuccguuugauaauu

SEQ ID NO: 470483 - RNA, 61 nt, hsa
ccuagagaagccaugugauucccagagccaggcgcuuuacaccuaaaguaguuugacuuuc

SEQ ID NO: 470484 - RNA, 61 nt, hsa
cuuguguguguagcuucuuguagcuuagaaagcgcuuuaugcccaugaugucauuucaggc

SEQ ID NO: 470485 - RNA, 62 nt, hsa; identical to SEQ ID NO: 103289

SEQ ID NO: 470486 - RNA, 62 nt, hsa; identical to SEQ ID NO: 103290

SEQ ID NO: 470487 - RNA, 62 nt, hsa; identical to SEQ ID NO: 103291

SEQ ID NO: 470488 - RNA, 62 nt, hsa; identical to SEQ ID NO: 103292

SEQ ID NO: 470489 - RNA, 62 nt, hsa; identical to SEQ ID NO: 103293

SEQ ID NO: 470490 - RNA, 62 nt, hsa; identical to SEQ ID NO: 103294

SEQ ID NO: 470491 - RNA, 62 nt, hsa; identical to SEQ ID NO: 103295

SEQ ID NO: 470492 - RNA, 62 nt, hsa; identical to SEQ ID NO: 103296

SEQ ID NO: 470493 - RNA, 62 nt, hsa; identical to SEQ ID NO: 103297

SEQ ID NO: 470494 - RNA, 62 nt, hsa; identical to SEQ ID NO: 103298

SEQ ID NO: 470495 - RNA, 62 nt, hsa; identical to SEQ ID NO: 103299

SEQ ID NO: 470496 - RNA, 57 nt, hsa; identical to SEQ ID NO: 103300

SEQ ID NO: 470497 - RNA, 62 nt, hsa; identical to SEQ ID NO: 103301

SEQ ID NO: 470498 - RNA, 62 nt, hsa; identical to SEQ ID NO: 103302

SEQ ID NO: 470499 - RNA, 62 nt, hsa; identical to SEQ ID NO: 103303

SEQ ID NO: 470500 - RNA, 62 nt, hsa; identical to SEQ ID NO: 103304

SEQ ID NO: 470501 - RNA, 62 nt, hsa; identical to SEQ ID NO: 103305

SEQ ID NO: 470502 - RNA, 62 nt, hsa; identical to SEQ ID NO: 103306

SEQ ID NO: 470503 - RNA, 62 nt, hsa; identical to SEQ ID NO: 103307

SEQ ID NO: 470504 - RNA, 62 nt, hsa; identical to SEQ ID NO: 103308

SEQ ID NO: 470505 - RNA, 62 nt, hsa; identical to SEQ ID NO: 103309

SEQ ID NO: 470506 - RNA, 62 nt, hsa; identical to SEQ ID NO: 103310

SEQ ID NO: 470507 - RNA, 62 nt, hsa; identical to SEQ ID NO: 103311

SEQ ID NO: 470508 - RNA, 62 nt, hsa; identical to SEQ ID NO: 103312

SEQ ID NO: 470509 - RNA, 62 nt, hsa; identical to SEQ ID NO: 103313

SEQ ID NO: 470510 - RNA, 62 nt, hsa; identical to SEQ ID NO: 103314

SEQ ID NO: 470511 - RNA, 62 nt, hsa; identical to SEQ ID NO: 103315

SEQ ID NO: 470512 - RNA, 62 nt, hsa; identical to SEQ ID NO: 103316

SEQ ID NO: 470513 - RNA, 62 nt, hsa; identical to SEQ ID NO: 103317

SEQ ID NO: 470514 - RNA, 62 nt, hsa; identical to SEQ ID NO: 103318

SEQ ID NO: 470515 - RNA, 62 nt, hsa; identical to SEQ ID NO: 103319

SEQ ID NO: 470516 - RNA, 62 nt, hsa; identical to SEQ ID NO: 103320

SEQ ID NO: 470517 - RNA, 62 nt, hsa; identical to SEQ ID NO: 103321

SEQ ID NO: 470518 - RNA, 62 nt, hsa; identical to SEQ ID NO: 103322

SEQ ID NO: 470519 - RNA, 62 nt, hsa; identical to SEQ ID NO: 103323

SEQ ID NO: 470520 - RNA, 62 nt, hsa; identical to SEQ ID NO: 103324

SEQ ID NO: 470521 - RNA, 62 nt, hsa; identical to SEQ ID NO: 103325

SEQ ID NO: 470522 - RNA, 62 nt, hsa; identical to SEQ ID NO: 103326

SEQ ID NO: 470523 - RNA, 62 nt, hsa; identical to SEQ ID NO: 103327

SEQ ID NO: 470524 - RNA, 62 nt, hsa; identical to SEQ ID NO: 103328

SEQ ID NO: 470525 - RNA, 62 nt, hsa; identical to SEQ ID NO: 103329

SEQ ID NO: 470526 - RNA, 62 nt, hsa; identical to SEQ ID NO: 103330

SEQ ID NO: 470527 - RNA, 62 nt, hsa; identical to SEQ ID NO: 103331

SEQ ID NO: 470528 - RNA, 62 nt, hsa; identical to SEQ ID NO: 103332

SEQ ID NO: 470529 - RNA, 62 nt, hsa; identical to SEQ ID NO: 103333

SEQ ID NO: 470530 - RNA, 62 nt, hsa; identical to SEQ ID NO: 103334

SEQ ID NO: 470531 - RNA, 62 nt, hsa; identical to SEQ ID NO: 103335

SEQ ID NO: 470532 - RNA, 62 nt, hsa; identical to SEQ ID NO: 103336

SEQ ID NO: 470533 - RNA, 62 nt, hsa; identical to SEQ ID NO: 103337

SEQ ID NO: 470534 - RNA, 62 nt, hsa; identical to SEQ ID NO: 103338

SEQ ID NO: 470535 - RNA, 62 nt, hsa; identical to SEQ ID NO: 103339

SEQ ID NO: 470536 - RNA, 62 nt, hsa; identical to SEQ ID NO: 103340

SEQ ID NO: 470537 - RNA, 62 nt, hsa; identical to SEQ ID NO: 103341

SEQ ID NO: 470538 - RNA, 62 nt, hsa; identical to SEQ ID NO: 103342

SEQ ID NO: 470539 - RNA, 62 nt, hsa; identical to SEQ ID NO: 103343

SEQ ID NO: 470540 - RNA, 62 nt, hsa; identical to SEQ ID NO: 103344

SEQ ID NO: 470541 - RNA, 62 nt, hsa; identical to SEQ ID NO: 103345

SEQ ID NO: 470542 - RNA, 62 nt, hsa; identical to SEQ ID NO: 103346

SEQ ID NO: 470543 - RNA, 62 nt, hsa; identical to SEQ ID NO: 103347

SEQ ID NO: 470544 - RNA, 62 nt, hsa; identical to SEQ ID NO: 103348

SEQ ID NO: 470545 - RNA, 62 nt, hsa; identical to SEQ ID NO: 103349

SEQ ID NO: 470546 - RNA, 62 nt, hsa; identical to SEQ ID NO: 103350

SEQ ID NO: 470547 - RNA, 62 nt, hsa; identical to SEQ ID NO: 103351

SEQ ID NO: 470548 - RNA, 62 nt, hsa; identical to SEQ ID NO: 103352

SEQ ID NO: 470549 - RNA, 62 nt, hsa; identical to SEQ ID NO: 103353

SEQ ID NO: 470550 - RNA, 62 nt, hsa; identical to SEQ ID NO: 103354

SEQ ID NO: 470551 - RNA, 62 nt, hsa; identical to SEQ ID NO: 103355

SEQ ID NO: 470552 - RNA, 62 nt, hsa; identical to SEQ ID NO: 103356

SEQ ID NO: 470553 - RNA, 62 nt, hsa; identical to SEQ ID NO: 103357

SEQ ID NO: 470554 - RNA, 62 nt, hsa; identical to SEQ ID NO: 103358

SEQ ID NO: 470555 - RNA, 62 nt, hsa; identical to SEQ ID NO: 103359

SEQ ID NO: 470556 - RNA, 62 nt, hsa; identical to SEQ ID NO: 103360

SEQ ID NO: 470557 - RNA, 62 nt, hsa; identical to SEQ ID NO: 103361

SEQ ID NO: 470558 - RNA, 62 nt, hsa; identical to SEQ ID NO: 103362

SEQ ID NO: 470559 - RNA, 62 nt, hsa; identical to SEQ ID NO: 103363

SEQ ID NO: 470560 - RNA, 62 nt, hsa; identical to SEQ ID NO: 103364

SEQ ID NO: 470561 - RNA, 62 nt, hsa; identical to SEQ ID NO: 103365

SEQ ID NO: 470562 - RNA, 62 nt, hsa; identical to SEQ ID NO: 103366

SEQ ID NO: 470563 - RNA, 62 nt, hsa; identical to SEQ ID NO: 103367

SEQ ID NO: 470564 - RNA, 62 nt, hsa; identical to SEQ ID NO: 103368

SEQ ID NO: 470565 - RNA, 62 nt, hsa; identical to SEQ ID NO: 103369

SEQ ID NO: 470566 - RNA, 62 nt, hsa; identical to SEQ ID NO: 103370

SEQ ID NO: 470567 - RNA, 62 nt, hsa; identical to SEQ ID NO: 103371

SEQ ID NO: 470568 - RNA, 59 nt, hsa; identical to SEQ ID NO: 103372

SEQ ID NO: 470569 - RNA, 62 nt, hsa; identical to SEQ ID NO: 103373

SEQ ID NO: 470570 - RNA, 62 nt, hsa; identical to SEQ ID NO: 103374

SEQ ID NO: 470571 - RNA, 62 nt, hsa; identical to SEQ ID NO: 103375

SEQ ID NO: 470572 - RNA, 62 nt, hsa; identical to SEQ ID NO: 103376

SEQ ID NO: 470573 - RNA, 62 nt, hsa; identical to SEQ ID NO: 103377

SEQ ID NO: 470574 - RNA, 62 nt, hsa; identical to SEQ ID NO: 103378

SEQ ID NO: 470575 - RNA, 62 nt, hsa; identical to SEQ ID NO: 103379

SEQ ID NO: 470576 - RNA, 62 nt, hsa; identical to SEQ ID NO: 103380

SEQ ID NO: 470577 - RNA, 62 nt, hsa; identical to SEQ ID NO: 103381

SEQ ID NO: 470578 - RNA, 62 nt, hsa; identical to SEQ ID NO: 103382

SEQ ID NO: 470579 - RNA, 62 nt, hsa; identical to SEQ ID NO: 103383

SEQ ID NO: 470580 - RNA, 62 nt, hsa; identical to SEQ ID NO: 103384

SEQ ID NO: 470581 - RNA, 62 nt, hsa; identical to SEQ ID NO: 103385

SEQ ID NO: 470582 - RNA, 62 nt, hsa; identical to SEQ ID NO: 103386

SEQ ID NO: 470583 - RNA, 62 nt, hsa; identical to SEQ ID NO: 103387

SEQ ID NO: 470584 - RNA, 62 nt, hsa; identical to SEQ ID NO: 103388

SEQ ID NO: 470585 - RNA, 62 nt, hsa; identical to SEQ ID NO: 103389

SEQ ID NO: 470586 - RNA, 62 nt, hsa; identical to SEQ ID NO: 103390

SEQ ID NO: 470587 - RNA, 62 nt, hsa; identical to SEQ ID NO: 103391

SEQ ID NO: 470588 - RNA, 62 nt, hsa; identical to SEQ ID NO: 103392

SEQ ID NO: 470589 - RNA, 60 nt, hsa; identical to SEQ ID NO: 103393

SEQ ID NO: 470590 - RNA, 62 nt, hsa; identical to SEQ ID NO: 103394

SEQ ID NO: 470591 - RNA, 62 nt, hsa; identical to SEQ ID NO: 103395

SEQ ID NO: 470592 - RNA, 62 nt, hsa; identical to SEQ ID NO: 103396

SEQ ID NO: 470593 - RNA, 62 nt, hsa; identical to SEQ ID NO: 103397

SEQ ID NO: 470594 - RNA, 62 nt, hsa; identical to SEQ ID NO: 103398

SEQ ID NO: 470595 - RNA, 62 nt, hsa; identical to SEQ ID NO: 103399

SEQ ID NO: 470596 - RNA, 62 nt, hsa; identical to SEQ ID NO: 103400

SEQ ID NO: 470597 - RNA, 62 nt, hsa; identical to SEQ ID NO: 103401

SEQ ID NO: 470598 - RNA, 62 nt, hsa; identical to SEQ ID NO: 103402

SEQ ID NO: 470599 - RNA, 62 nt, hsa; identical to SEQ ID NO: 103403

SEQ ID NO: 470600 - RNA, 62 nt, hsa; identical to SEQ ID NO: 103404

SEQ ID NO: 470601 - RNA, 62 nt, hsa; identical to SEQ ID NO: 103405

SEQ ID NO: 470602 - RNA, 62 nt, hsa; identical to SEQ ID NO: 103406

SEQ ID NO: 470603 - RNA, 62 nt, hsa; identical to SEQ ID NO: 103407

SEQ ID NO: 470604 - RNA, 62 nt, hsa; identical to SEQ ID NO: 103408

SEQ ID NO: 470605 - RNA, 62 nt, hsa; identical to SEQ ID NO: 103409

SEQ ID NO: 470606 - RNA, 62 nt, hsa; identical to SEQ ID NO: 103410

SEQ ID NO: 470607 - RNA, 62 nt, hsa; identical to SEQ ID NO: 103411

SEQ ID NO: 470608 - RNA, 62 nt, hsa; identical to SEQ ID NO: 103412

SEQ ID NO: 470609 - RNA, 62 nt, hsa; identical to SEQ ID NO: 103413

SEQ ID NO: 470610 - RNA, 62 nt, hsa; identical to SEQ ID NO: 103414

SEQ ID NO: 470611 - RNA, 62 nt, hsa; identical to SEQ ID NO: 103415

SEQ ID NO: 470612 - RNA, 62 nt, hsa; identical to SEQ ID NO: 103416

SEQ ID NO: 470613 - RNA, 62 nt, hsa; identical to SEQ ID NO: 103417

SEQ ID NO: 470614 - RNA, 62 nt, hsa; identical to SEQ ID NO: 103418

SEQ ID NO: 470615 - RNA, 62 nt, hsa; identical to SEQ ID NO: 103419

SEQ ID NO: 470616 - RNA, 62 nt, hsa; identical to SEQ ID NO: 103420

SEQ ID NO: 470617 - RNA, 62 nt, hsa; identical to SEQ ID NO: 103421

SEQ ID NO: 470618 - RNA, 62 nt, hsa; identical to SEQ ID NO: 103422

SEQ ID NO: 470619 - RNA, 62 nt, hsa; identical to SEQ ID NO: 103423

SEQ ID NO: 470620 - RNA, 62 nt, hsa; identical to SEQ ID NO: 103424

SEQ ID NO: 470621 - RNA, 62 nt, hsa; identical to SEQ ID NO: 103425

SEQ ID NO: 470622 - RNA, 62 nt, hsa; identical to SEQ ID NO: 103426

SEQ ID NO: 470623 - RNA, 62 nt, hsa; identical to SEQ ID NO: 103427

SEQ ID NO: 470624 - RNA, 62 nt, hsa; identical to SEQ ID NO: 103428

SEQ ID NO: 470625 - RNA, 62 nt, hsa; identical to SEQ ID NO: 103429

SEQ ID NO: 470626 - RNA, 62 nt, hsa; identical to SEQ ID NO: 103430

SEQ ID NO: 470627 - RNA, 62 nt, hsa; identical to SEQ ID NO: 103431

SEQ ID NO: 470628 - RNA, 62 nt, hsa; identical to SEQ ID NO: 103432

SEQ ID NO: 470629 - RNA, 62 nt, hsa; identical to SEQ ID NO: 103433

SEQ ID NO: 470630 - RNA, 62 nt, hsa; identical to SEQ ID NO: 103434

SEQ ID NO: 470631 - RNA, 62 nt, hsa; identical to SEQ ID NO: 103435

SEQ ID NO: 470632 - RNA, 62 nt, hsa; identical to SEQ ID NO: 103436

SEQ ID NO: 470633 - RNA, 62 nt, hsa; identical to SEQ ID NO: 103437

SEQ ID NO: 470634 - RNA, 62 nt, hsa; identical to SEQ ID NO: 103438

SEQ ID NO: 470635 - RNA, 62 nt, hsa; identical to SEQ ID NO: 103439

SEQ ID NO: 470636 - RNA, 62 nt, hsa; identical to SEQ ID NO: 103440

SEQ ID NO: 470637 - RNA, 62 nt, hsa; identical to SEQ ID NO: 103441

SEQ ID NO: 470638 - RNA, 62 nt, hsa; identical to SEQ ID NO: 103442

SEQ ID NO: 470639 - RNA, 62 nt, hsa; identical to SEQ ID NO: 103443

SEQ ID NO: 470640 - RNA, 62 nt, hsa; identical to SEQ ID NO: 103444

SEQ ID NO: 470641 - RNA, 62 nt, hsa; identical to SEQ ID NO: 103445

SEQ ID NO: 470642 - RNA, 62 nt, hsa; identical to SEQ ID NO: 103446

SEQ ID NO: 470643 - RNA, 62 nt, hsa; identical to SEQ ID NO: 103447

SEQ ID NO: 470644 - RNA, 62 nt, hsa; identical to SEQ ID NO: 103448

SEQ ID NO: 470645 - RNA, 62 nt, hsa; identical to SEQ ID NO: 103449

SEQ ID NO: 470646 - RNA, 62 nt, hsa; identical to SEQ ID NO: 103450

SEQ ID NO: 470647 - RNA, 62 nt, hsa; identical to SEQ ID NO: 103451

SEQ ID NO: 470648 - RNA, 62 nt, hsa; identical to SEQ ID NO: 103452

SEQ ID NO: 470649 - RNA, 62 nt, hsa; identical to SEQ ID NO: 103453

SEQ ID NO: 470650 - RNA, 62 nt, hsa; identical to SEQ ID NO: 103454

SEQ ID NO: 470651 - RNA, 62 nt, hsa; identical to SEQ ID NO: 103455

SEQ ID NO: 470652 - RNA, 62 nt, hsa; identical to SEQ ID NO: 103456

SEQ ID NO: 470653 - RNA, 62 nt, hsa; identical to SEQ ID NO: 103457

SEQ ID NO: 470654 - RNA, 62 nt, hsa; identical to SEQ ID NO: 103458

SEQ ID NO: 470655 - RNA, 62 nt, hsa; identical to SEQ ID NO: 103459

SEQ ID NO: 470656 - RNA, 62 nt, hsa; identical to SEQ ID NO: 103460

SEQ ID NO: 470657 - RNA, 62 nt, hsa; identical to SEQ ID NO: 103461

SEQ ID NO: 470658 - RNA, 62 nt, hsa; identical to SEQ ID NO: 103462

SEQ ID NO: 470659 - RNA, 62 nt, hsa; identical to SEQ ID NO: 103463

SEQ ID NO: 470660 - RNA, 62 nt, hsa; identical to SEQ ID NO: 103464

SEQ ID NO: 470661 - RNA, 62 nt, hsa; identical to SEQ ID NO: 103465

SEQ ID NO: 470662 - RNA, 62 nt, hsa; identical to SEQ ID NO: 103466

SEQ ID NO: 470663 - RNA, 62 nt, hsa; identical to SEQ ID NO: 103467

SEQ ID NO: 470664 - RNA, 62 nt, hsa; identical to SEQ ID NO: 103468

SEQ ID NO: 470665 - RNA, 62 nt, hsa; identical to SEQ ID NO: 103469

SEQ ID NO: 470666 - RNA, 62 nt, hsa; identical to SEQ ID NO: 103470

SEQ ID NO: 470667 - RNA, 62 nt, hsa; identical to SEQ ID NO: 103471

SEQ ID NO: 470668 - RNA, 62 nt, hsa; identical to SEQ ID NO: 103472

SEQ ID NO: 470669 - RNA, 62 nt, hsa; identical to SEQ ID NO: 103473

SEQ ID NO: 470670 - RNA, 62 nt, hsa; identical to SEQ ID NO: 103474

SEQ ID NO: 470671 - RNA, 62 nt, hsa; identical to SEQ ID NO: 103475

SEQ ID NO: 470672 - RNA, 62 nt, hsa; identical to SEQ ID NO: 103476

SEQ ID NO: 470673 - RNA, 62 nt, hsa; identical to SEQ ID NO: 103477

SEQ ID NO: 470674 - RNA, 62 nt, hsa; identical to SEQ ID NO: 103478

SEQ ID NO: 470675 - RNA, 62 nt, hsa; identical to SEQ ID NO: 103479

SEQ ID NO: 470676 - RNA, 62 nt, hsa; identical to SEQ ID NO: 103480

SEQ ID NO: 470677 - RNA, 62 nt, hsa; identical to SEQ ID NO: 103481

SEQ ID NO: 470678 - RNA, 62 nt, hsa; identical to SEQ ID NO: 103482

SEQ ID NO: 470679 - RNA, 62 nt, hsa; identical to SEQ ID NO: 103483

SEQ ID NO: 470680 - RNA, 62 nt, hsa; identical to SEQ ID NO: 103484

SEQ ID NO: 470681 - RNA, 62 nt, hsa; identical to SEQ ID NO: 103485

SEQ ID NO: 470682 - RNA, 62 nt, hsa; identical to SEQ ID NO: 103486

SEQ ID NO: 470683 - RNA, 62 nt, hsa; identical to SEQ ID NO: 103487

SEQ ID NO: 470684 - RNA, 62 nt, hsa; identical to SEQ ID NO: 103488

SEQ ID NO: 470685 - RNA, 62 nt, hsa; identical to SEQ ID NO: 103489

SEQ ID NO: 470686 - RNA, 62 nt, hsa; identical to SEQ ID NO: 103490

SEQ ID NO: 470687 - RNA, 62 nt, hsa; identical to SEQ ID NO: 103491

SEQ ID NO: 470688 - RNA, 62 nt, hsa; identical to SEQ ID NO: 103492

SEQ ID NO: 470689 - RNA, 62 nt, hsa; identical to SEQ ID NO: 103493

SEQ ID NO: 470690 - RNA, 62 nt, hsa; identical to SEQ ID NO: 103494

SEQ ID NO: 470691 - RNA, 62 nt, hsa; identical to SEQ ID NO: 103495

SEQ ID NO: 470692 - RNA, 62 nt, hsa; identical to SEQ ID NO: 103496

SEQ ID NO: 470693 - RNA, 62 nt, hsa; identical to SEQ ID NO: 103497

SEQ ID NO: 470694 - RNA, 62 nt, hsa; identical to SEQ ID NO: 103498

SEQ ID NO: 470695 - RNA, 62 nt, hsa; identical to SEQ ID NO: 103499

SEQ ID NO: 470696 - RNA, 62 nt, hsa; identical to SEQ ID NO: 103500

SEQ ID NO: 470697 - RNA, 62 nt, hsa; identical to SEQ ID NO: 103501

SEQ ID NO: 470698 - RNA, 62 nt, hsa; identical to SEQ ID NO: 103502

SEQ ID NO: 470699 - RNA, 62 nt, hsa; identical to SEQ ID NO: 103503

SEQ ID NO: 470700 - RNA, 62 nt, hsa; identical to SEQ ID NO: 103504

SEQ ID NO: 470701 - RNA, 62 nt, hsa; identical to SEQ ID NO: 103505

SEQ ID NO: 470702 - RNA, 62 nt, hsa; identical to SEQ ID NO: 103506

SEQ ID NO: 470703 - RNA, 62 nt, hsa; identical to SEQ ID NO: 103507

SEQ ID NO: 470704 - RNA, 64 nt, hsa; identical to SEQ ID NO: 257499

SEQ ID NO: 470705 - RNA, 64 nt, hsa; identical to SEQ ID NO: 257500

SEQ ID NO: 470706 - RNA, 64 nt, hsa; identical to SEQ ID NO: 257501

SEQ ID NO: 470707 - RNA, 64 nt, hsa; identical to SEQ ID NO: 257502

SEQ ID NO: 470708 - RNA, 64 nt, hsa
auacgaaauaucugcuuuuggaauaagcagaaugaggcuaaacauggguuauacaaaggguauc

SEQ ID NO: 470709 - RNA, 64 nt, hsa
aaacaaugcauucuugcuuuaaaaaaaaaaaagaaggcuaaaaaauuaccucuuuuuaaauuau

SEQ ID NO: 470710 - RNA, 64 nt, hsa
acauucagaaauguggcaaaaaaggcauagcuaaaggcuaaacauauggcuuuaguaguaacaa

SEQ ID NO: 470711 - RNA, 64 nt, hsa
ucaacaauaagccacgucaaugcauaaguuguauaggcuaaauguugcuuguaggcuacauuaa

SEQ ID NO: 470712 - RNA, 64 nt, hsa
auugccuuuuuauaaaauugaagcuauagcuuuuaggcuaaaauuuuaacguagauauuuuuau

SEQ ID NO: 470713 - RNA, 64 nt, hsa
caagguacccagaauuuuuagaagccuucagaagaggcuaaaauauccagcuuugggggaccug

SEQ ID NO: 470714 - RNA, 64 nt, hsa
cugucuucuguugggaacagccaaagggauuccaaggcuaaaucuuuguaacagcucucuuucc

SEQ ID NO: 470715 - RNA, 64 nt, hsa
gccagcucauuuccuucaauuuccuuugaccuauaggcuaaaaaagaaaggcucauuccagcca

SEQ ID NO: 470716 - RNA, 64 nt, hsa; identical to SEQ ID NO: 454921

SEQ ID NO: 470717 - RNA, 64 nt, hsa; identical to SEQ ID NO: 454922

SEQ ID NO: 470718 - RNA, 64 nt, hsa; identical to SEQ ID NO: 454923

SEQ ID NO: 470719 - RNA, 64 nt, hsa; identical to SEQ ID NO: 454924

SEQ ID NO: 470720 - RNA, 64 nt, hsa; identical to SEQ ID NO: 454925

SEQ ID NO: 470721 - RNA, 64 nt, hsa; identical to SEQ ID NO: 454926

SEQ ID NO: 470722 - RNA, 64 nt, hsa; identical to SEQ ID NO: 454927

SEQ ID NO: 470723 - RNA, 64 nt, hsa; identical to SEQ ID NO: 454928

SEQ ID NO: 470724 - RNA, 64 nt, hsa; identical to SEQ ID NO: 454929

SEQ ID NO: 470725 - RNA, 64 nt, hsa; identical to SEQ ID NO: 454930

SEQ ID NO: 470726 - RNA, 64 nt, hsa; identical to SEQ ID NO: 454931

SEQ ID NO: 470727 - RNA, 64 nt, hsa; identical to SEQ ID NO: 454932

SEQ ID NO: 470728 - RNA, 64 nt, hsa; identical to SEQ ID NO: 454933

SEQ ID NO: 470729 - RNA, 64 nt, hsa; identical to SEQ ID NO: 454934

SEQ ID NO: 470730 - RNA, 64 nt, hsa; identical to SEQ ID NO: 454935

SEQ ID NO: 470731 - RNA, 64 nt, hsa; identical to SEQ ID NO: 454936

SEQ ID NO: 470732 - RNA, 64 nt, hsa; identical to SEQ ID NO: 454937

SEQ ID NO: 470733 - RNA, 64 nt, hsa; identical to SEQ ID NO: 454938

SEQ ID NO: 470734 - RNA, 64 nt, hsa; identical to SEQ ID NO: 454939

SEQ ID NO: 470735 - RNA, 64 nt, hsa; identical to SEQ ID NO: 454940

SEQ ID NO: 470736 - RNA, 64 nt, hsa; identical to SEQ ID NO: 454941

SEQ ID NO: 470737 - RNA, 64 nt, hsa; identical to SEQ ID NO: 454942

SEQ ID NO: 470738 - RNA, 64 nt, hsa; identical to SEQ ID NO: 454943

SEQ ID NO: 470739 - RNA, 64 nt, hsa; identical to SEQ ID NO: 454944

SEQ ID NO: 470740 - RNA, 64 nt, hsa; identical to SEQ ID NO: 454945

SEQ ID NO: 470741 - RNA, 64 nt, hsa; identical to SEQ ID NO: 454946

SEQ ID NO: 470742 - RNA, 64 nt, hsa; identical to SEQ ID NO: 454947

SEQ ID NO: 470743 - RNA, 64 nt, hsa; identical to SEQ ID NO: 454948

SEQ ID NO: 470744 - RNA, 64 nt, hsa; identical to SEQ ID NO: 454949

SEQ ID NO: 470745 - RNA, 64 nt, hsa; identical to SEQ ID NO: 454950

SEQ ID NO: 470746 - RNA, 64 nt, hsa; identical to SEQ ID NO: 454951

SEQ ID NO: 470747 - RNA, 64 nt, hsa; identical to SEQ ID NO: 454952

SEQ ID NO: 470748 - RNA, 64 nt, hsa; identical to SEQ ID NO: 454953

SEQ ID NO: 470749 - RNA, 64 nt, hsa; identical to SEQ ID NO: 454954

SEQ ID NO: 470750 - RNA, 64 nt, hsa; identical to SEQ ID NO: 454955

SEQ ID NO: 470751 - RNA, 64 nt, hsa; identical to SEQ ID NO: 454956

SEQ ID NO: 470752 - RNA, 64 nt, hsa; identical to SEQ ID NO: 454957

SEQ ID NO: 470753 - RNA, 64 nt, hsa; identical to SEQ ID NO: 454958

SEQ ID NO: 470754 - RNA, 64 nt, hsa; identical to SEQ ID NO: 454959

SEQ ID NO: 470755 - RNA, 64 nt, hsa; identical to SEQ ID NO: 454960

SEQ ID NO: 470756 - RNA, 64 nt, hsa; identical to SEQ ID NO: 454961

SEQ ID NO: 470757 - RNA, 64 nt, hsa; identical to SEQ ID NO: 454962

SEQ ID NO: 470758 - RNA, 64 nt, hsa; identical to SEQ ID NO: 454963

SEQ ID NO: 470759 - RNA, 64 nt, hsa; identical to SEQ ID NO: 454964

SEQ ID NO: 470760 - RNA, 64 nt, hsa; identical to SEQ ID NO: 454965

SEQ ID NO: 470761 - RNA, 64 nt, hsa; identical to SEQ ID NO: 454966

SEQ ID NO: 470762 - RNA, 64 nt, hsa; identical to SEQ ID NO: 454967

SEQ ID NO: 470763 - RNA, 64 nt, hsa; identical to SEQ ID NO: 454968

SEQ ID NO: 470764 - RNA, 64 nt, hsa; identical to SEQ ID NO: 454969

SEQ ID NO: 470765 - RNA, 64 nt, hsa; identical to SEQ ID NO: 454970

SEQ ID NO: 470766 - RNA, 64 nt, hsa; identical to SEQ ID NO: 454971

SEQ ID NO: 470767 - RNA, 64 nt, hsa; identical to SEQ ID NO: 454972

SEQ ID NO: 470768 - RNA, 64 nt, hsa; identical to SEQ ID NO: 454973

SEQ ID NO: 470769 - RNA, 64 nt, hsa; identical to SEQ ID NO: 454974

SEQ ID NO: 470770 - RNA, 64 nt, hsa; identical to SEQ ID NO: 454975

SEQ ID NO: 470771 - RNA, 64 nt, hsa; identical to SEQ ID NO: 454976

SEQ ID NO: 470772 - RNA, 64 nt, hsa; identical to SEQ ID NO: 454977

SEQ ID NO: 470773 - RNA, 64 nt, hsa; identical to SEQ ID NO: 454978

SEQ ID NO: 470774 - RNA, 64 nt, hsa; identical to SEQ ID NO: 454979

SEQ ID NO: 470775 - RNA, 64 nt, hsa; identical to SEQ ID NO: 454980

SEQ ID NO: 470776 - RNA, 64 nt, hsa; identical to SEQ ID NO: 454981

SEQ ID NO: 470777 - RNA, 64 nt, hsa; identical to SEQ ID NO: 454982

SEQ ID NO: 470778 - RNA, 64 nt, hsa; identical to SEQ ID NO: 454983

SEQ ID NO: 470779 - RNA, 64 nt, hsa; identical to SEQ ID NO: 454984

SEQ ID NO: 470780 - RNA, 64 nt, hsa; identical to SEQ ID NO: 454985

SEQ ID NO: 470781 - RNA, 62 nt, hsa
uauugacugcagagucuauuuaagcaugugguuuuaaaaauagacaguauuuuuuaaaaauc

SEQ ID NO: 470782 - RNA, 62 nt, hsa
uaagcaugugguuuuaaaaauagacaguauuuuuuaaaaaucaaaaaaugacuugcaaauug

SEQ ID NO: 470783 - RNA, 62 nt, hsa
aaaagaagagaaaaaaaaugcccaaguugcccuuuaaaaaaaaagagcguaaauacaaacag

SEQ ID NO: 470784 - RNA, 62 nt, hsa
ugaaauauuuuaagccaaaaaaaaauucccuuuuuaaaaaaggggguuuaaauacuguuggc

SEQ ID NO: 470785 - RNA, 62 nt, hsa
agcuuguggauuaaacagaauaaauuucuaaauuuaaaaauuuugccacucuuacuuaguag

SEQ ID NO: 470786 - RNA, 62 nt, hsa
ccauucauuuggaacuuuauugcauucuuuauuuuaaaaagcuuguuuuuacguaaucauag

SEQ ID NO: 470787 - RNA, 62 nt, hsa
aggggagcauccauuauugauacaugugggcuuuuaaaaacuccauccuuuauaaauaguca

SEQ ID NO: 470788 - RNA, 62 nt, hsa
auuuucuugaauacuuuuuucauaguuauuuguuuaaaaagauuuaaaaaucauugcacuuu

SEQ ID NO: 470789 - RNA, 62 nt, hsa
auacuuuuuucauaguuauuuguuuaaaaagauuuaaaaaucauugcacuuuggucagaaaa

SEQ ID NO: 470790 - RNA, 62 nt, hsa
ccaaaggaauauucuuuuacaccaauucuuccuuuaaaaaucucugaggaauuuguuuucgc

SEQ ID NO: 470791 - RNA, 62 nt, hsa
augguauuuuuauguaaagccuugacccaauguuuaaaaauauaauuguauuuagaucuugu

SEQ ID NO: 470792 - RNA, 62 nt, hsa
uucuagauuguuaaaauuggcaaaugaacuuuuuuaaaaaucaucuuccauguugcaguuag

SEQ ID NO: 470793 - RNA, 62 nt, hsa
gauuacauaaguaaguauuccccauauaaucuuuuaaaaaguuguguaugauuauuuuaaaa

SEQ ID NO: 470794 - RNA, 62 nt, hsa
uccauaaaguuucagccauuaugggcacugguuuuaaaaaauuuauuaguuugacuauuuga

SEQ ID NO: 470795 - RNA, 62 nt, hsa
gacuauuugauguuuuuauagugauugccaacuuuaaaaaguaggcuguucauaagcacuga

SEQ ID NO: 470796 - RNA, 62 nt, hsa
uuuuuuaaaaguuuugaaaugcugcacuuacauuuaaaaaaacaacaacaacauuuuuucaa

SEQ ID NO: 470797 - RNA, 62 nt, hsa
uuuuauguuuuuuauuguuaaacuuguaucccuuuaaaaacugaaggaaauuaaaaaaaaaa

SEQ ID NO: 470798 - RNA, 62 nt, hsa
gaacucuaaaacugcaacaucugacaaauagcuuuaaaaauacaaugauuauaaguauggaa

SEQ ID NO: 470799 - RNA, 62 nt, hsa
uuauuucaaguaauaaaucugaauucuauuaguuuaaaaauuguaaaauucaaguuaaauga

SEQ ID NO: 470800 - RNA, 62 nt, hsa
acuuuaaagcugucagacucuuuuaaggguauuuuaaaaauuaguaaauuugaaugaacuaa

SEQ ID NO: 470801 - RNA, 62 nt, hsa
uuaugcuagcaugauuuuuuuauauauagaaguuuaaaaauaaaccaggucagguuuguaua

SEQ ID NO: 470802 - RNA, 62 nt, hsa
uguugcaguguuggagaugccauuuucaccuuuuuaaaaagaugcauuuuauuugcagguuu

SEQ ID NO: 470803 - RNA, 62 nt, hsa
auacauuuuaggaaauguuacuuuuguuaaucuuuaaaaaauacaccuaaugaaagacauuc

SEQ ID NO: 470804 - RNA, 62 nt, hsa
cagccacuauaacuugauaagucauugcacuauuuaaaaaguuuuaguaauaucaugaauuu

SEQ ID NO: 470805 - RNA, 62 nt, hsa
ucacucuguuucucuucugcuggauuauauaauuuaaaaauaauguguucccguauuuugua

SEQ ID NO: 470806 - RNA, 62 nt, hsa
ugacauuauugucuccauaauugagugauagcuuuaaaaaaaagauuaguuuugcuuaagaa

SEQ ID NO: 470807 - RNA, 62 nt, hsa
agugcauuuggaugagauagaagaaauuguuuuuuaaaaaguuuaaguaccaaagguagucu

SEQ ID NO: 470808 - RNA, 62 nt, hsa
uacauuguaaaauaaaguugagcuuaguuuuuuuuaaaaaaaaaaacaaagcaacaaauuaa

SEQ ID NO: 470809 - RNA, 62 nt, hsa
augcuaucacugucuuugacugugauuuuauguuuaaaaaguauguucuaaaauuauuauau

SEQ ID NO: 470810 - RNA, 62 nt, hsa
aaaacaaagaaaugguaaaugaauuguuugcauuuaaaaaaaaaaacucuuaagaaaacugu

SEQ ID NO: 470811 - RNA, 62 nt, hsa
uaaaguguauauuuuuguguccaguuauauuauuuaaaaaaguguuacuuuguaaaaauugu

SEQ ID NO: 470812 - RNA, 62 nt, hsa
cuuucauucccacaaaaccaguauuacuuuuuuuuaaaaaaagaaagaaauuggaaaucugu

SEQ ID NO: 470813 - RNA, 62 nt, hsa
aucuagaugaagggagcuuuuggaugugugccuuuaaaaacugauuauguauaaauacugau

SEQ ID NO: 470814 - RNA, 62 nt, hsa
uuuuggaauuugguugaagucacuuugauuucuuuaaaaaacaucuuuucaaugaaaugugu

SEQ ID NO: 470815 - RNA, 62 nt, hsa
cagugcaauuaaaccgagagaugucuuguuuuuuuaaaaagaauaguauuuaauagguuucu

SEQ ID NO: 470816 - RNA, 62 nt, hsa
acaaaguuuuucagaaaagaggaaaaaaagaauuuaaaaaaggaucuccacucuucaugacu

SEQ ID NO: 470817 - RNA, 62 nt, hsa
aauuuaacugguuuuuacuacugaugacuugauuuaaaaaaaauacaaagaugcuggaugcu

SEQ ID NO: 470818 - RNA, 62 nt, hsa
agagagugaucuauccuaaugacauuuuacuguuuaaaaaaguuuccuagccaugaagcccu

SEQ ID NO: 470819 - RNA, 62 nt, hsa
ucuaugaccaggccuuaagggaaggucaguuuuuuaaaaaaccaaguagugucuuccuaccu

SEQ ID NO: 470820 - RNA, 62 nt, hsa
uuugucucucugacuugauuucuauaaaugcuuuuaaaaacaagugaagccccucuuuauuu

SEQ ID NO: 470821 - RNA, 62 nt, hsa
uaauaagugcauguaggaauugcaaaaaauauuuuaaaaauuuauuacugaauuuaaaaaua

SEQ ID NO: 470822 - RNA, 62 nt, hsa
ugcaaaaaauauuuuaaaaauuuauuacugaauuuaaaaauauuuuagaaguuuuguaaugg

SEQ ID NO: 470823 - RNA, 62 nt, hsa
uuaccuuagucacuugccuagcaguguguggcuuuaaaaacuagagauuuuucagucuuagu

SEQ ID NO: 470824 - RNA, 62 nt, hsa
cacaauuugcacuguguucauauuaauccucuuuuaaaaaaggaaauauacagaagacaaac

SEQ ID NO: 470825 - RNA, 62 nt, hsa
ugggcaacauagaaaccugugucuacaaaaaauuuaaaaauuagccaaguauggugacaggc

SEQ ID NO: 470826 - RNA, 62 nt, hsa
ugagccuggcaagaauguguuuaaacuugguuuuuaaaaaacugcugacuguuuucucuuga

SEQ ID NO: 470827 - RNA, 62 nt, hsa
gaaagcccugagcuuucugcuaucaaagagguuuuaaaaaaaucccauuuaaaaaaaauccc

SEQ ID NO: 470828 - RNA, 62 nt, hsa
ucugcuaucaaagagguuuuaaaaaaaucccauuuaaaaaaaaucccuuaccucggugccuu

SEQ ID NO: 470829 - RNA, 62 nt, hsa
ucucauaguguagugaacuucaaccccaaaauuuuaaaaauguauuuccccccaguuuuaaa

SEQ ID NO: 470830 - RNA, 62 nt, hsa
uauuuccccccaguuuuaaauugccuuugaaauuuaaaaaaaaaaaauuuagacuuaguacc

SEQ ID NO: 470831 - RNA, 62 nt, hsa
caauagauguagcucuaucaugucuagcauaauuuaaaaaaucaguguuuuuaggauuuggg

SEQ ID NO: 470832 - RNA, 62 nt, hsa
uauuuuauguccauuugaguagguagguagguuuuaaaaauacuaguuaaaaugccacaagc

SEQ ID NO: 470833 - RNA, 62 nt, hsa
gaaaggcauucagaaauuaugguuucuaccuuuuuaaaaaguagaugggauugugucaaucu

SEQ ID NO: 470834 - RNA, 62 nt, hsa
gugaugucgaugucucugucuuuuuuuuugucuuuaaaaaauaauuggcagcaacuguauuu

SEQ ID NO: 470835 - RNA, 53 nt, hsa
cuacaaaggagcacaaaugagccuuuaaaaaccaauucugagacugaacuuuu

SEQ ID NO: 470836 - RNA, 62 nt, hsa
ggacugcaauuauucaguauuuuuuucuuuccuuuaaaaaaauauaucugaaguuucuugug

SEQ ID NO: 470837 - RNA, 62 nt, hsa
uuuucaugguauuuucuuccauaauaucucauuuuaaaaagaaguucuuuaugaacuuagug

SEQ ID NO: 470838 - RNA, 62 nt, hsa
uagguauauuuccaacuuuauauaucacaguauuuaaaaagacauguuugcauugagaaauu

SEQ ID NO: 470839 - RNA, 62 nt, hsa
ugcccucacgucaguuguacauggcauggaacuuuaaaaauuuuaauauaaacuuucaucca

SEQ ID NO: 470840 - RNA, 62 nt, hsa
uuuuaaagauaccagugggacagauuugguuuuuuaaaaaucucauguguucaaauuaacau

SEQ ID NO: 470841 - RNA, 62 nt, hsa
ccuuuaaacugaaauaugucaugugaaauuauuuuaaaaauguaaaaacaaaacuuucugcu

SEQ ID NO: 470842 - RNA, 62 nt, hsa
aauguguguuacauggucuguaaauauuuguauuuaaaaaugccaugcauuaggcuuuggaa

SEQ ID NO: 470843 - RNA, 62 nt, hsa
gaagcaauuucuguuuacauguccuugcuacuuuuaaaaacuugcauuuauuccucagauuu

SEQ ID NO: 470844 - RNA, 62 nt, hsa
uacuuuuaaaaacuugcauuuauuccucagauuuuaaaaauaaauaaauaauucauuuaaga

SEQ ID NO: 470845 - RNA, 62 nt, hsa
gcuaauuaaaaacuugcuuuaaagauauugaauuuaaaaaggcauaauaaucaaauacuuaa

SEQ ID NO: 470846 - RNA, 62 nt, hsa
cagucuuuuucaucauccaaguuuguaguucauuuaaaaauacaacauuaaacacauuuugc

SEQ ID NO: 470847 - RNA, 62 nt, hsa
gaacuaaugucucauaugauguauuuacuuauuuuaaaaaaaagaauaggaaugagaugucc

SEQ ID NO: 470848 - RNA, 62 nt, hsa
gauagucaaauacacguuuagauuaaaacuaguuuaaaaaauuauaaaugaaucuaaucaaa

SEQ ID NO: 470849 - RNA, 62 nt, hsa
aacacacacagaaugggcugguuucuuucaaguuuaaaaaaagcccccuucuccaugcacaa

SEQ ID NO: 470850 - RNA, 62 nt, hsa
cacuccagccuaggagacaaaacgagacuucauuuaaaaaaaauaaaaauaaaaauaaaaau

SEQ ID NO: 470851 - RNA, 62 nt, hsa
gggaaggaacaggcccaugggaagaaggggguuuuaaaaacaugucuucaacucagcagaga

SEQ ID NO: 470852 - RNA, 62 nt, hsa
agguuuauguugauguuuacccacuacaauuuuuuaaaaauauaagcucacaugccuuuucc

SEQ ID NO: 470853 - RNA, 62 nt, hsa
uguuuccccaaagggaagccagucauugaccauuuaaaaagucuccugcuaaguauggaaau

SEQ ID NO: 470854 - RNA, 62 nt, hsa
auuuucuuuuuaaaugucuuucuuauauggguuuuaaaaaaaaguaauaaaagccuguugca

SEQ ID NO: 470855 - RNA, 62 nt, hsa
ucacucaugucugucauuuuauaagcauaucauuuaaaaagcuucuaaaaagcuauuucgcc

SEQ ID NO: 470856 - RNA, 62 nt, hsa
gggaacuuuaaaauuucaucucaaaaauaauuuuuaaaaagccugagguaugauauagcaua

SEQ ID NO: 470857 - RNA, 62 nt, hsa
aaaauauauuucccuguaagcugaauuacucauuuaaaaauuuuaacuucuauaugggaccc

SEQ ID NO: 470858 - RNA, 62 nt, hsa
ggauucauaaucacaaauauagagaauuccuauuuaaaaaaauagaaaaauagugaagacua

SEQ ID NO: 470859 - RNA, 62 nt, hsa
aacauuguggauguguaaacaggcaccacugcuuuaaaaaacaauuaucccuuacagacuug

SEQ ID NO: 470860 - RNA, 62 nt, hsa
guagcgggauaagucacuguuuucuuuauuucuuuaaaaaaaaaaaaguucuguugcaaacg

SEQ ID NO: 470861 - RNA, 62 nt, hsa
aaaauaaugaucucagacuuucuaaguuaaauuuuaaaaauuuugauuguuugccauauugg

SEQ ID NO: 470862 - RNA, 62 nt, hsa
ugcugccaaggccacaucaccaauuuucucgauuuaaaaaacugucaagagauuuauuuuuc

SEQ ID NO: 470863 - RNA, 62 nt, hsa
ucugucccccacugcaugaacaucuauacaauuuuaaaaauacuuccucauaggaugcuuug

SEQ ID NO: 470864 - RNA, 62 nt, hsa
gcauaggaauuuggaauccaagagcuauaauuuuuaaaaaaaaaaaucuuuuauuuuaauac

SEQ ID NO: 470865 - RNA, 62 nt, hsa
aaaagaauaucuucuaaagauuucuuuauauauuuaaaaacccacaacuaaaaauguaucca

SEQ ID NO: 470866 - RNA, 62 nt, hsa
acuuuaaggcuuguaaauacauagaacaaauauuuaaaaaaacaaaaagaaauugacucagu

SEQ ID NO: 470867 - RNA, 62 nt, hsa
aaaugcuguggaccacagaacuccaagaauuguuuaaaaaaaaaaaagugcuacccugagaa

SEQ ID NO: 470868 - RNA, 62 nt, hsa
uuucugccugccucucagcuugcuucagaaaauuuaaaaaaucacaauaguaaucaaaacau

SEQ ID NO: 470869 - RNA, 62 nt, hsa
aaaugaaacaaaagaaacaauuuaaguauuuuuuuaaaaaguuucacgucuucgccaaucac

SEQ ID NO: 470870 - RNA, 62 nt, hsa
gaauaaauguucuuuauacagccuaguuaauguuuaaaaagaaaaaaauagcuugguuuuau

SEQ ID NO: 470871 - RNA, 62 nt, hsa
ucagggugguugguuuaacaaaaaaaaaaagcuuuaaaaaaaaaagaaaaaaaggaaaaggu

SEQ ID NO: 470872 - RNA, 62 nt, hsa
ugugagccauggcacccggucuugguuuauauuuuaaaaagacaacuguguagcugggcgug

SEQ ID NO: 470873 - RNA, 62 nt, hsa
uucuucugguucauccaguaaucucuuucuuuuuuaaaaauguggcgacaaggucuugcucu

SEQ ID NO: 470874 - RNA, 62 nt, hsa
acacagggagacccccucucuacaaaaacauuuuuaaaaaauuagcuggguguggugaugca

SEQ ID NO: 470875 - RNA, 62 nt, hsa
ugguugcucagccucugagggcaauacaggcauuuaaaaaauuaaaaugaccaggcacagug

SEQ ID NO: 470876 - RNA, 62 nt, hsa
cccucccccauuuagauuauuuauuaacauauuuuaaaaaucagaugaguucuauaaauaau

SEQ ID NO: 470877 - RNA, 62 nt, hsa
ugggggccaauggcacaguaccuuacucaucauuuaaaaacuauauuuacagaagauguuug

SEQ ID NO: 470878 - RNA, 62 nt, hsa
aaauguucuaccuguauaugguaauguccaguuuuaaaaauauuggacaucuucaaucuuaa

SEQ ID NO: 470879 - RNA, 62 nt, hsa
ugccacauuuauugauaaacagugaaggaauuuuuaaaaaauuuuuaagaauuguuugucac

SEQ ID NO: 470880 - RNA, 62 nt, hsa
ccauucacaccuaaagacugaauuuuaucuguuuuaaaaaugaacuucucccgcuacacaga

SEQ ID NO: 470881 - RNA, 62 nt, hsa
uuguuuuuaaauuucuuuucuuccagagauuguuuaaaaauaaauauugacaaaaauaaugu

SEQ ID NO: 470882 - RNA, 62 nt, hsa
cauaaaagcaaguacauauaguagugacuauauuuaaaaaaacagcauaaaaugcuuaaaaa

SEQ ID NO: 470883 - RNA, 62 nt, hsa
gguaccuaucugcuccaauuauauuuuuaacauuuaaaaaccaaaguccucuacacuugauu

SEQ ID NO: 470884 - RNA, 62 nt, hsa
gaaagcacugaguugagcaagcaauuccuuuauuuaaaaaaaaaaguacguauuuagauaau

SEQ ID NO: 470885 - RNA, 62 nt, hsa
aggugucuuggucaugauaaauugugauucuuuuuaaaaauuuuuuccaaaaacaauuaggu

SEQ ID NO: 470886 - RNA, 62 nt, hsa
uuuacccuuuacauuuuuguaucauaauagauuuuaaaaaucuaauguucuuuauugcaaga

SEQ ID NO: 470887 - RNA, 62 nt, hsa
acagcucauuuugucuuuuucaauauacaaauuuuaaaaauacuacaauauuuaacuaaggc

SEQ ID NO: 470888 - RNA, 62 nt, hsa
agagcagcuuagauuucccuacuggcaagguuuuuaaaaaugagguaaaugccguauaugau

SEQ ID NO: 470889 - RNA, 62 nt, hsa
uuuauggaaacuaauauagguugguuuuacaauuuaaaaaguauauucuauaauaaauaaua

SEQ ID NO: 470890 - RNA, 62 nt, hsa
agaacaaaaagcacuuuuaucccauuuauuucuuuaaaaaauguaaggauuucauuuauauu

SEQ ID NO: 470891 - RNA, 62 nt, hsa
gccuuaguuuguuuauugacauuaacgaguguuuuaaaaagguuuuuaaugaauagucuuaa

SEQ ID NO: 470892 - RNA, 62 nt, hsa
cuuucuaaucuguuuuaucauugcuacagguuuuuaaaaaagaaccuuucacuagcuagcac

SEQ ID NO: 470893 - RNA, 62 nt, hsa
caaaguaaaauucuucucaggcaacauuugcuuuuaaaaauaaucaugaagagaaggcuguu

SEQ ID NO: 470894 - RNA, 62 nt, hsa
ugcagcuucuaggacccgguuucuuuuacugauuuaaaaacaaaacaaaaaaaaauaaaaaa

SEQ ID NO: 470895 - RNA, 62 nt, hsa
ugaggaccauaugaggguagaauauauuaucuuuuaaaaauuacaaaaauuuguauaggcaa

SEQ ID NO: 470896 - RNA, 62 nt, hsa
uacaccaguuuuaacaccuuccucguguuauguuuaaaaaaauaaauaaauuuaagaaaacc

SEQ ID NO: 470897 - RNA, 62 nt, hsa
uuaacguguuacauuuaguaaaccauagauuuuuuaaaaacuacauuuuguaaggccacaca

SEQ ID NO: 470898 - RNA, 62 nt, hsa
auccaauuugaauaagucaugcuuuccuagaauuuaaaaauaaaaaagucuuccucuggaaa

SEQ ID NO: 470899 - RNA, 62 nt, hsa
ucagcaacacuagcacuucacuauuauaguuuuuuaaaaaguguauuauucuuaucuguagu

SEQ ID NO: 470900 - RNA, 62 nt, hsa
agaauccaaauaaacccugaauauuuaguaaguuuaaaaagacaaauugagaacaaguagac

SEQ ID NO: 470901 - RNA, 62 nt, hsa
gguugaguaacuuagaacugaaaaugaucucuuuuaaaaagaaauuaaaucagacaccacau

SEQ ID NO: 470902 - RNA, 62 nt, hsa
auguucccaaccacuuuuugaauggugugccauuuaaaaauccaggccagauccuauuauaa

SEQ ID NO: 470903 - RNA, 62 nt, hsa
gccaggagcuaauuguucaagaaguguugaacuuuaaaaagacaagaccacuuguugaaauc

SEQ ID NO: 470904 - RNA, 62 nt, hsa
uucuacagcaacccuagauauaaaauuguggcuuuaaaaaugcaugaaaccaccuuuaauua

SEQ ID NO: 470905 - RNA, 62 nt, hsa
cuuuucucucuuccacaaaauuggaagcuuuuuuuaaaaauguuuuccccacaagucaucuu

SEQ ID NO: 470906 - RNA, 62 nt, hsa
cuuuguaaaauucucccucaccccacccugcuuuuaaaaauucuaaucuauccccucuaacc

SEQ ID NO: 470907 - RNA, 62 nt, hsa
cgagaaaaaaaguuuuaauguauuggagaaguuuuaaaaaacccagaaaaacgcuuuuuuuu

SEQ ID NO: 470908 - RNA, 62 nt, hsa
gcgcgcacguguguguagguggguauguguuguuuaaaaauauauauuauuuuguauaauau

SEQ ID NO: 470909 - RNA, 62 nt, hsa
agguguacguaucauuucuaauuuuaaguuauuuuaaaaaaauucaucauaugaauguucuu

SEQ ID NO: 470910 - RNA, 62 nt, hsa
gacuuuuuuucugauucaaaagugaacuugauuuuaaaaaccagucaagagcaaucaaagca

SEQ ID NO: 470911 - RNA, 62 nt, hsa
acauaagaguaagcucuauuaugaaauacaacuuuaaaaaauuuuagcuauaaauuauauaa

SEQ ID NO: 470912 - RNA, 62 nt, hsa
gaguuaaacuuuaggaaaaaggauucccuuuuuuuaaaaaaaaucaauaccucaaaagcagg

SEQ ID NO: 470913 - RNA, 62 nt, hsa
aacaugacccauaguauuaaauacauaucauuuuuaaaaauaaaaaaaaacccaaaaauaau

SEQ ID NO: 470914 - RNA, 62 nt, hsa
cagaaaauuauguguauccacaaccuaguuauuuuaaaaauuauguugacuaaauacaaagu

SEQ ID NO: 470915 - RNA, 62 nt, hsa
uaugcuuguauaaaacacuguucacuguuuuuuuuaaaaaaaaaacuugauuuguuauuaac

SEQ ID NO: 470916 - RNA, 62 nt, hsa
uacguucccauucuaauuaaugcccuuucuuauuuaaaaacaaaaccaaaugauaucuaagu

SEQ ID NO: 470917 - RNA, 62 nt, hsa
uaagaagauuaaaagagaaaaaaaaaggcccuuuuaaaaauaguauacacuuauuuuaagug

SEQ ID NO: 470918 - RNA, 62 nt, hsa
gaacaauguauacaaugcacuuuuaugaaguuuuuaaaaauaaaggaaaacaaaaaacuuua

SEQ ID NO: 470919 - RNA, 62 nt, hsa
caucaaugcaguucucacgaaaguauuuacuuuuuaaaaauaacugagauauuauuuuaaau

SEQ ID NO: 470920 - RNA, 62 nt, hsa
auauaacaaaaaagguuucccaaaacaaucuauuuaaaaaacuguauaaggagauucugugu

SEQ ID NO: 470921 - RNA, 62 nt, hsa
uuuuauaauaauccaaacucuaugaaagcaauuuuaaaaauuauuaagguuuuaugaaguug

SEQ ID NO: 470922 - RNA, 62 nt, hsa
aacuagauggaaauauauguaauucucucauauuuaaaaacguaaucucuucucuuagaagu

SEQ ID NO: 470923 - RNA, 62 nt, hsa
agcacaguugaaguccuagaauaauggauuuuuuuaaaaaaaaaaaguuguuaguuugaaua

SEQ ID NO: 470924 - RNA, 62 nt, hsa
uacuguuagucuguuagucuuucaaauugacuuuuaaaaauacauaucuuuaugauuuucau

SEQ ID NO: 470925 - RNA, 62 nt, hsa
uggggaaagauauuuaauauuuaauacuaagcuuuaaaaagaaaccugcuaucauugcuaug

SEQ ID NO: 470926 - RNA, 62 nt, hsa
cugcgggguggaggaggaacuucccaagugcuuuuaaaaauaacuucuuugcugaagugaga

SEQ ID NO: 470927 - RNA, 62 nt, hsa
ggagaugaguaguuguguuacaguucauuuucuuuaaaaaaaaguauuuugagaaaaggugc

SEQ ID NO: 470928 - RNA, 62 nt, hsa
uucucccgcaauuuguuccuucuuuuuaccuuuuuaaaaaucuguuagaagaaaaaaagcag

SEQ ID NO: 470929 - RNA, 62 nt, hsa
uaaugaccugcuaauauauuuuaagaacauguuuuaaaaagauacacucuaucacauauuua

SEQ ID NO: 470930 - RNA, 62 nt, hsa
ugcauuauuuuacaugugcaaaucagaauauauuuaaaaaaaagcaaaagaaauucaaugga

SEQ ID NO: 470931 - RNA, 62 nt, hsa
gucuuuguacuaaagcauuugcuauaauuauuuuuaaaaaaacaaacagaugaaaaccucag

SEQ ID NO: 470932 - RNA, 62 nt, hsa
acaggcgggagccacugcacauggcagcauuuuuuaaaaauucaguuuuaagaucucugguu

SEQ ID NO: 470933 - RNA, 62 nt, hsa
cucacaaauaggaaauaaaacuaaaacguggauuuaaaaagaacugcacgggcuuuagggua

SEQ ID NO: 470934 - RNA, 62 nt, hsa
ugauucuauaagauuauuuauauauguaaguguuuaaaaagauuauuuuccagaaaguuugu

SEQ ID NO: 470935 - RNA, 62 nt, hsa
cugugauaggaguucagaaauuggcacaucccuuuaaaaauaacaacagaaaauacaacucc

SEQ ID NO: 470936 - RNA, 62 nt, hsa
aaugaaggacaaaugaauccugaaggaagauuuuuaaaaauguuuuguuucuucuuacaaau

SEQ ID NO: 470937 - RNA, 62 nt, hsa
uccccuuuuuucuaaauuugaaauagcuuuaguuuaaaaaaaaauccucccuucccccuuuc

SEQ ID NO: 470938 - RNA, 62 nt, hsa
uuuaauccuagcucuuuguuauucaccagcuuuuuaaaaaaguguuugaaaauuauacauuc

SEQ ID NO: 470939 - RNA, 62 nt, hsa
ucuggaaucucacucuuguuuuucacaguaauuuuaaaaacguuucuacuccaauuaagaau

SEQ ID NO: 470940 - RNA, 62 nt, hsa
gagugcuucugaaguacaguuuaaaaacacuuuuuaaaaaguggaguaaaagugaggcacau

SEQ ID NO: 470941 - RNA, 62 nt, hsa
aucugaguuuucagagugcuucugaaguacaguuuaaaaacacuuuuuaaaaaguggaguaa

SEQ ID NO: 470942 - RNA, 62 nt, hsa
guugccccguaaaaggguuaacagcacaauuuuuuaaaaauaaauuaagaaguauuuauagg

SEQ ID NO: 470943 - RNA, 62 nt, hsa
ucaauccugguaaccaaauauuaaagauucucuuuaaaaaagacugaacauguuuacagguu

SEQ ID NO: 470944 - RNA, 62 nt, hsa
acaaaaaaauaucagacaagcacuauuuuauauuuaaaaauuguuucuugacaagcugacuu

SEQ ID NO: 470945 - RNA, 62 nt, hsa
cauuucuacaucuuagcagugacaaacugcaauuuaaaaaguguguuugguuauuaauauau

SEQ ID NO: 470946 - RNA, 62 nt, hsa
gacuaauucaagaaguugcaggauacacaauuuuuaaaaaucucauuucuacaucuuagcag

SEQ ID NO: 470947 - RNA, 62 nt, hsa
ugggaaaugagaaguuauaccaauaaaaagcauuuaaaaauuuaggggauauuguaacccag

SEQ ID NO: 470948 - RNA, 62 nt, hsa
uuaaaguagcaaagucauggauuguauugacuuuuaaaaauauaguaaaagucauauuuaaa

SEQ ID NO: 470949 - RNA, 62 nt, hsa
acauuuuugauacauaacagaccucagucuuuuuuaaaaauuaauauauuuucaggcguauu

SEQ ID NO: 470950 - RNA, 62 nt, hsa
gcaugcaaguauguugguacguuauguccugguuuaaaaaggauuaaaauuuuaaaauaauc

SEQ ID NO: 470951 - RNA, 62 nt, hsa
uaaaauaauccuugcaucuaaaggccuugugguuuaaaaaaaaaaagcaaacuuuuuuuugu

SEQ ID NO: 470952 - RNA, 62 nt, hsa
uuuagcaaaaaagaaaaaaaaaaggcacauaguuuaaaaaguuucucauuuugugcaauaua

SEQ ID NO: 470953 - RNA, 62 nt, hsa
aggcaaauauuguagcuauauuacagugggauuuuaaaaaucuuguuaaacauucuauaaag

SEQ ID NO: 470954 - RNA, 62 nt, hsa
caaauuaaaaaaacauuuuuuucuugguagucuuuaaaaauuaggggauugaaaggauccag

SEQ ID NO: 470955 - RNA, 62 nt, hsa
auuuugcauguguaaagcuucaugaaguucucuuuaaaaaauaccaaagcuuguuuauuucu

SEQ ID NO: 470956 - RNA, 62 nt, hsa
cuucacaacuaggagagcaugccgucuugauguuuaaaaaacccagggucuccacccuuccu

SEQ ID NO: 470957 - RNA, 62 nt, hsa
gcagcccauguucucuaaugccacugcucuguuuuaaaaacucagaggcaauuuuuacauau

SEQ ID NO: 470958 - RNA, 62 nt, hsa
aagacacacauuccuuugaaauccacccaguguuuaaaaagcaacuuggaaauuuacacauu

SEQ ID NO: 470959 - RNA, 62 nt, hsa
caccaucuaaagaaaagaggucuuguuuuuuguuuaaaaaaguuuguggggaggaaagacau

SEQ ID NO: 470960 - RNA, 61 nt, hsa
caauggacugcuggugcagaagaauaaacaacuuuaaaaauaacagucugccuacuuuguu

SEQ ID NO: 470961 - RNA, 62 nt, hsa
agacuugaaagaaagagccacuuaaauucuuguuuaaaaauaccaauuugccuccuccuucc

SEQ ID NO: 470962 - RNA, 62 nt, hsa
auacuguauuuucuucuaaauuaacccuaauguuuaaaaacucacuuucccccuuuaauuga

SEQ ID NO: 470963 - RNA, 62 nt, hsa
uacauuaaaaaggaauuuuagagauugauuguuuuaaaaaaaaauacgcacauuguccaauc

SEQ ID NO: 470964 - RNA, 62 nt, hsa
ucauuaaauuuaaaggauggaaauuuaucauguuuaaaaauuauucaagcacucuuaaaacc

SEQ ID NO: 470965 - RNA, 62 nt, hsa
uuuucuuuuucuuuucuuuuuuuuuuuuuuuuuuuaaaaaagcaccuuuuuuuguuguuucc

SEQ ID NO: 470966 - RNA, 62 nt, hsa
uucaucugugugaaagccuuuuucuucuuugauuuaaaaaaauuaacuauacaguuaauggu

SEQ ID NO: 470967 - RNA, 62 nt, hsa
uuuuuaagaucauuaugugcaaaacaccaaguuuuaaaaauaacucacagaauggccuuagu

SEQ ID NO: 470968 - RNA, 62 nt, hsa
ccuuggcuacuguuuuucuuuuacuucaguuuuuuaaaaaucucaaaugaaaaagucuucga

SEQ ID NO: 470969 - RNA, 62 nt, hsa
uuguaauauguaaaguaagcccaacaaaaauuuuuaaaaauuugaugauccccaauauaucu

SEQ ID NO: 470970 - RNA, 62 nt, hsa
uuguugaagcucuagcuuaagaagaaacuuuuuuuaaaaagacuguuuggggauucuuuuuc

SEQ ID NO: 470971 - RNA, 62 nt, hsa
acuaauuaacccauuugugcauugaguuuucuuuuaaaaaugcuuguugugaaagacacaga

SEQ ID NO: 470972 - RNA, 62 nt, hsa
uguuguaaauacuuggacagagguugcugaacuuuaaaaaaaauuaauuuauuauuauaaug

SEQ ID NO: 470973 - RNA, 62 nt, hsa
gccucucugggcccaauaaaacaacacacauuuuuaaaaaauauggguauugauguccggcu

SEQ ID NO: 470974 - RNA, 62 nt, hsa
uuacaaagcuaguugccauauuucuauuuuauuuuaaaaaguaaacaugcggcugggcgugg

SEQ ID NO: 470975 - RNA, 62 nt, hsa
ggucauuuugaccuugcuuuguuaauaauaucuuuaaaaacaaagacaauccuuaaagcuuu

SEQ ID NO: 470976 - RNA, 62 nt, hsa
cuguggcaauguacuguucucacauuaagccuuuuaaaaauguuccauacuguauuagcauc

SEQ ID NO: 470977 - RNA, 62 nt, hsa
ugaugacauucaguucucuuuuguuuuuauuuuuuaaaaacucagguguaauuauuaucugu

SEQ ID NO: 470978 - RNA, 62 nt, hsa
ccuccaaaggugaaaaaacaaugcauucuugcuuuaaaaaaaaaaaagaaggcuaaaaaauu

SEQ ID NO: 470979 - RNA, 62 nt, hsa
acucccuacaguccuucaauggaaaaguaacauuuaaaaauccuuuggguaauucgaauuac

SEQ ID NO: 470980 - RNA, 62 nt, hsa
aauaauuacuggcaguagguuauaauuggugguuuaaaaauaacauuggaauacaggacuug

SEQ ID NO: 470981 - RNA, 62 nt, hsa
augagucccucaggaaaaaaaaaaaauucuguuuuaaaaagcaaucugauucuuagcucuug

SEQ ID NO: 470982 - RNA, 62 nt, hsa
ccaaggagcaucccuaauucuucauagggaccuuuaaaaagcaggaaauaccaacugaaguc

SEQ ID NO: 470983 - RNA, 62 nt, hsa
guuauccauauuacguuguuucuuauagauuuuuuaaaaaaaaugugaaauuuuuccacacu

SEQ ID NO: 470984 - RNA, 62 nt, hsa
cauucuaguauuaaauccucacuucaggagcuuuuaaaaauacugagacccccccauaacca

SEQ ID NO: 470985 - RNA, 62 nt, hsa
aacauggugaaaccccaucucuacaaaaaauuuuuaaaaaguuggccaggcaugguaaugcg

SEQ ID NO: 470986 - RNA, 62 nt, hsa
aaagaauagccacaauuagcugaaaaggcuauuuuaaaaacuuuuccaacugcguaucugug

SEQ ID NO: 470987 - RNA, 62 nt, hsa
aaccuccagaacugugaaaaauaaauuuguuauuuaaaaagaaaaaaaaaaaaacaaaaacc

SEQ ID NO: 470988 - RNA, 62 nt, hsa
ccgaaagcucacagauugcagaaauuagcuuuuuuaaaaaacaaaccccaguaaauauaauu

SEQ ID NO: 470989 - RNA, 61 nt, hsa
ucauauuugcacaggaaaaauaaagaccuggauuuaaaaauaggaaugacucuugcuucag

SEQ ID NO: 470990 - RNA, 62 nt, hsa
ggcacuucagaguagagggcuugggaagaucuuuuaaaaaggcaguaggcccgguguggugg

SEQ ID NO: 470991 - RNA, 62 nt, hsa
acauguaacauagauuuauguaaugcuuuauguuuaaaaacauuccccaauuaucuuauuua

SEQ ID NO: 470992 - RNA, 62 nt, hsa
cuaauuuuauauauagagaaagugaccuauuuuuuaaaaaaaucacacucuaaguucuauug

SEQ ID NO: 470993 - RNA, 62 nt, hsa
aauuuugguaccauaccaacuggaauuuaggcuuuaaaaauaauguuucaaggccaggugug

SEQ ID NO: 470994 - RNA, 62 nt, hsa
ugaaauuugcugcugauauguugaguuuguucuuuaaaaaauagcucauauaucucaucuuu

SEQ ID NO: 470995 - RNA, 62 nt, hsa
guggaaaaaucuaaacauuuuuaucuucauaauuuaaaaaauauauauguauauauugcaua

SEQ ID NO: 470996 - RNA, 62 nt, hsa
gguagagaugauuucaauccaaauacucuuacuuuaaaaaauuuccuuuccccaagaaucuc

SEQ ID NO: 470997 - RNA, 62 nt, hsa
uaugccucccguggguauacguuuuuaccuuuuuuaaaaaacauuuuuguagaaaaaauaau

SEQ ID NO: 470998 - RNA, 62 nt, hsa
uuccaauaaguaucuuaggaacuuauuuccuuuuuaaaaaauauuuuuuaaauuuuuaaaau

SEQ ID NO: 470999 - RNA, 62 nt, hsa
cacugacuacaugcuggaaugacugugaagcuuuuaaaaaauguuagugcccacucuucccc

SEQ ID NO: 471000 - RNA, 62 nt, hsa
uaaaaaacagaguauuuuauguaauuucuguuuuuaaaaagacauuauuaaaugggucaaag

SEQ ID NO: 471001 - RNA, 62 nt, hsa
uaaaucuaggcaggauacugcauuuuugugguuuuaaaaaaguccuuaggacagacugaauu

SEQ ID NO: 471002 - RNA, 62 nt, hsa
ugugguuuuauugaaugucuauuugaguaucauuuaaaaaguauuugccuuuuacugucauc

SEQ ID NO: 471003 - RNA, 62 nt, hsa
gccaaauuauuucagcauauuccggugauaacuuuaaaaauuagauacauuuucuuaacauu

SEQ ID NO: 471004 - RNA, 62 nt, hsa
gguuuuaaaauugucaagaguuauucuguuuguuuaaaaaguaagaaaccucuguaagcaau

SEQ ID NO: 471005 - RNA, 62 nt, hsa
caagcaucucauuuaaauaaagguuugucaucuuuaaaaauacagcaauaugugacuuuuua

SEQ ID NO: 471006 - RNA, 62 nt, hsa
gucaucuuuaaaaauacagcaauaugugacuuuuuaaaaaagcugucaaauaggugugaccc

SEQ ID NO: 471007 - RNA, 62 nt, hsa
gugugacccuacuaauaauuauuagaaauacauuuaaaaacaucgaguaccucaagucaguu

SEQ ID NO: 471008 - RNA, 62 nt, hsa
agucucauuuugauaaucauuugcuuccaguguuuaaaaauuaaaaaaagaauggggagaag

SEQ ID NO: 471009 - RNA, 62 nt, hsa
auuccaaauucaccuagcaauaaaaucuaauuuuuaaaaaguauauaaauauaaaauguaua

SEQ ID NO: 471010 - RNA, 62 nt, hsa
uauaugagacuugccagucaaaugcuauuugguuuaaaaaaauuauugcaaucucaaguuaa

SEQ ID NO: 471011 - RNA, 62 nt, hsa
acugcugugaaaaacaauuuauguuugcaggguuuaaaaaucaguaaaaaugggaaugauug

SEQ ID NO: 471012 - RNA, 62 nt, hsa
uuuugauauuggugaauuagucaccaguaaauuuuaaaaaagcacuugguugaaaauuguac

SEQ ID NO: 471013 - RNA, 62 nt, hsa
uaacuuuuauaagucccauuuauaaacccacuuuuaaaaauaacagguccaaguuagaguga

SEQ ID NO: 471014 - RNA, 62 nt, hsa
gaucuucacauuugcacuccaguuuuuuuuucuuuaaaaaagcgguuucuaccucucuaugu

SEQ ID NO: 471015 - RNA, 62 nt, hsa
cuugaauguaaauauauacaguauguauauuuuuuaaaaagauuugcuugcaaugaccuuau

SEQ ID NO: 471016 - RNA, 62 nt, hsa
cauguauucuuuguuauuugcuuuuaacaaccuuuaaaaaauauuaaaacgauucuuagcuc

SEQ ID NO: 471017 - RNA, 62 nt, hsa
augcuaucccuaaccauauauuuauauuucguuuuaaaaacacccaugauguggcacaguaa

SEQ ID NO: 471018 - RNA, 62 nt, hsa
uggggauaaaucacucugucauuccuaguuauuuuaaaaaaagaacuuuaugauuacggucc

SEQ ID NO: 471019 - RNA, 62 nt, hsa
gucaauaccuuuauaagcaaaaccaugauaaauuuaaaaacaacagaaauguggcaugauua

SEQ ID NO: 471020 - RNA, 62 nt, hsa
ccucaccuucacuauugaucuguaauuuuuauuuuaaaaacagcuuacuguaaaguagauca

SEQ ID NO: 471021 - RNA, 62 nt, hsa
uuucauuauugaugugcugaugaaccuggacuuuuaaaaauauuuguuuccuauaccuuuac

SEQ ID NO: 471022 - RNA, 62 nt, hsa
uuuaacagauagaauuuguauuuuuauuguacuuuaaaaagauuuauguaauagguauauau

SEQ ID NO: 471023 - RNA, 62 nt, hsa
aucuauacuuucuuuuuucuuggagagaaccguuuaaaaaauuacaagauauauuuaaaaag

SEQ ID NO: 471024 - RNA, 62 nt, hsa
ggagagaaccguuuaaaaaauuacaagauauauuuaaaaaguaaccagauaaaaguagcaca

SEQ ID NO: 471025 - RNA, 62 nt, hsa
cuuaguacuguuuucccugcacguaggggucuuuuaaaaauauaaagcuugugauaaagaga

SEQ ID NO: 471026 - RNA, 62 nt, hsa
auagagaucgaaccaaaaaaaaucauuuaaacuuuaaaaauauuuuaaauggacuuugggga

SEQ ID NO: 471027 - RNA, 62 nt, hsa
gggguaggugaggguuuggagcauguggucuuuuuaaaaaauuguaacccucuagaaaauau

SEQ ID NO: 471028 - RNA, 62 nt, hsa
uacaggggcccgccaccacaccuggcuaauuuuuuaaaaauauuuuuaguagagacaggguu

SEQ ID NO: 471029 - RNA, 62 nt, hsa
uuuuuuaauaaaacaaaauuuguuugaaaucuuuuaaaaauucaaaugauuuuuacaaguuu

SEQ ID NO: 471030 - RNA, 62 nt, hsa
auuuuuugcaucauuuaaacaugcagaagauguuuaaaaauaaaaaaaaaacugcuuuaucc

SEQ ID NO: 471031 - RNA, 62 nt, hsa
uuuuuaauauugggaaaauuaugauaaaaugcuuuaaaaauuaauaugccagauuaaaauaa

SEQ ID NO: 471032 - RNA, 62 nt, hsa
auaugacaggauguguaaugggcuaacguuuauuuaaaaaguucaggccaggugcaguggcu

SEQ ID NO: 471033 - RNA, 62 nt, hsa
auggugaaaccccgucucuauuaaaaauauuuuuuaaaaauuaacugagcgugguggugggc

SEQ ID NO: 471034 - RNA, 62 nt, hsa
auugaugggagaaaugaggaaaagaaaaucuuuuuaaaaaugauuucaagguuugugcugag

SEQ ID NO: 471035 - RNA, 62 nt, hsa
cuuaaaaaaaaaaaaaaaagacuaagguggauuuuaaaaauuggaaacugacauaauguuag

SEQ ID NO: 471036 - RNA, 62 nt, hsa
ggaacuucuuguuuaauagcauuuuuguuuauuuuaaaaagugaucagaaguaguaaacuau

SEQ ID NO: 471037 - RNA, 62 nt, hsa
acuaaugugaugcuaaguuccacuuggccccuuuuaaaaacguguaugugccuuuugaagau

SEQ ID NO: 471038 - RNA, 62 nt, hsa
ccccaaacuguaguaauuguuacaauuuucuauuuaaaaaaugaauaguacaugcagaaauu

SEQ ID NO: 471039 - RNA, 62 nt, hsa
gcucugcucuguuuugcauggaguauuauuauuuuaaaaauugcauuuuuaccuuucaugug

SEQ ID NO: 471040 - RNA, 62 nt, hsa
ugguaauaauaaagcagauauuuuuguccccauuuaaaaaaugaagaaauuaaugcuuaaua

SEQ ID NO: 471041 - RNA, 62 nt, hsa
cuuggguuugucuggcuuuuguuuucuuuuucuuuaaaaauaaauguacaguaaaacuacaa

SEQ ID NO: 471042 - RNA, 62 nt, hsa
uugguuauuugggggcuuuuuuacuuacuguauuuaaaaauacaaggguauugauaugaaau

SEQ ID NO: 471043 - RNA, 62 nt, hsa
uguauggaugugugugagucagugguagcuuauuuaaaaagcaccuuauccuuucucccaua

SEQ ID NO: 471044 - RNA, 62 nt, hsa
guucuuacaaaccauacugaaagaguccauuguuuaaaaaucuuaauguaucaaacuguaua

SEQ ID NO: 471045 - RNA, 62 nt, hsa
uuuagauucacuuaacaaacaaauuuuucugcuuuaaaaaugucuuauugucccaaguguac

SEQ ID NO: 471046 - RNA, 62 nt, hsa
cacugaucuuagcuuuaaacacaagagaagucuuuaaaaagccugcauuguguauuaaacac

SEQ ID NO: 471047 - RNA, 62 nt, hsa
cugcaaaaggccuauuuuaacuauugauuuuuuuuaaaaaaaauugucuuugaauguauugg

SEQ ID NO: 471048 - RNA, 62 nt, hsa
cgaacacaacucagaaacuuggaaucguuuuuuuuaaaaaugccucugagcaacccauauaa

SEQ ID NO: 471049 - RNA, 62 nt, hsa
uuaaaaguuuuaucuuaaauugauuaaaacuuuuuaaaaagcuuugguauuaaaagagguaa

SEQ ID NO: 471050 - RNA, 62 nt, hsa
cuggcucucuuucccccacaaaauucgacauauuuaaaaaucuccguguggcuuuaaaaaau

SEQ ID NO: 471051 - RNA, 62 nt, hsa
aaauucgacauauuuaaaaaucuccguguggcuuuaaaaaaugguuuuuuguuuuuuuguuu

SEQ ID NO: 471052 - RNA, 62 nt, hsa
uugcaugaucuuuaacaaauguuuuaagcaauuuuaaaaaggcaggauguuauugacauuau

SEQ ID NO: 471053 - RNA, 62 nt, hsa
ucuggggaaggaucauaagaaaggaaauacuuuuuaaaaaaaaauuuggaaacauguaacaa

SEQ ID NO: 471054 - RNA, 62 nt, hsa
cugaagaguaggaaguacauaaugaagagggcuuuaaaaauugccaacaaagugagucacca

SEQ ID NO: 471055 - RNA, 62 nt, hsa
guaaauuuauuucuccaaaucgagagugauuuuuuaaaaauuuuuuaucuuuauaugguuuc

SEQ ID NO: 471056 - RNA, 62 nt, hsa
uuaacaaucaacugcauaaauauuauuaauauuuuaaaaagaguuaaguuguauuuugauaa

SEQ ID NO: 471057 - RNA, 62 nt, hsa
guaagcagccacugcaagcucugaaucaguuuuuuaaaaaaaagaaaaaaaaaaaaaaggag

SEQ ID NO: 471058 - RNA, 62 nt, hsa
ucaauguguccuuaguuuucuuagccuguuaauuuaaaaauccagacuugggggucauugug

SEQ ID NO: 471059 - RNA, 62 nt, hsa
gaaaguauauaaaaucuuccuguccugugaauuuuaaaaagcuaucccauaucgauugccaa

SEQ ID NO: 471060 - RNA, 62 nt, hsa
aaacaguauuuguaaauggaacuaaugcuauauuuaaaaacacugauuuuuuuuuaaccugc

SEQ ID NO: 471061 - RNA, 62 nt, hsa
ucuuuuuacauuucagcuccagcagccagcuauuuaaaaaauauuuuuaaauaucuucccca

SEQ ID NO: 471062 - RNA, 62 nt, hsa
uaugucacaugcgggaacuguuuaacaaauacuuuaaaaauuuggccaaaauuuaaacugua

SEQ ID NO: 471063 - RNA, 62 nt, hsa
uguuuucccguuuccuugaaugauuacacauuuuuaaaaaauacauuauuugaacauuuuaa

SEQ ID NO: 471064 - RNA, 62 nt, hsa
caacucaugacaagagauaccacuguuuguuuuuuaaaaaacauuuuucauuuuguuucucc

SEQ ID NO: 471065 - RNA, 62 nt, hsa
uaacaagacaccuagcaacuauaggaaucauuuuuaaaaaucuuuaaggagacuuuuaacag

SEQ ID NO: 471066 - RNA, 62 nt, hsa
ugucuuggugguguuacaagacuuguuauccauuuaaaaaugguaguggaaauucuaugccu

SEQ ID NO: 471067 - RNA, 62 nt, hsa
uuuuuuaaauauaaauguuaagaaaaauuuuuuuuaaaaaacacuucauuauguuuaggggg

SEQ ID NO: 471068 - RNA, 62 nt, hsa
aaaauugaacacaaucucauugaggagcauuuuuuaaaaacuaaaaaaaaaaaaacuuugcc

SEQ ID NO: 471069 - RNA, 62 nt, hsa
uuuuaugaagauauuugcuuuaauaaugucuuuuuaaaaauacuggcaccaaaagaaauaga

SEQ ID NO: 471070 - RNA, 62 nt, hsa
uuauuuuacuucaacugucgaaacuuccuuguuuuaaaaaaugaucauuuggguucacucag

SEQ ID NO: 471071 - RNA, 62 nt, hsa
auuacaaaacuguucugaauuuucuuuugguuuuuaaaaaacaaaacuuguugcuuagaagc

SEQ ID NO: 471072 - RNA, 62 nt, hsa
gauggcuucuuuaggaauaacuuuuauauuuauuuaaaaauuuuuaaauuaugggauguuuu

SEQ ID NO: 471073 - RNA, 62 nt, hsa
uagcuuuuuauuccuagugguguacauuuaauuuuaaaaagguugcaauguaucaugcuugu

SEQ ID NO: 471074 - RNA, 62 nt, hsa
augaaucccuaccagcaguaguuauuauccuuuuuaaaaaugcauugaaaauuugaaaggua

SEQ ID NO: 471075 - RNA, 62 nt, hsa
uaauaucuuuuaguucucuuuaacuaccuuuauuuaaaaauaagucaauaugaaaaucucag

SEQ ID NO: 471076 - RNA, 62 nt, hsa
uaccuggcgguguauaccaggcagugugccaguuuaaaaagaugaaaaagaauaaaaacuuu

SEQ ID NO: 471077 - RNA, 62 nt, hsa
aaugaaaucuucccaguauuauaaauuguguauuuaaaaaaaagaaacuuuucugaaugccu

SEQ ID NO: 471078 - RNA, 62 nt, hsa
uuugaagugcagcucauguuuuuaacuuuuaauuuaaaaacacaaaaaaaauuuuagcucuu

SEQ ID NO: 471079 - RNA, 62 nt, hsa
ugaaauuugcugcugauauguugaguuuguucuuuaaaaaauaucucauauaucucgucuuu

SEQ ID NO: 471080 - RNA, 62 nt, hsa; identical to SEQ ID NO: 470993

SEQ ID NO: 471081 - RNA, 62 nt, hsa
ucuuccuccucagcgaaccacuaggcccccuuuuuaaaaacaccuuuagagccuaauuacuc

SEQ ID NO: 471082 - RNA, 62 nt, hsa
agauggcgaaacccuguguguggggugcaguuuuuaaaaaucagagcgcucuagccacuacu

SEQ ID NO: 471083 - RNA, 62 nt, hsa
cugcaaaguagccuuuaaaaaaauguaaauuuuuuaaaaaguccacagaggagaauuugcug

SEQ ID NO: 471084 - RNA, 62 nt, hsa
agcaucuuugaugaauacucugcaaaguagccuuuaaaaaaauguaaauuuuuuaaaaaguc

SEQ ID NO: 471085 - RNA, 62 nt, hsa
uaaaaaacuaugucuaauuuauauuaauacauuuuaaaaaggugcccgcacuaccauacauc

SEQ ID NO: 471086 - RNA, 62 nt, hsa
gaauugcacucuacuuauguaucacuacaaacuuuaaaaaacuaugucuaauuuauauuaau

SEQ ID NO: 471087 - RNA, 62 nt, hsa
guuauuuacaaaauaauaauuuuuaaaaaacauuuaaaaaaaauccaaagcugcucucgaua

SEQ ID NO: 471088 - RNA, 62 nt, hsa
acaaaucuucuguuauuuacaaaauaauaauuuuuaaaaaacauuuaaaaaaaauccaaagc

SEQ ID NO: 471089 - RNA, 62 nt, hsa
auucagauugggaaaaacaauggacauuaguuuuuaaaaaguuacguggaagcaagauuucu

SEQ ID NO: 471090 - RNA, 62 nt, hsa
uuaaaagaauauuuuaacuuccuuggacucauuuuaaaaaauggaacauaaaauacaauguu

SEQ ID NO: 471091 - RNA, 62 nt, hsa
caagggugaugggaaagcauuguaaaugugcuuuuaaaaaaaaauacugauguuccuaguga

SEQ ID NO: 471092 - RNA, 62 nt, hsa
uaaaguuccuuaagcaucugauagaaugauguuuuaaaaaaauuugacgcuugcuuaggaga

SEQ ID NO: 471093 - RNA, 62 nt, hsa
aguaaugauacuguguguuuucccaaagcacuuuuaaaaaaauuuuuauaaauuacuaucug

SEQ ID NO: 471094 - RNA, 62 nt, hsa
auuuugaaauacuaagaucagacuuugaaaauuuuaaaaauucuuucauucuuacuuuucag

SEQ ID NO: 471095 - RNA, 62 nt, hsa
auaaacauacaacuuccaaaaggcaucugauuuuuaaaaaauuaaaauuucugaaaaccaau

SEQ ID NO: 471096 - RNA, 62 nt, hsa
aagguauaacaagcuuggcaaaguguuggcuuuuuaaaaaaaaauuuuuuuaaucucuagca

SEQ ID NO: 471097 - RNA, 62 nt, hsa
augguuuuguuuaaaauuaccauuacuuguuuuuuaaaaacacaugaccacauauguauaug

SEQ ID NO: 471098 - RNA, 62 nt, hsa
uggaagauggaagcuagugcagaaaccucuuguuuaaaaaacaaaaaaggcaagaugggcuu

SEQ ID NO: 471099 - RNA, 62 nt, hsa
ugcuaucuauucugugugcugcagccugaguuuuuaaaaaacagaaaaugaggggccaggug

SEQ ID NO: 471100 - RNA, 62 nt, hsa
uaggaaacugaaacucuguggaauauaaacuuuuuaaaaauaauuucaucagguuuuuugua

SEQ ID NO: 471101 - RNA, 62 nt, hsa
uuuauuaacaacugaacaaaacauuuuuaucauuuaaaaaucuauuuuuaugauuuaauauc

SEQ ID NO: 471102 - RNA, 62 nt, hsa
cacuaugauuaucaaggugacuuuggaaaccuuuuaaaaaugcauuuuugcaaaacaagaua

SEQ ID NO: 471103 - RNA, 62 nt, hsa
uaaguguggaagcuuauuaauauuuuugguuuuuuaaaaacugaaauuuuuaauuuuuacuu

SEQ ID NO: 471104 - RNA, 62 nt, hsa
uucuauuuaaaaaauaaaaaaauacaguaaaguuuaaaaaauacaccacgaauuuggugugg

SEQ ID NO: 471105 - RNA, 62 nt, hsa
caccuuauguauuauuuucuauagcucuucuauuuaaaaaauaaaaaaauacaguaaaguuu

SEQ ID NO: 471106 - RNA, 62 nt, hsa
agaagaauagaagaaaaaaaguuuguauauauuuuaaaaaauuguuuuaaaagucaguuugc

SEQ ID NO: 471107 - RNA, 62 nt, hsa
uagcuaauuuauuuuuuugcaucuuaguuauuuuuaaaaacaaauucuucaaguaugaagac

SEQ ID NO: 471108 - RNA, 62 nt, hsa
cuguuuaaauuucccgcauauuccaauucacuuuuaaaaaauaccauuugaauuuguauuuc

SEQ ID NO: 471109 - RNA, 62 nt, hsa
guagccaaggaauacaaacauaauugcauguuuuuaaaaauuccuuggaggcuggaaggggu

SEQ ID NO: 471110 - RNA, 62 nt, hsa
caauaccuuuuuaauacucaguguucuguuuuuuuaaaaacuugauauuccuguauggugca

SEQ ID NO: 471111 - RNA, 62 nt, hsa
ggcuucacugaagaaaaggcauuuuaagauuuuuuaaaaaucuugucagaagaucccagaaa

SEQ ID NO: 471112 - RNA, 62 nt, hsa
agccucaguccccuucauauuacccucuccuuuuuaaaaauuacgugugcacagagagguca

SEQ ID NO: 471113 - RNA, 62 nt, hsa
uuuuuuuucuuuucccucaauccuuuuuuauuuuuaaaaauaguucuuuuguaauguggugu

SEQ ID NO: 471114 - RNA, 62 nt, hsa
aaaauagauaaauaaauauaugauuaacuaauuuuaaaaauguuaaaauguauucuuaaauu

SEQ ID NO: 471115 - RNA, 62 nt, hsa
cuugacuccuugugauguggcaauaaauuuuuuuuaaaaaacugaaaauacuuaggaaggau

SEQ ID NO: 471116 - RNA, 62 nt, hsa
aguuuguauuuuucucucagauauuuuucuucuuuaaaaaucuuucccagaaguugguuccu

SEQ ID NO: 471117 - RNA, 62 nt, hsa
aacugaccuuuuaaaggccacuggcaguaggauuuaaaaagcagcccacugcucaguuucca

SEQ ID NO: 471118 - RNA, 62 nt, hsa
uuuucacuaaauuguacaguauucuacuucuguuuaaaaaggggagaugagaaagggaauac

SEQ ID NO: 471119 - RNA, 62 nt, hsa
gcaaccagcaaauuaacuaauuuaaguacauuuuuaaaaaaagagcuaagauaaagacugug

SEQ ID NO: 471120 - RNA, 62 nt, hsa
gcaaguaagaauggccaacucaacuuucauaauuuaaaaaucuccauuaaaguuauaacuag

SEQ ID NO: 471121 - RNA, 62 nt, hsa
guuuucguguuacaucaccuaaagagauuucuuuuaaaaacuuucuagacucuuugcaaaau

SEQ ID NO: 471122 - RNA, 62 nt, hsa
ggacaguagccacuuacaaacaaaucaacauuuuuaaaaagaaaauguaaagguguguuuug

SEQ ID NO: 471123 - RNA, 62 nt, hsa
caaauucugauugauuugaaucuauauuuuucuuuaaaaagucaaggguucuauauugugag

SEQ ID NO: 471124 - RNA, 62 nt, hsa
auuuucugcagcuuuuaguuuggaaaaaauauuuuaaaaacaaaauuugugaaaccuauaga

SEQ ID NO: 471125 - RNA, 62 nt, hsa
aggaugauuagauugaaacacauguuguauguuuuaaaaacuacauugcuucauuacuuuca

SEQ ID NO: 471126 - RNA, 62 nt, hsa
uagaccauucauuugccugagcguggcacaguuuuaaaaauaguucucuugauugauuucau

SEQ ID NO: 471127 - RNA, 62 nt, hsa
caucuacugggacuaggguuuuaaauacagcuuuuaaaaacaaaaacagggaauaaaagcuu

SEQ ID NO: 471128 - RNA, 62 nt, hsa
ggaaagugcaaauaagcaaaaaugaaaacaauuuuaaaaauguaaaaccucucuugccaggg

SEQ ID NO: 471129 - RNA, 62 nt, hsa
gaggacgugguacaggguugcagauguuuaguuuuaaaaauucaauuauaaaaauaauaaau

SEQ ID NO: 471130 - RNA, 62 nt, hsa
ccacuuuuguucuacuccuucccuaauagcuuuuuaaaaaaaucuccccaguagagaaacau

SEQ ID NO: 471131 - RNA, 62 nt, hsa
cucauagugagaacccaucuauacaaaaaauuuuuaaaaauuagcauggcggcacacaucug

SEQ ID NO: 471132 - RNA, 62 nt, hsa
uaacaaacacccaaacuguuuggauugauugcuuuaaaaaacaaaccuggcucuuaccuuug

SEQ ID NO: 471133 - RNA, 62 nt, hsa
ccaagcuggaauuuaucuaaucuauuuuuguguuuaaaaaagcuguaccuaccaaauaaaua

SEQ ID NO: 471134 - RNA, 62 nt, hsa
acuuaaagaaauucacuacugcaguuuuuauuuuuaaaaaacaguaauugagauauugaaga

SEQ ID NO: 471135 - RNA, 62 nt, hsa
gguggacaaauuuaacaaguuuucuguuacuuuuuaaaaagaaaaaauccagaacauaagaa

SEQ ID NO: 471136 - RNA, 62 nt, hsa
uucugaaggacuuuaaggaagggauacaugauuuuaaaaaagccuguaagaggugaaauaug

SEQ ID NO: 471137 - RNA, 62 nt, hsa
uucuauauugaaagcauuuuuauguuuucuaauuuaaaaauuaauauuuucuuauagauauu

SEQ ID NO: 471138 - RNA, 62 nt, hsa
uuguacugguacaaaauaguuuuaaauuauauuuuaaaaagcuuccaaucuugugguguguu

SEQ ID NO: 471139 - RNA, 62 nt, hsa
aaaacauuuuacaguaaaguuauuaagguugguuuaaaaacaacugcauuagaaauaaugcg

SEQ ID NO: 471140 - RNA, 62 nt, hsa
agaagauagagguuguuuucguuucuuuucuuuuuaaaaaaaaaaaaauuuauuugaccgac

SEQ ID NO: 471141 - RNA, 62 nt, hsa
ugaaaguaugauuguaaaagggagugaauugguuuaaaaauauauguauauuuuaaacuuug

SEQ ID NO: 471142 - RNA, 62 nt, hsa
caggcuuuauuucugguaugaaguuuauauuuuuuaaaaaaauccuauauuaucacaccaga

SEQ ID NO: 471143 - RNA, 62 nt, hsa
uuuucagcuuacacauguguucaaaguggauuuuuaaaaaguguuuuagcaauacuccuuaa

SEQ ID NO: 471144 - RNA, 62 nt, hsa
cuuuggggcuuauuuucuggguaaggcucaucuuuaaaaacuggcuucagaggggagagggg

SEQ ID NO: 471145 - RNA, 62 nt, hsa
uuuaauuagcuguugcagaauaaguaauauauuuuaaaaaccuagcuccuuucauuauuuaa

SEQ ID NO: 471146 - RNA, 62 nt, hsa
ugugaugagagaauucagauauacuuuaucuuuuuaaaaaaguguaaauaaaaucaaagaau

SEQ ID NO: 471147 - RNA, 62 nt, hsa
aguaguacuuuaccagggugcuuuuaaguuacuuuaaaaaaagccuacaaaauauuuuuuuu

SEQ ID NO: 471148 - RNA, 62 nt, hsa
uuuguguauucauguuuaaagaaaaaaagugauuuaaaaaugaucuuaccuguaccagaaaa

SEQ ID NO: 471149 - RNA, 62 nt, hsa
gcuuuauauuugcuuauuuguuguagcuacauuuuaaaaaaaagauugaacuugaugacuua

SEQ ID NO: 471150 - RNA, 62 nt, hsa
cuuaaugguguuagaaaucaacaaaacuccuuuuuaaaaagaaaagauauuaagccugccua

SEQ ID NO: 471151 - RNA, 62 nt, hsa
caguagauaggaaaccaguuauuccuucuaccuuuaaaaauuuugagaacuugccaaccagg

SEQ ID NO: 471152 - RNA, 62 nt, hsa
ucuuucaucaggaaaccuuauucaggaggguuuuuaaaaaguguuuaaaugucaaaugugaa

SEQ ID NO: 471153 - RNA, 62 nt, hsa
auguuaguuuuccuuagcugauuuugaggguuuuuaaaaauaaagcaagguugacuaaccua

SEQ ID NO: 471154 - RNA, 62 nt, hsa
auuauaugcuaaagaauaaaacuccaguuagauuuaaaaaaaucccauuuacaagcauugca

SEQ ID NO: 471155 - RNA, 62 nt, hsa
cuugugaugucugacgcaugauggccuaugguuuuaaaaauaguauuguggaauauauuuuu

SEQ ID NO: 471156 - RNA, 62 nt, hsa
cagauuuuuugaaccauccacuuacauauauuuuuaaaaaaugaaauccuuuuccuguucau

SEQ ID NO: 471157 - RNA, 62 nt, hsa
auucuguauuggauauauaagagcaugaaauuuuuaaaaauacacuugugauuauaaaauua

SEQ ID NO: 471158 - RNA, 62 nt, hsa
auuuuaaaacuauuuuuauauuuuuuuaaaucuuuaaaaauuuuaauuacugugauauugau

SEQ ID NO: 471159 - RNA, 62 nt, hsa
guucuuuaaguguacaucguaauuugaccuaauuuaaaaauaauauauuuucgaaguaguag

SEQ ID NO: 471160 - RNA, 62 nt, hsa
uacauuuuaugucguuuaauauaauuauuuacuuuaaaaauuguacuucagaacaucagauu

SEQ ID NO: 471161 - RNA, 62 nt, hsa
cucucaaaaauuaauuuuuauuccuuaagcauuuuaaaaacauuuuaaaaaauguuuuguaa

SEQ ID NO: 471162 - RNA, 62 nt, hsa
uaauuuuuauuccuuaagcauuuuaaaaacauuuuaaaaaauguuuuguaaauccaggugua

SEQ ID NO: 471163 - RNA, 62 nt, hsa
gacuucagguaugcuaauuuggccauuaauuauuuaaaaacuaaauauucccucaaaagggc

SEQ ID NO: 471164 - RNA, 62 nt, hsa
auguuuaauauauuuuauuuuuuaauugucuuuuuaaaaaauuuaguuuaugacuuugcagu

SEQ ID NO: 471165 - RNA, 62 nt, hsa
uaaaauagaaaagaacaagugaauuguugcuauuuaaaaaaauuuuacaauucuuacuaagg

SEQ ID NO: 471166 - RNA, 62 nt, hsa
uaauaaauuugacucauuaaaaaccuuuuuuuuuuaaaaaaaaaaaaaaagaaaaucucauu

SEQ ID NO: 471167 - RNA, 62 nt, hsa
acuuaucuuugcagcugaguacuuaaauucuuuuuaaaaagauacccuuuggauugaucaca

SEQ ID NO: 471168 - RNA, 62 nt, hsa
ccacaacaguuagggaaaugaugcuagagcacuuuaaaaaucagcaggacaacccugaggca

SEQ ID NO: 471169 - RNA, 62 nt, hsa
aaauugaaugaaaaggagcuugugcaaaaaaauuuaaaaauggaugucaagauguuauguaa

SEQ ID NO: 471170 - RNA, 62 nt, hsa
uuauacagaucauucauauguguacauaaaauuuuaaaaauaaagggaauugacugcuuugu

SEQ ID NO: 471171 - RNA, 62 nt, hsa
aaacaacccccacacagaccccgcaauccuuuuuuaaaaaaucugccaauagacccaggacg

SEQ ID NO: 471172 - RNA, 62 nt, hsa
cccaggacgaguaagagaggaagcaucaaccuuuuaaaaauuuccuuucgcuuucauuauuu

SEQ ID NO: 471173 - RNA, 62 nt, hsa
aauacuguuucagaguucuaaaaaggcaguuuuuuaaaaaacuuaaguugauaaaaacugua

SEQ ID NO: 471174 - RNA, 62 nt, hsa
uuaaacauggugugguauucuaaagccuuuuuuuuaaaaaaagagaucuuuuugagagaaac

SEQ ID NO: 471175 - RNA, 62 nt, hsa
aaucuauaguaaaacauguagcuauaacauauuuuaaaaauaaaaucugaaaaccucagaaa

SEQ ID NO: 471176 - RNA, 62 nt, hsa
ugagauuuuccuucuuacacuguuaaucuuauuuuaaaaaauauuacauucuuguauacuuu

SEQ ID NO: 471177 - RNA, 62 nt, hsa
acuucauggaugagauugaugcagcccuugauuuuaaaaauguguccauuguugcauuuuau

SEQ ID NO: 471178 - RNA, 62 nt, hsa
uuccuuucuucagugggccauuguuuuagauauuuaaaaaauccaacaguuucuaucauaau

SEQ ID NO: 471179 - RNA, 62 nt, hsa
ccuacagaugaguaaugaaguuaucuuuuuuguuuaaaaaaaaaaaaaacacugcauuaaaa

SEQ ID NO: 471180 - RNA, 62 nt, hsa
uauauuaccuauuaguuuuggaguucuuuauguuuaaaaauucagguguaaauuuuauugcc

SEQ ID NO: 471181 - RNA, 62 nt, hsa
aaacuaggaaaagguuaaacuggauuuuuuuuuuuaaaaaaaagaaaaaaaaagaagaaaag

SEQ ID NO: 471182 - RNA, 62 nt, hsa
guauuauuaaucuucugacauuuucuuauguuuuuaaaaagauaagagcaucuagugcauua

SEQ ID NO: 471183 - RNA, 62 nt, hsa
agaaaauuauucaaauuuggacauuuuaauuguuuaaaaauuguacaaaaggaaaaaauuag

SEQ ID NO: 471184 - RNA, 62 nt, hsa
auaaguacuggcgaaccaucucuguggucuuguuuaaaaagggcaaaaguuuuagacuguac

SEQ ID NO: 471185 - RNA, 62 nt, hsa
aagaguaucuguaaauaaaaggguuccaaccuuuuaaaaaagaaggaaaaaacuuuuuggug

SEQ ID NO: 471186 - RNA, 62 nt, hsa
aacuuuuuggugcuccaguguagggcuaucuuuuuaaaaaaugucaacaaagggaaaauaaa

SEQ ID NO: 471187 - RNA, 62 nt, hsa
uuuugcucuuguauggcaaaauaauuagugaguuuaaaaaaaaucuauaguuuccaauaaac

SEQ ID NO: 471188 - RNA, 62 nt, hsa
ucauucauuuauucauucauucaucgaguaacuuuaaaaaaaucauaugcuauguucccagu

SEQ ID NO: 471189 - RNA, 62 nt, hsa
agaguaaauagcauucucuaucaauauauaaauuuaaaaaacuaucuuuuugcuuacaguuu

SEQ ID NO: 471190 - RNA, 62 nt, hsa
ggauaugcuagaaaaggcauuuugggguuauguuuaaaaaaacauuauugucccacaauauu

SEQ ID NO: 471191 - RNA, 62 nt, hsa
ccaaauuagccagacaugguggcaugcgcuuguuuaaaaaaacaaauaaauaaauaaucgac

SEQ ID NO: 471192 - RNA, 62 nt, hsa
ucacuacuguuaucacaucccuuuguauaaguuuuaaaaagagauggagggagaucuucauu

SEQ ID NO: 471193 - RNA, 62 nt, hsa
auauccaaacuuaauuuggcuaggacuucaauuuuaaaaaucaguguaccuaggcagugcac

SEQ ID NO: 471194 - RNA, 62 nt, hsa
aacucuuauuuuuauuuuugaagguuuuuuuuuuuaaaaaaaaaaacguauaaaauaaugcc

SEQ ID NO: 471195 - RNA, 62 nt, hsa
aucugauagggccuuggaggagaagguccaguuuuaaaaaaugacaguuuguguuuaauaaa

SEQ ID NO: 471196 - RNA, 62 nt, hsa
auagagcuauucaugccauuuuuugggaaaacuuuaaaaauugccccaaauacugacauuga

SEQ ID NO: 471197 - RNA, 62 nt, hsa
aauccuuguucaguucuuaaguuucgguuuuuuuuaaaaacaggaugcaacuuaaacuuuuc

SEQ ID NO: 471198 - RNA, 62 nt, hsa
cgauuuugagaauguacuaaaaaccaaugaacuuuaaaaaauaaaaauaaacaaaaaaaauu

SEQ ID NO: 471199 - RNA, 62 nt, hsa
auaacacaacaauaaggagaaaaauaaaucaauuuaaaaaaugggcuaacgguuugaauaga

SEQ ID NO: 471200 - RNA, 62 nt, hsa
gacaagauguuaauuucucuguagguuguaacuuuaaaaauaaaugaaauuauuuaaggguu

SEQ ID NO: 471201 - RNA, 62 nt, hsa
auuuucaccaccucugguguucagagggggcuuuuaaaaaagcguguaugcugggauaccca

SEQ ID NO: 471202 - RNA, 62 nt, hsa
cucagaaauugaaagcacuaugaauuuguccauuuaaaaaugaucuguaguuuuuuuggugc

SEQ ID NO: 471203 - RNA, 62 nt, hsa
uaaaagcaaauacugauuuucaaaaaaauguuuuuaaaaaccuauuuugaaaggucagaauu

SEQ ID NO: 471204 - RNA, 62 nt, hsa
ugaaagaaacuaagauuuaucugcaaggauuuuuuaaaaauuggcauuuuaaguguuuaaaa

SEQ ID NO: 471205 - RNA, 62 nt, hsa
acuuuuuuuucauucucauuguuacaugauuuuuuaaaaaaaggaaaagaaaaugugaaaca

SEQ ID NO: 471206 - RNA, 62 nt, hsa
cuccacacugaucuuuggaaacuugccccuuauuuaaaaaaaaaaaagaaaaaaaagaguuu

SEQ ID NO: 471207 - RNA, 62 nt, hsa
augauacugaucuuauaucuguuaaaaguuguuuuaaaaagcuguggcaucccauuguucau

SEQ ID NO: 471208 - RNA, 62 nt, hsa
auuaagcacccauaccauuuauaacuucugaauuuaaaaaguuauacaaugccaguuugcaa

SEQ ID NO: 471209 - RNA, 62 nt, hsa
accucuucccuucaauaucuguucuucguauuuuuaaaaaaauuuguuuuagacugccuugu

SEQ ID NO: 471210 - RNA, 62 nt, hsa
uauauucauagauccucucaaguauuauacaauuuaaaaacucuuguuccaaaguccugucu

SEQ ID NO: 471211 - RNA, 62 nt, hsa
uugucuuaucugcguggguauugcugcuuuauuuuaaaaaauccugccuaaaguaaacacuu

SEQ ID NO: 471212 - RNA, 62 nt, hsa
guacaucuugaaauuuggggaggcaucucugauuuaaaaaaagaaaaaggcugcuugaugua

SEQ ID NO: 471213 - RNA, 62 nt, hsa
ugcucuuccucaccugucacauaaagcauuuuuuuaaaaagucagcugcuccaaaaucauca

SEQ ID NO: 471214 - RNA, 62 nt, hsa
guaaauuuuauuuuaauaaaaucaguuuuuuguuuaaaaaccuuguuucacugucacauaug

SEQ ID NO: 471215 - RNA, 62 nt, hsa
uuuuauuuucucugucugaagaaccagccauuuuuaaaaagguuauuauugacaucccaaua

SEQ ID NO: 471216 - RNA, 62 nt, hsa
gcugugauauugauagcuuuuauuuucuaauuuuuaaaaaauggucauauuaugagucaaag

SEQ ID NO: 471217 - RNA, 62 nt, hsa
uuuauuaucccagggacuaccucggcuuuuaauuuaaaaaaaaaaaagaaguggguaagaaa

SEQ ID NO: 471218 - RNA, 62 nt, hsa
uuacuacauaguauacaaguuuuuaaugagcauuuaaaaaaauaaguaaaucuaggcuauuu

SEQ ID NO: 471219 - RNA, 62 nt, hsa
uacuaauuacuaacuuguuacuaaugcuaacuuuuaaaaauguuuuugaaaauugcaauuuc

SEQ ID NO: 471220 - RNA, 62 nt, hsa
uuaauaugacauuugucauugucacugauuuuuuuaaaaaagcaaugcacauguugguugug

SEQ ID NO: 471221 - RNA, 62 nt, hsa
uugagcugcugagauuucaguggugcaaugucuuuaaaaaaacaggcuuuguugggagggua

SEQ ID NO: 471222 - RNA, 62 nt, hsa
guucauacauuugaaaagaaaaaaaaauguuguuuaaaaaauguuuucuccugcugcaguaa

SEQ ID NO: 471223 - RNA, 62 nt, hsa
ccucaguucaaaccuuuagggaaugauuaaaauuuaaaaaaaaaacauuucacucaguugca

SEQ ID NO: 471224 - RNA, 62 nt, hsa
uguauaaagggcagucuguggucacgcaagacuuuaaaaaaaaaaaaaaaaaaaaaaaaaaa

SEQ ID NO: 471225 - RNA, 62 nt, hsa
uugagggauuuauuucuuuaacuuuauaagacuuuaaaaaaaaaacccaaauucuaagcacu

SEQ ID NO: 471226 - RNA, 62 nt, hsa
aguguauauuaggauuuaaauuuaugccacaauuuaaaaauaaaaccagagguuauauacaa

SEQ ID NO: 471227 - RNA, 62 nt, hsa
uuuacuuguuuuuaauuauucauucauggcaauuuaaaaagucauauuuuaagugggauuug

SEQ ID NO: 471228 - RNA, 62 nt, hsa
uuguuuuauccauuaucaucuuugauuaagacuuuaaaaaaaugcuauuuccaguuaaugca

SEQ ID NO: 471229 - RNA, 62 nt, hsa
gcuaaguucuaucagagacccaaauuauauuuuuuaaaaauuuaacagcuggaaacuuggac

SEQ ID NO: 471230 - RNA, 62 nt, hsa
gaaauguucuacaucucugaaugaccucugacuuuaaaaaaguuuuuauuugcauggcugua

SEQ ID NO: 471231 - RNA, 62 nt, hsa
uccagccugggcaauauagcaagaccccauccuuuaaaaaauuuuagaacuuuuuuaaaauc

SEQ ID NO: 471232 - RNA, 62 nt, hsa
cuauaauaauuaguacuauuuaauggugagcuuuuaaaaauguaggauagaggguacagugg

SEQ ID NO: 471233 - RNA, 62 nt, hsa
aaacaaaaaauuuuaccugugcaaaauaguuuuuuaaaaauuauacauguagcucaacuuga

SEQ ID NO: 471234 - RNA, 62 nt, hsa
gcucaagcaugcaguaugaauacuguguauuuuuuaaaaaaauaauuuaguaucaaggcuuc

SEQ ID NO: 471235 - RNA, 62 nt, hsa
uauguuccauccucuguuguuacuagauuuaguuuaaaaauuguguaugaccauuaauguau

SEQ ID NO: 471236 - RNA, 62 nt, hsa
cauauauuacuaaguugccucucccaguuuacuuuaaaaauggcuuuaaggauaaagaauaa

SEQ ID NO: 471237 - RNA, 62 nt, hsa
auaucugcaaucuuugccaagguacuuuuuuauuuaaaaaaaaacauaacuuuguaaauauu

SEQ ID NO: 471238 - RNA, 62 nt, hsa
aauauuuacauuuugcuaaccuaguuuguuacuuuaaaaaucaguuuugaugaaaggaggga

SEQ ID NO: 471239 - RNA, 62 nt, hsa
acaaugacaaauaugccaguuuauuuaauuuguuuaaaaaaaaaaaggcagaaaacccacca

SEQ ID NO: 471240 - RNA, 62 nt, hsa
gaaugcuuuauguuuaggacaacaaaaauaauuuuaaaaaguuauuuuuuacccuaauacuu

SEQ ID NO: 471241 - RNA, 62 nt, hsa
aaaaaaugcuaauaagaaaauuggaagauucuuuuaaaaauuuuucuuuuuuguuguuguua

SEQ ID NO: 471242 - RNA, 62 nt, hsa
uucggaaaauuaagucagagaugguauuaccuuuuaaaaaaugcuaauaagaaaauuggaag

SEQ ID NO: 471243 - RNA, 62 nt, hsa
gacgguuucuuuuaauuuuggcaguuugguauuuuaaaaauugucuauuguuaaauuuugag

SEQ ID NO: 471244 - RNA, 62 nt, hsa
aguagagccaaguuggccaaaaaacuuggauauuuaaaaagacgguuucuuuuaauuuuggc

SEQ ID NO: 471245 - RNA, 62 nt, hsa
guuuuauuaaauauuacacuugagagacacuuuuuaaaaauguguuaaugucaauaugauga

SEQ ID NO: 471246 - RNA, 62 nt, hsa
uuaccuauuauccaccucuguuggaacucucuuuuaaaaaguacauuuauagauugaucaga

SEQ ID NO: 471247 - RNA, 62 nt, hsa
aguggauucagccauugugccugaaaucaguguuuaaaaaaaaaaaucaaccagguuguggu

SEQ ID NO: 471248 - RNA, 62 nt, hsa
uuucuuuuuuuuuuuuuuuaaaaaaagaaaacuuuaaaaaaacucccauuaaaaacaaaaca

SEQ ID NO: 471249 - RNA, 62 nt, hsa
gccguuuguccuuaacuuucuuuuuuuuuuuuuuuaaaaaaagaaaacuuuaaaaaaacucc

SEQ ID NO: 471250 - RNA, 62 nt, hsa
cuguacuuuaaaaaaccaacaacauauacacauuuaaaaauagcacguuuuggugauuuuua

SEQ ID NO: 471251 - RNA, 62 nt, hsa
uuucauauuuaauacuucuacuacuccuguacuuuaaaaaaccaacaacauauacacauuua

SEQ ID NO: 471252 - RNA, 62 nt, hsa
acauuagucacaagaaucccugauugcugcacuuuaaaaaauucuuuaccuuuuccuugagc

SEQ ID NO: 471253 - RNA, 62 nt, hsa
aauuaaacauuuggaacauuugaauuugaaacuuuaaaaaaauguuguacgaaauuuuacua

SEQ ID NO: 471254 - RNA, 62 nt, hsa
uuuuuauuuucuuggcacuaaagauuagcuuuuuuaaaaaaacaucccauaaaacaguagaa

SEQ ID NO: 471255 - RNA, 62 nt, hsa
uacuuuauuaagauugccaaaaacuguuaaaauuuaaaaaaaauuuaaaucauguguauaca

SEQ ID NO: 471256 - RNA, 62 nt, hsa
uagagaaguggcugugaaagucguucucugucuuuaaaaaucaauugcagaaguucauuugu

SEQ ID NO: 471257 - RNA, 62 nt, hsa
ugagaugggguggacuaagaccacccccaaaguuuaaaaauaugcucauucaacuugaaucu

SEQ ID NO: 471258 - RNA, 62 nt, hsa
uucauugagaugaguagugcauuuaauuauuuuuuaaaaaacuuuuuaaguacuugaauuuu

SEQ ID NO: 471259 - RNA, 62 nt, hsa
guacaaauaacaagacuaauaauauuuucuuauuuaaaaaaagcaugggaagauuuuuauuu

SEQ ID NO: 471260 - RNA, 62 nt, hsa
uuagcauaagacgugauauuuuuaauuucuuuuuuaaaaaauuauauuugucucuuagaguu

SEQ ID NO: 471261 - RNA, 62 nt, hsa
cucauuuuuacaugcugcuacuagcuuuuuuuuuuaaaaaaaguaaaaguugcugcuuucua

SEQ ID NO: 471262 - RNA, 62 nt, hsa
aagacaaacuuguuucaaugauagucuucauuuuuaaaaacaaaaaggcaggcagacagaaa

SEQ ID NO: 471263 - RNA, 62 nt, hsa
aaacaauuuugugguuaaaacuggauuuuaaauuuaaaaaucaauaaaaauuucaaauguuu

SEQ ID NO: 471264 - RNA, 62 nt, hsa
cuguuagauguuguuauauuuuaaaaguuuaauuuaaaaaauuuaauuuguccuuccuaaga

SEQ ID NO: 471265 - RNA, 62 nt, hsa
aaaacacacucauaaguaaguuuggcaaguuguuuaaaaaaugucucuuuguuuuguacagu

SEQ ID NO: 471266 - RNA, 62 nt, hsa
accaaaugcuuuaaaaacuauuuaacuugagcuuuaaaaaucauuguauggauaguaaaauu

SEQ ID NO: 471267 - RNA, 62 nt, hsa
aaaacuguauugaugacaguaguaccaaaugcuuuaaaaacuauuuaacuugagcuuuaaaa

SEQ ID NO: 471268 - RNA, 62 nt, hsa
gauacagucuaacucaucugauuuaauaugcauuuaaaaaaaugccauaacuauuaaacacc

SEQ ID NO: 471269 - RNA, 62 nt, hsa
cuauuguuugggccuuguggauaauguacagauuuaaaaacaaaucuuguugcugauuuguc

SEQ ID NO: 471270 - RNA, 62 nt, hsa
auuaaaaaauaaaauaaauauaaaauauaggcuuuaaaaaagcauagucuuauuaaccaugu

SEQ ID NO: 471271 - RNA, 62 nt, hsa
aaugaacaucuauaaaauguaucaacacacauuuuaaaaaauuuguuuaaaguauacucuua

SEQ ID NO: 471272 - RNA, 62 nt, hsa
caguuaggguaacacuuuagagguuuauuauuuuuaaaaaacuuuucuugaacuccuggcca

SEQ ID NO: 471273 - RNA, 62 nt, hsa
ggagacacaagauguuuuuauagucuagagccuuuaaaaaacccagcagaauguaauucagu

SEQ ID NO: 471274 - RNA, 62 nt, hsa
agaaggcaaagcagaaagaagagguauacuuauuuaaaaaacuaagaugaaaaaagugcgca

SEQ ID NO: 471275 - RNA, 62 nt, hsa
acuggggggaguuaccaacuuaaauguguguuuuuaaaaaugcgcuaagaaggcaaagcaga

SEQ ID NO: 471276 - RNA, 62 nt, hsa
aaacaaauuuuaaaauuaaaguauuuuauacauuuaaaaauauggaaaaacaacccagacga

SEQ ID NO: 471277 - RNA, 62 nt, hsa
uauuguuauauuucaauaagaagcuuaaaauguuuaaaaauaaaugguuaaaagguuuuaug

SEQ ID NO: 471278 - RNA, 62 nt, hsa
ugguaaauuuuguuauguauauuuuaucauaauuuaaaaaauauaucuagaaugggcaagaa

SEQ ID NO: 471279 - RNA, 62 nt, hsa
gcuauaauacauacaauggaauauuauuuagcuuuaaaaaggaaugaaauucugauaaauac

SEQ ID NO: 471280 - RNA, 62 nt, hsa
uaaagcaagaaaaucugaaguauugucuuguuuuuaaaaaauacaguuccuaguguuuuuag

SEQ ID NO: 471281 - RNA, 62 nt, hsa
agguuuuguguauaucuuauguggauuaccaauuuaaaaauauauguaguucugugucaaaa

SEQ ID NO: 471282 - RNA, 62 nt, hsa
agguccacaucugugguugaccucuguuauuguuuaaaaaaaauaaauaaaaauuaaaaaaa

SEQ ID NO: 471283 - RNA, 62 nt, hsa
guuaguggggacuaugauacuguaauaauauuuuuaaaaauuuacaucaagagaggcaguca

SEQ ID NO: 471284 - RNA, 62 nt, hsa
gccauuacauggcaaaauguuugcuaccuuaguuuaaaaaacaaucucaaacaaaagacuug

SEQ ID NO: 471285 - RNA, 62 nt, hsa
aagugaucaaacuaagaauauuguuuauagguuuuaaaaaccaaaccaauaaaauuuuuauu

SEQ ID NO: 471286 - RNA, 62 nt, hsa
acgguuagaagaagcuaauauuugaaacagauuuuaaaaacuugaaaaauuacaggugagau

SEQ ID NO: 471287 - RNA, 62 nt, hsa
acagguuaagagauccuguuucauaugcuguauuuaaaaagcaacaaugauaacaacauagu

SEQ ID NO: 471288 - RNA, 62 nt, hsa
cccauccuccugaagccuucguuuucaagacuuuuaaaaagcacuucuacuugguuuuuuga

SEQ ID NO: 471289 - RNA, 62 nt, hsa
gccuucuuuuggacaaaccuugaaaauguuuauuuaaaaaaaaaaaagaugacaaagaaaaa

SEQ ID NO: 471290 - RNA, 62 nt, hsa
agccaucaauauucagcaaaaugauuccuuucuuuaaaaaaaaaaaauguggaggaaaguag

SEQ ID NO: 471291 - RNA, 62 nt, hsa
gcauuacucuuuuucaauaaauuguuuuuuaauuuaaaaaaaggauuauuggcuuguuuucu

SEQ ID NO: 471292 - RNA, 62 nt, hsa
gagauagaauacauguaagugugguuuuguaauuuaaaaagugcuauacuaagggaaagaau

SEQ ID NO: 471293 - RNA, 62 nt, hsa
acauucagaaucuggccaauuuaaguuuguauuuuaaaaauauuuuaugcauguuaaguaug

SEQ ID NO: 471294 - RNA, 62 nt, hsa
uauaacauuuaugugcuuaagauuucuaagguuuuaaaaaguuaccuuuaauacaauccuua

SEQ ID NO: 471295 - RNA, 55 nt, hsa
aagauucacagaaauucugaauuuuuuuaaaaaugggaaaauaugaaaucuggug

SEQ ID NO: 471296 - RNA, 62 nt, hsa
uuugguacacugggcagacuucagagcaguuuuuuaaaaaaauaaauauucuaauguagcua

SEQ ID NO: 471297 - RNA, 62 nt, hsa
guagcucuuacaaaguuuauugauuugauuuuuuuaaaaaucaaaagccaauugaacaacag

SEQ ID NO: 471298 - RNA, 62 nt, hsa
ccagaacaagugcugggucugucacagagaaguuuaaaaaagaaaacuaagauuauaaauua

SEQ ID NO: 471299 - RNA, 62 nt, hsa
uuuuaaaaucaauagauucaucaccuuaguuuuuuaaaaaaaaucuauaaauaggguaauug

SEQ ID NO: 471300 - RNA, 62 nt, hsa
aucuagguagcaugaacaaauuauaaaauuuguuuaaaaaagcaaacuugcaugcauuauug

SEQ ID NO: 471301 - RNA, 62 nt, hsa
agcaaacuugcaugcauuauugugacuucaaguuuaaaaaaucgucuuacauguguacaaua

SEQ ID NO: 471302 - RNA, 62 nt, hsa
ucaccaaauguaagacccauaagaaacccauauuuaaaaaucugaauuuuuuagaagaaugc

SEQ ID NO: 471303 - RNA, 62 nt, hsa
cuaagcaaagcacccaacaaugguaaauguuuuuuaaaaaugcagaacuaagauuuuugacu

SEQ ID NO: 471304 - RNA, 62 nt, hsa
caaaaguaugacuguggaggaaaaaaaaauacuuuaaaaauccacacuuuuuguuaagaagg

SEQ ID NO: 471305 - RNA, 62 nt, hsa
caccaaaaaguugacuuugaauuuguuggacuuuuaaaaaaccaguuggaaauauagguugg

SEQ ID NO: 471306 - RNA, 62 nt, hsa
ugaguugaccaauaaauaaaaauaccacuuucuuuaaaaaagccuagggaauugaagcucug

SEQ ID NO: 471307 - RNA, 62 nt, hsa
aaaauuaaguaccaaaccuauuaggaaauuuuuuuaaaaaguggauuuaacuuaaauuacug

SEQ ID NO: 471308 - RNA, 62 nt, hsa
uuuuugaccaguuucuuuucuuuuguuuuuuuuuuaaaaaagacauuuaaagacaaagacau

SEQ ID NO: 471309 - RNA, 62 nt, hsa
guggagacauauuucagugauuuuuaguaaccuuuaaaaauguauaaugacuuuuaaaauuu

SEQ ID NO: 471310 - RNA, 62 nt, hsa
uuuucuuuaugcauggaagcaucaauaaauuguuuaaaaaccauguauaguaaauucagcuu

SEQ ID NO: 471311 - RNA, 62 nt, hsa
uccuuucaauauucugggaacccagggaaguuuuuaaaaaugucauuacuuucaaaggaaca

SEQ ID NO: 471312 - RNA, 62 nt, hsa
aguacuugaaauguauugacugcugacuauauuuuaaaaacaaaaugaaauaauuugaguug

SEQ ID NO: 471313 - RNA, 62 nt, hsa
ugauuucauugagcuucauugcagccugaaauuuuaaaaaaguuguguaauacgccaaccag

SEQ ID NO: 471314 - RNA, 62 nt, hsa
gucugacuuuuguuaaauucaguaaugcaguuuuuaaaaaccuguaucugacccacuuugua

SEQ ID NO: 471315 - RNA, 62 nt, hsa
caaacaguauuucugguguauauuuuaauguuuuuaaaaagaguaauuucauuuaaauaucu

SEQ ID NO: 471316 - RNA, 62 nt, hsa
acuaggagcacuuugauguaaaccagaauagcuuuaaaaagacaaaaaggaucguagaucug

SEQ ID NO: 471317 - RNA, 62 nt, hsa
guauuuuauauguaaaguaguauugcugacauuuuaaaaaaauacaaaauacaaaagaaacc

SEQ ID NO: 471318 - RNA, 62 nt, hsa
uuguuuaucauaaaacauauuauguuccuaguuuuaaaaagacccaaaguaugauuaauaua

SEQ ID NO: 471319 - RNA, 62 nt, hsa
uuugcugaauagguuuaagucagauaauagauuuuaaaaaagcaaaugaggcaaugugucaa

SEQ ID NO: 471320 - RNA, 62 nt, hsa
aaagucaaaagaaacaaauagaagcuuuuuuuuuuaaaaaauguauugcuucugaacuuuuu

SEQ ID NO: 471321 - RNA, 62 nt, hsa
gggcaggaagguaaugguuugaguagccuuuguuuaaaaaaaagacuaaauauauuuaaaag

SEQ ID NO: 471322 - RNA, 62 nt, hsa
cugauaccuucaauuuguuacuuuucaagauuuuuaaaaauaacuaguguagcuuaucuuaa

SEQ ID NO: 471323 - RNA, 62 nt, hsa
auugucaaacuaugguauuauuuuaauguuacuuuaaaaauccauaaucugcuaguuuugca

SEQ ID NO: 471324 - RNA, 62 nt, hsa
aguuuugagaaauuauucagaagccuuguuauuuuaaaaaugaaauauuucaaagacugaau

SEQ ID NO: 471325 - RNA, 62 nt, hsa
caguuugagaauacguuaauugcuauuuacuauuuaaaaaguuuuacugaaaucaguccaua

SEQ ID NO: 471326 - RNA, 62 nt, hsa
uauaaaaaguguauaugcaguaugauaccacuuuuaaaaaaagauaaauuuauagaaaaaag

SEQ ID NO: 471327 - RNA, 62 nt, hsa
auaauuaaaauaaauuguuagagaaaaguuacuuuaaaaauagcuauaacgcuuugcaauuu

SEQ ID NO: 471328 - RNA, 62 nt, hsa
auuuaugggagccuauauaaacauaucuugcuuuuaaaaaguucuugagggaauagcaacuu

SEQ ID NO: 471329 - RNA, 62 nt, hsa
ggggggauuguguuuaaaucaaauauauguauuuuaaaaauaaugacaugcucaaccuuccu

SEQ ID NO: 471330 - RNA, 62 nt, hsa
auaauaguggcccugaaggaauaaauuccagcuuuaaaaaccaagucugaggaaauauuugg

SEQ ID NO: 471331 - RNA, 62 nt, hsa
ccuuaaauuuuaucaauaacagaauuauuguauuuaaaaaaaaacuaauacuuaucuuuaaa

SEQ ID NO: 471332 - RNA, 62 nt, hsa
acagagaauuuuaucaguaauaggugucaguuuuuaaaaaauugcuuguaggcugagcgcgg

SEQ ID NO: 471333 - RNA, 62 nt, hsa
ucuuuuuguuucguuuuguuucuucuucugcauuuaaaaauuaaaagauugguuugaggaug

SEQ ID NO: 471334 - RNA, 62 nt, hsa
uagaagaacggaucaugugccaacuguaguuuuuuaaaaaaaacgcuccuuuguaggguuuu

SEQ ID NO: 471335 - RNA, 62 nt, hsa
agccaccacaccuggccuuucugcaacauuuuuuuaaaaaaaucuaauaaaucuuagauuuu

SEQ ID NO: 471336 - RNA, 62 nt, hsa
uuuuuuuaaaaaaaucuaauaaaucuuagauuuuuaaaaaagaauuaaaaugugggaguucu

SEQ ID NO: 471337 - RNA, 62 nt, hsa
uacuaauaucuacaugguccacacuuuucuauuuuaaaaaauuguguucucuuguuaaauag

SEQ ID NO: 471338 - RNA, 62 nt, hsa
aucaaauacuaauaaacaauuagaaaucuuacuuuaaaaaacuuauaacucacuugucuuca

SEQ ID NO: 471339 - RNA, 62 nt, hsa
aaucaucaucuagacuuguuaaguagaaaaauuuuaaaaauuugcuuaugaaaauauaaccc

SEQ ID NO: 471340 - RNA, 62 nt, hsa
ucccaucaugccauuuuuuguucauuuuaaucuuuaaaaaauaaaaauuaggcauauuaauu

SEQ ID NO: 471341 - RNA, 62 nt, hsa
ucauugucucccaaaguauuuaggagaagcccuuuaaaaagcugccuuccucuaccacuuug

SEQ ID NO: 471342 - RNA, 62 nt, hsa
ugcauucuauuuucuauaugacccucuugauauuuaaaaaacacuauggauaacaauucuuc

SEQ ID NO: 471343 - RNA, 62 nt, hsa
agggagaucauguuuucuuaaucaugcuggaauuuaaaaauuguuuuacuuguaucgaaauu

SEQ ID NO: 471344 - RNA, 62 nt, hsa
cauuuaugguuuuuuauuacuauuauuaugguuuuaaaaagaguaacuuuauuucuuuuugu

SEQ ID NO: 471345 - RNA, 62 nt, hsa
uuguuuuaauuuuuuauauauauguuuuuauuuuuaaaaaacauaccaguugaaugggguua

SEQ ID NO: 471346 - RNA, 62 nt, hsa
uaauuacuaauuuuuaaagaacaaaucacacauuuaaaaaaucuguagaauuuauuuuaacu

SEQ ID NO: 471347 - RNA, 62 nt, hsa
auugaugcuagagguaaaaaaaaauacuuguuuuuaaaaaauccuuuacgucuuguguaauu

SEQ ID NO: 471348 - RNA, 62 nt, hsa
aucacugugucuguauuucaaguacaaauguuuuuaaaaaggauucuuuauacauaugugcu

SEQ ID NO: 471349 - RNA, 62 nt, hsa
uggcuguuugcaggaaggcagacgagacaguguuuaaaaaguccacaagaaugaucaaguaa

SEQ ID NO: 471350 - RNA, 62 nt, hsa
ugugauagagacaucucuaaaguauuuugaauuuuaaaaaaagauggcagauuuucugcauu

SEQ ID NO: 471351 - RNA, 62 nt, hsa
uuagguuuaauauuuuuuuaguuagguagaguuuuaaaaaauacuugagccuguccgugaua

SEQ ID NO: 471352 - RNA, 62 nt, hsa
ggaggaguauuuuuaguuugacaauuuaauaauuuaaaaacaagacaucuccagguaggaaa

SEQ ID NO: 471353 - RNA, 62 nt, hsa
auccaaaugacauuaucugcacguuuuuaaaauuuaaaaacaaaggacuauuuaaaaauaca

SEQ ID NO: 471354 - RNA, 62 nt, hsa
gcacguuuuuaaaauuuaaaaacaaaggacuauuuaaaaauacaguuuauuaacaaacguga

SEQ ID NO: 471355 - RNA, 62 nt, hsa
uucauaguuugagcugguauuuacccccuggguuuaaaaaucagauuaacuucuuggucucc

SEQ ID NO: 471356 - RNA, 62 nt, hsa
cacuuguauucuuucuacuguaaaauggcgccuuuaaaaaagauguaagacuuugguuccca

SEQ ID NO: 471357 - RNA, 62 nt, hsa
ggcauuuuuaaacauuuaaaaauuauuaaacauuuaaaaauuaguuuauuaucagauaucag

SEQ ID NO: 471358 - RNA, 62 nt, hsa
uagaaauuaguuuuaucuggcauuuuuaaacauuuaaaaauuauuaaacauuuaaaaauuag

SEQ ID NO: 471359 - RNA, 62 nt, hsa
aaagucugcugaaaagauuugcugauuauuaguuuaaaaaucuuguaacacucagcagugcu

SEQ ID NO: 471360 - RNA, 62 nt, hsa
uuggcuaacugcaugacaugcccauucuaccauuuaaaaaaaaaucuuaaagccuguaauuu

SEQ ID NO: 471361 - RNA, 62 nt, hsa
gaaguauuuaacuaugaauaucaugaagguuauuuaaaaauguauuuauuuuaucuuugggg

SEQ ID NO: 471362 - RNA, 62 nt, hsa
gaaauauuuguuaacagcccauugaacauacuuuuaaaaacacuaugguagagaaugcugug

SEQ ID NO: 471363 - RNA, 62 nt, hsa
auuuauucuuuaaaucaaaguaaauuagaauuuuuaaaaagcacaaaacugcaggacaguuu

SEQ ID NO: 471364 - RNA, 62 nt, hsa
aaauuugucuaugcuuaggcauuuaaggagcauuuaaaaauauguauauaugugacugaaug

SEQ ID NO: 471365 - RNA, 62 nt, hsa
gugcugcacaugggcugaauuuuuaaauuuuuuuuaaaaacuugaagcagaaccuuguaauu

SEQ ID NO: 471366 - RNA, 62 nt, hsa
ccagauuuuuauuaauguaaaaaaaaucaauuuuuaaaaaauaguuggacuuuggcagcuuu

SEQ ID NO: 471367 - RNA, 62 nt, hsa
guauaaguuucaccaccuugagaaauaauuuuuuuaaaaaaucuuccucuuucucuggggag

SEQ ID NO: 471368 - RNA, 62 nt, hsa
cucacuggauguaaaaucuaucaguuaauaguuuuaaaaaugucucuuuuguuaagaauaaa

SEQ ID NO: 471369 - RNA, 62 nt, hsa
augauuuuuuuucuuaccuuuacauaugaagguuuaaaaauacaucauguggccaaagaaug

SEQ ID NO: 471370 - RNA, 62 nt, hsa
agaaauaauuauuugguuauucauuggcuuccuuuaaaaaaaaguguucuucuacaaaucuu

SEQ ID NO: 471371 - RNA, 62 nt, hsa
uuucauugauauuugaaaacagacuaugacauuuuaaaaaucugcccuaugaguaucaaccu

SEQ ID NO: 471372 - RNA, 62 nt, hsa
aaguuggcauguuucguaaaacuugcgugucuuuuaaaaauaauaaaaggaagaugaguauu

SEQ ID NO: 471373 - RNA, 62 nt, hsa
guacuuuucuugauacuguuaacuuugugcuuuuuaaaaaaagugauucucuaacagaccuc

SEQ ID NO: 471374 - RNA, 62 nt, hsa
aguuuuuucauuuaauaauucaaaccaacacuuuuaaaaaaauaauucagaugagacugagc

SEQ ID NO: 471375 - RNA, 62 nt, hsa
uauauaaaucaaaguacacauuauuuaaaauauuuaaaaaaauuuucaguuucuucauuuuu

SEQ ID NO: 471376 - RNA, 62 nt, hsa
aauucuuaugucgcucaaaaaauaaaauuuaauuuaaaaaguaucugauuuuuaaaguaaau

SEQ ID NO: 471377 - RNA, 62 nt, hsa
agcauauugagacucugucucuacaaaaaaauuuuaaaaaguaaaaauuagcugggcguggu

SEQ ID NO: 471378 - RNA, 62 nt, hsa
uuauuuuaguccuauuuguauuauuuuaugcauuuaaaaacacaguccugagagggauggac

SEQ ID NO: 471379 - RNA, 62 nt, hsa
uuauuucagcccuauuuguauuauuuugugcauuuaaaaaacacaaucuuaaggggauagac

SEQ ID NO: 471380 - RNA, 62 nt, hsa
uugcuguauuugauuacuuagagauaggaauuuuuaaaaaucaaaacaaaaaauaccacagc

SEQ ID NO: 471381 - RNA, 62 nt, hsa
uuuuauucagcaguguucuuuaaacgguuucauuuaaaaaguaacuuuuuuuuuuugccugu

SEQ ID NO: 471382 - RNA, 62 nt, hsa
uaaaauuuuuguuuaaacuguccaggaucugauuuaaaaauauggucuuuguuuuauaugau

SEQ ID NO: 471383 - RNA, 62 nt, hsa
acuguaguguuuauauaauuuuauguucuacuuuuaaaaaaauaaauuaauaucuaauugua

SEQ ID NO: 471384 - RNA, 62 nt, hsa
uuaacaaugucuauugguaaaggaaaguuauuuuuaaaaauuguauuguaauuccaugaccc

SEQ ID NO: 471385 - RNA, 62 nt, hsa
uaacuaguuucugagguauuuaaaaauuugguuuuaaaaauauuaagcuuuuugcucauuug

SEQ ID NO: 471386 - RNA, 62 nt, hsa
uaccucuuuugauauaacuaguuucugagguauuuaaaaauuugguuuuaaaaauauuaagc

SEQ ID NO: 471387 - RNA, 62 nt, hsa
uuuugucuucuuuuuaauauauaaaaguuauauuuaaaaaguauauaacauacuauauaugu

SEQ ID NO: 471388 - RNA, 62 nt, hsa
acauuuuauuuucucuuauuucuguugugauuuuuaaaaacuuuuuuuuggaccuaaauaau

SEQ ID NO: 471389 - RNA, 62 nt, hsa
uucuuaauucggcaauggaauaucuuuuaaguuuuaaaaaaacuggaauaauuauaucuauc

SEQ ID NO: 471390 - RNA, 62 nt, hsa
gccuuuuaaaaaugcuuauagagaaaaaaaauuuuaaaaagaaagcuaaugcuaguauauac

SEQ ID NO: 471391 - RNA, 62 nt, hsa
auggugauuaaacaccucuuuuggguaugccuuuuaaaaaugcuuauagagaaaaaaaauuu

SEQ ID NO: 471392 - RNA, 62 nt, hsa
uuuuuuuaaaagaagcuuuguaauaaaacauuuuuaaaaauugucauuuuauuaagagugaa

SEQ ID NO: 471393 - RNA, 62 nt, hsa
aguuguuaaaaugagcauugauguacccauuuuuuaaaaaagcaaggcacagccuuugccca

SEQ ID NO: 471394 - RNA, 62 nt, hsa
gggcuuuuucagcaucucguuuauguguggaauuuaaaaagaauaaaguuuuauuccauucu

SEQ ID NO: 471395 - RNA, 62 nt, hsa
aacucaaaaucaauuuauuaagagccauauucuuuaaaaaaaaaaagcuggauaauauucuc

SEQ ID NO: 471396 - RNA, 62 nt, hsa
uguaaaugggaauucaugaaauuaaauauuacuuuaaaaaggacauugaacuuagucuuuuu

SEQ ID NO: 471397 - RNA, 62 nt, hsa
uacagguagugauuauuagugcuucauccccauuuaaaaaaacacaguacuaauggguaaca

SEQ ID NO: 471398 - RNA, 62 nt, hsa
aaaaaaaucugcaagauaauguaacugaauguuuuaaaaacagaacuugucacuuuauauaa

SEQ ID NO: 471399 - RNA, 62 nt, hsa
uuauuaaucuugcuguugagcuguauacaugguuuaaaaaauaguacuguuuaaugcuaagu

SEQ ID NO: 471400 - RNA, 62 nt, hsa
aguccaaguaggaguugguuuguuuugccuuguuuaaaaauugcuguuagucacagaguuug

SEQ ID NO: 471401 - RNA, 62 nt, hsa
ucauuaagaaucuaaguucuucuaagugggccuuuaaaaaccccagcugccagagaccccaa

SEQ ID NO: 471402 - RNA, 62 nt, hsa
ugacugggguuugaucucagcuucugaaaauguuuaaaaauuggaaggaaauacuacucaua

SEQ ID NO: 471403 - RNA, 62 nt, hsa
cagaaacucuuagguggaauguuucugaaggcuuuaaaaaaaauacaauaaaguaaaaaccg

SEQ ID NO: 471404 - RNA, 62 nt, hsa
uaaacuacuuugaauagaggccaaauuaaucuuuuaaaaaugaugauaaucaucagguuuac

SEQ ID NO: 471405 - RNA, 62 nt, hsa
auagagggguuuuagauuuuuaaaagguagguuuuaaaaauaaguuuuauacauaaacaguu

SEQ ID NO: 471406 - RNA, 62 nt, hsa
ucguauggugcuagaguuagauuaaucugcauuuuaaaaaacugaauuggaauagaauuggu

SEQ ID NO: 471407 - RNA, 62 nt, hsa
accagaacauucuauguacuacaaaccugguuuuuaaaaaggaacuauguugcuaugaauua

SEQ ID NO: 471408 - RNA, 62 nt, hsa
aguccaauguuucaucaucaggaacuuucgguuuuaaaaaagaaacauuacuuuugucugcu

SEQ ID NO: 471409 - RNA, 62 nt, hsa
augcuuuaaacaauaaaguaggauuuaaaucauuuaaaaaacuaaacugcagggaauuucag

SEQ ID NO: 471410 - RNA, 62 nt, hsa
uugcucccaacugauugucacuuaaaugaaaauuuaaaaaugaauaaaaagacauacuucuc

SEQ ID NO: 471411 - RNA, 62 nt, hsa
uacuuauagccuauggucccggaugacaucuguuuaaaaacaagcacaaccugcaacauacu

SEQ ID NO: 471412 - RNA, 62 nt, hsa
acuauuaauauuuaaaaacgagaaauacaacauuuaaaaaauuaagaguauuuugcauuagu

SEQ ID NO: 471413 - RNA, 62 nt, hsa
caugaaaaacuuagaauagugaacuauuaauauuuaaaaacgagaaauacaacauuuaaaaa

SEQ ID NO: 471414 - RNA, 62 nt, hsa
uuuuuggucuaaguuacaucaguguuguuuuguuuaaaaagccuucaugagauacaauucac

SEQ ID NO: 471415 - RNA, 62 nt, hsa
uauuuugggaaauuaguguauuuuauaaaaauuuuaaaaagaaaaaagacuacuacagguua

SEQ ID NO: 471416 - RNA, 62 nt, hsa
aaacaauguauauuauguuccuguguguugaauuuaaaaaaaaaauacuuuacuuggauauu

SEQ ID NO: 471417 - RNA, 62 nt, hsa
gaagaugaaaucauuccuaaauuaaccuuuuuuuuaaaaaaaaacaauguauauuauguucc

SEQ ID NO: 471418 - RNA, 62 nt, hsa
ucuuugucuuaauaugcuaaguuaauuuucacuuuaaaaaagccauuugaagaccagagcua

SEQ ID NO: 471419 - RNA, 62 nt, hsa
uuuggguuuuuuaggauguugcauuucguuuuuuuaaaaaaaauuuuguaauaaaauuaugu

SEQ ID NO: 471420 - RNA, 62 nt, hsa
uagcugauaagauucucuguagagaaaauacuuuuaaaaaaugcagguuguagcuuuuugau

SEQ ID NO: 471421 - RNA, 62 nt, hsa
uaaggugcaauuucuaaauuuguaagaguagguuuaaaaaaaaaagugcuucuuaucuuugu

SEQ ID NO: 471422 - RNA, 62 nt, hsa
uguuuaacuaagggccauccaaccauccaaccuuuaaaaaacaaaacgaaagugcuucucau

SEQ ID NO: 471423 - RNA, 62 nt, hsa
gauuccccgacuccauccuuuuucagggguuauuuaaaaaucugccuuagauucuauaguga

SEQ ID NO: 471424 - RNA, 62 nt, hsa
aagaguacagugcacuagagggaaguguucccuuuaaaaauaagaacaacuguccuggcugg

SEQ ID NO: 471425 - RNA, 62 nt, hsa
uaaaugugcuaaguuauuugagacuuccucaguuuaaaaaguggguuuuaaaucuucugucu

SEQ ID NO: 471426 - RNA, 62 nt, hsa
aguucaaaaauguucugcucuguuuuugacucuuuaaaaauaacuuagauucaaauuuauag

SEQ ID NO: 471427 - RNA, 62 nt, hsa
aauaugcugaacauuagacauaauuaaaucuuuuuaaaaauugauaauuuaucucuguuuua

SEQ ID NO: 471428 - RNA, 62 nt, hsa
guaagugcaauaauaugaaauagccuguacauuuuaaaaauguugucaccaaguuauauaaa

SEQ ID NO: 471429 - RNA, 62 nt, hsa
cacaucucuguaaacaaccuuuuuuaaguaauuuuaaaaaaaauaaacacucugcuuacuac

SEQ ID NO: 471430 - RNA, 62 nt, hsa
gcuuaaaacccuucaucaugauauccuguggauuuaaaaacucuaauuccauguuuucuucc

SEQ ID NO: 471431 - RNA, 62 nt, hsa
aaauacuuuuuagguagccaugcuugagacuuuuuaaaaauauaacuuuuuccuuaaaguuu

SEQ ID NO: 471432 - RNA, 62 nt, hsa
aauacuucauaauaugugaaaaacucggaucuuuuaaaaagcaucauagaucauuuuuccau

SEQ ID NO: 471433 - RNA, 62 nt, hsa
agaucauuuuuccauaugacacugguuccgauuuuaaaaauuauuuuuaaauaaccgauuau

SEQ ID NO: 471434 - RNA, 62 nt, hsa
auuuucaacuuuuucccucacuaauugguacuuuuaaaaacauaacauaaauuuuuugaagu

SEQ ID NO: 471435 - RNA, 62 nt, hsa
aacccauaauugaaguguauaauauaaaaaauuuuaaaaaucuaagcagcuuauuguuucuc

SEQ ID NO: 471436 - RNA, 62 nt, hsa
aauuucuacuucccuuaggcauuuuauaaaaauuuaaaaauuauuuuucuauuuuguuuaaa

SEQ ID NO: 471437 - RNA, 62 nt, hsa
auuauuuucuuuauuguugguaaacuccauauuuuaaaaauuuaccuguauacauagugcuu

SEQ ID NO: 471438 - RNA, 62 nt, hsa
aaaggcauucuuagauucauuuuaaccacauuuuuaaaaacucacaguugguuaacaugaug

SEQ ID NO: 471439 - RNA, 62 nt, hsa
uuuuguuguuucuuaaauaagaaacuuuuuuauuuaaaaaacuaaaaacuagaggugagaaa

SEQ ID NO: 471440 - RNA, 62 nt, hsa
aaucucaucucagugaagaauacuucucauuuuuuaaaaaagcuuaaaacuuugaaguuagc

SEQ ID NO: 471441 - RNA, 62 nt, hsa
gagagauuuuucaaaagcaguaaucccucaauuuuaaaaaaggauugaaaauucuaaauguc

SEQ ID NO: 471442 - RNA, 62 nt, hsa
auuuuuuaugccuccucaguaaccagaaauguuuuaaaaaacuaaguguuuaggauuucaag

SEQ ID NO: 471443 - RNA, 62 nt, hsa
uuuuuguugaguaagcaaaauuacaaaguguuuuuaaaaaaaccuguacaaauauguuuaug

SEQ ID NO: 471444 - RNA, 62 nt, hsa
uuuaucuaggauggaaaaucaggauagacucguuuaaaaacaaguauauuaaauggguuaaa

SEQ ID NO: 471445 - RNA, 62 nt, hsa
ggacaaaguuccaaaaugccaaauucuuauuuuuuaaaaagcuaguucuauaaaauacuggu

SEQ ID NO: 471446 - RNA, 62 nt, hsa
uauauguauauauaugcacauauauauauguauuuaaaaaaaucaaaacaaaaaaaaacuca

SEQ ID NO: 471447 - RNA, 62 nt, hsa
guauuuuuuaaagcuacaaucuguucaauguuuuuaaaaaucuguuuauaugacauuguuaa

SEQ ID NO: 471448 - RNA, 62 nt, hsa
uuaauaaaguauaagugauguuuuauaugauuuuuaaaaaaaauucucaagugcaauguguu

SEQ ID NO: 471449 - RNA, 62 nt, hsa
ccauaugaguuuauauugauuuuuuuuuuccauuuaaaaauccacuaaugguguaaaagaga

SEQ ID NO: 471450 - RNA, 62 nt, hsa
ugccacuuagaauagcauuugccacuuaguauuuuaaaaaauaauuguuggaguauuuauug

SEQ ID NO: 471451 - RNA, 62 nt, hsa
aaugacuuuauacaacgauuguauuugugacuuuuaaaaauaauuauuuuauuguguaauug

SEQ ID NO: 471452 - RNA, 62 nt, hsa
aggcuaaucauagaaaaaaaaccucuaguuuuuuuaaaaauagaauuuggaaacuuauuuuu

SEQ ID NO: 471453 - RNA, 62 nt, hsa
uccugauucagaaauguguaugguuugcagcuuuuaaaaaccauuuuuuuaaaacuaauaaa

SEQ ID NO: 471454 - RNA, 62 nt, hsa
aaugcaguagaaaguagugguaauaauuccuuuuuaaaaaaauuucgguagucauauaguaa

SEQ ID NO: 471455 - RNA, 62 nt, hsa
auugugauauuagaggcuggaaauccuuauuuuuuaaaaaaucagauaggcauaaauaguua

SEQ ID NO: 471456 - RNA, 62 nt, hsa
auuuaauaugaguuugagagagaaaauuguuuuuuaaaaauauaugugcauugaaaugaugg

SEQ ID NO: 471457 - RNA, 62 nt, hsa
ggaacaguauucuuuauuuucuggguguuauauuuaaaaaagcaaguuuggauuuuuacacc

SEQ ID NO: 471458 - RNA, 62 nt, hsa
uuuuuucauaguucuuguuuucauguuuuauuuuuaaaaagacauauaaagauugcauauuu

SEQ ID NO: 471459 - RNA, 62 nt, hsa
uuauuaugacauuuccuaauaaaccccuuugauuuaaaaauguauuuuuaaaaauguuuaca

SEQ ID NO: 471460 - RNA, 62 nt, hsa
ccuaauaaaccccuuugauuuaaaaauguauuuuuaaaaauguuuacauugaugaugaguaa

SEQ ID NO: 471461 - RNA, 62 nt, hsa
uauauguguguguguguaacuaucauguggguuuuaaaaauccuuuuuuacagugguaucca

SEQ ID NO: 471462 - RNA, 62 nt, hsa
uccaaggugcagugcacugugaaucuuuuauuuuuaaaaaaauuuguaggugcuuuuaugua

SEQ ID NO: 471463 - RNA, 62 nt, hsa
uaaacaaacaauuugaaguuaaacauuucauuuuuaaaaacacugaauuacaguucuuauug

SEQ ID NO: 471464 - RNA, 62 nt, hsa
caaaaaaccagugaaauucuacaagugucccuuuuaaaaauagugugugcuaacuaagggcu

SEQ ID NO: 471465 - RNA, 62 nt, hsa
aaguucaaaauuuaaacaaguucauacaaguuuuuaaaaauucucaacugguagcuugcuug

SEQ ID NO: 471466 - RNA, 62 nt, hsa
acuguguugcagaaguggcaaaagcgcuuauuuuuaaaaaugcaaaauauuuguacaaugua

SEQ ID NO: 471467 - RNA, 62 nt, hsa
auaauguauguuagacagcaagaaaugaauacuuuaaaaagugauguauguuggaguuauaa

SEQ ID NO: 471468 - RNA, 62 nt, hsa
auuuuuuuuuugcuaaauacuuuggaauucuauuuaaaaaauagaugaucaagaucuaaagg

SEQ ID NO: 471469 - RNA, 62 nt, hsa
ggcuauuuugauuuggcaugacuacuuaauuuuuuaaaaaaauugugguuugugaauugcac

SEQ ID NO: 471470 - RNA, 62 nt, hsa
uucuguacaaacaaaaaguauguaauacccauuuuaaaaaaccauuugaaaguagacaacuu

SEQ ID NO: 471471 - RNA, 62 nt, hsa
cugaugcgacuuguuuugcugcuugguagcacuuuaaaaaauuuuuugauuaaugaagaaag

SEQ ID NO: 471472 - RNA, 62 nt, hsa
aacauaauaagacuuuucucuacuuuaaauuuuuuaaaaaauuaguugggcauaguggcacu

SEQ ID NO: 471473 - RNA, 62 nt, hsa
cuccagccugggugacagagcaauacccugucuuuaaaaauaaaagcuauuacuuggcaaau

SEQ ID NO: 471474 - RNA, 62 nt, hsa
auauuuuaaauguccggauaauauucuagagguuuaaaaaauggaaauauuugaacuuucua

SEQ ID NO: 471475 - RNA, 62 nt, hsa
aaaaaaaaaaaaagaaaaaaagaauguaaaauuuuaaaaauacaguuuaacagcuguaaaag

SEQ ID NO: 471476 - RNA, 62 nt, hsa
acuuucauucuuuaaauauuauugacuuacaguuuaaaaauaaauaaauaaaagcauacuau

SEQ ID NO: 471477 - RNA, 62 nt, hsa
augcuauauaucuuuuguaagacauuuccuuuuuuaaaaaaauuuuugcaaauaacugaucu

SEQ ID NO: 471478 - RNA, 62 nt, hsa
auguauaggagauaaaauuugcuaguaagauuuuuaaaaacuggcuagugaaaggaaaguac

SEQ ID NO: 471479 - RNA, 62 nt, hsa
ugucaguaauccauaagacagaaaucuguuuuuuuaaaaauaucuuuuucuccucucagcuc

SEQ ID NO: 471480 - RNA, 62 nt, hsa
gcaagcuauuuguuuguuuucuaauuuauaguuuuaaaaacuucgcuuauugaguuuuuguu

SEQ ID NO: 471481 - RNA, 62 nt, hsa
uauuugauacuugacagugcaaguuucuguaauuuaaaaagaugugguggccugacaccugc

SEQ ID NO: 471482 - RNA, 62 nt, hsa
caccuuucgcuguuuguuguuucauagauuuauuuaaaaaaagagaaagucuauagcuauaa

SEQ ID NO: 471483 - RNA, 62 nt, hsa
ggcauuaauauaaaagagguaggagucuguuauuuaaaaaaagcauuaaauuuaaaaaaaaa

SEQ ID NO: 471484 - RNA, 62 nt, hsa
guaggagucuguuauuuaaaaaaagcauuaaauuuaaaaaaaaacugucuugucuacuuuua

SEQ ID NO: 471485 - RNA, 62 nt, hsa
aaaauuugacaauuuugauucucacugguauguuuaaaaacugaauaaaaggaauagaauuu

SEQ ID NO: 471486 - RNA, 62 nt, hsa
cuauuuaucuuugauuucagucuuggcaauuguuuaaaaaaaaaaucuagauuuguuuuauu

SEQ ID NO: 471487 - RNA, 62 nt, hsa
gguaaauuauaaauguuucaugaagaaaaaauuuuaaaaaucuacgucuuuauuacacaaac

SEQ ID NO: 471488 - RNA, 62 nt, hsa
auguauacuccauagaaacuaaacuaaaauaguuuaaaaauauucccuuuuucacccuauuu

SEQ ID NO: 471489 - RNA, 62 nt, hsa
gcaguguaauucuuuguuuuuaauugcagacauuuaaaaaugucauuuucuacuguuaagag

SEQ ID NO: 471490 - RNA, 62 nt, hsa
aaucuuucuacuaauguaaauuugagauuauuuuuaaaaauggaauaaaagagguuuugguc

SEQ ID NO: 471491 - RNA, 62 nt, hsa
uucaaagacgauauaccagcccucacccagguuuuaaaaaagcacugguaggcauagaauag

SEQ ID NO: 471492 - RNA, 62 nt, hsa
aaaauauacauaacgaugaaaaauaauacaaauuuaaaaaccaauacaguauaacaacuauu

SEQ ID NO: 471493 - RNA, 62 nt, hsa
auuuaauucauagaaaaaauguaaaaggucuuuuuaaaaaucaugaaaaauaguugaauaua

SEQ ID NO: 471494 - RNA, 62 nt, hsa
uaaaagaguaagcuucaauaugugaauuuucuuuuaaaaacagucacugaguuaauaaugua

SEQ ID NO: 471495 - RNA, 62 nt, hsa
auuaaucuguuugugcaaacauaauaccaccauuuaaaaauguuagggagaugaguugcagu

SEQ ID NO: 471496 - RNA, 62 nt, hsa
ucaaauuuuuuuuuaacguggcuuguagaauuuuuaaaaaagugaucuuagguuuguuuuuu

SEQ ID NO: 471497 - RNA, 62 nt, hsa
cgaguucaccuaaguaaggcucagauccuaguuuuaaaaaccauuucccauuaaaaugaagu

SEQ ID NO: 471498 - RNA, 62 nt, hsa
uccaugaguucaugcugauacucaaauuucuuuuuaaaaaggagaaacaggaagguuucuuu

SEQ ID NO: 471499 - RNA, 62 nt, hsa
auucgugauacgcguuucuccacugacagacauuuaaaaacaaccuucagcuccguuucaau

SEQ ID NO: 471500 - RNA, 62 nt, hsa
cauuuagguacuucaggaaacaugcagcauuuuuuaaaaaaugaaaauuguuuuucuacuuc

SEQ ID NO: 471501 - RNA, 62 nt, hsa
uaauguuuuauauuuauauuuuuguauuuauuuuuaaaaaaauaaaccaguuuuuacaacua

SEQ ID NO: 471502 - RNA, 62 nt, hsa
uagguacauguccugcccuugcaaaugaagcuuuuaaaaaggugaagaaaaauuuuacagua

SEQ ID NO: 471503 - RNA, 62 nt, hsa
auuaauuuuuuuugaagcucauauuguaucuuuuuaaaaaccauguuguggaaaaaagccag

SEQ ID NO: 471504 - RNA, 62 nt, hsa
auuuacacuucuaagacuagagacccacauuuuuuaaaaaucauuuuauuuugugauacagu

SEQ ID NO: 471505 - RNA, 62 nt, hsa
guuucaaauguuaagaacacuaaauagcaugauuuaaaaaaugaaaaaugcuaacacccaag

SEQ ID NO: 471506 - RNA, 62 nt, hsa
uaucuuauauucucuauucaagugaccugucuuuuaaaaaggcagugcugucuuaccucuug

SEQ ID NO: 471507 - RNA, 62 nt, hsa
ccuaaggaagaauaauaauauaagaaaggaaauuuaaaaacauuccacaagaagaaaaauua

SEQ ID NO: 471508 - RNA, 62 nt, hsa
gaagaaaaggaggaaccaauuaaauaggaccuuuuaaaaauuguuaauuuuguaaacuuugc

SEQ ID NO: 471509 - RNA, 62 nt, hsa
ugacuucccccccaaauuuuauuaugaacauuuuuaaaaacagaaaaauugaaaaacuguuu

SEQ ID NO: 471510 - RNA, 62 nt, hsa
agaaaacuauaaaauacuuaaagauauauaaauuuaaaaaaacauagcugcaggucuuuggu

SEQ ID NO: 471511 - RNA, 62 nt, hsa
uugccaaagugugcuucagaaauauauacugcuuuaaaaaagaauaaaagaauauccuuuua

SEQ ID NO: 471512 - RNA, 62 nt, hsa
acuuuuauuauuaaauguauugagguauuauauuuaaaaaaaacuauguucagaacuucauc

SEQ ID NO: 471513 - RNA, 62 nt, hsa
aaaguaagugaaauguaaauaaacuuauuuuuuuuaaaaaugccauaccucguguuucuuuu

SEQ ID NO: 471514 - RNA, 62 nt, hsa
cuacugaaauauagauaaagauugccuuaguuuuuaaaaauguuuggccauuaguauuuuua

SEQ ID NO: 471515 - RNA, 62 nt, hsa
guugugguucauucuuuucaaaucuauuuuuguuuaaaaacaauacaaguuuuagaaaacaa

SEQ ID NO: 471516 - RNA, 62 nt, hsa
aauuaaauagaaacuuauugaauauacauucuuuuaaaaaguauauuuguuauuuaaguuuu

SEQ ID NO: 471517 - RNA, 62 nt, hsa
aggaaucuuggauugggaauucaguacuuugcuuuaaaaaaauuuuguggcagaauuaaauu

SEQ ID NO: 471518 - RNA, 62 nt, hsa
auuaguaauuuuuaaaaacacuuuaucaguauuuuaaaaauguuaaugcaggagaaaagaua

SEQ ID NO: 471519 - RNA, 62 nt, hsa
gugagccacugagccagccagcauuaguaauuuuuaaaaacacuuuaucaguauuuuaaaaa

SEQ ID NO: 471520 - RNA, 62 nt, hsa
aguuuucuuugguaccaauuuguuuagauaauuuuaaaaauguuuuuuaguucuagcuacua

SEQ ID NO: 471521 - RNA, 62 nt, hsa
auuauuuggcuuccuuuagaauuauugugaaguuuaaaaauagccuuucuccugcaaauuuu

SEQ ID NO: 471522 - RNA, 62 nt, hsa
aagugccauagucuuuuuuuauguguagcauauuuaaaaauauauauguauauuauacauac

SEQ ID NO: 471523 - RNA, 62 nt, hsa
gcuagucuaaaccaugcucuuccacacagcuguuuaaaaaccacuggguaugaggaauaugc

SEQ ID NO: 471524 - RNA, 62 nt, hsa
auugugauugaaguggagagguacucuaggaauuuaaaaagacacaaaauuauuuuuuucca

SEQ ID NO: 471525 - RNA, 62 nt, hsa
uuaaaaauuuuaaauuuuaaagaauuaaaaauuuuaaaaauuuaaauuaaaaaaauuaaaaa

SEQ ID NO: 471526 - RNA, 62 nt, hsa
auuacaaguauauuacauguaaaacaggacaauuuaaaaauuuuaaauuuuaaagaauuaaa

SEQ ID NO: 471527 - RNA, 62 nt, hsa
cauaguaauuauuuaauuacuguggcuuuuauuuuaaaaaguaauuagagguuuuuccauuu

SEQ ID NO: 471528 - RNA, 62 nt, hsa
caucauggauaaaaacuaagcgcuugccuucuuuuaaaaagaaaaacugaugauuagauuag

SEQ ID NO: 471529 - RNA, 62 nt, hsa
aaagaaagaaggccacguauguugggguaauuuuuaaaaauuuucagauuggcuaaauauuu

SEQ ID NO: 471530 - RNA, 62 nt, hsa
aacacaggcaauauuccagcuauggagcuagcuuuaaaaaggaacaguaaaaauauuaaucg

SEQ ID NO: 471531 - RNA, 62 nt, hsa
gccacacaugguuuauuugaaguauuuuauaauuuaaaaaaauacagaagcaggaaaaccaa

SEQ ID NO: 471532 - RNA, 62 nt, hsa
cauaaagaaccucucuaugucccuuuuuuuaauuuaaaaaaaaugacucuugucuaauauuc

SEQ ID NO: 471533 - RNA, 62 nt, hsa
guauuucuaauuauauaaaauauuaagaaucuuuuaaaaaaaucugugaaauuaacaugcuu

SEQ ID NO: 471534 - RNA, 62 nt, hsa
gaaaugauguuaaagcauaauaauaacauaucuuuaaaaagcuuuucaaaauauauuuucac

SEQ ID NO: 471535 - RNA, 62 nt, hsa
acugaccauuuuuaucauauuuuaggccuuuuuuuaaaaaaucaggguauaguaggcacuaa

SEQ ID NO: 471536 - RNA, 62 nt, hsa
acaaaagcauaaaauaaugauuuuucacucucuuuaaaaauacuaaaucauuuauguccauu

SEQ ID NO: 471537 - RNA, 62 nt, hsa
aauauucuagaaacuuucugaaauaauuucuguuuaaaaauauugaauauuugcuucauuuc

SEQ ID NO: 471538 - RNA, 62 nt, hsa
uccacaaaauccaaauuuaccauauuauuguuuuuaaaaaagcaguuuagagcaaacuguca

SEQ ID NO: 471539 - RNA, 62 nt, hsa
auacuuaggauuaaauaaauaauauggauuguuuuaaaaaauauccaaggaucagagucucu

SEQ ID NO: 471540 - RNA, 62 nt, hsa
ccagaauuaggugaaguagcaugauagcaguguuuaaaaauacuuaggauuaaauaaauaau

SEQ ID NO: 471541 - RNA, 62 nt, hsa
uuucccaucaaacauuaucaauauaccaauguuuuaaaaauugagugaggguuauuauuugu

SEQ ID NO: 471542 - RNA, 62 nt, hsa
acaggcgugagccaccgugccuggccgacauuuuuaaaaaaguuuuauuuugcacggcucua

SEQ ID NO: 471543 - RNA, 62 nt, hsa
agccaccaauguaauuaauggugugcaguuauuuuaaaaacuacagaucauuucauuauuuu

SEQ ID NO: 471544 - RNA, 62 nt, hsa
uuuuaguuuuuaacuucaaaggcuucuuucucuuuaaaaaaaaauuauuuuuaauauagagu

SEQ ID NO: 471545 - RNA, 62 nt, hsa
agaagaaaaguugaauaagaguuggcuuaaauuuuaaaaaagaaaaagaaaauugagguuuu

SEQ ID NO: 471546 - RNA, 62 nt, hsa
auuucaugugcaaauaauuauauauaaauauauuuaaaaaugcuauauauaguauaugccau

SEQ ID NO: 471547 - RNA, 62 nt, hsa
uugauaaucuucaggugaacacuuagugaucauuuaaaaagcucacugcugaucguagaaaa

SEQ ID NO: 471548 - RNA, 62 nt, hsa
ggcaaauuaacuguauguguguagguuaucuuuuuaaaaacucuucagugcaaauuguaucu

SEQ ID NO: 471549 - RNA, 62 nt, hsa
ucuguaguuucugguuagcuacccuaaagugauuuaaaaauuuagaaugcuuuguguuuccu

SEQ ID NO: 471550 - RNA, 62 nt, hsa
uuaagacuacuuuucuuauagguaguugauauuuuaaaaacuuuagauuuaaugucuacaug

SEQ ID NO: 471551 - RNA, 62 nt, hsa
uuccaguucgaucuucuggguuuaguuuugucuuuaaaaagaauucaaaaaaagacugacaa

SEQ ID NO: 471552 - RNA, 62 nt, hsa
aaacacaaauacauuuuuuaaaaucaagaaaauuuaaaaagacaaaaaaaaaagaauucauu

SEQ ID NO: 471553 - RNA, 62 nt, hsa
acaaugaauugauguuuaguuugcuuuagucauuuaaaaagauauuguaccaggaugugcua

SEQ ID NO: 471554 - RNA, 62 nt, hsa
acacagagcugaaugggcaguguaaucaauaauuuaaaaaacaugaaugucauuagauccuu

SEQ ID NO: 471555 - RNA, 62 nt, hsa
auaaauuugagcuauuuuuuuuagaggugcuuuuuaaaaauccaauagauacaagagauguu

SEQ ID NO: 471556 - RNA, 62 nt, hsa
agaaauagaaauacaagacugguaaacaugccuuuaaaaauauauauauuuucaacuaguau

SEQ ID NO: 471557 - RNA, 62 nt, hsa
uccacccaaguguacauauguaccuauuuuuuuuuaaaaagcagaaauagaaauacaagacu

SEQ ID NO: 471558 - RNA, 62 nt, hsa
cuuuaaaacacuuuuuuauuuuguuuuucuauuuuaaaaauaaaauauuauuuucugaauuu

SEQ ID NO: 471559 - RNA, 62 nt, hsa
acugcucaguuaucuuugccugcguguauauuuuuaaaaauucacucugaaguguuauggau

SEQ ID NO: 471560 - RNA, 62 nt, hsa
auuuaaaaagcuuucucuuuaaguugcuacaauuuaaaaaucaaguaagcuacucuaaauca

SEQ ID NO: 471561 - RNA, 62 nt, hsa
aagaugaaauauuauuuauccuauuuauuaaauuuaaaaagcuuucucuuuaaguugcuaca

SEQ ID NO: 471562 - RNA, 62 nt, hsa
guagcuccagguagaugagccuuuuuuuuuuuuuuaaaaauaccauauucaagggagucugc

SEQ ID NO: 471563 - RNA, 62 nt, hsa
cgggcauuugagggggcauggaguaauuuguauuuaaaaaaccuuaaaguugugcuguuccu

SEQ ID NO: 471564 - RNA, 62 nt, hsa
uggauuugaggcuuccuaagaugugcuugcauuuuaaaaagggagcuuggugagagcuuugc

SEQ ID NO: 471565 - RNA, 62 nt, hsa
uauauucauuuauggaguuagcuguauuuuuuuuuaaaaaagaaaaguaguaaauuagcagc

SEQ ID NO: 471566 - RNA, 62 nt, hsa
uguccaagagaaaugguuuuugccaaacucuuuuuaaaaaacaaauuguugcuauuuccuag

SEQ ID NO: 471567 - RNA, 62 nt, hsa
ggaacuuuagcuuuauccauaacauuaauuuuuuuaaaaaauaaggucuuaauguuucauuu

SEQ ID NO: 471568 - RNA, 62 nt, hsa
uguacuuaauuucuaaauauauaaaauccacauuuaaaaauuauaaaagcaaggacuuggga

SEQ ID NO: 471569 - RNA, 62 nt, hsa
ucagauuuuggaaacugccguauagucacuguuuuaaaaaccccggaggggcuguauuaauu

SEQ ID NO: 471570 - RNA, 62 nt, hsa
auuuuugaagagggugaaguuuggagaacaaauuuaaaaaccaucagucaugugagcagauu

SEQ ID NO: 471571 - RNA, 62 nt, hsa
uaucaaaaaacccuucaauagcauccuuaagauuuaaaaaaaaaaaaaaaaaaaaggaaaaa

SEQ ID NO: 471572 - RNA, 62 nt, hsa
auugagaaaccaagucaaucaagcaggaaucauuuaaaaaccagauaaagccauguuuuucu

SEQ ID NO: 471573 - RNA, 62 nt, hsa
agaacauggcaaguauuuacuuuuaucuuuuuuuuaaaaacacucaugacagaaaacaguuu

SEQ ID NO: 471574 - RNA, 62 nt, hsa
ugacuuuaaagagacuucaaaauauugaguauuuuaaaaauuuaaaaguaggucaguuuaua

SEQ ID NO: 471575 - RNA, 62 nt, hsa
cuucagaagaaagcugacauuuuaaugaauuuuuuaaaaaauuaauaaacaaauugucuaaa

SEQ ID NO: 471576 - RNA, 62 nt, hsa
acuaaucaguuuagcuuuguguuguaugcuaguuuaaaaaagaaaauauguaauauaaugua

SEQ ID NO: 471577 - RNA, 62 nt, hsa
ggauucaaacgcaacucaaaucugugcuggacuuuaaaaaaacaauucaggaccaaauuuuu

SEQ ID NO: 471578 - RNA, 62 nt, hsa
uuuuuuauauuuaaauguagacuuuugacacuuuuaaaaaacaaaaaaagacaagagagaug

SEQ ID NO: 471579 - RNA, 62 nt, hsa
auaacagggcggcugguuaauaucucacacaguuuaaaaaaucagccccuaauuucuccaug

SEQ ID NO: 471580 - RNA, 62 nt, hsa
uagcauauguguucagguuuauagcuguuguguuuaaaaauugaaaaaaguggaaaacaucu

SEQ ID NO: 471581 - RNA, 62 nt, hsa
uuuuagaggcaggaucuugcuguccaauuuuuuuuaaaaagcuaaaauugccaacuuuagaa

SEQ ID NO: 471582 - RNA, 62 nt, hsa
aaccccagcaauuuauacaacgcugucauauuuuuaaaaaaacaaaaguaagccauccucaa

SEQ ID NO: 471583 - RNA, 62 nt, hsa
guguuacgggggcuuguaggauucuuugguucuuuaaaaaaauuuaaaaggagacuuaucua

SEQ ID NO: 471584 - RNA, 62 nt, hsa
uuuuuaaauaaaguagccauauguaacgggauuuuaaaaauauauacauuuuacaacaugga

SEQ ID NO: 471585 - RNA, 62 nt, hsa
cccuuguacauauaucuuuagagagaagauauuuuaaaaagaaauaccuuuuuaaaaauuau

SEQ ID NO: 471586 - RNA, 62 nt, hsa
uagagagaagauauuuuaaaaagaaauaccuuuuuaaaaauuauuuuauuauuuuuuaauag

SEQ ID NO: 471587 - RNA, 62 nt, hsa
aaauaaauaaaaaccaauaguacuaauuuugcuuuaaaaaaauuucuaauuuuuuucacaua

SEQ ID NO: 471588 - RNA, 62 nt, hsa
aauauuaacucgaauuguaaauuaagcaaaaauuuaaaaaguauauguugaugggacaagaa

SEQ ID NO: 471589 - RNA, 62 nt, hsa
auauugaacuauguguuaauucauuuguaucuuuuaaaaaauuaucacuguuaaagccauug

SEQ ID NO: 471590 - RNA, 56 nt, hsa
aggagaaacacaggaaaugaaaaauuuuuaaaaaaagaaggaaaaauguuuuaaau

SEQ ID NO: 471591 - RNA, 62 nt, hsa
uauauuagguagaauacacauacaaucaaaauuuuaaaaaaaaaagcuaaauaacuuaaaaa

SEQ ID NO: 471592 - RNA, 62 nt, hsa
aacauuuuucaaaaucaggagauuuucguccauuuaaaaaauguauaggugcagauauugaa

SEQ ID NO: 471593 - RNA, 62 nt, hsa
gcuuuaagaaauaacaauuacaauguguauuauuuaaaaaugggagaaauaguuuguucuau

SEQ ID NO: 471594 - RNA, 62 nt, hsa
uaaaguuuaauaguuaucaaaaucaccuaauuuuuaaaaauagcuuucguuuugaguucugg

SEQ ID NO: 471595 - RNA, 62 nt, hsa
acugucaaaaucaguauauacuauuaguuauauuuaaaaauauuuuuuuaaauucuuuacag

SEQ ID NO: 471596 - RNA, 62 nt, hsa
cccagaggaacuuagggauuucaccccuggcuuuuaaaaaaaacgaaauaccgacaagccac

SEQ ID NO: 471597 - RNA, 62 nt, hsa
gauuggaacacaaaaaaucuuuuuuuaaucuuuuuaaaaacugcugugguuuugcugcuaca

SEQ ID NO: 471598 - RNA, 62 nt, hsa
uugggggacacaccuggcgagcaagcucgcuuuuuaaaaaugaaauuugggggcaggggaag

SEQ ID NO: 471599 - RNA, 62 nt, hsa
uuacagauaauguugaugacauugacccuuuguuuaaaaaaagaaacuguaaauuugacaua

SEQ ID NO: 471600 - RNA, 62 nt, hsa
uuucuaaaguaaguguguauaaaagucuccuuuuuaaaaagaucauauuuuuaaauaaagca

SEQ ID NO: 471601 - RNA, 62 nt, hsa
uaaaccaccaaugugggagggggugcuaaaacuuuaaaaaaaaucucuacugugcaaauauc

SEQ ID NO: 471602 - RNA, 62 nt, hsa
aacaucugugugccuuuuuaucuuugguuucuuuuaaaaaguauauuuaaugccuuuacaau

SEQ ID NO: 471603 - RNA, 62 nt, hsa
gaauggagaugauaagugcuuuccccucuuuauuuaaaaaagauuaaaaggaauaaaagaaa

SEQ ID NO: 471604 - RNA, 62 nt, hsa
guacauagucaaaacacaaugugaagaauuuguuuaaaaacauccuguagaaaguuuauaag

SEQ ID NO: 471605 - RNA, 62 nt, hsa
ugguucauuugauuucuaaaaauaccaugaccuuuaaaaauucuuuuaauagaucauguuau

SEQ ID NO: 471606 - RNA, 62 nt, hsa
cacuuaaagggaauauaugagguuuuuuuuuuuuuaaaaaaaaacuuuuauuuauuauuugu

SEQ ID NO: 471607 - RNA, 62 nt, hsa
aauguauaacaaguacuauuuacauaucugcauuuaaaaaagcaauucuuagaauacuuccu

SEQ ID NO: 471608 - RNA, 62 nt, hsa
gucuucuuggauuucacccaacuaaaaggauuuuuaaaaauaaauaacagucuuaccuaaau

SEQ ID NO: 471609 - RNA, 62 nt, hsa
uagccaguuguuaauaucuuaaugcagauuuuuuuaaaaaaaacauaaaaugauuuaucugu

SEQ ID NO: 471610 - RNA, 62 nt, hsa
cuuuucucgaucacuaaacauaugcauauauuuuuaaaaaucaguaaaagcauuacucuaag

SEQ ID NO: 471611 - RNA, 62 nt, hsa
caaaccauuuuaugaguuuucuguuagcuugcuuuaaaaauuauuacuguaagaaauaguuu

SEQ ID NO: 471612 - RNA, 62 nt, hsa
ugcugcauuuuuuuaaaguuggauugcugcuauuuaaaaaaaaaaaaaggacacagaucaaa

SEQ ID NO: 471613 - RNA, 62 nt, hsa
uuuaaagaaccacuugaaaucggaucauuuuauuuaaaaauaaaaaauguuaaugccaguug

SEQ ID NO: 471614 - RNA, 62 nt, hsa
ucaguuccacaccaagaaugaacugcauuuccuuuaaaaauuauuuuaaaacaccuuuauug

SEQ ID NO: 471615 - RNA, 62 nt, hsa
cccuaauaucacagggcuugugcauucagauuuuuaaaaaauuaggauagauaaggaaacaa

SEQ ID NO: 471616 - RNA, 62 nt, hsa
ugauguauuuuuuucaugcauuaguaugcauuuuuaaaaaauaaugcauguuucuuuaauaa

SEQ ID NO: 471617 - RNA, 62 nt, hsa
guuguuuuuacuuuauuguguuguuuaaauauuuuaaaaauaucuuuagcguuuggucuuuu

SEQ ID NO: 471618 - RNA, 62 nt, hsa
aauugcuucagcccaagaaagcuguguauuguuuuaaaaauuguaaaaauuauugugaugau

SEQ ID NO: 471619 - RNA, 62 nt, hsa
uagacaaucacuauuggcuuuuuucuuuuauuuuuaaaaaacucacauagaggagacaauca

SEQ ID NO: 471620 - RNA, 62 nt, hsa
ucacucuuugcaggcacucuucaaauuuuuauuuuaaaaauuauaaugcaaacaucuggcca

SEQ ID NO: 471621 - RNA, 62 nt, hsa
gguucuuuuuaauguuuauacuuagauuuucuuuuaaaaaaauuaaaauaaaacaaaaaaaa

SEQ ID NO: 471622 - RNA, 62 nt, hsa
ggcugauguugguauuggguguaggaacaugauuuaaaaaaaaacucuugccucugcuuucc

SEQ ID NO: 471623 - RNA, 62 nt, hsa
uuuucagaugcagucuauauuuuaugcugaguuuuaaaaaugaaauacuuuaugcaaacagg

SEQ ID NO: 471624 - RNA, 62 nt, hsa
ucaaaaacagcacaacccccucaaucugcccauuuaaaaauugguggagugaacaaagagca

SEQ ID NO: 471625 - RNA, 62 nt, hsa
agacaccaacacuuacccagaaucuguugcuauuuaaaaaucagggagaggagggcacaugu

SEQ ID NO: 471626 - RNA, 62 nt, hsa
uguuucccugccaucuugagauuuuuuacuuuuuuaaaaaaauuuuuugaucuuagucacug

SEQ ID NO: 471627 - RNA, 62 nt, hsa
ugauuuuaaaaaaaaaagagagagagauguaauuuaaaaaguuuauuauaaauuaaauucag

SEQ ID NO: 471628 - RNA, 62 nt, hsa
aaaaaaagauuuugacauaaaagagccuugauuuuaaaaaaaaaagagagagagauguaauu

SEQ ID NO: 471629 - RNA, 62 nt, hsa
auuuguggguuuugaaugcaucuuuaaagugcuuuaaaaaaaaguuuuauaaguagggagaa

SEQ ID NO: 471630 - RNA, 62 nt, hsa
ugaagaugagcauauauuacuaucuuuaagcauuuaaaaauacuguucacacuuuauuacca

SEQ ID NO: 471631 - RNA, 62 nt, hsa
uauuuaguauaaucugugacuaauaaagacauuuuaaaaaaccaugcccacaauaccauuau

SEQ ID NO: 471632 - RNA, 62 nt, hsa
caccuaaauugcaagaucuaaggauauguguuuuuaaaaaucuaaagcugaauuccuuuucu

SEQ ID NO: 471633 - RNA, 62 nt, hsa
aauauuguuuuuuauauuauuguuguaugacauuuaaaaauuucuuucuauguguauuuaua

SEQ ID NO: 471634 - RNA, 62 nt, hsa
ugauuaguucuuuauuaaauaugucauaaauauuuaaaaauaauacagcaauaccaaaauaa

SEQ ID NO: 471635 - RNA, 62 nt, hsa
aagucagcauaugaggaauuaaagacauuguuuuuaaaaaaaaaaaaucauuuagaugcacu

SEQ ID NO: 471636 - RNA, 62 nt, hsa
aaaauuuugacuuuuuaguacuaagcuuaauuuuuaaaaacaaaaucuguaggguugacaaa

SEQ ID NO: 471637 - RNA, 62 nt, hsa
uaccuuugaacuuucauagcacugcagaaaccuuuaaaaaaaaaaugcuucaugaauuucuc

SEQ ID NO: 471638 - RNA, 62 nt, hsa
aaauguggaggcuccauauuaaugcauuauuuuuuaaaaaguuuugauaacucuuaaagcau

SEQ ID NO: 471639 - RNA, 62 nt, hsa
agagaagcaucaugagccaauuugauagguguuuuaaaaauaacuugaguuuuccuaaguuc

SEQ ID NO: 471640 - RNA, 62 nt, hsa
ucuuccccgccaugauucacauuugaugaguuuuuaaaaaucaaagugauuuugaaaaucuc

SEQ ID NO: 471641 - RNA, 62 nt, hsa
cuucccuucaaaucugccuuugaaucaucauuuuuaaaaaaaaauuaacauguuuuuguugu

SEQ ID NO: 471642 - RNA, 62 nt, hsa
ccugaguuuccauaaggaaaaugaaaacuccuuuuaaaaauaaaaucugaggaguguacaau

SEQ ID NO: 471643 - RNA, 62 nt, hsa
uuguauauuuguacaaauguuucagcugugcuuuuaaaaaaucuggauguuuuuuauuuagu

SEQ ID NO: 471644 - RNA, 62 nt, hsa
uccccagaugaaagaacucuaaguaaauacauuuuaaaaaauuuuucugacacccuuuaaug

SEQ ID NO: 471645 - RNA, 62 nt, hsa
gcauuuuauacagucaacuuuguaaugaacuuuuuaaaaauuaauugauuuuccuuuggggu

SEQ ID NO: 471646 - RNA, 62 nt, hsa
uuagaaucuaaagauguguuuagaaccucuuguuuaaaaauaauagacugcuuaucauaaaa

SEQ ID NO: 471647 - RNA, 62 nt, hsa
uguuaugguagagaaacacacaugccuuaaaauuuaaaaagcagggcccaaagcuuauuagu

SEQ ID NO: 471648 - RNA, 62 nt, hsa
uaacaugauaggugcugaauugugauucacaauuuaaaaacacuguaauccaaacuuuuuuu

SEQ ID NO: 471649 - RNA, 62 nt, hsa
uucugaacaguuuagucccaagagaauagcguuuuaaaaaagaaaaacaagauuuggaguca

SEQ ID NO: 471650 - RNA, 62 nt, hsa
guguaauaguugugucaccauucuuguugcuuuuuaaaaaucaggcuaaucaugugguccau

SEQ ID NO: 471651 - RNA, 62 nt, hsa
ccaauuucaaaauggcuuucuuuguauuucaguuuaaaaacccagugcauguacgcccucug

SEQ ID NO: 471652 - RNA, 62 nt, hsa
uuuguggcacuguauauguuaagaaauuuuauuuuaaaaaauauaaagguuaacguccauaa

SEQ ID NO: 471653 - RNA, 62 nt, hsa
gaaguuguguuacaacuguagcaaauuuuccuuuuaaaaaauccaggcaauggcauuaaaca

SEQ ID NO: 471654 - RNA, 62 nt, hsa
guggcuugauguugauacacauuugaauuuuuuuuaaaaaaagaaaguuaucguagccagcc

SEQ ID NO: 471655 - RNA, 62 nt, hsa
uacugauucuggaacaaaacaguuagaaaaacuuuaaaaaaaaaaaaaccgacaaaguuacg

SEQ ID NO: 471656 - RNA, 62 nt, hsa
uuguugccuuuccaagugaccucuccucuucuuuuaaaaaaagaacacuuucugcucauauc

SEQ ID NO: 471657 - RNA, 62 nt, hsa
uaaagauuucauaaaaugauaguauugguuauuuuaaaaaggcuuuggcuuaugcugaauua

SEQ ID NO: 471658 - RNA, 62 nt, hsa
aaaauacuauuaaccuauauaaccauuuaaaauuuaaaaaauuauguuccaaguaccucuau

SEQ ID NO: 471659 - RNA, 62 nt, hsa
ccauuguuuuuggauauaaagcuaauaagcacuuuaaaaaggaaaaggcagccuuuacuauu

SEQ ID NO: 471660 - RNA, 62 nt, hsa
acaucuuauuuuugccuuuauuucauaaguaauuuaaaaaucacuggauugcuuuauuauau

SEQ ID NO: 471661 - RNA, 62 nt, hsa
aucucaaguagaaaaguuuuugaaaacuaacauuuaaaaauuaaucaguuacaguaaagacu

SEQ ID NO: 471662 - RNA, 62 nt, hsa
aaguuuuuuucaagaauugaaauaaguaucaguuuaaaaauuuauauuaaauuuauuaaaau

SEQ ID NO: 471663 - RNA, 62 nt, hsa
cauaggucacuuuaaauguucuaguagcaacuuuuaaaaacauaaaaagaagcaggugaaaa

SEQ ID NO: 471664 - RNA, 62 nt, hsa
acaaauauaacaaaguucauuguuuuaggguuuuuaaaaaacguguuguaccuaaggccaua

SEQ ID NO: 471665 - RNA, 62 nt, hsa
gcugauuauuguauaugcaaauuacaugcauuuuuaaaaacuauucuuucugaacuuaucua

SEQ ID NO: 471666 - RNA, 62 nt, hsa
uuuguuacaaaccugugggccuguugcaauacuuuaaaaauaaaaaauuuuauuccauuugc

SEQ ID NO: 471667 - RNA, 62 nt, hsa
accacguguagcauuuugaaacauuauuuuuuuuuaaaaaaugcugucuugcuuuagcuauu

SEQ ID NO: 471668 - RNA, 62 nt, hsa
ucuucugaaaacagacccuuggcuucacacauuuuaaaaauguuugcuacuuguuaagggag

SEQ ID NO: 471669 - RNA, 62 nt, hsa
aaagugacccagggaauuuagaaaaaaauuauuuuaaaaaauauguuugaugcuauuuugua

SEQ ID NO: 471670 - RNA, 62 nt, hsa
cuaaugaagcuuuuaaaaucuacaauuucuucuuuaaaaauauuuauuaaugugaauggaau

SEQ ID NO: 471671 - RNA, 62 nt, hsa
caaguuggccaauaauagcauucucucugacauuuaaaaauaauuucuauucaaaauacaug

SEQ ID NO: 471672 - RNA, 62 nt, hsa
guacuuauauaaaaucuaguccaguucucucauuuaaaaaaaugaagacacugaaauacaga

SEQ ID NO: 471673 - RNA, 62 nt, hsa
cauaaaauguuuaugaucccagcaauacacuuuuuaaaaaaugugaaagucaaagaauuaag

SEQ ID NO: 471674 - RNA, 62 nt, hsa
cuggaguaaaauucaugggaaauggcccuucauuuaaaaaaagauguaccucacuacccacu

SEQ ID NO: 471675 - RNA, 62 nt, hsa
agggacuuguaagcauuucuggaaauauuugauuuaaaaacauauauuaauagauguuuucc

SEQ ID NO: 471676 - RNA, 62 nt, hsa
gaucugugguuccuuagaauauugaggaucucuuuaaaaaaugaaauuucugaucucacccc

SEQ ID NO: 471677 - RNA, 62 nt, hsa
gacuuuuauauuucuuuaaaaaauuccuuccuuuuaaaaaauauaaaagggacuacuguuca

SEQ ID NO: 471678 - RNA, 62 nt, hsa
uauuucacuuuuugacuugacuuuuauauuucuuuaaaaaauuccuuccuuuuaaaaaauau

SEQ ID NO: 471679 - RNA, 62 nt, hsa
aaaauaaaacuggccugacuuaagauaaccauuuuaaaaaauugggcugucaugugggaaua

SEQ ID NO: 471680 - RNA, 62 nt, hsa
acuuaauaaauuaucuguuaauguagauuuuauuuaaaaaacuauauuugaacauuggucuu

SEQ ID NO: 471681 - RNA, 62 nt, hsa
uauugacuuuuucucuuuuuuauuugggauaauuuaaaaaaugauggaugagaaaagaaaga

SEQ ID NO: 471682 - RNA, 62 nt, hsa
uuucagccugggggauacagugagaccuugucuuuaaaaaaaaaaugcugcaaaaccaaaaa

SEQ ID NO: 471683 - RNA, 62 nt, hsa
gcaacauggugaaauccugucuuuaccaaaaguuuaaaaauuagcuugguguggugcccucu

SEQ ID NO: 471684 - RNA, 62 nt, hsa
uccagauaaucagauuauuucauuugguaaauuuuaaaaaauaugcaaucaggcacagugcc

SEQ ID NO: 471685 - RNA, 62 nt, hsa
guuuuuuucugucuugugaaugcacuugauaauuuaaaaauaaaaauaucuguuucucugca

SEQ ID NO: 471686 - RNA, 62 nt, hsa
aaaauugguaaacaugucccgcuguguagaacuuuaaaaaaaaggcauuuuugaaaguguug

SEQ ID NO: 471687 - RNA, 62 nt, hsa
gacuggcaacaauguucccaaugucuuuacuuuuuaaaaaaggcuuuucauauuuaagcaca

SEQ ID NO: 471688 - RNA, 62 nt, hsa
cagauccaagcauauaaaaagccuguauauuuuuuaaaaacacaucuuaacuccacgcuuua

SEQ ID NO: 471689 - RNA, 62 nt, hsa
gagaaacacagcauacuguucauuaauaguauuuuaaaaaaauuguuuuucaaaugucacca

SEQ ID NO: 471690 - RNA, 62 nt, hsa
guuuguauauugaauuacauuaaggaguguucuuuaaaaagagaaauaaauauacaauuaca

SEQ ID NO: 471691 - RNA, 62 nt, hsa
cacuagguugccacagaccuaugcuaggugucuuuaaaaaauuaaggugacaaagcacaugg

SEQ ID NO: 471692 - RNA, 62 nt, hsa
aaaucacccaaaacuuuuggcaaauaaaagcauuuaaaaagaccuuucuguacaggauuuuu

SEQ ID NO: 471693 - RNA, 62 nt, hsa
cuaggaaauuaguuguauuuugugcaagcuaauuuaaaaacaugaugggcuguuuuaagacc

SEQ ID NO: 471694 - RNA, 62 nt, hsa
uauaaacauuacaacuauguuguuuuaagacauuuaaaaacgugaaauuuguuaucuuugua

SEQ ID NO: 471695 - RNA, 62 nt, hsa
aaaucauaaaguuugguaaugcaguuuaucguuuuaaaaauaauccacaaagauguuuuuau

SEQ ID NO: 471696 - RNA, 62 nt, hsa
aaaugcuguauuugaguuucugacaaauuuguuuuaaaaaucaaauuugaauguacuauucu

SEQ ID NO: 471697 - RNA, 62 nt, hsa
accgucuuacuagacugaaugucacuuaucuuuuuaaaaaacucucauuuuuacaaagacua

SEQ ID NO: 471698 - RNA, 62 nt, hsa
auaggccuuucaguaacacaggugaagaaauuuuuaaaaauacauugauuauuaucuagguu

SEQ ID NO: 471699 - RNA, 62 nt, hsa
gaacuuaaaacugcucuaaaaaaaauaucuuuuuuaaaaaagagagaauuagcauugugucu

SEQ ID NO: 471700 - RNA, 62 nt, hsa
caaauuuuaauuuuugcuuuuagaaaagggaguuuaaaaaugguaucaaaauuacauauacu

SEQ ID NO: 471701 - RNA, 62 nt, hsa
caaagcacccauuucaauguguauaaauugucuuuaaaaacuguuuuagaccuauaauccuu

SEQ ID NO: 471702 - RNA, 62 nt, hsa
aaauuauuuguaagauauuugcaguuuuucauuuuaaaaaguccauaccuuauauaugcacu

SEQ ID NO: 471703 - RNA, 62 nt, hsa
uuggcacguguuguuuacauuuugcugugacauuuaaaaauauuucuuuaaaaauguuacug

SEQ ID NO: 471704 - RNA, 62 nt, hsa
uuacauuuugcugugacauuuaaaaauauuucuuuaaaaauguuacugcuaaagauacauua

SEQ ID NO: 471705 - RNA, 62 nt, hsa
aaaauguuacugcuaaagauacauuauccuuuuuuaaaaagucuccauucaaauuaaauuaa

SEQ ID NO: 471706 - RNA, 62 nt, hsa
aggguuuggggucaacacgugaaguguugaauuuuaaaaaauacaaaaagcagacugaugua

SEQ ID NO: 471707 - RNA, 62 nt, hsa
cuucccaucucuuaauaucauguguuaacauguuuaaaaagaccuuaguaguuugcaggcug

SEQ ID NO: 471708 - RNA, 62 nt, hsa
gaucuugcccuccaaugaaaugacuuacauguuuuaaaaaaccgaguugguuuuauugaauu

SEQ ID NO: 471709 - RNA, 62 nt, hsa
auguuuuaaaaaaccgaguugguuuuauugaauuuaaaaagauagguaacuaaguagcauuu

SEQ ID NO: 471710 - RNA, 62 nt, hsa
cgacuugcuaauuucagaaauaauuauucauuuuuaaaaagccccuuuuaaagcaucuacuu

SEQ ID NO: 471711 - RNA, 62 nt, hsa
acuggcuuccuaagaaauguuuaagacucagcuuuaaaaagaaguuaacauucauaucucug

SEQ ID NO: 471712 - RNA, 62 nt, hsa
uacugcaugcauagcacuuaauaaaauggauuuuuaaaaaauccacuaguaauaucagaaug

SEQ ID NO: 471713 - RNA, 62 nt, hsa
aaucagcagugaaucaucuugcagcuaugcaauuuaaaaaaaauacagauuaccaauuucaa

SEQ ID NO: 471714 - RNA, 62 nt, hsa
gaacuuggaauuugagggagauuuuauauaccuuuaaaaacuguaauuuaauugggaugcca

SEQ ID NO: 471715 - RNA, 62 nt, hsa
gcuaaauuugcauauaccaucuaaaauccuuuuuuaaaaaaauuuaauguaauaaagauuca

SEQ ID NO: 471716 - RNA, 62 nt, hsa
guaaacauugcagguuuaaacauaaaggagucuuuaaaaaaaaaucauuuacguuggaauuu

SEQ ID NO: 471717 - RNA, 62 nt, hsa
guucaaaguuugcuuaguuacaacaaagcaccuuuaaaaaaaauacauuuuaaaaaaacauu

SEQ ID NO: 471718 - RNA, 62 nt, hsa
guuacaacaaagcaccuuuaaaaaaaauacauuuuaaaaaaacauuccaagccaauuggaag

SEQ ID NO: 471719 - RNA, 62 nt, hsa
cagauuuccugaaaauaauugaaauaucuuacuuuaaaaauauuuucaucucugaaauaucu

SEQ ID NO: 471720 - RNA, 62 nt, hsa
aucagauauaaauauauacuuaauuuuuuaauuuuaaaaauagauaccuguuugacuuugag

SEQ ID NO: 471721 - RNA, 62 nt, hsa
cuggcugcaaagaagaaucaacagggacacuuuuuaaaaacacucuuaucagccugggcaac

SEQ ID NO: 471722 - RNA, 62 nt, hsa
uuuuuauuuugcaauucucuguauucuaugucuuuaaaaauuugaucuugacauuuaauguc

SEQ ID NO: 471723 - RNA, 62 nt, hsa
ucuugacauuuaaugucacaaaguuuuguuuuuuuaaaaagugauuuaaacuuaagauccga

SEQ ID NO: 471724 - RNA, 62 nt, hsa
cuuugaaaauacuuuggauaauaaauuggaguuuuaaaaaugcaaauuugcuuaguaucuaa

SEQ ID NO: 471725 - RNA, 62 nt, hsa
gagaucaaaaaaauauaugacagauuauuuuguuuaaaaaugcaguuuuaauuaucuuaguc

SEQ ID NO: 471726 - RNA, 62 nt, hsa
aaaucauguacauuugaaaauauuugcacacauuuaaaaauaaauguaaaguugucuuuuaa

SEQ ID NO: 471727 - RNA, 62 nt, hsa
uuaucuuuuguuuguguuaaaacuggagaguguuuaaaaauuuccuuuuggggggaagaaaa

SEQ ID NO: 471728 - RNA, 62 nt, hsa
uguauuauccugaauacacuauuuugaaaauuuuuaaaaaugacuucuuuauuuugcuuuac

SEQ ID NO: 471729 - RNA, 62 nt, hsa
cauugacaugugauuucaaaacacaguguucuuuuaaaaaucuauaauaugucaaaauacaa

SEQ ID NO: 471730 - RNA, 62 nt, hsa
ugggaagaacuggcuucauuccuaguacaucuuuuaaaaaguuacuaauuuuccagcaguac

SEQ ID NO: 471731 - RNA, 62 nt, hsa
aaagaaaaaaaacuuuuugauguuuuaggugauuuaaaaauauaccguguugguggugaaug

SEQ ID NO: 471732 - RNA, 62 nt, hsa
aauaaacuucagcugaagauuuuauauaggacuuuaaaaagaagagaagagaaagaagaaac

SEQ ID NO: 471733 - RNA, 62 nt, hsa
auugcaauuguauuagguguuaaaauaaaguuuuuaaaaaauuacuuguauuuauacuuuac

SEQ ID NO: 471734 - RNA, 62 nt, hsa
ugcccugaguggaucuccaaggaccagguuauuuuaaaaagauuuguuuugucaagugucau

SEQ ID NO: 471735 - RNA, 62 nt, hsa
gccacaucccuuugaaacaagauaacugagaauuuaaaaauaagaaaauacauaagaccaua

SEQ ID NO: 471736 - RNA, 62 nt, hsa
ccgucuuaaaaaaaaaaaaaaaaaaguuuguuuuuaaaaaaaucuaaauaaaauaacuuugc

SEQ ID NO: 471737 - RNA, 62 nt, hsa
uuuccuuucuuagacuucauaggagauagugcuuuaaaaaaaaaaaaaacuucuauuauuug

SEQ ID NO: 471738 - RNA, 62 nt, hsa
auuauuuguuuaguauguuguaaguagaucauuuuaaaaaacugaaucuauauuauguuuaa

SEQ ID NO: 471739 - RNA, 62 nt, hsa
guguaauaggaauaauauuuauccaaaagauuuuuaaaaauagggcuguguuuaaaaaaaaa

SEQ ID NO: 471740 - RNA, 62 nt, hsa
uuauccaaaagauuuuuaaaaauagggcuguguuuaaaaaaaaaaaacaaaacaagaaaagc

SEQ ID NO: 471741 - RNA, 62 nt, hsa
uggaguuaauuuguuuuacaggaauuuuguuuuuuaaaaaaauaggaucauucugaacuuug

SEQ ID NO: 471742 - RNA, 62 nt, hsa
agaggaaucuaguauuugcacuuagcaaaauauuuaaaaacugaaaaaaaugugcaugaucu

SEQ ID NO: 471743 - RNA, 62 nt, hsa
uccagccugagcaacaaaagcaaaacucuaucuuuaaaaaaaaaaaaaaaaaaacuaagaua

SEQ ID NO: 471744 - RNA, 62 nt, hsa
aguauuugauuuuuuuccccaauauuugauuuuuuaaaaauauacacauaggugcugcauuu

SEQ ID NO: 471745 - RNA, 62 nt, hsa
uuacacugaucuaaaggacauauauauaacccuuuaaaaaaaaaaucacugccucauucuua

SEQ ID NO: 471746 - RNA, 62 nt, hsa
uauacuuuauaaugauagaaguccaaccguuuuuuaaaaaauaaauuuaaaauuuaacagca

SEQ ID NO: 471747 - RNA, 62 nt, hsa
ugagccaccacgccuggccaauuauguaauuuuuuaaaaaggacauuucuaucagggauaua

SEQ ID NO: 471748 - RNA, 62 nt, hsa
uuugaaguccuagucugaguucugguggggaauuuaaaaaugcauccuggaaauccuuuaaa

SEQ ID NO: 471749 - RNA, 62 nt, hsa
uaauuuuuccuuccucuguaagauaucccagcuuuaaaaagaaaaaaaaagaauuaccaaga

SEQ ID NO: 471750 - RNA, 62 nt, hsa
gcagguuggcaaacgggcuugacuuuggcugauuuaaaaagugagaaagaaaguaaaaaagg

SEQ ID NO: 471751 - RNA, 62 nt, hsa
gggaaauaauuguguacauaaaauuaggcuuuuuuaaaaaaauagauuaugaugcagaauau

SEQ ID NO: 471752 - RNA, 62 nt, hsa
cuaagaauacagaaccaaauuggauccauuuuuuuaaaaaaaugguuuugcauggaaccugg

SEQ ID NO: 471753 - RNA, 62 nt, hsa
gauccugucucuaaaaagaagccacagaaauguuuaaaaacuucaucgacuuagccugaguc

SEQ ID NO: 471754 - RNA, 62 nt, hsa
ccagccugagugacagagcgagacuccaucucuuuaaaaacaaacaaaaaauuaucugaaug

SEQ ID NO: 471755 - RNA, 62 nt, hsa
acaauuauuaaauuguguacacuuucauuacuuuuaaaaauguagaaauucuucaugaacau

SEQ ID NO: 471756 - RNA, 62 nt, hsa
uuaaaaugcugacauaacaccaaacuucauuuuuuaaaaaaucuguuguuccaaauguguau

SEQ ID NO: 471757 - RNA, 62 nt, hsa
gugaaaaaaauuauucaugcucucauauauauuuuaaaaacacuacuuuugcuuuuuuauuu

SEQ ID NO: 471758 - RNA, 62 nt, hsa
uucccuauaaccucuucauuguuuucuuuucuuuuaaaaauaauaaacuuuucuaugaucac

SEQ ID NO: 471759 - RNA, 62 nt, hsa
auaucuuaccuguuuguuauuaaccaaauauuuuuaaaaauauuuccuccauaaauauucau

SEQ ID NO: 471760 - RNA, 62 nt, hsa
aauucagaaucuguugugagaaaugcccaggcuuuaaaaauuaaaaauggauggaucuucuc

SEQ ID NO: 471761 - RNA, 62 nt, hsa
auaacugaaaagacuauguagugaaauguauuuuuaaaaacuauauucaguaaaagccugcu

SEQ ID NO: 471762 - RNA, 62 nt, hsa
agcucaaagcaauuaagugggaacauuuuuaauuuaaaaaaaauuuccaaauauuugugggu

SEQ ID NO: 471763 - RNA, 62 nt, hsa
uuuaauaaaagugaaccagaacaaaucacucauuuaaaaaguaauucagaagaacagugugg

SEQ ID NO: 471764 - RNA, 62 nt, hsa
accaaugauauuucaguauauauuuucucucuuuuaaaaaauauuuaucauacucuguauau

SEQ ID NO: 471765 - RNA, 62 nt, hsa
agcagguacuacauuuauaauggaaggaauuuuuuaaaaaauuuuaagcuguacacuuucaa

SEQ ID NO: 471766 - RNA, 62 nt, hsa
uacauccauuuugauauaccauguauucacacuuuaaaaaauacacauagcagaguaucgga

SEQ ID NO: 471767 - RNA, 62 nt, hsa
ugugacagauaaagauguaugauuucuaaggcuuuaaaaauuauucauaaaacagugggcaa

SEQ ID NO: 471768 - RNA, 62 nt, hsa
aaagacauuuuugcuagggccuacaaauugaauuuaaaaacucacugcacugauucaucuga

SEQ ID NO: 471769 - RNA, 62 nt, hsa
cuauagguuuagggaguguaccucagauagauuuuaaaaaaaagaauagaaagccuuuauuu

SEQ ID NO: 471770 - RNA, 62 nt, hsa
aaggccaacgguccaagggauuacaucugcaguuuaaaaaguaaauauauauucuaucguau

SEQ ID NO: 471771 - RNA, 62 nt, hsa
uccuagauuacugucauugucuaaaaguaacuuuuaaaaagcagaguucaugaaaacugcaa

SEQ ID NO: 471772 - RNA, 62 nt, hsa
aaaaucauggcaacauaauucacuuuccaucuuuuaaaaauauauuuugccauuaauccaau

SEQ ID NO: 471773 - RNA, 62 nt, hsa
ucaaguaaguguggguagcaaaaacaauuaucuuuaaaaaaaaaaucacaucaguauaggcc

SEQ ID NO: 471774 - RNA, 62 nt, hsa
uccccuugagaguauauauuuuccccuacgguuuuaaaaaacagauaaaacauggacaaugg

SEQ ID NO: 471775 - RNA, 62 nt, hsa
agauccagugcaguuuuucucuugaaggaucauuuaaaaagggacgcgaauaaguuugcucc

SEQ ID NO: 471776 - RNA, 62 nt, hsa
ugcuuggccuccaguagcugccuccauucucuuuuaaaaaaagggggugauucugaggcacu

SEQ ID NO: 471777 - RNA, 62 nt, hsa
cuuucccuuaguauuagauuuguugaggguuuuuuaaaaaucaggucuguugaaagucuucu

SEQ ID NO: 471778 - RNA, 62 nt, hsa
gacagcuaaucucucuagggacuauuuggugguuuaaaaaaagggucagacuuuuaaacacu

SEQ ID NO: 471779 - RNA, 62 nt, hsa
uagagcuguguguugagcuaaaaauauaauuuuuuaaaaauugacuagcaaaaucuauggcc

SEQ ID NO: 471780 - RNA, 62 nt, hsa
aucagaagaacauuguuguuugauuauauguuuuuaaaaaccugaagcuuuuuugguggcag

SEQ ID NO: 471781 - RNA, 62 nt, hsa
uaccacauaguauuuuuauguuacccaucaucuuuaaaaacauuauaggcugggcauggugg

SEQ ID NO: 471782 - RNA, 62 nt, hsa
auauaauaagcucuugugccuuguaugcacuauuuaaaaaaaguuuuuuuuauuugagucca

SEQ ID NO: 471783 - RNA, 62 nt, hsa
uaacuuucauuuuagagcacguuuuggucauuuuuaaaaauaccuaaagugccagaccggaa

SEQ ID NO: 471784 - RNA, 62 nt, hsa
uauuuauauaaaauuuaccuuuaaguauuuacuuuaaaaaauuuaauggcuuaacucgaacu

SEQ ID NO: 471785 - RNA, 62 nt, hsa
cccaucagugauuggggaaucaaacauuuugguuuaaaaaacaugauuauuuaaaacuggaa

SEQ ID NO: 471786 - RNA, 62 nt, hsa
gauagaaaauauuaguuucagaauuacccuccuuuaaaaaauaagagacuauuuguuuucuu

SEQ ID NO: 471787 - RNA, 62 nt, hsa
uuuucuuuuaauuucuaugaauaaaagaaauuuuuaaaaacuuuaaaauuuuaaauauuagu

SEQ ID NO: 471788 - RNA, 62 nt, hsa
ugaauugcccagagcugccuuuuucuuuucuuuuuaaaaauuuuaagaaguuuucuuugugg

SEQ ID NO: 471789 - RNA, 62 nt, hsa
guuuauuuguuauuuuaaagguaaauugcacuuuuaaaaaaauaauugguugacuuaauaua

SEQ ID NO: 471790 - RNA, 62 nt, hsa
uuugucuugucuaagguggaaaucuugugcuguuuaaaaagcagauuuuauucuuugccuuu

SEQ ID NO: 471791 - RNA, 62 nt, hsa
augauuagucuuaguaugaauaucauuuaaucuuuaaaaaaucaaguaaaaauguuuaucug

SEQ ID NO: 471792 - RNA, 62 nt, hsa
ugggcagaaugaaguauguuuguuuauuuuucuuuaaaaauaaaggauuuuggaacucugga

SEQ ID NO: 471793 - RNA, 62 nt, hsa
aagguuugacuggccuccagauuccaguuauuuuuaaaaagcaacuuaccacuaaauccuug

SEQ ID NO: 471794 - RNA, 62 nt, hsa
uaaaaaaacugacuguggcugaaagaauugcauuuaaaaauauuuaugugcaccuuguuacu

SEQ ID NO: 471795 - RNA, 62 nt, hsa
aaauccuuuguuauuuuucuaaaaaaauaaaauuuaaaaagaaagaaaacuaaggaagaaca

SEQ ID NO: 471796 - RNA, 62 nt, hsa
cuuuccgcccuaugaaaaucaagaaaaucuuuuuuaaaaauggaguccugcuauuuuccacu

SEQ ID NO: 471797 - RNA, 62 nt, hsa
aggcaauguagugacaccucauuucuauuuauuuuaaaaaaaagagagaguaacuacagaag

SEQ ID NO: 471798 - RNA, 62 nt, hsa
uuaaaaaaaagagagaguaacuacagaagaacuuuaaaaaauaaaaaauaagcuuaccuugg

SEQ ID NO: 471799 - RNA, 62 nt, hsa
aaacuuguguuguuucuuuuuuaaaucaacuuuuuaaaaaaauaaaguguaaauuaaccgac

SEQ ID NO: 471800 - RNA, 62 nt, hsa
agaauacauagcagcucugcaaaggaacaguuuuuaaaaaugggaacuucuacauugaaaag

SEQ ID NO: 471801 - RNA, 62 nt, hsa
aauaugauucaguagucaacuugagggaaauuuuuaaaaaacuauucucaauuauauacgag

SEQ ID NO: 471802 - RNA, 62 nt, hsa
acaaauuucauuuggcagcgccauaacauucauuuaaaaaguuuaugaaaacauucauuuga

SEQ ID NO: 471803 - RNA, 62 nt, hsa
aaaucucaguuuaauauaaaaugagcuaaguuuuuaaaaauaaauuauaaacuuggagauua

SEQ ID NO: 471804 - RNA, 62 nt, hsa
aaaaacuggucgaguaauuaucaauaauuuuuuuuaaaaagaggaucccaaacuguaaaaga

SEQ ID NO: 471805 - RNA, 62 nt, hsa
ugaucuguagcaauuauuuaaugaauugaauauuuaaaaaauuuuuuauuugcugucuuugg

SEQ ID NO: 471806 - RNA, 62 nt, hsa
uguaacuuguaaaaccaaaaguucuaaugguuuuuaaaaaccaguguugaguggaaaagugu

SEQ ID NO: 471807 - RNA, 62 nt, hsa
ccuaaagaacaaaguaguaaaauaaaaaaaaauuuaaaaaauuaaaaaauaaaaaaaagagg

SEQ ID NO: 471808 - RNA, 62 nt, hsa
caaguaaaaugaauucuaauguacaaguuuguuuuaaaaaguguaugucaagcuuuuauuua

SEQ ID NO: 471809 - RNA, 62 nt, hsa
uuaacuaaacugucaugguuuaguuuacaauuuuuaaaaaguucuuaaaauacugaaaaugc

SEQ ID NO: 471810 - RNA, 62 nt, hsa
caacucuucuuaguuacuaauacuuuguugacuuuaaaaaugaaaucauucacaaacuuuug

SEQ ID NO: 471811 - RNA, 62 nt, hsa
uucagaacucugagcucagagagacuccagauuuuaaaaaauaauuugagugcuuggaaacu

SEQ ID NO: 471812 - RNA, 62 nt, hsa
gcaaaccccaaaucuucaaaguuggaaggaacuuuaaaaaucauccgguccaaucucuuucc

SEQ ID NO: 471813 - RNA, 62 nt, hsa
aaugaagaacaacuuuaucaaggaagcuaguauuuaaaaacaaauucaugagcaagcugcaa

SEQ ID NO: 471814 - RNA, 62 nt, hsa
aguuguggaauucuuacuucauuaugaauguauuuaaaaaacaaacaccaaauaauuggaau

SEQ ID NO: 471815 - RNA, 62 nt, hsa
gaaaagcuucauuucugaagaugaauuuuauuuuuaaaaaauacaugcacacucaaaacuuu

SEQ ID NO: 471816 - RNA, 62 nt, hsa
uaacaugaaauguuaccuuuuaacagacuguuuuuaaaaauuaaaaauguauguauagguuu

SEQ ID NO: 471817 - RNA, 61 nt, hsa
augaugaagcugacuccuaaaccaaaagugcuuuaaaaaccagccuggcgaggacagcccu

SEQ ID NO: 471818 - RNA, 62 nt, hsa
ggccuugcuuacugccugcaaauuuugagaaauuuaaaaauaagcauucuaacacuuuuauu

SEQ ID NO: 471819 - RNA, 62 nt, hsa
gagccaccaugccuggccuucauuaucucuuuuuuaaaaaugaaaaaguuuauaauuuacau

SEQ ID NO: 471820 - RNA, 62 nt, hsa
acaguguaugucuauaaaaacaauaaacauuuuuuaaaaaaugacaaaguaucuaugccaaa

SEQ ID NO: 471821 - RNA, 62 nt, hsa
auaaaugaaaacauuuaauuguguucaucauauuuaaaaauauagaauauauuagagaacug

SEQ ID NO: 471822 - RNA, 62 nt, hsa
cucugagaucuauagucuguuucuccucauuauuuaaaaaugcuaaaccuuguaucucacuu

SEQ ID NO: 471823 - RNA, 62 nt, hsa
agcuucaguauaccauguuugcauaguuuaucuuuaaaaacaacuuuaaagguucuuuugug

SEQ ID NO: 471824 - RNA, 62 nt, hsa
uuucaagaucuuucugguaauccgugaauauauuuaaaaaaaaaaagucugugacaaaacgg

SEQ ID NO: 471825 - RNA, 62 nt, hsa
aaauugcauuuuauuaccauuucaaacuauuuuuuaaaaauaaauacaguuaacauagagug

SEQ ID NO: 471826 - RNA, 62 nt, hsa
guccuuuuaacugucuccguuuuuuucuuuuauuuaaaaaugcacuuuuuuucccuugugag

SEQ ID NO: 471827 - RNA, 62 nt, hsa
gccaauauaauauaguuaaugaaaacagcauuuuuaaaaaccgaaauauugaaaugguguaa

SEQ ID NO: 471828 - RNA, 62 nt, hsa
ugugcuauccagauuuuuuauaugucugcauguuuaaaaaaaaaaagcaacaaaagaaaaug

SEQ ID NO: 471829 - RNA, 62 nt, hsa
cauuuguccuugugucacguuccauuauuuuauuuaaaaaccucaguaaucguuuuagcuuc

SEQ ID NO: 471830 - RNA, 62 nt, hsa
agccucaucaacacagugaaacuccaucucaauuuaaaaagaaaaaaagugguuuuaggaug

SEQ ID NO: 471831 - RNA, 62 nt, hsa
auuuuuaaaacuagcaacucuuauuucuuuccuuuaaaaauacauagcauuaaaucccaaau

SEQ ID NO: 471832 - RNA, 62 nt, hsa
ccgucuccccaaagcuuuaucugucuugacuuuuuaaaaaaguuugggggcagauucugaau

SEQ ID NO: 471833 - RNA, 62 nt, hsa
uuccaaguauuauuuuuacuguuaaaaaauuuuuuaaaaaugugaaauguaauguuuuuaca

SEQ ID NO: 471834 - RNA, 62 nt, hsa
caauuuucucccauugugcgaacauuuuauuuuuuaaaaaaaagaaacaaaaauauuuuucc

SEQ ID NO: 471835 - RNA, 62 nt, hsa
cuuaaagacuuaccuaaauauucaguuacauuuuuaaaaaaucuguacgugacagaauauua

SEQ ID NO: 471836 - RNA, 62 nt, hsa
agauuugaaaagacgauagaguuaaaacaauauuuaaaaaacauuucuauuugguccaugca

SEQ ID NO: 471837 - RNA, 62 nt, hsa
aauaccuaagcugcuucuuuaacauagagaucuuuaaaaagggaaggucaagcaaagaacug

SEQ ID NO: 471838 - RNA, 62 nt, hsa
auuacuuauauaaaaacaguucagaauauuuuuuuaaaaaaaauucuauauauacuguaaaa

SEQ ID NO: 471839 - RNA, 62 nt, hsa
cauauccuccucuagccuguaaaggaguuucauuuaaaaaaauaacauuugauuacuuauau

SEQ ID NO: 471840 - RNA, 62 nt, hsa
uagguagaaacgguguuuauuuaaaaaucaguuuuaaaaaaugagcuaccauaugugcuguc

SEQ ID NO: 471841 - RNA, 62 nt, hsa
aacugucuguucuuagguagaaacgguguuuauuuaaaaaucaguuuuaaaaaaugagcuac

SEQ ID NO: 471842 - RNA, 62 nt, hsa
ugagcaauacacauauuauaggccaauauuuuuuuaaaaaauagagcuuggucaaccucuau

SEQ ID NO: 471843 - RNA, 62 nt, hsa
gauauauuguguuaauuuggacaguagcgguuuuuaaaaaccauauacugacugaaacauga

SEQ ID NO: 471844 - RNA, 62 nt, hsa
cauuggccuuaguaggcuguauucacugcuaauuuaaaaaagggaguaccaggauuuauuaa

SEQ ID NO: 471845 - RNA, 62 nt, hsa
gggugggagguuuuuagaagaguauauaucucuuuaaaaaaaaacagaaagaaaaauauuuc

SEQ ID NO: 471846 - RNA, 62 nt, hsa
ggaagcuucuuuugcaucauuugggacugccauuuaaaaaaggauagguaaacaaagaaaug

SEQ ID NO: 471847 - RNA, 62 nt, hsa
uauaaaauauuaaaauuaugcucauuucuauuuuuaaaaauaauuuaagaaauuuuacccuu

SEQ ID NO: 471848 - RNA, 62 nt, hsa
ucauuccccauacucccuauuuucauuccuuuuuuaaaaaauaauauaagcuacagaaacca

SEQ ID NO: 471849 - RNA, 62 nt, hsa
uaagauuuuaucugggggaaagaaaagaauuuuuuaaaaaauuaaacuaaagauguuuuaag

SEQ ID NO: 471850 - RNA, 62 nt, hsa
ugcuucccucauuauugcauugcuaaggccuuuuuaaaaagcuuaugcuuacauaauauacu

SEQ ID NO: 471851 - RNA, 62 nt, hsa
uguuuuaccuuaagaaacacaauaaaucacuguuuaaaaaagaucucaauuuauauaaagua

SEQ ID NO: 471852 - RNA, 62 nt, hsa
agaaggauuguuuucaguuuuuaagagaauuuuuuaaaaauacauuuuaugguucucuuaag

SEQ ID NO: 471853 - RNA, 62 nt, hsa
uguuuauauacugcuaguuaacaauuaccacuuuuaaaaaauuauaaccguuuuuguucuau

SEQ ID NO: 471854 - RNA, 62 nt, hsa
augugaguuaaugauacuacaacuaaguucuuuuuaaaaagugauuaauguauuuuauaaau

SEQ ID NO: 471855 - RNA, 62 nt, hsa
uuaacuucauugccgcuggauucuguucagccuuuaaaaauauuucuuaguggucauugcuc

SEQ ID NO: 471856 - RNA, 62 nt, hsa
ugcaagaauugacauaauguuuguuucacugauuuaaaaaauuuugcauguaagaauguacu

SEQ ID NO: 471857 - RNA, 62 nt, hsa
ucuauuucuaucugcaaauaguuucaaaugaguuuaaaaaaauaacaucugaaaagaaaugc

SEQ ID NO: 471858 - RNA, 62 nt, hsa
agucuaugcuuaggccagucaguacacccaauuuuaaaaaauaacauauucuugcuuucaca

SEQ ID NO: 471859 - RNA, 62 nt, hsa
aauuguuuaaucaauggaauuuguaccagccuuuuaaaaaguuuuaguuuuuccuaagugau

SEQ ID NO: 471860 - RNA, 62 nt, hsa
cucaacugcuccauggauugaaaaaauaacaguuuaaaaagggaaacaaugugggaggaaga

SEQ ID NO: 471861 - RNA, 62 nt, hsa
auuuaaucccuucaauuuggggcuuaaucuuguuuaaaaaaauguaagugaagauggaaggc

SEQ ID NO: 471862 - RNA, 62 nt, hsa
uugauuauugagaaaauguagcaguuugcauauuuaaaaauuaaucauuuugcauuuuacau

SEQ ID NO: 471863 - RNA, 62 nt, hsa
aguucuuaaagaaucaagaaguuguguaaucuuuuaaaaauauuaucuugcagauaaagaaa

SEQ ID NO: 471864 - RNA, 62 nt, hsa
aaaaucauuuucuuguuuaaauaguuucuuuuuuuaaaaaaaugguuacauuaguuuuaaaa

SEQ ID NO: 471865 - RNA, 62 nt, hsa
cuuugcuuguacuagauuucuuacuuagaauuuuuaaaaaucauuuucuuguuuaaauaguu

SEQ ID NO: 471866 - RNA, 62 nt, hsa
uugcuuugcugguuucauauuuauuuguuguauuuaaaaaauacauuguuguaagagugauu

SEQ ID NO: 471867 - RNA, 62 nt, hsa
auuuuguaacuuuacaguuaaacuaguuuuaguuuaaaaagaaaaaaugcagggugauuucu

SEQ ID NO: 471868 - RNA, 62 nt, hsa
cuucaguccauucccuuaggcaauuuuuaauuuuuaaaaauuauuaucaggggagaaaaauu

SEQ ID NO: 471869 - RNA, 62 nt, hsa
ugcauguguauacauacauguaacuucauuauuuuaaaaauauuuuuagaacuccaauacuc

SEQ ID NO: 471870 - RNA, 62 nt, hsa
ucgacuauagaaaacuccacugacugucgggcuuuaaaaagggaagaaacugcugagcuugc

SEQ ID NO: 471871 - RNA, 62 nt, hsa
ugugcuuuauaaacuauauuagagggacuggguuuaaaaaaaaagauauaggguagaaauaa

SEQ ID NO: 471872 - RNA, 62 nt, hsa
ugagagugcuuacucacaguuuauuugcuuuuuuuaaaaaggagauuauucuaaaauauaaa

SEQ ID NO: 471873 - RNA, 62 nt, hsa
gaaaaugaugugccagcuaaaauugugugccauuuaaaaacugaaaauauuuuaaaauuauu

SEQ ID NO: 471874 - RNA, 62 nt, hsa
uuuagauucauuuuguccacacauguacccauuuuaaaaaacaauguccucgaugcuucugu

SEQ ID NO: 471875 - RNA, 62 nt, hsa
aaauagacaauuuggcucucauaccauaagcauuuaaaaacauaugaaauauuuugauuucu

SEQ ID NO: 471876 - RNA, 62 nt, hsa
aauuauuucuauaugacacaaaguaugauaccuuuaaaaaggugagcuuauauauuguuuau

SEQ ID NO: 471877 - RNA, 62 nt, hsa
uaaaauacugagauuuggggaagcaauucuuuuuuaaaaaaauuuugaauaacuaucuuuug

SEQ ID NO: 471878 - RNA, 62 nt, hsa
augcacuaagcuuuuuuuuuuucuuuuacacguuuaaaaacuucuuaaagcacucuguaaua

SEQ ID NO: 471879 - RNA, 62 nt, hsa
uggguggcuuuuuucauacuacuguuaacuuuuuuaaaaaagaagcaauguaaagaccguaa

SEQ ID NO: 471880 - RNA, 62 nt, hsa
ugaugcuuggaaauuaagagacuaaagcuuuuuuuaaaaaaagguggaaaauaggaacuguc

SEQ ID NO: 471881 - RNA, 62 nt, hsa
uuauuguggcuugaucuucuuaggacaucuuuuuuaaaaagcuguuuaguaucauuuugugu

SEQ ID NO: 471882 - RNA, 62 nt, hsa
aaggguaaggcaguuuuaaaaaugugaaaacauuuaaaaaugauaauagcagggaauucuua

SEQ ID NO: 471883 - RNA, 62 nt, hsa
gaauccaaauacauccaaaaggguaaggcaguuuuaaaaaugugaaaacauuuaaaaaugau

SEQ ID NO: 471884 - RNA, 62 nt, hsa
cuugaaagcuucaccuggccuacaacuuuuauuuuaaaaagaugaucaagaaaacuucaucu

SEQ ID NO: 471885 - RNA, 62 nt, hsa
caagaaagauaaaccccugucucaaggaacauuuuaaaaagaacgucuguccccugugaugc

SEQ ID NO: 471886 - RNA, 62 nt, hsa
cuuuacccuuccaucacuauauugauucuuuuuuuaaaaaauaugaacccaaacucccgccu

SEQ ID NO: 471887 - RNA, 62 nt, hsa
aaagaaaauggaaaaaaacccacaaaacaaacuuuaaaaaaaaaaaaaaacaaauuugccaa

SEQ ID NO: 471888 - RNA, 62 nt, hsa
ucuuauguuauuagcaagguuaagacaucuuuuuuaaaaaaauuauagcuucuaccaagaga

SEQ ID NO: 471889 - RNA, 62 nt, hsa
guauuuaaacaauuuccgaugcccaugaugaguuuaaaaaccagcauugacaccauccccaa

SEQ ID NO: 471890 - RNA, 62 nt, hsa
uucugaacuuggcaaaauuggaaauuaaaauuuuuaaaaauuacaaauauacaaaguuauuu

SEQ ID NO: 471891 - RNA, 62 nt, hsa
caaaacaaaacaaaacaaacaaaugaaaaacguuuaaaaagaagaagaagaaaaaaaacaag

SEQ ID NO: 471892 - RNA, 62 nt, hsa
agacgccauagcuggauuggaaacauugauguuuuaaaaauuuauuuuuuuuggaaauaguu

SEQ ID NO: 471893 - RNA, 62 nt, hsa
uuucuggggaauccaauuauaguugcuuuguauuuaaaaacaagaacagccaaggguuguuc

SEQ ID NO: 471894 - RNA, 62 nt, hsa
aaggagacaauuuuggagagcaagcaaaucuuuuuaaaaaauaguaugaaugugaauacuag

SEQ ID NO: 471895 - RNA, 62 nt, hsa
aaaaauaguaugaaugugaauacuagaaaagauuuaaaaaauaguaugagugugaguacuag

SEQ ID NO: 471896 - RNA, 62 nt, hsa
uuuuuaauaacuuagaggagauuuuaacuuuauuuaaaaauagguaaaauuauuguaccuaa

SEQ ID NO: 471897 - RNA, 62 nt, hsa
uuuaugcgauaacuccuuuuuguuacaauuuuuuuaaaaaaagcuauuuuuguuaauguaaa

SEQ ID NO: 471898 - RNA, 62 nt, hsa
uuuuucagaauauuugcaauaagagucuggauuuuaaaaaacacaugcauacacacaauuaa

SEQ ID NO: 471899 - RNA, 62 nt, hsa
uacuaucuauuauuuaguucuaacacagaagcuuuaaaaauacauagucauccaagguuuuc

SEQ ID NO: 471900 - RNA, 62 nt, hsa
uauacuauauaauauucucaauuacauuugaauuuaaaaauauugagcucuugauuacaauu

SEQ ID NO: 471901 - RNA, 62 nt, hsa
cugucauugcaaaguaacaaaaauuuuaagcuuuuaaaaauguagauuuuucauauuuuuaa

SEQ ID NO: 471902 - RNA, 62 nt, hsa
gucuuaaucugaagucuuuuucaugcccuuguuuuaaaaaaacuacuuuuuuuggccucaaa

SEQ ID NO: 471903 - RNA, 62 nt, hsa
ucauggcaacacuggauaauggcuuugugaaauuuaaaaaauuuuuguagcgacuguaaaca

SEQ ID NO: 471904 - RNA, 62 nt, hsa
uuaucagcaagucgugagucaaacugcugccuuuuaaaaaacccacaaaaugcugauucagu

SEQ ID NO: 471905 - RNA, 62 nt, hsa
augccauccucuagucaaauuuuuuuucauuguuuaaaaauacggaaguguuccaauauaau

SEQ ID NO: 471906 - RNA, 62 nt, hsa
auguaauuuaacaaauugcugcauguauuccauuuaaaaauauguuuaaauuguccuaaaac

SEQ ID NO: 471907 - RNA, 62 nt, hsa
aagacccuaucucuaccccccuaauaaauuaauuuaaaaagccccccaaucugugguauuuu

SEQ ID NO: 471908 - RNA, 62 nt, hsa
agaggcugggaggguugaggggaagauaaacuuuuaaaaagcucuuaucuuucauuucaauc

SEQ ID NO: 471909 - RNA, 62 nt, hsa
uccauucuuggauucccuuucuuuccuuuuauuuuaaaaaagaacaguaccccucuuuuaag

SEQ ID NO: 471910 - RNA, 62 nt, hsa
ugcacagaccaagaauucagugaaugucauuuuuuaaaaaacuaauuuguauugucugcucu

SEQ ID NO: 471911 - RNA, 62 nt, hsa
uuugaaacaaaagaaaauaaugcauuguguuuuuuaaaaagaguaucuuauacauguauccu

SEQ ID NO: 471912 - RNA, 62 nt, hsa
auuuauauaaaaauaauuuaucaaaaggauauuuuaaaaaagcuagucugucuugaaacuug

SEQ ID NO: 471913 - RNA, 62 nt, hsa
ggggaaaauuuuauuucccuuuucuucugauauuuaaaaaauucaucgaucuuucaagauga

SEQ ID NO: 471914 - RNA, 62 nt, hsa
ugaaacaagccgucuuacaagucguuauugccuuuaaaaaucuguuccguuuuuuucccagg

SEQ ID NO: 471915 - RNA, 62 nt, hsa
aaagaacucuauuggugucgucugagcagccauuuaaaaauuggaaucuaaaggaugguugc

SEQ ID NO: 471916 - RNA, 62 nt, hsa
uuuaacaaaauguaucauucgauaaagugaauuuuaaaaaaguuacauaacucuucauuuuu

SEQ ID NO: 471917 - RNA, 62 nt, hsa
aauaacauuuuagggggaaaggggagggaauguuuaaaaagaaaguccuugauuuaguuuuu

SEQ ID NO: 471918 - RNA, 62 nt, hsa
uccauuagaauacugcaaaacccauauaucuuuuuaaaaaauuuauguacucacagucuuuc

SEQ ID NO: 471919 - RNA, 62 nt, hsa
auaaccuuuccuuuuaaaugugcugcaacguuuuuaaaaaugcagcagcauaggagugaaca

SEQ ID NO: 471920 - RNA, 62 nt, hsa
aacacucauuuccaaggcccuaacccuuauccuuuaaaaagaaauccucugaacugggucgg

SEQ ID NO: 471921 - RNA, 62 nt, hsa
aggccaauuuguuggccaccagaaaaccgcuuuuuaaaaaaacacuuggugauucuuucaag

SEQ ID NO: 471922 - RNA, 62 nt, hsa
uaaacuauugccauacuucaguaagugucuuuuuuaaaaaaaauucacuuguauaaaaaugg

SEQ ID NO: 471923 - RNA, 62 nt, hsa
ucuauucauuuauguuagcauuaaugcacauuuuuaaaaaaagaaaaaaacauggucuuguu

SEQ ID NO: 471924 - RNA, 62 nt, hsa
aaucaugaaugauacacaugaagauaacuuuuuuuaaaaaaaagcagaaauacacaaugauc

SEQ ID NO: 471925 - RNA, 62 nt, hsa
agagauugaacuccaagagguggguaauuugguuuaaaaauacauguucauggguuuaccac

SEQ ID NO: 471926 - RNA, 62 nt, hsa
uauguucaaauuguuuauguauauaauaaaguuuuaaaaauuuguauguacuugacaauucc

SEQ ID NO: 471927 - RNA, 62 nt, hsa
aagugggcaucacaauuaucuauaaaucuuguuuuaaaaauacauauuuccaccucucucug

SEQ ID NO: 471928 - RNA, 62 nt, hsa
guaaugcguuugauuguuugagauuuucuguuuuuaaaaauguagcacuugacuuuuugcca

SEQ ID NO: 471929 - RNA, 62 nt, hsa
agaacuucuaucauuuuaaacugacuuguauauuuaaaaaaaaaaucuucaguaggauguuu

SEQ ID NO: 471930 - RNA, 62 nt, hsa
uguuggauagauguuuuaacaguuuuuucugguuuaaaaaccaaauuguaaauggagugugu

SEQ ID NO: 471931 - RNA, 62 nt, hsa
guaauugauauuaaaaguggcacauuuaaaaauuuaaaaauugaagugcaaaaaaaauuuuu

SEQ ID NO: 471932 - RNA, 62 nt, hsa
aguaguuuguaauugauauuaaaaguggcacauuuaaaaauuuaaaaauugaagugcaaaaa

SEQ ID NO: 471933 - RNA, 62 nt, hsa
caaacugaauuuuugaaagacuauugcagguguuuaaaaagaaagaaaaguuguuuuaucua

SEQ ID NO: 471934 - RNA, 62 nt, hsa
gcacuuagauggauauaaaugcagcaacuuguuuuaaaaaaaugcacaauuuacuucccaaa

SEQ ID NO: 471935 - RNA, 62 nt, hsa
caauauucugauuuuccucucccugcauuguuuuuaaaaagcacauuguagccuaagaucaa

SEQ ID NO: 471936 - RNA, 62 nt, hsa
cuuugcucuuucugcuuuaugccucaguuugguuuaaaaacuucuguacuggcaaauggugg

SEQ ID NO: 471937 - RNA, 62 nt, hsa
ugcaugcaucacuucugcauuuauuguaauuuuuuaaaaacaucaccuuuuauaguugggug

SEQ ID NO: 471938 - RNA, 62 nt, hsa
gaguggauuuuauuuuucguuauuguuggugguuuaaaaaauuccccccauguaauuauugu

SEQ ID NO: 471939 - RNA, 62 nt, hsa
guccugcaucuuuuuuuuuuuaucugcuucuguuuaaaaagccaacauuccucugcuucaua

SEQ ID NO: 471940 - RNA, 62 nt, hsa
gccuuaaacguuguauuuuuauagacauguuuuuuaaaaauccuaaguuuuuaaauaacuau

SEQ ID NO: 471941 - RNA, 62 nt, hsa
uuauaaauuguaugcuucagaaauaauuuauuuuuaaaaagaaauuaaaaguuuuaaacuca

SEQ ID NO: 471942 - RNA, 62 nt, hsa
guugccaugguguugaacaaugcaacuuuuuauuuaaaaaagcucugcacugccauguauga

SEQ ID NO: 471943 - RNA, 62 nt, hsa
cauaugcuuuuuuuuuuuuaauuauuaccugauuuaaaaaucucuguaaaaacguguagugu

SEQ ID NO: 471944 - RNA, 62 nt, hsa
uucgguauuuaacacuuuguuaucaagcauauuuuaaaaagaacuguacuguaaauggaaug

SEQ ID NO: 471945 - RNA, 62 nt, hsa
agagauuugaggacauuauuuuuauuuugagcuuuaaaaagaugaauagguguucucaggag

SEQ ID NO: 471946 - RNA, 62 nt, hsa
auauuuauaauggauauuuaaugauuguuauuuuuaaaaaccagcuuauaauuccucguuau

SEQ ID NO: 471947 - RNA, 62 nt, hsa
guagccucuuaaaaaaaaaaaaccugcuaggauuuaaaaauaaaaaucagaggccuaucucc

SEQ ID NO: 471948 - RNA, 62 nt, hsa
ccagguggaggagaaaggggaaucucccaaaauuuaaaaacaaauuggaagaauaaccagga

SEQ ID NO: 471949 - RNA, 62 nt, hsa
agagcagagcaccucccacugggggugggguauuuaaaaauuaacucauuaguaucauaaac

SEQ ID NO: 471950 - RNA, 62 nt, hsa
uauuaggauauauucccaugaaggauucuuuuuuuaaaaaaaugugaaaugucaucuuguac

SEQ ID NO: 471951 - RNA, 62 nt, hsa
acugauaauaucacaacccagaaguaaccaccuuuaaaaagcaacccccauguaugccuaua

SEQ ID NO: 471952 - RNA, 62 nt, hsa
ccuuauacaacauuucuaaacucauuuguacuuuuaaaaaauuuaaacacagacuucuaaaa

SEQ ID NO: 471953 - RNA, 62 nt, hsa
aaaauaacucugaguuugauauucaaguauauuuuaaaaaucaagggauuuuuuuuuuuugu

SEQ ID NO: 471954 - RNA, 62 nt, hsa
acuuuuuugcccaugugucuuuuaagugugauuuuaaaaaaaugagugguucaguucauucc

SEQ ID NO: 471955 - RNA, 62 nt, hsa
gauucauuuuuauuuuugucuuuguuuaacuuuuuaaaaaauaagauuucuggaguagauug

SEQ ID NO: 471956 - RNA, 62 nt, hsa
auuaucauuugcguuuuuuuccuuuuuuuaacuuuaaaaauguauauucuagggucagggga

SEQ ID NO: 471957 - RNA, 62 nt, hsa
cuuuuuuuauauuauuaaauauucuacaacuuuuuaaaaaugucuauuaauauuccaucgua

SEQ ID NO: 471958 - RNA, 62 nt, hsa
cucaacuuuaaaaaaaaaaaaagaagaaaagauuuaaaaaaaaaaaaaaaggagacuuuuuu

SEQ ID NO: 471959 - RNA, 62 nt, hsa
agguuuccauacacugaagcuuuuaccucaacuuuaaaaaaaaaaaaagaagaaaagauuua

SEQ ID NO: 471960 - RNA, 62 nt, hsa
uuugugguuuuuuaauauaguauaaaaauccuuuuaaaaaaacaacaaucugugugccucuc

SEQ ID NO: 471961 - RNA, 62 nt, hsa
gguuuggagacauaaggaauauucugacccuuuuuaaaaaaggauuuucucauguuuuuauu

SEQ ID NO: 471962 - RNA, 62 nt, hsa
uuuuauuauguguuuuguauaaaucccuaauauuuaaaaaaaaaaacaaaacaaaaaaaggu

SEQ ID NO: 471963 - RNA, 62 nt, hsa
aucuuaagugcuaauuaaaaaaaaaauaaaauuuuaaaaaaaccuguaguuucauuaccuuu

SEQ ID NO: 471964 - RNA, 62 nt, hsa
ugguuuccaacaccaugaugaagcucuugcuuuuuaaaaaguaguuaguaaauucugcauga

SEQ ID NO: 471965 - RNA, 62 nt, hsa
aguuaguaaauucugcaugaauuuuaguaaacuuuaaaaaauagauuuuuucccuaagaaag

SEQ ID NO: 471966 - RNA, 62 nt, hsa
uuccauuggcuaugauggaauuaauauuguauuuuaaaaaugcauauugaucacuauaauuc

SEQ ID NO: 471967 - RNA, 62 nt, hsa
cuuuuacauauauugcuguuacuucugcuuucuuuaaaaauauaguaaaggauguuuuauga

SEQ ID NO: 471968 - RNA, 62 nt, hsa
ucaaauccuauuaggcacaagucggaguuacauuuaaaaaaaauuaacagucuacaacaacu

SEQ ID NO: 471969 - RNA, 62 nt, hsa
gggaccggcagaaauggaaguauccauacauuuuuaaaaagcaacaaguuugcacagcuaga

SEQ ID NO: 471970 - RNA, 62 nt, hsa
uuccuggaggggcucuuauuauuuucucucuuuuuaaaaaacuuccaguagaaguaaagugg

SEQ ID NO: 471971 - RNA, 62 nt, hsa
aauuucaaaaaaaaauuacaaaaguaugugaauuuaaaaaugagagcaguccucucacccua

SEQ ID NO: 471972 - RNA, 62 nt, hsa
auauauacugcaguguaucucacguauuaauuuuuaaaaaucuuuuguuuuacuuaauucug

SEQ ID NO: 471973 - RNA, 62 nt, hsa
gacaaagcucaccaacuuuaaaauauuaaguuuuuaaaaaaucaaauaugaaguauguucag

SEQ ID NO: 471974 - RNA, 62 nt, hsa
cuguuuuugguuuacaguguaauaauaccucauuuaaaaaauaaaaaccacuacuguuacau

SEQ ID NO: 471975 - RNA, 62 nt, hsa
aaauaaaaaccacuacuguuacauuuuauuaauuuaaaaagcuagaaaauucauguaguuac

SEQ ID NO: 471976 - RNA, 62 nt, hsa
gaagaaagauuugguggagggaagcuuucugguuuaaaaauuaguaaggugugucuuuuugu

SEQ ID NO: 471977 - RNA, 62 nt, hsa
auaugccauucuuguuauagaagaauaugccuuuuaaaaaagcuuauuaauaacacuuuccc

SEQ ID NO: 471978 - RNA, 62 nt, hsa
aagcuuauuaauaacacuuucccaauuuauauuuuaaaaagcuaaagaacacuggauuaaua

SEQ ID NO: 471979 - RNA, 62 nt, hsa
uguuuuuucuuaaguuauauuuguuuuuacuuuuuaaaaaagaagaggaaacaaagcccccu

SEQ ID NO: 471980 - RNA, 62 nt, hsa
acuucuauuauuuguuuugguuagaaagugaauuuaaaaaacaaaccaaacucuaaacuuuc

SEQ ID NO: 471981 - RNA, 62 nt, hsa
gauagauuugucaaaacgacauuuaagucauguuuaaaaagucauuugggcaguucuggaaa

SEQ ID NO: 471982 - RNA, 62 nt, hsa
uuguccaaucuggugaaugucuaacccuaaaguuuaaaaauuucugccuccuaaguuuaugu

SEQ ID NO: 471983 - RNA, 62 nt, hsa
ucccauuguuucagugggcauuaacagaaugcuuuaaaaacuucuaagacaagaaucuauag

SEQ ID NO: 471984 - RNA, 62 nt, hsa
cuauagcauuaguauacacuggcacauaauuuuuuaaaaaguuuuaagaaaagauucauuug

SEQ ID NO: 471985 - RNA, 62 nt, hsa
uaagaaaacuaccacuucuugauuuuuacagauuuaaaaaaaucuuuucagugaccuuucuu

SEQ ID NO: 471986 - RNA, 62 nt, hsa
aguaaccugugaacuaugcuuuuccauaacuuuuuaaaaauauauauaucuaaaugaaugca

SEQ ID NO: 471987 - RNA, 62 nt, hsa
gcauuuccagcuaaucucuucugcucuaaauauuuaaaaacaguucuucucaaacauuuuca

SEQ ID NO: 471988 - RNA, 62 nt, hsa
uacuaauagaggaguagagauuguugaccauuuuuaaaaaacgauagccacucuuuuucuuu

SEQ ID NO: 471989 - RNA, 62 nt, hsa
uuguuugaagcgaguuaauauucucaguugucuuuaaaaaucaguuacucuaauuccaggug

SEQ ID NO: 471990 - RNA, 62 nt, hsa
aucauauuguguauaacuuggaaauggugcuguuuaaaaaaauuguguauuuauacaguaac

SEQ ID NO: 471991 - RNA, 62 nt, hsa
auuuucucuacacacucacccucuuccaguucuuuaaaaacguuuaugauauuaagaucaaa

SEQ ID NO: 471992 - RNA, 62 nt, hsa
ucucuuaugaaaaguauauguaaacacauucauuuaaaaauccuuggaacucaauguggaac

SEQ ID NO: 471993 - RNA, 62 nt, hsa
aucuagggaguggccaaacuaaauauaauuucuuuaaaaaagaaagaaaaaggaaaaaucca
